United States Patent 10,706,955 (BIOINFORMATIC PROCESSES FOR DETERMINATION OF PEPTIDE BINDING) - sequence listing, part 12

SEQ ID NO: 436193 - protein, 9 aa, Mycobacterium
ASGLGTDEE

SEQ ID NO: 436194 - protein, 8 aa, Mycobacterium
ASGLIEPS

SEQ ID NO: 436195 - protein, 7 aa, Mycobacterium
ASGLPDD

SEQ ID NO: 436196 - protein, 7 aa, Mycobacterium
ASGLPPE

SEQ ID NO: 436197 - protein, 11 aa, Mycobacterium
ASGLSNLEDAP

SEQ ID NO: 436198 - protein, 7 aa, Mycobacterium
ASGLSSD

SEQ ID NO: 436199 - protein, 8 aa, Mycobacterium
ASGLSSDE

SEQ ID NO: 436200 - protein, 7 aa, Mycobacterium
ASGLTGG

SEQ ID NO: 436201 - protein, 8 aa, Mycobacterium
ASGLTGGA

SEQ ID NO: 436202 - protein, 10 aa, Mycobacterium
ASGLTGGPAL

SEQ ID NO: 436203 - protein, 8 aa, Mycobacterium
ASGLTRPV

SEQ ID NO: 436204 - protein, 19 aa, Mycobacterium
ASGLVGGSIEDATGRPDAP

SEQ ID NO: 436205 - protein, 5 aa, Mycobacterium
ASGMG

SEQ ID NO: 436206 - protein, 10 aa, Mycobacterium
ASGMGSDPRV

SEQ ID NO: 436207 - protein, 7 aa, Mycobacterium
ASGMSSE

SEQ ID NO: 436208 - protein, 17 aa, Mycobacterium
ASGNADGDLHKPAPIQA

SEQ ID NO: 436209 - protein, 7 aa, Mycobacterium
ASGNEGI

SEQ ID NO: 436210 - protein, 6 aa, Mycobacterium
ASGNEV

SEQ ID NO: 436211 - protein, 10 aa, Mycobacterium
ASGNGGQGGH

SEQ ID NO: 436212 - protein, 10 aa, Mycobacterium
ASGNIDATLT

SEQ ID NO: 436213 - protein, 14 aa, Mycobacterium
ASGNIDGSGKNPSM

SEQ ID NO: 436214 - protein, 10 aa, Mycobacterium
ASGNINPERT

SEQ ID NO: 436215 - protein, 10 aa, Mycobacterium
ASGNRQRAHY

SEQ ID NO: 436216 - protein, 10 aa, Mycobacterium
ASGNRSDADH

SEQ ID NO: 436217 - protein, 15 aa, Mycobacterium
ASGNSIADPADPRQL

SEQ ID NO: 436218 - protein, 17 aa, Mycobacterium
ASGNTGFGNAGSTNTGF

SEQ ID NO: 436219 - protein, 18 aa, Mycobacterium
ASGNVEGDRHKPPAITAS

SEQ ID NO: 436220 - protein, 17 aa, Mycobacterium
ASGNVEGDRHKPPPITA

SEQ ID NO: 436221 - protein, 18 aa, Mycobacterium
ASGPAGASRVPVPSWPPG

SEQ ID NO: 436222 - protein, 11 aa, Mycobacterium
ASGPDKIGRDA

SEQ ID NO: 436223 - protein, 8 aa, Mycobacterium
ASGPDRAI

SEQ ID NO: 436224 - protein, 11 aa, Mycobacterium
ASGPDRDAAAV

SEQ ID NO: 436225 - protein, 11 aa, Mycobacterium
ASGPERDGAAV

SEQ ID NO: 436226 - protein, 11 aa, Mycobacterium
ASGPGAAAEYQ

SEQ ID NO: 436227 - protein, 6 aa, Mycobacterium
ASGPGE

SEQ ID NO: 436228 - protein, 12 aa, Mycobacterium
ASGPGTTPPAVP

SEQ ID NO: 436229 - protein, 5 aa, Mycobacterium
ASGPH

SEQ ID NO: 436230 - protein, 5 aa, Mycobacterium
ASGPI

SEQ ID NO: 436231 - protein, 7 aa, Mycobacterium
ASGPIPP

SEQ ID NO: 436232 - protein, 7 aa, Mycobacterium
ASGPIPS

SEQ ID NO: 436233 - protein, 9 aa, Mycobacterium
ASGPKRYTE

SEQ ID NO: 436234 - protein, 5 aa, Mycobacterium
ASGPL

SEQ ID NO: 436235 - protein, 7 aa, Mycobacterium
ASGPNMT

SEQ ID NO: 436236 - protein, 12 aa, Mycobacterium
ASGPPGGGPDVA

SEQ ID NO: 436237 - protein, 7 aa, Mycobacterium
ASGPPMY

SEQ ID NO: 436238 - protein, 6 aa, Mycobacterium
ASGPRI

SEQ ID NO: 436239 - protein, 5 aa, Mycobacterium
ASGPS

SEQ ID NO: 436240 - protein, 8 aa, Mycobacterium
ASGPTAAI

SEQ ID NO: 436241 - protein, 8 aa, Mycobacterium
ASGPTAAL

SEQ ID NO: 436242 - protein, 6 aa, Mycobacterium
ASGPTV

SEQ ID NO: 436243 - protein, 16 aa, Mycobacterium
ASGPVPPIDPQRLNTA

SEQ ID NO: 436244 - protein, 15 aa, Mycobacterium
ASGPVPPVDPQRLNA

SEQ ID NO: 436245 - protein, 16 aa, Mycobacterium
ASGPVPPVDPQRLNAA

SEQ ID NO: 436246 - protein, 7 aa, Mycobacterium
ASGPVSE

SEQ ID NO: 436247 - protein, 5 aa, Mycobacterium
ASGQG

SEQ ID NO: 436248 - protein, 16 aa, Mycobacterium
ASGQGAVVTDADGKSY

SEQ ID NO: 436249 - protein, 12 aa, Mycobacterium
ASGQIPASINPH

SEQ ID NO: 436250 - protein, 5 aa, Mycobacterium
ASGQL

SEQ ID NO: 436251 - protein, 6 aa, Mycobacterium
ASGQPR

SEQ ID NO: 436252 - protein, 7 aa, Mycobacterium
ASGQQIS

SEQ ID NO: 436253 - protein, 9 aa, Mycobacterium
ASGQTASAA

SEQ ID NO: 436254 - protein, 27 aa, Mycobacterium
ASGQVPDHLPTDEELDNAGTRRTQAYE

SEQ ID NO: 436255 - protein, 15 aa, Mycobacterium
ASGQVPPFDPQRLTA

SEQ ID NO: 436256 - protein, 12 aa, Mycobacterium
ASGRADPASLGA

SEQ ID NO: 436257 - protein, 5 aa, Mycobacterium
ASGRD

SEQ ID NO: 436258 - protein, 6 aa, Mycobacterium
ASGRDT

SEQ ID NO: 436259 - protein, 10 aa, Mycobacterium
ASGREGGSWE

SEQ ID NO: 436260 - protein, 7 aa, Mycobacterium
ASGREIA

SEQ ID NO: 436261 - protein, 5 aa, Mycobacterium
ASGRF

SEQ ID NO: 436262 - protein, 5 aa, Mycobacterium
ASGRG

SEQ ID NO: 436263 - protein, 7 aa, Mycobacterium
ASGRGSR

SEQ ID NO: 436264 - protein, 11 aa, Mycobacterium
ASGRGVSSATF

SEQ ID NO: 436265 - protein, 7 aa, Mycobacterium
ASGRHDV

SEQ ID NO: 436266 - protein, 10 aa, Mycobacterium
ASGRLGTHRG

SEQ ID NO: 436267 - protein, 21 aa, Mycobacterium
ASGRLTGADTGPGRLPEAEEI

SEQ ID NO: 436268 - protein, 20 aa, Mycobacterium
ASGRLTGSDTGAGRLPEAEE

SEQ ID NO: 436269 - protein, 8 aa, Mycobacterium
ASGRNGGF

SEQ ID NO: 436270 - protein, 9 aa, Mycobacterium
ASGRPAPHI

SEQ ID NO: 436271 - protein, 9 aa, Mycobacterium
ASGRPAPHL

SEQ ID NO: 436272 - protein, 8 aa, Mycobacterium
ASGRPARH

SEQ ID NO: 436273 - protein, 15 aa, Mycobacterium
ASGRPGVTVETKPAS

SEQ ID NO: 436274 - protein, 7 aa, Mycobacterium
ASGRPPA

SEQ ID NO: 436275 - protein, 9 aa, Mycobacterium
ASGRRAGPR

SEQ ID NO: 436276 - protein, 10 aa, Mycobacterium
ASGRRDLADS

SEQ ID NO: 436277 - protein, 10 aa, Mycobacterium
ASGRRDNAQR

SEQ ID NO: 436278 - protein, 11 aa, Mycobacterium
ASGRRDNAQRL

SEQ ID NO: 436279 - protein, 11 aa, Mycobacterium
ASGRRDTAQRL

SEQ ID NO: 436280 - protein, 5 aa, Mycobacterium
ASGRS

SEQ ID NO: 436281 - protein, 8 aa, Mycobacterium
ASGRSAPL

SEQ ID NO: 436282 - protein, 21 aa, Mycobacterium
ASGRSAQAGYDGLTRTPAPVA

SEQ ID NO: 436283 - protein, 21 aa, Mycobacterium
ASGRSAQPGYDGLSRTPPSVA

SEQ ID NO: 436284 - protein, 12 aa, Mycobacterium
ASGRTDDDGRIK

SEQ ID NO: 436285 - protein, 6 aa, Mycobacterium
ASGRTF

SEQ ID NO: 436286 - protein, 12 aa, Mycobacterium
ASGRTLTSYPSL

SEQ ID NO: 436287 - protein, 7 aa, Mycobacterium
ASGRTPY

SEQ ID NO: 436288 - protein, 6 aa, Mycobacterium
ASGRTQ

SEQ ID NO: 436289 - protein, 7 aa, Mycobacterium
ASGRTRN

SEQ ID NO: 436290 - protein, 9 aa, Mycobacterium
ASGRWPGPV

SEQ ID NO: 436291 - protein, 24 aa, Mycobacterium
ASGRYAHKRDQHRAPLDPNFTGTG

SEQ ID NO: 436292 - protein, 13 aa, Mycobacterium
ASGSADAFGGVTT

SEQ ID NO: 436293 - protein, 9 aa, Mycobacterium
ASGSAQNML

SEQ ID NO: 436294 - protein, 15 aa, Mycobacterium
ASGSARRDSDADQQH

SEQ ID NO: 436295 - protein, 6 aa, Mycobacterium
ASGSEA

SEQ ID NO: 436296 - protein, 9 aa, Mycobacterium
ASGSERYGG

SEQ ID NO: 436297 - protein, 11 aa, Mycobacterium
ASGSGAAAAPG

SEQ ID NO: 436298 - protein, 8 aa, Mycobacterium
ASGSGKST

SEQ ID NO: 436299 - protein, 5 aa, Mycobacterium
ASGSI

SEQ ID NO: 436300 - protein, 13 aa, Mycobacterium
ASGSKSAQRGATR

SEQ ID NO: 436301 - protein, 5 aa, Mycobacterium
ASGSP

SEQ ID NO: 436302 - protein, 6 aa, Mycobacterium
ASGSPD

SEQ ID NO: 436303 - protein, 11 aa, Mycobacterium
ASGSPDQDPLP

SEQ ID NO: 436304 - protein, 15 aa, Mycobacterium
ASGSPLRISKIFLAC

SEQ ID NO: 436305 - protein, 12 aa, Mycobacterium
ASGSPSNMATCS

SEQ ID NO: 436306 - protein, 9 aa, Mycobacterium
ASGSQPRNM

SEQ ID NO: 436307 - protein, 27 aa, Mycobacterium
ASGSSQPDIKPRSRDVTDGLEKTAARG

SEQ ID NO: 436308 - protein, 19 aa, Mycobacterium
ASGSSYAAAEAANTNPLQG

SEQ ID NO: 436309 - protein, 10 aa, Mycobacterium
ASGSTDEELT

SEQ ID NO: 436310 - protein, 10 aa, Mycobacterium
ASGSTNAKEL

SEQ ID NO: 436311 - protein, 7 aa, Mycobacterium
ASGSTVV

SEQ ID NO: 436312 - protein, 9 aa, Mycobacterium
ASGSVNKSG

SEQ ID NO: 436313 - protein, 11 aa, Mycobacterium
ASGSVTPSRAG

SEQ ID NO: 436314 - protein, 5 aa, Mycobacterium
ASGSY

SEQ ID NO: 436315 - protein, 9 aa, Mycobacterium
ASGTAEELK

SEQ ID NO: 436316 - protein, 12 aa, Mycobacterium
ASGTAKRDPALG

SEQ ID NO: 436317 - protein, 18 aa, Mycobacterium
ASGTDPDFGRGASAYDGY

SEQ ID NO: 436318 - protein, 11 aa, Mycobacterium
ASGTETGLPAA

SEQ ID NO: 436319 - protein, 10 aa, Mycobacterium
ASGTGDARKI

SEQ ID NO: 436320 - protein, 11 aa, Mycobacterium
ASGTGDARKIR

SEQ ID NO: 436321 - protein, 7 aa, Mycobacterium
ASGTGPF

SEQ ID NO: 436322 - protein, 5 aa, Mycobacterium
ASGTI

SEQ ID NO: 436323 - protein, 5 aa, Mycobacterium
ASGTK

SEQ ID NO: 436324 - protein, 5 aa, Mycobacterium
ASGTN

SEQ ID NO: 436325 - protein, 8 aa, Mycobacterium
ASGTPAVV

SEQ ID NO: 436326 - protein, 8 aa, Mycobacterium
ASGTPDEI

SEQ ID NO: 436327 - protein, 8 aa, Mycobacterium
ASGTPGMK

SEQ ID NO: 436328 - protein, 8 aa, Mycobacterium
ASGTSAKE

SEQ ID NO: 436329 - protein, 8 aa, Mycobacterium
ASGTSAQE

SEQ ID NO: 436330 - protein, 9 aa, Mycobacterium
ASGTSEELK

SEQ ID NO: 436331 - protein, 9 aa, Mycobacterium
ASGTSLGDA

SEQ ID NO: 436332 - protein, 7 aa, Mycobacterium
ASGTVNG

SEQ ID NO: 436333 - protein, 6 aa, Mycobacterium
ASGTVT

SEQ ID NO: 436334 - protein, 5 aa, Mycobacterium
ASGVA

SEQ ID NO: 436335 - protein, 8 aa, Mycobacterium
ASGVDPAD

SEQ ID NO: 436336 - protein, 8 aa, Mycobacterium
ASGVDPDA

SEQ ID NO: 436337 - protein, 7 aa, Mycobacterium
ASGVEVP

SEQ ID NO: 436338 - protein, 10 aa, Mycobacterium
ASGVGRRHGA

SEQ ID NO: 436339 - protein, 17 aa, Mycobacterium
ASGVGSEPDVAGLDDEV

SEQ ID NO: 436340 - protein, 5 aa, Mycobacterium
ASGVM

SEQ ID NO: 436341 - protein, 11 aa, Mycobacterium
ASGVPGSGVGD

SEQ ID NO: 436342 - protein, 16 aa, Mycobacterium
ASGVPRSTSEFGGSGI

SEQ ID NO: 436343 - protein, 16 aa, Mycobacterium
ASGVPSIAPDAGGPRD

SEQ ID NO: 436344 - protein, 5 aa, Mycobacterium
ASGVR

SEQ ID NO: 436345 - protein, 21 aa, Mycobacterium
ASGVRGQPATAPYSAAKGALE

SEQ ID NO: 436346 - protein, 7 aa, Mycobacterium
ASGVSAR

SEQ ID NO: 436347 - protein, 16 aa, Mycobacterium
ASGVSDAAAEATGLRV

SEQ ID NO: 436348 - protein, 8 aa, Mycobacterium
ASGVTDAQ

SEQ ID NO: 436349 - protein, 13 aa, Mycobacterium
ASGYKGFTLAGSR

SEQ ID NO: 436350 - protein, 13 aa, Mycobacterium
ASGYRAPSTPTEE

SEQ ID NO: 436351 - protein, 6 aa, Mycobacterium
ASGYRG

SEQ ID NO: 436352 - protein, 11 aa, Mycobacterium
ASGYRKKFDTA

SEQ ID NO: 436353 - protein, 11 aa, Mycobacterium
ASGYSGSTLNS

SEQ ID NO: 436354 - protein, 5 aa, Mycobacterium
ASGYT

SEQ ID NO: 436355 - protein, 6 aa, Mycobacterium
ASGYTA

SEQ ID NO: 436356 - protein, 15 aa, Mycobacterium
ASGYWGKPADESTFG

SEQ ID NO: 436357 - protein, 5 aa, Mycobacterium
ASHAG

SEQ ID NO: 436358 - protein, 7 aa, Mycobacterium
ASHAGGE

SEQ ID NO: 436359 - protein, 10 aa, Mycobacterium
ASHAGRTFGA

SEQ ID NO: 436360 - protein, 7 aa, Mycobacterium
ASHAGSA

SEQ ID NO: 436361 - protein, 7 aa, Mycobacterium
ASHARAA

SEQ ID NO: 436362 - protein, 8 aa, Mycobacterium
ASHARQAG

SEQ ID NO: 436363 - protein, 30 aa, Mycobacterium
ASHDAAKAATSAVSTEAARAGWSGSGGPVL

SEQ ID NO: 436364 - protein, 11 aa, Mycobacterium
ASHDGNTAQAA

SEQ ID NO: 436365 - protein, 6 aa, Mycobacterium
ASHDPG

SEQ ID NO: 436366 - protein, 6 aa, Mycobacterium
ASHDRL

SEQ ID NO: 436367 - protein, 11 aa, Mycobacterium
ASHDTADVEPT

SEQ ID NO: 436368 - protein, 8 aa, Mycobacterium
ASHDTEPV

SEQ ID NO: 436369 - protein, 6 aa, Mycobacterium
ASHEES

SEQ ID NO: 436370 - protein, 8 aa, Mycobacterium
ASHEGGIA

SEQ ID NO: 436371 - protein, 15 aa, Mycobacterium
ASHEPARGASSAEAY

SEQ ID NO: 436372 - protein, 5 aa, Mycobacterium
ASHEQ

SEQ ID NO: 436373 - protein, 13 aa, Mycobacterium
ASHGAPETQAATA

SEQ ID NO: 436374 - protein, 20 aa, Mycobacterium
ASHGGGEYAPSAQLASREEQ

SEQ ID NO: 436375 - protein, 12 aa, Mycobacterium
ASHGGPARTEDR

SEQ ID NO: 436376 - protein, 6 aa, Mycobacterium
ASHGGS

SEQ ID NO: 436377 - protein, 15 aa, Mycobacterium
ASHGGTGGDGGRSGW

SEQ ID NO: 436378 - protein, 16 aa, Mycobacterium
ASHGKTFDNVNPATGQ

SEQ ID NO: 436379 - protein, 8 aa, Mycobacterium
ASHGNQLD

SEQ ID NO: 436380 - protein, 5 aa, Mycobacterium
ASHGS

SEQ ID NO: 436381 - protein, 6 aa, Mycobacterium
ASHGTP

SEQ ID NO: 436382 - protein, 11 aa, Mycobacterium
ASHNDKPVPTT

SEQ ID NO: 436383 - protein, 31 aa, Mycobacterium
ASHNNTDLASHNNTPIMSPNQDAGANAQQGA

SEQ ID NO: 436384 - protein, 9 aa, Mycobacterium
ASHNPDPVP

SEQ ID NO: 436385 - protein, 8 aa, Mycobacterium
ASHNPDSY

SEQ ID NO: 436386 - protein, 4 aa, Mycobacterium
ASHP

SEQ ID NO: 436387 - protein, 5 aa, Mycobacterium
ASHPA

SEQ ID NO: 436388 - protein, 8 aa, Mycobacterium
ASHPAPDW

SEQ ID NO: 436389 - protein, 6 aa, Mycobacterium
ASHPDK

SEQ ID NO: 436390 - protein, 7 aa, Mycobacterium
ASHPGEV

SEQ ID NO: 436391 - protein, 6 aa, Mycobacterium
ASHPGV

SEQ ID NO: 436392 - protein, 10 aa, Mycobacterium
ASHPRDARLG

SEQ ID NO: 436393 - protein, 7 aa, Mycobacterium
ASHPRTP

SEQ ID NO: 436394 - protein, 6 aa, Mycobacterium
ASHQKL

SEQ ID NO: 436395 - protein, 10 aa, Mycobacterium
ASHQPDTHPT

SEQ ID NO: 436396 - protein, 5 aa, Mycobacterium
ASHQY

SEQ ID NO: 436397 - protein, 7 aa, Mycobacterium
ASHRNMS

SEQ ID NO: 436398 - protein, 7 aa, Mycobacterium
ASHRQGA

SEQ ID NO: 436399 - protein, 8 aa, Mycobacterium
ASHRTASC

SEQ ID NO: 436400 - protein, 11 aa, Mycobacterium
ASHSEGAACQA

SEQ ID NO: 436401 - protein, 10 aa, Mycobacterium
ASHSLHPDGR

SEQ ID NO: 436402 - protein, 5 aa, Mycobacterium
ASHSR

SEQ ID NO: 436403 - protein, 14 aa, Mycobacterium
ASHSSAARALPGTL

SEQ ID NO: 436404 - protein, 6 aa, Mycobacterium
ASHTPR

SEQ ID NO: 436405 - protein, 29 aa, Mycobacterium
ASHTSATGPVRNPWDPTRTSGGSSSGSAA

SEQ ID NO: 436406 - protein, 26 aa, Mycobacterium
ASHTSGGSDPADAAITPPTPSPLRRT

SEQ ID NO: 436407 - protein, 14 aa, Mycobacterium
ASHYGGAGARGFSP

SEQ ID NO: 436408 - protein, 10 aa, Mycobacterium
ASIADDQNAQ

SEQ ID NO: 436409 - protein, 5 aa, Mycobacterium
ASIAG

SEQ ID NO: 436410 - protein, 10 aa, Mycobacterium
ASIAGRAVRP

SEQ ID NO: 436411 - protein, 12 aa, Mycobacterium
ASIDGARSASAT

SEQ ID NO: 436412 - protein, 16 aa, Mycobacterium
ASIDKKDHDADPCGQI

SEQ ID NO: 436413 - protein, 14 aa, Mycobacterium
ASIDPQSLRGSQTG

SEQ ID NO: 436414 - protein, 13 aa, Mycobacterium
ASIDPTSLEGSNT

SEQ ID NO: 436415 - protein, 4 aa, Mycobacterium
ASIE

SEQ ID NO: 436416 - protein, 13 aa, Mycobacterium
ASIEKARQAPVSS

SEQ ID NO: 436417 - protein, 4 aa, Mycobacterium
ASIG

SEQ ID NO: 436418 - protein, 10 aa, Mycobacterium
ASIGGDLPRP

SEQ ID NO: 436419 - protein, 8 aa, Mycobacterium
ASIGGQTV

SEQ ID NO: 436420 - protein, 6 aa, Mycobacterium
ASIGMG

SEQ ID NO: 436421 - protein, 9 aa, Mycobacterium
ASIGTTASS

SEQ ID NO: 436422 - protein, 6 aa, Mycobacterium
ASIKGW

SEQ ID NO: 436423 - protein, 6 aa, Mycobacterium
ASIPAA

SEQ ID NO: 436424 - protein, 8 aa, Mycobacterium
ASIPGVQN

SEQ ID NO: 436425 - protein, 14 aa, Mycobacterium
ASIPLTSTKSSLGH

SEQ ID NO: 436426 - protein, 4 aa, Mycobacterium
ASIS

SEQ ID NO: 436427 - protein, 7 aa, Mycobacterium
ASISAAA

SEQ ID NO: 436428 - protein, 6 aa, Mycobacterium
ASISPV

SEQ ID NO: 436429 - protein, 14 aa, Mycobacterium
ASITDGQPLATPQV

SEQ ID NO: 436430 - protein, 6 aa, Mycobacterium
ASITGP

SEQ ID NO: 436431 - protein, 6 aa, Mycobacterium
ASITGS

SEQ ID NO: 436432 - protein, 49 aa, Mycobacterium
ASITGSPAGAAGAADAAGTVSAEQPPTGPAIAAGTARSTGTAGPAVGAG

SEQ ID NO: 436433 - protein, 7 aa, Mycobacterium
ASITGSY

SEQ ID NO: 436434 - protein, 9 aa, Mycobacterium
ASITRGDSV

SEQ ID NO: 436435 - protein, 4 aa, Mycobacterium
ASKA

SEQ ID NO: 436436 - protein, 8 aa, Mycobacterium
ASKAADVD

SEQ ID NO: 436437 - protein, 10 aa, Mycobacterium
ASKAAEGSIN

SEQ ID NO: 436438 - protein, 10 aa, Mycobacterium
ASKAAGAPTY

SEQ ID NO: 436439 - protein, 7 aa, Mycobacterium
ASKAELA

SEQ ID NO: 436440 - protein, 9 aa, Mycobacterium
ASKAELSDA

SEQ ID NO: 436441 - protein, 10 aa, Mycobacterium
ASKAGKSLMS

SEQ ID NO: 436442 - protein, 5 aa, Mycobacterium
ASKAH

SEQ ID NO: 436443 - protein, 14 aa, Mycobacterium
ASKAHTAGRSREEI

SEQ ID NO: 436444 - protein, 5 aa, Mycobacterium
ASKAM

SEQ ID NO: 436445 - protein, 11 aa, Mycobacterium
ASKANADPRSV

SEQ ID NO: 436446 - protein, 7 aa, Mycobacterium
ASKARSV

SEQ ID NO: 436447 - protein, 8 aa, Mycobacterium
ASKASVGD

SEQ ID NO: 436448 - protein, 8 aa, Mycobacterium
ASKATAVR

SEQ ID NO: 436449 - protein, 6 aa, Mycobacterium
ASKATQ

SEQ ID NO: 436450 - protein, 8 aa, Mycobacterium
ASKCNDEV

SEQ ID NO: 436451 - protein, 7 aa, Mycobacterium
ASKDTIE

SEQ ID NO: 436452 - protein, 6 aa, Mycobacterium
ASKEFG

SEQ ID NO: 436453 - protein, 9 aa, Mycobacterium
ASKEPEPSA

SEQ ID NO: 436454 - protein, 9 aa, Mycobacterium
ASKEPEPTA

SEQ ID NO: 436455 - protein, 9 aa, Mycobacterium
ASKEYGERG

SEQ ID NO: 436456 - protein, 4 aa, Mycobacterium
ASKG

SEQ ID NO: 436457 - protein, 10 aa, Mycobacterium
ASKGALGAQQ

SEQ ID NO: 436458 - protein, 10 aa, Mycobacterium
ASKGDSADGV

SEQ ID NO: 436459 - protein, 9 aa, Mycobacterium
ASKGDSVDG

SEQ ID NO: 436460 - protein, 9 aa, Mycobacterium
ASKGDTADG

SEQ ID NO: 436461 - protein, 10 aa, Mycobacterium
ASKGGDPKHP

SEQ ID NO: 436462 - protein, 6 aa, Mycobacterium
ASKGGV

SEQ ID NO: 436463 - protein, 7 aa, Mycobacterium
ASKGGVQ

SEQ ID NO: 436464 - protein, 10 aa, Mycobacterium
ASKGQGGGYQ

SEQ ID NO: 436465 - protein, 13 aa, Mycobacterium
ASKIERGSVPRAD

SEQ ID NO: 436466 - protein, 4 aa, Mycobacterium
ASKK

SEQ ID NO: 436467 - protein, 40 aa, Mycobacterium
ASKKPADVRTPQKRRAEDKVARDAARAAGHRAPHAVKSQA

SEQ ID NO: 436468 - protein, 7 aa, Mycobacterium
ASKLEAR

SEQ ID NO: 436469 - protein, 10 aa, Mycobacterium
ASKNAGGDAA

SEQ ID NO: 436470 - protein, 6 aa, Mycobacterium
ASKNDA

SEQ ID NO: 436471 - protein, 9 aa, Mycobacterium
ASKNGVAPQ

SEQ ID NO: 436472 - protein, 14 aa, Mycobacterium
ASKPGADGVTPIDH

SEQ ID NO: 436473 - protein, 12 aa, Mycobacterium
ASKPGSDGVTPI

SEQ ID NO: 436474 - protein, 8 aa, Mycobacterium
ASKPIQER

SEQ ID NO: 436475 - protein, 8 aa, Mycobacterium
ASKPMEEV

SEQ ID NO: 436476 - protein, 5 aa, Mycobacterium
ASKPR

SEQ ID NO: 436477 - protein, 13 aa, Mycobacterium
ASKPYDGPAPQFS

SEQ ID NO: 436478 - protein, 14 aa, Mycobacterium
ASKPYDGPPPSAAD

SEQ ID NO: 436479 - protein, 27 aa, Mycobacterium
ASKQEASSPGDVPTATEPAAGTGADAV

SEQ ID NO: 436480 - protein, 8 aa, Mycobacterium
ASKQELGD

SEQ ID NO: 436481 - protein, 6 aa, Mycobacterium
ASKRGA

SEQ ID NO: 436482 - protein, 5 aa, Mycobacterium
ASKSA

SEQ ID NO: 436483 - protein, 7 aa, Mycobacterium
ASKSLAP

SEQ ID NO: 436484 - protein, 8 aa, Mycobacterium
ASKSLAPG

SEQ ID NO: 436485 - protein, 8 aa, Mycobacterium
ASKSQAKR

SEQ ID NO: 436486 - protein, 9 aa, Mycobacterium
ASKSSGESS

SEQ ID NO: 436487 - protein, 7 aa, Mycobacterium
ASKSYAA

SEQ ID NO: 436488 - protein, 14 aa, Mycobacterium
ASKTTTGAADEIDG

SEQ ID NO: 436489 - protein, 9 aa, Mycobacterium
ASKVAEGQP

SEQ ID NO: 436490 - protein, 14 aa, Mycobacterium
ASKVASESGVDDPT

SEQ ID NO: 436491 - protein, 7 aa, Mycobacterium
ASKWGRR

SEQ ID NO: 436492 - protein, 10 aa, Mycobacterium
ASKYAGTPHE

SEQ ID NO: 436493 - protein, 6 aa, Mycobacterium
ASKYGL

SEQ ID NO: 436494 - protein, 13 aa, Mycobacterium
ASLAAGDTPEPPM

SEQ ID NO: 436495 - protein, 10 aa, Mycobacterium
ASLAAGSGEV

SEQ ID NO: 436496 - protein, 5 aa, Mycobacterium
ASLAE

SEQ ID NO: 436497 - protein, 6 aa, Mycobacterium
ASLAGV

SEQ ID NO: 436498 - protein, 5 aa, Mycobacterium
ASLAK

SEQ ID NO: 436499 - protein, 8 aa, Mycobacterium
ASLAPADR

SEQ ID NO: 436500 - protein, 8 aa, Mycobacterium
ASLARPDG

SEQ ID NO: 436501 - protein, 11 aa, Mycobacterium
ASLASAPGGQS

SEQ ID NO: 436502 - protein, 7 aa, Mycobacterium
ASLASQP

SEQ ID NO: 436503 - protein, 7 aa, Mycobacterium
ASLATGA

SEQ ID NO: 436504 - protein, 12 aa, Mycobacterium
ASLATTDAPSAR

SEQ ID NO: 436505 - protein, 9 aa, Mycobacterium
ASLDAPPAD

SEQ ID NO: 436506 - protein, 24 aa, Mycobacterium
ASLDDSGHAGGTACPNARPVTGPT

SEQ ID NO: 436507 - protein, 9 aa, Mycobacterium
ASLDDTSKA

SEQ ID NO: 436508 - protein, 7 aa, Mycobacterium
ASLDGEQ

SEQ ID NO: 436509 - protein, 12 aa, Mycobacterium
ASLDGVRGNSQL

SEQ ID NO: 436510 - protein, 7 aa, Mycobacterium
ASLDPEA

SEQ ID NO: 436511 - protein, 8 aa, Mycobacterium
ASLDPTAR

SEQ ID NO: 436512 - protein, 6 aa, Mycobacterium
ASLDRL

SEQ ID NO: 436513 - protein, 7 aa, Mycobacterium
ASLDSEP

SEQ ID NO: 436514 - protein, 7 aa, Mycobacterium
ASLDTDP

SEQ ID NO: 436515 - protein, 5 aa, Mycobacterium
ASLEA

SEQ ID NO: 436516 - protein, 6 aa, Mycobacterium
ASLEAS

SEQ ID NO: 436517 - protein, 5 aa, Mycobacterium
ASLED

SEQ ID NO: 436518 - protein, 8 aa, Mycobacterium
ASLEDPRY

SEQ ID NO: 436519 - protein, 17 aa, Mycobacterium
ASLEDVQRATEDLDEAH

SEQ ID NO: 436520 - protein, 6 aa, Mycobacterium
ASLEGR

SEQ ID NO: 436521 - protein, 8 aa, Mycobacterium
ASLEKGPR

SEQ ID NO: 436522 - protein, 7 aa, Mycobacterium
ASLEPGR

SEQ ID NO: 436523 - protein, 23 aa, Mycobacterium
ASLEPYSDTPAKTASTPAELGAA

SEQ ID NO: 436524 - protein, 4 aa, Mycobacterium
ASLF

SEQ ID NO: 436525 - protein, 7 aa, Mycobacterium
ASLGAEG

SEQ ID NO: 436526 - protein, 13 aa, Mycobacterium
ASLGASPAADRRT

SEQ ID NO: 436527 - protein, 13 aa, Mycobacterium
ASLGEDERTAYNE

SEQ ID NO: 436528 - protein, 18 aa, Mycobacterium
ASLGEPDAHGLPASTPIT

SEQ ID NO: 436529 - protein, 12 aa, Mycobacterium
ASLGGAVGASAG

SEQ ID NO: 436530 - protein, 8 aa, Mycobacterium
ASLGGDEG

SEQ ID NO: 436531 - protein, 19 aa, Mycobacterium
ASLGGGAHGDGAGAQLPHG

SEQ ID NO: 436532 - protein, 13 aa, Mycobacterium
ASLGGQVSEGDGV

SEQ ID NO: 436533 - protein, 11 aa, Mycobacterium
ASLGGRDGSNV

SEQ ID NO: 436534 - protein, 10 aa, Mycobacterium
ASLGGRDGTN

SEQ ID NO: 436535 - protein, 6 aa, Mycobacterium
ASLGMG

SEQ ID NO: 436536 - protein, 11 aa, Mycobacterium
ASLGPGAATEV

SEQ ID NO: 436537 - protein, 8 aa, Mycobacterium
ASLGRKVR

SEQ ID NO: 436538 - protein, 12 aa, Mycobacterium
ASLGTDINNASN

SEQ ID NO: 436539 - protein, 13 aa, Mycobacterium
ASLNEAASESDGY

SEQ ID NO: 436540 - protein, 14 aa, Mycobacterium
ASLNEATSDVDGYR

SEQ ID NO: 436541 - protein, 8 aa, Mycobacterium
ASLNPRKR

SEQ ID NO: 436542 - protein, 16 aa, Mycobacterium
ASLPAGEYRQVSGNTA

SEQ ID NO: 436543 - protein, 11 aa, Mycobacterium
ASLPAGTTSNY

SEQ ID NO: 436544 - protein, 15 aa, Mycobacterium
ASLPATAVSDPRPDD

SEQ ID NO: 436545 - protein, 8 aa, Mycobacterium
ASLPEDER

SEQ ID NO: 436546 - protein, 36 aa, Mycobacterium
ASLPEQAPAAAPPPAASSTTAPSTGAGARPGGFGGS

SEQ ID NO: 436547 - protein, 7 aa, Mycobacterium
ASLPEST

SEQ ID NO: 436548 - protein, 8 aa, Mycobacterium
ASLPGPYD

SEQ ID NO: 436549 - protein, 17 aa, Mycobacterium
ASLPGSRTTTSRGTPGL

SEQ ID NO: 436550 - protein, 6 aa, Mycobacterium
ASLPNG

SEQ ID NO: 436551 - protein, 11 aa, Mycobacterium
ASLPPPAELTD

SEQ ID NO: 436552 - protein, 5 aa, Mycobacterium
ASLPQ

SEQ ID NO: 436553 - protein, 8 aa, Mycobacterium
ASLPQFEG

SEQ ID NO: 436554 - protein, 5 aa, Mycobacterium
ASLPR

SEQ ID NO: 436555 - protein, 9 aa, Mycobacterium
ASLPSGRGE

SEQ ID NO: 436556 - protein, 7 aa, Mycobacterium
ASLPSGS

SEQ ID NO: 436557 - protein, 7 aa, Mycobacterium
ASLPSSS

SEQ ID NO: 436558 - protein, 10 aa, Mycobacterium
ASLPTSEPLR

SEQ ID NO: 436559 - protein, 7 aa, Mycobacterium
ASLQPGD

SEQ ID NO: 436560 - protein, 15 aa, Mycobacterium
ASLQRNAAVKGPLRC

SEQ ID NO: 436561 - protein, 5 aa, Mycobacterium
ASLQT

SEQ ID NO: 436562 - protein, 8 aa, Mycobacterium
ASLRDGRA

SEQ ID NO: 436563 - protein, 5 aa, Mycobacterium
ASLRE

SEQ ID NO: 436564 - protein, 6 aa, Mycobacterium
ASLREP

SEQ ID NO: 436565 - protein, 13 aa, Mycobacterium
ASLRTARADGGAR

SEQ ID NO: 436566 - protein, 4 aa, Mycobacterium
ASLS

SEQ ID NO: 436567 - protein, 10 aa, Mycobacterium
ASLSADEQEL

SEQ ID NO: 436568 - protein, 12 aa, Mycobacterium
ASLSAQAEAAAH

SEQ ID NO: 436569 - protein, 8 aa, Mycobacterium
ASLSATEE

SEQ ID NO: 436570 - protein, 11 aa, Mycobacterium
ASLSDDERAVR

SEQ ID NO: 436571 - protein, 15 aa, Mycobacterium
ASLSDRDAAAPSLQE

SEQ ID NO: 436572 - protein, 9 aa, Mycobacterium
ASLSDSLSR

SEQ ID NO: 436573 - protein, 5 aa, Mycobacterium
ASLSF

SEQ ID NO: 436574 - protein, 12 aa, Mycobacterium
ASLSGHPDAARR

SEQ ID NO: 436575 - protein, 7 aa, Mycobacterium
ASLSPDE

SEQ ID NO: 436576 - protein, 9 aa, Mycobacterium
ASLSPGATE

SEQ ID NO: 436577 - protein, 7 aa, Mycobacterium
ASLSPSH

SEQ ID NO: 436578 - protein, 15 aa, Mycobacterium
ASLSSTRARPVPPED

SEQ ID NO: 436579 - protein, 9 aa, Mycobacterium
ASLSSTTRA

SEQ ID NO: 436580 - protein, 8 aa, Mycobacterium
ASLSTGAA

SEQ ID NO: 436581 - protein, 6 aa, Mycobacterium
ASLTDD

SEQ ID NO: 436582 - protein, 11 aa, Mycobacterium
ASLTDDQWATP

SEQ ID NO: 436583 - protein, 6 aa, Mycobacterium
ASLTEA

SEQ ID NO: 436584 - protein, 7 aa, Mycobacterium
ASLTEEG

SEQ ID NO: 436585 - protein, 11 aa, Mycobacterium
ASLTESPSYWD

SEQ ID NO: 436586 - protein, 12 aa, Mycobacterium
ASLTGDAPDLHR

SEQ ID NO: 436587 - protein, 8 aa, Mycobacterium
ASLTPQQA

SEQ ID NO: 436588 - protein, 8 aa, Mycobacterium
ASMAGSQV

SEQ ID NO: 436589 - protein, 10 aa, Mycobacterium
ASMATAAAPY

SEQ ID NO: 436590 - protein, 12 aa, Mycobacterium
ASMATGANLPMP

SEQ ID NO: 436591 - protein, 9 aa, Mycobacterium
ASMDDRGSP

SEQ ID NO: 436592 - protein, 6 aa, Mycobacterium
ASMEGV

SEQ ID NO: 436593 - protein, 7 aa, Mycobacterium
ASMGLPE

SEQ ID NO: 436594 - protein, 11 aa, Mycobacterium
ASMGNANDKDS

SEQ ID NO: 436595 - protein, 12 aa, Mycobacterium
ASMGNTNPKDNW

SEQ ID NO: 436596 - protein, 8 aa, Mycobacterium
ASMHGRGQ

SEQ ID NO: 436597 - protein, 29 aa, Mycobacterium
ASMPGAQAPIEPDERAEDEFDPKDPSLGS

SEQ ID NO: 436598 - protein, 5 aa, Mycobacterium
ASMPS

SEQ ID NO: 436599 - protein, 8 aa, Mycobacterium
ASMTDDDW

SEQ ID NO: 436600 - protein, 12 aa, Mycobacterium
ASMTTSGTKFRS

SEQ ID NO: 436601 - protein, 8 aa, Mycobacterium
ASNAATMG

SEQ ID NO: 436602 - protein, 8 aa, Mycobacterium
ASNAPTTL

SEQ ID NO: 436603 - protein, 7 aa, Mycobacterium
ASNARRV

SEQ ID NO: 436604 - protein, 11 aa, Mycobacterium
ASNATTSDQVR

SEQ ID NO: 436605 - protein, 4 aa, Mycobacterium
ASND

SEQ ID NO: 436606 - protein, 9 aa, Mycobacterium
ASNDETKYG

SEQ ID NO: 436607 - protein, 12 aa, Mycobacterium
ASNDGTRAAKSD

SEQ ID NO: 436608 - protein, 25 aa, Mycobacterium
ASNDTVGAGTITEAREVKPETHSRT

SEQ ID NO: 436609 - protein, 6 aa, Mycobacterium
ASNELA

SEQ ID NO: 436610 - protein, 7 aa, Mycobacterium
ASNETVA

SEQ ID NO: 436611 - protein, 7 aa, Mycobacterium
ASNEYQT

SEQ ID NO: 436612 - protein, 4 aa, Mycobacterium
ASNG

SEQ ID NO: 436613 - protein, 5 aa, Mycobacterium
ASNGA

SEQ ID NO: 436614 - protein, 40 aa, Mycobacterium
ASNGAWGKGAGKAFAGGVGEGAKGNDGTSAAVKGTEGSIT

SEQ ID NO: 436615 - protein, 13 aa, Mycobacterium
ASNGGISRGVPTG

SEQ ID NO: 436616 - protein, 8 aa, Mycobacterium
ASNGGVSR

SEQ ID NO: 436617 - protein, 10 aa, Mycobacterium
ASNGQVHEDA

SEQ ID NO: 436618 - protein, 6 aa, Mycobacterium
ASNHGR

SEQ ID NO: 436619 - protein, 4 aa, Mycobacterium
ASNL

SEQ ID NO: 436620 - protein, 6 aa, Mycobacterium
ASNLKN

SEQ ID NO: 436621 - protein, 5 aa, Mycobacterium
ASNNA

SEQ ID NO: 436622 - protein, 4 aa, Mycobacterium
ASNP

SEQ ID NO: 436623 - protein, 6 aa, Mycobacterium
ASNPAV

SEQ ID NO: 436624 - protein, 8 aa, Mycobacterium
ASNPEATL

SEQ ID NO: 436625 - protein, 6 aa, Mycobacterium
ASNPQR

SEQ ID NO: 436626 - protein, 7 aa, Mycobacterium
ASNPRFT

SEQ ID NO: 436627 - protein, 4 aa, Mycobacterium
ASNQ

SEQ ID NO: 436628 - protein, 7 aa, Mycobacterium
ASNQAVG

SEQ ID NO: 436629 - protein, 5 aa, Mycobacterium
ASNQR

SEQ ID NO: 436630 - protein, 6 aa, Mycobacterium
ASNRAA

SEQ ID NO: 436631 - protein, 8 aa, Mycobacterium
ASNRDAAD

SEQ ID NO: 436632 - protein, 7 aa, Mycobacterium
ASNREIG

SEQ ID NO: 436633 - protein, 6 aa, Mycobacterium
ASNRNA

SEQ ID NO: 436634 - protein, 8 aa, Mycobacterium
ASNRPDGR

SEQ ID NO: 436635 - protein, 14 aa, Mycobacterium
ASNRPKYQQRVMGP

SEQ ID NO: 436636 - protein, 25 aa, Mycobacterium
ASNSAAATALTPFSSPELSVDPDGV

SEQ ID NO: 436637 - protein, 6 aa, Mycobacterium
ASNSAE

SEQ ID NO: 436638 - protein, 7 aa, Mycobacterium
ASNSAIT

SEQ ID NO: 436639 - protein, 6 aa, Mycobacterium
ASNSRE

SEQ ID NO: 436640 - protein, 6 aa, Mycobacterium
ASNSRK

SEQ ID NO: 436641 - protein, 17 aa, Mycobacterium
ASNSSAQAELQRAGDAV

SEQ ID NO: 436642 - protein, 23 aa, Mycobacterium
ASNTLDAASNTLDASSNTLDAAH

SEQ ID NO: 436643 - protein, 5 aa, Mycobacterium
ASNTN

SEQ ID NO: 436644 - protein, 6 aa, Mycobacterium
ASNTQQ

SEQ ID NO: 436645 - protein, 12 aa, Mycobacterium
ASNTRDRSRSEW

SEQ ID NO: 436646 - protein, 8 aa, Mycobacterium
ASNTSSLS

SEQ ID NO: 436647 - protein, 22 aa, Mycobacterium
ASNVTATTEAAKLSNARPISLL

SEQ ID NO: 436648 - protein, 6 aa, Mycobacterium
ASNYGY

SEQ ID NO: 436649 - protein, 45 aa, Mycobacterium
ASNYSRAEAASTLGGGSGVLPAPHDPEQFSAPGPPGTLGAGPPPP

SEQ ID NO: 436650 - protein, 4 aa, Mycobacterium
ASPA

SEQ ID NO: 436651 - protein, 6 aa, Mycobacterium
ASPAAR

SEQ ID NO: 436652 - protein, 5 aa, Mycobacterium
ASPAD

SEQ ID NO: 436653 - protein, 8 aa, Mycobacterium
ASPADDTV

SEQ ID NO: 436654 - protein, 5 aa, Mycobacterium
ASPAE

SEQ ID NO: 436655 - protein, 9 aa, Mycobacterium
ASPAEDEPV

SEQ ID NO: 436656 - protein, 12 aa, Mycobacterium
ASPAELDTADYR

SEQ ID NO: 436657 - protein, 7 aa, Mycobacterium
ASPAESN

SEQ ID NO: 436658 - protein, 5 aa, Mycobacterium
ASPAG

SEQ ID NO: 436659 - protein, 12 aa, Mycobacterium
ASPAGDPAPLRE

SEQ ID NO: 436660 - protein, 11 aa, Mycobacterium
ASPAGGPIRGP

SEQ ID NO: 436661 - protein, 13 aa, Mycobacterium
ASPAGLTGLRGSE

SEQ ID NO: 436662 - protein, 13 aa, Mycobacterium
ASPAGQDPASLGE

SEQ ID NO: 436663 - protein, 9 aa, Mycobacterium
ASPAGSGTW

SEQ ID NO: 436664 - protein, 6 aa, Mycobacterium
ASPAIG

SEQ ID NO: 436665 - protein, 8 aa, Mycobacterium
ASPAIGSV

SEQ ID NO: 436666 - protein, 5 aa, Mycobacterium
ASPAL

SEQ ID NO: 436667 - protein, 11 aa, Mycobacterium
ASPALAASQSS

SEQ ID NO: 436668 - protein, 7 aa, Mycobacterium
ASPALQQ

SEQ ID NO: 436669 - protein, 10 aa, Mycobacterium
ASPANPSPQL

SEQ ID NO: 436670 - protein, 9 aa, Mycobacterium
ASPAPDDAV

SEQ ID NO: 436671 - protein, 14 aa, Mycobacterium
ASPAPLPPTAELTD

SEQ ID NO: 436672 - protein, 15 aa, Mycobacterium
ASPAPPMEPSPYLPT

SEQ ID NO: 436673 - protein, 11 aa, Mycobacterium
ASPAPRGHVPQ

SEQ ID NO: 436674 - protein, 22 aa, Mycobacterium
ASPAPRGHVPQMSNKKQGEASA

SEQ ID NO: 436675 - protein, 11 aa, Mycobacterium
ASPAPSEAQVS

SEQ ID NO: 436676 - protein, 6 aa, Mycobacterium
ASPAPT

SEQ ID NO: 436677 - protein, 7 aa, Mycobacterium
ASPAQNT

SEQ ID NO: 436678 - protein, 8 aa, Mycobacterium
ASPASADM

SEQ ID NO: 436679 - protein, 8 aa, Mycobacterium
ASPASEPA

SEQ ID NO: 436680 - protein, 21 aa, Mycobacterium
ASPATAPVTASPRTAPYSEGL

SEQ ID NO: 436681 - protein, 8 aa, Mycobacterium
ASPAVSNR

SEQ ID NO: 436682 - protein, 6 aa, Mycobacterium
ASPAVT

SEQ ID NO: 436683 - protein, 17 aa, Mycobacterium
ASPCGTDVASARSLEDT

SEQ ID NO: 436684 - protein, 7 aa, Mycobacterium
ASPCQAP

SEQ ID NO: 436685 - protein, 4 aa, Mycobacterium
ASPD

SEQ ID NO: 436686 - protein, 5 aa, Mycobacterium
ASPDA

SEQ ID NO: 436687 - protein, 8 aa, Mycobacterium
ASPDAALT

SEQ ID NO: 436688 - protein, 7 aa, Mycobacterium
ASPDAAM

SEQ ID NO: 436689 - protein, 6 aa, Mycobacterium
ASPDAD

SEQ ID NO: 436690 - protein, 14 aa, Mycobacterium
ASPDANHANHAPAR

SEQ ID NO: 436691 - protein, 9 aa, Mycobacterium
ASPDASQAA

SEQ ID NO: 436692 - protein, 12 aa, Mycobacterium
ASPDETAPPIDR

SEQ ID NO: 436693 - protein, 5 aa, Mycobacterium
ASPDG

SEQ ID NO: 436694 - protein, 12 aa, Mycobacterium
ASPDGNGGSRYR

SEQ ID NO: 436695 - protein, 7 aa, Mycobacterium
ASPDGRL

SEQ ID NO: 436696 - protein, 12 aa, Mycobacterium
ASPDGVRSSKAD

SEQ ID NO: 436697 - protein, 5 aa, Mycobacterium
ASPDI

SEQ ID NO: 436698 - protein, 11 aa, Mycobacterium
ASPDKTQASID

SEQ ID NO: 436699 - protein, 10 aa, Mycobacterium
ASPDKVGRDA

SEQ ID NO: 436700 - protein, 17 aa, Mycobacterium
ASPDQDFAPYNRDPETL

SEQ ID NO: 436701 - protein, 5 aa, Mycobacterium
ASPDR

SEQ ID NO: 436702 - protein, 13 aa, Mycobacterium
ASPDRARAGAEAL

SEQ ID NO: 436703 - protein, 8 aa, Mycobacterium
ASPDTQQE

SEQ ID NO: 436704 - protein, 5 aa, Mycobacterium
ASPEA

SEQ ID NO: 436705 - protein, 6 aa, Mycobacterium
ASPEAE

SEQ ID NO: 436706 - protein, 6 aa, Mycobacterium
ASPEAT

SEQ ID NO: 436707 - protein, 8 aa, Mycobacterium
ASPEAVAA

SEQ ID NO: 436708 - protein, 8 aa, Mycobacterium
ASPEGGHM

SEQ ID NO: 436709 - protein, 11 aa, Mycobacterium
ASPEIDPETDY

SEQ ID NO: 436710 - protein, 6 aa, Mycobacterium
ASPEIR

SEQ ID NO: 436711 - protein, 5 aa, Mycobacterium
ASPEL

SEQ ID NO: 436712 - protein, 17 aa, Mycobacterium
ASPENVDAYSGTGNAHS

SEQ ID NO: 436713 - protein, 9 aa, Mycobacterium
ASPEPLSEA

SEQ ID NO: 436714 - protein, 9 aa, Mycobacterium
ASPEPLSKA

SEQ ID NO: 436715 - protein, 10 aa, Mycobacterium
ASPEQQRALQ

SEQ ID NO: 436716 - protein, 9 aa, Mycobacterium
ASPERLSGK

SEQ ID NO: 436717 - protein, 10 aa, Mycobacterium
ASPESDNNKP

SEQ ID NO: 436718 - protein, 9 aa, Mycobacterium
ASPESVSAQ

SEQ ID NO: 436719 - protein, 7 aa, Mycobacterium
ASPETSL

SEQ ID NO: 436720 - protein, 5 aa, Mycobacterium
ASPEV

SEQ ID NO: 436721 - protein, 8 aa, Mycobacterium
ASPEVPSH

SEQ ID NO: 436722 - protein, 7 aa, Mycobacterium
ASPFPEP

SEQ ID NO: 436723 - protein, 9 aa, Mycobacterium
ASPFPGPTR

SEQ ID NO: 436724 - protein, 10 aa, Mycobacterium
ASPFSPQTQF

SEQ ID NO: 436725 - protein, 12 aa, Mycobacterium
ASPGADPAPSEQ

SEQ ID NO: 436726 - protein, 7 aa, Mycobacterium
ASPGALS

SEQ ID NO: 436727 - protein, 8 aa, Mycobacterium
ASPGASTA

SEQ ID NO: 436728 - protein, 9 aa, Mycobacterium
ASPGATSGQ

SEQ ID NO: 436729 - protein, 24 aa, Mycobacterium
ASPGDQPKATTSAAPQAHSAAAVL

SEQ ID NO: 436730 - protein, 6 aa, Mycobacterium
ASPGEL

SEQ ID NO: 436731 - protein, 6 aa, Mycobacterium
ASPGFD

SEQ ID NO: 436732 - protein, 13 aa, Mycobacterium
ASPGGGSATASNF

SEQ ID NO: 436733 - protein, 13 aa, Mycobacterium
ASPGGGSATATNF

SEQ ID NO: 436734 - protein, 7 aa, Mycobacterium
ASPGHEA

SEQ ID NO: 436735 - protein, 6 aa, Mycobacterium
ASPGHI

SEQ ID NO: 436736 - protein, 9 aa, Mycobacterium
ASPGNMGTV

SEQ ID NO: 436737 - protein, 7 aa, Mycobacterium
ASPGPAG

SEQ ID NO: 436738 - protein, 10 aa, Mycobacterium
ASPGSADTRP

SEQ ID NO: 436739 - protein, 18 aa, Mycobacterium
ASPGSSTDASAKRAFTET

SEQ ID NO: 436740 - protein, 17 aa, Mycobacterium
ASPGSVSASGTGGTVSV

SEQ ID NO: 436741 - protein, 6 aa, Mycobacterium
ASPGVR

SEQ ID NO: 436742 - protein, 4 aa, Mycobacterium
ASPH

SEQ ID NO: 436743 - protein, 27 aa, Mycobacterium
ASPHAKRGGFYGPRGPGHLGGPPGEQR

SEQ ID NO: 436744 - protein, 8 aa, Mycobacterium
ASPHLTEG

SEQ ID NO: 436745 - protein, 12 aa, Mycobacterium
ASPIAPKAGRPA

SEQ ID NO: 436746 - protein, 5 aa, Mycobacterium
ASPID

SEQ ID NO: 436747 - protein, 5 aa, Mycobacterium
ASPIP

SEQ ID NO: 436748 - protein, 16 aa, Mycobacterium
ASPIRTDEHTGASSRL

SEQ ID NO: 436749 - protein, 7 aa, Mycobacterium
ASPKATV

SEQ ID NO: 436750 - protein, 7 aa, Mycobacterium
ASPKGAR

SEQ ID NO: 436751 - protein, 16 aa, Mycobacterium
ASPKPGAVSAASVASR

SEQ ID NO: 436752 - protein, 8 aa, Mycobacterium
ASPKVTAN

SEQ ID NO: 436753 - protein, 12 aa, Mycobacterium
ASPLDGYPRPGK

SEQ ID NO: 436754 - protein, 6 aa, Mycobacterium
ASPLGE

SEQ ID NO: 436755 - protein, 8 aa, Mycobacterium
ASPLGGDE

SEQ ID NO: 436756 - protein, 6 aa, Mycobacterium
ASPLGS

SEQ ID NO: 436757 - protein, 10 aa, Mycobacterium
ASPLGTAESG

SEQ ID NO: 436758 - protein, 5 aa, Mycobacterium
ASPLI

SEQ ID NO: 436759 - protein, 10 aa, Mycobacterium
ASPLPGPAGN

SEQ ID NO: 436760 - protein, 6 aa, Mycobacterium
ASPLPK

SEQ ID NO: 436761 - protein, 6 aa, Mycobacterium
ASPLSQ

SEQ ID NO: 436762 - protein, 11 aa, Mycobacterium
ASPLSRTADGV

SEQ ID NO: 436763 - protein, 7 aa, Mycobacterium
ASPLSSL

SEQ ID NO: 436764 - protein, 10 aa, Mycobacterium
ASPLSSPASL

SEQ ID NO: 436765 - protein, 17 aa, Mycobacterium
ASPMHPHSDDPNPPSEV

SEQ ID NO: 436766 - protein, 6 aa, Mycobacterium
ASPNAV

SEQ ID NO: 436767 - protein, 7 aa, Mycobacterium
ASPNEVN

SEQ ID NO: 436768 - protein, 9 aa, Mycobacterium
ASPNGAKRA

SEQ ID NO: 436769 - protein, 11 aa, Mycobacterium
ASPNGAKRAVA

SEQ ID NO: 436770 - protein, 6 aa, Mycobacterium
ASPNHA

SEQ ID NO: 436771 - protein, 5 aa, Mycobacterium
ASPNP

SEQ ID NO: 436772 - protein, 7 aa, Mycobacterium
ASPNPAE

SEQ ID NO: 436773 - protein, 9 aa, Mycobacterium
ASPNSGTPG

SEQ ID NO: 436774 - protein, 7 aa, Mycobacterium
ASPNSRL

SEQ ID NO: 436775 - protein, 7 aa, Mycobacterium
ASPPAAV

SEQ ID NO: 436776 - protein, 6 aa, Mycobacterium
ASPPAD

SEQ ID NO: 436777 - protein, 16 aa, Mycobacterium
ASPPDAPVAAPGEAEL

SEQ ID NO: 436778 - protein, 9 aa, Mycobacterium
ASPPENAGE

SEQ ID NO: 436779 - protein, 6 aa, Mycobacterium
ASPPFD

SEQ ID NO: 436780 - protein, 6 aa, Mycobacterium
ASPPFN

SEQ ID NO: 436781 - protein, 5 aa, Mycobacterium
ASPPM

SEQ ID NO: 436782 - protein, 13 aa, Mycobacterium
ASPPPEPLVSPEG

SEQ ID NO: 436783 - protein, 18 aa, Mycobacterium
ASPPPQNEQTPFYPRSPY

SEQ ID NO: 436784 - protein, 20 aa, Mycobacterium
ASPPPQSEQTPFYPRSPYGA

SEQ ID NO: 436785 - protein, 9 aa, Mycobacterium
ASPPQTSFG

SEQ ID NO: 436786 - protein, 6 aa, Mycobacterium
ASPPQY

SEQ ID NO: 436787 - protein, 18 aa, Mycobacterium
ASPPRARNAESTSPPANT

SEQ ID NO: 436788 - protein, 7 aa, Mycobacterium
ASPPRAV

SEQ ID NO: 436789 - protein, 4 aa, Mycobacterium
ASPQ

SEQ ID NO: 436790 - protein, 8 aa, Mycobacterium
ASPQGGEA

SEQ ID NO: 436791 - protein, 8 aa, Mycobacterium
ASPQGNSL

SEQ ID NO: 436792 - protein, 8 aa, Mycobacterium
ASPQPRAI

SEQ ID NO: 436793 - protein, 16 aa, Mycobacterium
ASPQSDITAEAPGEAE

SEQ ID NO: 436794 - protein, 15 aa, Mycobacterium
ASPQSTVIGGATETV

SEQ ID NO: 436795 - protein, 4 aa, Mycobacterium
ASPR

SEQ ID NO: 436796 - protein, 6 aa, Mycobacterium
ASPRAF

SEQ ID NO: 436797 - protein, 7 aa, Mycobacterium
ASPRAGE

SEQ ID NO: 436798 - protein, 23 aa, Mycobacterium
ASPRAREVAAQAPASTIPPSYQQ

SEQ ID NO: 436799 - protein, 6 aa, Mycobacterium
ASPRDD

SEQ ID NO: 436800 - protein, 6 aa, Mycobacterium
ASPREA

SEQ ID NO: 436801 - protein, 7 aa, Mycobacterium
ASPRELY

SEQ ID NO: 436802 - protein, 6 aa, Mycobacterium
ASPREV

SEQ ID NO: 436803 - protein, 6 aa, Mycobacterium
ASPRFP

SEQ ID NO: 436804 - protein, 9 aa, Mycobacterium
ASPRGLDDE

SEQ ID NO: 436805 - protein, 10 aa, Mycobacterium
ASPRGRGGYR

SEQ ID NO: 436806 - protein, 9 aa, Mycobacterium
ASPRGRREI

SEQ ID NO: 436807 - protein, 5 aa, Mycobacterium
ASPRI

SEQ ID NO: 436808 - protein, 5 aa, Mycobacterium
ASPRQ

SEQ ID NO: 436809 - protein, 10 aa, Mycobacterium
ASPRQDVETV

SEQ ID NO: 436810 - protein, 6 aa, Mycobacterium
ASPRQS

SEQ ID NO: 436811 - protein, 14 aa, Mycobacterium
ASPRQTAIAGPPQQ

SEQ ID NO: 436812 - protein, 5 aa, Mycobacterium
ASPRR

SEQ ID NO: 436813 - protein, 7 aa, Mycobacterium
ASPSAEA

SEQ ID NO: 436814 - protein, 7 aa, Mycobacterium
ASPSAGC

SEQ ID NO: 436815 - protein, 14 aa, Mycobacterium
ASPSALPAADPSSL

SEQ ID NO: 436816 - protein, 8 aa, Mycobacterium
ASPSDGVE

SEQ ID NO: 436817 - protein, 12 aa, Mycobacterium
ASPSGGSPRRAV

SEQ ID NO: 436818 - protein, 12 aa, Mycobacterium
ASPSGTAGSWNA

SEQ ID NO: 436819 - protein, 6 aa, Mycobacterium
ASPSIT

SEQ ID NO: 436820 - protein, 7 aa, Mycobacterium
ASPSPHR

SEQ ID NO: 436821 - protein, 14 aa, Mycobacterium
ASPSQRDHNSAGPC

SEQ ID NO: 436822 - protein, 7 aa, Mycobacterium
ASPSRKV

SEQ ID NO: 436823 - protein, 7 aa, Mycobacterium
ASPSRTV

SEQ ID NO: 436824 - protein, 5 aa, Mycobacterium
ASPST

SEQ ID NO: 436825 - protein, 22 aa, Mycobacterium
ASPTAGGMTSTNSFAPEAPEYT

SEQ ID NO: 436826 - protein, 5 aa, Mycobacterium
ASPTD

SEQ ID NO: 436827 - protein, 7 aa, Mycobacterium
ASPTDAN

SEQ ID NO: 436828 - protein, 6 aa, Mycobacterium
ASPTDV

SEQ ID NO: 436829 - protein, 5 aa, Mycobacterium
ASPTE

SEQ ID NO: 436830 - protein, 8 aa, Mycobacterium
ASPTGDLG

SEQ ID NO: 436831 - protein, 6 aa, Mycobacterium
ASPTGE

SEQ ID NO: 436832 - protein, 6 aa, Mycobacterium
ASPTLR

SEQ ID NO: 436833 - protein, 11 aa, Mycobacterium
ASPTLTAAPEA

SEQ ID NO: 436834 - protein, 8 aa, Mycobacterium
ASPTMEGV

SEQ ID NO: 436835 - protein, 8 aa, Mycobacterium
ASPTPREV

SEQ ID NO: 436836 - protein, 13 aa, Mycobacterium
ASPTPSTSPGNFG

SEQ ID NO: 436837 - protein, 7 aa, Mycobacterium
ASPTPVT

SEQ ID NO: 436838 - protein, 6 aa, Mycobacterium
ASPTRA

SEQ ID NO: 436839 - protein, 6 aa, Mycobacterium
ASPTRF

SEQ ID NO: 436840 - protein, 6 aa, Mycobacterium
ASPTRT

SEQ ID NO: 436841 - protein, 12 aa, Mycobacterium
ASPTSALTAATS

SEQ ID NO: 436842 - protein, 8 aa, Mycobacterium
ASPTSGGM

SEQ ID NO: 436843 - protein, 29 aa, Mycobacterium
ASPTSPTAAPQRRPSAGPAGLPSCTGTAS

SEQ ID NO: 436844 - protein, 5 aa, Mycobacterium
ASPVP

SEQ ID NO: 436845 - protein, 8 aa, Mycobacterium
ASPVPEFD

SEQ ID NO: 436846 - protein, 12 aa, Mycobacterium
ASPVRAYDEAAE

SEQ ID NO: 436847 - protein, 13 aa, Mycobacterium
ASPVRSAHPADRQ

SEQ ID NO: 436848 - protein, 7 aa, Mycobacterium
ASPVRYG

SEQ ID NO: 436849 - protein, 5 aa, Mycobacterium
ASPVT

SEQ ID NO: 436850 - protein, 4 aa, Mycobacterium
ASPY

SEQ ID NO: 436851 - protein, 10 aa, Mycobacterium
ASQAAPGLDL

SEQ ID NO: 436852 - protein, 9 aa, Mycobacterium
ASQAAPGLE

SEQ ID NO: 436853 - protein, 15 aa, Mycobacterium
ASQAISGSLGRGGGE

SEQ ID NO: 436854 - protein, 5 aa, Mycobacterium
ASQAL

SEQ ID NO: 436855 - protein, 17 aa, Mycobacterium
ASQANELSELRRSGAHA

SEQ ID NO: 436856 - protein, 8 aa, Mycobacterium
ASQANQAG

SEQ ID NO: 436857 - protein, 12 aa, Mycobacterium
ASQASQEYGQSL

SEQ ID NO: 436858 - protein, 22 aa, Mycobacterium
ASQATQAPTTATNAASTGTTTS

SEQ ID NO: 436859 - protein, 4 aa, Mycobacterium
ASQC

SEQ ID NO: 436860 - protein, 7 aa, Mycobacterium
ASQDDKY

SEQ ID NO: 436861 - protein, 7 aa, Mycobacterium
ASQDPAH

SEQ ID NO: 436862 - protein, 10 aa, Mycobacterium
ASQDVPGTAV

SEQ ID NO: 436863 - protein, 7 aa, Mycobacterium
ASQEARE

SEQ ID NO: 436864 - protein, 7 aa, Mycobacterium
ASQEDAS

SEQ ID NO: 436865 - protein, 9 aa, Mycobacterium
ASQEGKPDG

SEQ ID NO: 436866 - protein, 7 aa, Mycobacterium
ASQELRD

SEQ ID NO: 436867 - protein, 7 aa, Mycobacterium
ASQELRE

SEQ ID NO: 436868 - protein, 7 aa, Mycobacterium
ASQERDY

SEQ ID NO: 436869 - protein, 4 aa, Mycobacterium
ASQG

SEQ ID NO: 436870 - protein, 6 aa, Mycobacterium
ASQGGE

SEQ ID NO: 436871 - protein, 13 aa, Mycobacterium
ASQGGIARGVPTG

SEQ ID NO: 436872 - protein, 14 aa, Mycobacterium
ASQGGISKGVPTGF

SEQ ID NO: 436873 - protein, 10 aa, Mycobacterium
ASQGKGAWPT

SEQ ID NO: 436874 - protein, 10 aa, Mycobacterium
ASQGSSPDQY

SEQ ID NO: 436875 - protein, 8 aa, Mycobacterium
ASQGVGRG

SEQ ID NO: 436876 - protein, 9 aa, Mycobacterium
ASQHAGGRL

SEQ ID NO: 436877 - protein, 4 aa, Mycobacterium
ASQI

SEQ ID NO: 436878 - protein, 10 aa, Mycobacterium
ASQKARRPKK

SEQ ID NO: 436879 - protein, 11 aa, Mycobacterium
ASQKARRPKTF

SEQ ID NO: 436880 - protein, 18 aa, Mycobacterium
ASQKDKYPAQLSGGQQQR

SEQ ID NO: 436881 - protein, 13 aa, Mycobacterium
ASQLDEAASAAAG

SEQ ID NO: 436882 - protein, 7 aa, Mycobacterium
ASQLGPD

SEQ ID NO: 436883 - protein, 7 aa, Mycobacterium
ASQLPPA

SEQ ID NO: 436884 - protein, 8 aa, Mycobacterium
ASQLPPAD

SEQ ID NO: 436885 - protein, 5 aa, Mycobacterium
ASQNR

SEQ ID NO: 436886 - protein, 5 aa, Mycobacterium
ASQNT

SEQ ID NO: 436887 - protein, 8 aa, Mycobacterium
ASQPAEPD

SEQ ID NO: 436888 - protein, 10 aa, Mycobacterium
ASQPAQMAGQ

SEQ ID NO: 436889 - protein, 6 aa, Mycobacterium
ASQPED

SEQ ID NO: 436890 - protein, 9 aa, Mycobacterium
ASQPEREFE

SEQ ID NO: 436891 - protein, 12 aa, Mycobacterium
ASQPGTPGSEAA

SEQ ID NO: 436892 - protein, 5 aa, Mycobacterium
ASQPL

SEQ ID NO: 436893 - protein, 7 aa, Mycobacterium
ASQPLHG

SEQ ID NO: 436894 - protein, 6 aa, Mycobacterium
ASQPLY

SEQ ID NO: 436895 - protein, 7 aa, Mycobacterium
ASQPMSS

SEQ ID NO: 436896 - protein, 7 aa, Mycobacterium
ASQPSTI

SEQ ID NO: 436897 - protein, 6 aa, Mycobacterium
ASQPTL

SEQ ID NO: 436898 - protein, 5 aa, Mycobacterium
ASQQA

SEQ ID NO: 436899 - protein, 16 aa, Mycobacterium
ASQQSRPVGSRAELDE

SEQ ID NO: 436900 - protein, 36 aa, Mycobacterium
ASQRAAATAPAARDSAPPLPGGDAPPDWDHPTPVTG

SEQ ID NO: 436901 - protein, 6 aa, Mycobacterium
ASQRAS

SEQ ID NO: 436902 - protein, 20 aa, Mycobacterium
ASQRESMGNASFADAFGANT

SEQ ID NO: 436903 - protein, 15 aa, Mycobacterium
ASQRHRADAIGQRRT

SEQ ID NO: 436904 - protein, 13 aa, Mycobacterium
ASQRKAKQAWDEG

SEQ ID NO: 436905 - protein, 5 aa, Mycobacterium
ASQRR

SEQ ID NO: 436906 - protein, 15 aa, Mycobacterium
ASQRRAHPDAGPEQV

SEQ ID NO: 436907 - protein, 10 aa, Mycobacterium
ASQRRDASPR

SEQ ID NO: 436908 - protein, 7 aa, Mycobacterium
ASQRRTL

SEQ ID NO: 436909 - protein, 16 aa, Mycobacterium
ASQRRVYPDPTAEQRR

SEQ ID NO: 436910 - protein, 9 aa, Mycobacterium
ASQRSTVTN

SEQ ID NO: 436911 - protein, 8 aa, Mycobacterium
ASQRTSRI

SEQ ID NO: 436912 - protein, 8 aa, Mycobacterium
ASQRVGNR

SEQ ID NO: 436913 - protein, 20 aa, Mycobacterium
ASQSALDAQVSDRVAAFDPD

SEQ ID NO: 436914 - protein, 13 aa, Mycobacterium
ASQSDAPVGAPRR

SEQ ID NO: 436915 - protein, 14 aa, Mycobacterium
ASQSDAPVGAPRRF

SEQ ID NO: 436916 - protein, 15 aa, Mycobacterium
ASQSEAASAPPSRDA

SEQ ID NO: 436917 - protein, 5 aa, Mycobacterium
ASQSG

SEQ ID NO: 436918 - protein, 13 aa, Mycobacterium
ASQSMAGRNGTAA

SEQ ID NO: 436919 - protein, 15 aa, Mycobacterium
ASQSRVNPDPSPEEL

SEQ ID NO: 436920 - protein, 5 aa, Mycobacterium
ASQSS

SEQ ID NO: 436921 - protein, 9 aa, Mycobacterium
ASQTAGRWP

SEQ ID NO: 436922 - protein, 23 aa, Mycobacterium
ASQTAVQAETAAQAYEQAAAKMT

SEQ ID NO: 436923 - protein, 11 aa, Mycobacterium
ASQTDSDERLR

SEQ ID NO: 436924 - protein, 6 aa, Mycobacterium
ASQTIS

SEQ ID NO: 436925 - protein, 11 aa, Mycobacterium
ASQTKAKQAWA

SEQ ID NO: 436926 - protein, 8 aa, Mycobacterium
ASQTPQQQ

SEQ ID NO: 436927 - protein, 6 aa, Mycobacterium
ASQTTG

SEQ ID NO: 436928 - protein, 4 aa, Mycobacterium
ASQV

SEQ ID NO: 436929 - protein, 4 aa, Mycobacterium
ASQW

SEQ ID NO: 436930 - protein, 5 aa, Mycobacterium
ASQYR

SEQ ID NO: 436931 - protein, 6 aa, Mycobacterium
ASRAAE

SEQ ID NO: 436932 - protein, 12 aa, Mycobacterium
ASRAAETAGADP

SEQ ID NO: 436933 - protein, 8 aa, Mycobacterium
ASRAAGAH

SEQ ID NO: 436934 - protein, 12 aa, Mycobacterium
ASRADSCAGGGQ

SEQ ID NO: 436935 - protein, 12 aa, Mycobacterium
ASRAENRSAGER

SEQ ID NO: 436936 - protein, 6 aa, Mycobacterium
ASRAER

SEQ ID NO: 436937 - protein, 5 aa, Mycobacterium
ASRAG

SEQ ID NO: 436938 - protein, 7 aa, Mycobacterium
ASRAGLK

SEQ ID NO: 436939 - protein, 11 aa, Mycobacterium
ASRAGRRTAPA

SEQ ID NO: 436940 - protein, 8 aa, Mycobacterium
ASRAGVGK

SEQ ID NO: 436941 - protein, 8 aa, Mycobacterium
ASRAGVNK

SEQ ID NO: 436942 - protein, 17 aa, Mycobacterium
ASRAHDAASARRSERQR

SEQ ID NO: 436943 - protein, 16 aa, Mycobacterium
ASRALPGLLQRLPSLL

SEQ ID NO: 436944 - protein, 6 aa, Mycobacterium
ASRAPA

SEQ ID NO: 436945 - protein, 8 aa, Mycobacterium
ASRAPGPL

SEQ ID NO: 436946 - protein, 6 aa, Mycobacterium
ASRAPK

SEQ ID NO: 436947 - protein, 10 aa, Mycobacterium
ASRAPSLHNS

SEQ ID NO: 436948 - protein, 9 aa, Mycobacterium
ASRARGTTL

SEQ ID NO: 436949 - protein, 19 aa, Mycobacterium
ASRARRREREKATRSAVSP

SEQ ID NO: 436950 - protein, 5 aa, Mycobacterium
ASRAS

SEQ ID NO: 436951 - protein, 15 aa, Mycobacterium
ASRATDSQRQAAREL

SEQ ID NO: 436952 - protein, 9 aa, Mycobacterium
ASRATFAEA

SEQ ID NO: 436953 - protein, 8 aa, Mycobacterium
ASRATGDH

SEQ ID NO: 436954 - protein, 9 aa, Mycobacterium
ASRATGDHA

SEQ ID NO: 436955 - protein, 9 aa, Mycobacterium
ASRATGTSV

SEQ ID NO: 436956 - protein, 8 aa, Mycobacterium
ASRATGVR

SEQ ID NO: 436957 - protein, 18 aa, Mycobacterium
ASRAYASAEAVNASPLQT

SEQ ID NO: 436958 - protein, 4 aa, Mycobacterium
ASRC

SEQ ID NO: 436959 - protein, 31 aa, Mycobacterium
ASRCGAGAAAGRRRRGIRSRRRRGRRAPGRA

SEQ ID NO: 436960 - protein, 12 aa, Mycobacterium
ASRDENSLRDTA

SEQ ID NO: 436961 - protein, 11 aa, Mycobacterium
ASRDEREYPEP

SEQ ID NO: 436962 - protein, 7 aa, Mycobacterium
ASRDGAR

SEQ ID NO: 436963 - protein, 6 aa, Mycobacterium
ASRDGE

SEQ ID NO: 436964 - protein, 6 aa, Mycobacterium
ASRDGF

SEQ ID NO: 436965 - protein, 8 aa, Mycobacterium
ASRDGKDE

SEQ ID NO: 436966 - protein, 5 aa, Mycobacterium
ASRDH

SEQ ID NO: 436967 - protein, 5 aa, Mycobacterium
ASRDI

SEQ ID NO: 436968 - protein, 6 aa, Mycobacterium
ASRDIQ

SEQ ID NO: 436969 - protein, 11 aa, Mycobacterium
ASRDPDARRQL

SEQ ID NO: 436970 - protein, 6 aa, Mycobacterium
ASRDPI

SEQ ID NO: 436971 - protein, 8 aa, Mycobacterium
ASRDPSRL

SEQ ID NO: 436972 - protein, 8 aa, Mycobacterium
ASRDPVTK

SEQ ID NO: 436973 - protein, 11 aa, Mycobacterium
ASRDSLATRTV

SEQ ID NO: 436974 - protein, 7 aa, Mycobacterium
ASRDTLS

SEQ ID NO: 436975 - protein, 5 aa, Mycobacterium
ASRDV

SEQ ID NO: 436976 - protein, 6 aa, Mycobacterium
ASREAL

SEQ ID NO: 436977 - protein, 6 aa, Mycobacterium
ASREDP

SEQ ID NO: 436978 - protein, 5 aa, Mycobacterium
ASREH

SEQ ID NO: 436979 - protein, 6 aa, Mycobacterium
ASREIT

SEQ ID NO: 436980 - protein, 7 aa, Mycobacterium
ASRELRE

SEQ ID NO: 436981 - protein, 12 aa, Mycobacterium
ASRENAADALRS

SEQ ID NO: 436982 - protein, 16 aa, Mycobacterium
ASRERSQLAPYESGQS

SEQ ID NO: 436983 - protein, 8 aa, Mycobacterium
ASRESTHY

SEQ ID NO: 436984 - protein, 7 aa, Mycobacterium
ASRFDDD

SEQ ID NO: 436985 - protein, 5 aa, Mycobacterium
ASRFT

SEQ ID NO: 436986 - protein, 6 aa, Mycobacterium
ASRGAD

SEQ ID NO: 436987 - protein, 6 aa, Mycobacterium
ASRGAS

SEQ ID NO: 436988 - protein, 6 aa, Mycobacterium
ASRGEA

SEQ ID NO: 436989 - protein, 6 aa, Mycobacterium
ASRGEG

SEQ ID NO: 436990 - protein, 8 aa, Mycobacterium
ASRGEPNM

SEQ ID NO: 436991 - protein, 7 aa, Mycobacterium
ASRGEQQ

SEQ ID NO: 436992 - protein, 7 aa, Mycobacterium
ASRGESH

SEQ ID NO: 436993 - protein, 14 aa, Mycobacterium
ASRGETDGPRVDEA

SEQ ID NO: 436994 - protein, 7 aa, Mycobacterium
ASRGFTG

SEQ ID NO: 436995 - protein, 9 aa, Mycobacterium
ASRGGAAGC

SEQ ID NO: 436996 - protein, 9 aa, Mycobacterium
ASRGKGQRV

SEQ ID NO: 436997 - protein, 6 aa, Mycobacterium
ASRGNW

SEQ ID NO: 436998 - protein, 8 aa, Mycobacterium
ASRGPVAA

SEQ ID NO: 436999 - protein, 17 aa, Mycobacterium
ASRGRRSAPHSGDDRER

SEQ ID NO: 437000 - protein, 9 aa, Mycobacterium
ASRGSDAPP

SEQ ID NO: 437001 - protein, 24 aa, Mycobacterium
ASRGSRIANSSSGAGSKDTWIFTD

SEQ ID NO: 437002 - protein, 10 aa, Mycobacterium
ASRGTPTASG

SEQ ID NO: 437003 - protein, 7 aa, Mycobacterium
ASRGTYP

SEQ ID NO: 437004 - protein, 5 aa, Mycobacterium
ASRGV

SEQ ID NO: 437005 - protein, 5 aa, Mycobacterium
ASRGW

SEQ ID NO: 437006 - protein, 9 aa, Mycobacterium
ASRHRRRES

SEQ ID NO: 437007 - protein, 12 aa, Mycobacterium
ASRIAENDPAIK

SEQ ID NO: 437008 - protein, 4 aa, Mycobacterium
ASRK

SEQ ID NO: 437009 - protein, 9 aa, Mycobacterium
ASRKGVTDA

SEQ ID NO: 437010 - protein, 5 aa, Mycobacterium
ASRKL

SEQ ID NO: 437011 - protein, 14 aa, Mycobacterium
ASRKNTAVSRGVGT

SEQ ID NO: 437012 - protein, 6 aa, Mycobacterium
ASRKYR

SEQ ID NO: 437013 - protein, 7 aa, Mycobacterium
ASRLADS

SEQ ID NO: 437014 - protein, 11 aa, Mycobacterium
ASRLEGDRSGF

SEQ ID NO: 437015 - protein, 7 aa, Mycobacterium
ASRLETA

SEQ ID NO: 437016 - protein, 14 aa, Mycobacterium
ASRLGEGEAYEVSA

SEQ ID NO: 437017 - protein, 7 aa, Mycobacterium
ASRLPDG

SEQ ID NO: 437018 - protein, 5 aa, Mycobacterium
ASRLT

SEQ ID NO: 437019 - protein, 8 aa, Mycobacterium
ASRLTPDA

SEQ ID NO: 437020 - protein, 7 aa, Mycobacterium
ASRMEST

SEQ ID NO: 437021 - protein, 6 aa, Mycobacterium
ASRNER

SEQ ID NO: 437022 - protein, 5 aa, Mycobacterium
ASRNG

SEQ ID NO: 437023 - protein, 7 aa, Mycobacterium
ASRNGVS

SEQ ID NO: 437024 - protein, 16 aa, Mycobacterium
ASRNNPSEPRRDPEEA

SEQ ID NO: 437025 - protein, 13 aa, Mycobacterium
ASRNSLKGPTRTR

SEQ ID NO: 437026 - protein, 7 aa, Mycobacterium
ASRNTGI

SEQ ID NO: 437027 - protein, 4 aa, Mycobacterium
ASRP

SEQ ID NO: 437028 - protein, 9 aa, Mycobacterium
ASRPARPGH

SEQ ID NO: 437029 - protein, 14 aa, Mycobacterium
ASRPATKDAPATRG

SEQ ID NO: 437030 - protein, 13 aa, Mycobacterium
ASRPAVEAAGQDV

SEQ ID NO: 437031 - protein, 14 aa, Mycobacterium
ASRPDDGRLSDKEL

SEQ ID NO: 437032 - protein, 11 aa, Mycobacterium
ASRPDLRHPRR

SEQ ID NO: 437033 - protein, 6 aa, Mycobacterium
ASRPEE

SEQ ID NO: 437034 - protein, 7 aa, Mycobacterium
ASRPEFG

SEQ ID NO: 437035 - protein, 9 aa, Mycobacterium
ASRPEPPIG

SEQ ID NO: 437036 - protein, 11 aa, Mycobacterium
ASRPGANEKSR

SEQ ID NO: 437037 - protein, 12 aa, Mycobacterium
ASRPGDDAPSQE

SEQ ID NO: 437038 - protein, 6 aa, Mycobacterium
ASRPGM

SEQ ID NO: 437039 - protein, 9 aa, Mycobacterium
ASRPGSAGI

SEQ ID NO: 437040 - protein, 17 aa, Mycobacterium
ASRPHAAAGTAKAAADA

SEQ ID NO: 437041 - protein, 9 aa, Mycobacterium
ASRPPDDPI

SEQ ID NO: 437042 - protein, 8 aa, Mycobacterium
ASRPPSGA

SEQ ID NO: 437043 - protein, 7 aa, Mycobacterium
ASRPRAG

SEQ ID NO: 437044 - protein, 9 aa, Mycobacterium
ASRPRAGTR

SEQ ID NO: 437045 - protein, 8 aa, Mycobacterium
ASRPSYDE

SEQ ID NO: 437046 - protein, 18 aa, Mycobacterium
ASRPTRADDCAAAESALS

SEQ ID NO: 437047 - protein, 4 aa, Mycobacterium
ASRQ

SEQ ID NO: 437048 - protein, 14 aa, Mycobacterium
ASRQGDKKPLTPGT

SEQ ID NO: 437049 - protein, 9 aa, Mycobacterium
ASRQGKPDG

SEQ ID NO: 437050 - protein, 7 aa, Mycobacterium
ASRQHPQ

SEQ ID NO: 437051 - protein, 17 aa, Mycobacterium
ASRQKARAARRLGFDIS

SEQ ID NO: 437052 - protein, 16 aa, Mycobacterium
ASRQKARAARRLGFDV

SEQ ID NO: 437053 - protein, 4 aa, Mycobacterium
ASRR

SEQ ID NO: 437054 - protein, 8 aa, Mycobacterium
ASRRAAGL

SEQ ID NO: 437055 - protein, 10 aa, Mycobacterium
ASRRAGAATL

SEQ ID NO: 437056 - protein, 12 aa, Mycobacterium
ASRRANPTDDLA

SEQ ID NO: 437057 - protein, 11 aa, Mycobacterium
ASRRAQPTEDL

SEQ ID NO: 437058 - protein, 5 aa, Mycobacterium
ASRRC

SEQ ID NO: 437059 - protein, 6 aa, Mycobacterium
ASRRDV

SEQ ID NO: 437060 - protein, 12 aa, Mycobacterium
ASRRFAPGSQSR

SEQ ID NO: 437061 - protein, 7 aa, Mycobacterium
ASRRGDG

SEQ ID NO: 437062 - protein, 11 aa, Mycobacterium
ASRRGGSQLSD

SEQ ID NO: 437063 - protein, 13 aa, Mycobacterium
ASRRGPRAPKHTY

SEQ ID NO: 437064 - protein, 6 aa, Mycobacterium
ASRRGR

SEQ ID NO: 437065 - protein, 6 aa, Mycobacterium
ASRRGV

SEQ ID NO: 437066 - protein, 6 aa, Mycobacterium
ASRRHT

SEQ ID NO: 437067 - protein, 9 aa, Mycobacterium
ASRRPEELP

SEQ ID NO: 437068 - protein, 15 aa, Mycobacterium
ASRRQHPTDDLASTI

SEQ ID NO: 437069 - protein, 6 aa, Mycobacterium
ASRRRG

SEQ ID NO: 437070 - protein, 10 aa, Mycobacterium
ASRRRGWRRP

SEQ ID NO: 437071 - protein, 11 aa, Mycobacterium
ASRRRSQARPE

SEQ ID NO: 437072 - protein, 11 aa, Mycobacterium
ASRRTADTYRD

SEQ ID NO: 437073 - protein, 9 aa, Mycobacterium
ASRRTPADV

SEQ ID NO: 437074 - protein, 5 aa, Mycobacterium
ASRRV

SEQ ID NO: 437075 - protein, 12 aa, Mycobacterium
ASRRYQSHPARP

SEQ ID NO: 437076 - protein, 12 aa, Mycobacterium
ASRSAGPGTRAN

SEQ ID NO: 437077 - protein, 5 aa, Mycobacterium
ASRSD

SEQ ID NO: 437078 - protein, 9 aa, Mycobacterium
ASRSGGTNI

SEQ ID NO: 437079 - protein, 6 aa, Mycobacterium
ASRSGL

SEQ ID NO: 437080 - protein, 9 aa, Mycobacterium
ASRSGLRTD

SEQ ID NO: 437081 - protein, 20 aa, Mycobacterium
ASRSLGAPSYAVTSTGPDHH

SEQ ID NO: 437082 - protein, 7 aa, Mycobacterium
ASRSMQR

SEQ ID NO: 437083 - protein, 7 aa, Mycobacterium
ASRSPDI

SEQ ID NO: 437084 - protein, 7 aa, Mycobacterium
ASRSPRV

SEQ ID NO: 437085 - protein, 11 aa, Mycobacterium
ASRSQSAQRGA

SEQ ID NO: 437086 - protein, 15 aa, Mycobacterium
ASRSRINASTDDVRD

SEQ ID NO: 437087 - protein, 17 aa, Mycobacterium
ASRSSHDWAKGKREELI

SEQ ID NO: 437088 - protein, 14 aa, Mycobacterium
ASRSVSSVANAPTH

SEQ ID NO: 437089 - protein, 5 aa, Mycobacterium
ASRSW

SEQ ID NO: 437090 - protein, 7 aa, Mycobacterium
ASRSYTD

SEQ ID NO: 437091 - protein, 4 aa, Mycobacterium
ASRT

SEQ ID NO: 437092 - protein, 14 aa, Mycobacterium
ASRTAPYLAARLAG

SEQ ID NO: 437093 - protein, 11 aa, Mycobacterium
ASRTDSATEAI

SEQ ID NO: 437094 - protein, 7 aa, Mycobacterium
ASRTELA

SEQ ID NO: 437095 - protein, 7 aa, Mycobacterium
ASRTGPH

SEQ ID NO: 437096 - protein, 5 aa, Mycobacterium
ASRTP

SEQ ID NO: 437097 - protein, 6 aa, Mycobacterium
ASRTPV

SEQ ID NO: 437098 - protein, 7 aa, Mycobacterium
ASRTQHP

SEQ ID NO: 437099 - protein, 15 aa, Mycobacterium
ASRTRLNASTDDVRD

SEQ ID NO: 437100 - protein, 15 aa, Mycobacterium
ASRTRLQASTDDVRD

SEQ ID NO: 437101 - protein, 7 aa, Mycobacterium
ASRTSYE

SEQ ID NO: 437102 - protein, 8 aa, Mycobacterium
ASRVAGAE

SEQ ID NO: 437103 - protein, 8 aa, Mycobacterium
ASRVATGD

SEQ ID NO: 437104 - protein, 8 aa, Mycobacterium
ASRVGADE

SEQ ID NO: 437105 - protein, 11 aa, Mycobacterium
ASRVGAPPWDP

SEQ ID NO: 437106 - protein, 9 aa, Mycobacterium
ASRVRSASS

SEQ ID NO: 437107 - protein, 5 aa, Mycobacterium
ASRVT

SEQ ID NO: 437108 - protein, 17 aa, Mycobacterium
ASRWERPAAVSSRPATD

SEQ ID NO: 437109 - protein, 7 aa, Mycobacterium
ASRWPDK

SEQ ID NO: 437110 - protein, 7 aa, Mycobacterium
ASRYADP

SEQ ID NO: 437111 - protein, 7 aa, Mycobacterium
ASRYHTG

SEQ ID NO: 437112 - protein, 8 aa, Mycobacterium
ASRYPYSD

SEQ ID NO: 437113 - protein, 8 aa, Mycobacterium
ASRYTQGE

SEQ ID NO: 437114 - protein, 11 aa, Mycobacterium
ASSAAAETQEL

SEQ ID NO: 437115 - protein, 41 aa, Mycobacterium
ASSAAAGTLNPLTTPAQIANPAGLASQAAAVSQAAAATTVE

SEQ ID NO: 437116 - protein, 16 aa, Mycobacterium
ASSAADVDAAVGEAAD

SEQ ID NO: 437117 - protein, 9 aa, Mycobacterium
ASSAAGREA

SEQ ID NO: 437118 - protein, 13 aa, Mycobacterium
ASSAARNAKGSPS

SEQ ID NO: 437119 - protein, 10 aa, Mycobacterium
ASSAATDHDR

SEQ ID NO: 437120 - protein, 5 aa, Mycobacterium
ASSAC

SEQ ID NO: 437121 - protein, 12 aa, Mycobacterium
ASSADAASDDVD

SEQ ID NO: 437122 - protein, 11 aa, Mycobacterium
ASSADALRSTA

SEQ ID NO: 437123 - protein, 9 aa, Mycobacterium
ASSADDVPR

SEQ ID NO: 437124 - protein, 13 aa, Mycobacterium
ASSADSDLGRADR

SEQ ID NO: 437125 - protein, 9 aa, Mycobacterium
ASSAFGGPC

SEQ ID NO: 437126 - protein, 10 aa, Mycobacterium
ASSAGEPLTA

SEQ ID NO: 437127 - protein, 10 aa, Mycobacterium
ASSAGEPLTP

SEQ ID NO: 437128 - protein, 11 aa, Mycobacterium
ASSAGGQADRA

SEQ ID NO: 437129 - protein, 7 aa, Mycobacterium
ASSAGQR

SEQ ID NO: 437130 - protein, 9 aa, Mycobacterium
ASSAGTGIL

SEQ ID NO: 437131 - protein, 13 aa, Mycobacterium
ASSAINQIDALLT

SEQ ID NO: 437132 - protein, 13 aa, Mycobacterium
ASSAINQIDELVR

SEQ ID NO: 437133 - protein, 8 aa, Mycobacterium
ASSAIQGN

SEQ ID NO: 437134 - protein, 7 aa, Mycobacterium
ASSALRG

SEQ ID NO: 437135 - protein, 10 aa, Mycobacterium
ASSAPADAAS

SEQ ID NO: 437136 - protein, 8 aa, Mycobacterium
ASSAPDWL

SEQ ID NO: 437137 - protein, 7 aa, Mycobacterium
ASSAPSW

SEQ ID NO: 437138 - protein, 10 aa, Mycobacterium
ASSAQARIAA

SEQ ID NO: 437139 - protein, 9 aa, Mycobacterium
ASSASASAF

SEQ ID NO: 437140 - protein, 25 aa, Mycobacterium
ASSASASALSPVAAPPPQTATSTVA

SEQ ID NO: 437141 - protein, 47 aa, Mycobacterium
ASSASASALTPFAPPPRTTNDSAGPAQAAAVAQSGGQSGSNTATQLS

SEQ ID NO: 437142 - protein, 8 aa, Mycobacterium
ASSASASL

SEQ ID NO: 437143 - protein, 9 aa, Mycobacterium
ASSASGTLT

SEQ ID NO: 437144 - protein, 35 aa, Mycobacterium
ASSASYRPLETPGLRAPPRPAQGGGALMYRLCVIR

SEQ ID NO: 437145 - protein, 5 aa, Mycobacterium
ASSAT

SEQ ID NO: 437146 - protein, 9 aa, Mycobacterium
ASSATAAQV

SEQ ID NO: 437147 - protein, 9 aa, Mycobacterium
ASSATALAA

SEQ ID NO: 437148 - protein, 10 aa, Mycobacterium
ASSATASQLT

SEQ ID NO: 437149 - protein, 8 aa, Mycobacterium
ASSATATR

SEQ ID NO: 437150 - protein, 20 aa, Mycobacterium
ASSATHSVGATAAKAAGSLG

SEQ ID NO: 437151 - protein, 6 aa, Mycobacterium
ASSAVQ

SEQ ID NO: 437152 - protein, 6 aa, Mycobacterium
ASSCGA

SEQ ID NO: 437153 - protein, 10 aa, Mycobacterium
ASSDAATRHT

SEQ ID NO: 437154 - protein, 15 aa, Mycobacterium
ASSDAEVPAASRALE

SEQ ID NO: 437155 - protein, 8 aa, Mycobacterium
ASSDAKFS

SEQ ID NO: 437156 - protein, 8 aa, Mycobacterium
ASSDDVTK

SEQ ID NO: 437157 - protein, 6 aa, Mycobacterium
ASSDEF

SEQ ID NO: 437158 - protein, 5 aa, Mycobacterium
ASSDF

SEQ ID NO: 437159 - protein, 9 aa, Mycobacterium
ASSDGRPGL

SEQ ID NO: 437160 - protein, 8 aa, Mycobacterium
ASSDPDGI

SEQ ID NO: 437161 - protein, 18 aa, Mycobacterium
ASSDSGAAPATNTNLRTA

SEQ ID NO: 437162 - protein, 10 aa, Mycobacterium
ASSDTKVRPE

SEQ ID NO: 437163 - protein, 5 aa, Mycobacterium
ASSDV

SEQ ID NO: 437164 - protein, 9 aa, Mycobacterium
ASSDVPDGA

SEQ ID NO: 437165 - protein, 4 aa, Mycobacterium
ASSE

SEQ ID NO: 437166 - protein, 7 aa, Mycobacterium
ASSEADW

SEQ ID NO: 437167 - protein, 8 aa, Mycobacterium
ASSEAHPD

SEQ ID NO: 437168 - protein, 6 aa, Mycobacterium
ASSEAI

SEQ ID NO: 437169 - protein, 7 aa, Mycobacterium
ASSEAIG

SEQ ID NO: 437170 - protein, 9 aa, Mycobacterium
ASSEANPDV

SEQ ID NO: 437171 - protein, 11 aa, Mycobacterium
ASSEDVDGRRA

SEQ ID NO: 437172 - protein, 5 aa, Mycobacterium
ASSEF

SEQ ID NO: 437173 - protein, 6 aa, Mycobacterium
ASSENP

SEQ ID NO: 437174 - protein, 8 aa, Mycobacterium
ASSEPQTL

SEQ ID NO: 437175 - protein, 8 aa, Mycobacterium
ASSEPTPV

SEQ ID NO: 437176 - protein, 8 aa, Mycobacterium
ASSETSGR

SEQ ID NO: 437177 - protein, 4 aa, Mycobacterium
ASSF

SEQ ID NO: 437178 - protein, 8 aa, Mycobacterium
ASSFDRNP

SEQ ID NO: 437179 - protein, 16 aa, Mycobacterium
ASSFTTGSVVRADGGI

SEQ ID NO: 437180 - protein, 9 aa, Mycobacterium
ASSFYPGRG

SEQ ID NO: 437181 - protein, 5 aa, Mycobacterium
ASSGA

SEQ ID NO: 437182 - protein, 9 aa, Mycobacterium
ASSGAGALR

SEQ ID NO: 437183 - protein, 6 aa, Mycobacterium
ASSGAR

SEQ ID NO: 437184 - protein, 8 aa, Mycobacterium
ASSGARPS

SEQ ID NO: 437185 - protein, 15 aa, Mycobacterium
ASSGASGGVSAERRA

SEQ ID NO: 437186 - protein, 7 aa, Mycobacterium
ASSGDDE

SEQ ID NO: 437187 - protein, 11 aa, Mycobacterium
ASSGDRAPART

SEQ ID NO: 437188 - protein, 7 aa, Mycobacterium
ASSGDVS

SEQ ID NO: 437189 - protein, 17 aa, Mycobacterium
ASSGGLTPSGVLLLRRD

SEQ ID NO: 437190 - protein, 194 aa, Mycobacterium
ASSGGTGGAGGAGGLGGQAADGGNAGDGGTGGQGGTGGQGAAGPTVNDTAGDGGAGGDGGVGGAGGQGGQATDGGNAGNAGDGGNGGQGGTGGQGAAAPSAAKAAGNGGAGGVGGDGGNGADASGGGNGGDGGKSGGGGTGGTGGKSLGNLPSGDGGVGGNAGTGGNGGNATDGGAGGKGGDGAAGGTGGNAGE

SEQ ID NO: 437191 - protein, 13 aa, Mycobacterium
ASSGHSAGEPCYD

SEQ ID NO: 437192 - protein, 5 aa, Mycobacterium
ASSGI

SEQ ID NO: 437193 - protein, 9 aa, Mycobacterium
ASSGIGAAA

SEQ ID NO: 437194 - protein, 8 aa, Mycobacterium
ASSGIGAS

SEQ ID NO: 437195 - protein, 7 aa, Mycobacterium
ASSGIGE

SEQ ID NO: 437196 - protein, 9 aa, Mycobacterium
ASSGIGEAA

SEQ ID NO: 437197 - protein, 9 aa, Mycobacterium
ASSGIGEEA

SEQ ID NO: 437198 - protein, 7 aa, Mycobacterium
ASSGIGR

SEQ ID NO: 437199 - protein, 9 aa, Mycobacterium
ASSGKAPSH

SEQ ID NO: 437200 - protein, 5 aa, Mycobacterium
ASSGL

SEQ ID NO: 437201 - protein, 16 aa, Mycobacterium
ASSGLGRESARALAAG

SEQ ID NO: 437202 - protein, 16 aa, Mycobacterium
ASSGLGRESARALAST

SEQ ID NO: 437203 - protein, 5 aa, Mycobacterium
ASSGN

SEQ ID NO: 437204 - protein, 9 aa, Mycobacterium
ASSGNAPIA

SEQ ID NO: 437205 - protein, 10 aa, Mycobacterium
ASSGPGVEPL

SEQ ID NO: 437206 - protein, 12 aa, Mycobacterium
ASSGPVPPFDPQ

SEQ ID NO: 437207 - protein, 8 aa, Mycobacterium
ASSGQPRQ

SEQ ID NO: 437208 - protein, 9 aa, Mycobacterium
ASSGRDEAY

SEQ ID NO: 437209 - protein, 6 aa, Mycobacterium
ASSGRR

SEQ ID NO: 437210 - protein, 10 aa, Mycobacterium
ASSGSEVGDP

SEQ ID NO: 437211 - protein, 8 aa, Mycobacterium
ASSGTDAM

SEQ ID NO: 437212 - protein, 6 aa, Mycobacterium
ASSGTT

SEQ ID NO: 437213 - protein, 11 aa, Mycobacterium
ASSGTTGQPTV

SEQ ID NO: 437214 - protein, 5 aa, Mycobacterium
ASSHD

SEQ ID NO: 437215 - protein, 6 aa, Mycobacterium
ASSHEG

SEQ ID NO: 437216 - protein, 5 aa, Mycobacterium
ASSHH

SEQ ID NO: 437217 - protein, 14 aa, Mycobacterium
ASSHTVTRGDTPIA

SEQ ID NO: 437218 - protein, 8 aa, Mycobacterium
ASSIDPPS

SEQ ID NO: 437219 - protein, 14 aa, Mycobacterium
ASSIDQTSGTKTVE

SEQ ID NO: 437220 - protein, 22 aa, Mycobacterium
ASSIEGDVRATDGDKKAASARV

SEQ ID NO: 437221 - protein, 7 aa, Mycobacterium
ASSIETD

SEQ ID NO: 437222 - protein, 6 aa, Mycobacterium
ASSIKA

SEQ ID NO: 437223 - protein, 4 aa, Mycobacterium
ASSK

SEQ ID NO: 437224 - protein, 8 aa, Mycobacterium
ASSKDSMK

SEQ ID NO: 437225 - protein, 11 aa, Mycobacterium
ASSKLPGKPTL

SEQ ID NO: 437226 - protein, 8 aa, Mycobacterium
ASSKSYAA

SEQ ID NO: 437227 - protein, 8 aa, Mycobacterium
ASSKVTAN

SEQ ID NO: 437228 - protein, 12 aa, Mycobacterium
ASSLGKGLTASS

SEQ ID NO: 437229 - protein, 11 aa, Mycobacterium
ASSLPTASALG

SEQ ID NO: 437230 - protein, 29 aa, Mycobacterium
ASSLSGLGSGKDIKPDQVKPIDEASVRAA

SEQ ID NO: 437231 - protein, 5 aa, Mycobacterium
ASSLT

SEQ ID NO: 437232 - protein, 7 aa, Mycobacterium
ASSMETR

SEQ ID NO: 437233 - protein, 4 aa, Mycobacterium
ASSN

SEQ ID NO: 437234 - protein, 7 aa, Mycobacterium
ASSNAVD

SEQ ID NO: 437235 - protein, 11 aa, Mycobacterium
ASSNESQDESA

SEQ ID NO: 437236 - protein, 6 aa, Mycobacterium
ASSNLE

SEQ ID NO: 437237 - protein, 9 aa, Mycobacterium
ASSNLEAQR

SEQ ID NO: 437238 - protein, 11 aa, Mycobacterium
ASSNNYGSPQA

SEQ ID NO: 437239 - protein, 7 aa, Mycobacterium
ASSNRPP

SEQ ID NO: 437240 - protein, 5 aa, Mycobacterium
ASSNT

SEQ ID NO: 437241 - protein, 13 aa, Mycobacterium
ASSNTSASAPSGL

SEQ ID NO: 437242 - protein, 19 aa, Mycobacterium
ASSNYATLSTDSTSGPDGD

SEQ ID NO: 437243 - protein, 5 aa, Mycobacterium
ASSPA

SEQ ID NO: 437244 - protein, 6 aa, Mycobacterium
ASSPAI

SEQ ID NO: 437245 - protein, 8 aa, Mycobacterium
ASSPALSK

SEQ ID NO: 437246 - protein, 11 aa, Mycobacterium
ASSPASGSLTR

SEQ ID NO: 437247 - protein, 7 aa, Mycobacterium
ASSPDIE

SEQ ID NO: 437248 - protein, 13 aa, Mycobacterium
ASSPDSVAPHGQA

SEQ ID NO: 437249 - protein, 7 aa, Mycobacterium
ASSPEFG

SEQ ID NO: 437250 - protein, 15 aa, Mycobacterium
ASSPEPLTIGARPPQ

SEQ ID NO: 437251 - protein, 7 aa, Mycobacterium
ASSPGFG

SEQ ID NO: 437252 - protein, 5 aa, Mycobacterium
ASSPI

SEQ ID NO: 437253 - protein, 6 aa, Mycobacterium
ASSPLN

SEQ ID NO: 437254 - protein, 16 aa, Mycobacterium
ASSPMLTGRPTGRRNT

SEQ ID NO: 437255 - protein, 9 aa, Mycobacterium
ASSPPTAIA

SEQ ID NO: 437256 - protein, 8 aa, Mycobacterium
ASSPPTYA

SEQ ID NO: 437257 - protein, 9 aa, Mycobacterium
ASSPRQYTR

SEQ ID NO: 437258 - protein, 9 aa, Mycobacterium
ASSPSLPPR

SEQ ID NO: 437259 - protein, 9 aa, Mycobacterium
ASSPSLQQH

SEQ ID NO: 437260 - protein, 20 aa, Mycobacterium
ASSPTPGSPVVSSRSGGATV

SEQ ID NO: 437261 - protein, 8 aa, Mycobacterium
ASSPTSWP

SEQ ID NO: 437262 - protein, 20 aa, Mycobacterium
ASSPYPPPTKPNGDTPATPI

SEQ ID NO: 437263 - protein, 4 aa, Mycobacterium
ASSQ

SEQ ID NO: 437264 - protein, 7 aa, Mycobacterium
ASSQAGE

SEQ ID NO: 437265 - protein, 7 aa, Mycobacterium
ASSQDTN

SEQ ID NO: 437266 - protein, 7 aa, Mycobacterium
ASSQGET

SEQ ID NO: 437267 - protein, 8 aa, Mycobacterium
ASSQGLGR

SEQ ID NO: 437268 - protein, 6 aa, Mycobacterium
ASSQVA

SEQ ID NO: 437269 - protein, 8 aa, Mycobacterium
ASSRAGHS

SEQ ID NO: 437270 - protein, 9 aa, Mycobacterium
ASSRARDFG

SEQ ID NO: 437271 - protein, 6 aa, Mycobacterium
ASSRDE

SEQ ID NO: 437272 - protein, 6 aa, Mycobacterium
ASSRDF

SEQ ID NO: 437273 - protein, 7 aa, Mycobacterium
ASSREEM

SEQ ID NO: 437274 - protein, 8 aa, Mycobacterium
ASSRIDEV

SEQ ID NO: 437275 - protein, 7 aa, Mycobacterium
ASSRLED

SEQ ID NO: 437276 - protein, 8 aa, Mycobacterium
ASSRNGGY

SEQ ID NO: 437277 - protein, 9 aa, Mycobacterium
ASSRSDGPA

SEQ ID NO: 437278 - protein, 10 aa, Mycobacterium
ASSRSGRRCT

SEQ ID NO: 437279 - protein, 13 aa, Mycobacterium
ASSRTAPYLAVQL

SEQ ID NO: 437280 - protein, 8 aa, Mycobacterium
ASSRTSEA

SEQ ID NO: 437281 - protein, 7 aa, Mycobacterium
ASSRTVK

SEQ ID NO: 437282 - protein, 10 aa, Mycobacterium
ASSSAAAAAL

SEQ ID NO: 437283 - protein, 31 aa, Mycobacterium
ASSSATAAKVTPFTAPPPTTNPAGLAGQAGA

SEQ ID NO: 437284 - protein, 8 aa, Mycobacterium
ASSSATAS

SEQ ID NO: 437285 - protein, 10 aa, Mycobacterium
ASSSDVPDGA

SEQ ID NO: 437286 - protein, 10 aa, Mycobacterium
ASSSGPGALE

SEQ ID NO: 437287 - protein, 8 aa, Mycobacterium
ASSSGRTT

SEQ ID NO: 437288 - protein, 8 aa, Mycobacterium
ASSSHEGP

SEQ ID NO: 437289 - protein, 5 aa, Mycobacterium
ASSSP

SEQ ID NO: 437290 - protein, 10 aa, Mycobacterium
ASSSPEYKSA

SEQ ID NO: 437291 - protein, 68 aa, Mycobacterium
ASSSPLASTAANAGSSAMSGAAPLGSGMGGGAPAGGASKAGLASATGPGDQDERERDEQADAQSGERL

SEQ ID NO: 437292 - protein, 36 aa, Mycobacterium
ASSSPSGAGDCSAGRAGAGASGAGCSGTTAEAGHAG

SEQ ID NO: 437293 - protein, 9 aa, Mycobacterium
ASSSQSVEV

SEQ ID NO: 437294 - protein, 8 aa, Mycobacterium
ASSSSAAT

SEQ ID NO: 437295 - protein, 11 aa, Mycobacterium
ASSSSADGRQR

SEQ ID NO: 437296 - protein, 22 aa, Mycobacterium
ASSSSEAEHGDGEVEESGEELT

SEQ ID NO: 437297 - protein, 8 aa, Mycobacterium
ASSSSETL

SEQ ID NO: 437298 - protein, 8 aa, Mycobacterium
ASSSSETV

SEQ ID NO: 437299 - protein, 10 aa, Mycobacterium
ASSSSTPGDY

SEQ ID NO: 437300 - protein, 13 aa, Mycobacterium
ASSTASLRRDERD

SEQ ID NO: 437301 - protein, 7 aa, Mycobacterium
ASSTATI

SEQ ID NO: 437302 - protein, 12 aa, Mycobacterium
ASSTATISAPGA

SEQ ID NO: 437303 - protein, 9 aa, Mycobacterium
ASSTAVPAY

SEQ ID NO: 437304 - protein, 7 aa, Mycobacterium
ASSTDRP

SEQ ID NO: 437305 - protein, 15 aa, Mycobacterium
ASSTDTDTGDPAATV

SEQ ID NO: 437306 - protein, 17 aa, Mycobacterium
ASSTDTVRSRSMTGKPA

SEQ ID NO: 437307 - protein, 11 aa, Mycobacterium
ASSTEALRQTA

SEQ ID NO: 437308 - protein, 6 aa, Mycobacterium
ASSTGF

SEQ ID NO: 437309 - protein, 9 aa, Mycobacterium
ASSTGGFDE

SEQ ID NO: 437310 - protein, 8 aa, Mycobacterium
ASSTGKSQ

SEQ ID NO: 437311 - protein, 16 aa, Mycobacterium
ASSTGSPNTAITPDNG

SEQ ID NO: 437312 - protein, 8 aa, Mycobacterium
ASSTLSDN

SEQ ID NO: 437313 - protein, 8 aa, Mycobacterium
ASSTPGID

SEQ ID NO: 437314 - protein, 10 aa, Mycobacterium
ASSTRRGRPT

SEQ ID NO: 437315 - protein, 12 aa, Mycobacterium
ASSTTAAEQATY

SEQ ID NO: 437316 - protein, 11 aa, Mycobacterium
ASSTTASQMTP

SEQ ID NO: 437317 - protein, 7 aa, Mycobacterium
ASSVDEQ

SEQ ID NO: 437318 - protein, 6 aa, Mycobacterium
ASSVEE

SEQ ID NO: 437319 - protein, 7 aa, Mycobacterium
ASSVGKP

SEQ ID NO: 437320 - protein, 6 aa, Mycobacterium
ASSVGR

SEQ ID NO: 437321 - protein, 10 aa, Mycobacterium
ASSVKGRSGV

SEQ ID NO: 437322 - protein, 11 aa, Mycobacterium
ASSVPASGQLA

SEQ ID NO: 437323 - protein, 10 aa, Mycobacterium
ASSVSGDAVT

SEQ ID NO: 437324 - protein, 5 aa, Mycobacterium
ASSWG

SEQ ID NO: 437325 - protein, 8 aa, Mycobacterium
ASSWGSGK

SEQ ID NO: 437326 - protein, 7 aa, Mycobacterium
ASSWQGS

SEQ ID NO: 437327 - protein, 6 aa, Mycobacterium
ASSYIT

SEQ ID NO: 437328 - protein, 6 aa, Mycobacterium
ASSYMT

SEQ ID NO: 437329 - protein, 6 aa, Mycobacterium
ASSYPD

SEQ ID NO: 437330 - protein, 15 aa, Mycobacterium
ASSYTPVSELGPDGR

SEQ ID NO: 437331 - protein, 49 aa, Mycobacterium
ASTAADRGKPLAKKARKRGEEIAEEAAERAAPLAKKARKRGEELADDAA

SEQ ID NO: 437332 - protein, 16 aa, Mycobacterium
ASTAAGAAAGNGGGSV

SEQ ID NO: 437333 - protein, 11 aa, Mycobacterium
ASTAAGAAEVD

SEQ ID NO: 437334 - protein, 9 aa, Mycobacterium
ASTAAGGAS

SEQ ID NO: 437335 - protein, 27 aa, Mycobacterium
ASTAARNPKTTVTERGSNRSSGTHHRS

SEQ ID NO: 437336 - protein, 28 aa, Mycobacterium
ASTAARNPKTTVTERGSNRSSGTHHRSA

SEQ ID NO: 437337 - protein, 30 aa, Mycobacterium
ASTAARNPRTTVTEAGSGRNTGSGTHHRSA

SEQ ID NO: 437338 - protein, 27 aa, Mycobacterium
ASTAARNPRTTVTERGANRGSGTHHRS

SEQ ID NO: 437339 - protein, 9 aa, Mycobacterium
ASTAAYPGL

SEQ ID NO: 437340 - protein, 15 aa, Mycobacterium
ASTAEAQDRAGTDVA

SEQ ID NO: 437341 - protein, 19 aa, Mycobacterium
ASTAGALRRKNNGSDPLQR

SEQ ID NO: 437342 - protein, 7 aa, Mycobacterium
ASTAGAQ

SEQ ID NO: 437343 - protein, 8 aa, Mycobacterium
ASTAGAQV

SEQ ID NO: 437344 - protein, 13 aa, Mycobacterium
ASTAGEAAYAAKN

SEQ ID NO: 437345 - protein, 7 aa, Mycobacterium
ASTAGQR

SEQ ID NO: 437346 - protein, 14 aa, Mycobacterium
ASTAIGRPAEPSEI

SEQ ID NO: 437347 - protein, 8 aa, Mycobacterium
ASTAKRPA

SEQ ID NO: 437348 - protein, 8 aa, Mycobacterium
ASTALSPD

SEQ ID NO: 437349 - protein, 6 aa, Mycobacterium
ASTAMT

SEQ ID NO: 437350 - protein, 15 aa, Mycobacterium
ASTANTGANTPEEVS

SEQ ID NO: 437351 - protein, 10 aa, Mycobacterium
ASTAPEDKAW

SEQ ID NO: 437352 - protein, 7 aa, Mycobacterium
ASTAPLA

SEQ ID NO: 437353 - protein, 7 aa, Mycobacterium
ASTAPLT

SEQ ID NO: 437354 - protein, 14 aa, Mycobacterium
ASTASGTATYGTTW

SEQ ID NO: 437355 - protein, 8 aa, Mycobacterium
ASTATAPA

SEQ ID NO: 437356 - protein, 9 aa, Mycobacterium
ASTATQGGV

SEQ ID NO: 437357 - protein, 8 aa, Mycobacterium
ASTAVANG

SEQ ID NO: 437358 - protein, 8 aa, Mycobacterium
ASTAVGGA

SEQ ID NO: 437359 - protein, 5 aa, Mycobacterium
ASTCN

SEQ ID NO: 437360 - protein, 6 aa, Mycobacterium
ASTCNE

SEQ ID NO: 437361 - protein, 10 aa, Mycobacterium
ASTDEPGALT

SEQ ID NO: 437362 - protein, 13 aa, Mycobacterium
ASTDEQYPDAQGR

SEQ ID NO: 437363 - protein, 11 aa, Mycobacterium
ASTDKARASID

SEQ ID NO: 437364 - protein, 9 aa, Mycobacterium
ASTDPAADI

SEQ ID NO: 437365 - protein, 11 aa, Mycobacterium
ASTDPAQRTAG

SEQ ID NO: 437366 - protein, 17 aa, Mycobacterium
ASTDRQKVAQAGEVESA

SEQ ID NO: 437367 - protein, 9 aa, Mycobacterium
ASTDTGGRD

SEQ ID NO: 437368 - protein, 9 aa, Mycobacterium
ASTDTSAGR

SEQ ID NO: 437369 - protein, 6 aa, Mycobacterium
ASTDVD

SEQ ID NO: 437370 - protein, 13 aa, Mycobacterium
ASTEAAPRISGSH

SEQ ID NO: 437371 - protein, 8 aa, Mycobacterium
ASTEDDPL

SEQ ID NO: 437372 - protein, 7 aa, Mycobacterium
ASTEEMS

SEQ ID NO: 437373 - protein, 7 aa, Mycobacterium
ASTEGTT

SEQ ID NO: 437374 - protein, 33 aa, Mycobacterium
ASTEKDRSRSLTQVNDSSEYDGEAAGLSDEQLR

SEQ ID NO: 437375 - protein, 8 aa, Mycobacterium
ASTENPER

SEQ ID NO: 437376 - protein, 5 aa, Mycobacterium
ASTER

SEQ ID NO: 437377 - protein, 6 aa, Mycobacterium
ASTERA

SEQ ID NO: 437378 - protein, 34 aa, Mycobacterium
ASTERNQARSLSEVKGAADFEKKAADLDDEQLTK

SEQ ID NO: 437379 - protein, 6 aa, Mycobacterium
ASTERP

SEQ ID NO: 437380 - protein, 11 aa, Mycobacterium
ASTERPEYPPG

SEQ ID NO: 437381 - protein, 7 aa, Mycobacterium
ASTERQR

SEQ ID NO: 437382 - protein, 6 aa, Mycobacterium
ASTEVF

SEQ ID NO: 437383 - protein, 11 aa, Mycobacterium
ASTEVRGDSTD

SEQ ID NO: 437384 - protein, 6 aa, Mycobacterium
ASTEYQ

SEQ ID NO: 437385 - protein, 4 aa, Mycobacterium
ASTF

SEQ ID NO: 437386 - protein, 13 aa, Mycobacterium
ASTFGGPVPTPAL

SEQ ID NO: 437387 - protein, 13 aa, Mycobacterium
ASTFGGPVPTPTL

SEQ ID NO: 437388 - protein, 17 aa, Mycobacterium
ASTFRNSDKRGGANGAR

SEQ ID NO: 437389 - protein, 18 aa, Mycobacterium
ASTFRSSDLRGGANGGRI

SEQ ID NO: 437390 - protein, 4 aa, Mycobacterium
ASTG

SEQ ID NO: 437391 - protein, 6 aa, Mycobacterium
ASTGAA

SEQ ID NO: 437392 - protein, 8 aa, Mycobacterium
ASTGAGAL

SEQ ID NO: 437393 - protein, 9 aa, Mycobacterium
ASTGATPPW

SEQ ID NO: 437394 - protein, 7 aa, Mycobacterium
ASTGDGC

SEQ ID NO: 437395 - protein, 6 aa, Mycobacterium
ASTGDI

SEQ ID NO: 437396 - protein, 6 aa, Mycobacterium
ASTGDM

SEQ ID NO: 437397 - protein, 6 aa, Mycobacterium
ASTGDV

SEQ ID NO: 437398 - protein, 8 aa, Mycobacterium
ASTGDVAS

SEQ ID NO: 437399 - protein, 12 aa, Mycobacterium
ASTGEDLRKEKP

SEQ ID NO: 437400 - protein, 6 aa, Mycobacterium
ASTGES

SEQ ID NO: 437401 - protein, 5 aa, Mycobacterium
ASTGG

SEQ ID NO: 437402 - protein, 7 aa, Mycobacterium
ASTGGHL

SEQ ID NO: 437403 - protein, 6 aa, Mycobacterium
ASTGGN

SEQ ID NO: 437404 - protein, 9 aa, Mycobacterium
ASTGGNTSV

SEQ ID NO: 437405 - protein, 7 aa, Mycobacterium
ASTGGNV

SEQ ID NO: 437406 - protein, 8 aa, Mycobacterium
ASTGGNVG

SEQ ID NO: 437407 - protein, 8 aa, Mycobacterium
ASTGGRRA

SEQ ID NO: 437408 - protein, 9 aa, Mycobacterium
ASTGIDRPA

SEQ ID NO: 437409 - protein, 5 aa, Mycobacterium
ASTGL

SEQ ID NO: 437410 - protein, 9 aa, Mycobacterium
ASTGNATAV

SEQ ID NO: 437411 - protein, 6 aa, Mycobacterium
ASTGNL

SEQ ID NO: 437412 - protein, 26 aa, Mycobacterium
ASTGPDESVADELEQAATRAHQRGGI

SEQ ID NO: 437413 - protein, 7 aa, Mycobacterium
ASTGPGL

SEQ ID NO: 437414 - protein, 6 aa, Mycobacterium
ASTGQP

SEQ ID NO: 437415 - protein, 5 aa, Mycobacterium
ASTGR

SEQ ID NO: 437416 - protein, 7 aa, Mycobacterium
ASTGSDH

SEQ ID NO: 437417 - protein, 11 aa, Mycobacterium
ASTGTQRPRTG

SEQ ID NO: 437418 - protein, 8 aa, Mycobacterium
ASTGTREF

SEQ ID NO: 437419 - protein, 6 aa, Mycobacterium
ASTGTT

SEQ ID NO: 437420 - protein, 10 aa, Mycobacterium
ASTGTTEAPG

SEQ ID NO: 437421 - protein, 9 aa, Mycobacterium
ASTGYNAPY

SEQ ID NO: 437422 - protein, 7 aa, Mycobacterium
ASTHEAN

SEQ ID NO: 437423 - protein, 11 aa, Mycobacterium
ASTIGKSAAAV

SEQ ID NO: 437424 - protein, 15 aa, Mycobacterium
ASTISGHTSISNPSW

SEQ ID NO: 437425 - protein, 7 aa, Mycobacterium
ASTKDRM

SEQ ID NO: 437426 - protein, 8 aa, Mycobacterium
ASTKGEAV

SEQ ID NO: 437427 - protein, 5 aa, Mycobacterium
ASTLK

SEQ ID NO: 437428 - protein, 7 aa, Mycobacterium
ASTLQGI

SEQ ID NO: 437429 - protein, 28 aa, Mycobacterium
ASTLSSERQMVSGSGSGGMGRLGGSSAE

SEQ ID NO: 437430 - protein, 16 aa, Mycobacterium
ASTMPRPLASGPLNGV

SEQ ID NO: 437431 - protein, 12 aa, Mycobacterium
ASTNCEVRIVLT

SEQ ID NO: 437432 - protein, 9 aa, Mycobacterium
ASTNKHSQR

SEQ ID NO: 437433 - protein, 4 aa, Mycobacterium
ASTP

SEQ ID NO: 437434 - protein, 9 aa, Mycobacterium
ASTPAAARD

SEQ ID NO: 437435 - protein, 25 aa, Mycobacterium
ASTPAPVGTGPLPGPAVPPPPTAPL

SEQ ID NO: 437436 - protein, 8 aa, Mycobacterium
ASTPDDAR

SEQ ID NO: 437437 - protein, 9 aa, Mycobacterium
ASTPDHPQP

SEQ ID NO: 437438 - protein, 11 aa, Mycobacterium
ASTPESLAATR

SEQ ID NO: 437439 - protein, 6 aa, Mycobacterium
ASTPGA

SEQ ID NO: 437440 - protein, 8 aa, Mycobacterium
ASTPGLGE

SEQ ID NO: 437441 - protein, 7 aa, Mycobacterium
ASTPGQR

SEQ ID NO: 437442 - protein, 15 aa, Mycobacterium
ASTPGSDGVTPIEHP

SEQ ID NO: 437443 - protein, 7 aa, Mycobacterium
ASTPGTL

SEQ ID NO: 437444 - protein, 18 aa, Mycobacterium
ASTPLAPATPIVSRLVAR

SEQ ID NO: 437445 - protein, 8 aa, Mycobacterium
ASTPLDRT

SEQ ID NO: 437446 - protein, 7 aa, Mycobacterium
ASTPQEA

SEQ ID NO: 437447 - protein, 22 aa, Mycobacterium
ASTPTDRSDRPTEPVVIESITI

SEQ ID NO: 437448 - protein, 7 aa, Mycobacterium
ASTPTEY

SEQ ID NO: 437449 - protein, 9 aa, Mycobacterium
ASTPTTDPA

SEQ ID NO: 437450 - protein, 6 aa, Mycobacterium
ASTPVA

SEQ ID NO: 437451 - protein, 7 aa, Mycobacterium
ASTPVAN

SEQ ID NO: 437452 - protein, 4 aa, Mycobacterium
ASTQ

SEQ ID NO: 437453 - protein, 6 aa, Mycobacterium
ASTQAA

SEQ ID NO: 437454 - protein, 15 aa, Mycobacterium
ASTQAAGAASQAKAV

SEQ ID NO: 437455 - protein, 7 aa, Mycobacterium
ASTQAAR

SEQ ID NO: 437456 - protein, 16 aa, Mycobacterium
ASTQAKTRGLQAGAQA

SEQ ID NO: 437457 - protein, 8 aa, Mycobacterium
ASTQAQAA

SEQ ID NO: 437458 - protein, 16 aa, Mycobacterium
ASTQDPDDRDREGRAH

SEQ ID NO: 437459 - protein, 6 aa, Mycobacterium
ASTQPI

SEQ ID NO: 437460 - protein, 29 aa, Mycobacterium
ASTRADEAALAAQSSALAARTAAEQASAV

SEQ ID NO: 437461 - protein, 11 aa, Mycobacterium
ASTRAENRAAA

SEQ ID NO: 437462 - protein, 7 aa, Mycobacterium
ASTRESF

SEQ ID NO: 437463 - protein, 11 aa, Mycobacterium
ASTRGDPNNVD

SEQ ID NO: 437464 - protein, 9 aa, Mycobacterium
ASTRGELTE

SEQ ID NO: 437465 - protein, 6 aa, Mycobacterium
ASTRHG

SEQ ID NO: 437466 - protein, 5 aa, Mycobacterium
ASTRK

SEQ ID NO: 437467 - protein, 6 aa, Mycobacterium
ASTRLN

SEQ ID NO: 437468 - protein, 5 aa, Mycobacterium
ASTRM

SEQ ID NO: 437469 - protein, 12 aa, Mycobacterium
ASTRSDDEPTTL

SEQ ID NO: 437470 - protein, 6 aa, Mycobacterium
ASTRSI

SEQ ID NO: 437471 - protein, 5 aa, Mycobacterium
ASTRY

SEQ ID NO: 437472 - protein, 14 aa, Mycobacterium
ASTSAPAPAPAGVS

SEQ ID NO: 437473 - protein, 6 aa, Mycobacterium
ASTSAQ

SEQ ID NO: 437474 - protein, 6 aa, Mycobacterium
ASTSAT

SEQ ID NO: 437475 - protein, 14 aa, Mycobacterium
ASTSATSAGSPAPF

SEQ ID NO: 437476 - protein, 10 aa, Mycobacterium
ASTSDSRQTL

SEQ ID NO: 437477 - protein, 7 aa, Mycobacterium
ASTSEAA

SEQ ID NO: 437478 - protein, 17 aa, Mycobacterium
ASTSGEMRELAAKILRK

SEQ ID NO: 437479 - protein, 27 aa, Mycobacterium
ASTSGKPLPQPPQVPYNRASGRAPEGM

SEQ ID NO: 437480 - protein, 11 aa, Mycobacterium
ASTSPEDKAWT

SEQ ID NO: 437481 - protein, 9 aa, Mycobacterium
ASTSRSTRI

SEQ ID NO: 437482 - protein, 10 aa, Mycobacterium
ASTSRTPTGE

SEQ ID NO: 437483 - protein, 7 aa, Mycobacterium
ASTSSIE

SEQ ID NO: 437484 - protein, 7 aa, Mycobacterium
ASTSSSK

SEQ ID NO: 437485 - protein, 4 aa, Mycobacterium
ASTT

SEQ ID NO: 437486 - protein, 9 aa, Mycobacterium
ASTTAAPPL

SEQ ID NO: 437487 - protein, 7 aa, Mycobacterium
ASTTAGL

SEQ ID NO: 437488 - protein, 7 aa, Mycobacterium
ASTTAGT

SEQ ID NO: 437489 - protein, 8 aa, Mycobacterium
ASTTAKPW

SEQ ID NO: 437490 - protein, 7 aa, Mycobacterium
ASTTAST

SEQ ID NO: 437491 - protein, 6 aa, Mycobacterium
ASTTAV

SEQ ID NO: 437492 - protein, 6 aa, Mycobacterium
ASTTDV

SEQ ID NO: 437493 - protein, 20 aa, Mycobacterium
ASTTESGDRDDLKPGVPDRS

SEQ ID NO: 437494 - protein, 7 aa, Mycobacterium
ASTTFNA

SEQ ID NO: 437495 - protein, 6 aa, Mycobacterium
ASTTGI

SEQ ID NO: 437496 - protein, 7 aa, Mycobacterium
ASTTGLP

SEQ ID NO: 437497 - protein, 20 aa, Mycobacterium
ASTTHQQLSPEEQLSTGVTP

SEQ ID NO: 437498 - protein, 20 aa, Mycobacterium
ASTTHRQLTDEQLTAGGVGP

SEQ ID NO: 437499 - protein, 8 aa, Mycobacterium
ASTTITSG

SEQ ID NO: 437500 - protein, 5 aa, Mycobacterium
ASTTL

SEQ ID NO: 437501 - protein, 42 aa, Mycobacterium
ASTTNTGTRGLPGVAPQPSTGAAGTPGTGGTTGAAIATSTAG

SEQ ID NO: 437502 - protein, 7 aa, Mycobacterium
ASTTPAA

SEQ ID NO: 437503 - protein, 7 aa, Mycobacterium
ASTTPLD

SEQ ID NO: 437504 - protein, 9 aa, Mycobacterium
ASTTPNHRA

SEQ ID NO: 437505 - protein, 12 aa, Mycobacterium
ASTTSLAPHAED

SEQ ID NO: 437506 - protein, 13 aa, Mycobacterium
ASTTSLPETPGGV

SEQ ID NO: 437507 - protein, 14 aa, Mycobacterium
ASTTSLPETPHGER

SEQ ID NO: 437508 - protein, 15 aa, Mycobacterium
ASTTSLPETPQGERN

SEQ ID NO: 437509 - protein, 6 aa, Mycobacterium
ASTTTA

SEQ ID NO: 437510 - protein, 31 aa, Mycobacterium
ASTTTATALADTEPEPALAAGGPPAPTGNSL

SEQ ID NO: 437511 - protein, 7 aa, Mycobacterium
ASTTTTR

SEQ ID NO: 437512 - protein, 5 aa, Mycobacterium
ASTTV

SEQ ID NO: 437513 - protein, 15 aa, Mycobacterium
ASTTVKVTSSPPSRA

SEQ ID NO: 437514 - protein, 6 aa, Mycobacterium
ASTTVT

SEQ ID NO: 437515 - protein, 8 aa, Mycobacterium
ASTVAEAG

SEQ ID NO: 437516 - protein, 7 aa, Mycobacterium
ASTVESA

SEQ ID NO: 437517 - protein, 13 aa, Mycobacterium
ASTVGGMHGREGT

SEQ ID NO: 437518 - protein, 8 aa, Mycobacterium
ASTVGKSE

SEQ ID NO: 437519 - protein, 5 aa, Mycobacterium
ASTVI

SEQ ID NO: 437520 - protein, 10 aa, Mycobacterium
ASTVPDYTGI

SEQ ID NO: 437521 - protein, 7 aa, Mycobacterium
ASTVPLP

SEQ ID NO: 437522 - protein, 25 aa, Mycobacterium
ASTVRPASYPTLAPASAAKARAALR

SEQ ID NO: 437523 - protein, 20 aa, Mycobacterium
ASTVSGDSSFVGRNTDPARA

SEQ ID NO: 437524 - protein, 9 aa, Mycobacterium
ASTVSSGSI

SEQ ID NO: 437525 - protein, 9 aa, Mycobacterium
ASTVTPPGG

SEQ ID NO: 437526 - protein, 8 aa, Mycobacterium
ASTYPDPE

SEQ ID NO: 437527 - protein, 10 aa, Mycobacterium
ASTYQTPADV

SEQ ID NO: 437528 - protein, 7 aa, Mycobacterium
ASTYTYD

SEQ ID NO: 437529 - protein, 19 aa, Mycobacterium
ASVAAAQTGQVSSAMTSQR

SEQ ID NO: 437530 - protein, 9 aa, Mycobacterium
ASVAAARDS

SEQ ID NO: 437531 - protein, 12 aa, Mycobacterium
ASVAAPRAYRAA

SEQ ID NO: 437532 - protein, 7 aa, Mycobacterium
ASVADRE

SEQ ID NO: 437533 - protein, 14 aa, Mycobacterium
ASVAEQAGIQARAA

SEQ ID NO: 437534 - protein, 8 aa, Mycobacterium
ASVAEREL

SEQ ID NO: 437535 - protein, 11 aa, Mycobacterium
ASVAETTSPAG

SEQ ID NO: 437536 - protein, 9 aa, Mycobacterium
ASVAKPDKI

SEQ ID NO: 437537 - protein, 6 aa, Mycobacterium
ASVANA

SEQ ID NO: 437538 - protein, 8 aa, Mycobacterium
ASVANGDA

SEQ ID NO: 437539 - protein, 9 aa, Mycobacterium
ASVDARRRS

SEQ ID NO: 437540 - protein, 10 aa, Mycobacterium
ASVDDPAGVR

SEQ ID NO: 437541 - protein, 8 aa, Mycobacterium
ASVDPDAD

SEQ ID NO: 437542 - protein, 8 aa, Mycobacterium
ASVDQLSG

SEQ ID NO: 437543 - protein, 10 aa, Mycobacterium
ASVEATAQQD

SEQ ID NO: 437544 - protein, 5 aa, Mycobacterium
ASVEE

SEQ ID NO: 437545 - protein, 13 aa, Mycobacterium
ASVEGAGTAPGVL

SEQ ID NO: 437546 - protein, 6 aa, Mycobacterium
ASVEGV

SEQ ID NO: 437547 - protein, 15 aa, Mycobacterium
ASVEQALSGGNAQPA

SEQ ID NO: 437548 - protein, 7 aa, Mycobacterium
ASVGARE

SEQ ID NO: 437549 - protein, 8 aa, Mycobacterium
ASVGEGPT

SEQ ID NO: 437550 - protein, 12 aa, Mycobacterium
ASVGESNSGTTQ

SEQ ID NO: 437551 - protein, 13 aa, Mycobacterium
ASVGGQQPPSKKE

SEQ ID NO: 437552 - protein, 9 aa, Mycobacterium
ASVGPDGLG

SEQ ID NO: 437553 - protein, 10 aa, Mycobacterium
ASVGPDGVGV

SEQ ID NO: 437554 - protein, 9 aa, Mycobacterium
ASVGRNGAT

SEQ ID NO: 437555 - protein, 10 aa, Mycobacterium
ASVGRSGSIG

SEQ ID NO: 437556 - protein, 20 aa, Mycobacterium
ASVGSAVSAANTAAAAPTTS

SEQ ID NO: 437557 - protein, 4 aa, Mycobacterium
ASVH

SEQ ID NO: 437558 - protein, 10 aa, Mycobacterium
ASVISKGGDD

SEQ ID NO: 437559 - protein, 14 aa, Mycobacterium
ASVKERKGSVQSPK

SEQ ID NO: 437560 - protein, 13 aa, Mycobacterium
ASVKKRQAEKAST

SEQ ID NO: 437561 - protein, 8 aa, Mycobacterium
ASVKPLPS

SEQ ID NO: 437562 - protein, 4 aa, Mycobacterium
ASVN

SEQ ID NO: 437563 - protein, 14 aa, Mycobacterium
ASVNPQGVAGNGVA

SEQ ID NO: 437564 - protein, 7 aa, Mycobacterium
ASVNRQL

SEQ ID NO: 437565 - protein, 8 aa, Mycobacterium
ASVNTDPY

SEQ ID NO: 437566 - protein, 11 aa, Mycobacterium
ASVPAKFDGRP

SEQ ID NO: 437567 - protein, 5 aa, Mycobacterium
ASVPD

SEQ ID NO: 437568 - protein, 10 aa, Mycobacterium
ASVPDAPEPL

SEQ ID NO: 437569 - protein, 7 aa, Mycobacterium
ASVPGGV

SEQ ID NO: 437570 - protein, 6 aa, Mycobacterium
ASVPGL

SEQ ID NO: 437571 - protein, 19 aa, Mycobacterium
ASVPGMPPRAGGSSATDAT

SEQ ID NO: 437572 - protein, 6 aa, Mycobacterium
ASVPGQ

SEQ ID NO: 437573 - protein, 11 aa, Mycobacterium
ASVPNGVPADV

SEQ ID NO: 437574 - protein, 19 aa, Mycobacterium
ASVPPGARTAPPTADAERS

SEQ ID NO: 437575 - protein, 19 aa, Mycobacterium
ASVPPGARVAPATADAERS

SEQ ID NO: 437576 - protein, 8 aa, Mycobacterium
ASVPPSAL

SEQ ID NO: 437577 - protein, 8 aa, Mycobacterium
ASVPSEET

SEQ ID NO: 437578 - protein, 7 aa, Mycobacterium
ASVPTPV

SEQ ID NO: 437579 - protein, 14 aa, Mycobacterium
ASVRALKGAGRPVM

SEQ ID NO: 437580 - protein, 6 aa, Mycobacterium
ASVRNE

SEQ ID NO: 437581 - protein, 7 aa, Mycobacterium
ASVRPGD

SEQ ID NO: 437582 - protein, 8 aa, Mycobacterium
ASVRPGDS

SEQ ID NO: 437583 - protein, 7 aa, Mycobacterium
ASVRPTH

SEQ ID NO: 437584 - protein, 4 aa, Mycobacterium
ASVS

SEQ ID NO: 437585 - protein, 8 aa, Mycobacterium
ASVSDGSF

SEQ ID NO: 437586 - protein, 6 aa, Mycobacterium
ASVSDH

SEQ ID NO: 437587 - protein, 12 aa, Mycobacterium
ASVSDPKAAPPT

SEQ ID NO: 437588 - protein, 13 aa, Mycobacterium
ASVSDPKAQPPTF

SEQ ID NO: 437589 - protein, 13 aa, Mycobacterium
ASVSDPQAAPPTF

SEQ ID NO: 437590 - protein, 14 aa, Mycobacterium
ASVSDPQASPPTFS

SEQ ID NO: 437591 - protein, 11 aa, Mycobacterium
ASVSGGAPLGS

SEQ ID NO: 437592 - protein, 7 aa, Mycobacterium
ASVSGNT

SEQ ID NO: 437593 - protein, 4 aa, Mycobacterium
ASVT

SEQ ID NO: 437594 - protein, 15 aa, Mycobacterium
ASVTAGDAPNLAQGG

SEQ ID NO: 437595 - protein, 13 aa, Mycobacterium
ASVTASRRDDGIT

SEQ ID NO: 437596 - protein, 7 aa, Mycobacterium
ASVTDGA

SEQ ID NO: 437597 - protein, 10 aa, Mycobacterium
ASVTDGQPLS

SEQ ID NO: 437598 - protein, 14 aa, Mycobacterium
ASVTLGGATAPGLV

SEQ ID NO: 437599 - protein, 12 aa, Mycobacterium
ASVTPAGASHAG

SEQ ID NO: 437600 - protein, 24 aa, Mycobacterium
ASVTQGMETGETMRSQMPDTIGPT

SEQ ID NO: 437601 - protein, 7 aa, Mycobacterium
ASVTSRR

SEQ ID NO: 437602 - protein, 7 aa, Mycobacterium
ASVTVGP

SEQ ID NO: 437603 - protein, 10 aa, Mycobacterium
ASWAEAATEV

SEQ ID NO: 437604 - protein, 11 aa, Mycobacterium
ASWAGRTPADI

SEQ ID NO: 437605 - protein, 11 aa, Mycobacterium
ASWAPAAGEPL

SEQ ID NO: 437606 - protein, 10 aa, Mycobacterium
ASWAPAEGEP

SEQ ID NO: 437607 - protein, 6 aa, Mycobacterium
ASWEET

SEQ ID NO: 437608 - protein, 8 aa, Mycobacterium
ASWGSDGQ

SEQ ID NO: 437609 - protein, 10 aa, Mycobacterium
ASWPAQPGRV

SEQ ID NO: 437610 - protein, 9 aa, Mycobacterium
ASWPEGQPF

SEQ ID NO: 437611 - protein, 22 aa, Mycobacterium
ASWSDGAEPAVVPPAQPAPVTG

SEQ ID NO: 437612 - protein, 13 aa, Mycobacterium
ASWSEGAAPAAPV

SEQ ID NO: 437613 - protein, 17 aa, Mycobacterium
ASWSPDAADELTDDPQV

SEQ ID NO: 437614 - protein, 11 aa, Mycobacterium
ASWSTAAPAVT

SEQ ID NO: 437615 - protein, 9 aa, Mycobacterium
ASWTDPKGG

SEQ ID NO: 437616 - protein, 8 aa, Mycobacterium
ASWTEPKG

SEQ ID NO: 437617 - protein, 9 aa, Mycobacterium
ASWTEPKGG

SEQ ID NO: 437618 - protein, 20 aa, Mycobacterium
ASWTPSTTQTCRSQQLPRPE

SEQ ID NO: 437619 - protein, 20 aa, Mycobacterium
ASWTVSGDGLASKSANTPFE

SEQ ID NO: 437620 - protein, 6 aa, Mycobacterium
ASYADL

SEQ ID NO: 437621 - protein, 8 aa, Mycobacterium
ASYAEPGW

SEQ ID NO: 437622 - protein, 11 aa, Mycobacterium
ASYAGPDSPMN

SEQ ID NO: 437623 - protein, 16 aa, Mycobacterium
ASYAGSPVRCGETAGT

SEQ ID NO: 437624 - protein, 12 aa, Mycobacterium
ASYAPRAGGRAT

SEQ ID NO: 437625 - protein, 13 aa, Mycobacterium
ASYAPRSGGRATL

SEQ ID NO: 437626 - protein, 13 aa, Mycobacterium
ASYASAEAANVSP

SEQ ID NO: 437627 - protein, 7 aa, Mycobacterium
ASYDPET

SEQ ID NO: 437628 - protein, 9 aa, Mycobacterium
ASYDPGAES

SEQ ID NO: 437629 - protein, 6 aa, Mycobacterium
ASYDPH

SEQ ID NO: 437630 - protein, 11 aa, Mycobacterium
ASYEARRYGAR

SEQ ID NO: 437631 - protein, 4 aa, Mycobacterium
ASYF

SEQ ID NO: 437632 - protein, 19 aa, Mycobacterium
ASYGAAATAISSGATNSEV

SEQ ID NO: 437633 - protein, 10 aa, Mycobacterium
ASYGNEEAVG

SEQ ID NO: 437634 - protein, 9 aa, Mycobacterium
ASYGPRSAA

SEQ ID NO: 437635 - protein, 6 aa, Mycobacterium
ASYGSD

SEQ ID NO: 437636 - protein, 6 aa, Mycobacterium
ASYGSG

SEQ ID NO: 437637 - protein, 7 aa, Mycobacterium
ASYGSTV

SEQ ID NO: 437638 - protein, 17 aa, Mycobacterium
ASYKGPARVTGGPGTGK

SEQ ID NO: 437639 - protein, 11 aa, Mycobacterium
ASYNEDTKEIT

SEQ ID NO: 437640 - protein, 11 aa, Mycobacterium
ASYNEESKEIT

SEQ ID NO: 437641 - protein, 10 aa, Mycobacterium
ASYNEETKEI

SEQ ID NO: 437642 - protein, 7 aa, Mycobacterium
ASYNRGD

SEQ ID NO: 437643 - protein, 6 aa, Mycobacterium
ASYPAL

SEQ ID NO: 437644 - protein, 5 aa, Mycobacterium
ASYPD

SEQ ID NO: 437645 - protein, 13 aa, Mycobacterium
ASYPDPGRAPECA

SEQ ID NO: 437646 - protein, 7 aa, Mycobacterium
ASYPEDV

SEQ ID NO: 437647 - protein, 9 aa, Mycobacterium
ASYPGYTPR

SEQ ID NO: 437648 - protein, 7 aa, Mycobacterium
ASYPKEA

SEQ ID NO: 437649 - protein, 8 aa, Mycobacterium
ASYPNNTN

SEQ ID NO: 437650 - protein, 6 aa, Mycobacterium
ASYPPV

SEQ ID NO: 437651 - protein, 6 aa, Mycobacterium
ASYPRD

SEQ ID NO: 437652 - protein, 5 aa, Mycobacterium
ASYQI

SEQ ID NO: 437653 - protein, 15 aa, Mycobacterium
ASYQQTEADNQQTLQ

SEQ ID NO: 437654 - protein, 6 aa, Mycobacterium
ASYQRG

SEQ ID NO: 437655 - protein, 7 aa, Mycobacterium
ASYQRQR

SEQ ID NO: 437656 - protein, 16 aa, Mycobacterium
ASYQRQRRVAEDHDGD

SEQ ID NO: 437657 - protein, 9 aa, Mycobacterium
ASYRPSTTH

SEQ ID NO: 437658 - protein, 8 aa, Mycobacterium
ASYRSAEQ

SEQ ID NO: 437659 - protein, 6 aa, Mycobacterium
ASYSPE

SEQ ID NO: 437660 - protein, 4 aa, Mycobacterium
ASYT

SEQ ID NO: 437661 - protein, 5 aa, Mycobacterium
ASYTG

SEQ ID NO: 437662 - protein, 18 aa, Mycobacterium
ASYTGTAPIAASSGDVTR

SEQ ID NO: 437663 - protein, 9 aa, Mycobacterium
ASYTKGRDG

SEQ ID NO: 437664 - protein, 4 aa, Mycobacterium
ASYV

SEQ ID NO: 437665 - protein, 24 aa, Mycobacterium
ASYVNSGARSGTVVGTTPSGQTIP

SEQ ID NO: 437666 - protein, 5 aa, Mycobacterium
ASYVT

SEQ ID NO: 437667 - protein, 14 aa, Mycobacterium
ASYYSVTTSSGDTV

SEQ ID NO: 437668 - protein, 6 aa, Mycobacterium
ATAAAA

SEQ ID NO: 437669 - protein, 11 aa, Mycobacterium
ATAAAAPSTTS

SEQ ID NO: 437670 - protein, 15 aa, Mycobacterium
ATAAAARTESRGCHA

SEQ ID NO: 437671 - protein, 10 aa, Mycobacterium
ATAAADAERL

SEQ ID NO: 437672 - protein, 10 aa, Mycobacterium
ATAAAGADDM

SEQ ID NO: 437673 - protein, 19 aa, Mycobacterium
ATAAAPAEGAVATETTPTE

SEQ ID NO: 437674 - protein, 12 aa, Mycobacterium
ATAAAPPPERAF

SEQ ID NO: 437675 - protein, 12 aa, Mycobacterium
ATAAAQLEGRIG

SEQ ID NO: 437676 - protein, 7 aa, Mycobacterium
ATAAARY

SEQ ID NO: 437677 - protein, 8 aa, Mycobacterium
ATAAASDL

SEQ ID NO: 437678 - protein, 11 aa, Mycobacterium
ATAADAHPQTL

SEQ ID NO: 437679 - protein, 9 aa, Mycobacterium
ATAADDRDV

SEQ ID NO: 437680 - protein, 8 aa, Mycobacterium
ATAADEAA

SEQ ID NO: 437681 - protein, 25 aa, Mycobacterium
ATAADGAPAVTVDGSPWIGNAGWQS

SEQ ID NO: 437682 - protein, 9 aa, Mycobacterium
ATAADGQRV

SEQ ID NO: 437683 - protein, 12 aa, Mycobacterium
ATAADLNAEPQT

SEQ ID NO: 437684 - protein, 9 aa, Mycobacterium
ATAADVDRG

SEQ ID NO: 437685 - protein, 8 aa, Mycobacterium
ATAAECDR

SEQ ID NO: 437686 - protein, 6 aa, Mycobacterium
ATAAEV

SEQ ID NO: 437687 - protein, 5 aa, Mycobacterium
ATAAF

SEQ ID NO: 437688 - protein, 5 aa, Mycobacterium
ATAAG

SEQ ID NO: 437689 - protein, 8 aa, Mycobacterium
ATAAGASI

SEQ ID NO: 437690 - protein, 8 aa, Mycobacterium
ATAAGAYT

SEQ ID NO: 437691 - protein, 8 aa, Mycobacterium
ATAAGGQA

SEQ ID NO: 437692 - protein, 6 aa, Mycobacterium
ATAAGI

SEQ ID NO: 437693 - protein, 22 aa, Mycobacterium
ATAAGIGASDGAPVTVSTERGA

SEQ ID NO: 437694 - protein, 6 aa, Mycobacterium
ATAAGR

SEQ ID NO: 437695 - protein, 7 aa, Mycobacterium
ATAAGRN

SEQ ID NO: 437696 - protein, 10 aa, Mycobacterium
ATAAGRPAPR

SEQ ID NO: 437697 - protein, 7 aa, Mycobacterium
ATAAGRR

SEQ ID NO: 437698 - protein, 17 aa, Mycobacterium
ATAAGSDLKRLPTEDEV

SEQ ID NO: 437699 - protein, 10 aa, Mycobacterium
ATAAGSNGGV

SEQ ID NO: 437700 - protein, 11 aa, Mycobacterium
ATAAGSPGIAA

SEQ ID NO: 437701 - protein, 9 aa, Mycobacterium
ATAAGTPCG

SEQ ID NO: 437702 - protein, 6 aa, Mycobacterium
ATAAGV

SEQ ID NO: 437703 - protein, 17 aa, Mycobacterium
ATAAIGAGRYQRTEGRA

SEQ ID NO: 437704 - protein, 10 aa, Mycobacterium
ATAAIGRSGV

SEQ ID NO: 437705 - protein, 5 aa, Mycobacterium
ATAAK

SEQ ID NO: 437706 - protein, 10 aa, Mycobacterium
ATAAKLADDH

SEQ ID NO: 437707 - protein, 17 aa, Mycobacterium
ATAANSDLKRLPTEDEV

SEQ ID NO: 437708 - protein, 7 aa, Mycobacterium
ATAAPAG

SEQ ID NO: 437709 - protein, 8 aa, Mycobacterium
ATAAPALD

SEQ ID NO: 437710 - protein, 8 aa, Mycobacterium
ATAAPGDY

SEQ ID NO: 437711 - protein, 8 aa, Mycobacterium
ATAAPGST

SEQ ID NO: 437712 - protein, 7 aa, Mycobacterium
ATAAPRE

SEQ ID NO: 437713 - protein, 7 aa, Mycobacterium
ATAASAC

SEQ ID NO: 437714 - protein, 9 aa, Mycobacterium
ATAASEQER

SEQ ID NO: 437715 - protein, 10 aa, Mycobacterium
ATAASQSSVV

SEQ ID NO: 437716 - protein, 8 aa, Mycobacterium
ATAASRDI

SEQ ID NO: 437717 - protein, 15 aa, Mycobacterium
ATAATDDRSQSEPPV

SEQ ID NO: 437718 - protein, 21 aa, Mycobacterium
ATAATGLSKARAKAAKALSKA

SEQ ID NO: 437719 - protein, 26 aa, Mycobacterium
ATAATGRPHRRKERIPPGPAAKAAAA

SEQ ID NO: 437720 - protein, 17 aa, Mycobacterium
ATAATNVGDVRTGMSSD

SEQ ID NO: 437721 - protein, 7 aa, Mycobacterium
ATAATPV

SEQ ID NO: 437722 - protein, 5 aa, Mycobacterium
ATAAY

SEQ ID NO: 437723 - protein, 5 aa, Mycobacterium
ATADA

SEQ ID NO: 437724 - protein, 8 aa, Mycobacterium
ATADAAAA

SEQ ID NO: 437725 - protein, 7 aa, Mycobacterium
ATADAGR

SEQ ID NO: 437726 - protein, 9 aa, Mycobacterium
ATADDATHQ

SEQ ID NO: 437727 - protein, 6 aa, Mycobacterium
ATADDI

SEQ ID NO: 437728 - protein, 6 aa, Mycobacterium
ATADEA

SEQ ID NO: 437729 - protein, 18 aa, Mycobacterium
ATADEAASAVSTALRENQ

SEQ ID NO: 437730 - protein, 9 aa, Mycobacterium
ATADGAGEL

SEQ ID NO: 437731 - protein, 21 aa, Mycobacterium
ATADGAPPLTEAELEKLFLAL

SEQ ID NO: 437732 - protein, 7 aa, Mycobacterium
ATADGDI

SEQ ID NO: 437733 - protein, 7 aa, Mycobacterium
ATADGHR

SEQ ID NO: 437734 - protein, 26 aa, Mycobacterium
ATADGSAGLADPDKFAGYTGELGSPS

SEQ ID NO: 437735 - protein, 26 aa, Mycobacterium
ATADGSVGLAGPEKFAGYTGELGSPD

SEQ ID NO: 437736 - protein, 14 aa, Mycobacterium
ATADGTRFTNDRTG

SEQ ID NO: 437737 - protein, 5 aa, Mycobacterium
ATADL

SEQ ID NO: 437738 - protein, 9 aa, Mycobacterium
ATADLDPGQ

SEQ ID NO: 437739 - protein, 8 aa, Mycobacterium
ATADLSQR

SEQ ID NO: 437740 - protein, 15 aa, Mycobacterium
ATADLSRVAGRVRGG

SEQ ID NO: 437741 - protein, 7 aa, Mycobacterium
ATADNGE

SEQ ID NO: 437742 - protein, 15 aa, Mycobacterium
ATADNSVAGPGTGKR

SEQ ID NO: 437743 - protein, 6 aa, Mycobacterium
ATADPD

SEQ ID NO: 437744 - protein, 8 aa, Mycobacterium
ATADPDTF

SEQ ID NO: 437745 - protein, 9 aa, Mycobacterium
ATADPDTFK

SEQ ID NO: 437746 - protein, 7 aa, Mycobacterium
ATADPGC

SEQ ID NO: 437747 - protein, 6 aa, Mycobacterium
ATADPN

SEQ ID NO: 437748 - protein, 10 aa, Mycobacterium
ATADPPVHTT

SEQ ID NO: 437749 - protein, 6 aa, Mycobacterium
ATADQL

SEQ ID NO: 437750 - protein, 8 aa, Mycobacterium
ATADQLDS

SEQ ID NO: 437751 - protein, 6 aa, Mycobacterium
ATADQP

SEQ ID NO: 437752 - protein, 6 aa, Mycobacterium
ATADSG

SEQ ID NO: 437753 - protein, 6 aa, Mycobacterium
ATADSR

SEQ ID NO: 437754 - protein, 7 aa, Mycobacterium
ATADTAQ

SEQ ID NO: 437755 - protein, 5 aa, Mycobacterium
ATADY

SEQ ID NO: 437756 - protein, 10 aa, Mycobacterium
ATADYSDTEM

SEQ ID NO: 437757 - protein, 7 aa, Mycobacterium
ATADYSV

SEQ ID NO: 437758 - protein, 5 aa, Mycobacterium
ATAEA

SEQ ID NO: 437759 - protein, 8 aa, Mycobacterium
ATAEAHRR

SEQ ID NO: 437760 - protein, 8 aa, Mycobacterium
ATAEAIDG

SEQ ID NO: 437761 - protein, 10 aa, Mycobacterium
ATAEARQAHP

SEQ ID NO: 437762 - protein, 15 aa, Mycobacterium
ATAEASAALPGDDIE

SEQ ID NO: 437763 - protein, 12 aa, Mycobacterium
ATAEATNASPLQ

SEQ ID NO: 437764 - protein, 7 aa, Mycobacterium
ATAEDAV

SEQ ID NO: 437765 - protein, 15 aa, Mycobacterium
ATAEDDPAAATAKGS

SEQ ID NO: 437766 - protein, 5 aa, Mycobacterium
ATAEF

SEQ ID NO: 437767 - protein, 6 aa, Mycobacterium
ATAEFD

SEQ ID NO: 437768 - protein, 5 aa, Mycobacterium
ATAEG

SEQ ID NO: 437769 - protein, 8 aa, Mycobacterium
ATAELPAA

SEQ ID NO: 437770 - protein, 8 aa, Mycobacterium
ATAELPAH

SEQ ID NO: 437771 - protein, 5 aa, Mycobacterium
ATAEN

SEQ ID NO: 437772 - protein, 6 aa, Mycobacterium
ATAENP

SEQ ID NO: 437773 - protein, 5 aa, Mycobacterium
ATAEP

SEQ ID NO: 437774 - protein, 18 aa, Mycobacterium
ATAEPADKQAILGVLRYT

SEQ ID NO: 437775 - protein, 8 aa, Mycobacterium
ATAEPAEL

SEQ ID NO: 437776 - protein, 18 aa, Mycobacterium
ATAEPAPSPRRGLLDRLL

SEQ ID NO: 437777 - protein, 12 aa, Mycobacterium
ATAEPEATTAMP

SEQ ID NO: 437778 - protein, 8 aa, Mycobacterium
ATAEPEER

SEQ ID NO: 437779 - protein, 7 aa, Mycobacterium
ATAEPGS

SEQ ID NO: 437780 - protein, 14 aa, Mycobacterium
ATAEPHGATRWRFA

SEQ ID NO: 437781 - protein, 8 aa, Mycobacterium
ATAEPTAT

SEQ ID NO: 437782 - protein, 6 aa, Mycobacterium
ATAEPV

SEQ ID NO: 437783 - protein, 11 aa, Mycobacterium
ATAEPWHGRPA

SEQ ID NO: 437784 - protein, 16 aa, Mycobacterium
ATAEQLAAGPREAQNR

SEQ ID NO: 437785 - protein, 5 aa, Mycobacterium
ATAER

SEQ ID NO: 437786 - protein, 17 aa, Mycobacterium
ATAETAGALEAQERNRG

SEQ ID NO: 437787 - protein, 7 aa, Mycobacterium
ATAETAQ

SEQ ID NO: 437788 - protein, 16 aa, Mycobacterium
ATAETPEFASPDQVDA

SEQ ID NO: 437789 - protein, 98 aa, Mycobacterium
ATAETPSNTTATKAAPAKKAPAKAATKAPAKKAPAKKAPAKAATKAPAKKAPAKKAPAKKAAAKATDPALEPQGAADDADIEPGDDLDTDLADDADIE

SEQ ID NO: 437790 - protein, 16 aa, Mycobacterium
ATAEVAASSANLGPGF

SEQ ID NO: 437791 - protein, 13 aa, Mycobacterium
ATAGAAPPVSDGS

SEQ ID NO: 437792 - protein, 6 aa, Mycobacterium
ATAGAD

SEQ ID NO: 437793 - protein, 8 aa, Mycobacterium
ATAGAGWP

SEQ ID NO: 437794 - protein, 7 aa, Mycobacterium
ATAGALP

SEQ ID NO: 437795 - protein, 8 aa, Mycobacterium
ATAGCDPR

SEQ ID NO: 437796 - protein, 9 aa, Mycobacterium
ATAGCDPRE

SEQ ID NO: 437797 - protein, 8 aa, Mycobacterium
ATAGDAGR

SEQ ID NO: 437798 - protein, 14 aa, Mycobacterium
ATAGDHAGAALRRG

SEQ ID NO: 437799 - protein, 8 aa, Mycobacterium
ATAGDLSA

SEQ ID NO: 437800 - protein, 12 aa, Mycobacterium
ATAGDRQVSESV

SEQ ID NO: 437801 - protein, 12 aa, Mycobacterium
ATAGELPAVSSG

SEQ ID NO: 437802 - protein, 6 aa, Mycobacterium
ATAGEP

SEQ ID NO: 437803 - protein, 6 aa, Mycobacterium
ATAGEW

SEQ ID NO: 437804 - protein, 11 aa, Mycobacterium
ATAGEWSQRSA

SEQ ID NO: 437805 - protein, 14 aa, Mycobacterium
ATAGFAGAPPVGQI

SEQ ID NO: 437806 - protein, 10 aa, Mycobacterium
ATAGGARALR

SEQ ID NO: 437807 - protein, 9 aa, Mycobacterium
ATAGGDTIG

SEQ ID NO: 437808 - protein, 7 aa, Mycobacterium
ATAGGKK

SEQ ID NO: 437809 - protein, 20 aa, Mycobacterium
ATAGGNDNGVGASGVGVGGN

SEQ ID NO: 437810 - protein, 20 aa, Mycobacterium
ATAGGSGNTTVAAEASGAEN

SEQ ID NO: 437811 - protein, 5 aa, Mycobacterium
ATAGK

SEQ ID NO: 437812 - protein, 6 aa, Mycobacterium
ATAGKE

SEQ ID NO: 437813 - protein, 14 aa, Mycobacterium
ATAGKGGGLGAPRY

SEQ ID NO: 437814 - protein, 18 aa, Mycobacterium
ATAGKLRGATGSAEPDVV

SEQ ID NO: 437815 - protein, 21 aa, Mycobacterium
ATAGKLRGPNNSGEPAEVDPE

SEQ ID NO: 437816 - protein, 18 aa, Mycobacterium
ATAGKLRGPTGSGEFTEV

SEQ ID NO: 437817 - protein, 20 aa, Mycobacterium
ATAGKLSGSGEEAEQVDPAL

SEQ ID NO: 437818 - protein, 7 aa, Mycobacterium
ATAGLKG

SEQ ID NO: 437819 - protein, 12 aa, Mycobacterium
ATAGMASRSVSG

SEQ ID NO: 437820 - protein, 7 aa, Mycobacterium
ATAGNTH

SEQ ID NO: 437821 - protein, 10 aa, Mycobacterium
ATAGPARRRP

SEQ ID NO: 437822 - protein, 13 aa, Mycobacterium
ATAGPDEDARTRA

SEQ ID NO: 437823 - protein, 6 aa, Mycobacterium
ATAGPG

SEQ ID NO: 437824 - protein, 7 aa, Mycobacterium
ATAGPGL

SEQ ID NO: 437825 - protein, 8 aa, Mycobacterium
ATAGPHSY

SEQ ID NO: 437826 - protein, 6 aa, Mycobacterium
ATAGPL

SEQ ID NO: 437827 - protein, 8 aa, Mycobacterium
ATAGPRDV

SEQ ID NO: 437828 - protein, 8 aa, Mycobacterium
ATAGPTAV

SEQ ID NO: 437829 - protein, 6 aa, Mycobacterium
ATAGPV

SEQ ID NO: 437830 - protein, 6 aa, Mycobacterium
ATAGQG

SEQ ID NO: 437831 - protein, 12 aa, Mycobacterium
ATAGQSKPGKTE

SEQ ID NO: 437832 - protein, 9 aa, Mycobacterium
ATAGQVPSV

SEQ ID NO: 437833 - protein, 6 aa, Mycobacterium
ATAGRA

SEQ ID NO: 437834 - protein, 6 aa, Mycobacterium
ATAGRF

SEQ ID NO: 437835 - protein, 10 aa, Mycobacterium
ATAGRRGVES

SEQ ID NO: 437836 - protein, 18 aa, Mycobacterium
ATAGSAMAAADKDSRSQV

SEQ ID NO: 437837 - protein, 10 aa, Mycobacterium
ATAGSEKRRQ

SEQ ID NO: 437838 - protein, 10 aa, Mycobacterium
ATAGSPERRD

SEQ ID NO: 437839 - protein, 25 aa, Mycobacterium
ATAGSTTTPLSEHDERATRSTASNP

SEQ ID NO: 437840 - protein, 5 aa, Mycobacterium
ATAGT

SEQ ID NO: 437841 - protein, 9 aa, Mycobacterium
ATAGTPRRY

SEQ ID NO: 437842 - protein, 14 aa, Mycobacterium
ATAGTTIGTGVATG

SEQ ID NO: 437843 - protein, 5 aa, Mycobacterium
ATAHA

SEQ ID NO: 437844 - protein, 9 aa, Mycobacterium
ATAHEPTDE

SEQ ID NO: 437845 - protein, 6 aa, Mycobacterium
ATAHTR

SEQ ID NO: 437846 - protein, 9 aa, Mycobacterium
ATAIADRTG

SEQ ID NO: 437847 - protein, 17 aa, Mycobacterium
ATAIATASAAAAERGLT

SEQ ID NO: 437848 - protein, 4 aa, Mycobacterium
ATAK

SEQ ID NO: 437849 - protein, 5 aa, Mycobacterium
ATAKA

SEQ ID NO: 437850 - protein, 7 aa, Mycobacterium
ATAKAAE

SEQ ID NO: 437851 - protein, 9 aa, Mycobacterium
ATAKARRMT

SEQ ID NO: 437852 - protein, 6 aa, Mycobacterium
ATAKEA

SEQ ID NO: 437853 - protein, 9 aa, Mycobacterium
ATAKEPAGN

SEQ ID NO: 437854 - protein, 6 aa, Mycobacterium
ATAKGQ

SEQ ID NO: 437855 - protein, 10 aa, Mycobacterium
ATAKKELGAM

SEQ ID NO: 437856 - protein, 9 aa, Mycobacterium
ATAKNGRFA

SEQ ID NO: 437857 - protein, 5 aa, Mycobacterium
ATAKP

SEQ ID NO: 437858 - protein, 10 aa, Mycobacterium
ATAKPDRWRR

SEQ ID NO: 437859 - protein, 21 aa, Mycobacterium
ATAKREYEASTGRAKSEADRL

SEQ ID NO: 437860 - protein, 6 aa, Mycobacterium
ATAKSM

SEQ ID NO: 437861 - protein, 13 aa, Mycobacterium
ATALAGSAKNRHE

SEQ ID NO: 437862 - protein, 7 aa, Mycobacterium
ATALDGS

SEQ ID NO: 437863 - protein, 8 aa, Mycobacterium
ATALDTAA

SEQ ID NO: 437864 - protein, 6 aa, Mycobacterium
ATALNP

SEQ ID NO: 437865 - protein, 5 aa, Mycobacterium
ATALP

SEQ ID NO: 437866 - protein, 5 aa, Mycobacterium
ATALR

SEQ ID NO: 437867 - protein, 14 aa, Mycobacterium
ATALTTDSDGIVNG

SEQ ID NO: 437868 - protein, 4 aa, Mycobacterium
ATAN

SEQ ID NO: 437869 - protein, 11 aa, Mycobacterium
ATANAASAAAD

SEQ ID NO: 437870 - protein, 9 aa, Mycobacterium
ATANALAPS

SEQ ID NO: 437871 - protein, 15 aa, Mycobacterium
ATANEIGAAEGESVT

SEQ ID NO: 437872 - protein, 7 aa, Mycobacterium
ATANGGT

SEQ ID NO: 437873 - protein, 8 aa, Mycobacterium
ATANGKRA

SEQ ID NO: 437874 - protein, 11 aa, Mycobacterium
ATANGLGRDGR

SEQ ID NO: 437875 - protein, 12 aa, Mycobacterium
ATANGSAPTEAE

SEQ ID NO: 437876 - protein, 8 aa, Mycobacterium
ATANPDTI

SEQ ID NO: 437877 - protein, 9 aa, Mycobacterium
ATANPLATQ

SEQ ID NO: 437878 - protein, 9 aa, Mycobacterium
ATAPADATP

SEQ ID NO: 437879 - protein, 10 aa, Mycobacterium
ATAPAPPGAY

SEQ ID NO: 437880 - protein, 10 aa, Mycobacterium
ATAPASPQRH

SEQ ID NO: 437881 - protein, 19 aa, Mycobacterium
ATAPATAPAGLGYSARGAA

SEQ ID NO: 437882 - protein, 6 aa, Mycobacterium
ATAPAW

SEQ ID NO: 437883 - protein, 15 aa, Mycobacterium
ATAPDAADEASTAFS

SEQ ID NO: 437884 - protein, 6 aa, Mycobacterium
ATAPDG

SEQ ID NO: 437885 - protein, 7 aa, Mycobacterium
ATAPDGR

SEQ ID NO: 437886 - protein, 10 aa, Mycobacterium
ATAPDGTSTI

SEQ ID NO: 437887 - protein, 11 aa, Mycobacterium
ATAPDLNTEPH

SEQ ID NO: 437888 - protein, 14 aa, Mycobacterium
ATAPEKRPRSGRRQ

SEQ ID NO: 437889 - protein, 14 aa, Mycobacterium
ATAPERIRSQGIRP

SEQ ID NO: 437890 - protein, 5 aa, Mycobacterium
ATAPF

SEQ ID NO: 437891 - protein, 7 aa, Mycobacterium
ATAPGCE

SEQ ID NO: 437892 - protein, 6 aa, Mycobacterium
ATAPGG

SEQ ID NO: 437893 - protein, 9 aa, Mycobacterium
ATAPGITEQ

SEQ ID NO: 437894 - protein, 7 aa, Mycobacterium
ATAPGQV

SEQ ID NO: 437895 - protein, 5 aa, Mycobacterium
ATAPK

SEQ ID NO: 437896 - protein, 6 aa, Mycobacterium
ATAPKA

SEQ ID NO: 437897 - protein, 18 aa, Mycobacterium
ATAPKCPKRVAKAARAVR

SEQ ID NO: 437898 - protein, 6 aa, Mycobacterium
ATAPKK

SEQ ID NO: 437899 - protein, 8 aa, Mycobacterium
ATAPKPSG

SEQ ID NO: 437900 - protein, 7 aa, Mycobacterium
ATAPPAA

SEQ ID NO: 437901 - protein, 8 aa, Mycobacterium
ATAPPARD

SEQ ID NO: 437902 - protein, 26 aa, Mycobacterium
ATAPPPPAAPPAPAPDALPPANDPGV

SEQ ID NO: 437903 - protein, 5 aa, Mycobacterium
ATAPQ

SEQ ID NO: 437904 - protein, 6 aa, Mycobacterium
ATAPQL

SEQ ID NO: 437905 - protein, 8 aa, Mycobacterium
ATAPQTAQ

SEQ ID NO: 437906 - protein, 8 aa, Mycobacterium
ATAPRERA

SEQ ID NO: 437907 - protein, 7 aa, Mycobacterium
ATAPRTL

SEQ ID NO: 437908 - protein, 7 aa, Mycobacterium
ATAPTAG

SEQ ID NO: 437909 - protein, 7 aa, Mycobacterium
ATAPTRK

SEQ ID NO: 437910 - protein, 7 aa, Mycobacterium
ATAPTSY

SEQ ID NO: 437911 - protein, 6 aa, Mycobacterium
ATAPTT

SEQ ID NO: 437912 - protein, 20 aa, Mycobacterium
ATAPVAPAATAAAATPLPRS

SEQ ID NO: 437913 - protein, 10 aa, Mycobacterium
ATAPVTSART

SEQ ID NO: 437914 - protein, 9 aa, Mycobacterium
ATAPWTRPE

SEQ ID NO: 437915 - protein, 8 aa, Mycobacterium
ATAQESVR

SEQ ID NO: 437916 - protein, 15 aa, Mycobacterium
ATAQGLQDLSERDAH

SEQ ID NO: 437917 - protein, 5 aa, Mycobacterium
ATAQH

SEQ ID NO: 437918 - protein, 16 aa, Mycobacterium
ATAQMRSGRDSRQFDS

SEQ ID NO: 437919 - protein, 6 aa, Mycobacterium
ATAQNG

SEQ ID NO: 437920 - protein, 7 aa, Mycobacterium
ATAQNGR

SEQ ID NO: 437921 - protein, 5 aa, Mycobacterium
ATAQP

SEQ ID NO: 437922 - protein, 12 aa, Mycobacterium
ATAQSAADAGRL

SEQ ID NO: 437923 - protein, 12 aa, Mycobacterium
ATAQSADDAGRL

SEQ ID NO: 437924 - protein, 11 aa, Mycobacterium
ATAQSAEDAGR

SEQ ID NO: 437925 - protein, 11 aa, Mycobacterium
ATAQSAGDAGR

SEQ ID NO: 437926 - protein, 7 aa, Mycobacterium
ATARAAA

SEQ ID NO: 437927 - protein, 19 aa, Mycobacterium
ATARAEATAAQRTIEAERE

SEQ ID NO: 437928 - protein, 14 aa, Mycobacterium
ATARAQEPALSPEV

SEQ ID NO: 437929 - protein, 9 aa, Mycobacterium
ATARASKAT

SEQ ID NO: 437930 - protein, 17 aa, Mycobacterium
ATARCEERHDARQLAGE

SEQ ID NO: 437931 - protein, 23 aa, Mycobacterium
ATARDDLATARELSADDPSFADE

SEQ ID NO: 437932 - protein, 10 aa, Mycobacterium
ATARDEGDYL

SEQ ID NO: 437933 - protein, 7 aa, Mycobacterium
ATARDIS

SEQ ID NO: 437934 - protein, 18 aa, Mycobacterium
ATARDPADRYADATEMGA

SEQ ID NO: 437935 - protein, 9 aa, Mycobacterium
ATAREAGVN

SEQ ID NO: 437936 - protein, 7 aa, Mycobacterium
ATAREQL

SEQ ID NO: 437937 - protein, 12 aa, Mycobacterium
ATARGEIAPDTD

SEQ ID NO: 437938 - protein, 14 aa, Mycobacterium
ATARGGATGGRDAL

SEQ ID NO: 437939 - protein, 8 aa, Mycobacterium
ATARIDEG

SEQ ID NO: 437940 - protein, 5 aa, Mycobacterium
ATARN

SEQ ID NO: 437941 - protein, 10 aa, Mycobacterium
ATARNAGDEM

SEQ ID NO: 437942 - protein, 5 aa, Mycobacterium
ATARP

SEQ ID NO: 437943 - protein, 8 aa, Mycobacterium
ATARPQDD

SEQ ID NO: 437944 - protein, 7 aa, Mycobacterium
ATARQTD

SEQ ID NO: 437945 - protein, 6 aa, Mycobacterium
ATARRE

SEQ ID NO: 437946 - protein, 12 aa, Mycobacterium
ATARRGGDVPDE

SEQ ID NO: 437947 - protein, 6 aa, Mycobacterium
ATARRP

SEQ ID NO: 437948 - protein, 8 aa, Mycobacterium
ATARSAPR

SEQ ID NO: 437949 - protein, 7 aa, Mycobacterium
ATARSAR

SEQ ID NO: 437950 - protein, 7 aa, Mycobacterium
ATARSGH

SEQ ID NO: 437951 - protein, 8 aa, Mycobacterium
ATARSPRE

SEQ ID NO: 437952 - protein, 14 aa, Mycobacterium
ATARSSDYATAPAH

SEQ ID NO: 437953 - protein, 12 aa, Mycobacterium
ATARSVDYTGAG

SEQ ID NO: 437954 - protein, 5 aa, Mycobacterium
ATART

SEQ ID NO: 437955 - protein, 9 aa, Mycobacterium
ATARTAESV

SEQ ID NO: 437956 - protein, 10 aa, Mycobacterium
ATARTDGQHS

SEQ ID NO: 437957 - protein, 25 aa, Mycobacterium
ATARTESRGSHHRGDFPDTDPTQEV

SEQ ID NO: 437958 - protein, 4 aa, Mycobacterium
ATAS

SEQ ID NO: 437959 - protein, 11 aa, Mycobacterium
ATASAATDTEV

SEQ ID NO: 437960 - protein, 12 aa, Mycobacterium
ATASAKAHQLVA

SEQ ID NO: 437961 - protein, 10 aa, Mycobacterium
ATASARKRPL

SEQ ID NO: 437962 - protein, 13 aa, Mycobacterium
ATASARSAERLRR

SEQ ID NO: 437963 - protein, 10 aa, Mycobacterium
ATASDPLTKN

SEQ ID NO: 437964 - protein, 11 aa, Mycobacterium
ATASEARDTEV

SEQ ID NO: 437965 - protein, 12 aa, Mycobacterium
ATASGEVCFVKA

SEQ ID NO: 437966 - protein, 16 aa, Mycobacterium
ATASGGTLLRWSAPLL

SEQ ID NO: 437967 - protein, 18 aa, Mycobacterium
ATASGLARTTVADSGGSQ

SEQ ID NO: 437968 - protein, 7 aa, Mycobacterium
ATASGRR

SEQ ID NO: 437969 - protein, 18 aa, Mycobacterium
ATASGSSVLAGRKNKGAL

SEQ ID NO: 437970 - protein, 6 aa, Mycobacterium
ATASGV

SEQ ID NO: 437971 - protein, 19 aa, Mycobacterium
ATASGVSATPATAAAASTR

SEQ ID NO: 437972 - protein, 6 aa, Mycobacterium
ATASLG

SEQ ID NO: 437973 - protein, 6 aa, Mycobacterium
ATASLS

SEQ ID NO: 437974 - protein, 10 aa, Mycobacterium
ATASPAIDTD

SEQ ID NO: 437975 - protein, 12 aa, Mycobacterium
ATASPLPGPSGN

SEQ ID NO: 437976 - protein, 11 aa, Mycobacterium
ATASPRQANNH

SEQ ID NO: 437977 - protein, 9 aa, Mycobacterium
ATASQCESR

SEQ ID NO: 437978 - protein, 6 aa, Mycobacterium
ATASQP

SEQ ID NO: 437979 - protein, 9 aa, Mycobacterium
ATASSGQSM

SEQ ID NO: 437980 - protein, 6 aa, Mycobacterium
ATASSH

SEQ ID NO: 437981 - protein, 9 aa, Mycobacterium
ATASSPPHD

SEQ ID NO: 437982 - protein, 6 aa, Mycobacterium
ATASSR

SEQ ID NO: 437983 - protein, 18 aa, Mycobacterium
ATASSYLTTETANAERTL

SEQ ID NO: 437984 - protein, 9 aa, Mycobacterium
ATASTDPPV

SEQ ID NO: 437985 - protein, 7 aa, Mycobacterium
ATASTSL

SEQ ID NO: 437986 - protein, 6 aa, Mycobacterium
ATASTY

SEQ ID NO: 437987 - protein, 6 aa, Mycobacterium
ATASYR

SEQ ID NO: 437988 - protein, 5 aa, Mycobacterium
ATATA

SEQ ID NO: 437989 - protein, 6 aa, Mycobacterium
ATATAE

SEQ ID NO: 437990 - protein, 10 aa, Mycobacterium
ATATAGDTTI

SEQ ID NO: 437991 - protein, 8 aa, Mycobacterium
ATATAIAK

SEQ ID NO: 437992 - protein, 11 aa, Mycobacterium
ATATDGGYRVN

SEQ ID NO: 437993 - protein, 12 aa, Mycobacterium
ATATDGTTSEHD

SEQ ID NO: 437994 - protein, 8 aa, Mycobacterium
ATATDLEG

SEQ ID NO: 437995 - protein, 11 aa, Mycobacterium
ATATELAEERG

SEQ ID NO: 437996 - protein, 9 aa, Mycobacterium
ATATEPSRI

SEQ ID NO: 437997 - protein, 7 aa, Mycobacterium
ATATEQP

SEQ ID NO: 437998 - protein, 10 aa, Mycobacterium
ATATGESRSV

SEQ ID NO: 437999 - protein, 7 aa, Mycobacterium
ATATGHE

SEQ ID NO: 438000 - protein, 6 aa, Mycobacterium
ATATGI

SEQ ID NO: 438001 - protein, 10 aa, Mycobacterium
ATATGWPDDD

SEQ ID NO: 438002 - protein, 6 aa, Mycobacterium
ATATHG

SEQ ID NO: 438003 - protein, 10 aa, Mycobacterium
ATATNPAAIS

SEQ ID NO: 438004 - protein, 14 aa, Mycobacterium
ATATPIGDTAEANA

SEQ ID NO: 438005 - protein, 9 aa, Mycobacterium
ATATPKPGT

SEQ ID NO: 438006 - protein, 9 aa, Mycobacterium
ATATPPAVD

SEQ ID NO: 438007 - protein, 6 aa, Mycobacterium
ATATPQ

SEQ ID NO: 438008 - protein, 8 aa, Mycobacterium
ATATPRPL

SEQ ID NO: 438009 - protein, 10 aa, Mycobacterium
ATATRNGEPI

SEQ ID NO: 438010 - protein, 8 aa, Mycobacterium
ATATRNNG

SEQ ID NO: 438011 - protein, 16 aa, Mycobacterium
ATATRRVNTIAELART

SEQ ID NO: 438012 - protein, 14 aa, Mycobacterium
ATATRSLPGPDGNL

SEQ ID NO: 438013 - protein, 5 aa, Mycobacterium
ATATS

SEQ ID NO: 438014 - protein, 14 aa, Mycobacterium
ATATSVGDVAEGRA

SEQ ID NO: 438015 - protein, 6 aa, Mycobacterium
ATATTD

SEQ ID NO: 438016 - protein, 26 aa, Mycobacterium
ATATTGRPHRRKERIPPGAAAKAAAA

SEQ ID NO: 438017 - protein, 6 aa, Mycobacterium
ATATTR

SEQ ID NO: 438018 - protein, 21 aa, Mycobacterium
ATATVSSIDQDAGRTIQGDSG

SEQ ID NO: 438019 - protein, 7 aa, Mycobacterium
ATATVTA

SEQ ID NO: 438020 - protein, 6 aa, Mycobacterium
ATATYD

SEQ ID NO: 438021 - protein, 8 aa, Mycobacterium
ATAVAPSA

SEQ ID NO: 438022 - protein, 5 aa, Mycobacterium
ATAVD

SEQ ID NO: 438023 - protein, 14 aa, Mycobacterium
ATAVGATAVGPSLS

SEQ ID NO: 438024 - protein, 7 aa, Mycobacterium
ATAVGSP

SEQ ID NO: 438025 - protein, 6 aa, Mycobacterium
ATAVGT

SEQ ID NO: 438026 - protein, 6 aa, Mycobacterium
ATAVQG

SEQ ID NO: 438027 - protein, 18 aa, Mycobacterium
ATAVRGKLASPADLPAAA

SEQ ID NO: 438028 - protein, 18 aa, Mycobacterium
ATAVRGKLSSPADLAKSV

SEQ ID NO: 438029 - protein, 6 aa, Mycobacterium
ATAVTA

SEQ ID NO: 438030 - protein, 12 aa, Mycobacterium
ATAVTKRSGTEP

SEQ ID NO: 438031 - protein, 4 aa, Mycobacterium
ATAY

SEQ ID NO: 438032 - protein, 7 aa, Mycobacterium
ATCAGTS

SEQ ID NO: 438033 - protein, 12 aa, Mycobacterium
ATCGEASKARAA

SEQ ID NO: 438034 - protein, 13 aa, Mycobacterium
ATCSSADKPRYGD

SEQ ID NO: 438035 - protein, 6 aa, Mycobacterium
ATCTGA

SEQ ID NO: 438036 - protein, 5 aa, Mycobacterium
ATDAA

SEQ ID NO: 438037 - protein, 7 aa, Mycobacterium
ATDAAAQ

SEQ ID NO: 438038 - protein, 21 aa, Mycobacterium
ATDAAELNPIRQAQEDGGLPD

SEQ ID NO: 438039 - protein, 13 aa, Mycobacterium
ATDAAVSPTDAEL

SEQ ID NO: 438040 - protein, 6 aa, Mycobacterium
ATDADF

SEQ ID NO: 438041 - protein, 7 aa, Mycobacterium
ATDADGS

SEQ ID NO: 438042 - protein, 7 aa, Mycobacterium
ATDADGV

SEQ ID NO: 438043 - protein, 7 aa, Mycobacterium
ATDAEGV

SEQ ID NO: 438044 - protein, 8 aa, Mycobacterium
ATDAELAA

SEQ ID NO: 438045 - protein, 7 aa, Mycobacterium
ATDAEMA

SEQ ID NO: 438046 - protein, 14 aa, Mycobacterium
ATDAEMAIPLIAFG

SEQ ID NO: 438047 - protein, 7 aa, Mycobacterium
ATDAEST

SEQ ID NO: 438048 - protein, 5 aa, Mycobacterium
ATDAG

SEQ ID NO: 438049 - protein, 8 aa, Mycobacterium
ATDAGADR

SEQ ID NO: 438050 - protein, 10 aa, Mycobacterium
ATDAGATITR

SEQ ID NO: 438051 - protein, 11 aa, Mycobacterium
ATDAGTARDEL

SEQ ID NO: 438052 - protein, 11 aa, Mycobacterium
ATDAGTTAVRP

SEQ ID NO: 438053 - protein, 10 aa, Mycobacterium
ATDAKTALEQ

SEQ ID NO: 438054 - protein, 5 aa, Mycobacterium
ATDAL

SEQ ID NO: 438055 - protein, 10 aa, Mycobacterium
ATDALNARSV

SEQ ID NO: 438056 - protein, 14 aa, Mycobacterium
ATDALRSSARNRAD

SEQ ID NO: 438057 - protein, 9 aa, Mycobacterium
ATDAPADVH

SEQ ID NO: 438058 - protein, 7 aa, Mycobacterium
ATDAPQP

SEQ ID NO: 438059 - protein, 22 aa, Mycobacterium
ATDAQAVPKTAADRRPPVVAAR

SEQ ID NO: 438060 - protein, 5 aa, Mycobacterium
ATDAR

SEQ ID NO: 438061 - protein, 6 aa, Mycobacterium
ATDARA

SEQ ID NO: 438062 - protein, 13 aa, Mycobacterium
ATDARRHTRAETP

SEQ ID NO: 438063 - protein, 16 aa, Mycobacterium
ATDARRHTRAETPFYS

SEQ ID NO: 438064 - protein, 8 aa, Mycobacterium
ATDARRHV

SEQ ID NO: 438065 - protein, 7 aa, Mycobacterium
ATDASRA

SEQ ID NO: 438066 - protein, 13 aa, Mycobacterium
ATDASVRPSEAEL

SEQ ID NO: 438067 - protein, 7 aa, Mycobacterium
ATDATVG

SEQ ID NO: 438068 - protein, 14 aa, Mycobacterium
ATDAVSDLSPRQDA

SEQ ID NO: 438069 - protein, 11 aa, Mycobacterium
ATDAVTDPDRR

SEQ ID NO: 438070 - protein, 10 aa, Mycobacterium
ATDAYPSRTD

SEQ ID NO: 438071 - protein, 7 aa, Mycobacterium
ATDCGTD

SEQ ID NO: 438072 - protein, 4 aa, Mycobacterium
ATDD

SEQ ID NO: 438073 - protein, 7 aa, Mycobacterium
ATDDAGR

SEQ ID NO: 438074 - protein, 10 aa, Mycobacterium
ATDDASGRIE

SEQ ID NO: 438075 - protein, 8 aa, Mycobacterium
ATDDDLRE

SEQ ID NO: 438076 - protein, 6 aa, Mycobacterium
ATDDDS

SEQ ID NO: 438077 - protein, 7 aa, Mycobacterium
ATDDDSI

SEQ ID NO: 438078 - protein, 9 aa, Mycobacterium
ATDDDTIGQ

SEQ ID NO: 438079 - protein, 6 aa, Mycobacterium
ATDDDV

SEQ ID NO: 438080 - protein, 6 aa, Mycobacterium
ATDDEL

SEQ ID NO: 438081 - protein, 6 aa, Mycobacterium
ATDDEW

SEQ ID NO: 438082 - protein, 5 aa, Mycobacterium
ATDDG

SEQ ID NO: 438083 - protein, 7 aa, Mycobacterium
ATDDGAT

SEQ ID NO: 438084 - protein, 7 aa, Mycobacterium
ATDDLSG

SEQ ID NO: 438085 - protein, 6 aa, Mycobacterium
ATDDPA

SEQ ID NO: 438086 - protein, 10 aa, Mycobacterium
ATDDPARPLT

SEQ ID NO: 438087 - protein, 6 aa, Mycobacterium
ATDDPD

SEQ ID NO: 438088 - protein, 6 aa, Mycobacterium
ATDDPI

SEQ ID NO: 438089 - protein, 9 aa, Mycobacterium
ATDDPRGLT

SEQ ID NO: 438090 - protein, 9 aa, Mycobacterium
ATDDQSEGM

SEQ ID NO: 438091 - protein, 5 aa, Mycobacterium
ATDDR

SEQ ID NO: 438092 - protein, 13 aa, Mycobacterium
ATDDRIAAAIRRL

SEQ ID NO: 438093 - protein, 5 aa, Mycobacterium
ATDDS

SEQ ID NO: 438094 - protein, 6 aa, Mycobacterium
ATDDSV

SEQ ID NO: 438095 - protein, 6 aa, Mycobacterium
ATDDTA

SEQ ID NO: 438096 - protein, 6 aa, Mycobacterium
ATDDTR

SEQ ID NO: 438097 - protein, 6 aa, Mycobacterium
ATDDTV

SEQ ID NO: 438098 - protein, 5 aa, Mycobacterium
ATDDV

SEQ ID NO: 438099 - protein, 6 aa, Mycobacterium
ATDDWD

SEQ ID NO: 438100 - protein, 8 aa, Mycobacterium
ATDEALSE

SEQ ID NO: 438101 - protein, 6 aa, Mycobacterium
ATDEEA

SEQ ID NO: 438102 - protein, 12 aa, Mycobacterium
ATDEEALEKHSE

SEQ ID NO: 438103 - protein, 5 aa, Mycobacterium
ATDEF

SEQ ID NO: 438104 - protein, 8 aa, Mycobacterium
ATDEHTGQ

SEQ ID NO: 438105 - protein, 7 aa, Mycobacterium
ATDEPDE

SEQ ID NO: 438106 - protein, 7 aa, Mycobacterium
ATDEPDR

SEQ ID NO: 438107 - protein, 8 aa, Mycobacterium
ATDEPRPG

SEQ ID NO: 438108 - protein, 6 aa, Mycobacterium
ATDEPV

SEQ ID NO: 438109 - protein, 23 aa, Mycobacterium
ATDEQFRSTKPDAALQRAARQPE

SEQ ID NO: 438110 - protein, 13 aa, Mycobacterium
ATDEQHPDAQGRI

SEQ ID NO: 438111 - protein, 6 aa, Mycobacterium
ATDEQL

SEQ ID NO: 438112 - protein, 5 aa, Mycobacterium
ATDER

SEQ ID NO: 438113 - protein, 13 aa, Mycobacterium
ATDERIAAAVRRL

SEQ ID NO: 438114 - protein, 15 aa, Mycobacterium
ATDERIDAAAHRLTA

SEQ ID NO: 438115 - protein, 14 aa, Mycobacterium
ATDERIDAAVERLG

SEQ ID NO: 438116 - protein, 14 aa, Mycobacterium
ATDERIQQAAERLA

SEQ ID NO: 438117 - protein, 13 aa, Mycobacterium
ATDERVAAAAGRL

SEQ ID NO: 438118 - protein, 7 aa, Mycobacterium
ATDESAW

SEQ ID NO: 438119 - protein, 9 aa, Mycobacterium
ATDESFAAE

SEQ ID NO: 438120 - protein, 7 aa, Mycobacterium
ATDESPV

SEQ ID NO: 438121 - protein, 7 aa, Mycobacterium
ATDEVGK

SEQ ID NO: 438122 - protein, 5 aa, Mycobacterium
ATDGA

SEQ ID NO: 438123 - protein, 6 aa, Mycobacterium
ATDGAL

SEQ ID NO: 438124 - protein, 8 aa, Mycobacterium
ATDGARKC

SEQ ID NO: 438125 - protein, 9 aa, Mycobacterium
ATDGATDTV

SEQ ID NO: 438126 - protein, 5 aa, Mycobacterium
ATDGD

SEQ ID NO: 438127 - protein, 7 aa, Mycobacterium
ATDGDDE

SEQ ID NO: 438128 - protein, 8 aa, Mycobacterium
ATDGDGEA

SEQ ID NO: 438129 - protein, 9 aa, Mycobacterium
ATDGDGEAV

SEQ ID NO: 438130 - protein, 9 aa, Mycobacterium
ATDGDGETI

SEQ ID NO: 438131 - protein, 6 aa, Mycobacterium
ATDGDL

SEQ ID NO: 438132 - protein, 9 aa, Mycobacterium
ATDGDPALD

SEQ ID NO: 438133 - protein, 8 aa, Mycobacterium
ATDGERGW

SEQ ID NO: 438134 - protein, 11 aa, Mycobacterium
ATDGFDSGSPL

SEQ ID NO: 438135 - protein, 9 aa, Mycobacterium
ATDGGESEK

SEQ ID NO: 438136 - protein, 7 aa, Mycobacterium
ATDGGLE

SEQ ID NO: 438137 - protein, 11 aa, Mycobacterium
ATDGGTGAAGG

SEQ ID NO: 438138 - protein, 6 aa, Mycobacterium
ATDGGV

SEQ ID NO: 438139 - protein, 6 aa, Mycobacterium
ATDGIG

SEQ ID NO: 438140 - protein, 14 aa, Mycobacterium
ATDGKIALGAVRYD

SEQ ID NO: 438141 - protein, 6 aa, Mycobacterium
ATDGLG

SEQ ID NO: 438142 - protein, 7 aa, Mycobacterium
ATDGLKG

SEQ ID NO: 438143 - protein, 8 aa, Mycobacterium
ATDGPTAA

SEQ ID NO: 438144 - protein, 5 aa, Mycobacterium
ATDGQ

SEQ ID NO: 438145 - protein, 10 aa, Mycobacterium
ATDGQARPPA

SEQ ID NO: 438146 - protein, 7 aa, Mycobacterium
ATDGQDV

SEQ ID NO: 438147 - protein, 6 aa, Mycobacterium
ATDGQG

SEQ ID NO: 438148 - protein, 7 aa, Mycobacterium
ATDGQPV

SEQ ID NO: 438149 - protein, 6 aa, Mycobacterium
ATDGRG

SEQ ID NO: 438150 - protein, 9 aa, Mycobacterium
ATDGRPPAS

SEQ ID NO: 438151 - protein, 7 aa, Mycobacterium
ATDGTGR

SEQ ID NO: 438152 - protein, 6 aa, Mycobacterium
ATDGTL

SEQ ID NO: 438153 - protein, 8 aa, Mycobacterium
ATDGTLPG

SEQ ID NO: 438154 - protein, 8 aa, Mycobacterium
ATDGVSSH

SEQ ID NO: 438155 - protein, 5 aa, Mycobacterium
ATDHR

SEQ ID NO: 438156 - protein, 6 aa, Mycobacterium
ATDHRP

SEQ ID NO: 438157 - protein, 4 aa, Mycobacterium
ATDI

SEQ ID NO: 438158 - protein, 8 aa, Mycobacterium
ATDIEEVE

SEQ ID NO: 438159 - protein, 12 aa, Mycobacterium
ATDKALRGDGRE

SEQ ID NO: 438160 - protein, 12 aa, Mycobacterium
ATDKAVHGDERE

SEQ ID NO: 438161 - protein, 12 aa, Mycobacterium
ATDKAVRGDETE

SEQ ID NO: 438162 - protein, 11 aa, Mycobacterium
ATDKAVRGDQT

SEQ ID NO: 438163 - protein, 9 aa, Mycobacterium
ATDKNQSQS

SEQ ID NO: 438164 - protein, 9 aa, Mycobacterium
ATDKPDPLE

SEQ ID NO: 438165 - protein, 5 aa, Mycobacterium
ATDKQ

SEQ ID NO: 438166 - protein, 8 aa, Mycobacterium
ATDKRDMA

SEQ ID NO: 438167 - protein, 5 aa, Mycobacterium
ATDLD

SEQ ID NO: 438168 - protein, 5 aa, Mycobacterium
ATDLE

SEQ ID NO: 438169 - protein, 8 aa, Mycobacterium
ATDLGEQL

SEQ ID NO: 438170 - protein, 7 aa, Mycobacterium
ATDLPPG

SEQ ID NO: 438171 - protein, 5 aa, Mycobacterium
ATDLT

SEQ ID NO: 438172 - protein, 6 aa, Mycobacterium
ATDNEA

SEQ ID NO: 438173 - protein, 5 aa, Mycobacterium
ATDPA

SEQ ID NO: 438174 - protein, 9 aa, Mycobacterium
ATDPAEKAF

SEQ ID NO: 438175 - protein, 6 aa, Mycobacterium
ATDPAG

SEQ ID NO: 438176 - protein, 8 aa, Mycobacterium
ATDPAGAE

SEQ ID NO: 438177 - protein, 8 aa, Mycobacterium
ATDPAGRY

SEQ ID NO: 438178 - protein, 7 aa, Mycobacterium
ATDPAGT

SEQ ID NO: 438179 - protein, 11 aa, Mycobacterium
ATDPAIPEQRR

SEQ ID NO: 438180 - protein, 6 aa, Mycobacterium
ATDPAV

SEQ ID NO: 438181 - protein, 9 aa, Mycobacterium
ATDPAVRAK

SEQ ID NO: 438182 - protein, 13 aa, Mycobacterium
ATDPDEDLSTGKH

SEQ ID NO: 438183 - protein, 7 aa, Mycobacterium
ATDPDGV

SEQ ID NO: 438184 - protein, 7 aa, Mycobacterium
ATDPDRL

SEQ ID NO: 438185 - protein, 9 aa, Mycobacterium
ATDPDSHPK

SEQ ID NO: 438186 - protein, 9 aa, Mycobacterium
ATDPDTHPK

SEQ ID NO: 438187 - protein, 6 aa, Mycobacterium
ATDPEQ

SEQ ID NO: 438188 - protein, 22 aa, Mycobacterium
ATDPGERNPRPARRPRRRPRTA

SEQ ID NO: 438189 - protein, 8 aa, Mycobacterium
ATDPGRRL

SEQ ID NO: 438190 - protein, 5 aa, Mycobacterium
ATDPL

SEQ ID NO: 438191 - protein, 15 aa, Mycobacterium
ATDPLRSSARNRADG

SEQ ID NO: 438192 - protein, 8 aa, Mycobacterium
ATDPLTAQ

SEQ ID NO: 438193 - protein, 10 aa, Mycobacterium
ATDPNSRQTG

SEQ ID NO: 438194 - protein, 13 aa, Mycobacterium
ATDPNTGESLSDQ

SEQ ID NO: 438195 - protein, 10 aa, Mycobacterium
ATDPPPGKER

SEQ ID NO: 438196 - protein, 10 aa, Mycobacterium
ATDPPPGRER

SEQ ID NO: 438197 - protein, 6 aa, Mycobacterium
ATDPQV

SEQ ID NO: 438198 - protein, 7 aa, Mycobacterium
ATDPQVR

SEQ ID NO: 438199 - protein, 6 aa, Mycobacterium
ATDPRA

SEQ ID NO: 438200 - protein, 8 aa, Mycobacterium
ATDPRHPF

SEQ ID NO: 438201 - protein, 6 aa, Mycobacterium
ATDPRV

SEQ ID NO: 438202 - protein, 10 aa, Mycobacterium
ATDPSPQAQV

SEQ ID NO: 438203 - protein, 6 aa, Mycobacterium
ATDQGR

SEQ ID NO: 438204 - protein, 6 aa, Mycobacterium
ATDQIR

SEQ ID NO: 438205 - protein, 10 aa, Mycobacterium
ATDQPRRAGV

SEQ ID NO: 438206 - protein, 17 aa, Mycobacterium
ATDQSDSILGYYGTTRK

SEQ ID NO: 438207 - protein, 4 aa, Mycobacterium
ATDR

SEQ ID NO: 438208 - protein, 9 aa, Mycobacterium
ATDRAAVPH

SEQ ID NO: 438209 - protein, 6 aa, Mycobacterium
ATDRAE

SEQ ID NO: 438210 - protein, 13 aa, Mycobacterium
ATDRATRGDETES

SEQ ID NO: 438211 - protein, 11 aa, Mycobacterium
ATDRDDEEDVV

SEQ ID NO: 438212 - protein, 9 aa, Mycobacterium
ATDRDVDRA

SEQ ID NO: 438213 - protein, 10 aa, Mycobacterium
ATDREAEGQR

SEQ ID NO: 438214 - protein, 5 aa, Mycobacterium
ATDRK

SEQ ID NO: 438215 - protein, 13 aa, Mycobacterium
ATDRPRSASPTYH

SEQ ID NO: 438216 - protein, 8 aa, Mycobacterium
ATDRPSPF

SEQ ID NO: 438217 - protein, 6 aa, Mycobacterium
ATDRRA

SEQ ID NO: 438218 - protein, 8 aa, Mycobacterium
ATDRRGGT

SEQ ID NO: 438219 - protein, 5 aa, Mycobacterium
ATDRS

SEQ ID NO: 438220 - protein, 5 aa, Mycobacterium
ATDRT

SEQ ID NO: 438221 - protein, 7 aa, Mycobacterium
ATDSDDA

SEQ ID NO: 438222 - protein, 11 aa, Mycobacterium
ATDSDLDGRFG

SEQ ID NO: 438223 - protein, 9 aa, Mycobacterium
ATDSEDWPR

SEQ ID NO: 438224 - protein, 8 aa, Mycobacterium
ATDSGGRV

SEQ ID NO: 438225 - protein, 6 aa, Mycobacterium
ATDSKV

SEQ ID NO: 438226 - protein, 8 aa, Mycobacterium
ATDSPVGQ

SEQ ID NO: 438227 - protein, 8 aa, Mycobacterium
ATDSTDAD

SEQ ID NO: 438228 - protein, 6 aa, Mycobacterium
ATDSVG

SEQ ID NO: 438229 - protein, 5 aa, Mycobacterium
ATDTA

SEQ ID NO: 438230 - protein, 6 aa, Mycobacterium
ATDTAA

SEQ ID NO: 438231 - protein, 9 aa, Mycobacterium
ATDTAPRFT

SEQ ID NO: 438232 - protein, 21 aa, Mycobacterium
ATDTARTAGPARKSGSTYGTG

SEQ ID NO: 438233 - protein, 19 aa, Mycobacterium
ATDTDEQLANSAGRPIPGS

SEQ ID NO: 438234 - protein, 6 aa, Mycobacterium
ATDTDH

SEQ ID NO: 438235 - protein, 11 aa, Mycobacterium
ATDTFGAEPDE

SEQ ID NO: 438236 - protein, 5 aa, Mycobacterium
ATDTP

SEQ ID NO: 438237 - protein, 8 aa, Mycobacterium
ATDTPAQG

SEQ ID NO: 438238 - protein, 5 aa, Mycobacterium
ATDTQ

SEQ ID NO: 438239 - protein, 7 aa, Mycobacterium
ATDTSGR

SEQ ID NO: 438240 - protein, 14 aa, Mycobacterium
ATDTTCHPKPVGQA

SEQ ID NO: 438241 - protein, 8 aa, Mycobacterium
ATDVDGHH

SEQ ID NO: 438242 - protein, 20 aa, Mycobacterium
ATDVGPRSTVPGASYQPDAG

SEQ ID NO: 438243 - protein, 17 aa, Mycobacterium
ATDVPAAEKADRANPDH

SEQ ID NO: 438244 - protein, 10 aa, Mycobacterium
ATDVPADPIA

SEQ ID NO: 438245 - protein, 7 aa, Mycobacterium
ATDVPAL

SEQ ID NO: 438246 - protein, 4 aa, Mycobacterium
ATDW

SEQ ID NO: 438247 - protein, 4 aa, Mycobacterium
ATDY

SEQ ID NO: 438248 - protein, 13 aa, Mycobacterium
ATDYREPQTETEQ

SEQ ID NO: 438249 - protein, 6 aa, Mycobacterium
ATDYSD

SEQ ID NO: 438250 - protein, 13 aa, Mycobacterium
ATEAAAALGDGSC

SEQ ID NO: 438251 - protein, 6 aa, Mycobacterium
ATEAAK

SEQ ID NO: 438252 - protein, 9 aa, Mycobacterium
ATEAARPDA

SEQ ID NO: 438253 - protein, 10 aa, Mycobacterium
ATEAARTDGI

SEQ ID NO: 438254 - protein, 6 aa, Mycobacterium
ATEAAV

SEQ ID NO: 438255 - protein, 5 aa, Mycobacterium
ATEAD

SEQ ID NO: 438256 - protein, 8 aa, Mycobacterium
ATEADAPN

SEQ ID NO: 438257 - protein, 5 aa, Mycobacterium
ATEAE

SEQ ID NO: 438258 - protein, 11 aa, Mycobacterium
ATEAEKNGEPV

SEQ ID NO: 438259 - protein, 9 aa, Mycobacterium
ATEAFDGSA

SEQ ID NO: 438260 - protein, 8 aa, Mycobacterium
ATEAGADI

SEQ ID NO: 438261 - protein, 14 aa, Mycobacterium
ATEAGASEKTLPRE

SEQ ID NO: 438262 - protein, 7 aa, Mycobacterium
ATEAGEG

SEQ ID NO: 438263 - protein, 10 aa, Mycobacterium
ATEAGPAAQP

SEQ ID NO: 438264 - protein, 7 aa, Mycobacterium
ATEAGVP

SEQ ID NO: 438265 - protein, 34 aa, Mycobacterium
ATEAIGTGRYQRSGERTVHRNGHRPKTVSTTAGD

SEQ ID NO: 438266 - protein, 8 aa, Mycobacterium
ATEANPAF

SEQ ID NO: 438267 - protein, 22 aa, Mycobacterium
ATEAPRTGLPRRTELRTDRQTT

SEQ ID NO: 438268 - protein, 8 aa, Mycobacterium
ATEASARS

SEQ ID NO: 438269 - protein, 10 aa, Mycobacterium
ATEASTSVRS

SEQ ID NO: 438270 - protein, 11 aa, Mycobacterium
ATEATRGRGAE

SEQ ID NO: 438271 - protein, 13 aa, Mycobacterium
ATEAVRPGARSTT

SEQ ID NO: 438272 - protein, 7 aa, Mycobacterium
ATEAVSR

SEQ ID NO: 438273 - protein, 15 aa, Mycobacterium
ATEDAGFQSSQDALR

SEQ ID NO: 438274 - protein, 11 aa, Mycobacterium
ATEDDLPDGEG

SEQ ID NO: 438275 - protein, 6 aa, Mycobacterium
ATEDDP

SEQ ID NO: 438276 - protein, 6 aa, Mycobacterium
ATEDEV

SEQ ID NO: 438277 - protein, 5 aa, Mycobacterium
ATEDG

SEQ ID NO: 438278 - protein, 7 aa, Mycobacterium
ATEDGVR

SEQ ID NO: 438279 - protein, 6 aa, Mycobacterium
ATEDTV

SEQ ID NO: 438280 - protein, 9 aa, Mycobacterium
ATEEDKTDE

SEQ ID NO: 438281 - protein, 11 aa, Mycobacterium
ATEEDRIGSRR

SEQ ID NO: 438282 - protein, 5 aa, Mycobacterium
ATEEF

SEQ ID NO: 438283 - protein, 14 aa, Mycobacterium
ATEEGKTRAEGIGE

SEQ ID NO: 438284 - protein, 12 aa, Mycobacterium
ATEELGASTSLE

SEQ ID NO: 438285 - protein, 6 aa, Mycobacterium
ATEEME

SEQ ID NO: 438286 - protein, 7 aa, Mycobacterium
ATEEPGR

SEQ ID NO: 438287 - protein, 10 aa, Mycobacterium
ATEEPTGEDD

SEQ ID NO: 438288 - protein, 6 aa, Mycobacterium
ATEEQL

SEQ ID NO: 438289 - protein, 6 aa, Mycobacterium
ATEETF

SEQ ID NO: 438290 - protein, 7 aa, Mycobacterium
ATEETTM

SEQ ID NO: 438291 - protein, 15 aa, Mycobacterium
ATEEVERITARLAAL

SEQ ID NO: 438292 - protein, 6 aa, Mycobacterium
ATEEVG

SEQ ID NO: 438293 - protein, 7 aa, Mycobacterium
ATEEVGQ

SEQ ID NO: 438294 - protein, 4 aa, Mycobacterium
ATEG

SEQ ID NO: 438295 - protein, 6 aa, Mycobacterium
ATEGAR

SEQ ID NO: 438296 - protein, 6 aa, Mycobacterium
ATEGAY

SEQ ID NO: 438297 - protein, 9 aa, Mycobacterium
ATEGDRREA

SEQ ID NO: 438298 - protein, 5 aa, Mycobacterium
ATEGF

SEQ ID NO: 438299 - protein, 6 aa, Mycobacterium
ATEGKL

SEQ ID NO: 438300 - protein, 6 aa, Mycobacterium
ATEGPG

SEQ ID NO: 438301 - protein, 9 aa, Mycobacterium
ATEGPSSVE

SEQ ID NO: 438302 - protein, 8 aa, Mycobacterium
ATEGRAQD

SEQ ID NO: 438303 - protein, 7 aa, Mycobacterium
ATEGRTA

SEQ ID NO: 438304 - protein, 7 aa, Mycobacterium
ATEGTEE

SEQ ID NO: 438305 - protein, 14 aa, Mycobacterium
ATEGVEEGTPPDQG

SEQ ID NO: 438306 - protein, 6 aa, Mycobacterium
ATEGVP

SEQ ID NO: 438307 - protein, 6 aa, Mycobacterium
ATEHKD

SEQ ID NO: 438308 - protein, 16 aa, Mycobacterium
ATEHPAGSSAAESLNS

SEQ ID NO: 438309 - protein, 6 aa, Mycobacterium
ATEHRS

SEQ ID NO: 438310 - protein, 4 aa, Mycobacterium
ATEI

SEQ ID NO: 438311 - protein, 5 aa, Mycobacterium
ATEIE

SEQ ID NO: 438312 - protein, 10 aa, Mycobacterium
ATEKALARSG

SEQ ID NO: 438313 - protein, 8 aa, Mycobacterium
ATEKRDLA

SEQ ID NO: 438314 - protein, 4 aa, Mycobacterium
ATEL

SEQ ID NO: 438315 - protein, 8 aa, Mycobacterium
ATELAGSV

SEQ ID NO: 438316 - protein, 6 aa, Mycobacterium
ATELDA

SEQ ID NO: 438317 - protein, 6 aa, Mycobacterium
ATELEA

SEQ ID NO: 438318 - protein, 13 aa, Mycobacterium
ATELETAKASEEL

SEQ ID NO: 438319 - protein, 9 aa, Mycobacterium
ATELGPQGV

SEQ ID NO: 438320 - protein, 8 aa, Mycobacterium
ATELTATR

SEQ ID NO: 438321 - protein, 7 aa, Mycobacterium
ATELTPD

SEQ ID NO: 438322 - protein, 6 aa, Mycobacterium
ATELTR

SEQ ID NO: 438323 - protein, 11 aa, Mycobacterium
ATEMDSNQPIA

SEQ ID NO: 438324 - protein, 4 aa, Mycobacterium
ATEN

SEQ ID NO: 438325 - protein, 7 aa, Mycobacterium
ATENPHP

SEQ ID NO: 438326 - protein, 18 aa, Mycobacterium
ATENQGVDRQAATPEDKL

SEQ ID NO: 438327 - protein, 9 aa, Mycobacterium
ATEPADKEA

SEQ ID NO: 438328 - protein, 6 aa, Mycobacterium
ATEPAE

SEQ ID NO: 438329 - protein, 7 aa, Mycobacterium
ATEPAVA

SEQ ID NO: 438330 - protein, 6 aa, Mycobacterium
ATEPEL

SEQ ID NO: 438331 - protein, 6 aa, Mycobacterium
ATEPEQ

SEQ ID NO: 438332 - protein, 13 aa, Mycobacterium
ATEPLDRLPADGA

SEQ ID NO: 438333 - protein, 6 aa, Mycobacterium
ATEPLS

SEQ ID NO: 438334 - protein, 18 aa, Mycobacterium
ATEPLTKTTIDRRKPGPH

SEQ ID NO: 438335 - protein, 19 aa, Mycobacterium
ATEPLTKTTIERRDPGPHD

SEQ ID NO: 438336 - protein, 19 aa, Mycobacterium
ATEPLTKTTIERRDPGPRD

SEQ ID NO: 438337 - protein, 19 aa, Mycobacterium
ATEPLTKTTITRRDPGPHD

SEQ ID NO: 438338 - protein, 17 aa, Mycobacterium
ATEPLTKTTITRREVGP

SEQ ID NO: 438339 - protein, 7 aa, Mycobacterium
ATEPSHH

SEQ ID NO: 438340 - protein, 7 aa, Mycobacterium
ATEPTGM

SEQ ID NO: 438341 - protein, 6 aa, Mycobacterium
ATEPTQ

SEQ ID NO: 438342 - protein, 8 aa, Mycobacterium
ATEPTSGD

SEQ ID NO: 438343 - protein, 9 aa, Mycobacterium
ATEPTSGDN

SEQ ID NO: 438344 - protein, 7 aa, Mycobacterium
ATEPVES

SEQ ID NO: 438345 - protein, 11 aa, Mycobacterium
ATEQDATTSGA

SEQ ID NO: 438346 - protein, 8 aa, Mycobacterium
ATEQFGDP

SEQ ID NO: 438347 - protein, 6 aa, Mycobacterium
ATEQGV

SEQ ID NO: 438348 - protein, 8 aa, Mycobacterium
ATEQHGTT

SEQ ID NO: 438349 - protein, 8 aa, Mycobacterium
ATEQISPG

SEQ ID NO: 438350 - protein, 9 aa, Mycobacterium
ATEQKGRRG

SEQ ID NO: 438351 - protein, 5 aa, Mycobacterium
ATEQL

SEQ ID NO: 438352 - protein, 7 aa, Mycobacterium
ATEQPAS

SEQ ID NO: 438353 - protein, 8 aa, Mycobacterium
ATEQPASR

SEQ ID NO: 438354 - protein, 10 aa, Mycobacterium
ATEQPLPDEL

SEQ ID NO: 438355 - protein, 9 aa, Mycobacterium
ATEQRANTA

SEQ ID NO: 438356 - protein, 7 aa, Mycobacterium
ATEQRLG

SEQ ID NO: 438357 - protein, 10 aa, Mycobacterium
ATEQRSSKAQ

SEQ ID NO: 438358 - protein, 16 aa, Mycobacterium
ATERAHQAGANNVEER

SEQ ID NO: 438359 - protein, 13 aa, Mycobacterium
ATERARLDGQSER

SEQ ID NO: 438360 - protein, 7 aa, Mycobacterium
ATEREPH

SEQ ID NO: 438361 - protein, 14 aa, Mycobacterium
ATEREPSSHADAAE

SEQ ID NO: 438362 - protein, 6 aa, Mycobacterium
ATERGA

SEQ ID NO: 438363 - protein, 13 aa, Mycobacterium
ATERGLRAPDPGV

SEQ ID NO: 438364 - protein, 5 aa, Mycobacterium
ATERI

SEQ ID NO: 438365 - protein, 5 aa, Mycobacterium
ATERL

SEQ ID NO: 438366 - protein, 14 aa, Mycobacterium
ATERRPVPSTGLRK

SEQ ID NO: 438367 - protein, 13 aa, Mycobacterium
ATERVRNIPEPEG

SEQ ID NO: 438368 - protein, 4 aa, Mycobacterium
ATES

SEQ ID NO: 438369 - protein, 5 aa, Mycobacterium
ATESA

SEQ ID NO: 438370 - protein, 6 aa, Mycobacterium
ATESAY

SEQ ID NO: 438371 - protein, 6 aa, Mycobacterium
ATESCT

SEQ ID NO: 438372 - protein, 6 aa, Mycobacterium
ATESDL

SEQ ID NO: 438373 - protein, 6 aa, Mycobacterium
ATESEA

SEQ ID NO: 438374 - protein, 15 aa, Mycobacterium
ATESEDANSLAPLEG

SEQ ID NO: 438375 - protein, 6 aa, Mycobacterium
ATESEQ

SEQ ID NO: 438376 - protein, 11 aa, Mycobacterium
ATESHAAGGLG

SEQ ID NO: 438377 - protein, 9 aa, Mycobacterium
ATESHPAFS

SEQ ID NO: 438378 - protein, 7 aa, Mycobacterium
ATESHSA

SEQ ID NO: 438379 - protein, 5 aa, Mycobacterium
ATESL

SEQ ID NO: 438380 - protein, 7 aa, Mycobacterium
ATESLDG

SEQ ID NO: 438381 - protein, 10 aa, Mycobacterium
ATESNPTAAQ

SEQ ID NO: 438382 - protein, 9 aa, Mycobacterium
ATESSVSKR

SEQ ID NO: 438383 - protein, 8 aa, Mycobacterium
ATETADVT

SEQ ID NO: 438384 - protein, 8 aa, Mycobacterium
ATETAEGL

SEQ ID NO: 438385 - protein, 17 aa, Mycobacterium
ATETALKERKESVEDAV

SEQ ID NO: 438386 - protein, 8 aa, Mycobacterium
ATETARPD

SEQ ID NO: 438387 - protein, 6 aa, Mycobacterium
ATETEQ

SEQ ID NO: 438388 - protein, 7 aa, Mycobacterium
ATETERI

SEQ ID NO: 438389 - protein, 9 aa, Mycobacterium
ATETGKPVR

SEQ ID NO: 438390 - protein, 10 aa, Mycobacterium
ATETGRNNFG

SEQ ID NO: 438391 - protein, 9 aa, Mycobacterium
ATETGTPVT

SEQ ID NO: 438392 - protein, 20 aa, Mycobacterium
ATETIAAGAAGAAVTSNAVG

SEQ ID NO: 438393 - protein, 16 aa, Mycobacterium
ATETLDEEHADSETAA

SEQ ID NO: 438394 - protein, 17 aa, Mycobacterium
ATETLEEEHSESEAASL

SEQ ID NO: 438395 - protein, 8 aa, Mycobacterium
ATETQVRQ

SEQ ID NO: 438396 - protein, 5 aa, Mycobacterium
ATETR

SEQ ID NO: 438397 - protein, 21 aa, Mycobacterium
ATETRKAAEATGATYEPHPAE

SEQ ID NO: 438398 - protein, 16 aa, Mycobacterium
ATETRKATEAAGGTHV

SEQ ID NO: 438399 - protein, 8 aa, Mycobacterium
ATETSTSG

SEQ ID NO: 438400 - protein, 4 aa, Mycobacterium
ATEV

SEQ ID NO: 438401 - protein, 6 aa, Mycobacterium
ATEVAD

SEQ ID NO: 438402 - protein, 17 aa, Mycobacterium
ATEVADAAKPGRRGTAA

SEQ ID NO: 438403 - protein, 11 aa, Mycobacterium
ATEVDDAAKPD

SEQ ID NO: 438404 - protein, 7 aa, Mycobacterium
ATEVPDA

SEQ ID NO: 438405 - protein, 15 aa, Mycobacterium
ATEVTPGLESPTIAP

SEQ ID NO: 438406 - protein, 5 aa, Mycobacterium
ATEWT

SEQ ID NO: 438407 - protein, 5 aa, Mycobacterium
ATEYG

SEQ ID NO: 438408 - protein, 6 aa, Mycobacterium
ATEYGS

SEQ ID NO: 438409 - protein, 6 aa, Mycobacterium
ATEYPG

SEQ ID NO: 438410 - protein, 6 aa, Mycobacterium
ATEYTE

SEQ ID NO: 438411 - protein, 9 aa, Mycobacterium
ATEYTTTDW

SEQ ID NO: 438412 - protein, 5 aa, Mycobacterium
ATEYV

SEQ ID NO: 438413 - protein, 4 aa, Mycobacterium
ATFA

SEQ ID NO: 438414 - protein, 12 aa, Mycobacterium
ATFASGGGGHDA

SEQ ID NO: 438415 - protein, 10 aa, Mycobacterium
ATFASPPTVD

SEQ ID NO: 438416 - protein, 10 aa, Mycobacterium
ATFDGEPLQA

SEQ ID NO: 438417 - protein, 12 aa, Mycobacterium
ATFDPERKNARQ

SEQ ID NO: 438418 - protein, 18 aa, Mycobacterium
ATFGGPVETPAGDALAQE

SEQ ID NO: 438419 - protein, 10 aa, Mycobacterium
ATFPDGRLPE

SEQ ID NO: 438420 - protein, 11 aa, Mycobacterium
ATFPDGSIPDV

SEQ ID NO: 438421 - protein, 11 aa, Mycobacterium
ATFPDGSIPEV

SEQ ID NO: 438422 - protein, 11 aa, Mycobacterium
ATFPDGSRPEV

SEQ ID NO: 438423 - protein, 7 aa, Mycobacterium
ATFPGTK

SEQ ID NO: 438424 - protein, 11 aa, Mycobacterium
ATFRTQSPDNM

SEQ ID NO: 438425 - protein, 12 aa, Mycobacterium
ATFSDDAAKEAA

SEQ ID NO: 438426 - protein, 10 aa, Mycobacterium
ATFSDEAARA

SEQ ID NO: 438427 - protein, 11 aa, Mycobacterium
ATFSGSDEAQI

SEQ ID NO: 438428 - protein, 26 aa, Mycobacterium
ATFSSTSSFTATPAGDGLSVDGQARS

SEQ ID NO: 438429 - protein, 12 aa, Mycobacterium
ATFTDEAAKAAA

SEQ ID NO: 438430 - protein, 10 aa, Mycobacterium
ATFTDEAAQA

SEQ ID NO: 438431 - protein, 6 aa, Mycobacterium
ATFTPG

SEQ ID NO: 438432 - protein, 14 aa, Mycobacterium
ATFTPGKPLGPGLD

SEQ ID NO: 438433 - protein, 15 aa, Mycobacterium
ATFTPGRKAGAGLDE

SEQ ID NO: 438434 - protein, 9 aa, Mycobacterium
ATFTPGRRI

SEQ ID NO: 438435 - protein, 15 aa, Mycobacterium
ATFTPSRPLGPGLDE

SEQ ID NO: 438436 - protein, 11 aa, Mycobacterium
ATGAAHPDHER

SEQ ID NO: 438437 - protein, 13 aa, Mycobacterium
ATGAASTTYTAGT

SEQ ID NO: 438438 - protein, 13 aa, Mycobacterium
ATGAATGHMATEG

SEQ ID NO: 438439 - protein, 7 aa, Mycobacterium
ATGADAI

SEQ ID NO: 438440 - protein, 8 aa, Mycobacterium
ATGADGKS

SEQ ID NO: 438441 - protein, 15 aa, Mycobacterium
ATGADGYDSRPTLSE

SEQ ID NO: 438442 - protein, 13 aa, Mycobacterium
ATGADLRDERAQD

SEQ ID NO: 438443 - protein, 14 aa, Mycobacterium
ATGADLRDPSAQDS

SEQ ID NO: 438444 - protein, 9 aa, Mycobacterium
ATGADTVKG

SEQ ID NO: 438445 - protein, 6 aa, Mycobacterium
ATGAES

SEQ ID NO: 438446 - protein, 7 aa, Mycobacterium
ATGAGAA

SEQ ID NO: 438447 - protein, 12 aa, Mycobacterium
ATGAGGAALGSP

SEQ ID NO: 438448 - protein, 10 aa, Mycobacterium
ATGAGTEQVR

SEQ ID NO: 438449 - protein, 5 aa, Mycobacterium
ATGAL

SEQ ID NO: 438450 - protein, 10 aa, Mycobacterium
ATGANPEGMR

SEQ ID NO: 438451 - protein, 19 aa, Mycobacterium
ATGANRAPMVAPPGSCPRS

SEQ ID NO: 438452 - protein, 10 aa, Mycobacterium
ATGAPAGQDV

SEQ ID NO: 438453 - protein, 9 aa, Mycobacterium
ATGAPEDVA

SEQ ID NO: 438454 - protein, 36 aa, Mycobacterium
ATGAPGAETAVKAAPAAPAAPAASAIPESADQAATA

SEQ ID NO: 438455 - protein, 12 aa, Mycobacterium
ATGAPKPARADD

SEQ ID NO: 438456 - protein, 7 aa, Mycobacterium
ATGAPLG

SEQ ID NO: 438457 - protein, 9 aa, Mycobacterium
ATGAPNATV

SEQ ID NO: 438458 - protein, 7 aa, Mycobacterium
ATGAPRT

SEQ ID NO: 438459 - protein, 9 aa, Mycobacterium
ATGAPSVAD

SEQ ID NO: 438460 - protein, 10 aa, Mycobacterium
ATGAPTAAHS

SEQ ID NO: 438461 - protein, 5 aa, Mycobacterium
ATGAQ

SEQ ID NO: 438462 - protein, 5 aa, Mycobacterium
ATGAR

SEQ ID NO: 438463 - protein, 6 aa, Mycobacterium
ATGARS

SEQ ID NO: 438464 - protein, 7 aa, Mycobacterium
ATGARSI

SEQ ID NO: 438465 - protein, 10 aa, Mycobacterium
ATGARTRPLP

SEQ ID NO: 438466 - protein, 5 aa, Mycobacterium
ATGAS

SEQ ID NO: 438467 - protein, 8 aa, Mycobacterium
ATGASADD

SEQ ID NO: 438468 - protein, 7 aa, Mycobacterium
ATGASSA

SEQ ID NO: 438469 - protein, 10 aa, Mycobacterium
ATGASVDAGE

SEQ ID NO: 438470 - protein, 7 aa, Mycobacterium
ATGASVT

SEQ ID NO: 438471 - protein, 8 aa, Mycobacterium
ATGATGKP

SEQ ID NO: 438472 - protein, 6 aa, Mycobacterium
ATGATH

SEQ ID NO: 438473 - protein, 6 aa, Mycobacterium
ATGATI

SEQ ID NO: 438474 - protein, 8 aa, Mycobacterium
ATGATIGG

SEQ ID NO: 438475 - protein, 5 aa, Mycobacterium
ATGAV

SEQ ID NO: 438476 - protein, 11 aa, Mycobacterium
ATGAVRPPDCA

SEQ ID NO: 438477 - protein, 15 aa, Mycobacterium
ATGAYNAATDKSTPL

SEQ ID NO: 438478 - protein, 4 aa, Mycobacterium
ATGC

SEQ ID NO: 438479 - protein, 7 aa, Mycobacterium
ATGCGSA

SEQ ID NO: 438480 - protein, 7 aa, Mycobacterium
ATGCGTA

SEQ ID NO: 438481 - protein, 10 aa, Mycobacterium
ATGDAPPLRP

SEQ ID NO: 438482 - protein, 11 aa, Mycobacterium
ATGDAYRQTTY

SEQ ID NO: 438483 - protein, 5 aa, Mycobacterium
ATGDD

SEQ ID NO: 438484 - protein, 6 aa, Mycobacterium
ATGDDK

SEQ ID NO: 438485 - protein, 5 aa, Mycobacterium
ATGDF

SEQ ID NO: 438486 - protein, 6 aa, Mycobacterium
ATGDFP

SEQ ID NO: 438487 - protein, 5 aa, Mycobacterium
ATGDG

SEQ ID NO: 438488 - protein, 12 aa, Mycobacterium
ATGDGARRSKTE

SEQ ID NO: 438489 - protein, 9 aa, Mycobacterium
ATGDGYRHT

SEQ ID NO: 438490 - protein, 6 aa, Mycobacterium
ATGDHN

SEQ ID NO: 438491 - protein, 6 aa, Mycobacterium
ATGDIR

SEQ ID NO: 438492 - protein, 10 aa, Mycobacterium
ATGDKAAMPS

SEQ ID NO: 438493 - protein, 9 aa, Mycobacterium
ATGDKAAQV

SEQ ID NO: 438494 - protein, 5 aa, Mycobacterium
ATGDM

SEQ ID NO: 438495 - protein, 5 aa, Mycobacterium
ATGDP

SEQ ID NO: 438496 - protein, 6 aa, Mycobacterium
ATGDPA

SEQ ID NO: 438497 - protein, 8 aa, Mycobacterium
ATGDPDAF

SEQ ID NO: 438498 - protein, 6 aa, Mycobacterium
ATGDPE

SEQ ID NO: 438499 - protein, 8 aa, Mycobacterium
ATGDPQLH

SEQ ID NO: 438500 - protein, 9 aa, Mycobacterium
ATGDPQPGL

SEQ ID NO: 438501 - protein, 9 aa, Mycobacterium
ATGDPQPLR

SEQ ID NO: 438502 - protein, 6 aa, Mycobacterium
ATGDPV

SEQ ID NO: 438503 - protein, 10 aa, Mycobacterium
ATGDQAAMPS

SEQ ID NO: 438504 - protein, 10 aa, Mycobacterium
ATGDQSRAAP

SEQ ID NO: 438505 - protein, 33 aa, Mycobacterium
ATGDRSAHGASRNPWDPSRISGGSSGGSAVATA

SEQ ID NO: 438506 - protein, 10 aa, Mycobacterium
ATGDRTKNNA

SEQ ID NO: 438507 - protein, 11 aa, Mycobacterium
ATGDRTKNNAV

SEQ ID NO: 438508 - protein, 8 aa, Mycobacterium
ATGDTTKL

SEQ ID NO: 438509 - protein, 5 aa, Mycobacterium
ATGDY

SEQ ID NO: 438510 - protein, 11 aa, Mycobacterium
ATGDYQERDLR

SEQ ID NO: 438511 - protein, 11 aa, Mycobacterium
ATGEAVPPETD

SEQ ID NO: 438512 - protein, 7 aa, Mycobacterium
ATGEDAR

SEQ ID NO: 438513 - protein, 11 aa, Mycobacterium
ATGEEYPGKPL

SEQ ID NO: 438514 - protein, 9 aa, Mycobacterium
ATGEGKTLA

SEQ ID NO: 438515 - protein, 11 aa, Mycobacterium
ATGEGKTLSGA

SEQ ID NO: 438516 - protein, 8 aa, Mycobacterium
ATGEGQRR

SEQ ID NO: 438517 - protein, 7 aa, Mycobacterium
ATGEGRG

SEQ ID NO: 438518 - protein, 5 aa, Mycobacterium
ATGEI

SEQ ID NO: 438519 - protein, 7 aa, Mycobacterium
ATGEITG

SEQ ID NO: 438520 - protein, 6 aa, Mycobacterium
ATGELA

SEQ ID NO: 438521 - protein, 10 aa, Mycobacterium
ATGELAAQPP

SEQ ID NO: 438522 - protein, 10 aa, Mycobacterium
ATGEPAAGSR

SEQ ID NO: 438523 - protein, 11 aa, Mycobacterium
ATGEPAAGSRV

SEQ ID NO: 438524 - protein, 7 aa, Mycobacterium
ATGEPDS

SEQ ID NO: 438525 - protein, 7 aa, Mycobacterium
ATGEPTV

SEQ ID NO: 438526 - protein, 6 aa, Mycobacterium
ATGEPV

SEQ ID NO: 438527 - protein, 7 aa, Mycobacterium
ATGEPVA

SEQ ID NO: 438528 - protein, 8 aa, Mycobacterium
ATGEPVPE

SEQ ID NO: 438529 - protein, 5 aa, Mycobacterium
ATGEQ

SEQ ID NO: 438530 - protein, 11 aa, Mycobacterium
ATGERGGGDHC

SEQ ID NO: 438531 - protein, 6 aa, Mycobacterium
ATGERI

SEQ ID NO: 438532 - protein, 10 aa, Mycobacterium
ATGERTKTNA

SEQ ID NO: 438533 - protein, 13 aa, Mycobacterium
ATGERTRNNATRL

SEQ ID NO: 438534 - protein, 5 aa, Mycobacterium
ATGES

SEQ ID NO: 438535 - protein, 12 aa, Mycobacterium
ATGESDEHGPSA

SEQ ID NO: 438536 - protein, 6 aa, Mycobacterium
ATGESI

SEQ ID NO: 438537 - protein, 6 aa, Mycobacterium
ATGESR

SEQ ID NO: 438538 - protein, 6 aa, Mycobacterium
ATGETE

SEQ ID NO: 438539 - protein, 24 aa, Mycobacterium
ATGETGDSGVTGESTPAPESDSGS

SEQ ID NO: 438540 - protein, 5 aa, Mycobacterium
ATGEV

SEQ ID NO: 438541 - protein, 5 aa, Mycobacterium
ATGEY

SEQ ID NO: 438542 - protein, 4 aa, Mycobacterium
ATGF

SEQ ID NO: 438543 - protein, 5 aa, Mycobacterium
ATGFA

SEQ ID NO: 438544 - protein, 6 aa, Mycobacterium
ATGFER

SEQ ID NO: 438545 - protein, 7 aa, Mycobacterium
ATGGALP

SEQ ID NO: 438546 - protein, 28 aa, Mycobacterium
ATGGDGGDSGGGGAGGNGGAGGAGGHGS

SEQ ID NO: 438547 - protein, 9 aa, Mycobacterium
ATGGDPVTA

SEQ ID NO: 438548 - protein, 11 aa, Mycobacterium
ATGGDQGGSVR

SEQ ID NO: 438549 - protein, 8 aa, Mycobacterium
ATGGERGD

SEQ ID NO: 438550 - protein, 8 aa, Mycobacterium
ATGGGTLA

SEQ ID NO: 438551 - protein, 10 aa, Mycobacterium
ATGGGTPGRM

SEQ ID NO: 438552 - protein, 5 aa, Mycobacterium
ATGGI

SEQ ID NO: 438553 - protein, 6 aa, Mycobacterium
ATGGLN

SEQ ID NO: 438554 - protein, 6 aa, Mycobacterium
ATGGMS

SEQ ID NO: 438555 - protein, 6 aa, Mycobacterium
ATGGNV

SEQ ID NO: 438556 - protein, 5 aa, Mycobacterium
ATGGP

SEQ ID NO: 438557 - protein, 7 aa, Mycobacterium
ATGGPDV

SEQ ID NO: 438558 - protein, 7 aa, Mycobacterium
ATGGPFQ

SEQ ID NO: 438559 - protein, 7 aa, Mycobacterium
ATGGPRN

SEQ ID NO: 438560 - protein, 8 aa, Mycobacterium
ATGGPSAI

SEQ ID NO: 438561 - protein, 10 aa, Mycobacterium
ATGGPTTGAN

SEQ ID NO: 438562 - protein, 5 aa, Mycobacterium
ATGGR

SEQ ID NO: 438563 - protein, 7 aa, Mycobacterium
ATGGRAR

SEQ ID NO: 438564 - protein, 7 aa, Mycobacterium
ATGGREH

SEQ ID NO: 438565 - protein, 8 aa, Mycobacterium
ATGGRGAD

SEQ ID NO: 438566 - protein, 7 aa, Mycobacterium
ATGGRGV

SEQ ID NO: 438567 - protein, 7 aa, Mycobacterium
ATGGRVG

SEQ ID NO: 438568 - protein, 5 aa, Mycobacterium
ATGGS

SEQ ID NO: 438569 - protein, 12 aa, Mycobacterium
ATGGSNTTSTLS

SEQ ID NO: 438570 - protein, 12 aa, Mycobacterium
ATGGSSTPIGFD

SEQ ID NO: 438571 - protein, 8 aa, Mycobacterium
ATGGSTNH

SEQ ID NO: 438572 - protein, 5 aa, Mycobacterium
ATGGT

SEQ ID NO: 438573 - protein, 9 aa, Mycobacterium
ATGGTAGCR

SEQ ID NO: 438574 - protein, 6 aa, Mycobacterium
ATGGTY

SEQ ID NO: 438575 - protein, 7 aa, Mycobacterium
ATGGVGA

SEQ ID NO: 438576 - protein, 6 aa, Mycobacterium
ATGHDA

SEQ ID NO: 438577 - protein, 5 aa, Mycobacterium
ATGHG

SEQ ID NO: 438578 - protein, 11 aa, Mycobacterium
ATGHGAVGVGP

SEQ ID NO: 438579 - protein, 11 aa, Mycobacterium
ATGHGGSGAGW

SEQ ID NO: 438580 - protein, 5 aa, Mycobacterium
ATGHL

SEQ ID NO: 438581 - protein, 5 aa, Mycobacterium
ATGHN

SEQ ID NO: 438582 - protein, 6 aa, Mycobacterium
ATGHPV

SEQ ID NO: 438583 - protein, 6 aa, Mycobacterium
ATGHQD

SEQ ID NO: 438584 - protein, 5 aa, Mycobacterium
ATGHR

SEQ ID NO: 438585 - protein, 10 aa, Mycobacterium
ATGHRPAETR

SEQ ID NO: 438586 - protein, 12 aa, Mycobacterium
ATGHTGIRPQTA

SEQ ID NO: 438587 - protein, 4 aa, Mycobacterium
ATGI

SEQ ID NO: 438588 - protein, 8 aa, Mycobacterium
ATGIDDDD

SEQ ID NO: 438589 - protein, 5 aa, Mycobacterium
ATGIE

SEQ ID NO: 438590 - protein, 7 aa, Mycobacterium
ATGIEYQ

SEQ ID NO: 438591 - protein, 6 aa, Mycobacterium
ATGIGA

SEQ ID NO: 438592 - protein, 15 aa, Mycobacterium
ATGIGAATAARLAGE

SEQ ID NO: 438593 - protein, 17 aa, Mycobacterium
ATGIGAGTAKRLADEGA

SEQ ID NO: 438594 - protein, 9 aa, Mycobacterium
ATGIQDGPG

SEQ ID NO: 438595 - protein, 12 aa, Mycobacterium
ATGKIDEANSLA

SEQ ID NO: 438596 - protein, 6 aa, Mycobacterium
ATGKNL

SEQ ID NO: 438597 - protein, 6 aa, Mycobacterium
ATGKPF

SEQ ID NO: 438598 - protein, 8 aa, Mycobacterium
ATGKPVRV

SEQ ID NO: 438599 - protein, 6 aa, Mycobacterium
ATGKSA

SEQ ID NO: 438600 - protein, 7 aa, Mycobacterium
ATGKSGI

SEQ ID NO: 438601 - protein, 6 aa, Mycobacterium
ATGLAR

SEQ ID NO: 438602 - protein, 5 aa, Mycobacterium
ATGLD

SEQ ID NO: 438603 - protein, 7 aa, Mycobacterium
ATGLGDS

SEQ ID NO: 438604 - protein, 18 aa, Mycobacterium
ATGLIGDPRDTSERNLHG

SEQ ID NO: 438605 - protein, 8 aa, Mycobacterium
ATGLNPER

SEQ ID NO: 438606 - protein, 7 aa, Mycobacterium
ATGLPGV

SEQ ID NO: 438607 - protein, 7 aa, Mycobacterium
ATGLPTA

SEQ ID NO: 438608 - protein, 14 aa, Mycobacterium
ATGLPTVADDSGLE

SEQ ID NO: 438609 - protein, 7 aa, Mycobacterium
ATGLSGR

SEQ ID NO: 438610 - protein, 22 aa, Mycobacterium
ATGMIGDPRDTGERTMNTEDTV

SEQ ID NO: 438611 - protein, 17 aa, Mycobacterium
ATGMIGDPRDVGERTLN

SEQ ID NO: 438612 - protein, 7 aa, Mycobacterium
ATGMPAG

SEQ ID NO: 438613 - protein, 7 aa, Mycobacterium
ATGMPYG

SEQ ID NO: 438614 - protein, 5 aa, Mycobacterium
ATGMS

SEQ ID NO: 438615 - protein, 4 aa, Mycobacterium
ATGN

SEQ ID NO: 438616 - protein, 11 aa, Mycobacterium
ATGNDADADRH

SEQ ID NO: 438617 - protein, 13 aa, Mycobacterium
ATGNDADADRHGV

SEQ ID NO: 438618 - protein, 11 aa, Mycobacterium
ATGNDADSDRH

SEQ ID NO: 438619 - protein, 12 aa, Mycobacterium
ATGNDADSDRHG

SEQ ID NO: 438620 - protein, 7 aa, Mycobacterium
ATGNGHP

SEQ ID NO: 438621 - protein, 8 aa, Mycobacterium
ATGNGSAG

SEQ ID NO: 438622 - protein, 8 aa, Mycobacterium
ATGNGVGP

SEQ ID NO: 438623 - protein, 6 aa, Mycobacterium
ATGNKD

SEQ ID NO: 438624 - protein, 5 aa, Mycobacterium
ATGNN

SEQ ID NO: 438625 - protein, 7 aa, Mycobacterium
ATGNPTV

SEQ ID NO: 438626 - protein, 7 aa, Mycobacterium
ATGNSAS

SEQ ID NO: 438627 - protein, 7 aa, Mycobacterium
ATGNSDV

SEQ ID NO: 438628 - protein, 10 aa, Mycobacterium
ATGNSVATEI

SEQ ID NO: 438629 - protein, 8 aa, Mycobacterium
ATGNTTAS

SEQ ID NO: 438630 - protein, 8 aa, Mycobacterium
ATGNTTAT

SEQ ID NO: 438631 - protein, 9 aa, Mycobacterium
ATGNTTGKV

SEQ ID NO: 438632 - protein, 4 aa, Mycobacterium
ATGP

SEQ ID NO: 438633 - protein, 5 aa, Mycobacterium
ATGPA

SEQ ID NO: 438634 - protein, 16 aa, Mycobacterium
ATGPADTTGRASPAPI

SEQ ID NO: 438635 - protein, 7 aa, Mycobacterium
ATGPAGV

SEQ ID NO: 438636 - protein, 8 aa, Mycobacterium
ATGPDAPT

SEQ ID NO: 438637 - protein, 13 aa, Mycobacterium
ATGPDGEPRTVAR

SEQ ID NO: 438638 - protein, 8 aa, Mycobacterium
ATGPENGR

SEQ ID NO: 438639 - protein, 8 aa, Mycobacterium
ATGPESGR

SEQ ID NO: 438640 - protein, 7 aa, Mycobacterium
ATGPGLP

SEQ ID NO: 438641 - protein, 9 aa, Mycobacterium
ATGPGTTGA

SEQ ID NO: 438642 - protein, 15 aa, Mycobacterium
ATGPKGAGVAKRVGA

SEQ ID NO: 438643 - protein, 5 aa, Mycobacterium
ATGPL

SEQ ID NO: 438644 - protein, 63 aa, Mycobacterium
ATGPLADPLGSESPAVPDDPMGDDDADDAGPDEAGKIADAKEAGEAGEPGSGTGTDGTAAAMP

SEQ ID NO: 438645 - protein, 24 aa, Mycobacterium
ATGPLGLTADGSPASAGPAGEPNP

SEQ ID NO: 438646 - protein, 7 aa, Mycobacterium
ATGPLGR

SEQ ID NO: 438647 - protein, 14 aa, Mycobacterium
ATGPMEVIYERSYF

SEQ ID NO: 438648 - protein, 6 aa, Mycobacterium
ATGPNA

SEQ ID NO: 438649 - protein, 9 aa, Mycobacterium
ATGPPPPAL

SEQ ID NO: 438650 - protein, 7 aa, Mycobacterium
ATGPQRT

SEQ ID NO: 438651 - protein, 5 aa, Mycobacterium
ATGPR

SEQ ID NO: 438652 - protein, 6 aa, Mycobacterium
ATGPRA

SEQ ID NO: 438653 - protein, 7 aa, Mycobacterium
ATGPRAV

SEQ ID NO: 438654 - protein, 5 aa, Mycobacterium
ATGPT

SEQ ID NO: 438655 - protein, 7 aa, Mycobacterium
ATGPTGL

SEQ ID NO: 438656 - protein, 10 aa, Mycobacterium
ATGPTSTGQS

SEQ ID NO: 438657 - protein, 5 aa, Mycobacterium
ATGPV

SEQ ID NO: 438658 - protein, 7 aa, Mycobacterium
ATGQADA

SEQ ID NO: 438659 - protein, 11 aa, Mycobacterium
ATGQDGYDRRP

SEQ ID NO: 438660 - protein, 26 aa, Mycobacterium
ATGQPASGPTAALTGPGPVSATPRRR

SEQ ID NO: 438661 - protein, 6 aa, Mycobacterium
ATGQRM

SEQ ID NO: 438662 - protein, 11 aa, Mycobacterium
ATGQRPAETAL

SEQ ID NO: 438663 - protein, 7 aa, Mycobacterium
ATGQSEA

SEQ ID NO: 438664 - protein, 6 aa, Mycobacterium
ATGQSR

SEQ ID NO: 438665 - protein, 19 aa, Mycobacterium
ATGQTTVDGASVSGSNDGM

SEQ ID NO: 438666 - protein, 5 aa, Mycobacterium
ATGRA

SEQ ID NO: 438667 - protein, 9 aa, Mycobacterium
ATGRAAGVR

SEQ ID NO: 438668 - protein, 6 aa, Mycobacterium
ATGRAG

SEQ ID NO: 438669 - protein, 11 aa, Mycobacterium
ATGRAKRDPAL

SEQ ID NO: 438670 - protein, 12 aa, Mycobacterium
ATGRAKRNPALG

SEQ ID NO: 438671 - protein, 10 aa, Mycobacterium
ATGREEDVAD

SEQ ID NO: 438672 - protein, 8 aa, Mycobacterium
ATGRGNGH

SEQ ID NO: 438673 - protein, 10 aa, Mycobacterium
ATGRHGNTGE

SEQ ID NO: 438674 - protein, 6 aa, Mycobacterium
ATGRNI

SEQ ID NO: 438675 - protein, 6 aa, Mycobacterium
ATGRPA

SEQ ID NO: 438676 - protein, 7 aa, Mycobacterium
ATGRPAF

SEQ ID NO: 438677 - protein, 13 aa, Mycobacterium
ATGRPTAAATTPE

SEQ ID NO: 438678 - protein, 6 aa, Mycobacterium
ATGRPW

SEQ ID NO: 438679 - protein, 9 aa, Mycobacterium
ATGRRAGSR

SEQ ID NO: 438680 - protein, 7 aa, Mycobacterium
ATGRRRE

SEQ ID NO: 438681 - protein, 10 aa, Mycobacterium
ATGRSDFPNQ

SEQ ID NO: 438682 - protein, 6 aa, Mycobacterium
ATGRSI

SEQ ID NO: 438683 - protein, 18 aa, Mycobacterium
ATGRSKTDEALGPRSAEV

SEQ ID NO: 438684 - protein, 13 aa, Mycobacterium
ATGRSSDFAAAPA

SEQ ID NO: 438685 - protein, 6 aa, Mycobacterium
ATGRTD

SEQ ID NO: 438686 - protein, 7 aa, Mycobacterium
ATGRTDI

SEQ ID NO: 438687 - protein, 8 aa, Mycobacterium
ATGRTRDV

SEQ ID NO: 438688 - protein, 8 aa, Mycobacterium
ATGRTREY

SEQ ID NO: 438689 - protein, 7 aa, Mycobacterium
ATGRTRS

SEQ ID NO: 438690 - protein, 8 aa, Mycobacterium
ATGRVTPP

SEQ ID NO: 438691 - protein, 5 aa, Mycobacterium
ATGRY

SEQ ID NO: 438692 - protein, 7 aa, Mycobacterium
ATGSAAG

SEQ ID NO: 438693 - protein, 5 aa, Mycobacterium
ATGSD

SEQ ID NO: 438694 - protein, 7 aa, Mycobacterium
ATGSDEV

SEQ ID NO: 438695 - protein, 10 aa, Mycobacterium
ATGSDGETTF

SEQ ID NO: 438696 - protein, 7 aa, Mycobacterium
ATGSDHE

SEQ ID NO: 438697 - protein, 15 aa, Mycobacterium
ATGSFTAADETDTVE

SEQ ID NO: 438698 - protein, 11 aa, Mycobacterium
ATGSGADEHQR

SEQ ID NO: 438699 - protein, 11 aa, Mycobacterium
ATGSGADVPES

SEQ ID NO: 438700 - protein, 7 aa, Mycobacterium
ATGSHTA

SEQ ID NO: 438701 - protein, 14 aa, Mycobacterium
ATGSKDGKPNPASS

SEQ ID NO: 438702 - protein, 8 aa, Mycobacterium
ATGSLGSV

SEQ ID NO: 438703 - protein, 6 aa, Mycobacterium
ATGSNT

SEQ ID NO: 438704 - protein, 5 aa, Mycobacterium
ATGSP

SEQ ID NO: 438705 - protein, 8 aa, Mycobacterium
ATGSPAAV

SEQ ID NO: 438706 - protein, 13 aa, Mycobacterium
ATGSPDTGDPAWT

SEQ ID NO: 438707 - protein, 9 aa, Mycobacterium
ATGSPVGPQ

SEQ ID NO: 438708 - protein, 5 aa, Mycobacterium
ATGSR

SEQ ID NO: 438709 - protein, 12 aa, Mycobacterium
ATGSRTANAGPV

SEQ ID NO: 438710 - protein, 14 aa, Mycobacterium
ATGSRWRDIVEFAR

SEQ ID NO: 438711 - protein, 10 aa, Mycobacterium
ATGSSARVKQ

SEQ ID NO: 438712 - protein, 8 aa, Mycobacterium
ATGSSPDR

SEQ ID NO: 438713 - protein, 15 aa, Mycobacterium
ATGSSTRLVPGTSLS

SEQ ID NO: 438714 - protein, 9 aa, Mycobacterium
ATGSTKGQA

SEQ ID NO: 438715 - protein, 8 aa, Mycobacterium
ATGSTWTG

SEQ ID NO: 438716 - protein, 8 aa, Mycobacterium
ATGSVRPG

SEQ ID NO: 438717 - protein, 8 aa, Mycobacterium
ATGTAGSR

SEQ ID NO: 438718 - protein, 6 aa, Mycobacterium
ATGTAL

SEQ ID NO: 438719 - protein, 7 aa, Mycobacterium
ATGTASD

SEQ ID NO: 438720 - protein, 51 aa, Mycobacterium
ATGTATGGNGGAGGSGAVGGGHGGIGGSASSASATGDAIGGTGGDGGRGFG

SEQ ID NO: 438721 - protein, 6 aa, Mycobacterium
ATGTCT

SEQ ID NO: 438722 - protein, 7 aa, Mycobacterium
ATGTDFG

SEQ ID NO: 438723 - protein, 8 aa, Mycobacterium
ATGTDPAG

SEQ ID NO: 438724 - protein, 7 aa, Mycobacterium
ATGTDPE

SEQ ID NO: 438725 - protein, 7 aa, Mycobacterium
ATGTDTF

SEQ ID NO: 438726 - protein, 8 aa, Mycobacterium
ATGTEPYT

SEQ ID NO: 438727 - protein, 17 aa, Mycobacterium
ATGTGDARKIKSAAAAL

SEQ ID NO: 438728 - protein, 9 aa, Mycobacterium
ATGTGEGGI

SEQ ID NO: 438729 - protein, 13 aa, Mycobacterium
ATGTGISARDRAR

SEQ ID NO: 438730 - protein, 7 aa, Mycobacterium
ATGTIRA

SEQ ID NO: 438731 - protein, 7 aa, Mycobacterium
ATGTNPD

SEQ ID NO: 438732 - protein, 24 aa, Mycobacterium
ATGTNQDGRTSAITVPNGKAQEAL

SEQ ID NO: 438733 - protein, 7 aa, Mycobacterium
ATGTPAE

SEQ ID NO: 438734 - protein, 9 aa, Mycobacterium
ATGTPISNS

SEQ ID NO: 438735 - protein, 8 aa, Mycobacterium
ATGTPQLP

SEQ ID NO: 438736 - protein, 12 aa, Mycobacterium
ATGTPSGVGYAR

SEQ ID NO: 438737 - protein, 5 aa, Mycobacterium
ATGTR

SEQ ID NO: 438738 - protein, 7 aa, Mycobacterium
ATGTRGI

SEQ ID NO: 438739 - protein, 11 aa, Mycobacterium
ATGTSADSIGS

SEQ ID NO: 438740 - protein, 8 aa, Mycobacterium
ATGTSGYQ

SEQ ID NO: 438741 - protein, 13 aa, Mycobacterium
ATGTSTPRPSWRA

SEQ ID NO: 438742 - protein, 10 aa, Mycobacterium
ATGTSVETVS

SEQ ID NO: 438743 - protein, 30 aa, Mycobacterium
ATGVATGNTAIGGNGGAASANGAVGGNGGF

SEQ ID NO: 438744 - protein, 19 aa, Mycobacterium
ATGVDPDRGPGEAAAATQL

SEQ ID NO: 438745 - protein, 13 aa, Mycobacterium
ATGVGDRAAANAE

SEQ ID NO: 438746 - protein, 10 aa, Mycobacterium
ATGVGTTATL

SEQ ID NO: 438747 - protein, 13 aa, Mycobacterium
ATGVKDRAATNAE

SEQ ID NO: 438748 - protein, 10 aa, Mycobacterium
ATGVPRARRD

SEQ ID NO: 438749 - protein, 12 aa, Mycobacterium
ATGVPRKRRQPL

SEQ ID NO: 438750 - protein, 11 aa, Mycobacterium
ATGVPRQDRYP

SEQ ID NO: 438751 - protein, 7 aa, Mycobacterium
ATGVRRG

SEQ ID NO: 438752 - protein, 15 aa, Mycobacterium
ATGVRRPPRFVPTLS

SEQ ID NO: 438753 - protein, 5 aa, Mycobacterium
ATGVT

SEQ ID NO: 438754 - protein, 16 aa, Mycobacterium
ATGVTGVTDATPDLDA

SEQ ID NO: 438755 - protein, 32 aa, Mycobacterium
ATGVTGVTDATPDLDADDRASLAAAHGRGEFR

SEQ ID NO: 438756 - protein, 7 aa, Mycobacterium
ATGVTVT

SEQ ID NO: 438757 - protein, 6 aa, Mycobacterium
ATGYAK

SEQ ID NO: 438758 - protein, 8 aa, Mycobacterium
ATGYDRTY

SEQ ID NO: 438759 - protein, 5 aa, Mycobacterium
ATGYG

SEQ ID NO: 438760 - protein, 20 aa, Mycobacterium
ATGYGRLNPGVEDDFPGGPT

SEQ ID NO: 438761 - protein, 5 aa, Mycobacterium
ATGYL

SEQ ID NO: 438762 - protein, 10 aa, Mycobacterium
ATGYSNEAPK

SEQ ID NO: 438763 - protein, 12 aa, Mycobacterium
ATGYSRRSGLTA

SEQ ID NO: 438764 - protein, 8 aa, Mycobacterium
ATGYTTGR

SEQ ID NO: 438765 - protein, 12 aa, Mycobacterium
ATHAGDKEKATE

SEQ ID NO: 438766 - protein, 8 aa, Mycobacterium
ATHAGSGA

SEQ ID NO: 438767 - protein, 5 aa, Mycobacterium
ATHAP

SEQ ID NO: 438768 - protein, 90 aa, Mycobacterium
ATHDAADDAGDHAAHDDGPGDHDGRSDDRSPDHGRSDDRRSPADAAADPGADASTNPTGTNPTGTNPTADCGPTGAADGGSGSAAATRGW

SEQ ID NO: 438769 - protein, 7 aa, Mycobacterium
ATHDESA

SEQ ID NO: 438770 - protein, 10 aa, Mycobacterium
ATHEGSTPSH

SEQ ID NO: 438771 - protein, 4 aa, Mycobacterium
ATHG

SEQ ID NO: 438772 - protein, 13 aa, Mycobacterium
ATHGARGRNQDEL

SEQ ID NO: 438773 - protein, 10 aa, Mycobacterium
ATHGDDAKPF

SEQ ID NO: 438774 - protein, 21 aa, Mycobacterium
ATHGGYGHHSGAYGRDSYAGA

SEQ ID NO: 438775 - protein, 7 aa, Mycobacterium
ATHGRRT

SEQ ID NO: 438776 - protein, 10 aa, Mycobacterium
ATHHDSRVGG

SEQ ID NO: 438777 - protein, 5 aa, Mycobacterium
ATHHE

SEQ ID NO: 438778 - protein, 6 aa, Mycobacterium
ATHHRL

SEQ ID NO: 438779 - protein, 7 aa, Mycobacterium
ATHKDGH

SEQ ID NO: 438780 - protein, 6 aa, Mycobacterium
ATHPEV

SEQ ID NO: 438781 - protein, 7 aa, Mycobacterium
ATHPGVN

SEQ ID NO: 438782 - protein, 12 aa, Mycobacterium
ATHPNYPERHEP

SEQ ID NO: 438783 - protein, 5 aa, Mycobacterium
ATHPS

SEQ ID NO: 438784 - protein, 14 aa, Mycobacterium
ATHPSGVGGSSGHL

SEQ ID NO: 438785 - protein, 9 aa, Mycobacterium
ATHPTATPA

SEQ ID NO: 438786 - protein, 10 aa, Mycobacterium
ATHQQNLTGS

SEQ ID NO: 438787 - protein, 7 aa, Mycobacterium
ATHQTGA

SEQ ID NO: 438788 - protein, 15 aa, Mycobacterium
ATHRKTAPSAGASPE

SEQ ID NO: 438789 - protein, 8 aa, Mycobacterium
ATHRQKTV

SEQ ID NO: 438790 - protein, 9 aa, Mycobacterium
ATHRSATAT

SEQ ID NO: 438791 - protein, 7 aa, Mycobacterium
ATHRSGK

SEQ ID NO: 438792 - protein, 12 aa, Mycobacterium
ATHRTEGGRQIP

SEQ ID NO: 438793 - protein, 4 aa, Mycobacterium
ATHS

SEQ ID NO: 438794 - protein, 17 aa, Mycobacterium
ATHSDSGPDGPVSSEHD

SEQ ID NO: 438795 - protein, 7 aa, Mycobacterium
ATHSGFR

SEQ ID NO: 438796 - protein, 6 aa, Mycobacterium
ATHSPR

SEQ ID NO: 438797 - protein, 7 aa, Mycobacterium
ATHSPRN

SEQ ID NO: 438798 - protein, 13 aa, Mycobacterium
ATHSRSTVTGTAT

SEQ ID NO: 438799 - protein, 6 aa, Mycobacterium
ATHSRT

SEQ ID NO: 438800 - protein, 9 aa, Mycobacterium
ATHTAADWN

SEQ ID NO: 438801 - protein, 8 aa, Mycobacterium
ATHTAAPN

SEQ ID NO: 438802 - protein, 8 aa, Mycobacterium
ATHTPGPN

SEQ ID NO: 438803 - protein, 6 aa, Mycobacterium
ATHTPR

SEQ ID NO: 438804 - protein, 6 aa, Mycobacterium
ATHTPV

SEQ ID NO: 438805 - protein, 16 aa, Mycobacterium
ATHTSRPPHTPHGPEP

SEQ ID NO: 438806 - protein, 4 aa, Mycobacterium
ATIA

SEQ ID NO: 438807 - protein, 5 aa, Mycobacterium
ATIAA

SEQ ID NO: 438808 - protein, 18 aa, Mycobacterium
ATIAAGSALTGAAAQATF

SEQ ID NO: 438809 - protein, 6 aa, Mycobacterium
ATIAGA

SEQ ID NO: 438810 - protein, 6 aa, Mycobacterium
ATIAGK

SEQ ID NO: 438811 - protein, 8 aa, Mycobacterium
ATIAPGTQ

SEQ ID NO: 438812 - protein, 5 aa, Mycobacterium
ATIAT

SEQ ID NO: 438813 - protein, 5 aa, Mycobacterium
ATIDD

SEQ ID NO: 438814 - protein, 6 aa, Mycobacterium
ATIDGQ

SEQ ID NO: 438815 - protein, 10 aa, Mycobacterium
ATIDKTREQV

SEQ ID NO: 438816 - protein, 6 aa, Mycobacterium
ATIDNA

SEQ ID NO: 438817 - protein, 9 aa, Mycobacterium
ATIDQPDAR

SEQ ID NO: 438818 - protein, 4 aa, Mycobacterium
ATIE

SEQ ID NO: 438819 - protein, 5 aa, Mycobacterium
ATIEG

SEQ ID NO: 438820 - protein, 7 aa, Mycobacterium
ATIEGSR

SEQ ID NO: 438821 - protein, 4 aa, Mycobacterium
ATIG

SEQ ID NO: 438822 - protein, 7 aa, Mycobacterium
ATIGDGL

SEQ ID NO: 438823 - protein, 6 aa, Mycobacterium
ATIGGK

SEQ ID NO: 438824 - protein, 10 aa, Mycobacterium
ATIGGTTAVS

SEQ ID NO: 438825 - protein, 7 aa, Mycobacterium
ATIGPAD

SEQ ID NO: 438826 - protein, 5 aa, Mycobacterium
ATIGQ

SEQ ID NO: 438827 - protein, 12 aa, Mycobacterium
ATINGEPLSDMD

SEQ ID NO: 438828 - protein, 9 aa, Mycobacterium
ATINSGNVT

SEQ ID NO: 438829 - protein, 7 aa, Mycobacterium
ATIPDAE

SEQ ID NO: 438830 - protein, 7 aa, Mycobacterium
ATIPSSH

SEQ ID NO: 438831 - protein, 15 aa, Mycobacterium
ATIQPPGPLDGLPEA

SEQ ID NO: 438832 - protein, 12 aa, Mycobacterium
ATISAETSELAK

SEQ ID NO: 438833 - protein, 15 aa, Mycobacterium
ATISPGSLDHEQHQQ

SEQ ID NO: 438834 - protein, 22 aa, Mycobacterium
ATISPVRQPGGRGLEPHYRPSA

SEQ ID NO: 438835 - protein, 10 aa, Mycobacterium
ATITGSGSAV

SEQ ID NO: 438836 - protein, 15 aa, Mycobacterium
ATITNKKSQSPLPPG

SEQ ID NO: 438837 - protein, 8 aa, Mycobacterium
ATITPDHG

SEQ ID NO: 438838 - protein, 9 aa, Mycobacterium
ATITSPSGR

SEQ ID NO: 438839 - protein, 4 aa, Mycobacterium
ATKA

SEQ ID NO: 438840 - protein, 12 aa, Mycobacterium
ATKAADDAQRQA

SEQ ID NO: 438841 - protein, 8 aa, Mycobacterium
ATKAAVTS

SEQ ID NO: 438842 - protein, 8 aa, Mycobacterium
ATKADAVT

SEQ ID NO: 438843 - protein, 19 aa, Mycobacterium
ATKADTEAHRTPEYNVPTQ

SEQ ID NO: 438844 - protein, 11 aa, Mycobacterium
ATKAEIGEHDE

SEQ ID NO: 438845 - protein, 11 aa, Mycobacterium
ATKAELGDHDE

SEQ ID NO: 438846 - protein, 9 aa, Mycobacterium
ATKAETGKV

SEQ ID NO: 438847 - protein, 10 aa, Mycobacterium
ATKAGGAHPY

SEQ ID NO: 438848 - protein, 7 aa, Mycobacterium
ATKAGLP

SEQ ID NO: 438849 - protein, 6 aa, Mycobacterium
ATKAKA

SEQ ID NO: 438850 - protein, 5 aa, Mycobacterium
ATKAL

SEQ ID NO: 438851 - protein, 11 aa, Mycobacterium
ATKANADPRSL

SEQ ID NO: 438852 - protein, 18 aa, Mycobacterium
ATKANKALTIGPPDSDSV

SEQ ID NO: 438853 - protein, 9 aa, Mycobacterium
ATKAPIATE

SEQ ID NO: 438854 - protein, 5 aa, Mycobacterium
ATKAY

SEQ ID NO: 438855 - protein, 9 aa, Mycobacterium
ATKDGADPI

SEQ ID NO: 438856 - protein, 7 aa, Mycobacterium
ATKDLDE

SEQ ID NO: 438857 - protein, 11 aa, Mycobacterium
ATKEATTSPSV

SEQ ID NO: 438858 - protein, 10 aa, Mycobacterium
ATKEDGSKVE

SEQ ID NO: 438859 - protein, 10 aa, Mycobacterium
ATKEPEPSAS

SEQ ID NO: 438860 - protein, 10 aa, Mycobacterium
ATKEPVGPDD

SEQ ID NO: 438861 - protein, 10 aa, Mycobacterium
ATKESGDPVE

SEQ ID NO: 438862 - protein, 6 aa, Mycobacterium
ATKGAV

SEQ ID NO: 438863 - protein, 5 aa, Mycobacterium
ATKGF

SEQ ID NO: 438864 - protein, 16 aa, Mycobacterium
ATKGLDPDFGRGQSAY

SEQ ID NO: 438865 - protein, 8 aa, Mycobacterium
ATKGQADA

SEQ ID NO: 438866 - protein, 19 aa, Mycobacterium
ATKGQADAARVRELVMAAC

SEQ ID NO: 438867 - protein, 7 aa, Mycobacterium
ATKGRRS

SEQ ID NO: 438868 - protein, 10 aa, Mycobacterium
ATKGSADAAR

SEQ ID NO: 438869 - protein, 6 aa, Mycobacterium
ATKGTY

SEQ ID NO: 438870 - protein, 5 aa, Mycobacterium
ATKGV

SEQ ID NO: 438871 - protein, 12 aa, Mycobacterium
ATKGVQRATEKG

SEQ ID NO: 438872 - protein, 4 aa, Mycobacterium
ATKH

SEQ ID NO: 438873 - protein, 5 aa, Mycobacterium
ATKKA

SEQ ID NO: 438874 - protein, 9 aa, Mycobacterium
ATKKAGAGQ

SEQ ID NO: 438875 - protein, 5 aa, Mycobacterium
ATKLG

SEQ ID NO: 438876 - protein, 22 aa, Mycobacterium
ATKLGTRTRYESVSKARRLHLI

SEQ ID NO: 438877 - protein, 12 aa, Mycobacterium
ATKMPDSPVAGR

SEQ ID NO: 438878 - protein, 8 aa, Mycobacterium
ATKNNPGV

SEQ ID NO: 438879 - protein, 7 aa, Mycobacterium
ATKNPGR

SEQ ID NO: 438880 - protein, 7 aa, Mycobacterium
ATKNPRR

SEQ ID NO: 438881 - protein, 7 aa, Mycobacterium
ATKNPSR

SEQ ID NO: 438882 - protein, 4 aa, Mycobacterium
ATKP

SEQ ID NO: 438883 - protein, 14 aa, Mycobacterium
ATKPARTADPRGLS

SEQ ID NO: 438884 - protein, 6 aa, Mycobacterium
ATKPGA

SEQ ID NO: 438885 - protein, 11 aa, Mycobacterium
ATKPGPITSAA

SEQ ID NO: 438886 - protein, 5 aa, Mycobacterium
ATKPN

SEQ ID NO: 438887 - protein, 11 aa, Mycobacterium
ATKPPTATQGT

SEQ ID NO: 438888 - protein, 8 aa, Mycobacterium
ATKPPTVQ

SEQ ID NO: 438889 - protein, 8 aa, Mycobacterium
ATKPPTVR

SEQ ID NO: 438890 - protein, 7 aa, Mycobacterium
ATKPSNL

SEQ ID NO: 438891 - protein, 5 aa, Mycobacterium
ATKQE

SEQ ID NO: 438892 - protein, 9 aa, Mycobacterium
ATKQLPPGY

SEQ ID NO: 438893 - protein, 5 aa, Mycobacterium
ATKRA

SEQ ID NO: 438894 - protein, 7 aa, Mycobacterium
ATKRAGE

SEQ ID NO: 438895 - protein, 12 aa, Mycobacterium
ATKREVDAPEPL

SEQ ID NO: 438896 - protein, 9 aa, Mycobacterium
ATKRGRGRI

SEQ ID NO: 438897 - protein, 8 aa, Mycobacterium
ATKRHPAT

SEQ ID NO: 438898 - protein, 9 aa, Mycobacterium
ATKRTRRLD

SEQ ID NO: 438899 - protein, 4 aa, Mycobacterium
ATKS

SEQ ID NO: 438900 - protein, 10 aa, Mycobacterium
ATKSALSSFT

SEQ ID NO: 438901 - protein, 9 aa, Mycobacterium
ATKSLSGHS

SEQ ID NO: 438902 - protein, 6 aa, Mycobacterium
ATKSNG

SEQ ID NO: 438903 - protein, 10 aa, Mycobacterium
ATKSREKAAQ

SEQ ID NO: 438904 - protein, 10 aa, Mycobacterium
ATKSRSRDVK

SEQ ID NO: 438905 - protein, 14 aa, Mycobacterium
ATKSSEPQDVSQGR

SEQ ID NO: 438906 - protein, 7 aa, Mycobacterium
ATKSYTA

SEQ ID NO: 438907 - protein, 4 aa, Mycobacterium
ATKT

SEQ ID NO: 438908 - protein, 6 aa, Mycobacterium
ATKTDV

SEQ ID NO: 438909 - protein, 5 aa, Mycobacterium
ATKTP

SEQ ID NO: 438910 - protein, 6 aa, Mycobacterium
ATKTQH

SEQ ID NO: 438911 - protein, 8 aa, Mycobacterium
ATKTRERE

SEQ ID NO: 438912 - protein, 26 aa, Mycobacterium
ATLAAANTDLRTTNRSLRKAAGTARF

SEQ ID NO: 438913 - protein, 9 aa, Mycobacterium
ATLAADGDT

SEQ ID NO: 438914 - protein, 15 aa, Mycobacterium
ATLAAGGRRPATPEA

SEQ ID NO: 438915 - protein, 10 aa, Mycobacterium
ATLAAQPGLA

SEQ ID NO: 438916 - protein, 12 aa, Mycobacterium
ATLADNGDFAVV

SEQ ID NO: 438917 - protein, 16 aa, Mycobacterium
ATLADSGATPSADRRE

SEQ ID NO: 438918 - protein, 6 aa, Mycobacterium
ATLAES

SEQ ID NO: 438919 - protein, 17 aa, Mycobacterium
ATLAGNGVTPSADRREV

SEQ ID NO: 438920 - protein, 16 aa, Mycobacterium
ATLAGPGTKAEQRQQV

SEQ ID NO: 438921 - protein, 11 aa, Mycobacterium
ATLAGTSQTTL

SEQ ID NO: 438922 - protein, 6 aa, Mycobacterium
ATLAGY

SEQ ID NO: 438923 - protein, 12 aa, Mycobacterium
ATLAPGNGDLTG

SEQ ID NO: 438924 - protein, 5 aa, Mycobacterium
ATLAQ

SEQ ID NO: 438925 - protein, 17 aa, Mycobacterium
ATLARKEGRSEDAAEIE

SEQ ID NO: 438926 - protein, 11 aa, Mycobacterium
ATLARTATEAA

SEQ ID NO: 438927 - protein, 6 aa, Mycobacterium
ATLATD

SEQ ID NO: 438928 - protein, 4 aa, Mycobacterium
ATLD

SEQ ID NO: 438929 - protein, 12 aa, Mycobacterium
ATLDGDGGAPAW

SEQ ID NO: 438930 - protein, 6 aa, Mycobacterium
ATLDPA

SEQ ID NO: 438931 - protein, 6 aa, Mycobacterium
ATLDQS

SEQ ID NO: 438932 - protein, 14 aa, Mycobacterium
ATLDSGAGTASELR

SEQ ID NO: 438933 - protein, 7 aa, Mycobacterium
ATLEDAE

SEQ ID NO: 438934 - protein, 10 aa, Mycobacterium
ATLEPATEET

SEQ ID NO: 438935 - protein, 7 aa, Mycobacterium
ATLEPGR

SEQ ID NO: 438936 - protein, 15 aa, Mycobacterium
ATLETREAKHEPRSF

SEQ ID NO: 438937 - protein, 23 aa, Mycobacterium
ATLETREAKHEPRSLAEQRQTWR

SEQ ID NO: 438938 - protein, 17 aa, Mycobacterium
ATLETRQAKHEPRSLGE

SEQ ID NO: 438939 - protein, 4 aa, Mycobacterium
ATLG

SEQ ID NO: 438940 - protein, 7 aa, Mycobacterium
ATLGADQ

SEQ ID NO: 438941 - protein, 11 aa, Mycobacterium
ATLGDEHERRE

SEQ ID NO: 438942 - protein, 6 aa, Mycobacterium
ATLGDG

SEQ ID NO: 438943 - protein, 10 aa, Mycobacterium
ATLGDQHEKR

SEQ ID NO: 438944 - protein, 5 aa, Mycobacterium
ATLGE

SEQ ID NO: 438945 - protein, 12 aa, Mycobacterium
ATLGETEQATAQ

SEQ ID NO: 438946 - protein, 6 aa, Mycobacterium
ATLGGD

SEQ ID NO: 438947 - protein, 6 aa, Mycobacterium
ATLGLP

SEQ ID NO: 438948 - protein, 7 aa, Mycobacterium
ATLGNND

SEQ ID NO: 438949 - protein, 7 aa, Mycobacterium
ATLGNQD

SEQ ID NO: 438950 - protein, 14 aa, Mycobacterium
ATLGNQDHLTDPEF

SEQ ID NO: 438951 - protein, 6 aa, Mycobacterium
ATLGQA

SEQ ID NO: 438952 - protein, 9 aa, Mycobacterium
ATLGTGPNA

SEQ ID NO: 438953 - protein, 10 aa, Mycobacterium
ATLGTPPRRR

SEQ ID NO: 438954 - protein, 11 aa, Mycobacterium
ATLGTTPGWSG

SEQ ID NO: 438955 - protein, 4 aa, Mycobacterium
ATLH

SEQ ID NO: 438956 - protein, 11 aa, Mycobacterium
ATLNDSEPLTG

SEQ ID NO: 438957 - protein, 10 aa, Mycobacterium
ATLPEERSRE

SEQ ID NO: 438958 - protein, 5 aa, Mycobacterium
ATLPK

SEQ ID NO: 438959 - protein, 8 aa, Mycobacterium
ATLPPDPA

SEQ ID NO: 438960 - protein, 8 aa, Mycobacterium
ATLPSGAT

SEQ ID NO: 438961 - protein, 6 aa, Mycobacterium
ATLPTE

SEQ ID NO: 438962 - protein, 14 aa, Mycobacterium
ATLPTSGSTNPALT

SEQ ID NO: 438963 - protein, 5 aa, Mycobacterium
ATLQE

SEQ ID NO: 438964 - protein, 8 aa, Mycobacterium
ATLQEAED

SEQ ID NO: 438965 - protein, 9 aa, Mycobacterium
ATLQEQGVS

SEQ ID NO: 438966 - protein, 16 aa, Mycobacterium
ATLRATSKTKSGGLVE

SEQ ID NO: 438967 - protein, 8 aa, Mycobacterium
ATLREDDE

SEQ ID NO: 438968 - protein, 7 aa, Mycobacterium
ATLRTHG

SEQ ID NO: 438969 - protein, 12 aa, Mycobacterium
ATLSEGEPASAA

SEQ ID NO: 438970 - protein, 8 aa, Mycobacterium
ATLSETAR

SEQ ID NO: 438971 - protein, 10 aa, Mycobacterium
ATLSGGERRR

SEQ ID NO: 438972 - protein, 6 aa, Mycobacterium
ATLSGL

SEQ ID NO: 438973 - protein, 9 aa, Mycobacterium
ATLSPTSSV

SEQ ID NO: 438974 - protein, 6 aa, Mycobacterium
ATLSRE

SEQ ID NO: 438975 - protein, 11 aa, Mycobacterium
ATLTGDDLRPA

SEQ ID NO: 438976 - protein, 14 aa, Mycobacterium
ATLTGSEPAGQSVG

SEQ ID NO: 438977 - protein, 13 aa, Mycobacterium
ATLTGSEPAGRSV

SEQ ID NO: 438978 - protein, 7 aa, Mycobacterium
ATLTPGE

SEQ ID NO: 438979 - protein, 6 aa, Mycobacterium
ATLTPQ

SEQ ID NO: 438980 - protein, 10 aa, Mycobacterium
ATLTQTTDQV

SEQ ID NO: 438981 - protein, 15 aa, Mycobacterium
ATLTRGNPSGGTGTT

SEQ ID NO: 438982 - protein, 10 aa, Mycobacterium
ATLTSTLADR

SEQ ID NO: 438983 - protein, 16 aa, Mycobacterium
ATLTVDDPQHSHPAGS

SEQ ID NO: 438984 - protein, 13 aa, Mycobacterium
ATLVPDDADLASA

SEQ ID NO: 438985 - protein, 7 aa, Mycobacterium
ATMETRT

SEQ ID NO: 438986 - protein, 7 aa, Mycobacterium
ATMGPGV

SEQ ID NO: 438987 - protein, 8 aa, Mycobacterium
ATMGPGVP

SEQ ID NO: 438988 - protein, 8 aa, Mycobacterium
ATMNDGKP

SEQ ID NO: 438989 - protein, 4 aa, Mycobacterium
ATMP

SEQ ID NO: 438990 - protein, 6 aa, Mycobacterium
ATMPGG

SEQ ID NO: 438991 - protein, 6 aa, Mycobacterium
ATMPVP

SEQ ID NO: 438992 - protein, 7 aa, Mycobacterium
ATMPYGG

SEQ ID NO: 438993 - protein, 6 aa, Mycobacterium
ATMSKA

SEQ ID NO: 438994 - protein, 6 aa, Mycobacterium
ATMTVP

SEQ ID NO: 438995 - protein, 4 aa, Mycobacterium
ATNA

SEQ ID NO: 438996 - protein, 17 aa, Mycobacterium
ATNAAAEDDGASSERDE

SEQ ID NO: 438997 - protein, 6 aa, Mycobacterium
ATNAGD

SEQ ID NO: 438998 - protein, 11 aa, Mycobacterium
ATNAGHRELPR

SEQ ID NO: 438999 - protein, 7 aa, Mycobacterium
ATNAIAG

SEQ ID NO: 439000 - protein, 5 aa, Mycobacterium
ATNAV

SEQ ID NO: 439001 - protein, 12 aa, Mycobacterium
ATNCAAPDTGNM

SEQ ID NO: 439002 - protein, 4 aa, Mycobacterium
ATND

SEQ ID NO: 439003 - protein, 12 aa, Mycobacterium
ATNDDDGEIDPA

SEQ ID NO: 439004 - protein, 6 aa, Mycobacterium
ATNDPA

SEQ ID NO: 439005 - protein, 14 aa, Mycobacterium
ATNDPIEEHRKGQV

SEQ ID NO: 439006 - protein, 8 aa, Mycobacterium
ATNDPIPA

SEQ ID NO: 439007 - protein, 4 aa, Mycobacterium
ATNE

SEQ ID NO: 439008 - protein, 5 aa, Mycobacterium
ATNEG

SEQ ID NO: 439009 - protein, 8 aa, Mycobacterium
ATNEHGSD

SEQ ID NO: 439010 - protein, 16 aa, Mycobacterium
ATNEPGSVNGAVNEAA

SEQ ID NO: 439011 - protein, 6 aa, Mycobacterium
ATNEPK

SEQ ID NO: 439012 - protein, 5 aa, Mycobacterium
ATNEQ

SEQ ID NO: 439013 - protein, 6 aa, Mycobacterium
ATNEQL

SEQ ID NO: 439014 - protein, 4 aa, Mycobacterium
ATNG

SEQ ID NO: 439015 - protein, 8 aa, Mycobacterium
ATNGAQAL

SEQ ID NO: 439016 - protein, 5 aa, Mycobacterium
ATNGH

SEQ ID NO: 439017 - protein, 10 aa, Mycobacterium
ATNGHADPRP

SEQ ID NO: 439018 - protein, 9 aa, Mycobacterium
ATNGHNPRE

SEQ ID NO: 439019 - protein, 7 aa, Mycobacterium
ATNGIGK

SEQ ID NO: 439020 - protein, 5 aa, Mycobacterium
ATNGK

SEQ ID NO: 439021 - protein, 5 aa, Mycobacterium
ATNGL

SEQ ID NO: 439022 - protein, 7 aa, Mycobacterium
ATNGPAL

SEQ ID NO: 439023 - protein, 9 aa, Mycobacterium
ATNGPSGGR

SEQ ID NO: 439024 - protein, 6 aa, Mycobacterium
ATNGQQ

SEQ ID NO: 439025 - protein, 7 aa, Mycobacterium
ATNGVGL

SEQ ID NO: 439026 - protein, 9 aa, Mycobacterium
ATNGVGLGT

SEQ ID NO: 439027 - protein, 10 aa, Mycobacterium
ATNGVGLGTS

SEQ ID NO: 439028 - protein, 5 aa, Mycobacterium
ATNHK

SEQ ID NO: 439029 - protein, 7 aa, Mycobacterium
ATNHNTR

SEQ ID NO: 439030 - protein, 6 aa, Mycobacterium
ATNKDV

SEQ ID NO: 439031 - protein, 4 aa, Mycobacterium
ATNL

SEQ ID NO: 439032 - protein, 6 aa, Mycobacterium
ATNNTV

SEQ ID NO: 439033 - protein, 6 aa, Mycobacterium
ATNNVA

SEQ ID NO: 439034 - protein, 4 aa, Mycobacterium
ATNP

SEQ ID NO: 439035 - protein, 9 aa, Mycobacterium
ATNPADGKQ

SEQ ID NO: 439036 - protein, 11 aa, Mycobacterium
ATNPAGEALSP

SEQ ID NO: 439037 - protein, 10 aa, Mycobacterium
ATNPANGKPV

SEQ ID NO: 439038 - protein, 9 aa, Mycobacterium
ATNPANGQQ

SEQ ID NO: 439039 - protein, 6 aa, Mycobacterium
ATNPCG

SEQ ID NO: 439040 - protein, 7 aa, Mycobacterium
ATNPPLY

SEQ ID NO: 439041 - protein, 11 aa, Mycobacterium
ATNPPPGQPRL

SEQ ID NO: 439042 - protein, 7 aa, Mycobacterium
ATNPRAQ

SEQ ID NO: 439043 - protein, 10 aa, Mycobacterium
ATNPSPADRI

SEQ ID NO: 439044 - protein, 10 aa, Mycobacterium
ATNPTNGKPV

SEQ ID NO: 439045 - protein, 9 aa, Mycobacterium
ATNPVSGKP

SEQ ID NO: 439046 - protein, 5 aa, Mycobacterium
ATNQR

SEQ ID NO: 439047 - protein, 4 aa, Mycobacterium
ATNR

SEQ ID NO: 439048 - protein, 5 aa, Mycobacterium
ATNRE

SEQ ID NO: 439049 - protein, 5 aa, Mycobacterium
ATNRG

SEQ ID NO: 439050 - protein, 8 aa, Mycobacterium
ATNRGGDA

SEQ ID NO: 439051 - protein, 9 aa, Mycobacterium
ATNRKARHN

SEQ ID NO: 439052 - protein, 4 aa, Mycobacterium
ATNS

SEQ ID NO: 439053 - protein, 7 aa, Mycobacterium
ATNSESL

SEQ ID NO: 439054 - protein, 13 aa, Mycobacterium
ATNSGGGKPRPGN

SEQ ID NO: 439055 - protein, 5 aa, Mycobacterium
ATNSP

SEQ ID NO: 439056 - protein, 11 aa, Mycobacterium
ATNSPTAIRTT

SEQ ID NO: 439057 - protein, 6 aa, Mycobacterium
ATNSRG

SEQ ID NO: 439058 - protein, 13 aa, Mycobacterium
ATNSSGHRPRTGD

SEQ ID NO: 439059 - protein, 6 aa, Mycobacterium
ATNTAA

SEQ ID NO: 439060 - protein, 7 aa, Mycobacterium
ATNTAVT

SEQ ID NO: 439061 - protein, 6 aa, Mycobacterium
ATNTED

SEQ ID NO: 439062 - protein, 9 aa, Mycobacterium
ATNTGPDDV

SEQ ID NO: 439063 - protein, 13 aa, Mycobacterium
ATNTPSTERSRAE

SEQ ID NO: 439064 - protein, 47 aa, Mycobacterium
ATNTQTGLASDTCRTTGSKTGLAGDTGLASDARLTGKTGLTGKTGLT

SEQ ID NO: 439065 - protein, 7 aa, Mycobacterium
ATNTSRS

SEQ ID NO: 439066 - protein, 37 aa, Mycobacterium
ATNTVSATPGTDGTPGGAGVTGGNGGAGGSASQPVTS

SEQ ID NO: 439067 - protein, 5 aa, Mycobacterium
ATNVK

SEQ ID NO: 439068 - protein, 4 aa, Mycobacterium
ATNW

SEQ ID NO: 439069 - protein, 8 aa, Mycobacterium
ATNYSGPQ

SEQ ID NO: 439070 - protein, 5 aa, Mycobacterium
ATPAA

SEQ ID NO: 439071 - protein, 9 aa, Mycobacterium
ATPAADDTP

SEQ ID NO: 439072 - protein, 15 aa, Mycobacterium
ATPAAFKEESRGKAI

SEQ ID NO: 439073 - protein, 6 aa, Mycobacterium
ATPAAG

SEQ ID NO: 439074 - protein, 8 aa, Mycobacterium
ATPAAKPG

SEQ ID NO: 439075 - protein, 6 aa, Mycobacterium
ATPAAL

SEQ ID NO: 439076 - protein, 20 aa, Mycobacterium
ATPAALPAVQPDADTYVSAG

SEQ ID NO: 439077 - protein, 36 aa, Mycobacterium
ATPAAPPSDEAPLAPVASTAAVQTTPTPPQPLSPAA

SEQ ID NO: 439078 - protein, 21 aa, Mycobacterium
ATPADLRAAPDTAGKPAEGTE

SEQ ID NO: 439079 - protein, 21 aa, Mycobacterium
ATPADLRAAPDTAGRPAEGTE

SEQ ID NO: 439080 - protein, 21 aa, Mycobacterium
ATPADLRAAPDTAGRPAGGTE

SEQ ID NO: 439081 - protein, 17 aa, Mycobacterium
ATPADLREAPETVGKPV

SEQ ID NO: 439082 - protein, 12 aa, Mycobacterium
ATPAEASDESVI

SEQ ID NO: 439083 - protein, 7 aa, Mycobacterium
ATPAEAV

SEQ ID NO: 439084 - protein, 6 aa, Mycobacterium
ATPAEL

SEQ ID NO: 439085 - protein, 6 aa, Mycobacterium
ATPAGA

SEQ ID NO: 439086 - protein, 7 aa, Mycobacterium
ATPAGGQ

SEQ ID NO: 439087 - protein, 6 aa, Mycobacterium
ATPAGK

SEQ ID NO: 439088 - protein, 9 aa, Mycobacterium
ATPAGRAHP

SEQ ID NO: 439089 - protein, 9 aa, Mycobacterium
ATPAGREHP

SEQ ID NO: 439090 - protein, 10 aa, Mycobacterium
ATPAHEPRPA

SEQ ID NO: 439091 - protein, 14 aa, Mycobacterium
ATPAKAARLSKPQI

SEQ ID NO: 439092 - protein, 5 aa, Mycobacterium
ATPAL

SEQ ID NO: 439093 - protein, 10 aa, Mycobacterium
ATPALPDDTQ

SEQ ID NO: 439094 - protein, 6 aa, Mycobacterium
ATPALT

SEQ ID NO: 439095 - protein, 7 aa, Mycobacterium
ATPAPAR

SEQ ID NO: 439096 - protein, 10 aa, Mycobacterium
ATPAPDRKRT

SEQ ID NO: 439097 - protein, 7 aa, Mycobacterium
ATPAPHG

SEQ ID NO: 439098 - protein, 6 aa, Mycobacterium
ATPAPI

SEQ ID NO: 439099 - protein, 6 aa, Mycobacterium
ATPAPL

SEQ ID NO: 439100 - protein, 11 aa, Mycobacterium
ATPAPTIPSTS

SEQ ID NO: 439101 - protein, 9 aa, Mycobacterium
ATPAQADAA

SEQ ID NO: 439102 - protein, 5 aa, Mycobacterium
ATPAR

SEQ ID NO: 439103 - protein, 22 aa, Mycobacterium
ATPARLDAASTAETLDRDDAST

SEQ ID NO: 439104 - protein, 8 aa, Mycobacterium
ATPARQAV

SEQ ID NO: 439105 - protein, 28 aa, Mycobacterium
ATPASGDSSTIADQRQTNPALTQDEQSY

SEQ ID NO: 439106 - protein, 9 aa, Mycobacterium
ATPASPHFE

SEQ ID NO: 439107 - protein, 16 aa, Mycobacterium
ATPASVDSIPSSAMQE

SEQ ID NO: 439108 - protein, 6 aa, Mycobacterium
ATPATA

SEQ ID NO: 439109 - protein, 7 aa, Mycobacterium
ATPATER

SEQ ID NO: 439110 - protein, 6 aa, Mycobacterium
ATPATL

SEQ ID NO: 439111 - protein, 7 aa, Mycobacterium
ATPATLS

SEQ ID NO: 439112 - protein, 9 aa, Mycobacterium
ATPATPGRV

SEQ ID NO: 439113 - protein, 7 aa, Mycobacterium
ATPATRF

SEQ ID NO: 439114 - protein, 6 aa, Mycobacterium
ATPAVE

SEQ ID NO: 439115 - protein, 6 aa, Mycobacterium
ATPAVL

SEQ ID NO: 439116 - protein, 6 aa, Mycobacterium
ATPDAA

SEQ ID NO: 439117 - protein, 6 aa, Mycobacterium
ATPDAG

SEQ ID NO: 439118 - protein, 6 aa, Mycobacterium
ATPDAK

SEQ ID NO: 439119 - protein, 6 aa, Mycobacterium
ATPDAP

SEQ ID NO: 439120 - protein, 10 aa, Mycobacterium
ATPDASQQKD

SEQ ID NO: 439121 - protein, 6 aa, Mycobacterium
ATPDAT

SEQ ID NO: 439122 - protein, 9 aa, Mycobacterium
ATPDDVEGI

SEQ ID NO: 439123 - protein, 7 aa, Mycobacterium
ATPDDVR

SEQ ID NO: 439124 - protein, 5 aa, Mycobacterium
ATPDE

SEQ ID NO: 439125 - protein, 7 aa, Mycobacterium
ATPDEAT

SEQ ID NO: 439126 - protein, 6 aa, Mycobacterium
ATPDEL

SEQ ID NO: 439127 - protein, 7 aa, Mycobacterium
ATPDELE

SEQ ID NO: 439128 - protein, 16 aa, Mycobacterium
ATPDELEPIVAEYRAT

SEQ ID NO: 439129 - protein, 16 aa, Mycobacterium
ATPDELEPVIAAYRAG

SEQ ID NO: 439130 - protein, 6 aa, Mycobacterium
ATPDEV

SEQ ID NO: 439131 - protein, 7 aa, Mycobacterium
ATPDFTA

SEQ ID NO: 439132 - protein, 13 aa, Mycobacterium
ATPDGESTSTLGE

SEQ ID NO: 439133 - protein, 9 aa, Mycobacterium
ATPDGGTAD

SEQ ID NO: 439134 - protein, 6 aa, Mycobacterium
ATPDGK

SEQ ID NO: 439135 - protein, 9 aa, Mycobacterium
ATPDKRTTT

SEQ ID NO: 439136 - protein, 13 aa, Mycobacterium
ATPDMRPRRGLNG

SEQ ID NO: 439137 - protein, 9 aa, Mycobacterium
ATPDNPYYT

SEQ ID NO: 439138 - protein, 7 aa, Mycobacterium
ATPDPAE

SEQ ID NO: 439139 - protein, 14 aa, Mycobacterium
ATPDPSTVGASTQA

SEQ ID NO: 439140 - protein, 5 aa, Mycobacterium
ATPDQ

SEQ ID NO: 439141 - protein, 7 aa, Mycobacterium
ATPDTSI

SEQ ID NO: 439142 - protein, 7 aa, Mycobacterium
ATPDTTN

SEQ ID NO: 439143 - protein, 6 aa, Mycobacterium
ATPDVP

SEQ ID NO: 439144 - protein, 6 aa, Mycobacterium
ATPEAE

SEQ ID NO: 439145 - protein, 8 aa, Mycobacterium
ATPEDALP

SEQ ID NO: 439146 - protein, 9 aa, Mycobacterium
ATPEDALPA

SEQ ID NO: 439147 - protein, 6 aa, Mycobacterium
ATPEDF

SEQ ID NO: 439148 - protein, 6 aa, Mycobacterium
ATPEDL

SEQ ID NO: 439149 - protein, 11 aa, Mycobacterium
ATPEDLEETAR

SEQ ID NO: 439150 - protein, 7 aa, Mycobacterium
ATPEEAA

SEQ ID NO: 439151 - protein, 6 aa, Mycobacterium
ATPEEL

SEQ ID NO: 439152 - protein, 6 aa, Mycobacterium
ATPEEN

SEQ ID NO: 439153 - protein, 9 aa, Mycobacterium
ATPEGARLS

SEQ ID NO: 439154 - protein, 6 aa, Mycobacterium
ATPEGF

SEQ ID NO: 439155 - protein, 7 aa, Mycobacterium
ATPEGRV

SEQ ID NO: 439156 - protein, 10 aa, Mycobacterium
ATPEGSGPWP

SEQ ID NO: 439157 - protein, 12 aa, Mycobacterium
ATPEIASRRGAV

SEQ ID NO: 439158 - protein, 6 aa, Mycobacterium
ATPEKL

SEQ ID NO: 439159 - protein, 9 aa, Mycobacterium
ATPENRTGG

SEQ ID NO: 439160 - protein, 7 aa, Mycobacterium
ATPEPQA

SEQ ID NO: 439161 - protein, 13 aa, Mycobacterium
ATPEPVADAEHNE

SEQ ID NO: 439162 - protein, 9 aa, Mycobacterium
ATPERGDGV

SEQ ID NO: 439163 - protein, 13 aa, Mycobacterium
ATPERHLDPEGTQ

SEQ ID NO: 439164 - protein, 6 aa, Mycobacterium
ATPERL

SEQ ID NO: 439165 - protein, 17 aa, Mycobacterium
ATPERQPGRLARRGNHQ

SEQ ID NO: 439166 - protein, 14 aa, Mycobacterium
ATPERVRRAEATGF

SEQ ID NO: 439167 - protein, 8 aa, Mycobacterium
ATPESGQL

SEQ ID NO: 439168 - protein, 7 aa, Mycobacterium
ATPESGR

SEQ ID NO: 439169 - protein, 20 aa, Mycobacterium
ATPESQERQSARQQHTPAAQ

SEQ ID NO: 439170 - protein, 13 aa, Mycobacterium
ATPETRPSPTRVV

SEQ ID NO: 439171 - protein, 6 aa, Mycobacterium
ATPEVA

SEQ ID NO: 439172 - protein, 7 aa, Mycobacterium
ATPFRPK

SEQ ID NO: 439173 - protein, 8 aa, Mycobacterium
ATPGADER

SEQ ID NO: 439174 - protein, 6 aa, Mycobacterium
ATPGAQ

SEQ ID NO: 439175 - protein, 15 aa, Mycobacterium
ATPGATKADEHARRQ

SEQ ID NO: 439176 - protein, 7 aa, Mycobacterium
ATPGDPC

SEQ ID NO: 439177 - protein, 7 aa, Mycobacterium
ATPGDWR

SEQ ID NO: 439178 - protein, 7 aa, Mycobacterium
ATPGEIR

SEQ ID NO: 439179 - protein, 6 aa, Mycobacterium
ATPGEP

SEQ ID NO: 439180 - protein, 16 aa, Mycobacterium
ATPGFGNSTDAPSSGF

SEQ ID NO: 439181 - protein, 16 aa, Mycobacterium
ATPGFGNTTTNPSSGF

SEQ ID NO: 439182 - protein, 12 aa, Mycobacterium
ATPGGGSPRRAV

SEQ ID NO: 439183 - protein, 6 aa, Mycobacterium
ATPGGL

SEQ ID NO: 439184 - protein, 6 aa, Mycobacterium
ATPGHE

SEQ ID NO: 439185 - protein, 15 aa, Mycobacterium
ATPGHPNQVGPRKRP

SEQ ID NO: 439186 - protein, 7 aa, Mycobacterium
ATPGKGR

SEQ ID NO: 439187 - protein, 13 aa, Mycobacterium
ATPGKTSDPRGLS

SEQ ID NO: 439188 - protein, 5 aa, Mycobacterium
ATPGL

SEQ ID NO: 439189 - protein, 6 aa, Mycobacterium
ATPGNF

SEQ ID NO: 439190 - protein, 7 aa, Mycobacterium
ATPGNKA

SEQ ID NO: 439191 - protein, 14 aa, Mycobacterium
ATPGNYERSAAGGE

SEQ ID NO: 439192 - protein, 9 aa, Mycobacterium
ATPGPYEIS

SEQ ID NO: 439193 - protein, 9 aa, Mycobacterium
ATPGPYELS

SEQ ID NO: 439194 - protein, 15 aa, Mycobacterium
ATPGRNPGPATDHDQ

SEQ ID NO: 439195 - protein, 9 aa, Mycobacterium
ATPGSGKTR

SEQ ID NO: 439196 - protein, 8 aa, Mycobacterium
ATPGTAGA

SEQ ID NO: 439197 - protein, 8 aa, Mycobacterium
ATPGVDPW

SEQ ID NO: 439198 - protein, 5 aa, Mycobacterium
ATPGW

SEQ ID NO: 439199 - protein, 4 aa, Mycobacterium
ATPH

SEQ ID NO: 439200 - protein, 6 aa, Mycobacterium
ATPHAA

SEQ ID NO: 439201 - protein, 7 aa, Mycobacterium
ATPHAGE

SEQ ID NO: 439202 - protein, 37 aa, Mycobacterium
ATPHGRPRKPRQDAPDGPGAKATPLRGRPEGRALTPA

SEQ ID NO: 439203 - protein, 37 aa, Mycobacterium
ATPHGRPRKPRQDAPEGPGVKATPLRGRPEGRALTPA

SEQ ID NO: 439204 - protein, 5 aa, Mycobacterium
ATPHH

SEQ ID NO: 439205 - protein, 6 aa, Mycobacterium
ATPHNL

SEQ ID NO: 439206 - protein, 18 aa, Mycobacterium
ATPHPESAAPITGATEPC

SEQ ID NO: 439207 - protein, 16 aa, Mycobacterium
ATPHPESAAPVTGATG

SEQ ID NO: 439208 - protein, 15 aa, Mycobacterium
ATPHPSTSAAITGAT

SEQ ID NO: 439209 - protein, 9 aa, Mycobacterium
ATPHRNRLS

SEQ ID NO: 439210 - protein, 4 aa, Mycobacterium
ATPI

SEQ ID NO: 439211 - protein, 6 aa, Mycobacterium
ATPIDA

SEQ ID NO: 439212 - protein, 19 aa, Mycobacterium
ATPIPQGLTDAQAAAVTTA

SEQ ID NO: 439213 - protein, 5 aa, Mycobacterium
ATPIT

SEQ ID NO: 439214 - protein, 20 aa, Mycobacterium
ATPITGAGAAAPMTARGIPA

SEQ ID NO: 439215 - protein, 10 aa, Mycobacterium
ATPITPAEER

SEQ ID NO: 439216 - protein, 6 aa, Mycobacterium
ATPIYD

SEQ ID NO: 439217 - protein, 4 aa, Mycobacterium
ATPK

SEQ ID NO: 439218 - protein, 6 aa, Mycobacterium
ATPKGE

SEQ ID NO: 439219 - protein, 7 aa, Mycobacterium
ATPKQLR

SEQ ID NO: 439220 - protein, 15 aa, Mycobacterium
ATPKSEGDGADVRRN

SEQ ID NO: 439221 - protein, 6 aa, Mycobacterium
ATPLDP

SEQ ID NO: 439222 - protein, 5 aa, Mycobacterium
ATPLE

SEQ ID NO: 439223 - protein, 7 aa, Mycobacterium
ATPLGGD

SEQ ID NO: 439224 - protein, 8 aa, Mycobacterium
ATPLGGDS

SEQ ID NO: 439225 - protein, 7 aa, Mycobacterium
ATPLGGR

SEQ ID NO: 439226 - protein, 15 aa, Mycobacterium
ATPLGPGTDGRPRTA

SEQ ID NO: 439227 - protein, 9 aa, Mycobacterium
ATPLPAGNA

SEQ ID NO: 439228 - protein, 20 aa, Mycobacterium
ATPLTTLPTDEVPASGIPGI

SEQ ID NO: 439229 - protein, 20 aa, Mycobacterium
ATPLTTLPTDEVPASGIPGM

SEQ ID NO: 439230 - protein, 5 aa, Mycobacterium
ATPMP

SEQ ID NO: 439231 - protein, 4 aa, Mycobacterium
ATPN

SEQ ID NO: 439232 - protein, 6 aa, Mycobacterium
ATPNAT

SEQ ID NO: 439233 - protein, 8 aa, Mycobacterium
ATPNATSV

SEQ ID NO: 439234 - protein, 9 aa, Mycobacterium
ATPNEATAA

SEQ ID NO: 439235 - protein, 12 aa, Mycobacterium
ATPNGGAPRRAV

SEQ ID NO: 439236 - protein, 7 aa, Mycobacterium
ATPNGGQ

SEQ ID NO: 439237 - protein, 6 aa, Mycobacterium
ATPNGI

SEQ ID NO: 439238 - protein, 13 aa, Mycobacterium
ATPNRDARAAGEA

SEQ ID NO: 439239 - protein, 7 aa, Mycobacterium
ATPNRIA

SEQ ID NO: 439240 - protein, 7 aa, Mycobacterium
ATPPALP

SEQ ID NO: 439241 - protein, 9 aa, Mycobacterium
ATPPALPAV

SEQ ID NO: 439242 - protein, 14 aa, Mycobacterium
ATPPAPATPASEAT

SEQ ID NO: 439243 - protein, 11 aa, Mycobacterium
ATPPAPSERGA

SEQ ID NO: 439244 - protein, 8 aa, Mycobacterium
ATPPDADG

SEQ ID NO: 439245 - protein, 17 aa, Mycobacterium
ATPPEATLPTDDGGGTW

SEQ ID NO: 439246 - protein, 7 aa, Mycobacterium
ATPPGAG

SEQ ID NO: 439247 - protein, 8 aa, Mycobacterium
ATPPGGGV

SEQ ID NO: 439248 - protein, 8 aa, Mycobacterium
ATPPGPDG

SEQ ID NO: 439249 - protein, 8 aa, Mycobacterium
ATPPGPGV

SEQ ID NO: 439250 - protein, 6 aa, Mycobacterium
ATPPHP

SEQ ID NO: 439251 - protein, 6 aa, Mycobacterium
ATPPLE

SEQ ID NO: 439252 - protein, 6 aa, Mycobacterium
ATPPLT

SEQ ID NO: 439253 - protein, 10 aa, Mycobacterium
ATPPPGTDPW

SEQ ID NO: 439254 - protein, 19 aa, Mycobacterium
ATPPPLPAPRSTTDTYETA

SEQ ID NO: 439255 - protein, 10 aa, Mycobacterium
ATPPPPVPQP

SEQ ID NO: 439256 - protein, 29 aa, Mycobacterium
ATPPPQPLAPRVDPNAAPEAARVNPAPPL

SEQ ID NO: 439257 - protein, 7 aa, Mycobacterium
ATPPPRI

SEQ ID NO: 439258 - protein, 26 aa, Mycobacterium
ATPPPRPPKLHSSSESANQSQAVSAT

SEQ ID NO: 439259 - protein, 40 aa, Mycobacterium
ATPPPTGWQTPDMADAQSAIDGTSLPVASPADASGEATID

SEQ ID NO: 439260 - protein, 12 aa, Mycobacterium
ATPPPVRGGRQP

SEQ ID NO: 439261 - protein, 5 aa, Mycobacterium
ATPPQ

SEQ ID NO: 439262 - protein, 9 aa, Mycobacterium
ATPPSWRPD

SEQ ID NO: 439263 - protein, 11 aa, Mycobacterium
ATPPTRPRVSP

SEQ ID NO: 439264 - protein, 4 aa, Mycobacterium
ATPQ

SEQ ID NO: 439265 - protein, 10 aa, Mycobacterium
ATPQAEGGAF

SEQ ID NO: 439266 - protein, 7 aa, Mycobacterium
ATPQAEV

SEQ ID NO: 439267 - protein, 9 aa, Mycobacterium
ATPQEGRSL

SEQ ID NO: 439268 - protein, 17 aa, Mycobacterium
ATPQEGRSLGIDPETGH

SEQ ID NO: 439269 - protein, 9 aa, Mycobacterium
ATPQGDETI

SEQ ID NO: 439270 - protein, 18 aa, Mycobacterium
ATPQPASAAPITGGTEPC

SEQ ID NO: 439271 - protein, 11 aa, Mycobacterium
ATPQPATPSAV

SEQ ID NO: 439272 - protein, 6 aa, Mycobacterium
ATPQPD

SEQ ID NO: 439273 - protein, 6 aa, Mycobacterium
ATPQPV

SEQ ID NO: 439274 - protein, 6 aa, Mycobacterium
ATPQQG

SEQ ID NO: 439275 - protein, 9 aa, Mycobacterium
ATPQQLGAK

SEQ ID NO: 439276 - protein, 13 aa, Mycobacterium
ATPQSAPTPGAVT

SEQ ID NO: 439277 - protein, 8 aa, Mycobacterium
ATPQSTIS

SEQ ID NO: 439278 - protein, 4 aa, Mycobacterium
ATPR

SEQ ID NO: 439279 - protein, 5 aa, Mycobacterium
ATPRA

SEQ ID NO: 439280 - protein, 8 aa, Mycobacterium
ATPRDAND

SEQ ID NO: 439281 - protein, 21 aa, Mycobacterium
ATPRDLRAAPDTAGRPAEGTE

SEQ ID NO: 439282 - protein, 9 aa, Mycobacterium
ATPRDNHRK

SEQ ID NO: 439283 - protein, 6 aa, Mycobacterium
ATPRFP

SEQ ID NO: 439284 - protein, 7 aa, Mycobacterium
ATPRGGQ

SEQ ID NO: 439285 - protein, 5 aa, Mycobacterium
ATPRM

SEQ ID NO: 439286 - protein, 9 aa, Mycobacterium
ATPRNNHAS

SEQ ID NO: 439287 - protein, 7 aa, Mycobacterium
ATPRPGR

SEQ ID NO: 439288 - protein, 8 aa, Mycobacterium
ATPRPRSE

SEQ ID NO: 439289 - protein, 10 aa, Mycobacterium
ATPRRATAAE

SEQ ID NO: 439290 - protein, 13 aa, Mycobacterium
ATPRRQADLDTRT

SEQ ID NO: 439291 - protein, 7 aa, Mycobacterium
ATPRSLT

SEQ ID NO: 439292 - protein, 15 aa, Mycobacterium
ATPRSVGGGGADKVR

SEQ ID NO: 439293 - protein, 5 aa, Mycobacterium
ATPRT

SEQ ID NO: 439294 - protein, 9 aa, Mycobacterium
ATPSADAQA

SEQ ID NO: 439295 - protein, 12 aa, Mycobacterium
ATPSALDQQAKQ

SEQ ID NO: 439296 - protein, 15 aa, Mycobacterium
ATPSDPDARLRGGEA

SEQ ID NO: 439297 - protein, 12 aa, Mycobacterium
ATPSDPSGAARR

SEQ ID NO: 439298 - protein, 8 aa, Mycobacterium
ATPSDREV

SEQ ID NO: 439299 - protein, 8 aa, Mycobacterium
ATPSDTIY

SEQ ID NO: 439300 - protein, 7 aa, Mycobacterium
ATPSGGQ

SEQ ID NO: 439301 - protein, 7 aa, Mycobacterium
ATPSGGW

SEQ ID NO: 439302 - protein, 7 aa, Mycobacterium
ATPSGVA

SEQ ID NO: 439303 - protein, 10 aa, Mycobacterium
ATPSKTAQTA

SEQ ID NO: 439304 - protein, 9 aa, Mycobacterium
ATPSNSGYQ

SEQ ID NO: 439305 - protein, 7 aa, Mycobacterium
ATPSRGR

SEQ ID NO: 439306 - protein, 12 aa, Mycobacterium
ATPSRPVGAPPT

SEQ ID NO: 439307 - protein, 7 aa, Mycobacterium
ATPSRRP

SEQ ID NO: 439308 - protein, 7 aa, Mycobacterium
ATPSSGQ

SEQ ID NO: 439309 - protein, 6 aa, Mycobacterium
ATPSTE

SEQ ID NO: 439310 - protein, 6 aa, Mycobacterium
ATPSTL

SEQ ID NO: 439311 - protein, 9 aa, Mycobacterium
ATPSTPTTF

SEQ ID NO: 439312 - protein, 21 aa, Mycobacterium
ATPSTSSGVSAVGAQAGRVGA

SEQ ID NO: 439313 - protein, 7 aa, Mycobacterium
ATPTADL

SEQ ID NO: 439314 - protein, 11 aa, Mycobacterium
ATPTAGVDGAY

SEQ ID NO: 439315 - protein, 10 aa, Mycobacterium
ATPTDDAKTL

SEQ ID NO: 439316 - protein, 12 aa, Mycobacterium
ATPTDDSKTVGD

SEQ ID NO: 439317 - protein, 7 aa, Mycobacterium
ATPTEEI

SEQ ID NO: 439318 - protein, 7 aa, Mycobacterium
ATPTHQR

SEQ ID NO: 439319 - protein, 5 aa, Mycobacterium
ATPTI

SEQ ID NO: 439320 - protein, 6 aa, Mycobacterium
ATPTKA

SEQ ID NO: 439321 - protein, 12 aa, Mycobacterium
ATPTMKAAGRGS

SEQ ID NO: 439322 - protein, 7 aa, Mycobacterium
ATPTPDG

SEQ ID NO: 439323 - protein, 29 aa, Mycobacterium
ATPTPRRPDPTTTASPETRGRPIRPTQSD

SEQ ID NO: 439324 - protein, 8 aa, Mycobacterium
ATPTRPAL

SEQ ID NO: 439325 - protein, 8 aa, Mycobacterium
ATPTSSGK

SEQ ID NO: 439326 - protein, 8 aa, Mycobacterium
ATPTSSMA

SEQ ID NO: 439327 - protein, 5 aa, Mycobacterium
ATPTV

SEQ ID NO: 439328 - protein, 5 aa, Mycobacterium
ATPVA

SEQ ID NO: 439329 - protein, 17 aa, Mycobacterium
ATPVAANNSEDGPRERK

SEQ ID NO: 439330 - protein, 21 aa, Mycobacterium
ATPVASTPVGSTPAAPPRQSL

SEQ ID NO: 439331 - protein, 6 aa, Mycobacterium
ATPVDP

SEQ ID NO: 439332 - protein, 6 aa, Mycobacterium
ATPVGD

SEQ ID NO: 439333 - protein, 16 aa, Mycobacterium
ATPVGGPAPEMHEKKA

SEQ ID NO: 439334 - protein, 9 aa, Mycobacterium
ATPVGPGVD

SEQ ID NO: 439335 - protein, 5 aa, Mycobacterium
ATPVH

SEQ ID NO: 439336 - protein, 12 aa, Mycobacterium
ATPVKDAKSIGQ

SEQ ID NO: 439337 - protein, 5 aa, Mycobacterium
ATPVL

SEQ ID NO: 439338 - protein, 5 aa, Mycobacterium
ATPVP

SEQ ID NO: 439339 - protein, 9 aa, Mycobacterium
ATPVPDEAL

SEQ ID NO: 439340 - protein, 13 aa, Mycobacterium
ATPVSDSVEVTYD

SEQ ID NO: 439341 - protein, 11 aa, Mycobacterium
ATPVSGKDGIA

SEQ ID NO: 439342 - protein, 9 aa, Mycobacterium
ATPVSGKEA

SEQ ID NO: 439343 - protein, 22 aa, Mycobacterium
ATPVSVGPDRTGLVAPSPLCPE

SEQ ID NO: 439344 - protein, 6 aa, Mycobacterium
ATPVTG

SEQ ID NO: 439345 - protein, 7 aa, Mycobacterium
ATPVTPT

SEQ ID NO: 439346 - protein, 6 aa, Mycobacterium
ATPVTY

SEQ ID NO: 439347 - protein, 13 aa, Mycobacterium
ATPVTYRNSPPPL

SEQ ID NO: 439348 - protein, 18 aa, Mycobacterium
ATPVYGSGGFTSYDNGTL

SEQ ID NO: 439349 - protein, 12 aa, Mycobacterium
ATPWKRNGQRRI

SEQ ID NO: 439350 - protein, 6 aa, Mycobacterium
ATPYNL

SEQ ID NO: 439351 - protein, 8 aa, Mycobacterium
ATPYPELD

SEQ ID NO: 439352 - protein, 23 aa, Mycobacterium
ATQAAGEQTDATGGGQAGSADDV

SEQ ID NO: 439353 - protein, 20 aa, Mycobacterium
ATQAAQTPAAVTNSSESGLL

SEQ ID NO: 439354 - protein, 25 aa, Mycobacterium
ATQADAAAAGAPGGQPGGAEPGADD

SEQ ID NO: 439355 - protein, 8 aa, Mycobacterium
ATQADIAG

SEQ ID NO: 439356 - protein, 8 aa, Mycobacterium
ATQADLKG

SEQ ID NO: 439357 - protein, 9 aa, Mycobacterium
ATQADLSGK

SEQ ID NO: 439358 - protein, 9 aa, Mycobacterium
ATQAELESR

SEQ ID NO: 439359 - protein, 26 aa, Mycobacterium
ATQAEQAAGGAPGGESTGASNSGDDV

SEQ ID NO: 439360 - protein, 21 aa, Mycobacterium
ATQAEQPAGGSDNGAPGDDNV

SEQ ID NO: 439361 - protein, 17 aa, Mycobacterium
ATQAEQVAAQAAATATA

SEQ ID NO: 439362 - protein, 5 aa, Mycobacterium
ATQAG

SEQ ID NO: 439363 - protein, 9 aa, Mycobacterium
ATQAGQRTV

SEQ ID NO: 439364 - protein, 6 aa, Mycobacterium
ATQALQ

SEQ ID NO: 439365 - protein, 6 aa, Mycobacterium
ATQANQ

SEQ ID NO: 439366 - protein, 14 aa, Mycobacterium
ATQARFETEHPRAR

SEQ ID NO: 439367 - protein, 6 aa, Mycobacterium
ATQASD

SEQ ID NO: 439368 - protein, 6 aa, Mycobacterium
ATQATL

SEQ ID NO: 439369 - protein, 7 aa, Mycobacterium
ATQATLS

SEQ ID NO: 439370 - protein, 13 aa, Mycobacterium
ATQAVAAAGQART

SEQ ID NO: 439371 - protein, 6 aa, Mycobacterium
ATQAYG

SEQ ID NO: 439372 - protein, 4 aa, Mycobacterium
ATQD

SEQ ID NO: 439373 - protein, 5 aa, Mycobacterium
ATQDG

SEQ ID NO: 439374 - protein, 18 aa, Mycobacterium
ATQDLQDPALDAKSRGEL

SEQ ID NO: 439375 - protein, 9 aa, Mycobacterium
ATQDQPDGL

SEQ ID NO: 439376 - protein, 8 aa, Mycobacterium
ATQDSIEA

SEQ ID NO: 439377 - protein, 8 aa, Mycobacterium
ATQDSIET

SEQ ID NO: 439378 - protein, 15 aa, Mycobacterium
ATQDVTVRGSEIKAG

SEQ ID NO: 439379 - protein, 4 aa, Mycobacterium
ATQE

SEQ ID NO: 439380 - protein, 7 aa, Mycobacterium
ATQEAGL

SEQ ID NO: 439381 - protein, 12 aa, Mycobacterium
ATQEEEHSTRGR

SEQ ID NO: 439382 - protein, 7 aa, Mycobacterium
ATQEPRS

SEQ ID NO: 439383 - protein, 9 aa, Mycobacterium
ATQEQLTQR

SEQ ID NO: 439384 - protein, 14 aa, Mycobacterium
ATQERRAKRAERDL

SEQ ID NO: 439385 - protein, 14 aa, Mycobacterium
ATQERRAKRAEREL

SEQ ID NO: 439386 - protein, 7 aa, Mycobacterium
ATQESDM

SEQ ID NO: 439387 - protein, 7 aa, Mycobacterium
ATQESEM

SEQ ID NO: 439388 - protein, 5 aa, Mycobacterium
ATQGD

SEQ ID NO: 439389 - protein, 5 aa, Mycobacterium
ATQGG

SEQ ID NO: 439390 - protein, 8 aa, Mycobacterium
ATQGHSGT

SEQ ID NO: 439391 - protein, 8 aa, Mycobacterium
ATQGNTTA

SEQ ID NO: 439392 - protein, 9 aa, Mycobacterium
ATQGPSSLG

SEQ ID NO: 439393 - protein, 7 aa, Mycobacterium
ATQGQAE

SEQ ID NO: 439394 - protein, 6 aa, Mycobacterium
ATQGRP

SEQ ID NO: 439395 - protein, 9 aa, Mycobacterium
ATQGRPEGL

SEQ ID NO: 439396 - protein, 12 aa, Mycobacterium
ATQGVRKKHRRA

SEQ ID NO: 439397 - protein, 7 aa, Mycobacterium
ATQHANQ

SEQ ID NO: 439398 - protein, 5 aa, Mycobacterium
ATQHP

SEQ ID NO: 439399 - protein, 5 aa, Mycobacterium
ATQLR

SEQ ID NO: 439400 - protein, 9 aa, Mycobacterium
ATQNDSTRG

SEQ ID NO: 439401 - protein, 8 aa, Mycobacterium
ATQNEAAA

SEQ ID NO: 439402 - protein, 8 aa, Mycobacterium
ATQNPAKL

SEQ ID NO: 439403 - protein, 6 aa, Mycobacterium
ATQNPF

SEQ ID NO: 439404 - protein, 6 aa, Mycobacterium
ATQNPI

SEQ ID NO: 439405 - protein, 7 aa, Mycobacterium
ATQNRDI

SEQ ID NO: 439406 - protein, 4 aa, Mycobacterium
ATQP

SEQ ID NO: 439407 - protein, 21 aa, Mycobacterium
ATQPAMAEAGRSLEAAAARPG

SEQ ID NO: 439408 - protein, 5 aa, Mycobacterium
ATQPE

SEQ ID NO: 439409 - protein, 7 aa, Mycobacterium
ATQPMQA

SEQ ID NO: 439410 - protein, 9 aa, Mycobacterium
ATQPNYPAE

SEQ ID NO: 439411 - protein, 13 aa, Mycobacterium
ATQPPDQHEGGVS

SEQ ID NO: 439412 - protein, 5 aa, Mycobacterium
ATQPR

SEQ ID NO: 439413 - protein, 6 aa, Mycobacterium
ATQPRA

SEQ ID NO: 439414 - protein, 10 aa, Mycobacterium
ATQPSDAFRA

SEQ ID NO: 439415 - protein, 5 aa, Mycobacterium
ATQQA

SEQ ID NO: 439416 - protein, 5 aa, Mycobacterium
ATQQG

SEQ ID NO: 439417 - protein, 14 aa, Mycobacterium
ATQQGPDAGADNHE

SEQ ID NO: 439418 - protein, 11 aa, Mycobacterium
ATQQPGPDESI

SEQ ID NO: 439419 - protein, 5 aa, Mycobacterium
ATQQR

SEQ ID NO: 439420 - protein, 14 aa, Mycobacterium
ATQQRRAKRAEREL

SEQ ID NO: 439421 - protein, 4 aa, Mycobacterium
ATQR

SEQ ID NO: 439422 - protein, 7 aa, Mycobacterium
ATQRDAE

SEQ ID NO: 439423 - protein, 8 aa, Mycobacterium
ATQRDAQR

SEQ ID NO: 439424 - protein, 5 aa, Mycobacterium
ATQRG

SEQ ID NO: 439425 - protein, 5 aa, Mycobacterium
ATQRH

SEQ ID NO: 439426 - protein, 15 aa, Mycobacterium
ATQRLGQQDPTGDAV

SEQ ID NO: 439427 - protein, 5 aa, Mycobacterium
ATQRP

SEQ ID NO: 439428 - protein, 12 aa, Mycobacterium
ATQRPPRRPATV

SEQ ID NO: 439429 - protein, 12 aa, Mycobacterium
ATQRPRREPTTV

SEQ ID NO: 439430 - protein, 5 aa, Mycobacterium
ATQRR

SEQ ID NO: 439431 - protein, 9 aa, Mycobacterium
ATQRRAGRR

SEQ ID NO: 439432 - protein, 6 aa, Mycobacterium
ATQSAG

SEQ ID NO: 439433 - protein, 6 aa, Mycobacterium
ATQSDS

SEQ ID NO: 439434 - protein, 5 aa, Mycobacterium
ATQSM

SEQ ID NO: 439435 - protein, 13 aa, Mycobacterium
ATQSPVPDAQSSP

SEQ ID NO: 439436 - protein, 21 aa, Mycobacterium
ATQSQIAQSTGFAQGPTSFSQ

SEQ ID NO: 439437 - protein, 9 aa, Mycobacterium
ATQSSIDKR

SEQ ID NO: 439438 - protein, 6 aa, Mycobacterium
ATQSST

SEQ ID NO: 439439 - protein, 6 aa, Mycobacterium
ATQTAG

SEQ ID NO: 439440 - protein, 14 aa, Mycobacterium
ATQTASGLADQPLP

SEQ ID NO: 439441 - protein, 7 aa, Mycobacterium
ATQTGAA

SEQ ID NO: 439442 - protein, 15 aa, Mycobacterium
ATQTGHEWSGPASGL

SEQ ID NO: 439443 - protein, 6 aa, Mycobacterium
ATQTGL

SEQ ID NO: 439444 - protein, 7 aa, Mycobacterium
ATQTIRG

SEQ ID NO: 439445 - protein, 11 aa, Mycobacterium
ATQTKQTAMQA

SEQ ID NO: 439446 - protein, 7 aa, Mycobacterium
ATQTNAR

SEQ ID NO: 439447 - protein, 8 aa, Mycobacterium
ATQTPEQQ

SEQ ID NO: 439448 - protein, 20 aa, Mycobacterium
ATQTQAAATAASAGAASTNL

SEQ ID NO: 439449 - protein, 6 aa, Mycobacterium
ATQTSG

SEQ ID NO: 439450 - protein, 4 aa, Mycobacterium
ATQV

SEQ ID NO: 439451 - protein, 7 aa, Mycobacterium
ATQVGAR

SEQ ID NO: 439452 - protein, 7 aa, Mycobacterium
ATQYPNR

SEQ ID NO: 439453 - protein, 5 aa, Mycobacterium
ATQYR

SEQ ID NO: 439454 - protein, 25 aa, Mycobacterium
ATRAAAAGRHAATAAAAYETARTAT

SEQ ID NO: 439455 - protein, 6 aa, Mycobacterium
ATRADA

SEQ ID NO: 439456 - protein, 6 aa, Mycobacterium
ATRAEA

SEQ ID NO: 439457 - protein, 7 aa, Mycobacterium
ATRAEDG

SEQ ID NO: 439458 - protein, 7 aa, Mycobacterium
ATRAEEG

SEQ ID NO: 439459 - protein, 7 aa, Mycobacterium
ATRAENP

SEQ ID NO: 439460 - protein, 7 aa, Mycobacterium
ATRAERP

SEQ ID NO: 439461 - protein, 6 aa, Mycobacterium
ATRAGI

SEQ ID NO: 439462 - protein, 7 aa, Mycobacterium
ATRAGQR

SEQ ID NO: 439463 - protein, 8 aa, Mycobacterium
ATRAGSHG

SEQ ID NO: 439464 - protein, 12 aa, Mycobacterium
ATRAGTDVEVEA

SEQ ID NO: 439465 - protein, 9 aa, Mycobacterium
ATRAGVSRS

SEQ ID NO: 439466 - protein, 6 aa, Mycobacterium
ATRAHA

SEQ ID NO: 439467 - protein, 13 aa, Mycobacterium
ATRAIGGSKPGIG

SEQ ID NO: 439468 - protein, 9 aa, Mycobacterium
ATRALTDEG

SEQ ID NO: 439469 - protein, 6 aa, Mycobacterium
ATRAPT

SEQ ID NO: 439470 - protein, 9 aa, Mycobacterium
ATRAQRADD

SEQ ID NO: 439471 - protein, 12 aa, Mycobacterium
ATRARAGNGPSL

SEQ ID NO: 439472 - protein, 6 aa, Mycobacterium
ATRARI

SEQ ID NO: 439473 - protein, 12 aa, Mycobacterium
ATRARPEQQAAA

SEQ ID NO: 439474 - protein, 9 aa, Mycobacterium
ATRARVSPA

SEQ ID NO: 439475 - protein, 8 aa, Mycobacterium
ATRASQTA

SEQ ID NO: 439476 - protein, 9 aa, Mycobacterium
ATRATITPD

SEQ ID NO: 439477 - protein, 5 aa, Mycobacterium
ATRAV

SEQ ID NO: 439478 - protein, 11 aa, Mycobacterium
ATRDADLGAAL

SEQ ID NO: 439479 - protein, 13 aa, Mycobacterium
ATRDAEREDEVRS

SEQ ID NO: 439480 - protein, 12 aa, Mycobacterium
ATRDAESTNDSA

SEQ ID NO: 439481 - protein, 7 aa, Mycobacterium
ATRDEER

SEQ ID NO: 439482 - protein, 5 aa, Mycobacterium
ATRDG

SEQ ID NO: 439483 - protein, 7 aa, Mycobacterium
ATRDGDD

SEQ ID NO: 439484 - protein, 6 aa, Mycobacterium
ATRDGE

SEQ ID NO: 439485 - protein, 11 aa, Mycobacterium
ATRDGSPGIAA

SEQ ID NO: 439486 - protein, 8 aa, Mycobacterium
ATRDGSSY

SEQ ID NO: 439487 - protein, 6 aa, Mycobacterium
ATRDLD

SEQ ID NO: 439488 - protein, 6 aa, Mycobacterium
ATRDNA

SEQ ID NO: 439489 - protein, 10 aa, Mycobacterium
ATRDNPEHRA

SEQ ID NO: 439490 - protein, 17 aa, Mycobacterium
ATRDNSSSPNTPPSTIA

SEQ ID NO: 439491 - protein, 5 aa, Mycobacterium
ATRDP

SEQ ID NO: 439492 - protein, 6 aa, Mycobacterium
ATRDPA

SEQ ID NO: 439493 - protein, 5 aa, Mycobacterium
ATRDR

SEQ ID NO: 439494 - protein, 9 aa, Mycobacterium
ATRDSEETV

SEQ ID NO: 439495 - protein, 8 aa, Mycobacterium
ATRDTEVR

SEQ ID NO: 439496 - protein, 8 aa, Mycobacterium
ATRDTSPV

SEQ ID NO: 439497 - protein, 15 aa, Mycobacterium
ATRDVEVGGQTIAAG

SEQ ID NO: 439498 - protein, 5 aa, Mycobacterium
ATRDY

SEQ ID NO: 439499 - protein, 8 aa, Mycobacterium
ATREAAEA

SEQ ID NO: 439500 - protein, 6 aa, Mycobacterium
ATREEA

SEQ ID NO: 439501 - protein, 11 aa, Mycobacterium
ATREPALPRPS

SEQ ID NO: 439502 - protein, 5 aa, Mycobacterium
ATREQ

SEQ ID NO: 439503 - protein, 7 aa, Mycobacterium
ATREQED

SEQ ID NO: 439504 - protein, 20 aa, Mycobacterium
ATRERAEAQLARQGSQFRPE

SEQ ID NO: 439505 - protein, 10 aa, Mycobacterium
ATRERDGTRH

SEQ ID NO: 439506 - protein, 9 aa, Mycobacterium
ATRERRPAG

SEQ ID NO: 439507 - protein, 9 aa, Mycobacterium
ATRERRPSG

SEQ ID NO: 439508 - protein, 8 aa, Mycobacterium
ATRETEAV

SEQ ID NO: 439509 - protein, 10 aa, Mycobacterium
ATRGAAPECD

SEQ ID NO: 439510 - protein, 6 aa, Mycobacterium
ATRGAE

SEQ ID NO: 439511 - protein, 11 aa, Mycobacterium
ATRGAVDDTTK

SEQ ID NO: 439512 - protein, 20 aa, Mycobacterium
ATRGDEKLSTTQVGDRILGK

SEQ ID NO: 439513 - protein, 10 aa, Mycobacterium
ATRGDPNNVD

SEQ ID NO: 439514 - protein, 11 aa, Mycobacterium
ATRGDRPRTYT

SEQ ID NO: 439515 - protein, 20 aa, Mycobacterium
ATRGEEKLSTSATGDRIASF

SEQ ID NO: 439516 - protein, 5 aa, Mycobacterium
ATRGF

SEQ ID NO: 439517 - protein, 6 aa, Mycobacterium
ATRGGA

SEQ ID NO: 439518 - protein, 7 aa, Mycobacterium
ATRGGQR

SEQ ID NO: 439519 - protein, 18 aa, Mycobacterium
ATRGGVGTVSNELAKDAP

SEQ ID NO: 439520 - protein, 6 aa, Mycobacterium
ATRGIS

SEQ ID NO: 439521 - protein, 8 aa, Mycobacterium
ATRGNGAM

SEQ ID NO: 439522 - protein, 8 aa, Mycobacterium
ATRGPGVG

SEQ ID NO: 439523 - protein, 7 aa, Mycobacterium
ATRGPKS

SEQ ID NO: 439524 - protein, 17 aa, Mycobacterium
ATRGPLPGDEGTGADNA

SEQ ID NO: 439525 - protein, 13 aa, Mycobacterium
ATRGRSTATLSTR

SEQ ID NO: 439526 - protein, 20 aa, Mycobacterium
ATRGSERLATREVGERIAAG

SEQ ID NO: 439527 - protein, 10 aa, Mycobacterium
ATRGVTTSDE

SEQ ID NO: 439528 - protein, 15 aa, Mycobacterium
ATRHARTTQPPQPSH

SEQ ID NO: 439529 - protein, 5 aa, Mycobacterium
ATRIP

SEQ ID NO: 439530 - protein, 19 aa, Mycobacterium
ATRKGVEDAGGTYEPHPAE

SEQ ID NO: 439531 - protein, 32 aa, Mycobacterium
ATRKNTGAKENPQGSPAVNAEKPFTHEQHVPT

SEQ ID NO: 439532 - protein, 10 aa, Mycobacterium
ATRKPDGGWG

SEQ ID NO: 439533 - protein, 4 aa, Mycobacterium
ATRL

SEQ ID NO: 439534 - protein, 6 aa, Mycobacterium
ATRLEE

SEQ ID NO: 439535 - protein, 13 aa, Mycobacterium
ATRLERARATTTD

SEQ ID NO: 439536 - protein, 10 aa, Mycobacterium
ATRLPGEERT

SEQ ID NO: 439537 - protein, 6 aa, Mycobacterium
ATRMPG

SEQ ID NO: 439538 - protein, 6 aa, Mycobacterium
ATRNHP

SEQ ID NO: 439539 - protein, 5 aa, Mycobacterium
ATRNP

SEQ ID NO: 439540 - protein, 15 aa, Mycobacterium
ATRNPDIPNIPITEE

SEQ ID NO: 439541 - protein, 6 aa, Mycobacterium
ATRNSP

SEQ ID NO: 439542 - protein, 6 aa, Mycobacterium
ATRNTQ

SEQ ID NO: 439543 - protein, 5 aa, Mycobacterium
ATRNW

SEQ ID NO: 439544 - protein, 6 aa, Mycobacterium
ATRPAR

SEQ ID NO: 439545 - protein, 13 aa, Mycobacterium
ATRPDGPARATMA

SEQ ID NO: 439546 - protein, 7 aa, Mycobacterium
ATRPDLP

SEQ ID NO: 439547 - protein, 6 aa, Mycobacterium
ATRPFA

SEQ ID NO: 439548 - protein, 6 aa, Mycobacterium
ATRPLR

SEQ ID NO: 439549 - protein, 8 aa, Mycobacterium
ATRPLTDA

SEQ ID NO: 439550 - protein, 6 aa, Mycobacterium
ATRPPA

SEQ ID NO: 439551 - protein, 6 aa, Mycobacterium
ATRPPR

SEQ ID NO: 439552 - protein, 20 aa, Mycobacterium
ATRPPRAGLTATATSEVERD

SEQ ID NO: 439553 - protein, 14 aa, Mycobacterium
ATRPPRQPPALGAD

SEQ ID NO: 439554 - protein, 15 aa, Mycobacterium
ATRPPTDAALDRSGA

SEQ ID NO: 439555 - protein, 10 aa, Mycobacterium
ATRPRPQALA

SEQ ID NO: 439556 - protein, 18 aa, Mycobacterium
ATRPRRSWNADQTTDHSD

SEQ ID NO: 439557 - protein, 15 aa, Mycobacterium
ATRPRRSWNADQTTG

SEQ ID NO: 439558 - protein, 18 aa, Mycobacterium
ATRPSDGSYANGYGNSKW

SEQ ID NO: 439559 - protein, 6 aa, Mycobacterium
ATRPYM

SEQ ID NO: 439560 - protein, 6 aa, Mycobacterium
ATRQAY

SEQ ID NO: 439561 - protein, 5 aa, Mycobacterium
ATRQG

SEQ ID NO: 439562 - protein, 6 aa, Mycobacterium
ATRQGD

SEQ ID NO: 439563 - protein, 6 aa, Mycobacterium
ATRQGG

SEQ ID NO: 439564 - protein, 11 aa, Mycobacterium
ATRQGPPEDPW

SEQ ID NO: 439565 - protein, 6 aa, Mycobacterium
ATRQNV

SEQ ID NO: 439566 - protein, 10 aa, Mycobacterium
ATRQPDGGWG

SEQ ID NO: 439567 - protein, 10 aa, Mycobacterium
ATRQRFERES

SEQ ID NO: 439568 - protein, 7 aa, Mycobacterium
ATRQRTH

SEQ ID NO: 439569 - protein, 6 aa, Mycobacterium
ATRQRV

SEQ ID NO: 439570 - protein, 9 aa, Mycobacterium
ATRQSLPKS

SEQ ID NO: 439571 - protein, 9 aa, Mycobacterium
ATRQTGGVA

SEQ ID NO: 439572 - protein, 7 aa, Mycobacterium
ATRQTLT

SEQ ID NO: 439573 - protein, 6 aa, Mycobacterium
ATRQTV

SEQ ID NO: 439574 - protein, 4 aa, Mycobacterium
ATRR

SEQ ID NO: 439575 - protein, 6 aa, Mycobacterium
ATRRAE

SEQ ID NO: 439576 - protein, 10 aa, Mycobacterium
ATRRDLQDAA

SEQ ID NO: 439577 - protein, 6 aa, Mycobacterium
ATRRDR

SEQ ID NO: 439578 - protein, 5 aa, Mycobacterium
ATRRG

SEQ ID NO: 439579 - protein, 10 aa, Mycobacterium
ATRRGAGVPE

SEQ ID NO: 439580 - protein, 7 aa, Mycobacterium
ATRRGGA

SEQ ID NO: 439581 - protein, 8 aa, Mycobacterium
ATRRGRPP

SEQ ID NO: 439582 - protein, 13 aa, Mycobacterium
ATRRHRDRTGRTA

SEQ ID NO: 439583 - protein, 10 aa, Mycobacterium
ATRRLGGRPP

SEQ ID NO: 439584 - protein, 13 aa, Mycobacterium
ATRRPETITGGDS

SEQ ID NO: 439585 - protein, 5 aa, Mycobacterium
ATRRR

SEQ ID NO: 439586 - protein, 12 aa, Mycobacterium
ATRRRSSARSER

SEQ ID NO: 439587 - protein, 5 aa, Mycobacterium
ATRRS

SEQ ID NO: 439588 - protein, 8 aa, Mycobacterium
ATRRSDIG

SEQ ID NO: 439589 - protein, 9 aa, Mycobacterium
ATRRTADTD

SEQ ID NO: 439590 - protein, 15 aa, Mycobacterium
ATRRVGERQERVDAY

SEQ ID NO: 439591 - protein, 10 aa, Mycobacterium
ATRSETELAS

SEQ ID NO: 439592 - protein, 5 aa, Mycobacterium
ATRSF

SEQ ID NO: 439593 - protein, 15 aa, Mycobacterium
ATRSFPNRRRAASEV

SEQ ID NO: 439594 - protein, 5 aa, Mycobacterium
ATRSG

SEQ ID NO: 439595 - protein, 10 aa, Mycobacterium
ATRSGGATVA

SEQ ID NO: 439596 - protein, 10 aa, Mycobacterium
ATRSGHDQTS

SEQ ID NO: 439597 - protein, 13 aa, Mycobacterium
ATRSGPACPQRPS

SEQ ID NO: 439598 - protein, 8 aa, Mycobacterium
ATRSGSAR

SEQ ID NO: 439599 - protein, 6 aa, Mycobacterium
ATRSHS

SEQ ID NO: 439600 - protein, 6 aa, Mycobacterium
ATRSIH

SEQ ID NO: 439601 - protein, 6 aa, Mycobacterium
ATRSIP

SEQ ID NO: 439602 - protein, 23 aa, Mycobacterium
ATRSNGAAAAEREADPPQERDGT

SEQ ID NO: 439603 - protein, 9 aa, Mycobacterium
ATRSPEDPI

SEQ ID NO: 439604 - protein, 7 aa, Mycobacterium
ATRSPGR

SEQ ID NO: 439605 - protein, 7 aa, Mycobacterium
ATRSPRV

SEQ ID NO: 439606 - protein, 18 aa, Mycobacterium
ATRSPTDAALDRSKAFAA

SEQ ID NO: 439607 - protein, 7 aa, Mycobacterium
ATRSQGR

SEQ ID NO: 439608 - protein, 13 aa, Mycobacterium
ATRSSGQDSAGYG

SEQ ID NO: 439609 - protein, 6 aa, Mycobacterium
ATRSSI

SEQ ID NO: 439610 - protein, 13 aa, Mycobacterium
ATRSSLEPRELPP

SEQ ID NO: 439611 - protein, 12 aa, Mycobacterium
ATRSTATGEAGE

SEQ ID NO: 439612 - protein, 6 aa, Mycobacterium
ATRTDA

SEQ ID NO: 439613 - protein, 6 aa, Mycobacterium
ATRTDQ

SEQ ID NO: 439614 - protein, 5 aa, Mycobacterium
ATRTE

SEQ ID NO: 439615 - protein, 7 aa, Mycobacterium
ATRTEPV

SEQ ID NO: 439616 - protein, 5 aa, Mycobacterium
ATRTG

SEQ ID NO: 439617 - protein, 11 aa, Mycobacterium
ATRTGLPDGGF

SEQ ID NO: 439618 - protein, 6 aa, Mycobacterium
ATRTGQ

SEQ ID NO: 439619 - protein, 7 aa, Mycobacterium
ATRTGTA

SEQ ID NO: 439620 - protein, 7 aa, Mycobacterium
ATRTGVP

SEQ ID NO: 439621 - protein, 8 aa, Mycobacterium
ATRTLGDA

SEQ ID NO: 439622 - protein, 7 aa, Mycobacterium
ATRTQGR

SEQ ID NO: 439623 - protein, 13 aa, Mycobacterium
ATRTRQTLATTGI

SEQ ID NO: 439624 - protein, 13 aa, Mycobacterium
ATRTRQTLEQTGI

SEQ ID NO: 439625 - protein, 10 aa, Mycobacterium
ATRVDSGGAA

SEQ ID NO: 439626 - protein, 5 aa, Mycobacterium
ATRVR

SEQ ID NO: 439627 - protein, 10 aa, Mycobacterium
ATRVTTDEEI

SEQ ID NO: 439628 - protein, 4 aa, Mycobacterium
ATRY

SEQ ID NO: 439629 - protein, 9 aa, Mycobacterium
ATRYGNERG

SEQ ID NO: 439630 - protein, 11 aa, Mycobacterium
ATRYPPNGIRG

SEQ ID NO: 439631 - protein, 9 aa, Mycobacterium
ATSAAESHA

SEQ ID NO: 439632 - protein, 8 aa, Mycobacterium
ATSAAGGL

SEQ ID NO: 439633 - protein, 14 aa, Mycobacterium
ATSAASTVFDGPPR

SEQ ID NO: 439634 - protein, 18 aa, Mycobacterium
ATSAASYLSTETANAVAS

SEQ ID NO: 439635 - protein, 8 aa, Mycobacterium
ATSAATYT

SEQ ID NO: 439636 - protein, 5 aa, Mycobacterium
ATSAD

SEQ ID NO: 439637 - protein, 6 aa, Mycobacterium
ATSADF

SEQ ID NO: 439638 - protein, 13 aa, Mycobacterium
ATSADKGAVRSLS

SEQ ID NO: 439639 - protein, 7 aa, Mycobacterium
ATSADTV

SEQ ID NO: 439640 - protein, 8 aa, Mycobacterium
ATSAEPAL

SEQ ID NO: 439641 - protein, 7 aa, Mycobacterium
ATSAEQL

SEQ ID NO: 439642 - protein, 6 aa, Mycobacterium
ATSAGA

SEQ ID NO: 439643 - protein, 20 aa, Mycobacterium
ATSAGPGRRFRGTNRSGRYR

SEQ ID NO: 439644 - protein, 13 aa, Mycobacterium
ATSAGRAALTEDR

SEQ ID NO: 439645 - protein, 16 aa, Mycobacterium
ATSAGSAGRSGLTGRA

SEQ ID NO: 439646 - protein, 8 aa, Mycobacterium
ATSAHPAF

SEQ ID NO: 439647 - protein, 8 aa, Mycobacterium
ATSAIRPG

SEQ ID NO: 439648 - protein, 7 aa, Mycobacterium
ATSAKDF

SEQ ID NO: 439649 - protein, 20 aa, Mycobacterium
ATSAPGNNSIRPKEKAPLAE

SEQ ID NO: 439650 - protein, 10 aa, Mycobacterium
ATSAPPGPKV

SEQ ID NO: 439651 - protein, 13 aa, Mycobacterium
ATSAQAAAQHEAA

SEQ ID NO: 439652 - protein, 5 aa, Mycobacterium
ATSAR

SEQ ID NO: 439653 - protein, 7 aa, Mycobacterium
ATSARRQ

SEQ ID NO: 439654 - protein, 8 aa, Mycobacterium
ATSASLAD

SEQ ID NO: 439655 - protein, 5 aa, Mycobacterium
ATSAT

SEQ ID NO: 439656 - protein, 16 aa, Mycobacterium
ATSATTLRLSSVERLP

SEQ ID NO: 439657 - protein, 6 aa, Mycobacterium
ATSATV

SEQ ID NO: 439658 - protein, 7 aa, Mycobacterium
ATSAVPT

SEQ ID NO: 439659 - protein, 7 aa, Mycobacterium
ATSAVRP

SEQ ID NO: 439660 - protein, 8 aa, Mycobacterium
ATSAVRPG

SEQ ID NO: 439661 - protein, 8 aa, Mycobacterium
ATSAVRSG

SEQ ID NO: 439662 - protein, 9 aa, Mycobacterium
ATSAVSEPD

SEQ ID NO: 439663 - protein, 23 aa, Mycobacterium
ATSCGSAGGCGSADGAGSSAGDP

SEQ ID NO: 439664 - protein, 4 aa, Mycobacterium
ATSD

SEQ ID NO: 439665 - protein, 7 aa, Mycobacterium
ATSDAAS

SEQ ID NO: 439666 - protein, 8 aa, Mycobacterium
ATSDAPRL

SEQ ID NO: 439667 - protein, 14 aa, Mycobacterium
ATSDDDVDRSAAAI

SEQ ID NO: 439668 - protein, 11 aa, Mycobacterium
ATSDDLGAQEV

SEQ ID NO: 439669 - protein, 9 aa, Mycobacterium
ATSDDPEQA

SEQ ID NO: 439670 - protein, 8 aa, Mycobacterium
ATSDEDAG

SEQ ID NO: 439671 - protein, 8 aa, Mycobacterium
ATSDGGKQ

SEQ ID NO: 439672 - protein, 7 aa, Mycobacterium
ATSDGQD

SEQ ID NO: 439673 - protein, 10 aa, Mycobacterium
ATSDGRTAVS

SEQ ID NO: 439674 - protein, 8 aa, Mycobacterium
ATSDGTPL

SEQ ID NO: 439675 - protein, 5 aa, Mycobacterium
ATSDH

SEQ ID NO: 439676 - protein, 5 aa, Mycobacterium
ATSDL

SEQ ID NO: 439677 - protein, 9 aa, Mycobacterium
ATSDNAAAT

SEQ ID NO: 439678 - protein, 8 aa, Mycobacterium
ATSDPDTF

SEQ ID NO: 439679 - protein, 9 aa, Mycobacterium
ATSDPDTFR

SEQ ID NO: 439680 - protein, 8 aa, Mycobacterium
ATSDPDTP

SEQ ID NO: 439681 - protein, 9 aa, Mycobacterium
ATSDQGFKG

SEQ ID NO: 439682 - protein, 15 aa, Mycobacterium
ATSDSAKTEAATYQG

SEQ ID NO: 439683 - protein, 6 aa, Mycobacterium
ATSDTV

SEQ ID NO: 439684 - protein, 4 aa, Mycobacterium
ATSE

SEQ ID NO: 439685 - protein, 9 aa, Mycobacterium
ATSEDGTSI

SEQ ID NO: 439686 - protein, 6 aa, Mycobacterium
ATSEDI

SEQ ID NO: 439687 - protein, 6 aa, Mycobacterium
ATSEDP

SEQ ID NO: 439688 - protein, 12 aa, Mycobacterium
ATSEDVVTSAQS

SEQ ID NO: 439689 - protein, 6 aa, Mycobacterium
ATSELQ

SEQ ID NO: 439690 - protein, 14 aa, Mycobacterium
ATSEPRTAATAVSG

SEQ ID NO: 439691 - protein, 14 aa, Mycobacterium
ATSESGHRPGRKAG

SEQ ID NO: 439692 - protein, 5 aa, Mycobacterium
ATSEV

SEQ ID NO: 439693 - protein, 7 aa, Mycobacterium
ATSEVSG

SEQ ID NO: 439694 - protein, 10 aa, Mycobacterium
ATSGATDVQG

SEQ ID NO: 439695 - protein, 5 aa, Mycobacterium
ATSGD

SEQ ID NO: 439696 - protein, 8 aa, Mycobacterium
ATSGDTVR

SEQ ID NO: 439697 - protein, 8 aa, Mycobacterium
ATSGGDKF

SEQ ID NO: 439698 - protein, 7 aa, Mycobacterium
ATSGGGC

SEQ ID NO: 439699 - protein, 5 aa, Mycobacterium
ATSGN

SEQ ID NO: 439700 - protein, 8 aa, Mycobacterium
ATSGNTGI

SEQ ID NO: 439701 - protein, 10 aa, Mycobacterium
ATSGQAELSS

SEQ ID NO: 439702 - protein, 7 aa, Mycobacterium
ATSGQPI

SEQ ID NO: 439703 - protein, 5 aa, Mycobacterium
ATSGR

SEQ ID NO: 439704 - protein, 6 aa, Mycobacterium
ATSGRQ

SEQ ID NO: 439705 - protein, 13 aa, Mycobacterium
ATSGTPRDAGKPR

SEQ ID NO: 439706 - protein, 6 aa, Mycobacterium
ATSHDH

SEQ ID NO: 439707 - protein, 15 aa, Mycobacterium
ATSHEKAAQATKQGL

SEQ ID NO: 439708 - protein, 5 aa, Mycobacterium
ATSHG

SEQ ID NO: 439709 - protein, 9 aa, Mycobacterium
ATSHGGDDL

SEQ ID NO: 439710 - protein, 17 aa, Mycobacterium
ATSHGTVGAVQRSVSTT

SEQ ID NO: 439711 - protein, 6 aa, Mycobacterium
ATSKGL

SEQ ID NO: 439712 - protein, 7 aa, Mycobacterium
ATSKLER

SEQ ID NO: 439713 - protein, 12 aa, Mycobacterium
ATSKSPRRERRR

SEQ ID NO: 439714 - protein, 9 aa, Mycobacterium
ATSKTGAIV

SEQ ID NO: 439715 - protein, 17 aa, Mycobacterium
ATSLDGGESNSATTVSA

SEQ ID NO: 439716 - protein, 14 aa, Mycobacterium
ATSLENKGLPGTTM

SEQ ID NO: 439717 - protein, 7 aa, Mycobacterium
ATSLGVD

SEQ ID NO: 439718 - protein, 7 aa, Mycobacterium
ATSLNDT

SEQ ID NO: 439719 - protein, 11 aa, Mycobacterium
ATSLPPASDMR

SEQ ID NO: 439720 - protein, 6 aa, Mycobacterium
ATSLRG

SEQ ID NO: 439721 - protein, 7 aa, Mycobacterium
ATSNALG

SEQ ID NO: 439722 - protein, 16 aa, Mycobacterium
ATSNGTATAGGDFTAA

SEQ ID NO: 439723 - protein, 11 aa, Mycobacterium
ATSNGTATAGV

SEQ ID NO: 439724 - protein, 21 aa, Mycobacterium
ATSNGTATAGVDYTAKSGTVT

SEQ ID NO: 439725 - protein, 11 aa, Mycobacterium
ATSNGTAVAGT

SEQ ID NO: 439726 - protein, 9 aa, Mycobacterium
ATSNPDARE

SEQ ID NO: 439727 - protein, 8 aa, Mycobacterium
ATSNPRRL

SEQ ID NO: 439728 - protein, 19 aa, Mycobacterium
ATSNQTAGAGSDYAPATGT

SEQ ID NO: 439729 - protein, 11 aa, Mycobacterium
ATSNTLPEQLG

SEQ ID NO: 439730 - protein, 18 aa, Mycobacterium
ATSPAEKDPFFAPSGDKV

SEQ ID NO: 439731 - protein, 7 aa, Mycobacterium
ATSPAEL

SEQ ID NO: 439732 - protein, 7 aa, Mycobacterium
ATSPAVD

SEQ ID NO: 439733 - protein, 8 aa, Mycobacterium
ATSPDDVQ

SEQ ID NO: 439734 - protein, 10 aa, Mycobacterium
ATSPDHDRDG

SEQ ID NO: 439735 - protein, 8 aa, Mycobacterium
ATSPDPQV

SEQ ID NO: 439736 - protein, 11 aa, Mycobacterium
ATSPEAADPLS

SEQ ID NO: 439737 - protein, 10 aa, Mycobacterium
ATSPEELGNI

SEQ ID NO: 439738 - protein, 8 aa, Mycobacterium
ATSPEEST

SEQ ID NO: 439739 - protein, 8 aa, Mycobacterium
ATSPGALS

SEQ ID NO: 439740 - protein, 18 aa, Mycobacterium
ATSPGALSAAGRLATATG

SEQ ID NO: 439741 - protein, 9 aa, Mycobacterium
ATSPGYSGV

SEQ ID NO: 439742 - protein, 6 aa, Mycobacterium
ATSPLE

SEQ ID NO: 439743 - protein, 7 aa, Mycobacterium
ATSPRDD

SEQ ID NO: 439744 - protein, 9 aa, Mycobacterium
ATSPRERSE

SEQ ID NO: 439745 - protein, 6 aa, Mycobacterium
ATSPRF

SEQ ID NO: 439746 - protein, 8 aa, Mycobacterium
ATSPSGAA

SEQ ID NO: 439747 - protein, 5 aa, Mycobacterium
ATSPT

SEQ ID NO: 439748 - protein, 6 aa, Mycobacterium
ATSPVG

SEQ ID NO: 439749 - protein, 5 aa, Mycobacterium
ATSPY

SEQ ID NO: 439750 - protein, 10 aa, Mycobacterium
ATSQAQPVDI

SEQ ID NO: 439751 - protein, 6 aa, Mycobacterium
ATSQGM

SEQ ID NO: 439752 - protein, 8 aa, Mycobacterium
ATSQPAAI

SEQ ID NO: 439753 - protein, 15 aa, Mycobacterium
ATSQSGAYAARTEVS

SEQ ID NO: 439754 - protein, 10 aa, Mycobacterium
ATSQSPQPRE

SEQ ID NO: 439755 - protein, 8 aa, Mycobacterium
ATSQVTPE

SEQ ID NO: 439756 - protein, 5 aa, Mycobacterium
ATSRD

SEQ ID NO: 439757 - protein, 7 aa, Mycobacterium
ATSRDAV

SEQ ID NO: 439758 - protein, 20 aa, Mycobacterium
ATSRDTVRSAGRTGKPSRQL

SEQ ID NO: 439759 - protein, 17 aa, Mycobacterium
ATSRDTVRSRSFTGKPA

SEQ ID NO: 439760 - protein, 9 aa, Mycobacterium
ATSREGKAQ

SEQ ID NO: 439761 - protein, 7 aa, Mycobacterium
ATSREGL

SEQ ID NO: 439762 - protein, 12 aa, Mycobacterium
ATSRIKDGRRAV

SEQ ID NO: 439763 - protein, 11 aa, Mycobacterium
ATSRPESAERA

SEQ ID NO: 439764 - protein, 6 aa, Mycobacterium
ATSRPP

SEQ ID NO: 439765 - protein, 9 aa, Mycobacterium
ATSRPSALS

SEQ ID NO: 439766 - protein, 15 aa, Mycobacterium
ATSRSSDFAAAPPHG

SEQ ID NO: 439767 - protein, 15 aa, Mycobacterium
ATSRSSEFPAAPARG

SEQ ID NO: 439768 - protein, 13 aa, Mycobacterium
ATSRTPEDAADAL

SEQ ID NO: 439769 - protein, 8 aa, Mycobacterium
ATSRTPVR

SEQ ID NO: 439770 - protein, 28 aa, Mycobacterium
ATSRVEAERADKRLNEVTEQYRAAGGGL

SEQ ID NO: 439771 - protein, 6 aa, Mycobacterium
ATSSAA

SEQ ID NO: 439772 - protein, 9 aa, Mycobacterium
ATSSADAPV

SEQ ID NO: 439773 - protein, 9 aa, Mycobacterium
ATSSADQPI

SEQ ID NO: 439774 - protein, 13 aa, Mycobacterium
ATSSATELTPFTQ

SEQ ID NO: 439775 - protein, 7 aa, Mycobacterium
ATSSAYG

SEQ ID NO: 439776 - protein, 6 aa, Mycobacterium
ATSSGC

SEQ ID NO: 439777 - protein, 30 aa, Mycobacterium
ATSSGRRRPTGPNKAKPWSSTPPQAATITA

SEQ ID NO: 439778 - protein, 18 aa, Mycobacterium
ATSSGSYAATEAANAAAA

SEQ ID NO: 439779 - protein, 6 aa, Mycobacterium
ATSSGW

SEQ ID NO: 439780 - protein, 13 aa, Mycobacterium
ATSSPTQEVSSPR

SEQ ID NO: 439781 - protein, 7 aa, Mycobacterium
ATSSQAF

SEQ ID NO: 439782 - protein, 10 aa, Mycobacterium
ATSSSDEPVV

SEQ ID NO: 439783 - protein, 7 aa, Mycobacterium
ATSSTAA

SEQ ID NO: 439784 - protein, 37 aa, Mycobacterium
ATSSTANAGPPATTFASRSSPGSNAPTTAADDKPAWA

SEQ ID NO: 439785 - protein, 11 aa, Mycobacterium
ATSSTGPGSPV

SEQ ID NO: 439786 - protein, 4 aa, Mycobacterium
ATST

SEQ ID NO: 439787 - protein, 6 aa, Mycobacterium
ATSTAR

SEQ ID NO: 439788 - protein, 6 aa, Mycobacterium
ATSTDE

SEQ ID NO: 439789 - protein, 15 aa, Mycobacterium
ATSTDQVAEAAGFSR

SEQ ID NO: 439790 - protein, 7 aa, Mycobacterium
ATSTDRC

SEQ ID NO: 439791 - protein, 18 aa, Mycobacterium
ATSTDSGPARPSLTERET

SEQ ID NO: 439792 - protein, 7 aa, Mycobacterium
ATSTDTE

SEQ ID NO: 439793 - protein, 13 aa, Mycobacterium
ATSTGELAQAAEN

SEQ ID NO: 439794 - protein, 6 aa, Mycobacterium
ATSTIT

SEQ ID NO: 439795 - protein, 6 aa, Mycobacterium
ATSTMA

SEQ ID NO: 439796 - protein, 6 aa, Mycobacterium
ATSTMG

SEQ ID NO: 439797 - protein, 8 aa, Mycobacterium
ATSTPAAA

SEQ ID NO: 439798 - protein, 8 aa, Mycobacterium
ATSTPASA

SEQ ID NO: 439799 - protein, 15 aa, Mycobacterium
ATSTPHAASPAGPGK

SEQ ID NO: 439800 - protein, 8 aa, Mycobacterium
ATSTPPAA

SEQ ID NO: 439801 - protein, 5 aa, Mycobacterium
ATSTQ

SEQ ID NO: 439802 - protein, 9 aa, Mycobacterium
ATSTQVTAG

SEQ ID NO: 439803 - protein, 13 aa, Mycobacterium
ATSTSFTDDERAA

SEQ ID NO: 439804 - protein, 12 aa, Mycobacterium
ATSTSGLASTVS

SEQ ID NO: 439805 - protein, 9 aa, Mycobacterium
ATSTTEPAA

SEQ ID NO: 439806 - protein, 12 aa, Mycobacterium
ATSTTNADNSTV

SEQ ID NO: 439807 - protein, 4 aa, Mycobacterium
ATSV

SEQ ID NO: 439808 - protein, 11 aa, Mycobacterium
ATSVAERVAGA

SEQ ID NO: 439809 - protein, 5 aa, Mycobacterium
ATSVG

SEQ ID NO: 439810 - protein, 14 aa, Mycobacterium
ATSVGDQAQFTRPQ

SEQ ID NO: 439811 - protein, 5 aa, Mycobacterium
ATSVN

SEQ ID NO: 439812 - protein, 21 aa, Mycobacterium
ATSVPQASSTLATTGTSSSSL

SEQ ID NO: 439813 - protein, 8 aa, Mycobacterium
ATSVQTTA

SEQ ID NO: 439814 - protein, 7 aa, Mycobacterium
ATSVSGV

SEQ ID NO: 439815 - protein, 4 aa, Mycobacterium
ATSW

SEQ ID NO: 439816 - protein, 5 aa, Mycobacterium
ATSWQ

SEQ ID NO: 439817 - protein, 6 aa, Mycobacterium
ATSYTT

SEQ ID NO: 439818 - protein, 12 aa, Mycobacterium
ATTAAASDSVAR

SEQ ID NO: 439819 - protein, 12 aa, Mycobacterium
ATTAAATPAELA

SEQ ID NO: 439820 - protein, 6 aa, Mycobacterium
ATTAAD

SEQ ID NO: 439821 - protein, 26 aa, Mycobacterium
ATTAAGQDRLTEPPPGATPRRHLPAW

SEQ ID NO: 439822 - protein, 20 aa, Mycobacterium
ATTAAPEAAAGEAAAAPEQS

SEQ ID NO: 439823 - protein, 20 aa, Mycobacterium
ATTAARAKQAELDKNRDDEL

SEQ ID NO: 439824 - protein, 10 aa, Mycobacterium
ATTADAAAQA

SEQ ID NO: 439825 - protein, 7 aa, Mycobacterium
ATTADGV

SEQ ID NO: 439826 - protein, 6 aa, Mycobacterium
ATTADV

SEQ ID NO: 439827 - protein, 6 aa, Mycobacterium
ATTAEA

SEQ ID NO: 439828 - protein, 11 aa, Mycobacterium
ATTAELDSTGR

SEQ ID NO: 439829 - protein, 7 aa, Mycobacterium
ATTAERL

SEQ ID NO: 439830 - protein, 5 aa, Mycobacterium
ATTAG

SEQ ID NO: 439831 - protein, 7 aa, Mycobacterium
ATTAGAD

SEQ ID NO: 439832 - protein, 6 aa, Mycobacterium
ATTAGE

SEQ ID NO: 439833 - protein, 12 aa, Mycobacterium
ATTAGEAKYAAK

SEQ ID NO: 439834 - protein, 7 aa, Mycobacterium
ATTAGGV

SEQ ID NO: 439835 - protein, 7 aa, Mycobacterium
ATTAGPV

SEQ ID NO: 439836 - protein, 7 aa, Mycobacterium
ATTAGSQ

SEQ ID NO: 439837 - protein, 10 aa, Mycobacterium
ATTAGSTSAT

SEQ ID NO: 439838 - protein, 10 aa, Mycobacterium
ATTAGTPEQI

SEQ ID NO: 439839 - protein, 6 aa, Mycobacterium
ATTAGV

SEQ ID NO: 439840 - protein, 8 aa, Mycobacterium
ATTAHAPN

SEQ ID NO: 439841 - protein, 5 aa, Mycobacterium
ATTAM

SEQ ID NO: 439842 - protein, 5 aa, Mycobacterium
ATTAN

SEQ ID NO: 439843 - protein, 10 aa, Mycobacterium
ATTANPGAAA

SEQ ID NO: 439844 - protein, 9 aa, Mycobacterium
ATTAQPAIT

SEQ ID NO: 439845 - protein, 13 aa, Mycobacterium
ATTASATNVQLSE

SEQ ID NO: 439846 - protein, 19 aa, Mycobacterium
ATTASSEADPNAAGTGHLP

SEQ ID NO: 439847 - protein, 5 aa, Mycobacterium
ATTAT

SEQ ID NO: 439848 - protein, 12 aa, Mycobacterium
ATTATQGGTPIG

SEQ ID NO: 439849 - protein, 12 aa, Mycobacterium
ATTAVLSGDEDR

SEQ ID NO: 439850 - protein, 5 aa, Mycobacterium
ATTDF

SEQ ID NO: 439851 - protein, 12 aa, Mycobacterium
ATTDFSEAANSA

SEQ ID NO: 439852 - protein, 5 aa, Mycobacterium
ATTDG

SEQ ID NO: 439853 - protein, 11 aa, Mycobacterium
ATTDGGKPPFV

SEQ ID NO: 439854 - protein, 6 aa, Mycobacterium
ATTDGH

SEQ ID NO: 439855 - protein, 7 aa, Mycobacterium
ATTDGKW

SEQ ID NO: 439856 - protein, 11 aa, Mycobacterium
ATTDGVNAAQG

SEQ ID NO: 439857 - protein, 7 aa, Mycobacterium
ATTDHDS

SEQ ID NO: 439858 - protein, 10 aa, Mycobacterium
ATTDKATLEA

SEQ ID NO: 439859 - protein, 6 aa, Mycobacterium
ATTDKD

SEQ ID NO: 439860 - protein, 7 aa, Mycobacterium
ATTDKDR

SEQ ID NO: 439861 - protein, 7 aa, Mycobacterium
ATTDLPT

SEQ ID NO: 439862 - protein, 5 aa, Mycobacterium
ATTDR

SEQ ID NO: 439863 - protein, 8 aa, Mycobacterium
ATTDRHDQ

SEQ ID NO: 439864 - protein, 9 aa, Mycobacterium
ATTDSGQGD

SEQ ID NO: 439865 - protein, 11 aa, Mycobacterium
ATTDSPSATAT

SEQ ID NO: 439866 - protein, 6 aa, Mycobacterium
ATTDSV

SEQ ID NO: 439867 - protein, 9 aa, Mycobacterium
ATTDTLSSE

SEQ ID NO: 439868 - protein, 6 aa, Mycobacterium
ATTDVI

SEQ ID NO: 439869 - protein, 6 aa, Mycobacterium
ATTDVT

SEQ ID NO: 439870 - protein, 10 aa, Mycobacterium
ATTEAEESER

SEQ ID NO: 439871 - protein, 13 aa, Mycobacterium
ATTEAGAGPAGHV

SEQ ID NO: 439872 - protein, 13 aa, Mycobacterium
ATTEARARVGDGG

SEQ ID NO: 439873 - protein, 11 aa, Mycobacterium
ATTEDGERFSD

SEQ ID NO: 439874 - protein, 6 aa, Mycobacterium
ATTEEP

SEQ ID NO: 439875 - protein, 15 aa, Mycobacterium
ATTEGYAARPGGAQA

SEQ ID NO: 439876 - protein, 10 aa, Mycobacterium
ATTEPRTAAT

SEQ ID NO: 439877 - protein, 5 aa, Mycobacterium
ATTEQ

SEQ ID NO: 439878 - protein, 7 aa, Mycobacterium
ATTEQAR

SEQ ID NO: 439879 - protein, 6 aa, Mycobacterium
ATTEQD

SEQ ID NO: 439880 - protein, 6 aa, Mycobacterium
ATTEQS

SEQ ID NO: 439881 - protein, 15 aa, Mycobacterium
ATTERAGGSATRNPW

SEQ ID NO: 439882 - protein, 10 aa, Mycobacterium
ATTESDPLSA

SEQ ID NO: 439883 - protein, 7 aa, Mycobacterium
ATTESQY

SEQ ID NO: 439884 - protein, 10 aa, Mycobacterium
ATTETGDQRP

SEQ ID NO: 439885 - protein, 7 aa, Mycobacterium
ATTETTT

SEQ ID NO: 439886 - protein, 4 aa, Mycobacterium
ATTF

SEQ ID NO: 439887 - protein, 5 aa, Mycobacterium
ATTFE

SEQ ID NO: 439888 - protein, 6 aa, Mycobacterium
ATTFEQ

SEQ ID NO: 439889 - protein, 5 aa, Mycobacterium
ATTFG

SEQ ID NO: 439890 - protein, 12 aa, Mycobacterium
ATTFPDPDRFDP

SEQ ID NO: 439891 - protein, 6 aa, Mycobacterium
ATTGAE

SEQ ID NO: 439892 - protein, 13 aa, Mycobacterium
ATTGATEEENTHP

SEQ ID NO: 439893 - protein, 22 aa, Mycobacterium
ATTGDAYRNPKDPNEPKIGEEI

SEQ ID NO: 439894 - protein, 7 aa, Mycobacterium
ATTGDEY

SEQ ID NO: 439895 - protein, 7 aa, Mycobacterium
ATTGDGD

SEQ ID NO: 439896 - protein, 7 aa, Mycobacterium
ATTGDGI

SEQ ID NO: 439897 - protein, 7 aa, Mycobacterium
ATTGDPE

SEQ ID NO: 439898 - protein, 9 aa, Mycobacterium
ATTGETHTI

SEQ ID NO: 439899 - protein, 5 aa, Mycobacterium
ATTGF

SEQ ID NO: 439900 - protein, 5 aa, Mycobacterium
ATTGL

SEQ ID NO: 439901 - protein, 6 aa, Mycobacterium
ATTGLG

SEQ ID NO: 439902 - protein, 9 aa, Mycobacterium
ATTGNSGAQ

SEQ ID NO: 439903 - protein, 7 aa, Mycobacterium
ATTGQVD

SEQ ID NO: 439904 - protein, 10 aa, Mycobacterium
ATTGRKATRD

SEQ ID NO: 439905 - protein, 12 aa, Mycobacterium
ATTGSHETRNTH

SEQ ID NO: 439906 - protein, 7 aa, Mycobacterium
ATTGSLD

SEQ ID NO: 439907 - protein, 27 aa, Mycobacterium
ATTGSNHGYDVTDPTTVSPELGGRDGL

SEQ ID NO: 439908 - protein, 27 aa, Mycobacterium
ATTGSSHGYDVTDPTTVSPELGGRDGL

SEQ ID NO: 439909 - protein, 15 aa, Mycobacterium
ATTGSTLYTDGGYAL

SEQ ID NO: 439910 - protein, 9 aa, Mycobacterium
ATTGSVRPG

SEQ ID NO: 439911 - protein, 9 aa, Mycobacterium
ATTGTSTRN

SEQ ID NO: 439912 - protein, 16 aa, Mycobacterium
ATTGTYGVNASSAMGT

SEQ ID NO: 439913 - protein, 22 aa, Mycobacterium
ATTGWPGPEPLDGAAYTAAILA

SEQ ID NO: 439914 - protein, 11 aa, Mycobacterium
ATTHDGVAPVG

SEQ ID NO: 439915 - protein, 6 aa, Mycobacterium
ATTHGT

SEQ ID NO: 439916 - protein, 15 aa, Mycobacterium
ATTIGTSDHASLTSH

SEQ ID NO: 439917 - protein, 10 aa, Mycobacterium
ATTKALGTGL

SEQ ID NO: 439918 - protein, 4 aa, Mycobacterium
ATTL

SEQ ID NO: 439919 - protein, 5 aa, Mycobacterium
ATTLD

SEQ ID NO: 439920 - protein, 10 aa, Mycobacterium
ATTLDQPDLQ

SEQ ID NO: 439921 - protein, 18 aa, Mycobacterium
ATTLESGGRISDITEEAV

SEQ ID NO: 439922 - protein, 15 aa, Mycobacterium
ATTLQEELGPTSGAH

SEQ ID NO: 439923 - protein, 11 aa, Mycobacterium
ATTNAQGAANF

SEQ ID NO: 439924 - protein, 6 aa, Mycobacterium
ATTNGK

SEQ ID NO: 439925 - protein, 12 aa, Mycobacterium
ATTNPDGATGDG

SEQ ID NO: 439926 - protein, 12 aa, Mycobacterium
ATTNPDGSTADG

SEQ ID NO: 439927 - protein, 12 aa, Mycobacterium
ATTNPEGSTGDG

SEQ ID NO: 439928 - protein, 4 aa, Mycobacterium
ATTP

SEQ ID NO: 439929 - protein, 7 aa, Mycobacterium
ATTPAGV

SEQ ID NO: 439930 - protein, 13 aa, Mycobacterium
ATTPAPAGRPVPG

SEQ ID NO: 439931 - protein, 12 aa, Mycobacterium
ATTPAPAPELQL

SEQ ID NO: 439932 - protein, 8 aa, Mycobacterium
ATTPAPDL

SEQ ID NO: 439933 - protein, 10 aa, Mycobacterium
ATTPAPPGAY

SEQ ID NO: 439934 - protein, 8 aa, Mycobacterium
ATTPARTA

SEQ ID NO: 439935 - protein, 9 aa, Mycobacterium
ATTPATEAE

SEQ ID NO: 439936 - protein, 6 aa, Mycobacterium
ATTPDL

SEQ ID NO: 439937 - protein, 7 aa, Mycobacterium
ATTPDVD

SEQ ID NO: 439938 - protein, 5 aa, Mycobacterium
ATTPE

SEQ ID NO: 439939 - protein, 8 aa, Mycobacterium
ATTPEGAD

SEQ ID NO: 439940 - protein, 8 aa, Mycobacterium
ATTPENIG

SEQ ID NO: 439941 - protein, 14 aa, Mycobacterium
ATTPERIRELTAGG

SEQ ID NO: 439942 - protein, 7 aa, Mycobacterium
ATTPGAL

SEQ ID NO: 439943 - protein, 7 aa, Mycobacterium
ATTPGSH

SEQ ID NO: 439944 - protein, 7 aa, Mycobacterium
ATTPIPA

SEQ ID NO: 439945 - protein, 8 aa, Mycobacterium
ATTPKARE

SEQ ID NO: 439946 - protein, 5 aa, Mycobacterium
ATTPL

SEQ ID NO: 439947 - protein, 7 aa, Mycobacterium
ATTPMRP

SEQ ID NO: 439948 - protein, 7 aa, Mycobacterium
ATTPMSE

SEQ ID NO: 439949 - protein, 8 aa, Mycobacterium
ATTPPAER

SEQ ID NO: 439950 - protein, 6 aa, Mycobacterium
ATTPRI

SEQ ID NO: 439951 - protein, 5 aa, Mycobacterium
ATTPT

SEQ ID NO: 439952 - protein, 22 aa, Mycobacterium
ATTPTDGNDRPTDPVVIESITI

SEQ ID NO: 439953 - protein, 27 aa, Mycobacterium
ATTPTTGNPWAPDRTPGGSSGGSGAAV

SEQ ID NO: 439954 - protein, 5 aa, Mycobacterium
ATTPV

SEQ ID NO: 439955 - protein, 6 aa, Mycobacterium
ATTPVP

SEQ ID NO: 439956 - protein, 10 aa, Mycobacterium
ATTPVPKSRT

SEQ ID NO: 439957 - protein, 24 aa, Mycobacterium
ATTPVTAGAGDPTAETPTESTTDP

SEQ ID NO: 439958 - protein, 5 aa, Mycobacterium
ATTPY

SEQ ID NO: 439959 - protein, 5 aa, Mycobacterium
ATTQA

SEQ ID NO: 439960 - protein, 6 aa, Mycobacterium
ATTQAR

SEQ ID NO: 439961 - protein, 5 aa, Mycobacterium
ATTQE

SEQ ID NO: 439962 - protein, 7 aa, Mycobacterium
ATTQKPQ

SEQ ID NO: 439963 - protein, 8 aa, Mycobacterium
ATTQKPQA

SEQ ID NO: 439964 - protein, 9 aa, Mycobacterium
ATTQKPQSV

SEQ ID NO: 439965 - protein, 8 aa, Mycobacterium
ATTQPAAI

SEQ ID NO: 439966 - protein, 9 aa, Mycobacterium
ATTQSAAET

SEQ ID NO: 439967 - protein, 4 aa, Mycobacterium
ATTR

SEQ ID NO: 439968 - protein, 12 aa, Mycobacterium
ATTRAAAGPGPL

SEQ ID NO: 439969 - protein, 11 aa, Mycobacterium
ATTRAKENNDL

SEQ ID NO: 439970 - protein, 7 aa, Mycobacterium
ATTRGSA

SEQ ID NO: 439971 - protein, 5 aa, Mycobacterium
ATTRL

SEQ ID NO: 439972 - protein, 6 aa, Mycobacterium
ATTRNG

SEQ ID NO: 439973 - protein, 7 aa, Mycobacterium
ATTRPKS

SEQ ID NO: 439974 - protein, 23 aa, Mycobacterium
ATTRRRSGSGSGADDRDSPSGLF

SEQ ID NO: 439975 - protein, 12 aa, Mycobacterium
ATTRSGSLTGPL

SEQ ID NO: 439976 - protein, 6 aa, Mycobacterium
ATTRTD

SEQ ID NO: 439977 - protein, 12 aa, Mycobacterium
ATTRTPRPGEVD

SEQ ID NO: 439978 - protein, 5 aa, Mycobacterium
ATTRY

SEQ ID NO: 439979 - protein, 12 aa, Mycobacterium
ATTSAGQQKLND

SEQ ID NO: 439980 - protein, 11 aa, Mycobacterium
ATTSAGRHPDS

SEQ ID NO: 439981 - protein, 5 aa, Mycobacterium
ATTSD

SEQ ID NO: 439982 - protein, 6 aa, Mycobacterium
ATTSGG

SEQ ID NO: 439983 - protein, 11 aa, Mycobacterium
ATTSISPDIES

SEQ ID NO: 439984 - protein, 8 aa, Mycobacterium
ATTSNPAF

SEQ ID NO: 439985 - protein, 5 aa, Mycobacterium
ATTSP

SEQ ID NO: 439986 - protein, 13 aa, Mycobacterium
ATTSPKASLEQPE

SEQ ID NO: 439987 - protein, 23 aa, Mycobacterium
ATTSPNSVSSPTSVAATAGYSRR

SEQ ID NO: 439988 - protein, 11 aa, Mycobacterium
ATTSPQAARTI

SEQ ID NO: 439989 - protein, 10 aa, Mycobacterium
ATTSPQDART

SEQ ID NO: 439990 - protein, 11 aa, Mycobacterium
ATTSPQEARTI

SEQ ID NO: 439991 - protein, 10 aa, Mycobacterium
ATTSPQPTRT

SEQ ID NO: 439992 - protein, 10 aa, Mycobacterium
ATTSPQQART

SEQ ID NO: 439993 - protein, 7 aa, Mycobacterium
ATTSPSV

SEQ ID NO: 439994 - protein, 24 aa, Mycobacterium
ATTSQTTQQVTTAGALSTTTGNSL

SEQ ID NO: 439995 - protein, 5 aa, Mycobacterium
ATTSR

SEQ ID NO: 439996 - protein, 30 aa, Mycobacterium
ATTSRRGTGESKNETKALDAGGWGKSGGGY

SEQ ID NO: 439997 - protein, 30 aa, Mycobacterium
ATTSRRTCGESKNDTKALDAGSWGKSGGGY

SEQ ID NO: 439998 - protein, 10 aa, Mycobacterium
ATTSSGVPES

SEQ ID NO: 439999 - protein, 11 aa, Mycobacterium
ATTSSPAETAA

SEQ ID NO: 440000 - protein, 10 aa, Mycobacterium
ATTSTAAHTA

SEQ ID NO: 440001 - protein, 22 aa, Mycobacterium
ATTSTDGNDRPSEPVVIESITI

SEQ ID NO: 440002 - protein, 22 aa, Mycobacterium
ATTSTDGSDRPTEPVVIESITI

SEQ ID NO: 440003 - protein, 9 aa, Mycobacterium
ATTSTLRKA

SEQ ID NO: 440004 - protein, 11 aa, Mycobacterium
ATTSVSPDIES

SEQ ID NO: 440005 - protein, 6 aa, Mycobacterium
ATTTAA

SEQ ID NO: 440006 - protein, 6 aa, Mycobacterium
ATTTAE

SEQ ID NO: 440007 - protein, 7 aa, Mycobacterium
ATTTDGL

SEQ ID NO: 440008 - protein, 13 aa, Mycobacterium
ATTTPSSPKKERV

SEQ ID NO: 440009 - protein, 6 aa, Mycobacterium
ATTTQA

SEQ ID NO: 440010 - protein, 7 aa, Mycobacterium
ATTTQAA

SEQ ID NO: 440011 - protein, 21 aa, Mycobacterium
ATTTQQAVDAAPLPEKTSAGI

SEQ ID NO: 440012 - protein, 5 aa, Mycobacterium
ATTTS

SEQ ID NO: 440013 - protein, 12 aa, Mycobacterium
ATTTSADKTSVL

SEQ ID NO: 440014 - protein, 5 aa, Mycobacterium
ATTTT

SEQ ID NO: 440015 - protein, 7 aa, Mycobacterium
ATTTTTE

SEQ ID NO: 440016 - protein, 5 aa, Mycobacterium
ATTTV

SEQ ID NO: 440017 - protein, 7 aa, Mycobacterium
ATTVAGR

SEQ ID NO: 440018 - protein, 5 aa, Mycobacterium
ATTVS

SEQ ID NO: 440019 - protein, 7 aa, Mycobacterium
ATTVTGD

SEQ ID NO: 440020 - protein, 5 aa, Mycobacterium
ATTWP

SEQ ID NO: 440021 - protein, 7 aa, Mycobacterium
ATTYPPD

SEQ ID NO: 440022 - protein, 39 aa, Mycobacterium
ATVAASDASVPSSATDTVAPPPAVPQRVSSTQLSERERE

SEQ ID NO: 440023 - protein, 11 aa, Mycobacterium
ATVADAAATGI

SEQ ID NO: 440024 - protein, 5 aa, Mycobacterium
ATVAE

SEQ ID NO: 440025 - protein, 5 aa, Mycobacterium
ATVAG

SEQ ID NO: 440026 - protein, 23 aa, Mycobacterium
ATVAPGEVDSATSDYIRIATERL

SEQ ID NO: 440027 - protein, 7 aa, Mycobacterium
ATVAPGH

SEQ ID NO: 440028 - protein, 17 aa, Mycobacterium
ATVASGAQAAAVAGTDQ

SEQ ID NO: 440029 - protein, 7 aa, Mycobacterium
ATVASGT

SEQ ID NO: 440030 - protein, 6 aa, Mycobacterium
ATVATG

SEQ ID NO: 440031 - protein, 22 aa, Mycobacterium
ATVATRNTRHFDGTGVDLVNPW

SEQ ID NO: 440032 - protein, 4 aa, Mycobacterium
ATVD

SEQ ID NO: 440033 - protein, 5 aa, Mycobacterium
ATVDA

SEQ ID NO: 440034 - protein, 9 aa, Mycobacterium
ATVDAPAAT

SEQ ID NO: 440035 - protein, 17 aa, Mycobacterium
ATVDDREPPPARDSPAE

SEQ ID NO: 440036 - protein, 12 aa, Mycobacterium
ATVDGAEKAAVG

SEQ ID NO: 440037 - protein, 10 aa, Mycobacterium
ATVDGQPLNQ

SEQ ID NO: 440038 - protein, 5 aa, Mycobacterium
ATVDP

SEQ ID NO: 440039 - protein, 5 aa, Mycobacterium
ATVDQ

SEQ ID NO: 440040 - protein, 5 aa, Mycobacterium
ATVDS

SEQ ID NO: 440041 - protein, 6 aa, Mycobacterium
ATVEAR

SEQ ID NO: 440042 - protein, 8 aa, Mycobacterium
ATVEEDGT

SEQ ID NO: 440043 - protein, 7 aa, Mycobacterium
ATVEERR

SEQ ID NO: 440044 - protein, 6 aa, Mycobacterium
ATVEGA

SEQ ID NO: 440045 - protein, 7 aa, Mycobacterium
ATVEGGA

SEQ ID NO: 440046 - protein, 13 aa, Mycobacterium
ATVEGRSDDPGYL

SEQ ID NO: 440047 - protein, 6 aa, Mycobacterium
ATVEST

SEQ ID NO: 440048 - protein, 7 aa, Mycobacterium
ATVETRN

SEQ ID NO: 440049 - protein, 5 aa, Mycobacterium
ATVGA

SEQ ID NO: 440050 - protein, 15 aa, Mycobacterium
ATVGDGQHLSDPEFE

SEQ ID NO: 440051 - protein, 5 aa, Mycobacterium
ATVGG

SEQ ID NO: 440052 - protein, 10 aa, Mycobacterium
ATVGGSGAIN

SEQ ID NO: 440053 - protein, 12 aa, Mycobacterium
ATVGGTGGAGGA

SEQ ID NO: 440054 - protein, 6 aa, Mycobacterium
ATVGNP

SEQ ID NO: 440055 - protein, 13 aa, Mycobacterium
ATVGSDSDPTAVT

SEQ ID NO: 440056 - protein, 6 aa, Mycobacterium
ATVGTA

SEQ ID NO: 440057 - protein, 8 aa, Mycobacterium
ATVKGGTY

SEQ ID NO: 440058 - protein, 7 aa, Mycobacterium
ATVKSAH

SEQ ID NO: 440059 - protein, 9 aa, Mycobacterium
ATVNGEPLN

SEQ ID NO: 440060 - protein, 13 aa, Mycobacterium
ATVPAERAAAAQR

SEQ ID NO: 440061 - protein, 7 aa, Mycobacterium
ATVPAGP

SEQ ID NO: 440062 - protein, 6 aa, Mycobacterium
ATVPDD

SEQ ID NO: 440063 - protein, 7 aa, Mycobacterium
ATVPGAS

SEQ ID NO: 440064 - protein, 6 aa, Mycobacterium
ATVPGF

SEQ ID NO: 440065 - protein, 8 aa, Mycobacterium
ATVPGGTV

SEQ ID NO: 440066 - protein, 6 aa, Mycobacterium
ATVPGS

SEQ ID NO: 440067 - protein, 7 aa, Mycobacterium
ATVPGSS

SEQ ID NO: 440068 - protein, 6 aa, Mycobacterium
ATVPPE

SEQ ID NO: 440069 - protein, 8 aa, Mycobacterium
ATVPRSSV

SEQ ID NO: 440070 - protein, 4 aa, Mycobacterium
ATVQ

SEQ ID NO: 440071 - protein, 6 aa, Mycobacterium
ATVQQR

SEQ ID NO: 440072 - protein, 5 aa, Mycobacterium
ATVRE

SEQ ID NO: 440073 - protein, 9 aa, Mycobacterium
ATVRRGTAE

SEQ ID NO: 440074 - protein, 9 aa, Mycobacterium
ATVRSDAGE

SEQ ID NO: 440075 - protein, 8 aa, Mycobacterium
ATVRSDTA

SEQ ID NO: 440076 - protein, 4 aa, Mycobacterium
ATVS

SEQ ID NO: 440077 - protein, 7 aa, Mycobacterium
ATVSATA

SEQ ID NO: 440078 - protein, 7 aa, Mycobacterium
ATVSDGS

SEQ ID NO: 440079 - protein, 25 aa, Mycobacterium
ATVSDRGAGPLGSAGTAATRSAAGL

SEQ ID NO: 440080 - protein, 7 aa, Mycobacterium
ATVSGAQ

SEQ ID NO: 440081 - protein, 12 aa, Mycobacterium
ATVSGDAAVTDA

SEQ ID NO: 440082 - protein, 10 aa, Mycobacterium
ATVSPDGNTL

SEQ ID NO: 440083 - protein, 6 aa, Mycobacterium
ATVSTA

SEQ ID NO: 440084 - protein, 13 aa, Mycobacterium
ATVSTTALDETDC

SEQ ID NO: 440085 - protein, 4 aa, Mycobacterium
ATVT

SEQ ID NO: 440086 - protein, 6 aa, Mycobacterium
ATVTAQ

SEQ ID NO: 440087 - protein, 15 aa, Mycobacterium
ATVTDGGEGERRAEG

SEQ ID NO: 440088 - protein, 13 aa, Mycobacterium
ATVTDSDGNTIDT

SEQ ID NO: 440089 - protein, 8 aa, Mycobacterium
ATVTGTSD

SEQ ID NO: 440090 - protein, 8 aa, Mycobacterium
ATVTQTDD

SEQ ID NO: 440091 - protein, 9 aa, Mycobacterium
ATVTSDANA

SEQ ID NO: 440092 - protein, 9 aa, Mycobacterium
ATVTTDADK

SEQ ID NO: 440093 - protein, 10 aa, Mycobacterium
ATVTTGQPGV

SEQ ID NO: 440094 - protein, 6 aa, Mycobacterium
ATVTTQ

SEQ ID NO: 440095 - protein, 4 aa, Mycobacterium
ATVV

SEQ ID NO: 440096 - protein, 7 aa, Mycobacterium
ATVVPGR

SEQ ID NO: 440097 - protein, 15 aa, Mycobacterium
ATVVQGGAERTDSVR

SEQ ID NO: 440098 - protein, 13 aa, Mycobacterium
ATVVTDKDAVRDA

SEQ ID NO: 440099 - protein, 4 aa, Mycobacterium
ATVY

SEQ ID NO: 440100 - protein, 7 aa, Mycobacterium
ATWAEAS

SEQ ID NO: 440101 - protein, 13 aa, Mycobacterium
ATWGGTRQGAYAA

SEQ ID NO: 440102 - protein, 6 aa, Mycobacterium
ATWGQN

SEQ ID NO: 440103 - protein, 7 aa, Mycobacterium
ATWPDAA

SEQ ID NO: 440104 - protein, 6 aa, Mycobacterium
ATWPPT

SEQ ID NO: 440105 - protein, 6 aa, Mycobacterium
ATWPTE

SEQ ID NO: 440106 - protein, 6 aa, Mycobacterium
ATWPTL

SEQ ID NO: 440107 - protein, 4 aa, Mycobacterium
ATWT

SEQ ID NO: 440108 - protein, 18 aa, Mycobacterium
ATWTADSGGKVSAARRPV

SEQ ID NO: 440109 - protein, 12 aa, Mycobacterium
ATWTADSGGVVS

SEQ ID NO: 440110 - protein, 6 aa, Mycobacterium
ATWTEP

SEQ ID NO: 440111 - protein, 7 aa, Mycobacterium
ATWTEQQ

SEQ ID NO: 440112 - protein, 6 aa, Mycobacterium
ATWTRE

SEQ ID NO: 440113 - protein, 6 aa, Mycobacterium
ATWTVS

SEQ ID NO: 440114 - protein, 7 aa, Mycobacterium
ATWYGGP

SEQ ID NO: 440115 - protein, 5 aa, Mycobacterium
ATYAK

SEQ ID NO: 440116 - protein, 7 aa, Mycobacterium
ATYARTG

SEQ ID NO: 440117 - protein, 6 aa, Mycobacterium
ATYDAA

SEQ ID NO: 440118 - protein, 8 aa, Mycobacterium
ATYDGAGT

SEQ ID NO: 440119 - protein, 5 aa, Mycobacterium
ATYDP

SEQ ID NO: 440120 - protein, 5 aa, Mycobacterium
ATYDQ

SEQ ID NO: 440121 - protein, 12 aa, Mycobacterium
ATYDRIAAEAQA

SEQ ID NO: 440122 - protein, 12 aa, Mycobacterium
ATYETDAYTPAD

SEQ ID NO: 440123 - protein, 23 aa, Mycobacterium
ATYGATYGATYGATYGATYPEGL

SEQ ID NO: 440124 - protein, 7 aa, Mycobacterium
ATYGDQV

SEQ ID NO: 440125 - protein, 7 aa, Mycobacterium
ATYGEQV

SEQ ID NO: 440126 - protein, 19 aa, Mycobacterium
ATYGPALPDGAPEDGTDRG

SEQ ID NO: 440127 - protein, 18 aa, Mycobacterium
ATYGPALPEGAPDDGVER

SEQ ID NO: 440128 - protein, 9 aa, Mycobacterium
ATYKTMPPA

SEQ ID NO: 440129 - protein, 5 aa, Mycobacterium
ATYNE

SEQ ID NO: 440130 - protein, 7 aa, Mycobacterium
ATYPAGP

SEQ ID NO: 440131 - protein, 8 aa, Mycobacterium
ATYPDASA

SEQ ID NO: 440132 - protein, 10 aa, Mycobacterium
ATYPDGSTPE

SEQ ID NO: 440133 - protein, 18 aa, Mycobacterium
ATYPGGLAGGMSEGGVTA

SEQ ID NO: 440134 - protein, 7 aa, Mycobacterium
ATYPGGP

SEQ ID NO: 440135 - protein, 19 aa, Mycobacterium
ATYPNHPQFDPADSEVTAR

SEQ ID NO: 440136 - protein, 7 aa, Mycobacterium
ATYQTAS

SEQ ID NO: 440137 - protein, 7 aa, Mycobacterium
ATYRPTV

SEQ ID NO: 440138 - protein, 11 aa, Mycobacterium
ATYRSRALPRG

SEQ ID NO: 440139 - protein, 19 aa, Mycobacterium
ATYRSRRHGRERDRGDGLE

SEQ ID NO: 440140 - protein, 6 aa, Mycobacterium
ATYTDR

SEQ ID NO: 440141 - protein, 18 aa, Mycobacterium
ATYTGAAGQLVEEALTHL

SEQ ID NO: 440142 - protein, 7 aa, Mycobacterium
AVAAAAG

SEQ ID NO: 440143 - protein, 13 aa, Mycobacterium
AVAAAAGKPWEDL

SEQ ID NO: 440144 - protein, 5 aa, Mycobacterium
AVAAD

SEQ ID NO: 440145 - protein, 6 aa, Mycobacterium
AVAADP

SEQ ID NO: 440146 - protein, 6 aa, Mycobacterium
AVAAEG

SEQ ID NO: 440147 - protein, 5 aa, Mycobacterium
AVAAG

SEQ ID NO: 440148 - protein, 8 aa, Mycobacterium
AVAAGDDL

SEQ ID NO: 440149 - protein, 17 aa, Mycobacterium
AVAAGSAEPGAADAGAD

SEQ ID NO: 440150 - protein, 6 aa, Mycobacterium
AVAANP

SEQ ID NO: 440151 - protein, 27 aa, Mycobacterium
AVAAPADAEATDAEAGSADADADEAPQ

SEQ ID NO: 440152 - protein, 9 aa, Mycobacterium
AVAAPAPGW

SEQ ID NO: 440153 - protein, 12 aa, Mycobacterium
AVAAPEDPPEDP

SEQ ID NO: 440154 - protein, 8 aa, Mycobacterium
AVAAPTTS

SEQ ID NO: 440155 - protein, 9 aa, Mycobacterium
AVAAQDDGK

SEQ ID NO: 440156 - protein, 7 aa, Mycobacterium
AVAAQDQ

SEQ ID NO: 440157 - protein, 8 aa, Mycobacterium
AVAAQDQV

SEQ ID NO: 440158 - protein, 7 aa, Mycobacterium
AVAAQEN

SEQ ID NO: 440159 - protein, 7 aa, Mycobacterium
AVAAQKD

SEQ ID NO: 440160 - protein, 8 aa, Mycobacterium
AVAAQKDG

SEQ ID NO: 440161 - protein, 8 aa, Mycobacterium
AVAAQSEG

SEQ ID NO: 440162 - protein, 15 aa, Mycobacterium
AVAARTAGDSAFDQA

SEQ ID NO: 440163 - protein, 15 aa, Mycobacterium
AVAARTAGDSAFDRA

SEQ ID NO: 440164 - protein, 15 aa, Mycobacterium
AVAARTAGDSSFDRA

SEQ ID NO: 440165 - protein, 27 aa, Mycobacterium
AVAARTAGRTHGRDSTDSAGAAGTAMA

SEQ ID NO: 440166 - protein, 5 aa, Mycobacterium
AVAAT

SEQ ID NO: 440167 - protein, 10 aa, Mycobacterium
AVAATAPTPM

SEQ ID NO: 440168 - protein, 17 aa, Mycobacterium
AVADAEMGTQHESVDPA

SEQ ID NO: 440169 - protein, 10 aa, Mycobacterium
AVADAHTTKV

SEQ ID NO: 440170 - protein, 12 aa, Mycobacterium
AVADATAKRHGG

SEQ ID NO: 440171 - protein, 6 aa, Mycobacterium
AVADDS

SEQ ID NO: 440172 - protein, 6 aa, Mycobacterium
AVADET

SEQ ID NO: 440173 - protein, 6 aa, Mycobacterium
AVADGD

SEQ ID NO: 440174 - protein, 9 aa, Mycobacterium
AVADGDGWR

SEQ ID NO: 440175 - protein, 8 aa, Mycobacterium
AVADGEAG

SEQ ID NO: 440176 - protein, 10 aa, Mycobacterium
AVADIPKDRW

SEQ ID NO: 440177 - protein, 17 aa, Mycobacterium
AVADQRDADLEARAQKL

SEQ ID NO: 440178 - protein, 15 aa, Mycobacterium
AVADSDATAPMPSDG

SEQ ID NO: 440179 - protein, 20 aa, Mycobacterium
AVADSRAALAEDQDDVAPLN

SEQ ID NO: 440180 - protein, 10 aa, Mycobacterium
AVADSTEDFP

SEQ ID NO: 440181 - protein, 11 aa, Mycobacterium
AVADTAQTARG

SEQ ID NO: 440182 - protein, 8 aa, Mycobacterium
AVAEDSRQ

SEQ ID NO: 440183 - protein, 5 aa, Mycobacterium
AVAEE

SEQ ID NO: 440184 - protein, 9 aa, Mycobacterium
AVAEETRSF

SEQ ID NO: 440185 - protein, 5 aa, Mycobacterium
AVAEH

SEQ ID NO: 440186 - protein, 7 aa, Mycobacterium
AVAEPGP

SEQ ID NO: 440187 - protein, 9 aa, Mycobacterium
AVAEPSGIS

SEQ ID NO: 440188 - protein, 14 aa, Mycobacterium
AVAEPTPHDPDARG

SEQ ID NO: 440189 - protein, 5 aa, Mycobacterium
AVAER

SEQ ID NO: 440190 - protein, 7 aa, Mycobacterium
AVAERRQ

SEQ ID NO: 440191 - protein, 6 aa, Mycobacterium
AVAESA

SEQ ID NO: 440192 - protein, 8 aa, Mycobacterium
AVAESAAD

SEQ ID NO: 440193 - protein, 11 aa, Mycobacterium
AVAESEARTQR

SEQ ID NO: 440194 - protein, 11 aa, Mycobacterium
AVAETAAAKGV

SEQ ID NO: 440195 - protein, 8 aa, Mycobacterium
AVAETARA

SEQ ID NO: 440196 - protein, 18 aa, Mycobacterium
AVAETLDDTGFSDNHSVP

SEQ ID NO: 440197 - protein, 5 aa, Mycobacterium
AVAGA

SEQ ID NO: 440198 - protein, 20 aa, Mycobacterium
AVAGADKTSLVEDANPETAA

SEQ ID NO: 440199 - protein, 105 aa, Mycobacterium
AVAGDADDTTADDTAGDAPESEPTAAEDSSETSKEDGQSRHENPVAAPSGGGGGATSGGGGGAPSSASSAGPAGTPQVPSPPGFGAANTPTDAQPGAAAASDAAG

SEQ ID NO: 440200 - protein, 11 aa, Mycobacterium
AVAGDGSPQAL

SEQ ID NO: 440201 - protein, 10 aa, Mycobacterium
AVAGDVAGAA

SEQ ID NO: 440202 - protein, 14 aa, Mycobacterium
AVAGEGYHQTENGY

SEQ ID NO: 440203 - protein, 6 aa, Mycobacterium
AVAGGA

SEQ ID NO: 440204 - protein, 6 aa, Mycobacterium
AVAGGG

SEQ ID NO: 440205 - protein, 8 aa, Mycobacterium
AVAGIEDG

SEQ ID NO: 440206 - protein, 8 aa, Mycobacterium
AVAGNPGL

SEQ ID NO: 440207 - protein, 5 aa, Mycobacterium
AVAGQ

SEQ ID NO: 440208 - protein, 7 aa, Mycobacterium
AVAGQDS

SEQ ID NO: 440209 - protein, 21 aa, Mycobacterium
AVAGRDPSLPRPPRGEAPDRN

SEQ ID NO: 440210 - protein, 7 aa, Mycobacterium
AVAGRQD

SEQ ID NO: 440211 - protein, 8 aa, Mycobacterium
AVAGRTGA

SEQ ID NO: 440212 - protein, 19 aa, Mycobacterium
AVAGSGDRAVAAAAERAKL

SEQ ID NO: 440213 - protein, 7 aa, Mycobacterium
AVAGTET

SEQ ID NO: 440214 - protein, 9 aa, Mycobacterium
AVAGTTNTL

SEQ ID NO: 440215 - protein, 4 aa, Mycobacterium
AVAK

SEQ ID NO: 440216 - protein, 12 aa, Mycobacterium
AVAKGDAHKTDL

SEQ ID NO: 440217 - protein, 5 aa, Mycobacterium
AVAKN

SEQ ID NO: 440218 - protein, 10 aa, Mycobacterium
AVAKQHSSAI

SEQ ID NO: 440219 - protein, 9 aa, Mycobacterium
AVANGSEPW

SEQ ID NO: 440220 - protein, 10 aa, Mycobacterium
AVANNTARQL

SEQ ID NO: 440221 - protein, 17 aa, Mycobacterium
AVANQPGDGLPAPSPEN

SEQ ID NO: 440222 - protein, 8 aa, Mycobacterium
AVANSDGS

SEQ ID NO: 440223 - protein, 4 aa, Mycobacterium
AVAP

SEQ ID NO: 440224 - protein, 10 aa, Mycobacterium
AVAPDRPQGP

SEQ ID NO: 440225 - protein, 6 aa, Mycobacterium
AVAPDS

SEQ ID NO: 440226 - protein, 6 aa, Mycobacterium
AVAPEA

SEQ ID NO: 440227 - protein, 9 aa, Mycobacterium
AVAPEDRIT

SEQ ID NO: 440228 - protein, 7 aa, Mycobacterium
AVAPEGG

SEQ ID NO: 440229 - protein, 11 aa, Mycobacterium
AVAPESVPTEL

SEQ ID NO: 440230 - protein, 5 aa, Mycobacterium
AVAPG

SEQ ID NO: 440231 - protein, 19 aa, Mycobacterium
AVAPGAHGTLATRRNGSDG

SEQ ID NO: 440232 - protein, 8 aa, Mycobacterium
AVAPGDAD

SEQ ID NO: 440233 - protein, 9 aa, Mycobacterium
AVAPGDGSQ

SEQ ID NO: 440234 - protein, 7 aa, Mycobacterium
AVAPGED

SEQ ID NO: 440235 - protein, 8 aa, Mycobacterium
AVAPGKRA

SEQ ID NO: 440236 - protein, 20 aa, Mycobacterium
AVAPGNVGTGNEDQPPGEYN

SEQ ID NO: 440237 - protein, 6 aa, Mycobacterium
AVAPGR

SEQ ID NO: 440238 - protein, 12 aa, Mycobacterium
AVAPKDKAAARA

SEQ ID NO: 440239 - protein, 12 aa, Mycobacterium
AVAPKDKAAARD

SEQ ID NO: 440240 - protein, 12 aa, Mycobacterium
AVAPKDKPTARD

SEQ ID NO: 440241 - protein, 8 aa, Mycobacterium
AVAPNIPG

SEQ ID NO: 440242 - protein, 16 aa, Mycobacterium
AVAPPPGGVSAGDGRC

SEQ ID NO: 440243 - protein, 6 aa, Mycobacterium
AVAPPQ

SEQ ID NO: 440244 - protein, 5 aa, Mycobacterium
AVAPQ

SEQ ID NO: 440245 - protein, 5 aa, Mycobacterium
AVAPR

SEQ ID NO: 440246 - protein, 23 aa, Mycobacterium
AVAPRGRSRPFADDAEGFGQGEG

SEQ ID NO: 440247 - protein, 7 aa, Mycobacterium
AVAPRSV

SEQ ID NO: 440248 - protein, 8 aa, Mycobacterium
AVAPSGQP

SEQ ID NO: 440249 - protein, 4 aa, Mycobacterium
AVAQ

SEQ ID NO: 440250 - protein, 8 aa, Mycobacterium
AVAQDGRT

SEQ ID NO: 440251 - protein, 13 aa, Mycobacterium
AVAQGEDAATLQR

SEQ ID NO: 440252 - protein, 7 aa, Mycobacterium
AVAREES

SEQ ID NO: 440253 - protein, 8 aa, Mycobacterium
AVAREGSE

SEQ ID NO: 440254 - protein, 6 aa, Mycobacterium
AVARES

SEQ ID NO: 440255 - protein, 7 aa, Mycobacterium
AVARRGD

SEQ ID NO: 440256 - protein, 5 aa, Mycobacterium
AVASA

SEQ ID NO: 440257 - protein, 11 aa, Mycobacterium
AVASADPDPLI

SEQ ID NO: 440258 - protein, 8 aa, Mycobacterium
AVASASIG

SEQ ID NO: 440259 - protein, 10 aa, Mycobacterium
AVASEGVPGG

SEQ ID NO: 440260 - protein, 5 aa, Mycobacterium
AVASG

SEQ ID NO: 440261 - protein, 6 aa, Mycobacterium
AVASGG

SEQ ID NO: 440262 - protein, 10 aa, Mycobacterium
AVASKGPDAL

SEQ ID NO: 440263 - protein, 8 aa, Mycobacterium
AVASNSRT

SEQ ID NO: 440264 - protein, 10 aa, Mycobacterium
AVASQGPDAL

SEQ ID NO: 440265 - protein, 10 aa, Mycobacterium
AVASQSEISA

SEQ ID NO: 440266 - protein, 11 aa, Mycobacterium
AVASRAGAPLG

SEQ ID NO: 440267 - protein, 31 aa, Mycobacterium
AVASRSASTPDKDAAGSSEPSVSGDSDDAVD

SEQ ID NO: 440268 - protein, 15 aa, Mycobacterium
AVASRTAVRSPKTAE

SEQ ID NO: 440269 - protein, 10 aa, Mycobacterium
AVASSDATNV

SEQ ID NO: 440270 - protein, 8 aa, Mycobacterium
AVASTGMA

SEQ ID NO: 440271 - protein, 9 aa, Mycobacterium
AVASTGPTL

SEQ ID NO: 440272 - protein, 13 aa, Mycobacterium
AVASTPPSTPAPR

SEQ ID NO: 440273 - protein, 7 aa, Mycobacterium
AVATAAG

SEQ ID NO: 440274 - protein, 9 aa, Mycobacterium
AVATAGPGY

SEQ ID NO: 440275 - protein, 9 aa, Mycobacterium
AVATGTPAE

SEQ ID NO: 440276 - protein, 10 aa, Mycobacterium
AVATPGEEGK

SEQ ID NO: 440277 - protein, 5 aa, Mycobacterium
AVATR

SEQ ID NO: 440278 - protein, 10 aa, Mycobacterium
AVATRKDKRA

SEQ ID NO: 440279 - protein, 7 aa, Mycobacterium
AVATSGS

SEQ ID NO: 440280 - protein, 18 aa, Mycobacterium
AVATSSADLVTGRSDGPL

SEQ ID NO: 440281 - protein, 11 aa, Mycobacterium
AVATSSTETIT

SEQ ID NO: 440282 - protein, 12 aa, Mycobacterium
AVATTAEVSGGA

SEQ ID NO: 440283 - protein, 6 aa, Mycobacterium
AVATTD

SEQ ID NO: 440284 - protein, 6 aa, Mycobacterium
AVATTG

SEQ ID NO: 440285 - protein, 6 aa, Mycobacterium
AVDAAK

SEQ ID NO: 440286 - protein, 13 aa, Mycobacterium
AVDADGRARPNYK

SEQ ID NO: 440287 - protein, 7 aa, Mycobacterium
AVDADTA

SEQ ID NO: 440288 - protein, 5 aa, Mycobacterium
AVDAE

SEQ ID NO: 440289 - protein, 5 aa, Mycobacterium
AVDAG

SEQ ID NO: 440290 - protein, 11 aa, Mycobacterium
AVDAGGNAQGN

SEQ ID NO: 440291 - protein, 8 aa, Mycobacterium
AVDAPDEV

SEQ ID NO: 440292 - protein, 10 aa, Mycobacterium
AVDARGARRA

SEQ ID NO: 440293 - protein, 5 aa, Mycobacterium
AVDDA

SEQ ID NO: 440294 - protein, 10 aa, Mycobacterium
AVDDAEARAR

SEQ ID NO: 440295 - protein, 14 aa, Mycobacterium
AVDDDEIRAAMMSA

SEQ ID NO: 440296 - protein, 6 aa, Mycobacterium
AVDDDT

SEQ ID NO: 440297 - protein, 9 aa, Mycobacterium
AVDDEETTA

SEQ ID NO: 440298 - protein, 12 aa, Mycobacterium
AVDDGDAEGVDA

SEQ ID NO: 440299 - protein, 9 aa, Mycobacterium
AVDDGLQRT

SEQ ID NO: 440300 - protein, 12 aa, Mycobacterium
AVDDGSDSPVPQ

SEQ ID NO: 440301 - protein, 6 aa, Mycobacterium
AVDDGT

SEQ ID NO: 440302 - protein, 5 aa, Mycobacterium
AVDDP

SEQ ID NO: 440303 - protein, 14 aa, Mycobacterium
AVDDPATIATDPYG

SEQ ID NO: 440304 - protein, 11 aa, Mycobacterium
AVDDPRIQSGP

SEQ ID NO: 440305 - protein, 12 aa, Mycobacterium
AVDDPYRAAKAA

SEQ ID NO: 440306 - protein, 5 aa, Mycobacterium
AVDDQ

SEQ ID NO: 440307 - protein, 5 aa, Mycobacterium
AVDEA

SEQ ID NO: 440308 - protein, 7 aa, Mycobacterium
AVDEAGN

SEQ ID NO: 440309 - protein, 6 aa, Mycobacterium
AVDEDT

SEQ ID NO: 440310 - protein, 11 aa, Mycobacterium
AVDEGAAELGG

SEQ ID NO: 440311 - protein, 10 aa, Mycobacterium
AVDEGVGPVA

SEQ ID NO: 440312 - protein, 11 aa, Mycobacterium
AVDELPGGRSW

SEQ ID NO: 440313 - protein, 5 aa, Mycobacterium
AVDEP

SEQ ID NO: 440314 - protein, 15 aa, Mycobacterium
AVDEPAPLESPAAAA

SEQ ID NO: 440315 - protein, 9 aa, Mycobacterium
AVDEPDDAT

SEQ ID NO: 440316 - protein, 5 aa, Mycobacterium
AVDEQ

SEQ ID NO: 440317 - protein, 9 aa, Mycobacterium
AVDEQTEEI

SEQ ID NO: 440318 - protein, 5 aa, Mycobacterium
AVDER

SEQ ID NO: 440319 - protein, 6 aa, Mycobacterium
AVDGDP

SEQ ID NO: 440320 - protein, 12 aa, Mycobacterium
AVDGEPTSQVRG

SEQ ID NO: 440321 - protein, 8 aa, Mycobacterium
AVDGGAAV

SEQ ID NO: 440322 - protein, 8 aa, Mycobacterium
AVDGGADG

SEQ ID NO: 440323 - protein, 7 aa, Mycobacterium
AVDGGDR

SEQ ID NO: 440324 - protein, 9 aa, Mycobacterium
AVDGGGGLQ

SEQ ID NO: 440325 - protein, 7 aa, Mycobacterium
AVDGIPP

SEQ ID NO: 440326 - protein, 10 aa, Mycobacterium
AVDGKANAAV

SEQ ID NO: 440327 - protein, 11 aa, Mycobacterium
AVDGKANDAVT

SEQ ID NO: 440328 - protein, 10 aa, Mycobacterium
AVDGKANEAV

SEQ ID NO: 440329 - protein, 11 aa, Mycobacterium
AVDGPGAARAA

SEQ ID NO: 440330 - protein, 6 aa, Mycobacterium
AVDGPH

SEQ ID NO: 440331 - protein, 24 aa, Mycobacterium
AVDGRGGGKADLAQGSGKDPTGID

SEQ ID NO: 440332 - protein, 11 aa, Mycobacterium
AVDGSGVAQTP

SEQ ID NO: 440333 - protein, 8 aa, Mycobacterium
AVDGTNTY

SEQ ID NO: 440334 - protein, 5 aa, Mycobacterium
AVDHP

SEQ ID NO: 440335 - protein, 6 aa, Mycobacterium
AVDIPE

SEQ ID NO: 440336 - protein, 8 aa, Mycobacterium
AVDKGLAR

SEQ ID NO: 440337 - protein, 4 aa, Mycobacterium
AVDL

SEQ ID NO: 440338 - protein, 6 aa, Mycobacterium
AVDNGH

SEQ ID NO: 440339 - protein, 8 aa, Mycobacterium
AVDPASHG

SEQ ID NO: 440340 - protein, 10 aa, Mycobacterium
AVDPEHPAGA

SEQ ID NO: 440341 - protein, 14 aa, Mycobacterium
AVDPEPAESSTDEW

SEQ ID NO: 440342 - protein, 13 aa, Mycobacterium
AVDPERGWGHRGE

SEQ ID NO: 440343 - protein, 5 aa, Mycobacterium
AVDPG

SEQ ID NO: 440344 - protein, 20 aa, Mycobacterium
AVDPGERKTRTFGPSTRDQL

SEQ ID NO: 440345 - protein, 14 aa, Mycobacterium
AVDPGPGGAPTSAS

SEQ ID NO: 440346 - protein, 8 aa, Mycobacterium
AVDPGRLG

SEQ ID NO: 440347 - protein, 8 aa, Mycobacterium
AVDPGSEA

SEQ ID NO: 440348 - protein, 8 aa, Mycobacterium
AVDPGTAV

SEQ ID NO: 440349 - protein, 7 aa, Mycobacterium
AVDPLSP

SEQ ID NO: 440350 - protein, 10 aa, Mycobacterium
AVDPPGQARS

SEQ ID NO: 440351 - protein, 11 aa, Mycobacterium
AVDPPGSARSD

SEQ ID NO: 440352 - protein, 6 aa, Mycobacterium
AVDPPH

SEQ ID NO: 440353 - protein, 7 aa, Mycobacterium
AVDPRSG

SEQ ID NO: 440354 - protein, 6 aa, Mycobacterium
AVDPSA

SEQ ID NO: 440355 - protein, 9 aa, Mycobacterium
AVDPSAPWQ

SEQ ID NO: 440356 - protein, 6 aa, Mycobacterium
AVDPSR

SEQ ID NO: 440357 - protein, 7 aa, Mycobacterium
AVDPTAQ

SEQ ID NO: 440358 - protein, 8 aa, Mycobacterium
AVDPTSVR

SEQ ID NO: 440359 - protein, 6 aa, Mycobacterium
AVDPTV

SEQ ID NO: 440360 - protein, 14 aa, Mycobacterium
AVDQAAGNSAASNV

SEQ ID NO: 440361 - protein, 11 aa, Mycobacterium
AVDRDEEADLP

SEQ ID NO: 440362 - protein, 9 aa, Mycobacterium
AVDREPTRE

SEQ ID NO: 440363 - protein, 6 aa, Mycobacterium
AVDRGP

SEQ ID NO: 440364 - protein, 13 aa, Mycobacterium
AVDRRDDAHRRDA

SEQ ID NO: 440365 - protein, 4 aa, Mycobacterium
AVDS

SEQ ID NO: 440366 - protein, 10 aa, Mycobacterium
AVDSAEFKSA

SEQ ID NO: 440367 - protein, 9 aa, Mycobacterium
AVDSGSGDL

SEQ ID NO: 440368 - protein, 5 aa, Mycobacterium
AVDSR

SEQ ID NO: 440369 - protein, 9 aa, Mycobacterium
AVDSSTLRT

SEQ ID NO: 440370 - protein, 5 aa, Mycobacterium
AVDTA

SEQ ID NO: 440371 - protein, 17 aa, Mycobacterium
AVDTDPEGQYAAPDRQE

SEQ ID NO: 440372 - protein, 16 aa, Mycobacterium
AVDTDTEPAPGRRTAT

SEQ ID NO: 440373 - protein, 6 aa, Mycobacterium
AVDTGE

SEQ ID NO: 440374 - protein, 19 aa, Mycobacterium
AVDTPGHVKRSRGSLGAPA

SEQ ID NO: 440375 - protein, 16 aa, Mycobacterium
AVDTPVDRLHGLGEIS

SEQ ID NO: 440376 - protein, 5 aa, Mycobacterium
AVDYP

SEQ ID NO: 440377 - protein, 13 aa, Mycobacterium
AVEAAPAAGAGEQ

SEQ ID NO: 440378 - protein, 10 aa, Mycobacterium
AVEAAQQTFE

SEQ ID NO: 440379 - protein, 6 aa, Mycobacterium
AVEADD

SEQ ID NO: 440380 - protein, 9 aa, Mycobacterium
AVEADESGF

SEQ ID NO: 440381 - protein, 10 aa, Mycobacterium
AVEADGTTLE

SEQ ID NO: 440382 - protein, 5 aa, Mycobacterium
AVEAG

SEQ ID NO: 440383 - protein, 5 aa, Mycobacterium
AVEAP

SEQ ID NO: 440384 - protein, 11 aa, Mycobacterium
AVEAPGDARPD

SEQ ID NO: 440385 - protein, 5 aa, Mycobacterium
AVEAQ

SEQ ID NO: 440386 - protein, 41 aa, Mycobacterium
AVEAQAEPQPEAQAQSEAQAQPQPGPEAPAPEAPAEEEPES

SEQ ID NO: 440387 - protein, 7 aa, Mycobacterium
AVEAQKG

SEQ ID NO: 440388 - protein, 5 aa, Mycobacterium
AVEAS

SEQ ID NO: 440389 - protein, 11 aa, Mycobacterium
AVEASGDDTIR

SEQ ID NO: 440390 - protein, 10 aa, Mycobacterium
AVEASRAGAD

SEQ ID NO: 440391 - protein, 9 aa, Mycobacterium
AVEATGKAV

SEQ ID NO: 440392 - protein, 14 aa, Mycobacterium
AVEDAEAGEVLAKL

SEQ ID NO: 440393 - protein, 6 aa, Mycobacterium
AVEDDP

SEQ ID NO: 440394 - protein, 6 aa, Mycobacterium
AVEDDR

SEQ ID NO: 440395 - protein, 10 aa, Mycobacterium
AVEDGGPGCG

SEQ ID NO: 440396 - protein, 12 aa, Mycobacterium
AVEDGSPLPPEE

SEQ ID NO: 440397 - protein, 6 aa, Mycobacterium
AVEDPD

SEQ ID NO: 440398 - protein, 12 aa, Mycobacterium
AVEDPQGPTVPV

SEQ ID NO: 440399 - protein, 10 aa, Mycobacterium
AVEDVRAAGG

SEQ ID NO: 440400 - protein, 9 aa, Mycobacterium
AVEEANEAG

SEQ ID NO: 440401 - protein, 6 aa, Mycobacterium
AVEEHG

SEQ ID NO: 440402 - protein, 19 aa, Mycobacterium
AVEEPAPAPEPRTYTVESG

SEQ ID NO: 440403 - protein, 12 aa, Mycobacterium
AVEEPGEPNAET

SEQ ID NO: 440404 - protein, 9 aa, Mycobacterium
AVEGHGTGT

SEQ ID NO: 440405 - protein, 11 aa, Mycobacterium
AVEGPQSPVPV

SEQ ID NO: 440406 - protein, 7 aa, Mycobacterium
AVEGQPG

SEQ ID NO: 440407 - protein, 6 aa, Mycobacterium
AVEGSE

SEQ ID NO: 440408 - protein, 10 aa, Mycobacterium
AVEGTETVDA

SEQ ID NO: 440409 - protein, 12 aa, Mycobacterium
AVEKAAKDGGHE

SEQ ID NO: 440410 - protein, 10 aa, Mycobacterium
AVEKAARDAG

SEQ ID NO: 440411 - protein, 9 aa, Mycobacterium
AVEKGETQG

SEQ ID NO: 440412 - protein, 6 aa, Mycobacterium
AVEKGL

SEQ ID NO: 440413 - protein, 8 aa, Mycobacterium
AVEKGLNR

SEQ ID NO: 440414 - protein, 10 aa, Mycobacterium
AVENGLAPAP

SEQ ID NO: 440415 - protein, 7 aa, Mycobacterium
AVENQPG

SEQ ID NO: 440416 - protein, 10 aa, Mycobacterium
AVENREADPL

SEQ ID NO: 440417 - protein, 5 aa, Mycobacterium
AVEPA

SEQ ID NO: 440418 - protein, 8 aa, Mycobacterium
AVEPAERR

SEQ ID NO: 440419 - protein, 17 aa, Mycobacterium
AVEPDPRVSDVPSTKGV

SEQ ID NO: 440420 - protein, 17 aa, Mycobacterium
AVEPDPRVSGVPSTKGV

SEQ ID NO: 440421 - protein, 17 aa, Mycobacterium
AVEPDPRVTGVPSTKGS

SEQ ID NO: 440422 - protein, 7 aa, Mycobacterium
AVEPGAA

SEQ ID NO: 440423 - protein, 11 aa, Mycobacterium
AVEPGQPLDAQ

SEQ ID NO: 440424 - protein, 8 aa, Mycobacterium
AVEPKTRD

SEQ ID NO: 440425 - protein, 11 aa, Mycobacterium
AVEPPAPAGGR

SEQ ID NO: 440426 - protein, 8 aa, Mycobacterium
AVEPPASA

SEQ ID NO: 440427 - protein, 9 aa, Mycobacterium
AVEPPGDAR

SEQ ID NO: 440428 - protein, 10 aa, Mycobacterium
AVEPSPQRAG

SEQ ID NO: 440429 - protein, 8 aa, Mycobacterium
AVEPSSHR

SEQ ID NO: 440430 - protein, 7 aa, Mycobacterium
AVEPTDA

SEQ ID NO: 440431 - protein, 10 aa, Mycobacterium
AVEQPGPDNV

SEQ ID NO: 440432 - protein, 13 aa, Mycobacterium
AVEQSKPSRPDSV

SEQ ID NO: 440433 - protein, 11 aa, Mycobacterium
AVERAATPGRM

SEQ ID NO: 440434 - protein, 8 aa, Mycobacterium
AVERDGSD

SEQ ID NO: 440435 - protein, 22 aa, Mycobacterium
AVERPSSVSSGRALPANLTGAG

SEQ ID NO: 440436 - protein, 6 aa, Mycobacterium
AVERRG

SEQ ID NO: 440437 - protein, 14 aa, Mycobacterium
AVESAARPLPFSGR

SEQ ID NO: 440438 - protein, 16 aa, Mycobacterium
AVESDDESLTAGTQGP

SEQ ID NO: 440439 - protein, 10 aa, Mycobacterium
AVESGAQSLG

SEQ ID NO: 440440 - protein, 9 aa, Mycobacterium
AVETAGANP

SEQ ID NO: 440441 - protein, 16 aa, Mycobacterium
AVETATPLGVRTGDGV

SEQ ID NO: 440442 - protein, 9 aa, Mycobacterium
AVETEQPAP

SEQ ID NO: 440443 - protein, 5 aa, Mycobacterium
AVETG

SEQ ID NO: 440444 - protein, 11 aa, Mycobacterium
AVETSKPEPLI

SEQ ID NO: 440445 - protein, 6 aa, Mycobacterium
AVETTH

SEQ ID NO: 440446 - protein, 4 aa, Mycobacterium
AVEV

SEQ ID NO: 440447 - protein, 14 aa, Mycobacterium
AVFGKTGEAEFPGG

SEQ ID NO: 440448 - protein, 5 aa, Mycobacterium
AVFGT

SEQ ID NO: 440449 - protein, 6 aa, Mycobacterium
AVFPDP

SEQ ID NO: 440450 - protein, 4 aa, Mycobacterium
AVGA

SEQ ID NO: 440451 - protein, 8 aa, Mycobacterium
AVGAAAGA

SEQ ID NO: 440452 - protein, 10 aa, Mycobacterium
AVGAARPGVT

SEQ ID NO: 440453 - protein, 11 aa, Mycobacterium
AVGAASGLDPL

SEQ ID NO: 440454 - protein, 9 aa, Mycobacterium
AVGAATPKH

SEQ ID NO: 440455 - protein, 5 aa, Mycobacterium
AVGAD

SEQ ID NO: 440456 - protein, 18 aa, Mycobacterium
AVGADNAVSATASGAGGN

SEQ ID NO: 440457 - protein, 6 aa, Mycobacterium
AVGAEA

SEQ ID NO: 440458 - protein, 10 aa, Mycobacterium
AVGAEGVPGG

SEQ ID NO: 440459 - protein, 6 aa, Mycobacterium
AVGAEQ

SEQ ID NO: 440460 - protein, 9 aa, Mycobacterium
AVGAGDTEA

SEQ ID NO: 440461 - protein, 8 aa, Mycobacterium
AVGAGDTL

SEQ ID NO: 440462 - protein, 9 aa, Mycobacterium
AVGAGSAGA

SEQ ID NO: 440463 - protein, 17 aa, Mycobacterium
AVGAGTARGAGHGRVLV

SEQ ID NO: 440464 - protein, 12 aa, Mycobacterium
AVGAPDEPEFHP

SEQ ID NO: 440465 - protein, 7 aa, Mycobacterium
AVGAPSG

SEQ ID NO: 440466 - protein, 8 aa, Mycobacterium
AVGAPSGV

SEQ ID NO: 440467 - protein, 5 aa, Mycobacterium
AVGAT

SEQ ID NO: 440468 - protein, 29 aa, Mycobacterium
AVGATGGNGGNSGSGGHGGSGGMGGTGGH

SEQ ID NO: 440469 - protein, 8 aa, Mycobacterium
AVGDAELG

SEQ ID NO: 440470 - protein, 10 aa, Mycobacterium
AVGDDAAGLD

SEQ ID NO: 440471 - protein, 17 aa, Mycobacterium
AVGDGNTGIAARGHQAG

SEQ ID NO: 440472 - protein, 8 aa, Mycobacterium
AVGDPGAY

SEQ ID NO: 440473 - protein, 8 aa, Mycobacterium
AVGDPVTS

SEQ ID NO: 440474 - protein, 6 aa, Mycobacterium
AVGDQT

SEQ ID NO: 440475 - protein, 18 aa, Mycobacterium
AVGDRRTQNQPGTTDEYP

SEQ ID NO: 440476 - protein, 7 aa, Mycobacterium
AVGDTES

SEQ ID NO: 440477 - protein, 17 aa, Mycobacterium
AVGEAATDGEPATAGSR

SEQ ID NO: 440478 - protein, 5 aa, Mycobacterium
AVGED

SEQ ID NO: 440479 - protein, 10 aa, Mycobacterium
AVGEDNPATV

SEQ ID NO: 440480 - protein, 5 aa, Mycobacterium
AVGEP

SEQ ID NO: 440481 - protein, 6 aa, Mycobacterium
AVGEPP

SEQ ID NO: 440482 - protein, 16 aa, Mycobacterium
AVGEPVDDDPLAAAGA

SEQ ID NO: 440483 - protein, 5 aa, Mycobacterium
AVGEQ

SEQ ID NO: 440484 - protein, 8 aa, Mycobacterium
AVGERPSA

SEQ ID NO: 440485 - protein, 6 aa, Mycobacterium
AVGESW

SEQ ID NO: 440486 - protein, 5 aa, Mycobacterium
AVGET

SEQ ID NO: 440487 - protein, 19 aa, Mycobacterium
AVGGAAPVSVPAAGAIGRE

SEQ ID NO: 440488 - protein, 19 aa, Mycobacterium
AVGGADPVDIPAAGAVGRE

SEQ ID NO: 440489 - protein, 19 aa, Mycobacterium
AVGGADPVDVPAAGAKGIE

SEQ ID NO: 440490 - protein, 11 aa, Mycobacterium
AVGGAPDIGPH

SEQ ID NO: 440491 - protein, 9 aa, Mycobacterium
AVGGASAGV

SEQ ID NO: 440492 - protein, 7 aa, Mycobacterium
AVGGASD

SEQ ID NO: 440493 - protein, 7 aa, Mycobacterium
AVGGATD

SEQ ID NO: 440494 - protein, 11 aa, Mycobacterium
AVGGDDADQLR

SEQ ID NO: 440495 - protein, 5 aa, Mycobacterium
AVGGE

SEQ ID NO: 440496 - protein, 15 aa, Mycobacterium
AVGGGAAAGGNNPLG

SEQ ID NO: 440497 - protein, 8 aa, Mycobacterium
AVGGGDAR

SEQ ID NO: 440498 - protein, 7 aa, Mycobacterium
AVGGGDC

SEQ ID NO: 440499 - protein, 13 aa, Mycobacterium
AVGGGGAPDVELP

SEQ ID NO: 440500 - protein, 13 aa, Mycobacterium
AVGGGQPAGPADD

SEQ ID NO: 440501 - protein, 23 aa, Mycobacterium
AVGGGSEFASGTGAENANEMPPD

SEQ ID NO: 440502 - protein, 9 aa, Mycobacterium
AVGGGTMSL

SEQ ID NO: 440503 - protein, 9 aa, Mycobacterium
AVGGNARRA

SEQ ID NO: 440504 - protein, 6 aa, Mycobacterium
AVGGNF

SEQ ID NO: 440505 - protein, 11 aa, Mycobacterium
AVGGQATPAQI

SEQ ID NO: 440506 - protein, 7 aa, Mycobacterium
AVGGQHA

SEQ ID NO: 440507 - protein, 13 aa, Mycobacterium
AVGGSGDDQRGAR

SEQ ID NO: 440508 - protein, 26 aa, Mycobacterium
AVGGSNSGPIASGQGSTAVNGDVRDS

SEQ ID NO: 440509 - protein, 16 aa, Mycobacterium
AVGGTHGRLPDSDEER

SEQ ID NO: 440510 - protein, 6 aa, Mycobacterium
AVGGTP

SEQ ID NO: 440511 - protein, 17 aa, Mycobacterium
AVGGTPVSGEASLRERE

SEQ ID NO: 440512 - protein, 9 aa, Mycobacterium
AVGGTQSAV

SEQ ID NO: 440513 - protein, 10 aa, Mycobacterium
AVGKAGAVAT

SEQ ID NO: 440514 - protein, 19 aa, Mycobacterium
AVGKGDPQVYAGRAGRPRF

SEQ ID NO: 440515 - protein, 8 aa, Mycobacterium
AVGKRGGA

SEQ ID NO: 440516 - protein, 9 aa, Mycobacterium
AVGKRGGSL

SEQ ID NO: 440517 - protein, 8 aa, Mycobacterium
AVGKRNGA

SEQ ID NO: 440518 - protein, 9 aa, Mycobacterium
AVGKRNGSL

SEQ ID NO: 440519 - protein, 9 aa, Mycobacterium
AVGKSGPAV

SEQ ID NO: 440520 - protein, 6 aa, Mycobacterium
AVGLPT

SEQ ID NO: 440521 - protein, 16 aa, Mycobacterium
AVGNPEGAPGLEATLA

SEQ ID NO: 440522 - protein, 6 aa, Mycobacterium
AVGNSD

SEQ ID NO: 440523 - protein, 4 aa, Mycobacterium
AVGP

SEQ ID NO: 440524 - protein, 6 aa, Mycobacterium
AVGPAG

SEQ ID NO: 440525 - protein, 5 aa, Mycobacterium
AVGPD

SEQ ID NO: 440526 - protein, 11 aa, Mycobacterium
AVGPDADPRTV

SEQ ID NO: 440527 - protein, 13 aa, Mycobacterium
AVGPDAKADSRAT

SEQ ID NO: 440528 - protein, 13 aa, Mycobacterium
AVGPDAKAESRAT

SEQ ID NO: 440529 - protein, 6 aa, Mycobacterium
AVGPDG

SEQ ID NO: 440530 - protein, 9 aa, Mycobacterium
AVGPDPYKG

SEQ ID NO: 440531 - protein, 8 aa, Mycobacterium
AVGPDRDL

SEQ ID NO: 440532 - protein, 6 aa, Mycobacterium
AVGPGD

SEQ ID NO: 440533 - protein, 20 aa, Mycobacterium
AVGPGDVASHRESYQTAKGA

SEQ ID NO: 440534 - protein, 6 aa, Mycobacterium
AVGPGG

SEQ ID NO: 440535 - protein, 7 aa, Mycobacterium
AVGPGNL

SEQ ID NO: 440536 - protein, 9 aa, Mycobacterium
AVGPGSKVY

SEQ ID NO: 440537 - protein, 9 aa, Mycobacterium
AVGPKDNES

SEQ ID NO: 440538 - protein, 6 aa, Mycobacterium
AVGPKT

SEQ ID NO: 440539 - protein, 6 aa, Mycobacterium
AVGPLG

SEQ ID NO: 440540 - protein, 5 aa, Mycobacterium
AVGPN

SEQ ID NO: 440541 - protein, 21 aa, Mycobacterium
AVGPNEDDKIEAPDSPQAQAT

SEQ ID NO: 440542 - protein, 6 aa, Mycobacterium
AVGPNI

SEQ ID NO: 440543 - protein, 11 aa, Mycobacterium
AVGPQANNASS

SEQ ID NO: 440544 - protein, 13 aa, Mycobacterium
AVGPQGTARSARD

SEQ ID NO: 440545 - protein, 6 aa, Mycobacterium
AVGPRT

SEQ ID NO: 440546 - protein, 8 aa, Mycobacterium
AVGPSRAK

SEQ ID NO: 440547 - protein, 7 aa, Mycobacterium
AVGPTAE

SEQ ID NO: 440548 - protein, 5 aa, Mycobacterium
AVGQG

SEQ ID NO: 440549 - protein, 11 aa, Mycobacterium
AVGQGRVERTQ

SEQ ID NO: 440550 - protein, 20 aa, Mycobacterium
AVGQGSEFASGGGSEGGNAI

SEQ ID NO: 440551 - protein, 22 aa, Mycobacterium
AVGQGSEFASGSGSEGGNANPV

SEQ ID NO: 440552 - protein, 11 aa, Mycobacterium
AVGQNAPGTPV

SEQ ID NO: 440553 - protein, 9 aa, Mycobacterium
AVGQPSVTI

SEQ ID NO: 440554 - protein, 11 aa, Mycobacterium
AVGQSGTGAEL

SEQ ID NO: 440555 - protein, 6 aa, Mycobacterium
AVGRDP

SEQ ID NO: 440556 - protein, 11 aa, Mycobacterium
AVGRGESSLVG

SEQ ID NO: 440557 - protein, 10 aa, Mycobacterium
AVGRPATTKA

SEQ ID NO: 440558 - protein, 7 aa, Mycobacterium
AVGRPYP

SEQ ID NO: 440559 - protein, 8 aa, Mycobacterium
AVGRPYPG

SEQ ID NO: 440560 - protein, 5 aa, Mycobacterium
AVGRS

SEQ ID NO: 440561 - protein, 5 aa, Mycobacterium
AVGSA

SEQ ID NO: 440562 - protein, 10 aa, Mycobacterium
AVGSADAETI

SEQ ID NO: 440563 - protein, 15 aa, Mycobacterium
AVGSAEGERDGYDVA

SEQ ID NO: 440564 - protein, 8 aa, Mycobacterium
AVGSAEHD

SEQ ID NO: 440565 - protein, 96 aa, Mycobacterium
AVGSDTETAGRTSVAAATAVADEQAAAATGTAHAGGAATLAGTAGPAGSAIAEQPRGATRTAHTAGPVTHQTGSGLATAAARTTIAPQSTPPAGAT

SEQ ID NO: 440566 - protein, 10 aa, Mycobacterium
AVGSGDAETI

SEQ ID NO: 440567 - protein, 13 aa, Mycobacterium
AVGSGGEERAEQL

SEQ ID NO: 440568 - protein, 5 aa, Mycobacterium
AVGSN

SEQ ID NO: 440569 - protein, 9 aa, Mycobacterium
AVGSPAPAF

SEQ ID NO: 440570 - protein, 8 aa, Mycobacterium
AVGSPRAV

SEQ ID NO: 440571 - protein, 7 aa, Mycobacterium
AVGSRSG

SEQ ID NO: 440572 - protein, 16 aa, Mycobacterium
AVGSTGTTAANALASE

SEQ ID NO: 440573 - protein, 4 aa, Mycobacterium
AVGT

SEQ ID NO: 440574 - protein, 9 aa, Mycobacterium
AVGTADPDI

SEQ ID NO: 440575 - protein, 12 aa, Mycobacterium
AVGTLPPGTAAS

SEQ ID NO: 440576 - protein, 14 aa, Mycobacterium
AVGTNGIGTALGTR

SEQ ID NO: 440577 - protein, 6 aa, Mycobacterium
AVGTPA

SEQ ID NO: 440578 - protein, 5 aa, Mycobacterium
AVGTS

SEQ ID NO: 440579 - protein, 5 aa, Mycobacterium
AVGTT

SEQ ID NO: 440580 - protein, 4 aa, Mycobacterium
AVGV

SEQ ID NO: 440581 - protein, 8 aa, Mycobacterium
AVGVTDTT

SEQ ID NO: 440582 - protein, 9 aa, Mycobacterium
AVGVTDTTF

SEQ ID NO: 440583 - protein, 5 aa, Mycobacterium
AVHDG

SEQ ID NO: 440584 - protein, 4 aa, Mycobacterium
AVHG

SEQ ID NO: 440585 - protein, 7 aa, Mycobacterium
AVHGEGS

SEQ ID NO: 440586 - protein, 6 aa, Mycobacterium
AVHGGP

SEQ ID NO: 440587 - protein, 14 aa, Mycobacterium
AVHPRDAPPQRQGL

SEQ ID NO: 440588 - protein, 13 aa, Mycobacterium
AVHRTGPGPMGPS

SEQ ID NO: 440589 - protein, 19 aa, Mycobacterium
AVHSGPAAVRAATAGDGLQ

SEQ ID NO: 440590 - protein, 13 aa, Mycobacterium
AVKAPADLDALAE

SEQ ID NO: 440591 - protein, 7 aa, Mycobacterium
AVKARGS

SEQ ID NO: 440592 - protein, 8 aa, Mycobacterium
AVKDADGS

SEQ ID NO: 440593 - protein, 6 aa, Mycobacterium
AVKDAY

SEQ ID NO: 440594 - protein, 7 aa, Mycobacterium
AVKDGPD

SEQ ID NO: 440595 - protein, 10 aa, Mycobacterium
AVKENSQQRN

SEQ ID NO: 440596 - protein, 6 aa, Mycobacterium
AVKERQ

SEQ ID NO: 440597 - protein, 5 aa, Mycobacterium
AVKET

SEQ ID NO: 440598 - protein, 4 aa, Mycobacterium
AVKG

SEQ ID NO: 440599 - protein, 7 aa, Mycobacterium
AVKGTRV

SEQ ID NO: 440600 - protein, 5 aa, Mycobacterium
AVKPD

SEQ ID NO: 440601 - protein, 6 aa, Mycobacterium
AVKPET

SEQ ID NO: 440602 - protein, 7 aa, Mycobacterium
AVKPETL

SEQ ID NO: 440603 - protein, 6 aa, Mycobacterium
AVKPGD

SEQ ID NO: 440604 - protein, 8 aa, Mycobacterium
AVKPGTAK

SEQ ID NO: 440605 - protein, 7 aa, Mycobacterium
AVKPPED

SEQ ID NO: 440606 - protein, 13 aa, Mycobacterium
AVKPPTPSRRLPK

SEQ ID NO: 440607 - protein, 8 aa, Mycobacterium
AVKPSNSH

SEQ ID NO: 440608 - protein, 8 aa, Mycobacterium
AVKPTGPP

SEQ ID NO: 440609 - protein, 7 aa, Mycobacterium
AVKQAAA

SEQ ID NO: 440610 - protein, 5 aa, Mycobacterium
AVKQG

SEQ ID NO: 440611 - protein, 8 aa, Mycobacterium
AVKSGKTG

SEQ ID NO: 440612 - protein, 13 aa, Mycobacterium
AVKSPADLDALAE

SEQ ID NO: 440613 - protein, 8 aa, Mycobacterium
AVKTGRAD

SEQ ID NO: 440614 - protein, 7 aa, Mycobacterium
AVKTPDE

SEQ ID NO: 440615 - protein, 10 aa, Mycobacterium
AVKTSAGQRA

SEQ ID NO: 440616 - protein, 9 aa, Mycobacterium
AVKTSGSRG

SEQ ID NO: 440617 - protein, 4 aa, Mycobacterium
AVLP

SEQ ID NO: 440618 - protein, 17 aa, Mycobacterium
AVLPDPRSARQPDGVHE

SEQ ID NO: 440619 - protein, 14 aa, Mycobacterium
AVLSGGQKGPHPIQ

SEQ ID NO: 440620 - protein, 4 aa, Mycobacterium
AVNA

SEQ ID NO: 440621 - protein, 8 aa, Mycobacterium
AVNADKRA

SEQ ID NO: 440622 - protein, 8 aa, Mycobacterium
AVNAHDGV

SEQ ID NO: 440623 - protein, 8 aa, Mycobacterium
AVNAHDSV

SEQ ID NO: 440624 - protein, 9 aa, Mycobacterium
AVNASGGVT

SEQ ID NO: 440625 - protein, 5 aa, Mycobacterium
AVNDG

SEQ ID NO: 440626 - protein, 175 aa, Mycobacterium
AVNDGDVQASPTSAPGGPGGPGSGTPGGGGAGGGGGTPEMPELPSTDPSMSPMSANSAGEEQSSGSPSSGGSPSGSPSGGSPSGGGAPSGAGMPDGGLPSDLPGGPDIPGLDDPSLKPASAGGGGGGGVGGGGGGMPAAPLGPAVGADSVSPSPSSTRGGGVGVPGGPGGGAGGM

SEQ ID NO: 440627 - protein, 10 aa, Mycobacterium
AVNDRDADDI

SEQ ID NO: 440628 - protein, 12 aa, Mycobacterium
AVNDSDGPALRT

SEQ ID NO: 440629 - protein, 6 aa, Mycobacterium
AVNEAG

SEQ ID NO: 440630 - protein, 11 aa, Mycobacterium
AVNESLDPRDP

SEQ ID NO: 440631 - protein, 7 aa, Mycobacterium
AVNGDPV

SEQ ID NO: 440632 - protein, 9 aa, Mycobacterium
AVNGEGGYF

SEQ ID NO: 440633 - protein, 9 aa, Mycobacterium
AVNGPGGYF

SEQ ID NO: 440634 - protein, 11 aa, Mycobacterium
AVNGPNPRTFG

SEQ ID NO: 440635 - protein, 7 aa, Mycobacterium
AVNGPNQ

SEQ ID NO: 440636 - protein, 9 aa, Mycobacterium
AVNGSTDEA

SEQ ID NO: 440637 - protein, 10 aa, Mycobacterium
AVNKPSNSDV

SEQ ID NO: 440638 - protein, 19 aa, Mycobacterium
AVNNDGGNKAGFAAPSISG

SEQ ID NO: 440639 - protein, 8 aa, Mycobacterium
AVNNDPHV

SEQ ID NO: 440640 - protein, 5 aa, Mycobacterium
AVNPA

SEQ ID NO: 440641 - protein, 12 aa, Mycobacterium
AVNPGPLDASGV

SEQ ID NO: 440642 - protein, 13 aa, Mycobacterium
AVNPQGAAGNGVA

SEQ ID NO: 440643 - protein, 20 aa, Mycobacterium
AVNQDGASNGLTAPNGPAQE

SEQ ID NO: 440644 - protein, 20 aa, Mycobacterium
AVNQDGASNGLTAPNGPSQQ

SEQ ID NO: 440645 - protein, 20 aa, Mycobacterium
AVNQDGASNGLTAPSGPAQQ

SEQ ID NO: 440646 - protein, 21 aa, Mycobacterium
AVNQDGASSGLTVPNGGAQQR

SEQ ID NO: 440647 - protein, 20 aa, Mycobacterium
AVNQDGASSGVTVPNGPAQQ

SEQ ID NO: 440648 - protein, 19 aa, Mycobacterium
AVNQDGRSAGLSAPSGDAQ

SEQ ID NO: 440649 - protein, 11 aa, Mycobacterium
AVNQDGRSNGI

SEQ ID NO: 440650 - protein, 18 aa, Mycobacterium
AVNQDGRSNGITAPNTAA

SEQ ID NO: 440651 - protein, 11 aa, Mycobacterium
AVNQDGRSNGL

SEQ ID NO: 440652 - protein, 5 aa, Mycobacterium
AVNQT

SEQ ID NO: 440653 - protein, 8 aa, Mycobacterium
AVNQVDGA

SEQ ID NO: 440654 - protein, 5 aa, Mycobacterium
AVNRG

SEQ ID NO: 440655 - protein, 10 aa, Mycobacterium
AVNRGNAAQA

SEQ ID NO: 440656 - protein, 10 aa, Mycobacterium
AVNRGNATQA

SEQ ID NO: 440657 - protein, 8 aa, Mycobacterium
AVNTAADR

SEQ ID NO: 440658 - protein, 4 aa, Mycobacterium
AVPA

SEQ ID NO: 440659 - protein, 6 aa, Mycobacterium
AVPAAQ

SEQ ID NO: 440660 - protein, 6 aa, Mycobacterium
AVPADA

SEQ ID NO: 440661 - protein, 14 aa, Mycobacterium
AVPADDAAATLTGS

SEQ ID NO: 440662 - protein, 10 aa, Mycobacterium
AVPADDPRTI

SEQ ID NO: 440663 - protein, 12 aa, Mycobacterium
AVPADDPRTRAT

SEQ ID NO: 440664 - protein, 10 aa, Mycobacterium
AVPADGADSQ

SEQ ID NO: 440665 - protein, 7 aa, Mycobacterium
AVPADNA

SEQ ID NO: 440666 - protein, 6 aa, Mycobacterium
AVPAEK

SEQ ID NO: 440667 - protein, 7 aa, Mycobacterium
AVPAEQL

SEQ ID NO: 440668 - protein, 15 aa, Mycobacterium
AVPAGAGPAVPPTAP

SEQ ID NO: 440669 - protein, 14 aa, Mycobacterium
AVPAGGADSPNGIS

SEQ ID NO: 440670 - protein, 9 aa, Mycobacterium
AVPAGHGSK

SEQ ID NO: 440671 - protein, 13 aa, Mycobacterium
AVPAGRSAPGPRD

SEQ ID NO: 440672 - protein, 5 aa, Mycobacterium
AVPAP

SEQ ID NO: 440673 - protein, 9 aa, Mycobacterium
AVPAQDPLG

SEQ ID NO: 440674 - protein, 10 aa, Mycobacterium
AVPAQGATSL

SEQ ID NO: 440675 - protein, 5 aa, Mycobacterium
AVPAR

SEQ ID NO: 440676 - protein, 7 aa, Mycobacterium
AVPAREQ

SEQ ID NO: 440677 - protein, 5 aa, Mycobacterium
AVPAS

SEQ ID NO: 440678 - protein, 6 aa, Mycobacterium
AVPAST

SEQ ID NO: 440679 - protein, 5 aa, Mycobacterium
AVPAT

SEQ ID NO: 440680 - protein, 10 aa, Mycobacterium
AVPATDPRTV

SEQ ID NO: 440681 - protein, 6 aa, Mycobacterium
AVPDAL

SEQ ID NO: 440682 - protein, 32 aa, Mycobacterium
AVPDAVAAPAASGRREQSRHRRRTRPGLVDPG

SEQ ID NO: 440683 - protein, 5 aa, Mycobacterium
AVPDD

SEQ ID NO: 440684 - protein, 6 aa, Mycobacterium
AVPDDV

SEQ ID NO: 440685 - protein, 7 aa, Mycobacterium
AVPDGAD

SEQ ID NO: 440686 - protein, 6 aa, Mycobacterium
AVPDGE

SEQ ID NO: 440687 - protein, 10 aa, Mycobacterium
AVPDGGPVDP

SEQ ID NO: 440688 - protein, 21 aa, Mycobacterium
AVPDGRSDTVAATTSLPQFPA

SEQ ID NO: 440689 - protein, 16 aa, Mycobacterium
AVPDGRSDTVAATTTL

SEQ ID NO: 440690 - protein, 14 aa, Mycobacterium
AVPDGTCCSADGVT

SEQ ID NO: 440691 - protein, 18 aa, Mycobacterium
AVPDGVDPASVPKPLAPE

SEQ ID NO: 440692 - protein, 18 aa, Mycobacterium
AVPDGVDPATVPKPLQPD

SEQ ID NO: 440693 - protein, 21 aa, Mycobacterium
AVPDKASESDDPPAPAKNSVG

SEQ ID NO: 440694 - protein, 10 aa, Mycobacterium
AVPDNVDPRL

SEQ ID NO: 440695 - protein, 14 aa, Mycobacterium
AVPDPSADPVRNGQ

SEQ ID NO: 440696 - protein, 5 aa, Mycobacterium
AVPDR

SEQ ID NO: 440697 - protein, 11 aa, Mycobacterium
AVPDRGGLSTH

SEQ ID NO: 440698 - protein, 5 aa, Mycobacterium
AVPDS

SEQ ID NO: 440699 - protein, 8 aa, Mycobacterium
AVPDSDAD

SEQ ID NO: 440700 - protein, 14 aa, Mycobacterium
AVPDSVDADGIDAP

SEQ ID NO: 440701 - protein, 5 aa, Mycobacterium
AVPDV

SEQ ID NO: 440702 - protein, 6 aa, Mycobacterium
AVPEAE

SEQ ID NO: 440703 - protein, 11 aa, Mycobacterium
AVPEAPDGPGW

SEQ ID NO: 440704 - protein, 6 aa, Mycobacterium
AVPEAS

SEQ ID NO: 440705 - protein, 6 aa, Mycobacterium
AVPEDI

SEQ ID NO: 440706 - protein, 7 aa, Mycobacterium
AVPEGAA

SEQ ID NO: 440707 - protein, 6 aa, Mycobacterium
AVPEGD

SEQ ID NO: 440708 - protein, 18 aa, Mycobacterium
AVPEGVDPATVPKPLAPE

SEQ ID NO: 440709 - protein, 6 aa, Mycobacterium
AVPENV

SEQ ID NO: 440710 - protein, 8 aa, Mycobacterium
AVPERSRA

SEQ ID NO: 440711 - protein, 7 aa, Mycobacterium
AVPEVPA

SEQ ID NO: 440712 - protein, 5 aa, Mycobacterium
AVPGA

SEQ ID NO: 440713 - protein, 10 aa, Mycobacterium
AVPGAGKGVA

SEQ ID NO: 440714 - protein, 11 aa, Mycobacterium
AVPGAPAGPVA

SEQ ID NO: 440715 - protein, 10 aa, Mycobacterium
AVPGAPDIGP

SEQ ID NO: 440716 - protein, 10 aa, Mycobacterium
AVPGDAPERL

SEQ ID NO: 440717 - protein, 6 aa, Mycobacterium
AVPGDE

SEQ ID NO: 440718 - protein, 9 aa, Mycobacterium
AVPGEPQSL

SEQ ID NO: 440719 - protein, 19 aa, Mycobacterium
AVPGEQSAHGDGVEAFLDE

SEQ ID NO: 440720 - protein, 13 aa, Mycobacterium
AVPGGDWPQYTRD

SEQ ID NO: 440721 - protein, 11 aa, Mycobacterium
AVPGGGFDDGY

SEQ ID NO: 440722 - protein, 15 aa, Mycobacterium
AVPGGSARGGALIRV

SEQ ID NO: 440723 - protein, 11 aa, Mycobacterium
AVPGGTTPIPP

SEQ ID NO: 440724 - protein, 7 aa, Mycobacterium
AVPGGYR

SEQ ID NO: 440725 - protein, 5 aa, Mycobacterium
AVPGH

SEQ ID NO: 440726 - protein, 28 aa, Mycobacterium
AVPGIPGDAPNAPNVPGIGGASANVPGL

SEQ ID NO: 440727 - protein, 10 aa, Mycobacterium
AVPGNGPTGL

SEQ ID NO: 440728 - protein, 9 aa, Mycobacterium
AVPGNRAPD

SEQ ID NO: 440729 - protein, 8 aa, Mycobacterium
AVPGPEGE

SEQ ID NO: 440730 - protein, 13 aa, Mycobacterium
AVPGPITSAASVG

SEQ ID NO: 440731 - protein, 6 aa, Mycobacterium
AVPGPL

SEQ ID NO: 440732 - protein, 8 aa, Mycobacterium
AVPGQPVA

SEQ ID NO: 440733 - protein, 8 aa, Mycobacterium
AVPGRGIG

SEQ ID NO: 440734 - protein, 7 aa, Mycobacterium
AVPGSAD

SEQ ID NO: 440735 - protein, 14 aa, Mycobacterium
AVPGSDGQAPPVKP

SEQ ID NO: 440736 - protein, 8 aa, Mycobacterium
AVPGSGGD

SEQ ID NO: 440737 - protein, 11 aa, Mycobacterium
AVPGSGGIRGP

SEQ ID NO: 440738 - protein, 37 aa, Mycobacterium
AVPGSSQDSHRACRPRRRSAGTSPASSGLSPGPASTM

SEQ ID NO: 440739 - protein, 12 aa, Mycobacterium
AVPGSVTSSASA

SEQ ID NO: 440740 - protein, 5 aa, Mycobacterium
AVPGT

SEQ ID NO: 440741 - protein, 6 aa, Mycobacterium
AVPGTE

SEQ ID NO: 440742 - protein, 14 aa, Mycobacterium
AVPGVEEVSDGTYR

SEQ ID NO: 440743 - protein, 11 aa, Mycobacterium
AVPGVPSGNAL

SEQ ID NO: 440744 - protein, 5 aa, Mycobacterium
AVPGW

SEQ ID NO: 440745 - protein, 14 aa, Mycobacterium
AVPKKGVPNCCVNT

SEQ ID NO: 440746 - protein, 14 aa, Mycobacterium
AVPLSSSSLAGAGV

SEQ ID NO: 440747 - protein, 4 aa, Mycobacterium
AVPN

SEQ ID NO: 440748 - protein, 30 aa, Mycobacterium
AVPNDGEPDEAPAPAADPGFGLSTVPPTHE

SEQ ID NO: 440749 - protein, 11 aa, Mycobacterium
AVPNDPRPPMV

SEQ ID NO: 440750 - protein, 4 aa, Mycobacterium
AVPP

SEQ ID NO: 440751 - protein, 13 aa, Mycobacterium
AVPPALPQTEGAT

SEQ ID NO: 440752 - protein, 7 aa, Mycobacterium
AVPPAQV

SEQ ID NO: 440753 - protein, 6 aa, Mycobacterium
AVPPAR

SEQ ID NO: 440754 - protein, 6 aa, Mycobacterium
AVPPAT

SEQ ID NO: 440755 - protein, 9 aa, Mycobacterium
AVPPDDIPD

SEQ ID NO: 440756 - protein, 11 aa, Mycobacterium
AVPPDDPGAQL

SEQ ID NO: 440757 - protein, 7 aa, Mycobacterium
AVPPDDY

SEQ ID NO: 440758 - protein, 15 aa, Mycobacterium
AVPPDPKTPTAMSPE

SEQ ID NO: 440759 - protein, 10 aa, Mycobacterium
AVPPDSEPDL

SEQ ID NO: 440760 - protein, 7 aa, Mycobacterium
AVPPDSI

SEQ ID NO: 440761 - protein, 8 aa, Mycobacterium
AVPPDVPA

SEQ ID NO: 440762 - protein, 6 aa, Mycobacterium
AVPPFS

SEQ ID NO: 440763 - protein, 5 aa, Mycobacterium
AVPPG

SEQ ID NO: 440764 - protein, 11 aa, Mycobacterium
AVPPGNPAGIT

SEQ ID NO: 440765 - protein, 6 aa, Mycobacterium
AVPPGQ

SEQ ID NO: 440766 - protein, 6 aa, Mycobacterium
AVPPHE

SEQ ID NO: 440767 - protein, 13 aa, Mycobacterium
AVPPPPIPGLPDP

SEQ ID NO: 440768 - protein, 8 aa, Mycobacterium
AVPPPSVP

SEQ ID NO: 440769 - protein, 8 aa, Mycobacterium
AVPPQPVT

SEQ ID NO: 440770 - protein, 7 aa, Mycobacterium
AVPPQRL

SEQ ID NO: 440771 - protein, 9 aa, Mycobacterium
AVPPQSGTS

SEQ ID NO: 440772 - protein, 11 aa, Mycobacterium
AVPPRPDPNAL

SEQ ID NO: 440773 - protein, 6 aa, Mycobacterium
AVPPSF

SEQ ID NO: 440774 - protein, 14 aa, Mycobacterium
AVPPTPAQPSEGEV

SEQ ID NO: 440775 - protein, 6 aa, Mycobacterium
AVPPVT

SEQ ID NO: 440776 - protein, 17 aa, Mycobacterium
AVPQAAGRGLGHTGGTL

SEQ ID NO: 440777 - protein, 5 aa, Mycobacterium
AVPQG

SEQ ID NO: 440778 - protein, 9 aa, Mycobacterium
AVPQPAEGV

SEQ ID NO: 440779 - protein, 9 aa, Mycobacterium
AVPQPGDDT

SEQ ID NO: 440780 - protein, 8 aa, Mycobacterium
AVPQPGGG

SEQ ID NO: 440781 - protein, 13 aa, Mycobacterium
AVPQQGNSVPPAM

SEQ ID NO: 440782 - protein, 6 aa, Mycobacterium
AVPQVG

SEQ ID NO: 440783 - protein, 7 aa, Mycobacterium
AVPRGDV

SEQ ID NO: 440784 - protein, 5 aa, Mycobacterium
AVPRP

SEQ ID NO: 440785 - protein, 6 aa, Mycobacterium
AVPRSL

SEQ ID NO: 440786 - protein, 11 aa, Mycobacterium
AVPRTSGKVDA

SEQ ID NO: 440787 - protein, 14 aa, Mycobacterium
AVPSDAEAGESAAG

SEQ ID NO: 440788 - protein, 13 aa, Mycobacterium
AVPSDDGASGYRT

SEQ ID NO: 440789 - protein, 8 aa, Mycobacterium
AVPSETAA

SEQ ID NO: 440790 - protein, 8 aa, Mycobacterium
AVPSGPIY

SEQ ID NO: 440791 - protein, 7 aa, Mycobacterium
AVPSNTQ

SEQ ID NO: 440792 - protein, 7 aa, Mycobacterium
AVPSPGR

SEQ ID NO: 440793 - protein, 12 aa, Mycobacterium
AVPSPREQAQVT

SEQ ID NO: 440794 - protein, 12 aa, Mycobacterium
AVPSPREQTGAS

SEQ ID NO: 440795 - protein, 5 aa, Mycobacterium
AVPSR

SEQ ID NO: 440796 - protein, 7 aa, Mycobacterium
AVPSSCT

SEQ ID NO: 440797 - protein, 6 aa, Mycobacterium
AVPSSE

SEQ ID NO: 440798 - protein, 7 aa, Mycobacterium
AVPSSRT

SEQ ID NO: 440799 - protein, 4 aa, Mycobacterium
AVPT

SEQ ID NO: 440800 - protein, 14 aa, Mycobacterium
AVPTDPAARERRRR

SEQ ID NO: 440801 - protein, 11 aa, Mycobacterium
AVPTEDAVTAA

SEQ ID NO: 440802 - protein, 7 aa, Mycobacterium
AVPTEQG

SEQ ID NO: 440803 - protein, 15 aa, Mycobacterium
AVPTKRREAIAQAGK

SEQ ID NO: 440804 - protein, 5 aa, Mycobacterium
AVPTP

SEQ ID NO: 440805 - protein, 6 aa, Mycobacterium
AVPTPA

SEQ ID NO: 440806 - protein, 5 aa, Mycobacterium
AVPTT

SEQ ID NO: 440807 - protein, 6 aa, Mycobacterium
AVPTTG

SEQ ID NO: 440808 - protein, 5 aa, Mycobacterium
AVPVG

SEQ ID NO: 440809 - protein, 7 aa, Mycobacterium
AVPVGAS

SEQ ID NO: 440810 - protein, 9 aa, Mycobacterium
AVPVPAASA

SEQ ID NO: 440811 - protein, 6 aa, Mycobacterium
AVPYRP

SEQ ID NO: 440812 - protein, 12 aa, Mycobacterium
AVQADGSMKSNP

SEQ ID NO: 440813 - protein, 12 aa, Mycobacterium
AVQASPDSGSAT

SEQ ID NO: 440814 - protein, 5 aa, Mycobacterium
AVQDG

SEQ ID NO: 440815 - protein, 6 aa, Mycobacterium
AVQDGD

SEQ ID NO: 440816 - protein, 9 aa, Mycobacterium
AVQDGEISQ

SEQ ID NO: 440817 - protein, 6 aa, Mycobacterium
AVQDGK

SEQ ID NO: 440818 - protein, 15 aa, Mycobacterium
AVQDTQRRVARRRGA

SEQ ID NO: 440819 - protein, 5 aa, Mycobacterium
AVQGP

SEQ ID NO: 440820 - protein, 6 aa, Mycobacterium
AVQGPN

SEQ ID NO: 440821 - protein, 8 aa, Mycobacterium
AVQGPSAV

SEQ ID NO: 440822 - protein, 6 aa, Mycobacterium
AVQGRD

SEQ ID NO: 440823 - protein, 13 aa, Mycobacterium
AVQGRKDAKLQKR

SEQ ID NO: 440824 - protein, 6 aa, Mycobacterium
AVQGVQ

SEQ ID NO: 440825 - protein, 20 aa, Mycobacterium
AVQKEYQRRTNQPQTGEVSQ

SEQ ID NO: 440826 - protein, 16 aa, Mycobacterium
AVQPDQRPSIGCGIKW

SEQ ID NO: 440827 - protein, 5 aa, Mycobacterium
AVQPG

SEQ ID NO: 440828 - protein, 7 aa, Mycobacterium
AVQPGAD

SEQ ID NO: 440829 - protein, 10 aa, Mycobacterium
AVQPGAKARE

SEQ ID NO: 440830 - protein, 11 aa, Mycobacterium
AVQPGGDTDFT

SEQ ID NO: 440831 - protein, 7 aa, Mycobacterium
AVQPGGS

SEQ ID NO: 440832 - protein, 7 aa, Mycobacterium
AVQPGRR

SEQ ID NO: 440833 - protein, 10 aa, Mycobacterium
AVQPQPSRQA

SEQ ID NO: 440834 - protein, 6 aa, Mycobacterium
AVQQEK

SEQ ID NO: 440835 - protein, 7 aa, Mycobacterium
AVQQENA

SEQ ID NO: 440836 - protein, 5 aa, Mycobacterium
AVQRA

SEQ ID NO: 440837 - protein, 9 aa, Mycobacterium
AVQRQNPAL

SEQ ID NO: 440838 - protein, 13 aa, Mycobacterium
AVQRRAGVEAEAR

SEQ ID NO: 440839 - protein, 11 aa, Mycobacterium
AVQRRDSRAPT

SEQ ID NO: 440840 - protein, 8 aa, Mycobacterium
AVQTAGAD

SEQ ID NO: 440841 - protein, 8 aa, Mycobacterium
AVQTGDVA

SEQ ID NO: 440842 - protein, 9 aa, Mycobacterium
AVQTPGADR

SEQ ID NO: 440843 - protein, 13 aa, Mycobacterium
AVQTRRDALDDRR

SEQ ID NO: 440844 - protein, 5 aa, Mycobacterium
AVQTT

SEQ ID NO: 440845 - protein, 8 aa, Mycobacterium
AVRADGDY

SEQ ID NO: 440846 - protein, 11 aa, Mycobacterium
AVRAGGAESVA

SEQ ID NO: 440847 - protein, 8 aa, Mycobacterium
AVRAGKAR

SEQ ID NO: 440848 - protein, 5 aa, Mycobacterium
AVRDD

SEQ ID NO: 440849 - protein, 5 aa, Mycobacterium
AVRDE

SEQ ID NO: 440850 - protein, 21 aa, Mycobacterium
AVRDGADEVADADRRAAGAWG

SEQ ID NO: 440851 - protein, 21 aa, Mycobacterium
AVRDGADEVANADRRAAGVWA

SEQ ID NO: 440852 - protein, 6 aa, Mycobacterium
AVRDGD

SEQ ID NO: 440853 - protein, 7 aa, Mycobacterium
AVRDGDD

SEQ ID NO: 440854 - protein, 10 aa, Mycobacterium
AVRDGDGPHS

SEQ ID NO: 440855 - protein, 7 aa, Mycobacterium
AVRDGDR

SEQ ID NO: 440856 - protein, 6 aa, Mycobacterium
AVRDGS

SEQ ID NO: 440857 - protein, 21 aa, Mycobacterium
AVRDGSDDVAATDRSAANAWG

SEQ ID NO: 440858 - protein, 21 aa, Mycobacterium
AVRDGSDEVAATDRSAANAWG

SEQ ID NO: 440859 - protein, 9 aa, Mycobacterium
AVRDKDGIS

SEQ ID NO: 440860 - protein, 6 aa, Mycobacterium
AVRDNG

SEQ ID NO: 440861 - protein, 5 aa, Mycobacterium
AVRDR

SEQ ID NO: 440862 - protein, 5 aa, Mycobacterium
AVREE

SEQ ID NO: 440863 - protein, 7 aa, Mycobacterium
AVREGDT

SEQ ID NO: 440864 - protein, 10 aa, Mycobacterium
AVREGGDDGL

SEQ ID NO: 440865 - protein, 8 aa, Mycobacterium
AVREGREG

SEQ ID NO: 440866 - protein, 8 aa, Mycobacterium
AVREGRPT

SEQ ID NO: 440867 - protein, 8 aa, Mycobacterium
AVREHDPS

SEQ ID NO: 440868 - protein, 8 aa, Mycobacterium
AVRETSTL

SEQ ID NO: 440869 - protein, 5 aa, Mycobacterium
AVRGA

SEQ ID NO: 440870 - protein, 9 aa, Mycobacterium
AVRGDPARQ

SEQ ID NO: 440871 - protein, 14 aa, Mycobacterium
AVRGDRAASNQTTI

SEQ ID NO: 440872 - protein, 7 aa, Mycobacterium
AVRGGDW

SEQ ID NO: 440873 - protein, 12 aa, Mycobacterium
AVRGGHSALTAA

SEQ ID NO: 440874 - protein, 7 aa, Mycobacterium
AVRGPAG

SEQ ID NO: 440875 - protein, 8 aa, Mycobacterium
AVRGPAGE

SEQ ID NO: 440876 - protein, 6 aa, Mycobacterium
AVRGPR

SEQ ID NO: 440877 - protein, 8 aa, Mycobacterium
AVRGQQSR

SEQ ID NO: 440878 - protein, 7 aa, Mycobacterium
AVRGQVQ

SEQ ID NO: 440879 - protein, 9 aa, Mycobacterium
AVRGQWGSG

SEQ ID NO: 440880 - protein, 17 aa, Mycobacterium
AVRGTPVSGEESLRERE

SEQ ID NO: 440881 - protein, 14 aa, Mycobacterium
AVRHGRQRVGDPHR

SEQ ID NO: 440882 - protein, 12 aa, Mycobacterium
AVRKGERNQQQG

SEQ ID NO: 440883 - protein, 5 aa, Mycobacterium
AVRKN

SEQ ID NO: 440884 - protein, 11 aa, Mycobacterium
AVRNANGYSKD

SEQ ID NO: 440885 - protein, 9 aa, Mycobacterium
AVRPALNGS

SEQ ID NO: 440886 - protein, 6 aa, Mycobacterium
AVRPAY

SEQ ID NO: 440887 - protein, 10 aa, Mycobacterium
AVRPDATALP

SEQ ID NO: 440888 - protein, 6 aa, Mycobacterium
AVRPDG

SEQ ID NO: 440889 - protein, 8 aa, Mycobacterium
AVRPDGTH

SEQ ID NO: 440890 - protein, 10 aa, Mycobacterium
AVRPETDTFA

SEQ ID NO: 440891 - protein, 6 aa, Mycobacterium
AVRPGE

SEQ ID NO: 440892 - protein, 8 aa, Mycobacterium
AVRPGGTV

SEQ ID NO: 440893 - protein, 15 aa, Mycobacterium
AVRPGPHQVDPKVTE

SEQ ID NO: 440894 - protein, 11 aa, Mycobacterium
AVRPPGSTDEI

SEQ ID NO: 440895 - protein, 12 aa, Mycobacterium
AVRPSRHDGPHE

SEQ ID NO: 440896 - protein, 12 aa, Mycobacterium
AVRPSSGPSALN

SEQ ID NO: 440897 - protein, 15 aa, Mycobacterium
AVRPYTASRRSQFAS

SEQ ID NO: 440898 - protein, 7 aa, Mycobacterium
AVRQGDP

SEQ ID NO: 440899 - protein, 12 aa, Mycobacterium
AVRQGDPLDSET

SEQ ID NO: 440900 - protein, 11 aa, Mycobacterium
AVRQGDPLNTE

SEQ ID NO: 440901 - protein, 12 aa, Mycobacterium
AVRQGSAPGSDY

SEQ ID NO: 440902 - protein, 4 aa, Mycobacterium
AVRR

SEQ ID NO: 440903 - protein, 10 aa, Mycobacterium
AVRREQLSDE

SEQ ID NO: 440904 - protein, 7 aa, Mycobacterium
AVRRGAA

SEQ ID NO: 440905 - protein, 5 aa, Mycobacterium
AVRRN

SEQ ID NO: 440906 - protein, 8 aa, Mycobacterium
AVRRPAPR

SEQ ID NO: 440907 - protein, 5 aa, Mycobacterium
AVRRR

SEQ ID NO: 440908 - protein, 13 aa, Mycobacterium
AVRRSESGNRGNY

SEQ ID NO: 440909 - protein, 17 aa, Mycobacterium
AVRRSRAGVADPNRPTG

SEQ ID NO: 440910 - protein, 20 aa, Mycobacterium
AVRRTGSGETITPSFVLPMD

SEQ ID NO: 440911 - protein, 4 aa, Mycobacterium
AVRS

SEQ ID NO: 440912 - protein, 30 aa, Mycobacterium
AVRSADRSRPGDGVAATSRRGNRLPRDERR

SEQ ID NO: 440913 - protein, 10 aa, Mycobacterium
AVRSDSPPRT

SEQ ID NO: 440914 - protein, 6 aa, Mycobacterium
AVRSGA

SEQ ID NO: 440915 - protein, 12 aa, Mycobacterium
AVRSGANATLGR

SEQ ID NO: 440916 - protein, 6 aa, Mycobacterium
AVRSGD

SEQ ID NO: 440917 - protein, 10 aa, Mycobacterium
AVRSGDRAAL

SEQ ID NO: 440918 - protein, 12 aa, Mycobacterium
AVRSGQDAGDIA

SEQ ID NO: 440919 - protein, 9 aa, Mycobacterium
AVRSGTLRP

SEQ ID NO: 440920 - protein, 6 aa, Mycobacterium
AVRSPR

SEQ ID NO: 440921 - protein, 7 aa, Mycobacterium
AVRSRRD

SEQ ID NO: 440922 - protein, 7 aa, Mycobacterium
AVRSSGV

SEQ ID NO: 440923 - protein, 11 aa, Mycobacterium
AVRSSQGSPEV

SEQ ID NO: 440924 - protein, 4 aa, Mycobacterium
AVRT

SEQ ID NO: 440925 - protein, 66 aa, Mycobacterium
AVRTADEDSERDIPPSVRDNAPPLGSPPASEATPPPIPVAPPRTQAAQQVPPPSWPAETPGQAGNQ

SEQ ID NO: 440926 - protein, 18 aa, Mycobacterium
AVRTDGAFGSNPAGNART

SEQ ID NO: 440927 - protein, 14 aa, Mycobacterium
AVRTSARVDSSDRF

SEQ ID NO: 440928 - protein, 4 aa, Mycobacterium
AVSA

SEQ ID NO: 440929 - protein, 28 aa, Mycobacterium
AVSAESAATRALPDVTPATTRRRCLPAD

SEQ ID NO: 440930 - protein, 12 aa, Mycobacterium
AVSAGARSRIED

SEQ ID NO: 440931 - protein, 17 aa, Mycobacterium
AVSAPTAENLTADGTFK

SEQ ID NO: 440932 - protein, 21 aa, Mycobacterium
AVSARPPITGLTGPDALGPAD

SEQ ID NO: 440933 - protein, 6 aa, Mycobacterium
AVSASS

SEQ ID NO: 440934 - protein, 5 aa, Mycobacterium
AVSDA

SEQ ID NO: 440935 - protein, 6 aa, Mycobacterium
AVSDAD

SEQ ID NO: 440936 - protein, 11 aa, Mycobacterium
AVSDDDRSDGM

SEQ ID NO: 440937 - protein, 6 aa, Mycobacterium
AVSDDL

SEQ ID NO: 440938 - protein, 7 aa, Mycobacterium
AVSDGDD

SEQ ID NO: 440939 - protein, 8 aa, Mycobacterium
AVSDGGGL

SEQ ID NO: 440940 - protein, 7 aa, Mycobacterium
AVSDNTH

SEQ ID NO: 440941 - protein, 8 aa, Mycobacterium
AVSDSPVP

SEQ ID NO: 440942 - protein, 4 aa, Mycobacterium
AVSE

SEQ ID NO: 440943 - protein, 6 aa, Mycobacterium
AVSEDE

SEQ ID NO: 440944 - protein, 7 aa, Mycobacterium
AVSEDGV

SEQ ID NO: 440945 - protein, 10 aa, Mycobacterium
AVSESEPQAA

SEQ ID NO: 440946 - protein, 11 aa, Mycobacterium
AVSGAAAALAA

SEQ ID NO: 440947 - protein, 6 aa, Mycobacterium
AVSGDG

SEQ ID NO: 440948 - protein, 7 aa, Mycobacterium
AVSGDKL

SEQ ID NO: 440949 - protein, 12 aa, Mycobacterium
AVSGDVRDPYPE

SEQ ID NO: 440950 - protein, 5 aa, Mycobacterium
AVSGG

SEQ ID NO: 440951 - protein, 12 aa, Mycobacterium
AVSGGELRTESG

SEQ ID NO: 440952 - protein, 57 aa, Mycobacterium
AVSGGGATDCGGGSGCATQRGNATTSTKFATAGRGSGRRTAGATTAGSATATDCPAV

SEQ ID NO: 440953 - protein, 17 aa, Mycobacterium
AVSGGPLRKNGIPQPPL

SEQ ID NO: 440954 - protein, 11 aa, Mycobacterium
AVSGGSRGIGR

SEQ ID NO: 440955 - protein, 11 aa, Mycobacterium
AVSGKGAQARR

SEQ ID NO: 440956 - protein, 12 aa, Mycobacterium
AVSGKGSQARRA

SEQ ID NO: 440957 - protein, 7 aa, Mycobacterium
AVSGLTG

SEQ ID NO: 440958 - protein, 14 aa, Mycobacterium
AVSGNDGVDPDQAA

SEQ ID NO: 440959 - protein, 20 aa, Mycobacterium
AVSGPGGGASVPPGATPAPV

SEQ ID NO: 440960 - protein, 9 aa, Mycobacterium
AVSGPRVGV

SEQ ID NO: 440961 - protein, 18 aa, Mycobacterium
AVSGRGELHNTDMSPAAA

SEQ ID NO: 440962 - protein, 9 aa, Mycobacterium
AVSGRNYEV

SEQ ID NO: 440963 - protein, 7 aa, Mycobacterium
AVSGRVR

SEQ ID NO: 440964 - protein, 6 aa, Mycobacterium
AVSGSA

SEQ ID NO: 440965 - protein, 8 aa, Mycobacterium
AVSGSGIA

SEQ ID NO: 440966 - protein, 8 aa, Mycobacterium
AVSGSGLA

SEQ ID NO: 440967 - protein, 9 aa, Mycobacterium
AVSGSGLAG

SEQ ID NO: 440968 - protein, 9 aa, Mycobacterium
AVSGSGPDR

SEQ ID NO: 440969 - protein, 9 aa, Mycobacterium
AVSGSGVAG

SEQ ID NO: 440970 - protein, 4 aa, Mycobacterium
AVSL

SEQ ID NO: 440971 - protein, 6 aa, Mycobacterium
AVSNAE

SEQ ID NO: 440972 - protein, 7 aa, Mycobacterium
AVSNRPS

SEQ ID NO: 440973 - protein, 10 aa, Mycobacterium
AVSNSTASWR

SEQ ID NO: 440974 - protein, 4 aa, Mycobacterium
AVSP

SEQ ID NO: 440975 - protein, 9 aa, Mycobacterium
AVSPATVSE

SEQ ID NO: 440976 - protein, 7 aa, Mycobacterium
AVSPDKP

SEQ ID NO: 440977 - protein, 13 aa, Mycobacterium
AVSPEDVRPFRPD

SEQ ID NO: 440978 - protein, 6 aa, Mycobacterium
AVSPEV

SEQ ID NO: 440979 - protein, 14 aa, Mycobacterium
AVSPGSGAPAVVPG

SEQ ID NO: 440980 - protein, 19 aa, Mycobacterium
AVSPKGNGRPHSYDAGRTL

SEQ ID NO: 440981 - protein, 11 aa, Mycobacterium
AVSPPNNTGDG

SEQ ID NO: 440982 - protein, 6 aa, Mycobacterium
AVSPPP

SEQ ID NO: 440983 - protein, 8 aa, Mycobacterium
AVSPPQGG

SEQ ID NO: 440984 - protein, 8 aa, Mycobacterium
AVSPTDAD

SEQ ID NO: 440985 - protein, 8 aa, Mycobacterium
AVSPTSHR

SEQ ID NO: 440986 - protein, 20 aa, Mycobacterium
AVSPYGAGALAGSSLGLDPD

SEQ ID NO: 440987 - protein, 20 aa, Mycobacterium
AVSPYGSGALAGSSLGLDPD

SEQ ID NO: 440988 - protein, 21 aa, Mycobacterium
AVSPYGSGALAGSSLGLDPDA

SEQ ID NO: 440989 - protein, 7 aa, Mycobacterium
AVSQAGL

SEQ ID NO: 440990 - protein, 6 aa, Mycobacterium
AVSQET

SEQ ID NO: 440991 - protein, 12 aa, Mycobacterium
AVSQRNRDQIGG

SEQ ID NO: 440992 - protein, 7 aa, Mycobacterium
AVSRGAT

SEQ ID NO: 440993 - protein, 7 aa, Mycobacterium
AVSRGEN

SEQ ID NO: 440994 - protein, 7 aa, Mycobacterium
AVSRGQQ

SEQ ID NO: 440995 - protein, 7 aa, Mycobacterium
AVSRGSL

SEQ ID NO: 440996 - protein, 9 aa, Mycobacterium
AVSRPGPRH

SEQ ID NO: 440997 - protein, 6 aa, Mycobacterium
AVSRTQ

SEQ ID NO: 440998 - protein, 4 aa, Mycobacterium
AVSS

SEQ ID NO: 440999 - protein, 5 aa, Mycobacterium
AVSSA

SEQ ID NO: 441000 - protein, 11 aa, Mycobacterium
AVSSAAGAIGT

SEQ ID NO: 441001 - protein, 10 aa, Mycobacterium
AVSSAQARIA

SEQ ID NO: 441002 - protein, 9 aa, Mycobacterium
AVSSGAAGL

SEQ ID NO: 441003 - protein, 7 aa, Mycobacterium
AVSSGAI

SEQ ID NO: 441004 - protein, 18 aa, Mycobacterium
AVSSGARALTGGARIPGH

SEQ ID NO: 441005 - protein, 8 aa, Mycobacterium
AVSSGASV

SEQ ID NO: 441006 - protein, 9 aa, Mycobacterium
AVSSGATGI

SEQ ID NO: 441007 - protein, 9 aa, Mycobacterium
AVSSGGDHY

SEQ ID NO: 441008 - protein, 10 aa, Mycobacterium
AVSSLSGGEL

SEQ ID NO: 441009 - protein, 10 aa, Mycobacterium
AVSSPQGRFA

SEQ ID NO: 441010 - protein, 17 aa, Mycobacterium
AVSSPQGRFADSAAAVD

SEQ ID NO: 441011 - protein, 11 aa, Mycobacterium
AVSSTDGNGGA

SEQ ID NO: 441012 - protein, 9 aa, Mycobacterium
AVSSTEEED

SEQ ID NO: 441013 - protein, 7 aa, Mycobacterium
AVSSTTA

SEQ ID NO: 441014 - protein, 14 aa, Mycobacterium
AVSSVTSKEDGDRF

SEQ ID NO: 441015 - protein, 4 aa, Mycobacterium
AVST

SEQ ID NO: 441016 - protein, 6 aa, Mycobacterium
AVSTDD

SEQ ID NO: 441017 - protein, 18 aa, Mycobacterium
AVSTDELDEVDATSSPLD

SEQ ID NO: 441018 - protein, 6 aa, Mycobacterium
AVSTDT

SEQ ID NO: 441019 - protein, 15 aa, Mycobacterium
AVSTECRDDRSQEFP

SEQ ID NO: 441020 - protein, 6 aa, Mycobacterium
AVSTGG

SEQ ID NO: 441021 - protein, 16 aa, Mycobacterium
AVSTPAAVSRRRQPIP

SEQ ID NO: 441022 - protein, 6 aa, Mycobacterium
AVSTQA

SEQ ID NO: 441023 - protein, 12 aa, Mycobacterium
AVSTRPEPDNSV

SEQ ID NO: 441024 - protein, 16 aa, Mycobacterium
AVSTSTADNPNALNTR

SEQ ID NO: 441025 - protein, 7 aa, Mycobacterium
AVSTTTA

SEQ ID NO: 441026 - protein, 8 aa, Mycobacterium
AVSTTVDQ

SEQ ID NO: 441027 - protein, 8 aa, Mycobacterium
AVSTTVEQ

SEQ ID NO: 441028 - protein, 12 aa, Mycobacterium
AVSVPERNQPWP

SEQ ID NO: 441029 - protein, 12 aa, Mycobacterium
AVSVPFSRKFLL

SEQ ID NO: 441030 - protein, 7 aa, Mycobacterium
AVTAAGG

SEQ ID NO: 441031 - protein, 9 aa, Mycobacterium
AVTAAGGSR

SEQ ID NO: 441032 - protein, 8 aa, Mycobacterium
AVTAAPEG

SEQ ID NO: 441033 - protein, 9 aa, Mycobacterium
AVTAARREL

SEQ ID NO: 441034 - protein, 8 aa, Mycobacterium
AVTADSSV

SEQ ID NO: 441035 - protein, 13 aa, Mycobacterium
AVTAETASGGLAT

SEQ ID NO: 441036 - protein, 20 aa, Mycobacterium
AVTAGAAGAAGLTRSGGVGA

SEQ ID NO: 441037 - protein, 8 aa, Mycobacterium
AVTAGENE

SEQ ID NO: 441038 - protein, 9 aa, Mycobacterium
AVTAGPPDA

SEQ ID NO: 441039 - protein, 22 aa, Mycobacterium
AVTAPGGGRQPHSGSVGSIGSV

SEQ ID NO: 441040 - protein, 12 aa, Mycobacterium
AVTAQLGGVKPT

SEQ ID NO: 441041 - protein, 8 aa, Mycobacterium
AVTAQQDG

SEQ ID NO: 441042 - protein, 14 aa, Mycobacterium
AVTASAQPASLGER

SEQ ID NO: 441043 - protein, 8 aa, Mycobacterium
AVTATAAR

SEQ ID NO: 441044 - protein, 13 aa, Mycobacterium
AVTATDGQARPPA

SEQ ID NO: 441045 - protein, 14 aa, Mycobacterium
AVTATDGRATPPAR

SEQ ID NO: 441046 - protein, 9 aa, Mycobacterium
AVTDDEDFR

SEQ ID NO: 441047 - protein, 6 aa, Mycobacterium
AVTDDG

SEQ ID NO: 441048 - protein, 6 aa, Mycobacterium
AVTDDS

SEQ ID NO: 441049 - protein, 10 aa, Mycobacterium
AVTDGAGAHP

SEQ ID NO: 441050 - protein, 14 aa, Mycobacterium
AVTDGDNGGNPGVG

SEQ ID NO: 441051 - protein, 19 aa, Mycobacterium
AVTDGSAWRPPRRRGEPLQ

SEQ ID NO: 441052 - protein, 5 aa, Mycobacterium
AVTDN

SEQ ID NO: 441053 - protein, 9 aa, Mycobacterium
AVTDPTKLQ

SEQ ID NO: 441054 - protein, 26 aa, Mycobacterium
AVTDQGLRKDSGRLSIKDDRSKLRPS

SEQ ID NO: 441055 - protein, 7 aa, Mycobacterium
AVTDSGV

SEQ ID NO: 441056 - protein, 5 aa, Mycobacterium
AVTDY

SEQ ID NO: 441057 - protein, 4 aa, Mycobacterium
AVTE

SEQ ID NO: 441058 - protein, 5 aa, Mycobacterium
AVTEA

SEQ ID NO: 441059 - protein, 8 aa, Mycobacterium
AVTEAPQG

SEQ ID NO: 441060 - protein, 8 aa, Mycobacterium
AVTEAPSG

SEQ ID NO: 441061 - protein, 11 aa, Mycobacterium
AVTEATAGSGF

SEQ ID NO: 441062 - protein, 9 aa, Mycobacterium
AVTEESTAM

SEQ ID NO: 441063 - protein, 10 aa, Mycobacterium
AVTEGDPRAA

SEQ ID NO: 441064 - protein, 10 aa, Mycobacterium
AVTEGSADPA

SEQ ID NO: 441065 - protein, 7 aa, Mycobacterium
AVTEPGE

SEQ ID NO: 441066 - protein, 12 aa, Mycobacterium
AVTEPGEPEGTV

SEQ ID NO: 441067 - protein, 7 aa, Mycobacterium
AVTERSS

SEQ ID NO: 441068 - protein, 6 aa, Mycobacterium
AVTESG

SEQ ID NO: 441069 - protein, 6 aa, Mycobacterium
AVTETG

SEQ ID NO: 441070 - protein, 14 aa, Mycobacterium
AVTETNAHPHSDCG

SEQ ID NO: 441071 - protein, 24 aa, Mycobacterium
AVTETPPDRRDPDASGNGGTRRGG

SEQ ID NO: 441072 - protein, 5 aa, Mycobacterium
AVTGA

SEQ ID NO: 441073 - protein, 17 aa, Mycobacterium
AVTGAAAVGRPDPHAGE

SEQ ID NO: 441074 - protein, 6 aa, Mycobacterium
AVTGAD

SEQ ID NO: 441075 - protein, 7 aa, Mycobacterium
AVTGADP

SEQ ID NO: 441076 - protein, 7 aa, Mycobacterium
AVTGDHA

SEQ ID NO: 441077 - protein, 12 aa, Mycobacterium
AVTGDIAGSTET

SEQ ID NO: 441078 - protein, 11 aa, Mycobacterium
AVTGDVAGAAE

SEQ ID NO: 441079 - protein, 8 aa, Mycobacterium
AVTGEQRS

SEQ ID NO: 441080 - protein, 5 aa, Mycobacterium
AVTGG

SEQ ID NO: 441081 - protein, 6 aa, Mycobacterium
AVTGGA

SEQ ID NO: 441082 - protein, 7 aa, Mycobacterium
AVTGGIA

SEQ ID NO: 441083 - protein, 6 aa, Mycobacterium
AVTGGP

SEQ ID NO: 441084 - protein, 7 aa, Mycobacterium
AVTGGRA

SEQ ID NO: 441085 - protein, 8 aa, Mycobacterium
AVTGGSGT

SEQ ID NO: 441086 - protein, 6 aa, Mycobacterium
AVTGKS

SEQ ID NO: 441087 - protein, 58 aa, Mycobacterium
AVTGNDSLTAEGQLEKTQAKERREAGRAAAVADAEARQARAEEAQAQADGAQKRAAVA

SEQ ID NO: 441088 - protein, 10 aa, Mycobacterium
AVTGNVGQAH

SEQ ID NO: 441089 - protein, 11 aa, Mycobacterium
AVTGPNGCGKS

SEQ ID NO: 441090 - protein, 5 aa, Mycobacterium
AVTGR

SEQ ID NO: 441091 - protein, 6 aa, Mycobacterium
AVTGRD

SEQ ID NO: 441092 - protein, 15 aa, Mycobacterium
AVTGRGEDNPPDPQI

SEQ ID NO: 441093 - protein, 15 aa, Mycobacterium
AVTGRGKDNPPDPQM

SEQ ID NO: 441094 - protein, 8 aa, Mycobacterium
AVTGRGSA

SEQ ID NO: 441095 - protein, 7 aa, Mycobacterium
AVTGRRV

SEQ ID NO: 441096 - protein, 9 aa, Mycobacterium
AVTGRTDEP

SEQ ID NO: 441097 - protein, 5 aa, Mycobacterium
AVTGS

SEQ ID NO: 441098 - protein, 11 aa, Mycobacterium
AVTGSQVEAQA

SEQ ID NO: 441099 - protein, 13 aa, Mycobacterium
AVTGTKPAADDYA

SEQ ID NO: 441100 - protein, 15 aa, Mycobacterium
AVTGTRPAAAEYETD

SEQ ID NO: 441101 - protein, 19 aa, Mycobacterium
AVTGYPDGPPCNPQGPADP

SEQ ID NO: 441102 - protein, 8 aa, Mycobacterium
AVTKAGGL

SEQ ID NO: 441103 - protein, 8 aa, Mycobacterium
AVTLGGPR

SEQ ID NO: 441104 - protein, 14 aa, Mycobacterium
AVTNPDGTGVRGKD

SEQ ID NO: 441105 - protein, 5 aa, Mycobacterium
AVTNQ

SEQ ID NO: 441106 - protein, 12 aa, Mycobacterium
AVTNRKQLSDTI

SEQ ID NO: 441107 - protein, 4 aa, Mycobacterium
AVTP

SEQ ID NO: 441108 - protein, 7 aa, Mycobacterium
AVTPART

SEQ ID NO: 441109 - protein, 9 aa, Mycobacterium
AVTPATAAR

SEQ ID NO: 441110 - protein, 8 aa, Mycobacterium
AVTPDPAR

SEQ ID NO: 441111 - protein, 6 aa, Mycobacterium
AVTPEE

SEQ ID NO: 441112 - protein, 7 aa, Mycobacterium
AVTPEEI

SEQ ID NO: 441113 - protein, 8 aa, Mycobacterium
AVTPEENI

SEQ ID NO: 441114 - protein, 8 aa, Mycobacterium
AVTPEQME

SEQ ID NO: 441115 - protein, 8 aa, Mycobacterium
AVTPGQVG

SEQ ID NO: 441116 - protein, 9 aa, Mycobacterium
AVTPGTDRE

SEQ ID NO: 441117 - protein, 10 aa, Mycobacterium
AVTPKQAAEI

SEQ ID NO: 441118 - protein, 6 aa, Mycobacterium
AVTPKT

SEQ ID NO: 441119 - protein, 8 aa, Mycobacterium
AVTPNGDV

SEQ ID NO: 441120 - protein, 19 aa, Mycobacterium
AVTPPGTTDNSDLKTRSQR

SEQ ID NO: 441121 - protein, 6 aa, Mycobacterium
AVTPQK

SEQ ID NO: 441122 - protein, 6 aa, Mycobacterium
AVTPQT

SEQ ID NO: 441123 - protein, 12 aa, Mycobacterium
AVTPRDGAAPID

SEQ ID NO: 441124 - protein, 9 aa, Mycobacterium
AVTPVDDET

SEQ ID NO: 441125 - protein, 6 aa, Mycobacterium
AVTQPT

SEQ ID NO: 441126 - protein, 15 aa, Mycobacterium
AVTRAGQAARATSAE

SEQ ID NO: 441127 - protein, 7 aa, Mycobacterium
AVTRDGD

SEQ ID NO: 441128 - protein, 15 aa, Mycobacterium
AVTRPTQLAAGAGGR

SEQ ID NO: 441129 - protein, 11 aa, Mycobacterium
AVTRQTAAASV

SEQ ID NO: 441130 - protein, 5 aa, Mycobacterium
AVTSA

SEQ ID NO: 441131 - protein, 8 aa, Mycobacterium
AVTSDADA

SEQ ID NO: 441132 - protein, 29 aa, Mycobacterium
AVTSGANLAGEPRDTVAADPAALTGTTVP

SEQ ID NO: 441133 - protein, 14 aa, Mycobacterium
AVTSRRVAERAGLK

SEQ ID NO: 441134 - protein, 11 aa, Mycobacterium
AVTSSGKQRSR

SEQ ID NO: 441135 - protein, 17 aa, Mycobacterium
AVTSTPRTIGGRAGEEI

SEQ ID NO: 441136 - protein, 6 aa, Mycobacterium
AVTTAE

SEQ ID NO: 441137 - protein, 7 aa, Mycobacterium
AVTTAEA

SEQ ID NO: 441138 - protein, 10 aa, Mycobacterium
AVTTAEPTAT

SEQ ID NO: 441139 - protein, 11 aa, Mycobacterium
AVTTAGGGQYA

SEQ ID NO: 441140 - protein, 15 aa, Mycobacterium
AVTTECRDDRPQEFP

SEQ ID NO: 441141 - protein, 7 aa, Mycobacterium
AVTTEEI

SEQ ID NO: 441142 - protein, 5 aa, Mycobacterium
AVTTG

SEQ ID NO: 441143 - protein, 23 aa, Mycobacterium
AVTTGAPVSVTAPAPSATAPASA

SEQ ID NO: 441144 - protein, 12 aa, Mycobacterium
AVTTGDPGPIIP

SEQ ID NO: 441145 - protein, 12 aa, Mycobacterium
AVTTGPAGTAVH

SEQ ID NO: 441146 - protein, 8 aa, Mycobacterium
AVTYGPEG

SEQ ID NO: 441147 - protein, 19 aa, Mycobacterium
AVVGDGESEPFGGGDEIQQ

SEQ ID NO: 441148 - protein, 9 aa, Mycobacterium
AVVGSPRGT

SEQ ID NO: 441149 - protein, 7 aa, Mycobacterium
AVVPPGG

SEQ ID NO: 441150 - protein, 7 aa, Mycobacterium
AVVSPTG

SEQ ID NO: 441151 - protein, 7 aa, Mycobacterium
AVVTPSA

SEQ ID NO: 441152 - protein, 29 aa, Mycobacterium
AVYGSRNPFRQPERITPDTPVNPIDQYGQ

SEQ ID NO: 441153 - protein, 15 aa, Mycobacterium
AVYGSRNPHRQPERI

SEQ ID NO: 441154 - protein, 29 aa, Mycobacterium
AVYGSRNPYRQPERITPDTPVNPIDQYGQ

SEQ ID NO: 441155 - protein, 4 aa, Mycobacterium
AVYP

SEQ ID NO: 441156 - protein, 11 aa, Mycobacterium
AVYPDPARFDP

SEQ ID NO: 441157 - protein, 12 aa, Mycobacterium
AVYRGADSGYAS

SEQ ID NO: 441158 - protein, 6 aa, Mycobacterium
AVYSSS

SEQ ID NO: 441159 - protein, 7 aa, Mycobacterium
AWAGPSA

SEQ ID NO: 441160 - protein, 12 aa, Mycobacterium
AWAPDARTAEER

SEQ ID NO: 441161 - protein, 4 aa, Mycobacterium
AWAT

SEQ ID NO: 441162 - protein, 10 aa, Mycobacterium
AWATGESSAE

SEQ ID NO: 441163 - protein, 7 aa, Mycobacterium
AWDEQAG

SEQ ID NO: 441164 - protein, 9 aa, Mycobacterium
AWDGPRGDA

SEQ ID NO: 441165 - protein, 4 aa, Mycobacterium
AWDP

SEQ ID NO: 441166 - protein, 7 aa, Mycobacterium
AWDTGPE

SEQ ID NO: 441167 - protein, 5 aa, Mycobacterium
AWEDR

SEQ ID NO: 441168 - protein, 12 aa, Mycobacterium
AWEGGSPPAALQ

SEQ ID NO: 441169 - protein, 9 aa, Mycobacterium
AWEGPSAES

SEQ ID NO: 441170 - protein, 5 aa, Mycobacterium
AWEPR

SEQ ID NO: 441171 - protein, 10 aa, Mycobacterium
AWETGDPKQQ

SEQ ID NO: 441172 - protein, 9 aa, Mycobacterium
AWGDEDRRV

SEQ ID NO: 441173 - protein, 6 aa, Mycobacterium
AWGEGA

SEQ ID NO: 441174 - protein, 8 aa, Mycobacterium
AWGGGNGA

SEQ ID NO: 441175 - protein, 9 aa, Mycobacterium
AWGGNPERD

SEQ ID NO: 441176 - protein, 6 aa, Mycobacterium
AWGGPP

SEQ ID NO: 441177 - protein, 13 aa, Mycobacterium
AWGGSGSEAYQGV

SEQ ID NO: 441178 - protein, 11 aa, Mycobacterium
AWGGTGSEAYQ

SEQ ID NO: 441179 - protein, 7 aa, Mycobacterium
AWGGYSG

SEQ ID NO: 441180 - protein, 10 aa, Mycobacterium
AWGNGSAALE

SEQ ID NO: 441181 - protein, 18 aa, Mycobacterium
AWGPESDNLKGRRETASQ

SEQ ID NO: 441182 - protein, 10 aa, Mycobacterium
AWGQNSDPAS

SEQ ID NO: 441183 - protein, 11 aa, Mycobacterium
AWGRRDGAAVD

SEQ ID NO: 441184 - protein, 5 aa, Mycobacterium
AWGSG

SEQ ID NO: 441185 - protein, 16 aa, Mycobacterium
AWGTPEAHRRRVLEAL

SEQ ID NO: 441186 - protein, 15 aa, Mycobacterium
AWGTPEVHRRRVLEA

SEQ ID NO: 441187 - protein, 4 aa, Mycobacterium
AWHG

SEQ ID NO: 441188 - protein, 9 aa, Mycobacterium
AWNSRDPQR

SEQ ID NO: 441189 - protein, 9 aa, Mycobacterium
AWPAAPGDP

SEQ ID NO: 441190 - protein, 7 aa, Mycobacterium
AWPASAT

SEQ ID NO: 441191 - protein, 8 aa, Mycobacterium
AWPDGTDA

SEQ ID NO: 441192 - protein, 10 aa, Mycobacterium
AWPDGTDERW

SEQ ID NO: 441193 - protein, 10 aa, Mycobacterium
AWPDPATAPR

SEQ ID NO: 441194 - protein, 10 aa, Mycobacterium
AWPDPATSPR

SEQ ID NO: 441195 - protein, 5 aa, Mycobacterium
AWPGD

SEQ ID NO: 441196 - protein, 9 aa, Mycobacterium
AWPGGRAGR

SEQ ID NO: 441197 - protein, 5 aa, Mycobacterium
AWPGL

SEQ ID NO: 441198 - protein, 14 aa, Mycobacterium
AWPGQEAKVATPGL

SEQ ID NO: 441199 - protein, 6 aa, Mycobacterium
AWPNTS

SEQ ID NO: 441200 - protein, 5 aa, Mycobacterium
AWPPA

SEQ ID NO: 441201 - protein, 7 aa, Mycobacterium
AWPPAGA

SEQ ID NO: 441202 - protein, 11 aa, Mycobacterium
AWPPASKGRPY

SEQ ID NO: 441203 - protein, 6 aa, Mycobacterium
AWPPGR

SEQ ID NO: 441204 - protein, 6 aa, Mycobacterium
AWPPSR

SEQ ID NO: 441205 - protein, 5 aa, Mycobacterium
AWPPT

SEQ ID NO: 441206 - protein, 15 aa, Mycobacterium
AWPQDPAGSLPGPEL

SEQ ID NO: 441207 - protein, 21 aa, Mycobacterium
AWPQTPAGWRRGDDARADDYL

SEQ ID NO: 441208 - protein, 6 aa, Mycobacterium
AWPTGP

SEQ ID NO: 441209 - protein, 25 aa, Mycobacterium
AWPTNIGGDRDWGYTSESEPSLGGR

SEQ ID NO: 441210 - protein, 9 aa, Mycobacterium
AWQGDTGVT

SEQ ID NO: 441211 - protein, 8 aa, Mycobacterium
AWQGPAAQ

SEQ ID NO: 441212 - protein, 5 aa, Mycobacterium
AWQNG

SEQ ID NO: 441213 - protein, 6 aa, Mycobacterium
AWQRDG

SEQ ID NO: 441214 - protein, 11 aa, Mycobacterium
AWRDDPALRDP

SEQ ID NO: 441215 - protein, 6 aa, Mycobacterium
AWRGGP

SEQ ID NO: 441216 - protein, 5 aa, Mycobacterium
AWRGK

SEQ ID NO: 441217 - protein, 8 aa, Mycobacterium
AWRPGTRH

SEQ ID NO: 441218 - protein, 18 aa, Mycobacterium
AWSAPGHGGDSGAASPWP

SEQ ID NO: 441219 - protein, 9 aa, Mycobacterium
AWSDGPRAY

SEQ ID NO: 441220 - protein, 10 aa, Mycobacterium
AWSEDDTPEL

SEQ ID NO: 441221 - protein, 4 aa, Mycobacterium
AWSG

SEQ ID NO: 441222 - protein, 13 aa, Mycobacterium
AWSGDPDTAPAAL

SEQ ID NO: 441223 - protein, 5 aa, Mycobacterium
AWSGL

SEQ ID NO: 441224 - protein, 17 aa, Mycobacterium
AWSGRPESAPAAHAARY

SEQ ID NO: 441225 - protein, 8 aa, Mycobacterium
AWSPKGKP

SEQ ID NO: 441226 - protein, 8 aa, Mycobacterium
AWSPPDVP

SEQ ID NO: 441227 - protein, 11 aa, Mycobacterium
AWSPSSSNTQP

SEQ ID NO: 441228 - protein, 6 aa, Mycobacterium
AWSSSE

SEQ ID NO: 441229 - protein, 12 aa, Mycobacterium
AWSYPNPTPGFE

SEQ ID NO: 441230 - protein, 5 aa, Mycobacterium
AWTAA

SEQ ID NO: 441231 - protein, 4 aa, Mycobacterium
AWTE

SEQ ID NO: 441232 - protein, 11 aa, Mycobacterium
AWTGGGSEKAL

SEQ ID NO: 441233 - protein, 13 aa, Mycobacterium
AWTPHRADNDSEI

SEQ ID NO: 441234 - protein, 10 aa, Mycobacterium
AWTQDEAEQR

SEQ ID NO: 441235 - protein, 11 aa, Mycobacterium
AWTRDEAEQQR

SEQ ID NO: 441236 - protein, 11 aa, Mycobacterium
AYAADDDERTV

SEQ ID NO: 441237 - protein, 10 aa, Mycobacterium
AYAAGDDDEL

SEQ ID NO: 441238 - protein, 10 aa, Mycobacterium
AYAAREASAT

SEQ ID NO: 441239 - protein, 15 aa, Mycobacterium
AYAARSQERAAAAWS

SEQ ID NO: 441240 - protein, 7 aa, Mycobacterium
AYAASFD

SEQ ID NO: 441241 - protein, 10 aa, Mycobacterium
AYAASGIGSN

SEQ ID NO: 441242 - protein, 14 aa, Mycobacterium
AYAASKAAAWSATN

SEQ ID NO: 441243 - protein, 17 aa, Mycobacterium
AYAASPAVTAYNASKAA

SEQ ID NO: 441244 - protein, 19 aa, Mycobacterium
AYAASPGLAPYNASKAAVE

SEQ ID NO: 441245 - protein, 6 aa, Mycobacterium
AYAATG

SEQ ID NO: 441246 - protein, 6 aa, Mycobacterium
AYAAYS

SEQ ID NO: 441247 - protein, 8 aa, Mycobacterium
AYADDGAV

SEQ ID NO: 441248 - protein, 7 aa, Mycobacterium
AYADDPG

SEQ ID NO: 441249 - protein, 10 aa, Mycobacterium
AYADGDPVAP

SEQ ID NO: 441250 - protein, 9 aa, Mycobacterium
AYAEEPDVL

SEQ ID NO: 441251 - protein, 10 aa, Mycobacterium
AYAEGDDDEL

SEQ ID NO: 441252 - protein, 7 aa, Mycobacterium
AYAEPGW

SEQ ID NO: 441253 - protein, 15 aa, Mycobacterium
AYAGAADGTGFSEGG

SEQ ID NO: 441254 - protein, 13 aa, Mycobacterium
AYAGAADGVGWSE

SEQ ID NO: 441255 - protein, 5 aa, Mycobacterium
AYAGD

SEQ ID NO: 441256 - protein, 5 aa, Mycobacterium
AYAGE

SEQ ID NO: 441257 - protein, 6 aa, Mycobacterium
AYAGEA

SEQ ID NO: 441258 - protein, 14 aa, Mycobacterium
AYAGEQPQRIAIES

SEQ ID NO: 441259 - protein, 6 aa, Mycobacterium
AYAGGG

SEQ ID NO: 441260 - protein, 13 aa, Mycobacterium
AYAGSRAQRIAIT

SEQ ID NO: 441261 - protein, 21 aa, Mycobacterium
AYAKASSRDTVRSRSFTGKPA

SEQ ID NO: 441262 - protein, 21 aa, Mycobacterium
AYAKATSRDTVRSRSFTGKPA

SEQ ID NO: 441263 - protein, 13 aa, Mycobacterium
AYAKQQATRPQTI

SEQ ID NO: 441264 - protein, 16 aa, Mycobacterium
AYAKQVDQAQAFSDAA

SEQ ID NO: 441265 - protein, 13 aa, Mycobacterium
AYANAAAQKIEIT

SEQ ID NO: 441266 - protein, 4 aa, Mycobacterium
AYAP

SEQ ID NO: 441267 - protein, 5 aa, Mycobacterium
AYAPG

SEQ ID NO: 441268 - protein, 10 aa, Mycobacterium
AYAPGRYGER

SEQ ID NO: 441269 - protein, 5 aa, Mycobacterium
AYAQS

SEQ ID NO: 441270 - protein, 5 aa, Mycobacterium
AYASA

SEQ ID NO: 441271 - protein, 7 aa, Mycobacterium
AYASGAT

SEQ ID NO: 441272 - protein, 57 aa, Mycobacterium
AYATSTQVSGIDQGGMDTDADEVPTDGTGVVPGTGDGSGDGTDDGTGAVVDTSPGAL

SEQ ID NO: 441273 - protein, 9 aa, Mycobacterium
AYDAEPDLP

SEQ ID NO: 441274 - protein, 18 aa, Mycobacterium
AYDDPDDLSARTDMSNAA

SEQ ID NO: 441275 - protein, 18 aa, Mycobacterium
AYDDPDDLSARTSMSNAA

SEQ ID NO: 441276 - protein, 10 aa, Mycobacterium
AYDDPDMPAT

SEQ ID NO: 441277 - protein, 6 aa, Mycobacterium
AYDEDN

SEQ ID NO: 441278 - protein, 7 aa, Mycobacterium
AYDEDND

SEQ ID NO: 441279 - protein, 6 aa, Mycobacterium
AYDEPA

SEQ ID NO: 441280 - protein, 18 aa, Mycobacterium
AYDEPASVAYRDPDAVTD

SEQ ID NO: 441281 - protein, 18 aa, Mycobacterium
AYDEPASVAYRDPDEVTD

SEQ ID NO: 441282 - protein, 8 aa, Mycobacterium
AYDEPTAV

SEQ ID NO: 441283 - protein, 8 aa, Mycobacterium
AYDESTGI

SEQ ID NO: 441284 - protein, 7 aa, Mycobacterium
AYDETTE

SEQ ID NO: 441285 - protein, 4 aa, Mycobacterium
AYDG

SEQ ID NO: 441286 - protein, 15 aa, Mycobacterium
AYDGLADRGYGYGPA

SEQ ID NO: 441287 - protein, 7 aa, Mycobacterium
AYDGPDR

SEQ ID NO: 441288 - protein, 12 aa, Mycobacterium
AYDGSTAGCNDA

SEQ ID NO: 441289 - protein, 9 aa, Mycobacterium
AYDGTPAHD

SEQ ID NO: 441290 - protein, 9 aa, Mycobacterium
AYDNETRHS

SEQ ID NO: 441291 - protein, 21 aa, Mycobacterium
AYDPDGPLPDVDPVENPNITR

SEQ ID NO: 441292 - protein, 8 aa, Mycobacterium
AYDPDTGA

SEQ ID NO: 441293 - protein, 10 aa, Mycobacterium
AYDPIPGNEA

SEQ ID NO: 441294 - protein, 8 aa, Mycobacterium
AYDPNDPL

SEQ ID NO: 441295 - protein, 7 aa, Mycobacterium
AYDQTAA

SEQ ID NO: 441296 - protein, 4 aa, Mycobacterium
AYDR

SEQ ID NO: 441297 - protein, 10 aa, Mycobacterium
AYDREEQTEG

SEQ ID NO: 441298 - protein, 7 aa, Mycobacterium
AYDRRSD

SEQ ID NO: 441299 - protein, 5 aa, Mycobacterium
AYDRS

SEQ ID NO: 441300 - protein, 4 aa, Mycobacterium
AYDS

SEQ ID NO: 441301 - protein, 7 aa, Mycobacterium
AYDSGAR

SEQ ID NO: 441302 - protein, 46 aa, Mycobacterium
AYDSGWDNSGNSGQVKSLGNSGFGNSGTSSSGGFNAGSGQSGFFNP

SEQ ID NO: 441303 - protein, 8 aa, Mycobacterium
AYEAEDGR

SEQ ID NO: 441304 - protein, 8 aa, Mycobacterium
AYEDGEDT

SEQ ID NO: 441305 - protein, 4 aa, Mycobacterium
AYEE

SEQ ID NO: 441306 - protein, 6 aa, Mycobacterium
AYEGAG

SEQ ID NO: 441307 - protein, 6 aa, Mycobacterium
AYEGDA

SEQ ID NO: 441308 - protein, 8 aa, Mycobacterium
AYEGGASI

SEQ ID NO: 441309 - protein, 7 aa, Mycobacterium
AYEGPDR

SEQ ID NO: 441310 - protein, 7 aa, Mycobacterium
AYEPETS

SEQ ID NO: 441311 - protein, 5 aa, Mycobacterium
AYEPG

SEQ ID NO: 441312 - protein, 6 aa, Mycobacterium
AYEPGA

SEQ ID NO: 441313 - protein, 7 aa, Mycobacterium
AYEPGSG

SEQ ID NO: 441314 - protein, 19 aa, Mycobacterium
AYEPGYHSDSTRTYSIGEP

SEQ ID NO: 441315 - protein, 5 aa, Mycobacterium
AYEPQ

SEQ ID NO: 441316 - protein, 17 aa, Mycobacterium
AYEPRRGARLPVQQISE

SEQ ID NO: 441317 - protein, 6 aa, Mycobacterium
AYEQDG

SEQ ID NO: 441318 - protein, 18 aa, Mycobacterium
AYEQIDEGAATALGTDAH

SEQ ID NO: 441319 - protein, 30 aa, Mycobacterium
AYEQIDEGAATALGTNGHGIGAPPVPAGTD

SEQ ID NO: 441320 - protein, 7 aa, Mycobacterium
AYERGTR

SEQ ID NO: 441321 - protein, 7 aa, Mycobacterium
AYESDDG

SEQ ID NO: 441322 - protein, 13 aa, Mycobacterium
AYESDKNKTYPAD

SEQ ID NO: 441323 - protein, 8 aa, Mycobacterium
AYESPRAE

SEQ ID NO: 441324 - protein, 19 aa, Mycobacterium
AYGAAYSGAEGVDEHGTTL

SEQ ID NO: 441325 - protein, 13 aa, Mycobacterium
AYGADAGNEIAEA

SEQ ID NO: 441326 - protein, 15 aa, Mycobacterium
AYGAEAGTEIEQALS

SEQ ID NO: 441327 - protein, 7 aa, Mycobacterium
AYGAGSP

SEQ ID NO: 441328 - protein, 6 aa, Mycobacterium
AYGAPE

SEQ ID NO: 441329 - protein, 9 aa, Mycobacterium
AYGARRGDV

SEQ ID NO: 441330 - protein, 8 aa, Mycobacterium
AYGASKTA

SEQ ID NO: 441331 - protein, 9 aa, Mycobacterium
AYGASKTAN

SEQ ID NO: 441332 - protein, 5 aa, Mycobacterium
AYGDA

SEQ ID NO: 441333 - protein, 14 aa, Mycobacterium
AYGDDAANEITAVL

SEQ ID NO: 441334 - protein, 7 aa, Mycobacterium
AYGDEKR

SEQ ID NO: 441335 - protein, 7 aa, Mycobacterium
AYGDGDG

SEQ ID NO: 441336 - protein, 6 aa, Mycobacterium
AYGDNI

SEQ ID NO: 441337 - protein, 13 aa, Mycobacterium
AYGDYGFGPEDAK

SEQ ID NO: 441338 - protein, 13 aa, Mycobacterium
AYGEDDKATADAA

SEQ ID NO: 441339 - protein, 15 aa, Mycobacterium
AYGEDDMATAQAGGI

SEQ ID NO: 441340 - protein, 8 aa, Mycobacterium
AYGEDPER

SEQ ID NO: 441341 - protein, 5 aa, Mycobacterium
AYGEG

SEQ ID NO: 441342 - protein, 7 aa, Mycobacterium
AYGEYDA

SEQ ID NO: 441343 - protein, 5 aa, Mycobacterium
AYGGA

SEQ ID NO: 441344 - protein, 6 aa, Mycobacterium
AYGGAY

SEQ ID NO: 441345 - protein, 12 aa, Mycobacterium
AYGGDAGFPKDQ

SEQ ID NO: 441346 - protein, 11 aa, Mycobacterium
AYGGDEGFAKD

SEQ ID NO: 441347 - protein, 17 aa, Mycobacterium
AYGGEDGFRKKGQTLLP

SEQ ID NO: 441348 - protein, 12 aa, Mycobacterium
AYGGEEGFARKG

SEQ ID NO: 441349 - protein, 14 aa, Mycobacterium
AYGGEEGYARSAQS

SEQ ID NO: 441350 - protein, 6 aa, Mycobacterium
AYGGGY

SEQ ID NO: 441351 - protein, 15 aa, Mycobacterium
AYGGHKEAATSLPPG

SEQ ID NO: 441352 - protein, 11 aa, Mycobacterium
AYGGKRPEGLD

SEQ ID NO: 441353 - protein, 13 aa, Mycobacterium
AYGGNGPEGSRPG

SEQ ID NO: 441354 - protein, 13 aa, Mycobacterium
AYGGNGPHGSRPG

SEQ ID NO: 441355 - protein, 6 aa, Mycobacterium
AYGGNP

SEQ ID NO: 441356 - protein, 7 aa, Mycobacterium
AYGGRIT

SEQ ID NO: 441357 - protein, 12 aa, Mycobacterium
AYGGRITSADDV

SEQ ID NO: 441358 - protein, 7 aa, Mycobacterium
AYGGTAV

SEQ ID NO: 441359 - protein, 15 aa, Mycobacterium
AYGGTTAWASTEAAY

SEQ ID NO: 441360 - protein, 4 aa, Mycobacterium
AYGH

SEQ ID NO: 441361 - protein, 7 aa, Mycobacterium
AYGIDGA

SEQ ID NO: 441362 - protein, 6 aa, Mycobacterium
AYGNHT

SEQ ID NO: 441363 - protein, 7 aa, Mycobacterium
AYGNTGA

SEQ ID NO: 441364 - protein, 11 aa, Mycobacterium
AYGPDSREQMN

SEQ ID NO: 441365 - protein, 5 aa, Mycobacterium
AYGPE

SEQ ID NO: 441366 - protein, 9 aa, Mycobacterium
AYGPGVNAM

SEQ ID NO: 441367 - protein, 8 aa, Mycobacterium
AYGPHPPG

SEQ ID NO: 441368 - protein, 5 aa, Mycobacterium
AYGPL

SEQ ID NO: 441369 - protein, 8 aa, Mycobacterium
AYGPPKKV

SEQ ID NO: 441370 - protein, 6 aa, Mycobacterium
AYGPRD

SEQ ID NO: 441371 - protein, 6 aa, Mycobacterium
AYGPRT

SEQ ID NO: 441372 - protein, 5 aa, Mycobacterium
AYGPS

SEQ ID NO: 441373 - protein, 10 aa, Mycobacterium
AYGPTEAVTT

SEQ ID NO: 441374 - protein, 7 aa, Mycobacterium
AYGPTNQ

SEQ ID NO: 441375 - protein, 7 aa, Mycobacterium
AYGPTRN

SEQ ID NO: 441376 - protein, 6 aa, Mycobacterium
AYGQGQ

SEQ ID NO: 441377 - protein, 10 aa, Mycobacterium
AYGQPPPVRR

SEQ ID NO: 441378 - protein, 4 aa, Mycobacterium
AYGR

SEQ ID NO: 441379 - protein, 10 aa, Mycobacterium
AYGRDGQNCR

SEQ ID NO: 441380 - protein, 8 aa, Mycobacterium
AYGREGEH

SEQ ID NO: 441381 - protein, 10 aa, Mycobacterium
AYGREGQGCR

SEQ ID NO: 441382 - protein, 9 aa, Mycobacterium
AYGREGQNC

SEQ ID NO: 441383 - protein, 8 aa, Mycobacterium
AYGRGEVT

SEQ ID NO: 441384 - protein, 11 aa, Mycobacterium
AYGRSAKDAVD

SEQ ID NO: 441385 - protein, 9 aa, Mycobacterium
AYGSDAQKK

SEQ ID NO: 441386 - protein, 12 aa, Mycobacterium
AYGSSTETAFGA

SEQ ID NO: 441387 - protein, 9 aa, Mycobacterium
AYGSTPTAE

SEQ ID NO: 441388 - protein, 7 aa, Mycobacterium
AYGSTRN

SEQ ID NO: 441389 - protein, 7 aa, Mycobacterium
AYGSTSV

SEQ ID NO: 441390 - protein, 12 aa, Mycobacterium
AYGTDFGSSRRS

SEQ ID NO: 441391 - protein, 16 aa, Mycobacterium
AYGTGAARAALADREH

SEQ ID NO: 441392 - protein, 7 aa, Mycobacterium
AYGTSDT

SEQ ID NO: 441393 - protein, 6 aa, Mycobacterium
AYHAPG

SEQ ID NO: 441394 - protein, 7 aa, Mycobacterium
AYHGNTA

SEQ ID NO: 441395 - protein, 14 aa, Mycobacterium
AYISSGAHRPTPTI

SEQ ID NO: 441396 - protein, 10 aa, Mycobacterium
AYKAKKAVKT

SEQ ID NO: 441397 - protein, 12 aa, Mycobacterium
AYKENSDHAGAA

SEQ ID NO: 441398 - protein, 11 aa, Mycobacterium
AYKGPGHPHTN

SEQ ID NO: 441399 - protein, 17 aa, Mycobacterium
AYKKEAKAAAKAAKAAK

SEQ ID NO: 441400 - protein, 4 aa, Mycobacterium
AYKP

SEQ ID NO: 441401 - protein, 9 aa, Mycobacterium
AYKSPVTAS

SEQ ID NO: 441402 - protein, 12 aa, Mycobacterium
AYLGTPSHPIDP

SEQ ID NO: 441403 - protein, 4 aa, Mycobacterium
AYLP

SEQ ID NO: 441404 - protein, 8 aa, Mycobacterium
AYLPGPSL

SEQ ID NO: 441405 - protein, 7 aa, Mycobacterium
AYLSEGD

SEQ ID NO: 441406 - protein, 11 aa, Mycobacterium
AYNEPSPGAWS

SEQ ID NO: 441407 - protein, 17 aa, Mycobacterium
AYNGPNTVLSGPGEDLE

SEQ ID NO: 441408 - protein, 4 aa, Mycobacterium
AYNP

SEQ ID NO: 441409 - protein, 7 aa, Mycobacterium
AYNPQRR

SEQ ID NO: 441410 - protein, 13 aa, Mycobacterium
AYNPTGSGAGREQ

SEQ ID NO: 441411 - protein, 9 aa, Mycobacterium
AYNQPDPKL

SEQ ID NO: 441412 - protein, 7 aa, Mycobacterium
AYNQTSR

SEQ ID NO: 441413 - protein, 7 aa, Mycobacterium
AYPADDD

SEQ ID NO: 441414 - protein, 20 aa, Mycobacterium
AYPADTAAAGAEPAPPPSIE

SEQ ID NO: 441415 - protein, 9 aa, Mycobacterium
AYPAKKREP

SEQ ID NO: 441416 - protein, 13 aa, Mycobacterium
AYPASYDAAKRDH

SEQ ID NO: 441417 - protein, 5 aa, Mycobacterium
AYPDE

SEQ ID NO: 441418 - protein, 5 aa, Mycobacterium
AYPDG

SEQ ID NO: 441419 - protein, 7 aa, Mycobacterium
AYPDGPY

SEQ ID NO: 441420 - protein, 8 aa, Mycobacterium
AYPDGTEQ

SEQ ID NO: 441421 - protein, 9 aa, Mycobacterium
AYPDGTESD

SEQ ID NO: 441422 - protein, 6 aa, Mycobacterium
AYPDLK

SEQ ID NO: 441423 - protein, 21 aa, Mycobacterium
AYPDNNAGGMAGAPPDEETFD

SEQ ID NO: 441424 - protein, 5 aa, Mycobacterium
AYPDR

SEQ ID NO: 441425 - protein, 16 aa, Mycobacterium
AYPDRGNEAMPEKPSW

SEQ ID NO: 441426 - protein, 5 aa, Mycobacterium
AYPDT

SEQ ID NO: 441427 - protein, 6 aa, Mycobacterium
AYPDTS

SEQ ID NO: 441428 - protein, 5 aa, Mycobacterium
AYPED

SEQ ID NO: 441429 - protein, 5 aa, Mycobacterium
AYPEP

SEQ ID NO: 441430 - protein, 5 aa, Mycobacterium
AYPER

SEQ ID NO: 441431 - protein, 7 aa, Mycobacterium
AYPGGLT

SEQ ID NO: 441432 - protein, 5 aa, Mycobacterium
AYPGR

SEQ ID NO: 441433 - protein, 8 aa, Mycobacterium
AYPGRNKP

SEQ ID NO: 441434 - protein, 10 aa, Mycobacterium
AYPGSDARAV

SEQ ID NO: 441435 - protein, 8 aa, Mycobacterium
AYPGYSGS

SEQ ID NO: 441436 - protein, 5 aa, Mycobacterium
AYPHT

SEQ ID NO: 441437 - protein, 7 aa, Mycobacterium
AYPIPDT

SEQ ID NO: 441438 - protein, 6 aa, Mycobacterium
AYPNDP

SEQ ID NO: 441439 - protein, 6 aa, Mycobacterium
AYPPDA

SEQ ID NO: 441440 - protein, 9 aa, Mycobacterium
AYPPGATAR

SEQ ID NO: 441441 - protein, 18 aa, Mycobacterium
AYPPNAGALRGQPSRSDQ

SEQ ID NO: 441442 - protein, 10 aa, Mycobacterium
AYPPRGGGPV

SEQ ID NO: 441443 - protein, 9 aa, Mycobacterium
AYPPRPDGT

SEQ ID NO: 441444 - protein, 9 aa, Mycobacterium
AYPPRSDGT

SEQ ID NO: 441445 - protein, 9 aa, Mycobacterium
AYPPVKTSE

SEQ ID NO: 441446 - protein, 21 aa, Mycobacterium
AYPPYAEYQAKTSRQIPVFVL

SEQ ID NO: 441447 - protein, 24 aa, Mycobacterium
AYPPYAEYQTKTDRQIPVFVLTPV

SEQ ID NO: 441448 - protein, 13 aa, Mycobacterium
AYPRADADTRAEV

SEQ ID NO: 441449 - protein, 5 aa, Mycobacterium
AYPRT

SEQ ID NO: 441450 - protein, 4 aa, Mycobacterium
AYPS

SEQ ID NO: 441451 - protein, 12 aa, Mycobacterium
AYPSEDSVDPDL

SEQ ID NO: 441452 - protein, 8 aa, Mycobacterium
AYPSGSEH

SEQ ID NO: 441453 - protein, 12 aa, Mycobacterium
AYPSPVTASYNE

SEQ ID NO: 441454 - protein, 8 aa, Mycobacterium
AYPSTLGY

SEQ ID NO: 441455 - protein, 20 aa, Mycobacterium
AYPTESIPERWSPDAGPEQL

SEQ ID NO: 441456 - protein, 9 aa, Mycobacterium
AYQAASAQA

SEQ ID NO: 441457 - protein, 11 aa, Mycobacterium
AYQAASAQAAA

SEQ ID NO: 441458 - protein, 10 aa, Mycobacterium
AYQERSVQRT

SEQ ID NO: 441459 - protein, 7 aa, Mycobacterium
AYQGPDA

SEQ ID NO: 441460 - protein, 6 aa, Mycobacterium
AYQNDS

SEQ ID NO: 441461 - protein, 8 aa, Mycobacterium
AYQPQSIE

SEQ ID NO: 441462 - protein, 13 aa, Mycobacterium
AYQQSRRINAASG

SEQ ID NO: 441463 - protein, 6 aa, Mycobacterium
AYQRRG

SEQ ID NO: 441464 - protein, 7 aa, Mycobacterium
AYQRRGA

SEQ ID NO: 441465 - protein, 5 aa, Mycobacterium
AYQSA

SEQ ID NO: 441466 - protein, 6 aa, Mycobacterium
AYQTGA

SEQ ID NO: 441467 - protein, 5 aa, Mycobacterium
AYQTL

SEQ ID NO: 441468 - protein, 14 aa, Mycobacterium
AYRAKTRVRATPRR

SEQ ID NO: 441469 - protein, 18 aa, Mycobacterium
AYRDGGEVGEVSWLSRGV

SEQ ID NO: 441470 - protein, 11 aa, Mycobacterium
AYRDGRPPVDV

SEQ ID NO: 441471 - protein, 16 aa, Mycobacterium
AYRDPAASEPQRIAIT

SEQ ID NO: 441472 - protein, 12 aa, Mycobacterium
AYRDPSTPTERR

SEQ ID NO: 441473 - protein, 5 aa, Mycobacterium
AYRDR

SEQ ID NO: 441474 - protein, 5 aa, Mycobacterium
AYRDS

SEQ ID NO: 441475 - protein, 4 aa, Mycobacterium
AYRE

SEQ ID NO: 441476 - protein, 16 aa, Mycobacterium
AYRGDDPDGYLTASAT

SEQ ID NO: 441477 - protein, 11 aa, Mycobacterium
AYRGDPAYRHR

SEQ ID NO: 441478 - protein, 14 aa, Mycobacterium
AYRGDTGFQGPPPW

SEQ ID NO: 441479 - protein, 12 aa, Mycobacterium
AYRGGRPIADPR

SEQ ID NO: 441480 - protein, 7 aa, Mycobacterium
AYRGSRN

SEQ ID NO: 441481 - protein, 14 aa, Mycobacterium
AYRKPRDLGNITER

SEQ ID NO: 441482 - protein, 19 aa, Mycobacterium
AYRNETETGRAIANSGVPR

SEQ ID NO: 441483 - protein, 11 aa, Mycobacterium
AYRPAGDESRA

SEQ ID NO: 441484 - protein, 9 aa, Mycobacterium
AYRPAPAAL

SEQ ID NO: 441485 - protein, 13 aa, Mycobacterium
AYRPPPTHPTRAA

SEQ ID NO: 441486 - protein, 22 aa, Mycobacterium
AYRQDRQEERDRRLLDKSRYFD

SEQ ID NO: 441487 - protein, 8 aa, Mycobacterium
AYRQESAL

SEQ ID NO: 441488 - protein, 12 aa, Mycobacterium
AYRQSRDGRDAD

SEQ ID NO: 441489 - protein, 4 aa, Mycobacterium
AYRR

SEQ ID NO: 441490 - protein, 13 aa, Mycobacterium
AYRRAKGRIPADA

SEQ ID NO: 441491 - protein, 17 aa, Mycobacterium
AYRRGEHAADVREEQAK

SEQ ID NO: 441492 - protein, 11 aa, Mycobacterium
AYRSPGGAGVR

SEQ ID NO: 441493 - protein, 9 aa, Mycobacterium
AYRSTATNH

SEQ ID NO: 441494 - protein, 5 aa, Mycobacterium
AYSAD

SEQ ID NO: 441495 - protein, 11 aa, Mycobacterium
AYSAGDEDELS

SEQ ID NO: 441496 - protein, 9 aa, Mycobacterium
AYSAGGARV

SEQ ID NO: 441497 - protein, 18 aa, Mycobacterium
AYSAGYSGFEAADENGTP

SEQ ID NO: 441498 - protein, 12 aa, Mycobacterium
AYSARSPHEPRL

SEQ ID NO: 441499 - protein, 10 aa, Mycobacterium
AYSASKAGMN

SEQ ID NO: 441500 - protein, 8 aa, Mycobacterium
AYSASPRS

SEQ ID NO: 441501 - protein, 5 aa, Mycobacterium
AYSAT

SEQ ID NO: 441502 - protein, 10 aa, Mycobacterium
AYSATGNAHS

SEQ ID NO: 441503 - protein, 11 aa, Mycobacterium
AYSATKADQAH

SEQ ID NO: 441504 - protein, 5 aa, Mycobacterium
AYSDD

SEQ ID NO: 441505 - protein, 14 aa, Mycobacterium
AYSDDDGIVVVATD

SEQ ID NO: 441506 - protein, 13 aa, Mycobacterium
AYSDDDGIVVVTA

SEQ ID NO: 441507 - protein, 24 aa, Mycobacterium
AYSDTAGLDGATPPVPAATAGTLD

SEQ ID NO: 441508 - protein, 6 aa, Mycobacterium
AYSEAD

SEQ ID NO: 441509 - protein, 17 aa, Mycobacterium
AYSEKEAKKGLTIAPES

SEQ ID NO: 441510 - protein, 6 aa, Mycobacterium
AYSEPT

SEQ ID NO: 441511 - protein, 4 aa, Mycobacterium
AYSG

SEQ ID NO: 441512 - protein, 24 aa, Mycobacterium
AYSGEQLPETPRVGAAAPDTTDED

SEQ ID NO: 441513 - protein, 6 aa, Mycobacterium
AYSGGA

SEQ ID NO: 441514 - protein, 9 aa, Mycobacterium
AYSGGERSS

SEQ ID NO: 441515 - protein, 6 aa, Mycobacterium
AYSGNH

SEQ ID NO: 441516 - protein, 6 aa, Mycobacterium
AYSGSH

SEQ ID NO: 441517 - protein, 16 aa, Mycobacterium
AYSNADAARQVAEGQV

SEQ ID NO: 441518 - protein, 24 aa, Mycobacterium
AYSNEAPNFNNSNGQPLSDHSPPA

SEQ ID NO: 441519 - protein, 9 aa, Mycobacterium
AYSNGTSSN

SEQ ID NO: 441520 - protein, 14 aa, Mycobacterium
AYSPAGSMNAYATS

SEQ ID NO: 441521 - protein, 7 aa, Mycobacterium
AYSPDGG

SEQ ID NO: 441522 - protein, 5 aa, Mycobacterium
AYSPF

SEQ ID NO: 441523 - protein, 8 aa, Mycobacterium
AYSPGDTD

SEQ ID NO: 441524 - protein, 9 aa, Mycobacterium
AYSPGSRGQ

SEQ ID NO: 441525 - protein, 6 aa, Mycobacterium
AYSPKT

SEQ ID NO: 441526 - protein, 7 aa, Mycobacterium
AYSPQKA

SEQ ID NO: 441527 - protein, 4 aa, Mycobacterium
AYSQ

SEQ ID NO: 441528 - protein, 4 aa, Mycobacterium
AYSR

SEQ ID NO: 441529 - protein, 7 aa, Mycobacterium
AYSRASD

SEQ ID NO: 441530 - protein, 5 aa, Mycobacterium
AYSSA

SEQ ID NO: 441531 - protein, 6 aa, Mycobacterium
AYSSET

SEQ ID NO: 441532 - protein, 9 aa, Mycobacterium
AYSSGQRSS

SEQ ID NO: 441533 - protein, 5 aa, Mycobacterium
AYSSS

SEQ ID NO: 441534 - protein, 7 aa, Mycobacterium
AYSTHDE

SEQ ID NO: 441535 - protein, 21 aa, Mycobacterium
AYSTRSTEQPTTFSGDGEGLS

SEQ ID NO: 441536 - protein, 4 aa, Mycobacterium
AYTA

SEQ ID NO: 441537 - protein, 12 aa, Mycobacterium
AYTAAEAASVNP

SEQ ID NO: 441538 - protein, 9 aa, Mycobacterium
AYTAETRNE

SEQ ID NO: 441539 - protein, 14 aa, Mycobacterium
AYTAGKDRGASRFE

SEQ ID NO: 441540 - protein, 11 aa, Mycobacterium
AYTAGSPGDEG

SEQ ID NO: 441541 - protein, 8 aa, Mycobacterium
AYTASGLS

SEQ ID NO: 441542 - protein, 6 aa, Mycobacterium
AYTDEA

SEQ ID NO: 441543 - protein, 8 aa, Mycobacterium
AYTDEHGE

SEQ ID NO: 441544 - protein, 5 aa, Mycobacterium
AYTDG

SEQ ID NO: 441545 - protein, 19 aa, Mycobacterium
AYTDGDQRKVLPTDSQKQT

SEQ ID NO: 441546 - protein, 18 aa, Mycobacterium
AYTDGESLADGDATSSWA

SEQ ID NO: 441547 - protein, 16 aa, Mycobacterium
AYTDPDGFAAAPALPD

SEQ ID NO: 441548 - protein, 28 aa, Mycobacterium
AYTDPDGFRGEPTAAAPPPDDVTDPAAD

SEQ ID NO: 441549 - protein, 11 aa, Mycobacterium
AYTDSALPPGC

SEQ ID NO: 441550 - protein, 8 aa, Mycobacterium
AYTEPPDL

SEQ ID NO: 441551 - protein, 23 aa, Mycobacterium
AYTGAELGPTPAPVVEPPTSDED

SEQ ID NO: 441552 - protein, 13 aa, Mycobacterium
AYTGGPDPLAPPV

SEQ ID NO: 441553 - protein, 7 aa, Mycobacterium
AYTGSDG

SEQ ID NO: 441554 - protein, 14 aa, Mycobacterium
AYTGSTDTAEREQL

SEQ ID NO: 441555 - protein, 8 aa, Mycobacterium
AYTGYSPT

SEQ ID NO: 441556 - protein, 15 aa, Mycobacterium
AYTIPTDAPESDGTL

SEQ ID NO: 441557 - protein, 6 aa, Mycobacterium
AYTKAK

SEQ ID NO: 441558 - protein, 7 aa, Mycobacterium
AYTNPGQ

SEQ ID NO: 441559 - protein, 14 aa, Mycobacterium
AYTPDDGGRVVMRR

SEQ ID NO: 441560 - protein, 7 aa, Mycobacterium
AYTPDGI

SEQ ID NO: 441561 - protein, 7 aa, Mycobacterium
AYTPEIG

SEQ ID NO: 441562 - protein, 7 aa, Mycobacterium
AYTPEQL

SEQ ID NO: 441563 - protein, 14 aa, Mycobacterium
AYTPRDGGRVVAHR

SEQ ID NO: 441564 - protein, 15 aa, Mycobacterium
AYTQAAAGQPPNPLP

SEQ ID NO: 441565 - protein, 10 aa, Mycobacterium
AYTQPTASAR

SEQ ID NO: 441566 - protein, 5 aa, Mycobacterium
AYTQS

SEQ ID NO: 441567 - protein, 5 aa, Mycobacterium
AYTRK

SEQ ID NO: 441568 - protein, 10 aa, Mycobacterium
AYTSADPVSG

SEQ ID NO: 441569 - protein, 5 aa, Mycobacterium
AYTSG

SEQ ID NO: 441570 - protein, 9 aa, Mycobacterium
AYTSQGPSR

SEQ ID NO: 441571 - protein, 11 aa, Mycobacterium
AYVAPQDSGPW

SEQ ID NO: 441572 - protein, 7 aa, Mycobacterium
AYVPGGR

SEQ ID NO: 441573 - protein, 9 aa, Mycobacterium
AYVPGSPEW

SEQ ID NO: 441574 - protein, 14 aa, Mycobacterium
AYVPQSKKVQSVGK

SEQ ID NO: 441575 - protein, 5 aa, Mycobacterium
AYVPS

SEQ ID NO: 441576 - protein, 4 aa, Mycobacterium
AYVT

SEQ ID NO: 441577 - protein, 5 aa, Mycobacterium
AYYDR

SEQ ID NO: 441578 - protein, 6 aa, Mycobacterium
AYYDTD

SEQ ID NO: 441579 - protein, 26 aa, Mycobacterium
AYYTDAETTVAPDGTRTATATGTPVD

SEQ ID NO: 441580 - protein, 17 aa, Mycobacterium
CAAARSGDAFGRRPRRE

SEQ ID NO: 441581 - protein, 4 aa, Mycobacterium
CAAD

SEQ ID NO: 441582 - protein, 11 aa, Mycobacterium
CAADSDAQRAA

SEQ ID NO: 441583 - protein, 6 aa, Mycobacterium
CAAEGA

SEQ ID NO: 441584 - protein, 6 aa, Mycobacterium
CAAGDG

SEQ ID NO: 441585 - protein, 7 aa, Mycobacterium
CAAGDSS

SEQ ID NO: 441586 - protein, 7 aa, Mycobacterium
CAAGGDD

SEQ ID NO: 441587 - protein, 10 aa, Mycobacterium
CAAGGRAAGP

SEQ ID NO: 441588 - protein, 11 aa, Mycobacterium
CAAGGRAAGPV

SEQ ID NO: 441589 - protein, 17 aa, Mycobacterium
CAAGQAAVQSAAAGVRA

SEQ ID NO: 441590 - protein, 8 aa, Mycobacterium
CAANPTPR

SEQ ID NO: 441591 - protein, 11 aa, Mycobacterium
CAAPPEGPDGA

SEQ ID NO: 441592 - protein, 9 aa, Mycobacterium
CAAPSGQPL

SEQ ID NO: 441593 - protein, 10 aa, Mycobacterium
CAASEPERSS

SEQ ID NO: 441594 - protein, 14 aa, Mycobacterium
CADARGTKDGQGVL

SEQ ID NO: 441595 - protein, 4 aa, Mycobacterium
CADD

SEQ ID NO: 441596 - protein, 6 aa, Mycobacterium
CADGQF

SEQ ID NO: 441597 - protein, 4 aa, Mycobacterium
CADN

SEQ ID NO: 441598 - protein, 8 aa, Mycobacterium
CADPDTGV

SEQ ID NO: 441599 - protein, 7 aa, Mycobacterium
CADPPKT

SEQ ID NO: 441600 - protein, 6 aa, Mycobacterium
CADQQG

SEQ ID NO: 441601 - protein, 7 aa, Mycobacterium
CADRGAE

SEQ ID NO: 441602 - protein, 8 aa, Mycobacterium
CAEARSKD

SEQ ID NO: 441603 - protein, 9 aa, Mycobacterium
CAEDNPGLA

SEQ ID NO: 441604 - protein, 11 aa, Mycobacterium
CAEDPQESTPV

SEQ ID NO: 441605 - protein, 8 aa, Mycobacterium
CAEPAEQR

SEQ ID NO: 441606 - protein, 6 aa, Mycobacterium
CAEPAV

SEQ ID NO: 441607 - protein, 7 aa, Mycobacterium
CAEPSIQ

SEQ ID NO: 441608 - protein, 5 aa, Mycobacterium
CAEQG

SEQ ID NO: 441609 - protein, 6 aa, Mycobacterium
CAGDTS

SEQ ID NO: 441610 - protein, 8 aa, Mycobacterium
CAGEAPGW

SEQ ID NO: 441611 - protein, 10 aa, Mycobacterium
CAGGGRPRSL

SEQ ID NO: 441612 - protein, 7 aa, Mycobacterium
CAGGSAW

SEQ ID NO: 441613 - protein, 12 aa, Mycobacterium
CAGGSGNGPAYV

SEQ ID NO: 441614 - protein, 4 aa, Mycobacterium
CAGI

SEQ ID NO: 441615 - protein, 6 aa, Mycobacterium
CAGPGA

SEQ ID NO: 441616 - protein, 4 aa, Mycobacterium
CAGQ

SEQ ID NO: 441617 - protein, 12 aa, Mycobacterium
CAGQAEKAVGDQ

SEQ ID NO: 441618 - protein, 8 aa, Mycobacterium
CAGQSPEW

SEQ ID NO: 441619 - protein, 8 aa, Mycobacterium
CAGQTPGW

SEQ ID NO: 441620 - protein, 8 aa, Mycobacterium
CAGREPDW

SEQ ID NO: 441621 - protein, 10 aa, Mycobacterium
CAGSEALSAT

SEQ ID NO: 441622 - protein, 8 aa, Mycobacterium
CAGSGDPL

SEQ ID NO: 441623 - protein, 9 aa, Mycobacterium
CAGSGSGLR

SEQ ID NO: 441624 - protein, 8 aa, Mycobacterium
CAKEAEQV

SEQ ID NO: 441625 - protein, 8 aa, Mycobacterium
CAKGGSGR

SEQ ID NO: 441626 - protein, 7 aa, Mycobacterium
CAKTQAL

SEQ ID NO: 441627 - protein, 8 aa, Mycobacterium
CANDGTVE

SEQ ID NO: 441628 - protein, 7 aa, Mycobacterium
CANEEAR

SEQ ID NO: 441629 - protein, 7 aa, Mycobacterium
CANGDTG

SEQ ID NO: 441630 - protein, 7 aa, Mycobacterium
CAPADPQ

SEQ ID NO: 441631 - protein, 6 aa, Mycobacterium
CAPDAA

SEQ ID NO: 441632 - protein, 6 aa, Mycobacterium
CAPDRH

SEQ ID NO: 441633 - protein, 15 aa, Mycobacterium
CAPDSRFARVTRAAG

SEQ ID NO: 441634 - protein, 8 aa, Mycobacterium
CAPEAPAG

SEQ ID NO: 441635 - protein, 5 aa, Mycobacterium
CAPGE

SEQ ID NO: 441636 - protein, 18 aa, Mycobacterium
CAPGGKGGNQAVAAARAG

SEQ ID NO: 441637 - protein, 5 aa, Mycobacterium
CAPGQ

SEQ ID NO: 441638 - protein, 11 aa, Mycobacterium
CAPNAAATSLT

SEQ ID NO: 441639 - protein, 12 aa, Mycobacterium
CAPPATPVEPTV

SEQ ID NO: 441640 - protein, 15 aa, Mycobacterium
CAPPDNAPSPAERTT

SEQ ID NO: 441641 - protein, 13 aa, Mycobacterium
CAPPEQGYTPSKA

SEQ ID NO: 441642 - protein, 8 aa, Mycobacterium
CAPPGART

SEQ ID NO: 441643 - protein, 6 aa, Mycobacterium
CAPPTG

SEQ ID NO: 441644 - protein, 20 aa, Mycobacterium
CAQAGGDLDTVEAAARSAIA

SEQ ID NO: 441645 - protein, 16 aa, Mycobacterium
CAQDPDRAKARTSRSH

SEQ ID NO: 441646 - protein, 5 aa, Mycobacterium
CAQRS

SEQ ID NO: 441647 - protein, 4 aa, Mycobacterium
CARA

SEQ ID NO: 441648 - protein, 9 aa, Mycobacterium
CARAENRAV

SEQ ID NO: 441649 - protein, 20 aa, Mycobacterium
CARAPDAGLSGPPARPQPAC

SEQ ID NO: 441650 - protein, 6 aa, Mycobacterium
CARGGG

SEQ ID NO: 441651 - protein, 12 aa, Mycobacterium
CARGQPVGRVLT

SEQ ID NO: 441652 - protein, 7 aa, Mycobacterium
CARGRGR

SEQ ID NO: 441653 - protein, 11 aa, Mycobacterium
CARGSQAPQQL

SEQ ID NO: 441654 - protein, 9 aa, Mycobacterium
CARPDTQRD

SEQ ID NO: 441655 - protein, 10 aa, Mycobacterium
CARPTDPVAE

SEQ ID NO: 441656 - protein, 4 aa, Mycobacterium
CARR

SEQ ID NO: 441657 - protein, 15 aa, Mycobacterium
CARSPGCPLGTDPSQ

SEQ ID NO: 441658 - protein, 17 aa, Mycobacterium
CARSRAAGRRTHGAGAA

SEQ ID NO: 441659 - protein, 5 aa, Mycobacterium
CARST

SEQ ID NO: 441660 - protein, 16 aa, Mycobacterium
CASEPSMTSAAHRPDG

SEQ ID NO: 441661 - protein, 7 aa, Mycobacterium
CASGEEA

SEQ ID NO: 441662 - protein, 14 aa, Mycobacterium
CASGNDQSFSHSPM

SEQ ID NO: 441663 - protein, 7 aa, Mycobacterium
CASGQEA

SEQ ID NO: 441664 - protein, 6 aa, Mycobacterium
CASPTA

SEQ ID NO: 441665 - protein, 5 aa, Mycobacterium
CATDG

SEQ ID NO: 441666 - protein, 7 aa, Mycobacterium
CATGATA

SEQ ID NO: 441667 - protein, 7 aa, Mycobacterium
CATGEMD

SEQ ID NO: 441668 - protein, 9 aa, Mycobacterium
CATPAEQRD

SEQ ID NO: 441669 - protein, 27 aa, Mycobacterium
CATRGGTGGTGGNGGPGGAGGPGGHGG

SEQ ID NO: 441670 - protein, 12 aa, Mycobacterium
CATRKEAVGPQT

SEQ ID NO: 441671 - protein, 5 aa, Mycobacterium
CATSR

SEQ ID NO: 441672 - protein, 21 aa, Mycobacterium
CATTGATERQQDPLTPATRDQ

SEQ ID NO: 441673 - protein, 5 aa, Mycobacterium
CCDGS

SEQ ID NO: 441674 - protein, 5 aa, Mycobacterium
CCGET

SEQ ID NO: 441675 - protein, 11 aa, Mycobacterium
CDAAAKPAAGG

SEQ ID NO: 441676 - protein, 7 aa, Mycobacterium
CDAAGRD

SEQ ID NO: 441677 - protein, 19 aa, Mycobacterium
CDAEGAPAYLESSKESNVP

SEQ ID NO: 441678 - protein, 5 aa, Mycobacterium
CDAGE

SEQ ID NO: 441679 - protein, 8 aa, Mycobacterium
CDARDEPH

SEQ ID NO: 441680 - protein, 5 aa, Mycobacterium
CDDAA

SEQ ID NO: 441681 - protein, 11 aa, Mycobacterium
CDDAKGNSSTF

SEQ ID NO: 441682 - protein, 7 aa, Mycobacterium
CDDDDAD

SEQ ID NO: 441683 - protein, 9 aa, Mycobacterium
CDDDDPDVA

SEQ ID NO: 441684 - protein, 8 aa, Mycobacterium
CDDDPATL

SEQ ID NO: 441685 - protein, 11 aa, Mycobacterium
CDDGSDALAGQ

SEQ ID NO: 441686 - protein, 13 aa, Mycobacterium
CDDGSDELAGEYG

SEQ ID NO: 441687 - protein, 6 aa, Mycobacterium
CDDSED

SEQ ID NO: 441688 - protein, 8 aa, Mycobacterium
CDDSRTSC

SEQ ID NO: 441689 - protein, 10 aa, Mycobacterium
CDEARDALGR

SEQ ID NO: 441690 - protein, 8 aa, Mycobacterium
CDERNTLR

SEQ ID NO: 441691 - protein, 6 aa, Mycobacterium
CDESSC

SEQ ID NO: 441692 - protein, 6 aa, Mycobacterium
CDETGV

SEQ ID NO: 441693 - protein, 7 aa, Mycobacterium
CDETNAA

SEQ ID NO: 441694 - protein, 4 aa, Mycobacterium
CDGA

SEQ ID NO: 441695 - protein, 5 aa, Mycobacterium
CDGDS

SEQ ID NO: 441696 - protein, 5 aa, Mycobacterium
CDGEE

SEQ ID NO: 441697 - protein, 8 aa, Mycobacterium
CDGGAGAN

SEQ ID NO: 441698 - protein, 7 aa, Mycobacterium
CDGGGPG

SEQ ID NO: 441699 - protein, 4 aa, Mycobacterium
CDGM

SEQ ID NO: 441700 - protein, 6 aa, Mycobacterium
CDGNGN

SEQ ID NO: 441701 - protein, 7 aa, Mycobacterium
CDGPTRS

SEQ ID NO: 441702 - protein, 8 aa, Mycobacterium
CDGSPEAV

SEQ ID NO: 441703 - protein, 9 aa, Mycobacterium
CDGSPGAEV

SEQ ID NO: 441704 - protein, 7 aa, Mycobacterium
CDGSQVA

SEQ ID NO: 441705 - protein, 9 aa, Mycobacterium
CDGSRGSER

SEQ ID NO: 441706 - protein, 8 aa, Mycobacterium
CDGSRHSE

SEQ ID NO: 441707 - protein, 8 aa, Mycobacterium
CDGSRKAE

SEQ ID NO: 441708 - protein, 8 aa, Mycobacterium
CDGTRSSE

SEQ ID NO: 441709 - protein, 7 aa, Mycobacterium
CDITDED

SEQ ID NO: 441710 - protein, 12 aa, Mycobacterium
CDKPQATTGPAR

SEQ ID NO: 441711 - protein, 21 aa, Mycobacterium
CDKRGAQALAPTRAAQDAFND

SEQ ID NO: 441712 - protein, 20 aa, Mycobacterium
CDKRGAQALAPTRAAQDRFN

SEQ ID NO: 441713 - protein, 21 aa, Mycobacterium
CDKRGAQALAPTRAAQDRFND

SEQ ID NO: 441714 - protein, 8 aa, Mycobacterium
CDNPEAPT

SEQ ID NO: 441715 - protein, 5 aa, Mycobacterium
CDPAQ

SEQ ID NO: 441716 - protein, 6 aa, Mycobacterium
CDPDGT

SEQ ID NO: 441717 - protein, 12 aa, Mycobacterium
CDPDPPLQRDGY

SEQ ID NO: 441718 - protein, 5 aa, Mycobacterium
CDPDS

SEQ ID NO: 441719 - protein, 7 aa, Mycobacterium
CDPDTGA

SEQ ID NO: 441720 - protein, 4 aa, Mycobacterium
CDPE

SEQ ID NO: 441721 - protein, 7 aa, Mycobacterium
CDPGAVT

SEQ ID NO: 441722 - protein, 5 aa, Mycobacterium
CDPGL

SEQ ID NO: 441723 - protein, 12 aa, Mycobacterium
CDPGPPAERGEV

SEQ ID NO: 441724 - protein, 9 aa, Mycobacterium
CDPGSPLPI

SEQ ID NO: 441725 - protein, 4 aa, Mycobacterium
CDPQ

SEQ ID NO: 441726 - protein, 7 aa, Mycobacterium
CDPRTAE

SEQ ID NO: 441727 - protein, 10 aa, Mycobacterium
CDQGPTPTPC

SEQ ID NO: 441728 - protein, 11 aa, Mycobacterium
CDQPRSERADL

SEQ ID NO: 441729 - protein, 19 aa, Mycobacterium
CDQPRSERADLTAAAAEAM

SEQ ID NO: 441730 - protein, 19 aa, Mycobacterium
CDQPRSGRADLTAAAAEAM

SEQ ID NO: 441731 - protein, 5 aa, Mycobacterium
CDRDA

SEQ ID NO: 441732 - protein, 7 aa, Mycobacterium
CDRDDDG

SEQ ID NO: 441733 - protein, 7 aa, Mycobacterium
CDRGETR

SEQ ID NO: 441734 - protein, 7 aa, Mycobacterium
CDRSSGQ

SEQ ID NO: 441735 - protein, 15 aa, Mycobacterium
CDSDAAGLRHGEGSH

SEQ ID NO: 441736 - protein, 12 aa, Mycobacterium
CDSIASKTGVKA

SEQ ID NO: 441737 - protein, 7 aa, Mycobacterium
CDSPHGD

SEQ ID NO: 441738 - protein, 16 aa, Mycobacterium
CDSSQGDKPHIGSPKA

SEQ ID NO: 441739 - protein, 13 aa, Mycobacterium
CDTARSVDYTGAG

SEQ ID NO: 441740 - protein, 18 aa, Mycobacterium
CDTGSPASPDYGPTANAF

SEQ ID NO: 441741 - protein, 12 aa, Mycobacterium
CDTPGELPHSGG

SEQ ID NO: 441742 - protein, 7 aa, Mycobacterium
CDTTAKT

SEQ ID NO: 441743 - protein, 8 aa, Mycobacterium
CEAGGSSI

SEQ ID NO: 441744 - protein, 7 aa, Mycobacterium
CEAPRAE

SEQ ID NO: 441745 - protein, 10 aa, Mycobacterium
CEARDPKGLY

SEQ ID NO: 441746 - protein, 4 aa, Mycobacterium
CEAT

SEQ ID NO: 441747 - protein, 7 aa, Mycobacterium
CECGPET

SEQ ID NO: 441748 - protein, 6 aa, Mycobacterium
CEDEAA

SEQ ID NO: 441749 - protein, 18 aa, Mycobacterium
CEDGGVLDGADAATVSDR

SEQ ID NO: 441750 - protein, 5 aa, Mycobacterium
CEDGH

SEQ ID NO: 441751 - protein, 7 aa, Mycobacterium
CEDPPTA

SEQ ID NO: 441752 - protein, 23 aa, Mycobacterium
CEDQPRPAGRARSLNQEPAGNRE

SEQ ID NO: 441753 - protein, 15 aa, Mycobacterium
CEDQQEVDDPAHTML

SEQ ID NO: 441754 - protein, 8 aa, Mycobacterium
CEDTDPDI

SEQ ID NO: 441755 - protein, 7 aa, Mycobacterium
CEEADRD

SEQ ID NO: 441756 - protein, 12 aa, Mycobacterium
CEEAGRDPATLE

SEQ ID NO: 441757 - protein, 12 aa, Mycobacterium
CEEAGRDPSTLE

SEQ ID NO: 441758 - protein, 4 aa, Mycobacterium
CEEC

SEQ ID NO: 441759 - protein, 6 aa, Mycobacterium
CEEDHE

SEQ ID NO: 441760 - protein, 8 aa, Mycobacterium
CEEEDPTI

SEQ ID NO: 441761 - protein, 7 aa, Mycobacterium
CEEPSRS

SEQ ID NO: 441762 - protein, 7 aa, Mycobacterium
CEETGQH

SEQ ID NO: 441763 - protein, 5 aa, Mycobacterium
CEGEP

SEQ ID NO: 441764 - protein, 4 aa, Mycobacterium
CEGP

SEQ ID NO: 441765 - protein, 6 aa, Mycobacterium
CEGPTR

SEQ ID NO: 441766 - protein, 7 aa, Mycobacterium
CEGRGDS

SEQ ID NO: 441767 - protein, 9 aa, Mycobacterium
CEGSSAHPV

SEQ ID NO: 441768 - protein, 12 aa, Mycobacterium
CEGTHDRVSTTY

SEQ ID NO: 441769 - protein, 5 aa, Mycobacterium
CEHPR

SEQ ID NO: 441770 - protein, 12 aa, Mycobacterium
CEKAAADAGVSP

SEQ ID NO: 441771 - protein, 9 aa, Mycobacterium
CEKEANPGE

SEQ ID NO: 441772 - protein, 9 aa, Mycobacterium
CEKGGSTFY

SEQ ID NO: 441773 - protein, 10 aa, Mycobacterium
CEKRDPKGLY

SEQ ID NO: 441774 - protein, 4 aa, Mycobacterium
CELD

SEQ ID NO: 441775 - protein, 4 aa, Mycobacterium
CEPA

SEQ ID NO: 441776 - protein, 9 aa, Mycobacterium
CEPAAADAL

SEQ ID NO: 441777 - protein, 7 aa, Mycobacterium
CEPDGEL

SEQ ID NO: 441778 - protein, 5 aa, Mycobacterium
CEPGR

SEQ ID NO: 441779 - protein, 8 aa, Mycobacterium
CEPGSPDF

SEQ ID NO: 441780 - protein, 9 aa, Mycobacterium
CEPGTPNAE

SEQ ID NO: 441781 - protein, 7 aa, Mycobacterium
CEPNRRT

SEQ ID NO: 441782 - protein, 16 aa, Mycobacterium
CEPNSVAPTGGAPGNF

SEQ ID NO: 441783 - protein, 22 aa, Mycobacterium
CEPNSVAPTGGAPGNFNSAGGH

SEQ ID NO: 441784 - protein, 6 aa, Mycobacterium
CEPPQK

SEQ ID NO: 441785 - protein, 6 aa, Mycobacterium
CEPTDE

SEQ ID NO: 441786 - protein, 9 aa, Mycobacterium
CEQGPTATP

SEQ ID NO: 441787 - protein, 13 aa, Mycobacterium
CEQRSRAGLDDAE

SEQ ID NO: 441788 - protein, 11 aa, Mycobacterium
CERAQNAAAAR

SEQ ID NO: 441789 - protein, 7 aa, Mycobacterium
CERGDEG

SEQ ID NO: 441790 - protein, 8 aa, Mycobacterium
CERGDEGV

SEQ ID NO: 441791 - protein, 8 aa, Mycobacterium
CERGGSTF

SEQ ID NO: 441792 - protein, 14 aa, Mycobacterium
CERNNGLSAQSHAS

SEQ ID NO: 441793 - protein, 4 aa, Mycobacterium
CERP

SEQ ID NO: 441794 - protein, 10 aa, Mycobacterium
CERPSEPAVE

SEQ ID NO: 441795 - protein, 10 aa, Mycobacterium
CERPTDPVAE

SEQ ID NO: 441796 - protein, 8 aa, Mycobacterium
CERPTEAV

SEQ ID NO: 441797 - protein, 9 aa, Mycobacterium
CERTGSWSE

SEQ ID NO: 441798 - protein, 10 aa, Mycobacterium
CERTGSWSEP

SEQ ID NO: 441799 - protein, 10 aa, Mycobacterium
CESGEPVDPV

SEQ ID NO: 441800 - protein, 5 aa, Mycobacterium
CESGG

SEQ ID NO: 441801 - protein, 15 aa, Mycobacterium
CESGGNWAADTGNGF

SEQ ID NO: 441802 - protein, 18 aa, Mycobacterium
CESGGNWHANTGNGNYGG

SEQ ID NO: 441803 - protein, 8 aa, Mycobacterium
CESGGNWS

SEQ ID NO: 441804 - protein, 18 aa, Mycobacterium
CESGGNWSISTGNGYAGG

SEQ ID NO: 441805 - protein, 10 aa, Mycobacterium
CESISDNGSE

SEQ ID NO: 441806 - protein, 5 aa, Mycobacterium
CESKG

SEQ ID NO: 441807 - protein, 13 aa, Mycobacterium
CESRRDRKRGPLA

SEQ ID NO: 441808 - protein, 7 aa, Mycobacterium
CETDPER

SEQ ID NO: 441809 - protein, 4 aa, Mycobacterium
CETE

SEQ ID NO: 441810 - protein, 5 aa, Mycobacterium
CETER

SEQ ID NO: 441811 - protein, 6 aa, Mycobacterium
CETERG

SEQ ID NO: 441812 - protein, 6 aa, Mycobacterium
CETHEA

SEQ ID NO: 441813 - protein, 10 aa, Mycobacterium
CETTQVREQG

SEQ ID NO: 441814 - protein, 21 aa, Mycobacterium
CEVSRADQNPPPADDPRANLR

SEQ ID NO: 441815 - protein, 11 aa, Mycobacterium
CFGGSTALSGG

SEQ ID NO: 441816 - protein, 7 aa, Mycobacterium
CFPPPPG

SEQ ID NO: 441817 - protein, 8 aa, Mycobacterium
CFPPPPGY

SEQ ID NO: 441818 - protein, 16 aa, Mycobacterium
CGAAGAAEAAVAAGSA

SEQ ID NO: 441819 - protein, 15 aa, Mycobacterium
CGAAKSDFVMVEVAR

SEQ ID NO: 441820 - protein, 15 aa, Mycobacterium
CGAARREELAESGIP

SEQ ID NO: 441821 - protein, 7 aa, Mycobacterium
CGAESAN

SEQ ID NO: 441822 - protein, 6 aa, Mycobacterium
CGAESS

SEQ ID NO: 441823 - protein, 6 aa, Mycobacterium
CGAGAD

SEQ ID NO: 441824 - protein, 7 aa, Mycobacterium
CGAGDEI

SEQ ID NO: 441825 - protein, 8 aa, Mycobacterium
CGAGGDCG

SEQ ID NO: 441826 - protein, 9 aa, Mycobacterium
CGAGGDCGR

SEQ ID NO: 441827 - protein, 6 aa, Mycobacterium
CGAGGG

SEQ ID NO: 441828 - protein, 5 aa, Mycobacterium
CGAGR

SEQ ID NO: 441829 - protein, 12 aa, Mycobacterium
CGAGRTVAGSPD

SEQ ID NO: 441830 - protein, 6 aa, Mycobacterium
CGAGRV

SEQ ID NO: 441831 - protein, 8 aa, Mycobacterium
CGAGSDCG

SEQ ID NO: 441832 - protein, 10 aa, Mycobacterium
CGAGSSFGHQ

SEQ ID NO: 441833 - protein, 22 aa, Mycobacterium
CGAHSDTPAPAGTGSPAYEPYD

SEQ ID NO: 441834 - protein, 18 aa, Mycobacterium
CGAHSDTPAPAGTGSPMY

SEQ ID NO: 441835 - protein, 20 aa, Mycobacterium
CGAHSDTPAPAGTGSPMYEP

SEQ ID NO: 441836 - protein, 18 aa, Mycobacterium
CGAHSDTPAPPGTGSPLY

SEQ ID NO: 441837 - protein, 6 aa, Mycobacterium
CGAPST

SEQ ID NO: 441838 - protein, 4 aa, Mycobacterium
CGAQ

SEQ ID NO: 441839 - protein, 10 aa, Mycobacterium
CGASAGTAGD

SEQ ID NO: 441840 - protein, 20 aa, Mycobacterium
CGASGGDGAPEGARSPVETT

SEQ ID NO: 441841 - protein, 11 aa, Mycobacterium
CGATARPLPET

SEQ ID NO: 441842 - protein, 6 aa, Mycobacterium
CGATGD

SEQ ID NO: 441843 - protein, 4 aa, Mycobacterium
CGDD

SEQ ID NO: 441844 - protein, 10 aa, Mycobacterium
CGDDPEQKAG

SEQ ID NO: 441845 - protein, 9 aa, Mycobacterium
CGDDPLREA

SEQ ID NO: 441846 - protein, 7 aa, Mycobacterium
CGDDPQL

SEQ ID NO: 441847 - protein, 8 aa, Mycobacterium
CGDDPVRE

SEQ ID NO: 441848 - protein, 10 aa, Mycobacterium
CGDGPSFTAD

SEQ ID NO: 441849 - protein, 4 aa, Mycobacterium
CGDP

SEQ ID NO: 441850 - protein, 7 aa, Mycobacterium
CGDPGYR

SEQ ID NO: 441851 - protein, 10 aa, Mycobacterium
CGDPQDPGTL

SEQ ID NO: 441852 - protein, 17 aa, Mycobacterium
CGDQRRGGADLGGRAER

SEQ ID NO: 441853 - protein, 4 aa, Mycobacterium
CGDR

SEQ ID NO: 441854 - protein, 8 aa, Mycobacterium
CGDRSAAV

SEQ ID NO: 441855 - protein, 9 aa, Mycobacterium
CGDRSAAVT

SEQ ID NO: 441856 - protein, 8 aa, Mycobacterium
CGDRTPPG

SEQ ID NO: 441857 - protein, 17 aa, Mycobacterium
CGDTSKPSGGYDKKTVA

SEQ ID NO: 441858 - protein, 6 aa, Mycobacterium
CGEGGD

SEQ ID NO: 441859 - protein, 10 aa, Mycobacterium
CGEPAHDPDF

SEQ ID NO: 441860 - protein, 6 aa, Mycobacterium
CGEPRE

SEQ ID NO: 441861 - protein, 4 aa, Mycobacterium
CGET

SEQ ID NO: 441862 - protein, 6 aa, Mycobacterium
CGETED

SEQ ID NO: 441863 - protein, 5 aa, Mycobacterium
CGETP

SEQ ID NO: 441864 - protein, 10 aa, Mycobacterium
CGGAATPAIR

SEQ ID NO: 441865 - protein, 8 aa, Mycobacterium
CGGAGASA

SEQ ID NO: 441866 - protein, 11 aa, Mycobacterium
CGGAGDTETMT

SEQ ID NO: 441867 - protein, 5 aa, Mycobacterium
CGGAP

SEQ ID NO: 441868 - protein, 9 aa, Mycobacterium
CGGAPGAAR

SEQ ID NO: 441869 - protein, 6 aa, Mycobacterium
CGGDEV

SEQ ID NO: 441870 - protein, 10 aa, Mycobacterium
CGGDGRVRAR

SEQ ID NO: 441871 - protein, 5 aa, Mycobacterium
CGGDV

SEQ ID NO: 441872 - protein, 9 aa, Mycobacterium
CGGEGGVSR

SEQ ID NO: 441873 - protein, 11 aa, Mycobacterium
CGGEKAPDGLR

SEQ ID NO: 441874 - protein, 10 aa, Mycobacterium
CGGESEDEFE

SEQ ID NO: 441875 - protein, 4 aa, Mycobacterium
CGGG

SEQ ID NO: 441876 - protein, 15 aa, Mycobacterium
CGGGEPVVRRLGMAT

SEQ ID NO: 441877 - protein, 13 aa, Mycobacterium
CGGGGEPRGGDYG

SEQ ID NO: 441878 - protein, 9 aa, Mycobacterium
CGGGRPADM

SEQ ID NO: 441879 - protein, 9 aa, Mycobacterium
CGGGRPADR

SEQ ID NO: 441880 - protein, 10 aa, Mycobacterium
CGGGRPADRD

SEQ ID NO: 441881 - protein, 10 aa, Mycobacterium
CGGGRPAGRD

SEQ ID NO: 441882 - protein, 11 aa, Mycobacterium
CGGGRPEGKDR

SEQ ID NO: 441883 - protein, 6 aa, Mycobacterium
CGGHPQ

SEQ ID NO: 441884 - protein, 38 aa, Mycobacterium
CGGNHNAAPAESVTSSGPAGPSTSSSVAGPSPGQPTDY

SEQ ID NO: 441885 - protein, 15 aa, Mycobacterium
CGGPGATVAAESDVA

SEQ ID NO: 441886 - protein, 9 aa, Mycobacterium
CGGPPEADD

SEQ ID NO: 441887 - protein, 14 aa, Mycobacterium
CGGPPIAAASREQI

SEQ ID NO: 441888 - protein, 14 aa, Mycobacterium
CGGPPIAAASREQL

SEQ ID NO: 441889 - protein, 14 aa, Mycobacterium
CGGPPIAAATRDQL

SEQ ID NO: 441890 - protein, 14 aa, Mycobacterium
CGGPPIAAATREQL

SEQ ID NO: 441891 - protein, 15 aa, Mycobacterium
CGGPPVAAATRDQLK

SEQ ID NO: 441892 - protein, 15 aa, Mycobacterium
CGGPPVAAATREQLQ

SEQ ID NO: 441893 - protein, 5 aa, Mycobacterium
CGGPS

SEQ ID NO: 441894 - protein, 6 aa, Mycobacterium
CGGPTK

SEQ ID NO: 441895 - protein, 13 aa, Mycobacterium
CGGQAGGPNARTA

SEQ ID NO: 441896 - protein, 22 aa, Mycobacterium
CGGQRGESNDAASAEPTGCEIT

SEQ ID NO: 441897 - protein, 14 aa, Mycobacterium
CGGRPQVDGIAVQE

SEQ ID NO: 441898 - protein, 13 aa, Mycobacterium
CGGSGRSVTTPAE

SEQ ID NO: 441899 - protein, 6 aa, Mycobacterium
CGGSSA

SEQ ID NO: 441900 - protein, 11 aa, Mycobacterium
CGGTRPDGPGW

SEQ ID NO: 441901 - protein, 11 aa, Mycobacterium
CGGTTEQAAAA

SEQ ID NO: 441902 - protein, 4 aa, Mycobacterium
CGGV

SEQ ID NO: 441903 - protein, 9 aa, Mycobacterium
CGGYDGGQA

SEQ ID NO: 441904 - protein, 4 aa, Mycobacterium
CGHA

SEQ ID NO: 441905 - protein, 5 aa, Mycobacterium
CGHKA

SEQ ID NO: 441906 - protein, 21 aa, Mycobacterium
CGHSNGPDQRDGHEPRLLADP

SEQ ID NO: 441907 - protein, 4 aa, Mycobacterium
CGIG

SEQ ID NO: 441908 - protein, 7 aa, Mycobacterium
CGKGTPG

SEQ ID NO: 441909 - protein, 12 aa, Mycobacterium
CGKPGSADAAAA

SEQ ID NO: 441910 - protein, 10 aa, Mycobacterium
CGKPGSVDAA

SEQ ID NO: 441911 - protein, 19 aa, Mycobacterium
CGKPPTGVRATTDKDAIEA

SEQ ID NO: 441912 - protein, 11 aa, Mycobacterium
CGLGTAGTASV

SEQ ID NO: 441913 - protein, 4 aa, Mycobacterium
CGLT

SEQ ID NO: 441914 - protein, 27 aa, Mycobacterium
CGNAANLRASRARRRERERAAGSAVPR

SEQ ID NO: 441915 - protein, 8 aa, Mycobacterium
CGNAEQDW

SEQ ID NO: 441916 - protein, 8 aa, Mycobacterium
CGNDTDTV

SEQ ID NO: 441917 - protein, 14 aa, Mycobacterium
CGNRAKAARHYAKN

SEQ ID NO: 441918 - protein, 13 aa, Mycobacterium
CGNRAKKAALGRR

SEQ ID NO: 441919 - protein, 7 aa, Mycobacterium
CGNRQKK

SEQ ID NO: 441920 - protein, 11 aa, Mycobacterium
CGNSTHLPDAP

SEQ ID NO: 441921 - protein, 6 aa, Mycobacterium
CGNTDS

SEQ ID NO: 441922 - protein, 15 aa, Mycobacterium
CGPAAAREAPPGNER

SEQ ID NO: 441923 - protein, 6 aa, Mycobacterium
CGPAAK

SEQ ID NO: 441924 - protein, 5 aa, Mycobacterium
CGPAG

SEQ ID NO: 441925 - protein, 10 aa, Mycobacterium
CGPAPPGLRR

SEQ ID NO: 441926 - protein, 15 aa, Mycobacterium
CGPASRFAKLTLAAG

SEQ ID NO: 441927 - protein, 13 aa, Mycobacterium
CGPDRESGRRGAR

SEQ ID NO: 441928 - protein, 15 aa, Mycobacterium
CGPDSRFARVTRLAG

SEQ ID NO: 441929 - protein, 7 aa, Mycobacterium
CGPEGRL

SEQ ID NO: 441930 - protein, 4 aa, Mycobacterium
CGPG

SEQ ID NO: 441931 - protein, 5 aa, Mycobacterium
CGPGD

SEQ ID NO: 441932 - protein, 10 aa, Mycobacterium
CGPGEAPSPL

SEQ ID NO: 441933 - protein, 29 aa, Mycobacterium
CGPGESGHATQLPPATPHPEFPAPRCLPP

SEQ ID NO: 441934 - protein, 8 aa, Mycobacterium
CGPGNLTE

SEQ ID NO: 441935 - protein, 9 aa, Mycobacterium
CGPGNPAPA

SEQ ID NO: 441936 - protein, 12 aa, Mycobacterium
CGPGQATAELGA

SEQ ID NO: 441937 - protein, 8 aa, Mycobacterium
CGPGTAAR

SEQ ID NO: 441938 - protein, 5 aa, Mycobacterium
CGPHE

SEQ ID NO: 441939 - protein, 6 aa, Mycobacterium
CGPHTT

SEQ ID NO: 441940 - protein, 18 aa, Mycobacterium
CGPITDDPRLTEAAQRHA

SEQ ID NO: 441941 - protein, 7 aa, Mycobacterium
CGPPIET

SEQ ID NO: 441942 - protein, 8 aa, Mycobacterium
CGPPIETG

SEQ ID NO: 441943 - protein, 15 aa, Mycobacterium
CGPRRRAKAPEPRPC

SEQ ID NO: 441944 - protein, 9 aa, Mycobacterium
CGPTRTPDD

SEQ ID NO: 441945 - protein, 6 aa, Mycobacterium
CGQEDA

SEQ ID NO: 441946 - protein, 6 aa, Mycobacterium
CGQEDE

SEQ ID NO: 441947 - protein, 6 aa, Mycobacterium
CGQEDQ

SEQ ID NO: 441948 - protein, 11 aa, Mycobacterium
CGQHGAEHAST

SEQ ID NO: 441949 - protein, 7 aa, Mycobacterium
CGQPGSV

SEQ ID NO: 441950 - protein, 12 aa, Mycobacterium
CGQRAAAALSDH

SEQ ID NO: 441951 - protein, 16 aa, Mycobacterium
CGQSTFPVRDQEEARL

SEQ ID NO: 441952 - protein, 12 aa, Mycobacterium
CGQTPDPKAAQI

SEQ ID NO: 441953 - protein, 4 aa, Mycobacterium
CGQW

SEQ ID NO: 441954 - protein, 7 aa, Mycobacterium
CGQWPGS

SEQ ID NO: 441955 - protein, 6 aa, Mycobacterium
CGRATT

SEQ ID NO: 441956 - protein, 6 aa, Mycobacterium
CGRGDF

SEQ ID NO: 441957 - protein, 12 aa, Mycobacterium
CGRGDPGLVRLD

SEQ ID NO: 441958 - protein, 9 aa, Mycobacterium
CGRGTDDLE

SEQ ID NO: 441959 - protein, 12 aa, Mycobacterium
CGRNAANAALAA

SEQ ID NO: 441960 - protein, 21 aa, Mycobacterium
CGRNAANAALAAGGVSGWPRR

SEQ ID NO: 441961 - protein, 10 aa, Mycobacterium
CGRNAARAAL

SEQ ID NO: 441962 - protein, 5 aa, Mycobacterium
CGRNG

SEQ ID NO: 441963 - protein, 4 aa, Mycobacterium
CGRP

SEQ ID NO: 441964 - protein, 5 aa, Mycobacterium
CGRPH

SEQ ID NO: 441965 - protein, 11 aa, Mycobacterium
CGRPTKGTGRP

SEQ ID NO: 441966 - protein, 5 aa, Mycobacterium
CGRQA

SEQ ID NO: 441967 - protein, 11 aa, Mycobacterium
CGRQKAPSVLD

SEQ ID NO: 441968 - protein, 9 aa, Mycobacterium
CGRQPAAQR

SEQ ID NO: 441969 - protein, 7 aa, Mycobacterium
CGRSARG

SEQ ID NO: 441970 - protein, 9 aa, Mycobacterium
CGRSPAAPI

SEQ ID NO: 441971 - protein, 13 aa, Mycobacterium
CGRSRQDGQTPHF

SEQ ID NO: 441972 - protein, 11 aa, Mycobacterium
CGRSRRDGQTP

SEQ ID NO: 441973 - protein, 13 aa, Mycobacterium
CGRSRRDGQTPHF

SEQ ID NO: 441974 - protein, 7 aa, Mycobacterium
CGRVPDK

SEQ ID NO: 441975 - protein, 6 aa, Mycobacterium
CGSADR

SEQ ID NO: 441976 - protein, 14 aa, Mycobacterium
CGSAGGDAHAGHTE

SEQ ID NO: 441977 - protein, 6 aa, Mycobacterium
CGSAIS

SEQ ID NO: 441978 - protein, 5 aa, Mycobacterium
CGSAN

SEQ ID NO: 441979 - protein, 4 aa, Mycobacterium
CGSD

SEQ ID NO: 441980 - protein, 5 aa, Mycobacterium
CGSDT

SEQ ID NO: 441981 - protein, 6 aa, Mycobacterium
CGSGEN

SEQ ID NO: 441982 - protein, 6 aa, Mycobacterium
CGSNGY

SEQ ID NO: 441983 - protein, 7 aa, Mycobacterium
CGSPADA

SEQ ID NO: 441984 - protein, 22 aa, Mycobacterium
CGSPGRATTTGSPEPEPTPPSQ

SEQ ID NO: 441985 - protein, 6 aa, Mycobacterium
CGSPLS

SEQ ID NO: 441986 - protein, 8 aa, Mycobacterium
CGSPPAGQ

SEQ ID NO: 441987 - protein, 7 aa, Mycobacterium
CGSPPVG

SEQ ID NO: 441988 - protein, 18 aa, Mycobacterium
CGSPSAPPAPTPPSTPAH

SEQ ID NO: 441989 - protein, 8 aa, Mycobacterium
CGSPSTGQ

SEQ ID NO: 441990 - protein, 13 aa, Mycobacterium
CGSRPDADSAPAV

SEQ ID NO: 441991 - protein, 16 aa, Mycobacterium
CGSSGAVDDPSASPLA

SEQ ID NO: 441992 - protein, 4 aa, Mycobacterium
CGST

SEQ ID NO: 441993 - protein, 7 aa, Mycobacterium
CGSTGDR

SEQ ID NO: 441994 - protein, 5 aa, Mycobacterium
CGSVG

SEQ ID NO: 441995 - protein, 5 aa, Mycobacterium
CGTAG

SEQ ID NO: 441996 - protein, 5 aa, Mycobacterium
CGTGA

SEQ ID NO: 441997 - protein, 17 aa, Mycobacterium
CGTGAGLATGPGVTGVT

SEQ ID NO: 441998 - protein, 9 aa, Mycobacterium
CGTGDPRAT

SEQ ID NO: 441999 - protein, 7 aa, Mycobacterium
CGTGDSS

SEQ ID NO: 442000 - protein, 6 aa, Mycobacterium
CGTGER

SEQ ID NO: 442001 - protein, 5 aa, Mycobacterium
CGTGL

SEQ ID NO: 442002 - protein, 23 aa, Mycobacterium
CGTGNKPVAAPAPANSGAPPPGM

SEQ ID NO: 442003 - protein, 5 aa, Mycobacterium
CGTGT

SEQ ID NO: 442004 - protein, 6 aa, Mycobacterium
CGTHQA

SEQ ID NO: 442005 - protein, 7 aa, Mycobacterium
CGTPDAP

SEQ ID NO: 442006 - protein, 8 aa, Mycobacterium
CGTPTEAA

SEQ ID NO: 442007 - protein, 7 aa, Mycobacterium
CGTSGAP

SEQ ID NO: 442008 - protein, 6 aa, Mycobacterium
CGTTPP

SEQ ID NO: 442009 - protein, 17 aa, Mycobacterium
CGTTRERIEDPSNMNPI

SEQ ID NO: 442010 - protein, 12 aa, Mycobacterium
CGVAPGHRRRGG

SEQ ID NO: 442011 - protein, 5 aa, Mycobacterium
CGYGE

SEQ ID NO: 442012 - protein, 12 aa, Mycobacterium
CHEPARADEPYR

SEQ ID NO: 442013 - protein, 20 aa, Mycobacterium
CHETPDESGQFSGHLNKGEL

SEQ ID NO: 442014 - protein, 6 aa, Mycobacterium
CHGGPG

SEQ ID NO: 442015 - protein, 13 aa, Mycobacterium
CHPTNEAINAIIA

SEQ ID NO: 442016 - protein, 17 aa, Mycobacterium
CHSDGYNTMANANGTGR

SEQ ID NO: 442017 - protein, 24 aa, Mycobacterium
CIRPNGASGLQRASARVRGLDSGE

SEQ ID NO: 442018 - protein, 8 aa, Mycobacterium
CKDGEQEA

SEQ ID NO: 442019 - protein, 10 aa, Mycobacterium
CKGEKAPESL

SEQ ID NO: 442020 - protein, 11 aa, Mycobacterium
CKGERAPEGLR

SEQ ID NO: 442021 - protein, 7 aa, Mycobacterium
CKGGEHG

SEQ ID NO: 442022 - protein, 17 aa, Mycobacterium
CKGGQDWSSAPGDDDIG

SEQ ID NO: 442023 - protein, 12 aa, Mycobacterium
CKGHNRSHARAT

SEQ ID NO: 442024 - protein, 7 aa, Mycobacterium
CKGRPER

SEQ ID NO: 442025 - protein, 9 aa, Mycobacterium
CKGSRSPTW

SEQ ID NO: 442026 - protein, 4 aa, Mycobacterium
CKPE

SEQ ID NO: 442027 - protein, 7 aa, Mycobacterium
CKPEPSD

SEQ ID NO: 442028 - protein, 8 aa, Mycobacterium
CKPGDGLG

SEQ ID NO: 442029 - protein, 9 aa, Mycobacterium
CKPGDGLGI

SEQ ID NO: 442030 - protein, 20 aa, Mycobacterium
CKPGNGPFSLTGQPNAMGGR

SEQ ID NO: 442031 - protein, 7 aa, Mycobacterium
CKPKPSD

SEQ ID NO: 442032 - protein, 9 aa, Mycobacterium
CKSCPSSAA

SEQ ID NO: 442033 - protein, 6 aa, Mycobacterium
CKTFDA

SEQ ID NO: 442034 - protein, 7 aa, Mycobacterium
CLDDPSV

SEQ ID NO: 442035 - protein, 5 aa, Mycobacterium
CLDNS

SEQ ID NO: 442036 - protein, 10 aa, Mycobacterium
CLTPADDGDV

SEQ ID NO: 442037 - protein, 10 aa, Mycobacterium
CLTPSDDDNV

SEQ ID NO: 442038 - protein, 10 aa, Mycobacterium
CLTPSDENEV

SEQ ID NO: 442039 - protein, 10 aa, Mycobacterium
CLTPSNDDHA

SEQ ID NO: 442040 - protein, 15 aa, Mycobacterium
CMGPSGEDAEQEAED

SEQ ID NO: 442041 - protein, 12 aa, Mycobacterium
CNAAGESPATEV

SEQ ID NO: 442042 - protein, 7 aa, Mycobacterium
CNAKPGD

SEQ ID NO: 442043 - protein, 10 aa, Mycobacterium
CNASKCNDEV

SEQ ID NO: 442044 - protein, 7 aa, Mycobacterium
CNASRAA

SEQ ID NO: 442045 - protein, 31 aa, Mycobacterium
CNATNDDEHAVSTDTAGPSNPSTYDTRPEAT

SEQ ID NO: 442046 - protein, 17 aa, Mycobacterium
CNDGGAATNTTINSAPD

SEQ ID NO: 442047 - protein, 10 aa, Mycobacterium
CNDQGDPPYR

SEQ ID NO: 442048 - protein, 11 aa, Mycobacterium
CNDQGDPPYRG

SEQ ID NO: 442049 - protein, 7 aa, Mycobacterium
CNEGSIR

SEQ ID NO: 442050 - protein, 6 aa, Mycobacterium
CNEPLP

SEQ ID NO: 442051 - protein, 7 aa, Mycobacterium
CNEPSEL

SEQ ID NO: 442052 - protein, 12 aa, Mycobacterium
CNEPTPANAATA

SEQ ID NO: 442053 - protein, 7 aa, Mycobacterium
CNERGTV

SEQ ID NO: 442054 - protein, 11 aa, Mycobacterium
CNGAPPGPPGI

SEQ ID NO: 442055 - protein, 10 aa, Mycobacterium
CNGDKGGALP

SEQ ID NO: 442056 - protein, 8 aa, Mycobacterium
CNGGDRPL

SEQ ID NO: 442057 - protein, 20 aa, Mycobacterium
CNPDDETPCVKGEPTDEVTA

SEQ ID NO: 442058 - protein, 31 aa, Mycobacterium
CNPENEKPCVEGEPSEGLATGDVRSHAQRQH

SEQ ID NO: 442059 - protein, 6 aa, Mycobacterium
CNPGQL

SEQ ID NO: 442060 - protein, 7 aa, Mycobacterium
CNPKSDI

SEQ ID NO: 442061 - protein, 6 aa, Mycobacterium
CNPQGV

SEQ ID NO: 442062 - protein, 7 aa, Mycobacterium
CNPTGGL

SEQ ID NO: 442063 - protein, 8 aa, Mycobacterium
CNQEAGLE

SEQ ID NO: 442064 - protein, 11 aa, Mycobacterium
CNRGAKSSLDH

SEQ ID NO: 442065 - protein, 9 aa, Mycobacterium
CNRHPDAAK

SEQ ID NO: 442066 - protein, 9 aa, Mycobacterium
CNRHPEAAE

SEQ ID NO: 442067 - protein, 19 aa, Mycobacterium
CNRRAPGTGCSAIDGRNRT

SEQ ID NO: 442068 - protein, 18 aa, Mycobacterium
CNRREPGSGCPAIGGRNR

SEQ ID NO: 442069 - protein, 9 aa, Mycobacterium
CNRRGPDAG

SEQ ID NO: 442070 - protein, 7 aa, Mycobacterium
CNSEKRD

SEQ ID NO: 442071 - protein, 14 aa, Mycobacterium
CNSGGGGRRSRSPW

SEQ ID NO: 442072 - protein, 10 aa, Mycobacterium
CPADDQPQRG

SEQ ID NO: 442073 - protein, 5 aa, Mycobacterium
CPADT

SEQ ID NO: 442074 - protein, 8 aa, Mycobacterium
CPAEEPGD

SEQ ID NO: 442075 - protein, 6 aa, Mycobacterium
CPAEHA

SEQ ID NO: 442076 - protein, 12 aa, Mycobacterium
CPAGARPDEPYR

SEQ ID NO: 442077 - protein, 11 aa, Mycobacterium
CPAPGGDPSIH

SEQ ID NO: 442078 - protein, 6 aa, Mycobacterium
CPAPRA

SEQ ID NO: 442079 - protein, 6 aa, Mycobacterium
CPAPTA

SEQ ID NO: 442080 - protein, 13 aa, Mycobacterium
CPCGAGDTNERAS

SEQ ID NO: 442081 - protein, 10 aa, Mycobacterium
CPDAADPRPA

SEQ ID NO: 442082 - protein, 16 aa, Mycobacterium
CPDGESVAQVSERADR

SEQ ID NO: 442083 - protein, 12 aa, Mycobacterium
CPDGSSYPGQQT

SEQ ID NO: 442084 - protein, 9 aa, Mycobacterium
CPDGTEAEY

SEQ ID NO: 442085 - protein, 6 aa, Mycobacterium
CPDGTF

SEQ ID NO: 442086 - protein, 8 aa, Mycobacterium
CPDGTSFT

SEQ ID NO: 442087 - protein, 6 aa, Mycobacterium
CPDHEA

SEQ ID NO: 442088 - protein, 9 aa, Mycobacterium
CPDPDDDQL

SEQ ID NO: 442089 - protein, 8 aa, Mycobacterium
CPDRTAGT

SEQ ID NO: 442090 - protein, 4 aa, Mycobacterium
CPDS

SEQ ID NO: 442091 - protein, 8 aa, Mycobacterium
CPDTGGPG

SEQ ID NO: 442092 - protein, 4 aa, Mycobacterium
CPEG

SEQ ID NO: 442093 - protein, 6 aa, Mycobacterium
CPEGER

SEQ ID NO: 442094 - protein, 4 aa, Mycobacterium
CPES

SEQ ID NO: 442095 - protein, 33 aa, Mycobacterium
CPETAPAGSPARSDEIKRGIRQGELGWPQGPPH

SEQ ID NO: 442096 - protein, 8 aa, Mycobacterium
CPFAPPPK

SEQ ID NO: 442097 - protein, 4 aa, Mycobacterium
CPGA

SEQ ID NO: 442098 - protein, 11 aa, Mycobacterium
CPGDDPATITA

SEQ ID NO: 442099 - protein, 11 aa, Mycobacterium
CPGERNDAATH

SEQ ID NO: 442100 - protein, 13 aa, Mycobacterium
CPGGEGDAATGMN

SEQ ID NO: 442101 - protein, 8 aa, Mycobacterium
CPGGESVA

SEQ ID NO: 442102 - protein, 18 aa, Mycobacterium
CPGGESVAQVSERADAAV

SEQ ID NO: 442103 - protein, 16 aa, Mycobacterium
CPGGESVEEVGERADR

SEQ ID NO: 442104 - protein, 9 aa, Mycobacterium
CPGGETSAQ

SEQ ID NO: 442105 - protein, 8 aa, Mycobacterium
CPGGETVA

SEQ ID NO: 442106 - protein, 14 aa, Mycobacterium
CPGGTGAAKFGGNY

SEQ ID NO: 442107 - protein, 19 aa, Mycobacterium
CPGKKVSYNPTGSGAGREQ

SEQ ID NO: 442108 - protein, 4 aa, Mycobacterium
CPGP

SEQ ID NO: 442109 - protein, 12 aa, Mycobacterium
CPGPDGRYPVLT

SEQ ID NO: 442110 - protein, 5 aa, Mycobacterium
CPHAN

SEQ ID NO: 442111 - protein, 15 aa, Mycobacterium
CPHQGGPLGQGTLEN

SEQ ID NO: 442112 - protein, 11 aa, Mycobacterium
CPKGSASKQLV

SEQ ID NO: 442113 - protein, 16 aa, Mycobacterium
CPKGSASKQLVTGPQR

SEQ ID NO: 442114 - protein, 20 aa, Mycobacterium
CPKGSASKQLVTGPQRETTV

SEQ ID NO: 442115 - protein, 17 aa, Mycobacterium
CPKGSASTQLVTGPQRE

SEQ ID NO: 442116 - protein, 10 aa, Mycobacterium
CPKKSEITER

SEQ ID NO: 442117 - protein, 11 aa, Mycobacterium
CPKKTEISERV

SEQ ID NO: 442118 - protein, 8 aa, Mycobacterium
CPKPPPRR

SEQ ID NO: 442119 - protein, 14 aa, Mycobacterium
CPLPPPEVRARFVE

SEQ ID NO: 442120 - protein, 8 aa, Mycobacterium
CPMPSGSA

SEQ ID NO: 442121 - protein, 8 aa, Mycobacterium
CPNGEPAV

SEQ ID NO: 442122 - protein, 18 aa, Mycobacterium
CPNHGGDGTGDNTGSKNT

SEQ ID NO: 442123 - protein, 4 aa, Mycobacterium
CPNK

SEQ ID NO: 442124 - protein, 9 aa, Mycobacterium
CPNSQRCPA

SEQ ID NO: 442125 - protein, 10 aa, Mycobacterium
CPNSRSCPAQ

SEQ ID NO: 442126 - protein, 7 aa, Mycobacterium
CPNTETA

SEQ ID NO: 442127 - protein, 9 aa, Mycobacterium
CPPAGTGTH

SEQ ID NO: 442128 - protein, 12 aa, Mycobacterium
CPPAQAPLEPGQ

SEQ ID NO: 442129 - protein, 4 aa, Mycobacterium
CPPD

SEQ ID NO: 442130 - protein, 9 aa, Mycobacterium
CPPDAARQA

SEQ ID NO: 442131 - protein, 9 aa, Mycobacterium
CPPDEVDPN

SEQ ID NO: 442132 - protein, 12 aa, Mycobacterium
CPPDGASNRSPI

SEQ ID NO: 442133 - protein, 5 aa, Mycobacterium
CPPDR

SEQ ID NO: 442134 - protein, 12 aa, Mycobacterium
CPPDSSGRNPIR

SEQ ID NO: 442135 - protein, 4 aa, Mycobacterium
CPPE

SEQ ID NO: 442136 - protein, 6 aa, Mycobacterium
CPPEDL

SEQ ID NO: 442137 - protein, 5 aa, Mycobacterium
CPPEL

SEQ ID NO: 442138 - protein, 10 aa, Mycobacterium
CPPESEVDRN

SEQ ID NO: 442139 - protein, 6 aa, Mycobacterium
CPPESV

SEQ ID NO: 442140 - protein, 5 aa, Mycobacterium
CPPGR

SEQ ID NO: 442141 - protein, 12 aa, Mycobacterium
CPPMPPRSRDAH

SEQ ID NO: 442142 - protein, 8 aa, Mycobacterium
CPPPEEPV

SEQ ID NO: 442143 - protein, 14 aa, Mycobacterium
CPPQYKTAHEGKGV

SEQ ID NO: 442144 - protein, 10 aa, Mycobacterium
CPPSSKPENV

SEQ ID NO: 442145 - protein, 4 aa, Mycobacterium
CPQI

SEQ ID NO: 442146 - protein, 10 aa, Mycobacterium
CPQLDNPDEV

SEQ ID NO: 442147 - protein, 15 aa, Mycobacterium
CPQPTAFDRLRKRFL

SEQ ID NO: 442148 - protein, 9 aa, Mycobacterium
CPQPTDPKI

SEQ ID NO: 442149 - protein, 18 aa, Mycobacterium
CPRAPRNRSAAQAAARQR

SEQ ID NO: 442150 - protein, 5 aa, Mycobacterium
CPREE

SEQ ID NO: 442151 - protein, 32 aa, Mycobacterium
CPRPSRRALSGSNVRASGGAHRKTPQAAGAAH

SEQ ID NO: 442152 - protein, 4 aa, Mycobacterium
CPSC

SEQ ID NO: 442153 - protein, 8 aa, Mycobacterium
CPSDEADT

SEQ ID NO: 442154 - protein, 5 aa, Mycobacterium
CPSGA

SEQ ID NO: 442155 - protein, 7 aa, Mycobacterium
CPSGEVQ

SEQ ID NO: 442156 - protein, 9 aa, Mycobacterium
CPSKAGTDL

SEQ ID NO: 442157 - protein, 8 aa, Mycobacterium
CPSKGATD

SEQ ID NO: 442158 - protein, 5 aa, Mycobacterium
CPSNL

SEQ ID NO: 442159 - protein, 7 aa, Mycobacterium
CPSSDGS

SEQ ID NO: 442160 - protein, 32 aa, Mycobacterium
CPSSGPGTIASLPAQSELLGGTGQLESTVSDE

SEQ ID NO: 442161 - protein, 11 aa, Mycobacterium
CPSYGTGPTDP

SEQ ID NO: 442162 - protein, 14 aa, Mycobacterium
CPTGMSNSSFQSVS

SEQ ID NO: 442163 - protein, 6 aa, Mycobacterium
CPTGQQ

SEQ ID NO: 442164 - protein, 11 aa, Mycobacterium
CPTQARDTAIE

SEQ ID NO: 442165 - protein, 4 aa, Mycobacterium
CPTT

SEQ ID NO: 442166 - protein, 9 aa, Mycobacterium
CPVPAPETY

SEQ ID NO: 442167 - protein, 14 aa, Mycobacterium
CPVPPPEVRARFLD

SEQ ID NO: 442168 - protein, 13 aa, Mycobacterium
CPVPQPATYHDDP

SEQ ID NO: 442169 - protein, 13 aa, Mycobacterium
CPVPQPETYHDDP

SEQ ID NO: 442170 - protein, 8 aa, Mycobacterium
CPVQSEDH

SEQ ID NO: 442171 - protein, 18 aa, Mycobacterium
CPVSPQGYDAPPVPLGPD

SEQ ID NO: 442172 - protein, 25 aa, Mycobacterium
CPYDDGYDGRYAEADANKALEELRG

SEQ ID NO: 442173 - protein, 5 aa, Mycobacterium
CQAER

SEQ ID NO: 442174 - protein, 8 aa, Mycobacterium
CQAPRPAR

SEQ ID NO: 442175 - protein, 6 aa, Mycobacterium
CQASYE

SEQ ID NO: 442176 - protein, 6 aa, Mycobacterium
CQDART

SEQ ID NO: 442177 - protein, 10 aa, Mycobacterium
CQDGEAGTVA

SEQ ID NO: 442178 - protein, 6 aa, Mycobacterium
CQGEVG

SEQ ID NO: 442179 - protein, 8 aa, Mycobacterium
CQGEVGSA

SEQ ID NO: 442180 - protein, 13 aa, Mycobacterium
CQGEVGSAASMAA

SEQ ID NO: 442181 - protein, 12 aa, Mycobacterium
CQGGGGKGDDAG

SEQ ID NO: 442182 - protein, 8 aa, Mycobacterium
CQGGPNPV

SEQ ID NO: 442183 - protein, 9 aa, Mycobacterium
CQGNPPPRL

SEQ ID NO: 442184 - protein, 8 aa, Mycobacterium
CQGRQVDD

SEQ ID NO: 442185 - protein, 9 aa, Mycobacterium
CQGRQVDDD

SEQ ID NO: 442186 - protein, 10 aa, Mycobacterium
CQGRQVDDDA

SEQ ID NO: 442187 - protein, 8 aa, Mycobacterium
CQKGGSTI

SEQ ID NO: 442188 - protein, 11 aa, Mycobacterium
CQPEGDQQDVL

SEQ ID NO: 442189 - protein, 9 aa, Mycobacterium
CQPGASARG

SEQ ID NO: 442190 - protein, 9 aa, Mycobacterium
CQPGDGLGI

SEQ ID NO: 442191 - protein, 8 aa, Mycobacterium
CQPGQRAP

SEQ ID NO: 442192 - protein, 4 aa, Mycobacterium
CQPP

SEQ ID NO: 442193 - protein, 10 aa, Mycobacterium
CQQDDDLHAS

SEQ ID NO: 442194 - protein, 4 aa, Mycobacterium
CQQT

SEQ ID NO: 442195 - protein, 5 aa, Mycobacterium
CQRGA

SEQ ID NO: 442196 - protein, 6 aa, Mycobacterium
CQRSQD

SEQ ID NO: 442197 - protein, 8 aa, Mycobacterium
CQSASGSA

SEQ ID NO: 442198 - protein, 4 aa, Mycobacterium
CQTR

SEQ ID NO: 442199 - protein, 6 aa, Mycobacterium
CQTRAP

SEQ ID NO: 442200 - protein, 4 aa, Mycobacterium
CQTT

SEQ ID NO: 442201 - protein, 10 aa, Mycobacterium
CRADNTDTGG

SEQ ID NO: 442202 - protein, 7 aa, Mycobacterium
CRAEPSD

SEQ ID NO: 442203 - protein, 11 aa, Mycobacterium
CRAGEQQYCTG

SEQ ID NO: 442204 - protein, 9 aa, Mycobacterium
CRASDVAAG

SEQ ID NO: 442205 - protein, 8 aa, Mycobacterium
CRCGRTGQ

SEQ ID NO: 442206 - protein, 7 aa, Mycobacterium
CRDADGG

SEQ ID NO: 442207 - protein, 11 aa, Mycobacterium
CRDDKKRTTDG

SEQ ID NO: 442208 - protein, 11 aa, Mycobacterium
CRDDPNAANQR

SEQ ID NO: 442209 - protein, 6 aa, Mycobacterium
CRDEPE

SEQ ID NO: 442210 - protein, 8 aa, Mycobacterium
CRDPDPRT

SEQ ID NO: 442211 - protein, 10 aa, Mycobacterium
CRDQDPAAAG

SEQ ID NO: 442212 - protein, 9 aa, Mycobacterium
CREAAAEAG

SEQ ID NO: 442213 - protein, 13 aa, Mycobacterium
CREESERIGDGPL

SEQ ID NO: 442214 - protein, 6 aa, Mycobacterium
CREGAK

SEQ ID NO: 442215 - protein, 15 aa, Mycobacterium
CRERGDTKSSGAGTV

SEQ ID NO: 442216 - protein, 13 aa, Mycobacterium
CRGAGVADSGQAP

SEQ ID NO: 442217 - protein, 14 aa, Mycobacterium
CRGDDEDEAGGPHA

SEQ ID NO: 442218 - protein, 7 aa, Mycobacterium
CRGEESG

SEQ ID NO: 442219 - protein, 11 aa, Mycobacterium
CRGEKAPEGLR

SEQ ID NO: 442220 - protein, 11 aa, Mycobacterium
CRGGAPGTRET

SEQ ID NO: 442221 - protein, 13 aa, Mycobacterium
CRGQSRSRARASA

SEQ ID NO: 442222 - protein, 9 aa, Mycobacterium
CRGSGNPAA

SEQ ID NO: 442223 - protein, 9 aa, Mycobacterium
CRGSGSPAA

SEQ ID NO: 442224 - protein, 9 aa, Mycobacterium
CRGSGSPNA

SEQ ID NO: 442225 - protein, 12 aa, Mycobacterium
CRGSGSVGDRNG

SEQ ID NO: 442226 - protein, 20 aa, Mycobacterium
CRGSTGPGSLAPDGKPWGSR

SEQ ID NO: 442227 - protein, 18 aa, Mycobacterium
CRGSTGPSSLARDGKPWG

SEQ ID NO: 442228 - protein, 20 aa, Mycobacterium
CRGSTGPSSLARDGKPWGSR

SEQ ID NO: 442229 - protein, 18 aa, Mycobacterium
CRGSTGPSSLARDGRPWG

SEQ ID NO: 442230 - protein, 19 aa, Mycobacterium
CRGSTGPSSRTRDGKPWGS

SEQ ID NO: 442231 - protein, 6 aa, Mycobacterium
CRGTGS

SEQ ID NO: 442232 - protein, 20 aa, Mycobacterium
CRGTTGPTSLARDGKPWGSR

SEQ ID NO: 442233 - protein, 5 aa, Mycobacterium
CRGWT

SEQ ID NO: 442234 - protein, 36 aa, Mycobacterium
CRHPGSPRSRSAVGRPPPSQQPPRGTAMNSTGPPSV

SEQ ID NO: 442235 - protein, 10 aa, Mycobacterium
CRKGSSTFYG

SEQ ID NO: 442236 - protein, 9 aa, Mycobacterium
CRKSPDPLS

SEQ ID NO: 442237 - protein, 7 aa, Mycobacterium
CRNGDGG

SEQ ID NO: 442238 - protein, 6 aa, Mycobacterium
CRNGGT

SEQ ID NO: 442239 - protein, 9 aa, Mycobacterium
CRNTGQPKA

SEQ ID NO: 442240 - protein, 8 aa, Mycobacterium
CRPAPSTT

SEQ ID NO: 442241 - protein, 13 aa, Mycobacterium
CRPDASPGSPEWN

SEQ ID NO: 442242 - protein, 6 aa, Mycobacterium
CRPDNT

SEQ ID NO: 442243 - protein, 12 aa, Mycobacterium
CRPDPPPARGEY

SEQ ID NO: 442244 - protein, 8 aa, Mycobacterium
CRPDSGTD

SEQ ID NO: 442245 - protein, 4 aa, Mycobacterium
CRPE

SEQ ID NO: 442246 - protein, 7 aa, Mycobacterium
CRPESGT

SEQ ID NO: 442247 - protein, 10 aa, Mycobacterium
CRPGDGLGIT

SEQ ID NO: 442248 - protein, 5 aa, Mycobacterium
CRPGG

SEQ ID NO: 442249 - protein, 9 aa, Mycobacterium
CRPGRPTSA

SEQ ID NO: 442250 - protein, 10 aa, Mycobacterium
CRPKPPAEHD

SEQ ID NO: 442251 - protein, 4 aa, Mycobacterium
CRPN

SEQ ID NO: 442252 - protein, 7 aa, Mycobacterium
CRPPPRR

SEQ ID NO: 442253 - protein, 7 aa, Mycobacterium
CRPQGDQ

SEQ ID NO: 442254 - protein, 6 aa, Mycobacterium
CRPRPE

SEQ ID NO: 442255 - protein, 15 aa, Mycobacterium
CRPTGPSSTTAQSFS

SEQ ID NO: 442256 - protein, 18 aa, Mycobacterium
CRQTAESIAATQESSGAI

SEQ ID NO: 442257 - protein, 7 aa, Mycobacterium
CRQTDPD

SEQ ID NO: 442258 - protein, 4 aa, Mycobacterium
CRRE

SEQ ID NO: 442259 - protein, 5 aa, Mycobacterium
CRRGD

SEQ ID NO: 442260 - protein, 5 aa, Mycobacterium
CRRGE

SEQ ID NO: 442261 - protein, 22 aa, Mycobacterium
CRRGGAGDRPAVRHGPPHVGGE

SEQ ID NO: 442262 - protein, 15 aa, Mycobacterium
CRRNTASRDADLHPV

SEQ ID NO: 442263 - protein, 6 aa, Mycobacterium
CRRQEP

SEQ ID NO: 442264 - protein, 21 aa, Mycobacterium
CRRRPARRPQAGHRGGCQSRN

SEQ ID NO: 442265 - protein, 11 aa, Mycobacterium
CRSGPGRRATG

SEQ ID NO: 442266 - protein, 8 aa, Mycobacterium
CRSGRAAN

SEQ ID NO: 442267 - protein, 8 aa, Mycobacterium
CRSPAGHS

SEQ ID NO: 442268 - protein, 9 aa, Mycobacterium
CRSTDPRKS

SEQ ID NO: 442269 - protein, 10 aa, Mycobacterium
CRSTDPTKSE

SEQ ID NO: 442270 - protein, 6 aa, Mycobacterium
CRTDDT

SEQ ID NO: 442271 - protein, 6 aa, Mycobacterium
CRTPSG

SEQ ID NO: 442272 - protein, 18 aa, Mycobacterium
CRTPYPATAPAGDDDKRT

SEQ ID NO: 442273 - protein, 7 aa, Mycobacterium
CRTSDPD

SEQ ID NO: 442274 - protein, 10 aa, Mycobacterium
CRTSDVAAGR

SEQ ID NO: 442275 - protein, 23 aa, Mycobacterium
CSADEAARRIERAGGDIRTAIGA

SEQ ID NO: 442276 - protein, 9 aa, Mycobacterium
CSADPSYTV

SEQ ID NO: 442277 - protein, 4 aa, Mycobacterium
CSAP

SEQ ID NO: 442278 - protein, 8 aa, Mycobacterium
CSAPDTGN

SEQ ID NO: 442279 - protein, 6 aa, Mycobacterium
CSAPTL

SEQ ID NO: 442280 - protein, 14 aa, Mycobacterium
CSASAIAGTRPLDT

SEQ ID NO: 442281 - protein, 4 aa, Mycobacterium
CSCG

SEQ ID NO: 442282 - protein, 14 aa, Mycobacterium
CSDGDGPKLSTEAG

SEQ ID NO: 442283 - protein, 9 aa, Mycobacterium
CSDPEDGRA

SEQ ID NO: 442284 - protein, 11 aa, Mycobacterium
CSDPSKLAGWG

SEQ ID NO: 442285 - protein, 5 aa, Mycobacterium
CSEAG

SEQ ID NO: 442286 - protein, 19 aa, Mycobacterium
CSEGGAEAERNRRLDSDAA

SEQ ID NO: 442287 - protein, 6 aa, Mycobacterium
CSEPPE

SEQ ID NO: 442288 - protein, 9 aa, Mycobacterium
CSESEGEVR

SEQ ID NO: 442289 - protein, 6 aa, Mycobacterium
CSGANS

SEQ ID NO: 442290 - protein, 4 aa, Mycobacterium
CSGD

SEQ ID NO: 442291 - protein, 11 aa, Mycobacterium
CSGDPLTKLPN

SEQ ID NO: 442292 - protein, 10 aa, Mycobacterium
CSGEALSDEG

SEQ ID NO: 442293 - protein, 11 aa, Mycobacterium
CSGEKAPDSLR

SEQ ID NO: 442294 - protein, 9 aa, Mycobacterium
CSGGSPGLR

SEQ ID NO: 442295 - protein, 4 aa, Mycobacterium
CSGK

SEQ ID NO: 442296 - protein, 9 aa, Mycobacterium
CSGNGGFAP

SEQ ID NO: 442297 - protein, 9 aa, Mycobacterium
CSGRARGRN

SEQ ID NO: 442298 - protein, 9 aa, Mycobacterium
CSGRRSPLQ

SEQ ID NO: 442299 - protein, 8 aa, Mycobacterium
CSGSAAGQ

SEQ ID NO: 442300 - protein, 6 aa, Mycobacterium
CSGTLG

SEQ ID NO: 442301 - protein, 7 aa, Mycobacterium
CSGTSSL

SEQ ID NO: 442302 - protein, 5 aa, Mycobacterium
CSGYG

SEQ ID NO: 442303 - protein, 5 aa, Mycobacterium
CSNDE

SEQ ID NO: 442304 - protein, 8 aa, Mycobacterium
CSNSEAHA

SEQ ID NO: 442305 - protein, 23 aa, Mycobacterium
CSNTSQPAPTTSSSTAAAQPPAG

SEQ ID NO: 442306 - protein, 12 aa, Mycobacterium
CSPAAPDADGIP

SEQ ID NO: 442307 - protein, 10 aa, Mycobacterium
CSPAGSAGRR

SEQ ID NO: 442308 - protein, 24 aa, Mycobacterium
CSPDGSDNAAHGSYGDNGMTSQAA

SEQ ID NO: 442309 - protein, 8 aa, Mycobacterium
CSPDQRPS

SEQ ID NO: 442310 - protein, 9 aa, Mycobacterium
CSPEETEAT

SEQ ID NO: 442311 - protein, 6 aa, Mycobacterium
CSPQRL

SEQ ID NO: 442312 - protein, 12 aa, Mycobacterium
CSPSAEALNRLM

SEQ ID NO: 442313 - protein, 9 aa, Mycobacterium
CSPSGGPVA

SEQ ID NO: 442314 - protein, 9 aa, Mycobacterium
CSPSKDRIT

SEQ ID NO: 442315 - protein, 8 aa, Mycobacterium
CSPSKERV

SEQ ID NO: 442316 - protein, 11 aa, Mycobacterium
CSPSRTVGPQR

SEQ ID NO: 442317 - protein, 5 aa, Mycobacterium
CSPST

SEQ ID NO: 442318 - protein, 22 aa, Mycobacterium
CSPTMPTTGSRVGGPQSAWRPA

SEQ ID NO: 442319 - protein, 7 aa, Mycobacterium
CSPTPPF

SEQ ID NO: 442320 - protein, 9 aa, Mycobacterium
CSPTSDGSA

SEQ ID NO: 442321 - protein, 10 aa, Mycobacterium
CSPTSDGSAA

SEQ ID NO: 442322 - protein, 11 aa, Mycobacterium
CSPTSDGSAAA

SEQ ID NO: 442323 - protein, 10 aa, Mycobacterium
CSPVAEDGTA

SEQ ID NO: 442324 - protein, 6 aa, Mycobacterium
CSQNGA

SEQ ID NO: 442325 - protein, 22 aa, Mycobacterium
CSQPPTASPTPTPSSWSSPNAA

SEQ ID NO: 442326 - protein, 4 aa, Mycobacterium
CSRD

SEQ ID NO: 442327 - protein, 5 aa, Mycobacterium
CSRDN

SEQ ID NO: 442328 - protein, 11 aa, Mycobacterium
CSRGNAAAAGV

SEQ ID NO: 442329 - protein, 5 aa, Mycobacterium
CSRPV

SEQ ID NO: 442330 - protein, 4 aa, Mycobacterium
CSRQ

SEQ ID NO: 442331 - protein, 5 aa, Mycobacterium
CSSEQ

SEQ ID NO: 442332 - protein, 5 aa, Mycobacterium
CSSES

SEQ ID NO: 442333 - protein, 4 aa, Mycobacterium
CSSG

SEQ ID NO: 442334 - protein, 7 aa, Mycobacterium
CSSGSEA

SEQ ID NO: 442335 - protein, 9 aa, Mycobacterium
CSSGSTGVP

SEQ ID NO: 442336 - protein, 4 aa, Mycobacterium
CSSS

SEQ ID NO: 442337 - protein, 5 aa, Mycobacterium
CSTAE

SEQ ID NO: 442338 - protein, 7 aa, Mycobacterium
CSTAEAR

SEQ ID NO: 442339 - protein, 14 aa, Mycobacterium
CSTAEPPLESVAPN

SEQ ID NO: 442340 - protein, 9 aa, Mycobacterium
CSTGSEDRI

SEQ ID NO: 442341 - protein, 13 aa, Mycobacterium
CSTGSTVAPGPAV

SEQ ID NO: 442342 - protein, 4 aa, Mycobacterium
CSTP

SEQ ID NO: 442343 - protein, 6 aa, Mycobacterium
CSTPSR

SEQ ID NO: 442344 - protein, 10 aa, Mycobacterium
CSTRSTTTTC

SEQ ID NO: 442345 - protein, 6 aa, Mycobacterium
CSTSRK

SEQ ID NO: 442346 - protein, 13 aa, Mycobacterium
CSVGGRGARSVPG

SEQ ID NO: 442347 - protein, 5 aa, Mycobacterium
CSVSS

SEQ ID NO: 442348 - protein, 4 aa, Mycobacterium
CSYG

SEQ ID NO: 442349 - protein, 9 aa, Mycobacterium
CSYGAPNRL

SEQ ID NO: 442350 - protein, 11 aa, Mycobacterium
CTAADAPRYGD

SEQ ID NO: 442351 - protein, 8 aa, Mycobacterium
CTAETRQK

SEQ ID NO: 442352 - protein, 4 aa, Mycobacterium
CTAP

SEQ ID NO: 442353 - protein, 10 aa, Mycobacterium
CTAPPMPSPE

SEQ ID NO: 442354 - protein, 13 aa, Mycobacterium
CTDDQGARFYLGE

SEQ ID NO: 442355 - protein, 8 aa, Mycobacterium
CTDGAPKV

SEQ ID NO: 442356 - protein, 8 aa, Mycobacterium
CTDGRPGL

SEQ ID NO: 442357 - protein, 6 aa, Mycobacterium
CTDNRV

SEQ ID NO: 442358 - protein, 9 aa, Mycobacterium
CTDPNEARA

SEQ ID NO: 442359 - protein, 7 aa, Mycobacterium
CTEGDPA

SEQ ID NO: 442360 - protein, 7 aa, Mycobacterium
CTEGEPA

SEQ ID NO: 442361 - protein, 13 aa, Mycobacterium
CTEPSNVKAGGGA

SEQ ID NO: 442362 - protein, 14 aa, Mycobacterium
CTEPTNVKAGGGAC

SEQ ID NO: 442363 - protein, 19 aa, Mycobacterium
CTEQDVRQTISSDEGYDPQ

SEQ ID NO: 442364 - protein, 6 aa, Mycobacterium
CTETVG

SEQ ID NO: 442365 - protein, 4 aa, Mycobacterium
CTFG

SEQ ID NO: 442366 - protein, 7 aa, Mycobacterium
CTGAPTV

SEQ ID NO: 442367 - protein, 5 aa, Mycobacterium
CTGAR

SEQ ID NO: 442368 - protein, 6 aa, Mycobacterium
CTGDGT

SEQ ID NO: 442369 - protein, 4 aa, Mycobacterium
CTGG

SEQ ID NO: 442370 - protein, 5 aa, Mycobacterium
CTGHA

SEQ ID NO: 442371 - protein, 14 aa, Mycobacterium
CTGLPGCGRSRTDV

SEQ ID NO: 442372 - protein, 18 aa, Mycobacterium
CTGPGAPLGGGTPGSTVG

SEQ ID NO: 442373 - protein, 4 aa, Mycobacterium
CTGS

SEQ ID NO: 442374 - protein, 10 aa, Mycobacterium
CTGSPGCAKS

SEQ ID NO: 442375 - protein, 17 aa, Mycobacterium
CTGSPGCASSAADVRAD

SEQ ID NO: 442376 - protein, 20 aa, Mycobacterium
CTGSPRKPADAGASSSEQVA

SEQ ID NO: 442377 - protein, 12 aa, Mycobacterium
CTGSRRPTAVDD

SEQ ID NO: 442378 - protein, 10 aa, Mycobacterium
CTGTGGEPQL

SEQ ID NO: 442379 - protein, 9 aa, Mycobacterium
CTGTPEQIA

SEQ ID NO: 442380 - protein, 10 aa, Mycobacterium
CTHRGRPADF

SEQ ID NO: 442381 - protein, 8 aa, Mycobacterium
CTIGTGTK

SEQ ID NO: 442382 - protein, 6 aa, Mycobacterium
CTNTER

SEQ ID NO: 442383 - protein, 9 aa, Mycobacterium
CTNTSNPSV

SEQ ID NO: 442384 - protein, 4 aa, Mycobacterium
CTPC

SEQ ID NO: 442385 - protein, 4 aa, Mycobacterium
CTPD

SEQ ID NO: 442386 - protein, 9 aa, Mycobacterium
CTPDDSVDS

SEQ ID NO: 442387 - protein, 8 aa, Mycobacterium
CTPDEPDA

SEQ ID NO: 442388 - protein, 7 aa, Mycobacterium
CTPEEAE

SEQ ID NO: 442389 - protein, 9 aa, Mycobacterium
CTPESRDQL

SEQ ID NO: 442390 - protein, 5 aa, Mycobacterium
CTPET

SEQ ID NO: 442391 - protein, 7 aa, Mycobacterium
CTPETPI

SEQ ID NO: 442392 - protein, 7 aa, Mycobacterium
CTPETRQ

SEQ ID NO: 442393 - protein, 8 aa, Mycobacterium
CTPGQKKA

SEQ ID NO: 442394 - protein, 6 aa, Mycobacterium
CTPGSV

SEQ ID NO: 442395 - protein, 15 aa, Mycobacterium
CTPGTLSGPQAYVTS

SEQ ID NO: 442396 - protein, 8 aa, Mycobacterium
CTPGTPYR

SEQ ID NO: 442397 - protein, 4 aa, Mycobacterium
CTPN

SEQ ID NO: 442398 - protein, 7 aa, Mycobacterium
CTPRDTV

SEQ ID NO: 442399 - protein, 6 aa, Mycobacterium
CTPRGT

SEQ ID NO: 442400 - protein, 17 aa, Mycobacterium
CTQDPDRWTTSPDDEAK

SEQ ID NO: 442401 - protein, 7 aa, Mycobacterium
CTQGDPD

SEQ ID NO: 442402 - protein, 10 aa, Mycobacterium
CTQPAGPRGR

SEQ ID NO: 442403 - protein, 6 aa, Mycobacterium
CTQPQQ

SEQ ID NO: 442404 - protein, 5 aa, Mycobacterium
CTRDE

SEQ ID NO: 442405 - protein, 5 aa, Mycobacterium
CTRQP

SEQ ID NO: 442406 - protein, 5 aa, Mycobacterium
CTSAE

SEQ ID NO: 442407 - protein, 9 aa, Mycobacterium
CTSAGTSCG

SEQ ID NO: 442408 - protein, 6 aa, Mycobacterium
CTSAQA

SEQ ID NO: 442409 - protein, 7 aa, Mycobacterium
CTSGEID

SEQ ID NO: 442410 - protein, 14 aa, Mycobacterium
CTSGGNAAKIGAVI

SEQ ID NO: 442411 - protein, 7 aa, Mycobacterium
CTSGRPS

SEQ ID NO: 442412 - protein, 9 aa, Mycobacterium
CTSGTAPNY

SEQ ID NO: 442413 - protein, 47 aa, Mycobacterium
CTSNTNDTSGSSLSGTSSNSNDTTATTQDSTTATSNSGGVNEPPTDI

SEQ ID NO: 442414 - protein, 11 aa, Mycobacterium
CTSSDGRAWAT

SEQ ID NO: 442415 - protein, 4 aa, Mycobacterium
CTST

SEQ ID NO: 442416 - protein, 10 aa, Mycobacterium
CTTAKRGRKL

SEQ ID NO: 442417 - protein, 9 aa, Mycobacterium
CTTARDGRS

SEQ ID NO: 442418 - protein, 17 aa, Mycobacterium
CTTDTREDQANGDSYRT

SEQ ID NO: 442419 - protein, 9 aa, Mycobacterium
CTTGDADLG

SEQ ID NO: 442420 - protein, 9 aa, Mycobacterium
CTTNERSMQ

SEQ ID NO: 442421 - protein, 9 aa, Mycobacterium
CTTPARTAY

SEQ ID NO: 442422 - protein, 12 aa, Mycobacterium
CTTRNKRRAARL

SEQ ID NO: 442423 - protein, 18 aa, Mycobacterium
CTTRNKRRAARLQSSYDR

SEQ ID NO: 442424 - protein, 10 aa, Mycobacterium
CTTRNQRRAA

SEQ ID NO: 442425 - protein, 6 aa, Mycobacterium
CTTRYS

SEQ ID NO: 442426 - protein, 7 aa, Mycobacterium
CTTSIDG

SEQ ID NO: 442427 - protein, 11 aa, Mycobacterium
CTTTAAGARAD

SEQ ID NO: 442428 - protein, 5 aa, Mycobacterium
CTTTT

SEQ ID NO: 442429 - protein, 6 aa, Mycobacterium
CTVTES

SEQ ID NO: 442430 - protein, 6 aa, Mycobacterium
CTYPTA

SEQ ID NO: 442431 - protein, 23 aa, Mycobacterium
CVGGATSNRPDANKVGSVGKPLG

SEQ ID NO: 442432 - protein, 9 aa, Mycobacterium
CVGRSEPAV

SEQ ID NO: 442433 - protein, 6 aa, Mycobacterium
CVSPST

SEQ ID NO: 442434 - protein, 7 aa, Mycobacterium
CVTDGSQ

SEQ ID NO: 442435 - protein, 6 aa, Mycobacterium
CVTSDP

SEQ ID NO: 442436 - protein, 8 aa, Mycobacterium
CYDPNERV

SEQ ID NO: 442437 - protein, 5 aa, Mycobacterium
CYGPP

SEQ ID NO: 442438 - protein, 12 aa, Mycobacterium
CYPDGTRLPTES

SEQ ID NO: 442439 - protein, 8 aa, Mycobacterium
DAAAAAER

SEQ ID NO: 442440 - protein, 11 aa, Mycobacterium
DAAAAAKAQGF

SEQ ID NO: 442441 - protein, 13 aa, Mycobacterium
DAAAAASYVVSSG

SEQ ID NO: 442442 - protein, 14 aa, Mycobacterium
DAAAAATYLASGGL

SEQ ID NO: 442443 - protein, 10 aa, Mycobacterium
DAAAADAGYP

SEQ ID NO: 442444 - protein, 8 aa, Mycobacterium
DAAAADAL

SEQ ID NO: 442445 - protein, 6 aa, Mycobacterium
DAAAAG

SEQ ID NO: 442446 - protein, 7 aa, Mycobacterium
DAAAAGA

SEQ ID NO: 442447 - protein, 35 aa, Mycobacterium
DAAAAGDPVEAERPAEAAAPSPQAPGWTGARGTPT

SEQ ID NO: 442448 - protein, 19 aa, Mycobacterium
DAAAAGSGCAARSALAAGT

SEQ ID NO: 442449 - protein, 8 aa, Mycobacterium
DAAAAKAK

SEQ ID NO: 442450 - protein, 9 aa, Mycobacterium
DAAAAKAKA

SEQ ID NO: 442451 - protein, 7 aa, Mycobacterium
DAAAALE

SEQ ID NO: 442452 - protein, 9 aa, Mycobacterium
DAAAARALG

SEQ ID NO: 442453 - protein, 10 aa, Mycobacterium
DAAAARKAGR

SEQ ID NO: 442454 - protein, 7 aa, Mycobacterium
DAAAATG

SEQ ID NO: 442455 - protein, 7 aa, Mycobacterium
DAAAATK

SEQ ID NO: 442456 - protein, 6 aa, Mycobacterium
DAAAAV

SEQ ID NO: 442457 - protein, 5 aa, Mycobacterium
DAAAD

SEQ ID NO: 442458 - protein, 6 aa, Mycobacterium
DAAADA

SEQ ID NO: 442459 - protein, 7 aa, Mycobacterium
DAAADGF

SEQ ID NO: 442460 - protein, 8 aa, Mycobacterium
DAAADLTS

SEQ ID NO: 442461 - protein, 11 aa, Mycobacterium
DAAADNRRLNS

SEQ ID NO: 442462 - protein, 7 aa, Mycobacterium
DAAADPA

SEQ ID NO: 442463 - protein, 7 aa, Mycobacterium
DAAADPG

SEQ ID NO: 442464 - protein, 29 aa, Mycobacterium
DAAADQPAAEAASTPAPAAPMSASGLDDD

SEQ ID NO: 442465 - protein, 6 aa, Mycobacterium
DAAADT

SEQ ID NO: 442466 - protein, 11 aa, Mycobacterium
DAAADTGQVGG

SEQ ID NO: 442467 - protein, 7 aa, Mycobacterium
DAAADTV

SEQ ID NO: 442468 - protein, 15 aa, Mycobacterium
DAAADVADEGVGPVA

SEQ ID NO: 442469 - protein, 6 aa, Mycobacterium
DAAAEE

SEQ ID NO: 442470 - protein, 6 aa, Mycobacterium
DAAAEP

SEQ ID NO: 442471 - protein, 9 aa, Mycobacterium
DAAAESGVT

SEQ ID NO: 442472 - protein, 10 aa, Mycobacterium
DAAAGADEIR

SEQ ID NO: 442473 - protein, 10 aa, Mycobacterium
DAAAGELGGL

SEQ ID NO: 442474 - protein, 6 aa, Mycobacterium
DAAAGG

SEQ ID NO: 442475 - protein, 12 aa, Mycobacterium
DAAAGGRGGLGN

SEQ ID NO: 442476 - protein, 7 aa, Mycobacterium
DAAAGHR

SEQ ID NO: 442477 - protein, 8 aa, Mycobacterium
DAAAGQRT

SEQ ID NO: 442478 - protein, 6 aa, Mycobacterium
DAAAGR

SEQ ID NO: 442479 - protein, 13 aa, Mycobacterium
DAAAGSGHNGGAG

SEQ ID NO: 442480 - protein, 6 aa, Mycobacterium
DAAAIE

SEQ ID NO: 442481 - protein, 7 aa, Mycobacterium
DAAAKAG

SEQ ID NO: 442482 - protein, 6 aa, Mycobacterium
DAAAKQ

SEQ ID NO: 442483 - protein, 5 aa, Mycobacterium
DAAAN

SEQ ID NO: 442484 - protein, 8 aa, Mycobacterium
DAAANGWG

SEQ ID NO: 442485 - protein, 8 aa, Mycobacterium
DAAANRAA

SEQ ID NO: 442486 - protein, 9 aa, Mycobacterium
DAAAPAAAL

SEQ ID NO: 442487 - protein, 11 aa, Mycobacterium
DAAAPESVDAR

SEQ ID NO: 442488 - protein, 8 aa, Mycobacterium
DAAAPGWG

SEQ ID NO: 442489 - protein, 9 aa, Mycobacterium
DAAAPSGQP

SEQ ID NO: 442490 - protein, 5 aa, Mycobacterium
DAAAQ

SEQ ID NO: 442491 - protein, 8 aa, Mycobacterium
DAAAQGRL

SEQ ID NO: 442492 - protein, 8 aa, Mycobacterium
DAAARAGS

SEQ ID NO: 442493 - protein, 13 aa, Mycobacterium
DAAARGVVDGPED

SEQ ID NO: 442494 - protein, 24 aa, Mycobacterium
DAAASAREALAGADADGDAHDSHS

SEQ ID NO: 442495 - protein, 9 aa, Mycobacterium
DAAASDGAI

SEQ ID NO: 442496 - protein, 7 aa, Mycobacterium
DAAASGE

SEQ ID NO: 442497 - protein, 9 aa, Mycobacterium
DAAASGKLG

SEQ ID NO: 442498 - protein, 8 aa, Mycobacterium
DAAATADE

SEQ ID NO: 442499 - protein, 13 aa, Mycobacterium
DAAATDPAGKPAE

SEQ ID NO: 442500 - protein, 14 aa, Mycobacterium
DAAATEPPAPADPV

SEQ ID NO: 442501 - protein, 11 aa, Mycobacterium
DAAATGGERVP

SEQ ID NO: 442502 - protein, 6 aa, Mycobacterium
DAAATY

SEQ ID NO: 442503 - protein, 6 aa, Mycobacterium
DAAAVD

SEQ ID NO: 442504 - protein, 26 aa, Mycobacterium
DAAAVPDLTQPGKITPPTAQHATRQG

SEQ ID NO: 442505 - protein, 26 aa, Mycobacterium
DAAAVPDLTQPGQITPPTAQHATRQG

SEQ ID NO: 442506 - protein, 6 aa, Mycobacterium
DAAAVR

SEQ ID NO: 442507 - protein, 5 aa, Mycobacterium
DAAAY

SEQ ID NO: 442508 - protein, 13 aa, Mycobacterium
DAAAYRPSTNTEM

SEQ ID NO: 442509 - protein, 4 aa, Mycobacterium
DAAC

SEQ ID NO: 442510 - protein, 11 aa, Mycobacterium
DAADAAGAGEV

SEQ ID NO: 442511 - protein, 7 aa, Mycobacterium
DAADAKA

SEQ ID NO: 442512 - protein, 6 aa, Mycobacterium
DAADAR

SEQ ID NO: 442513 - protein, 8 aa, Mycobacterium
DAADASDR

SEQ ID NO: 442514 - protein, 21 aa, Mycobacterium
DAADDAPRLAAAARKPAVFTR

SEQ ID NO: 442515 - protein, 7 aa, Mycobacterium
DAADDGR

SEQ ID NO: 442516 - protein, 7 aa, Mycobacterium
DAADDGY

SEQ ID NO: 442517 - protein, 8 aa, Mycobacterium
DAADEPVA

SEQ ID NO: 442518 - protein, 8 aa, Mycobacterium
DAADESSM

SEQ ID NO: 442519 - protein, 5 aa, Mycobacterium
DAADG

SEQ ID NO: 442520 - protein, 16 aa, Mycobacterium
DAADGAMPAGRPPAFT

SEQ ID NO: 442521 - protein, 10 aa, Mycobacterium
DAADGLAGRQ

SEQ ID NO: 442522 - protein, 11 aa, Mycobacterium
DAADGTGFSEG

SEQ ID NO: 442523 - protein, 8 aa, Mycobacterium
DAADPATA

SEQ ID NO: 442524 - protein, 8 aa, Mycobacterium
DAADPLSD

SEQ ID NO: 442525 - protein, 8 aa, Mycobacterium
DAADPNAR

SEQ ID NO: 442526 - protein, 8 aa, Mycobacterium
DAADPRAP

SEQ ID NO: 442527 - protein, 7 aa, Mycobacterium
DAADRAA

SEQ ID NO: 442528 - protein, 8 aa, Mycobacterium
DAADRDNV

SEQ ID NO: 442529 - protein, 11 aa, Mycobacterium
DAADREANEAD

SEQ ID NO: 442530 - protein, 7 aa, Mycobacterium
DAADSDM

SEQ ID NO: 442531 - protein, 8 aa, Mycobacterium
DAADTAAG

SEQ ID NO: 442532 - protein, 14 aa, Mycobacterium
DAADTDGASNPSDL

SEQ ID NO: 442533 - protein, 7 aa, Mycobacterium
DAADTDV

SEQ ID NO: 442534 - protein, 7 aa, Mycobacterium
DAADTID

SEQ ID NO: 442535 - protein, 5 aa, Mycobacterium
DAAEA

SEQ ID NO: 442536 - protein, 13 aa, Mycobacterium
DAAEAAGRPQPRV

SEQ ID NO: 442537 - protein, 13 aa, Mycobacterium
DAAEAARDPRRRG

SEQ ID NO: 442538 - protein, 9 aa, Mycobacterium
DAAEAERAG

SEQ ID NO: 442539 - protein, 10 aa, Mycobacterium
DAAEAERSGL

SEQ ID NO: 442540 - protein, 7 aa, Mycobacterium
DAAEDGD

SEQ ID NO: 442541 - protein, 7 aa, Mycobacterium
DAAEEAL

SEQ ID NO: 442542 - protein, 11 aa, Mycobacterium
DAAEEDESRAY

SEQ ID NO: 442543 - protein, 12 aa, Mycobacterium
DAAEEDGGTDKI

SEQ ID NO: 442544 - protein, 11 aa, Mycobacterium
DAAEGSGANRV

SEQ ID NO: 442545 - protein, 6 aa, Mycobacterium
DAAEGV

SEQ ID NO: 442546 - protein, 6 aa, Mycobacterium
DAAEKL

SEQ ID NO: 442547 - protein, 8 aa, Mycobacterium
DAAEKVPG

SEQ ID NO: 442548 - protein, 8 aa, Mycobacterium
DAAELGPR

SEQ ID NO: 442549 - protein, 13 aa, Mycobacterium
DAAELQIGDGSEV

SEQ ID NO: 442550 - protein, 7 aa, Mycobacterium
DAAENTL

SEQ ID NO: 442551 - protein, 9 aa, Mycobacterium
DAAENTRSA

SEQ ID NO: 442552 - protein, 7 aa, Mycobacterium
DAAEPGV

SEQ ID NO: 442553 - protein, 12 aa, Mycobacterium
DAAEQAFRAALR

SEQ ID NO: 442554 - protein, 5 aa, Mycobacterium
DAAER

SEQ ID NO: 442555 - protein, 8 aa, Mycobacterium
DAAERAGV

SEQ ID NO: 442556 - protein, 9 aa, Mycobacterium
DAAERGIAE

SEQ ID NO: 442557 - protein, 6 aa, Mycobacterium
DAAERN

SEQ ID NO: 442558 - protein, 7 aa, Mycobacterium
DAAERRR

SEQ ID NO: 442559 - protein, 8 aa, Mycobacterium
DAAERSDV

SEQ ID NO: 442560 - protein, 7 aa, Mycobacterium
DAAERTG

SEQ ID NO: 442561 - protein, 13 aa, Mycobacterium
DAAESLTRPRLIT

SEQ ID NO: 442562 - protein, 6 aa, Mycobacterium
DAAESM

SEQ ID NO: 442563 - protein, 10 aa, Mycobacterium
DAAESTTKAY

SEQ ID NO: 442564 - protein, 7 aa, Mycobacterium
DAAETDR

SEQ ID NO: 442565 - protein, 14 aa, Mycobacterium
DAAETEAKEVQEAG

SEQ ID NO: 442566 - protein, 7 aa, Mycobacterium
DAAETEL

SEQ ID NO: 442567 - protein, 13 aa, Mycobacterium
DAAETGLDTGSAD

SEQ ID NO: 442568 - protein, 7 aa, Mycobacterium
DAAETGR

SEQ ID NO: 442569 - protein, 9 aa, Mycobacterium
DAAETNPIY

SEQ ID NO: 442570 - protein, 11 aa, Mycobacterium
DAAETSEGRTA

SEQ ID NO: 442571 - protein, 6 aa, Mycobacterium
DAAETV

SEQ ID NO: 442572 - protein, 4 aa, Mycobacterium
DAAF

SEQ ID NO: 442573 - protein, 14 aa, Mycobacterium
DAAFPKRLGRPEEY

SEQ ID NO: 442574 - protein, 11 aa, Mycobacterium
DAAGAAAQPAW

SEQ ID NO: 442575 - protein, 28 aa, Mycobacterium
DAAGAAGTHGVGPQWASSYDAAAEEAGQ

SEQ ID NO: 442576 - protein, 6 aa, Mycobacterium
DAAGAE

SEQ ID NO: 442577 - protein, 9 aa, Mycobacterium
DAAGAHDDE

SEQ ID NO: 442578 - protein, 7 aa, Mycobacterium
DAAGAKY

SEQ ID NO: 442579 - protein, 6 aa, Mycobacterium
DAAGAL

SEQ ID NO: 442580 - protein, 6 aa, Mycobacterium
DAAGAP

SEQ ID NO: 442581 - protein, 15 aa, Mycobacterium
DAAGAPSGVFVEGRK

SEQ ID NO: 442582 - protein, 28 aa, Mycobacterium
DAAGDAQASTETATPSAGAPRTRLASAK

SEQ ID NO: 442583 - protein, 13 aa, Mycobacterium
DAAGDGGDWAGPE

SEQ ID NO: 442584 - protein, 8 aa, Mycobacterium
DAAGDPGL

SEQ ID NO: 442585 - protein, 7 aa, Mycobacterium
DAAGDVS

SEQ ID NO: 442586 - protein, 11 aa, Mycobacterium
DAAGEGSAAQD

SEQ ID NO: 442587 - protein, 6 aa, Mycobacterium
DAAGEL

SEQ ID NO: 442588 - protein, 8 aa, Mycobacterium
DAAGEYPT

SEQ ID NO: 442589 - protein, 12 aa, Mycobacterium
DAAGGTATGVTG

SEQ ID NO: 442590 - protein, 5 aa, Mycobacterium
DAAGH

SEQ ID NO: 442591 - protein, 8 aa, Mycobacterium
DAAGHDPG

SEQ ID NO: 442592 - protein, 9 aa, Mycobacterium
DAAGHRADA

SEQ ID NO: 442593 - protein, 10 aa, Mycobacterium
DAAGKGGSIK

SEQ ID NO: 442594 - protein, 9 aa, Mycobacterium
DAAGKYPTY

SEQ ID NO: 442595 - protein, 5 aa, Mycobacterium
DAAGL

SEQ ID NO: 442596 - protein, 6 aa, Mycobacterium
DAAGLA

SEQ ID NO: 442597 - protein, 7 aa, Mycobacterium
DAAGLAE

SEQ ID NO: 442598 - protein, 18 aa, Mycobacterium
DAAGLAEERYGAGNNQPG

SEQ ID NO: 442599 - protein, 5 aa, Mycobacterium
DAAGM

SEQ ID NO: 442600 - protein, 6 aa, Mycobacterium
DAAGNQ

SEQ ID NO: 442601 - protein, 7 aa, Mycobacterium
DAAGNRV

SEQ ID NO: 442602 - protein, 10 aa, Mycobacterium
DAAGNSAGLN

SEQ ID NO: 442603 - protein, 7 aa, Mycobacterium
DAAGNVA

SEQ ID NO: 442604 - protein, 6 aa, Mycobacterium
DAAGNW

SEQ ID NO: 442605 - protein, 18 aa, Mycobacterium
DAAGPDRQVLDWRFTALQ

SEQ ID NO: 442606 - protein, 35 aa, Mycobacterium
DAAGPGRKPVTGEAQQAAAPAAAGQPIAPGKAGRL

SEQ ID NO: 442607 - protein, 7 aa, Mycobacterium
DAAGPLA

SEQ ID NO: 442608 - protein, 6 aa, Mycobacterium
DAAGPT

SEQ ID NO: 442609 - protein, 5 aa, Mycobacterium
DAAGQ

SEQ ID NO: 442610 - protein, 5 aa, Mycobacterium
DAAGR

SEQ ID NO: 442611 - protein, 6 aa, Mycobacterium
DAAGRA

SEQ ID NO: 442612 - protein, 6 aa, Mycobacterium
DAAGRL

SEQ ID NO: 442613 - protein, 11 aa, Mycobacterium
DAAGRRPNKGE

SEQ ID NO: 442614 - protein, 5 aa, Mycobacterium
DAAGS

SEQ ID NO: 442615 - protein, 10 aa, Mycobacterium
DAAGSGGGSL

SEQ ID NO: 442616 - protein, 12 aa, Mycobacterium
DAAGSISSSEPI

SEQ ID NO: 442617 - protein, 9 aa, Mycobacterium
DAAGSPDAL

SEQ ID NO: 442618 - protein, 7 aa, Mycobacterium
DAAGSPL

SEQ ID NO: 442619 - protein, 7 aa, Mycobacterium
DAAGSSL

SEQ ID NO: 442620 - protein, 14 aa, Mycobacterium
DAAGTAAGRSQRAS

SEQ ID NO: 442621 - protein, 11 aa, Mycobacterium
DAAGTIGSARS

SEQ ID NO: 442622 - protein, 13 aa, Mycobacterium
DAAGTKSSFRTGD

SEQ ID NO: 442623 - protein, 18 aa, Mycobacterium
DAAGTPFKEGTSAELAER

SEQ ID NO: 442624 - protein, 7 aa, Mycobacterium
DAAGTYS

SEQ ID NO: 442625 - protein, 5 aa, Mycobacterium
DAAGV

SEQ ID NO: 442626 - protein, 6 aa, Mycobacterium
DAAGVD

SEQ ID NO: 442627 - protein, 4 aa, Mycobacterium
DAAH

SEQ ID NO: 442628 - protein, 11 aa, Mycobacterium
DAAHAAGEDTF

SEQ ID NO: 442629 - protein, 11 aa, Mycobacterium
DAAHAASGASI

SEQ ID NO: 442630 - protein, 14 aa, Mycobacterium
DAAHAASGSTITPR

SEQ ID NO: 442631 - protein, 6 aa, Mycobacterium
DAAHAG

SEQ ID NO: 442632 - protein, 7 aa, Mycobacterium
DAAHAGE

SEQ ID NO: 442633 - protein, 8 aa, Mycobacterium
DAAHAGGA

SEQ ID NO: 442634 - protein, 5 aa, Mycobacterium
DAAHG

SEQ ID NO: 442635 - protein, 19 aa, Mycobacterium
DAAHGAARAWGKTPPAERA

SEQ ID NO: 442636 - protein, 5 aa, Mycobacterium
DAAHN

SEQ ID NO: 442637 - protein, 6 aa, Mycobacterium
DAAHPD

SEQ ID NO: 442638 - protein, 4 aa, Mycobacterium
DAAI

SEQ ID NO: 442639 - protein, 44 aa, Mycobacterium
DAAISTDSADEVDAGEDELEGESGDIEDETEESVELEDLIGPES

SEQ ID NO: 442640 - protein, 4 aa, Mycobacterium
DAAK

SEQ ID NO: 442641 - protein, 5 aa, Mycobacterium
DAAKA

SEQ ID NO: 442642 - protein, 7 aa, Mycobacterium
DAAKAAG

SEQ ID NO: 442643 - protein, 9 aa, Mycobacterium
DAAKAGNAS

SEQ ID NO: 442644 - protein, 6 aa, Mycobacterium
DAAKAK

SEQ ID NO: 442645 - protein, 22 aa, Mycobacterium
DAAKGYATAASRSGDDVKILLT

SEQ ID NO: 442646 - protein, 22 aa, Mycobacterium
DAAKGYATAESRSGDDVKILLQ

SEQ ID NO: 442647 - protein, 5 aa, Mycobacterium
DAAKL

SEQ ID NO: 442648 - protein, 9 aa, Mycobacterium
DAAKQGNSS

SEQ ID NO: 442649 - protein, 18 aa, Mycobacterium
DAAKREAYEARARGETGE

SEQ ID NO: 442650 - protein, 6 aa, Mycobacterium
DAAKSA

SEQ ID NO: 442651 - protein, 15 aa, Mycobacterium
DAAKSGRVVKPVLLP

SEQ ID NO: 442652 - protein, 8 aa, Mycobacterium
DAAKTGDW

SEQ ID NO: 442653 - protein, 8 aa, Mycobacterium
DAALAATQ

SEQ ID NO: 442654 - protein, 5 aa, Mycobacterium
DAALK

SEQ ID NO: 442655 - protein, 20 aa, Mycobacterium
DAALQGKRATTGSGPSATAS

SEQ ID NO: 442656 - protein, 6 aa, Mycobacterium
DAALQR

SEQ ID NO: 442657 - protein, 9 aa, Mycobacterium
DAALRAGPV

SEQ ID NO: 442658 - protein, 6 aa, Mycobacterium
DAALRG

SEQ ID NO: 442659 - protein, 6 aa, Mycobacterium
DAAMAG

SEQ ID NO: 442660 - protein, 7 aa, Mycobacterium
DAAMERD

SEQ ID NO: 442661 - protein, 5 aa, Mycobacterium
DAAMT

SEQ ID NO: 442662 - protein, 4 aa, Mycobacterium
DAAN

SEQ ID NO: 442663 - protein, 5 aa, Mycobacterium
DAANA

SEQ ID NO: 442664 - protein, 8 aa, Mycobacterium
DAANADTD

SEQ ID NO: 442665 - protein, 7 aa, Mycobacterium
DAANAEA

SEQ ID NO: 442666 - protein, 14 aa, Mycobacterium
DAANAGATAATTRI

SEQ ID NO: 442667 - protein, 8 aa, Mycobacterium
DAANAGIT

SEQ ID NO: 442668 - protein, 10 aa, Mycobacterium
DAANASRDAV

SEQ ID NO: 442669 - protein, 11 aa, Mycobacterium
DAANDASHEHP

SEQ ID NO: 442670 - protein, 5 aa, Mycobacterium
DAANE

SEQ ID NO: 442671 - protein, 6 aa, Mycobacterium
DAANGD

SEQ ID NO: 442672 - protein, 8 aa, Mycobacterium
DAANGEPV

SEQ ID NO: 442673 - protein, 9 aa, Mycobacterium
DAANGIEPY

SEQ ID NO: 442674 - protein, 6 aa, Mycobacterium
DAANPN

SEQ ID NO: 442675 - protein, 9 aa, Mycobacterium
DAANRDPTV

SEQ ID NO: 442676 - protein, 6 aa, Mycobacterium
DAANRV

SEQ ID NO: 442677 - protein, 6 aa, Mycobacterium
DAANRY

SEQ ID NO: 442678 - protein, 15 aa, Mycobacterium
DAANSGALKVVLTAT

SEQ ID NO: 442679 - protein, 8 aa, Mycobacterium
DAANSSLT

SEQ ID NO: 442680 - protein, 12 aa, Mycobacterium
DAANTDNGDQEV

SEQ ID NO: 442681 - protein, 12 aa, Mycobacterium
DAANTQLRHGGG

SEQ ID NO: 442682 - protein, 4 aa, Mycobacterium
DAAP

SEQ ID NO: 442683 - protein, 12 aa, Mycobacterium
DAAPAAEAQARR

SEQ ID NO: 442684 - protein, 10 aa, Mycobacterium
DAAPADTTRR

SEQ ID NO: 442685 - protein, 13 aa, Mycobacterium
DAAPAKLGRRMPG

SEQ ID NO: 442686 - protein, 7 aa, Mycobacterium
DAAPAPI

SEQ ID NO: 442687 - protein, 14 aa, Mycobacterium
DAAPAPQSDSSTDA

SEQ ID NO: 442688 - protein, 16 aa, Mycobacterium
DAAPAVPTNYAPAPPR

SEQ ID NO: 442689 - protein, 22 aa, Mycobacterium
DAAPDPHTAGEPARTPITDQTT

SEQ ID NO: 442690 - protein, 13 aa, Mycobacterium
DAAPDWPSGHDDD

SEQ ID NO: 442691 - protein, 13 aa, Mycobacterium
DAAPDWPSGTESD

SEQ ID NO: 442692 - protein, 5 aa, Mycobacterium
DAAPE

SEQ ID NO: 442693 - protein, 8 aa, Mycobacterium
DAAPGGVH

SEQ ID NO: 442694 - protein, 8 aa, Mycobacterium
DAAPGKAI

SEQ ID NO: 442695 - protein, 10 aa, Mycobacterium
DAAPGLPATT

SEQ ID NO: 442696 - protein, 6 aa, Mycobacterium
DAAPGM

SEQ ID NO: 442697 - protein, 7 aa, Mycobacterium
DAAPGQV

SEQ ID NO: 442698 - protein, 7 aa, Mycobacterium
DAAPGSI

SEQ ID NO: 442699 - protein, 8 aa, Mycobacterium
DAAPGSPL

SEQ ID NO: 442700 - protein, 7 aa, Mycobacterium
DAAPGSQ

SEQ ID NO: 442701 - protein, 7 aa, Mycobacterium
DAAPGTG

SEQ ID NO: 442702 - protein, 8 aa, Mycobacterium
DAAPKYAA

SEQ ID NO: 442703 - protein, 9 aa, Mycobacterium
DAAPKYAAA

SEQ ID NO: 442704 - protein, 7 aa, Mycobacterium
DAAPLNQ

SEQ ID NO: 442705 - protein, 19 aa, Mycobacterium
DAAPNQAGNAGAAVNGKTY

SEQ ID NO: 442706 - protein, 11 aa, Mycobacterium
DAAPPEPDRAA

SEQ ID NO: 442707 - protein, 8 aa, Mycobacterium
DAAPPEYV

SEQ ID NO: 442708 - protein, 10 aa, Mycobacterium
DAAPPPTPHH

SEQ ID NO: 442709 - protein, 6 aa, Mycobacterium
DAAPQQ

SEQ ID NO: 442710 - protein, 6 aa, Mycobacterium
DAAPRD

SEQ ID NO: 442711 - protein, 6 aa, Mycobacterium
DAAPSY

SEQ ID NO: 442712 - protein, 8 aa, Mycobacterium
DAAPTAEA

SEQ ID NO: 442713 - protein, 8 aa, Mycobacterium
DAAPTAEG

SEQ ID NO: 442714 - protein, 7 aa, Mycobacterium
DAAPTDI

SEQ ID NO: 442715 - protein, 7 aa, Mycobacterium
DAAPTRR

SEQ ID NO: 442716 - protein, 7 aa, Mycobacterium
DAAPTTA

SEQ ID NO: 442717 - protein, 20 aa, Mycobacterium
DAAPVEPAATAEAGTDDSPQ

SEQ ID NO: 442718 - protein, 17 aa, Mycobacterium
DAAPVGDADARHGAAHD

SEQ ID NO: 442719 - protein, 7 aa, Mycobacterium
DAAPVTQ

SEQ ID NO: 442720 - protein, 9 aa, Mycobacterium
DAAQARAIG

SEQ ID NO: 442721 - protein, 8 aa, Mycobacterium
DAAQARAV

SEQ ID NO: 442722 - protein, 10 aa, Mycobacterium
DAAQASESGQ

SEQ ID NO: 442723 - protein, 8 aa, Mycobacterium
DAAQDRAA

SEQ ID NO: 442724 - protein, 9 aa, Mycobacterium
DAAQDSHRP

SEQ ID NO: 442725 - protein, 7 aa, Mycobacterium
DAAQEKA

SEQ ID NO: 442726 - protein, 8 aa, Mycobacterium
DAAQGIRD

SEQ ID NO: 442727 - protein, 10 aa, Mycobacterium
DAAQGSPADQ

SEQ ID NO: 442728 - protein, 7 aa, Mycobacterium
DAAQGTR

SEQ ID NO: 442729 - protein, 17 aa, Mycobacterium
DAAQLRQDAAEAPDGTR

SEQ ID NO: 442730 - protein, 5 aa, Mycobacterium
DAAQR

SEQ ID NO: 442731 - protein, 10 aa, Mycobacterium
DAAQRDEAKI

SEQ ID NO: 442732 - protein, 9 aa, Mycobacterium
DAAQRDPST

SEQ ID NO: 442733 - protein, 7 aa, Mycobacterium
DAAQRDR

SEQ ID NO: 442734 - protein, 9 aa, Mycobacterium
DAAQREPGR

SEQ ID NO: 442735 - protein, 7 aa, Mycobacterium
DAAQRSI

SEQ ID NO: 442736 - protein, 8 aa, Mycobacterium
DAARAAAR

SEQ ID NO: 442737 - protein, 10 aa, Mycobacterium
DAARAGSGPT

SEQ ID NO: 442738 - protein, 7 aa, Mycobacterium
DAARAPA

SEQ ID NO: 442739 - protein, 7 aa, Mycobacterium
DAARARE

SEQ ID NO: 442740 - protein, 16 aa, Mycobacterium
DAARARLEDAERALRD

SEQ ID NO: 442741 - protein, 16 aa, Mycobacterium
DAARATKKSGATVLSG

SEQ ID NO: 442742 - protein, 13 aa, Mycobacterium
DAARATQANADGL

SEQ ID NO: 442743 - protein, 6 aa, Mycobacterium
DAARDA

SEQ ID NO: 442744 - protein, 9 aa, Mycobacterium
DAARDLAKP

SEQ ID NO: 442745 - protein, 6 aa, Mycobacterium
DAARDR

SEQ ID NO: 442746 - protein, 14 aa, Mycobacterium
DAAREALSGESAAI

SEQ ID NO: 442747 - protein, 13 aa, Mycobacterium
DAARERHGQANSW

SEQ ID NO: 442748 - protein, 11 aa, Mycobacterium
DAARETDSSPL

SEQ ID NO: 442749 - protein, 9 aa, Mycobacterium
DAARGAARL

SEQ ID NO: 442750 - protein, 9 aa, Mycobacterium
DAARGEALP

SEQ ID NO: 442751 - protein, 6 aa, Mycobacterium
DAARGG

SEQ ID NO: 442752 - protein, 18 aa, Mycobacterium
DAARGGPVAEGSVGGGTG

SEQ ID NO: 442753 - protein, 22 aa, Mycobacterium
DAARNGITDNDTVTVRSSAGEI

SEQ ID NO: 442754 - protein, 6 aa, Mycobacterium
DAARNR

SEQ ID NO: 442755 - protein, 7 aa, Mycobacterium
DAARNRD

SEQ ID NO: 442756 - protein, 8 aa, Mycobacterium
DAARPAAV

SEQ ID NO: 442757 - protein, 6 aa, Mycobacterium
DAARPI

SEQ ID NO: 442758 - protein, 12 aa, Mycobacterium
DAARPTPPWPTP

SEQ ID NO: 442759 - protein, 8 aa, Mycobacterium
DAARQAAT

SEQ ID NO: 442760 - protein, 8 aa, Mycobacterium
DAARQGNS

SEQ ID NO: 442761 - protein, 35 aa, Mycobacterium
DAARRAAISSADALRADQKSASKSVGAASPDERPA

SEQ ID NO: 442762 - protein, 37 aa, Mycobacterium
DAARRAAISSADALRAEQKSASKSVGAASPEERPARL

SEQ ID NO: 442763 - protein, 11 aa, Mycobacterium
DAARRADTSGA

SEQ ID NO: 442764 - protein, 10 aa, Mycobacterium
DAARRGDTAP

SEQ ID NO: 442765 - protein, 10 aa, Mycobacterium
DAARRGRTVT

SEQ ID NO: 442766 - protein, 12 aa, Mycobacterium
DAARRMQQEHSS

SEQ ID NO: 442767 - protein, 7 aa, Mycobacterium
DAARSEC

SEQ ID NO: 442768 - protein, 9 aa, Mycobacterium
DAARTAAEA

SEQ ID NO: 442769 - protein, 7 aa, Mycobacterium
DAARTGP

SEQ ID NO: 442770 - protein, 9 aa, Mycobacterium
DAARTPYRR

SEQ ID NO: 442771 - protein, 9 aa, Mycobacterium
DAARTRPWR

SEQ ID NO: 442772 - protein, 7 aa, Mycobacterium
DAARTTY

SEQ ID NO: 442773 - protein, 22 aa, Mycobacterium
DAARYKSAARQGRDAAAAGDIG

SEQ ID NO: 442774 - protein, 10 aa, Mycobacterium
DAASAARTLG

SEQ ID NO: 442775 - protein, 8 aa, Mycobacterium
DAASADKD

SEQ ID NO: 442776 - protein, 10 aa, Mycobacterium
DAASAEDAVS

SEQ ID NO: 442777 - protein, 10 aa, Mycobacterium
DAASAEQVAT

SEQ ID NO: 442778 - protein, 9 aa, Mycobacterium
DAASAGAAV

SEQ ID NO: 442779 - protein, 5 aa, Mycobacterium
DAASD

SEQ ID NO: 442780 - protein, 7 aa, Mycobacterium
DAASDRM

SEQ ID NO: 442781 - protein, 7 aa, Mycobacterium
DAASEIA

SEQ ID NO: 442782 - protein, 8 aa, Mycobacterium
DAASETGQ

SEQ ID NO: 442783 - protein, 16 aa, Mycobacterium
DAASGRESKNPPDPQI

SEQ ID NO: 442784 - protein, 7 aa, Mycobacterium
DAASGRV

SEQ ID NO: 442785 - protein, 5 aa, Mycobacterium
DAASH

SEQ ID NO: 442786 - protein, 16 aa, Mycobacterium
DAASKRGDASQQAADK

SEQ ID NO: 442787 - protein, 10 aa, Mycobacterium
DAASLGQAGP

SEQ ID NO: 442788 - protein, 76 aa, Mycobacterium
DAASPANDLGRSGNEAPREQFSAEESSAARQGDMPAGPLGQSAKNAGSDKGAAGGTGAVGRAPVNEGGDDEQNRPG

SEQ ID NO: 442789 - protein, 8 aa, Mycobacterium
DAASPEVE

SEQ ID NO: 442790 - protein, 7 aa, Mycobacterium
DAASREV

SEQ ID NO: 442791 - protein, 7 aa, Mycobacterium
DAASRVD

SEQ ID NO: 442792 - protein, 24 aa, Mycobacterium
DAASSPATGRAPGYVRSPAPTSRR

SEQ ID NO: 442793 - protein, 15 aa, Mycobacterium
DAASTDTDATRPLDQ

SEQ ID NO: 442794 - protein, 18 aa, Mycobacterium
DAASTGATGEENRELSEK

SEQ ID NO: 442795 - protein, 8 aa, Mycobacterium
DAASTKVF

SEQ ID NO: 442796 - protein, 5 aa, Mycobacterium
DAASV

SEQ ID NO: 442797 - protein, 10 aa, Mycobacterium
DAATADPSGL

SEQ ID NO: 442798 - protein, 9 aa, Mycobacterium
DAATADPTG

SEQ ID NO: 442799 - protein, 8 aa, Mycobacterium
DAATAGNA

SEQ ID NO: 442800 - protein, 6 aa, Mycobacterium
DAATAS

SEQ ID NO: 442801 - protein, 10 aa, Mycobacterium
DAATDPAGTA

SEQ ID NO: 442802 - protein, 9 aa, Mycobacterium
DAATDPAYT

SEQ ID NO: 442803 - protein, 7 aa, Mycobacterium
DAATDQQ

SEQ ID NO: 442804 - protein, 6 aa, Mycobacterium
DAATDT

SEQ ID NO: 442805 - protein, 5 aa, Mycobacterium
DAATE

SEQ ID NO: 442806 - protein, 7 aa, Mycobacterium
DAATGAL

SEQ ID NO: 442807 - protein, 7 aa, Mycobacterium
DAATGKL

SEQ ID NO: 442808 - protein, 11 aa, Mycobacterium
DAATGTADPEI

SEQ ID NO: 442809 - protein, 12 aa, Mycobacterium
DAATGTDPGGPI

SEQ ID NO: 442810 - protein, 7 aa, Mycobacterium
DAATGTV

SEQ ID NO: 442811 - protein, 8 aa, Mycobacterium
DAATGTVE

SEQ ID NO: 442812 - protein, 14 aa, Mycobacterium
DAATGWEPVTGTEI

SEQ ID NO: 442813 - protein, 16 aa, Mycobacterium
DAATIARRAGADGNPV

SEQ ID NO: 442814 - protein, 5 aa, Mycobacterium
DAATL

SEQ ID NO: 442815 - protein, 11 aa, Mycobacterium
DAATNRTPEQN

SEQ ID NO: 442816 - protein, 9 aa, Mycobacterium
DAATPGVAA

SEQ ID NO: 442817 - protein, 10 aa, Mycobacterium
DAATPSRAYA

SEQ ID NO: 442818 - protein, 7 aa, Mycobacterium
DAATPTA

SEQ ID NO: 442819 - protein, 8 aa, Mycobacterium
DAATQQAV

SEQ ID NO: 442820 - protein, 7 aa, Mycobacterium
DAATREV

SEQ ID NO: 442821 - protein, 7 aa, Mycobacterium
DAATRTR

SEQ ID NO: 442822 - protein, 15 aa, Mycobacterium
DAATRVAPGTALQGN

SEQ ID NO: 442823 - protein, 5 aa, Mycobacterium
DAATS

SEQ ID NO: 442824 - protein, 7 aa, Mycobacterium
DAATSIG

SEQ ID NO: 442825 - protein, 5 aa, Mycobacterium
DAATT

SEQ ID NO: 442826 - protein, 7 aa, Mycobacterium
DAATTAE

SEQ ID NO: 442827 - protein, 6 aa, Mycobacterium
DAATTR

SEQ ID NO: 442828 - protein, 5 aa, Mycobacterium
DAATV

SEQ ID NO: 442829 - protein, 6 aa, Mycobacterium
DAAVRG

SEQ ID NO: 442830 - protein, 5 aa, Mycobacterium
DAAVT

SEQ ID NO: 442831 - protein, 8 aa, Mycobacterium
DAAVTDDA

SEQ ID NO: 442832 - protein, 14 aa, Mycobacterium
DAAVTPDGVSREGA

SEQ ID NO: 442833 - protein, 7 aa, Mycobacterium
DAAYNEY

SEQ ID NO: 442834 - protein, 13 aa, Mycobacterium
DAAYQKTVRPEGE

SEQ ID NO: 442835 - protein, 7 aa, Mycobacterium
DAAYSER

SEQ ID NO: 442836 - protein, 18 aa, Mycobacterium
DAAYSSGAAGYEYTVRHV

SEQ ID NO: 442837 - protein, 4 aa, Mycobacterium
DACA

SEQ ID NO: 442838 - protein, 9 aa, Mycobacterium
DACERGGST

SEQ ID NO: 442839 - protein, 4 aa, Mycobacterium
DACG

SEQ ID NO: 442840 - protein, 8 aa, Mycobacterium
DACGDTEK

SEQ ID NO: 442841 - protein, 6 aa, Mycobacterium
DACGGD

SEQ ID NO: 442842 - protein, 9 aa, Mycobacterium
DACKQSQNR

SEQ ID NO: 442843 - protein, 5 aa, Mycobacterium
DACPG

SEQ ID NO: 442844 - protein, 6 aa, Mycobacterium
DACPGG

SEQ ID NO: 442845 - protein, 10 aa, Mycobacterium
DACRRGNSTI

SEQ ID NO: 442846 - protein, 7 aa, Mycobacterium
DACTRHP

SEQ ID NO: 442847 - protein, 4 aa, Mycobacterium
DADA

SEQ ID NO: 442848 - protein, 9 aa, Mycobacterium
DADAADMGR

SEQ ID NO: 442849 - protein, 11 aa, Mycobacterium
DADAAGSEGST

SEQ ID NO: 442850 - protein, 7 aa, Mycobacterium
DADAAPI

SEQ ID NO: 442851 - protein, 9 aa, Mycobacterium
DADAAPLTR

SEQ ID NO: 442852 - protein, 8 aa, Mycobacterium
DADAARRR

SEQ ID NO: 442853 - protein, 7 aa, Mycobacterium
DADAATV

SEQ ID NO: 442854 - protein, 5 aa, Mycobacterium
DADAD

SEQ ID NO: 442855 - protein, 11 aa, Mycobacterium
DADADGREGST

SEQ ID NO: 442856 - protein, 11 aa, Mycobacterium
DADADGSEGST

SEQ ID NO: 442857 - protein, 8 aa, Mycobacterium
DADAELPR

SEQ ID NO: 442858 - protein, 9 aa, Mycobacterium
DADAGARHV

SEQ ID NO: 442859 - protein, 8 aa, Mycobacterium
DADAGDMD

SEQ ID NO: 442860 - protein, 7 aa, Mycobacterium
DADAGTA

SEQ ID NO: 442861 - protein, 11 aa, Mycobacterium
DADAHAGHTET

SEQ ID NO: 442862 - protein, 15 aa, Mycobacterium
DADAIRQANDSQYGL

SEQ ID NO: 442863 - protein, 5 aa, Mycobacterium
DADAL

SEQ ID NO: 442864 - protein, 8 aa, Mycobacterium
DADALGVD

SEQ ID NO: 442865 - protein, 14 aa, Mycobacterium
DADAPARQARIGTR

SEQ ID NO: 442866 - protein, 11 aa, Mycobacterium
DADAQRAAAGA

SEQ ID NO: 442867 - protein, 8 aa, Mycobacterium
DADAQTYA

SEQ ID NO: 442868 - protein, 6 aa, Mycobacterium
DADARA

SEQ ID NO: 442869 - protein, 7 aa, Mycobacterium
DADARQR

SEQ ID NO: 442870 - protein, 6 aa, Mycobacterium
DADARV

SEQ ID NO: 442871 - protein, 13 aa, Mycobacterium
DADASLGAGWATG

SEQ ID NO: 442872 - protein, 6 aa, Mycobacterium
DADASM

SEQ ID NO: 442873 - protein, 9 aa, Mycobacterium
DADASPSIL

SEQ ID NO: 442874 - protein, 14 aa, Mycobacterium
DADATDPPPALGQH

SEQ ID NO: 442875 - protein, 13 aa, Mycobacterium
DADATLEEAQENK

SEQ ID NO: 442876 - protein, 12 aa, Mycobacterium
DADATLEQAQEN

SEQ ID NO: 442877 - protein, 20 aa, Mycobacterium
DADATPGFRGDKSDAPTLQA

SEQ ID NO: 442878 - protein, 16 aa, Mycobacterium
DADATTPLQNCGERTH

SEQ ID NO: 442879 - protein, 5 aa, Mycobacterium
DADAV

SEQ ID NO: 442880 - protein, 13 aa, Mycobacterium
DADAVASAGIEAR

SEQ ID NO: 442881 - protein, 27 aa, Mycobacterium
DADAVGRTAAARDGIVGQRADASAVSD

SEQ ID NO: 442882 - protein, 14 aa, Mycobacterium
DADAVRRRKERHAD

SEQ ID NO: 442883 - protein, 19 aa, Mycobacterium
DADAVSEADKKGLAAAAPD

SEQ ID NO: 442884 - protein, 4 aa, Mycobacterium
DADC

SEQ ID NO: 442885 - protein, 10 aa, Mycobacterium
DADDAANYGG

SEQ ID NO: 442886 - protein, 17 aa, Mycobacterium
DADDADLAAAQAAAAAE

SEQ ID NO: 442887 - protein, 14 aa, Mycobacterium
DADDAHGDFSSGSV

SEQ ID NO: 442888 - protein, 8 aa, Mycobacterium
DADDDAVK

SEQ ID NO: 442889 - protein, 8 aa, Mycobacterium
DADDDESV

SEQ ID NO: 442890 - protein, 12 aa, Mycobacterium
DADDDHSDHDMG

SEQ ID NO: 442891 - protein, 21 aa, Mycobacterium
DADDDRGTRPRTATRSDDEQW

SEQ ID NO: 442892 - protein, 12 aa, Mycobacterium
DADDEGDSGPAT

SEQ ID NO: 442893 - protein, 8 aa, Mycobacterium
DADDIESL

SEQ ID NO: 442894 - protein, 12 aa, Mycobacterium
DADDPDKATGTQ

SEQ ID NO: 442895 - protein, 12 aa, Mycobacterium
DADDPEAKAREM

SEQ ID NO: 442896 - protein, 8 aa, Mycobacterium
DADDPPFD

SEQ ID NO: 442897 - protein, 9 aa, Mycobacterium
DADDPSTSD

SEQ ID NO: 442898 - protein, 11 aa, Mycobacterium
DADDRANLDDS

SEQ ID NO: 442899 - protein, 7 aa, Mycobacterium
DADDREE

SEQ ID NO: 442900 - protein, 6 aa, Mycobacterium
DADDRL

SEQ ID NO: 442901 - protein, 73 aa, Mycobacterium
DADDSDSDDSDSDDAGDSDDSEAEDSGDEAEPAAEESEPEPEPEPEDEDEPEPEPKKKSSGGSGSSGSGTSVT

SEQ ID NO: 442902 - protein, 7 aa, Mycobacterium
DADDTAS

SEQ ID NO: 442903 - protein, 11 aa, Mycobacterium
DADDVSEDSLE

SEQ ID NO: 442904 - protein, 11 aa, Mycobacterium
DADEAGTADAV

SEQ ID NO: 442905 - protein, 7 aa, Mycobacterium
DADEANR

SEQ ID NO: 442906 - protein, 5 aa, Mycobacterium
DADED

SEQ ID NO: 442907 - protein, 10 aa, Mycobacterium
DADEDRGLGD

SEQ ID NO: 442908 - protein, 7 aa, Mycobacterium
DADEEAT

SEQ ID NO: 442909 - protein, 12 aa, Mycobacterium
DADEEFKQQSYE

SEQ ID NO: 442910 - protein, 7 aa, Mycobacterium
DADEETT

SEQ ID NO: 442911 - protein, 17 aa, Mycobacterium
DADEGGYVQTPRPVEGR

SEQ ID NO: 442912 - protein, 12 aa, Mycobacterium
DADEGPKSIAEP

SEQ ID NO: 442913 - protein, 10 aa, Mycobacterium
DADEGQPGGR

SEQ ID NO: 442914 - protein, 10 aa, Mycobacterium
DADEHTPRQW

SEQ ID NO: 442915 - protein, 12 aa, Mycobacterium
DADEKDYDLGPL

SEQ ID NO: 442916 - protein, 5 aa, Mycobacterium
DADEL

SEQ ID NO: 442917 - protein, 8 aa, Mycobacterium
DADEPSLT

SEQ ID NO: 442918 - protein, 7 aa, Mycobacterium
DADEPTT

SEQ ID NO: 442919 - protein, 5 aa, Mycobacterium
DADER

SEQ ID NO: 442920 - protein, 7 aa, Mycobacterium
DADERRR

SEQ ID NO: 442921 - protein, 8 aa, Mycobacterium
DADESARV

SEQ ID NO: 442922 - protein, 11 aa, Mycobacterium
DADESTPVPTC

SEQ ID NO: 442923 - protein, 9 aa, Mycobacterium
DADESTRSA

SEQ ID NO: 442924 - protein, 9 aa, Mycobacterium
DADESTRTA

SEQ ID NO: 442925 - protein, 8 aa, Mycobacterium
DADETDYD

SEQ ID NO: 442926 - protein, 6 aa, Mycobacterium
DADETG

SEQ ID NO: 442927 - protein, 8 aa, Mycobacterium
DADGATLA

SEQ ID NO: 442928 - protein, 13 aa, Mycobacterium
DADGDGAADGASP

SEQ ID NO: 442929 - protein, 14 aa, Mycobacterium
DADGDGAAEAAEHL

SEQ ID NO: 442930 - protein, 8 aa, Mycobacterium
DADGEPTG

SEQ ID NO: 442931 - protein, 7 aa, Mycobacterium
DADGERL

SEQ ID NO: 442932 - protein, 7 aa, Mycobacterium
DADGGGL

SEQ ID NO: 442933 - protein, 6 aa, Mycobacterium
DADGGI

SEQ ID NO: 442934 - protein, 6 aa, Mycobacterium
DADGGL

SEQ ID NO: 442935 - protein, 12 aa, Mycobacterium
DADGGPDQRLTG

SEQ ID NO: 442936 - protein, 7 aa, Mycobacterium
DADGGTG

SEQ ID NO: 442937 - protein, 7 aa, Mycobacterium
DADGGYA

SEQ ID NO: 442938 - protein, 9 aa, Mycobacterium
DADGKPRIA

SEQ ID NO: 442939 - protein, 5 aa, Mycobacterium
DADGM

SEQ ID NO: 442940 - protein, 26 aa, Mycobacterium
DADGNDLPGVTTSDCEYKGGLPGVDN

SEQ ID NO: 442941 - protein, 10 aa, Mycobacterium
DADGNEIPEG

SEQ ID NO: 442942 - protein, 6 aa, Mycobacterium
DADGNH

SEQ ID NO: 442943 - protein, 8 aa, Mycobacterium
DADGNPAY

SEQ ID NO: 442944 - protein, 9 aa, Mycobacterium
DADGNRQAA

SEQ ID NO: 442945 - protein, 7 aa, Mycobacterium
DADGNVT

SEQ ID NO: 442946 - protein, 6 aa, Mycobacterium
DADGPD

SEQ ID NO: 442947 - protein, 6 aa, Mycobacterium
DADGPF

SEQ ID NO: 442948 - protein, 9 aa, Mycobacterium
DADGPSTVR

SEQ ID NO: 442949 - protein, 6 aa, Mycobacterium
DADGPT

SEQ ID NO: 442950 - protein, 7 aa, Mycobacterium
DADGPTE

SEQ ID NO: 442951 - protein, 11 aa, Mycobacterium
DADGQPPITAK

SEQ ID NO: 442952 - protein, 9 aa, Mycobacterium
DADGQRLSE

SEQ ID NO: 442953 - protein, 8 aa, Mycobacterium
DADGRAAA

SEQ ID NO: 442954 - protein, 10 aa, Mycobacterium
DADGRAAAAE

SEQ ID NO: 442955 - protein, 15 aa, Mycobacterium
DADGRPRPIPHPSWA

SEQ ID NO: 442956 - protein, 8 aa, Mycobacterium
DADGRPVT

SEQ ID NO: 442957 - protein, 8 aa, Mycobacterium
DADGRRPR

SEQ ID NO: 442958 - protein, 9 aa, Mycobacterium
DADGRSAGL

SEQ ID NO: 442959 - protein, 6 aa, Mycobacterium
DADGRT

SEQ ID NO: 442960 - protein, 6 aa, Mycobacterium
DADGSL

SEQ ID NO: 442961 - protein, 6 aa, Mycobacterium
DADGSP

SEQ ID NO: 442962 - protein, 10 aa, Mycobacterium
DADGSPARAI

SEQ ID NO: 442963 - protein, 16 aa, Mycobacterium
DADGSPVDEATALPAG

SEQ ID NO: 442964 - protein, 7 aa, Mycobacterium
DADGSRA

SEQ ID NO: 442965 - protein, 12 aa, Mycobacterium
DADGSVLALRRE

SEQ ID NO: 442966 - protein, 16 aa, Mycobacterium
DADGSVVSRGKNLDEL

SEQ ID NO: 442967 - protein, 9 aa, Mycobacterium
DADGTATPF

SEQ ID NO: 442968 - protein, 9 aa, Mycobacterium
DADGTKAGF

SEQ ID NO: 442969 - protein, 14 aa, Mycobacterium
DADGTNSHLVDRFG

SEQ ID NO: 442970 - protein, 8 aa, Mycobacterium
DADGTPIM

SEQ ID NO: 442971 - protein, 8 aa, Mycobacterium
DADGTPLM

SEQ ID NO: 442972 - protein, 9 aa, Mycobacterium
DADGTREEL

SEQ ID NO: 442973 - protein, 10 aa, Mycobacterium
DADGTVGGNG

SEQ ID NO: 442974 - protein, 9 aa, Mycobacterium
DADGTVTVR

SEQ ID NO: 442975 - protein, 7 aa, Mycobacterium
DADGTYR

SEQ ID NO: 442976 - protein, 15 aa, Mycobacterium
DADGVNSHLVDRFGE

SEQ ID NO: 442977 - protein, 12 aa, Mycobacterium
DADGVTVTPQSS

SEQ ID NO: 442978 - protein, 4 aa, Mycobacterium
DADH

SEQ ID NO: 442979 - protein, 7 aa, Mycobacterium
DADHARG

SEQ ID NO: 442980 - protein, 8 aa, Mycobacterium
DADHDGPL

SEQ ID NO: 442981 - protein, 15 aa, Mycobacterium
DADHDPARRTEPREG

SEQ ID NO: 442982 - protein, 26 aa, Mycobacterium
DADHETDARTPAPAAREASRSQGRGL

SEQ ID NO: 442983 - protein, 7 aa, Mycobacterium
DADIARR

SEQ ID NO: 442984 - protein, 6 aa, Mycobacterium
DADIDE

SEQ ID NO: 442985 - protein, 5 aa, Mycobacterium
DADIE

SEQ ID NO: 442986 - protein, 7 aa, Mycobacterium
DADIEGA

SEQ ID NO: 442987 - protein, 8 aa, Mycobacterium
DADKAALE

SEQ ID NO: 442988 - protein, 9 aa, Mycobacterium
DADKAEGGE

SEQ ID NO: 442989 - protein, 29 aa, Mycobacterium
DADKGKIETSADEGNVEYRNTEEFKKKLE

SEQ ID NO: 442990 - protein, 7 aa, Mycobacterium
DADKPAN

SEQ ID NO: 442991 - protein, 7 aa, Mycobacterium
DADKPAT

SEQ ID NO: 442992 - protein, 4 aa, Mycobacterium
DADL

SEQ ID NO: 442993 - protein, 5 aa, Mycobacterium
DADLA

SEQ ID NO: 442994 - protein, 5 aa, Mycobacterium
DADLR

SEQ ID NO: 442995 - protein, 4 aa, Mycobacterium
DADM

SEQ ID NO: 442996 - protein, 9 aa, Mycobacterium
DADNDVPVD

SEQ ID NO: 442997 - protein, 6 aa, Mycobacterium
DADNPA

SEQ ID NO: 442998 - protein, 5 aa, Mycobacterium
DADNR

SEQ ID NO: 442999 - protein, 5 aa, Mycobacterium
DADPA

SEQ ID NO: 443000 - protein, 7 aa, Mycobacterium
DADPAAT

SEQ ID NO: 443001 - protein, 9 aa, Mycobacterium
DADPAEVAG

SEQ ID NO: 443002 - protein, 6 aa, Mycobacterium
DADPAL

SEQ ID NO: 443003 - protein, 7 aa, Mycobacterium
DADPARR

SEQ ID NO: 443004 - protein, 13 aa, Mycobacterium
DADPARYQPVAHT

SEQ ID NO: 443005 - protein, 9 aa, Mycobacterium
DADPASAIA

SEQ ID NO: 443006 - protein, 5 aa, Mycobacterium
DADPD

SEQ ID NO: 443007 - protein, 7 aa, Mycobacterium
DADPDAA

SEQ ID NO: 443008 - protein, 9 aa, Mycobacterium
DADPDALRE

SEQ ID NO: 443009 - protein, 6 aa, Mycobacterium
DADPDV

SEQ ID NO: 443010 - protein, 5 aa, Mycobacterium
DADPE

SEQ ID NO: 443011 - protein, 7 aa, Mycobacterium
DADPEAS

SEQ ID NO: 443012 - protein, 15 aa, Mycobacterium
DADPEGQLGPGSRAR

SEQ ID NO: 443013 - protein, 8 aa, Mycobacterium
DADPEHRE

SEQ ID NO: 443014 - protein, 5 aa, Mycobacterium
DADPG

SEQ ID NO: 443015 - protein, 8 aa, Mycobacterium
DADPGHGM

SEQ ID NO: 443016 - protein, 8 aa, Mycobacterium
DADPGKFQ

SEQ ID NO: 443017 - protein, 9 aa, Mycobacterium
DADPGQSAN

SEQ ID NO: 443018 - protein, 8 aa, Mycobacterium
DADPGYTA

SEQ ID NO: 443019 - protein, 14 aa, Mycobacterium
DADPHDGAVTRGGQ

SEQ ID NO: 443020 - protein, 7 aa, Mycobacterium
DADPITV

SEQ ID NO: 443021 - protein, 13 aa, Mycobacterium
DADPLQSDQESDI

SEQ ID NO: 443022 - protein, 8 aa, Mycobacterium
DADPLRPA

SEQ ID NO: 443023 - protein, 6 aa, Mycobacterium
DADPNL

SEQ ID NO: 443024 - protein, 5 aa, Mycobacterium
DADPP

SEQ ID NO: 443025 - protein, 7 aa, Mycobacterium
DADPPHI

SEQ ID NO: 443026 - protein, 9 aa, Mycobacterium
DADPPYQPD

SEQ ID NO: 443027 - protein, 10 aa, Mycobacterium
DADPRAATKS

SEQ ID NO: 443028 - protein, 10 aa, Mycobacterium
DADPRKVGRA

SEQ ID NO: 443029 - protein, 22 aa, Mycobacterium
DADPRKVGRAFSGGGGHGDRPG

SEQ ID NO: 443030 - protein, 14 aa, Mycobacterium
DADPRSAGERRSDA

SEQ ID NO: 443031 - protein, 12 aa, Mycobacterium
DADPRVAVPGRR

SEQ ID NO: 443032 - protein, 19 aa, Mycobacterium
DADPRVAVPGRRDDLSGLP

SEQ ID NO: 443033 - protein, 5 aa, Mycobacterium
DADPS

SEQ ID NO: 443034 - protein, 8 aa, Mycobacterium
DADPSADR

SEQ ID NO: 443035 - protein, 14 aa, Mycobacterium
DADPTAERNQRADL

SEQ ID NO: 443036 - protein, 11 aa, Mycobacterium
DADQARALGTS

SEQ ID NO: 443037 - protein, 5 aa, Mycobacterium
DADQD

SEQ ID NO: 443038 - protein, 8 aa, Mycobacterium
DADQDTLK

SEQ ID NO: 443039 - protein, 8 aa, Mycobacterium
DADQEITG

SEQ ID NO: 443040 - protein, 8 aa, Mycobacterium
DADQPSVR

SEQ ID NO: 443041 - protein, 5 aa, Mycobacterium
DADQV

SEQ ID NO: 443042 - protein, 6 aa, Mycobacterium
DADRAA

SEQ ID NO: 443043 - protein, 7 aa, Mycobacterium
DADRAAT

SEQ ID NO: 443044 - protein, 7 aa, Mycobacterium
DADRAGR

SEQ ID NO: 443045 - protein, 7 aa, Mycobacterium
DADRAKR

SEQ ID NO: 443046 - protein, 8 aa, Mycobacterium
DADRAYND

SEQ ID NO: 443047 - protein, 5 aa, Mycobacterium
DADRD

SEQ ID NO: 443048 - protein, 6 aa, Mycobacterium
DADRDA

SEQ ID NO: 443049 - protein, 7 aa, Mycobacterium
DADRDAY

SEQ ID NO: 443050 - protein, 6 aa, Mycobacterium
DADRDH

SEQ ID NO: 443051 - protein, 5 aa, Mycobacterium
DADRE

SEQ ID NO: 443052 - protein, 7 aa, Mycobacterium
DADRIST

SEQ ID NO: 443053 - protein, 14 aa, Mycobacterium
DADRLAGTDGDYHQ

SEQ ID NO: 443054 - protein, 8 aa, Mycobacterium
DADRNGTL

SEQ ID NO: 443055 - protein, 7 aa, Mycobacterium
DADRPGT

SEQ ID NO: 443056 - protein, 6 aa, Mycobacterium
DADRPL

SEQ ID NO: 443057 - protein, 7 aa, Mycobacterium
DADRPLS

SEQ ID NO: 443058 - protein, 8 aa, Mycobacterium
DADRPLTV

SEQ ID NO: 443059 - protein, 14 aa, Mycobacterium
DADRPSGRLGPQAR

SEQ ID NO: 443060 - protein, 8 aa, Mycobacterium
DADRQTAV

SEQ ID NO: 443061 - protein, 6 aa, Mycobacterium
DADRRT

SEQ ID NO: 443062 - protein, 7 aa, Mycobacterium
DADRSGR

SEQ ID NO: 443063 - protein, 7 aa, Mycobacterium
DADRTGR

SEQ ID NO: 443064 - protein, 7 aa, Mycobacterium
DADRYAP

SEQ ID NO: 443065 - protein, 7 aa, Mycobacterium
DADSAHP

SEQ ID NO: 443066 - protein, 7 aa, Mycobacterium
DADSAQQ

SEQ ID NO: 443067 - protein, 7 aa, Mycobacterium
DADSDDI

SEQ ID NO: 443068 - protein, 8 aa, Mycobacterium
DADSDTFA

SEQ ID NO: 443069 - protein, 8 aa, Mycobacterium
DADSEEAL

SEQ ID NO: 443070 - protein, 11 aa, Mycobacterium
DADSERDDLTR

SEQ ID NO: 443071 - protein, 8 aa, Mycobacterium
DADSIADG

SEQ ID NO: 443072 - protein, 16 aa, Mycobacterium
DADSLPIDTGSTEYAP

SEQ ID NO: 443073 - protein, 8 aa, Mycobacterium
DADSLQPE

SEQ ID NO: 443074 - protein, 9 aa, Mycobacterium
DADSPDAAR

SEQ ID NO: 443075 - protein, 17 aa, Mycobacterium
DADSPKAVAQASAGKVG

SEQ ID NO: 443076 - protein, 8 aa, Mycobacterium
DADSPTGA

SEQ ID NO: 443077 - protein, 5 aa, Mycobacterium
DADTA

SEQ ID NO: 443078 - protein, 12 aa, Mycobacterium
DADTAGSTTGLA

SEQ ID NO: 443079 - protein, 11 aa, Mycobacterium
DADTDGREGST

SEQ ID NO: 443080 - protein, 8 aa, Mycobacterium
DADTEGVE

SEQ ID NO: 443081 - protein, 7 aa, Mycobacterium
DADTEQR

SEQ ID NO: 443082 - protein, 12 aa, Mycobacterium
DADTERKVTRNE

SEQ ID NO: 443083 - protein, 6 aa, Mycobacterium
DADTGA

SEQ ID NO: 443084 - protein, 9 aa, Mycobacterium
DADTGAATV

SEQ ID NO: 443085 - protein, 8 aa, Mycobacterium
DADTGESP

SEQ ID NO: 443086 - protein, 9 aa, Mycobacterium
DADTGGPHD

SEQ ID NO: 443087 - protein, 34 aa, Mycobacterium
DADTGPPNVANPQTPTRPPTKAPNRPPSHSTKNR

SEQ ID NO: 443088 - protein, 7 aa, Mycobacterium
DADTGPR

SEQ ID NO: 443089 - protein, 32 aa, Mycobacterium
DADTGTGREATHAAQHRDAGPPADAEHHDTGA

SEQ ID NO: 443090 - protein, 10 aa, Mycobacterium
DADTGVFPSD

SEQ ID NO: 443091 - protein, 11 aa, Mycobacterium
DADTGVFPSDA

SEQ ID NO: 443092 - protein, 6 aa, Mycobacterium
DADTPL

SEQ ID NO: 443093 - protein, 10 aa, Mycobacterium
DADTPTEDDI

SEQ ID NO: 443094 - protein, 7 aa, Mycobacterium
DADTSQL

SEQ ID NO: 443095 - protein, 7 aa, Mycobacterium
DADTTRE

SEQ ID NO: 443096 - protein, 6 aa, Mycobacterium
DADTTT

SEQ ID NO: 443097 - protein, 8 aa, Mycobacterium
DADTVGSG

SEQ ID NO: 443098 - protein, 8 aa, Mycobacterium
DADTVNAA

SEQ ID NO: 443099 - protein, 11 aa, Mycobacterium
DADVAGPDPSI

SEQ ID NO: 443100 - protein, 14 aa, Mycobacterium
DADVKAKNLPYGSQ

SEQ ID NO: 443101 - protein, 8 aa, Mycobacterium
DADVRSGN

SEQ ID NO: 443102 - protein, 11 aa, Mycobacterium
DADYDAADAAL

SEQ ID NO: 443103 - protein, 5 aa, Mycobacterium
DADYP

SEQ ID NO: 443104 - protein, 20 aa, Mycobacterium
DADYSERDVEVGPAKDEAAG

SEQ ID NO: 443105 - protein, 12 aa, Mycobacterium
DAEAAAATLSKA

SEQ ID NO: 443106 - protein, 9 aa, Mycobacterium
DAEAAHRAQ

SEQ ID NO: 443107 - protein, 12 aa, Mycobacterium
DAEAARRPHGQH

SEQ ID NO: 443108 - protein, 11 aa, Mycobacterium
DAEAATIPNDR

SEQ ID NO: 443109 - protein, 14 aa, Mycobacterium
DAEAATRKANNTPL

SEQ ID NO: 443110 - protein, 7 aa, Mycobacterium
DAEADTP

SEQ ID NO: 443111 - protein, 5 aa, Mycobacterium
DAEAG

SEQ ID NO: 443112 - protein, 7 aa, Mycobacterium
DAEAGGG

SEQ ID NO: 443113 - protein, 7 aa, Mycobacterium
DAEAGKE

SEQ ID NO: 443114 - protein, 5 aa, Mycobacterium
DAEAH

SEQ ID NO: 443115 - protein, 10 aa, Mycobacterium
DAEANLGPNA

SEQ ID NO: 443116 - protein, 8 aa, Mycobacterium
DAEAPGAR

SEQ ID NO: 443117 - protein, 6 aa, Mycobacterium
DAEAPM

SEQ ID NO: 443118 - protein, 10 aa, Mycobacterium
DAEAQSADKA

SEQ ID NO: 443119 - protein, 6 aa, Mycobacterium
DAEARA

SEQ ID NO: 443120 - protein, 9 aa, Mycobacterium
DAEASDKAA

SEQ ID NO: 443121 - protein, 8 aa, Mycobacterium
DAEASDKV

SEQ ID NO: 443122 - protein, 6 aa, Mycobacterium
DAEASS

SEQ ID NO: 443123 - protein, 6 aa, Mycobacterium
DAEASV

SEQ ID NO: 443124 - protein, 5 aa, Mycobacterium
DAEAT

SEQ ID NO: 443125 - protein, 13 aa, Mycobacterium
DAEATLEEAQENK

SEQ ID NO: 443126 - protein, 12 aa, Mycobacterium
DAEATRRPHGQH

SEQ ID NO: 443127 - protein, 34 aa, Mycobacterium
DAEATRRPQRTAHHRGGTPRRRTARRGAASGPAA

SEQ ID NO: 443128 - protein, 5 aa, Mycobacterium
DAEAV

SEQ ID NO: 443129 - protein, 4 aa, Mycobacterium
DAED

SEQ ID NO: 443130 - protein, 10 aa, Mycobacterium
DAEDAERPSE

SEQ ID NO: 443131 - protein, 6 aa, Mycobacterium
DAEDAV

SEQ ID NO: 443132 - protein, 6 aa, Mycobacterium
DAEDAW

SEQ ID NO: 443133 - protein, 8 aa, Mycobacterium
DAEDDEYA

SEQ ID NO: 443134 - protein, 8 aa, Mycobacterium
DAEDDGPD

SEQ ID NO: 443135 - protein, 10 aa, Mycobacterium
DAEDDPTGAI

SEQ ID NO: 443136 - protein, 7 aa, Mycobacterium
DAEDKRT

SEQ ID NO: 443137 - protein, 6 aa, Mycobacterium
DAEDLA

SEQ ID NO: 443138 - protein, 9 aa, Mycobacterium
DAEDLDEPA

SEQ ID NO: 443139 - protein, 7 aa, Mycobacterium
DAEDPKI

SEQ ID NO: 443140 - protein, 7 aa, Mycobacterium
DAEDPKL

SEQ ID NO: 443141 - protein, 7 aa, Mycobacterium
DAEDPKV

SEQ ID NO: 443142 - protein, 7 aa, Mycobacterium
DAEDPLA

SEQ ID NO: 443143 - protein, 9 aa, Mycobacterium
DAEDPSTAD

SEQ ID NO: 443144 - protein, 5 aa, Mycobacterium
DAEEA

SEQ ID NO: 443145 - protein, 9 aa, Mycobacterium
DAEEASNEI

SEQ ID NO: 443146 - protein, 10 aa, Mycobacterium
DAEECDARRR

SEQ ID NO: 443147 - protein, 8 aa, Mycobacterium
DAEEGDRG

SEQ ID NO: 443148 - protein, 9 aa, Mycobacterium
DAEETPAEV

SEQ ID NO: 443149 - protein, 10 aa, Mycobacterium
DAEETRLPTA

SEQ ID NO: 443150 - protein, 11 aa, Mycobacterium
DAEFDGDPARA

SEQ ID NO: 443151 - protein, 9 aa, Mycobacterium
DAEFTEAAS

SEQ ID NO: 443152 - protein, 4 aa, Mycobacterium
DAEG

SEQ ID NO: 443153 - protein, 11 aa, Mycobacterium
DAEGAASRDEG

SEQ ID NO: 443154 - protein, 10 aa, Mycobacterium
DAEGAPEPLP

SEQ ID NO: 443155 - protein, 9 aa, Mycobacterium
DAEGGPKLG

SEQ ID NO: 443156 - protein, 6 aa, Mycobacterium
DAEGIA

SEQ ID NO: 443157 - protein, 6 aa, Mycobacterium
DAEGKV

SEQ ID NO: 443158 - protein, 5 aa, Mycobacterium
DAEGM

SEQ ID NO: 443159 - protein, 5 aa, Mycobacterium
DAEGN

SEQ ID NO: 443160 - protein, 6 aa, Mycobacterium
DAEGNP

SEQ ID NO: 443161 - protein, 10 aa, Mycobacterium
DAEGNPVELE

SEQ ID NO: 443162 - protein, 5 aa, Mycobacterium
DAEGQ

SEQ ID NO: 443163 - protein, 5 aa, Mycobacterium
DAEGR

SEQ ID NO: 443164 - protein, 7 aa, Mycobacterium
DAEGRAA

SEQ ID NO: 443165 - protein, 6 aa, Mycobacterium
DAEGRD

SEQ ID NO: 443166 - protein, 9 aa, Mycobacterium
DAEGRDKQL

SEQ ID NO: 443167 - protein, 7 aa, Mycobacterium
DAEGRSR

SEQ ID NO: 443168 - protein, 10 aa, Mycobacterium
DAEGSGVAEP

SEQ ID NO: 443169 - protein, 5 aa, Mycobacterium
DAEGT

SEQ ID NO: 443170 - protein, 9 aa, Mycobacterium
DAEGTARRA

SEQ ID NO: 443171 - protein, 5 aa, Mycobacterium
DAEGV

SEQ ID NO: 443172 - protein, 9 aa, Mycobacterium
DAEGVRPEQ

SEQ ID NO: 443173 - protein, 10 aa, Mycobacterium
DAEGVRPEQV

SEQ ID NO: 443174 - protein, 7 aa, Mycobacterium
DAEGVTR

SEQ ID NO: 443175 - protein, 7 aa, Mycobacterium
DAEGYPK

SEQ ID NO: 443176 - protein, 11 aa, Mycobacterium
DAEHDASQVSL

SEQ ID NO: 443177 - protein, 11 aa, Mycobacterium
DAEHDASQVSV

SEQ ID NO: 443178 - protein, 14 aa, Mycobacterium
DAEHDGRLGDTEAW

SEQ ID NO: 443179 - protein, 5 aa, Mycobacterium
DAEHG

SEQ ID NO: 443180 - protein, 11 aa, Mycobacterium
DAEHQAGQVSV

SEQ ID NO: 443181 - protein, 4 aa, Mycobacterium
DAEI

SEQ ID NO: 443182 - protein, 6 aa, Mycobacterium
DAEIAR

SEQ ID NO: 443183 - protein, 14 aa, Mycobacterium
DAEITTEANPESAW

SEQ ID NO: 443184 - protein, 14 aa, Mycobacterium
DAEITTEANPESTW

SEQ ID NO: 443185 - protein, 16 aa, Mycobacterium
DAEITTESNPESTSPR

SEQ ID NO: 443186 - protein, 7 aa, Mycobacterium
DAEITTR

SEQ ID NO: 443187 - protein, 4 aa, Mycobacterium
DAEK

SEQ ID NO: 443188 - protein, 9 aa, Mycobacterium
DAEKAGDWK

SEQ ID NO: 443189 - protein, 6 aa, Mycobacterium
DAEKIE

SEQ ID NO: 443190 - protein, 15 aa, Mycobacterium
DAEKIGDDAAATGAQ

SEQ ID NO: 443191 - protein, 10 aa, Mycobacterium
DAEKLGDATL

SEQ ID NO: 443192 - protein, 13 aa, Mycobacterium
DAEKQAALAGGGG

SEQ ID NO: 443193 - protein, 10 aa, Mycobacterium
DAEKTARTFP

SEQ ID NO: 443194 - protein, 4 aa, Mycobacterium
DAEL

SEQ ID NO: 443195 - protein, 5 aa, Mycobacterium
DAELA

SEQ ID NO: 443196 - protein, 10 aa, Mycobacterium
DAELASARAA

SEQ ID NO: 443197 - protein, 6 aa, Mycobacterium
DAELGE

SEQ ID NO: 443198 - protein, 6 aa, Mycobacterium
DAELPG

SEQ ID NO: 443199 - protein, 6 aa, Mycobacterium
DAELPS

SEQ ID NO: 443200 - protein, 21 aa, Mycobacterium
DAELRAKTDEFKKRHAEGESL

SEQ ID NO: 443201 - protein, 7 aa, Mycobacterium
DAELTKR

SEQ ID NO: 443202 - protein, 6 aa, Mycobacterium
DAEMAA

SEQ ID NO: 443203 - protein, 7 aa, Mycobacterium
DAENAAR

SEQ ID NO: 443204 - protein, 16 aa, Mycobacterium
DAENEKNYGEFSAREG

SEQ ID NO: 443205 - protein, 7 aa, Mycobacterium
DAENEKV

SEQ ID NO: 443206 - protein, 16 aa, Mycobacterium
DAENGDLTVPEPGSVD

SEQ ID NO: 443207 - protein, 4 aa, Mycobacterium
DAEP

SEQ ID NO: 443208 - protein, 20 aa, Mycobacterium
DAEPAEPHEHDGAELDHEPG

SEQ ID NO: 443209 - protein, 9 aa, Mycobacterium
DAEPATRER

SEQ ID NO: 443210 - protein, 21 aa, Mycobacterium
DAEPAVTDTGQPETTSSDPVH

SEQ ID NO: 443211 - protein, 25 aa, Mycobacterium
DAEPDAPAVTCGTDSVTRAELERRA

SEQ ID NO: 443212 - protein, 8 aa, Mycobacterium
DAEPDDYT

SEQ ID NO: 443213 - protein, 8 aa, Mycobacterium
DAEPDSAS

SEQ ID NO: 443214 - protein, 9 aa, Mycobacterium
DAEPEFSPS

SEQ ID NO: 443215 - protein, 7 aa, Mycobacterium
DAEPERI

SEQ ID NO: 443216 - protein, 9 aa, Mycobacterium
DAEPGGTPF

SEQ ID NO: 443217 - protein, 6 aa, Mycobacterium
DAEPGK

SEQ ID NO: 443218 - protein, 11 aa, Mycobacterium
DAEPGRARGCG

SEQ ID NO: 443219 - protein, 5 aa, Mycobacterium
DAEPL

SEQ ID NO: 443220 - protein, 10 aa, Mycobacterium
DAEPPPRLPA

SEQ ID NO: 443221 - protein, 7 aa, Mycobacterium
DAEPQRR

SEQ ID NO: 443222 - protein, 6 aa, Mycobacterium
DAEPRI

SEQ ID NO: 443223 - protein, 22 aa, Mycobacterium
DAEPRVPAAESVDSKLADGRLD

SEQ ID NO: 443224 - protein, 12 aa, Mycobacterium
DAEPTDEGPLRD

SEQ ID NO: 443225 - protein, 7 aa, Mycobacterium
DAEPTRK

SEQ ID NO: 443226 - protein, 5 aa, Mycobacterium
DAEPV

SEQ ID NO: 443227 - protein, 4 aa, Mycobacterium
DAEQ

SEQ ID NO: 443228 - protein, 7 aa, Mycobacterium
DAEQADS

SEQ ID NO: 443229 - protein, 9 aa, Mycobacterium
DAEQDEQTA

SEQ ID NO: 443230 - protein, 5 aa, Mycobacterium
DAEQF

SEQ ID NO: 443231 - protein, 7 aa, Mycobacterium
DAEQRIK

SEQ ID NO: 443232 - protein, 6 aa, Mycobacterium
DAEQTH

SEQ ID NO: 443233 - protein, 12 aa, Mycobacterium
DAEQTRTPTDGE

SEQ ID NO: 443234 - protein, 5 aa, Mycobacterium
DAEQY

SEQ ID NO: 443235 - protein, 5 aa, Mycobacterium
DAERA

SEQ ID NO: 443236 - protein, 13 aa, Mycobacterium
DAERAGGDADPGV

SEQ ID NO: 443237 - protein, 8 aa, Mycobacterium
DAERAGKP

SEQ ID NO: 443238 - protein, 9 aa, Mycobacterium
DAERARDKD

SEQ ID NO: 443239 - protein, 12 aa, Mycobacterium
DAERDDDRETAD

SEQ ID NO: 443240 - protein, 6 aa, Mycobacterium
DAERDE

SEQ ID NO: 443241 - protein, 18 aa, Mycobacterium
DAERDGADVDKAIMAAAH

SEQ ID NO: 443242 - protein, 10 aa, Mycobacterium
DAERDGDTEV

SEQ ID NO: 443243 - protein, 6 aa, Mycobacterium
DAERDR

SEQ ID NO: 443244 - protein, 6 aa, Mycobacterium
DAEREF

SEQ ID NO: 443245 - protein, 7 aa, Mycobacterium
DAERGEE

SEQ ID NO: 443246 - protein, 7 aa, Mycobacterium
DAERHNV

SEQ ID NO: 443247 - protein, 12 aa, Mycobacterium
DAERKSTGRDER

SEQ ID NO: 443248 - protein, 5 aa, Mycobacterium
DAERM

SEQ ID NO: 443249 - protein, 6 aa, Mycobacterium
DAERPE

SEQ ID NO: 443250 - protein, 7 aa, Mycobacterium
DAERPGT

SEQ ID NO: 443251 - protein, 5 aa, Mycobacterium
DAERR

SEQ ID NO: 443252 - protein, 7 aa, Mycobacterium
DAERRKH

SEQ ID NO: 443253 - protein, 7 aa, Mycobacterium
DAERRRL

SEQ ID NO: 443254 - protein, 8 aa, Mycobacterium
DAERSAQA

SEQ ID NO: 443255 - protein, 9 aa, Mycobacterium
DAERSGGRI

SEQ ID NO: 443256 - protein, 10 aa, Mycobacterium
DAERSGVAEP

SEQ ID NO: 443257 - protein, 5 aa, Mycobacterium
DAERV

SEQ ID NO: 443258 - protein, 4 aa, Mycobacterium
DAES

SEQ ID NO: 443259 - protein, 23 aa, Mycobacterium
DAESDVDTESTVENGAEAADDFD

SEQ ID NO: 443260 - protein, 10 aa, Mycobacterium
DAESEGERAA

SEQ ID NO: 443261 - protein, 7 aa, Mycobacterium
DAESEPE

SEQ ID NO: 443262 - protein, 7 aa, Mycobacterium
DAESERE

SEQ ID NO: 443263 - protein, 8 aa, Mycobacterium
DAESGARP

SEQ ID NO: 443264 - protein, 10 aa, Mycobacterium
DAESGTYSLP

SEQ ID NO: 443265 - protein, 7 aa, Mycobacterium
DAESHAT

SEQ ID NO: 443266 - protein, 13 aa, Mycobacterium
DAESHLGADTYRR

SEQ ID NO: 443267 - protein, 7 aa, Mycobacterium
DAESLGY

SEQ ID NO: 443268 - protein, 8 aa, Mycobacterium
DAESVRRA

SEQ ID NO: 443269 - protein, 6 aa, Mycobacterium
DAESYL

SEQ ID NO: 443270 - protein, 7 aa, Mycobacterium
DAESYLG

SEQ ID NO: 443271 - protein, 4 aa, Mycobacterium
DAET

SEQ ID NO: 443272 - protein, 9 aa, Mycobacterium
DAETADEDL

SEQ ID NO: 443273 - protein, 6 aa, Mycobacterium
DAETAE

SEQ ID NO: 443274 - protein, 7 aa, Mycobacterium
DAETATR

SEQ ID NO: 443275 - protein, 7 aa, Mycobacterium
DAETDDD

SEQ ID NO: 443276 - protein, 7 aa, Mycobacterium
DAETDDG

SEQ ID NO: 443277 - protein, 6 aa, Mycobacterium
DAETDE

SEQ ID NO: 443278 - protein, 16 aa, Mycobacterium
DAETDGARVTGTATGV

SEQ ID NO: 443279 - protein, 7 aa, Mycobacterium
DAETGED

SEQ ID NO: 443280 - protein, 7 aa, Mycobacterium
DAETGTG

SEQ ID NO: 443281 - protein, 7 aa, Mycobacterium
DAETQAS

SEQ ID NO: 443282 - protein, 10 aa, Mycobacterium
DAETQDIDDS

SEQ ID NO: 443283 - protein, 7 aa, Mycobacterium
DAETRAK

SEQ ID NO: 443284 - protein, 6 aa, Mycobacterium
DAETRG

SEQ ID NO: 443285 - protein, 6 aa, Mycobacterium
DAETRI

SEQ ID NO: 443286 - protein, 6 aa, Mycobacterium
DAETSH

SEQ ID NO: 443287 - protein, 11 aa, Mycobacterium
DAETSRASGAV

SEQ ID NO: 443288 - protein, 5 aa, Mycobacterium
DAETT

SEQ ID NO: 443289 - protein, 18 aa, Mycobacterium
DAETTGAARDAEHSTEPI

SEQ ID NO: 443290 - protein, 6 aa, Mycobacterium
DAETTV

SEQ ID NO: 443291 - protein, 10 aa, Mycobacterium
DAEVPDGGQV

SEQ ID NO: 443292 - protein, 7 aa, Mycobacterium
DAEVPGG

SEQ ID NO: 443293 - protein, 7 aa, Mycobacterium
DAEVTPI

SEQ ID NO: 443294 - protein, 4 aa, Mycobacterium
DAEY

SEQ ID NO: 443295 - protein, 5 aa, Mycobacterium
DAEYR

SEQ ID NO: 443296 - protein, 5 aa, Mycobacterium
DAEYV

SEQ ID NO: 443297 - protein, 12 aa, Mycobacterium
DAFARNPAISTE

SEQ ID NO: 443298 - protein, 21 aa, Mycobacterium
DAFDETGCGGHGGVFVVEEDD

SEQ ID NO: 443299 - protein, 14 aa, Mycobacterium
DAFGASSNIDTVPT

SEQ ID NO: 443300 - protein, 18 aa, Mycobacterium
DAFGGTRAPMLPSTWDAE

SEQ ID NO: 443301 - protein, 12 aa, Mycobacterium
DAFGPDDVAAGR

SEQ ID NO: 443302 - protein, 13 aa, Mycobacterium
DAFGPYRNAPVEQ

SEQ ID NO: 443303 - protein, 11 aa, Mycobacterium
DAFQEASRAYT

SEQ ID NO: 443304 - protein, 6 aa, Mycobacterium
DAFRPG

SEQ ID NO: 443305 - protein, 12 aa, Mycobacterium
DAFTDPAKSDLD

SEQ ID NO: 443306 - protein, 32 aa, Mycobacterium
DAFTKAAAEAARTAPPRENGGNQDIKNLTKGS

SEQ ID NO: 443307 - protein, 18 aa, Mycobacterium
DAFTPEPGVTPVTINVIK

SEQ ID NO: 443308 - protein, 5 aa, Mycobacterium
DAFTT

SEQ ID NO: 443309 - protein, 4 aa, Mycobacterium
DAGA

SEQ ID NO: 443310 - protein, 15 aa, Mycobacterium
DAGAADSATSGASGK

SEQ ID NO: 443311 - protein, 9 aa, Mycobacterium
DAGAADVDR

SEQ ID NO: 443312 - protein, 6 aa, Mycobacterium
DAGAAF

SEQ ID NO: 443313 - protein, 6 aa, Mycobacterium
DAGAAG

SEQ ID NO: 443314 - protein, 121 aa, Mycobacterium
DAGAAHAGDAARGAAGSGGPAGSTRDRARGATGTGRTTGATRNRAGGATRAGGTGGSTRDRTRGATGTGDSAGSTRNGTGDGRSGRGRPCRGRRGPTGRGRRRDAGRRGRRVGGRRCGTTS

SEQ ID NO: 443315 - protein, 7 aa, Mycobacterium
DAGAALG

SEQ ID NO: 443316 - protein, 19 aa, Mycobacterium
DAGAAPAGWGAAPSQAAGI

SEQ ID NO: 443317 - protein, 5 aa, Mycobacterium
DAGAD

SEQ ID NO: 443318 - protein, 7 aa, Mycobacterium
DAGADEV

SEQ ID NO: 443319 - protein, 6 aa, Mycobacterium
DAGADF

SEQ ID NO: 443320 - protein, 8 aa, Mycobacterium
DAGADSTT

SEQ ID NO: 443321 - protein, 8 aa, Mycobacterium
DAGADTVD

SEQ ID NO: 443322 - protein, 5 aa, Mycobacterium
DAGAE

SEQ ID NO: 443323 - protein, 10 aa, Mycobacterium
DAGAEGHGRD

SEQ ID NO: 443324 - protein, 8 aa, Mycobacterium
DAGAEGQN

SEQ ID NO: 443325 - protein, 16 aa, Mycobacterium
DAGAEIARRSRGTPRI

SEQ ID NO: 443326 - protein, 10 aa, Mycobacterium
DAGAERARAE

SEQ ID NO: 443327 - protein, 11 aa, Mycobacterium
DAGAERDRAEQ

SEQ ID NO: 443328 - protein, 10 aa, Mycobacterium
DAGAERGRAE

SEQ ID NO: 443329 - protein, 11 aa, Mycobacterium
DAGAERTRAEQ

SEQ ID NO: 443330 - protein, 6 aa, Mycobacterium
DAGAEV

SEQ ID NO: 443331 - protein, 8 aa, Mycobacterium
DAGAFDAS

SEQ ID NO: 443332 - protein, 14 aa, Mycobacterium
DAGAGGSGGAGGTS

SEQ ID NO: 443333 - protein, 25 aa, Mycobacterium
DAGAGPQGADGPSAGPTPSAPNPSA

SEQ ID NO: 443334 - protein, 27 aa, Mycobacterium
DAGAHEDDAHDHGHDEHGHAHAEEGVN

SEQ ID NO: 443335 - protein, 5 aa, Mycobacterium
DAGAN

SEQ ID NO: 443336 - protein, 18 aa, Mycobacterium
DAGANSYAGAEAANASPL

SEQ ID NO: 443337 - protein, 17 aa, Mycobacterium
DAGAPAFGAGPDGWDGP

SEQ ID NO: 443338 - protein, 18 aa, Mycobacterium
DAGAPAFGAGPDGWDGPG

SEQ ID NO: 443339 - protein, 8 aa, Mycobacterium
DAGAPATL

SEQ ID NO: 443340 - protein, 13 aa, Mycobacterium
DAGAPDPAGKPAE

SEQ ID NO: 443341 - protein, 8 aa, Mycobacterium
DAGAPEDI

SEQ ID NO: 443342 - protein, 9 aa, Mycobacterium
DAGAPHRQR

SEQ ID NO: 443343 - protein, 12 aa, Mycobacterium
DAGAPIGPPNLN

SEQ ID NO: 443344 - protein, 7 aa, Mycobacterium
DAGAPRL

SEQ ID NO: 443345 - protein, 12 aa, Mycobacterium
DAGAPSATRDHA

SEQ ID NO: 443346 - protein, 10 aa, Mycobacterium
DAGAQSPKET

SEQ ID NO: 443347 - protein, 7 aa, Mycobacterium
DAGARAR

SEQ ID NO: 443348 - protein, 6 aa, Mycobacterium
DAGARE

SEQ ID NO: 443349 - protein, 10 aa, Mycobacterium
DAGARPISDD

SEQ ID NO: 443350 - protein, 8 aa, Mycobacterium
DAGARRDV

SEQ ID NO: 443351 - protein, 6 aa, Mycobacterium
DAGARV

SEQ ID NO: 443352 - protein, 7 aa, Mycobacterium
DAGARVQ

SEQ ID NO: 443353 - protein, 8 aa, Mycobacterium
DAGASAVD

SEQ ID NO: 443354 - protein, 11 aa, Mycobacterium
DAGASGDDKAF

SEQ ID NO: 443355 - protein, 11 aa, Mycobacterium
DAGASGDERSF

SEQ ID NO: 443356 - protein, 9 aa, Mycobacterium
DAGASTGGF

SEQ ID NO: 443357 - protein, 7 aa, Mycobacterium
DAGATEY

SEQ ID NO: 443358 - protein, 13 aa, Mycobacterium
DAGATGADKSFYE

SEQ ID NO: 443359 - protein, 19 aa, Mycobacterium
DAGATGAQGSQGATGAAGA

SEQ ID NO: 443360 - protein, 8 aa, Mycobacterium
DAGATVGD

SEQ ID NO: 443361 - protein, 5 aa, Mycobacterium
DAGAV

SEQ ID NO: 443362 - protein, 8 aa, Mycobacterium
DAGAYGNH

SEQ ID NO: 443363 - protein, 8 aa, Mycobacterium
DAGCQTTK

SEQ ID NO: 443364 - protein, 10 aa, Mycobacterium
DAGDADSVRD

SEQ ID NO: 443365 - protein, 8 aa, Mycobacterium
DAGDAGER

SEQ ID NO: 443366 - protein, 8 aa, Mycobacterium
DAGDANER

SEQ ID NO: 443367 - protein, 8 aa, Mycobacterium
DAGDARAN

SEQ ID NO: 443368 - protein, 7 aa, Mycobacterium
DAGDDCP

SEQ ID NO: 443369 - protein, 10 aa, Mycobacterium
DAGDDPEAHR

SEQ ID NO: 443370 - protein, 8 aa, Mycobacterium
DAGDDPTL

SEQ ID NO: 443371 - protein, 6 aa, Mycobacterium
DAGDEL

SEQ ID NO: 443372 - protein, 7 aa, Mycobacterium
DAGDEPF

SEQ ID NO: 443373 - protein, 7 aa, Mycobacterium
DAGDGCT

SEQ ID NO: 443374 - protein, 22 aa, Mycobacterium
DAGDGGESARAATDLDRPRADL

SEQ ID NO: 443375 - protein, 64 aa, Mycobacterium
DAGDGGTGGDGGDGGTGTTGAGRGGTGGAGGGGGTGTGTPPPFGTGAPGGSGGTGGHGGDSGFG

SEQ ID NO: 443376 - protein, 6 aa, Mycobacterium
DAGDGI

SEQ ID NO: 443377 - protein, 8 aa, Mycobacterium
DAGDGLPS

SEQ ID NO: 443378 - protein, 8 aa, Mycobacterium
DAGDGRTK

SEQ ID NO: 443379 - protein, 7 aa, Mycobacterium
DAGDGTI

SEQ ID NO: 443380 - protein, 8 aa, Mycobacterium
DAGDLDPD

SEQ ID NO: 443381 - protein, 6 aa, Mycobacterium
DAGDLP

SEQ ID NO: 443382 - protein, 8 aa, Mycobacterium
DAGDPGEV

SEQ ID NO: 443383 - protein, 6 aa, Mycobacterium
DAGDPL

SEQ ID NO: 443384 - protein, 9 aa, Mycobacterium
DAGDPPPFD

SEQ ID NO: 443385 - protein, 14 aa, Mycobacterium
DAGDPQPSGKTYRL

SEQ ID NO: 443386 - protein, 7 aa, Mycobacterium
DAGDQAG

SEQ ID NO: 443387 - protein, 7 aa, Mycobacterium
DAGDRAK

SEQ ID NO: 443388 - protein, 12 aa, Mycobacterium
DAGDRRPGKPTG

SEQ ID NO: 443389 - protein, 6 aa, Mycobacterium
DAGDTE

SEQ ID NO: 443390 - protein, 6 aa, Mycobacterium
DAGDTG

SEQ ID NO: 443391 - protein, 7 aa, Mycobacterium
DAGDTRK

SEQ ID NO: 443392 - protein, 8 aa, Mycobacterium
DAGDTTGF

SEQ ID NO: 443393 - protein, 9 aa, Mycobacterium
DAGDWTSTA

SEQ ID NO: 443394 - protein, 8 aa, Mycobacterium
DAGEAAGA

SEQ ID NO: 443395 - protein, 7 aa, Mycobacterium
DAGEAEA

SEQ ID NO: 443396 - protein, 8 aa, Mycobacterium
DAGEALGD

SEQ ID NO: 443397 - protein, 7 aa, Mycobacterium
DAGEAYA

SEQ ID NO: 443398 - protein, 5 aa, Mycobacterium
DAGED

SEQ ID NO: 443399 - protein, 8 aa, Mycobacterium
DAGEDAGV

SEQ ID NO: 443400 - protein, 16 aa, Mycobacterium
DAGEDLASAVVEFLRD

SEQ ID NO: 443401 - protein, 7 aa, Mycobacterium
DAGEDVA

SEQ ID NO: 443402 - protein, 9 aa, Mycobacterium
DAGEDVESS

SEQ ID NO: 443403 - protein, 8 aa, Mycobacterium
DAGEGAGV

SEQ ID NO: 443404 - protein, 6 aa, Mycobacterium
DAGEGL

SEQ ID NO: 443405 - protein, 7 aa, Mycobacterium
DAGELPR

SEQ ID NO: 443406 - protein, 92 aa, Mycobacterium
DAGEPAGSDRDSDGPTDDSEDPEIDSGDREPLDEESDPVSDVEDPSVEDVPDATDSEVSRRDGDSAEPRPENDRETPAAGPTEPSAEPDDAA

SEQ ID NO: 443407 - protein, 7 aa, Mycobacterium
DAGEPLP

SEQ ID NO: 443408 - protein, 6 aa, Mycobacterium
DAGERA

SEQ ID NO: 443409 - protein, 31 aa, Mycobacterium
DAGERMAGQERAHERAPAGVPADAAAGSSID

SEQ ID NO: 443410 - protein, 9 aa, Mycobacterium
DAGESAGAK

SEQ ID NO: 443411 - protein, 17 aa, Mycobacterium
DAGESAPAVTLTGSPEA

SEQ ID NO: 443412 - protein, 18 aa, Mycobacterium
DAGESMARREHDAREAEQ

SEQ ID NO: 443413 - protein, 8 aa, Mycobacterium
DAGETLPT

SEQ ID NO: 443414 - protein, 10 aa, Mycobacterium
DAGETRLPTA

SEQ ID NO: 443415 - protein, 11 aa, Mycobacterium
DAGETTGPSYR

SEQ ID NO: 443416 - protein, 5 aa, Mycobacterium
DAGEV

SEQ ID NO: 443417 - protein, 6 aa, Mycobacterium
DAGEVA

SEQ ID NO: 443418 - protein, 4 aa, Mycobacterium
DAGF

SEQ ID NO: 443419 - protein, 11 aa, Mycobacterium
DAGFDKSRPTA

SEQ ID NO: 443420 - protein, 9 aa, Mycobacterium
DAGFGGDYE

SEQ ID NO: 443421 - protein, 6 aa, Mycobacterium
DAGFKD

SEQ ID NO: 443422 - protein, 4 aa, Mycobacterium
DAGG

SEQ ID NO: 443423 - protein, 9 aa, Mycobacterium
DAGGADQDG

SEQ ID NO: 443424 - protein, 49 aa, Mycobacterium
DAGGAGGVGGHGGSAGLIGSGGAGGAGGVGGTGGYPAGNGGAGGDGGRA

SEQ ID NO: 443425 - protein, 7 aa, Mycobacterium
DAGGARD

SEQ ID NO: 443426 - protein, 7 aa, Mycobacterium
DAGGATH

SEQ ID NO: 443427 - protein, 8 aa, Mycobacterium
DAGGDARA

SEQ ID NO: 443428 - protein, 14 aa, Mycobacterium
DAGGDGEAAREPTF

SEQ ID NO: 443429 - protein, 14 aa, Mycobacterium
DAGGDGSGAREPTF

SEQ ID NO: 443430 - protein, 14 aa, Mycobacterium
DAGGDPARSPSCPR

SEQ ID NO: 443431 - protein, 13 aa, Mycobacterium
DAGGDPVGLSSQQ

SEQ ID NO: 443432 - protein, 6 aa, Mycobacterium
DAGGDS

SEQ ID NO: 443433 - protein, 6 aa, Mycobacterium
DAGGDW

SEQ ID NO: 443434 - protein, 5 aa, Mycobacterium
DAGGE

SEQ ID NO: 443435 - protein, 8 aa, Mycobacterium
DAGGESGI

SEQ ID NO: 443436 - protein, 18 aa, Mycobacterium
DAGGGADRLREAREQTYV

SEQ ID NO: 443437 - protein, 7 aa, Mycobacterium
DAGGGAE

SEQ ID NO: 443438 - protein, 11 aa, Mycobacterium
DAGGGAGALAQ

SEQ ID NO: 443439 - protein, 13 aa, Mycobacterium
DAGGGGLSPADLP

SEQ ID NO: 443440 - protein, 15 aa, Mycobacterium
DAGGHIESTASNCPR

SEQ ID NO: 443441 - protein, 9 aa, Mycobacterium
DAGGLEPGH

SEQ ID NO: 443442 - protein, 16 aa, Mycobacterium
DAGGLGAASLTGETAP

SEQ ID NO: 443443 - protein, 7 aa, Mycobacterium
DAGGMTL

SEQ ID NO: 443444 - protein, 7 aa, Mycobacterium
DAGGPDA

SEQ ID NO: 443445 - protein, 11 aa, Mycobacterium
DAGGPDGTDPV

SEQ ID NO: 443446 - protein, 8 aa, Mycobacterium
DAGGPRTV

SEQ ID NO: 443447 - protein, 39 aa, Mycobacterium
DAGGPSRKPITPGGAAAPGTVAPGKAGQVNGGGSNGTSI

SEQ ID NO: 443448 - protein, 13 aa, Mycobacterium
DAGGPVPHDGETV

SEQ ID NO: 443449 - protein, 6 aa, Mycobacterium
DAGGRD

SEQ ID NO: 443450 - protein, 15 aa, Mycobacterium
DAGGRHDVDPIEEGE

SEQ ID NO: 443451 - protein, 7 aa, Mycobacterium
DAGGRPL

SEQ ID NO: 443452 - protein, 8 aa, Mycobacterium
DAGGSGDS

SEQ ID NO: 443453 - protein, 8 aa, Mycobacterium
DAGGSQLA

SEQ ID NO: 443454 - protein, 16 aa, Mycobacterium
DAGGSVQWTGKSGLRR

SEQ ID NO: 443455 - protein, 10 aa, Mycobacterium
DAGGTAAQLR

SEQ ID NO: 443456 - protein, 6 aa, Mycobacterium
DAGGTF

SEQ ID NO: 443457 - protein, 12 aa, Mycobacterium
DAGGTVSSFRTG

SEQ ID NO: 443458 - protein, 7 aa, Mycobacterium
DAGHAAQ

SEQ ID NO: 443459 - protein, 8 aa, Mycobacterium
DAGHGDSI

SEQ ID NO: 443460 - protein, 13 aa, Mycobacterium
DAGHGRSLAPAGI

SEQ ID NO: 443461 - protein, 9 aa, Mycobacterium
DAGHHDPAS

SEQ ID NO: 443462 - protein, 5 aa, Mycobacterium
DAGHP

SEQ ID NO: 443463 - protein, 6 aa, Mycobacterium
DAGHSE

SEQ ID NO: 443464 - protein, 7 aa, Mycobacterium
DAGIDAS

SEQ ID NO: 443465 - protein, 11 aa, Mycobacterium
DAGIDPGLTYQ

SEQ ID NO: 443466 - protein, 6 aa, Mycobacterium
DAGIGK

SEQ ID NO: 443467 - protein, 5 aa, Mycobacterium
DAGIN

SEQ ID NO: 443468 - protein, 9 aa, Mycobacterium
DAGIPTATQ

SEQ ID NO: 443469 - protein, 8 aa, Mycobacterium
DAGIQDGP

SEQ ID NO: 443470 - protein, 8 aa, Mycobacterium
DAGITAGD

SEQ ID NO: 443471 - protein, 7 aa, Mycobacterium
DAGITGA

SEQ ID NO: 443472 - protein, 10 aa, Mycobacterium
DAGKGQKALD

SEQ ID NO: 443473 - protein, 7 aa, Mycobacterium
DAGKHPG

SEQ ID NO: 443474 - protein, 13 aa, Mycobacterium
DAGKKVGELSPGH

SEQ ID NO: 443475 - protein, 9 aa, Mycobacterium
DAGKNWDKS

SEQ ID NO: 443476 - protein, 7 aa, Mycobacterium
DAGKPLR

SEQ ID NO: 443477 - protein, 13 aa, Mycobacterium
DAGKSCGAANPAV

SEQ ID NO: 443478 - protein, 8 aa, Mycobacterium
DAGKSTLT

SEQ ID NO: 443479 - protein, 9 aa, Mycobacterium
DAGKTAVTT

SEQ ID NO: 443480 - protein, 9 aa, Mycobacterium
DAGKVSDPV

SEQ ID NO: 443481 - protein, 5 aa, Mycobacterium
DAGLD

SEQ ID NO: 443482 - protein, 6 aa, Mycobacterium
DAGLDG

SEQ ID NO: 443483 - protein, 17 aa, Mycobacterium
DAGLNGVAGTSGNAGQH

SEQ ID NO: 443484 - protein, 8 aa, Mycobacterium
DAGLNTYG

SEQ ID NO: 443485 - protein, 9 aa, Mycobacterium
DAGLNTYGE

SEQ ID NO: 443486 - protein, 12 aa, Mycobacterium
DAGLPGRGAPDG

SEQ ID NO: 443487 - protein, 6 aa, Mycobacterium
DAGLPR

SEQ ID NO: 443488 - protein, 9 aa, Mycobacterium
DAGLSEDEI

SEQ ID NO: 443489 - protein, 12 aa, Mycobacterium
DAGLSFGPPEKK

SEQ ID NO: 443490 - protein, 8 aa, Mycobacterium
DAGLSPSD

SEQ ID NO: 443491 - protein, 6 aa, Mycobacterium
DAGLTA

SEQ ID NO: 443492 - protein, 11 aa, Mycobacterium
DAGLTGLGETY

SEQ ID NO: 443493 - protein, 10 aa, Mycobacterium
DAGMDPASTP

SEQ ID NO: 443494 - protein, 8 aa, Mycobacterium
DAGMDPKT

SEQ ID NO: 443495 - protein, 10 aa, Mycobacterium
DAGMDPNSTP

SEQ ID NO: 443496 - protein, 7 aa, Mycobacterium
DAGMDPT

SEQ ID NO: 443497 - protein, 6 aa, Mycobacterium
DAGMGR

SEQ ID NO: 443498 - protein, 5 aa, Mycobacterium
DAGNA

SEQ ID NO: 443499 - protein, 37 aa, Mycobacterium
DAGNGADGVNGGTGGTGTTSGGSGGTGGGAGGQGGNS

SEQ ID NO: 443500 - protein, 8 aa, Mycobacterium
DAGNHSPG

SEQ ID NO: 443501 - protein, 15 aa, Mycobacterium
DAGNPAAAADPKSLA

SEQ ID NO: 443502 - protein, 15 aa, Mycobacterium
DAGNPAMAADPNSLA

SEQ ID NO: 443503 - protein, 10 aa, Mycobacterium
DAGNQARAGE

SEQ ID NO: 443504 - protein, 9 aa, Mycobacterium
DAGNRESPV

SEQ ID NO: 443505 - protein, 13 aa, Mycobacterium
DAGNYEISRTGTK

SEQ ID NO: 443506 - protein, 10 aa, Mycobacterium
DAGPAAAGRI

SEQ ID NO: 443507 - protein, 8 aa, Mycobacterium
DAGPADAP

SEQ ID NO: 443508 - protein, 8 aa, Mycobacterium
DAGPADGP

SEQ ID NO: 443509 - protein, 6 aa, Mycobacterium
DAGPAL

SEQ ID NO: 443510 - protein, 9 aa, Mycobacterium
DAGPAPAYL

SEQ ID NO: 443511 - protein, 8 aa, Mycobacterium
DAGPASGP

SEQ ID NO: 443512 - protein, 8 aa, Mycobacterium
DAGPATAP

SEQ ID NO: 443513 - protein, 7 aa, Mycobacterium
DAGPDHA

SEQ ID NO: 443514 - protein, 8 aa, Mycobacterium
DAGPDRTA

SEQ ID NO: 443515 - protein, 7 aa, Mycobacterium
DAGPEAT

SEQ ID NO: 443516 - protein, 6 aa, Mycobacterium
DAGPEL

SEQ ID NO: 443517 - protein, 7 aa, Mycobacterium
DAGPENI

SEQ ID NO: 443518 - protein, 16 aa, Mycobacterium
DAGPEQSAIDSESSAR

SEQ ID NO: 443519 - protein, 9 aa, Mycobacterium
DAGPGASYI

SEQ ID NO: 443520 - protein, 8 aa, Mycobacterium
DAGPGDGP

SEQ ID NO: 443521 - protein, 9 aa, Mycobacterium
DAGPGPLDR

SEQ ID NO: 443522 - protein, 41 aa, Mycobacterium
DAGPGRKIRSGPPGTRLRSPRGTGDAMRTREVSPRTSCDQQ

SEQ ID NO: 443523 - protein, 6 aa, Mycobacterium
DAGPLS

SEQ ID NO: 443524 - protein, 19 aa, Mycobacterium
DAGPPDVPDDELGTAGPVV

SEQ ID NO: 443525 - protein, 10 aa, Mycobacterium
DAGPPSTRDL

SEQ ID NO: 443526 - protein, 8 aa, Mycobacterium
DAGPQADW

SEQ ID NO: 443527 - protein, 8 aa, Mycobacterium
DAGPQTQV

SEQ ID NO: 443528 - protein, 6 aa, Mycobacterium
DAGPQV

SEQ ID NO: 443529 - protein, 8 aa, Mycobacterium
DAGPRDGW

SEQ ID NO: 443530 - protein, 8 aa, Mycobacterium
DAGPREGW

SEQ ID NO: 443531 - protein, 14 aa, Mycobacterium
DAGPRGQMVARKGE

SEQ ID NO: 443532 - protein, 8 aa, Mycobacterium
DAGPRQPS

SEQ ID NO: 443533 - protein, 16 aa, Mycobacterium
DAGPRTRSVVVIRPAT

SEQ ID NO: 443534 - protein, 11 aa, Mycobacterium
DAGPRVGEPSY

SEQ ID NO: 443535 - protein, 9 aa, Mycobacterium
DAGPSRDKA

SEQ ID NO: 443536 - protein, 6 aa, Mycobacterium
DAGPSW

SEQ ID NO: 443537 - protein, 5 aa, Mycobacterium
DAGPT

SEQ ID NO: 443538 - protein, 6 aa, Mycobacterium
DAGPTL

SEQ ID NO: 443539 - protein, 10 aa, Mycobacterium
DAGPTTTALG

SEQ ID NO: 443540 - protein, 10 aa, Mycobacterium
DAGPVTAPGV

SEQ ID NO: 443541 - protein, 4 aa, Mycobacterium
DAGQ

SEQ ID NO: 443542 - protein, 5 aa, Mycobacterium
DAGQG

SEQ ID NO: 443543 - protein, 10 aa, Mycobacterium
DAGQGESELS

SEQ ID NO: 443544 - protein, 10 aa, Mycobacterium
DAGQNQTETN

SEQ ID NO: 443545 - protein, 10 aa, Mycobacterium
DAGQPTVPEP

SEQ ID NO: 443546 - protein, 8 aa, Mycobacterium
DAGQQDRV

SEQ ID NO: 443547 - protein, 7 aa, Mycobacterium
DAGQRAG

SEQ ID NO: 443548 - protein, 9 aa, Mycobacterium
DAGQREPQI

SEQ ID NO: 443549 - protein, 10 aa, Mycobacterium
DAGQRPQTDV

SEQ ID NO: 443550 - protein, 14 aa, Mycobacterium
DAGQRPRLVSRKED

SEQ ID NO: 443551 - protein, 5 aa, Mycobacterium
DAGQS

SEQ ID NO: 443552 - protein, 10 aa, Mycobacterium
DAGQSEGELD

SEQ ID NO: 443553 - protein, 14 aa, Mycobacterium
DAGQSTAEAEAAFN

SEQ ID NO: 443554 - protein, 6 aa, Mycobacterium
DAGQTG

SEQ ID NO: 443555 - protein, 14 aa, Mycobacterium
DAGQVPERLAGSRT

SEQ ID NO: 443556 - protein, 16 aa, Mycobacterium
DAGRAAVDAAQASESG

SEQ ID NO: 443557 - protein, 17 aa, Mycobacterium
DAGRAGSVGPLSVPPSW

SEQ ID NO: 443558 - protein, 6 aa, Mycobacterium
DAGRAM

SEQ ID NO: 443559 - protein, 14 aa, Mycobacterium
DAGRAMAARAGDAI

SEQ ID NO: 443560 - protein, 14 aa, Mycobacterium
DAGRAMAERAGDAI

SEQ ID NO: 443561 - protein, 7 aa, Mycobacterium
DAGRAQG

SEQ ID NO: 443562 - protein, 8 aa, Mycobacterium
DAGRDDDG

SEQ ID NO: 443563 - protein, 13 aa, Mycobacterium
DAGRDDNDADGMR

SEQ ID NO: 443564 - protein, 6 aa, Mycobacterium
DAGRDE

SEQ ID NO: 443565 - protein, 13 aa, Mycobacterium
DAGRDLGSVATAD

SEQ ID NO: 443566 - protein, 17 aa, Mycobacterium
DAGRDTVRELTGGQAEP

SEQ ID NO: 443567 - protein, 19 aa, Mycobacterium
DAGREAVNELEDRSESRAA

SEQ ID NO: 443568 - protein, 6 aa, Mycobacterium
DAGREL

SEQ ID NO: 443569 - protein, 9 aa, Mycobacterium
DAGRESGWD

SEQ ID NO: 443570 - protein, 7 aa, Mycobacterium
DAGRGAS

SEQ ID NO: 443571 - protein, 7 aa, Mycobacterium
DAGRGAV

SEQ ID NO: 443572 - protein, 14 aa, Mycobacterium
DAGRGDALVIEEGE

SEQ ID NO: 443573 - protein, 8 aa, Mycobacterium
DAGRGDSE

SEQ ID NO: 443574 - protein, 8 aa, Mycobacterium
DAGRGIAP

SEQ ID NO: 443575 - protein, 5 aa, Mycobacterium
DAGRH

SEQ ID NO: 443576 - protein, 10 aa, Mycobacterium
DAGRISPEQV

SEQ ID NO: 443577 - protein, 8 aa, Mycobacterium
DAGRKPKA

SEQ ID NO: 443578 - protein, 8 aa, Mycobacterium
DAGRNPGT

SEQ ID NO: 443579 - protein, 5 aa, Mycobacterium
DAGRP

SEQ ID NO: 443580 - protein, 39 aa, Mycobacterium
DAGRPERAGRSEPGADRHRLGAPRAGGPAGRRLNRRCGG

SEQ ID NO: 443581 - protein, 10 aa, Mycobacterium
DAGRQGAAAA

SEQ ID NO: 443582 - protein, 6 aa, Mycobacterium
DAGRQI

SEQ ID NO: 443583 - protein, 6 aa, Mycobacterium
DAGRRA

SEQ ID NO: 443584 - protein, 7 aa, Mycobacterium
DAGRRAD

SEQ ID NO: 443585 - protein, 11 aa, Mycobacterium
DAGRRHTPYDQ

SEQ ID NO: 443586 - protein, 17 aa, Mycobacterium
DAGRSAAISAQGEARAV

SEQ ID NO: 443587 - protein, 15 aa, Mycobacterium
DAGRTELEPGTLTAG

SEQ ID NO: 443588 - protein, 24 aa, Mycobacterium
DAGRTGDANGATYAAAKAGAAGLT

SEQ ID NO: 443589 - protein, 24 aa, Mycobacterium
DAGRTGDPGGAVYGASKAAAAGLT

SEQ ID NO: 443590 - protein, 22 aa, Mycobacterium
DAGRYGTKNGKGWTGDFDDETK

SEQ ID NO: 443591 - protein, 6 aa, Mycobacterium
DAGRYR

SEQ ID NO: 443592 - protein, 8 aa, Mycobacterium
DAGRYVDP

SEQ ID NO: 443593 - protein, 10 aa, Mycobacterium
DAGSADDLTQ

SEQ ID NO: 443594 - protein, 14 aa, Mycobacterium
DAGSAPEPQGDPSV

SEQ ID NO: 443595 - protein, 6 aa, Mycobacterium
DAGSDL

SEQ ID NO: 443596 - protein, 9 aa, Mycobacterium
DAGSDTGGL

SEQ ID NO: 443597 - protein, 8 aa, Mycobacterium
DAGSDWDN

SEQ ID NO: 443598 - protein, 7 aa, Mycobacterium
DAGSGFA

SEQ ID NO: 443599 - protein, 6 aa, Mycobacterium
DAGSGM

SEQ ID NO: 443600 - protein, 11 aa, Mycobacterium
DAGSGRLPDPL

SEQ ID NO: 443601 - protein, 9 aa, Mycobacterium
DAGSGTVTV

SEQ ID NO: 443602 - protein, 5 aa, Mycobacterium
DAGSI

SEQ ID NO: 443603 - protein, 8 aa, Mycobacterium
DAGSISRQ

SEQ ID NO: 443604 - protein, 8 aa, Mycobacterium
DAGSNTQT

SEQ ID NO: 443605 - protein, 9 aa, Mycobacterium
DAGSPDLAV

SEQ ID NO: 443606 - protein, 8 aa, Mycobacterium
DAGSQNLA

SEQ ID NO: 443607 - protein, 10 aa, Mycobacterium
DAGSRPTAED

SEQ ID NO: 443608 - protein, 15 aa, Mycobacterium
DAGSSPNSKTGAAIR

SEQ ID NO: 443609 - protein, 15 aa, Mycobacterium
DAGSVATAATDENRE

SEQ ID NO: 443610 - protein, 6 aa, Mycobacterium
DAGSWR

SEQ ID NO: 443611 - protein, 7 aa, Mycobacterium
DAGSYIT

SEQ ID NO: 443612 - protein, 5 aa, Mycobacterium
DAGTA

SEQ ID NO: 443613 - protein, 6 aa, Mycobacterium
DAGTAR

SEQ ID NO: 443614 - protein, 6 aa, Mycobacterium
DAGTGR

SEQ ID NO: 443615 - protein, 27 aa, Mycobacterium
DAGTGTKVVSAGDDAERSDEEERRRWK

SEQ ID NO: 443616 - protein, 6 aa, Mycobacterium
DAGTLT

SEQ ID NO: 443617 - protein, 9 aa, Mycobacterium
DAGTPDLAP

SEQ ID NO: 443618 - protein, 10 aa, Mycobacterium
DAGTPDLAPP

SEQ ID NO: 443619 - protein, 6 aa, Mycobacterium
DAGTRL

SEQ ID NO: 443620 - protein, 10 aa, Mycobacterium
DAGTRSRCNH

SEQ ID NO: 443621 - protein, 6 aa, Mycobacterium
DAGTSA

SEQ ID NO: 443622 - protein, 12 aa, Mycobacterium
DAGTSSAEAANR

SEQ ID NO: 443623 - protein, 13 aa, Mycobacterium
DAGTTDDRNFEGP

SEQ ID NO: 443624 - protein, 13 aa, Mycobacterium
DAGTTDNRDLAGP

SEQ ID NO: 443625 - protein, 8 aa, Mycobacterium
DAGTVGPA

SEQ ID NO: 443626 - protein, 7 aa, Mycobacterium
DAGVAEP

SEQ ID NO: 443627 - protein, 6 aa, Mycobacterium
DAGVDA

SEQ ID NO: 443628 - protein, 10 aa, Mycobacterium
DAGVEDGQEI

SEQ ID NO: 443629 - protein, 9 aa, Mycobacterium
DAGVEDGQQ

SEQ ID NO: 443630 - protein, 6 aa, Mycobacterium
DAGVPA

SEQ ID NO: 443631 - protein, 9 aa, Mycobacterium
DAGVPGRAA

SEQ ID NO: 443632 - protein, 9 aa, Mycobacterium
DAGVPGREA

SEQ ID NO: 443633 - protein, 6 aa, Mycobacterium
DAGVPY

SEQ ID NO: 443634 - protein, 8 aa, Mycobacterium
DAGVQTTV

SEQ ID NO: 443635 - protein, 6 aa, Mycobacterium
DAGVRR

SEQ ID NO: 443636 - protein, 6 aa, Mycobacterium
DAGVSN

SEQ ID NO: 443637 - protein, 17 aa, Mycobacterium
DAGVTETSLNTTGKGSV

SEQ ID NO: 443638 - protein, 6 aa, Mycobacterium
DAGVTQ

SEQ ID NO: 443639 - protein, 10 aa, Mycobacterium
DAGWARKTAA

SEQ ID NO: 443640 - protein, 7 aa, Mycobacterium
DAGWPEP

SEQ ID NO: 443641 - protein, 15 aa, Mycobacterium
DAGWRKGATQGHSGT

SEQ ID NO: 443642 - protein, 5 aa, Mycobacterium
DAGYD

SEQ ID NO: 443643 - protein, 14 aa, Mycobacterium
DAGYDDAGTPTFES

SEQ ID NO: 443644 - protein, 8 aa, Mycobacterium
DAGYPNRG

SEQ ID NO: 443645 - protein, 8 aa, Mycobacterium
DAHADKVE

SEQ ID NO: 443646 - protein, 6 aa, Mycobacterium
DAHAKS

SEQ ID NO: 443647 - protein, 7 aa, Mycobacterium
DAHAPGA

SEQ ID NO: 443648 - protein, 8 aa, Mycobacterium
DAHATADG

SEQ ID NO: 443649 - protein, 7 aa, Mycobacterium
DAHDAVP

SEQ ID NO: 443650 - protein, 8 aa, Mycobacterium
DAHDGAFE

SEQ ID NO: 443651 - protein, 16 aa, Mycobacterium
DAHDGNRADGSPGYQA

SEQ ID NO: 443652 - protein, 7 aa, Mycobacterium
DAHDPAR

SEQ ID NO: 443653 - protein, 6 aa, Mycobacterium
DAHDTY

SEQ ID NO: 443654 - protein, 4 aa, Mycobacterium
DAHE

SEQ ID NO: 443655 - protein, 14 aa, Mycobacterium
DAHELQQRQRYERR

SEQ ID NO: 443656 - protein, 5 aa, Mycobacterium
DAHEP

SEQ ID NO: 443657 - protein, 7 aa, Mycobacterium
DAHEQTY

SEQ ID NO: 443658 - protein, 7 aa, Mycobacterium
DAHETAV

SEQ ID NO: 443659 - protein, 8 aa, Mycobacterium
DAHGDQEA

SEQ ID NO: 443660 - protein, 5 aa, Mycobacterium
DAHGG

SEQ ID NO: 443661 - protein, 9 aa, Mycobacterium
DAHGKDPDF

SEQ ID NO: 443662 - protein, 5 aa, Mycobacterium
DAHGN

SEQ ID NO: 443663 - protein, 13 aa, Mycobacterium
DAHGRSRNVSDGY

SEQ ID NO: 443664 - protein, 11 aa, Mycobacterium
DAHGSNGEGST

SEQ ID NO: 443665 - protein, 12 aa, Mycobacterium
DAHGTHKLTDEQ

SEQ ID NO: 443666 - protein, 8 aa, Mycobacterium
DAHNAQSR

SEQ ID NO: 443667 - protein, 7 aa, Mycobacterium
DAHPAAL

SEQ ID NO: 443668 - protein, 16 aa, Mycobacterium
DAHPELRTPDSPTQLV

SEQ ID NO: 443669 - protein, 15 aa, Mycobacterium
DAHPETGLSGPANTV

SEQ ID NO: 443670 - protein, 5 aa, Mycobacterium
DAHPG

SEQ ID NO: 443671 - protein, 15 aa, Mycobacterium
DAHPGADGQSGGERH

SEQ ID NO: 443672 - protein, 7 aa, Mycobacterium
DAHPGDE

SEQ ID NO: 443673 - protein, 8 aa, Mycobacterium
DAHPGTSE

SEQ ID NO: 443674 - protein, 6 aa, Mycobacterium
DAHPPE

SEQ ID NO: 443675 - protein, 7 aa, Mycobacterium
DAHPRLE

SEQ ID NO: 443676 - protein, 13 aa, Mycobacterium
DAHPSGTRPFRRP

SEQ ID NO: 443677 - protein, 7 aa, Mycobacterium
DAHPSTA

SEQ ID NO: 443678 - protein, 6 aa, Mycobacterium
DAHPTA

SEQ ID NO: 443679 - protein, 8 aa, Mycobacterium
DAHRAAGR

SEQ ID NO: 443680 - protein, 9 aa, Mycobacterium
DAHRAAGRD

SEQ ID NO: 443681 - protein, 12 aa, Mycobacterium
DAHRAAGRDLSY

SEQ ID NO: 443682 - protein, 7 aa, Mycobacterium
DAHRAGA

SEQ ID NO: 443683 - protein, 6 aa, Mycobacterium
DAHRDR

SEQ ID NO: 443684 - protein, 7 aa, Mycobacterium
DAHRREY

SEQ ID NO: 443685 - protein, 7 aa, Mycobacterium
DAHSGGV

SEQ ID NO: 443686 - protein, 7 aa, Mycobacterium
DAHSRET

SEQ ID NO: 443687 - protein, 4 aa, Mycobacterium
DAHT

SEQ ID NO: 443688 - protein, 23 aa, Mycobacterium
DAIAEAEQAALSARPTIEMRGLL

SEQ ID NO: 443689 - protein, 14 aa, Mycobacterium
DAIAEGHNQYPPGI

SEQ ID NO: 443690 - protein, 5 aa, Mycobacterium
DAIDA

SEQ ID NO: 443691 - protein, 9 aa, Mycobacterium
DAIDGRPRG

SEQ ID NO: 443692 - protein, 8 aa, Mycobacterium
DAIDRSGL

SEQ ID NO: 443693 - protein, 4 aa, Mycobacterium
DAIE

SEQ ID NO: 443694 - protein, 6 aa, Mycobacterium
DAIEGP

SEQ ID NO: 443695 - protein, 13 aa, Mycobacterium
DAIERGELSADTD

SEQ ID NO: 443696 - protein, 10 aa, Mycobacterium
DAIGEPGELT

SEQ ID NO: 443697 - protein, 9 aa, Mycobacterium
DAIGETPEY

SEQ ID NO: 443698 - protein, 5 aa, Mycobacterium
DAIGG

SEQ ID NO: 443699 - protein, 11 aa, Mycobacterium
DAIGPDTQTVD

SEQ ID NO: 443700 - protein, 8 aa, Mycobacterium
DAIGPERS

SEQ ID NO: 443701 - protein, 12 aa, Mycobacterium
DAIGTPPDRPTL

SEQ ID NO: 443702 - protein, 5 aa, Mycobacterium
DAIPD

SEQ ID NO: 443703 - protein, 12 aa, Mycobacterium
DAIPEDYSHDEE

SEQ ID NO: 443704 - protein, 7 aa, Mycobacterium
DAIPGGQ

SEQ ID NO: 443705 - protein, 12 aa, Mycobacterium
DAIPGGTVKRGD

SEQ ID NO: 443706 - protein, 12 aa, Mycobacterium
DAIPNDSDDFDE

SEQ ID NO: 443707 - protein, 6 aa, Mycobacterium
DAIPNG

SEQ ID NO: 443708 - protein, 8 aa, Mycobacterium
DAIPSDGV

SEQ ID NO: 443709 - protein, 11 aa, Mycobacterium
DAIQKSGEKFD

SEQ ID NO: 443710 - protein, 8 aa, Mycobacterium
DAIRDTED

SEQ ID NO: 443711 - protein, 4 aa, Mycobacterium
DAIT

SEQ ID NO: 443712 - protein, 8 aa, Mycobacterium
DAITPIDD

SEQ ID NO: 443713 - protein, 12 aa, Mycobacterium
DAITRDANERAV

SEQ ID NO: 443714 - protein, 7 aa, Mycobacterium
DAITRPE

SEQ ID NO: 443715 - protein, 12 aa, Mycobacterium
DAKAAAAAHPDG

SEQ ID NO: 443716 - protein, 9 aa, Mycobacterium
DAKAGRDAG

SEQ ID NO: 443717 - protein, 5 aa, Mycobacterium
DAKAM

SEQ ID NO: 443718 - protein, 8 aa, Mycobacterium
DAKAQADR

SEQ ID NO: 443719 - protein, 12 aa, Mycobacterium
DAKAQASAHPDG

SEQ ID NO: 443720 - protein, 12 aa, Mycobacterium
DAKARAAAHPDG

SEQ ID NO: 443721 - protein, 6 aa, Mycobacterium
DAKARE

SEQ ID NO: 443722 - protein, 10 aa, Mycobacterium
DAKASGRPNA

SEQ ID NO: 443723 - protein, 8 aa, Mycobacterium
DAKATAKA

SEQ ID NO: 443724 - protein, 11 aa, Mycobacterium
DAKDPNTKYPP

SEQ ID NO: 443725 - protein, 6 aa, Mycobacterium
DAKDTL

SEQ ID NO: 443726 - protein, 19 aa, Mycobacterium
DAKEGAKAFAEKRAPVWQG

SEQ ID NO: 443727 - protein, 19 aa, Mycobacterium
DAKEGPQAFAQKRKPNFQN

SEQ ID NO: 443728 - protein, 19 aa, Mycobacterium
DAKEGPRAFAEKRKPNFQN

SEQ ID NO: 443729 - protein, 19 aa, Mycobacterium
DAKEGPRAFKEKRAPNFQM

SEQ ID NO: 443730 - protein, 18 aa, Mycobacterium
DAKEPTSATRIKKETSAV

SEQ ID NO: 443731 - protein, 9 aa, Mycobacterium
DAKETSKKL

SEQ ID NO: 443732 - protein, 5 aa, Mycobacterium
DAKFD

SEQ ID NO: 443733 - protein, 13 aa, Mycobacterium
DAKFDGADLRGAR

SEQ ID NO: 443734 - protein, 11 aa, Mycobacterium
DAKGDLPGGGQ

SEQ ID NO: 443735 - protein, 14 aa, Mycobacterium
DAKGRFDSSVPDYQ

SEQ ID NO: 443736 - protein, 6 aa, Mycobacterium
DAKGRH

SEQ ID NO: 443737 - protein, 10 aa, Mycobacterium
DAKGRSRNVT

SEQ ID NO: 443738 - protein, 9 aa, Mycobacterium
DAKGRVDEE

SEQ ID NO: 443739 - protein, 9 aa, Mycobacterium
DAKGSQLGL

SEQ ID NO: 443740 - protein, 7 aa, Mycobacterium
DAKGSYA

SEQ ID NO: 443741 - protein, 13 aa, Mycobacterium
DAKIASAKLPGEV

SEQ ID NO: 443742 - protein, 4 aa, Mycobacterium
DAKK

SEQ ID NO: 443743 - protein, 9 aa, Mycobacterium
DAKKDTELA

SEQ ID NO: 443744 - protein, 14 aa, Mycobacterium
DAKLSSLADKVTSG

SEQ ID NO: 443745 - protein, 22 aa, Mycobacterium
DAKLTKPATIGDGQLQAQESSR

SEQ ID NO: 443746 - protein, 7 aa, Mycobacterium
DAKNQPV

SEQ ID NO: 443747 - protein, 6 aa, Mycobacterium
DAKNSA

SEQ ID NO: 443748 - protein, 10 aa, Mycobacterium
DAKPAATGLE

SEQ ID NO: 443749 - protein, 6 aa, Mycobacterium
DAKPEA

SEQ ID NO: 443750 - protein, 6 aa, Mycobacterium
DAKPFT

SEQ ID NO: 443751 - protein, 10 aa, Mycobacterium
DAKPGATGLE

SEQ ID NO: 443752 - protein, 7 aa, Mycobacterium
DAKPGNF

SEQ ID NO: 443753 - protein, 7 aa, Mycobacterium
DAKPGVS

SEQ ID NO: 443754 - protein, 10 aa, Mycobacterium
DAKPKSTQRL

SEQ ID NO: 443755 - protein, 5 aa, Mycobacterium
DAKPR

SEQ ID NO: 443756 - protein, 22 aa, Mycobacterium
DAKPSGKLRDFPSSKQPAPSER

SEQ ID NO: 443757 - protein, 12 aa, Mycobacterium
DAKPTKVARRDT

SEQ ID NO: 443758 - protein, 23 aa, Mycobacterium
DAKQGADHYRDKARRAVDEATAQ

SEQ ID NO: 443759 - protein, 7 aa, Mycobacterium
DAKRGYL

SEQ ID NO: 443760 - protein, 8 aa, Mycobacterium
DAKRPEHR

SEQ ID NO: 443761 - protein, 7 aa, Mycobacterium
DAKRRDV

SEQ ID NO: 443762 - protein, 16 aa, Mycobacterium
DAKRRLQRAAARSAPV

SEQ ID NO: 443763 - protein, 9 aa, Mycobacterium
DAKSAAAAE

SEQ ID NO: 443764 - protein, 9 aa, Mycobacterium
DAKSAYEPT

SEQ ID NO: 443765 - protein, 9 aa, Mycobacterium
DAKSDAAPA

SEQ ID NO: 443766 - protein, 16 aa, Mycobacterium
DAKSDRNAVSGGTPYE

SEQ ID NO: 443767 - protein, 6 aa, Mycobacterium
DAKSEA

SEQ ID NO: 443768 - protein, 9 aa, Mycobacterium
DAKSSPGAA

SEQ ID NO: 443769 - protein, 8 aa, Mycobacterium
DAKSTFRE

SEQ ID NO: 443770 - protein, 9 aa, Mycobacterium
DAKSTFRGQ

SEQ ID NO: 443771 - protein, 6 aa, Mycobacterium
DAKSTL

SEQ ID NO: 443772 - protein, 8 aa, Mycobacterium
DAKSTQRC

SEQ ID NO: 443773 - protein, 11 aa, Mycobacterium
DAKTAAAAAEQ

SEQ ID NO: 443774 - protein, 9 aa, Mycobacterium
DAKTAAAHD

SEQ ID NO: 443775 - protein, 9 aa, Mycobacterium
DAKTAAGYY

SEQ ID NO: 443776 - protein, 15 aa, Mycobacterium
DAKTDRSALAGGTSY

SEQ ID NO: 443777 - protein, 15 aa, Mycobacterium
DAKTDRSAMTGGTPF

SEQ ID NO: 443778 - protein, 15 aa, Mycobacterium
DAKTDRSSVAGGTPF

SEQ ID NO: 443779 - protein, 10 aa, Mycobacterium
DAKTGATGLE

SEQ ID NO: 443780 - protein, 7 aa, Mycobacterium
DAKTGKP

SEQ ID NO: 443781 - protein, 15 aa, Mycobacterium
DAKTPDTDDSAGSVT

SEQ ID NO: 443782 - protein, 10 aa, Mycobacterium
DAKTTDGTGV

SEQ ID NO: 443783 - protein, 11 aa, Mycobacterium
DAKVGPDKDIP

SEQ ID NO: 443784 - protein, 6 aa, Mycobacterium
DAKVPG

SEQ ID NO: 443785 - protein, 10 aa, Mycobacterium
DALAEEHSAA

SEQ ID NO: 443786 - protein, 13 aa, Mycobacterium
DALAETPPWQGGG

SEQ ID NO: 443787 - protein, 7 aa, Mycobacterium
DALAPDL

SEQ ID NO: 443788 - protein, 8 aa, Mycobacterium
DALAPELG

SEQ ID NO: 443789 - protein, 19 aa, Mycobacterium
DALATESSGPWNNAGTGHT

SEQ ID NO: 443790 - protein, 6 aa, Mycobacterium
DALATR

SEQ ID NO: 443791 - protein, 10 aa, Mycobacterium
DALDPADRRS

SEQ ID NO: 443792 - protein, 4 aa, Mycobacterium
DALE

SEQ ID NO: 443793 - protein, 11 aa, Mycobacterium
DALEAAAGSRW

SEQ ID NO: 443794 - protein, 7 aa, Mycobacterium
DALEGPR

SEQ ID NO: 443795 - protein, 7 aa, Mycobacterium
DALEGRE

SEQ ID NO: 443796 - protein, 12 aa, Mycobacterium
DALENGGPGSVT

SEQ ID NO: 443797 - protein, 11 aa, Mycobacterium
DALGADATGAS

SEQ ID NO: 443798 - protein, 26 aa, Mycobacterium
DALGDKAGFTTLTSDQGEPATTGGQG

SEQ ID NO: 443799 - protein, 17 aa, Mycobacterium
DALGDTESTTDNHNGAN

SEQ ID NO: 443800 - protein, 5 aa, Mycobacterium
DALGG

SEQ ID NO: 443801 - protein, 6 aa, Mycobacterium
DALGGG

SEQ ID NO: 443802 - protein, 9 aa, Mycobacterium
DALGGPAAL

SEQ ID NO: 443803 - protein, 11 aa, Mycobacterium
DALGGSGPLAE

SEQ ID NO: 443804 - protein, 81 aa, Mycobacterium
DALGGSGSVGGSTAVGGGAHTSAINESMNSSINASHSSSMNESFGSSMGSHGAAGTGFEAQGHAQGHASETAHTTLPGAEH

SEQ ID NO: 443805 - protein, 9 aa, Mycobacterium
DALGPAGSE

SEQ ID NO: 443806 - protein, 7 aa, Mycobacterium
DALGPGR

SEQ ID NO: 443807 - protein, 5 aa, Mycobacterium
DALGQ

SEQ ID NO: 443808 - protein, 12 aa, Mycobacterium
DALGRPREGAGR

SEQ ID NO: 443809 - protein, 10 aa, Mycobacterium
DALGVGDDQV

SEQ ID NO: 443810 - protein, 15 aa, Mycobacterium
DALHQSQRAPAMPAS

SEQ ID NO: 443811 - protein, 17 aa, Mycobacterium
DALKESATEFKSNGNGA

SEQ ID NO: 443812 - protein, 8 aa, Mycobacterium
DALNPDGI

SEQ ID NO: 443813 - protein, 8 aa, Mycobacterium
DALNPDGL

SEQ ID NO: 443814 - protein, 9 aa, Mycobacterium
DALNTRPEP

SEQ ID NO: 443815 - protein, 4 aa, Mycobacterium
DALP

SEQ ID NO: 443816 - protein, 23 aa, Mycobacterium
DALPAPDSGTVTERREAQTPTQR

SEQ ID NO: 443817 - protein, 6 aa, Mycobacterium
DALPDA

SEQ ID NO: 443818 - protein, 8 aa, Mycobacterium
DALPDGSD

SEQ ID NO: 443819 - protein, 6 aa, Mycobacterium
DALPDR

SEQ ID NO: 443820 - protein, 5 aa, Mycobacterium
DALPE

SEQ ID NO: 443821 - protein, 5 aa, Mycobacterium
DALPG

SEQ ID NO: 443822 - protein, 7 aa, Mycobacterium
DALPGAD

SEQ ID NO: 443823 - protein, 8 aa, Mycobacterium
DALPGDEV

SEQ ID NO: 443824 - protein, 5 aa, Mycobacterium
DALPL

SEQ ID NO: 443825 - protein, 7 aa, Mycobacterium
DALPPAV

SEQ ID NO: 443826 - protein, 15 aa, Mycobacterium
DALPSIGRRDDAADD

SEQ ID NO: 443827 - protein, 12 aa, Mycobacterium
DALPSVGRRGYE

SEQ ID NO: 443828 - protein, 6 aa, Mycobacterium
DALPTR

SEQ ID NO: 443829 - protein, 6 aa, Mycobacterium
DALPTS

SEQ ID NO: 443830 - protein, 4 aa, Mycobacterium
DALQ

SEQ ID NO: 443831 - protein, 11 aa, Mycobacterium
DALQKHSAAPA

SEQ ID NO: 443832 - protein, 8 aa, Mycobacterium
DALQPPAR

SEQ ID NO: 443833 - protein, 4 aa, Mycobacterium
DALR

SEQ ID NO: 443834 - protein, 5 aa, Mycobacterium
DALRD

SEQ ID NO: 443835 - protein, 7 aa, Mycobacterium
DALRDVN

SEQ ID NO: 443836 - protein, 6 aa, Mycobacterium
DALREP

SEQ ID NO: 443837 - protein, 13 aa, Mycobacterium
DALRGGAGEAGME

SEQ ID NO: 443838 - protein, 21 aa, Mycobacterium
DALRQEAQTQLDRAGRSGEQV

SEQ ID NO: 443839 - protein, 11 aa, Mycobacterium
DALRTDNDPGV

SEQ ID NO: 443840 - protein, 6 aa, Mycobacterium
DALSAG

SEQ ID NO: 443841 - protein, 10 aa, Mycobacterium
DALSDTSDRI

SEQ ID NO: 443842 - protein, 8 aa, Mycobacterium
DALSGGAP

SEQ ID NO: 443843 - protein, 8 aa, Mycobacterium
DALSGKDL

SEQ ID NO: 443844 - protein, 8 aa, Mycobacterium
DALSGRDD

SEQ ID NO: 443845 - protein, 8 aa, Mycobacterium
DALSGSTD

SEQ ID NO: 443846 - protein, 5 aa, Mycobacterium
DALSR

SEQ ID NO: 443847 - protein, 9 aa, Mycobacterium
DALTASSDL

SEQ ID NO: 443848 - protein, 8 aa, Mycobacterium
DALTGGPG

SEQ ID NO: 443849 - protein, 9 aa, Mycobacterium
DALTKESDV

SEQ ID NO: 443850 - protein, 17 aa, Mycobacterium
DALTSETDWQTGDFDPT

SEQ ID NO: 443851 - protein, 11 aa, Mycobacterium
DALYGGSSPAE

SEQ ID NO: 443852 - protein, 7 aa, Mycobacterium
DAMESSG

SEQ ID NO: 443853 - protein, 6 aa, Mycobacterium
DAMGTR

SEQ ID NO: 443854 - protein, 11 aa, Mycobacterium
DAMKSKDKLRT

SEQ ID NO: 443855 - protein, 6 aa, Mycobacterium
DAMPRD

SEQ ID NO: 443856 - protein, 10 aa, Mycobacterium
DAMPSRDEFR

SEQ ID NO: 443857 - protein, 6 aa, Mycobacterium
DAMRDG

SEQ ID NO: 443858 - protein, 12 aa, Mycobacterium
DAMRESPADDVR

SEQ ID NO: 443859 - protein, 15 aa, Mycobacterium
DAMRPNKAARPATSM

SEQ ID NO: 443860 - protein, 6 aa, Mycobacterium
DAMSDE

SEQ ID NO: 443861 - protein, 5 aa, Mycobacterium
DAMSQ

SEQ ID NO: 443862 - protein, 7 aa, Mycobacterium
DAMSQDA

SEQ ID NO: 443863 - protein, 4 aa, Mycobacterium
DAMT

SEQ ID NO: 443864 - protein, 5 aa, Mycobacterium
DANAA

SEQ ID NO: 443865 - protein, 8 aa, Mycobacterium
DANAALDG

SEQ ID NO: 443866 - protein, 8 aa, Mycobacterium
DANAARAA

SEQ ID NO: 443867 - protein, 9 aa, Mycobacterium
DANAATTLD

SEQ ID NO: 443868 - protein, 10 aa, Mycobacterium
DANADSSPFS

SEQ ID NO: 443869 - protein, 12 aa, Mycobacterium
DANASIPTPQPV

SEQ ID NO: 443870 - protein, 8 aa, Mycobacterium
DANDAGFN

SEQ ID NO: 443871 - protein, 13 aa, Mycobacterium
DANDDGGHAEDSV

SEQ ID NO: 443872 - protein, 7 aa, Mycobacterium
DANDQVS

SEQ ID NO: 443873 - protein, 8 aa, Mycobacterium
DANERAEV

SEQ ID NO: 443874 - protein, 7 aa, Mycobacterium
DANERIA

SEQ ID NO: 443875 - protein, 14 aa, Mycobacterium
DANGAVLGTPERAG

SEQ ID NO: 443876 - protein, 8 aa, Mycobacterium
DANGIGSK

SEQ ID NO: 443877 - protein, 7 aa, Mycobacterium
DANGIGT

SEQ ID NO: 443878 - protein, 5 aa, Mycobacterium
DANGP

SEQ ID NO: 443879 - protein, 18 aa, Mycobacterium
DANGPDERWPRPSVSEQT

SEQ ID NO: 443880 - protein, 15 aa, Mycobacterium
DANGQESAVAAEQRE

SEQ ID NO: 443881 - protein, 9 aa, Mycobacterium
DANGSEPGR

SEQ ID NO: 443882 - protein, 9 aa, Mycobacterium
DANGSPNLP

SEQ ID NO: 443883 - protein, 8 aa, Mycobacterium
DANGTDKF

SEQ ID NO: 443884 - protein, 23 aa, Mycobacterium
DANGTQHTSTFGEDELVRRYGKA

SEQ ID NO: 443885 - protein, 9 aa, Mycobacterium
DANGTTVAA

SEQ ID NO: 443886 - protein, 8 aa, Mycobacterium
DANHGSAN

SEQ ID NO: 443887 - protein, 6 aa, Mycobacterium
DANIDT

SEQ ID NO: 443888 - protein, 6 aa, Mycobacterium
DANIGM

SEQ ID NO: 443889 - protein, 9 aa, Mycobacterium
DANKSSIDA

SEQ ID NO: 443890 - protein, 13 aa, Mycobacterium
DANLSGHTYPDQS

SEQ ID NO: 443891 - protein, 6 aa, Mycobacterium
DANNPL

SEQ ID NO: 443892 - protein, 8 aa, Mycobacterium
DANPADVS

SEQ ID NO: 443893 - protein, 8 aa, Mycobacterium
DANPATAR

SEQ ID NO: 443894 - protein, 8 aa, Mycobacterium
DANPETAQ

SEQ ID NO: 443895 - protein, 7 aa, Mycobacterium
DANPGFG

SEQ ID NO: 443896 - protein, 8 aa, Mycobacterium
DANPPEVK

SEQ ID NO: 443897 - protein, 18 aa, Mycobacterium
DANPPNEQWPRPAVSEQT

SEQ ID NO: 443898 - protein, 8 aa, Mycobacterium
DANPQTAR

SEQ ID NO: 443899 - protein, 8 aa, Mycobacterium
DANPSGKL

SEQ ID NO: 443900 - protein, 11 aa, Mycobacterium
DANPSTRTGRA

SEQ ID NO: 443901 - protein, 7 aa, Mycobacterium
DANPVTA

SEQ ID NO: 443902 - protein, 11 aa, Mycobacterium
DANQAVSKAEA

SEQ ID NO: 443903 - protein, 5 aa, Mycobacterium
DANRA

SEQ ID NO: 443904 - protein, 7 aa, Mycobacterium
DANRNGH

SEQ ID NO: 443905 - protein, 9 aa, Mycobacterium
DANRVGEAH

SEQ ID NO: 443906 - protein, 5 aa, Mycobacterium
DANSA

SEQ ID NO: 443907 - protein, 7 aa, Mycobacterium
DANSDGW

SEQ ID NO: 443908 - protein, 6 aa, Mycobacterium
DANTAE

SEQ ID NO: 443909 - protein, 8 aa, Mycobacterium
DANTDAAE

SEQ ID NO: 443910 - protein, 18 aa, Mycobacterium
DANTDEYQKTIEEGRQVP

SEQ ID NO: 443911 - protein, 8 aa, Mycobacterium
DANTESAE

SEQ ID NO: 443912 - protein, 7 aa, Mycobacterium
DANTGEK

SEQ ID NO: 443913 - protein, 9 aa, Mycobacterium
DANTLEATQ

SEQ ID NO: 443914 - protein, 18 aa, Mycobacterium
DANTRARNRSRAKAAANN

SEQ ID NO: 443915 - protein, 9 aa, Mycobacterium
DANVSEAAD

SEQ ID NO: 443916 - protein, 8 aa, Mycobacterium
DANVSGYE

SEQ ID NO: 443917 - protein, 11 aa, Mycobacterium
DANYAGPTINR

SEQ ID NO: 443918 - protein, 15 aa, Mycobacterium
DANYEPDRSQSIAAR

SEQ ID NO: 443919 - protein, 9 aa, Mycobacterium
DAPAAEPGS

SEQ ID NO: 443920 - protein, 10 aa, Mycobacterium
DAPAAGPDGL

SEQ ID NO: 443921 - protein, 20 aa, Mycobacterium
DAPAAPAVAPDPEPTPGLTG

SEQ ID NO: 443922 - protein, 11 aa, Mycobacterium
DAPADREQKAR

SEQ ID NO: 443923 - protein, 24 aa, Mycobacterium
DAPADREQKARLSKLSPEQVTATE

SEQ ID NO: 443924 - protein, 7 aa, Mycobacterium
DAPAGGG

SEQ ID NO: 443925 - protein, 8 aa, Mycobacterium
DAPAGGGF

SEQ ID NO: 443926 - protein, 7 aa, Mycobacterium
DAPAGSV

SEQ ID NO: 443927 - protein, 7 aa, Mycobacterium
DAPAGTR

SEQ ID NO: 443928 - protein, 15 aa, Mycobacterium
DAPAGVGQKELTESA

SEQ ID NO: 443929 - protein, 9 aa, Mycobacterium
DAPAHGVAD

SEQ ID NO: 443930 - protein, 5 aa, Mycobacterium
DAPAL

SEQ ID NO: 443931 - protein, 11 aa, Mycobacterium
DAPANRDQKAR

SEQ ID NO: 443932 - protein, 16 aa, Mycobacterium
DAPAPAPAAPAPTAIP

SEQ ID NO: 443933 - protein, 8 aa, Mycobacterium
DAPAPATY

SEQ ID NO: 443934 - protein, 8 aa, Mycobacterium
DAPAPGAS

SEQ ID NO: 443935 - protein, 13 aa, Mycobacterium
DAPAPQRRRRPEI

SEQ ID NO: 443936 - protein, 47 aa, Mycobacterium
DAPAPRRAPVEDRRYPRRGERFADDAEYGYDEPGYRAGGPAGYADED

SEQ ID NO: 443937 - protein, 8 aa, Mycobacterium
DAPASQAA

SEQ ID NO: 443938 - protein, 10 aa, Mycobacterium
DAPASREQKA

SEQ ID NO: 443939 - protein, 7 aa, Mycobacterium
DAPASYE

SEQ ID NO: 443940 - protein, 9 aa, Mycobacterium
DAPASYTRA

SEQ ID NO: 443941 - protein, 5 aa, Mycobacterium
DAPAT

SEQ ID NO: 443942 - protein, 8 aa, Mycobacterium
DAPDDEQT

SEQ ID NO: 443943 - protein, 7 aa, Mycobacterium
DAPDESA

SEQ ID NO: 443944 - protein, 8 aa, Mycobacterium
DAPDGRGL

SEQ ID NO: 443945 - protein, 6 aa, Mycobacterium
DAPDHG

SEQ ID NO: 443946 - protein, 9 aa, Mycobacterium
DAPDPEGAG

SEQ ID NO: 443947 - protein, 7 aa, Mycobacterium
DAPDPGA

SEQ ID NO: 443948 - protein, 11 aa, Mycobacterium
DAPDPSALDGA

SEQ ID NO: 443949 - protein, 6 aa, Mycobacterium
DAPDQQ

SEQ ID NO: 443950 - protein, 8 aa, Mycobacterium
DAPDSEAA

SEQ ID NO: 443951 - protein, 8 aa, Mycobacterium
DAPDSLKD

SEQ ID NO: 443952 - protein, 6 aa, Mycobacterium
DAPDTD

SEQ ID NO: 443953 - protein, 7 aa, Mycobacterium
DAPDTPR

SEQ ID NO: 443954 - protein, 7 aa, Mycobacterium
DAPEAGL

SEQ ID NO: 443955 - protein, 10 aa, Mycobacterium
DAPEAPEPLP

SEQ ID NO: 443956 - protein, 9 aa, Mycobacterium
DAPEDAKKY

SEQ ID NO: 443957 - protein, 6 aa, Mycobacterium
DAPEDV

SEQ ID NO: 443958 - protein, 6 aa, Mycobacterium
DAPEEF

SEQ ID NO: 443959 - protein, 8 aa, Mycobacterium
DAPEEFTS

SEQ ID NO: 443960 - protein, 7 aa, Mycobacterium
DAPEELR

SEQ ID NO: 443961 - protein, 7 aa, Mycobacterium
DAPEEQW

SEQ ID NO: 443962 - protein, 5 aa, Mycobacterium
DAPEG

SEQ ID NO: 443963 - protein, 7 aa, Mycobacterium
DAPEGRE

SEQ ID NO: 443964 - protein, 7 aa, Mycobacterium
DAPEHTQ

SEQ ID NO: 443965 - protein, 8 aa, Mycobacterium
DAPELADG

SEQ ID NO: 443966 - protein, 13 aa, Mycobacterium
DAPELAEGQMDPL

SEQ ID NO: 443967 - protein, 8 aa, Mycobacterium
DAPEPAAA

SEQ ID NO: 443968 - protein, 18 aa, Mycobacterium
DAPEPPPAPAQPEPVPDV

SEQ ID NO: 443969 - protein, 7 aa, Mycobacterium
DAPEPVE

SEQ ID NO: 443970 - protein, 6 aa, Mycobacterium
DAPERA

SEQ ID NO: 443971 - protein, 13 aa, Mycobacterium
DAPERIRSEGIRP

SEQ ID NO: 443972 - protein, 5 aa, Mycobacterium
DAPES

SEQ ID NO: 443973 - protein, 15 aa, Mycobacterium
DAPETECDGEPIGGD

SEQ ID NO: 443974 - protein, 5 aa, Mycobacterium
DAPEV

SEQ ID NO: 443975 - protein, 9 aa, Mycobacterium
DAPEVAGRI

SEQ ID NO: 443976 - protein, 15 aa, Mycobacterium
DAPEVEAGGVDPLSP

SEQ ID NO: 443977 - protein, 7 aa, Mycobacterium
DAPFASS

SEQ ID NO: 443978 - protein, 14 aa, Mycobacterium
DAPFPDKSYQAGAR

SEQ ID NO: 443979 - protein, 21 aa, Mycobacterium
DAPFPPAATGPRGRQGSASSV

SEQ ID NO: 443980 - protein, 5 aa, Mycobacterium
DAPGA

SEQ ID NO: 443981 - protein, 6 aa, Mycobacterium
DAPGAD

SEQ ID NO: 443982 - protein, 8 aa, Mycobacterium
DAPGADDW

SEQ ID NO: 443983 - protein, 15 aa, Mycobacterium
DAPGADKITDEQRPE

SEQ ID NO: 443984 - protein, 15 aa, Mycobacterium
DAPGADQVTEEQRPT

SEQ ID NO: 443985 - protein, 12 aa, Mycobacterium
DAPGADTIRPEF

SEQ ID NO: 443986 - protein, 6 aa, Mycobacterium
DAPGAE

SEQ ID NO: 443987 - protein, 15 aa, Mycobacterium
DAPGAFEPEPLPAPV

SEQ ID NO: 443988 - protein, 14 aa, Mycobacterium
DAPGARVSGVSTLG

SEQ ID NO: 443989 - protein, 15 aa, Mycobacterium
DAPGCCGGGDAASRA

SEQ ID NO: 443990 - protein, 6 aa, Mycobacterium
DAPGDV

SEQ ID NO: 443991 - protein, 6 aa, Mycobacterium
DAPGET

SEQ ID NO: 443992 - protein, 8 aa, Mycobacterium
DAPGFASS

SEQ ID NO: 443993 - protein, 7 aa, Mycobacterium
DAPGGDA

SEQ ID NO: 443994 - protein, 10 aa, Mycobacterium
DAPGGRRELD

SEQ ID NO: 443995 - protein, 8 aa, Mycobacterium
DAPGGSVT

SEQ ID NO: 443996 - protein, 11 aa, Mycobacterium
DAPGGVPPRET

SEQ ID NO: 443997 - protein, 12 aa, Mycobacterium
DAPGGVPPSETL

SEQ ID NO: 443998 - protein, 6 aa, Mycobacterium
DAPGKH

SEQ ID NO: 443999 - protein, 17 aa, Mycobacterium
DAPGKYRDAVEAFLSSF

SEQ ID NO: 444000 - protein, 7 aa, Mycobacterium
DAPGLRA

SEQ ID NO: 444001 - protein, 12 aa, Mycobacterium
DAPGMDATKDDR

SEQ ID NO: 444002 - protein, 7 aa, Mycobacterium
DAPGNDA

SEQ ID NO: 444003 - protein, 10 aa, Mycobacterium
DAPGPEPAAT

SEQ ID NO: 444004 - protein, 7 aa, Mycobacterium
DAPGPMA

SEQ ID NO: 444005 - protein, 14 aa, Mycobacterium
DAPGPPPAAPEPEV

SEQ ID NO: 444006 - protein, 14 aa, Mycobacterium
DAPGPTNAATARLA

SEQ ID NO: 444007 - protein, 8 aa, Mycobacterium
DAPGQADI

SEQ ID NO: 444008 - protein, 13 aa, Mycobacterium
DAPGRAPGRKSVR

SEQ ID NO: 444009 - protein, 14 aa, Mycobacterium
DAPGRGEPGTGSLP

SEQ ID NO: 444010 - protein, 5 aa, Mycobacterium
DAPGS

SEQ ID NO: 444011 - protein, 32 aa, Mycobacterium
DAPGSPPSHSDTDGPTSSARRAGALTPAPSRP

SEQ ID NO: 444012 - protein, 49 aa, Mycobacterium
DAPGSPPSHSDTDGPTSSARRARGLTPVPSRPFRSSPPSRRNPRSGSGW

SEQ ID NO: 444013 - protein, 5 aa, Mycobacterium
DAPGV

SEQ ID NO: 444014 - protein, 12 aa, Mycobacterium
DAPGVTIAPQQS

SEQ ID NO: 444015 - protein, 5 aa, Mycobacterium
DAPHG

SEQ ID NO: 444016 - protein, 7 aa, Mycobacterium
DAPHSQA

SEQ ID NO: 444017 - protein, 5 aa, Mycobacterium
DAPHT

SEQ ID NO: 444018 - protein, 12 aa, Mycobacterium
DAPIGSLSGGQR

SEQ ID NO: 444019 - protein, 8 aa, Mycobacterium
DAPIPAPG

SEQ ID NO: 444020 - protein, 6 aa, Mycobacterium
DAPIRA

SEQ ID NO: 444021 - protein, 6 aa, Mycobacterium
DAPKAT

SEQ ID NO: 444022 - protein, 12 aa, Mycobacterium
DAPKLADASDGE

SEQ ID NO: 444023 - protein, 7 aa, Mycobacterium
DAPKPRV

SEQ ID NO: 444024 - protein, 8 aa, Mycobacterium
DAPLADAA

SEQ ID NO: 444025 - protein, 9 aa, Mycobacterium
DAPLADRLG

SEQ ID NO: 444026 - protein, 5 aa, Mycobacterium
DAPLD

SEQ ID NO: 444027 - protein, 6 aa, Mycobacterium
DAPLDP

SEQ ID NO: 444028 - protein, 7 aa, Mycobacterium
DAPLDPD

SEQ ID NO: 444029 - protein, 7 aa, Mycobacterium
DAPLENT

SEQ ID NO: 444030 - protein, 9 aa, Mycobacterium
DAPLERNPT

SEQ ID NO: 444031 - protein, 6 aa, Mycobacterium
DAPLGR

SEQ ID NO: 444032 - protein, 7 aa, Mycobacterium
DAPLGRA

SEQ ID NO: 444033 - protein, 5 aa, Mycobacterium
DAPLP

SEQ ID NO: 444034 - protein, 8 aa, Mycobacterium
DAPLPAQT

SEQ ID NO: 444035 - protein, 8 aa, Mycobacterium
DAPLPTGA

SEQ ID NO: 444036 - protein, 7 aa, Mycobacterium
DAPLTDA

SEQ ID NO: 444037 - protein, 6 aa, Mycobacterium
DAPLYR

SEQ ID NO: 444038 - protein, 4 aa, Mycobacterium
DAPM

SEQ ID NO: 444039 - protein, 7 aa, Mycobacterium
DAPNGRQ

SEQ ID NO: 444040 - protein, 13 aa, Mycobacterium
DAPNGVAVDSAGS

SEQ ID NO: 444041 - protein, 22 aa, Mycobacterium
DAPPAAGGDSAVSGVEGLPAGS

SEQ ID NO: 444042 - protein, 6 aa, Mycobacterium
DAPPAI

SEQ ID NO: 444043 - protein, 10 aa, Mycobacterium
DAPPDIGQKE

SEQ ID NO: 444044 - protein, 6 aa, Mycobacterium
DAPPDL

SEQ ID NO: 444045 - protein, 7 aa, Mycobacterium
DAPPDTR

SEQ ID NO: 444046 - protein, 7 aa, Mycobacterium
DAPPEAM

SEQ ID NO: 444047 - protein, 8 aa, Mycobacterium
DAPPEASA

SEQ ID NO: 444048 - protein, 10 aa, Mycobacterium
DAPPERQREL

SEQ ID NO: 444049 - protein, 6 aa, Mycobacterium
DAPPGL

SEQ ID NO: 444050 - protein, 10 aa, Mycobacterium
DAPPGTPPLP

SEQ ID NO: 444051 - protein, 7 aa, Mycobacterium
DAPPIDE

SEQ ID NO: 444052 - protein, 8 aa, Mycobacterium
DAPPIPAE

SEQ ID NO: 444053 - protein, 6 aa, Mycobacterium
DAPPKS

SEQ ID NO: 444054 - protein, 7 aa, Mycobacterium
DAPPMDP

SEQ ID NO: 444055 - protein, 12 aa, Mycobacterium
DAPPNVDLDGDG

SEQ ID NO: 444056 - protein, 10 aa, Mycobacterium
DAPPPAGSKQ

SEQ ID NO: 444057 - protein, 18 aa, Mycobacterium
DAPPPAGSKQRLAELGPE

SEQ ID NO: 444058 - protein, 13 aa, Mycobacterium
DAPPPTPAELGQA

SEQ ID NO: 444059 - protein, 6 aa, Mycobacterium
DAPPPV

SEQ ID NO: 444060 - protein, 7 aa, Mycobacterium
DAPPQDP

SEQ ID NO: 444061 - protein, 7 aa, Mycobacterium
DAPPRGL

SEQ ID NO: 444062 - protein, 17 aa, Mycobacterium
DAPPSALAGLTEKHDAA

SEQ ID NO: 444063 - protein, 7 aa, Mycobacterium
DAPPSVH

SEQ ID NO: 444064 - protein, 6 aa, Mycobacterium
DAPPTF

SEQ ID NO: 444065 - protein, 6 aa, Mycobacterium
DAPPVE

SEQ ID NO: 444066 - protein, 9 aa, Mycobacterium
DAPPVGTGV

SEQ ID NO: 444067 - protein, 6 aa, Mycobacterium
DAPPVL

SEQ ID NO: 444068 - protein, 6 aa, Mycobacterium
DAPPVS

SEQ ID NO: 444069 - protein, 10 aa, Mycobacterium
DAPPVTPRGA

SEQ ID NO: 444070 - protein, 4 aa, Mycobacterium
DAPQ

SEQ ID NO: 444071 - protein, 5 aa, Mycobacterium
DAPQD

SEQ ID NO: 444072 - protein, 9 aa, Mycobacterium
DAPQEATPP

SEQ ID NO: 444073 - protein, 6 aa, Mycobacterium
DAPQEI

SEQ ID NO: 444074 - protein, 11 aa, Mycobacterium
DAPQGDGPRRV

SEQ ID NO: 444075 - protein, 16 aa, Mycobacterium
DAPQNTAGDGADPPRH

SEQ ID NO: 444076 - protein, 7 aa, Mycobacterium
DAPQPPL

SEQ ID NO: 444077 - protein, 6 aa, Mycobacterium
DAPQRA

SEQ ID NO: 444078 - protein, 9 aa, Mycobacterium
DAPQSAKRV

SEQ ID NO: 444079 - protein, 10 aa, Mycobacterium
DAPQSPAEPA

SEQ ID NO: 444080 - protein, 16 aa, Mycobacterium
DAPQTGSVKAELSETG

SEQ ID NO: 444081 - protein, 8 aa, Mycobacterium
DAPQWNPD

SEQ ID NO: 444082 - protein, 7 aa, Mycobacterium
DAPRAYD

SEQ ID NO: 444083 - protein, 8 aa, Mycobacterium
DAPRDEAA

SEQ ID NO: 444084 - protein, 11 aa, Mycobacterium
DAPRDKAFDDT

SEQ ID NO: 444085 - protein, 12 aa, Mycobacterium
DAPRGDAEQECA

SEQ ID NO: 444086 - protein, 8 aa, Mycobacterium
DAPRGEGM

SEQ ID NO: 444087 - protein, 7 aa, Mycobacterium
DAPRGIR

SEQ ID NO: 444088 - protein, 7 aa, Mycobacterium
DAPRGRV

SEQ ID NO: 444089 - protein, 12 aa, Mycobacterium
DAPRKLATGGRA

SEQ ID NO: 444090 - protein, 8 aa, Mycobacterium
DAPRPAPV

SEQ ID NO: 444091 - protein, 5 aa, Mycobacterium
DAPRR

SEQ ID NO: 444092 - protein, 15 aa, Mycobacterium
DAPRRASVNERGGTD

SEQ ID NO: 444093 - protein, 6 aa, Mycobacterium
DAPRSA

SEQ ID NO: 444094 - protein, 12 aa, Mycobacterium
DAPRSAAATEVS

SEQ ID NO: 444095 - protein, 12 aa, Mycobacterium
DAPRTDQTLVVI

SEQ ID NO: 444096 - protein, 22 aa, Mycobacterium
DAPRVAEGTERYEVDEQGQTIF

SEQ ID NO: 444097 - protein, 10 aa, Mycobacterium
DAPRVEQGTE

SEQ ID NO: 444098 - protein, 8 aa, Mycobacterium
DAPSADEF

SEQ ID NO: 444099 - protein, 8 aa, Mycobacterium
DAPSMSSD

SEQ ID NO: 444100 - protein, 9 aa, Mycobacterium
DAPSSHEGP

SEQ ID NO: 444101 - protein, 14 aa, Mycobacterium
DAPSTLIGPPGRAT

SEQ ID NO: 444102 - protein, 5 aa, Mycobacterium
DAPSV

SEQ ID NO: 444103 - protein, 5 aa, Mycobacterium
DAPTC

SEQ ID NO: 444104 - protein, 5 aa, Mycobacterium
DAPTD

SEQ ID NO: 444105 - protein, 19 aa, Mycobacterium
DAPTDTAAGTPLPAPPPDG

SEQ ID NO: 444106 - protein, 14 aa, Mycobacterium
DAPTGHGARESGLD

SEQ ID NO: 444107 - protein, 7 aa, Mycobacterium
DAPTGRR

SEQ ID NO: 444108 - protein, 10 aa, Mycobacterium
DAPTGTDHER

SEQ ID NO: 444109 - protein, 36 aa, Mycobacterium
DAPTKVTEPPAITQPMEAPEPPTESLKTSSSASRRV

SEQ ID NO: 444110 - protein, 8 aa, Mycobacterium
DAPTNEQA

SEQ ID NO: 444111 - protein, 16 aa, Mycobacterium
DAPTPPDRAQLPKGGT

SEQ ID NO: 444112 - protein, 10 aa, Mycobacterium
DAPTPTPTKG

SEQ ID NO: 444113 - protein, 21 aa, Mycobacterium
DAPTQSGTESSVSGVEGLPAG

SEQ ID NO: 444114 - protein, 6 aa, Mycobacterium
DAPTQT

SEQ ID NO: 444115 - protein, 8 aa, Mycobacterium
DAPTRANA

SEQ ID NO: 444116 - protein, 9 aa, Mycobacterium
DAPTRHDGP

SEQ ID NO: 444117 - protein, 6 aa, Mycobacterium
DAPTSL

SEQ ID NO: 444118 - protein, 13 aa, Mycobacterium
DAPTSSMESNDPI

SEQ ID NO: 444119 - protein, 7 aa, Mycobacterium
DAPTTLN

SEQ ID NO: 444120 - protein, 12 aa, Mycobacterium
DAPTWAGRERRR

SEQ ID NO: 444121 - protein, 6 aa, Mycobacterium
DAPVAG

SEQ ID NO: 444122 - protein, 6 aa, Mycobacterium
DAPVAP

SEQ ID NO: 444123 - protein, 6 aa, Mycobacterium
DAPVDE

SEQ ID NO: 444124 - protein, 11 aa, Mycobacterium
DAPVELPEAGR

SEQ ID NO: 444125 - protein, 6 aa, Mycobacterium
DAPVGA

SEQ ID NO: 444126 - protein, 6 aa, Mycobacterium
DAPVGK

SEQ ID NO: 444127 - protein, 7 aa, Mycobacterium
DAPVKGN

SEQ ID NO: 444128 - protein, 19 aa, Mycobacterium
DAPVPDGPYDDTHDDPLDT

SEQ ID NO: 444129 - protein, 8 aa, Mycobacterium
DAPVPSGY

SEQ ID NO: 444130 - protein, 5 aa, Mycobacterium
DAPVR

SEQ ID NO: 444131 - protein, 12 aa, Mycobacterium
DAPVSLSTPTDA

SEQ ID NO: 444132 - protein, 7 aa, Mycobacterium
DAPVTDA

SEQ ID NO: 444133 - protein, 6 aa, Mycobacterium
DAPVTE

SEQ ID NO: 444134 - protein, 6 aa, Mycobacterium
DAPVTG

SEQ ID NO: 444135 - protein, 11 aa, Mycobacterium
DAPVTPAQTDR

SEQ ID NO: 444136 - protein, 17 aa, Mycobacterium
DAPWPDRPTAFAERKAA

SEQ ID NO: 444137 - protein, 7 aa, Mycobacterium
DAPWPGG

SEQ ID NO: 444138 - protein, 8 aa, Mycobacterium
DAPWPPAR

SEQ ID NO: 444139 - protein, 8 aa, Mycobacterium
DAPWPPDL

SEQ ID NO: 444140 - protein, 6 aa, Mycobacterium
DAPYPG

SEQ ID NO: 444141 - protein, 4 aa, Mycobacterium
DAQA

SEQ ID NO: 444142 - protein, 19 aa, Mycobacterium
DAQAARAAAAGGGGGGDKI

SEQ ID NO: 444143 - protein, 8 aa, Mycobacterium
DAQAASAA

SEQ ID NO: 444144 - protein, 6 aa, Mycobacterium
DAQADR

SEQ ID NO: 444145 - protein, 17 aa, Mycobacterium
DAQAGFGSARSASALSS

SEQ ID NO: 444146 - protein, 7 aa, Mycobacterium
DAQAGGG

SEQ ID NO: 444147 - protein, 8 aa, Mycobacterium
DAQAPGAR

SEQ ID NO: 444148 - protein, 9 aa, Mycobacterium
DAQAPGQRM

SEQ ID NO: 444149 - protein, 6 aa, Mycobacterium
DAQAPL

SEQ ID NO: 444150 - protein, 15 aa, Mycobacterium
DAQAPRDDLSDRERA

SEQ ID NO: 444151 - protein, 56 aa, Mycobacterium
DAQAQGRTAGRGRRRAPGRRRDQLPRRPPHPVRGRQGWTTEQRNRAGPVSNPGDRH

SEQ ID NO: 444152 - protein, 8 aa, Mycobacterium
DAQARTQL

SEQ ID NO: 444153 - protein, 7 aa, Mycobacterium
DAQATVA

SEQ ID NO: 444154 - protein, 12 aa, Mycobacterium
DAQDAPTAPVTS

SEQ ID NO: 444155 - protein, 6 aa, Mycobacterium
DAQDAV

SEQ ID NO: 444156 - protein, 7 aa, Mycobacterium
DAQDEAM

SEQ ID NO: 444157 - protein, 5 aa, Mycobacterium
DAQDN

SEQ ID NO: 444158 - protein, 5 aa, Mycobacterium
DAQDR

SEQ ID NO: 444159 - protein, 11 aa, Mycobacterium
DAQEAAEASWS

SEQ ID NO: 444160 - protein, 7 aa, Mycobacterium
DAQERRR

SEQ ID NO: 444161 - protein, 7 aa, Mycobacterium
DAQESAV

SEQ ID NO: 444162 - protein, 5 aa, Mycobacterium
DAQFS

SEQ ID NO: 444163 - protein, 5 aa, Mycobacterium
DAQGF

SEQ ID NO: 444164 - protein, 6 aa, Mycobacterium
DAQGGV

SEQ ID NO: 444165 - protein, 12 aa, Mycobacterium
DAQGHGAGRAAM

SEQ ID NO: 444166 - protein, 5 aa, Mycobacterium
DAQGN

SEQ ID NO: 444167 - protein, 10 aa, Mycobacterium
DAQGNSAGLN

SEQ ID NO: 444168 - protein, 5 aa, Mycobacterium
DAQGP

SEQ ID NO: 444169 - protein, 5 aa, Mycobacterium
DAQGR

SEQ ID NO: 444170 - protein, 6 aa, Mycobacterium
DAQGRF

SEQ ID NO: 444171 - protein, 16 aa, Mycobacterium
DAQGRRVDPLTEEQPG

SEQ ID NO: 444172 - protein, 5 aa, Mycobacterium
DAQGT

SEQ ID NO: 444173 - protein, 7 aa, Mycobacterium
DAQHPDG

SEQ ID NO: 444174 - protein, 6 aa, Mycobacterium
DAQIRS

SEQ ID NO: 444175 - protein, 9 aa, Mycobacterium
DAQKAGKPV

SEQ ID NO: 444176 - protein, 5 aa, Mycobacterium
DAQKL

SEQ ID NO: 444177 - protein, 7 aa, Mycobacterium
DAQLPAD

SEQ ID NO: 444178 - protein, 6 aa, Mycobacterium
DAQLPE

SEQ ID NO: 444179 - protein, 6 aa, Mycobacterium
DAQLSG

SEQ ID NO: 444180 - protein, 7 aa, Mycobacterium
DAQNDDD

SEQ ID NO: 444181 - protein, 9 aa, Mycobacterium
DAQNSKTRL

SEQ ID NO: 444182 - protein, 7 aa, Mycobacterium
DAQPARR

SEQ ID NO: 444183 - protein, 5 aa, Mycobacterium
DAQPC

SEQ ID NO: 444184 - protein, 11 aa, Mycobacterium
DAQPDGELPPF

SEQ ID NO: 444185 - protein, 15 aa, Mycobacterium
DAQPDGELPPFGSPY

SEQ ID NO: 444186 - protein, 17 aa, Mycobacterium
DAQPDGELPPFGSPYAA

SEQ ID NO: 444187 - protein, 20 aa, Mycobacterium
DAQPDWDTVSTNGSGAVSTA

SEQ ID NO: 444188 - protein, 8 aa, Mycobacterium
DAQPEQDA

SEQ ID NO: 444189 - protein, 5 aa, Mycobacterium
DAQPF

SEQ ID NO: 444190 - protein, 8 aa, Mycobacterium
DAQPFEGD

SEQ ID NO: 444191 - protein, 7 aa, Mycobacterium
DAQPGRR

SEQ ID NO: 444192 - protein, 7 aa, Mycobacterium
DAQPQDF

SEQ ID NO: 444193 - protein, 7 aa, Mycobacterium
DAQPQMK

SEQ ID NO: 444194 - protein, 13 aa, Mycobacterium
DAQPRYSAARRDA

SEQ ID NO: 444195 - protein, 5 aa, Mycobacterium
DAQPT

SEQ ID NO: 444196 - protein, 13 aa, Mycobacterium
DAQPTRRTAGPCP

SEQ ID NO: 444197 - protein, 24 aa, Mycobacterium
DAQPVPEAASDNPRAGAETPADQR

SEQ ID NO: 444198 - protein, 11 aa, Mycobacterium
DAQQEAKASWS

SEQ ID NO: 444199 - protein, 8 aa, Mycobacterium
DAQQRADA

SEQ ID NO: 444200 - protein, 7 aa, Mycobacterium
DAQRAKA

SEQ ID NO: 444201 - protein, 8 aa, Mycobacterium
DAQRARAV

SEQ ID NO: 444202 - protein, 7 aa, Mycobacterium
DAQRDGD

SEQ ID NO: 444203 - protein, 17 aa, Mycobacterium
DAQRKEGLTDWGPGEFE

SEQ ID NO: 444204 - protein, 5 aa, Mycobacterium
DAQRN

SEQ ID NO: 444205 - protein, 7 aa, Mycobacterium
DAQRNRD

SEQ ID NO: 444206 - protein, 11 aa, Mycobacterium
DAQRPATPAEQ

SEQ ID NO: 444207 - protein, 11 aa, Mycobacterium
DAQRPEDRRQH

SEQ ID NO: 444208 - protein, 8 aa, Mycobacterium
DAQRPEQQ

SEQ ID NO: 444209 - protein, 7 aa, Mycobacterium
DAQRPIS

SEQ ID NO: 444210 - protein, 9 aa, Mycobacterium
DAQRQSNGR

SEQ ID NO: 444211 - protein, 5 aa, Mycobacterium
DAQRR

SEQ ID NO: 444212 - protein, 6 aa, Mycobacterium
DAQRVT

SEQ ID NO: 444213 - protein, 6 aa, Mycobacterium
DAQTAL

SEQ ID NO: 444214 - protein, 11 aa, Mycobacterium
DAQTAQQASAA

SEQ ID NO: 444215 - protein, 7 aa, Mycobacterium
DAQTAQR

SEQ ID NO: 444216 - protein, 10 aa, Mycobacterium
DAQTDGAGGF

SEQ ID NO: 444217 - protein, 19 aa, Mycobacterium
DAQTGFEAQATHESGLEPM

SEQ ID NO: 444218 - protein, 7 aa, Mycobacterium
DAQTGTV

SEQ ID NO: 444219 - protein, 11 aa, Mycobacterium
DAQTLDDERRR

SEQ ID NO: 444220 - protein, 8 aa, Mycobacterium
DAQTPVEV

SEQ ID NO: 444221 - protein, 8 aa, Mycobacterium
DAQTRREL

SEQ ID NO: 444222 - protein, 29 aa, Mycobacterium
DAQTRSETQLRQAQEKADALQSDAERKHS

SEQ ID NO: 444223 - protein, 13 aa, Mycobacterium
DARAADPSLKGPF

SEQ ID NO: 444224 - protein, 15 aa, Mycobacterium
DARAADRRRRELQST

SEQ ID NO: 444225 - protein, 19 aa, Mycobacterium
DARAAEGRGESTVASPVDA

SEQ ID NO: 444226 - protein, 11 aa, Mycobacterium
DARAAGDNVPG

SEQ ID NO: 444227 - protein, 6 aa, Mycobacterium
DARAAR

SEQ ID NO: 444228 - protein, 8 aa, Mycobacterium
DARAARAR

SEQ ID NO: 444229 - protein, 16 aa, Mycobacterium
DARAATGRDESVLTGE

SEQ ID NO: 444230 - protein, 6 aa, Mycobacterium
DARAAV

SEQ ID NO: 444231 - protein, 13 aa, Mycobacterium
DARADAADETRDA

SEQ ID NO: 444232 - protein, 8 aa, Mycobacterium
DARAGAER

SEQ ID NO: 444233 - protein, 8 aa, Mycobacterium
DARANADQ

SEQ ID NO: 444234 - protein, 9 aa, Mycobacterium
DARANAEQI

SEQ ID NO: 444235 - protein, 6 aa, Mycobacterium
DARAPL

SEQ ID NO: 444236 - protein, 5 aa, Mycobacterium
DARAQ

SEQ ID NO: 444237 - protein, 19 aa, Mycobacterium
DARAQNIAKTAASSGSGDF

SEQ ID NO: 444238 - protein, 7 aa, Mycobacterium
DARARTA

SEQ ID NO: 444239 - protein, 6 aa, Mycobacterium
DARATA

SEQ ID NO: 444240 - protein, 8 aa, Mycobacterium
DARATREI

SEQ ID NO: 444241 - protein, 8 aa, Mycobacterium
DARATYAE

SEQ ID NO: 444242 - protein, 12 aa, Mycobacterium
DARCGRADNPHG

SEQ ID NO: 444243 - protein, 6 aa, Mycobacterium
DARDAG

SEQ ID NO: 444244 - protein, 6 aa, Mycobacterium
DARDER

SEQ ID NO: 444245 - protein, 7 aa, Mycobacterium
DARDGRK

SEQ ID NO: 444246 - protein, 5 aa, Mycobacterium
DARDI

SEQ ID NO: 444247 - protein, 6 aa, Mycobacterium
DARDIA

SEQ ID NO: 444248 - protein, 13 aa, Mycobacterium
DARDPRSRRWPSD

SEQ ID NO: 444249 - protein, 5 aa, Mycobacterium
DARDR

SEQ ID NO: 444250 - protein, 5 aa, Mycobacterium
DARDT

SEQ ID NO: 444251 - protein, 19 aa, Mycobacterium
DARDTDERRWDPEDPDPQL

SEQ ID NO: 444252 - protein, 13 aa, Mycobacterium
DARDTKLGAEEIT

SEQ ID NO: 444253 - protein, 11 aa, Mycobacterium
DARDTLPEPLR

SEQ ID NO: 444254 - protein, 5 aa, Mycobacterium
DAREE

SEQ ID NO: 444255 - protein, 6 aa, Mycobacterium
DAREFA

SEQ ID NO: 444256 - protein, 6 aa, Mycobacterium
DAREGA

SEQ ID NO: 444257 - protein, 7 aa, Mycobacterium
DAREPRR

SEQ ID NO: 444258 - protein, 12 aa, Mycobacterium
DARERGEIGPED

SEQ ID NO: 444259 - protein, 7 aa, Mycobacterium
DARETLK

SEQ ID NO: 444260 - protein, 24 aa, Mycobacterium
DARETSPVPLHPGAAKALDELGAA

SEQ ID NO: 444261 - protein, 8 aa, Mycobacterium
DAREWGET

SEQ ID NO: 444262 - protein, 8 aa, Mycobacterium
DAREYEAS

SEQ ID NO: 444263 - protein, 12 aa, Mycobacterium
DARFGESPLAQT

SEQ ID NO: 444264 - protein, 8 aa, Mycobacterium
DARGGDAG

SEQ ID NO: 444265 - protein, 5 aa, Mycobacterium
DARGH

SEQ ID NO: 444266 - protein, 8 aa, Mycobacterium
DARGKSAA

SEQ ID NO: 444267 - protein, 8 aa, Mycobacterium
DARGLGGV

SEQ ID NO: 444268 - protein, 12 aa, Mycobacterium
DARGNPKSEAVE

SEQ ID NO: 444269 - protein, 7 aa, Mycobacterium
DARGPLG

SEQ ID NO: 444270 - protein, 5 aa, Mycobacterium
DARGQ

SEQ ID NO: 444271 - protein, 13 aa, Mycobacterium
DARGQLADHPSKE

SEQ ID NO: 444272 - protein, 11 aa, Mycobacterium
DARGRPTSLQS

SEQ ID NO: 444273 - protein, 6 aa, Mycobacterium
DARGRR

SEQ ID NO: 444274 - protein, 12 aa, Mycobacterium
DARGRRGRNPQD

SEQ ID NO: 444275 - protein, 5 aa, Mycobacterium
DARHA

SEQ ID NO: 444276 - protein, 7 aa, Mycobacterium
DARHGGS

SEQ ID NO: 444277 - protein, 6 aa, Mycobacterium
DARHGS

SEQ ID NO: 444278 - protein, 8 aa, Mycobacterium
DARHGSAA

SEQ ID NO: 444279 - protein, 12 aa, Mycobacterium
DARHGSASFATA

SEQ ID NO: 444280 - protein, 8 aa, Mycobacterium
DARHGSEK

SEQ ID NO: 444281 - protein, 13 aa, Mycobacterium
DARHHPDPQTGEQ

SEQ ID NO: 444282 - protein, 8 aa, Mycobacterium
DARHKSDE

SEQ ID NO: 444283 - protein, 5 aa, Mycobacterium
DARHP

SEQ ID NO: 444284 - protein, 10 aa, Mycobacterium
DARLATEDAI

SEQ ID NO: 444285 - protein, 5 aa, Mycobacterium
DARLN

SEQ ID NO: 444286 - protein, 8 aa, Mycobacterium
DARLSDEA

SEQ ID NO: 444287 - protein, 8 aa, Mycobacterium
DARLSPKS

SEQ ID NO: 444288 - protein, 9 aa, Mycobacterium
DARNAEITP

SEQ ID NO: 444289 - protein, 14 aa, Mycobacterium
DARNEPKGPQKPHP

SEQ ID NO: 444290 - protein, 14 aa, Mycobacterium
DARNEPKGPQQPHP

SEQ ID NO: 444291 - protein, 14 aa, Mycobacterium
DARNEPKGPQRPHP

SEQ ID NO: 444292 - protein, 9 aa, Mycobacterium
DARNGKPAL

SEQ ID NO: 444293 - protein, 7 aa, Mycobacterium
DARNIPE

SEQ ID NO: 444294 - protein, 9 aa, Mycobacterium
DARNKRNRR

SEQ ID NO: 444295 - protein, 5 aa, Mycobacterium
DARNP

SEQ ID NO: 444296 - protein, 10 aa, Mycobacterium
DARNRRDGRA

SEQ ID NO: 444297 - protein, 9 aa, Mycobacterium
DARPADEPI

SEQ ID NO: 444298 - protein, 5 aa, Mycobacterium
DARPD

SEQ ID NO: 444299 - protein, 7 aa, Mycobacterium
DARPDTD

SEQ ID NO: 444300 - protein, 5 aa, Mycobacterium
DARPE

SEQ ID NO: 444301 - protein, 9 aa, Mycobacterium
DARPEGGAG

SEQ ID NO: 444302 - protein, 5 aa, Mycobacterium
DARPG

SEQ ID NO: 444303 - protein, 14 aa, Mycobacterium
DARPHELSGGQQQR

SEQ ID NO: 444304 - protein, 5 aa, Mycobacterium
DARPP

SEQ ID NO: 444305 - protein, 9 aa, Mycobacterium
DARPQTDPG

SEQ ID NO: 444306 - protein, 5 aa, Mycobacterium
DARPR

SEQ ID NO: 444307 - protein, 11 aa, Mycobacterium
DARPRGRRGRR

SEQ ID NO: 444308 - protein, 7 aa, Mycobacterium
DARPRLA

SEQ ID NO: 444309 - protein, 6 aa, Mycobacterium
DARPTA

SEQ ID NO: 444310 - protein, 7 aa, Mycobacterium
DARPTRT

SEQ ID NO: 444311 - protein, 5 aa, Mycobacterium
DARQA

SEQ ID NO: 444312 - protein, 9 aa, Mycobacterium
DARQPESWD

SEQ ID NO: 444313 - protein, 6 aa, Mycobacterium
DARQPI

SEQ ID NO: 444314 - protein, 8 aa, Mycobacterium
DARQQGAD

SEQ ID NO: 444315 - protein, 8 aa, Mycobacterium
DARQSRPI

SEQ ID NO: 444316 - protein, 18 aa, Mycobacterium
DARQTAETTVSEARQRAD

SEQ ID NO: 444317 - protein, 12 aa, Mycobacterium
DARQTVQGLPEA

SEQ ID NO: 444318 - protein, 14 aa, Mycobacterium
DARQVRKAGRQTKG

SEQ ID NO: 444319 - protein, 5 aa, Mycobacterium
DARRA

SEQ ID NO: 444320 - protein, 8 aa, Mycobacterium
DARRAAAA

SEQ ID NO: 444321 - protein, 7 aa, Mycobacterium
DARRAGA

SEQ ID NO: 444322 - protein, 7 aa, Mycobacterium
DARRAGQ

SEQ ID NO: 444323 - protein, 7 aa, Mycobacterium
DARRAGR

SEQ ID NO: 444324 - protein, 5 aa, Mycobacterium
DARRC

SEQ ID NO: 444325 - protein, 22 aa, Mycobacterium
DARREHTDGGPEMSGPPSSQEF

SEQ ID NO: 444326 - protein, 6 aa, Mycobacterium
DARRGI

SEQ ID NO: 444327 - protein, 7 aa, Mycobacterium
DARRGKN

SEQ ID NO: 444328 - protein, 15 aa, Mycobacterium
DARRGPDIDAQGRPE

SEQ ID NO: 444329 - protein, 14 aa, Mycobacterium
DARRGRSDDPHGPL

SEQ ID NO: 444330 - protein, 7 aa, Mycobacterium
DARRNQH

SEQ ID NO: 444331 - protein, 8 aa, Mycobacterium
DARRPADR

SEQ ID NO: 444332 - protein, 6 aa, Mycobacterium
DARRPD

SEQ ID NO: 444333 - protein, 7 aa, Mycobacterium
DARRPLR

SEQ ID NO: 444334 - protein, 13 aa, Mycobacterium
DARRRDRESTRQV

SEQ ID NO: 444335 - protein, 7 aa, Mycobacterium
DARRRGH

SEQ ID NO: 444336 - protein, 7 aa, Mycobacterium
DARRRIR

SEQ ID NO: 444337 - protein, 6 aa, Mycobacterium
DARRSR

SEQ ID NO: 444338 - protein, 6 aa, Mycobacterium
DARRTE

SEQ ID NO: 444339 - protein, 9 aa, Mycobacterium
DARRTPAPV

SEQ ID NO: 444340 - protein, 7 aa, Mycobacterium
DARRYAR

SEQ ID NO: 444341 - protein, 8 aa, Mycobacterium
DARSAADA

SEQ ID NO: 444342 - protein, 8 aa, Mycobacterium
DARSDAVR

SEQ ID NO: 444343 - protein, 10 aa, Mycobacterium
DARSDDPDKM

SEQ ID NO: 444344 - protein, 10 aa, Mycobacterium
DARSDDPNKM

SEQ ID NO: 444345 - protein, 12 aa, Mycobacterium
DARSDQTSQEIT

SEQ ID NO: 444346 - protein, 8 aa, Mycobacterium
DARSERWR

SEQ ID NO: 444347 - protein, 7 aa, Mycobacterium
DARSGAR

SEQ ID NO: 444348 - protein, 9 aa, Mycobacterium
DARSGHDPY

SEQ ID NO: 444349 - protein, 16 aa, Mycobacterium
DARSGVAEAPAASRAQ

SEQ ID NO: 444350 - protein, 8 aa, Mycobacterium
DARSPAEA

SEQ ID NO: 444351 - protein, 8 aa, Mycobacterium
DARTADET

SEQ ID NO: 444352 - protein, 6 aa, Mycobacterium
DARTDD

SEQ ID NO: 444353 - protein, 10 aa, Mycobacterium
DARTGTDRTV

SEQ ID NO: 444354 - protein, 12 aa, Mycobacterium
DARTIETDTATR

SEQ ID NO: 444355 - protein, 12 aa, Mycobacterium
DARTKNREMFPG

SEQ ID NO: 444356 - protein, 19 aa, Mycobacterium
DARTPVPIPEQVATALEQL

SEQ ID NO: 444357 - protein, 9 aa, Mycobacterium
DARTTLNPN

SEQ ID NO: 444358 - protein, 4 aa, Mycobacterium
DARV

SEQ ID NO: 444359 - protein, 6 aa, Mycobacterium
DARVDP

SEQ ID NO: 444360 - protein, 7 aa, Mycobacterium
DARVEAG

SEQ ID NO: 444361 - protein, 5 aa, Mycobacterium
DARYG

SEQ ID NO: 444362 - protein, 19 aa, Mycobacterium
DARYGTEASAAVAAARAAG

SEQ ID NO: 444363 - protein, 5 aa, Mycobacterium
DARYP

SEQ ID NO: 444364 - protein, 11 aa, Mycobacterium
DASAAAAPWPT

SEQ ID NO: 444365 - protein, 14 aa, Mycobacterium
DASAAIAKSRDAVE

SEQ ID NO: 444366 - protein, 8 aa, Mycobacterium
DASAASAV

SEQ ID NO: 444367 - protein, 11 aa, Mycobacterium
DASADGYVRSE

SEQ ID NO: 444368 - protein, 8 aa, Mycobacterium
DASAEAET

SEQ ID NO: 444369 - protein, 16 aa, Mycobacterium
DASAEAVTRWGGVWRP

SEQ ID NO: 444370 - protein, 8 aa, Mycobacterium
DASAEQAR

SEQ ID NO: 444371 - protein, 8 aa, Mycobacterium
DASAGPCD

SEQ ID NO: 444372 - protein, 5 aa, Mycobacterium
DASAN

SEQ ID NO: 444373 - protein, 6 aa, Mycobacterium
DASAND

SEQ ID NO: 444374 - protein, 10 aa, Mycobacterium
DASANHSTAV

SEQ ID NO: 444375 - protein, 5 aa, Mycobacterium
DASAP

SEQ ID NO: 444376 - protein, 10 aa, Mycobacterium
DASAPHRQRA

SEQ ID NO: 444377 - protein, 24 aa, Mycobacterium
DASAQAAGEHARRGERRKEVESSS

SEQ ID NO: 444378 - protein, 9 aa, Mycobacterium
DASAQVGAK

SEQ ID NO: 444379 - protein, 12 aa, Mycobacterium
DASARLGNAAER

SEQ ID NO: 444380 - protein, 13 aa, Mycobacterium
DASARQARRAREL

SEQ ID NO: 444381 - protein, 8 aa, Mycobacterium
DASASSQF

SEQ ID NO: 444382 - protein, 8 aa, Mycobacterium
DASAYDDG

SEQ ID NO: 444383 - protein, 7 aa, Mycobacterium
DASCRPQ

SEQ ID NO: 444384 - protein, 5 aa, Mycobacterium
DASDA

SEQ ID NO: 444385 - protein, 10 aa, Mycobacterium
DASDAGPTNN

SEQ ID NO: 444386 - protein, 10 aa, Mycobacterium
DASDGGRSTL

SEQ ID NO: 444387 - protein, 16 aa, Mycobacterium
DASDGRIGPDPTTFNL

SEQ ID NO: 444388 - protein, 9 aa, Mycobacterium
DASDLDNPA

SEQ ID NO: 444389 - protein, 14 aa, Mycobacterium
DASDPDGFAPATSA

SEQ ID NO: 444390 - protein, 11 aa, Mycobacterium
DASDRSDPRVS

SEQ ID NO: 444391 - protein, 4 aa, Mycobacterium
DASE

SEQ ID NO: 444392 - protein, 9 aa, Mycobacterium
DASEADAID

SEQ ID NO: 444393 - protein, 16 aa, Mycobacterium
DASEARGSESEGRYPE

SEQ ID NO: 444394 - protein, 6 aa, Mycobacterium
DASEAV

SEQ ID NO: 444395 - protein, 5 aa, Mycobacterium
DASED

SEQ ID NO: 444396 - protein, 10 aa, Mycobacterium
DASEDPAETF

SEQ ID NO: 444397 - protein, 12 aa, Mycobacterium
DASEDVDRAENE

SEQ ID NO: 444398 - protein, 6 aa, Mycobacterium
DASEHP

SEQ ID NO: 444399 - protein, 9 aa, Mycobacterium
DASENREQM

SEQ ID NO: 444400 - protein, 9 aa, Mycobacterium
DASERRSYE

SEQ ID NO: 444401 - protein, 54 aa, Mycobacterium
DASESGGEEKPSQPEPEAPGHGNAEPAPQAQPAPQPEPVSEPAQPSGSGGDTTP

SEQ ID NO: 444402 - protein, 9 aa, Mycobacterium
DASEVQPQR

SEQ ID NO: 444403 - protein, 5 aa, Mycobacterium
DASFA

SEQ ID NO: 444404 - protein, 6 aa, Mycobacterium
DASGAA

SEQ ID NO: 444405 - protein, 11 aa, Mycobacterium
DASGAAELPGA

SEQ ID NO: 444406 - protein, 13 aa, Mycobacterium
DASGADRTRVDPA

SEQ ID NO: 444407 - protein, 7 aa, Mycobacterium
DASGAQI

SEQ ID NO: 444408 - protein, 10 aa, Mycobacterium
DASGAQRAQL

SEQ ID NO: 444409 - protein, 19 aa, Mycobacterium
DASGCPDAQPTPPASYCPA

SEQ ID NO: 444410 - protein, 7 aa, Mycobacterium
DASGDDL

SEQ ID NO: 444411 - protein, 6 aa, Mycobacterium
DASGEL

SEQ ID NO: 444412 - protein, 9 aa, Mycobacterium
DASGEPAHL

SEQ ID NO: 444413 - protein, 7 aa, Mycobacterium
DASGETV

SEQ ID NO: 444414 - protein, 6 aa, Mycobacterium
DASGGA

SEQ ID NO: 444415 - protein, 20 aa, Mycobacterium
DASGIANPDLIQPGQVLTIP

SEQ ID NO: 444416 - protein, 6 aa, Mycobacterium
DASGID

SEQ ID NO: 444417 - protein, 5 aa, Mycobacterium
DASGK

SEQ ID NO: 444418 - protein, 5 aa, Mycobacterium
DASGL

SEQ ID NO: 444419 - protein, 5 aa, Mycobacterium
DASGM

SEQ ID NO: 444420 - protein, 8 aa, Mycobacterium
DASGMTGR

SEQ ID NO: 444421 - protein, 6 aa, Mycobacterium
DASGNA

SEQ ID NO: 444422 - protein, 10 aa, Mycobacterium
DASGNAPDST

SEQ ID NO: 444423 - protein, 12 aa, Mycobacterium
DASGNPVGRPVE

SEQ ID NO: 444424 - protein, 8 aa, Mycobacterium
DASGNTLQ

SEQ ID NO: 444425 - protein, 10 aa, Mycobacterium
DASGPDTVPE

SEQ ID NO: 444426 - protein, 8 aa, Mycobacterium
DASGPEAV

SEQ ID NO: 444427 - protein, 8 aa, Mycobacterium
DASGPEPY

SEQ ID NO: 444428 - protein, 37 aa, Mycobacterium
DASGPGRKPVAGATGAAPGETGGAHRIESAKAGKLSS

SEQ ID NO: 444429 - protein, 9 aa, Mycobacterium
DASGPSGEV

SEQ ID NO: 444430 - protein, 13 aa, Mycobacterium
DASGQESAIAAEQ

SEQ ID NO: 444431 - protein, 7 aa, Mycobacterium
DASGQNY

SEQ ID NO: 444432 - protein, 6 aa, Mycobacterium
DASGQT

SEQ ID NO: 444433 - protein, 8 aa, Mycobacterium
DASGRGEI

SEQ ID NO: 444434 - protein, 7 aa, Mycobacterium
DASGRLE

SEQ ID NO: 444435 - protein, 6 aa, Mycobacterium
DASGRQ

SEQ ID NO: 444436 - protein, 5 aa, Mycobacterium
DASGT

SEQ ID NO: 444437 - protein, 19 aa, Mycobacterium
DASGTLAGAQVPVDKGHLT

SEQ ID NO: 444438 - protein, 9 aa, Mycobacterium
DASGTTQAQ

SEQ ID NO: 444439 - protein, 6 aa, Mycobacterium
DASIDP

SEQ ID NO: 444440 - protein, 12 aa, Mycobacterium
DASKANADPRSV

SEQ ID NO: 444441 - protein, 8 aa, Mycobacterium
DASKASEW

SEQ ID NO: 444442 - protein, 10 aa, Mycobacterium
DASKDKQGIA

SEQ ID NO: 444443 - protein, 32 aa, Mycobacterium
DASKGQPDGPDERLSAQTVGADADTAADSGWD

SEQ ID NO: 444444 - protein, 38 aa, Mycobacterium
DASKNEPNRPGEHAPAASVGDAPDLSAAAESSDTDAEW

SEQ ID NO: 444445 - protein, 4 aa, Mycobacterium
DASL

SEQ ID NO: 444446 - protein, 7 aa, Mycobacterium
DASLSNP

SEQ ID NO: 444447 - protein, 5 aa, Mycobacterium
DASLT

SEQ ID NO: 444448 - protein, 16 aa, Mycobacterium
DASMTEAANEAKNTDY

SEQ ID NO: 444449 - protein, 8 aa, Mycobacterium
DASNADVT

SEQ ID NO: 444450 - protein, 6 aa, Mycobacterium
DASNDR

SEQ ID NO: 444451 - protein, 6 aa, Mycobacterium
DASNGL

SEQ ID NO: 444452 - protein, 7 aa, Mycobacterium
DASNRVK

SEQ ID NO: 444453 - protein, 14 aa, Mycobacterium
DASPAPQSDSSTDA

SEQ ID NO: 444454 - protein, 21 aa, Mycobacterium
DASPDKVAAGVRSASLSNSGQ

SEQ ID NO: 444455 - protein, 6 aa, Mycobacterium
DASPNA

SEQ ID NO: 444456 - protein, 6 aa, Mycobacterium
DASPNL

SEQ ID NO: 444457 - protein, 10 aa, Mycobacterium
DASPQDGRAA

SEQ ID NO: 444458 - protein, 8 aa, Mycobacterium
DASPSEGL

SEQ ID NO: 444459 - protein, 10 aa, Mycobacterium
DASPVGSADR

SEQ ID NO: 444460 - protein, 5 aa, Mycobacterium
DASQH

SEQ ID NO: 444461 - protein, 6 aa, Mycobacterium
DASQNH

SEQ ID NO: 444462 - protein, 12 aa, Mycobacterium
DASQRRGQDDAR

SEQ ID NO: 444463 - protein, 11 aa, Mycobacterium
DASQSERPSRP

SEQ ID NO: 444464 - protein, 4 aa, Mycobacterium
DASR

SEQ ID NO: 444465 - protein, 5 aa, Mycobacterium
DASRA

SEQ ID NO: 444466 - protein, 17 aa, Mycobacterium
DASRDEDLAAAANADAR

SEQ ID NO: 444467 - protein, 6 aa, Mycobacterium
DASREH

SEQ ID NO: 444468 - protein, 17 aa, Mycobacterium
DASRGRYERRATDGRDA

SEQ ID NO: 444469 - protein, 5 aa, Mycobacterium
DASRL

SEQ ID NO: 444470 - protein, 10 aa, Mycobacterium
DASRRHPAVT

SEQ ID NO: 444471 - protein, 12 aa, Mycobacterium
DASRSGQPLVEI

SEQ ID NO: 444472 - protein, 12 aa, Mycobacterium
DASRTDQPLVGI

SEQ ID NO: 444473 - protein, 4 aa, Mycobacterium
DASS

SEQ ID NO: 444474 - protein, 8 aa, Mycobacterium
DASSDEEA

SEQ ID NO: 444475 - protein, 10 aa, Mycobacterium
DASSDHRPRG

SEQ ID NO: 444476 - protein, 9 aa, Mycobacterium
DASSEHPYA

SEQ ID NO: 444477 - protein, 9 aa, Mycobacterium
DASSGGHGG

SEQ ID NO: 444478 - protein, 7 aa, Mycobacterium
DASSPRR

SEQ ID NO: 444479 - protein, 18 aa, Mycobacterium
DASSPSEDFGRQPPQDMA

SEQ ID NO: 444480 - protein, 9 aa, Mycobacterium
DASSPSTLN

SEQ ID NO: 444481 - protein, 11 aa, Mycobacterium
DASSSKPRADF

SEQ ID NO: 444482 - protein, 8 aa, Mycobacterium
DASSSPQC

SEQ ID NO: 444483 - protein, 8 aa, Mycobacterium
DASSSTKF

SEQ ID NO: 444484 - protein, 8 aa, Mycobacterium
DASSTDVT

SEQ ID NO: 444485 - protein, 11 aa, Mycobacterium
DASSTRRGRPT

SEQ ID NO: 444486 - protein, 4 aa, Mycobacterium
DAST

SEQ ID NO: 444487 - protein, 7 aa, Mycobacterium
DASTADW

SEQ ID NO: 444488 - protein, 8 aa, Mycobacterium
DASTASRS

SEQ ID NO: 444489 - protein, 8 aa, Mycobacterium
DASTDAAA

SEQ ID NO: 444490 - protein, 9 aa, Mycobacterium
DASTDDSAD

SEQ ID NO: 444491 - protein, 13 aa, Mycobacterium
DASTGSDSDSHAD

SEQ ID NO: 444492 - protein, 8 aa, Mycobacterium
DASTGVDA

SEQ ID NO: 444493 - protein, 5 aa, Mycobacterium
DASTI

SEQ ID NO: 444494 - protein, 8 aa, Mycobacterium
DASTNSTP

SEQ ID NO: 444495 - protein, 15 aa, Mycobacterium
DASTQLGATTSIGTG

SEQ ID NO: 444496 - protein, 20 aa, Mycobacterium
DASTREQAYNLGGTLAAILM

SEQ ID NO: 444497 - protein, 6 aa, Mycobacterium
DASTRI

SEQ ID NO: 444498 - protein, 8 aa, Mycobacterium
DASTSGIR

SEQ ID NO: 444499 - protein, 5 aa, Mycobacterium
DASTW

SEQ ID NO: 444500 - protein, 7 aa, Mycobacterium
DASVNAD

SEQ ID NO: 444501 - protein, 19 aa, Mycobacterium
DASVPRQFKPRRTKFCASG

SEQ ID NO: 444502 - protein, 13 aa, Mycobacterium
DASVSDAQATPPT

SEQ ID NO: 444503 - protein, 15 aa, Mycobacterium
DASVSDPSASPPKFT

SEQ ID NO: 444504 - protein, 7 aa, Mycobacterium
DASVSQP

SEQ ID NO: 444505 - protein, 9 aa, Mycobacterium
DASVTAEGI

SEQ ID NO: 444506 - protein, 12 aa, Mycobacterium
DASVTEGAPGVG

SEQ ID NO: 444507 - protein, 6 aa, Mycobacterium
DASVVT

SEQ ID NO: 444508 - protein, 8 aa, Mycobacterium
DASYATGS

SEQ ID NO: 444509 - protein, 6 aa, Mycobacterium
DASYIS

SEQ ID NO: 444510 - protein, 6 aa, Mycobacterium
DATAAE

SEQ ID NO: 444511 - protein, 6 aa, Mycobacterium
DATAAG

SEQ ID NO: 444512 - protein, 9 aa, Mycobacterium
DATAAHSPD

SEQ ID NO: 444513 - protein, 13 aa, Mycobacterium
DATAAKVSAAGGS

SEQ ID NO: 444514 - protein, 7 aa, Mycobacterium
DATAAPR

SEQ ID NO: 444515 - protein, 11 aa, Mycobacterium
DATAARAELEA

SEQ ID NO: 444516 - protein, 8 aa, Mycobacterium
DATAASRV

SEQ ID NO: 444517 - protein, 19 aa, Mycobacterium
DATAATPAGCPVPHAPRVS

SEQ ID NO: 444518 - protein, 13 aa, Mycobacterium
DATADAADDVRDA

SEQ ID NO: 444519 - protein, 10 aa, Mycobacterium
DATADDARAA

SEQ ID NO: 444520 - protein, 7 aa, Mycobacterium
DATADSV

SEQ ID NO: 444521 - protein, 7 aa, Mycobacterium
DATAEDA

SEQ ID NO: 444522 - protein, 10 aa, Mycobacterium
DATAEDMGDA

SEQ ID NO: 444523 - protein, 6 aa, Mycobacterium
DATAEE

SEQ ID NO: 444524 - protein, 10 aa, Mycobacterium
DATAESRRTT

SEQ ID NO: 444525 - protein, 7 aa, Mycobacterium
DATAETF

SEQ ID NO: 444526 - protein, 9 aa, Mycobacterium
DATAGGGAG

SEQ ID NO: 444527 - protein, 6 aa, Mycobacterium
DATAGH

SEQ ID NO: 444528 - protein, 15 aa, Mycobacterium
DATAIADGYASQDPA

SEQ ID NO: 444529 - protein, 7 aa, Mycobacterium
DATAKVA

SEQ ID NO: 444530 - protein, 19 aa, Mycobacterium
DATALSTGDTVDVLPPFAG

SEQ ID NO: 444531 - protein, 6 aa, Mycobacterium
DATANR

SEQ ID NO: 444532 - protein, 6 aa, Mycobacterium
DATAPG

SEQ ID NO: 444533 - protein, 7 aa, Mycobacterium
DATAQEL

SEQ ID NO: 444534 - protein, 5 aa, Mycobacterium
DATAR

SEQ ID NO: 444535 - protein, 6 aa, Mycobacterium
DATARA

SEQ ID NO: 444536 - protein, 8 aa, Mycobacterium
DATARAGL

SEQ ID NO: 444537 - protein, 7 aa, Mycobacterium
DATARAR

SEQ ID NO: 444538 - protein, 15 aa, Mycobacterium
DATARARSRSRAKAR

SEQ ID NO: 444539 - protein, 10 aa, Mycobacterium
DATARGVRDG

SEQ ID NO: 444540 - protein, 8 aa, Mycobacterium
DATASVGS

SEQ ID NO: 444541 - protein, 9 aa, Mycobacterium
DATATAQSL

SEQ ID NO: 444542 - protein, 14 aa, Mycobacterium
DATATLAEAGIDSA

SEQ ID NO: 444543 - protein, 8 aa, Mycobacterium
DATATTTA

SEQ ID NO: 444544 - protein, 7 aa, Mycobacterium
DATATTV

SEQ ID NO: 444545 - protein, 8 aa, Mycobacterium
DATATTVE

SEQ ID NO: 444546 - protein, 6 aa, Mycobacterium
DATAVS

SEQ ID NO: 444547 - protein, 4 aa, Mycobacterium
DATD

SEQ ID NO: 444548 - protein, 5 aa, Mycobacterium
DATDA

SEQ ID NO: 444549 - protein, 14 aa, Mycobacterium
DATDADGKRGRAAT

SEQ ID NO: 444550 - protein, 10 aa, Mycobacterium
DATDAERDEY

SEQ ID NO: 444551 - protein, 9 aa, Mycobacterium
DATDAERDR

SEQ ID NO: 444552 - protein, 9 aa, Mycobacterium
DATDAERER

SEQ ID NO: 444553 - protein, 7 aa, Mycobacterium
DATDALG

SEQ ID NO: 444554 - protein, 8 aa, Mycobacterium
DATDAPDR

SEQ ID NO: 444555 - protein, 6 aa, Mycobacterium
DATDDE

SEQ ID NO: 444556 - protein, 10 aa, Mycobacterium
DATDEEESVH

SEQ ID NO: 444557 - protein, 11 aa, Mycobacterium
DATDEPNEKYR

SEQ ID NO: 444558 - protein, 7 aa, Mycobacterium
DATDGAT

SEQ ID NO: 444559 - protein, 8 aa, Mycobacterium
DATDGNEF

SEQ ID NO: 444560 - protein, 8 aa, Mycobacterium
DATDPQAQ

SEQ ID NO: 444561 - protein, 8 aa, Mycobacterium
DATDPRQL

SEQ ID NO: 444562 - protein, 7 aa, Mycobacterium
DATDRDA

SEQ ID NO: 444563 - protein, 7 aa, Mycobacterium
DATDTLT

SEQ ID NO: 444564 - protein, 13 aa, Mycobacterium
DATDYNGTGIGNM

SEQ ID NO: 444565 - protein, 5 aa, Mycobacterium
DATEA

SEQ ID NO: 444566 - protein, 5 aa, Mycobacterium
DATED

SEQ ID NO: 444567 - protein, 14 aa, Mycobacterium
DATEDRPVSITEGG

SEQ ID NO: 444568 - protein, 5 aa, Mycobacterium
DATEP

SEQ ID NO: 444569 - protein, 8 aa, Mycobacterium
DATEREAR

SEQ ID NO: 444570 - protein, 6 aa, Mycobacterium
DATERV

SEQ ID NO: 444571 - protein, 10 aa, Mycobacterium
DATESQREIR

SEQ ID NO: 444572 - protein, 9 aa, Mycobacterium
DATETTAPT

SEQ ID NO: 444573 - protein, 8 aa, Mycobacterium
DATEVSER

SEQ ID NO: 444574 - protein, 4 aa, Mycobacterium
DATF

SEQ ID NO: 444575 - protein, 5 aa, Mycobacterium
DATFG

SEQ ID NO: 444576 - protein, 8 aa, Mycobacterium
DATGAEPI

SEQ ID NO: 444577 - protein, 9 aa, Mycobacterium
DATGAEPVS

SEQ ID NO: 444578 - protein, 6 aa, Mycobacterium
DATGAG

SEQ ID NO: 444579 - protein, 8 aa, Mycobacterium
DATGAGSE

SEQ ID NO: 444580 - protein, 7 aa, Mycobacterium
DATGARA

SEQ ID NO: 444581 - protein, 8 aa, Mycobacterium
DATGASDQ

SEQ ID NO: 444582 - protein, 6 aa, Mycobacterium
DATGDH

SEQ ID NO: 444583 - protein, 11 aa, Mycobacterium
DATGDKSTMPS

SEQ ID NO: 444584 - protein, 10 aa, Mycobacterium
DATGDQAAMP

SEQ ID NO: 444585 - protein, 8 aa, Mycobacterium
DATGETQE

SEQ ID NO: 444586 - protein, 6 aa, Mycobacterium
DATGGA

SEQ ID NO: 444587 - protein, 6 aa, Mycobacterium
DATGGL

SEQ ID NO: 444588 - protein, 9 aa, Mycobacterium
DATGGQPVS

SEQ ID NO: 444589 - protein, 6 aa, Mycobacterium
DATGGR

SEQ ID NO: 444590 - protein, 8 aa, Mycobacterium
DATGGSDQ

SEQ ID NO: 444591 - protein, 5 aa, Mycobacterium
DATGL

SEQ ID NO: 444592 - protein, 11 aa, Mycobacterium
DATGNAAYTGV

SEQ ID NO: 444593 - protein, 6 aa, Mycobacterium
DATGNT

SEQ ID NO: 444594 - protein, 8 aa, Mycobacterium
DATGPALG

SEQ ID NO: 444595 - protein, 23 aa, Mycobacterium
DATGPGRKPVIGGNADKEEKVGA

SEQ ID NO: 444596 - protein, 7 aa, Mycobacterium
DATGPVE

SEQ ID NO: 444597 - protein, 8 aa, Mycobacterium
DATGPVGE

SEQ ID NO: 444598 - protein, 10 aa, Mycobacterium
DATGRTPQRL

SEQ ID NO: 444599 - protein, 7 aa, Mycobacterium
DATGSAL

SEQ ID NO: 444600 - protein, 5 aa, Mycobacterium
DATGT

SEQ ID NO: 444601 - protein, 7 aa, Mycobacterium
DATGVRV

SEQ ID NO: 444602 - protein, 7 aa, Mycobacterium
DATGVSN

SEQ ID NO: 444603 - protein, 15 aa, Mycobacterium
DATHGPSLRDANERR

SEQ ID NO: 444604 - protein, 5 aa, Mycobacterium
DATIS

SEQ ID NO: 444605 - protein, 8 aa, Mycobacterium
DATITEAA

SEQ ID NO: 444606 - protein, 11 aa, Mycobacterium
DATKGTDPLSA

SEQ ID NO: 444607 - protein, 5 aa, Mycobacterium
DATKH

SEQ ID NO: 444608 - protein, 11 aa, Mycobacterium
DATLEDPFGGG

SEQ ID NO: 444609 - protein, 9 aa, Mycobacterium
DATLPQPVT

SEQ ID NO: 444610 - protein, 16 aa, Mycobacterium
DATMTAGNSTPLTDGA

SEQ ID NO: 444611 - protein, 8 aa, Mycobacterium
DATNGIDP

SEQ ID NO: 444612 - protein, 8 aa, Mycobacterium
DATNGTDP

SEQ ID NO: 444613 - protein, 8 aa, Mycobacterium
DATNGVDP

SEQ ID NO: 444614 - protein, 5 aa, Mycobacterium
DATNN

SEQ ID NO: 444615 - protein, 7 aa, Mycobacterium
DATPAAE

SEQ ID NO: 444616 - protein, 7 aa, Mycobacterium
DATPALR

SEQ ID NO: 444617 - protein, 8 aa, Mycobacterium
DATPEELG

SEQ ID NO: 444618 - protein, 6 aa, Mycobacterium
DATPEQ

SEQ ID NO: 444619 - protein, 6 aa, Mycobacterium
DATPER

SEQ ID NO: 444620 - protein, 8 aa, Mycobacterium
DATPGTLE

SEQ ID NO: 444621 - protein, 6 aa, Mycobacterium
DATPMS

SEQ ID NO: 444622 - protein, 14 aa, Mycobacterium
DATPPADWDKPLDG

SEQ ID NO: 444623 - protein, 22 aa, Mycobacterium
DATPPARRRRRRRAGSRGVRGS

SEQ ID NO: 444624 - protein, 7 aa, Mycobacterium
DATPPDY

SEQ ID NO: 444625 - protein, 6 aa, Mycobacterium
DATPRL

SEQ ID NO: 444626 - protein, 9 aa, Mycobacterium
DATPSQREI

SEQ ID NO: 444627 - protein, 8 aa, Mycobacterium
DATPTGTK

SEQ ID NO: 444628 - protein, 13 aa, Mycobacterium
DATQLDTAATGTT

SEQ ID NO: 444629 - protein, 10 aa, Mycobacterium
DATQRPSDLE

SEQ ID NO: 444630 - protein, 8 aa, Mycobacterium
DATQYTPR

SEQ ID NO: 444631 - protein, 13 aa, Mycobacterium
DATRAAGEISAPG

SEQ ID NO: 444632 - protein, 7 aa, Mycobacterium
DATRAIA

SEQ ID NO: 444633 - protein, 8 aa, Mycobacterium
DATRASQI

SEQ ID NO: 444634 - protein, 5 aa, Mycobacterium
DATRG

SEQ ID NO: 444635 - protein, 7 aa, Mycobacterium
DATRHAG

SEQ ID NO: 444636 - protein, 7 aa, Mycobacterium
DATRNRE

SEQ ID NO: 444637 - protein, 7 aa, Mycobacterium
DATRPRF

SEQ ID NO: 444638 - protein, 7 aa, Mycobacterium
DATRSAD

SEQ ID NO: 444639 - protein, 6 aa, Mycobacterium
DATRSG

SEQ ID NO: 444640 - protein, 6 aa, Mycobacterium
DATRTG

SEQ ID NO: 444641 - protein, 9 aa, Mycobacterium
DATRYGPAC

SEQ ID NO: 444642 - protein, 6 aa, Mycobacterium
DATSAE

SEQ ID NO: 444643 - protein, 10 aa, Mycobacterium
DATSFGPACP

SEQ ID NO: 444644 - protein, 6 aa, Mycobacterium
DATSGV

SEQ ID NO: 444645 - protein, 12 aa, Mycobacterium
DATSRAAYSSDA

SEQ ID NO: 444646 - protein, 15 aa, Mycobacterium
DATSRARSRARAKAR

SEQ ID NO: 444647 - protein, 15 aa, Mycobacterium
DATSRARSRSRAKAR

SEQ ID NO: 444648 - protein, 10 aa, Mycobacterium
DATSSSPGAV

SEQ ID NO: 444649 - protein, 8 aa, Mycobacterium
DATSTSRH

SEQ ID NO: 444650 - protein, 6 aa, Mycobacterium
DATSWD

SEQ ID NO: 444651 - protein, 10 aa, Mycobacterium
DATTAPDPMN

SEQ ID NO: 444652 - protein, 6 aa, Mycobacterium
DATTER

SEQ ID NO: 444653 - protein, 8 aa, Mycobacterium
DATTGGDE

SEQ ID NO: 444654 - protein, 6 aa, Mycobacterium
DATTGT

SEQ ID NO: 444655 - protein, 7 aa, Mycobacterium
DATTLAT

SEQ ID NO: 444656 - protein, 8 aa, Mycobacterium
DATTLDGY

SEQ ID NO: 444657 - protein, 6 aa, Mycobacterium
DATTPA

SEQ ID NO: 444658 - protein, 15 aa, Mycobacterium
DATTRARSRSRAKAR

SEQ ID NO: 444659 - protein, 32 aa, Mycobacterium
DATTRKAPEANGKRAPAKGRRRAVSKAGDRPA

SEQ ID NO: 444660 - protein, 9 aa, Mycobacterium
DATTTAAPE

SEQ ID NO: 444661 - protein, 6 aa, Mycobacterium
DATVDD

SEQ ID NO: 444662 - protein, 10 aa, Mycobacterium
DATVDDPHEV

SEQ ID NO: 444663 - protein, 6 aa, Mycobacterium
DATVDE

SEQ ID NO: 444664 - protein, 7 aa, Mycobacterium
DATVDPR

SEQ ID NO: 444665 - protein, 8 aa, Mycobacterium
DATVEDPL

SEQ ID NO: 444666 - protein, 12 aa, Mycobacterium
DATVEDPVGSGE

SEQ ID NO: 444667 - protein, 10 aa, Mycobacterium
DATVKGGTYY

SEQ ID NO: 444668 - protein, 13 aa, Mycobacterium
DATVQGAAGTAGD

SEQ ID NO: 444669 - protein, 5 aa, Mycobacterium
DATVR

SEQ ID NO: 444670 - protein, 10 aa, Mycobacterium
DATWSRKTAA

SEQ ID NO: 444671 - protein, 6 aa, Mycobacterium
DATYEQ

SEQ ID NO: 444672 - protein, 6 aa, Mycobacterium
DAVAAG

SEQ ID NO: 444673 - protein, 9 aa, Mycobacterium
DAVADEDVK

SEQ ID NO: 444674 - protein, 7 aa, Mycobacterium
DAVADGD

SEQ ID NO: 444675 - protein, 8 aa, Mycobacterium
DAVADTPE

SEQ ID NO: 444676 - protein, 9 aa, Mycobacterium
DAVAEVNDE

SEQ ID NO: 444677 - protein, 12 aa, Mycobacterium
DAVAGGTKSSYL

SEQ ID NO: 444678 - protein, 6 aa, Mycobacterium
DAVAGL

SEQ ID NO: 444679 - protein, 5 aa, Mycobacterium
DAVAK

SEQ ID NO: 444680 - protein, 12 aa, Mycobacterium
DAVAKGGPGIGE

SEQ ID NO: 444681 - protein, 7 aa, Mycobacterium
DAVAPTE

SEQ ID NO: 444682 - protein, 17 aa, Mycobacterium
DAVASSPSGYLKTPDGW

SEQ ID NO: 444683 - protein, 18 aa, Mycobacterium
DAVDADEQRELEARAAGL

SEQ ID NO: 444684 - protein, 12 aa, Mycobacterium
DAVDDRVDPGLR

SEQ ID NO: 444685 - protein, 7 aa, Mycobacterium
DAVDEAG

SEQ ID NO: 444686 - protein, 10 aa, Mycobacterium
DAVDEVPADR

SEQ ID NO: 444687 - protein, 11 aa, Mycobacterium
DAVDKGATLHT

SEQ ID NO: 444688 - protein, 10 aa, Mycobacterium
DAVDPDSLQP

SEQ ID NO: 444689 - protein, 11 aa, Mycobacterium
DAVDPISRQPE

SEQ ID NO: 444690 - protein, 12 aa, Mycobacterium
DAVDPISRQPEY

SEQ ID NO: 444691 - protein, 15 aa, Mycobacterium
DAVDQARRIGTGAEG

SEQ ID NO: 444692 - protein, 7 aa, Mycobacterium
DAVDRET

SEQ ID NO: 444693 - protein, 4 aa, Mycobacterium
DAVE

SEQ ID NO: 444694 - protein, 5 aa, Mycobacterium
DAVED

SEQ ID NO: 444695 - protein, 9 aa, Mycobacterium
DAVEEGYRR

SEQ ID NO: 444696 - protein, 5 aa, Mycobacterium
DAVER

SEQ ID NO: 444697 - protein, 4 aa, Mycobacterium
DAVG

SEQ ID NO: 444698 - protein, 5 aa, Mycobacterium
DAVGE

SEQ ID NO: 444699 - protein, 11 aa, Mycobacterium
DAVGEPGELTR

SEQ ID NO: 444700 - protein, 8 aa, Mycobacterium
DAVGGTGF

SEQ ID NO: 444701 - protein, 7 aa, Mycobacterium
DAVGPDT

SEQ ID NO: 444702 - protein, 20 aa, Mycobacterium
DAVGPSADDQLAPPDSPEAQ

SEQ ID NO: 444703 - protein, 7 aa, Mycobacterium
DAVGPVP

SEQ ID NO: 444704 - protein, 9 aa, Mycobacterium
DAVGRYGPA

SEQ ID NO: 444705 - protein, 6 aa, Mycobacterium
DAVKDG

SEQ ID NO: 444706 - protein, 12 aa, Mycobacterium
DAVKDNDSRFPP

SEQ ID NO: 444707 - protein, 6 aa, Mycobacterium
DAVNDD

SEQ ID NO: 444708 - protein, 14 aa, Mycobacterium
DAVNGRGPAEPGKG

SEQ ID NO: 444709 - protein, 8 aa, Mycobacterium
DAVNPDGV

SEQ ID NO: 444710 - protein, 8 aa, Mycobacterium
DAVNRRRS

SEQ ID NO: 444711 - protein, 6 aa, Mycobacterium
DAVNSD

SEQ ID NO: 444712 - protein, 4 aa, Mycobacterium
DAVP

SEQ ID NO: 444713 - protein, 5 aa, Mycobacterium
DAVPG

SEQ ID NO: 444714 - protein, 10 aa, Mycobacterium
DAVPIGDPLP

SEQ ID NO: 444715 - protein, 5 aa, Mycobacterium
DAVPP

SEQ ID NO: 444716 - protein, 6 aa, Mycobacterium
DAVPPG

SEQ ID NO: 444717 - protein, 8 aa, Mycobacterium
DAVPPKVR

SEQ ID NO: 444718 - protein, 5 aa, Mycobacterium
DAVPR

SEQ ID NO: 444719 - protein, 15 aa, Mycobacterium
DAVPSELAPLSEPAS

SEQ ID NO: 444720 - protein, 7 aa, Mycobacterium
DAVPTDP

SEQ ID NO: 444721 - protein, 7 aa, Mycobacterium
DAVQASV

SEQ ID NO: 444722 - protein, 7 aa, Mycobacterium
DAVQPDE

SEQ ID NO: 444723 - protein, 8 aa, Mycobacterium
DAVQPGSN

SEQ ID NO: 444724 - protein, 8 aa, Mycobacterium
DAVQRGKQ

SEQ ID NO: 444725 - protein, 9 aa, Mycobacterium
DAVRAGRPT

SEQ ID NO: 444726 - protein, 14 aa, Mycobacterium
DAVRASQRLRGEDP

SEQ ID NO: 444727 - protein, 6 aa, Mycobacterium
DAVRDG

SEQ ID NO: 444728 - protein, 8 aa, Mycobacterium
DAVRDGDR

SEQ ID NO: 444729 - protein, 13 aa, Mycobacterium
DAVRGLGTPEIPS

SEQ ID NO: 444730 - protein, 9 aa, Mycobacterium
DAVRKQAAE

SEQ ID NO: 444731 - protein, 7 aa, Mycobacterium
DAVRPGD

SEQ ID NO: 444732 - protein, 16 aa, Mycobacterium
DAVRPQGRHHRREDRS

SEQ ID NO: 444733 - protein, 15 aa, Mycobacterium
DAVRQEERVPGNRAP

SEQ ID NO: 444734 - protein, 13 aa, Mycobacterium
DAVRRNAAQTPNR

SEQ ID NO: 444735 - protein, 8 aa, Mycobacterium
DAVRRRSG

SEQ ID NO: 444736 - protein, 16 aa, Mycobacterium
DAVRRSQLNRGEDPTL

SEQ ID NO: 444737 - protein, 16 aa, Mycobacterium
DAVRRSQLSRGEDPTL

SEQ ID NO: 444738 - protein, 7 aa, Mycobacterium
DAVRSDA

SEQ ID NO: 444739 - protein, 20 aa, Mycobacterium
DAVSGQTDAGAAMSGFGPGT

SEQ ID NO: 444740 - protein, 7 aa, Mycobacterium
DAVSPDY

SEQ ID NO: 444741 - protein, 8 aa, Mycobacterium
DAVSPNDD

SEQ ID NO: 444742 - protein, 8 aa, Mycobacterium
DAVSRDPE

SEQ ID NO: 444743 - protein, 8 aa, Mycobacterium
DAVSTAEA

SEQ ID NO: 444744 - protein, 17 aa, Mycobacterium
DAVSTSTADNPNALATR

SEQ ID NO: 444745 - protein, 18 aa, Mycobacterium
DAVSTSTADNPNALETRP

SEQ ID NO: 444746 - protein, 11 aa, Mycobacterium
DAVTAANATEF

SEQ ID NO: 444747 - protein, 6 aa, Mycobacterium
DAVTAG

SEQ ID NO: 444748 - protein, 7 aa, Mycobacterium
DAVTAGT

SEQ ID NO: 444749 - protein, 6 aa, Mycobacterium
DAVTGA

SEQ ID NO: 444750 - protein, 12 aa, Mycobacterium
DAVTGGAAQRGR

SEQ ID NO: 444751 - protein, 7 aa, Mycobacterium
DAVTGTA

SEQ ID NO: 444752 - protein, 18 aa, Mycobacterium
DAVTPEDAGLAAGADRRV

SEQ ID NO: 444753 - protein, 6 aa, Mycobacterium
DAVTTA

SEQ ID NO: 444754 - protein, 8 aa, Mycobacterium
DAVTTADA

SEQ ID NO: 444755 - protein, 8 aa, Mycobacterium
DAVTTDRK

SEQ ID NO: 444756 - protein, 9 aa, Mycobacterium
DAVTTTSLP

SEQ ID NO: 444757 - protein, 12 aa, Mycobacterium
DAVVGEPGKGWE

SEQ ID NO: 444758 - protein, 13 aa, Mycobacterium
DAWAPSPAAAHGD

SEQ ID NO: 444759 - protein, 6 aa, Mycobacterium
DAWEPA

SEQ ID NO: 444760 - protein, 20 aa, Mycobacterium
DAWTGNARATIDPNHTPAVE

SEQ ID NO: 444761 - protein, 11 aa, Mycobacterium
DAYAGDDDERT

SEQ ID NO: 444762 - protein, 18 aa, Mycobacterium
DAYARGDTVATSDRPPHE

SEQ ID NO: 444763 - protein, 11 aa, Mycobacterium
DAYATGERLPE

SEQ ID NO: 444764 - protein, 5 aa, Mycobacterium
DAYDQ

SEQ ID NO: 444765 - protein, 4 aa, Mycobacterium
DAYE

SEQ ID NO: 444766 - protein, 20 aa, Mycobacterium
DAYEGPDAGTRWLREHPDGI

SEQ ID NO: 444767 - protein, 4 aa, Mycobacterium
DAYG

SEQ ID NO: 444768 - protein, 10 aa, Mycobacterium
DAYGRYPTPV

SEQ ID NO: 444769 - protein, 7 aa, Mycobacterium
DAYKTKI

SEQ ID NO: 444770 - protein, 10 aa, Mycobacterium
DAYKVTGKAP

SEQ ID NO: 444771 - protein, 4 aa, Mycobacterium
DAYL

SEQ ID NO: 444772 - protein, 7 aa, Mycobacterium
DAYPDPH

SEQ ID NO: 444773 - protein, 7 aa, Mycobacterium
DAYPERL

SEQ ID NO: 444774 - protein, 6 aa, Mycobacterium
DAYPIE

SEQ ID NO: 444775 - protein, 6 aa, Mycobacterium
DAYPQR

SEQ ID NO: 444776 - protein, 7 aa, Mycobacterium
DAYPRTL

SEQ ID NO: 444777 - protein, 4 aa, Mycobacterium
DAYQ

SEQ ID NO: 444778 - protein, 4 aa, Mycobacterium
DAYR

SEQ ID NO: 444779 - protein, 10 aa, Mycobacterium
DAYRAPANPI

SEQ ID NO: 444780 - protein, 12 aa, Mycobacterium
DAYSGEAGEIDN

SEQ ID NO: 444781 - protein, 7 aa, Mycobacterium
DAYSSEE

SEQ ID NO: 444782 - protein, 8 aa, Mycobacterium
DAYSSTTA

SEQ ID NO: 444783 - protein, 20 aa, Mycobacterium
DAYTQRFESEPVPAPLTDPA

SEQ ID NO: 444784 - protein, 12 aa, Mycobacterium
DCAGGDARRLDG

SEQ ID NO: 444785 - protein, 9 aa, Mycobacterium
DCANGSGGQ

SEQ ID NO: 444786 - protein, 5 aa, Mycobacterium
DCARD

SEQ ID NO: 444787 - protein, 8 aa, Mycobacterium
DCARRTAE

SEQ ID NO: 444788 - protein, 8 aa, Mycobacterium
DCASPSGI

SEQ ID NO: 444789 - protein, 7 aa, Mycobacterium
DCATAGR

SEQ ID NO: 444790 - protein, 5 aa, Mycobacterium
DCDAA

SEQ ID NO: 444791 - protein, 5 aa, Mycobacterium
DCDAS

SEQ ID NO: 444792 - protein, 9 aa, Mycobacterium
DCDASQKPF

SEQ ID NO: 444793 - protein, 5 aa, Mycobacterium
DCDDP

SEQ ID NO: 444794 - protein, 8 aa, Mycobacterium
DCDGDDDV

SEQ ID NO: 444795 - protein, 4 aa, Mycobacterium
DCDP

SEQ ID NO: 444796 - protein, 7 aa, Mycobacterium
DCEAAGD

SEQ ID NO: 444797 - protein, 11 aa, Mycobacterium
DCEAGARTTSS

SEQ ID NO: 444798 - protein, 8 aa, Mycobacterium
DCEDPELT

SEQ ID NO: 444799 - protein, 6 aa, Mycobacterium
DCEGEP

SEQ ID NO: 444800 - protein, 4 aa, Mycobacterium
DCEP

SEQ ID NO: 444801 - protein, 6 aa, Mycobacterium
DCEPGV

SEQ ID NO: 444802 - protein, 11 aa, Mycobacterium
DCERRDPKGLY

SEQ ID NO: 444803 - protein, 13 aa, Mycobacterium
DCETDVGAATALS

SEQ ID NO: 444804 - protein, 11 aa, Mycobacterium
DCETEHGAAAA

SEQ ID NO: 444805 - protein, 7 aa, Mycobacterium
DCETERG

SEQ ID NO: 444806 - protein, 11 aa, Mycobacterium
DCETGPGAAAA

SEQ ID NO: 444807 - protein, 4 aa, Mycobacterium
DCGA

SEQ ID NO: 444808 - protein, 7 aa, Mycobacterium
DCGESPH

SEQ ID NO: 444809 - protein, 4 aa, Mycobacterium
DCGG

SEQ ID NO: 444810 - protein, 7 aa, Mycobacterium
DCGGSGM

SEQ ID NO: 444811 - protein, 5 aa, Mycobacterium
DCGST

SEQ ID NO: 444812 - protein, 11 aa, Mycobacterium
DCGTKGQWTEP

SEQ ID NO: 444813 - protein, 12 aa, Mycobacterium
DCNGGKSSMPAD

SEQ ID NO: 444814 - protein, 5 aa, Mycobacterium
DCPAA

SEQ ID NO: 444815 - protein, 13 aa, Mycobacterium
DCPAAADGDARAT

SEQ ID NO: 444816 - protein, 9 aa, Mycobacterium
DCPAPTGNA

SEQ ID NO: 444817 - protein, 4 aa, Mycobacterium
DCPD

SEQ ID NO: 444818 - protein, 14 aa, Mycobacterium
DCPEQSDGDDDWGF

SEQ ID NO: 444819 - protein, 4 aa, Mycobacterium
DCPG

SEQ ID NO: 444820 - protein, 7 aa, Mycobacterium
DCPGTDQ

SEQ ID NO: 444821 - protein, 4 aa, Mycobacterium
DCPT

SEQ ID NO: 444822 - protein, 12 aa, Mycobacterium
DCQGTGVTTRTR

SEQ ID NO: 444823 - protein, 6 aa, Mycobacterium
DCQRGQ

SEQ ID NO: 444824 - protein, 7 aa, Mycobacterium
DCQRGQE

SEQ ID NO: 444825 - protein, 10 aa, Mycobacterium
DCRDDAAHGK

SEQ ID NO: 444826 - protein, 7 aa, Mycobacterium
DCRDDFG

SEQ ID NO: 444827 - protein, 7 aa, Mycobacterium
DCRGSGS

SEQ ID NO: 444828 - protein, 7 aa, Mycobacterium
DCRKPGA

SEQ ID NO: 444829 - protein, 8 aa, Mycobacterium
DCRKPGTG

SEQ ID NO: 444830 - protein, 15 aa, Mycobacterium
DCRTQNQPGTTDEYP

SEQ ID NO: 444831 - protein, 14 aa, Mycobacterium
DCRVPDGADVMHSG

SEQ ID NO: 444832 - protein, 5 aa, Mycobacterium
DCSNG

SEQ ID NO: 444833 - protein, 7 aa, Mycobacterium
DCSSEDV

SEQ ID NO: 444834 - protein, 10 aa, Mycobacterium
DCSSGTGGAF

SEQ ID NO: 444835 - protein, 7 aa, Mycobacterium
DCSTQTM

SEQ ID NO: 444836 - protein, 11 aa, Mycobacterium
DCTAAARSAPS

SEQ ID NO: 444837 - protein, 7 aa, Mycobacterium
DCTDAPL

SEQ ID NO: 444838 - protein, 5 aa, Mycobacterium
DCTDE

SEQ ID NO: 444839 - protein, 7 aa, Mycobacterium
DCTGTLP

SEQ ID NO: 444840 - protein, 13 aa, Mycobacterium
DCTNAASLEQQSE

SEQ ID NO: 444841 - protein, 13 aa, Mycobacterium
DCTNAASLQQQSE

SEQ ID NO: 444842 - protein, 13 aa, Mycobacterium
DCTNAESLKQQSE

SEQ ID NO: 444843 - protein, 12 aa, Mycobacterium
DCTNATSLQQQA

SEQ ID NO: 444844 - protein, 4 aa, Mycobacterium
DDAA

SEQ ID NO: 444845 - protein, 6 aa, Mycobacterium
DDAAAQ

SEQ ID NO: 444846 - protein, 10 aa, Mycobacterium
DDAAARAQLT

SEQ ID NO: 444847 - protein, 6 aa, Mycobacterium
DDAAAV

SEQ ID NO: 444848 - protein, 9 aa, Mycobacterium
DDAADALRG

SEQ ID NO: 444849 - protein, 13 aa, Mycobacterium
DDAADGYGRGEGA

SEQ ID NO: 444850 - protein, 8 aa, Mycobacterium
DDAADLGL

SEQ ID NO: 444851 - protein, 8 aa, Mycobacterium
DDAADLSD

SEQ ID NO: 444852 - protein, 8 aa, Mycobacterium
DDAADNVP

SEQ ID NO: 444853 - protein, 8 aa, Mycobacterium
DDAADRDA

SEQ ID NO: 444854 - protein, 7 aa, Mycobacterium
DDAAEHQ

SEQ ID NO: 444855 - protein, 6 aa, Mycobacterium
DDAAEP

SEQ ID NO: 444856 - protein, 7 aa, Mycobacterium
DDAAERF

SEQ ID NO: 444857 - protein, 5 aa, Mycobacterium
DDAAG

SEQ ID NO: 444858 - protein, 7 aa, Mycobacterium
DDAAGGL

SEQ ID NO: 444859 - protein, 12 aa, Mycobacterium
DDAAKDPRAQGL

SEQ ID NO: 444860 - protein, 6 aa, Mycobacterium
DDAAKR

SEQ ID NO: 444861 - protein, 8 aa, Mycobacterium
DDAAPDRV

SEQ ID NO: 444862 - protein, 6 aa, Mycobacterium
DDAAPP

SEQ ID NO: 444863 - protein, 8 aa, Mycobacterium
DDAARARE

SEQ ID NO: 444864 - protein, 6 aa, Mycobacterium
DDAARC

SEQ ID NO: 444865 - protein, 7 aa, Mycobacterium
DDAARCA

SEQ ID NO: 444866 - protein, 8 aa, Mycobacterium
DDAARDAV

SEQ ID NO: 444867 - protein, 8 aa, Mycobacterium
DDAARDRA

SEQ ID NO: 444868 - protein, 7 aa, Mycobacterium
DDAARQS

SEQ ID NO: 444869 - protein, 19 aa, Mycobacterium
DDAARSVDIERGASAAIPP

SEQ ID NO: 444870 - protein, 8 aa, Mycobacterium
DDAATALT

SEQ ID NO: 444871 - protein, 11 aa, Mycobacterium
DDAATKKRRGE

SEQ ID NO: 444872 - protein, 9 aa, Mycobacterium
DDAATRAAD

SEQ ID NO: 444873 - protein, 11 aa, Mycobacterium
DDAATSAATRD

SEQ ID NO: 444874 - protein, 4 aa, Mycobacterium
DDAC

SEQ ID NO: 444875 - protein, 6 aa, Mycobacterium
DDADAL

SEQ ID NO: 444876 - protein, 26 aa, Mycobacterium
DDADAQLAGYPSAAAARSDVGAQDAA

SEQ ID NO: 444877 - protein, 5 aa, Mycobacterium
DDADD

SEQ ID NO: 444878 - protein, 7 aa, Mycobacterium
DDADDAR

SEQ ID NO: 444879 - protein, 10 aa, Mycobacterium
DDADEREVTP

SEQ ID NO: 444880 - protein, 33 aa, Mycobacterium
DDADGDAGVDADGDTENSAEPADADSADAAQGA

SEQ ID NO: 444881 - protein, 10 aa, Mycobacterium
DDADGPSPRE

SEQ ID NO: 444882 - protein, 7 aa, Mycobacterium
DDADLSD

SEQ ID NO: 444883 - protein, 7 aa, Mycobacterium
DDADNDE

SEQ ID NO: 444884 - protein, 5 aa, Mycobacterium
DDADQ

SEQ ID NO: 444885 - protein, 8 aa, Mycobacterium
DDADRSAL

SEQ ID NO: 444886 - protein, 25 aa, Mycobacterium
DDADSTRRRAQRARQGGEPQARTRP

SEQ ID NO: 444887 - protein, 4 aa, Mycobacterium
DDAE

SEQ ID NO: 444888 - protein, 8 aa, Mycobacterium
DDAEAQPA

SEQ ID NO: 444889 - protein, 7 aa, Mycobacterium
DDAEASL

SEQ ID NO: 444890 - protein, 5 aa, Mycobacterium
DDAEF

SEQ ID NO: 444891 - protein, 7 aa, Mycobacterium
DDAEGQR

SEQ ID NO: 444892 - protein, 6 aa, Mycobacterium
DDAEIR

SEQ ID NO: 444893 - protein, 8 aa, Mycobacterium
DDAEIRDV

SEQ ID NO: 444894 - protein, 12 aa, Mycobacterium
DDAEKAREIGRG

SEQ ID NO: 444895 - protein, 8 aa, Mycobacterium
DDAELGRR

SEQ ID NO: 444896 - protein, 7 aa, Mycobacterium
DDAENRA

SEQ ID NO: 444897 - protein, 5 aa, Mycobacterium
DDAEP

SEQ ID NO: 444898 - protein, 6 aa, Mycobacterium
DDAEQR

SEQ ID NO: 444899 - protein, 7 aa, Mycobacterium
DDAERAK

SEQ ID NO: 444900 - protein, 6 aa, Mycobacterium
DDAERG

SEQ ID NO: 444901 - protein, 7 aa, Mycobacterium
DDAERGV

SEQ ID NO: 444902 - protein, 15 aa, Mycobacterium
DDAERLTGASGLSTV

SEQ ID NO: 444903 - protein, 10 aa, Mycobacterium
DDAERQAAEK

SEQ ID NO: 444904 - protein, 7 aa, Mycobacterium
DDAERQE

SEQ ID NO: 444905 - protein, 8 aa, Mycobacterium
DDAESRTS

SEQ ID NO: 444906 - protein, 11 aa, Mycobacterium
DDAETANAAAA

SEQ ID NO: 444907 - protein, 12 aa, Mycobacterium
DDAETARRTAAE

SEQ ID NO: 444908 - protein, 8 aa, Mycobacterium
DDAEVSTP

SEQ ID NO: 444909 - protein, 4 aa, Mycobacterium
DDAF

SEQ ID NO: 444910 - protein, 9 aa, Mycobacterium
DDAGARAGL

SEQ ID NO: 444911 - protein, 11 aa, Mycobacterium
DDAGDEQEAAV

SEQ ID NO: 444912 - protein, 9 aa, Mycobacterium
DDAGDPALS

SEQ ID NO: 444913 - protein, 5 aa, Mycobacterium
DDAGG

SEQ ID NO: 444914 - protein, 17 aa, Mycobacterium
DDAGKPIHQRGVSSEPG

SEQ ID NO: 444915 - protein, 10 aa, Mycobacterium
DDAGLAPGDV

SEQ ID NO: 444916 - protein, 10 aa, Mycobacterium
DDAGLSPADV

SEQ ID NO: 444917 - protein, 10 aa, Mycobacterium
DDAGLTPGDV

SEQ ID NO: 444918 - protein, 9 aa, Mycobacterium
DDAGNESIG

SEQ ID NO: 444919 - protein, 9 aa, Mycobacterium
DDAGNPLSS

SEQ ID NO: 444920 - protein, 7 aa, Mycobacterium
DDAGNVT

SEQ ID NO: 444921 - protein, 11 aa, Mycobacterium
DDAGPEPPPHD

SEQ ID NO: 444922 - protein, 6 aa, Mycobacterium
DDAGPL

SEQ ID NO: 444923 - protein, 5 aa, Mycobacterium
DDAGQ

SEQ ID NO: 444924 - protein, 7 aa, Mycobacterium
DDAGRAA

SEQ ID NO: 444925 - protein, 7 aa, Mycobacterium
DDAGRDP

SEQ ID NO: 444926 - protein, 9 aa, Mycobacterium
DDAGRHRPQ

SEQ ID NO: 444927 - protein, 10 aa, Mycobacterium
DDAGRPAELG

SEQ ID NO: 444928 - protein, 6 aa, Mycobacterium
DDAGRQ

SEQ ID NO: 444929 - protein, 10 aa, Mycobacterium
DDAGRTSSVT

SEQ ID NO: 444930 - protein, 17 aa, Mycobacterium
DDAGSGPPSADEGSGPI

SEQ ID NO: 444931 - protein, 5 aa, Mycobacterium
DDAGT

SEQ ID NO: 444932 - protein, 46 aa, Mycobacterium
DDAGTATVGAPEPPTPDTPPPDGAGSPDPAPPDPPGRYQHIPVDID

SEQ ID NO: 444933 - protein, 6 aa, Mycobacterium
DDAGTI

SEQ ID NO: 444934 - protein, 10 aa, Mycobacterium
DDAGVAPGDV

SEQ ID NO: 444935 - protein, 6 aa, Mycobacterium
DDAGVD

SEQ ID NO: 444936 - protein, 10 aa, Mycobacterium
DDAGVTPGEV

SEQ ID NO: 444937 - protein, 15 aa, Mycobacterium
DDAHERAQRERYERR

SEQ ID NO: 444938 - protein, 15 aa, Mycobacterium
DDAHERTQRARYQRR

SEQ ID NO: 444939 - protein, 13 aa, Mycobacterium
DDAHTRVGKYSKG

SEQ ID NO: 444940 - protein, 6 aa, Mycobacterium
DDAIDG

SEQ ID NO: 444941 - protein, 6 aa, Mycobacterium
DDAIGR

SEQ ID NO: 444942 - protein, 14 aa, Mycobacterium
DDAIRDTKAAVGQL

SEQ ID NO: 444943 - protein, 7 aa, Mycobacterium
DDAIRDV

SEQ ID NO: 444944 - protein, 7 aa, Mycobacterium
DDAITEH

SEQ ID NO: 444945 - protein, 20 aa, Mycobacterium
DDAKEGPKAFAEKRRPNFQN

SEQ ID NO: 444946 - protein, 13 aa, Mycobacterium
DDAKESTGHGSPL

SEQ ID NO: 444947 - protein, 5 aa, Mycobacterium
DDAKL

SEQ ID NO: 444948 - protein, 7 aa, Mycobacterium
DDAKNRQ

SEQ ID NO: 444949 - protein, 6 aa, Mycobacterium
DDAKPK

SEQ ID NO: 444950 - protein, 7 aa, Mycobacterium
DDAKTEL

SEQ ID NO: 444951 - protein, 7 aa, Mycobacterium
DDAKTPF

SEQ ID NO: 444952 - protein, 7 aa, Mycobacterium
DDAKTPW

SEQ ID NO: 444953 - protein, 6 aa, Mycobacterium
DDAKVE

SEQ ID NO: 444954 - protein, 4 aa, Mycobacterium
DDAL

SEQ ID NO: 444955 - protein, 6 aa, Mycobacterium
DDALGG

SEQ ID NO: 444956 - protein, 9 aa, Mycobacterium
DDALRDTKA

SEQ ID NO: 444957 - protein, 17 aa, Mycobacterium
DDALTAATTPAATEKAY

SEQ ID NO: 444958 - protein, 14 aa, Mycobacterium
DDANGDAVKAGPDI

SEQ ID NO: 444959 - protein, 17 aa, Mycobacterium
DDANLDSDRRIGTEGQG

SEQ ID NO: 444960 - protein, 10 aa, Mycobacterium
DDANPGAAVG

SEQ ID NO: 444961 - protein, 10 aa, Mycobacterium
DDAPADAAGL

SEQ ID NO: 444962 - protein, 6 aa, Mycobacterium
DDAPAL

SEQ ID NO: 444963 - protein, 7 aa, Mycobacterium
DDAPARA

SEQ ID NO: 444964 - protein, 8 aa, Mycobacterium
DDAPDALA

SEQ ID NO: 444965 - protein, 23 aa, Mycobacterium
DDAPDSSTPGEKTSCNRPSARPV

SEQ ID NO: 444966 - protein, 7 aa, Mycobacterium
DDAPDST

SEQ ID NO: 444967 - protein, 7 aa, Mycobacterium
DDAPGQA

SEQ ID NO: 444968 - protein, 10 aa, Mycobacterium
DDAPMAPGSA

SEQ ID NO: 444969 - protein, 6 aa, Mycobacterium
DDAPPF

SEQ ID NO: 444970 - protein, 7 aa, Mycobacterium
DDAPPID

SEQ ID NO: 444971 - protein, 17 aa, Mycobacterium
DDAPPPGPAWDLQQGWL

SEQ ID NO: 444972 - protein, 7 aa, Mycobacterium
DDAPQGT

SEQ ID NO: 444973 - protein, 14 aa, Mycobacterium
DDAPQSIEPLLEMV

SEQ ID NO: 444974 - protein, 6 aa, Mycobacterium
DDAPRE

SEQ ID NO: 444975 - protein, 7 aa, Mycobacterium
DDAPRED

SEQ ID NO: 444976 - protein, 9 aa, Mycobacterium
DDAPRGETL

SEQ ID NO: 444977 - protein, 7 aa, Mycobacterium
DDAPRYA

SEQ ID NO: 444978 - protein, 10 aa, Mycobacterium
DDAPSAAGTD

SEQ ID NO: 444979 - protein, 8 aa, Mycobacterium
DDAQAKQN

SEQ ID NO: 444980 - protein, 7 aa, Mycobacterium
DDAQDAV

SEQ ID NO: 444981 - protein, 7 aa, Mycobacterium
DDAQNGA

SEQ ID NO: 444982 - protein, 8 aa, Mycobacterium
DDAQQTDF

SEQ ID NO: 444983 - protein, 10 aa, Mycobacterium
DDAQRERTPA

SEQ ID NO: 444984 - protein, 8 aa, Mycobacterium
DDAQTGAG

SEQ ID NO: 444985 - protein, 8 aa, Mycobacterium
DDARAERE

SEQ ID NO: 444986 - protein, 7 aa, Mycobacterium
DDARAKA

SEQ ID NO: 444987 - protein, 6 aa, Mycobacterium
DDARAT

SEQ ID NO: 444988 - protein, 8 aa, Mycobacterium
DDARDGKP

SEQ ID NO: 444989 - protein, 7 aa, Mycobacterium
DDARGDG

SEQ ID NO: 444990 - protein, 8 aa, Mycobacterium
DDARGDGV

SEQ ID NO: 444991 - protein, 9 aa, Mycobacterium
DDARGDGVA

SEQ ID NO: 444992 - protein, 8 aa, Mycobacterium
DDARGERF

SEQ ID NO: 444993 - protein, 8 aa, Mycobacterium
DDARKPYR

SEQ ID NO: 444994 - protein, 5 aa, Mycobacterium
DDARL

SEQ ID NO: 444995 - protein, 7 aa, Mycobacterium
DDARLGE

SEQ ID NO: 444996 - protein, 12 aa, Mycobacterium
DDARRAKDGGVD

SEQ ID NO: 444997 - protein, 11 aa, Mycobacterium
DDARSDAGSDT

SEQ ID NO: 444998 - protein, 19 aa, Mycobacterium
DDASADRADWQPPRYAPES

SEQ ID NO: 444999 - protein, 6 aa, Mycobacterium
DDASDF

SEQ ID NO: 445000 - protein, 14 aa, Mycobacterium
DDASDFAPAEPTIA

SEQ ID NO: 445001 - protein, 13 aa, Mycobacterium
DDASEFARTAPGF

SEQ ID NO: 445002 - protein, 15 aa, Mycobacterium
DDASEHQVTAATRAR

SEQ ID NO: 445003 - protein, 7 aa, Mycobacterium
DDASGRL

SEQ ID NO: 445004 - protein, 94 aa, Mycobacterium
DDASPPRTIAGTDLDSATTGPGARGGNAENFQNADGPAPQQTAGGGSFTGSGGQAANPQASPPRTGNSSWSGSGVPVPAGPPPTGPAPAPPPVI

SEQ ID NO: 445005 - protein, 7 aa, Mycobacterium
DDASRQI

SEQ ID NO: 445006 - protein, 14 aa, Mycobacterium
DDASSVTSYGPPAS

SEQ ID NO: 445007 - protein, 8 aa, Mycobacterium
DDATAQRH

SEQ ID NO: 445008 - protein, 8 aa, Mycobacterium
DDATARRH

SEQ ID NO: 445009 - protein, 8 aa, Mycobacterium
DDATGPDK

SEQ ID NO: 445010 - protein, 7 aa, Mycobacterium
DDATGTL

SEQ ID NO: 445011 - protein, 10 aa, Mycobacterium
DDATKASAMR

SEQ ID NO: 445012 - protein, 11 aa, Mycobacterium
DDATKASAMRS

SEQ ID NO: 445013 - protein, 7 aa, Mycobacterium
DDATLAE

SEQ ID NO: 445014 - protein, 6 aa, Mycobacterium
DDATNL

SEQ ID NO: 445015 - protein, 19 aa, Mycobacterium
DDATNRAAEGIAQADRERS

SEQ ID NO: 445016 - protein, 8 aa, Mycobacterium
DDATPASQ

SEQ ID NO: 445017 - protein, 20 aa, Mycobacterium
DDATPLSAGDTLDVLPPFAG

SEQ ID NO: 445018 - protein, 7 aa, Mycobacterium
DDATPLT

SEQ ID NO: 445019 - protein, 13 aa, Mycobacterium
DDATPTRVPGSQG

SEQ ID NO: 445020 - protein, 5 aa, Mycobacterium
DDATR

SEQ ID NO: 445021 - protein, 6 aa, Mycobacterium
DDATRL

SEQ ID NO: 445022 - protein, 8 aa, Mycobacterium
DDATRQEL

SEQ ID NO: 445023 - protein, 6 aa, Mycobacterium
DDATRR

SEQ ID NO: 445024 - protein, 4 aa, Mycobacterium
DDAV

SEQ ID NO: 445025 - protein, 6 aa, Mycobacterium
DDAVDS

SEQ ID NO: 445026 - protein, 15 aa, Mycobacterium
DDAVGADPNRAEYAD

SEQ ID NO: 445027 - protein, 12 aa, Mycobacterium
DDAVRSAYSDQA

SEQ ID NO: 445028 - protein, 4 aa, Mycobacterium
DDAW

SEQ ID NO: 445029 - protein, 4 aa, Mycobacterium
DDAY

SEQ ID NO: 445030 - protein, 9 aa, Mycobacterium
DDAYDDVTE

SEQ ID NO: 445031 - protein, 16 aa, Mycobacterium
DDCAPSAQPRSARDNE

SEQ ID NO: 445032 - protein, 14 aa, Mycobacterium
DDCETESGAQAALG

SEQ ID NO: 445033 - protein, 9 aa, Mycobacterium
DDCQTDGGV

SEQ ID NO: 445034 - protein, 12 aa, Mycobacterium
DDCQTDGGVASA

SEQ ID NO: 445035 - protein, 15 aa, Mycobacterium
DDCQVPDGADVMHSG

SEQ ID NO: 445036 - protein, 5 aa, Mycobacterium
DDDAA

SEQ ID NO: 445037 - protein, 6 aa, Mycobacterium
DDDAAA

SEQ ID NO: 445038 - protein, 7 aa, Mycobacterium
DDDAAAL

SEQ ID NO: 445039 - protein, 12 aa, Mycobacterium
DDDAATAAALDP

SEQ ID NO: 445040 - protein, 17 aa, Mycobacterium
DDDAGAPAGEAVPDEPH

SEQ ID NO: 445041 - protein, 8 aa, Mycobacterium
DDDAGWAS

SEQ ID NO: 445042 - protein, 8 aa, Mycobacterium
DDDARRDR

SEQ ID NO: 445043 - protein, 7 aa, Mycobacterium
DDDARSV

SEQ ID NO: 445044 - protein, 10 aa, Mycobacterium
DDDARTRYNE

SEQ ID NO: 445045 - protein, 56 aa, Mycobacterium
DDDASADSDPTGTGDAPTGTADSSEDAGESSTDAADSDASSDSAKPDASEDRGDPG

SEQ ID NO: 445046 - protein, 8 aa, Mycobacterium
DDDASGDM

SEQ ID NO: 445047 - protein, 7 aa, Mycobacterium
DDDASGK

SEQ ID NO: 445048 - protein, 6 aa, Mycobacterium
DDDAVR

SEQ ID NO: 445049 - protein, 6 aa, Mycobacterium
DDDAYA

SEQ ID NO: 445050 - protein, 4 aa, Mycobacterium
DDDD

SEQ ID NO: 445051 - protein, 10 aa, Mycobacterium
DDDDADVRAN

SEQ ID NO: 445052 - protein, 9 aa, Mycobacterium
DDDDAGVPL

SEQ ID NO: 445053 - protein, 8 aa, Mycobacterium
DDDDAVTI

SEQ ID NO: 445054 - protein, 8 aa, Mycobacterium
DDDDDDPE

SEQ ID NO: 445055 - protein, 11 aa, Mycobacterium
DDDDDLQRAAR

SEQ ID NO: 445056 - protein, 9 aa, Mycobacterium
DDDDDSDAL

SEQ ID NO: 445057 - protein, 8 aa, Mycobacterium
DDDDESAL

SEQ ID NO: 445058 - protein, 15 aa, Mycobacterium
DDDDHEKQQRQRYAN

SEQ ID NO: 445059 - protein, 32 aa, Mycobacterium
DDDDHPAGNQPGTGSWSKAPNFASDPQRAAAV

SEQ ID NO: 445060 - protein, 7 aa, Mycobacterium
DDDDLKR

SEQ ID NO: 445061 - protein, 5 aa, Mycobacterium
DDDDN

SEQ ID NO: 445062 - protein, 8 aa, Mycobacterium
DDDDNADR

SEQ ID NO: 445063 - protein, 9 aa, Mycobacterium
DDDDNPVAA

SEQ ID NO: 445064 - protein, 5 aa, Mycobacterium
DDDDQ

SEQ ID NO: 445065 - protein, 11 aa, Mycobacterium
DDDDRDVATDT

SEQ ID NO: 445066 - protein, 7 aa, Mycobacterium
DDDDRML

SEQ ID NO: 445067 - protein, 6 aa, Mycobacterium
DDDDRV

SEQ ID NO: 445068 - protein, 8 aa, Mycobacterium
DDDDTDAT

SEQ ID NO: 445069 - protein, 9 aa, Mycobacterium
DDDDTEETL

SEQ ID NO: 445070 - protein, 8 aa, Mycobacterium
DDDDVDPR

SEQ ID NO: 445071 - protein, 5 aa, Mycobacterium
DDDEA

SEQ ID NO: 445072 - protein, 5 aa, Mycobacterium
DDDED

SEQ ID NO: 445073 - protein, 9 aa, Mycobacterium
DDDEFSDAV

SEQ ID NO: 445074 - protein, 8 aa, Mycobacterium
DDDEHEAL

SEQ ID NO: 445075 - protein, 8 aa, Mycobacterium
DDDEIATA

SEQ ID NO: 445076 - protein, 15 aa, Mycobacterium
DDDEIGDTLEDNGFS

SEQ ID NO: 445077 - protein, 10 aa, Mycobacterium
DDDEKPANSH

SEQ ID NO: 445078 - protein, 5 aa, Mycobacterium
DDDEL

SEQ ID NO: 445079 - protein, 6 aa, Mycobacterium
DDDELG

SEQ ID NO: 445080 - protein, 7 aa, Mycobacterium
DDDELGD

SEQ ID NO: 445081 - protein, 6 aa, Mycobacterium
DDDELK

SEQ ID NO: 445082 - protein, 9 aa, Mycobacterium
DDDELRQRT

SEQ ID NO: 445083 - protein, 9 aa, Mycobacterium
DDDENPRAA

SEQ ID NO: 445084 - protein, 10 aa, Mycobacterium
DDDERPRLAE

SEQ ID NO: 445085 - protein, 10 aa, Mycobacterium
DDDESLGPSA

SEQ ID NO: 445086 - protein, 5 aa, Mycobacterium
DDDET

SEQ ID NO: 445087 - protein, 7 aa, Mycobacterium
DDDETVA

SEQ ID NO: 445088 - protein, 9 aa, Mycobacterium
DDDFGGGPR

SEQ ID NO: 445089 - protein, 7 aa, Mycobacterium
DDDGAGG

SEQ ID NO: 445090 - protein, 7 aa, Mycobacterium
DDDGAGK

SEQ ID NO: 445091 - protein, 6 aa, Mycobacterium
DDDGAV

SEQ ID NO: 445092 - protein, 7 aa, Mycobacterium
DDDGETF

SEQ ID NO: 445093 - protein, 18 aa, Mycobacterium
DDDGGDGAAKARAYERSA

SEQ ID NO: 445094 - protein, 21 aa, Mycobacterium
DDDGGDGAAKARAYERSATEA

SEQ ID NO: 445095 - protein, 16 aa, Mycobacterium
DDDGHAESYYTDDGSG

SEQ ID NO: 445096 - protein, 7 aa, Mycobacterium
DDDGLKN

SEQ ID NO: 445097 - protein, 8 aa, Mycobacterium
DDDGMASG

SEQ ID NO: 445098 - protein, 11 aa, Mycobacterium
DDDGNECPPGV

SEQ ID NO: 445099 - protein, 8 aa, Mycobacterium
DDDGNPLA

SEQ ID NO: 445100 - protein, 6 aa, Mycobacterium
DDDGPL

SEQ ID NO: 445101 - protein, 9 aa, Mycobacterium
DDDGPLPAD

SEQ ID NO: 445102 - protein, 9 aa, Mycobacterium
DDDGPYRGK

SEQ ID NO: 445103 - protein, 8 aa, Mycobacterium
DDDGQPDV

SEQ ID NO: 445104 - protein, 7 aa, Mycobacterium
DDDGRGP

SEQ ID NO: 445105 - protein, 22 aa, Mycobacterium
DDDGRPGALTGLPTAARPDGDV

SEQ ID NO: 445106 - protein, 5 aa, Mycobacterium
DDDGS

SEQ ID NO: 445107 - protein, 7 aa, Mycobacterium
DDDGSGK

SEQ ID NO: 445108 - protein, 7 aa, Mycobacterium
DDDGSIV

SEQ ID NO: 445109 - protein, 22 aa, Mycobacterium
DDDGTADHAARDLDGDGTPEAY

SEQ ID NO: 445110 - protein, 6 aa, Mycobacterium
DDDGTL

SEQ ID NO: 445111 - protein, 7 aa, Mycobacterium
DDDGTLS

SEQ ID NO: 445112 - protein, 14 aa, Mycobacterium
DDDGVERLTYAWRI

SEQ ID NO: 445113 - protein, 7 aa, Mycobacterium
DDDGVGS

SEQ ID NO: 445114 - protein, 5 aa, Mycobacterium
DDDGW

SEQ ID NO: 445115 - protein, 5 aa, Mycobacterium
DDDGY

SEQ ID NO: 445116 - protein, 4 aa, Mycobacterium
DDDH

SEQ ID NO: 445117 - protein, 8 aa, Mycobacterium
DDDHAAGQ

SEQ ID NO: 445118 - protein, 9 aa, Mycobacterium
DDDHDRLDE

SEQ ID NO: 445119 - protein, 6 aa, Mycobacterium
DDDHDS

SEQ ID NO: 445120 - protein, 13 aa, Mycobacterium
DDDHEKQQRERYA

SEQ ID NO: 445121 - protein, 8 aa, Mycobacterium
DDDHTAGR

SEQ ID NO: 445122 - protein, 13 aa, Mycobacterium
DDDIGEEEGATAT

SEQ ID NO: 445123 - protein, 7 aa, Mycobacterium
DDDIHGD

SEQ ID NO: 445124 - protein, 4 aa, Mycobacterium
DDDL

SEQ ID NO: 445125 - protein, 6 aa, Mycobacterium
DDDLTD

SEQ ID NO: 445126 - protein, 4 aa, Mycobacterium
DDDM

SEQ ID NO: 445127 - protein, 7 aa, Mycobacterium
DDDMAET

SEQ ID NO: 445128 - protein, 8 aa, Mycobacterium
DDDMGGFG

SEQ ID NO: 445129 - protein, 4 aa, Mycobacterium
DDDN

SEQ ID NO: 445130 - protein, 9 aa, Mycobacterium
DDDNGPVEL

SEQ ID NO: 445131 - protein, 6 aa, Mycobacterium
DDDNNP

SEQ ID NO: 445132 - protein, 10 aa, Mycobacterium
DDDPAGAVGK

SEQ ID NO: 445133 - protein, 10 aa, Mycobacterium
DDDPAGTVGK

SEQ ID NO: 445134 - protein, 18 aa, Mycobacterium
DDDPATASAQPASPTQVT

SEQ ID NO: 445135 - protein, 10 aa, Mycobacterium
DDDPATLRGY

SEQ ID NO: 445136 - protein, 9 aa, Mycobacterium
DDDPAVSIR

SEQ ID NO: 445137 - protein, 30 aa, Mycobacterium
DDDPDPTGGHGRGARRGPPDAGGIADPAPQ

SEQ ID NO: 445138 - protein, 6 aa, Mycobacterium
DDDPDV

SEQ ID NO: 445139 - protein, 7 aa, Mycobacterium
DDDPEDA

SEQ ID NO: 445140 - protein, 8 aa, Mycobacterium
DDDPEDTL

SEQ ID NO: 445141 - protein, 7 aa, Mycobacterium
DDDPEFS

SEQ ID NO: 445142 - protein, 6 aa, Mycobacterium
DDDPEL

SEQ ID NO: 445143 - protein, 16 aa, Mycobacterium
DDDPEYSAATKAAAAP

SEQ ID NO: 445144 - protein, 6 aa, Mycobacterium
DDDPFG

SEQ ID NO: 445145 - protein, 5 aa, Mycobacterium
DDDPG

SEQ ID NO: 445146 - protein, 10 aa, Mycobacterium
DDDPGASRAQ

SEQ ID NO: 445147 - protein, 8 aa, Mycobacterium
DDDPGVRR

SEQ ID NO: 445148 - protein, 8 aa, Mycobacterium
DDDPGYQT

SEQ ID NO: 445149 - protein, 8 aa, Mycobacterium
DDDPHDPL

SEQ ID NO: 445150 - protein, 6 aa, Mycobacterium
DDDPHV

SEQ ID NO: 445151 - protein, 5 aa, Mycobacterium
DDDPL

SEQ ID NO: 445152 - protein, 8 aa, Mycobacterium
DDDPLDTA

SEQ ID NO: 445153 - protein, 10 aa, Mycobacterium
DDDPLDTPAR

SEQ ID NO: 445154 - protein, 9 aa, Mycobacterium
DDDPLETAA

SEQ ID NO: 445155 - protein, 6 aa, Mycobacterium
DDDPLQ

SEQ ID NO: 445156 - protein, 6 aa, Mycobacterium
DDDPLR

SEQ ID NO: 445157 - protein, 8 aa, Mycobacterium
DDDPNEAP

SEQ ID NO: 445158 - protein, 14 aa, Mycobacterium
DDDPNQAKYVNTPE

SEQ ID NO: 445159 - protein, 10 aa, Mycobacterium
DDDPQRPLGP

SEQ ID NO: 445160 - protein, 10 aa, Mycobacterium
DDDPRRVSDR

SEQ ID NO: 445161 - protein, 11 aa, Mycobacterium
DDDPRRVSDRV

SEQ ID NO: 445162 - protein, 8 aa, Mycobacterium
DDDPRRVT

SEQ ID NO: 445163 - protein, 14 aa, Mycobacterium
DDDPRTLAQRRADA

SEQ ID NO: 445164 - protein, 8 aa, Mycobacterium
DDDPRVAA

SEQ ID NO: 445165 - protein, 9 aa, Mycobacterium
DDDPSGPDS

SEQ ID NO: 445166 - protein, 9 aa, Mycobacterium
DDDPTTAYS

SEQ ID NO: 445167 - protein, 6 aa, Mycobacterium
DDDQFN

SEQ ID NO: 445168 - protein, 7 aa, Mycobacterium
DDDQLPA

SEQ ID NO: 445169 - protein, 10 aa, Mycobacterium
DDDQRTPLRD

SEQ ID NO: 445170 - protein, 6 aa, Mycobacterium
DDDQSA

SEQ ID NO: 445171 - protein, 5 aa, Mycobacterium
DDDRF

SEQ ID NO: 445172 - protein, 8 aa, Mycobacterium
DDDRNNPA

SEQ ID NO: 445173 - protein, 8 aa, Mycobacterium
DDDRPAAL

SEQ ID NO: 445174 - protein, 10 aa, Mycobacterium
DDDRPAPPGV

SEQ ID NO: 445175 - protein, 6 aa, Mycobacterium
DDDRPD

SEQ ID NO: 445176 - protein, 7 aa, Mycobacterium
DDDRPIQ

SEQ ID NO: 445177 - protein, 8 aa, Mycobacterium
DDDRPITM

SEQ ID NO: 445178 - protein, 8 aa, Mycobacterium
DDDRPVPM

SEQ ID NO: 445179 - protein, 9 aa, Mycobacterium
DDDRPVPMQ

SEQ ID NO: 445180 - protein, 5 aa, Mycobacterium
DDDRQ

SEQ ID NO: 445181 - protein, 6 aa, Mycobacterium
DDDRRE

SEQ ID NO: 445182 - protein, 8 aa, Mycobacterium
DDDRTGLR

SEQ ID NO: 445183 - protein, 7 aa, Mycobacterium
DDDRVRD

SEQ ID NO: 445184 - protein, 6 aa, Mycobacterium
DDDRVT

SEQ ID NO: 445185 - protein, 22 aa, Mycobacterium
DDDSAAAAAADSPAPADAATAS

SEQ ID NO: 445186 - protein, 9 aa, Mycobacterium
DDDSDERSL

SEQ ID NO: 445187 - protein, 7 aa, Mycobacterium
DDDSDKA

SEQ ID NO: 445188 - protein, 5 aa, Mycobacterium
DDDSE

SEQ ID NO: 445189 - protein, 9 aa, Mycobacterium
DDDSEDGTA

SEQ ID NO: 445190 - protein, 14 aa, Mycobacterium
DDDSGAVSPSQPVR

SEQ ID NO: 445191 - protein, 12 aa, Mycobacterium
DDDSGETDEDQK

SEQ ID NO: 445192 - protein, 6 aa, Mycobacterium
DDDSGF

SEQ ID NO: 445193 - protein, 15 aa, Mycobacterium
DDDSHPTGPGPFSAL

SEQ ID NO: 445194 - protein, 12 aa, Mycobacterium
DDDSPFDNLPPS

SEQ ID NO: 445195 - protein, 8 aa, Mycobacterium
DDDSTLPL

SEQ ID NO: 445196 - protein, 6 aa, Mycobacterium
DDDSYP

SEQ ID NO: 445197 - protein, 4 aa, Mycobacterium
DDDT

SEQ ID NO: 445198 - protein, 5 aa, Mycobacterium
DDDTA

SEQ ID NO: 445199 - protein, 6 aa, Mycobacterium
DDDTAE

SEQ ID NO: 445200 - protein, 14 aa, Mycobacterium
DDDTARRGFGPYTP

SEQ ID NO: 445201 - protein, 8 aa, Mycobacterium
DDDTDFHD

SEQ ID NO: 445202 - protein, 7 aa, Mycobacterium
DDDTDKT

SEQ ID NO: 445203 - protein, 9 aa, Mycobacterium
DDDTDVAAA

SEQ ID NO: 445204 - protein, 6 aa, Mycobacterium
DDDTGA

SEQ ID NO: 445205 - protein, 6 aa, Mycobacterium
DDDTGQ

SEQ ID NO: 445206 - protein, 6 aa, Mycobacterium
DDDTPS

SEQ ID NO: 445207 - protein, 5 aa, Mycobacterium
DDDTR

SEQ ID NO: 445208 - protein, 6 aa, Mycobacterium
DDDTRY

SEQ ID NO: 445209 - protein, 5 aa, Mycobacterium
DDDTV

SEQ ID NO: 445210 - protein, 6 aa, Mycobacterium
DDDTVE

SEQ ID NO: 445211 - protein, 7 aa, Mycobacterium
DDDTYSV

SEQ ID NO: 445212 - protein, 5 aa, Mycobacterium
DDDVA

SEQ ID NO: 445213 - protein, 6 aa, Mycobacterium
DDDVEN

SEQ ID NO: 445214 - protein, 12 aa, Mycobacterium
DDDVGSPKERRD

SEQ ID NO: 445215 - protein, 26 aa, Mycobacterium
DDDVPRGGTGKVDTGRLRQMLSDANR

SEQ ID NO: 445216 - protein, 16 aa, Mycobacterium
DDDVRQTATKTAAAYR

SEQ ID NO: 445217 - protein, 6 aa, Mycobacterium
DDDWGA

SEQ ID NO: 445218 - protein, 7 aa, Mycobacterium
DDDWGQA

SEQ ID NO: 445219 - protein, 8 aa, Mycobacterium
DDDWSGRT

SEQ ID NO: 445220 - protein, 4 aa, Mycobacterium
DDDY

SEQ ID NO: 445221 - protein, 12 aa, Mycobacterium
DDDYTGRPFSER

SEQ ID NO: 445222 - protein, 12 aa, Mycobacterium
DDDYTRRPFSER

SEQ ID NO: 445223 - protein, 7 aa, Mycobacterium
DDDYTTR

SEQ ID NO: 445224 - protein, 12 aa, Mycobacterium
DDDYTTRPFSER

SEQ ID NO: 445225 - protein, 6 aa, Mycobacterium
DDEAAG

SEQ ID NO: 445226 - protein, 7 aa, Mycobacterium
DDEADEV

SEQ ID NO: 445227 - protein, 20 aa, Mycobacterium
DDEADGAGPNAPGAGPSASF

SEQ ID NO: 445228 - protein, 6 aa, Mycobacterium
DDEAER

SEQ ID NO: 445229 - protein, 8 aa, Mycobacterium
DDEAGGVH

SEQ ID NO: 445230 - protein, 7 aa, Mycobacterium
DDEAGSV

SEQ ID NO: 445231 - protein, 5 aa, Mycobacterium
DDEAQ

SEQ ID NO: 445232 - protein, 10 aa, Mycobacterium
DDEAQRANRT

SEQ ID NO: 445233 - protein, 8 aa, Mycobacterium
DDEARDRA

SEQ ID NO: 445234 - protein, 10 aa, Mycobacterium
DDEATARDQH

SEQ ID NO: 445235 - protein, 7 aa, Mycobacterium
DDEATTA

SEQ ID NO: 445236 - protein, 8 aa, Mycobacterium
DDECPQKA

SEQ ID NO: 445237 - protein, 4 aa, Mycobacterium
DDED

SEQ ID NO: 445238 - protein, 21 aa, Mycobacterium
DDEDALQRHRDAGHGALTTAA

SEQ ID NO: 445239 - protein, 8 aa, Mycobacterium
DDEDCDQA

SEQ ID NO: 445240 - protein, 8 aa, Mycobacterium
DDEDDAVR

SEQ ID NO: 445241 - protein, 6 aa, Mycobacterium
DDEDEA

SEQ ID NO: 445242 - protein, 122 aa, Mycobacterium
DDEDEDDDTETGAESDFDSGADSDSDDDQADRPRRRRRGRRGRGRGRGEQNDDATSDADTDSTEDQTDGDEQESGEDSDDSGDEDSTTTEGGTRRRRRRRRRKSGSGDSDDAVSPDDPPNTV

SEQ ID NO: 445243 - protein, 8 aa, Mycobacterium
DDEDETDL

SEQ ID NO: 445244 - protein, 5 aa, Mycobacterium
DDEDI

SEQ ID NO: 445245 - protein, 14 aa, Mycobacterium
DDEDLRGEGGDAST

SEQ ID NO: 445246 - protein, 7 aa, Mycobacterium
DDEDLSR

SEQ ID NO: 445247 - protein, 12 aa, Mycobacterium
DDEDPLSLPSDG

SEQ ID NO: 445248 - protein, 7 aa, Mycobacterium
DDEDTLS

SEQ ID NO: 445249 - protein, 8 aa, Mycobacterium
DDEDTSAA

SEQ ID NO: 445250 - protein, 10 aa, Mycobacterium
DDEEADRHYR

SEQ ID NO: 445251 - protein, 6 aa, Mycobacterium
DDEEDF

SEQ ID NO: 445252 - protein, 7 aa, Mycobacterium
DDEEERR

SEQ ID NO: 445253 - protein, 7 aa, Mycobacterium
DDEEPIP

SEQ ID NO: 445254 - protein, 7 aa, Mycobacterium
DDEERAV

SEQ ID NO: 445255 - protein, 7 aa, Mycobacterium
DDEETTA

SEQ ID NO: 445256 - protein, 5 aa, Mycobacterium
DDEEV

SEQ ID NO: 445257 - protein, 6 aa, Mycobacterium
DDEEYA

SEQ ID NO: 445258 - protein, 34 aa, Mycobacterium
DDEGDAADEIDATAEEVTSGAEPEARDNASAQER

SEQ ID NO: 445259 - protein, 10 aa, Mycobacterium
DDEGGGLNKP

SEQ ID NO: 445260 - protein, 10 aa, Mycobacterium
DDEGGPGVDH

SEQ ID NO: 445261 - protein, 22 aa, Mycobacterium
DDEGHEHGHTPAPTESRPGSWR

SEQ ID NO: 445262 - protein, 11 aa, Mycobacterium
DDEGKPVAPEA

SEQ ID NO: 445263 - protein, 12 aa, Mycobacterium
DDEGNDLPGVTT

SEQ ID NO: 445264 - protein, 13 aa, Mycobacterium
DDEGNDLPGVTTS

SEQ ID NO: 445265 - protein, 17 aa, Mycobacterium
DDEGNQLEPASGDEPVT

SEQ ID NO: 445266 - protein, 6 aa, Mycobacterium
DDEGNV

SEQ ID NO: 445267 - protein, 7 aa, Mycobacterium
DDEGRDA

SEQ ID NO: 445268 - protein, 6 aa, Mycobacterium
DDEGRW

SEQ ID NO: 445269 - protein, 7 aa, Mycobacterium
DDEGSYV

SEQ ID NO: 445270 - protein, 7 aa, Mycobacterium
DDEGTIL

SEQ ID NO: 445271 - protein, 8 aa, Mycobacterium
DDEGVRSQ

SEQ ID NO: 445272 - protein, 8 aa, Mycobacterium
DDEGYPQR

SEQ ID NO: 445273 - protein, 5 aa, Mycobacterium
DDEHP

SEQ ID NO: 445274 - protein, 7 aa, Mycobacterium
DDEHRAT

SEQ ID NO: 445275 - protein, 9 aa, Mycobacterium
DDEHRDPEA

SEQ ID NO: 445276 - protein, 6 aa, Mycobacterium
DDEHRR

SEQ ID NO: 445277 - protein, 4 aa, Mycobacterium
DDEI

SEQ ID NO: 445278 - protein, 68 aa, Mycobacterium
DDEIAKAAKASPLQGKYGQTVQRPVQPPAARAGGQAGSPPQAQPGYPPVPANEPVPPMPEPAEPKGPA

SEQ ID NO: 445279 - protein, 10 aa, Mycobacterium
DDEITTTAGP

SEQ ID NO: 445280 - protein, 4 aa, Mycobacterium
DDEK

SEQ ID NO: 445281 - protein, 7 aa, Mycobacterium
DDEKAQW

SEQ ID NO: 445282 - protein, 8 aa, Mycobacterium
DDEKRTTL

SEQ ID NO: 445283 - protein, 10 aa, Mycobacterium
DDEKTREAVD

SEQ ID NO: 445284 - protein, 5 aa, Mycobacterium
DDELA

SEQ ID NO: 445285 - protein, 6 aa, Mycobacterium
DDELAG

SEQ ID NO: 445286 - protein, 9 aa, Mycobacterium
DDELDDGRT

SEQ ID NO: 445287 - protein, 5 aa, Mycobacterium
DDELP

SEQ ID NO: 445288 - protein, 8 aa, Mycobacterium
DDELPGRL

SEQ ID NO: 445289 - protein, 8 aa, Mycobacterium
DDELQGNT

SEQ ID NO: 445290 - protein, 7 aa, Mycobacterium
DDELRGL

SEQ ID NO: 445291 - protein, 7 aa, Mycobacterium
DDEMGQR

SEQ ID NO: 445292 - protein, 7 aa, Mycobacterium
DDEMGQS

SEQ ID NO: 445293 - protein, 7 aa, Mycobacterium
DDENPAL

SEQ ID NO: 445294 - protein, 9 aa, Mycobacterium
DDENPTAEA

SEQ ID NO: 445295 - protein, 7 aa, Mycobacterium
DDENRFT

SEQ ID NO: 445296 - protein, 13 aa, Mycobacterium
DDEPADDPTVPES

SEQ ID NO: 445297 - protein, 7 aa, Mycobacterium
DDEPARL

SEQ ID NO: 445298 - protein, 5 aa, Mycobacterium
DDEPD

SEQ ID NO: 445299 - protein, 9 aa, Mycobacterium
DDEPDRKRI

SEQ ID NO: 445300 - protein, 8 aa, Mycobacterium
DDEPETNK

SEQ ID NO: 445301 - protein, 7 aa, Mycobacterium
DDEPEYH

SEQ ID NO: 445302 - protein, 7 aa, Mycobacterium
DDEPGVD

SEQ ID NO: 445303 - protein, 8 aa, Mycobacterium
DDEPLDPD

SEQ ID NO: 445304 - protein, 10 aa, Mycobacterium
DDEPLDTPAR

SEQ ID NO: 445305 - protein, 10 aa, Mycobacterium
DDEPLPSGSL

SEQ ID NO: 445306 - protein, 10 aa, Mycobacterium
DDEPLSTPAQ

SEQ ID NO: 445307 - protein, 8 aa, Mycobacterium
DDEPQFSR

SEQ ID NO: 445308 - protein, 5 aa, Mycobacterium
DDEPR

SEQ ID NO: 445309 - protein, 9 aa, Mycobacterium
DDEPTAKRL

SEQ ID NO: 445310 - protein, 5 aa, Mycobacterium
DDEPV

SEQ ID NO: 445311 - protein, 6 aa, Mycobacterium
DDEQAI

SEQ ID NO: 445312 - protein, 8 aa, Mycobacterium
DDEQDLGE

SEQ ID NO: 445313 - protein, 7 aa, Mycobacterium
DDEQLGE

SEQ ID NO: 445314 - protein, 6 aa, Mycobacterium
DDEQRE

SEQ ID NO: 445315 - protein, 7 aa, Mycobacterium
DDEQRGV

SEQ ID NO: 445316 - protein, 21 aa, Mycobacterium
DDEQRLTEKPEPDEDDKEEAA

SEQ ID NO: 445317 - protein, 13 aa, Mycobacterium
DDEQRRLAESGNR

SEQ ID NO: 445318 - protein, 12 aa, Mycobacterium
DDEQRRLATAGN

SEQ ID NO: 445319 - protein, 5 aa, Mycobacterium
DDEQT

SEQ ID NO: 445320 - protein, 7 aa, Mycobacterium
DDEQTIH

SEQ ID NO: 445321 - protein, 9 aa, Mycobacterium
DDEQWSGRR

SEQ ID NO: 445322 - protein, 5 aa, Mycobacterium
DDERG

SEQ ID NO: 445323 - protein, 5 aa, Mycobacterium
DDERL

SEQ ID NO: 445324 - protein, 7 aa, Mycobacterium
DDERPAA

SEQ ID NO: 445325 - protein, 6 aa, Mycobacterium
DDERPG

SEQ ID NO: 445326 - protein, 7 aa, Mycobacterium
DDERPIE

SEQ ID NO: 445327 - protein, 6 aa, Mycobacterium
DDERTL

SEQ ID NO: 445328 - protein, 9 aa, Mycobacterium
DDERTPQQQ

SEQ ID NO: 445329 - protein, 4 aa, Mycobacterium
DDES

SEQ ID NO: 445330 - protein, 7 aa, Mycobacterium
DDESAAE

SEQ ID NO: 445331 - protein, 7 aa, Mycobacterium
DDESDAL

SEQ ID NO: 445332 - protein, 7 aa, Mycobacterium
DDESEHH

SEQ ID NO: 445333 - protein, 7 aa, Mycobacterium
DDESGRR

SEQ ID NO: 445334 - protein, 13 aa, Mycobacterium
DDESHTLADYPLR

SEQ ID NO: 445335 - protein, 7 aa, Mycobacterium
DDESIAD

SEQ ID NO: 445336 - protein, 20 aa, Mycobacterium
DDESPVERSSDDGEPGGTAG

SEQ ID NO: 445337 - protein, 7 aa, Mycobacterium
DDESRER

SEQ ID NO: 445338 - protein, 6 aa, Mycobacterium
DDESSY

SEQ ID NO: 445339 - protein, 4 aa, Mycobacterium
DDET

SEQ ID NO: 445340 - protein, 12 aa, Mycobacterium
DDETAAKSVRNL

SEQ ID NO: 445341 - protein, 10 aa, Mycobacterium
DDETADRHYR

SEQ ID NO: 445342 - protein, 14 aa, Mycobacterium
DDETARRGFGPYTP

SEQ ID NO: 445343 - protein, 17 aa, Mycobacterium
DDETGKKVRIAKTNGKD

SEQ ID NO: 445344 - protein, 11 aa, Mycobacterium
DDETGTTRKLT

SEQ ID NO: 445345 - protein, 5 aa, Mycobacterium
DDETL

SEQ ID NO: 445346 - protein, 8 aa, Mycobacterium
DDETPYQA

SEQ ID NO: 445347 - protein, 9 aa, Mycobacterium
DDETREDAR

SEQ ID NO: 445348 - protein, 8 aa, Mycobacterium
DDETRTAK

SEQ ID NO: 445349 - protein, 17 aa, Mycobacterium
DDETSQLRNIVAVTATL

SEQ ID NO: 445350 - protein, 17 aa, Mycobacterium
DDETVVSPNPVLNPDGR

SEQ ID NO: 445351 - protein, 5 aa, Mycobacterium
DDEVG

SEQ ID NO: 445352 - protein, 5 aa, Mycobacterium
DDEVS

SEQ ID NO: 445353 - protein, 11 aa, Mycobacterium
DDEVTDADVAG

SEQ ID NO: 445354 - protein, 6 aa, Mycobacterium
DDEWEE

SEQ ID NO: 445355 - protein, 5 aa, Mycobacterium
DDEWQ

SEQ ID NO: 445356 - protein, 12 aa, Mycobacterium
DDEWQRGHAPQA

SEQ ID NO: 445357 - protein, 5 aa, Mycobacterium
DDEWR

SEQ ID NO: 445358 - protein, 5 aa, Mycobacterium
DDEYA

SEQ ID NO: 445359 - protein, 5 aa, Mycobacterium
DDEYE

SEQ ID NO: 445360 - protein, 8 aa, Mycobacterium
DDEYSSLE

SEQ ID NO: 445361 - protein, 20 aa, Mycobacterium
DDEYYDDRAPSRGYSRPRFD

SEQ ID NO: 445362 - protein, 19 aa, Mycobacterium
DDEYYDDRGPSRGYSRPRF

SEQ ID NO: 445363 - protein, 5 aa, Mycobacterium
DDFAP

SEQ ID NO: 445364 - protein, 17 aa, Mycobacterium
DDFAPPPPIDLPSPAEL

SEQ ID NO: 445365 - protein, 8 aa, Mycobacterium
DDFEGAEE

SEQ ID NO: 445366 - protein, 9 aa, Mycobacterium
DDFEPNSVP

SEQ ID NO: 445367 - protein, 8 aa, Mycobacterium
DDFEPPPR

SEQ ID NO: 445368 - protein, 8 aa, Mycobacterium
DDFERPPS

SEQ ID NO: 445369 - protein, 7 aa, Mycobacterium
DDFGGSD

SEQ ID NO: 445370 - protein, 8 aa, Mycobacterium
DDFGHDTD

SEQ ID NO: 445371 - protein, 9 aa, Mycobacterium
DDFGPPGQR

SEQ ID NO: 445372 - protein, 8 aa, Mycobacterium
DDFGTPDA

SEQ ID NO: 445373 - protein, 9 aa, Mycobacterium
DDFKSGSTV

SEQ ID NO: 445374 - protein, 4 aa, Mycobacterium
DDFP

SEQ ID NO: 445375 - protein, 13 aa, Mycobacterium
DDFPKPAKRLPRG

SEQ ID NO: 445376 - protein, 6 aa, Mycobacterium
DDFQDK

SEQ ID NO: 445377 - protein, 5 aa, Mycobacterium
DDFRD

SEQ ID NO: 445378 - protein, 26 aa, Mycobacterium
DDFSRQPSRFRGDRNKEVEQYAAGSG

SEQ ID NO: 445379 - protein, 11 aa, Mycobacterium
DDFSSDDRRRV

SEQ ID NO: 445380 - protein, 7 aa, Mycobacterium
DDFTPRV

SEQ ID NO: 445381 - protein, 7 aa, Mycobacterium
DDFTQTN

SEQ ID NO: 445382 - protein, 9 aa, Mycobacterium
DDGAAASMG

SEQ ID NO: 445383 - protein, 13 aa, Mycobacterium
DDGAAAVGEQITL

SEQ ID NO: 445384 - protein, 7 aa, Mycobacterium
DDGAADS

SEQ ID NO: 445385 - protein, 13 aa, Mycobacterium
DDGAAVPHDGETV

SEQ ID NO: 445386 - protein, 12 aa, Mycobacterium
DDGAAVSRGVTG

SEQ ID NO: 445387 - protein, 5 aa, Mycobacterium
DDGAD

SEQ ID NO: 445388 - protein, 9 aa, Mycobacterium
DDGADGRIG

SEQ ID NO: 445389 - protein, 10 aa, Mycobacterium
DDGADPGLRG

SEQ ID NO: 445390 - protein, 6 aa, Mycobacterium
DDGADT

SEQ ID NO: 445391 - protein, 7 aa, Mycobacterium
DDGADTA

SEQ ID NO: 445392 - protein, 9 aa, Mycobacterium
DDGADVEDV

SEQ ID NO: 445393 - protein, 8 aa, Mycobacterium
DDGAELDV

SEQ ID NO: 445394 - protein, 10 aa, Mycobacterium
DDGAESPQET

SEQ ID NO: 445395 - protein, 8 aa, Mycobacterium
DDGAGANE

SEQ ID NO: 445396 - protein, 6 aa, Mycobacterium
DDGAGG

SEQ ID NO: 445397 - protein, 9 aa, Mycobacterium
DDGAGGQVE

SEQ ID NO: 445398 - protein, 8 aa, Mycobacterium
DDGAGGWP

SEQ ID NO: 445399 - protein, 8 aa, Mycobacterium
DDGAGGWS

SEQ ID NO: 445400 - protein, 8 aa, Mycobacterium
DDGAGSRV

SEQ ID NO: 445401 - protein, 7 aa, Mycobacterium
DDGAGVT

SEQ ID NO: 445402 - protein, 9 aa, Mycobacterium
DDGAHARSA

SEQ ID NO: 445403 - protein, 15 aa, Mycobacterium
DDGAIPGKTTNEPAE

SEQ ID NO: 445404 - protein, 7 aa, Mycobacterium
DDGAKGL

SEQ ID NO: 445405 - protein, 6 aa, Mycobacterium
DDGALS

SEQ ID NO: 445406 - protein, 5 aa, Mycobacterium
DDGAN

SEQ ID NO: 445407 - protein, 14 aa, Mycobacterium
DDGAPDATITASTS

SEQ ID NO: 445408 - protein, 22 aa, Mycobacterium
DDGAPDMRPSAANGATGRPTNP

SEQ ID NO: 445409 - protein, 9 aa, Mycobacterium
DDGAQPTVV

SEQ ID NO: 445410 - protein, 5 aa, Mycobacterium
DDGAR

SEQ ID NO: 445411 - protein, 7 aa, Mycobacterium
DDGARET

SEQ ID NO: 445412 - protein, 6 aa, Mycobacterium
DDGARI

SEQ ID NO: 445413 - protein, 9 aa, Mycobacterium
DDGARSAAE

SEQ ID NO: 445414 - protein, 9 aa, Mycobacterium
DDGATDETF

SEQ ID NO: 445415 - protein, 6 aa, Mycobacterium
DDGATE

SEQ ID NO: 445416 - protein, 5 aa, Mycobacterium
DDGAV

SEQ ID NO: 445417 - protein, 4 aa, Mycobacterium
DDGC

SEQ ID NO: 445418 - protein, 7 aa, Mycobacterium
DDGCATP

SEQ ID NO: 445419 - protein, 8 aa, Mycobacterium
DDGCTTPE

SEQ ID NO: 445420 - protein, 5 aa, Mycobacterium
DDGDD

SEQ ID NO: 445421 - protein, 8 aa, Mycobacterium
DDGDDAAA

SEQ ID NO: 445422 - protein, 10 aa, Mycobacterium
DDGDEPGGGK

SEQ ID NO: 445423 - protein, 10 aa, Mycobacterium
DDGDFETPKR

SEQ ID NO: 445424 - protein, 16 aa, Mycobacterium
DDGDGGRGGPVIARYD

SEQ ID NO: 445425 - protein, 9 aa, Mycobacterium
DDGDGNSVE

SEQ ID NO: 445426 - protein, 9 aa, Mycobacterium
DDGDGPEEG

SEQ ID NO: 445427 - protein, 5 aa, Mycobacterium
DDGDI

SEQ ID NO: 445428 - protein, 14 aa, Mycobacterium
DDGDLDASGPGQAI

SEQ ID NO: 445429 - protein, 10 aa, Mycobacterium
DDGDLDPTAI

SEQ ID NO: 445430 - protein, 14 aa, Mycobacterium
DDGDPDAVLQAEPA

SEQ ID NO: 445431 - protein, 9 aa, Mycobacterium
DDGDPVVAD

SEQ ID NO: 445432 - protein, 7 aa, Mycobacterium
DDGDQAD

SEQ ID NO: 445433 - protein, 8 aa, Mycobacterium
DDGDQVSA

SEQ ID NO: 445434 - protein, 10 aa, Mycobacterium
DDGDRATAAR

SEQ ID NO: 445435 - protein, 14 aa, Mycobacterium
DDGDVDSNSSPIGV

SEQ ID NO: 445436 - protein, 6 aa, Mycobacterium
DDGDVV

SEQ ID NO: 445437 - protein, 6 aa, Mycobacterium
DDGDWS

SEQ ID NO: 445438 - protein, 9 aa, Mycobacterium
DDGEGNSVE

SEQ ID NO: 445439 - protein, 13 aa, Mycobacterium
DDGEHTAGTPARV

SEQ ID NO: 445440 - protein, 6 aa, Mycobacterium
DDGEIR

SEQ ID NO: 445441 - protein, 14 aa, Mycobacterium
DDGEPIFGEQGEKA

SEQ ID NO: 445442 - protein, 6 aa, Mycobacterium
DDGEPV

SEQ ID NO: 445443 - protein, 7 aa, Mycobacterium
DDGEPVT

SEQ ID NO: 445444 - protein, 8 aa, Mycobacterium
DDGERARL

SEQ ID NO: 445445 - protein, 10 aa, Mycobacterium
DDGERQAAEK

SEQ ID NO: 445446 - protein, 8 aa, Mycobacterium
DDGETASW

SEQ ID NO: 445447 - protein, 8 aa, Mycobacterium
DDGETRYN

SEQ ID NO: 445448 - protein, 7 aa, Mycobacterium
DDGFGSE

SEQ ID NO: 445449 - protein, 4 aa, Mycobacterium
DDGG

SEQ ID NO: 445450 - protein, 10 aa, Mycobacterium
DDGGDASVHD

SEQ ID NO: 445451 - protein, 12 aa, Mycobacterium
DDGGDFGLSLAV

SEQ ID NO: 445452 - protein, 11 aa, Mycobacterium
DDGGDYDRRDL

SEQ ID NO: 445453 - protein, 8 aa, Mycobacterium
DDGGERAV

SEQ ID NO: 445454 - protein, 8 aa, Mycobacterium
DDGGGARV

SEQ ID NO: 445455 - protein, 7 aa, Mycobacterium
DDGGGDD

SEQ ID NO: 445456 - protein, 16 aa, Mycobacterium
DDGGGPDRLREAREQT

SEQ ID NO: 445457 - protein, 8 aa, Mycobacterium
DDGGGRAL

SEQ ID NO: 445458 - protein, 9 aa, Mycobacterium
DDGGHTPKQ

SEQ ID NO: 445459 - protein, 5 aa, Mycobacterium
DDGGK

SEQ ID NO: 445460 - protein, 6 aa, Mycobacterium
DDGGKV

SEQ ID NO: 445461 - protein, 5 aa, Mycobacterium
DDGGR

SEQ ID NO: 445462 - protein, 11 aa, Mycobacterium
DDGGRTMSDRE

SEQ ID NO: 445463 - protein, 10 aa, Mycobacterium
DDGGSSGRLR

SEQ ID NO: 445464 - protein, 7 aa, Mycobacterium
DDGGVAT

SEQ ID NO: 445465 - protein, 30 aa, Mycobacterium
DDGGVTLKPEYQATLKSPKDVEAAQTRRAE

SEQ ID NO: 445466 - protein, 9 aa, Mycobacterium
DDGHPQGTG

SEQ ID NO: 445467 - protein, 6 aa, Mycobacterium
DDGIAE

SEQ ID NO: 445468 - protein, 6 aa, Mycobacterium
DDGIDH

SEQ ID NO: 445469 - protein, 5 aa, Mycobacterium
DDGIG

SEQ ID NO: 445470 - protein, 11 aa, Mycobacterium
DDGIPKSPQWA

SEQ ID NO: 445471 - protein, 10 aa, Mycobacterium
DDGKPRTTPI

SEQ ID NO: 445472 - protein, 8 aa, Mycobacterium
DDGLADDM

SEQ ID NO: 445473 - protein, 8 aa, Mycobacterium
DDGLATAE

SEQ ID NO: 445474 - protein, 7 aa, Mycobacterium
DDGLHGS

SEQ ID NO: 445475 - protein, 6 aa, Mycobacterium
DDGLKN

SEQ ID NO: 445476 - protein, 8 aa, Mycobacterium
DDGLPQEL

SEQ ID NO: 445477 - protein, 16 aa, Mycobacterium
DDGLPRGVSGAADPHF

SEQ ID NO: 445478 - protein, 6 aa, Mycobacterium
DDGLTD

SEQ ID NO: 445479 - protein, 4 aa, Mycobacterium
DDGN

SEQ ID NO: 445480 - protein, 9 aa, Mycobacterium
DDGNAEEAA

SEQ ID NO: 445481 - protein, 5 aa, Mycobacterium
DDGNE

SEQ ID NO: 445482 - protein, 11 aa, Mycobacterium
DDGNECPPGVP

SEQ ID NO: 445483 - protein, 13 aa, Mycobacterium
DDGNEVKPGSGVR

SEQ ID NO: 445484 - protein, 9 aa, Mycobacterium
DDGNGNSVE

SEQ ID NO: 445485 - protein, 9 aa, Mycobacterium
DDGNGPEEG

SEQ ID NO: 445486 - protein, 8 aa, Mycobacterium
DDGNRLPW

SEQ ID NO: 445487 - protein, 7 aa, Mycobacterium
DDGPARV

SEQ ID NO: 445488 - protein, 16 aa, Mycobacterium
DDGPDGPMSAAETTSN

SEQ ID NO: 445489 - protein, 15 aa, Mycobacterium
DDGPDGPMSVPETTA

SEQ ID NO: 445490 - protein, 10 aa, Mycobacterium
DDGPDRAREL

SEQ ID NO: 445491 - protein, 8 aa, Mycobacterium
DDGPEEIG

SEQ ID NO: 445492 - protein, 6 aa, Mycobacterium
DDGPGI

SEQ ID NO: 445493 - protein, 8 aa, Mycobacterium
DDGPIDGT

SEQ ID NO: 445494 - protein, 6 aa, Mycobacterium
DDGPIR

SEQ ID NO: 445495 - protein, 14 aa, Mycobacterium
DDGPKGVKTQIQGD

SEQ ID NO: 445496 - protein, 14 aa, Mycobacterium
DDGPKSVKTQIQGD

SEQ ID NO: 445497 - protein, 6 aa, Mycobacterium
DDGPLY

SEQ ID NO: 445498 - protein, 7 aa, Mycobacterium
DDGPPDI

SEQ ID NO: 445499 - protein, 8 aa, Mycobacterium
DDGPPRTL

SEQ ID NO: 445500 - protein, 10 aa, Mycobacterium
DDGPQPDTYD

SEQ ID NO: 445501 - protein, 8 aa, Mycobacterium
DDGPQQAA

SEQ ID NO: 445502 - protein, 6 aa, Mycobacterium
DDGPQW

SEQ ID NO: 445503 - protein, 5 aa, Mycobacterium
DDGPR

SEQ ID NO: 445504 - protein, 7 aa, Mycobacterium
DDGPRNS

SEQ ID NO: 445505 - protein, 8 aa, Mycobacterium
DDGPRTPM

SEQ ID NO: 445506 - protein, 16 aa, Mycobacterium
DDGPRTRSVVVIRPAT

SEQ ID NO: 445507 - protein, 8 aa, Mycobacterium
DDGPSEES

SEQ ID NO: 445508 - protein, 22 aa, Mycobacterium
DDGPTPIPDENRDRLESLTLRV

SEQ ID NO: 445509 - protein, 5 aa, Mycobacterium
DDGPV

SEQ ID NO: 445510 - protein, 6 aa, Mycobacterium
DDGPVQ

SEQ ID NO: 445511 - protein, 7 aa, Mycobacterium
DDGPVRH

SEQ ID NO: 445512 - protein, 8 aa, Mycobacterium
DDGPYEGA

SEQ ID NO: 445513 - protein, 8 aa, Mycobacterium
DDGPYSRP

SEQ ID NO: 445514 - protein, 22 aa, Mycobacterium
DDGQAHAIKSEPAQGERAEVEE

SEQ ID NO: 445515 - protein, 9 aa, Mycobacterium
DDGQARTLD

SEQ ID NO: 445516 - protein, 10 aa, Mycobacterium
DDGQLSSISA

SEQ ID NO: 445517 - protein, 6 aa, Mycobacterium
DDGQME

SEQ ID NO: 445518 - protein, 8 aa, Mycobacterium
DDGQTIES

SEQ ID NO: 445519 - protein, 14 aa, Mycobacterium
DDGRAAAEKIDTAP

SEQ ID NO: 445520 - protein, 12 aa, Mycobacterium
DDGRAKSDDAKD

SEQ ID NO: 445521 - protein, 10 aa, Mycobacterium
DDGRALESGR

SEQ ID NO: 445522 - protein, 5 aa, Mycobacterium
DDGRD

SEQ ID NO: 445523 - protein, 9 aa, Mycobacterium
DDGRGGEGI

SEQ ID NO: 445524 - protein, 8 aa, Mycobacterium
DDGRGRRP

SEQ ID NO: 445525 - protein, 18 aa, Mycobacterium
DDGRHRAASARQASSIRS

SEQ ID NO: 445526 - protein, 8 aa, Mycobacterium
DDGRISTA

SEQ ID NO: 445527 - protein, 9 aa, Mycobacterium
DDGRKSRDV

SEQ ID NO: 445528 - protein, 13 aa, Mycobacterium
DDGRNLADELGPA

SEQ ID NO: 445529 - protein, 5 aa, Mycobacterium
DDGRP

SEQ ID NO: 445530 - protein, 9 aa, Mycobacterium
DDGRPADTT

SEQ ID NO: 445531 - protein, 9 aa, Mycobacterium
DDGRPAQIP

SEQ ID NO: 445532 - protein, 9 aa, Mycobacterium
DDGRPGGTD

SEQ ID NO: 445533 - protein, 9 aa, Mycobacterium
DDGRPQNSE

SEQ ID NO: 445534 - protein, 9 aa, Mycobacterium
DDGRPRDTG

SEQ ID NO: 445535 - protein, 7 aa, Mycobacterium
DDGRPVT

SEQ ID NO: 445536 - protein, 13 aa, Mycobacterium
DDGRQAWSDDEVS

SEQ ID NO: 445537 - protein, 11 aa, Mycobacterium
DDGRRAVDAGA

SEQ ID NO: 445538 - protein, 13 aa, Mycobacterium
DDGRRAVDAGAGG

SEQ ID NO: 445539 - protein, 10 aa, Mycobacterium
DDGRTDRVDE

SEQ ID NO: 445540 - protein, 19 aa, Mycobacterium
DDGRTGTTRPPRPVRSADD

SEQ ID NO: 445541 - protein, 10 aa, Mycobacterium
DDGRTMADGE

SEQ ID NO: 445542 - protein, 5 aa, Mycobacterium
DDGRV

SEQ ID NO: 445543 - protein, 7 aa, Mycobacterium
DDGRVEQ

SEQ ID NO: 445544 - protein, 5 aa, Mycobacterium
DDGRW

SEQ ID NO: 445545 - protein, 4 aa, Mycobacterium
DDGS

SEQ ID NO: 445546 - protein, 10 aa, Mycobacterium
DDGSAPASDA

SEQ ID NO: 445547 - protein, 8 aa, Mycobacterium
DDGSAQGF

SEQ ID NO: 445548 - protein, 18 aa, Mycobacterium
DDGSEKVVTNPSDWPEGK

SEQ ID NO: 445549 - protein, 11 aa, Mycobacterium
DDGSGAAELPG

SEQ ID NO: 445550 - protein, 7 aa, Mycobacterium
DDGSGEG

SEQ ID NO: 445551 - protein, 12 aa, Mycobacterium
DDGSGETDEDQK

SEQ ID NO: 445552 - protein, 7 aa, Mycobacterium
DDGSGTW

SEQ ID NO: 445553 - protein, 10 aa, Mycobacterium
DDGSGYGVSR

SEQ ID NO: 445554 - protein, 7 aa, Mycobacterium
DDGSLAS

SEQ ID NO: 445555 - protein, 7 aa, Mycobacterium
DDGSPAV

SEQ ID NO: 445556 - protein, 9 aa, Mycobacterium
DDGSPEVSA

SEQ ID NO: 445557 - protein, 8 aa, Mycobacterium
DDGSPITD

SEQ ID NO: 445558 - protein, 9 aa, Mycobacterium
DDGSPQGAR

SEQ ID NO: 445559 - protein, 8 aa, Mycobacterium
DDGSQVTA

SEQ ID NO: 445560 - protein, 7 aa, Mycobacterium
DDGSRYR

SEQ ID NO: 445561 - protein, 12 aa, Mycobacterium
DDGSSADDYYPQ

SEQ ID NO: 445562 - protein, 7 aa, Mycobacterium
DDGSTID

SEQ ID NO: 445563 - protein, 5 aa, Mycobacterium
DDGTA

SEQ ID NO: 445564 - protein, 6 aa, Mycobacterium
DDGTAI

SEQ ID NO: 445565 - protein, 6 aa, Mycobacterium
DDGTAV

SEQ ID NO: 445566 - protein, 8 aa, Mycobacterium
DDGTEALR

SEQ ID NO: 445567 - protein, 7 aa, Mycobacterium
DDGTELP

SEQ ID NO: 445568 - protein, 5 aa, Mycobacterium
DDGTF

SEQ ID NO: 445569 - protein, 10 aa, Mycobacterium
DDGTGAESAG

SEQ ID NO: 445570 - protein, 7 aa, Mycobacterium
DDGTGEL

SEQ ID NO: 445571 - protein, 6 aa, Mycobacterium
DDGTGQ

SEQ ID NO: 445572 - protein, 9 aa, Mycobacterium
DDGTGQESK

SEQ ID NO: 445573 - protein, 11 aa, Mycobacterium
DDGTGSAAPTP

SEQ ID NO: 445574 - protein, 8 aa, Mycobacterium
DDGTGVES

SEQ ID NO: 445575 - protein, 7 aa, Mycobacterium
DDGTGWA

SEQ ID NO: 445576 - protein, 8 aa, Mycobacterium
DDGTHSAE

SEQ ID NO: 445577 - protein, 5 aa, Mycobacterium
DDGTL

SEQ ID NO: 445578 - protein, 9 aa, Mycobacterium
DDGTNERPD

SEQ ID NO: 445579 - protein, 6 aa, Mycobacterium
DDGTPL

SEQ ID NO: 445580 - protein, 12 aa, Mycobacterium
DDGTPTRVPGSQ

SEQ ID NO: 445581 - protein, 6 aa, Mycobacterium
DDGTPV

SEQ ID NO: 445582 - protein, 9 aa, Mycobacterium
DDGTQAQRP

SEQ ID NO: 445583 - protein, 22 aa, Mycobacterium
DDGTTDDTSTTTTSSKAKTYYY

SEQ ID NO: 445584 - protein, 8 aa, Mycobacterium
DDGTTGLS

SEQ ID NO: 445585 - protein, 7 aa, Mycobacterium
DDGTTIT

SEQ ID NO: 445586 - protein, 6 aa, Mycobacterium
DDGTVP

SEQ ID NO: 445587 - protein, 9 aa, Mycobacterium
DDGTVSIRP

SEQ ID NO: 445588 - protein, 20 aa, Mycobacterium
DDGTVTAPEGNRELQAEARR

SEQ ID NO: 445589 - protein, 7 aa, Mycobacterium
DDGTVTV

SEQ ID NO: 445590 - protein, 9 aa, Mycobacterium
DDGTWPRQR

SEQ ID NO: 445591 - protein, 8 aa, Mycobacterium
DDGTYVSS

SEQ ID NO: 445592 - protein, 22 aa, Mycobacterium
DDGVDEGAAALSDDGGYRRPPT

SEQ ID NO: 445593 - protein, 5 aa, Mycobacterium
DDGVE

SEQ ID NO: 445594 - protein, 18 aa, Mycobacterium
DDGVGEVTYPPKGTFRNG

SEQ ID NO: 445595 - protein, 18 aa, Mycobacterium
DDGVGEVTYPPRGTFRNG

SEQ ID NO: 445596 - protein, 22 aa, Mycobacterium
DDGVPHRAPRAAGDRDPWPSAP

SEQ ID NO: 445597 - protein, 23 aa, Mycobacterium
DDGVPSPSQYDPARNRHRDPRGW

SEQ ID NO: 445598 - protein, 20 aa, Mycobacterium
DDGVVDGATGIARQEGGRPW

SEQ ID NO: 445599 - protein, 9 aa, Mycobacterium
DDGYEAARR

SEQ ID NO: 445600 - protein, 8 aa, Mycobacterium
DDHADPAN

SEQ ID NO: 445601 - protein, 6 aa, Mycobacterium
DDHADS

SEQ ID NO: 445602 - protein, 9 aa, Mycobacterium
DDHAEEHED

SEQ ID NO: 445603 - protein, 8 aa, Mycobacterium
DDHAGPSV

SEQ ID NO: 445604 - protein, 7 aa, Mycobacterium
DDHAGTS

SEQ ID NO: 445605 - protein, 6 aa, Mycobacterium
DDHAPS

SEQ ID NO: 445606 - protein, 17 aa, Mycobacterium
DDHAVAPSQAMGNEPES

SEQ ID NO: 445607 - protein, 8 aa, Mycobacterium
DDHDAAEG

SEQ ID NO: 445608 - protein, 10 aa, Mycobacterium
DDHDARAAVR

SEQ ID NO: 445609 - protein, 7 aa, Mycobacterium
DDHDAVR

SEQ ID NO: 445610 - protein, 7 aa, Mycobacterium
DDHDDPA

SEQ ID NO: 445611 - protein, 7 aa, Mycobacterium
DDHDFAQ

SEQ ID NO: 445612 - protein, 7 aa, Mycobacterium
DDHEDTL

SEQ ID NO: 445613 - protein, 6 aa, Mycobacterium
DDHESG

SEQ ID NO: 445614 - protein, 9 aa, Mycobacterium
DDHESPGEA

SEQ ID NO: 445615 - protein, 7 aa, Mycobacterium
DDHGDAA

SEQ ID NO: 445616 - protein, 16 aa, Mycobacterium
DDHGDPLAPETDEGTH

SEQ ID NO: 445617 - protein, 6 aa, Mycobacterium
DDHGQM

SEQ ID NO: 445618 - protein, 7 aa, Mycobacterium
DDHGSEM

SEQ ID NO: 445619 - protein, 8 aa, Mycobacterium
DDHGTDVA

SEQ ID NO: 445620 - protein, 8 aa, Mycobacterium
DDHGTEVA

SEQ ID NO: 445621 - protein, 5 aa, Mycobacterium
DDHPG

SEQ ID NO: 445622 - protein, 6 aa, Mycobacterium
DDHPLS

SEQ ID NO: 445623 - protein, 8 aa, Mycobacterium
DDHPPAGR

SEQ ID NO: 445624 - protein, 8 aa, Mycobacterium
DDHPPESV

SEQ ID NO: 445625 - protein, 14 aa, Mycobacterium
DDHPTTPLPPPDPH

SEQ ID NO: 445626 - protein, 14 aa, Mycobacterium
DDHPTTPLPPPNPH

SEQ ID NO: 445627 - protein, 14 aa, Mycobacterium
DDHPTTPLPPPSPH

SEQ ID NO: 445628 - protein, 7 aa, Mycobacterium
DDHRVEE

SEQ ID NO: 445629 - protein, 8 aa, Mycobacterium
DDHSDTEG

SEQ ID NO: 445630 - protein, 6 aa, Mycobacterium
DDHSVA

SEQ ID NO: 445631 - protein, 5 aa, Mycobacterium
DDHTA

SEQ ID NO: 445632 - protein, 6 aa, Mycobacterium
DDHTDA

SEQ ID NO: 445633 - protein, 6 aa, Mycobacterium
DDHTKA

SEQ ID NO: 445634 - protein, 4 aa, Mycobacterium
DDHV

SEQ ID NO: 445635 - protein, 8 aa, Mycobacterium
DDHVYDND

SEQ ID NO: 445636 - protein, 23 aa, Mycobacterium
DDHYPTNGGDGSPRPVTVEISGD

SEQ ID NO: 445637 - protein, 4 aa, Mycobacterium
DDIA

SEQ ID NO: 445638 - protein, 6 aa, Mycobacterium
DDIANN

SEQ ID NO: 445639 - protein, 6 aa, Mycobacterium
DDIAPG

SEQ ID NO: 445640 - protein, 11 aa, Mycobacterium
DDIAPPPRPAI

SEQ ID NO: 445641 - protein, 8 aa, Mycobacterium
DDIARTDA

SEQ ID NO: 445642 - protein, 6 aa, Mycobacterium
DDIDIG

SEQ ID NO: 445643 - protein, 9 aa, Mycobacterium
DDIDPDDPT

SEQ ID NO: 445644 - protein, 20 aa, Mycobacterium
DDIDRGERPGVPSSESTELR

SEQ ID NO: 445645 - protein, 21 aa, Mycobacterium
DDIDRGVRPGVPTSESTELQA

SEQ ID NO: 445646 - protein, 15 aa, Mycobacterium
DDIEEDDSSGRANYA

SEQ ID NO: 445647 - protein, 6 aa, Mycobacterium
DDIEIG

SEQ ID NO: 445648 - protein, 8 aa, Mycobacterium
DDIESAEE

SEQ ID NO: 445649 - protein, 8 aa, Mycobacterium
DDIESDPG

SEQ ID NO: 445650 - protein, 4 aa, Mycobacterium
DDIG

SEQ ID NO: 445651 - protein, 7 aa, Mycobacterium
DDIGEAQ

SEQ ID NO: 445652 - protein, 7 aa, Mycobacterium
DDIGGTW

SEQ ID NO: 445653 - protein, 12 aa, Mycobacterium
DDIGRSKAEALA

SEQ ID NO: 445654 - protein, 13 aa, Mycobacterium
DDIPDPQDPQTFQ

SEQ ID NO: 445655 - protein, 9 aa, Mycobacterium
DDIPEEGSG

SEQ ID NO: 445656 - protein, 8 aa, Mycobacterium
DDIPEHGS

SEQ ID NO: 445657 - protein, 8 aa, Mycobacterium
DDIPESGK

SEQ ID NO: 445658 - protein, 6 aa, Mycobacterium
DDITTE

SEQ ID NO: 445659 - protein, 83 aa, Mycobacterium
DDKAAQTRKSFAESVKGKAKELAGAVTGNDSLTAEGQLEQAEAKERREASRKEAEADAEAAQAQAQAREARLEGAQERAAAEV

SEQ ID NO: 445660 - protein, 21 aa, Mycobacterium
DDKAATDADTIDTVREIYERG

SEQ ID NO: 445661 - protein, 8 aa, Mycobacterium
DDKAAVEA

SEQ ID NO: 445662 - protein, 4 aa, Mycobacterium
DDKE

SEQ ID NO: 445663 - protein, 7 aa, Mycobacterium
DDKERAE

SEQ ID NO: 445664 - protein, 8 aa, Mycobacterium
DDKETLGR

SEQ ID NO: 445665 - protein, 9 aa, Mycobacterium
DDKGASDRI

SEQ ID NO: 445666 - protein, 5 aa, Mycobacterium
DDKGD

SEQ ID NO: 445667 - protein, 17 aa, Mycobacterium
DDKGPADADTIDTVRAL

SEQ ID NO: 445668 - protein, 17 aa, Mycobacterium
DDKGPAEADTIDAVRAL

SEQ ID NO: 445669 - protein, 4 aa, Mycobacterium
DDKL

SEQ ID NO: 445670 - protein, 5 aa, Mycobacterium
DDKLD

SEQ ID NO: 445671 - protein, 9 aa, Mycobacterium
DDKLGPTGE

SEQ ID NO: 445672 - protein, 6 aa, Mycobacterium
DDKNTH

SEQ ID NO: 445673 - protein, 10 aa, Mycobacterium
DDKPIASASI

SEQ ID NO: 445674 - protein, 8 aa, Mycobacterium
DDKPSAYR

SEQ ID NO: 445675 - protein, 7 aa, Mycobacterium
DDKQLAA

SEQ ID NO: 445676 - protein, 16 aa, Mycobacterium
DDKQSGVPAQAPRRSH

SEQ ID NO: 445677 - protein, 4 aa, Mycobacterium
DDKR

SEQ ID NO: 445678 - protein, 11 aa, Mycobacterium
DDKRNPVEAND

SEQ ID NO: 445679 - protein, 9 aa, Mycobacterium
DDKRQTRRI

SEQ ID NO: 445680 - protein, 4 aa, Mycobacterium
DDKS

SEQ ID NO: 445681 - protein, 10 aa, Mycobacterium
DDKSGEQLPG

SEQ ID NO: 445682 - protein, 17 aa, Mycobacterium
DDKSPAEADTIDAVRAL

SEQ ID NO: 445683 - protein, 20 aa, Mycobacterium
DDKSPAEADTVETVRRFYER

SEQ ID NO: 445684 - protein, 17 aa, Mycobacterium
DDKSPDEADTIDTVRAL

SEQ ID NO: 445685 - protein, 7 aa, Mycobacterium
DDKSYPA

SEQ ID NO: 445686 - protein, 5 aa, Mycobacterium
DDKTA

SEQ ID NO: 445687 - protein, 8 aa, Mycobacterium
DDKTNPAQ

SEQ ID NO: 445688 - protein, 6 aa, Mycobacterium
DDKTQE

SEQ ID NO: 445689 - protein, 7 aa, Mycobacterium
DDKVAGD

SEQ ID NO: 445690 - protein, 8 aa, Mycobacterium
DDKVTGLS

SEQ ID NO: 445691 - protein, 4 aa, Mycobacterium
DDKW

SEQ ID NO: 445692 - protein, 5 aa, Mycobacterium
DDLAD

SEQ ID NO: 445693 - protein, 44 aa, Mycobacterium
DDLADEGRAQQDKADAQRDAGKKEAEAESARAGADAAEERQKKN

SEQ ID NO: 445694 - protein, 5 aa, Mycobacterium
DDLAG

SEQ ID NO: 445695 - protein, 10 aa, Mycobacterium
DDLAGAAKAA

SEQ ID NO: 445696 - protein, 13 aa, Mycobacterium
DDLAGRGYGYGPA

SEQ ID NO: 445697 - protein, 10 aa, Mycobacterium
DDLAKAQGIP

SEQ ID NO: 445698 - protein, 8 aa, Mycobacterium
DDLAPRAA

SEQ ID NO: 445699 - protein, 11 aa, Mycobacterium
DDLAQAQGIPP

SEQ ID NO: 445700 - protein, 10 aa, Mycobacterium
DDLASGPAHD

SEQ ID NO: 445701 - protein, 12 aa, Mycobacterium
DDLATGGVPPRV

SEQ ID NO: 445702 - protein, 9 aa, Mycobacterium
DDLATGRHV

SEQ ID NO: 445703 - protein, 13 aa, Mycobacterium
DDLDDPGDPGGRF

SEQ ID NO: 445704 - protein, 8 aa, Mycobacterium
DDLDGQGG

SEQ ID NO: 445705 - protein, 10 aa, Mycobacterium
DDLDRPGWES

SEQ ID NO: 445706 - protein, 8 aa, Mycobacterium
DDLEPDRA

SEQ ID NO: 445707 - protein, 10 aa, Mycobacterium
DDLERRGSGF

SEQ ID NO: 445708 - protein, 10 aa, Mycobacterium
DDLGEKESRG

SEQ ID NO: 445709 - protein, 45 aa, Mycobacterium
DDLGGKAKEGLGKLTGDKGTENEGKFDQAKSSIKDAGEKIKDAFK

SEQ ID NO: 445710 - protein, 12 aa, Mycobacterium
DDLGGSPEIVPG

SEQ ID NO: 445711 - protein, 14 aa, Mycobacterium
DDLGGSQEIAPGDP

SEQ ID NO: 445712 - protein, 21 aa, Mycobacterium
DDLGNPAYGYENTTGTGTTGG

SEQ ID NO: 445713 - protein, 8 aa, Mycobacterium
DDLGPKQW

SEQ ID NO: 445714 - protein, 14 aa, Mycobacterium
DDLGRDPSAVRAEA

SEQ ID NO: 445715 - protein, 8 aa, Mycobacterium
DDLGRRED

SEQ ID NO: 445716 - protein, 9 aa, Mycobacterium
DDLGRSPAE

SEQ ID NO: 445717 - protein, 14 aa, Mycobacterium
DDLGSGPQSPPVPS

SEQ ID NO: 445718 - protein, 10 aa, Mycobacterium
DDLNDTDDLE

SEQ ID NO: 445719 - protein, 9 aa, Mycobacterium
DDLPAADGY

SEQ ID NO: 445720 - protein, 7 aa, Mycobacterium
DDLPADP

SEQ ID NO: 445721 - protein, 5 aa, Mycobacterium
DDLPD

SEQ ID NO: 445722 - protein, 8 aa, Mycobacterium
DDLPDDAK

SEQ ID NO: 445723 - protein, 7 aa, Mycobacterium
DDLPEDA

SEQ ID NO: 445724 - protein, 10 aa, Mycobacterium
DDLPSGETAP

SEQ ID NO: 445725 - protein, 5 aa, Mycobacterium
DDLPT

SEQ ID NO: 445726 - protein, 13 aa, Mycobacterium
DDLPTRDLNPSEA

SEQ ID NO: 445727 - protein, 6 aa, Mycobacterium
DDLPVD

SEQ ID NO: 445728 - protein, 4 aa, Mycobacterium
DDLQ

SEQ ID NO: 445729 - protein, 10 aa, Mycobacterium
DDLQAAAREL

SEQ ID NO: 445730 - protein, 6 aa, Mycobacterium
DDLQTQ

SEQ ID NO: 445731 - protein, 10 aa, Mycobacterium
DDLRASGSSI

SEQ ID NO: 445732 - protein, 10 aa, Mycobacterium
DDLRDEPRWP

SEQ ID NO: 445733 - protein, 14 aa, Mycobacterium
DDLRDPMEKATPMK

SEQ ID NO: 445734 - protein, 5 aa, Mycobacterium
DDLRG

SEQ ID NO: 445735 - protein, 5 aa, Mycobacterium
DDLRR

SEQ ID NO: 445736 - protein, 12 aa, Mycobacterium
DDLRRARDAGIG

SEQ ID NO: 445737 - protein, 13 aa, Mycobacterium
DDLRTEPASATTQ

SEQ ID NO: 445738 - protein, 4 aa, Mycobacterium
DDLS

SEQ ID NO: 445739 - protein, 7 aa, Mycobacterium
DDLSAEL

SEQ ID NO: 445740 - protein, 6 aa, Mycobacterium
DDLSDQ

SEQ ID NO: 445741 - protein, 5 aa, Mycobacterium
DDLSR

SEQ ID NO: 445742 - protein, 6 aa, Mycobacterium
DDLSTG

SEQ ID NO: 445743 - protein, 4 aa, Mycobacterium
DDLT

SEQ ID NO: 445744 - protein, 5 aa, Mycobacterium
DDLTD

SEQ ID NO: 445745 - protein, 11 aa, Mycobacterium
DDLTDEEKQRF

SEQ ID NO: 445746 - protein, 9 aa, Mycobacterium
DDLTNSDTG

SEQ ID NO: 445747 - protein, 8 aa, Mycobacterium
DDLTPDEE

SEQ ID NO: 445748 - protein, 6 aa, Mycobacterium
DDLYAD

SEQ ID NO: 445749 - protein, 14 aa, Mycobacterium
DDLYPAADTPVNQS

SEQ ID NO: 445750 - protein, 5 aa, Mycobacterium
DDMEV

SEQ ID NO: 445751 - protein, 4 aa, Mycobacterium
DDMG

SEQ ID NO: 445752 - protein, 5 aa, Mycobacterium
DDMGA

SEQ ID NO: 445753 - protein, 7 aa, Mycobacterium
DDMGAGD

SEQ ID NO: 445754 - protein, 5 aa, Mycobacterium
DDMND

SEQ ID NO: 445755 - protein, 5 aa, Mycobacterium
DDMPE

SEQ ID NO: 445756 - protein, 9 aa, Mycobacterium
DDMPGMGAG

SEQ ID NO: 445757 - protein, 4 aa, Mycobacterium
DDMQ

SEQ ID NO: 445758 - protein, 19 aa, Mycobacterium
DDMRPTRSTEAGKTTPNLP

SEQ ID NO: 445759 - protein, 8 aa, Mycobacterium
DDMSEPTR

SEQ ID NO: 445760 - protein, 7 aa, Mycobacterium
DDMSGLP

SEQ ID NO: 445761 - protein, 9 aa, Mycobacterium
DDMTGDEAQ

SEQ ID NO: 445762 - protein, 6 aa, Mycobacterium
DDNADR

SEQ ID NO: 445763 - protein, 7 aa, Mycobacterium
DDNAGTV

SEQ ID NO: 445764 - protein, 14 aa, Mycobacterium
DDNAPAEPTTADDP

SEQ ID NO: 445765 - protein, 7 aa, Mycobacterium
DDNAQSI

SEQ ID NO: 445766 - protein, 7 aa, Mycobacterium
DDNAQTR

SEQ ID NO: 445767 - protein, 6 aa, Mycobacterium
DDNART

SEQ ID NO: 445768 - protein, 6 aa, Mycobacterium
DDNDLQ

SEQ ID NO: 445769 - protein, 9 aa, Mycobacterium
DDNDPRRHT

SEQ ID NO: 445770 - protein, 39 aa, Mycobacterium
DDNETLAAANTDLRSTNRTLREAAKAAKPAESRDREGTR

SEQ ID NO: 445771 - protein, 6 aa, Mycobacterium
DDNEWE

SEQ ID NO: 445772 - protein, 14 aa, Mycobacterium
DDNGDPVPHDGETV

SEQ ID NO: 445773 - protein, 5 aa, Mycobacterium
DDNGH

SEQ ID NO: 445774 - protein, 9 aa, Mycobacterium
DDNGNPKKA

SEQ ID NO: 445775 - protein, 23 aa, Mycobacterium
DDNGQQRTSTFGEDDVVRRYAKA

SEQ ID NO: 445776 - protein, 7 aa, Mycobacterium
DDNGRGP

SEQ ID NO: 445777 - protein, 12 aa, Mycobacterium
DDNGTDLFDPSS

SEQ ID NO: 445778 - protein, 30 aa, Mycobacterium
DDNGTYERRQHPWDNPRVTDNPGLGPRVPV

SEQ ID NO: 445779 - protein, 6 aa, Mycobacterium
DDNLDR

SEQ ID NO: 445780 - protein, 15 aa, Mycobacterium
DDNPDGQMSTTEIAD

SEQ ID NO: 445781 - protein, 7 aa, Mycobacterium
DDNPIKE

SEQ ID NO: 445782 - protein, 6 aa, Mycobacterium
DDNPIT

SEQ ID NO: 445783 - protein, 15 aa, Mycobacterium
DDNPNGAWAKSRRQR

SEQ ID NO: 445784 - protein, 15 aa, Mycobacterium
DDNPNQAWAKSRRER

SEQ ID NO: 445785 - protein, 8 aa, Mycobacterium
DDNPPEQI

SEQ ID NO: 445786 - protein, 10 aa, Mycobacterium
DDNPRGEDPA

SEQ ID NO: 445787 - protein, 11 aa, Mycobacterium
DDNPRGEDPAA

SEQ ID NO: 445788 - protein, 12 aa, Mycobacterium
DDNPRGEDPASI

SEQ ID NO: 445789 - protein, 12 aa, Mycobacterium
DDNPRGEDPGAI

SEQ ID NO: 445790 - protein, 11 aa, Mycobacterium
DDNPRNEEPAA

SEQ ID NO: 445791 - protein, 6 aa, Mycobacterium
DDNRDI

SEQ ID NO: 445792 - protein, 13 aa, Mycobacterium
DDNRDVLTDRQGH

SEQ ID NO: 445793 - protein, 7 aa, Mycobacterium
DDNRLGD

SEQ ID NO: 445794 - protein, 11 aa, Mycobacterium
DDNRPVPPGEV

SEQ ID NO: 445795 - protein, 6 aa, Mycobacterium
DDNRSA

SEQ ID NO: 445796 - protein, 8 aa, Mycobacterium
DDNSTTSA

SEQ ID NO: 445797 - protein, 7 aa, Mycobacterium
DDNSVSR

SEQ ID NO: 445798 - protein, 12 aa, Mycobacterium
DDNTESDGVSAP

SEQ ID NO: 445799 - protein, 7 aa, Mycobacterium
DDNTLEQ

SEQ ID NO: 445800 - protein, 6 aa, Mycobacterium
DDNTRT

SEQ ID NO: 445801 - protein, 9 aa, Mycobacterium
DDNVPSDAE

SEQ ID NO: 445802 - protein, 5 aa, Mycobacterium
DDPAA

SEQ ID NO: 445803 - protein, 9 aa, Mycobacterium
DDPAAARPV

SEQ ID NO: 445804 - protein, 6 aa, Mycobacterium
DDPAAE

SEQ ID NO: 445805 - protein, 9 aa, Mycobacterium
DDPAAGTGV

SEQ ID NO: 445806 - protein, 10 aa, Mycobacterium
DDPAAHGAAA

SEQ ID NO: 445807 - protein, 14 aa, Mycobacterium
DDPAAKSSSVPGAS

SEQ ID NO: 445808 - protein, 6 aa, Mycobacterium
DDPAAQ

SEQ ID NO: 445809 - protein, 8 aa, Mycobacterium
DDPAASPL

SEQ ID NO: 445810 - protein, 10 aa, Mycobacterium
DDPAASRAQM

SEQ ID NO: 445811 - protein, 10 aa, Mycobacterium
DDPAATAEAI

SEQ ID NO: 445812 - protein, 10 aa, Mycobacterium
DDPAATAQAI

SEQ ID NO: 445813 - protein, 7 aa, Mycobacterium
DDPAATG

SEQ ID NO: 445814 - protein, 9 aa, Mycobacterium
DDPADAEVA

SEQ ID NO: 445815 - protein, 7 aa, Mycobacterium
DDPADAI

SEQ ID NO: 445816 - protein, 8 aa, Mycobacterium
DDPADESF

SEQ ID NO: 445817 - protein, 8 aa, Mycobacterium
DDPADLDT

SEQ ID NO: 445818 - protein, 6 aa, Mycobacterium
DDPADR

SEQ ID NO: 445819 - protein, 7 aa, Mycobacterium
DDPAERL

SEQ ID NO: 445820 - protein, 7 aa, Mycobacterium
DDPAEVH

SEQ ID NO: 445821 - protein, 9 aa, Mycobacterium
DDPAGAVRD

SEQ ID NO: 445822 - protein, 7 aa, Mycobacterium
DDPAGFE

SEQ ID NO: 445823 - protein, 9 aa, Mycobacterium
DDPAGYQSR

SEQ ID NO: 445824 - protein, 8 aa, Mycobacterium
DDPAKIGQ

SEQ ID NO: 445825 - protein, 13 aa, Mycobacterium
DDPALGADPMRNN

SEQ ID NO: 445826 - protein, 19 aa, Mycobacterium
DDPALTARLPDGSLAARQP

SEQ ID NO: 445827 - protein, 19 aa, Mycobacterium
DDPALTARLPDGSLAPKQP

SEQ ID NO: 445828 - protein, 8 aa, Mycobacterium
DDPANAGV

SEQ ID NO: 445829 - protein, 9 aa, Mycobacterium
DDPAPAGLS

SEQ ID NO: 445830 - protein, 7 aa, Mycobacterium
DDPAPEA

SEQ ID NO: 445831 - protein, 5 aa, Mycobacterium
DDPAQ

SEQ ID NO: 445832 - protein, 9 aa, Mycobacterium
DDPAQGKDR

SEQ ID NO: 445833 - protein, 8 aa, Mycobacterium
DDPAQGSE

SEQ ID NO: 445834 - protein, 8 aa, Mycobacterium
DDPARGTE

SEQ ID NO: 445835 - protein, 8 aa, Mycobacterium
DDPARPAA

SEQ ID NO: 445836 - protein, 8 aa, Mycobacterium
DDPARPLT

SEQ ID NO: 445837 - protein, 8 aa, Mycobacterium
DDPARTYE

SEQ ID NO: 445838 - protein, 7 aa, Mycobacterium
DDPASAV

SEQ ID NO: 445839 - protein, 13 aa, Mycobacterium
DDPASGVYADPSK

SEQ ID NO: 445840 - protein, 16 aa, Mycobacterium
DDPASKSSTVPAVSER

SEQ ID NO: 445841 - protein, 7 aa, Mycobacterium
DDPASTT

SEQ ID NO: 445842 - protein, 5 aa, Mycobacterium
DDPAT

SEQ ID NO: 445843 - protein, 6 aa, Mycobacterium
DDPATG

SEQ ID NO: 445844 - protein, 6 aa, Mycobacterium
DDPATI

SEQ ID NO: 445845 - protein, 20 aa, Mycobacterium
DDPAVDDQPGTAPPGPGPDD

SEQ ID NO: 445846 - protein, 6 aa, Mycobacterium
DDPAVP

SEQ ID NO: 445847 - protein, 15 aa, Mycobacterium
DDPAVTLEGARGRQV

SEQ ID NO: 445848 - protein, 5 aa, Mycobacterium
DDPAY

SEQ ID NO: 445849 - protein, 13 aa, Mycobacterium
DDPCPGDGSVGAF

SEQ ID NO: 445850 - protein, 10 aa, Mycobacterium
DDPDAAQRRA

SEQ ID NO: 445851 - protein, 15 aa, Mycobacterium
DDPDAARPVAGATEA

SEQ ID NO: 445852 - protein, 12 aa, Mycobacterium
DDPDAATPTAGA

SEQ ID NO: 445853 - protein, 6 aa, Mycobacterium
DDPDAG

SEQ ID NO: 445854 - protein, 10 aa, Mycobacterium
DDPDASRANM

SEQ ID NO: 445855 - protein, 12 aa, Mycobacterium
DDPDATAEAIDP

SEQ ID NO: 445856 - protein, 6 aa, Mycobacterium
DDPDAV

SEQ ID NO: 445857 - protein, 9 aa, Mycobacterium
DDPDAVGPA

SEQ ID NO: 445858 - protein, 5 aa, Mycobacterium
DDPDD

SEQ ID NO: 445859 - protein, 7 aa, Mycobacterium
DDPDEPG

SEQ ID NO: 445860 - protein, 6 aa, Mycobacterium
DDPDGD

SEQ ID NO: 445861 - protein, 7 aa, Mycobacterium
DDPDGQR

SEQ ID NO: 445862 - protein, 7 aa, Mycobacterium
DDPDHDM

SEQ ID NO: 445863 - protein, 5 aa, Mycobacterium
DDPDL

SEQ ID NO: 445864 - protein, 7 aa, Mycobacterium
DDPDLDG

SEQ ID NO: 445865 - protein, 8 aa, Mycobacterium
DDPDLGPE

SEQ ID NO: 445866 - protein, 6 aa, Mycobacterium
DDPDLI

SEQ ID NO: 445867 - protein, 7 aa, Mycobacterium
DDPDLPA

SEQ ID NO: 445868 - protein, 7 aa, Mycobacterium
DDPDLPS

SEQ ID NO: 445869 - protein, 6 aa, Mycobacterium
DDPDMA

SEQ ID NO: 445870 - protein, 6 aa, Mycobacterium
DDPDNP

SEQ ID NO: 445871 - protein, 6 aa, Mycobacterium
DDPDQP

SEQ ID NO: 445872 - protein, 5 aa, Mycobacterium
DDPDR

SEQ ID NO: 445873 - protein, 8 aa, Mycobacterium
DDPDRADV

SEQ ID NO: 445874 - protein, 6 aa, Mycobacterium
DDPDRD

SEQ ID NO: 445875 - protein, 8 aa, Mycobacterium
DDPDRDAP

SEQ ID NO: 445876 - protein, 25 aa, Mycobacterium
DDPDRDKRGKNEPDPSSGANPLGPF

SEQ ID NO: 445877 - protein, 26 aa, Mycobacterium
DDPDRERGDAGRGSSGSGSSGADPFG

SEQ ID NO: 445878 - protein, 8 aa, Mycobacterium
DDPDRGRD

SEQ ID NO: 445879 - protein, 9 aa, Mycobacterium
DDPDRGREL

SEQ ID NO: 445880 - protein, 7 aa, Mycobacterium
DDPDRHR

SEQ ID NO: 445881 - protein, 7 aa, Mycobacterium
DDPDRQA

SEQ ID NO: 445882 - protein, 10 aa, Mycobacterium
DDPDSQGAGG

SEQ ID NO: 445883 - protein, 7 aa, Mycobacterium
DDPDTAV

SEQ ID NO: 445884 - protein, 8 aa, Mycobacterium
DDPDTSEC

SEQ ID NO: 445885 - protein, 6 aa, Mycobacterium
DDPDVS

SEQ ID NO: 445886 - protein, 6 aa, Mycobacterium
DDPDYP

SEQ ID NO: 445887 - protein, 4 aa, Mycobacterium
DDPE

SEQ ID NO: 445888 - protein, 5 aa, Mycobacterium
DDPEA

SEQ ID NO: 445889 - protein, 8 aa, Mycobacterium
DDPEANAA

SEQ ID NO: 445890 - protein, 7 aa, Mycobacterium
DDPEAPA

SEQ ID NO: 445891 - protein, 9 aa, Mycobacterium
DDPEARDGA

SEQ ID NO: 445892 - protein, 19 aa, Mycobacterium
DDPEATVTAGNASGQNDAA

SEQ ID NO: 445893 - protein, 19 aa, Mycobacterium
DDPEATVTAGNSSGQNDAA

SEQ ID NO: 445894 - protein, 8 aa, Mycobacterium
DDPEDGSS

SEQ ID NO: 445895 - protein, 8 aa, Mycobacterium
DDPEGFGP

SEQ ID NO: 445896 - protein, 10 aa, Mycobacterium
DDPEGTAAAI

SEQ ID NO: 445897 - protein, 11 aa, Mycobacterium
DDPELAQQPAL

SEQ ID NO: 445898 - protein, 11 aa, Mycobacterium
DDPELQPGERC

SEQ ID NO: 445899 - protein, 7 aa, Mycobacterium
DDPEQDP

SEQ ID NO: 445900 - protein, 8 aa, Mycobacterium
DDPERDRT

SEQ ID NO: 445901 - protein, 6 aa, Mycobacterium
DDPERH

SEQ ID NO: 445902 - protein, 9 aa, Mycobacterium
DDPERTAAA

SEQ ID NO: 445903 - protein, 9 aa, Mycobacterium
DDPESDAGF

SEQ ID NO: 445904 - protein, 10 aa, Mycobacterium
DDPESRDGAA

SEQ ID NO: 445905 - protein, 6 aa, Mycobacterium
DDPETN

SEQ ID NO: 445906 - protein, 6 aa, Mycobacterium
DDPEVL

SEQ ID NO: 445907 - protein, 6 aa, Mycobacterium
DDPEVS

SEQ ID NO: 445908 - protein, 6 aa, Mycobacterium
DDPEWG

SEQ ID NO: 445909 - protein, 5 aa, Mycobacterium
DDPEY

SEQ ID NO: 445910 - protein, 4 aa, Mycobacterium
DDPF

SEQ ID NO: 445911 - protein, 8 aa, Mycobacterium
DDPFYDPP

SEQ ID NO: 445912 - protein, 14 aa, Mycobacterium
DDPGAAALADRTDA

SEQ ID NO: 445913 - protein, 13 aa, Mycobacterium
DDPGAAELARRSA

SEQ ID NO: 445914 - protein, 9 aa, Mycobacterium
DDPGEALSP

SEQ ID NO: 445915 - protein, 7 aa, Mycobacterium
DDPGEPN

SEQ ID NO: 445916 - protein, 5 aa, Mycobacterium
DDPGG

SEQ ID NO: 445917 - protein, 9 aa, Mycobacterium
DDPGGAVSQ

SEQ ID NO: 445918 - protein, 12 aa, Mycobacterium
DDPGGDYGDPLV

SEQ ID NO: 445919 - protein, 9 aa, Mycobacterium
DDPGGISPH

SEQ ID NO: 445920 - protein, 7 aa, Mycobacterium
DDPGLPT

SEQ ID NO: 445921 - protein, 12 aa, Mycobacterium
DDPGLRDGERCG

SEQ ID NO: 445922 - protein, 8 aa, Mycobacterium
DDPGNDKV

SEQ ID NO: 445923 - protein, 9 aa, Mycobacterium
DDPGNDPRV

SEQ ID NO: 445924 - protein, 6 aa, Mycobacterium
DDPGNV

SEQ ID NO: 445925 - protein, 9 aa, Mycobacterium
DDPGRDDAV

SEQ ID NO: 445926 - protein, 9 aa, Mycobacterium
DDPGRDPVY

SEQ ID NO: 445927 - protein, 6 aa, Mycobacterium
DDPGRR

SEQ ID NO: 445928 - protein, 7 aa, Mycobacterium
DDPGRRL

SEQ ID NO: 445929 - protein, 8 aa, Mycobacterium
DDPGRSGE

SEQ ID NO: 445930 - protein, 16 aa, Mycobacterium
DDPGRWPLPSASTPHE

SEQ ID NO: 445931 - protein, 13 aa, Mycobacterium
DDPGSAALAERSA

SEQ ID NO: 445932 - protein, 7 aa, Mycobacterium
DDPGSGF

SEQ ID NO: 445933 - protein, 9 aa, Mycobacterium
DDPGSSERI

SEQ ID NO: 445934 - protein, 8 aa, Mycobacterium
DDPGTAPT

SEQ ID NO: 445935 - protein, 6 aa, Mycobacterium
DDPGTI

SEQ ID NO: 445936 - protein, 7 aa, Mycobacterium
DDPGTID

SEQ ID NO: 445937 - protein, 7 aa, Mycobacterium
DDPGTVA

SEQ ID NO: 445938 - protein, 7 aa, Mycobacterium
DDPGTVS

SEQ ID NO: 445939 - protein, 10 aa, Mycobacterium
DDPGTWTEPG

SEQ ID NO: 445940 - protein, 6 aa, Mycobacterium
DDPGVA

SEQ ID NO: 445941 - protein, 6 aa, Mycobacterium
DDPGVT

SEQ ID NO: 445942 - protein, 6 aa, Mycobacterium
DDPGYA

SEQ ID NO: 445943 - protein, 9 aa, Mycobacterium
DDPGYDEAR

SEQ ID NO: 445944 - protein, 7 aa, Mycobacterium
DDPGYGK

SEQ ID NO: 445945 - protein, 10 aa, Mycobacterium
DDPHAPPAPV

SEQ ID NO: 445946 - protein, 13 aa, Mycobacterium
DDPHGPLDRTHPA

SEQ ID NO: 445947 - protein, 5 aa, Mycobacterium
DDPHI

SEQ ID NO: 445948 - protein, 6 aa, Mycobacterium
DDPHLK

SEQ ID NO: 445949 - protein, 9 aa, Mycobacterium
DDPHPEGAG

SEQ ID NO: 445950 - protein, 19 aa, Mycobacterium
DDPHQDTSDSSVAAANYGS

SEQ ID NO: 445951 - protein, 15 aa, Mycobacterium
DDPHRRREGRPGAAQ

SEQ ID NO: 445952 - protein, 4 aa, Mycobacterium
DDPI

SEQ ID NO: 445953 - protein, 13 aa, Mycobacterium
DDPIEQTNRWPDP

SEQ ID NO: 445954 - protein, 5 aa, Mycobacterium
DDPIG

SEQ ID NO: 445955 - protein, 4 aa, Mycobacterium
DDPK

SEQ ID NO: 445956 - protein, 5 aa, Mycobacterium
DDPKA

SEQ ID NO: 445957 - protein, 12 aa, Mycobacterium
DDPKATAEAIDD

SEQ ID NO: 445958 - protein, 11 aa, Mycobacterium
DDPKRARRESR

SEQ ID NO: 445959 - protein, 9 aa, Mycobacterium
DDPKSSDRI

SEQ ID NO: 445960 - protein, 6 aa, Mycobacterium
DDPLAA

SEQ ID NO: 445961 - protein, 9 aa, Mycobacterium
DDPLATRPS

SEQ ID NO: 445962 - protein, 5 aa, Mycobacterium
DDPLG

SEQ ID NO: 445963 - protein, 13 aa, Mycobacterium
DDPLHGSQGPIPV

SEQ ID NO: 445964 - protein, 5 aa, Mycobacterium
DDPLP

SEQ ID NO: 445965 - protein, 21 aa, Mycobacterium
DDPLPESSNRGSGSDTVDTSV

SEQ ID NO: 445966 - protein, 9 aa, Mycobacterium
DDPLSPDVR

SEQ ID NO: 445967 - protein, 9 aa, Mycobacterium
DDPLTDNEA

SEQ ID NO: 445968 - protein, 9 aa, Mycobacterium
DDPMASPTA

SEQ ID NO: 445969 - protein, 9 aa, Mycobacterium
DDPNGETAG

SEQ ID NO: 445970 - protein, 9 aa, Mycobacterium
DDPNGSANV

SEQ ID NO: 445971 - protein, 9 aa, Mycobacterium
DDPNPEGAG

SEQ ID NO: 445972 - protein, 9 aa, Mycobacterium
DDPNPTREK

SEQ ID NO: 445973 - protein, 8 aa, Mycobacterium
DDPNRGHD

SEQ ID NO: 445974 - protein, 8 aa, Mycobacterium
DDPNRKKE

SEQ ID NO: 445975 - protein, 8 aa, Mycobacterium
DDPNWERR

SEQ ID NO: 445976 - protein, 4 aa, Mycobacterium
DDPP

SEQ ID NO: 445977 - protein, 9 aa, Mycobacterium
DDPPAPDPH

SEQ ID NO: 445978 - protein, 10 aa, Mycobacterium
DDPPASATAS

SEQ ID NO: 445979 - protein, 9 aa, Mycobacterium
DDPPAVEAY

SEQ ID NO: 445980 - protein, 9 aa, Mycobacterium
DDPPDDTAT

SEQ ID NO: 445981 - protein, 19 aa, Mycobacterium
DDPPDPDRERSMLVLGKYL

SEQ ID NO: 445982 - protein, 7 aa, Mycobacterium
DDPPHTR

SEQ ID NO: 445983 - protein, 11 aa, Mycobacterium
DDPPLTGDPRH

SEQ ID NO: 445984 - protein, 36 aa, Mycobacterium
DDPPPGRSGDRTDNDRKDSGPNGGDDQARKNVSRTY

SEQ ID NO: 445985 - protein, 8 aa, Mycobacterium
DDPPQGQW

SEQ ID NO: 445986 - protein, 7 aa, Mycobacterium
DDPPQIE

SEQ ID NO: 445987 - protein, 7 aa, Mycobacterium
DDPPSFD

SEQ ID NO: 445988 - protein, 8 aa, Mycobacterium
DDPPSGAD

SEQ ID NO: 445989 - protein, 4 aa, Mycobacterium
DDPQ

SEQ ID NO: 445990 - protein, 6 aa, Mycobacterium
DDPQAL

SEQ ID NO: 445991 - protein, 6 aa, Mycobacterium
DDPQGV

SEQ ID NO: 445992 - protein, 14 aa, Mycobacterium
DDPQLTARTPDNEL

SEQ ID NO: 445993 - protein, 6 aa, Mycobacterium
DDPQNI

SEQ ID NO: 445994 - protein, 7 aa, Mycobacterium
DDPQPEW

SEQ ID NO: 445995 - protein, 16 aa, Mycobacterium
DDPQPGWYDTESGDLV

SEQ ID NO: 445996 - protein, 16 aa, Mycobacterium
DDPQPGWYDTESGELV

SEQ ID NO: 445997 - protein, 15 aa, Mycobacterium
DDPQPGWYDTGTGEL

SEQ ID NO: 445998 - protein, 22 aa, Mycobacterium
DDPQPNRSAVPPVTASDPQPGV

SEQ ID NO: 445999 - protein, 60 aa, Mycobacterium
DDPQQGKRSERSSAPRRDDRNRDDRNQGRRNQNRDKNSGRREESRPTGSMADALRNAGFG

SEQ ID NO: 446000 - protein, 6 aa, Mycobacterium
DDPQSE

SEQ ID NO: 446001 - protein, 5 aa, Mycobacterium
DDPQV

SEQ ID NO: 446002 - protein, 6 aa, Mycobacterium
DDPQVG

SEQ ID NO: 446003 - protein, 5 aa, Mycobacterium
DDPRA

SEQ ID NO: 446004 - protein, 9 aa, Mycobacterium
DDPRANPDA

SEQ ID NO: 446005 - protein, 5 aa, Mycobacterium
DDPRD

SEQ ID NO: 446006 - protein, 27 aa, Mycobacterium
DDPRDDRSGRDKPGNNDPESGSDANPL

SEQ ID NO: 446007 - protein, 16 aa, Mycobacterium
DDPRDGEEPDGESGGP

SEQ ID NO: 446008 - protein, 9 aa, Mycobacterium
DDPRGERFA

SEQ ID NO: 446009 - protein, 8 aa, Mycobacterium
DDPRGLGG

SEQ ID NO: 446010 - protein, 6 aa, Mycobacterium
DDPRGR

SEQ ID NO: 446011 - protein, 8 aa, Mycobacterium
DDPRHPAQ

SEQ ID NO: 446012 - protein, 6 aa, Mycobacterium
DDPRKA

SEQ ID NO: 446013 - protein, 8 aa, Mycobacterium
DDPRLREG

SEQ ID NO: 446014 - protein, 8 aa, Mycobacterium
DDPRLSDE

SEQ ID NO: 446015 - protein, 6 aa, Mycobacterium
DDPRNY

SEQ ID NO: 446016 - protein, 8 aa, Mycobacterium
DDPRPAES

SEQ ID NO: 446017 - protein, 11 aa, Mycobacterium
DDPRPSREPQV

SEQ ID NO: 446018 - protein, 5 aa, Mycobacterium
DDPRR

SEQ ID NO: 446019 - protein, 8 aa, Mycobacterium
DDPRRATT

SEQ ID NO: 446020 - protein, 10 aa, Mycobacterium
DDPRSGRAAL

SEQ ID NO: 446021 - protein, 9 aa, Mycobacterium
DDPRTNPDA

SEQ ID NO: 446022 - protein, 13 aa, Mycobacterium
DDPRTRAQRRADA

SEQ ID NO: 446023 - protein, 5 aa, Mycobacterium
DDPRV

SEQ ID NO: 446024 - protein, 10 aa, Mycobacterium
DDPRVNPIAG

SEQ ID NO: 446025 - protein, 4 aa, Mycobacterium
DDPS

SEQ ID NO: 446026 - protein, 9 aa, Mycobacterium
DDPSAREAM

SEQ ID NO: 446027 - protein, 17 aa, Mycobacterium
DDPSASDRISQYSESNS

SEQ ID NO: 446028 - protein, 8 aa, Mycobacterium
DDPSIETG

SEQ ID NO: 446029 - protein, 9 aa, Mycobacterium
DDPSIPGKL

SEQ ID NO: 446030 - protein, 6 aa, Mycobacterium
DDPSLA

SEQ ID NO: 446031 - protein, 6 aa, Mycobacterium
DDPSLP

SEQ ID NO: 446032 - protein, 8 aa, Mycobacterium
DDPSQPPV

SEQ ID NO: 446033 - protein, 8 aa, Mycobacterium
DDPSRACN

SEQ ID NO: 446034 - protein, 9 aa, Mycobacterium
DDPSRGKDR

SEQ ID NO: 446035 - protein, 9 aa, Mycobacterium
DDPSSLRGT

SEQ ID NO: 446036 - protein, 10 aa, Mycobacterium
DDPSSPSHQV

SEQ ID NO: 446037 - protein, 7 aa, Mycobacterium
DDPSTPV

SEQ ID NO: 446038 - protein, 8 aa, Mycobacterium
DDPSVSRA

SEQ ID NO: 446039 - protein, 27 aa, Mycobacterium
DDPTAAPGWPTRPGWPNTLAGDGRTEI

SEQ ID NO: 446040 - protein, 11 aa, Mycobacterium
DDPTADTDART

SEQ ID NO: 446041 - protein, 11 aa, Mycobacterium
DDPTADVEEGR

SEQ ID NO: 446042 - protein, 12 aa, Mycobacterium
DDPTADVSEGRR

SEQ ID NO: 446043 - protein, 11 aa, Mycobacterium
DDPTADVTEGR

SEQ ID NO: 446044 - protein, 6 aa, Mycobacterium
DDPTAG

SEQ ID NO: 446045 - protein, 9 aa, Mycobacterium
DDPTASARE

SEQ ID NO: 446046 - protein, 8 aa, Mycobacterium
DDPTDDLG

SEQ ID NO: 446047 - protein, 8 aa, Mycobacterium
DDPTDESF

SEQ ID NO: 446048 - protein, 9 aa, Mycobacterium
DDPTDESFS

SEQ ID NO: 446049 - protein, 5 aa, Mycobacterium
DDPTF

SEQ ID NO: 446050 - protein, 11 aa, Mycobacterium
DDPTGRSLYDT

SEQ ID NO: 446051 - protein, 9 aa, Mycobacterium
DDPTGTDES

SEQ ID NO: 446052 - protein, 8 aa, Mycobacterium
DDPTGTTD

SEQ ID NO: 446053 - protein, 10 aa, Mycobacterium
DDPTKGKDRP

SEQ ID NO: 446054 - protein, 18 aa, Mycobacterium
DDPTLTARLPDGSLAARQ

SEQ ID NO: 446055 - protein, 17 aa, Mycobacterium
DDPTPNTSPSSTASGAA

SEQ ID NO: 446056 - protein, 9 aa, Mycobacterium
DDPTQGQDR

SEQ ID NO: 446057 - protein, 10 aa, Mycobacterium
DDPTQLGTAP

SEQ ID NO: 446058 - protein, 9 aa, Mycobacterium
DDPTQRCPE

SEQ ID NO: 446059 - protein, 7 aa, Mycobacterium
DDPTSGV

SEQ ID NO: 446060 - protein, 12 aa, Mycobacterium
DDPTSLGDAPVT

SEQ ID NO: 446061 - protein, 9 aa, Mycobacterium
DDPTTHDEI

SEQ ID NO: 446062 - protein, 5 aa, Mycobacterium
DDPVA

SEQ ID NO: 446063 - protein, 6 aa, Mycobacterium
DDPVAR

SEQ ID NO: 446064 - protein, 6 aa, Mycobacterium
DDPVPA

SEQ ID NO: 446065 - protein, 5 aa, Mycobacterium
DDPVQ

SEQ ID NO: 446066 - protein, 7 aa, Mycobacterium
DDPVRGT

SEQ ID NO: 446067 - protein, 5 aa, Mycobacterium
DDPVS

SEQ ID NO: 446068 - protein, 13 aa, Mycobacterium
DDPVSASPAATDA

SEQ ID NO: 446069 - protein, 7 aa, Mycobacterium
DDPVTRA

SEQ ID NO: 446070 - protein, 18 aa, Mycobacterium
DDPWADPDFSRDPVTETT

SEQ ID NO: 446071 - protein, 6 aa, Mycobacterium
DDPWPE

SEQ ID NO: 446072 - protein, 7 aa, Mycobacterium
DDPWPTT

SEQ ID NO: 446073 - protein, 7 aa, Mycobacterium
DDPYEAP

SEQ ID NO: 446074 - protein, 8 aa, Mycobacterium
DDPYPRAT

SEQ ID NO: 446075 - protein, 20 aa, Mycobacterium
DDPYSGIEGDCPRGHFHVLA

SEQ ID NO: 446076 - protein, 8 aa, Mycobacterium
DDQAAHDS

SEQ ID NO: 446077 - protein, 7 aa, Mycobacterium
DDQAERC

SEQ ID NO: 446078 - protein, 14 aa, Mycobacterium
DDQAGTDDNAPHET

SEQ ID NO: 446079 - protein, 11 aa, Mycobacterium
DDQANRAAGGL

SEQ ID NO: 446080 - protein, 8 aa, Mycobacterium
DDQARAAV

SEQ ID NO: 446081 - protein, 8 aa, Mycobacterium
DDQARTAH

SEQ ID NO: 446082 - protein, 4 aa, Mycobacterium
DDQD

SEQ ID NO: 446083 - protein, 31 aa, Mycobacterium
DDQDDALSRAQRRKAAMDRSGGQTDGPDPLD

SEQ ID NO: 446084 - protein, 5 aa, Mycobacterium
DDQDL

SEQ ID NO: 446085 - protein, 9 aa, Mycobacterium
DDQDNPDIS

SEQ ID NO: 446086 - protein, 8 aa, Mycobacterium
DDQDPATP

SEQ ID NO: 446087 - protein, 7 aa, Mycobacterium
DDQGGRF

SEQ ID NO: 446088 - protein, 7 aa, Mycobacterium
DDQGHRY

SEQ ID NO: 446089 - protein, 7 aa, Mycobacterium
DDQGHSD

SEQ ID NO: 446090 - protein, 16 aa, Mycobacterium
DDQGKDGGLPLRPWWS

SEQ ID NO: 446091 - protein, 6 aa, Mycobacterium
DDQGNL

SEQ ID NO: 446092 - protein, 6 aa, Mycobacterium
DDQGRG

SEQ ID NO: 446093 - protein, 8 aa, Mycobacterium
DDQGRMRP

SEQ ID NO: 446094 - protein, 6 aa, Mycobacterium
DDQGRP

SEQ ID NO: 446095 - protein, 6 aa, Mycobacterium
DDQGVH

SEQ ID NO: 446096 - protein, 4 aa, Mycobacterium
DDQI

SEQ ID NO: 446097 - protein, 4 aa, Mycobacterium
DDQL

SEQ ID NO: 446098 - protein, 9 aa, Mycobacterium
DDQLDATTA

SEQ ID NO: 446099 - protein, 6 aa, Mycobacterium
DDQLPS

SEQ ID NO: 446100 - protein, 11 aa, Mycobacterium
DDQLSDDARGV

SEQ ID NO: 446101 - protein, 11 aa, Mycobacterium
DDQLSDDARSV

SEQ ID NO: 446102 - protein, 10 aa, Mycobacterium
DDQLSDEARG

SEQ ID NO: 446103 - protein, 12 aa, Mycobacterium
DDQLSGATPCSG

SEQ ID NO: 446104 - protein, 16 aa, Mycobacterium
DDQNRTVARGQVRLQN

SEQ ID NO: 446105 - protein, 8 aa, Mycobacterium
DDQPGGIA

SEQ ID NO: 446106 - protein, 14 aa, Mycobacterium
DDQPTTDPTDAERV

SEQ ID NO: 446107 - protein, 7 aa, Mycobacterium
DDQPVSS

SEQ ID NO: 446108 - protein, 6 aa, Mycobacterium
DDQQRQ

SEQ ID NO: 446109 - protein, 7 aa, Mycobacterium
DDQQYEA

SEQ ID NO: 446110 - protein, 9 aa, Mycobacterium
DDQRAAGYA

SEQ ID NO: 446111 - protein, 5 aa, Mycobacterium
DDQRD

SEQ ID NO: 446112 - protein, 5 aa, Mycobacterium
DDQRE

SEQ ID NO: 446113 - protein, 7 aa, Mycobacterium
DDQSERI

SEQ ID NO: 446114 - protein, 9 aa, Mycobacterium
DDQSPTGPA

SEQ ID NO: 446115 - protein, 5 aa, Mycobacterium
DDQSW

SEQ ID NO: 446116 - protein, 5 aa, Mycobacterium
DDQTA

SEQ ID NO: 446117 - protein, 6 aa, Mycobacterium
DDQTGD

SEQ ID NO: 446118 - protein, 8 aa, Mycobacterium
DDQTGVKS

SEQ ID NO: 446119 - protein, 8 aa, Mycobacterium
DDQVPGDV

SEQ ID NO: 446120 - protein, 5 aa, Mycobacterium
DDQWQ

SEQ ID NO: 446121 - protein, 4 aa, Mycobacterium
DDQY

SEQ ID NO: 446122 - protein, 7 aa, Mycobacterium
DDQYRAT

SEQ ID NO: 446123 - protein, 5 aa, Mycobacterium
DDRAA

SEQ ID NO: 446124 - protein, 9 aa, Mycobacterium
DDRAAARAH

SEQ ID NO: 446125 - protein, 6 aa, Mycobacterium
DDRAAE

SEQ ID NO: 446126 - protein, 13 aa, Mycobacterium
DDRAAKAKAAAAL

SEQ ID NO: 446127 - protein, 7 aa, Mycobacterium
DDRADAA

SEQ ID NO: 446128 - protein, 7 aa, Mycobacterium
DDRAERD

SEQ ID NO: 446129 - protein, 6 aa, Mycobacterium
DDRAGG

SEQ ID NO: 446130 - protein, 13 aa, Mycobacterium
DDRAGLPAGTTSN

SEQ ID NO: 446131 - protein, 16 aa, Mycobacterium
DDRAGRAVLDRLFAFA

SEQ ID NO: 446132 - protein, 6 aa, Mycobacterium
DDRAHR

SEQ ID NO: 446133 - protein, 14 aa, Mycobacterium
DDRAHRYAPTHGRD

SEQ ID NO: 446134 - protein, 11 aa, Mycobacterium
DDRAKQTPCTE

SEQ ID NO: 446135 - protein, 8 aa, Mycobacterium
DDRAPGTV

SEQ ID NO: 446136 - protein, 5 aa, Mycobacterium
DDRAR

SEQ ID NO: 446137 - protein, 6 aa, Mycobacterium
DDRARG

SEQ ID NO: 446138 - protein, 6 aa, Mycobacterium
DDRARV

SEQ ID NO: 446139 - protein, 6 aa, Mycobacterium
DDRDAH

SEQ ID NO: 446140 - protein, 8 aa, Mycobacterium
DDRDASAH

SEQ ID NO: 446141 - protein, 7 aa, Mycobacterium
DDRDFPD

SEQ ID NO: 446142 - protein, 9 aa, Mycobacterium
DDRDGAENP

SEQ ID NO: 446143 - protein, 10 aa, Mycobacterium
DDRDKAREIG

SEQ ID NO: 446144 - protein, 17 aa, Mycobacterium
DDRDPDDEDDDGPAEES

SEQ ID NO: 446145 - protein, 6 aa, Mycobacterium
DDRDPP

SEQ ID NO: 446146 - protein, 6 aa, Mycobacterium
DDRDSA

SEQ ID NO: 446147 - protein, 33 aa, Mycobacterium
DDRDVQDGDRAAARRSHTKPGLAENAKDIPVQS

SEQ ID NO: 446148 - protein, 7 aa, Mycobacterium
DDREAAA

SEQ ID NO: 446149 - protein, 6 aa, Mycobacterium
DDREAQ

SEQ ID NO: 446150 - protein, 6 aa, Mycobacterium
DDREAV

SEQ ID NO: 446151 - protein, 5 aa, Mycobacterium
DDREK

SEQ ID NO: 446152 - protein, 10 aa, Mycobacterium
DDRFDEDRTG

SEQ ID NO: 446153 - protein, 4 aa, Mycobacterium
DDRG

SEQ ID NO: 446154 - protein, 7 aa, Mycobacterium
DDRGDPV

SEQ ID NO: 446155 - protein, 9 aa, Mycobacterium
DDRGKAAHR

SEQ ID NO: 446156 - protein, 7 aa, Mycobacterium
DDRGKSY

SEQ ID NO: 446157 - protein, 6 aa, Mycobacterium
DDRGNL

SEQ ID NO: 446158 - protein, 13 aa, Mycobacterium
DDRGPLALGASGD

SEQ ID NO: 446159 - protein, 10 aa, Mycobacterium
DDRGRTDRRR

SEQ ID NO: 446160 - protein, 8 aa, Mycobacterium
DDRGTEIA

SEQ ID NO: 446161 - protein, 5 aa, Mycobacterium
DDRGV

SEQ ID NO: 446162 - protein, 7 aa, Mycobacterium
DDRGWYD

SEQ ID NO: 446163 - protein, 9 aa, Mycobacterium
DDRIADRPA

SEQ ID NO: 446164 - protein, 13 aa, Mycobacterium
DDRKGVSPDPQRH

SEQ ID NO: 446165 - protein, 7 aa, Mycobacterium
DDRKSAI

SEQ ID NO: 446166 - protein, 9 aa, Mycobacterium
DDRLGDVRG

SEQ ID NO: 446167 - protein, 5 aa, Mycobacterium
DDRLP

SEQ ID NO: 446168 - protein, 14 aa, Mycobacterium
DDRLPSIEVGALGP

SEQ ID NO: 446169 - protein, 6 aa, Mycobacterium
DDRLRG

SEQ ID NO: 446170 - protein, 16 aa, Mycobacterium
DDRNAAELRAVRCSSA

SEQ ID NO: 446171 - protein, 6 aa, Mycobacterium
DDRNDR

SEQ ID NO: 446172 - protein, 7 aa, Mycobacterium
DDRNDRL

SEQ ID NO: 446173 - protein, 8 aa, Mycobacterium
DDRNPASV

SEQ ID NO: 446174 - protein, 10 aa, Mycobacterium
DDRNQTPVRP

SEQ ID NO: 446175 - protein, 11 aa, Mycobacterium
DDRNSSATTGL

SEQ ID NO: 446176 - protein, 4 aa, Mycobacterium
DDRP

SEQ ID NO: 446177 - protein, 8 aa, Mycobacterium
DDRPGRGF

SEQ ID NO: 446178 - protein, 15 aa, Mycobacterium
DDRPGRRLGPQARQY

SEQ ID NO: 446179 - protein, 8 aa, Mycobacterium
DDRPGRVF

SEQ ID NO: 446180 - protein, 10 aa, Mycobacterium
DDRPKGELGT

SEQ ID NO: 446181 - protein, 14 aa, Mycobacterium
DDRPLADYDEDGAR

SEQ ID NO: 446182 - protein, 6 aa, Mycobacterium
DDRPRT

SEQ ID NO: 446183 - protein, 17 aa, Mycobacterium
DDRPSGTMVAKTSVKVS

SEQ ID NO: 446184 - protein, 18 aa, Mycobacterium
DDRPVAERAEAKQISAES

SEQ ID NO: 446185 - protein, 19 aa, Mycobacterium
DDRPVAERAEAKQISAEST

SEQ ID NO: 446186 - protein, 23 aa, Mycobacterium
DDRPVAERAEAKQISAESTFPED

SEQ ID NO: 446187 - protein, 19 aa, Mycobacterium
DDRPVAERAEAKQISSEST

SEQ ID NO: 446188 - protein, 23 aa, Mycobacterium
DDRPVTENAPAKQISAESTFPED

SEQ ID NO: 446189 - protein, 13 aa, Mycobacterium
DDRPYKESYGMAS

SEQ ID NO: 446190 - protein, 8 aa, Mycobacterium
DDRPYSAS

SEQ ID NO: 446191 - protein, 15 aa, Mycobacterium
DDRQADKPVTVPSTS

SEQ ID NO: 446192 - protein, 6 aa, Mycobacterium
DDRQSL

SEQ ID NO: 446193 - protein, 6 aa, Mycobacterium
DDRRAD

SEQ ID NO: 446194 - protein, 6 aa, Mycobacterium
DDRRAS

SEQ ID NO: 446195 - protein, 8 aa, Mycobacterium
DDRRASDL

SEQ ID NO: 446196 - protein, 7 aa, Mycobacterium
DDRRASF

SEQ ID NO: 446197 - protein, 8 aa, Mycobacterium
DDRRPLKQ

SEQ ID NO: 446198 - protein, 13 aa, Mycobacterium
DDRRPRGGRPEPR

SEQ ID NO: 446199 - protein, 10 aa, Mycobacterium
DDRRPTPTDI

SEQ ID NO: 446200 - protein, 7 aa, Mycobacterium
DDRRRAH

SEQ ID NO: 446201 - protein, 12 aa, Mycobacterium
DDRSAEADRYET

SEQ ID NO: 446202 - protein, 7 aa, Mycobacterium
DDRSAGL

SEQ ID NO: 446203 - protein, 6 aa, Mycobacterium
DDRSEG

SEQ ID NO: 446204 - protein, 6 aa, Mycobacterium
DDRSEY

SEQ ID NO: 446205 - protein, 6 aa, Mycobacterium
DDRSLR

SEQ ID NO: 446206 - protein, 5 aa, Mycobacterium
DDRSR

SEQ ID NO: 446207 - protein, 7 aa, Mycobacterium
DDRSRHR

SEQ ID NO: 446208 - protein, 10 aa, Mycobacterium
DDRSRKNPAR

SEQ ID NO: 446209 - protein, 5 aa, Mycobacterium
DDRSV

SEQ ID NO: 446210 - protein, 4 aa, Mycobacterium
DDRT

SEQ ID NO: 446211 - protein, 5 aa, Mycobacterium
DDRTA

SEQ ID NO: 446212 - protein, 6 aa, Mycobacterium
DDRTAR

SEQ ID NO: 446213 - protein, 8 aa, Mycobacterium
DDRTAVQQ

SEQ ID NO: 446214 - protein, 17 aa, Mycobacterium
DDRTDLSAAQRGFAQPA

SEQ ID NO: 446215 - protein, 7 aa, Mycobacterium
DDRTEAL

SEQ ID NO: 446216 - protein, 7 aa, Mycobacterium
DDRTGPP

SEQ ID NO: 446217 - protein, 8 aa, Mycobacterium
DDRTGPPV

SEQ ID NO: 446218 - protein, 8 aa, Mycobacterium
DDRTHTDI

SEQ ID NO: 446219 - protein, 5 aa, Mycobacterium
DDRTR

SEQ ID NO: 446220 - protein, 7 aa, Mycobacterium
DDRTRFA

SEQ ID NO: 446221 - protein, 9 aa, Mycobacterium
DDRTRGPRA

SEQ ID NO: 446222 - protein, 12 aa, Mycobacterium
DDRTRRRAERRI

SEQ ID NO: 446223 - protein, 13 aa, Mycobacterium
DDRTSHGLPTATP

SEQ ID NO: 446224 - protein, 6 aa, Mycobacterium
DDRTTR

SEQ ID NO: 446225 - protein, 8 aa, Mycobacterium
DDRTTTQE

SEQ ID NO: 446226 - protein, 4 aa, Mycobacterium
DDRV

SEQ ID NO: 446227 - protein, 10 aa, Mycobacterium
DDRVDDRPAL

SEQ ID NO: 446228 - protein, 6 aa, Mycobacterium
DDRVGD

SEQ ID NO: 446229 - protein, 4 aa, Mycobacterium
DDRY

SEQ ID NO: 446230 - protein, 6 aa, Mycobacterium
DDRYGE

SEQ ID NO: 446231 - protein, 7 aa, Mycobacterium
DDRYPRR

SEQ ID NO: 446232 - protein, 4 aa, Mycobacterium
DDSA

SEQ ID NO: 446233 - protein, 7 aa, Mycobacterium
DDSAAAV

SEQ ID NO: 446234 - protein, 25 aa, Mycobacterium
DDSADTSQRGGSRADDDPASAPTTA

SEQ ID NO: 446235 - protein, 7 aa, Mycobacterium
DDSAGKL

SEQ ID NO: 446236 - protein, 6 aa, Mycobacterium
DDSAIP

SEQ ID NO: 446237 - protein, 28 aa, Mycobacterium
DDSALDEAARRAHQASQNALGGSAGSPI

SEQ ID NO: 446238 - protein, 10 aa, Mycobacterium
DDSAQGSRRE

SEQ ID NO: 446239 - protein, 8 aa, Mycobacterium
DDSASALE

SEQ ID NO: 446240 - protein, 9 aa, Mycobacterium
DDSATRRGL

SEQ ID NO: 446241 - protein, 12 aa, Mycobacterium
DDSATRRGRPTT

SEQ ID NO: 446242 - protein, 9 aa, Mycobacterium
DDSATTIRQ

SEQ ID NO: 446243 - protein, 17 aa, Mycobacterium
DDSATTQAGKTLGPIDT

SEQ ID NO: 446244 - protein, 6 aa, Mycobacterium
DDSAVR

SEQ ID NO: 446245 - protein, 9 aa, Mycobacterium
DDSDASALS

SEQ ID NO: 446246 - protein, 8 aa, Mycobacterium
DDSDDEPD

SEQ ID NO: 446247 - protein, 13 aa, Mycobacterium
DDSDKGADGLDDD

SEQ ID NO: 446248 - protein, 17 aa, Mycobacterium
DDSDPTTRAGGAHTATD

SEQ ID NO: 446249 - protein, 26 aa, Mycobacterium
DDSDRLREAANSVGSRQAPESDSRGK

SEQ ID NO: 446250 - protein, 6 aa, Mycobacterium
DDSDRW

SEQ ID NO: 446251 - protein, 4 aa, Mycobacterium
DDSE

SEQ ID NO: 446252 - protein, 9 aa, Mycobacterium
DDSEDLSGK

SEQ ID NO: 446253 - protein, 9 aa, Mycobacterium
DDSEEGPDA

SEQ ID NO: 446254 - protein, 7 aa, Mycobacterium
DDSEGRP

SEQ ID NO: 446255 - protein, 10 aa, Mycobacterium
DDSENAPPTA

SEQ ID NO: 446256 - protein, 15 aa, Mycobacterium
DDSENEDPASAPAGV

SEQ ID NO: 446257 - protein, 8 aa, Mycobacterium
DDSEPETR

SEQ ID NO: 446258 - protein, 7 aa, Mycobacterium
DDSESRI

SEQ ID NO: 446259 - protein, 10 aa, Mycobacterium
DDSESSDGAA

SEQ ID NO: 446260 - protein, 6 aa, Mycobacterium
DDSEVA

SEQ ID NO: 446261 - protein, 9 aa, Mycobacterium
DDSEYTREQ

SEQ ID NO: 446262 - protein, 11 aa, Mycobacterium
DDSFDDEQIPN

SEQ ID NO: 446263 - protein, 9 aa, Mycobacterium
DDSFSDGGR

SEQ ID NO: 446264 - protein, 8 aa, Mycobacterium
DDSFSTDV

SEQ ID NO: 446265 - protein, 4 aa, Mycobacterium
DDSG

SEQ ID NO: 446266 - protein, 10 aa, Mycobacterium
DDSGAESRAA

SEQ ID NO: 446267 - protein, 5 aa, Mycobacterium
DDSGC

SEQ ID NO: 446268 - protein, 8 aa, Mycobacterium
DDSGEVVG

SEQ ID NO: 446269 - protein, 6 aa, Mycobacterium
DDSGGD

SEQ ID NO: 446270 - protein, 9 aa, Mycobacterium
DDSGGDGRP

SEQ ID NO: 446271 - protein, 13 aa, Mycobacterium
DDSGIDPGYQQRE

SEQ ID NO: 446272 - protein, 7 aa, Mycobacterium
DDSGNDL

SEQ ID NO: 446273 - protein, 6 aa, Mycobacterium
DDSGNE

SEQ ID NO: 446274 - protein, 7 aa, Mycobacterium
DDSGNGL

SEQ ID NO: 446275 - protein, 7 aa, Mycobacterium
DDSGRFA

SEQ ID NO: 446276 - protein, 7 aa, Mycobacterium
DDSGRLT

SEQ ID NO: 446277 - protein, 5 aa, Mycobacterium
DDSGV

SEQ ID NO: 446278 - protein, 13 aa, Mycobacterium
DDSGWAQASGCPG

SEQ ID NO: 446279 - protein, 16 aa, Mycobacterium
DDSGYAQERDPAARSA

SEQ ID NO: 446280 - protein, 8 aa, Mycobacterium
DDSGYVDP

SEQ ID NO: 446281 - protein, 7 aa, Mycobacterium
DDSHTSA

SEQ ID NO: 446282 - protein, 11 aa, Mycobacterium
DDSKKLTEKTR

SEQ ID NO: 446283 - protein, 8 aa, Mycobacterium
DDSKRKFR

SEQ ID NO: 446284 - protein, 9 aa, Mycobacterium
DDSKSATFE

SEQ ID NO: 446285 - protein, 8 aa, Mycobacterium
DDSLADGN

SEQ ID NO: 446286 - protein, 8 aa, Mycobacterium
DDSLPPAY

SEQ ID NO: 446287 - protein, 4 aa, Mycobacterium
DDSN

SEQ ID NO: 446288 - protein, 9 aa, Mycobacterium
DDSPASRQA

SEQ ID NO: 446289 - protein, 6 aa, Mycobacterium
DDSPDL

SEQ ID NO: 446290 - protein, 10 aa, Mycobacterium
DDSPKPPPQR

SEQ ID NO: 446291 - protein, 8 aa, Mycobacterium
DDSPNPSE

SEQ ID NO: 446292 - protein, 8 aa, Mycobacterium
DDSPPEGW

SEQ ID NO: 446293 - protein, 7 aa, Mycobacterium
DDSPTGA

SEQ ID NO: 446294 - protein, 5 aa, Mycobacterium
DDSPV

SEQ ID NO: 446295 - protein, 10 aa, Mycobacterium
DDSPYGGGPG

SEQ ID NO: 446296 - protein, 8 aa, Mycobacterium
DDSQTGAV

SEQ ID NO: 446297 - protein, 5 aa, Mycobacterium
DDSQW

SEQ ID NO: 446298 - protein, 5 aa, Mycobacterium
DDSRA

SEQ ID NO: 446299 - protein, 6 aa, Mycobacterium
DDSRLA

SEQ ID NO: 446300 - protein, 12 aa, Mycobacterium
DDSRPRKLRPGD

SEQ ID NO: 446301 - protein, 10 aa, Mycobacterium
DDSRPRNDLP

SEQ ID NO: 446302 - protein, 5 aa, Mycobacterium
DDSRQ

SEQ ID NO: 446303 - protein, 8 aa, Mycobacterium
DDSRVGAN

SEQ ID NO: 446304 - protein, 11 aa, Mycobacterium
DDSSAHDQHSK

SEQ ID NO: 446305 - protein, 10 aa, Mycobacterium
DDSSGTTSRA

SEQ ID NO: 446306 - protein, 9 aa, Mycobacterium
DDSSLGALS

SEQ ID NO: 446307 - protein, 7 aa, Mycobacterium
DDSSLSA

SEQ ID NO: 446308 - protein, 19 aa, Mycobacterium
DDSSPSREEAVPESSTESV

SEQ ID NO: 446309 - protein, 9 aa, Mycobacterium
DDSSSRPLR

SEQ ID NO: 446310 - protein, 5 aa, Mycobacterium
DDSST

SEQ ID NO: 446311 - protein, 12 aa, Mycobacterium
DDSSTRRGRPTT

SEQ ID NO: 446312 - protein, 6 aa, Mycobacterium
DDSSYV

SEQ ID NO: 446313 - protein, 10 aa, Mycobacterium
DDSTAEPAEV

SEQ ID NO: 446314 - protein, 13 aa, Mycobacterium
DDSTAPADWDKPL

SEQ ID NO: 446315 - protein, 10 aa, Mycobacterium
DDSTAVPEGF

SEQ ID NO: 446316 - protein, 7 aa, Mycobacterium
DDSTDSA

SEQ ID NO: 446317 - protein, 5 aa, Mycobacterium
DDSTH

SEQ ID NO: 446318 - protein, 6 aa, Mycobacterium
DDSTNT

SEQ ID NO: 446319 - protein, 7 aa, Mycobacterium
DDSTQSA

SEQ ID NO: 446320 - protein, 9 aa, Mycobacterium
DDSTSPTDL

SEQ ID NO: 446321 - protein, 4 aa, Mycobacterium
DDSV

SEQ ID NO: 446322 - protein, 22 aa, Mycobacterium
DDSVADDSRTALAATAASETAW

SEQ ID NO: 446323 - protein, 6 aa, Mycobacterium
DDSVPG

SEQ ID NO: 446324 - protein, 5 aa, Mycobacterium
DDSVR

SEQ ID NO: 446325 - protein, 7 aa, Mycobacterium
DDSVSIR

SEQ ID NO: 446326 - protein, 7 aa, Mycobacterium
DDSVTAA

SEQ ID NO: 446327 - protein, 8 aa, Mycobacterium
DDSWPDPS

SEQ ID NO: 446328 - protein, 7 aa, Mycobacterium
DDSYPVP

SEQ ID NO: 446329 - protein, 6 aa, Mycobacterium
DDTAAV

SEQ ID NO: 446330 - protein, 9 aa, Mycobacterium
DDTAGNAAH

SEQ ID NO: 446331 - protein, 9 aa, Mycobacterium
DDTASADEF

SEQ ID NO: 446332 - protein, 9 aa, Mycobacterium
DDTASAEEF

SEQ ID NO: 446333 - protein, 7 aa, Mycobacterium
DDTATAR

SEQ ID NO: 446334 - protein, 11 aa, Mycobacterium
DDTATDARITP

SEQ ID NO: 446335 - protein, 8 aa, Mycobacterium
DDTDDAVR

SEQ ID NO: 446336 - protein, 6 aa, Mycobacterium
DDTDHR

SEQ ID NO: 446337 - protein, 26 aa, Mycobacterium
DDTDLAGTPTAFGTAGAVGSESEDAE

SEQ ID NO: 446338 - protein, 8 aa, Mycobacterium
DDTDRATL

SEQ ID NO: 446339 - protein, 5 aa, Mycobacterium
DDTDT

SEQ ID NO: 446340 - protein, 8 aa, Mycobacterium
DDTDVRVS

SEQ ID NO: 446341 - protein, 9 aa, Mycobacterium
DDTDWSRNT

SEQ ID NO: 446342 - protein, 4 aa, Mycobacterium
DDTE

SEQ ID NO: 446343 - protein, 7 aa, Mycobacterium
DDTEAPA

SEQ ID NO: 446344 - protein, 11 aa, Mycobacterium
DDTEASPAPTR

SEQ ID NO: 446345 - protein, 6 aa, Mycobacterium
DDTEET

SEQ ID NO: 446346 - protein, 6 aa, Mycobacterium
DDTEGR

SEQ ID NO: 446347 - protein, 21 aa, Mycobacterium
DDTEKDEDKDDEDGAAAGAAT

SEQ ID NO: 446348 - protein, 7 aa, Mycobacterium
DDTEPPI

SEQ ID NO: 446349 - protein, 6 aa, Mycobacterium
DDTESG

SEQ ID NO: 446350 - protein, 8 aa, Mycobacterium
DDTESRVE

SEQ ID NO: 446351 - protein, 7 aa, Mycobacterium
DDTGAAV

SEQ ID NO: 446352 - protein, 9 aa, Mycobacterium
DDTGADDVA

SEQ ID NO: 446353 - protein, 7 aa, Mycobacterium
DDTGAGM

SEQ ID NO: 446354 - protein, 6 aa, Mycobacterium
DDTGDE

SEQ ID NO: 446355 - protein, 11 aa, Mycobacterium
DDTGDGRTRMT

SEQ ID NO: 446356 - protein, 7 aa, Mycobacterium
DDTGETE

SEQ ID NO: 446357 - protein, 6 aa, Mycobacterium
DDTGEV

SEQ ID NO: 446358 - protein, 9 aa, Mycobacterium
DDTGKGAGL

SEQ ID NO: 446359 - protein, 10 aa, Mycobacterium
DDTGLDPTQL

SEQ ID NO: 446360 - protein, 8 aa, Mycobacterium
DDTGLGAR

SEQ ID NO: 446361 - protein, 7 aa, Mycobacterium
DDTGQPR

SEQ ID NO: 446362 - protein, 6 aa, Mycobacterium
DDTGRA

SEQ ID NO: 446363 - protein, 14 aa, Mycobacterium
DDTGRATAAATTPE

SEQ ID NO: 446364 - protein, 6 aa, Mycobacterium
DDTGRF

SEQ ID NO: 446365 - protein, 6 aa, Mycobacterium
DDTGRI

SEQ ID NO: 446366 - protein, 11 aa, Mycobacterium
DDTGRPRPTGR

SEQ ID NO: 446367 - protein, 5 aa, Mycobacterium
DDTGT

SEQ ID NO: 446368 - protein, 12 aa, Mycobacterium
DDTGTLQPQSAA

SEQ ID NO: 446369 - protein, 7 aa, Mycobacterium
DDTGVPQ

SEQ ID NO: 446370 - protein, 6 aa, Mycobacterium
DDTHPD

SEQ ID NO: 446371 - protein, 4 aa, Mycobacterium
DDTI

SEQ ID NO: 446372 - protein, 11 aa, Mycobacterium
DDTKDNPREGT

SEQ ID NO: 446373 - protein, 13 aa, Mycobacterium
DDTLAEPRAPYPH

SEQ ID NO: 446374 - protein, 10 aa, Mycobacterium
DDTLATPAQQ

SEQ ID NO: 446375 - protein, 6 aa, Mycobacterium
DDTLDE

SEQ ID NO: 446376 - protein, 16 aa, Mycobacterium
DDTLDEAIRRLQALRR

SEQ ID NO: 446377 - protein, 5 aa, Mycobacterium
DDTLG

SEQ ID NO: 446378 - protein, 6 aa, Mycobacterium
DDTLGS

SEQ ID NO: 446379 - protein, 5 aa, Mycobacterium
DDTLS

SEQ ID NO: 446380 - protein, 8 aa, Mycobacterium
DDTLTGTV

SEQ ID NO: 446381 - protein, 7 aa, Mycobacterium
DDTMPGK

SEQ ID NO: 446382 - protein, 22 aa, Mycobacterium
DDTNAEAGSDAVRSDEDAVPAE

SEQ ID NO: 446383 - protein, 4 aa, Mycobacterium
DDTP

SEQ ID NO: 446384 - protein, 6 aa, Mycobacterium
DDTPAE

SEQ ID NO: 446385 - protein, 15 aa, Mycobacterium
DDTPDRAREVAARSP

SEQ ID NO: 446386 - protein, 6 aa, Mycobacterium
DDTPFS

SEQ ID NO: 446387 - protein, 8 aa, Mycobacterium
DDTPGRPV

SEQ ID NO: 446388 - protein, 11 aa, Mycobacterium
DDTPVASASIG

SEQ ID NO: 446389 - protein, 8 aa, Mycobacterium
DDTPVGFT

SEQ ID NO: 446390 - protein, 7 aa, Mycobacterium
DDTQARE

SEQ ID NO: 446391 - protein, 8 aa, Mycobacterium
DDTQGTQG

SEQ ID NO: 446392 - protein, 6 aa, Mycobacterium
DDTQPS

SEQ ID NO: 446393 - protein, 5 aa, Mycobacterium
DDTRF

SEQ ID NO: 446394 - protein, 10 aa, Mycobacterium
DDTRKAAHAA

SEQ ID NO: 446395 - protein, 9 aa, Mycobacterium
DDTRLTAGE

SEQ ID NO: 446396 - protein, 8 aa, Mycobacterium
DDTRLTTA

SEQ ID NO: 446397 - protein, 5 aa, Mycobacterium
DDTRP

SEQ ID NO: 446398 - protein, 7 aa, Mycobacterium
DDTRRRA

SEQ ID NO: 446399 - protein, 5 aa, Mycobacterium
DDTRT

SEQ ID NO: 446400 - protein, 13 aa, Mycobacterium
DDTSGTEYQSPPK

SEQ ID NO: 446401 - protein, 15 aa, Mycobacterium
DDTSPAQQTDSSTDT

SEQ ID NO: 446402 - protein, 9 aa, Mycobacterium
DDTSPNALR

SEQ ID NO: 446403 - protein, 7 aa, Mycobacterium
DDTSPSV

SEQ ID NO: 446404 - protein, 5 aa, Mycobacterium
DDTSR

SEQ ID NO: 446405 - protein, 8 aa, Mycobacterium
DDTSSQLV

SEQ ID NO: 446406 - protein, 9 aa, Mycobacterium
DDTSTAEAL

SEQ ID NO: 446407 - protein, 8 aa, Mycobacterium
DDTSVDDI

SEQ ID NO: 446408 - protein, 7 aa, Mycobacterium
DDTTAAR

SEQ ID NO: 446409 - protein, 7 aa, Mycobacterium
DDTTARQ

SEQ ID NO: 446410 - protein, 8 aa, Mycobacterium
DDTTDPKA

SEQ ID NO: 446411 - protein, 8 aa, Mycobacterium
DDTTQPPL

SEQ ID NO: 446412 - protein, 18 aa, Mycobacterium
DDTTRAAEQNRRLDSDAA

SEQ ID NO: 446413 - protein, 8 aa, Mycobacterium
DDTTSRET

SEQ ID NO: 446414 - protein, 9 aa, Mycobacterium
DDTVTAEQA

SEQ ID NO: 446415 - protein, 10 aa, Mycobacterium
DDTVTEVPAD

SEQ ID NO: 446416 - protein, 21 aa, Mycobacterium
DDTWKGPGRPLSSGYAERNQR

SEQ ID NO: 446417 - protein, 18 aa, Mycobacterium
DDTYTGHVEPGTAARRTL

SEQ ID NO: 446418 - protein, 4 aa, Mycobacterium
DDVA

SEQ ID NO: 446419 - protein, 54 aa, Mycobacterium
DDVAADGEDADVDPTEAEDAEEEGAAPAAAAPEAAADDEEEIAEPSEKDKASGD

SEQ ID NO: 446420 - protein, 13 aa, Mycobacterium
DDVADDALPAPVD

SEQ ID NO: 446421 - protein, 7 aa, Mycobacterium
DDVAGDM

SEQ ID NO: 446422 - protein, 15 aa, Mycobacterium
DDVAQRIQRAKDAGA

SEQ ID NO: 446423 - protein, 5 aa, Mycobacterium
DDVDD

SEQ ID NO: 446424 - protein, 6 aa, Mycobacterium
DDVDEA

SEQ ID NO: 446425 - protein, 10 aa, Mycobacterium
DDVDEKQGDN

SEQ ID NO: 446426 - protein, 6 aa, Mycobacterium
DDVDGP

SEQ ID NO: 446427 - protein, 8 aa, Mycobacterium
DDVDNEQL

SEQ ID NO: 446428 - protein, 9 aa, Mycobacterium
DDVDPRRIR

SEQ ID NO: 446429 - protein, 5 aa, Mycobacterium
DDVDS

SEQ ID NO: 446430 - protein, 19 aa, Mycobacterium
DDVEKLSDAELRAKTEEFK

SEQ ID NO: 446431 - protein, 18 aa, Mycobacterium
DDVERGAQDSDWDPVKEA

SEQ ID NO: 446432 - protein, 19 aa, Mycobacterium
DDVERGSQDSDWDPVKDAA

SEQ ID NO: 446433 - protein, 6 aa, Mycobacterium
DDVERT

SEQ ID NO: 446434 - protein, 10 aa, Mycobacterium
DDVEVPESDQ

SEQ ID NO: 446435 - protein, 10 aa, Mycobacterium
DDVGAAEAAN

SEQ ID NO: 446436 - protein, 13 aa, Mycobacterium
DDVGASPVDTITA

SEQ ID NO: 446437 - protein, 5 aa, Mycobacterium
DDVGG

SEQ ID NO: 446438 - protein, 6 aa, Mycobacterium
DDVGGS

SEQ ID NO: 446439 - protein, 7 aa, Mycobacterium
DDVGGSL

SEQ ID NO: 446440 - protein, 14 aa, Mycobacterium
DDVGGTWRDNSYPG

SEQ ID NO: 446441 - protein, 9 aa, Mycobacterium
DDVGQEQAV

SEQ ID NO: 446442 - protein, 11 aa, Mycobacterium
DDVGRAQFPDA

SEQ ID NO: 446443 - protein, 11 aa, Mycobacterium
DDVGRNQFPDA

SEQ ID NO: 446444 - protein, 6 aa, Mycobacterium
DDVGTD

SEQ ID NO: 446445 - protein, 12 aa, Mycobacterium
DDVGTGADARGP

SEQ ID NO: 446446 - protein, 7 aa, Mycobacterium
DDVGTSK

SEQ ID NO: 446447 - protein, 13 aa, Mycobacterium
DDVGTSSLAKGCT

SEQ ID NO: 446448 - protein, 20 aa, Mycobacterium
DDVGYERRAVSDGDTVDAGP

SEQ ID NO: 446449 - protein, 6 aa, Mycobacterium
DDVIGS

SEQ ID NO: 446450 - protein, 9 aa, Mycobacterium
DDVKPDDSH

SEQ ID NO: 446451 - protein, 4 aa, Mycobacterium
DDVP

SEQ ID NO: 446452 - protein, 12 aa, Mycobacterium
DDVPADADPEKV

SEQ ID NO: 446453 - protein, 10 aa, Mycobacterium
DDVPAKKRSV

SEQ ID NO: 446454 - protein, 6 aa, Mycobacterium
DDVPAT

SEQ ID NO: 446455 - protein, 6 aa, Mycobacterium
DDVPAY

SEQ ID NO: 446456 - protein, 13 aa, Mycobacterium
DDVPDDDRQRVAA

SEQ ID NO: 446457 - protein, 8 aa, Mycobacterium
DDVPDSVA

SEQ ID NO: 446458 - protein, 6 aa, Mycobacterium
DDVPEP

SEQ ID NO: 446459 - protein, 13 aa, Mycobacterium
DDVPEPEARPGTV

SEQ ID NO: 446460 - protein, 16 aa, Mycobacterium
DDVPERLSAGKDFPAP

SEQ ID NO: 446461 - protein, 15 aa, Mycobacterium
DDVPERLSPSDDYPV

SEQ ID NO: 446462 - protein, 8 aa, Mycobacterium
DDVPGGRE

SEQ ID NO: 446463 - protein, 13 aa, Mycobacterium
DDVPNDLQGSASY

SEQ ID NO: 446464 - protein, 9 aa, Mycobacterium
DDVPPSNGL

SEQ ID NO: 446465 - protein, 6 aa, Mycobacterium
DDVPPT

SEQ ID NO: 446466 - protein, 9 aa, Mycobacterium
DDVPTEVRG

SEQ ID NO: 446467 - protein, 7 aa, Mycobacterium
DDVQKSR

SEQ ID NO: 446468 - protein, 7 aa, Mycobacterium
DDVRAAE

SEQ ID NO: 446469 - protein, 6 aa, Mycobacterium
DDVRDR

SEQ ID NO: 446470 - protein, 6 aa, Mycobacterium
DDVRDS

SEQ ID NO: 446471 - protein, 8 aa, Mycobacterium
DDVRERAN

SEQ ID NO: 446472 - protein, 6 aa, Mycobacterium
DDVRGR

SEQ ID NO: 446473 - protein, 5 aa, Mycobacterium
DDVRR

SEQ ID NO: 446474 - protein, 9 aa, Mycobacterium
DDVSEDTGR

SEQ ID NO: 446475 - protein, 9 aa, Mycobacterium
DDVSGTSIG

SEQ ID NO: 446476 - protein, 11 aa, Mycobacterium
DDVSGTSISYD

SEQ ID NO: 446477 - protein, 6 aa, Mycobacterium
DDVSTR

SEQ ID NO: 446478 - protein, 4 aa, Mycobacterium
DDVT

SEQ ID NO: 446479 - protein, 5 aa, Mycobacterium
DDVTG

SEQ ID NO: 446480 - protein, 8 aa, Mycobacterium
DDVTGVNR

SEQ ID NO: 446481 - protein, 10 aa, Mycobacterium
DDVTRPGSDR

SEQ ID NO: 446482 - protein, 5 aa, Mycobacterium
DDVTS

SEQ ID NO: 446483 - protein, 4 aa, Mycobacterium
DDVV

SEQ ID NO: 446484 - protein, 6 aa, Mycobacterium
DDVVPD

SEQ ID NO: 446485 - protein, 4 aa, Mycobacterium
DDVY

SEQ ID NO: 446486 - protein, 7 aa, Mycobacterium
DDWPPQR

SEQ ID NO: 446487 - protein, 5 aa, Mycobacterium
DDWPR

SEQ ID NO: 446488 - protein, 13 aa, Mycobacterium
DDWQGTLTPENTH

SEQ ID NO: 446489 - protein, 4 aa, Mycobacterium
DDYA

SEQ ID NO: 446490 - protein, 11 aa, Mycobacterium
DDYAARSQSRA

SEQ ID NO: 446491 - protein, 5 aa, Mycobacterium
DDYAR

SEQ ID NO: 446492 - protein, 5 aa, Mycobacterium
DDYDA

SEQ ID NO: 446493 - protein, 16 aa, Mycobacterium
DDYDARRLPSDPDERA

SEQ ID NO: 446494 - protein, 5 aa, Mycobacterium
DDYDD

SEQ ID NO: 446495 - protein, 4 aa, Mycobacterium
DDYE

SEQ ID NO: 446496 - protein, 16 aa, Mycobacterium
DDYERVPADEPNPEQI

SEQ ID NO: 446497 - protein, 6 aa, Mycobacterium
DDYEYT

SEQ ID NO: 446498 - protein, 4 aa, Mycobacterium
DDYG

SEQ ID NO: 446499 - protein, 7 aa, Mycobacterium
DDYGGSV

SEQ ID NO: 446500 - protein, 6 aa, Mycobacterium
DDYGPG

SEQ ID NO: 446501 - protein, 8 aa, Mycobacterium
DDYGQPPG

SEQ ID NO: 446502 - protein, 29 aa, Mycobacterium
DDYGRYEGRDYEDPRDPRDPRRDPRGDLR

SEQ ID NO: 446503 - protein, 5 aa, Mycobacterium
DDYHG

SEQ ID NO: 446504 - protein, 7 aa, Mycobacterium
DDYKQSM

SEQ ID NO: 446505 - protein, 8 aa, Mycobacterium
DDYPNVPD

SEQ ID NO: 446506 - protein, 7 aa, Mycobacterium
DDYQDKA

SEQ ID NO: 446507 - protein, 17 aa, Mycobacterium
DDYRKQESQRHGSARTG

SEQ ID NO: 446508 - protein, 5 aa, Mycobacterium
DDYST

SEQ ID NO: 446509 - protein, 7 aa, Mycobacterium
DDYTAAK

SEQ ID NO: 446510 - protein, 12 aa, Mycobacterium
DDYTTGGMQRNA

SEQ ID NO: 446511 - protein, 4 aa, Mycobacterium
DDYY

SEQ ID NO: 446512 - protein, 52 aa, Mycobacterium
DDYYEDDDRGPAPRGYRRPREDRFEDEGYAPRGYDGHPEDRRRDYDEPPAYR

SEQ ID NO: 446513 - protein, 5 aa, Mycobacterium
DEAAA

SEQ ID NO: 446514 - protein, 7 aa, Mycobacterium
DEAAAAA

SEQ ID NO: 446515 - protein, 10 aa, Mycobacterium
DEAAAAEYEV

SEQ ID NO: 446516 - protein, 11 aa, Mycobacterium
DEAAAARTEEF

SEQ ID NO: 446517 - protein, 8 aa, Mycobacterium
DEAAADAY

SEQ ID NO: 446518 - protein, 10 aa, Mycobacterium
DEAAAGEYEV

SEQ ID NO: 446519 - protein, 7 aa, Mycobacterium
DEAAANA

SEQ ID NO: 446520 - protein, 8 aa, Mycobacterium
DEAAANGD

SEQ ID NO: 446521 - protein, 6 aa, Mycobacterium
DEAAAQ

SEQ ID NO: 446522 - protein, 13 aa, Mycobacterium
DEAAARAQQARAE

SEQ ID NO: 446523 - protein, 15 aa, Mycobacterium
DEAAASATAGEHPDK

SEQ ID NO: 446524 - protein, 13 aa, Mycobacterium
DEAAATDSSLRAE

SEQ ID NO: 446525 - protein, 10 aa, Mycobacterium
DEAADDAQRQ

SEQ ID NO: 446526 - protein, 6 aa, Mycobacterium
DEAADE

SEQ ID NO: 446527 - protein, 6 aa, Mycobacterium
DEAADL

SEQ ID NO: 446528 - protein, 8 aa, Mycobacterium
DEAADNAA

SEQ ID NO: 446529 - protein, 5 aa, Mycobacterium
DEAAE

SEQ ID NO: 446530 - protein, 10 aa, Mycobacterium
DEAAEDAPDQ

SEQ ID NO: 446531 - protein, 7 aa, Mycobacterium
DEAAGSR

SEQ ID NO: 446532 - protein, 23 aa, Mycobacterium
DEAAKGYSIAGSRSGNDVKVLLK

SEQ ID NO: 446533 - protein, 5 aa, Mycobacterium
DEAAM

SEQ ID NO: 446534 - protein, 16 aa, Mycobacterium
DEAAPGPIPDVPEPSV

SEQ ID NO: 446535 - protein, 18 aa, Mycobacterium
DEAAPGPIPEVPTPSADE

SEQ ID NO: 446536 - protein, 6 aa, Mycobacterium
DEAAQQ

SEQ ID NO: 446537 - protein, 7 aa, Mycobacterium
DEAARHD

SEQ ID NO: 446538 - protein, 10 aa, Mycobacterium
DEAASENATA

SEQ ID NO: 446539 - protein, 10 aa, Mycobacterium
DEAASGTRRE

SEQ ID NO: 446540 - protein, 9 aa, Mycobacterium
DEAASVPGA

SEQ ID NO: 446541 - protein, 9 aa, Mycobacterium
DEAATAAAI

SEQ ID NO: 446542 - protein, 12 aa, Mycobacterium
DEAATKKRRGEF

SEQ ID NO: 446543 - protein, 8 aa, Mycobacterium
DEAATTDA

SEQ ID NO: 446544 - protein, 28 aa, Mycobacterium
DEADATSRANTRKATLERPGTGSPDMVP

SEQ ID NO: 446545 - protein, 16 aa, Mycobacterium
DEADAVAKANDTEYGL

SEQ ID NO: 446546 - protein, 10 aa, Mycobacterium
DEADENQQEA

SEQ ID NO: 446547 - protein, 6 aa, Mycobacterium
DEADER

SEQ ID NO: 446548 - protein, 11 aa, Mycobacterium
DEADGGGADLG

SEQ ID NO: 446549 - protein, 11 aa, Mycobacterium
DEADGRKETIA

SEQ ID NO: 446550 - protein, 9 aa, Mycobacterium
DEADHPDAR

SEQ ID NO: 446551 - protein, 5 aa, Mycobacterium
DEADL

SEQ ID NO: 446552 - protein, 7 aa, Mycobacterium
DEADMHQ

SEQ ID NO: 446553 - protein, 8 aa, Mycobacterium
DEADNDEV

SEQ ID NO: 446554 - protein, 5 aa, Mycobacterium
DEADP

SEQ ID NO: 446555 - protein, 9 aa, Mycobacterium
DEADPAAAV

SEQ ID NO: 446556 - protein, 8 aa, Mycobacterium
DEADPPAA

SEQ ID NO: 446557 - protein, 5 aa, Mycobacterium
DEADQ

SEQ ID NO: 446558 - protein, 5 aa, Mycobacterium
DEADR

SEQ ID NO: 446559 - protein, 7 aa, Mycobacterium
DEADRSV

SEQ ID NO: 446560 - protein, 4 aa, Mycobacterium
DEAE

SEQ ID NO: 446561 - protein, 18 aa, Mycobacterium
DEAEATAEPVGDGAATGW

SEQ ID NO: 446562 - protein, 6 aa, Mycobacterium
DEAEKA

SEQ ID NO: 446563 - protein, 6 aa, Mycobacterium
DEAEMR

SEQ ID NO: 446564 - protein, 5 aa, Mycobacterium
DEAER

SEQ ID NO: 446565 - protein, 7 aa, Mycobacterium
DEAEREL

SEQ ID NO: 446566 - protein, 7 aa, Mycobacterium
DEAETGI

SEQ ID NO: 446567 - protein, 5 aa, Mycobacterium
DEAFA

SEQ ID NO: 446568 - protein, 10 aa, Mycobacterium
DEAFGRAAEP

SEQ ID NO: 446569 - protein, 18 aa, Mycobacterium
DEAGAKATATAIDEAGGV

SEQ ID NO: 446570 - protein, 6 aa, Mycobacterium
DEAGAR

SEQ ID NO: 446571 - protein, 20 aa, Mycobacterium
DEAGDLGDLDYSDDSAFDNE

SEQ ID NO: 446572 - protein, 5 aa, Mycobacterium
DEAGE

SEQ ID NO: 446573 - protein, 23 aa, Mycobacterium
DEAGEHPGRAAPQPAGVDPAPLQ

SEQ ID NO: 446574 - protein, 8 aa, Mycobacterium
DEAGERSE

SEQ ID NO: 446575 - protein, 13 aa, Mycobacterium
DEAGETRPPSDEE

SEQ ID NO: 446576 - protein, 8 aa, Mycobacterium
DEAGHPRF

SEQ ID NO: 446577 - protein, 6 aa, Mycobacterium
DEAGIG

SEQ ID NO: 446578 - protein, 14 aa, Mycobacterium
DEAGIGNSRFNRPS

SEQ ID NO: 446579 - protein, 8 aa, Mycobacterium
DEAGLDTT

SEQ ID NO: 446580 - protein, 9 aa, Mycobacterium
DEAGLRPQD

SEQ ID NO: 446581 - protein, 6 aa, Mycobacterium
DEAGMD

SEQ ID NO: 446582 - protein, 40 aa, Mycobacterium
DEAGPGDTLNVSESTDSDEMHNADGDEPVEPPQKWSASGK

SEQ ID NO: 446583 - protein, 7 aa, Mycobacterium
DEAGRAA

SEQ ID NO: 446584 - protein, 12 aa, Mycobacterium
DEAGRGELKGLL

SEQ ID NO: 446585 - protein, 7 aa, Mycobacterium
DEAGRRQ

SEQ ID NO: 446586 - protein, 10 aa, Mycobacterium
DEAGTAGADD

SEQ ID NO: 446587 - protein, 7 aa, Mycobacterium
DEAGTPN

SEQ ID NO: 446588 - protein, 14 aa, Mycobacterium
DEAGTPRAQNRAHP

SEQ ID NO: 446589 - protein, 11 aa, Mycobacterium
DEAGTSTAHRT

SEQ ID NO: 446590 - protein, 6 aa, Mycobacterium
DEAGVG

SEQ ID NO: 446591 - protein, 24 aa, Mycobacterium
DEAGYTVPGGPADEMGELFATIMN

SEQ ID NO: 446592 - protein, 4 aa, Mycobacterium
DEAH

SEQ ID NO: 446593 - protein, 13 aa, Mycobacterium
DEAHEAGRDAGEY

SEQ ID NO: 446594 - protein, 7 aa, Mycobacterium
DEAHGRA

SEQ ID NO: 446595 - protein, 13 aa, Mycobacterium
DEAHGYADGRRRT

SEQ ID NO: 446596 - protein, 7 aa, Mycobacterium
DEAHPGG

SEQ ID NO: 446597 - protein, 7 aa, Mycobacterium
DEAIPAA

SEQ ID NO: 446598 - protein, 12 aa, Mycobacterium
DEAKAAADEAAV

SEQ ID NO: 446599 - protein, 14 aa, Mycobacterium
DEAKEMEKDRHGAA

SEQ ID NO: 446600 - protein, 17 aa, Mycobacterium
DEAKEVSVAPAAGDTPL

SEQ ID NO: 446601 - protein, 9 aa, Mycobacterium
DEAKHTGRT

SEQ ID NO: 446602 - protein, 6 aa, Mycobacterium
DEAKRP

SEQ ID NO: 446603 - protein, 8 aa, Mycobacterium
DEAKSAPM

SEQ ID NO: 446604 - protein, 13 aa, Mycobacterium
DEAKSGPGVAEAI

SEQ ID NO: 446605 - protein, 9 aa, Mycobacterium
DEAKTAAGM

SEQ ID NO: 446606 - protein, 9 aa, Mycobacterium
DEAKTAEAF

SEQ ID NO: 446607 - protein, 4 aa, Mycobacterium
DEAL

SEQ ID NO: 446608 - protein, 5 aa, Mycobacterium
DEALR

SEQ ID NO: 446609 - protein, 13 aa, Mycobacterium
DEAMARARKPDVY

SEQ ID NO: 446610 - protein, 13 aa, Mycobacterium
DEAMARARKPQVY

SEQ ID NO: 446611 - protein, 8 aa, Mycobacterium
DEAMDPSA

SEQ ID NO: 446612 - protein, 13 aa, Mycobacterium
DEAMGRARKPDVY

SEQ ID NO: 446613 - protein, 5 aa, Mycobacterium
DEAMH

SEQ ID NO: 446614 - protein, 6 aa, Mycobacterium
DEAMTA

SEQ ID NO: 446615 - protein, 4 aa, Mycobacterium
DEAN

SEQ ID NO: 446616 - protein, 5 aa, Mycobacterium
DEANA

SEQ ID NO: 446617 - protein, 23 aa, Mycobacterium
DEANERAQSVTRHGLSNRERAYE

SEQ ID NO: 446618 - protein, 6 aa, Mycobacterium
DEANSA

SEQ ID NO: 446619 - protein, 6 aa, Mycobacterium
DEANTE

SEQ ID NO: 446620 - protein, 7 aa, Mycobacterium
DEANTSG

SEQ ID NO: 446621 - protein, 6 aa, Mycobacterium
DEAPAL

SEQ ID NO: 446622 - protein, 11 aa, Mycobacterium
DEAPETGATFE

SEQ ID NO: 446623 - protein, 8 aa, Mycobacterium
DEAPPADM

SEQ ID NO: 446624 - protein, 9 aa, Mycobacterium
DEAPPGTRA

SEQ ID NO: 446625 - protein, 5 aa, Mycobacterium
DEAPR

SEQ ID NO: 446626 - protein, 13 aa, Mycobacterium
DEAPRFPDDGSMP

SEQ ID NO: 446627 - protein, 7 aa, Mycobacterium
DEAPRHQ

SEQ ID NO: 446628 - protein, 18 aa, Mycobacterium
DEAPSPADPSSDDKSRLR

SEQ ID NO: 446629 - protein, 15 aa, Mycobacterium
DEAPVTPADLGADTA

SEQ ID NO: 446630 - protein, 17 aa, Mycobacterium
DEAQAAEQDAQQTIDGG

SEQ ID NO: 446631 - protein, 5 aa, Mycobacterium
DEAQE

SEQ ID NO: 446632 - protein, 6 aa, Mycobacterium
DEAQEL

SEQ ID NO: 446633 - protein, 10 aa, Mycobacterium
DEAQFGPDAG

SEQ ID NO: 446634 - protein, 7 aa, Mycobacterium
DEAQIAK

SEQ ID NO: 446635 - protein, 13 aa, Mycobacterium
DEAQLDSDTVADA

SEQ ID NO: 446636 - protein, 5 aa, Mycobacterium
DEAQP

SEQ ID NO: 446637 - protein, 6 aa, Mycobacterium
DEAQQR

SEQ ID NO: 446638 - protein, 5 aa, Mycobacterium
DEAQR

SEQ ID NO: 446639 - protein, 9 aa, Mycobacterium
DEAQRAGFN

SEQ ID NO: 446640 - protein, 6 aa, Mycobacterium
DEAQRR

SEQ ID NO: 446641 - protein, 12 aa, Mycobacterium
DEAQSRASDLEA

SEQ ID NO: 446642 - protein, 9 aa, Mycobacterium
DEAQTRSPA

SEQ ID NO: 446643 - protein, 9 aa, Mycobacterium
DEARAAGRR

SEQ ID NO: 446644 - protein, 6 aa, Mycobacterium
DEARAL

SEQ ID NO: 446645 - protein, 7 aa, Mycobacterium
DEARDRY

SEQ ID NO: 446646 - protein, 5 aa, Mycobacterium
DEARE

SEQ ID NO: 446647 - protein, 7 aa, Mycobacterium
DEAREAV

SEQ ID NO: 446648 - protein, 5 aa, Mycobacterium
DEARG

SEQ ID NO: 446649 - protein, 9 aa, Mycobacterium
DEARGEGKR

SEQ ID NO: 446650 - protein, 9 aa, Mycobacterium
DEARGEPVR

SEQ ID NO: 446651 - protein, 7 aa, Mycobacterium
DEARPRA

SEQ ID NO: 446652 - protein, 7 aa, Mycobacterium
DEARRGL

SEQ ID NO: 446653 - protein, 6 aa, Mycobacterium
DEARRQ

SEQ ID NO: 446654 - protein, 9 aa, Mycobacterium
DEARRRGAP

SEQ ID NO: 446655 - protein, 7 aa, Mycobacterium
DEARRSE

SEQ ID NO: 446656 - protein, 7 aa, Mycobacterium
DEARSGA

SEQ ID NO: 446657 - protein, 7 aa, Mycobacterium
DEARSRI

SEQ ID NO: 446658 - protein, 8 aa, Mycobacterium
DEARTAME

SEQ ID NO: 446659 - protein, 7 aa, Mycobacterium
DEARTEL

SEQ ID NO: 446660 - protein, 10 aa, Mycobacterium
DEARTRPWTE

SEQ ID NO: 446661 - protein, 6 aa, Mycobacterium
DEARTV

SEQ ID NO: 446662 - protein, 5 aa, Mycobacterium
DEASA

SEQ ID NO: 446663 - protein, 8 aa, Mycobacterium
DEASAAEP

SEQ ID NO: 446664 - protein, 12 aa, Mycobacterium
DEASADARVAEG

SEQ ID NO: 446665 - protein, 6 aa, Mycobacterium
DEASAQ

SEQ ID NO: 446666 - protein, 6 aa, Mycobacterium
DEASCR

SEQ ID NO: 446667 - protein, 13 aa, Mycobacterium
DEASGAASDGFAP

SEQ ID NO: 446668 - protein, 15 aa, Mycobacterium
DEASGEVPPQAPARP

SEQ ID NO: 446669 - protein, 12 aa, Mycobacterium
DEASKRLDAIRD

SEQ ID NO: 446670 - protein, 9 aa, Mycobacterium
DEASPNTVK

SEQ ID NO: 446671 - protein, 7 aa, Mycobacterium
DEASRRG

SEQ ID NO: 446672 - protein, 8 aa, Mycobacterium
DEASSPFR

SEQ ID NO: 446673 - protein, 4 aa, Mycobacterium
DEAT

SEQ ID NO: 446674 - protein, 14 aa, Mycobacterium
DEATAAGDVAVGSG

SEQ ID NO: 446675 - protein, 29 aa, Mycobacterium
DEATAEARNAAGVDGPDVEGRRLTGQPAA

SEQ ID NO: 446676 - protein, 8 aa, Mycobacterium
DEATAQRH

SEQ ID NO: 446677 - protein, 13 aa, Mycobacterium
DEATASYDSSTWQ

SEQ ID NO: 446678 - protein, 7 aa, Mycobacterium
DEATERA

SEQ ID NO: 446679 - protein, 5 aa, Mycobacterium
DEATG

SEQ ID NO: 446680 - protein, 15 aa, Mycobacterium
DEATGAGGGHEQRGY

SEQ ID NO: 446681 - protein, 23 aa, Mycobacterium
DEATGGGEASDGRAGSAGAEAPQ

SEQ ID NO: 446682 - protein, 10 aa, Mycobacterium
DEATGRATVD

SEQ ID NO: 446683 - protein, 7 aa, Mycobacterium
DEATHDR

SEQ ID NO: 446684 - protein, 8 aa, Mycobacterium
DEATPGGQ

SEQ ID NO: 446685 - protein, 5 aa, Mycobacterium
DEATR

SEQ ID NO: 446686 - protein, 7 aa, Mycobacterium
DEATSGT

SEQ ID NO: 446687 - protein, 10 aa, Mycobacterium
DEATSGTVSV

SEQ ID NO: 446688 - protein, 6 aa, Mycobacterium
DEATSR

SEQ ID NO: 446689 - protein, 8 aa, Mycobacterium
DEATTDQL

SEQ ID NO: 446690 - protein, 7 aa, Mycobacterium
DEAVDAA

SEQ ID NO: 446691 - protein, 12 aa, Mycobacterium
DEAVGDARAPVE

SEQ ID NO: 446692 - protein, 16 aa, Mycobacterium
DEAVRLPGSSPAETYL

SEQ ID NO: 446693 - protein, 10 aa, Mycobacterium
DEAVTGMGAG

SEQ ID NO: 446694 - protein, 4 aa, Mycobacterium
DEAW

SEQ ID NO: 446695 - protein, 34 aa, Mycobacterium; identical to SEQ ID NO: 62133

SEQ ID NO: 446696 - protein, 8 aa, Mycobacterium
DEAYRNNS

SEQ ID NO: 446697 - protein, 8 aa, Mycobacterium
DECNGSDV

SEQ ID NO: 446698 - protein, 5 aa, Mycobacterium
DECPP

SEQ ID NO: 446699 - protein, 21 aa, Mycobacterium
DECRPTVGKQPVTDAEGDLEP

SEQ ID NO: 446700 - protein, 24 aa, Mycobacterium
DECRSGDAGGREERGDARREPRRN

SEQ ID NO: 446701 - protein, 6 aa, Mycobacterium
DECSPE

SEQ ID NO: 446702 - protein, 7 aa, Mycobacterium
DECSPED

SEQ ID NO: 446703 - protein, 7 aa, Mycobacterium
DECTVTE

SEQ ID NO: 446704 - protein, 6 aa, Mycobacterium
DEDAAR

SEQ ID NO: 446705 - protein, 6 aa, Mycobacterium
DEDADA

SEQ ID NO: 446706 - protein, 6 aa, Mycobacterium
DEDAEV

SEQ ID NO: 446707 - protein, 13 aa, Mycobacterium
DEDAGGSRFGESD

SEQ ID NO: 446708 - protein, 8 aa, Mycobacterium
DEDAGRAL

SEQ ID NO: 446709 - protein, 5 aa, Mycobacterium
DEDAK

SEQ ID NO: 446710 - protein, 22 aa, Mycobacterium
DEDALTEARAASYDAKAVEGVP

SEQ ID NO: 446711 - protein, 17 aa, Mycobacterium
DEDAPGPIPDVPEPSSE

SEQ ID NO: 446712 - protein, 17 aa, Mycobacterium
DEDAPGPIPDVPEPSSQ

SEQ ID NO: 446713 - protein, 18 aa, Mycobacterium
DEDAPGPIPDVPEPTPAE

SEQ ID NO: 446714 - protein, 18 aa, Mycobacterium
DEDAPGPIPDVPQATPAE

SEQ ID NO: 446715 - protein, 4 aa, Mycobacterium
DEDD

SEQ ID NO: 446716 - protein, 5 aa, Mycobacterium
DEDDA

SEQ ID NO: 446717 - protein, 7 aa, Mycobacterium
DEDDDIE

SEQ ID NO: 446718 - protein, 6 aa, Mycobacterium
DEDDDV

SEQ ID NO: 446719 - protein, 16 aa, Mycobacterium
DEDDEDSGGALREDEV

SEQ ID NO: 446720 - protein, 6 aa, Mycobacterium
DEDDER

SEQ ID NO: 446721 - protein, 6 aa, Mycobacterium
DEDDPA

SEQ ID NO: 446722 - protein, 11 aa, Mycobacterium
DEDDPTMDRRN

SEQ ID NO: 446723 - protein, 7 aa, Mycobacterium
DEDDTSV

SEQ ID NO: 446724 - protein, 4 aa, Mycobacterium
DEDE

SEQ ID NO: 446725 - protein, 5 aa, Mycobacterium
DEDEA

SEQ ID NO: 446726 - protein, 10 aa, Mycobacterium
DEDEAADDEY

SEQ ID NO: 446727 - protein, 8 aa, Mycobacterium
DEDEAARV

SEQ ID NO: 446728 - protein, 14 aa, Mycobacterium
DEDEAVAAANGTEF

SEQ ID NO: 446729 - protein, 10 aa, Mycobacterium
DEDEKLPPRR

SEQ ID NO: 446730 - protein, 9 aa, Mycobacterium
DEDEQPQFT

SEQ ID NO: 446731 - protein, 7 aa, Mycobacterium
DEDERAK

SEQ ID NO: 446732 - protein, 8 aa, Mycobacterium
DEDESDDH

SEQ ID NO: 446733 - protein, 20 aa, Mycobacterium
DEDETTRARAVSAAKATVGR

SEQ ID NO: 446734 - protein, 6 aa, Mycobacterium
DEDEVE

SEQ ID NO: 446735 - protein, 13 aa, Mycobacterium
DEDFGGTAVAAGA

SEQ ID NO: 446736 - protein, 6 aa, Mycobacterium
DEDGAV

SEQ ID NO: 446737 - protein, 11 aa, Mycobacterium
DEDGDGKTDPL

SEQ ID NO: 446738 - protein, 9 aa, Mycobacterium
DEDGDGVRT

SEQ ID NO: 446739 - protein, 10 aa, Mycobacterium
DEDGDRPTAA

SEQ ID NO: 446740 - protein, 6 aa, Mycobacterium
DEDGDY

SEQ ID NO: 446741 - protein, 6 aa, Mycobacterium
DEDGIA

SEQ ID NO: 446742 - protein, 26 aa, Mycobacterium
DEDGNDLPGITTSDCEYKGGLPGVDN

SEQ ID NO: 446743 - protein, 12 aa, Mycobacterium
DEDGNDLPGVTT

SEQ ID NO: 446744 - protein, 38 aa, Mycobacterium
DEDGNPKHEVAEGTDSQAKDDDGREQKDLQDQIEKDKA

SEQ ID NO: 446745 - protein, 56 aa, Mycobacterium
DEDGNPKHEVPDNAGSVEQKADDSRDEQDLQDQIEKDKALNEKLKEAATAENKGEK

SEQ ID NO: 446746 - protein, 13 aa, Mycobacterium
DEDGNVLGPGQTG

SEQ ID NO: 446747 - protein, 21 aa, Mycobacterium
DEDGPHHPYRDDGEIPASAQT

SEQ ID NO: 446748 - protein, 8 aa, Mycobacterium
DEDGQGQF

SEQ ID NO: 446749 - protein, 10 aa, Mycobacterium
DEDGQPVRGE

SEQ ID NO: 446750 - protein, 9 aa, Mycobacterium
DEDGQRSGA

SEQ ID NO: 446751 - protein, 8 aa, Mycobacterium
DEDGRPVP

SEQ ID NO: 446752 - protein, 10 aa, Mycobacterium
DEDGRQPPSY

SEQ ID NO: 446753 - protein, 9 aa, Mycobacterium
DEDGRTVAR

SEQ ID NO: 446754 - protein, 7 aa, Mycobacterium
DEDGRVT

SEQ ID NO: 446755 - protein, 13 aa, Mycobacterium
DEDGSPTPAGRDV

SEQ ID NO: 446756 - protein, 6 aa, Mycobacterium
DEDGTE

SEQ ID NO: 446757 - protein, 9 aa, Mycobacterium
DEDGTGTLN

SEQ ID NO: 446758 - protein, 8 aa, Mycobacterium
DEDGTLRA

SEQ ID NO: 446759 - protein, 6 aa, Mycobacterium
DEDGTV

SEQ ID NO: 446760 - protein, 8 aa, Mycobacterium
DEDGVPSF

SEQ ID NO: 446761 - protein, 9 aa, Mycobacterium
DEDHADIDS

SEQ ID NO: 446762 - protein, 9 aa, Mycobacterium
DEDKARARA

SEQ ID NO: 446763 - protein, 16 aa, Mycobacterium
DEDKDATGSVGVDPDG

SEQ ID NO: 446764 - protein, 5 aa, Mycobacterium
DEDKP

SEQ ID NO: 446765 - protein, 10 aa, Mycobacterium
DEDKPWGPIP

SEQ ID NO: 446766 - protein, 6 aa, Mycobacterium
DEDKRG

SEQ ID NO: 446767 - protein, 17 aa, Mycobacterium
DEDKRRAVEAVAAGEHY

SEQ ID NO: 446768 - protein, 7 aa, Mycobacterium
DEDLDAG

SEQ ID NO: 446769 - protein, 13 aa, Mycobacterium
DEDLEAAGKTVKQ

SEQ ID NO: 446770 - protein, 13 aa, Mycobacterium
DEDLEAAGKTVRN

SEQ ID NO: 446771 - protein, 5 aa, Mycobacterium
DEDLG

SEQ ID NO: 446772 - protein, 12 aa, Mycobacterium
DEDLGDSPDLSL

SEQ ID NO: 446773 - protein, 11 aa, Mycobacterium
DEDLPSGEELG

SEQ ID NO: 446774 - protein, 11 aa, Mycobacterium
DEDLQKAAREL

SEQ ID NO: 446775 - protein, 10 aa, Mycobacterium
DEDLTTAPDG

SEQ ID NO: 446776 - protein, 6 aa, Mycobacterium
DEDNAA

SEQ ID NO: 446777 - protein, 5 aa, Mycobacterium
DEDND

SEQ ID NO: 446778 - protein, 10 aa, Mycobacterium
DEDNDPQAAI

SEQ ID NO: 446779 - protein, 8 aa, Mycobacterium
DEDNRDGT

SEQ ID NO: 446780 - protein, 15 aa, Mycobacterium
DEDNREPPPKKQTTL

SEQ ID NO: 446781 - protein, 6 aa, Mycobacterium
DEDPAY

SEQ ID NO: 446782 - protein, 15 aa, Mycobacterium
DEDPEAPQPEDRDRA

SEQ ID NO: 446783 - protein, 8 aa, Mycobacterium
DEDPETAL

SEQ ID NO: 446784 - protein, 10 aa, Mycobacterium
DEDPGQRSCQ

SEQ ID NO: 446785 - protein, 8 aa, Mycobacterium
DEDPISGT

SEQ ID NO: 446786 - protein, 7 aa, Mycobacterium
DEDPQAA

SEQ ID NO: 446787 - protein, 8 aa, Mycobacterium
DEDPQAAL

SEQ ID NO: 446788 - protein, 5 aa, Mycobacterium
DEDPR

SEQ ID NO: 446789 - protein, 18 aa, Mycobacterium
DEDPRQDAHRRPERQRAH

SEQ ID NO: 446790 - protein, 6 aa, Mycobacterium
DEDPRR

SEQ ID NO: 446791 - protein, 7 aa, Mycobacterium
DEDPTQR

SEQ ID NO: 446792 - protein, 7 aa, Mycobacterium
DEDPTST

SEQ ID NO: 446793 - protein, 4 aa, Mycobacterium
DEDQ

SEQ ID NO: 446794 - protein, 8 aa, Mycobacterium
DEDQAEAL

SEQ ID NO: 446795 - protein, 6 aa, Mycobacterium
DEDQAR

SEQ ID NO: 446796 - protein, 5 aa, Mycobacterium
DEDQI

SEQ ID NO: 446797 - protein, 7 aa, Mycobacterium
DEDQRSR

SEQ ID NO: 446798 - protein, 8 aa, Mycobacterium
DEDRDEIE

SEQ ID NO: 446799 - protein, 7 aa, Mycobacterium
DEDRDTD

SEQ ID NO: 446800 - protein, 8 aa, Mycobacterium
DEDRENEG

SEQ ID NO: 446801 - protein, 11 aa, Mycobacterium
DEDRERANARK

SEQ ID NO: 446802 - protein, 9 aa, Mycobacterium
DEDRERPAT

SEQ ID NO: 446803 - protein, 5 aa, Mycobacterium
DEDRF

SEQ ID NO: 446804 - protein, 20 aa, Mycobacterium
DEDRPTTVLPGSGGTVAGTA

SEQ ID NO: 446805 - protein, 6 aa, Mycobacterium
DEDRRT

SEQ ID NO: 446806 - protein, 6 aa, Mycobacterium
DEDRTG

SEQ ID NO: 446807 - protein, 8 aa, Mycobacterium
DEDRTVAS

SEQ ID NO: 446808 - protein, 8 aa, Mycobacterium
DEDSASEV

SEQ ID NO: 446809 - protein, 19 aa, Mycobacterium
DEDSATAEPVGSGAATGWR

SEQ ID NO: 446810 - protein, 9 aa, Mycobacterium
DEDSDERSL

SEQ ID NO: 446811 - protein, 7 aa, Mycobacterium
DEDSDEV

SEQ ID NO: 446812 - protein, 7 aa, Mycobacterium
DEDSDIR

SEQ ID NO: 446813 - protein, 36 aa, Mycobacterium
DEDSDSDDESSDDAEDESDDAAEDDDTEDEDTADDD

SEQ ID NO: 446814 - protein, 5 aa, Mycobacterium
DEDSG

SEQ ID NO: 446815 - protein, 7 aa, Mycobacterium
DEDSGGQ

SEQ ID NO: 446816 - protein, 17 aa, Mycobacterium
DEDSGSDRESDDGGDVG

SEQ ID NO: 446817 - protein, 11 aa, Mycobacterium
DEDSPQRERRF

SEQ ID NO: 446818 - protein, 10 aa, Mycobacterium
DEDSQKEAAR

SEQ ID NO: 446819 - protein, 9 aa, Mycobacterium
DEDSQRDAA

SEQ ID NO: 446820 - protein, 5 aa, Mycobacterium
DEDSV

SEQ ID NO: 446821 - protein, 7 aa, Mycobacterium
DEDSVAR

SEQ ID NO: 446822 - protein, 6 aa, Mycobacterium
DEDSVG

SEQ ID NO: 446823 - protein, 14 aa, Mycobacterium
DEDTATRSSVRPRE

SEQ ID NO: 446824 - protein, 9 aa, Mycobacterium
DEDTDDDIR

SEQ ID NO: 446825 - protein, 10 aa, Mycobacterium
DEDTDDDIRA

SEQ ID NO: 446826 - protein, 9 aa, Mycobacterium
DEDTDDEIR

SEQ ID NO: 446827 - protein, 13 aa, Mycobacterium
DEDTEQALLAVAD

SEQ ID NO: 446828 - protein, 6 aa, Mycobacterium
DEDTKH

SEQ ID NO: 446829 - protein, 6 aa, Mycobacterium
DEDTSF

SEQ ID NO: 446830 - protein, 5 aa, Mycobacterium
DEDTV

SEQ ID NO: 446831 - protein, 9 aa, Mycobacterium
DEDTWQPTP

SEQ ID NO: 446832 - protein, 4 aa, Mycobacterium
DEDV

SEQ ID NO: 446833 - protein, 5 aa, Mycobacterium
DEDVA

SEQ ID NO: 446834 - protein, 21 aa, Mycobacterium
DEDVDTARRNAAEAAGRVRVS

SEQ ID NO: 446835 - protein, 5 aa, Mycobacterium
DEDVE

SEQ ID NO: 446836 - protein, 7 aa, Mycobacterium
DEDVERR

SEQ ID NO: 446837 - protein, 9 aa, Mycobacterium
DEDVETTAL

SEQ ID NO: 446838 - protein, 12 aa, Mycobacterium
DEDYTGRPFSER

SEQ ID NO: 446839 - protein, 6 aa, Mycobacterium
DEEAAR

SEQ ID NO: 446840 - protein, 6 aa, Mycobacterium
DEEADA

SEQ ID NO: 446841 - protein, 6 aa, Mycobacterium
DEEAEA

SEQ ID NO: 446842 - protein, 8 aa, Mycobacterium
DEEAGGNY

SEQ ID NO: 446843 - protein, 7 aa, Mycobacterium
DEEAGGV

SEQ ID NO: 446844 - protein, 5 aa, Mycobacterium
DEEAN

SEQ ID NO: 446845 - protein, 6 aa, Mycobacterium
DEEANA

SEQ ID NO: 446846 - protein, 9 aa, Mycobacterium
DEEAPPRIP

SEQ ID NO: 446847 - protein, 8 aa, Mycobacterium
DEEAQRDK

SEQ ID NO: 446848 - protein, 7 aa, Mycobacterium
DEEARAF

SEQ ID NO: 446849 - protein, 10 aa, Mycobacterium
DEEARAIAAT

SEQ ID NO: 446850 - protein, 7 aa, Mycobacterium
DEEAREK

SEQ ID NO: 446851 - protein, 7 aa, Mycobacterium
DEEAVGN

SEQ ID NO: 446852 - protein, 7 aa, Mycobacterium
DEEAVNA

SEQ ID NO: 446853 - protein, 7 aa, Mycobacterium
DEEAVTE

SEQ ID NO: 446854 - protein, 5 aa, Mycobacterium
DEEDA

SEQ ID NO: 446855 - protein, 19 aa, Mycobacterium
DEEDAAPPLTTNSDSGHTI

SEQ ID NO: 446856 - protein, 7 aa, Mycobacterium
DEEDPVQ

SEQ ID NO: 446857 - protein, 5 aa, Mycobacterium
DEEDR

SEQ ID NO: 446858 - protein, 9 aa, Mycobacterium
DEEENGKGI

SEQ ID NO: 446859 - protein, 16 aa, Mycobacterium
DEEERDHSPAPSDTYH

SEQ ID NO: 446860 - protein, 7 aa, Mycobacterium
DEEESDG

SEQ ID NO: 446861 - protein, 8 aa, Mycobacterium
DEEGGEAL

SEQ ID NO: 446862 - protein, 7 aa, Mycobacterium
DEEGGRV

SEQ ID NO: 446863 - protein, 8 aa, Mycobacterium
DEEGGRVS

SEQ ID NO: 446864 - protein, 8 aa, Mycobacterium
DEEGGSTH

SEQ ID NO: 446865 - protein, 6 aa, Mycobacterium
DEEGKQ

SEQ ID NO: 446866 - protein, 13 aa, Mycobacterium
DEEGLTARTADAV

SEQ ID NO: 446867 - protein, 7 aa, Mycobacterium
DEEGNEL

SEQ ID NO: 446868 - protein, 12 aa, Mycobacterium
DEEGQARTAEKK

SEQ ID NO: 446869 - protein, 8 aa, Mycobacterium
DEEGRTTA

SEQ ID NO: 446870 - protein, 7 aa, Mycobacterium
DEEGSRR

SEQ ID NO: 446871 - protein, 4 aa, Mycobacterium
DEEH

SEQ ID NO: 446872 - protein, 5 aa, Mycobacterium
DEEHH

SEQ ID NO: 446873 - protein, 6 aa, Mycobacterium
DEEIGP

SEQ ID NO: 446874 - protein, 6 aa, Mycobacterium
DEEIKA

SEQ ID NO: 446875 - protein, 6 aa, Mycobacterium
DEEKAA

SEQ ID NO: 446876 - protein, 5 aa, Mycobacterium
DEEKF

SEQ ID NO: 446877 - protein, 10 aa, Mycobacterium
DEEKSQRRDQ

SEQ ID NO: 446878 - protein, 4 aa, Mycobacterium
DEEL

SEQ ID NO: 446879 - protein, 15 aa, Mycobacterium
DEELAGHPGRTPRTE

SEQ ID NO: 446880 - protein, 11 aa, Mycobacterium
DEELPSGDELA

SEQ ID NO: 446881 - protein, 7 aa, Mycobacterium
DEELTER

SEQ ID NO: 446882 - protein, 5 aa, Mycobacterium
DEEMG

SEQ ID NO: 446883 - protein, 9 aa, Mycobacterium
DEENGGKWG

SEQ ID NO: 446884 - protein, 4 aa, Mycobacterium
DEEP

SEQ ID NO: 446885 - protein, 6 aa, Mycobacterium
DEEPDQ

SEQ ID NO: 446886 - protein, 9 aa, Mycobacterium
DEEPDRPLS

SEQ ID NO: 446887 - protein, 27 aa, Mycobacterium
DEEPGDLDDADEPPLEQGSFYDGVLEV

SEQ ID NO: 446888 - protein, 21 aa, Mycobacterium
DEEPMDAGSAEAREGEVGASG

SEQ ID NO: 446889 - protein, 12 aa, Mycobacterium
DEEPNEWPPGSS

SEQ ID NO: 446890 - protein, 40 aa, Mycobacterium
DEEPPQEPAEPEEQVEAPAEGETPKESRESRGGSKKRKGR

SEQ ID NO: 446891 - protein, 5 aa, Mycobacterium
DEEPT

SEQ ID NO: 446892 - protein, 6 aa, Mycobacterium
DEEQAE

SEQ ID NO: 446893 - protein, 6 aa, Mycobacterium
DEEQAV

SEQ ID NO: 446894 - protein, 6 aa, Mycobacterium
DEEQGL

SEQ ID NO: 446895 - protein, 6 aa, Mycobacterium
DEEQQR

SEQ ID NO: 446896 - protein, 5 aa, Mycobacterium
DEERA

SEQ ID NO: 446897 - protein, 7 aa, Mycobacterium
DEERAIR

SEQ ID NO: 446898 - protein, 8 aa, Mycobacterium
DEERDAVR

SEQ ID NO: 446899 - protein, 30 aa, Mycobacterium
DEERGEGDLPYPPSYPKMPGEPPRVQPSKK

SEQ ID NO: 446900 - protein, 7 aa, Mycobacterium
DEERGLG

SEQ ID NO: 446901 - protein, 10 aa, Mycobacterium
DEERPGQDNV

SEQ ID NO: 446902 - protein, 8 aa, Mycobacterium
DEERQALA

SEQ ID NO: 446903 - protein, 8 aa, Mycobacterium
DEERQELD

SEQ ID NO: 446904 - protein, 5 aa, Mycobacterium
DEERS

SEQ ID NO: 446905 - protein, 6 aa, Mycobacterium
DEERVA

SEQ ID NO: 446906 - protein, 4 aa, Mycobacterium
DEES

SEQ ID NO: 446907 - protein, 6 aa, Mycobacterium
DEESAA

SEQ ID NO: 446908 - protein, 7 aa, Mycobacterium
DEESAAE

SEQ ID NO: 446909 - protein, 8 aa, Mycobacterium
DEESARRT

SEQ ID NO: 446910 - protein, 7 aa, Mycobacterium
DEESASE

SEQ ID NO: 446911 - protein, 8 aa, Mycobacterium
DEESATGF

SEQ ID NO: 446912 - protein, 10 aa, Mycobacterium
DEESKRAGAD

SEQ ID NO: 446913 - protein, 6 aa, Mycobacterium
DEESNR

SEQ ID NO: 446914 - protein, 6 aa, Mycobacterium
DEESQK

SEQ ID NO: 446915 - protein, 5 aa, Mycobacterium
DEETA

SEQ ID NO: 446916 - protein, 6 aa, Mycobacterium
DEETAD

SEQ ID NO: 446917 - protein, 17 aa, Mycobacterium
DEETDADDDPLVFQVGA

SEQ ID NO: 446918 - protein, 6 aa, Mycobacterium
DEETDI

SEQ ID NO: 446919 - protein, 17 aa, Mycobacterium
DEETGKKVRISRRNGKD

SEQ ID NO: 446920 - protein, 7 aa, Mycobacterium
DEETGKR

SEQ ID NO: 446921 - protein, 12 aa, Mycobacterium
DEETGTAESWPM

SEQ ID NO: 446922 - protein, 11 aa, Mycobacterium
DEETRPGEEIN

SEQ ID NO: 446923 - protein, 9 aa, Mycobacterium
DEETRQRAQ

SEQ ID NO: 446924 - protein, 9 aa, Mycobacterium
DEETRRRAE

SEQ ID NO: 446925 - protein, 6 aa, Mycobacterium
DEEVAE

SEQ ID NO: 446926 - protein, 11 aa, Mycobacterium
DEEVTKPGSDR

SEQ ID NO: 446927 - protein, 5 aa, Mycobacterium
DEEWP

SEQ ID NO: 446928 - protein, 5 aa, Mycobacterium
DEEYG

SEQ ID NO: 446929 - protein, 14 aa, Mycobacterium
DEFADADSQSAEIG

SEQ ID NO: 446930 - protein, 7 aa, Mycobacterium
DEFADRQ

SEQ ID NO: 446931 - protein, 8 aa, Mycobacterium
DEFAPQGV

SEQ ID NO: 446932 - protein, 4 aa, Mycobacterium
DEFE

SEQ ID NO: 446933 - protein, 7 aa, Mycobacterium
DEFEDRD

SEQ ID NO: 446934 - protein, 8 aa, Mycobacterium
DEFEDRDT

SEQ ID NO: 446935 - protein, 5 aa, Mycobacterium
DEFGD

SEQ ID NO: 446936 - protein, 6 aa, Mycobacterium
DEFGEE

SEQ ID NO: 446937 - protein, 8 aa, Mycobacterium
DEFGGSGQ

SEQ ID NO: 446938 - protein, 12 aa, Mycobacterium
DEFGGSLENRAK

SEQ ID NO: 446939 - protein, 6 aa, Mycobacterium
DEFGIS

SEQ ID NO: 446940 - protein, 6 aa, Mycobacterium
DEFGRP

SEQ ID NO: 446941 - protein, 6 aa, Mycobacterium
DEFPAD

SEQ ID NO: 446942 - protein, 7 aa, Mycobacterium
DEFPAKS

SEQ ID NO: 446943 - protein, 8 aa, Mycobacterium
DEFPNPNN

SEQ ID NO: 446944 - protein, 6 aa, Mycobacterium
DEFPTA

SEQ ID NO: 446945 - protein, 4 aa, Mycobacterium
DEFT

SEQ ID NO: 446946 - protein, 8 aa, Mycobacterium
DEGADDAL

SEQ ID NO: 446947 - protein, 11 aa, Mycobacterium
DEGAEGSGPGE

SEQ ID NO: 446948 - protein, 8 aa, Mycobacterium
DEGAEPHE

SEQ ID NO: 446949 - protein, 5 aa, Mycobacterium
DEGAG

SEQ ID NO: 446950 - protein, 10 aa, Mycobacterium
DEGAGDRAQI

SEQ ID NO: 446951 - protein, 6 aa, Mycobacterium
DEGALD

SEQ ID NO: 446952 - protein, 8 aa, Mycobacterium
DEGALTPQ

SEQ ID NO: 446953 - protein, 6 aa, Mycobacterium
DEGAQG

SEQ ID NO: 446954 - protein, 7 aa, Mycobacterium
DEGARTK

SEQ ID NO: 446955 - protein, 9 aa, Mycobacterium
DEGATDGPL

SEQ ID NO: 446956 - protein, 8 aa, Mycobacterium
DEGATTSL

SEQ ID NO: 446957 - protein, 17 aa, Mycobacterium
DEGAVVRTGGQAATVDA

SEQ ID NO: 446958 - protein, 4 aa, Mycobacterium
DEGC

SEQ ID NO: 446959 - protein, 7 aa, Mycobacterium
DEGDAEL

SEQ ID NO: 446960 - protein, 15 aa, Mycobacterium
DEGDAGPTKVDKRNR

SEQ ID NO: 446961 - protein, 10 aa, Mycobacterium
DEGDDGSSVT

SEQ ID NO: 446962 - protein, 15 aa, Mycobacterium
DEGDDLGSLTKGPLT

SEQ ID NO: 446963 - protein, 5 aa, Mycobacterium
DEGDE

SEQ ID NO: 446964 - protein, 16 aa, Mycobacterium
DEGDEEAGSAVREDEV

SEQ ID NO: 446965 - protein, 12 aa, Mycobacterium
DEGDGPRASARA

SEQ ID NO: 446966 - protein, 11 aa, Mycobacterium
DEGDGVDKRDR

SEQ ID NO: 446967 - protein, 6 aa, Mycobacterium
DEGDKN

SEQ ID NO: 446968 - protein, 8 aa, Mycobacterium
DEGDRRSN

SEQ ID NO: 446969 - protein, 5 aa, Mycobacterium
DEGDS

SEQ ID NO: 446970 - protein, 7 aa, Mycobacterium
DEGDSWA

SEQ ID NO: 446971 - protein, 7 aa, Mycobacterium
DEGEAVE

SEQ ID NO: 446972 - protein, 13 aa, Mycobacterium
DEGEHTAETPARV

SEQ ID NO: 446973 - protein, 22 aa, Mycobacterium
DEGELEKESVKVTKPAPKKKAK

SEQ ID NO: 446974 - protein, 16 aa, Mycobacterium
DEGENPRPLLQLVPQP

SEQ ID NO: 446975 - protein, 22 aa, Mycobacterium
DEGFSVGPKEKKLGIKGSPTTE

SEQ ID NO: 446976 - protein, 14 aa, Mycobacterium
DEGFSVGPKERKLG

SEQ ID NO: 446977 - protein, 6 aa, Mycobacterium
DEGFTV

SEQ ID NO: 446978 - protein, 22 aa, Mycobacterium
DEGFTVGPKEKKLGIKGSPTTE

SEQ ID NO: 446979 - protein, 14 aa, Mycobacterium
DEGFTVGPKERKLG

SEQ ID NO: 446980 - protein, 4 aa, Mycobacterium
DEGG

SEQ ID NO: 446981 - protein, 6 aa, Mycobacterium
DEGGAH

SEQ ID NO: 446982 - protein, 6 aa, Mycobacterium
DEGGGA

SEQ ID NO: 446983 - protein, 7 aa, Mycobacterium
DEGGGAV

SEQ ID NO: 446984 - protein, 7 aa, Mycobacterium
DEGGHWP

SEQ ID NO: 446985 - protein, 6 aa, Mycobacterium
DEGGPV

SEQ ID NO: 446986 - protein, 8 aa, Mycobacterium
DEGGRPMA

SEQ ID NO: 446987 - protein, 4 aa, Mycobacterium
DEGH

SEQ ID NO: 446988 - protein, 11 aa, Mycobacterium
DEGHGAVNAEN

SEQ ID NO: 446989 - protein, 6 aa, Mycobacterium
DEGHGF

SEQ ID NO: 446990 - protein, 19 aa, Mycobacterium
DEGHLNTEEYQKLKNELLG

SEQ ID NO: 446991 - protein, 5 aa, Mycobacterium
DEGHS

SEQ ID NO: 446992 - protein, 5 aa, Mycobacterium
DEGIT

SEQ ID NO: 446993 - protein, 8 aa, Mycobacterium
DEGKAELK

SEQ ID NO: 446994 - protein, 9 aa, Mycobacterium
DEGKASLTT

SEQ ID NO: 446995 - protein, 8 aa, Mycobacterium
DEGKAVAA

SEQ ID NO: 446996 - protein, 10 aa, Mycobacterium
DEGKAVAAEV

SEQ ID NO: 446997 - protein, 12 aa, Mycobacterium
DEGKAVADEIGD

SEQ ID NO: 446998 - protein, 6 aa, Mycobacterium
DEGKDP

SEQ ID NO: 446999 - protein, 9 aa, Mycobacterium
DEGKEAGTA

SEQ ID NO: 447000 - protein, 10 aa, Mycobacterium
DEGKPVSQGT

SEQ ID NO: 447001 - protein, 5 aa, Mycobacterium
DEGLG

SEQ ID NO: 447002 - protein, 8 aa, Mycobacterium
DEGLPGTI

SEQ ID NO: 447003 - protein, 6 aa, Mycobacterium
DEGLQR

SEQ ID NO: 447004 - protein, 6 aa, Mycobacterium
DEGLRD

SEQ ID NO: 447005 - protein, 5 aa, Mycobacterium
DEGLS

SEQ ID NO: 447006 - protein, 4 aa, Mycobacterium
DEGM

SEQ ID NO: 447007 - protein, 5 aa, Mycobacterium
DEGMD

SEQ ID NO: 447008 - protein, 4 aa, Mycobacterium
DEGP

SEQ ID NO: 447009 - protein, 12 aa, Mycobacterium
DEGPARAGGGAV

SEQ ID NO: 447010 - protein, 7 aa, Mycobacterium
DEGPDGF

SEQ ID NO: 447011 - protein, 7 aa, Mycobacterium
DEGPDVE

SEQ ID NO: 447012 - protein, 15 aa, Mycobacterium
DEGPFSTISSGERIS

SEQ ID NO: 447013 - protein, 15 aa, Mycobacterium
DEGPKGVKAQIQGDE

SEQ ID NO: 447014 - protein, 26 aa, Mycobacterium
DEGPKGVKSQVQGDEIRVSSKKRDDL

SEQ ID NO: 447015 - protein, 13 aa, Mycobacterium
DEGPKGVKTQIQG

SEQ ID NO: 447016 - protein, 14 aa, Mycobacterium
DEGPKTVKTQIQGD

SEQ ID NO: 447017 - protein, 5 aa, Mycobacterium
DEGPL

SEQ ID NO: 447018 - protein, 10 aa, Mycobacterium
DEGPRESSLE

SEQ ID NO: 447019 - protein, 9 aa, Mycobacterium
DEGPRESTL

SEQ ID NO: 447020 - protein, 9 aa, Mycobacterium
DEGPRETSL

SEQ ID NO: 447021 - protein, 5 aa, Mycobacterium
DEGPW

SEQ ID NO: 447022 - protein, 10 aa, Mycobacterium
DEGQADGSIR

SEQ ID NO: 447023 - protein, 7 aa, Mycobacterium
DEGQEAT

SEQ ID NO: 447024 - protein, 7 aa, Mycobacterium
DEGQQSA

SEQ ID NO: 447025 - protein, 16 aa, Mycobacterium
DEGRAAAEKIDTPPWE

SEQ ID NO: 447026 - protein, 16 aa, Mycobacterium
DEGRAAAEKVETPPWD

SEQ ID NO: 447027 - protein, 8 aa, Mycobacterium
DEGREAAV

SEQ ID NO: 447028 - protein, 8 aa, Mycobacterium
DEGREVNR

SEQ ID NO: 447029 - protein, 10 aa, Mycobacterium
DEGRGPLPAE

SEQ ID NO: 447030 - protein, 6 aa, Mycobacterium
DEGRHV

SEQ ID NO: 447031 - protein, 10 aa, Mycobacterium
DEGRMSRPRP

SEQ ID NO: 447032 - protein, 8 aa, Mycobacterium
DEGRPAVD

SEQ ID NO: 447033 - protein, 7 aa, Mycobacterium
DEGRPGV

SEQ ID NO: 447034 - protein, 8 aa, Mycobacterium
DEGRPRTG

SEQ ID NO: 447035 - protein, 17 aa, Mycobacterium
DEGRRPEPDPLDVEDEA

SEQ ID NO: 447036 - protein, 6 aa, Mycobacterium
DEGRSA

SEQ ID NO: 447037 - protein, 5 aa, Mycobacterium
DEGRV

SEQ ID NO: 447038 - protein, 19 aa, Mycobacterium
DEGSATSMSDLARVFLQPC

SEQ ID NO: 447039 - protein, 10 aa, Mycobacterium
DEGSDDRLTT

SEQ ID NO: 447040 - protein, 11 aa, Mycobacterium
DEGSGTGGVQA

SEQ ID NO: 447041 - protein, 6 aa, Mycobacterium
DEGSIT

SEQ ID NO: 447042 - protein, 12 aa, Mycobacterium
DEGSPADVANSV

SEQ ID NO: 447043 - protein, 5 aa, Mycobacterium
DEGSQ

SEQ ID NO: 447044 - protein, 8 aa, Mycobacterium
DEGTEDPD

SEQ ID NO: 447045 - protein, 7 aa, Mycobacterium
DEGTFEH

SEQ ID NO: 447046 - protein, 9 aa, Mycobacterium
DEGTGGHTM

SEQ ID NO: 447047 - protein, 8 aa, Mycobacterium
DEGTRRGG

SEQ ID NO: 447048 - protein, 7 aa, Mycobacterium
DEGTRTA

SEQ ID NO: 447049 - protein, 7 aa, Mycobacterium
DEGTRTK

SEQ ID NO: 447050 - protein, 24 aa, Mycobacterium
DEGTVDSFSSDIDGAKPTAPQKNR

SEQ ID NO: 447051 - protein, 4 aa, Mycobacterium
DEGV

SEQ ID NO: 447052 - protein, 10 aa, Mycobacterium
DEGVATVEPS

SEQ ID NO: 447053 - protein, 9 aa, Mycobacterium
DEGVPWPPG

SEQ ID NO: 447054 - protein, 5 aa, Mycobacterium
DEGVR

SEQ ID NO: 447055 - protein, 14 aa, Mycobacterium
DEGVRQAARARPHF

SEQ ID NO: 447056 - protein, 13 aa, Mycobacterium
DEGVRRGSSAEKL

SEQ ID NO: 447057 - protein, 16 aa, Mycobacterium
DEGVSGGKAIDARPAL

SEQ ID NO: 447058 - protein, 5 aa, Mycobacterium
DEGVT

SEQ ID NO: 447059 - protein, 16 aa, Mycobacterium
DEGVTGYVDTDGDGKW

SEQ ID NO: 447060 - protein, 10 aa, Mycobacterium
DEGYKMSGNA

SEQ ID NO: 447061 - protein, 5 aa, Mycobacterium
DEGYR

SEQ ID NO: 447062 - protein, 6 aa, Mycobacterium
DEGYRR

SEQ ID NO: 447063 - protein, 8 aa, Mycobacterium
DEGYYKTG

SEQ ID NO: 447064 - protein, 7 aa, Mycobacterium
DEHADPK

SEQ ID NO: 447065 - protein, 8 aa, Mycobacterium
DEHADPKV

SEQ ID NO: 447066 - protein, 5 aa, Mycobacterium
DEHAE

SEQ ID NO: 447067 - protein, 7 aa, Mycobacterium
DEHASGW

SEQ ID NO: 447068 - protein, 7 aa, Mycobacterium
DEHDATA

SEQ ID NO: 447069 - protein, 7 aa, Mycobacterium
DEHERAR

SEQ ID NO: 447070 - protein, 6 aa, Mycobacterium
DEHESD

SEQ ID NO: 447071 - protein, 4 aa, Mycobacterium
DEHG

SEQ ID NO: 447072 - protein, 5 aa, Mycobacterium
DEHGA

SEQ ID NO: 447073 - protein, 7 aa, Mycobacterium
DEHGGDA

SEQ ID NO: 447074 - protein, 7 aa, Mycobacterium
DEHGNRA

SEQ ID NO: 447075 - protein, 5 aa, Mycobacterium
DEHGP

SEQ ID NO: 447076 - protein, 15 aa, Mycobacterium
DEHGPNVKTGPEYGD

SEQ ID NO: 447077 - protein, 7 aa, Mycobacterium
DEHGPTV

SEQ ID NO: 447078 - protein, 6 aa, Mycobacterium
DEHGQP

SEQ ID NO: 447079 - protein, 18 aa, Mycobacterium
DEHGQPAVSKTASQVRNG

SEQ ID NO: 447080 - protein, 11 aa, Mycobacterium
DEHGRETEREA

SEQ ID NO: 447081 - protein, 7 aa, Mycobacterium
DEHGRLT

SEQ ID NO: 447082 - protein, 6 aa, Mycobacterium
DEHGRP

SEQ ID NO: 447083 - protein, 5 aa, Mycobacterium
DEHLD

SEQ ID NO: 447084 - protein, 4 aa, Mycobacterium
DEHP

SEQ ID NO: 447085 - protein, 18 aa, Mycobacterium
DEHPAAKPFKDALSSDGI

SEQ ID NO: 447086 - protein, 6 aa, Mycobacterium
DEHPAH

SEQ ID NO: 447087 - protein, 6 aa, Mycobacterium
DEHPDA

SEQ ID NO: 447088 - protein, 5 aa, Mycobacterium
DEHPE

SEQ ID NO: 447089 - protein, 12 aa, Mycobacterium
DEHPGAADDLAS

SEQ ID NO: 447090 - protein, 6 aa, Mycobacterium
DEHPGW

SEQ ID NO: 447091 - protein, 5 aa, Mycobacterium
DEHPL

SEQ ID NO: 447092 - protein, 13 aa, Mycobacterium
DEHPRADTSVESL

SEQ ID NO: 447093 - protein, 10 aa, Mycobacterium
DEHPRADTTV

SEQ ID NO: 447094 - protein, 13 aa, Mycobacterium
DEHPRPGTTAETL

SEQ ID NO: 447095 - protein, 12 aa, Mycobacterium
DEHPRRGSSMES

SEQ ID NO: 447096 - protein, 15 aa, Mycobacterium
DEHPSHSDEAAAAEL

SEQ ID NO: 447097 - protein, 8 aa, Mycobacterium
DEHQAADY

SEQ ID NO: 447098 - protein, 5 aa, Mycobacterium
DEHQQ

SEQ ID NO: 447099 - protein, 4 aa, Mycobacterium
DEHR

SEQ ID NO: 447100 - protein, 8 aa, Mycobacterium
DEHRDLST

SEQ ID NO: 447101 - protein, 8 aa, Mycobacterium
DEHRGTRP

SEQ ID NO: 447102 - protein, 6 aa, Mycobacterium
DEHRPD

SEQ ID NO: 447103 - protein, 5 aa, Mycobacterium
DEHRS

SEQ ID NO: 447104 - protein, 6 aa, Mycobacterium
DEHSDA

SEQ ID NO: 447105 - protein, 14 aa, Mycobacterium
DEHSDGLAAAAEAV

SEQ ID NO: 447106 - protein, 7 aa, Mycobacterium
DEHSDPV

SEQ ID NO: 447107 - protein, 8 aa, Mycobacterium
DEHSQLDE

SEQ ID NO: 447108 - protein, 8 aa, Mycobacterium
DEHTPGIS

SEQ ID NO: 447109 - protein, 7 aa, Mycobacterium
DEHTQEL

SEQ ID NO: 447110 - protein, 6 aa, Mycobacterium
DEHVGA

SEQ ID NO: 447111 - protein, 4 aa, Mycobacterium
DEIA

SEQ ID NO: 447112 - protein, 6 aa, Mycobacterium
DEIAEG

SEQ ID NO: 447113 - protein, 4 aa, Mycobacterium
DEID

SEQ ID NO: 447114 - protein, 7 aa, Mycobacterium
DEIDATA

SEQ ID NO: 447115 - protein, 5 aa, Mycobacterium
DEIDG

SEQ ID NO: 447116 - protein, 10 aa, Mycobacterium
DEIDGARNAL

SEQ ID NO: 447117 - protein, 11 aa, Mycobacterium
DEIDRDPATLE

SEQ ID NO: 447118 - protein, 5 aa, Mycobacterium
DEIED

SEQ ID NO: 447119 - protein, 9 aa, Mycobacterium
DEIEPSATD

SEQ ID NO: 447120 - protein, 5 aa, Mycobacterium
DEIES

SEQ ID NO: 447121 - protein, 8 aa, Mycobacterium
DEIETDDG

SEQ ID NO: 447122 - protein, 4 aa, Mycobacterium
DEIG

SEQ ID NO: 447123 - protein, 6 aa, Mycobacterium
DEIGET

SEQ ID NO: 447124 - protein, 12 aa, Mycobacterium
DEIGRTQQGNNN

SEQ ID NO: 447125 - protein, 14 aa, Mycobacterium
DEIKQELSAAQPYG

SEQ ID NO: 447126 - protein, 12 aa, Mycobacterium
DEINSEHRNSEY

SEQ ID NO: 447127 - protein, 13 aa, Mycobacterium
DEIPDPQDPETFA

SEQ ID NO: 447128 - protein, 13 aa, Mycobacterium
DEIPDTGQMGGRT

SEQ ID NO: 447129 - protein, 7 aa, Mycobacterium
DEIPPGG

SEQ ID NO: 447130 - protein, 11 aa, Mycobacterium
DEIQRARSAVR

SEQ ID NO: 447131 - protein, 6 aa, Mycobacterium
DEIQSR

SEQ ID NO: 447132 - protein, 4 aa, Mycobacterium
DEIS

SEQ ID NO: 447133 - protein, 6 aa, Mycobacterium
DEISAQ

SEQ ID NO: 447134 - protein, 6 aa, Mycobacterium
DEISDE

SEQ ID NO: 447135 - protein, 5 aa, Mycobacterium
DEISE

SEQ ID NO: 447136 - protein, 9 aa, Mycobacterium
DEISGAGGA

SEQ ID NO: 447137 - protein, 8 aa, Mycobacterium
DEISPGTM

SEQ ID NO: 447138 - protein, 7 aa, Mycobacterium
DEISSET

SEQ ID NO: 447139 - protein, 6 aa, Mycobacterium
DEISTE

SEQ ID NO: 447140 - protein, 11 aa, Mycobacterium
DEITSGPSGSQ

SEQ ID NO: 447141 - protein, 10 aa, Mycobacterium
DEITTPGPGQ

SEQ ID NO: 447142 - protein, 9 aa, Mycobacterium
DEIYPGPDG

SEQ ID NO: 447143 - protein, 23 aa, Mycobacterium
DEKACQSAGLSRSSEPEPTMNGS

SEQ ID NO: 447144 - protein, 6 aa, Mycobacterium
DEKAQQ

SEQ ID NO: 447145 - protein, 9 aa, Mycobacterium
DEKASRRGA

SEQ ID NO: 447146 - protein, 13 aa, Mycobacterium
DEKAVKDKAERLE

SEQ ID NO: 447147 - protein, 9 aa, Mycobacterium
DEKDGGDHA

SEQ ID NO: 447148 - protein, 5 aa, Mycobacterium
DEKEL

SEQ ID NO: 447149 - protein, 6 aa, Mycobacterium
DEKGPM

SEQ ID NO: 447150 - protein, 6 aa, Mycobacterium
DEKGQL

SEQ ID NO: 447151 - protein, 5 aa, Mycobacterium
DEKGR

SEQ ID NO: 447152 - protein, 9 aa, Mycobacterium
DEKGRATRE

SEQ ID NO: 447153 - protein, 17 aa, Mycobacterium
DEKGRNKQPAFLLQAHK

SEQ ID NO: 447154 - protein, 5 aa, Mycobacterium
DEKGV

SEQ ID NO: 447155 - protein, 5 aa, Mycobacterium
DEKIA

SEQ ID NO: 447156 - protein, 5 aa, Mycobacterium
DEKLD

SEQ ID NO: 447157 - protein, 7 aa, Mycobacterium
DEKLPGE

SEQ ID NO: 447158 - protein, 5 aa, Mycobacterium
DEKPD

SEQ ID NO: 447159 - protein, 6 aa, Mycobacterium
DEKPEL

SEQ ID NO: 447160 - protein, 15 aa, Mycobacterium
DEKPGGHGDRAAAAA

SEQ ID NO: 447161 - protein, 7 aa, Mycobacterium
DEKPKAP

SEQ ID NO: 447162 - protein, 10 aa, Mycobacterium
DEKPTASDDG

SEQ ID NO: 447163 - protein, 6 aa, Mycobacterium
DEKPVT

SEQ ID NO: 447164 - protein, 17 aa, Mycobacterium
DEKQRVPGDPEADSIIE

SEQ ID NO: 447165 - protein, 11 aa, Mycobacterium
DEKQSTSRERL

SEQ ID NO: 447166 - protein, 5 aa, Mycobacterium
DEKRR

SEQ ID NO: 447167 - protein, 5 aa, Mycobacterium
DEKSA

SEQ ID NO: 447168 - protein, 9 aa, Mycobacterium
DEKSAADVG

SEQ ID NO: 447169 - protein, 9 aa, Mycobacterium
DEKSASDIG

SEQ ID NO: 447170 - protein, 5 aa, Mycobacterium
DEKST

SEQ ID NO: 447171 - protein, 8 aa, Mycobacterium
DEKTAIDP

SEQ ID NO: 447172 - protein, 9 aa, Mycobacterium
DEKTAQAID

SEQ ID NO: 447173 - protein, 11 aa, Mycobacterium
DEKTEGKYSDT

SEQ ID NO: 447174 - protein, 10 aa, Mycobacterium
DEKTGKSVAN

SEQ ID NO: 447175 - protein, 7 aa, Mycobacterium
DEKTHQP

SEQ ID NO: 447176 - protein, 8 aa, Mycobacterium
DEKTNRVA

SEQ ID NO: 447177 - protein, 11 aa, Mycobacterium
DEKTQGKYSDT

SEQ ID NO: 447178 - protein, 4 aa, Mycobacterium
DEKW

SEQ ID NO: 447179 - protein, 5 aa, Mycobacterium
DEKWG

SEQ ID NO: 447180 - protein, 6 aa, Mycobacterium
DEKWGE

SEQ ID NO: 447181 - protein, 9 aa, Mycobacterium
DEKYARTGT

SEQ ID NO: 447182 - protein, 16 aa, Mycobacterium
DELADTAEKVADRGRR

SEQ ID NO: 447183 - protein, 5 aa, Mycobacterium
DELAE

SEQ ID NO: 447184 - protein, 8 aa, Mycobacterium
DELAGGPE

SEQ ID NO: 447185 - protein, 6 aa, Mycobacterium
DELAGQ

SEQ ID NO: 447186 - protein, 10 aa, Mycobacterium
DELASDPALR

SEQ ID NO: 447187 - protein, 8 aa, Mycobacterium
DELATAQA

SEQ ID NO: 447188 - protein, 4 aa, Mycobacterium
DELD

SEQ ID NO: 447189 - protein, 12 aa, Mycobacterium
DELDAHGDNPAN

SEQ ID NO: 447190 - protein, 6 aa, Mycobacterium
DELDPD

SEQ ID NO: 447191 - protein, 7 aa, Mycobacterium
DELDRRR

SEQ ID NO: 447192 - protein, 13 aa, Mycobacterium
DELEAGRTKTVEE

SEQ ID NO: 447193 - protein, 5 aa, Mycobacterium
DELET

SEQ ID NO: 447194 - protein, 8 aa, Mycobacterium
DELETSSA

SEQ ID NO: 447195 - protein, 5 aa, Mycobacterium
DELGE

SEQ ID NO: 447196 - protein, 21 aa, Mycobacterium
DELGETRARRGEYAEQAATAR

SEQ ID NO: 447197 - protein, 5 aa, Mycobacterium
DELGG

SEQ ID NO: 447198 - protein, 10 aa, Mycobacterium
DELGGAGSTV

SEQ ID NO: 447199 - protein, 8 aa, Mycobacterium
DELGGGSL

SEQ ID NO: 447200 - protein, 14 aa, Mycobacterium
DELGGKDRVYDAEG

SEQ ID NO: 447201 - protein, 7 aa, Mycobacterium
DELGQPA

SEQ ID NO: 447202 - protein, 8 aa, Mycobacterium
DELGQSGV

SEQ ID NO: 447203 - protein, 28 aa, Mycobacterium
DELGRDLTAEETSQVEEATGKAKSLDSR

SEQ ID NO: 447204 - protein, 6 aa, Mycobacterium
DELGRQ

SEQ ID NO: 447205 - protein, 8 aa, Mycobacterium
DELGRRDD

SEQ ID NO: 447206 - protein, 13 aa, Mycobacterium
DELGSIRAGKKAD

SEQ ID NO: 447207 - protein, 12 aa, Mycobacterium
DELGTDRSGFNS

SEQ ID NO: 447208 - protein, 6 aa, Mycobacterium
DELHRS

SEQ ID NO: 447209 - protein, 6 aa, Mycobacterium
DELHSR

SEQ ID NO: 447210 - protein, 15 aa, Mycobacterium
DELKARTLPSVATGE

SEQ ID NO: 447211 - protein, 7 aa, Mycobacterium
DELKDQA

SEQ ID NO: 447212 - protein, 5 aa, Mycobacterium
DELNE

SEQ ID NO: 447213 - protein, 6 aa, Mycobacterium
DELPAL

SEQ ID NO: 447214 - protein, 6 aa, Mycobacterium
DELPDN

SEQ ID NO: 447215 - protein, 11 aa, Mycobacterium
DELPDRDDQTA

SEQ ID NO: 447216 - protein, 9 aa, Mycobacterium
DELPEGTKY

SEQ ID NO: 447217 - protein, 8 aa, Mycobacterium
DELPESSA

SEQ ID NO: 447218 - protein, 5 aa, Mycobacterium
DELPI

SEQ ID NO: 447219 - protein, 8 aa, Mycobacterium
DELPNGLP

SEQ ID NO: 447220 - protein, 6 aa, Mycobacterium
DELPPG

SEQ ID NO: 447221 - protein, 7 aa, Mycobacterium
DELPPGL

SEQ ID NO: 447222 - protein, 8 aa, Mycobacterium
DELPPTER

SEQ ID NO: 447223 - protein, 6 aa, Mycobacterium
DELPRG

SEQ ID NO: 447224 - protein, 10 aa, Mycobacterium
DELPRKPTGK

SEQ ID NO: 447225 - protein, 8 aa, Mycobacterium
DELPRKTR

SEQ ID NO: 447226 - protein, 13 aa, Mycobacterium
DELPSDASTLEEK

SEQ ID NO: 447227 - protein, 16 aa, Mycobacterium
DELPSTPSNRATVPQD

SEQ ID NO: 447228 - protein, 5 aa, Mycobacterium
DELPT

SEQ ID NO: 447229 - protein, 16 aa, Mycobacterium
DELPTEPVNRSAVPQG

SEQ ID NO: 447230 - protein, 6 aa, Mycobacterium
DELPTK

SEQ ID NO: 447231 - protein, 6 aa, Mycobacterium
DELPVE

SEQ ID NO: 447232 - protein, 6 aa, Mycobacterium
DELQAA

SEQ ID NO: 447233 - protein, 12 aa, Mycobacterium
DELQARKDRRVA

SEQ ID NO: 447234 - protein, 12 aa, Mycobacterium
DELQDDNAHLVD

SEQ ID NO: 447235 - protein, 13 aa, Mycobacterium
DELQKQPPDQARV

SEQ ID NO: 447236 - protein, 5 aa, Mycobacterium
DELRA

SEQ ID NO: 447237 - protein, 7 aa, Mycobacterium
DELRDTD

SEQ ID NO: 447238 - protein, 7 aa, Mycobacterium
DELRDTG

SEQ ID NO: 447239 - protein, 7 aa, Mycobacterium
DELRDTS

SEQ ID NO: 447240 - protein, 6 aa, Mycobacterium
DELRDY

SEQ ID NO: 447241 - protein, 9 aa, Mycobacterium
DELRKQAAD

SEQ ID NO: 447242 - protein, 4 aa, Mycobacterium
DELS

SEQ ID NO: 447243 - protein, 11 aa, Mycobacterium
DELSARTGIDA

SEQ ID NO: 447244 - protein, 6 aa, Mycobacterium
DELSGA

SEQ ID NO: 447245 - protein, 8 aa, Mycobacterium
DELSKDET

SEQ ID NO: 447246 - protein, 10 aa, Mycobacterium
DELSPEEEQA

SEQ ID NO: 447247 - protein, 8 aa, Mycobacterium
DELSPSSV

SEQ ID NO: 447248 - protein, 5 aa, Mycobacterium
DELSR

SEQ ID NO: 447249 - protein, 10 aa, Mycobacterium
DELSSDELER

SEQ ID NO: 447250 - protein, 5 aa, Mycobacterium
DELST

SEQ ID NO: 447251 - protein, 5 aa, Mycobacterium
DELTA

SEQ ID NO: 447252 - protein, 11 aa, Mycobacterium
DELTDEEKERF

SEQ ID NO: 447253 - protein, 7 aa, Mycobacterium
DELTGDV

SEQ ID NO: 447254 - protein, 9 aa, Mycobacterium
DELTGGEGG

SEQ ID NO: 447255 - protein, 7 aa, Mycobacterium
DELTPDE

SEQ ID NO: 447256 - protein, 11 aa, Mycobacterium
DELTPKIPRAG

SEQ ID NO: 447257 - protein, 7 aa, Mycobacterium
DELTREE

SEQ ID NO: 447258 - protein, 4 aa, Mycobacterium
DEMA

SEQ ID NO: 447259 - protein, 9 aa, Mycobacterium
DEMASPADW

SEQ ID NO: 447260 - protein, 12 aa, Mycobacterium
DEMEAGRNRTVS

SEQ ID NO: 447261 - protein, 5 aa, Mycobacterium
DEMEE

SEQ ID NO: 447262 - protein, 6 aa, Mycobacterium
DEMGQA

SEQ ID NO: 447263 - protein, 4 aa, Mycobacterium
DEMH

SEQ ID NO: 447264 - protein, 15 aa, Mycobacterium
DEMNGAHHDRAHHAD

SEQ ID NO: 447265 - protein, 6 aa, Mycobacterium
DEMTDT

SEQ ID NO: 447266 - protein, 30 aa, Mycobacterium; identical to SEQ ID NO: 31508

SEQ ID NO: 447267 - protein, 30 aa, Mycobacterium
DEMYPGSDGVVRSTNRAGGLEGGMTNGQPL

SEQ ID NO: 447268 - protein, 4 aa, Mycobacterium
DENA

SEQ ID NO: 447269 - protein, 6 aa, Mycobacterium
DENAEV

SEQ ID NO: 447270 - protein, 9 aa, Mycobacterium
DENAPPGTV

SEQ ID NO: 447271 - protein, 11 aa, Mycobacterium
DENDAVATDPD

SEQ ID NO: 447272 - protein, 16 aa, Mycobacterium
DENDEEESGTVREDEV

SEQ ID NO: 447273 - protein, 7 aa, Mycobacterium
DENDGTW

SEQ ID NO: 447274 - protein, 15 aa, Mycobacterium
DENDLDATQSVAMAH

SEQ ID NO: 447275 - protein, 7 aa, Mycobacterium
DENDPTV

SEQ ID NO: 447276 - protein, 9 aa, Mycobacterium
DENDPVATA

SEQ ID NO: 447277 - protein, 10 aa, Mycobacterium
DENDPVATDA

SEQ ID NO: 447278 - protein, 10 aa, Mycobacterium
DENDPVATDP

SEQ ID NO: 447279 - protein, 11 aa, Mycobacterium
DENDPVATDPD

SEQ ID NO: 447280 - protein, 4 aa, Mycobacterium
DENE

SEQ ID NO: 447281 - protein, 13 aa, Mycobacterium
DENELTASQQARV

SEQ ID NO: 447282 - protein, 11 aa, Mycobacterium
DENESRRAGYT

SEQ ID NO: 447283 - protein, 9 aa, Mycobacterium
DENGAGDGI

SEQ ID NO: 447284 - protein, 6 aa, Mycobacterium
DENGDT

SEQ ID NO: 447285 - protein, 22 aa, Mycobacterium
DENGKPSRAIGRATPVDDHPGR

SEQ ID NO: 447286 - protein, 5 aa, Mycobacterium
DENGN

SEQ ID NO: 447287 - protein, 7 aa, Mycobacterium
DENGRHA

SEQ ID NO: 447288 - protein, 8 aa, Mycobacterium
DENGTVRP

SEQ ID NO: 447289 - protein, 9 aa, Mycobacterium
DENGVTRKL

SEQ ID NO: 447290 - protein, 8 aa, Mycobacterium
DENKGDWY

SEQ ID NO: 447291 - protein, 5 aa, Mycobacterium
DENNL

SEQ ID NO: 447292 - protein, 7 aa, Mycobacterium
DENNYVG

SEQ ID NO: 447293 - protein, 8 aa, Mycobacterium
DENPATEP

SEQ ID NO: 447294 - protein, 5 aa, Mycobacterium
DENQH

SEQ ID NO: 447295 - protein, 9 aa, Mycobacterium
DENRADPAE

SEQ ID NO: 447296 - protein, 7 aa, Mycobacterium
DENRATI

SEQ ID NO: 447297 - protein, 7 aa, Mycobacterium
DENRDAG

SEQ ID NO: 447298 - protein, 11 aa, Mycobacterium
DENRGGIPSAE

SEQ ID NO: 447299 - protein, 19 aa, Mycobacterium
DENRIPPARREDPGTGAHT

SEQ ID NO: 447300 - protein, 5 aa, Mycobacterium
DENSA

SEQ ID NO: 447301 - protein, 6 aa, Mycobacterium
DENSPV

SEQ ID NO: 447302 - protein, 14 aa, Mycobacterium
DENTDFATDNDSRN

SEQ ID NO: 447303 - protein, 6 aa, Mycobacterium
DENTMP

SEQ ID NO: 447304 - protein, 8 aa, Mycobacterium
DEPAAAEA

SEQ ID NO: 447305 - protein, 8 aa, Mycobacterium
DEPAATVK

SEQ ID NO: 447306 - protein, 6 aa, Mycobacterium
DEPADA

SEQ ID NO: 447307 - protein, 22 aa, Mycobacterium
DEPADAAAAADYEGDEGGIILC

SEQ ID NO: 447308 - protein, 18 aa, Mycobacterium
DEPADAAKVGAAKAYTRY

SEQ ID NO: 447309 - protein, 10 aa, Mycobacterium
DEPADAEIND

SEQ ID NO: 447310 - protein, 16 aa, Mycobacterium
DEPADAGKVGASQAYT

SEQ ID NO: 447311 - protein, 12 aa, Mycobacterium
DEPADAKAVGAK

SEQ ID NO: 447312 - protein, 17 aa, Mycobacterium
DEPADAQAVGAKRAYTR

SEQ ID NO: 447313 - protein, 7 aa, Mycobacterium
DEPADDN

SEQ ID NO: 447314 - protein, 7 aa, Mycobacterium
DEPAEDN

SEQ ID NO: 447315 - protein, 6 aa, Mycobacterium
DEPAEH

SEQ ID NO: 447316 - protein, 7 aa, Mycobacterium
DEPAEYH

SEQ ID NO: 447317 - protein, 8 aa, Mycobacterium
DEPAGDNY

SEQ ID NO: 447318 - protein, 14 aa, Mycobacterium
DEPAGLTDADGFTP

SEQ ID NO: 447319 - protein, 6 aa, Mycobacterium
DEPALP

SEQ ID NO: 447320 - protein, 8 aa, Mycobacterium
DEPAPGGQ

SEQ ID NO: 447321 - protein, 18 aa, Mycobacterium
DEPAPGPVPDVAEPSAAE

SEQ ID NO: 447322 - protein, 6 aa, Mycobacterium
DEPAPQ

SEQ ID NO: 447323 - protein, 7 aa, Mycobacterium
DEPAQID

SEQ ID NO: 447324 - protein, 6 aa, Mycobacterium
DEPARR

SEQ ID NO: 447325 - protein, 7 aa, Mycobacterium
DEPARRL

SEQ ID NO: 447326 - protein, 7 aa, Mycobacterium
DEPATAE

SEQ ID NO: 447327 - protein, 8 aa, Mycobacterium
DEPATAEA

SEQ ID NO: 447328 - protein, 5 aa, Mycobacterium
DEPCE

SEQ ID NO: 447329 - protein, 5 aa, Mycobacterium
DEPCR

SEQ ID NO: 447330 - protein, 4 aa, Mycobacterium
DEPD

SEQ ID NO: 447331 - protein, 8 aa, Mycobacterium
DEPDADRR

SEQ ID NO: 447332 - protein, 7 aa, Mycobacterium
DEPDASV

SEQ ID NO: 447333 - protein, 6 aa, Mycobacterium
DEPDAV

SEQ ID NO: 447334 - protein, 5 aa, Mycobacterium
DEPDC

SEQ ID NO: 447335 - protein, 12 aa, Mycobacterium
DEPDGDHGQLDQ

SEQ ID NO: 447336 - protein, 8 aa, Mycobacterium
DEPDGDLN

SEQ ID NO: 447337 - protein, 9 aa, Mycobacterium
DEPDGDLSQ

SEQ ID NO: 447338 - protein, 7 aa, Mycobacterium
DEPDGHS

SEQ ID NO: 447339 - protein, 10 aa, Mycobacterium
DEPDGSPKQL

SEQ ID NO: 447340 - protein, 5 aa, Mycobacterium
DEPDL

SEQ ID NO: 447341 - protein, 7 aa, Mycobacterium
DEPDNDE

SEQ ID NO: 447342 - protein, 8 aa, Mycobacterium
DEPDPAGI

SEQ ID NO: 447343 - protein, 8 aa, Mycobacterium
DEPDPEAA

SEQ ID NO: 447344 - protein, 10 aa, Mycobacterium
DEPDPEPVSA

SEQ ID NO: 447345 - protein, 7 aa, Mycobacterium
DEPDPVE

SEQ ID NO: 447346 - protein, 7 aa, Mycobacterium
DEPDPVQ

SEQ ID NO: 447347 - protein, 7 aa, Mycobacterium
DEPDPVR

SEQ ID NO: 447348 - protein, 6 aa, Mycobacterium
DEPDQP

SEQ ID NO: 447349 - protein, 7 aa, Mycobacterium
DEPDSVT

SEQ ID NO: 447350 - protein, 5 aa, Mycobacterium
DEPDT

SEQ ID NO: 447351 - protein, 8 aa, Mycobacterium
DEPDTDNY

SEQ ID NO: 447352 - protein, 10 aa, Mycobacterium
DEPDTDSRLE

SEQ ID NO: 447353 - protein, 5 aa, Mycobacterium
DEPDY

SEQ ID NO: 447354 - protein, 7 aa, Mycobacterium
DEPEFGR

SEQ ID NO: 447355 - protein, 7 aa, Mycobacterium
DEPEFSA

SEQ ID NO: 447356 - protein, 5 aa, Mycobacterium
DEPEG

SEQ ID NO: 447357 - protein, 7 aa, Mycobacterium
DEPELSR

SEQ ID NO: 447358 - protein, 16 aa, Mycobacterium
DEPEPIRHGDAETAAR

SEQ ID NO: 447359 - protein, 6 aa, Mycobacterium
DEPERA

SEQ ID NO: 447360 - protein, 7 aa, Mycobacterium
DEPERHK

SEQ ID NO: 447361 - protein, 7 aa, Mycobacterium
DEPESRL

SEQ ID NO: 447362 - protein, 5 aa, Mycobacterium
DEPEV

SEQ ID NO: 447363 - protein, 7 aa, Mycobacterium
DEPEVGA

SEQ ID NO: 447364 - protein, 7 aa, Mycobacterium
DEPEVSE

SEQ ID NO: 447365 - protein, 20 aa, Mycobacterium
DEPEVSEPVAGQRRRVRPTE

SEQ ID NO: 447366 - protein, 9 aa, Mycobacterium
DEPFDPPSL

SEQ ID NO: 447367 - protein, 20 aa, Mycobacterium
DEPGAAATAARIESAGGNAV

SEQ ID NO: 447368 - protein, 7 aa, Mycobacterium
DEPGAKT

SEQ ID NO: 447369 - protein, 7 aa, Mycobacterium
DEPGAPH

SEQ ID NO: 447370 - protein, 8 aa, Mycobacterium
DEPGARVT

SEQ ID NO: 447371 - protein, 6 aa, Mycobacterium
DEPGDP

SEQ ID NO: 447372 - protein, 5 aa, Mycobacterium
DEPGF

SEQ ID NO: 447373 - protein, 7 aa, Mycobacterium
DEPGGHG

SEQ ID NO: 447374 - protein, 9 aa, Mycobacterium
DEPGKTVPD

SEQ ID NO: 447375 - protein, 9 aa, Mycobacterium
DEPGPEVSP

SEQ ID NO: 447376 - protein, 6 aa, Mycobacterium
DEPGPF

SEQ ID NO: 447377 - protein, 6 aa, Mycobacterium
DEPGQS

SEQ ID NO: 447378 - protein, 20 aa, Mycobacterium
DEPGRAVPSAPAVSAVRDGS

SEQ ID NO: 447379 - protein, 10 aa, Mycobacterium
DEPGVDKRDR

SEQ ID NO: 447380 - protein, 7 aa, Mycobacterium
DEPGVTE

SEQ ID NO: 447381 - protein, 7 aa, Mycobacterium
DEPGYGA

SEQ ID NO: 447382 - protein, 7 aa, Mycobacterium
DEPGYGE

SEQ ID NO: 447383 - protein, 7 aa, Mycobacterium
DEPGYGK

SEQ ID NO: 447384 - protein, 8 aa, Mycobacterium
DEPGYGSD

SEQ ID NO: 447385 - protein, 14 aa, Mycobacterium
DEPHEPYDRPPLSK

SEQ ID NO: 447386 - protein, 4 aa, Mycobacterium
DEPI

SEQ ID NO: 447387 - protein, 6 aa, Mycobacterium
DEPKAA

SEQ ID NO: 447388 - protein, 7 aa, Mycobacterium
DEPKGAA

SEQ ID NO: 447389 - protein, 9 aa, Mycobacterium
DEPLDTPAQ

SEQ ID NO: 447390 - protein, 7 aa, Mycobacterium
DEPLEDS

SEQ ID NO: 447391 - protein, 21 aa, Mycobacterium
DEPLGRRASGGTGNPSRVDPG

SEQ ID NO: 447392 - protein, 8 aa, Mycobacterium
DEPLTARG

SEQ ID NO: 447393 - protein, 7 aa, Mycobacterium
DEPMDPQ

SEQ ID NO: 447394 - protein, 6 aa, Mycobacterium
DEPMPR

SEQ ID NO: 447395 - protein, 7 aa, Mycobacterium
DEPNGGL

SEQ ID NO: 447396 - protein, 6 aa, Mycobacterium
DEPNVP

SEQ ID NO: 447397 - protein, 5 aa, Mycobacterium
DEPPA

SEQ ID NO: 447398 - protein, 7 aa, Mycobacterium
DEPPDLA

SEQ ID NO: 447399 - protein, 6 aa, Mycobacterium
DEPPHP

SEQ ID NO: 447400 - protein, 5 aa, Mycobacterium
DEPPL

SEQ ID NO: 447401 - protein, 15 aa, Mycobacterium
DEPPLPQGDLPCTGG

SEQ ID NO: 447402 - protein, 19 aa, Mycobacterium
DEPPQQTAARELQEEAGLR

SEQ ID NO: 447403 - protein, 7 aa, Mycobacterium
DEPPRIE

SEQ ID NO: 447404 - protein, 16 aa, Mycobacterium
DEPPSLGGQNTAPNPV

SEQ ID NO: 447405 - protein, 6 aa, Mycobacterium
DEPPTT

SEQ ID NO: 447406 - protein, 6 aa, Mycobacterium
DEPPVA

SEQ ID NO: 447407 - protein, 10 aa, Mycobacterium
DEPPVAPDPE

SEQ ID NO: 447408 - protein, 7 aa, Mycobacterium
DEPQFSQ

SEQ ID NO: 447409 - protein, 9 aa, Mycobacterium
DEPQLSRTR

SEQ ID NO: 447410 - protein, 13 aa, Mycobacterium
DEPQNKASEGTPT

SEQ ID NO: 447411 - protein, 25 aa, Mycobacterium
DEPQPGLREGERDHRRALPRDQRVG

SEQ ID NO: 447412 - protein, 5 aa, Mycobacterium
DEPQY

SEQ ID NO: 447413 - protein, 8 aa, Mycobacterium
DEPRDRVG

SEQ ID NO: 447414 - protein, 6 aa, Mycobacterium
DEPRFE

SEQ ID NO: 447415 - protein, 5 aa, Mycobacterium
DEPRK

SEQ ID NO: 447416 - protein, 11 aa, Mycobacterium
DEPRPAPTPQD

SEQ ID NO: 447417 - protein, 10 aa, Mycobacterium
DEPRRELRGP

SEQ ID NO: 447418 - protein, 6 aa, Mycobacterium
DEPSAA

SEQ ID NO: 447419 - protein, 7 aa, Mycobacterium
DEPSDLA

SEQ ID NO: 447420 - protein, 7 aa, Mycobacterium
DEPSGDD

SEQ ID NO: 447421 - protein, 10 aa, Mycobacterium
DEPSGNGALN

SEQ ID NO: 447422 - protein, 16 aa, Mycobacterium
DEPSGNGVLNGIPVTV

SEQ ID NO: 447423 - protein, 5 aa, Mycobacterium
DEPSL

SEQ ID NO: 447424 - protein, 9 aa, Mycobacterium
DEPSPEQPA

SEQ ID NO: 447425 - protein, 8 aa, Mycobacterium
DEPSPGGR

SEQ ID NO: 447426 - protein, 6 aa, Mycobacterium
DEPSPH

SEQ ID NO: 447427 - protein, 7 aa, Mycobacterium
DEPSPIG

SEQ ID NO: 447428 - protein, 6 aa, Mycobacterium
DEPSSA

SEQ ID NO: 447429 - protein, 5 aa, Mycobacterium
DEPTA

SEQ ID NO: 447430 - protein, 28 aa, Mycobacterium
DEPTANLDSATGKKVSAQLASAAKAQDS

SEQ ID NO: 447431 - protein, 13 aa, Mycobacterium
DEPTGNLDSATGA

SEQ ID NO: 447432 - protein, 13 aa, Mycobacterium
DEPTGNLDSTTGA

SEQ ID NO: 447433 - protein, 6 aa, Mycobacterium
DEPTKR

SEQ ID NO: 447434 - protein, 9 aa, Mycobacterium
DEPTPEQPA

SEQ ID NO: 447435 - protein, 6 aa, Mycobacterium
DEPTQA

SEQ ID NO: 447436 - protein, 5 aa, Mycobacterium
DEPTR

SEQ ID NO: 447437 - protein, 5 aa, Mycobacterium
DEPTS

SEQ ID NO: 447438 - protein, 10 aa, Mycobacterium
DEPTSGLDAT

SEQ ID NO: 447439 - protein, 5 aa, Mycobacterium
DEPTT

SEQ ID NO: 447440 - protein, 8 aa, Mycobacterium
DEPTTALD

SEQ ID NO: 447441 - protein, 39 aa, Mycobacterium
DEPTTGAPAADNADNADNADNAEDDGSDSQHGSGSKGFE

SEQ ID NO: 447442 - protein, 9 aa, Mycobacterium
DEPTVSGTT

SEQ ID NO: 447443 - protein, 7 aa, Mycobacterium
DEPVDDA

SEQ ID NO: 447444 - protein, 7 aa, Mycobacterium
DEPVDSA

SEQ ID NO: 447445 - protein, 10 aa, Mycobacterium
DEPVGGPADG

SEQ ID NO: 447446 - protein, 8 aa, Mycobacterium
DEPVPAPG

SEQ ID NO: 447447 - protein, 23 aa, Mycobacterium
DEPVPQADPGRPWPGQLPAPSPA

SEQ ID NO: 447448 - protein, 23 aa, Mycobacterium
DEPVPQADPRQPWPGQLPEPSPT

SEQ ID NO: 447449 - protein, 4 aa, Mycobacterium
DEPW

SEQ ID NO: 447450 - protein, 4 aa, Mycobacterium
DEPY

SEQ ID NO: 447451 - protein, 7 aa, Mycobacterium
DEPYASL

SEQ ID NO: 447452 - protein, 8 aa, Mycobacterium
DEPYDLPT

SEQ ID NO: 447453 - protein, 6 aa, Mycobacterium
DEPYGN

SEQ ID NO: 447454 - protein, 7 aa, Mycobacterium
DEPYPTD

SEQ ID NO: 447455 - protein, 8 aa, Mycobacterium
DEPYTPDF

SEQ ID NO: 447456 - protein, 6 aa, Mycobacterium
DEQAAA

SEQ ID NO: 447457 - protein, 9 aa, Mycobacterium
DEQADYAER

SEQ ID NO: 447458 - protein, 15 aa, Mycobacterium
DEQAGDPGKPDAESF

SEQ ID NO: 447459 - protein, 10 aa, Mycobacterium
DEQAGEAELG

SEQ ID NO: 447460 - protein, 16 aa, Mycobacterium
DEQAHRIGQSREPDDG

SEQ ID NO: 447461 - protein, 5 aa, Mycobacterium
DEQAP

SEQ ID NO: 447462 - protein, 11 aa, Mycobacterium
DEQAQKAAGNR

SEQ ID NO: 447463 - protein, 11 aa, Mycobacterium
DEQARAGAADL

SEQ ID NO: 447464 - protein, 8 aa, Mycobacterium
DEQARAND

SEQ ID NO: 447465 - protein, 12 aa, Mycobacterium
DEQARLTPTAGT

SEQ ID NO: 447466 - protein, 10 aa, Mycobacterium
DEQARRYSDR

SEQ ID NO: 447467 - protein, 11 aa, Mycobacterium
DEQARSTPSVS

SEQ ID NO: 447468 - protein, 8 aa, Mycobacterium
DEQATTAA

SEQ ID NO: 447469 - protein, 6 aa, Mycobacterium
DEQDAV

SEQ ID NO: 447470 - protein, 5 aa, Mycobacterium
DEQDL

SEQ ID NO: 447471 - protein, 6 aa, Mycobacterium
DEQDLR

SEQ ID NO: 447472 - protein, 8 aa, Mycobacterium
DEQDRSRW

SEQ ID NO: 447473 - protein, 4 aa, Mycobacterium
DEQE

SEQ ID NO: 447474 - protein, 5 aa, Mycobacterium
DEQEL

SEQ ID NO: 447475 - protein, 20 aa, Mycobacterium
DEQELDDRKTPAYYYLFQRR

SEQ ID NO: 447476 - protein, 6 aa, Mycobacterium
DEQEYR

SEQ ID NO: 447477 - protein, 4 aa, Mycobacterium
DEQG

SEQ ID NO: 447478 - protein, 12 aa, Mycobacterium
DEQGAAPKANRI

SEQ ID NO: 447479 - protein, 12 aa, Mycobacterium
DEQGEDLPGVTT

SEQ ID NO: 447480 - protein, 6 aa, Mycobacterium
DEQGFD

SEQ ID NO: 447481 - protein, 7 aa, Mycobacterium
DEQGGEL

SEQ ID NO: 447482 - protein, 7 aa, Mycobacterium
DEQGGSV

SEQ ID NO: 447483 - protein, 5 aa, Mycobacterium
DEQGK

SEQ ID NO: 447484 - protein, 10 aa, Mycobacterium
DEQGNSAGLN

SEQ ID NO: 447485 - protein, 5 aa, Mycobacterium
DEQGQ

SEQ ID NO: 447486 - protein, 6 aa, Mycobacterium
DEQGQL

SEQ ID NO: 447487 - protein, 5 aa, Mycobacterium
DEQGR

SEQ ID NO: 447488 - protein, 7 aa, Mycobacterium
DEQGREH

SEQ ID NO: 447489 - protein, 7 aa, Mycobacterium
DEQGRSV

SEQ ID NO: 447490 - protein, 7 aa, Mycobacterium
DEQGSAA

SEQ ID NO: 447491 - protein, 4 aa, Mycobacterium
DEQH

SEQ ID NO: 447492 - protein, 7 aa, Mycobacterium
DEQHERT

SEQ ID NO: 447493 - protein, 6 aa, Mycobacterium
DEQHRD

SEQ ID NO: 447494 - protein, 4 aa, Mycobacterium
DEQI

SEQ ID NO: 447495 - protein, 6 aa, Mycobacterium
DEQIPR

SEQ ID NO: 447496 - protein, 6 aa, Mycobacterium
DEQKAR

SEQ ID NO: 447497 - protein, 5 aa, Mycobacterium
DEQLP

SEQ ID NO: 447498 - protein, 5 aa, Mycobacterium
DEQLQ

SEQ ID NO: 447499 - protein, 10 aa, Mycobacterium
DEQNAGDPAY

SEQ ID NO: 447500 - protein, 5 aa, Mycobacterium
DEQPA

SEQ ID NO: 447501 - protein, 16 aa, Mycobacterium
DEQPAAELPMAQRYFL

SEQ ID NO: 447502 - protein, 6 aa, Mycobacterium
DEQPAI

SEQ ID NO: 447503 - protein, 6 aa, Mycobacterium
DEQPAV

SEQ ID NO: 447504 - protein, 8 aa, Mycobacterium
DEQPDGTT

SEQ ID NO: 447505 - protein, 10 aa, Mycobacterium
DEQPEDGPQT

SEQ ID NO: 447506 - protein, 7 aa, Mycobacterium
DEQPEHG

SEQ ID NO: 447507 - protein, 9 aa, Mycobacterium
DEQPGVAPE

SEQ ID NO: 447508 - protein, 6 aa, Mycobacterium
DEQPIA

SEQ ID NO: 447509 - protein, 5 aa, Mycobacterium
DEQPL

SEQ ID NO: 447510 - protein, 11 aa, Mycobacterium
DEQPRRDTSVE

SEQ ID NO: 447511 - protein, 4 aa, Mycobacterium
DEQQ

SEQ ID NO: 447512 - protein, 4 aa, Mycobacterium
DEQR

SEQ ID NO: 447513 - protein, 7 aa, Mycobacterium
DEQRARL

SEQ ID NO: 447514 - protein, 9 aa, Mycobacterium
DEQRAVSAR

SEQ ID NO: 447515 - protein, 5 aa, Mycobacterium
DEQRP

SEQ ID NO: 447516 - protein, 9 aa, Mycobacterium
DEQRPALAE

SEQ ID NO: 447517 - protein, 8 aa, Mycobacterium
DEQRPDGT

SEQ ID NO: 447518 - protein, 6 aa, Mycobacterium
DEQRPK

SEQ ID NO: 447519 - protein, 6 aa, Mycobacterium
DEQRPQ

SEQ ID NO: 447520 - protein, 7 aa, Mycobacterium
DEQRPSL

SEQ ID NO: 447521 - protein, 12 aa, Mycobacterium
DEQRRDGLLSPD

SEQ ID NO: 447522 - protein, 8 aa, Mycobacterium
DEQRTAQV

SEQ ID NO: 447523 - protein, 6 aa, Mycobacterium
DEQRTE

SEQ ID NO: 447524 - protein, 4 aa, Mycobacterium
DEQS

SEQ ID NO: 447525 - protein, 24 aa, Mycobacterium
DEQSPPDLSGSRIPASLSDPALRK

SEQ ID NO: 447526 - protein, 5 aa, Mycobacterium
DEQSR

SEQ ID NO: 447527 - protein, 8 aa, Mycobacterium
DEQSTAQR

SEQ ID NO: 447528 - protein, 7 aa, Mycobacterium
DEQSVER

SEQ ID NO: 447529 - protein, 12 aa, Mycobacterium
DEQTADRRIKEG

SEQ ID NO: 447530 - protein, 5 aa, Mycobacterium
DEQTD

SEQ ID NO: 447531 - protein, 7 aa, Mycobacterium
DEQTGRG

SEQ ID NO: 447532 - protein, 8 aa, Mycobacterium
DEQTGRGI

SEQ ID NO: 447533 - protein, 16 aa, Mycobacterium
DEQTHRIAPSREPDDG

SEQ ID NO: 447534 - protein, 5 aa, Mycobacterium
DEQTV

SEQ ID NO: 447535 - protein, 6 aa, Mycobacterium
DEQVGD

SEQ ID NO: 447536 - protein, 9 aa, Mycobacterium
DEQVQASAE

SEQ ID NO: 447537 - protein, 4 aa, Mycobacterium
DEQW

SEQ ID NO: 447538 - protein, 14 aa, Mycobacterium
DEQWSQGQDASTED

SEQ ID NO: 447539 - protein, 4 aa, Mycobacterium
DEQY

SEQ ID NO: 447540 - protein, 10 aa, Mycobacterium
DERAAALQSP

SEQ ID NO: 447541 - protein, 6 aa, Mycobacterium
DERAAR

SEQ ID NO: 447542 - protein, 6 aa, Mycobacterium
DERADD

SEQ ID NO: 447543 - protein, 7 aa, Mycobacterium
DERAEEK

SEQ ID NO: 447544 - protein, 6 aa, Mycobacterium
DERASE

SEQ ID NO: 447545 - protein, 11 aa, Mycobacterium
DERASSLPDDA

SEQ ID NO: 447546 - protein, 5 aa, Mycobacterium
DERAT

SEQ ID NO: 447547 - protein, 4 aa, Mycobacterium
DERD

SEQ ID NO: 447548 - protein, 10 aa, Mycobacterium
DERDASVPRT

SEQ ID NO: 447549 - protein, 6 aa, Mycobacterium
DERDAV

SEQ ID NO: 447550 - protein, 7 aa, Mycobacterium
DERDDGV

SEQ ID NO: 447551 - protein, 14 aa, Mycobacterium
DERDDLPPPPRMPN

SEQ ID NO: 447552 - protein, 10 aa, Mycobacterium
DERDDSVPRT

SEQ ID NO: 447553 - protein, 5 aa, Mycobacterium
DERDE

SEQ ID NO: 447554 - protein, 10 aa, Mycobacterium
DERDESVPRT

SEQ ID NO: 447555 - protein, 6 aa, Mycobacterium
DERDGA

SEQ ID NO: 447556 - protein, 7 aa, Mycobacterium
DERDGIY

SEQ ID NO: 447557 - protein, 5 aa, Mycobacterium
DERDN

SEQ ID NO: 447558 - protein, 10 aa, Mycobacterium
DERDTSVPRT

SEQ ID NO: 447559 - protein, 6 aa, Mycobacterium
DEREAQ

SEQ ID NO: 447560 - protein, 6 aa, Mycobacterium
DEREAV

SEQ ID NO: 447561 - protein, 10 aa, Mycobacterium
DEREEAGPAP

SEQ ID NO: 447562 - protein, 17 aa, Mycobacterium
DEREEREPRDPAGLGDG

SEQ ID NO: 447563 - protein, 20 aa, Mycobacterium
DEREPAHPERLPGGLAGHAS

SEQ ID NO: 447564 - protein, 6 aa, Mycobacterium
DERETV

SEQ ID NO: 447565 - protein, 6 aa, Mycobacterium
DEREVT

SEQ ID NO: 447566 - protein, 13 aa, Mycobacterium
DERGADSVTTDDI

SEQ ID NO: 447567 - protein, 9 aa, Mycobacterium
DERGAEGDR

SEQ ID NO: 447568 - protein, 12 aa, Mycobacterium
DERGGDSEDSSA

SEQ ID NO: 447569 - protein, 7 aa, Mycobacterium
DERGGEL

SEQ ID NO: 447570 - protein, 7 aa, Mycobacterium
DERGGSV

SEQ ID NO: 447571 - protein, 22 aa, Mycobacterium
DERGIDRPAESLTSHAPRSSIR

SEQ ID NO: 447572 - protein, 7 aa, Mycobacterium
DERGKFP

SEQ ID NO: 447573 - protein, 7 aa, Mycobacterium
DERGLGG

SEQ ID NO: 447574 - protein, 8 aa, Mycobacterium
DERGPNSI

SEQ ID NO: 447575 - protein, 17 aa, Mycobacterium
DERGRAPQQQAQPLPAL

SEQ ID NO: 447576 - protein, 8 aa, Mycobacterium
DERGRIPS

SEQ ID NO: 447577 - protein, 10 aa, Mycobacterium
DERGRTERRR

SEQ ID NO: 447578 - protein, 16 aa, Mycobacterium
DERGSDGGLPLRPWWN

SEQ ID NO: 447579 - protein, 7 aa, Mycobacterium
DERGTPP

SEQ ID NO: 447580 - protein, 5 aa, Mycobacterium
DERGV

SEQ ID NO: 447581 - protein, 5 aa, Mycobacterium
DERGW

SEQ ID NO: 447582 - protein, 9 aa, Mycobacterium
DERISPADG

SEQ ID NO: 447583 - protein, 9 aa, Mycobacterium
DERKDTASE

SEQ ID NO: 447584 - protein, 8 aa, Mycobacterium
DERKETAA

SEQ ID NO: 447585 - protein, 12 aa, Mycobacterium
DERKGKAPSDHA

SEQ ID NO: 447586 - protein, 5 aa, Mycobacterium
DERLG

SEQ ID NO: 447587 - protein, 6 aa, Mycobacterium
DERLRQ

SEQ ID NO: 447588 - protein, 15 aa, Mycobacterium
DERLTESVSRAADSG

SEQ ID NO: 447589 - protein, 4 aa, Mycobacterium
DERM

SEQ ID NO: 447590 - protein, 8 aa, Mycobacterium
DERMAPAD

SEQ ID NO: 447591 - protein, 11 aa, Mycobacterium
DERMDDRPALT

SEQ ID NO: 447592 - protein, 9 aa, Mycobacterium
DERMEGGPA

SEQ ID NO: 447593 - protein, 5 aa, Mycobacterium
DERPD

SEQ ID NO: 447594 - protein, 7 aa, Mycobacterium
DERPDAV

SEQ ID NO: 447595 - protein, 8 aa, Mycobacterium
DERPDPSP

SEQ ID NO: 447596 - protein, 17 aa, Mycobacterium
DERPEAVAAAQPGDSTL

SEQ ID NO: 447597 - protein, 20 aa, Mycobacterium
DERPEVTTRRDDGRPVNGFQ

SEQ ID NO: 447598 - protein, 7 aa, Mycobacterium
DERPGVV

SEQ ID NO: 447599 - protein, 15 aa, Mycobacterium
DERPIGDDFVKGIEN

SEQ ID NO: 447600 - protein, 8 aa, Mycobacterium
DERPLGEA

SEQ ID NO: 447601 - protein, 8 aa, Mycobacterium
DERPPQEE

SEQ ID NO: 447602 - protein, 6 aa, Mycobacterium
DERPRF

SEQ ID NO: 447603 - protein, 6 aa, Mycobacterium
DERPVA

SEQ ID NO: 447604 - protein, 6 aa, Mycobacterium
DERQDP

SEQ ID NO: 447605 - protein, 17 aa, Mycobacterium
DERQEAVTAARRAEELA

SEQ ID NO: 447606 - protein, 9 aa, Mycobacterium
DERQGAESE

SEQ ID NO: 447607 - protein, 7 aa, Mycobacterium
DERQQTA

SEQ ID NO: 447608 - protein, 9 aa, Mycobacterium
DERQRGYPE

SEQ ID NO: 447609 - protein, 5 aa, Mycobacterium
DERQV

SEQ ID NO: 447610 - protein, 11 aa, Mycobacterium
DERQVKTPAAV

SEQ ID NO: 447611 - protein, 5 aa, Mycobacterium
DERQW

SEQ ID NO: 447612 - protein, 13 aa, Mycobacterium
DERRAGHGREQAS

SEQ ID NO: 447613 - protein, 11 aa, Mycobacterium
DERRNRKQPPL

SEQ ID NO: 447614 - protein, 11 aa, Mycobacterium
DERRQRKQPPL

SEQ ID NO: 447615 - protein, 12 aa, Mycobacterium
DERRQRKQPPVQ

SEQ ID NO: 447616 - protein, 7 aa, Mycobacterium
DERRRQL

SEQ ID NO: 447617 - protein, 7 aa, Mycobacterium
DERRSRL

SEQ ID NO: 447618 - protein, 9 aa, Mycobacterium
DERSASDVA

SEQ ID NO: 447619 - protein, 28 aa, Mycobacterium
DERSATAVAKRAEKAFADAGKNAGQAFT

SEQ ID NO: 447620 - protein, 6 aa, Mycobacterium
DERSDA

SEQ ID NO: 447621 - protein, 17 aa, Mycobacterium
DERSGAVVNESGDPIPG

SEQ ID NO: 447622 - protein, 9 aa, Mycobacterium
DERSGDGAI

SEQ ID NO: 447623 - protein, 5 aa, Mycobacterium
DERSL

SEQ ID NO: 447624 - protein, 7 aa, Mycobacterium
DERSLSA

SEQ ID NO: 447625 - protein, 11 aa, Mycobacterium
DERSNRTAQAF

SEQ ID NO: 447626 - protein, 12 aa, Mycobacterium
DERSREERVASH

SEQ ID NO: 447627 - protein, 7 aa, Mycobacterium
DERSSAL

SEQ ID NO: 447628 - protein, 7 aa, Mycobacterium
DERSTPP

SEQ ID NO: 447629 - protein, 10 aa, Mycobacterium
DERTEDDEIT

SEQ ID NO: 447630 - protein, 13 aa, Mycobacterium
DERTERAERVGSA

SEQ ID NO: 447631 - protein, 14 aa, Mycobacterium
DERTERAGRVGSAN

SEQ ID NO: 447632 - protein, 9 aa, Mycobacterium
DERTESDVR

SEQ ID NO: 447633 - protein, 31 aa, Mycobacterium
DERTKRGEAAARREQADVDRQIADTEAGPDR

SEQ ID NO: 447634 - protein, 7 aa, Mycobacterium
DERTRNA

SEQ ID NO: 447635 - protein, 13 aa, Mycobacterium
DERTSNGLPTATP

SEQ ID NO: 447636 - protein, 6 aa, Mycobacterium
DERTSQ

SEQ ID NO: 447637 - protein, 7 aa, Mycobacterium
DERTVAP

SEQ ID NO: 447638 - protein, 20 aa, Mycobacterium
DERTWRGRATAEACGQLAAE

SEQ ID NO: 447639 - protein, 4 aa, Mycobacterium
DERV

SEQ ID NO: 447640 - protein, 5 aa, Mycobacterium
DERVA

SEQ ID NO: 447641 - protein, 13 aa, Mycobacterium
DERVDDGTDDDTP

SEQ ID NO: 447642 - protein, 14 aa, Mycobacterium
DERVDDGTDSDSPK

SEQ ID NO: 447643 - protein, 14 aa, Mycobacterium
DERVDDGTGSDTPK

SEQ ID NO: 447644 - protein, 5 aa, Mycobacterium
DERVG

SEQ ID NO: 447645 - protein, 7 aa, Mycobacterium
DERVGAE

SEQ ID NO: 447646 - protein, 7 aa, Mycobacterium
DERVGAQ

SEQ ID NO: 447647 - protein, 6 aa, Mycobacterium
DERVGD

SEQ ID NO: 447648 - protein, 13 aa, Mycobacterium
DERVSDSEVTDEV

SEQ ID NO: 447649 - protein, 10 aa, Mycobacterium
DERVTPRTRA

SEQ ID NO: 447650 - protein, 7 aa, Mycobacterium
DERYERA

SEQ ID NO: 447651 - protein, 6 aa, Mycobacterium
DERYGE

SEQ ID NO: 447652 - protein, 10 aa, Mycobacterium
DESAAPDLEG

SEQ ID NO: 447653 - protein, 10 aa, Mycobacterium
DESADKYPYE

SEQ ID NO: 447654 - protein, 12 aa, Mycobacterium
DESAGAFDPTGH

SEQ ID NO: 447655 - protein, 10 aa, Mycobacterium
DESAPGEPLL

SEQ ID NO: 447656 - protein, 7 aa, Mycobacterium
DESAPGR

SEQ ID NO: 447657 - protein, 5 aa, Mycobacterium
DESAR

SEQ ID NO: 447658 - protein, 11 aa, Mycobacterium
DESARGTRRER

SEQ ID NO: 447659 - protein, 9 aa, Mycobacterium
DESARRRGL

SEQ ID NO: 447660 - protein, 7 aa, Mycobacterium
DESARSL

SEQ ID NO: 447661 - protein, 10 aa, Mycobacterium
DESASGTRRE

SEQ ID NO: 447662 - protein, 6 aa, Mycobacterium
DESAWS

SEQ ID NO: 447663 - protein, 7 aa, Mycobacterium
DESCARA

SEQ ID NO: 447664 - protein, 16 aa, Mycobacterium
DESDEEASSAVREDEV

SEQ ID NO: 447665 - protein, 16 aa, Mycobacterium
DESDEEGGTAVREDEV

SEQ ID NO: 447666 - protein, 16 aa, Mycobacterium
DESDEESTGGVREDEV

SEQ ID NO: 447667 - protein, 5 aa, Mycobacterium
DESDF

SEQ ID NO: 447668 - protein, 7 aa, Mycobacterium
DESDLNT

SEQ ID NO: 447669 - protein, 11 aa, Mycobacterium
DESDPASTDPA

SEQ ID NO: 447670 - protein, 8 aa, Mycobacterium
DESDPHGM

SEQ ID NO: 447671 - protein, 12 aa, Mycobacterium
DESDPSKRDPDL

SEQ ID NO: 447672 - protein, 12 aa, Mycobacterium
DESDPSKRDPEL

SEQ ID NO: 447673 - protein, 12 aa, Mycobacterium
DESDPTKRDPEL

SEQ ID NO: 447674 - protein, 8 aa, Mycobacterium
DESDQGKI

SEQ ID NO: 447675 - protein, 11 aa, Mycobacterium
DESDRKALEQD

SEQ ID NO: 447676 - protein, 35 aa, Mycobacterium
DESDTDVAPEPTESSSEESGAEVEADEDADPAATL

SEQ ID NO: 447677 - protein, 10 aa, Mycobacterium
DESEAESREA

SEQ ID NO: 447678 - protein, 7 aa, Mycobacterium
DESEGNS

SEQ ID NO: 447679 - protein, 5 aa, Mycobacterium
DESEQ

SEQ ID NO: 447680 - protein, 9 aa, Mycobacterium
DESETAESF

SEQ ID NO: 447681 - protein, 9 aa, Mycobacterium
DESETARHR

SEQ ID NO: 447682 - protein, 8 aa, Mycobacterium
DESETGVN

SEQ ID NO: 447683 - protein, 7 aa, Mycobacterium
DESETIR

SEQ ID NO: 447684 - protein, 7 aa, Mycobacterium
DESETIT

SEQ ID NO: 447685 - protein, 5 aa, Mycobacterium
DESFD

SEQ ID NO: 447686 - protein, 8 aa, Mycobacterium
DESGAQFT

SEQ ID NO: 447687 - protein, 15 aa, Mycobacterium
DESGARPATDAPGIQ

SEQ ID NO: 447688 - protein, 7 aa, Mycobacterium
DESGETH

SEQ ID NO: 447689 - protein, 8 aa, Mycobacterium
DESGFPAS

SEQ ID NO: 447690 - protein, 6 aa, Mycobacterium
DESGGA

SEQ ID NO: 447691 - protein, 16 aa, Mycobacterium
DESGGRWDQSTLPQGV

SEQ ID NO: 447692 - protein, 7 aa, Mycobacterium
DESGGVW

SEQ ID NO: 447693 - protein, 13 aa, Mycobacterium
DESGKFRQLDIGQ

SEQ ID NO: 447694 - protein, 11 aa, Mycobacterium
DESGNDPLPGA

SEQ ID NO: 447695 - protein, 7 aa, Mycobacterium
DESGPRK

SEQ ID NO: 447696 - protein, 11 aa, Mycobacterium
DESGQALDEEM

SEQ ID NO: 447697 - protein, 8 aa, Mycobacterium
DESGQTVE

SEQ ID NO: 447698 - protein, 5 aa, Mycobacterium
DESGR

SEQ ID NO: 447699 - protein, 9 aa, Mycobacterium
DESGRFRGR

SEQ ID NO: 447700 - protein, 11 aa, Mycobacterium
DESGRFRSREE

SEQ ID NO: 447701 - protein, 15 aa, Mycobacterium
DESGRKMSKSKGNVI

SEQ ID NO: 447702 - protein, 10 aa, Mycobacterium
DESIRKADDP

SEQ ID NO: 447703 - protein, 19 aa, Mycobacterium
DESIRKADDPLAVAGAGAA

SEQ ID NO: 447704 - protein, 8 aa, Mycobacterium
DESKDGAT

SEQ ID NO: 447705 - protein, 14 aa, Mycobacterium
DESLDDGYDQVDDG

SEQ ID NO: 447706 - protein, 7 aa, Mycobacterium
DESLESI

SEQ ID NO: 447707 - protein, 5 aa, Mycobacterium
DESLS

SEQ ID NO: 447708 - protein, 5 aa, Mycobacterium
DESLT

SEQ ID NO: 447709 - protein, 7 aa, Mycobacterium
DESLYSD

SEQ ID NO: 447710 - protein, 8 aa, Mycobacterium
DESMDPDA

SEQ ID NO: 447711 - protein, 8 aa, Mycobacterium
DESMDPEA

SEQ ID NO: 447712 - protein, 30 aa, Mycobacterium
DESNAAKGKAGASRQRKSSTARGRSKAPAN

SEQ ID NO: 447713 - protein, 19 aa, Mycobacterium
DESNGNAQSAAPATTEKDI

SEQ ID NO: 447714 - protein, 8 aa, Mycobacterium
DESPAQVS

SEQ ID NO: 447715 - protein, 8 aa, Mycobacterium
DESPATVA

SEQ ID NO: 447716 - protein, 10 aa, Mycobacterium
DESPDGTGQL

SEQ ID NO: 447717 - protein, 9 aa, Mycobacterium
DESPFSGAH

SEQ ID NO: 447718 - protein, 13 aa, Mycobacterium
DESPMRRGRPTAH

SEQ ID NO: 447719 - protein, 7 aa, Mycobacterium
DESPSAR

SEQ ID NO: 447720 - protein, 13 aa, Mycobacterium
DESPSTSAVRGNR

SEQ ID NO: 447721 - protein, 7 aa, Mycobacterium
DESPTVV

SEQ ID NO: 447722 - protein, 12 aa, Mycobacterium
DESQAAATVRED

SEQ ID NO: 447723 - protein, 7 aa, Mycobacterium
DESQEDI

SEQ ID NO: 447724 - protein, 5 aa, Mycobacterium
DESQL

SEQ ID NO: 447725 - protein, 6 aa, Mycobacterium
DESQLP

SEQ ID NO: 447726 - protein, 8 aa, Mycobacterium
DESQLPAA

SEQ ID NO: 447727 - protein, 8 aa, Mycobacterium
DESQSRAA

SEQ ID NO: 447728 - protein, 8 aa, Mycobacterium
DESQTGGG

SEQ ID NO: 447729 - protein, 5 aa, Mycobacterium
DESRA

SEQ ID NO: 447730 - protein, 29 aa, Mycobacterium
DESRARQAAEAVGDARFTSAQVDATSADA

SEQ ID NO: 447731 - protein, 9 aa, Mycobacterium
DESRATGVA

SEQ ID NO: 447732 - protein, 9 aa, Mycobacterium
DESRDAARD

SEQ ID NO: 447733 - protein, 13 aa, Mycobacterium
DESRELSASVAFT

SEQ ID NO: 447734 - protein, 5 aa, Mycobacterium
DESRF

SEQ ID NO: 447735 - protein, 8 aa, Mycobacterium
DESRKVTA

SEQ ID NO: 447736 - protein, 19 aa, Mycobacterium
DESRKVTAAQIPVDQGSTQ

SEQ ID NO: 447737 - protein, 8 aa, Mycobacterium
DESRYATG

SEQ ID NO: 447738 - protein, 8 aa, Mycobacterium
DESRYSTG

SEQ ID NO: 447739 - protein, 7 aa, Mycobacterium
DESSEVY

SEQ ID NO: 447740 - protein, 6 aa, Mycobacterium
DESSHD

SEQ ID NO: 447741 - protein, 8 aa, Mycobacterium
DESSITEC

SEQ ID NO: 447742 - protein, 10 aa, Mycobacterium
DESSLSDGRP

SEQ ID NO: 447743 - protein, 7 aa, Mycobacterium
DESSPNY

SEQ ID NO: 447744 - protein, 9 aa, Mycobacterium
DESSRGAAT

SEQ ID NO: 447745 - protein, 9 aa, Mycobacterium
DESSRRSRF

SEQ ID NO: 447746 - protein, 5 aa, Mycobacterium
DESST

SEQ ID NO: 447747 - protein, 7 aa, Mycobacterium
DESSTAQ

SEQ ID NO: 447748 - protein, 14 aa, Mycobacterium
DESSTIRMVRLREN

SEQ ID NO: 447749 - protein, 14 aa, Mycobacterium
DESSTIRMVRLRPD

SEQ ID NO: 447750 - protein, 16 aa, Mycobacterium
DESSTTRLVRLHTEAD

SEQ ID NO: 447751 - protein, 6 aa, Mycobacterium
DESSVR

SEQ ID NO: 447752 - protein, 8 aa, Mycobacterium
DESSYATA

SEQ ID NO: 447753 - protein, 8 aa, Mycobacterium
DESSYSTG

SEQ ID NO: 447754 - protein, 9 aa, Mycobacterium
DESSYSTGA

SEQ ID NO: 447755 - protein, 4 aa, Mycobacterium
DEST

SEQ ID NO: 447756 - protein, 7 aa, Mycobacterium
DESTDIP

SEQ ID NO: 447757 - protein, 5 aa, Mycobacterium
DESTE

SEQ ID NO: 447758 - protein, 8 aa, Mycobacterium
DESTGRGI

SEQ ID NO: 447759 - protein, 9 aa, Mycobacterium
DESTKPANS

SEQ ID NO: 447760 - protein, 10 aa, Mycobacterium
DESTLTGESL

SEQ ID NO: 447761 - protein, 5 aa, Mycobacterium
DESTN

SEQ ID NO: 447762 - protein, 7 aa, Mycobacterium
DESTPVA

SEQ ID NO: 447763 - protein, 13 aa, Mycobacterium
DESTQGMSREEPR

SEQ ID NO: 447764 - protein, 8 aa, Mycobacterium
DESVATGA

SEQ ID NO: 447765 - protein, 8 aa, Mycobacterium
DESVDPPR

SEQ ID NO: 447766 - protein, 6 aa, Mycobacterium
DESVGA

SEQ ID NO: 447767 - protein, 8 aa, Mycobacterium
DESVPDRQ

SEQ ID NO: 447768 - protein, 8 aa, Mycobacterium
DESVPLPE

SEQ ID NO: 447769 - protein, 7 aa, Mycobacterium
DESVSEA

SEQ ID NO: 447770 - protein, 14 aa, Mycobacterium
DESWPQTIPSDRPT

SEQ ID NO: 447771 - protein, 10 aa, Mycobacterium
DESWSGPASM

SEQ ID NO: 447772 - protein, 6 aa, Mycobacterium
DETAAD

SEQ ID NO: 447773 - protein, 7 aa, Mycobacterium
DETADPE

SEQ ID NO: 447774 - protein, 66 aa, Mycobacterium
DETAESEAVEAAETTESEAVESDAAETEGADAAEEAGEAAEASEGVESSEGEGEAAPADEDEDPAV

SEQ ID NO: 447775 - protein, 9 aa, Mycobacterium
DETAGADEF

SEQ ID NO: 447776 - protein, 19 aa, Mycobacterium
DETAGPNYQPASRRRRYWD

SEQ ID NO: 447777 - protein, 5 aa, Mycobacterium
DETAM

SEQ ID NO: 447778 - protein, 7 aa, Mycobacterium
DETANAV

SEQ ID NO: 447779 - protein, 8 aa, Mycobacterium
DETAQEKI

SEQ ID NO: 447780 - protein, 7 aa, Mycobacterium
DETARAA

SEQ ID NO: 447781 - protein, 7 aa, Mycobacterium
DETAREH

SEQ ID NO: 447782 - protein, 22 aa, Mycobacterium
DETASRRYGKSSFADADPDTRE

SEQ ID NO: 447783 - protein, 9 aa, Mycobacterium
DETASSGTS

SEQ ID NO: 447784 - protein, 5 aa, Mycobacterium
DETAT

SEQ ID NO: 447785 - protein, 9 aa, Mycobacterium
DETCGAKTL

SEQ ID NO: 447786 - protein, 8 aa, Mycobacterium
DETDDLPT

SEQ ID NO: 447787 - protein, 11 aa, Mycobacterium
DETDEEADDPA

SEQ ID NO: 447788 - protein, 16 aa, Mycobacterium
DETDEEGGTAVREDEV

SEQ ID NO: 447789 - protein, 8 aa, Mycobacterium
DETDGARV

SEQ ID NO: 447790 - protein, 5 aa, Mycobacterium
DETDI

SEQ ID NO: 447791 - protein, 8 aa, Mycobacterium
DETDLDAE

SEQ ID NO: 447792 - protein, 5 aa, Mycobacterium
DETDP

SEQ ID NO: 447793 - protein, 9 aa, Mycobacterium
DETDPRGAV

SEQ ID NO: 447794 - protein, 11 aa, Mycobacterium
DETDPTKRDPE

SEQ ID NO: 447795 - protein, 7 aa, Mycobacterium
DETDSAV

SEQ ID NO: 447796 - protein, 8 aa, Mycobacterium
DETDTVPA

SEQ ID NO: 447797 - protein, 11 aa, Mycobacterium
DETDWSTDRVR

SEQ ID NO: 447798 - protein, 5 aa, Mycobacterium
DETEA

SEQ ID NO: 447799 - protein, 6 aa, Mycobacterium
DETETA

SEQ ID NO: 447800 - protein, 8 aa, Mycobacterium
DETGATKR

SEQ ID NO: 447801 - protein, 11 aa, Mycobacterium
DETGEESGPGD

SEQ ID NO: 447802 - protein, 5 aa, Mycobacterium
DETGG

SEQ ID NO: 447803 - protein, 7 aa, Mycobacterium
DETGGRW

SEQ ID NO: 447804 - protein, 13 aa, Mycobacterium
DETGGTASPHPRA

SEQ ID NO: 447805 - protein, 12 aa, Mycobacterium
DETGITPSYQQR

SEQ ID NO: 447806 - protein, 5 aa, Mycobacterium
DETGK

SEQ ID NO: 447807 - protein, 5 aa, Mycobacterium
DETGP

SEQ ID NO: 447808 - protein, 9 aa, Mycobacterium
DETGQPPMT

SEQ ID NO: 447809 - protein, 9 aa, Mycobacterium
DETGQPPTI

SEQ ID NO: 447810 - protein, 23 aa, Mycobacterium
DETGRGVSGNQAGPAISGAAGAM

SEQ ID NO: 447811 - protein, 5 aa, Mycobacterium
DETGS

SEQ ID NO: 447812 - protein, 8 aa, Mycobacterium
DETGSTNA

SEQ ID NO: 447813 - protein, 10 aa, Mycobacterium
DETGVDRKLT

SEQ ID NO: 447814 - protein, 9 aa, Mycobacterium
DETGWSTDT

SEQ ID NO: 447815 - protein, 6 aa, Mycobacterium
DETHQA

SEQ ID NO: 447816 - protein, 5 aa, Mycobacterium
DETIS

SEQ ID NO: 447817 - protein, 4 aa, Mycobacterium
DETL

SEQ ID NO: 447818 - protein, 6 aa, Mycobacterium
DETLDE

SEQ ID NO: 447819 - protein, 7 aa, Mycobacterium
DETLDSA

SEQ ID NO: 447820 - protein, 16 aa, Mycobacterium
DETLDSYGRGSNPTWR

SEQ ID NO: 447821 - protein, 5 aa, Mycobacterium
DETLS

SEQ ID NO: 447822 - protein, 20 aa, Mycobacterium
DETMREGGERAPFGATDDQK

SEQ ID NO: 447823 - protein, 5 aa, Mycobacterium
DETNL

SEQ ID NO: 447824 - protein, 6 aa, Mycobacterium
DETPDC

SEQ ID NO: 447825 - protein, 5 aa, Mycobacterium
DETPF

SEQ ID NO: 447826 - protein, 6 aa, Mycobacterium
DETPFD

SEQ ID NO: 447827 - protein, 5 aa, Mycobacterium
DETPG

SEQ ID NO: 447828 - protein, 7 aa, Mycobacterium
DETPVAA

SEQ ID NO: 447829 - protein, 9 aa, Mycobacterium
DETQPPHQN

SEQ ID NO: 447830 - protein, 6 aa, Mycobacterium
DETRKS

SEQ ID NO: 447831 - protein, 7 aa, Mycobacterium
DETRKSF

SEQ ID NO: 447832 - protein, 10 aa, Mycobacterium
DETRQYRGYE

SEQ ID NO: 447833 - protein, 6 aa, Mycobacterium
DETRSD

SEQ ID NO: 447834 - protein, 11 aa, Mycobacterium
DETRSDPRRAA

SEQ ID NO: 447835 - protein, 8 aa, Mycobacterium
DETRSRGV

SEQ ID NO: 447836 - protein, 6 aa, Mycobacterium
DETRSV

SEQ ID NO: 447837 - protein, 13 aa, Mycobacterium
DETRTAASEPIAQ

SEQ ID NO: 447838 - protein, 15 aa, Mycobacterium
DETRVTAAARAEADP

SEQ ID NO: 447839 - protein, 6 aa, Mycobacterium
DETSAS

SEQ ID NO: 447840 - protein, 7 aa, Mycobacterium
DETSDAR

SEQ ID NO: 447841 - protein, 6 aa, Mycobacterium
DETSRI

SEQ ID NO: 447842 - protein, 5 aa, Mycobacterium
DETST

SEQ ID NO: 447843 - protein, 14 aa, Mycobacterium
DETSTTRMVRLRAP

SEQ ID NO: 447844 - protein, 14 aa, Mycobacterium
DETSTTRMVRLRAQ

SEQ ID NO: 447845 - protein, 4 aa, Mycobacterium
DETT

SEQ ID NO: 447846 - protein, 5 aa, Mycobacterium
DETTD

SEQ ID NO: 447847 - protein, 8 aa, Mycobacterium
DETTDAEQ

SEQ ID NO: 447848 - protein, 5 aa, Mycobacterium
DETTG

SEQ ID NO: 447849 - protein, 10 aa, Mycobacterium
DETTHQPTPY

SEQ ID NO: 447850 - protein, 5 aa, Mycobacterium
DETTI

SEQ ID NO: 447851 - protein, 5 aa, Mycobacterium
DETTN

SEQ ID NO: 447852 - protein, 7 aa, Mycobacterium
DETTNRV

SEQ ID NO: 447853 - protein, 12 aa, Mycobacterium
DETTPAPSRDEL

SEQ ID NO: 447854 - protein, 50 aa, Mycobacterium
DETTPQRGPRRNERPRTPQRKPQRPNNTGGRETGKAGGSMARALRDAGFG

SEQ ID NO: 447855 - protein, 14 aa, Mycobacterium
DETTRHTLSGGSEQ

SEQ ID NO: 447856 - protein, 12 aa, Mycobacterium
DETTRHTLSGGT

SEQ ID NO: 447857 - protein, 13 aa, Mycobacterium
DETTRHTLSGGTA

SEQ ID NO: 447858 - protein, 8 aa, Mycobacterium
DETTTDEH

SEQ ID NO: 447859 - protein, 7 aa, Mycobacterium
DETTTDP

SEQ ID NO: 447860 - protein, 6 aa, Mycobacterium
DETTTT

SEQ ID NO: 447861 - protein, 7 aa, Mycobacterium
DETVGGA

SEQ ID NO: 447862 - protein, 8 aa, Mycobacterium
DETVGTPL

SEQ ID NO: 447863 - protein, 12 aa, Mycobacterium
DETVRGAQANFD

SEQ ID NO: 447864 - protein, 21 aa, Mycobacterium
DETVRNAQEGLGRSQSEGQRR

SEQ ID NO: 447865 - protein, 20 aa, Mycobacterium
DETWSTAGIRSSAYSRAKSA

SEQ ID NO: 447866 - protein, 8 aa, Mycobacterium
DETYETPI

SEQ ID NO: 447867 - protein, 4 aa, Mycobacterium
DEVA

SEQ ID NO: 447868 - protein, 7 aa, Mycobacterium
DEVADAQ

SEQ ID NO: 447869 - protein, 96 aa, Mycobacterium
DEVADQKKRQAGDELKEKRDQAVAAPQKAREEAKERVQEARAEAEQGKRQAAENVAKRTSQAEEQIDQSAQQRKQNAEKAKQNVQNRSRAAEKAEV

SEQ ID NO: 447870 - protein, 8 aa, Mycobacterium
DEVAGGPL

SEQ ID NO: 447871 - protein, 11 aa, Mycobacterium
DEVAGTPGHTV

SEQ ID NO: 447872 - protein, 24 aa, Mycobacterium
DEVAPDEEAAADETDGQDGEDAPF

SEQ ID NO: 447873 - protein, 14 aa, Mycobacterium
DEVAQGAAAYPADI

SEQ ID NO: 447874 - protein, 4 aa, Mycobacterium
DEVD

SEQ ID NO: 447875 - protein, 9 aa, Mycobacterium
DEVDAGGNE

SEQ ID NO: 447876 - protein, 9 aa, Mycobacterium
DEVDDGQTY

SEQ ID NO: 447877 - protein, 5 aa, Mycobacterium
DEVDT

SEQ ID NO: 447878 - protein, 16 aa, Mycobacterium
DEVDVDPDIAAAGRRS

SEQ ID NO: 447879 - protein, 13 aa, Mycobacterium
DEVDVDPDTARLA

SEQ ID NO: 447880 - protein, 4 aa, Mycobacterium
DEVE

SEQ ID NO: 447881 - protein, 6 aa, Mycobacterium
DEVEEA

SEQ ID NO: 447882 - protein, 5 aa, Mycobacterium
DEVEG

SEQ ID NO: 447883 - protein, 13 aa, Mycobacterium
DEVELGSRNEKPL

SEQ ID NO: 447884 - protein, 7 aa, Mycobacterium
DEVEPRK

SEQ ID NO: 447885 - protein, 7 aa, Mycobacterium
DEVGADD

SEQ ID NO: 447886 - protein, 17 aa, Mycobacterium
DEVGATEERWLQISEVL

SEQ ID NO: 447887 - protein, 6 aa, Mycobacterium
DEVGCS

SEQ ID NO: 447888 - protein, 7 aa, Mycobacterium
DEVGGTW

SEQ ID NO: 447889 - protein, 13 aa, Mycobacterium
DEVGKGSNIASAT

SEQ ID NO: 447890 - protein, 5 aa, Mycobacterium
DEVGP

SEQ ID NO: 447891 - protein, 22 aa, Mycobacterium
DEVGQRNAYTEKIGRPLPESLG

SEQ ID NO: 447892 - protein, 16 aa, Mycobacterium
DEVGRDGAVSSVTQAT

SEQ ID NO: 447893 - protein, 4 aa, Mycobacterium
DEVP

SEQ ID NO: 447894 - protein, 14 aa, Mycobacterium
DEVPAGKPAPDPYL

SEQ ID NO: 447895 - protein, 5 aa, Mycobacterium
DEVPD

SEQ ID NO: 447896 - protein, 10 aa, Mycobacterium
DEVPDTGSLR

SEQ ID NO: 447897 - protein, 6 aa, Mycobacterium
DEVPNV

SEQ ID NO: 447898 - protein, 16 aa, Mycobacterium
DEVPPELPVGSGPGVA

SEQ ID NO: 447899 - protein, 8 aa, Mycobacterium
DEVPPGAA

SEQ ID NO: 447900 - protein, 9 aa, Mycobacterium
DEVPPSSRH

SEQ ID NO: 447901 - protein, 6 aa, Mycobacterium
DEVPRD

SEQ ID NO: 447902 - protein, 13 aa, Mycobacterium
DEVPSGKPAPDPY

SEQ ID NO: 447903 - protein, 6 aa, Mycobacterium
DEVPVE

SEQ ID NO: 447904 - protein, 7 aa, Mycobacterium
DEVQATA

SEQ ID NO: 447905 - protein, 8 aa, Mycobacterium
DEVQTQRG

SEQ ID NO: 447906 - protein, 7 aa, Mycobacterium
DEVRAGE

SEQ ID NO: 447907 - protein, 12 aa, Mycobacterium
DEVREKGTEGTH

SEQ ID NO: 447908 - protein, 10 aa, Mycobacterium
DEVRGTVGRY

SEQ ID NO: 447909 - protein, 6 aa, Mycobacterium
DEVRQR

SEQ ID NO: 447910 - protein, 6 aa, Mycobacterium
DEVRTG

SEQ ID NO: 447911 - protein, 5 aa, Mycobacterium
DEVSA

SEQ ID NO: 447912 - protein, 8 aa, Mycobacterium
DEVSADTA

SEQ ID NO: 447913 - protein, 8 aa, Mycobacterium
DEVSTNTD

SEQ ID NO: 447914 - protein, 4 aa, Mycobacterium
DEVT

SEQ ID NO: 447915 - protein, 20 aa, Mycobacterium
DEVTAANNDDGVGRVLERWW

SEQ ID NO: 447916 - protein, 14 aa, Mycobacterium
DEVTLSTDAPKTIA

SEQ ID NO: 447917 - protein, 7 aa, Mycobacterium
DEVTPDG

SEQ ID NO: 447918 - protein, 11 aa, Mycobacterium
DEVTSSLSTAE

SEQ ID NO: 447919 - protein, 15 aa, Mycobacterium
DEVTTLSDTSPSAHA

SEQ ID NO: 447920 - protein, 6 aa, Mycobacterium
DEVTVE

SEQ ID NO: 447921 - protein, 4 aa, Mycobacterium
DEVV

SEQ ID NO: 447922 - protein, 13 aa, Mycobacterium
DEVVPDSDTAFDD

SEQ ID NO: 447923 - protein, 10 aa, Mycobacterium
DEWASPSGRR

SEQ ID NO: 447924 - protein, 7 aa, Mycobacterium
DEWGPGQ

SEQ ID NO: 447925 - protein, 13 aa, Mycobacterium
DEWHSGPAAMRKD

SEQ ID NO: 447926 - protein, 5 aa, Mycobacterium
DEWPE

SEQ ID NO: 447927 - protein, 7 aa, Mycobacterium
DEWRGPS

SEQ ID NO: 447928 - protein, 10 aa, Mycobacterium
DEWSSPSGRR

SEQ ID NO: 447929 - protein, 6 aa, Mycobacterium
DEWTPQ

SEQ ID NO: 447930 - protein, 4 aa, Mycobacterium
DEYA

SEQ ID NO: 447931 - protein, 7 aa, Mycobacterium
DEYADPK

SEQ ID NO: 447932 - protein, 6 aa, Mycobacterium
DEYAGP

SEQ ID NO: 447933 - protein, 7 aa, Mycobacterium
DEYAGTP

SEQ ID NO: 447934 - protein, 4 aa, Mycobacterium
DEYD

SEQ ID NO: 447935 - protein, 6 aa, Mycobacterium
DEYDNE

SEQ ID NO: 447936 - protein, 5 aa, Mycobacterium
DEYET

SEQ ID NO: 447937 - protein, 18 aa, Mycobacterium
DEYGGVGNPATASKQQQI

SEQ ID NO: 447938 - protein, 9 aa, Mycobacterium
DEYGQPGNY

SEQ ID NO: 447939 - protein, 22 aa, Mycobacterium
DEYGRPEIGGRAGGVQSTGPDG

SEQ ID NO: 447940 - protein, 7 aa, Mycobacterium
DEYPATA

SEQ ID NO: 447941 - protein, 5 aa, Mycobacterium
DEYPE

SEQ ID NO: 447942 - protein, 15 aa, Mycobacterium
DEYPELRTPDSPTQL

SEQ ID NO: 447943 - protein, 5 aa, Mycobacterium
DEYPP

SEQ ID NO: 447944 - protein, 6 aa, Mycobacterium
DEYPTP

SEQ ID NO: 447945 - protein, 5 aa, Mycobacterium
DEYPV

SEQ ID NO: 447946 - protein, 5 aa, Mycobacterium
DEYQR

SEQ ID NO: 447947 - protein, 6 aa, Mycobacterium
DEYRAQ

SEQ ID NO: 447948 - protein, 82 aa, Mycobacterium
DEYRGTAGGDHPKKKGAGGANGGGGDGGNGDTGGNTTDGGGGGGDGGSGGGDGGGAGGGGTPTGSGGLTDPLAGLGGAGMGD

SEQ ID NO: 447949 - protein, 5 aa, Mycobacterium
DEYRR

SEQ ID NO: 447950 - protein, 21 aa, Mycobacterium
DEYSAESHERAAAAQDGGAFT

SEQ ID NO: 447951 - protein, 9 aa, Mycobacterium
DEYSDEHGT

SEQ ID NO: 447952 - protein, 5 aa, Mycobacterium
DEYSQ

SEQ ID NO: 447953 - protein, 12 aa, Mycobacterium
DEYSSRYGSTRD

SEQ ID NO: 447954 - protein, 11 aa, Mycobacterium
DEYSTPAKPRY

SEQ ID NO: 447955 - protein, 11 aa, Mycobacterium
DEYSTPDKPRY

SEQ ID NO: 447956 - protein, 12 aa, Mycobacterium
DFAAAGADASGA

SEQ ID NO: 447957 - protein, 6 aa, Mycobacterium
DFAEGA

SEQ ID NO: 447958 - protein, 9 aa, Mycobacterium
DFAETGDYE

SEQ ID NO: 447959 - protein, 8 aa, Mycobacterium
DFAGRESG

SEQ ID NO: 447960 - protein, 6 aa, Mycobacterium
DFAPAP

SEQ ID NO: 447961 - protein, 4 aa, Mycobacterium
DFAS

SEQ ID NO: 447962 - protein, 13 aa, Mycobacterium
DFASAQKRMAETD

SEQ ID NO: 447963 - protein, 9 aa, Mycobacterium
DFASNGENR

SEQ ID NO: 447964 - protein, 9 aa, Mycobacterium
DFASSRGLT

SEQ ID NO: 447965 - protein, 11 aa, Mycobacterium
DFDARPRYTDP

SEQ ID NO: 447966 - protein, 5 aa, Mycobacterium
DFDEP

SEQ ID NO: 447967 - protein, 5 aa, Mycobacterium
DFDES

SEQ ID NO: 447968 - protein, 5 aa, Mycobacterium
DFDGG

SEQ ID NO: 447969 - protein, 7 aa, Mycobacterium
DFDGRTP

SEQ ID NO: 447970 - protein, 7 aa, Mycobacterium
DFDNDEA

SEQ ID NO: 447971 - protein, 8 aa, Mycobacterium
DFDNDGTV

SEQ ID NO: 447972 - protein, 8 aa, Mycobacterium
DFDPATGT

SEQ ID NO: 447973 - protein, 7 aa, Mycobacterium
DFDPRDS

SEQ ID NO: 447974 - protein, 12 aa, Mycobacterium
DFDPSRYNDTYQ

SEQ ID NO: 447975 - protein, 13 aa, Mycobacterium
DFDPTALNPEEGF

SEQ ID NO: 447976 - protein, 12 aa, Mycobacterium
DFDSRGRRADEQ

SEQ ID NO: 447977 - protein, 11 aa, Mycobacterium
DFEARPRYTDP

SEQ ID NO: 447978 - protein, 12 aa, Mycobacterium
DFEDDGVPAAET

SEQ ID NO: 447979 - protein, 17 aa, Mycobacterium
DFEDEPVHSPAPTDTYH

SEQ ID NO: 447980 - protein, 9 aa, Mycobacterium
DFEEASPAL

SEQ ID NO: 447981 - protein, 7 aa, Mycobacterium
DFENDDS

SEQ ID NO: 447982 - protein, 8 aa, Mycobacterium
DFEPAEDK

SEQ ID NO: 447983 - protein, 9 aa, Mycobacterium
DFEPRPSDA

SEQ ID NO: 447984 - protein, 6 aa, Mycobacterium
DFERED

SEQ ID NO: 447985 - protein, 8 aa, Mycobacterium
DFESAGAE

SEQ ID NO: 447986 - protein, 9 aa, Mycobacterium
DFESAGPEL

SEQ ID NO: 447987 - protein, 4 aa, Mycobacterium
DFGA

SEQ ID NO: 447988 - protein, 10 aa, Mycobacterium
DFGAGGSAQV

SEQ ID NO: 447989 - protein, 5 aa, Mycobacterium
DFGAR

SEQ ID NO: 447990 - protein, 5 aa, Mycobacterium
DFGDD

SEQ ID NO: 447991 - protein, 13 aa, Mycobacterium
DFGDGAERRARAN

SEQ ID NO: 447992 - protein, 14 aa, Mycobacterium
DFGENAPNSRQSWP

SEQ ID NO: 447993 - protein, 5 aa, Mycobacterium
DFGET

SEQ ID NO: 447994 - protein, 7 aa, Mycobacterium
DFGGAQL

SEQ ID NO: 447995 - protein, 6 aa, Mycobacterium
DFGGKP

SEQ ID NO: 447996 - protein, 18 aa, Mycobacterium
DFGGPGGLGAAGTGGLGG

SEQ ID NO: 447997 - protein, 12 aa, Mycobacterium
DFGGPKASNEYP

SEQ ID NO: 447998 - protein, 9 aa, Mycobacterium
DFGNPGRRY

SEQ ID NO: 447999 - protein, 4 aa, Mycobacterium
DFGP

SEQ ID NO: 448000 - protein, 6 aa, Mycobacterium
DFGPER

SEQ ID NO: 448001 - protein, 12 aa, Mycobacterium
DFGPGKGPAYER

SEQ ID NO: 448002 - protein, 11 aa, Mycobacterium
DFGPKGRDGVR

SEQ ID NO: 448003 - protein, 8 aa, Mycobacterium
DFGPPSQR

SEQ ID NO: 448004 - protein, 9 aa, Mycobacterium
DFGRGDDAL

SEQ ID NO: 448005 - protein, 4 aa, Mycobacterium
DFGS

SEQ ID NO: 448006 - protein, 11 aa, Mycobacterium
DFGSDDDNYRE

SEQ ID NO: 448007 - protein, 25 aa, Mycobacterium
DFGSDRTGALGGADSAGSRRIADPR

SEQ ID NO: 448008 - protein, 16 aa, Mycobacterium
DFGSPAGQLSVDSDAA

SEQ ID NO: 448009 - protein, 13 aa, Mycobacterium
DFGTGKVKGSKLD

SEQ ID NO: 448010 - protein, 4 aa, Mycobacterium
DFHG

SEQ ID NO: 448011 - protein, 6 aa, Mycobacterium
DFHGTP

SEQ ID NO: 448012 - protein, 6 aa, Mycobacterium
DFHPAG

SEQ ID NO: 448013 - protein, 6 aa, Mycobacterium
DFKGPS

SEQ ID NO: 448014 - protein, 6 aa, Mycobacterium
DFKRPS

SEQ ID NO: 448015 - protein, 7 aa, Mycobacterium
DFKRPSP

SEQ ID NO: 448016 - protein, 7 aa, Mycobacterium
DFNNDEA

SEQ ID NO: 448017 - protein, 13 aa, Mycobacterium
DFNPGSGNTGDFN

SEQ ID NO: 448018 - protein, 7 aa, Mycobacterium
DFNRRDK

SEQ ID NO: 448019 - protein, 12 aa, Mycobacterium
DFNSTATGGKKV

SEQ ID NO: 448020 - protein, 33 aa, Mycobacterium
DFNTGDFNSGGGTFGTSAGNSGSFNSSPNNTGF

SEQ ID NO: 448021 - protein, 7 aa, Mycobacterium
DFPAEGR

SEQ ID NO: 448022 - protein, 5 aa, Mycobacterium
DFPAG

SEQ ID NO: 448023 - protein, 8 aa, Mycobacterium
DFPAPSVA

SEQ ID NO: 448024 - protein, 8 aa, Mycobacterium
DFPATGGE

SEQ ID NO: 448025 - protein, 6 aa, Mycobacterium
DFPDES

SEQ ID NO: 448026 - protein, 6 aa, Mycobacterium
DFPDGP

SEQ ID NO: 448027 - protein, 14 aa, Mycobacterium
DFPDSIPNDSENFD

SEQ ID NO: 448028 - protein, 6 aa, Mycobacterium
DFPDTT

SEQ ID NO: 448029 - protein, 28 aa, Mycobacterium
DFPEEGGPGDTLNASEGTDSDEVHNDDG

SEQ ID NO: 448030 - protein, 6 aa, Mycobacterium
DFPEPG

SEQ ID NO: 448031 - protein, 6 aa, Mycobacterium
DFPESG

SEQ ID NO: 448032 - protein, 10 aa, Mycobacterium
DFPGGEPPTD

SEQ ID NO: 448033 - protein, 8 aa, Mycobacterium
DFPGGGTR

SEQ ID NO: 448034 - protein, 6 aa, Mycobacterium
DFPGTF

SEQ ID NO: 448035 - protein, 6 aa, Mycobacterium
DFPKPG

SEQ ID NO: 448036 - protein, 16 aa, Mycobacterium
DFPQSPKTDEDKEIRD

SEQ ID NO: 448037 - protein, 16 aa, Mycobacterium
DFPQSPKTDEEKEIRA

SEQ ID NO: 448038 - protein, 4 aa, Mycobacterium
DFPR

SEQ ID NO: 448039 - protein, 5 aa, Mycobacterium
DFPSA

SEQ ID NO: 448040 - protein, 16 aa, Mycobacterium
DFPSFDGDYDAAATEP

SEQ ID NO: 448041 - protein, 5 aa, Mycobacterium
DFPYE

SEQ ID NO: 448042 - protein, 9 aa, Mycobacterium
DFQTATNNQ

SEQ ID NO: 448043 - protein, 4 aa, Mycobacterium
DFRA

SEQ ID NO: 448044 - protein, 5 aa, Mycobacterium
DFRAA

SEQ ID NO: 448045 - protein, 4 aa, Mycobacterium
DFRD

SEQ ID NO: 448046 - protein, 8 aa, Mycobacterium
DFRGSGDQ

SEQ ID NO: 448047 - protein, 20 aa, Mycobacterium
DFRQEGHKEFEDKDATDPLE

SEQ ID NO: 448048 - protein, 20 aa, Mycobacterium
DFRQPGHAEFEDRDATDPLE

SEQ ID NO: 448049 - protein, 5 aa, Mycobacterium
DFRSE

SEQ ID NO: 448050 - protein, 6 aa, Mycobacterium
DFSAAE

SEQ ID NO: 448051 - protein, 7 aa, Mycobacterium
DFSDGRY

SEQ ID NO: 448052 - protein, 8 aa, Mycobacterium
DFSDPQRR

SEQ ID NO: 448053 - protein, 7 aa, Mycobacterium
DFSDTAT

SEQ ID NO: 448054 - protein, 4 aa, Mycobacterium
DFSE

SEQ ID NO: 448055 - protein, 4 aa, Mycobacterium
DFSG

SEQ ID NO: 448056 - protein, 24 aa, Mycobacterium
DFSGDTNPFDAPDGGGGFTAAPID

SEQ ID NO: 448057 - protein, 9 aa, Mycobacterium
DFSGEAAAL

SEQ ID NO: 448058 - protein, 25 aa, Mycobacterium
DFSGGASPFDAPAADGTFSASPITP

SEQ ID NO: 448059 - protein, 23 aa, Mycobacterium
DFSGGTSPFDAPGDEFSASPITP

SEQ ID NO: 448060 - protein, 6 aa, Mycobacterium
DFSGND

SEQ ID NO: 448061 - protein, 7 aa, Mycobacterium
DFSGPPV

SEQ ID NO: 448062 - protein, 6 aa, Mycobacterium
DFSGSD

SEQ ID NO: 448063 - protein, 7 aa, Mycobacterium
DFSHPTR

SEQ ID NO: 448064 - protein, 11 aa, Mycobacterium
DFSKNSGRSEL

SEQ ID NO: 448065 - protein, 9 aa, Mycobacterium
DFSNEDRRR

SEQ ID NO: 448066 - protein, 5 aa, Mycobacterium
DFSPA

SEQ ID NO: 448067 - protein, 8 aa, Mycobacterium
DFSPAEEE

SEQ ID NO: 448068 - protein, 25 aa, Mycobacterium
DFSPGQTEGGGDPAPESGDSKDAKD

SEQ ID NO: 448069 - protein, 7 aa, Mycobacterium
DFSPTRR

SEQ ID NO: 448070 - protein, 8 aa, Mycobacterium
DFSPTRRE

SEQ ID NO: 448071 - protein, 10 aa, Mycobacterium
DFSSGGPQGA

SEQ ID NO: 448072 - protein, 4 aa, Mycobacterium
DFTD

SEQ ID NO: 448073 - protein, 5 aa, Mycobacterium
DFTDE

SEQ ID NO: 448074 - protein, 11 aa, Mycobacterium
DFTDEGQRYTH

SEQ ID NO: 448075 - protein, 11 aa, Mycobacterium
DFTDESTGERL

SEQ ID NO: 448076 - protein, 5 aa, Mycobacterium
DFTDP

SEQ ID NO: 448077 - protein, 12 aa, Mycobacterium
DFTDTNRPPETV

SEQ ID NO: 448078 - protein, 5 aa, Mycobacterium
DFTET

SEQ ID NO: 448079 - protein, 10 aa, Mycobacterium
DFTGEGARLR

SEQ ID NO: 448080 - protein, 5 aa, Mycobacterium
DFTPA

SEQ ID NO: 448081 - protein, 8 aa, Mycobacterium
DFTPGSDT

SEQ ID NO: 448082 - protein, 5 aa, Mycobacterium
DFTPN

SEQ ID NO: 448083 - protein, 12 aa, Mycobacterium
DFTRDGGYSAAR

SEQ ID NO: 448084 - protein, 6 aa, Mycobacterium
DFTSKE

SEQ ID NO: 448085 - protein, 14 aa, Mycobacterium
DFTSPGLEISGDRE

SEQ ID NO: 448086 - protein, 4 aa, Mycobacterium
DFTT

SEQ ID NO: 448087 - protein, 10 aa, Mycobacterium
DFVPSDPTVA

SEQ ID NO: 448088 - protein, 5 aa, Mycobacterium
DGAAA

SEQ ID NO: 448089 - protein, 9 aa, Mycobacterium
DGAAADYYP

SEQ ID NO: 448090 - protein, 8 aa, Mycobacterium
DGAAAGQQ

SEQ ID NO: 448091 - protein, 6 aa, Mycobacterium
DGAAAQ

SEQ ID NO: 448092 - protein, 15 aa, Mycobacterium
DGAAARAARETPAEG

SEQ ID NO: 448093 - protein, 6 aa, Mycobacterium
DGAAAS

SEQ ID NO: 448094 - protein, 12 aa, Mycobacterium
DGAAATAASTAV

SEQ ID NO: 448095 - protein, 11 aa, Mycobacterium
DGAAAYGNKMT

SEQ ID NO: 448096 - protein, 13 aa, Mycobacterium
DGAADAQRVGTDA

SEQ ID NO: 448097 - protein, 6 aa, Mycobacterium
DGAADK

SEQ ID NO: 448098 - protein, 9 aa, Mycobacterium
DGAAEADLG

SEQ ID NO: 448099 - protein, 9 aa, Mycobacterium
DGAAEADLS

SEQ ID NO: 448100 - protein, 8 aa, Mycobacterium
DGAAEDLK

SEQ ID NO: 448101 - protein, 6 aa, Mycobacterium
DGAAEG

SEQ ID NO: 448102 - protein, 7 aa, Mycobacterium
DGAAEGS

SEQ ID NO: 448103 - protein, 15 aa, Mycobacterium
DGAAGAPGQDGGDGG

SEQ ID NO: 448104 - protein, 30 aa, Mycobacterium
DGAAGGAGGAGGASQTFTGDGGAGGTGGAG

SEQ ID NO: 448105 - protein, 10 aa, Mycobacterium
DGAAGGDPEF

SEQ ID NO: 448106 - protein, 27 aa, Mycobacterium
DGAAGIGGRAGAGGAGGALGAGGAGGI

SEQ ID NO: 448107 - protein, 11 aa, Mycobacterium
DGAAGPGRPES

SEQ ID NO: 448108 - protein, 19 aa, Mycobacterium
DGAAGQSPISASDRGAGTL

SEQ ID NO: 448109 - protein, 15 aa, Mycobacterium
DGAAGTAANPNGGAG

SEQ ID NO: 448110 - protein, 14 aa, Mycobacterium
DGAAGTASHPDGYD

SEQ ID NO: 448111 - protein, 16 aa, Mycobacterium
DGAAGTATDPNGGAGG

SEQ ID NO: 448112 - protein, 16 aa, Mycobacterium
DGAAGTATNPNGGAGG

SEQ ID NO: 448113 - protein, 101 aa, Mycobacterium
DGAAGTGGVGGNGGDGGNGADGGDGHSGDPSWRSGGDGGNGGNGAYGGNGGQGGLSGDGATRAAHGVQGTMGDGGDGGDGGNGSTTSDQPDIDGGNGGYGG

SEQ ID NO: 448114 - protein, 5 aa, Mycobacterium
DGAAI

SEQ ID NO: 448115 - protein, 9 aa, Mycobacterium
DGAAITGTV

SEQ ID NO: 448116 - protein, 5 aa, Mycobacterium
DGAAL

SEQ ID NO: 448117 - protein, 20 aa, Mycobacterium
DGAALPDGALGAEPGASRSE

SEQ ID NO: 448118 - protein, 9 aa, Mycobacterium
DGAALQPRG

SEQ ID NO: 448119 - protein, 11 aa, Mycobacterium
DGAAPPEAGEL

SEQ ID NO: 448120 - protein, 18 aa, Mycobacterium
DGAAPSGECGRGFGKGSV

SEQ ID NO: 448121 - protein, 8 aa, Mycobacterium
DGAAPVAQ

SEQ ID NO: 448122 - protein, 14 aa, Mycobacterium
DGAARAEQNISEGN

SEQ ID NO: 448123 - protein, 9 aa, Mycobacterium
DGAARDELS

SEQ ID NO: 448124 - protein, 13 aa, Mycobacterium
DGAARGDARGCGP

SEQ ID NO: 448125 - protein, 6 aa, Mycobacterium
DGAARR

SEQ ID NO: 448126 - protein, 7 aa, Mycobacterium
DGAARTR

SEQ ID NO: 448127 - protein, 10 aa, Mycobacterium
DGAASGAAKG

SEQ ID NO: 448128 - protein, 8 aa, Mycobacterium
DGAASGLR

SEQ ID NO: 448129 - protein, 9 aa, Mycobacterium
DGAASGLRA

SEQ ID NO: 448130 - protein, 10 aa, Mycobacterium
DGAASNESGR

SEQ ID NO: 448131 - protein, 7 aa, Mycobacterium
DGAASPI

SEQ ID NO: 448132 - protein, 9 aa, Mycobacterium
DGAASYTEA

SEQ ID NO: 448133 - protein, 10 aa, Mycobacterium
DGAATDEANG

SEQ ID NO: 448134 - protein, 13 aa, Mycobacterium
DGAATDPDDIGSR

SEQ ID NO: 448135 - protein, 15 aa, Mycobacterium
DGAATGGVASAPPRT

SEQ ID NO: 448136 - protein, 5 aa, Mycobacterium
DGAAV

SEQ ID NO: 448137 - protein, 6 aa, Mycobacterium
DGAAVG

SEQ ID NO: 448138 - protein, 7 aa, Mycobacterium
DGAAVTA

SEQ ID NO: 448139 - protein, 8 aa, Mycobacterium
DGACDPGG

SEQ ID NO: 448140 - protein, 12 aa, Mycobacterium
DGADAAGGLAAA

SEQ ID NO: 448141 - protein, 9 aa, Mycobacterium
DGADAGAGR

SEQ ID NO: 448142 - protein, 11 aa, Mycobacterium
DGADAKVAGQL

SEQ ID NO: 448143 - protein, 8 aa, Mycobacterium
DGADAQAA

SEQ ID NO: 448144 - protein, 17 aa, Mycobacterium
DGADAQVSHRGKTRTMR

SEQ ID NO: 448145 - protein, 7 aa, Mycobacterium
DGADARQ

SEQ ID NO: 448146 - protein, 9 aa, Mycobacterium
DGADATGAT

SEQ ID NO: 448147 - protein, 9 aa, Mycobacterium
DGADDFGVD

SEQ ID NO: 448148 - protein, 10 aa, Mycobacterium
DGADDFGVPE

SEQ ID NO: 448149 - protein, 8 aa, Mycobacterium
DGADETYP

SEQ ID NO: 448150 - protein, 8 aa, Mycobacterium
DGADFDPD

SEQ ID NO: 448151 - protein, 5 aa, Mycobacterium
DGADG

SEQ ID NO: 448152 - protein, 17 aa, Mycobacterium
DGADGAPGTGQDGGDGG

SEQ ID NO: 448153 - protein, 17 aa, Mycobacterium
DGADGAPGTGQNGGDGG

SEQ ID NO: 448154 - protein, 12 aa, Mycobacterium
DGADGDSSEDPD

SEQ ID NO: 448155 - protein, 20 aa, Mycobacterium
DGADGITNAQGVGTAGGAGG

SEQ ID NO: 448156 - protein, 9 aa, Mycobacterium
DGADGKTHT

SEQ ID NO: 448157 - protein, 11 aa, Mycobacterium
DGADGSFDSYG

SEQ ID NO: 448158 - protein, 14 aa, Mycobacterium
DGADGSPGQPGGAG

SEQ ID NO: 448159 - protein, 16 aa, Mycobacterium
DGADGTAPGQGGGAGG

SEQ ID NO: 448160 - protein, 5 aa, Mycobacterium
DGADI

SEQ ID NO: 448161 - protein, 10 aa, Mycobacterium
DGADIRDRTG

SEQ ID NO: 448162 - protein, 17 aa, Mycobacterium
DGADKPACVAESISRYI

SEQ ID NO: 448163 - protein, 9 aa, Mycobacterium
DGADLAGEA

SEQ ID NO: 448164 - protein, 10 aa, Mycobacterium
DGADPESLTN

SEQ ID NO: 448165 - protein, 6 aa, Mycobacterium
DGADPL

SEQ ID NO: 448166 - protein, 14 aa, Mycobacterium
DGADPRRPGPIPSE

SEQ ID NO: 448167 - protein, 5 aa, Mycobacterium
DGADS

SEQ ID NO: 448168 - protein, 5 aa, Mycobacterium
DGADT

SEQ ID NO: 448169 - protein, 15 aa, Mycobacterium
DGADTARRVGTDAIT

SEQ ID NO: 448170 - protein, 12 aa, Mycobacterium
DGADTDALPLGP

SEQ ID NO: 448171 - protein, 10 aa, Mycobacterium
DGADVTTSVG

SEQ ID NO: 448172 - protein, 10 aa, Mycobacterium
DGAEADPEQT

SEQ ID NO: 448173 - protein, 12 aa, Mycobacterium
DGAEAQRQARAN

SEQ ID NO: 448174 - protein, 7 aa, Mycobacterium
DGAEDQI

SEQ ID NO: 448175 - protein, 9 aa, Mycobacterium
DGAEFDGKS

SEQ ID NO: 448176 - protein, 8 aa, Mycobacterium
DGAEFDGQ

SEQ ID NO: 448177 - protein, 9 aa, Mycobacterium
DGAEFDGQS

SEQ ID NO: 448178 - protein, 8 aa, Mycobacterium
DGAEGEVR

SEQ ID NO: 448179 - protein, 10 aa, Mycobacterium
DGAEGEVREG

SEQ ID NO: 448180 - protein, 10 aa, Mycobacterium
DGAEHARAAG

SEQ ID NO: 448181 - protein, 15 aa, Mycobacterium
DGAEIGDGVRVEIAK

SEQ ID NO: 448182 - protein, 5 aa, Mycobacterium
DGAEK

SEQ ID NO: 448183 - protein, 7 aa, Mycobacterium
DGAEKFT

SEQ ID NO: 448184 - protein, 17 aa, Mycobacterium
DGAEKFTKQDLENETQG

SEQ ID NO: 448185 - protein, 17 aa, Mycobacterium
DGAEKFTPESLERETKG

SEQ ID NO: 448186 - protein, 9 aa, Mycobacterium
DGAEKFTPG

SEQ ID NO: 448187 - protein, 5 aa, Mycobacterium
DGAEL

SEQ ID NO: 448188 - protein, 6 aa, Mycobacterium
DGAELD

SEQ ID NO: 448189 - protein, 10 aa, Mycobacterium
DGAELDSATV

SEQ ID NO: 448190 - protein, 5 aa, Mycobacterium
DGAEP

SEQ ID NO: 448191 - protein, 9 aa, Mycobacterium
DGAEPEMGT

SEQ ID NO: 448192 - protein, 7 aa, Mycobacterium
DGAEPEQ

SEQ ID NO: 448193 - protein, 7 aa, Mycobacterium
DGAEPEV

SEQ ID NO: 448194 - protein, 7 aa, Mycobacterium
DGAEPGD

SEQ ID NO: 448195 - protein, 8 aa, Mycobacterium
DGAEQTCA

SEQ ID NO: 448196 - protein, 7 aa, Mycobacterium
DGAEQTV

SEQ ID NO: 448197 - protein, 5 aa, Mycobacterium
DGAER

SEQ ID NO: 448198 - protein, 7 aa, Mycobacterium
DGAETFD

SEQ ID NO: 448199 - protein, 7 aa, Mycobacterium
DGAETQV

SEQ ID NO: 448200 - protein, 5 aa, Mycobacterium
DGAEV

SEQ ID NO: 448201 - protein, 7 aa, Mycobacterium
DGAEVTT

SEQ ID NO: 448202 - protein, 4 aa, Mycobacterium
DGAF

SEQ ID NO: 448203 - protein, 15 aa, Mycobacterium
DGAFTDEDRARRRGL

SEQ ID NO: 448204 - protein, 5 aa, Mycobacterium
DGAGA

SEQ ID NO: 448205 - protein, 9 aa, Mycobacterium
DGAGAEHRG

SEQ ID NO: 448206 - protein, 8 aa, Mycobacterium
DGAGAEIG

SEQ ID NO: 448207 - protein, 20 aa, Mycobacterium
DGAGAENRAAAARNPLYGLL

SEQ ID NO: 448208 - protein, 9 aa, Mycobacterium
DGAGAEPVK

SEQ ID NO: 448209 - protein, 10 aa, Mycobacterium
DGAGAGRALT

SEQ ID NO: 448210 - protein, 19 aa, Mycobacterium
DGAGAGTIPDPFGGPGRAP

SEQ ID NO: 448211 - protein, 11 aa, Mycobacterium
DGAGAGVGPRY

SEQ ID NO: 448212 - protein, 8 aa, Mycobacterium
DGAGAGVP

SEQ ID NO: 448213 - protein, 9 aa, Mycobacterium
DGAGAPSIR

SEQ ID NO: 448214 - protein, 9 aa, Mycobacterium
DGAGAPVPD

SEQ ID NO: 448215 - protein, 15 aa, Mycobacterium
DGAGATKTKSAGPTV

SEQ ID NO: 448216 - protein, 9 aa, Mycobacterium
DGAGDAGFE

SEQ ID NO: 448217 - protein, 9 aa, Mycobacterium
DGAGDASWE

SEQ ID NO: 448218 - protein, 9 aa, Mycobacterium
DGAGDGVPD

SEQ ID NO: 448219 - protein, 11 aa, Mycobacterium
DGAGDKPAARE

SEQ ID NO: 448220 - protein, 5 aa, Mycobacterium
DGAGE

SEQ ID NO: 448221 - protein, 10 aa, Mycobacterium
DGAGELAEGD

SEQ ID NO: 448222 - protein, 12 aa, Mycobacterium
DGAGGGSPAGSV

SEQ ID NO: 448223 - protein, 8 aa, Mycobacterium
DGAGGGWS

SEQ ID NO: 448224 - protein, 6 aa, Mycobacterium
DGAGGL

SEQ ID NO: 448225 - protein, 10 aa, Mycobacterium
DGAGGSPMEK

SEQ ID NO: 448226 - protein, 7 aa, Mycobacterium
DGAGITD

SEQ ID NO: 448227 - protein, 7 aa, Mycobacterium
DGAGITR

SEQ ID NO: 448228 - protein, 9 aa, Mycobacterium
DGAGLRPEQ

SEQ ID NO: 448229 - protein, 6 aa, Mycobacterium
DGAGPL

SEQ ID NO: 448230 - protein, 21 aa, Mycobacterium
DGAGPLHRSGVEKSRAEADLS

SEQ ID NO: 448231 - protein, 20 aa, Mycobacterium
DGAGQELSSGTTDSDGRIGD

SEQ ID NO: 448232 - protein, 16 aa, Mycobacterium
DGAGRTRNVVVLRPAT

SEQ ID NO: 448233 - protein, 19 aa, Mycobacterium
DGAGSAAGLAATSGGDPAD

SEQ ID NO: 448234 - protein, 13 aa, Mycobacterium
DGAGSPATGTARV

SEQ ID NO: 448235 - protein, 14 aa, Mycobacterium
DGAGTENRTAAAQN

SEQ ID NO: 448236 - protein, 6 aa, Mycobacterium
DGAGYI

SEQ ID NO: 448237 - protein, 10 aa, Mycobacterium
DGAHAESSTF

SEQ ID NO: 448238 - protein, 16 aa, Mycobacterium
DGAHEDEPILRIGPIG

SEQ ID NO: 448239 - protein, 15 aa, Mycobacterium
DGAHGTVSSPNGAAG

SEQ ID NO: 448240 - protein, 9 aa, Mycobacterium
DGAHHTNAT

SEQ ID NO: 448241 - protein, 6 aa, Mycobacterium
DGAHPD

SEQ ID NO: 448242 - protein, 9 aa, Mycobacterium
DGAHPPAQA

SEQ ID NO: 448243 - protein, 6 aa, Mycobacterium
DGAHRG

SEQ ID NO: 448244 - protein, 4 aa, Mycobacterium
DGAI

SEQ ID NO: 448245 - protein, 8 aa, Mycobacterium
DGAIAGPR

SEQ ID NO: 448246 - protein, 5 aa, Mycobacterium
DGAIG

SEQ ID NO: 448247 - protein, 6 aa, Mycobacterium
DGAIPS

SEQ ID NO: 448248 - protein, 11 aa, Mycobacterium
DGAKPGETDSR

SEQ ID NO: 448249 - protein, 8 aa, Mycobacterium
DGAKPVDD

SEQ ID NO: 448250 - protein, 6 aa, Mycobacterium
DGAKQF

SEQ ID NO: 448251 - protein, 8 aa, Mycobacterium
DGAKSAAA

SEQ ID NO: 448252 - protein, 9 aa, Mycobacterium
DGAKSTVND

SEQ ID NO: 448253 - protein, 13 aa, Mycobacterium
DGALAESETRTAA

SEQ ID NO: 448254 - protein, 7 aa, Mycobacterium
DGALGRQ

SEQ ID NO: 448255 - protein, 6 aa, Mycobacterium
DGALND

SEQ ID NO: 448256 - protein, 5 aa, Mycobacterium
DGALP

SEQ ID NO: 448257 - protein, 6 aa, Mycobacterium
DGALPD

SEQ ID NO: 448258 - protein, 7 aa, Mycobacterium
DGALPGS

SEQ ID NO: 448259 - protein, 13 aa, Mycobacterium
DGALRDAGLPNVT

SEQ ID NO: 448260 - protein, 4 aa, Mycobacterium
DGAM

SEQ ID NO: 448261 - protein, 15 aa, Mycobacterium
DGANATTPGGNGGAG

SEQ ID NO: 448262 - protein, 16 aa, Mycobacterium
DGANATVAGGDGRPGG

SEQ ID NO: 448263 - protein, 6 aa, Mycobacterium
DGANET

SEQ ID NO: 448264 - protein, 15 aa, Mycobacterium
DGANGSAPGQAGGAG

SEQ ID NO: 448265 - protein, 17 aa, Mycobacterium
DGANGSPNTGADGGAGG

SEQ ID NO: 448266 - protein, 15 aa, Mycobacterium
DGANGTAPGQAGGAG

SEQ ID NO: 448267 - protein, 15 aa, Mycobacterium
DGANGTATSPNGGAG

SEQ ID NO: 448268 - protein, 5 aa, Mycobacterium
DGANN

SEQ ID NO: 448269 - protein, 6 aa, Mycobacterium
DGANNM

SEQ ID NO: 448270 - protein, 8 aa, Mycobacterium
DGANPAAR

SEQ ID NO: 448271 - protein, 9 aa, Mycobacterium
DGANSAVRE

SEQ ID NO: 448272 - protein, 8 aa, Mycobacterium
DGANSKVR

SEQ ID NO: 448273 - protein, 8 aa, Mycobacterium
DGAPAASV

SEQ ID NO: 448274 - protein, 64 aa, Mycobacterium
DGAPADGLDDLDDPEEPEELSDPEEEETAEEEPADEEPADEATGEATDEPAEAAEIEEEPVDAP

SEQ ID NO: 448275 - protein, 11 aa, Mycobacterium
DGAPAEALPVS

SEQ ID NO: 448276 - protein, 7 aa, Mycobacterium
DGAPAEH

SEQ ID NO: 448277 - protein, 8 aa, Mycobacterium
DGAPAGRP

SEQ ID NO: 448278 - protein, 8 aa, Mycobacterium
DGAPAGTR

SEQ ID NO: 448279 - protein, 15 aa, Mycobacterium
DGAPAPLDSDVEGRD

SEQ ID NO: 448280 - protein, 10 aa, Mycobacterium
DGAPATTDDT

SEQ ID NO: 448281 - protein, 15 aa, Mycobacterium
DGAPCEPPHCAARYQ

SEQ ID NO: 448282 - protein, 10 aa, Mycobacterium
DGAPDTALDD

SEQ ID NO: 448283 - protein, 7 aa, Mycobacterium
DGAPELY

SEQ ID NO: 448284 - protein, 8 aa, Mycobacterium
DGAPETRA

SEQ ID NO: 448285 - protein, 6 aa, Mycobacterium
DGAPEW

SEQ ID NO: 448286 - protein, 13 aa, Mycobacterium
DGAPFPRTGEHTG

SEQ ID NO: 448287 - protein, 9 aa, Mycobacterium
DGAPGDPGV

SEQ ID NO: 448288 - protein, 5 aa, Mycobacterium
DGAPI

SEQ ID NO: 448289 - protein, 10 aa, Mycobacterium
DGAPISPRDR

SEQ ID NO: 448290 - protein, 16 aa, Mycobacterium
DGAPLDPAPPTPRGAA

SEQ ID NO: 448291 - protein, 28 aa, Mycobacterium
DGAPLDQDDFEAKREQERAAMADGAERP

SEQ ID NO: 448292 - protein, 8 aa, Mycobacterium
DGAPLPDA

SEQ ID NO: 448293 - protein, 9 aa, Mycobacterium
DGAPMNPED

SEQ ID NO: 448294 - protein, 9 aa, Mycobacterium
DGAPPGAGS

SEQ ID NO: 448295 - protein, 9 aa, Mycobacterium
DGAPPGPVG

SEQ ID NO: 448296 - protein, 27 aa, Mycobacterium
DGAPPPDQTTLATGDAGARVACGVITG

SEQ ID NO: 448297 - protein, 8 aa, Mycobacterium
DGAPPRVG

SEQ ID NO: 448298 - protein, 6 aa, Mycobacterium
DGAPQL

SEQ ID NO: 448299 - protein, 7 aa, Mycobacterium
DGAPQLY

SEQ ID NO: 448300 - protein, 8 aa, Mycobacterium
DGAPRHPL

SEQ ID NO: 448301 - protein, 10 aa, Mycobacterium
DGAPRPPELL

SEQ ID NO: 448302 - protein, 10 aa, Mycobacterium
DGAPRYPAAE

SEQ ID NO: 448303 - protein, 17 aa, Mycobacterium
DGAPSAVEQARHNAKTR

SEQ ID NO: 448304 - protein, 14 aa, Mycobacterium
DGAPSGPGAQASGL

SEQ ID NO: 448305 - protein, 10 aa, Mycobacterium
DGAPSTGQHA

SEQ ID NO: 448306 - protein, 14 aa, Mycobacterium
DGAPTGPGAEASGL

SEQ ID NO: 448307 - protein, 6 aa, Mycobacterium
DGAPVD

SEQ ID NO: 448308 - protein, 14 aa, Mycobacterium
DGAPWRSGRSARNY

SEQ ID NO: 448309 - protein, 6 aa, Mycobacterium
DGAPYK

SEQ ID NO: 448310 - protein, 10 aa, Mycobacterium
DGAQAGPGVH

SEQ ID NO: 448311 - protein, 11 aa, Mycobacterium
DGAQDAAPTVR

SEQ ID NO: 448312 - protein, 5 aa, Mycobacterium
DGAQI

SEQ ID NO: 448313 - protein, 8 aa, Mycobacterium
DGAQLDAK

SEQ ID NO: 448314 - protein, 10 aa, Mycobacterium
DGAQLSAHSA

SEQ ID NO: 448315 - protein, 9 aa, Mycobacterium
DGAQPEHPR

SEQ ID NO: 448316 - protein, 7 aa, Mycobacterium
DGAQQDR

SEQ ID NO: 448317 - protein, 5 aa, Mycobacterium
DGAQR

SEQ ID NO: 448318 - protein, 7 aa, Mycobacterium
DGAQRDI

SEQ ID NO: 448319 - protein, 8 aa, Mycobacterium
DGAQSGAP

SEQ ID NO: 448320 - protein, 18 aa, Mycobacterium
DGAQSVNNQPHDLVVVPV

SEQ ID NO: 448321 - protein, 6 aa, Mycobacterium
DGAQTP

SEQ ID NO: 448322 - protein, 6 aa, Mycobacterium
DGAQTR

SEQ ID NO: 448323 - protein, 7 aa, Mycobacterium
DGAQTVS

SEQ ID NO: 448324 - protein, 6 aa, Mycobacterium
DGAQVS

SEQ ID NO: 448325 - protein, 10 aa, Mycobacterium
DGARARERVA

SEQ ID NO: 448326 - protein, 7 aa, Mycobacterium
DGARARG

SEQ ID NO: 448327 - protein, 5 aa, Mycobacterium
DGARE

SEQ ID NO: 448328 - protein, 17 aa, Mycobacterium
DGARGGGAGRRTGAHLP

SEQ ID NO: 448329 - protein, 5 aa, Mycobacterium
DGARI

SEQ ID NO: 448330 - protein, 5 aa, Mycobacterium
DGARL

SEQ ID NO: 448331 - protein, 11 aa, Mycobacterium
DGARLAKRDGA

SEQ ID NO: 448332 - protein, 10 aa, Mycobacterium
DGARLQPGEP

SEQ ID NO: 448333 - protein, 9 aa, Mycobacterium
DGARLQTGE

SEQ ID NO: 448334 - protein, 6 aa, Mycobacterium
DGARPD

SEQ ID NO: 448335 - protein, 8 aa, Mycobacterium
DGARPDRK

SEQ ID NO: 448336 - protein, 8 aa, Mycobacterium
DGARQRAH

SEQ ID NO: 448337 - protein, 11 aa, Mycobacterium
DGARRANDDLA

SEQ ID NO: 448338 - protein, 17 aa, Mycobacterium
DGARRRGDDHAPAESTA

SEQ ID NO: 448339 - protein, 7 aa, Mycobacterium
DGARRTL

SEQ ID NO: 448340 - protein, 6 aa, Mycobacterium
DGARRV

SEQ ID NO: 448341 - protein, 8 aa, Mycobacterium
DGARSRGI

SEQ ID NO: 448342 - protein, 8 aa, Mycobacterium
DGARSRGV

SEQ ID NO: 448343 - protein, 10 aa, Mycobacterium
DGARTGAAAT

SEQ ID NO: 448344 - protein, 8 aa, Mycobacterium
DGARTGAM

SEQ ID NO: 448345 - protein, 17 aa, Mycobacterium
DGARVAEDGYQQTENGY

SEQ ID NO: 448346 - protein, 14 aa, Mycobacterium
DGARVGKKRHTVST

SEQ ID NO: 448347 - protein, 6 aa, Mycobacterium
DGARVT

SEQ ID NO: 448348 - protein, 4 aa, Mycobacterium
DGAS

SEQ ID NO: 448349 - protein, 9 aa, Mycobacterium
DGASAYGNK

SEQ ID NO: 448350 - protein, 10 aa, Mycobacterium
DGASELSGEC

SEQ ID NO: 448351 - protein, 7 aa, Mycobacterium
DGASLEA

SEQ ID NO: 448352 - protein, 23 aa, Mycobacterium
DGASPQNGGNGPAGSGPRSDDAW

SEQ ID NO: 448353 - protein, 8 aa, Mycobacterium
DGASPVAG

SEQ ID NO: 448354 - protein, 9 aa, Mycobacterium
DGASQRKVR

SEQ ID NO: 448355 - protein, 9 aa, Mycobacterium
DGASRAEVA

SEQ ID NO: 448356 - protein, 14 aa, Mycobacterium
DGASSVRLVNQTGY

SEQ ID NO: 448357 - protein, 8 aa, Mycobacterium
DGASTLED

SEQ ID NO: 448358 - protein, 7 aa, Mycobacterium
DGASYTE

SEQ ID NO: 448359 - protein, 7 aa, Mycobacterium
DGATADL

SEQ ID NO: 448360 - protein, 8 aa, Mycobacterium
DGATDAGG

SEQ ID NO: 448361 - protein, 6 aa, Mycobacterium
DGATEA

SEQ ID NO: 448362 - protein, 7 aa, Mycobacterium
DGATEIA

SEQ ID NO: 448363 - protein, 17 aa, Mycobacterium
DGATEIGGSLPVNTDGG

SEQ ID NO: 448364 - protein, 9 aa, Mycobacterium
DGATEITGS

SEQ ID NO: 448365 - protein, 15 aa, Mycobacterium
DGATGAAGQNGGDGG

SEQ ID NO: 448366 - protein, 8 aa, Mycobacterium
DGATKIGG

SEQ ID NO: 448367 - protein, 17 aa, Mycobacterium
DGATKPAAVVESIVRYV

SEQ ID NO: 448368 - protein, 5 aa, Mycobacterium
DGATL

SEQ ID NO: 448369 - protein, 11 aa, Mycobacterium
DGATLKDPHEV

SEQ ID NO: 448370 - protein, 6 aa, Mycobacterium
DGATLS

SEQ ID NO: 448371 - protein, 8 aa, Mycobacterium
DGATPIRG

SEQ ID NO: 448372 - protein, 11 aa, Mycobacterium
DGATSEGDAHE

SEQ ID NO: 448373 - protein, 9 aa, Mycobacterium
DGATSEGDF

SEQ ID NO: 448374 - protein, 11 aa, Mycobacterium
DGATSEGYSED

SEQ ID NO: 448375 - protein, 8 aa, Mycobacterium
DGATSFHG

SEQ ID NO: 448376 - protein, 10 aa, Mycobacterium
DGATSQGDVS

SEQ ID NO: 448377 - protein, 11 aa, Mycobacterium
DGATSTASGTL

SEQ ID NO: 448378 - protein, 9 aa, Mycobacterium
DGATSTGDV

SEQ ID NO: 448379 - protein, 8 aa, Mycobacterium
DGATSVGD

SEQ ID NO: 448380 - protein, 8 aa, Mycobacterium
DGATTPVT

SEQ ID NO: 448381 - protein, 8 aa, Mycobacterium
DGATTTLQ

SEQ ID NO: 448382 - protein, 8 aa, Mycobacterium
DGATVDNP

SEQ ID NO: 448383 - protein, 6 aa, Mycobacterium
DGATVG

SEQ ID NO: 448384 - protein, 5 aa, Mycobacterium
DGATY

SEQ ID NO: 448385 - protein, 5 aa, Mycobacterium
DGAVD

SEQ ID NO: 448386 - protein, 12 aa, Mycobacterium
DGAVDDAARQCA

SEQ ID NO: 448387 - protein, 11 aa, Mycobacterium
DGAVDDDARAC

SEQ ID NO: 448388 - protein, 6 aa, Mycobacterium
DGAVDG

SEQ ID NO: 448389 - protein, 14 aa, Mycobacterium
DGAVPEPGEFTAED

SEQ ID NO: 448390 - protein, 9 aa, Mycobacterium
DGAVPTVSD

SEQ ID NO: 448391 - protein, 25 aa, Mycobacterium
DGAVQQAEELGAAETRVRGGRADDP

SEQ ID NO: 448392 - protein, 8 aa, Mycobacterium
DGAVSPAA

SEQ ID NO: 448393 - protein, 20 aa, Mycobacterium
DGAWSIPKGEYADGEDPWAA

SEQ ID NO: 448394 - protein, 19 aa, Mycobacterium
DGAWSVPKGEYTDDEDRWA

SEQ ID NO: 448395 - protein, 11 aa, Mycobacterium
DGAYAEASNQD

SEQ ID NO: 448396 - protein, 9 aa, Mycobacterium
DGAYGAADA

SEQ ID NO: 448397 - protein, 6 aa, Mycobacterium
DGAYGD

SEQ ID NO: 448398 - protein, 11 aa, Mycobacterium
DGAYGEAKSAL

SEQ ID NO: 448399 - protein, 13 aa, Mycobacterium
DGAYGEAKSALDA

SEQ ID NO: 448400 - protein, 10 aa, Mycobacterium
DGAYGESKAA

SEQ ID NO: 448401 - protein, 11 aa, Mycobacterium
DGAYGESKSAL

SEQ ID NO: 448402 - protein, 13 aa, Mycobacterium
DGAYGNGGWGGNK

SEQ ID NO: 448403 - protein, 5 aa, Mycobacterium
DGAYS

SEQ ID NO: 448404 - protein, 8 aa, Mycobacterium
DGAYTGAG

SEQ ID NO: 448405 - protein, 12 aa, Mycobacterium
DGCAARTPAAAA

SEQ ID NO: 448406 - protein, 11 aa, Mycobacterium
DGCDCRKPRPG

SEQ ID NO: 448407 - protein, 13 aa, Mycobacterium
DGCETAAGAAAAL

SEQ ID NO: 448408 - protein, 6 aa, Mycobacterium
DGCGDI

SEQ ID NO: 448409 - protein, 11 aa, Mycobacterium
DGCGGATPGRG

SEQ ID NO: 448410 - protein, 4 aa, Mycobacterium
DGCP

SEQ ID NO: 448411 - protein, 6 aa, Mycobacterium
DGCTEG

SEQ ID NO: 448412 - protein, 5 aa, Mycobacterium
DGDAA

SEQ ID NO: 448413 - protein, 24 aa, Mycobacterium
DGDAAGAQGISGGSVGAGSVGGAV

SEQ ID NO: 448414 - protein, 9 aa, Mycobacterium
DGDAARALA

SEQ ID NO: 448415 - protein, 7 aa, Mycobacterium
DGDAARR

SEQ ID NO: 448416 - protein, 9 aa, Mycobacterium
DGDAASGTQ

SEQ ID NO: 448417 - protein, 6 aa, Mycobacterium
DGDAAV

SEQ ID NO: 448418 - protein, 6 aa, Mycobacterium
DGDADT

SEQ ID NO: 448419 - protein, 8 aa, Mycobacterium
DGDAEPVE

SEQ ID NO: 448420 - protein, 9 aa, Mycobacterium
DGDAEQAGE

SEQ ID NO: 448421 - protein, 10 aa, Mycobacterium
DGDAERAEKV

SEQ ID NO: 448422 - protein, 15 aa, Mycobacterium
DGDAERGGVDIGDPD

SEQ ID NO: 448423 - protein, 9 aa, Mycobacterium
DGDAGELEA

SEQ ID NO: 448424 - protein, 11 aa, Mycobacterium
DGDAGESSEAI

SEQ ID NO: 448425 - protein, 8 aa, Mycobacterium
DGDAGKID

SEQ ID NO: 448426 - protein, 12 aa, Mycobacterium
DGDAGPPTDPYQ

SEQ ID NO: 448427 - protein, 6 aa, Mycobacterium
DGDAGR

SEQ ID NO: 448428 - protein, 7 aa, Mycobacterium
DGDAGSV

SEQ ID NO: 448429 - protein, 5 aa, Mycobacterium
DGDAL

SEQ ID NO: 448430 - protein, 6 aa, Mycobacterium
DGDALR

SEQ ID NO: 448431 - protein, 10 aa, Mycobacterium
DGDANGTAID

SEQ ID NO: 448432 - protein, 6 aa, Mycobacterium
DGDAPH

SEQ ID NO: 448433 - protein, 8 aa, Mycobacterium
DGDAPPTA

SEQ ID NO: 448434 - protein, 6 aa, Mycobacterium
DGDARN

SEQ ID NO: 448435 - protein, 7 aa, Mycobacterium
DGDARNV

SEQ ID NO: 448436 - protein, 14 aa, Mycobacterium
DGDARYGGKGVTKA

SEQ ID NO: 448437 - protein, 17 aa, Mycobacterium
DGDASRGGVDISAPGAV

SEQ ID NO: 448438 - protein, 6 aa, Mycobacterium
DGDATA

SEQ ID NO: 448439 - protein, 6 aa, Mycobacterium
DGDATD

SEQ ID NO: 448440 - protein, 7 aa, Mycobacterium
DGDATDL

SEQ ID NO: 448441 - protein, 6 aa, Mycobacterium
DGDATG

SEQ ID NO: 448442 - protein, 8 aa, Mycobacterium
DGDAVEEA

SEQ ID NO: 448443 - protein, 5 aa, Mycobacterium
DGDAY

SEQ ID NO: 448444 - protein, 4 aa, Mycobacterium
DGDD

SEQ ID NO: 448445 - protein, 21 aa, Mycobacterium
DGDDALARDPMTGERDIRSED

SEQ ID NO: 448446 - protein, 8 aa, Mycobacterium
DGDDDAVR

SEQ ID NO: 448447 - protein, 68 aa, Mycobacterium
DGDDDGGDGGDDGPPEQWGPGPLPNAGPPWGPAPQVPNGPSGLQQGVDQAGTTYQQASGAVNQTDDKL

SEQ ID NO: 448448 - protein, 6 aa, Mycobacterium
DGDDDL

SEQ ID NO: 448449 - protein, 13 aa, Mycobacterium
DGDDEDGEIRSSM

SEQ ID NO: 448450 - protein, 8 aa, Mycobacterium
DGDDEETL

SEQ ID NO: 448451 - protein, 19 aa, Mycobacterium
DGDDEQLGWSAGDGAAPVT

SEQ ID NO: 448452 - protein, 9 aa, Mycobacterium
DGDDGKARA

SEQ ID NO: 448453 - protein, 8 aa, Mycobacterium
DGDDGLGP

SEQ ID NO: 448454 - protein, 17 aa, Mycobacterium
DGDDLGPMPPAPTGERL

SEQ ID NO: 448455 - protein, 9 aa, Mycobacterium
DGDDPASDW

SEQ ID NO: 448456 - protein, 9 aa, Mycobacterium
DGDDPASEW

SEQ ID NO: 448457 - protein, 11 aa, Mycobacterium
DGDDPDIGSRR

SEQ ID NO: 448458 - protein, 20 aa, Mycobacterium
DGDDPDLGARRVDPARDRAG

SEQ ID NO: 448459 - protein, 9 aa, Mycobacterium
DGDDPRREI

SEQ ID NO: 448460 - protein, 9 aa, Mycobacterium
DGDDREARE

SEQ ID NO: 448461 - protein, 12 aa, Mycobacterium
DGDDSATADLSR

SEQ ID NO: 448462 - protein, 6 aa, Mycobacterium
DGDDSV

SEQ ID NO: 448463 - protein, 23 aa, Mycobacterium
DGDDTNGVARQGFPPSRPTRLSR

SEQ ID NO: 448464 - protein, 8 aa, Mycobacterium
DGDEADRV

SEQ ID NO: 448465 - protein, 10 aa, Mycobacterium
DGDEARGGVD

SEQ ID NO: 448466 - protein, 7 aa, Mycobacterium
DGDEATG

SEQ ID NO: 448467 - protein, 9 aa, Mycobacterium
DGDEATGAN

SEQ ID NO: 448468 - protein, 8 aa, Mycobacterium
DGDEATGT

SEQ ID NO: 448469 - protein, 7 aa, Mycobacterium
DGDEDAV

SEQ ID NO: 448470 - protein, 6 aa, Mycobacterium
DGDEDS

SEQ ID NO: 448471 - protein, 6 aa, Mycobacterium
DGDEGF

SEQ ID NO: 448472 - protein, 13 aa, Mycobacterium
DGDEGLDEPSVPP

SEQ ID NO: 448473 - protein, 6 aa, Mycobacterium
DGDELD

SEQ ID NO: 448474 - protein, 8 aa, Mycobacterium
DGDELPEG

SEQ ID NO: 448475 - protein, 9 aa, Mycobacterium
DGDEPGGGR

SEQ ID NO: 448476 - protein, 9 aa, Mycobacterium
DGDEPSGED

SEQ ID NO: 448477 - protein, 11 aa, Mycobacterium
DGDEQARARPI

SEQ ID NO: 448478 - protein, 6 aa, Mycobacterium
DGDERM

SEQ ID NO: 448479 - protein, 11 aa, Mycobacterium
DGDERSPREQI

SEQ ID NO: 448480 - protein, 7 aa, Mycobacterium
DGDERVD

SEQ ID NO: 448481 - protein, 17 aa, Mycobacterium
DGDESRGGVDISRPGAV

SEQ ID NO: 448482 - protein, 6 aa, Mycobacterium
DGDEVK

SEQ ID NO: 448483 - protein, 7 aa, Mycobacterium
DGDEVPA

SEQ ID NO: 448484 - protein, 10 aa, Mycobacterium
DGDFRSDEGS

SEQ ID NO: 448485 - protein, 6 aa, Mycobacterium
DGDFSE

SEQ ID NO: 448486 - protein, 6 aa, Mycobacterium
DGDFSS

SEQ ID NO: 448487 - protein, 7 aa, Mycobacterium
DGDGAFT

SEQ ID NO: 448488 - protein, 28 aa, Mycobacterium
DGDGDAERAFSTTDSGNSVYADTTGDGR

SEQ ID NO: 448489 - protein, 28 aa, Mycobacterium
DGDGDGIAEAARPVASPQVSAENPVEGL

SEQ ID NO: 448490 - protein, 6 aa, Mycobacterium
DGDGDR

SEQ ID NO: 448491 - protein, 5 aa, Mycobacterium
DGDGG

SEQ ID NO: 448492 - protein, 7 aa, Mycobacterium
DGDGGAE

SEQ ID NO: 448493 - protein, 12 aa, Mycobacterium
DGDGGDPDTTTV

SEQ ID NO: 448494 - protein, 8 aa, Mycobacterium
DGDGGLRE

SEQ ID NO: 448495 - protein, 8 aa, Mycobacterium
DGDGGPWR

SEQ ID NO: 448496 - protein, 8 aa, Mycobacterium
DGDGGTGC

SEQ ID NO: 448497 - protein, 5 aa, Mycobacterium
DGDGK

SEQ ID NO: 448498 - protein, 7 aa, Mycobacterium
DGDGKAK

SEQ ID NO: 448499 - protein, 7 aa, Mycobacterium
DGDGKAR

SEQ ID NO: 448500 - protein, 5 aa, Mycobacterium
DGDGL

SEQ ID NO: 448501 - protein, 16 aa, Mycobacterium
DGDGLAPYDPALTPAQ

SEQ ID NO: 448502 - protein, 10 aa, Mycobacterium
DGDGLPDASG

SEQ ID NO: 448503 - protein, 8 aa, Mycobacterium
DGDGMPDD

SEQ ID NO: 448504 - protein, 6 aa, Mycobacterium
DGDGNN

SEQ ID NO: 448505 - protein, 9 aa, Mycobacterium
DGDGNVRPA

SEQ ID NO: 448506 - protein, 11 aa, Mycobacterium
DGDGPDGAGIP

SEQ ID NO: 448507 - protein, 8 aa, Mycobacterium
DGDGPGAV

SEQ ID NO: 448508 - protein, 8 aa, Mycobacterium
DGDGQAVG

SEQ ID NO: 448509 - protein, 7 aa, Mycobacterium
DGDGQPL

SEQ ID NO: 448510 - protein, 8 aa, Mycobacterium
DGDGQTVV

SEQ ID NO: 448511 - protein, 9 aa, Mycobacterium
DGDGRADVD

SEQ ID NO: 448512 - protein, 8 aa, Mycobacterium
DGDGRPVR

SEQ ID NO: 448513 - protein, 7 aa, Mycobacterium
DGDGRQL

SEQ ID NO: 448514 - protein, 8 aa, Mycobacterium
DGDGRTDD

SEQ ID NO: 448515 - protein, 18 aa, Mycobacterium
DGDGRTVARGQVRLQNLE

SEQ ID NO: 448516 - protein, 8 aa, Mycobacterium
DGDGRTVV

SEQ ID NO: 448517 - protein, 7 aa, Mycobacterium
DGDGRYI

SEQ ID NO: 448518 - protein, 5 aa, Mycobacterium
DGDGS

SEQ ID NO: 448519 - protein, 8 aa, Mycobacterium
DGDGSADH

SEQ ID NO: 448520 - protein, 9 aa, Mycobacterium
DGDGSPEAV

SEQ ID NO: 448521 - protein, 6 aa, Mycobacterium
DGDGTI

SEQ ID NO: 448522 - protein, 6 aa, Mycobacterium
DGDGTQ

SEQ ID NO: 448523 - protein, 9 aa, Mycobacterium
DGDGTRADP

SEQ ID NO: 448524 - protein, 9 aa, Mycobacterium
DGDGVQATT

SEQ ID NO: 448525 - protein, 9 aa, Mycobacterium
DGDHESNPI

SEQ ID NO: 448526 - protein, 5 aa, Mycobacterium
DGDHH

SEQ ID NO: 448527 - protein, 11 aa, Mycobacterium
DGDHHRKDRRQ

SEQ ID NO: 448528 - protein, 7 aa, Mycobacterium
DGDHPHE

SEQ ID NO: 448529 - protein, 10 aa, Mycobacterium
DGDHSNLDRA

SEQ ID NO: 448530 - protein, 6 aa, Mycobacterium
DGDHVE

SEQ ID NO: 448531 - protein, 5 aa, Mycobacterium
DGDIA

SEQ ID NO: 448532 - protein, 8 aa, Mycobacterium
DGDIAETQ

SEQ ID NO: 448533 - protein, 15 aa, Mycobacterium
DGDIEEGVTSEASSL

SEQ ID NO: 448534 - protein, 20 aa, Mycobacterium
DGDIEEGVTSEASSLAGTQQ

SEQ ID NO: 448535 - protein, 7 aa, Mycobacterium
DGDKASS

SEQ ID NO: 448536 - protein, 9 aa, Mycobacterium
DGDKGDTET

SEQ ID NO: 448537 - protein, 7 aa, Mycobacterium
DGDKGLD

SEQ ID NO: 448538 - protein, 8 aa, Mycobacterium
DGDKLTDD

SEQ ID NO: 448539 - protein, 9 aa, Mycobacterium
DGDLASNQH

SEQ ID NO: 448540 - protein, 5 aa, Mycobacterium
DGDLG

SEQ ID NO: 448541 - protein, 6 aa, Mycobacterium
DGDLPA

SEQ ID NO: 448542 - protein, 4 aa, Mycobacterium
DGDM

SEQ ID NO: 448543 - protein, 20 aa, Mycobacterium
DGDMEEGVTSEASSLAGTQQ

SEQ ID NO: 448544 - protein, 27 aa, Mycobacterium
DGDMGEPAPLRRRDGTSVYTRHGSTTY

SEQ ID NO: 448545 - protein, 7 aa, Mycobacterium
DGDMPPR

SEQ ID NO: 448546 - protein, 26 aa, Mycobacterium
DGDNAGDIVSGDGAVLGDGNTTNNGD

SEQ ID NO: 448547 - protein, 10 aa, Mycobacterium
DGDNARGGVD

SEQ ID NO: 448548 - protein, 25 aa, Mycobacterium
DGDNDGDIVSGDGAVLGDGNTMNNG

SEQ ID NO: 448549 - protein, 8 aa, Mycobacterium
DGDNEETL

SEQ ID NO: 448550 - protein, 9 aa, Mycobacterium
DGDNPHEVP

SEQ ID NO: 448551 - protein, 7 aa, Mycobacterium
DGDPAAE

SEQ ID NO: 448552 - protein, 7 aa, Mycobacterium
DGDPAAL

SEQ ID NO: 448553 - protein, 8 aa, Mycobacterium
DGDPADRF

SEQ ID NO: 448554 - protein, 6 aa, Mycobacterium
DGDPAH

SEQ ID NO: 448555 - protein, 8 aa, Mycobacterium
DGDPAQLA

SEQ ID NO: 448556 - protein, 8 aa, Mycobacterium
DGDPASET

SEQ ID NO: 448557 - protein, 10 aa, Mycobacterium
DGDPASPHYN

SEQ ID NO: 448558 - protein, 5 aa, Mycobacterium
DGDPD

SEQ ID NO: 448559 - protein, 7 aa, Mycobacterium
DGDPDAL

SEQ ID NO: 448560 - protein, 6 aa, Mycobacterium
DGDPDL

SEQ ID NO: 448561 - protein, 28 aa, Mycobacterium
DGDPETLDAPGQAGKLNDSPVYRLHSCP

SEQ ID NO: 448562 - protein, 6 aa, Mycobacterium
DGDPGA

SEQ ID NO: 448563 - protein, 14 aa, Mycobacterium
DGDPGGADGEAALP

SEQ ID NO: 448564 - protein, 8 aa, Mycobacterium
DGDPGGVA

SEQ ID NO: 448565 - protein, 13 aa, Mycobacterium
DGDPGSAEAKGAI

SEQ ID NO: 448566 - protein, 12 aa, Mycobacterium
DGDPKNATPARR

SEQ ID NO: 448567 - protein, 10 aa, Mycobacterium
DGDPKNDRRE

SEQ ID NO: 448568 - protein, 12 aa, Mycobacterium
DGDPKSREDDTV

SEQ ID NO: 448569 - protein, 5 aa, Mycobacterium
DGDPL

SEQ ID NO: 448570 - protein, 7 aa, Mycobacterium
DGDPLGA

SEQ ID NO: 448571 - protein, 8 aa, Mycobacterium
DGDPLSDI

SEQ ID NO: 448572 - protein, 8 aa, Mycobacterium
DGDPPREL

SEQ ID NO: 448573 - protein, 7 aa, Mycobacterium
DGDPQAV

SEQ ID NO: 448574 - protein, 8 aa, Mycobacterium
DGDPRRVS

SEQ ID NO: 448575 - protein, 10 aa, Mycobacterium
DGDPRRVSDR

SEQ ID NO: 448576 - protein, 7 aa, Mycobacterium
DGDPSLP

SEQ ID NO: 448577 - protein, 7 aa, Mycobacterium
DGDPSRP

SEQ ID NO: 448578 - protein, 7 aa, Mycobacterium
DGDPTKG

SEQ ID NO: 448579 - protein, 6 aa, Mycobacterium
DGDPTM

SEQ ID NO: 448580 - protein, 10 aa, Mycobacterium
DGDPTNNRRE

SEQ ID NO: 448581 - protein, 6 aa, Mycobacterium
DGDPVD

SEQ ID NO: 448582 - protein, 13 aa, Mycobacterium
DGDPVETTSGDRG

SEQ ID NO: 448583 - protein, 10 aa, Mycobacterium
DGDPVGFDGS

SEQ ID NO: 448584 - protein, 9 aa, Mycobacterium
DGDQDPYSA

SEQ ID NO: 448585 - protein, 10 aa, Mycobacterium
DGDQDPYTAA

SEQ ID NO: 448586 - protein, 8 aa, Mycobacterium
DGDQGPAT

SEQ ID NO: 448587 - protein, 11 aa, Mycobacterium
DGDQHRSDRRQ

SEQ ID NO: 448588 - protein, 10 aa, Mycobacterium
DGDQHRTDRR

SEQ ID NO: 448589 - protein, 10 aa, Mycobacterium
DGDQHRTERR

SEQ ID NO: 448590 - protein, 5 aa, Mycobacterium
DGDQR

SEQ ID NO: 448591 - protein, 8 aa, Mycobacterium
DGDQRSLD

SEQ ID NO: 448592 - protein, 23 aa, Mycobacterium
DGDQSAQAGDPKPVPEGSAGVER

SEQ ID NO: 448593 - protein, 5 aa, Mycobacterium
DGDQT

SEQ ID NO: 448594 - protein, 8 aa, Mycobacterium
DGDRAASP

SEQ ID NO: 448595 - protein, 9 aa, Mycobacterium
DGDRAREGV

SEQ ID NO: 448596 - protein, 7 aa, Mycobacterium
DGDREGE

SEQ ID NO: 448597 - protein, 5 aa, Mycobacterium
DGDRG

SEQ ID NO: 448598 - protein, 6 aa, Mycobacterium
DGDRIT

SEQ ID NO: 448599 - protein, 5 aa, Mycobacterium
DGDRL

SEQ ID NO: 448600 - protein, 8 aa, Mycobacterium
DGDRLTDA

SEQ ID NO: 448601 - protein, 8 aa, Mycobacterium
DGDRLTDE

SEQ ID NO: 448602 - protein, 6 aa, Mycobacterium
DGDRMK

SEQ ID NO: 448603 - protein, 5 aa, Mycobacterium
DGDRP

SEQ ID NO: 448604 - protein, 6 aa, Mycobacterium
DGDRPH

SEQ ID NO: 448605 - protein, 8 aa, Mycobacterium
DGDRPLEM

SEQ ID NO: 448606 - protein, 6 aa, Mycobacterium
DGDRPV

SEQ ID NO: 448607 - protein, 9 aa, Mycobacterium
DGDRRGVGG

SEQ ID NO: 448608 - protein, 7 aa, Mycobacterium
DGDRVEA

SEQ ID NO: 448609 - protein, 12 aa, Mycobacterium
DGDRYRSRALPS

SEQ ID NO: 448610 - protein, 8 aa, Mycobacterium
DGDSPAGL

SEQ ID NO: 448611 - protein, 7 aa, Mycobacterium
DGDSRNV

SEQ ID NO: 448612 - protein, 5 aa, Mycobacterium
DGDTA

SEQ ID NO: 448613 - protein, 9 aa, Mycobacterium
DGDTAEART

SEQ ID NO: 448614 - protein, 15 aa, Mycobacterium
DGDTAKPSGRMTDEE

SEQ ID NO: 448615 - protein, 12 aa, Mycobacterium
DGDTAPLQASGK

SEQ ID NO: 448616 - protein, 22 aa, Mycobacterium
DGDTAQQEPGTGDAETKSETES

SEQ ID NO: 448617 - protein, 7 aa, Mycobacterium
DGDTASS

SEQ ID NO: 448618 - protein, 7 aa, Mycobacterium
DGDTATA

SEQ ID NO: 448619 - protein, 7 aa, Mycobacterium
DGDTATV

SEQ ID NO: 448620 - protein, 8 aa, Mycobacterium
DGDTGLTQ

SEQ ID NO: 448621 - protein, 17 aa, Mycobacterium
DGDTGRTWGAGQEIRGP

SEQ ID NO: 448622 - protein, 8 aa, Mycobacterium
DGDTGTVA

SEQ ID NO: 448623 - protein, 9 aa, Mycobacterium
DGDTGVFPS

SEQ ID NO: 448624 - protein, 19 aa, Mycobacterium
DGDTHTGQAAGAVDSDPDY

SEQ ID NO: 448625 - protein, 6 aa, Mycobacterium
DGDTID

SEQ ID NO: 448626 - protein, 7 aa, Mycobacterium
DGDTIDV

SEQ ID NO: 448627 - protein, 7 aa, Mycobacterium
DGDTRNV

SEQ ID NO: 448628 - protein, 13 aa, Mycobacterium
DGDTSGGGQQAAL

SEQ ID NO: 448629 - protein, 8 aa, Mycobacterium
DGDTSTRQ

SEQ ID NO: 448630 - protein, 6 aa, Mycobacterium
DGDTVT

SEQ ID NO: 448631 - protein, 7 aa, Mycobacterium
DGDTYAP

SEQ ID NO: 448632 - protein, 4 aa, Mycobacterium
DGDV

SEQ ID NO: 448633 - protein, 9 aa, Mycobacterium
DGDVASNQH

SEQ ID NO: 448634 - protein, 6 aa, Mycobacterium
DGDVDD

SEQ ID NO: 448635 - protein, 7 aa, Mycobacterium
DGDVNDE

SEQ ID NO: 448636 - protein, 8 aa, Mycobacterium
DGDVNDED

SEQ ID NO: 448637 - protein, 13 aa, Mycobacterium
DGDVQSDTVAQGY

SEQ ID NO: 448638 - protein, 5 aa, Mycobacterium
DGDVR

SEQ ID NO: 448639 - protein, 8 aa, Mycobacterium
DGDVRPVK

SEQ ID NO: 448640 - protein, 5 aa, Mycobacterium
DGDVS

SEQ ID NO: 448641 - protein, 8 aa, Mycobacterium
DGDVSDED

SEQ ID NO: 448642 - protein, 8 aa, Mycobacterium
DGDVSRAD

SEQ ID NO: 448643 - protein, 6 aa, Mycobacterium
DGDVTA

SEQ ID NO: 448644 - protein, 6 aa, Mycobacterium
DGDYGE

SEQ ID NO: 448645 - protein, 6 aa, Mycobacterium
DGDYGP

SEQ ID NO: 448646 - protein, 14 aa, Mycobacterium
DGDYSAVPDVEVIT

SEQ ID NO: 448647 - protein, 11 aa, Mycobacterium
DGDYSDEECAR

SEQ ID NO: 448648 - protein, 6 aa, Mycobacterium
DGEAAA

SEQ ID NO: 448649 - protein, 8 aa, Mycobacterium
DGEAAATA

SEQ ID NO: 448650 - protein, 6 aa, Mycobacterium
DGEAAI

SEQ ID NO: 448651 - protein, 8 aa, Mycobacterium
DGEAARTV

SEQ ID NO: 448652 - protein, 7 aa, Mycobacterium
DGEADDL

SEQ ID NO: 448653 - protein, 8 aa, Mycobacterium
DGEADPAG

SEQ ID NO: 448654 - protein, 6 aa, Mycobacterium
DGEAGR

SEQ ID NO: 448655 - protein, 5 aa, Mycobacterium
DGEAL

SEQ ID NO: 448656 - protein, 8 aa, Mycobacterium
DGEALARQ

SEQ ID NO: 448657 - protein, 6 aa, Mycobacterium
DGEALS

SEQ ID NO: 448658 - protein, 16 aa, Mycobacterium
DGEAMPQQAVTNDDRG

SEQ ID NO: 448659 - protein, 8 aa, Mycobacterium
DGEAPPDI

SEQ ID NO: 448660 - protein, 10 aa, Mycobacterium
DGEATADETV

SEQ ID NO: 448661 - protein, 7 aa, Mycobacterium
DGEATDR

SEQ ID NO: 448662 - protein, 8 aa, Mycobacterium
DGEATEHA

SEQ ID NO: 448663 - protein, 8 aa, Mycobacterium
DGEAVGDA

SEQ ID NO: 448664 - protein, 6 aa, Mycobacterium
DGEAYR

SEQ ID NO: 448665 - protein, 8 aa, Mycobacterium
DGEAYREA

SEQ ID NO: 448666 - protein, 11 aa, Mycobacterium
DGECCGSGGEG

SEQ ID NO: 448667 - protein, 7 aa, Mycobacterium
DGECGTE

SEQ ID NO: 448668 - protein, 9 aa, Mycobacterium
DGECTECGA

SEQ ID NO: 448669 - protein, 4 aa, Mycobacterium
DGED

SEQ ID NO: 448670 - protein, 10 aa, Mycobacterium
DGEDADRHYR

SEQ ID NO: 448671 - protein, 10 aa, Mycobacterium
DGEDAERHYR

SEQ ID NO: 448672 - protein, 9 aa, Mycobacterium
DGEDHRRRR

SEQ ID NO: 448673 - protein, 8 aa, Mycobacterium
DGEDLASS

SEQ ID NO: 448674 - protein, 15 aa, Mycobacterium
DGEDPLDASGVHPES

SEQ ID NO: 448675 - protein, 16 aa, Mycobacterium
DGEDVPSALTTPEAPA

SEQ ID NO: 448676 - protein, 5 aa, Mycobacterium
DGEED

SEQ ID NO: 448677 - protein, 6 aa, Mycobacterium
DGEEEF

SEQ ID NO: 448678 - protein, 8 aa, Mycobacterium
DGEEHEYG

SEQ ID NO: 448679 - protein, 6 aa, Mycobacterium
DGEEHT

SEQ ID NO: 448680 - protein, 6 aa, Mycobacterium
DGEERE

SEQ ID NO: 448681 - protein, 11 aa, Mycobacterium
DGEERELRQGR

SEQ ID NO: 448682 - protein, 9 aa, Mycobacterium
DGEESDRVD

SEQ ID NO: 448683 - protein, 8 aa, Mycobacterium
DGEEVDSA

SEQ ID NO: 448684 - protein, 8 aa, Mycobacterium
DGEFDPEQ

SEQ ID NO: 448685 - protein, 5 aa, Mycobacterium
DGEFG

SEQ ID NO: 448686 - protein, 11 aa, Mycobacterium
DGEFRPGESIG

SEQ ID NO: 448687 - protein, 6 aa, Mycobacterium
DGEGAE

SEQ ID NO: 448688 - protein, 6 aa, Mycobacterium
DGEGAL

SEQ ID NO: 448689 - protein, 6 aa, Mycobacterium
DGEGEQ

SEQ ID NO: 448690 - protein, 10 aa, Mycobacterium
DGEGGADETV

SEQ ID NO: 448691 - protein, 8 aa, Mycobacterium
DGEGGSVP

SEQ ID NO: 448692 - protein, 8 aa, Mycobacterium
DGEGQAVG

SEQ ID NO: 448693 - protein, 14 aa, Mycobacterium
DGEGRNPGQRLPGN

SEQ ID NO: 448694 - protein, 16 aa, Mycobacterium
DGEGRPPVTDGPFAET

SEQ ID NO: 448695 - protein, 8 aa, Mycobacterium
DGEGRPVT

SEQ ID NO: 448696 - protein, 7 aa, Mycobacterium
DGEGRSV

SEQ ID NO: 448697 - protein, 6 aa, Mycobacterium
DGEGRW

SEQ ID NO: 448698 - protein, 6 aa, Mycobacterium
DGEGSC

SEQ ID NO: 448699 - protein, 6 aa, Mycobacterium
DGEGTF

SEQ ID NO: 448700 - protein, 11 aa, Mycobacterium
DGEGTGGGIGE

SEQ ID NO: 448701 - protein, 5 aa, Mycobacterium
DGEHA

SEQ ID NO: 448702 - protein, 13 aa, Mycobacterium
DGEHARRIEKWRS

SEQ ID NO: 448703 - protein, 5 aa, Mycobacterium
DGEHL

SEQ ID NO: 448704 - protein, 5 aa, Mycobacterium
DGEHP

SEQ ID NO: 448705 - protein, 7 aa, Mycobacterium
DGEHPAE

SEQ ID NO: 448706 - protein, 5 aa, Mycobacterium
DGEHQ

SEQ ID NO: 448707 - protein, 19 aa, Mycobacterium
DGEHSGGFPQYSPSSVGPG

SEQ ID NO: 448708 - protein, 6 aa, Mycobacterium
DGEIAA

SEQ ID NO: 448709 - protein, 7 aa, Mycobacterium
DGEIAGV

SEQ ID NO: 448710 - protein, 11 aa, Mycobacterium
DGEIDSAARAA

SEQ ID NO: 448711 - protein, 14 aa, Mycobacterium
DGEIEQGGVNSSTI

SEQ ID NO: 448712 - protein, 6 aa, Mycobacterium
DGEIGS

SEQ ID NO: 448713 - protein, 7 aa, Mycobacterium
DGEIQAR

SEQ ID NO: 448714 - protein, 8 aa, Mycobacterium
DGEIQTVD

SEQ ID NO: 448715 - protein, 9 aa, Mycobacterium
DGEISEEVS

SEQ ID NO: 448716 - protein, 5 aa, Mycobacterium
DGEKL

SEQ ID NO: 448717 - protein, 7 aa, Mycobacterium
DGEKQAA

SEQ ID NO: 448718 - protein, 8 aa, Mycobacterium
DGEKQRVA

SEQ ID NO: 448719 - protein, 7 aa, Mycobacterium
DGEKRTA

SEQ ID NO: 448720 - protein, 10 aa, Mycobacterium
DGEKVHRSAT

SEQ ID NO: 448721 - protein, 19 aa, Mycobacterium
DGELAPEPAEPVAAARTGW

SEQ ID NO: 448722 - protein, 10 aa, Mycobacterium
DGELAPGDRF

SEQ ID NO: 448723 - protein, 10 aa, Mycobacterium
DGELAPGTRL

SEQ ID NO: 448724 - protein, 19 aa, Mycobacterium
DGELAPTPAEPVAAARTGW

SEQ ID NO: 448725 - protein, 8 aa, Mycobacterium
DGELDEPT

SEQ ID NO: 448726 - protein, 12 aa, Mycobacterium
DGELGDHEDRLT

SEQ ID NO: 448727 - protein, 8 aa, Mycobacterium
DGELGDHP

SEQ ID NO: 448728 - protein, 17 aa, Mycobacterium
DGELPTGWHQVPDGWIG

SEQ ID NO: 448729 - protein, 6 aa, Mycobacterium
DGELPY

SEQ ID NO: 448730 - protein, 6 aa, Mycobacterium
DGELQE

SEQ ID NO: 448731 - protein, 15 aa, Mycobacterium
DGELREQERARKRGI

SEQ ID NO: 448732 - protein, 10 aa, Mycobacterium
DGELTDEGRN

SEQ ID NO: 448733 - protein, 9 aa, Mycobacterium
DGELTDEPE

SEQ ID NO: 448734 - protein, 6 aa, Mycobacterium
DGELTG

SEQ ID NO: 448735 - protein, 8 aa, Mycobacterium
DGELTGPV

SEQ ID NO: 448736 - protein, 9 aa, Mycobacterium
DGEMEEGQT

SEQ ID NO: 448737 - protein, 30 aa, Mycobacterium
DGEMGEPAQLRRRDGTSVHSRHGSATYTSQ

SEQ ID NO: 448738 - protein, 13 aa, Mycobacterium
DGENAQSPSPAHP

SEQ ID NO: 448739 - protein, 11 aa, Mycobacterium
DGENKSRTTIG

SEQ ID NO: 448740 - protein, 9 aa, Mycobacterium
DGENPREDG

SEQ ID NO: 448741 - protein, 4 aa, Mycobacterium
DGEP

SEQ ID NO: 448742 - protein, 10 aa, Mycobacterium
DGEPAGPTLA

SEQ ID NO: 448743 - protein, 11 aa, Mycobacterium
DGEPAKRPVRR

SEQ ID NO: 448744 - protein, 9 aa, Mycobacterium
DGEPAPDAE

SEQ ID NO: 448745 - protein, 5 aa, Mycobacterium
DGEPD

SEQ ID NO: 448746 - protein, 17 aa, Mycobacterium
DGEPGTIPALHNVFVPM

SEQ ID NO: 448747 - protein, 6 aa, Mycobacterium
DGEPGY

SEQ ID NO: 448748 - protein, 6 aa, Mycobacterium
DGEPHG

SEQ ID NO: 448749 - protein, 6 aa, Mycobacterium
DGEPIR

SEQ ID NO: 448750 - protein, 6 aa, Mycobacterium
DGEPIT

SEQ ID NO: 448751 - protein, 15 aa, Mycobacterium
DGEPLAVDGNPLGKG

SEQ ID NO: 448752 - protein, 5 aa, Mycobacterium
DGEPM

SEQ ID NO: 448753 - protein, 6 aa, Mycobacterium
DGEPMS

SEQ ID NO: 448754 - protein, 7 aa, Mycobacterium
DGEPPAA

SEQ ID NO: 448755 - protein, 8 aa, Mycobacterium
DGEPPRRH

SEQ ID NO: 448756 - protein, 11 aa, Mycobacterium
DGEPPRSRGAH

SEQ ID NO: 448757 - protein, 6 aa, Mycobacterium
DGEPQA

SEQ ID NO: 448758 - protein, 8 aa, Mycobacterium
DGEPQGEL

SEQ ID NO: 448759 - protein, 6 aa, Mycobacterium
DGEPTA

SEQ ID NO: 448760 - protein, 8 aa, Mycobacterium
DGEPTIGA

SEQ ID NO: 448761 - protein, 7 aa, Mycobacterium
DGEPVDV

SEQ ID NO: 448762 - protein, 8 aa, Mycobacterium
DGEPVHST

SEQ ID NO: 448763 - protein, 6 aa, Mycobacterium
DGEPVK

SEQ ID NO: 448764 - protein, 11 aa, Mycobacterium
DGEPVPGTYAA

SEQ ID NO: 448765 - protein, 7 aa, Mycobacterium
DGEQANH

SEQ ID NO: 448766 - protein, 7 aa, Mycobacterium
DGEQAYP

SEQ ID NO: 448767 - protein, 7 aa, Mycobacterium
DGEQGSK

SEQ ID NO: 448768 - protein, 7 aa, Mycobacterium
DGEQGTP

SEQ ID NO: 448769 - protein, 11 aa, Mycobacterium
DGEQHRNDRRQ

SEQ ID NO: 448770 - protein, 11 aa, Mycobacterium
DGEQHRTDRRQ

SEQ ID NO: 448771 - protein, 6 aa, Mycobacterium
DGEQQV

SEQ ID NO: 448772 - protein, 12 aa, Mycobacterium
DGEQRRLADEGN

SEQ ID NO: 448773 - protein, 6 aa, Mycobacterium
DGEQVV

SEQ ID NO: 448774 - protein, 4 aa, Mycobacterium
DGER

SEQ ID NO: 448775 - protein, 9 aa, Mycobacterium
DGERAGRTI

SEQ ID NO: 448776 - protein, 7 aa, Mycobacterium
DGERARL

SEQ ID NO: 448777 - protein, 7 aa, Mycobacterium
DGERDTL

SEQ ID NO: 448778 - protein, 6 aa, Mycobacterium
DGEREF

SEQ ID NO: 448779 - protein, 12 aa, Mycobacterium
DGERGALIGPQG

SEQ ID NO: 448780 - protein, 8 aa, Mycobacterium
DGERGISD

SEQ ID NO: 448781 - protein, 7 aa, Mycobacterium
DGERGRA

SEQ ID NO: 448782 - protein, 8 aa, Mycobacterium
DGERGRAR

SEQ ID NO: 448783 - protein, 15 aa, Mycobacterium
DGERGRARMQREQRA

SEQ ID NO: 448784 - protein, 16 aa, Mycobacterium
DGERGRARMQREQRAK

SEQ ID NO: 448785 - protein, 6 aa, Mycobacterium
DGERLT

SEQ ID NO: 448786 - protein, 7 aa, Mycobacterium
DGERLTE

SEQ ID NO: 448787 - protein, 8 aa, Mycobacterium
DGERLTSA

SEQ ID NO: 448788 - protein, 9 aa, Mycobacterium
DGERNGLEA

SEQ ID NO: 448789 - protein, 7 aa, Mycobacterium
DGERPAV

SEQ ID NO: 448790 - protein, 6 aa, Mycobacterium
DGERPD

SEQ ID NO: 448791 - protein, 9 aa, Mycobacterium
DGERPRAHY

SEQ ID NO: 448792 - protein, 8 aa, Mycobacterium
DGERPSVP

SEQ ID NO: 448793 - protein, 6 aa, Mycobacterium
DGERQV

SEQ ID NO: 448794 - protein, 13 aa, Mycobacterium
DGERTSESTRPTF

SEQ ID NO: 448795 - protein, 6 aa, Mycobacterium
DGERYS

SEQ ID NO: 448796 - protein, 6 aa, Mycobacterium
DGESAE

SEQ ID NO: 448797 - protein, 7 aa, Mycobacterium
DGESALA

SEQ ID NO: 448798 - protein, 6 aa, Mycobacterium
DGESCK

SEQ ID NO: 448799 - protein, 11 aa, Mycobacterium
DGESEASEVHE

SEQ ID NO: 448800 - protein, 10 aa, Mycobacterium
DGESGEIVEE

SEQ ID NO: 448801 - protein, 8 aa, Mycobacterium
DGESGGAT

SEQ ID NO: 448802 - protein, 13 aa, Mycobacterium
DGESGVADTGVGP

SEQ ID NO: 448803 - protein, 11 aa, Mycobacterium
DGESKRRTTIG

SEQ ID NO: 448804 - protein, 6 aa, Mycobacterium
DGESMP

SEQ ID NO: 448805 - protein, 14 aa, Mycobacterium
DGESPCGASGRAFQ

SEQ ID NO: 448806 - protein, 15 aa, Mycobacterium
DGESPCGASGRAFQK

SEQ ID NO: 448807 - protein, 9 aa, Mycobacterium
DGESQRAAA

SEQ ID NO: 448808 - protein, 11 aa, Mycobacterium
DGESQTSRLGA

SEQ ID NO: 448809 - protein, 5 aa, Mycobacterium
DGETA

SEQ ID NO: 448810 - protein, 16 aa, Mycobacterium
DGETAGTLDSAGARIA

SEQ ID NO: 448811 - protein, 7 aa, Mycobacterium
DGETDEK

SEQ ID NO: 448812 - protein, 5 aa, Mycobacterium
DGETE

SEQ ID NO: 448813 - protein, 5 aa, Mycobacterium
DGETF

SEQ ID NO: 448814 - protein, 7 aa, Mycobacterium
DGETGNV

SEQ ID NO: 448815 - protein, 8 aa, Mycobacterium
DGETKRRT

SEQ ID NO: 448816 - protein, 6 aa, Mycobacterium
DGETLT

SEQ ID NO: 448817 - protein, 8 aa, Mycobacterium
DGETPPGA

SEQ ID NO: 448818 - protein, 6 aa, Mycobacterium
DGETRG

SEQ ID NO: 448819 - protein, 10 aa, Mycobacterium
DGETRQISPA

SEQ ID NO: 448820 - protein, 9 aa, Mycobacterium
DGETRTPRE

SEQ ID NO: 448821 - protein, 9 aa, Mycobacterium
DGETTRHAT

SEQ ID NO: 448822 - protein, 5 aa, Mycobacterium
DGETV

SEQ ID NO: 448823 - protein, 21 aa, Mycobacterium
DGETWSEVPGPQPHAETDEQL

SEQ ID NO: 448824 - protein, 13 aa, Mycobacterium
DGEVDREDDETAA

SEQ ID NO: 448825 - protein, 7 aa, Mycobacterium
DGEVGRD

SEQ ID NO: 448826 - protein, 5 aa, Mycobacterium
DGEVH

SEQ ID NO: 448827 - protein, 5 aa, Mycobacterium
DGEVP

SEQ ID NO: 448828 - protein, 9 aa, Mycobacterium
DGEVPDDPV

SEQ ID NO: 448829 - protein, 25 aa, Mycobacterium
DGEVQQPAADGTVGAESPESPPRGH

SEQ ID NO: 448830 - protein, 8 aa, Mycobacterium
DGEVRDVT

SEQ ID NO: 448831 - protein, 7 aa, Mycobacterium
DGEVSDE

SEQ ID NO: 448832 - protein, 6 aa, Mycobacterium
DGEVSG

SEQ ID NO: 448833 - protein, 9 aa, Mycobacterium
DGEVSGGSW

SEQ ID NO: 448834 - protein, 4 aa, Mycobacterium
DGEW

SEQ ID NO: 448835 - protein, 6 aa, Mycobacterium
DGEYAT

SEQ ID NO: 448836 - protein, 5 aa, Mycobacterium
DGEYS

SEQ ID NO: 448837 - protein, 6 aa, Mycobacterium
DGEYSR

SEQ ID NO: 448838 - protein, 8 aa, Mycobacterium
DGFAADGA

SEQ ID NO: 448839 - protein, 5 aa, Mycobacterium
DGFAG

SEQ ID NO: 448840 - protein, 6 aa, Mycobacterium
DGFAGE

SEQ ID NO: 448841 - protein, 4 aa, Mycobacterium
DGFD

SEQ ID NO: 448842 - protein, 12 aa, Mycobacterium
DGFDAAGTACSD

SEQ ID NO: 448843 - protein, 6 aa, Mycobacterium
DGFDEG

SEQ ID NO: 448844 - protein, 12 aa, Mycobacterium
DGFDSIDKSDLR

SEQ ID NO: 448845 - protein, 5 aa, Mycobacterium
DGFDT

SEQ ID NO: 448846 - protein, 7 aa, Mycobacterium
DGFDTPT

SEQ ID NO: 448847 - protein, 8 aa, Mycobacterium
DGFDTPTP

SEQ ID NO: 448848 - protein, 11 aa, Mycobacterium
DGFGDKRLTGL

SEQ ID NO: 448849 - protein, 6 aa, Mycobacterium
DGFGGD

SEQ ID NO: 448850 - protein, 6 aa, Mycobacterium
DGFGPA

SEQ ID NO: 448851 - protein, 7 aa, Mycobacterium
DGFGPAE

SEQ ID NO: 448852 - protein, 8 aa, Mycobacterium
DGFGRPEG

SEQ ID NO: 448853 - protein, 6 aa, Mycobacterium
DGFGSL

SEQ ID NO: 448854 - protein, 6 aa, Mycobacterium
DGFGTL

SEQ ID NO: 448855 - protein, 7 aa, Mycobacterium
DGFGTLG

SEQ ID NO: 448856 - protein, 8 aa, Mycobacterium
DGFHPDPS

SEQ ID NO: 448857 - protein, 13 aa, Mycobacterium
DGFPGARNRSDPA

SEQ ID NO: 448858 - protein, 8 aa, Mycobacterium
DGFPKGSF

SEQ ID NO: 448859 - protein, 6 aa, Mycobacterium
DGFSGA

SEQ ID NO: 448860 - protein, 6 aa, Mycobacterium
DGFSTL

SEQ ID NO: 448861 - protein, 6 aa, Mycobacterium
DGFTGE

SEQ ID NO: 448862 - protein, 21 aa, Mycobacterium
DGFTPRSSTVSLEDRPPMNTL

SEQ ID NO: 448863 - protein, 12 aa, Mycobacterium
DGFTQPAAPYRI

SEQ ID NO: 448864 - protein, 5 aa, Mycobacterium
DGFVS

SEQ ID NO: 448865 - protein, 12 aa, Mycobacterium
DGGAADALQRGA

SEQ ID NO: 448866 - protein, 21 aa, Mycobacterium
DGGAAERARNAADPDRQAAHQ

SEQ ID NO: 448867 - protein, 8 aa, Mycobacterium
DGGAAGAL

SEQ ID NO: 448868 - protein, 13 aa, Mycobacterium
DGGAAGTGGVGGF

SEQ ID NO: 448869 - protein, 11 aa, Mycobacterium
DGGAAPDPGGP

SEQ ID NO: 448870 - protein, 6 aa, Mycobacterium
DGGAAR

SEQ ID NO: 448871 - protein, 10 aa, Mycobacterium
DGGAASAEES

SEQ ID NO: 448872 - protein, 16 aa, Mycobacterium
DGGAASGEVELAALNI

SEQ ID NO: 448873 - protein, 9 aa, Mycobacterium
DGGADQDHQ

SEQ ID NO: 448874 - protein, 9 aa, Mycobacterium
DGGAFADNP

SEQ ID NO: 448875 - protein, 5 aa, Mycobacterium
DGGAG

SEQ ID NO: 448876 - protein, 6 aa, Mycobacterium
DGGAGF

SEQ ID NO: 448877 - protein, 27 aa, Mycobacterium
DGGAGGAGGAGAGAGGGVGGAGGAGGL

SEQ ID NO: 448878 - protein, 26 aa, Mycobacterium
DGGAGGAGGIGGAAAGGKGGDGGDAA

SEQ ID NO: 448879 - protein, 13 aa, Mycobacterium
DGGAGGAGGLGSD

SEQ ID NO: 448880 - protein, 13 aa, Mycobacterium
DGGAGGAGGPVVP

SEQ ID NO: 448881 - protein, 19 aa, Mycobacterium
DGGAGGAGGSGGPGGTTHD

SEQ ID NO: 448882 - protein, 14 aa, Mycobacterium
DGGAGGAGGTGGGL

SEQ ID NO: 448883 - protein, 25 aa, Mycobacterium
DGGAGGFGGSGANAGGVGGSGGAAG

SEQ ID NO: 448884 - protein, 9 aa, Mycobacterium
DGGAGGMGG

SEQ ID NO: 448885 - protein, 35 aa, Mycobacterium
DGGAGGNGGDGGDGGAASGFAGDGGRGGQGAVGGA

SEQ ID NO: 448886 - protein, 14 aa, Mycobacterium
DGGAGGNSGDGGSF

SEQ ID NO: 448887 - protein, 29 aa, Mycobacterium
DGGAGGQGGAAAESINDGSPGQGGNGGSA

SEQ ID NO: 448888 - protein, 36 aa, Mycobacterium
DGGAGGQGGIGGMGGTGGAGGSGVAGAHGGNATSSI

SEQ ID NO: 448889 - protein, 37 aa, Mycobacterium
DGGAGGQGGTGATGIAGSNPTPLGTAAPGSDGANQIM

SEQ ID NO: 448890 - protein, 23 aa, Mycobacterium
DGGAGGSAAATPGAAGGAGGAAG

SEQ ID NO: 448891 - protein, 9 aa, Mycobacterium
DGGAGGSAP

SEQ ID NO: 448892 - protein, 23 aa, Mycobacterium
DGGAGGSAVAGSDGAGGSGGAAG

SEQ ID NO: 448893 - protein, 24 aa, Mycobacterium
DGGAGGSGAAGSGIAGGDGGAAGL

SEQ ID NO: 448894 - protein, 23 aa, Mycobacterium
DGGAGGSGAANTGASGGAGGAAG

SEQ ID NO: 448895 - protein, 22 aa, Mycobacterium
DGGAGGSGAMSTGADGGAGGAA

SEQ ID NO: 448896 - protein, 21 aa, Mycobacterium
DGGAGGSGAPGKAGGAGGAAG

SEQ ID NO: 448897 - protein, 51 aa, Mycobacterium
DGGAGGSGAPGLNGGAGGAAGLLGSGGAGGAGGSSTSTNGGAGGAGGAGGW

SEQ ID NO: 448898 - protein, 21 aa, Mycobacterium
DGGAGGSGAPGMAGGNGGAAG

SEQ ID NO: 448899 - protein, 23 aa, Mycobacterium
DGGAGGSGAPGVGHNGGAGGSAG

SEQ ID NO: 448900 - protein, 51 aa, Mycobacterium
DGGAGGSGATGQVGGNGGAAGLLGSGGAGGAGGGSTVGNGGAGGVGGTGGW

SEQ ID NO: 448901 - protein, 20 aa, Mycobacterium
DGGAGGSGEAGQAGGSGGAA

SEQ ID NO: 448902 - protein, 37 aa, Mycobacterium
DGGAGGSGGGGAMGGAGAAGGQGGTGGTGGDSSAIDD

SEQ ID NO: 448903 - protein, 20 aa, Mycobacterium
DGGAGGSGGLEQQGGTGGAA

SEQ ID NO: 448904 - protein, 26 aa, Mycobacterium
DGGAGGSGGPNGGTDPGGTGGNGGRA

SEQ ID NO: 448905 - protein, 20 aa, Mycobacterium
DGGAGGSGLAGRDGGAGGAA

SEQ ID NO: 448906 - protein, 23 aa, Mycobacterium
DGGAGGSSTAGSGLDGGTGGAAG

SEQ ID NO: 448907 - protein, 9 aa, Mycobacterium
DGGAGGTGG

SEQ ID NO: 448908 - protein, 10 aa, Mycobacterium
DGGAGGTGGF

SEQ ID NO: 448909 - protein, 26 aa, Mycobacterium
DGGAGGTGGVATSAGGAGGAGGNAAD

SEQ ID NO: 448910 - protein, 18 aa, Mycobacterium
DGGAGITGGFGGRGGQSV

SEQ ID NO: 448911 - protein, 9 aa, Mycobacterium
DGGAGPFVE

SEQ ID NO: 448912 - protein, 13 aa, Mycobacterium
DGGALRGPRQASN

SEQ ID NO: 448913 - protein, 26 aa, Mycobacterium
DGGAPARHPQVGTRTPVLSDDGSDLA

SEQ ID NO: 448914 - protein, 8 aa, Mycobacterium
DGGAPDPA

SEQ ID NO: 448915 - protein, 6 aa, Mycobacterium
DGGAPL

SEQ ID NO: 448916 - protein, 21 aa, Mycobacterium
DGGAPQTPQGAPAVTPTVPSA

SEQ ID NO: 448917 - protein, 8 aa, Mycobacterium
DGGATDDA

SEQ ID NO: 448918 - protein, 7 aa, Mycobacterium
DGGATEL

SEQ ID NO: 448919 - protein, 18 aa, Mycobacterium
DGGATSGGSSGAMGGPGD

SEQ ID NO: 448920 - protein, 18 aa, Mycobacterium
DGGATSGGSSGTMGGPGD

SEQ ID NO: 448921 - protein, 8 aa, Mycobacterium
DGGAVRRG

SEQ ID NO: 448922 - protein, 7 aa, Mycobacterium
DGGCDAA

SEQ ID NO: 448923 - protein, 17 aa, Mycobacterium
DGGDAARALGSGRQRPG

SEQ ID NO: 448924 - protein, 8 aa, Mycobacterium
DGGDAEDH

SEQ ID NO: 448925 - protein, 6 aa, Mycobacterium
DGGDAR

SEQ ID NO: 448926 - protein, 15 aa, Mycobacterium
DGGDCRGDRPFPRRR

SEQ ID NO: 448927 - protein, 10 aa, Mycobacterium
DGGDDAAARV

SEQ ID NO: 448928 - protein, 8 aa, Mycobacterium
DGGDDAPY

SEQ ID NO: 448929 - protein, 6 aa, Mycobacterium
DGGDDG

SEQ ID NO: 448930 - protein, 6 aa, Mycobacterium
DGGDDL

SEQ ID NO: 448931 - protein, 9 aa, Mycobacterium
DGGDEPALS

SEQ ID NO: 448932 - protein, 6 aa, Mycobacterium
DGGDFT

SEQ ID NO: 448933 - protein, 28 aa, Mycobacterium
DGGDGGAGGDGNAGSLAGGTGGNGGDAK

SEQ ID NO: 448934 - protein, 26 aa, Mycobacterium
DGGDGGSGTPGTATSPAGGAGGAGGS

SEQ ID NO: 448935 - protein, 5 aa, Mycobacterium
DGGDI

SEQ ID NO: 448936 - protein, 14 aa, Mycobacterium
DGGDLSDRHGRRSR

SEQ ID NO: 448937 - protein, 9 aa, Mycobacterium
DGGDPRQPI

SEQ ID NO: 448938 - protein, 5 aa, Mycobacterium
DGGDQ

SEQ ID NO: 448939 - protein, 6 aa, Mycobacterium
DGGDQI

SEQ ID NO: 448940 - protein, 19 aa, Mycobacterium
DGGDQVVTSSVTKDAATDL

SEQ ID NO: 448941 - protein, 6 aa, Mycobacterium
DGGDRA

SEQ ID NO: 448942 - protein, 8 aa, Mycobacterium
DGGDRQPE

SEQ ID NO: 448943 - protein, 7 aa, Mycobacterium
DGGDTEL

SEQ ID NO: 448944 - protein, 5 aa, Mycobacterium
DGGDV

SEQ ID NO: 448945 - protein, 4 aa, Mycobacterium
DGGE

SEQ ID NO: 448946 - protein, 7 aa, Mycobacterium
DGGEADE

SEQ ID NO: 448947 - protein, 7 aa, Mycobacterium
DGGEATV

SEQ ID NO: 448948 - protein, 8 aa, Mycobacterium
DGGEDDTY

SEQ ID NO: 448949 - protein, 8 aa, Mycobacterium
DGGEDEAY

SEQ ID NO: 448950 - protein, 14 aa, Mycobacterium
DGGEEVDRFTSPDP

SEQ ID NO: 448951 - protein, 7 aa, Mycobacterium
DGGEHEQ

SEQ ID NO: 448952 - protein, 14 aa, Mycobacterium
DGGEIRNGSDLPRI

SEQ ID NO: 448953 - protein, 6 aa, Mycobacterium
DGGENR

SEQ ID NO: 448954 - protein, 5 aa, Mycobacterium
DGGEP

SEQ ID NO: 448955 - protein, 14 aa, Mycobacterium
DGGEPESLTVQTPE

SEQ ID NO: 448956 - protein, 5 aa, Mycobacterium
DGGEQ

SEQ ID NO: 448957 - protein, 31 aa, Mycobacterium
DGGEQPEPAAHDAAGREIAAPAAAAPDLGET

SEQ ID NO: 448958 - protein, 7 aa, Mycobacterium
DGGERGP

SEQ ID NO: 448959 - protein, 8 aa, Mycobacterium
DGGESAVS

SEQ ID NO: 448960 - protein, 7 aa, Mycobacterium
DGGETAL

SEQ ID NO: 448961 - protein, 8 aa, Mycobacterium
DGGETDEY

SEQ ID NO: 448962 - protein, 4 aa, Mycobacterium
DGGF

SEQ ID NO: 448963 - protein, 12 aa, Mycobacterium
DGGFDDANAGER

SEQ ID NO: 448964 - protein, 6 aa, Mycobacterium
DGGGAA

SEQ ID NO: 448965 - protein, 8 aa, Mycobacterium
DGGGAAFD

SEQ ID NO: 448966 - protein, 11 aa, Mycobacterium
DGGGAKDAVAN

SEQ ID NO: 448967 - protein, 10 aa, Mycobacterium
DGGGASAISG

SEQ ID NO: 448968 - protein, 6 aa, Mycobacterium
DGGGAV

SEQ ID NO: 448969 - protein, 8 aa, Mycobacterium
DGGGDAVE

SEQ ID NO: 448970 - protein, 6 aa, Mycobacterium
DGGGDL

SEQ ID NO: 448971 - protein, 11 aa, Mycobacterium
DGGGFDSTAAG

SEQ ID NO: 448972 - protein, 29 aa, Mycobacterium
DGGGGGGGGSGGGGGASGGTGGTGGAGGL

SEQ ID NO: 448973 - protein, 31 aa, Mycobacterium
DGGGGGSGGSGANGFGTIGGTGGSGGRGGDA

SEQ ID NO: 448974 - protein, 30 aa, Mycobacterium
DGGGGGTGGSTTFGSSGAGGNGGAGGNGGL

SEQ ID NO: 448975 - protein, 21 aa, Mycobacterium
DGGGGLTPSDIAPARLNQPQI

SEQ ID NO: 448976 - protein, 17 aa, Mycobacterium
DGGGGLTPSDIAPARLT

SEQ ID NO: 448977 - protein, 10 aa, Mycobacterium
DGGGHAGVGS

SEQ ID NO: 448978 - protein, 5 aa, Mycobacterium
DGGGK

SEQ ID NO: 448979 - protein, 15 aa, Mycobacterium
DGGGKAKWSGVPGGL

SEQ ID NO: 448980 - protein, 7 aa, Mycobacterium
DGGGLGK

SEQ ID NO: 448981 - protein, 8 aa, Mycobacterium
DGGGLGKG

SEQ ID NO: 448982 - protein, 26 aa, Mycobacterium
DGGGLGKGASVSLRAGDTEVASGRVD

SEQ ID NO: 448983 - protein, 14 aa, Mycobacterium
DGGGLPAGARGETI

SEQ ID NO: 448984 - protein, 8 aa, Mycobacterium
DGGGLPTG

SEQ ID NO: 448985 - protein, 11 aa, Mycobacterium
DGGGPASADFN

SEQ ID NO: 448986 - protein, 9 aa, Mycobacterium
DGGGPATVQ

SEQ ID NO: 448987 - protein, 6 aa, Mycobacterium
DGGGPE

SEQ ID NO: 448988 - protein, 8 aa, Mycobacterium
DGGGPPDV

SEQ ID NO: 448989 - protein, 6 aa, Mycobacterium
DGGGQV

SEQ ID NO: 448990 - protein, 5 aa, Mycobacterium
DGGGR

SEQ ID NO: 448991 - protein, 11 aa, Mycobacterium
DGGGRGARDAG

SEQ ID NO: 448992 - protein, 8 aa, Mycobacterium
DGGGRPVA

SEQ ID NO: 448993 - protein, 9 aa, Mycobacterium
DGGGSEDAI

SEQ ID NO: 448994 - protein, 6 aa, Mycobacterium
DGGGSI

SEQ ID NO: 448995 - protein, 7 aa, Mycobacterium
DGGGSSA

SEQ ID NO: 448996 - protein, 9 aa, Mycobacterium
DGGGTAEAI

SEQ ID NO: 448997 - protein, 16 aa, Mycobacterium
DGGGTQDAIEGRKGQL

SEQ ID NO: 448998 - protein, 14 aa, Mycobacterium
DGGGVKPSSMLDPS

SEQ ID NO: 448999 - protein, 7 aa, Mycobacterium
DGGGVNA

SEQ ID NO: 449000 - protein, 6 aa, Mycobacterium
DGGGVT

SEQ ID NO: 449001 - protein, 4 aa, Mycobacterium
DGGH

SEQ ID NO: 449002 - protein, 7 aa, Mycobacterium
DGGHENP

SEQ ID NO: 449003 - protein, 5 aa, Mycobacterium
DGGHS

SEQ ID NO: 449004 - protein, 8 aa, Mycobacterium
DGGHTPKQ

SEQ ID NO: 449005 - protein, 12 aa, Mycobacterium
DGGIPADELAGT

SEQ ID NO: 449006 - protein, 12 aa, Mycobacterium
DGGKDVATTTDP

SEQ ID NO: 449007 - protein, 46 aa, Mycobacterium
DGGKGFSSATAGVAGGSGGSAGLFGSGGAGGTGGGGALGGNGGTGG

SEQ ID NO: 449008 - protein, 12 aa, Mycobacterium
DGGKGGDGGAPV

SEQ ID NO: 449009 - protein, 6 aa, Mycobacterium
DGGKGW

SEQ ID NO: 449010 - protein, 24 aa, Mycobacterium
DGGKGYSQAAGSGLAGGNGGAAGL

SEQ ID NO: 449011 - protein, 12 aa, Mycobacterium
DGGKNVATATDP

SEQ ID NO: 449012 - protein, 9 aa, Mycobacterium
DGGKPVPGI

SEQ ID NO: 449013 - protein, 8 aa, Mycobacterium
DGGKRQPV

SEQ ID NO: 449014 - protein, 6 aa, Mycobacterium
DGGKTS

SEQ ID NO: 449015 - protein, 4 aa, Mycobacterium
DGGL

SEQ ID NO: 449016 - protein, 13 aa, Mycobacterium
DGGLGDDRDGVAD

SEQ ID NO: 449017 - protein, 13 aa, Mycobacterium
DGGLGEDTEGGPS

SEQ ID NO: 449018 - protein, 25 aa, Mycobacterium
DGGLGGHGGTGGTNGATGGAGGRGG

SEQ ID NO: 449019 - protein, 6 aa, Mycobacterium
DGGLGR

SEQ ID NO: 449020 - protein, 6 aa, Mycobacterium
DGGLRT

SEQ ID NO: 449021 - protein, 13 aa, Mycobacterium
DGGLSDPHNGGRS

SEQ ID NO: 449022 - protein, 13 aa, Mycobacterium
DGGLTGELLILRQ

SEQ ID NO: 449023 - protein, 5 aa, Mycobacterium
DGGND

SEQ ID NO: 449024 - protein, 6 aa, Mycobacterium
DGGNDL

SEQ ID NO: 449025 - protein, 5 aa, Mycobacterium
DGGNF

SEQ ID NO: 449026 - protein, 34 aa, Mycobacterium
DGGNGGNGGIGVTPGTGGAGGTGGQLLGQDGNNG

SEQ ID NO: 449027 - protein, 34 aa, Mycobacterium
DGGNGGNGGKAATNGKAGTGGTGGLVGADGLNGL

SEQ ID NO: 449028 - protein, 90 aa, Mycobacterium
DGGNGGNGGNPGLGGAGGNGGAGSHAGAHGLAGSSPTTNAGHGGKGGDGYTSTDPGTDGGNGGHGGAGGYYGNGGAGGNGGNGATGNLGA

SEQ ID NO: 449029 - protein, 23 aa, Mycobacterium
DGGNGGNGGTGATAGVGGTAGTG

SEQ ID NO: 449030 - protein, 34 aa, Mycobacterium
DGGNGGNGGTGGTPGTGGTGGSGGILIGADGTNG

SEQ ID NO: 449031 - protein, 21 aa, Mycobacterium
DGGNGGNGSNGGIGGEGGTGG

SEQ ID NO: 449032 - protein, 24 aa, Mycobacterium
DGGNGGSGQSGVSGGQGGNGGAAG

SEQ ID NO: 449033 - protein, 11 aa, Mycobacterium
DGGNPGDDDFD

SEQ ID NO: 449034 - protein, 12 aa, Mycobacterium
DGGNQRWRAVKA

SEQ ID NO: 449035 - protein, 13 aa, Mycobacterium
DGGNSLHGGTAGF

SEQ ID NO: 449036 - protein, 5 aa, Mycobacterium
DGGNT

SEQ ID NO: 449037 - protein, 4 aa, Mycobacterium
DGGP

SEQ ID NO: 449038 - protein, 18 aa, Mycobacterium
DGGPAKPTDKPPRPFEEG

SEQ ID NO: 449039 - protein, 15 aa, Mycobacterium
DGGPDEPSRTARARA

SEQ ID NO: 449040 - protein, 5 aa, Mycobacterium
DGGPE

SEQ ID NO: 449041 - protein, 14 aa, Mycobacterium
DGGPEVLTTSPSWR

SEQ ID NO: 449042 - protein, 8 aa, Mycobacterium
DGGPEVQE

SEQ ID NO: 449043 - protein, 6 aa, Mycobacterium
DGGPGE

SEQ ID NO: 449044 - protein, 21 aa, Mycobacterium
DGGPGMYESGPFGEASGGPVP

SEQ ID NO: 449045 - protein, 21 aa, Mycobacterium
DGGPGMYGSGPFGEASGGPVP

SEQ ID NO: 449046 - protein, 175 aa, Mycobacterium
DGGPGSPGAASFDPTVAGGAGGPGGDARGIGDGGRGGDGGPGATGAPGGRGSDGGPGGKGGNAGDYGNGGTGGTGGIGGAGGPGSPGGTPGAQGFRAGDAGNGGVGGIGGDGGHIKGHGGAGGIGGQGGAGGIGGDGQAGSAGEFPGDRGGSGGDGARGGNGGDGGAGGAGGQAL

SEQ ID NO: 449047 - protein, 174 aa, Mycobacterium
DGGPGSPGAASFDPTVAGGAGGPGGDARGIGDGGRGGDGGPGATGAPGGRGSDGGPGGKGGNAGDYGNGGTGGTGGIGGAGGPGSPGQSWGDPGSQGGLGGRGGAGGIGGDGGQLSGSGGAGGIGGEGGHGGAGGDGKDAVESPQFGKAGGPGGDGGRGGLGGFGGDGGAGGHA

SEQ ID NO: 449048 - protein, 9 aa, Mycobacterium
DGGPGSRSV

SEQ ID NO: 449049 - protein, 25 aa, Mycobacterium
DGGPGYTPISGPGAVPGGNGGSAGW

SEQ ID NO: 449050 - protein, 9 aa, Mycobacterium
DGGPPAADL

SEQ ID NO: 449051 - protein, 7 aa, Mycobacterium
DGGPPCA

SEQ ID NO: 449052 - protein, 8 aa, Mycobacterium
DGGPPTAD

SEQ ID NO: 449053 - protein, 10 aa, Mycobacterium
DGGPSGAATF

SEQ ID NO: 449054 - protein, 6 aa, Mycobacterium
DGGPTT

SEQ ID NO: 449055 - protein, 8 aa, Mycobacterium
DGGQASNV

SEQ ID NO: 449056 - protein, 8 aa, Mycobacterium
DGGQASVS

SEQ ID NO: 449057 - protein, 6 aa, Mycobacterium
DGGQDV

SEQ ID NO: 449058 - protein, 7 aa, Mycobacterium
DGGQEAR

SEQ ID NO: 449059 - protein, 6 aa, Mycobacterium
DGGREP

SEQ ID NO: 449060 - protein, 7 aa, Mycobacterium
DGGRGGS

SEQ ID NO: 449061 - protein, 5 aa, Mycobacterium
DGGRK

SEQ ID NO: 449062 - protein, 16 aa, Mycobacterium
DGGRLDAEPPAAQGYS

SEQ ID NO: 449063 - protein, 16 aa, Mycobacterium
DGGRLDPEPPAAQGHS

SEQ ID NO: 449064 - protein, 15 aa, Mycobacterium
DGGRLQAEPPPAHGH

SEQ ID NO: 449065 - protein, 7 aa, Mycobacterium
DGGRLSD

SEQ ID NO: 449066 - protein, 5 aa, Mycobacterium
DGGRS

SEQ ID NO: 449067 - protein, 7 aa, Mycobacterium
DGGRSAT

SEQ ID NO: 449068 - protein, 11 aa, Mycobacterium
DGGRSDNPRVA

SEQ ID NO: 449069 - protein, 6 aa, Mycobacterium
DGGRSL

SEQ ID NO: 449070 - protein, 8 aa, Mycobacterium
DGGRSTIR

SEQ ID NO: 449071 - protein, 7 aa, Mycobacterium
DGGRSTV

SEQ ID NO: 449072 - protein, 8 aa, Mycobacterium
DGGRTDAD

SEQ ID NO: 449073 - protein, 12 aa, Mycobacterium
DGGRTGCRTTAE

SEQ ID NO: 449074 - protein, 5 aa, Mycobacterium
DGGRV

SEQ ID NO: 449075 - protein, 5 aa, Mycobacterium
DGGRW

SEQ ID NO: 449076 - protein, 6 aa, Mycobacterium
DGGSAA

SEQ ID NO: 449077 - protein, 8 aa, Mycobacterium
DGGSATDI

SEQ ID NO: 449078 - protein, 6 aa, Mycobacterium
DGGSDL

SEQ ID NO: 449079 - protein, 7 aa, Mycobacterium
DGGSDSY

SEQ ID NO: 449080 - protein, 12 aa, Mycobacterium
DGGSESPQETRT

SEQ ID NO: 449081 - protein, 42 aa, Mycobacterium
DGGSGGAGGAGGQGGAGRGSEIGGGAGGAGSVGGAGGAGGTG

SEQ ID NO: 449082 - protein, 115 aa, Mycobacterium
DGGSGGHGGNGGAGGSSPQGSGGGGGNGGAGGTGGDAGLQEGGGGTGGNGGNGGAGGTGKASSATGGIGGGGGNGGAAGQVGDGGGGGTGGNGGNGGAGRDGAMGGTGGIGGDAG

SEQ ID NO: 449083 - protein, 58 aa, Mycobacterium
DGGSGGSGGHGGVGAGGGEFPDPGGGGGRGGSGGAAGLVGNGGSGGSGGGGGTGGTAD

SEQ ID NO: 449084 - protein, 51 aa, Mycobacterium
DGGSGGSGGNGGNGGTGGNGGTAGSSGKGGNGGNGGNGGNAGDGGSGANGG

SEQ ID NO: 449085 - protein, 13 aa, Mycobacterium
DGGSGYTSAKHAQ

SEQ ID NO: 449086 - protein, 17 aa, Mycobacterium
DGGSMAQRKNGRGHRNH

SEQ ID NO: 449087 - protein, 7 aa, Mycobacterium
DGGSNDV

SEQ ID NO: 449088 - protein, 7 aa, Mycobacterium
DGGSNVE

SEQ ID NO: 449089 - protein, 7 aa, Mycobacterium
DGGSPFY

SEQ ID NO: 449090 - protein, 10 aa, Mycobacterium
DGGSSPTRGQ

SEQ ID NO: 449091 - protein, 6 aa, Mycobacterium
DGGSTR

SEQ ID NO: 449092 - protein, 8 aa, Mycobacterium
DGGSVGAA

SEQ ID NO: 449093 - protein, 9 aa, Mycobacterium
DGGSVTAPV

SEQ ID NO: 449094 - protein, 27 aa, Mycobacterium
DGGSYTATVTAPERDNAVALAGVEFVP

SEQ ID NO: 449095 - protein, 7 aa, Mycobacterium
DGGTAAD

SEQ ID NO: 449096 - protein, 8 aa, Mycobacterium
DGGTADAF

SEQ ID NO: 449097 - protein, 6 aa, Mycobacterium
DGGTAG

SEQ ID NO: 449098 - protein, 8 aa, Mycobacterium
DGGTAVSH

SEQ ID NO: 449099 - protein, 13 aa, Mycobacterium
DGGTCAGSPGSGA

SEQ ID NO: 449100 - protein, 9 aa, Mycobacterium
DGGTDPDER

SEQ ID NO: 449101 - protein, 8 aa, Mycobacterium
DGGTEAAG

SEQ ID NO: 449102 - protein, 175 aa, Mycobacterium
DGGTGAAATATTVAGRGGDAGLIGTGGAGGAGLAGSSAATMAGGAGGRGGSLLGDGGAGAPGAASFDPNVAGGAGGAGGDAGKIGDGGRGGDGGHGATGTAGDATHLEGGRGSDGGAGGKGGNAGDYGHGGAGGTGGQGGQGGTGSAGLTPGDKGFQGGLGGSGGVGGAGGEGGL

SEQ ID NO: 449103 - protein, 19 aa, Mycobacterium
DGGTGGASGPGGVGGIGGR

SEQ ID NO: 449104 - protein, 21 aa, Mycobacterium
DGGTGGDALSAGTGGAGGSGG

SEQ ID NO: 449105 - protein, 16 aa, Mycobacterium
DGGTGGDGGQGGGGHL

SEQ ID NO: 449106 - protein, 28 aa, Mycobacterium
DGGTGGFGGDGGVGGAGGAGGGGGAAGL

SEQ ID NO: 449107 - protein, 41 aa, Mycobacterium
DGGTGGHGGAGFGGGNGSDSPQGGQGGNAGVAGNGGAGGSA

SEQ ID NO: 449108 - protein, 153 aa, Mycobacterium
DGGTGGQGGTGLAGADGVNPTPTGTAGTGAAGGNVSGNGPLTGGNGDTGDTGGTGETGGTGGAGGSATASSGSATGGKGGAGGDPGGGANGGAGGAGGDAESFSGQAHGGAGGDGSQGGIPGGSGGAGGDGGKATGLASGIGGDGGDGGRGFA

SEQ ID NO: 449109 - protein, 14 aa, Mycobacterium
DGGTGGTGSQAGTQ

SEQ ID NO: 449110 - protein, 8 aa, Mycobacterium
DGGTHAAG

SEQ ID NO: 449111 - protein, 8 aa, Mycobacterium
DGGTHAAS

SEQ ID NO: 449112 - protein, 8 aa, Mycobacterium
DGGTITDA

SEQ ID NO: 449113 - protein, 5 aa, Mycobacterium
DGGTL

SEQ ID NO: 449114 - protein, 6 aa, Mycobacterium
DGGTLG

SEQ ID NO: 449115 - protein, 14 aa, Mycobacterium
DGGTLPAEPPAIQG

SEQ ID NO: 449116 - protein, 12 aa, Mycobacterium
DGGTPAADTYEG

SEQ ID NO: 449117 - protein, 7 aa, Mycobacterium
DGGTPEV

SEQ ID NO: 449118 - protein, 8 aa, Mycobacterium
DGGTQAAG

SEQ ID NO: 449119 - protein, 10 aa, Mycobacterium
DGGTQASSGW

SEQ ID NO: 449120 - protein, 10 aa, Mycobacterium
DGGTQRRYSL

SEQ ID NO: 449121 - protein, 6 aa, Mycobacterium
DGGTRD

SEQ ID NO: 449122 - protein, 8 aa, Mycobacterium
DGGTSNLE

SEQ ID NO: 449123 - protein, 6 aa, Mycobacterium
DGGTSR

SEQ ID NO: 449124 - protein, 5 aa, Mycobacterium
DGGTT

SEQ ID NO: 449125 - protein, 30 aa, Mycobacterium
DGGTTKPSFDIPASPPQPAAVVANDPLPQT

SEQ ID NO: 449126 - protein, 13 aa, Mycobacterium
DGGTTPPGPPVTY

SEQ ID NO: 449127 - protein, 15 aa, Mycobacterium
DGGTVAGKAIRSQRR

SEQ ID NO: 449128 - protein, 13 aa, Mycobacterium
DGGTVAGKVIRRS

SEQ ID NO: 449129 - protein, 4 aa, Mycobacterium
DGGV

SEQ ID NO: 449130 - protein, 10 aa, Mycobacterium
DGGVAGRPSR

SEQ ID NO: 449131 - protein, 5 aa, Mycobacterium
DGGVD

SEQ ID NO: 449132 - protein, 5 aa, Mycobacterium
DGGVE

SEQ ID NO: 449133 - protein, 6 aa, Mycobacterium
DGGVEQ

SEQ ID NO: 449134 - protein, 5 aa, Mycobacterium
DGGVG

SEQ ID NO: 449135 - protein, 14 aa, Mycobacterium
DGGVGGAGGAGGLF

SEQ ID NO: 449136 - protein, 10 aa, Mycobacterium
DGGVPDDRQR

SEQ ID NO: 449137 - protein, 6 aa, Mycobacterium
DGGVPS

SEQ ID NO: 449138 - protein, 6 aa, Mycobacterium
DGGVTG

SEQ ID NO: 449139 - protein, 5 aa, Mycobacterium
DGGVY

SEQ ID NO: 449140 - protein, 7 aa, Mycobacterium
DGGYDQP

SEQ ID NO: 449141 - protein, 6 aa, Mycobacterium
DGGYDV

SEQ ID NO: 449142 - protein, 7 aa, Mycobacterium
DGGYIDE

SEQ ID NO: 449143 - protein, 6 aa, Mycobacterium
DGGYPR

SEQ ID NO: 449144 - protein, 5 aa, Mycobacterium
DGGYQ

SEQ ID NO: 449145 - protein, 12 aa, Mycobacterium
DGGYQTAPAGGS

SEQ ID NO: 449146 - protein, 5 aa, Mycobacterium
DGGYT

SEQ ID NO: 449147 - protein, 9 aa, Mycobacterium
DGGYTAGRD

SEQ ID NO: 449148 - protein, 19 aa, Mycobacterium
DGGYTAGRDHGVVELFGFP

SEQ ID NO: 449149 - protein, 19 aa, Mycobacterium
DGGYTAGRDHGVVRLFGFP

SEQ ID NO: 449150 - protein, 4 aa, Mycobacterium
DGHA

SEQ ID NO: 449151 - protein, 12 aa, Mycobacterium
DGHAGTVTSAPV

SEQ ID NO: 449152 - protein, 7 aa, Mycobacterium
DGHAPGW

SEQ ID NO: 449153 - protein, 5 aa, Mycobacterium
DGHAQ

SEQ ID NO: 449154 - protein, 6 aa, Mycobacterium
DGHASA

SEQ ID NO: 449155 - protein, 7 aa, Mycobacterium
DGHASPV

SEQ ID NO: 449156 - protein, 4 aa, Mycobacterium
DGHC

SEQ ID NO: 449157 - protein, 4 aa, Mycobacterium
DGHD

SEQ ID NO: 449158 - protein, 7 aa, Mycobacterium
DGHDDVP

SEQ ID NO: 449159 - protein, 7 aa, Mycobacterium
DGHDEHA

SEQ ID NO: 449160 - protein, 6 aa, Mycobacterium
DGHDER

SEQ ID NO: 449161 - protein, 10 aa, Mycobacterium
DGHDESAVEG

SEQ ID NO: 449162 - protein, 11 aa, Mycobacterium
DGHDHGRHHEY

SEQ ID NO: 449163 - protein, 13 aa, Mycobacterium
DGHDNQLLRFAQD

SEQ ID NO: 449164 - protein, 6 aa, Mycobacterium
DGHDPA

SEQ ID NO: 449165 - protein, 11 aa, Mycobacterium
DGHDSRDQQRV

SEQ ID NO: 449166 - protein, 12 aa, Mycobacterium
DGHEIDKRENRA

SEQ ID NO: 449167 - protein, 6 aa, Mycobacterium
DGHEQS

SEQ ID NO: 449168 - protein, 13 aa, Mycobacterium
DGHEVADGTTGEL

SEQ ID NO: 449169 - protein, 4 aa, Mycobacterium
DGHG

SEQ ID NO: 449170 - protein, 9 aa, Mycobacterium
DGHGAEVRA

SEQ ID NO: 449171 - protein, 14 aa, Mycobacterium
DGHGAPGEQTFRST

SEQ ID NO: 449172 - protein, 18 aa, Mycobacterium
DGHGDAASAQASARTGVP

SEQ ID NO: 449173 - protein, 16 aa, Mycobacterium
DGHGDLAAARASARTG

SEQ ID NO: 449174 - protein, 8 aa, Mycobacterium
DGHGDLAT

SEQ ID NO: 449175 - protein, 16 aa, Mycobacterium
DGHGDLATARAAAATG

SEQ ID NO: 449176 - protein, 16 aa, Mycobacterium
DGHGDLATARAAARTG

SEQ ID NO: 449177 - protein, 17 aa, Mycobacterium
DGHGDLATARAAARTGV

SEQ ID NO: 449178 - protein, 6 aa, Mycobacterium
DGHGDT

SEQ ID NO: 449179 - protein, 6 aa, Mycobacterium
DGHGGI

SEQ ID NO: 449180 - protein, 5 aa, Mycobacterium
DGHGK

SEQ ID NO: 449181 - protein, 6 aa, Mycobacterium
DGHGLT

SEQ ID NO: 449182 - protein, 8 aa, Mycobacterium
DGHLTDDV

SEQ ID NO: 449183 - protein, 21 aa, Mycobacterium
DGHPDDPPGAGITPRPGKGPE

SEQ ID NO: 449184 - protein, 6 aa, Mycobacterium
DGHPEN

SEQ ID NO: 449185 - protein, 11 aa, Mycobacterium
DGHPENAVSRD

SEQ ID NO: 449186 - protein, 9 aa, Mycobacterium
DGHPGPGIT

SEQ ID NO: 449187 - protein, 6 aa, Mycobacterium
DGHPLS

SEQ ID NO: 449188 - protein, 35 aa, Mycobacterium
DGHPPAAAGERHRQRAPRRAQALQPAPHVGATRAG

SEQ ID NO: 449189 - protein, 12 aa, Mycobacterium
DGHPQRKDYPLG

SEQ ID NO: 449190 - protein, 28 aa, Mycobacterium
DGHPRIGGRVDNPSSAREQAGVADADAA

SEQ ID NO: 449191 - protein, 8 aa, Mycobacterium
DGHPRPLP

SEQ ID NO: 449192 - protein, 6 aa, Mycobacterium
DGHPSA

SEQ ID NO: 449193 - protein, 13 aa, Mycobacterium
DGHPVAPGAEGEL

SEQ ID NO: 449194 - protein, 9 aa, Mycobacterium
DGHPVGPGA

SEQ ID NO: 449195 - protein, 14 aa, Mycobacterium
DGHPVVNGPPAAAP

SEQ ID NO: 449196 - protein, 5 aa, Mycobacterium
DGHPW

SEQ ID NO: 449197 - protein, 9 aa, Mycobacterium
DGHRGPGIT

SEQ ID NO: 449198 - protein, 10 aa, Mycobacterium
DGHRGPGVTH

SEQ ID NO: 449199 - protein, 6 aa, Mycobacterium
DGHRGR

SEQ ID NO: 449200 - protein, 5 aa, Mycobacterium
DGHRN

SEQ ID NO: 449201 - protein, 6 aa, Mycobacterium
DGHRNG

SEQ ID NO: 449202 - protein, 6 aa, Mycobacterium
DGHRPG

SEQ ID NO: 449203 - protein, 12 aa, Mycobacterium
DGHRTDNPTDDV

SEQ ID NO: 449204 - protein, 8 aa, Mycobacterium
DGHRTGNG

SEQ ID NO: 449205 - protein, 4 aa, Mycobacterium
DGHT

SEQ ID NO: 449206 - protein, 5 aa, Mycobacterium
DGHTG

SEQ ID NO: 449207 - protein, 19 aa, Mycobacterium
DGHTGPGGTLPTNTGGGQL

SEQ ID NO: 449208 - protein, 6 aa, Mycobacterium
DGHTGR

SEQ ID NO: 449209 - protein, 5 aa, Mycobacterium
DGHTP

SEQ ID NO: 449210 - protein, 23 aa, Mycobacterium
DGHTRRANSAVPLDHSASSRALG

SEQ ID NO: 449211 - protein, 6 aa, Mycobacterium
DGHTRT

SEQ ID NO: 449212 - protein, 5 aa, Mycobacterium
DGHTV

SEQ ID NO: 449213 - protein, 16 aa, Mycobacterium
DGHVDATEHTDAGTRI

SEQ ID NO: 449214 - protein, 5 aa, Mycobacterium
DGHVH

SEQ ID NO: 449215 - protein, 5 aa, Mycobacterium
DGHVR

SEQ ID NO: 449216 - protein, 4 aa, Mycobacterium
DGHY

SEQ ID NO: 449217 - protein, 26 aa, Mycobacterium
DGHYSGAAALGNAQGYKYSHDNPDGV

SEQ ID NO: 449218 - protein, 13 aa, Mycobacterium
DGHYTDADRARAR

SEQ ID NO: 449219 - protein, 4 aa, Mycobacterium
DGIA

SEQ ID NO: 449220 - protein, 5 aa, Mycobacterium
DGIAA

SEQ ID NO: 449221 - protein, 5 aa, Mycobacterium
DGIAG

SEQ ID NO: 449222 - protein, 12 aa, Mycobacterium
DGIAGVEQIIDK

SEQ ID NO: 449223 - protein, 8 aa, Mycobacterium
DGIANPAN

SEQ ID NO: 449224 - protein, 9 aa, Mycobacterium
DGIAPPDST

SEQ ID NO: 449225 - protein, 10 aa, Mycobacterium
DGIATTSEEM

SEQ ID NO: 449226 - protein, 5 aa, Mycobacterium
DGIDA

SEQ ID NO: 449227 - protein, 9 aa, Mycobacterium
DGIDAEQAQ

SEQ ID NO: 449228 - protein, 101 aa, Mycobacterium
DGIDDLEEDADNAGEPDDIEDFEDTDEEDTDEEDTDEDADEDTDEDEELDDEELDDDELDDDDLGDDDLDDELDVDDSDTDDDDTDSEPADSPDGPPGPVE

SEQ ID NO: 449229 - protein, 8 aa, Mycobacterium
DGIDPDSA

SEQ ID NO: 449230 - protein, 6 aa, Mycobacterium
DGIDRY

SEQ ID NO: 449231 - protein, 8 aa, Mycobacterium
DGIDTGAI

SEQ ID NO: 449232 - protein, 4 aa, Mycobacterium
DGIE

SEQ ID NO: 449233 - protein, 12 aa, Mycobacterium
DGIEARTPEQRA

SEQ ID NO: 449234 - protein, 7 aa, Mycobacterium
DGIEGEE

SEQ ID NO: 449235 - protein, 5 aa, Mycobacterium
DGIEY

SEQ ID NO: 449236 - protein, 4 aa, Mycobacterium
DGIG

SEQ ID NO: 449237 - protein, 17 aa, Mycobacterium
DGIGDEAPDDGVRAGTA

SEQ ID NO: 449238 - protein, 6 aa, Mycobacterium
DGIGGA

SEQ ID NO: 449239 - protein, 6 aa, Mycobacterium
DGIGPE

SEQ ID NO: 449240 - protein, 8 aa, Mycobacterium
DGIGPVAP

SEQ ID NO: 449241 - protein, 6 aa, Mycobacterium
DGIGTE

SEQ ID NO: 449242 - protein, 10 aa, Mycobacterium
DGINGEAAPP

SEQ ID NO: 449243 - protein, 8 aa, Mycobacterium
DGIPDTPG

SEQ ID NO: 449244 - protein, 5 aa, Mycobacterium
DGIPE

SEQ ID NO: 449245 - protein, 7 aa, Mycobacterium
DGIPEGP

SEQ ID NO: 449246 - protein, 8 aa, Mycobacterium
DGIPGEPV

SEQ ID NO: 449247 - protein, 7 aa, Mycobacterium
DGIPKPT

SEQ ID NO: 449248 - protein, 9 aa, Mycobacterium
DGIPPPGST

SEQ ID NO: 449249 - protein, 13 aa, Mycobacterium
DGIPTDSGAEAER

SEQ ID NO: 449250 - protein, 4 aa, Mycobacterium
DGIQ

SEQ ID NO: 449251 - protein, 12 aa, Mycobacterium
DGIQPIASPEAT

SEQ ID NO: 449252 - protein, 4 aa, Mycobacterium
DGIR

SEQ ID NO: 449253 - protein, 6 aa, Mycobacterium
DGIRDA

SEQ ID NO: 449254 - protein, 10 aa, Mycobacterium
DGIRSGTAVT

SEQ ID NO: 449255 - protein, 7 aa, Mycobacterium
DGISAGA

SEQ ID NO: 449256 - protein, 11 aa, Mycobacterium
DGISDDDAAAI

SEQ ID NO: 449257 - protein, 5 aa, Mycobacterium
DGISG

SEQ ID NO: 449258 - protein, 18 aa, Mycobacterium
DGISGQTTAWKEAGTPGF

SEQ ID NO: 449259 - protein, 5 aa, Mycobacterium
DGISR

SEQ ID NO: 449260 - protein, 11 aa, Mycobacterium
DGITEGVEDPD

SEQ ID NO: 449261 - protein, 6 aa, Mycobacterium
DGITES

SEQ ID NO: 449262 - protein, 6 aa, Mycobacterium
DGITGD

SEQ ID NO: 449263 - protein, 5 aa, Mycobacterium
DGITP

SEQ ID NO: 449264 - protein, 6 aa, Mycobacterium
DGKAAR

SEQ ID NO: 449265 - protein, 7 aa, Mycobacterium
DGKADVV

SEQ ID NO: 449266 - protein, 5 aa, Mycobacterium
DGKAG

SEQ ID NO: 449267 - protein, 14 aa, Mycobacterium
DGKAPDHELTTPDW

SEQ ID NO: 449268 - protein, 8 aa, Mycobacterium
DGKARAVG

SEQ ID NO: 449269 - protein, 9 aa, Mycobacterium
DGKDARHRR

SEQ ID NO: 449270 - protein, 10 aa, Mycobacterium
DGKDETLAQY

SEQ ID NO: 449271 - protein, 7 aa, Mycobacterium
DGKDREM

SEQ ID NO: 449272 - protein, 6 aa, Mycobacterium
DGKEPL

SEQ ID NO: 449273 - protein, 7 aa, Mycobacterium
DGKEPQW

SEQ ID NO: 449274 - protein, 15 aa, Mycobacterium
DGKETEVNGTGNGPL

SEQ ID NO: 449275 - protein, 5 aa, Mycobacterium
DGKFR

SEQ ID NO: 449276 - protein, 13 aa, Mycobacterium
DGKFSDADRARQR

SEQ ID NO: 449277 - protein, 14 aa, Mycobacterium
DGKFSDADRARQRG

SEQ ID NO: 449278 - protein, 8 aa, Mycobacterium
DGKGEGHE

SEQ ID NO: 449279 - protein, 6 aa, Mycobacterium
DGKGGY

SEQ ID NO: 449280 - protein, 8 aa, Mycobacterium
DGKGITSR

SEQ ID NO: 449281 - protein, 8 aa, Mycobacterium
DGKGPGHE

SEQ ID NO: 449282 - protein, 9 aa, Mycobacterium
DGKGRATRE

SEQ ID NO: 449283 - protein, 8 aa, Mycobacterium
DGKGTGHE

SEQ ID NO: 449284 - protein, 9 aa, Mycobacterium
DGKILSPKA

SEQ ID NO: 449285 - protein, 10 aa, Mycobacterium
DGKITDPGRI

SEQ ID NO: 449286 - protein, 5 aa, Mycobacterium
DGKKI

SEQ ID NO: 449287 - protein, 9 aa, Mycobacterium
DGKKLSAAS

SEQ ID NO: 449288 - protein, 9 aa, Mycobacterium
DGKKMTDDE

SEQ ID NO: 449289 - protein, 9 aa, Mycobacterium
DGKKREDGV

SEQ ID NO: 449290 - protein, 9 aa, Mycobacterium
DGKKTTGSW

SEQ ID NO: 449291 - protein, 8 aa, Mycobacterium
DGKKVEGT

SEQ ID NO: 449292 - protein, 9 aa, Mycobacterium
DGKKVEGTW

SEQ ID NO: 449293 - protein, 12 aa, Mycobacterium
DGKKVSLSSYKG

SEQ ID NO: 449294 - protein, 12 aa, Mycobacterium
DGKLPAGTDTDR

SEQ ID NO: 449295 - protein, 5 aa, Mycobacterium
DGKLS

SEQ ID NO: 449296 - protein, 8 aa, Mycobacterium
DGKLSNKL

SEQ ID NO: 449297 - protein, 8 aa, Mycobacterium
DGKLTGDV

SEQ ID NO: 449298 - protein, 9 aa, Mycobacterium
DGKLTGDVA

SEQ ID NO: 449299 - protein, 15 aa, Mycobacterium
DGKNDDAALIDPSDA

SEQ ID NO: 449300 - protein, 10 aa, Mycobacterium
DGKNGEHREM

SEQ ID NO: 449301 - protein, 17 aa, Mycobacterium
DGKNYKALGGQDWDPEQ

SEQ ID NO: 449302 - protein, 8 aa, Mycobacterium
DGKPAISP

SEQ ID NO: 449303 - protein, 7 aa, Mycobacterium
DGKPAYI

SEQ ID NO: 449304 - protein, 7 aa, Mycobacterium
DGKPEFS

SEQ ID NO: 449305 - protein, 6 aa, Mycobacterium
DGKPEL

SEQ ID NO: 449306 - protein, 24 aa, Mycobacterium
DGKPFGSLNRSSTPPVISPDPEGI

SEQ ID NO: 449307 - protein, 9 aa, Mycobacterium
DGKPGHDGT

SEQ ID NO: 449308 - protein, 6 aa, Mycobacterium
DGKPHA

SEQ ID NO: 449309 - protein, 8 aa, Mycobacterium
DGKPHGVE

SEQ ID NO: 449310 - protein, 8 aa, Mycobacterium
DGKPLQSI

SEQ ID NO: 449311 - protein, 10 aa, Mycobacterium
DGKPLQSVAK

SEQ ID NO: 449312 - protein, 32 aa, Mycobacterium
DGKPLQSVAKGEVDLDSAEDQSEAEREEQQKE

SEQ ID NO: 449313 - protein, 32 aa, Mycobacterium
DGKPLQSVAKGEVDLGAEGDESQAEREEQQKE

SEQ ID NO: 449314 - protein, 6 aa, Mycobacterium
DGKPLV

SEQ ID NO: 449315 - protein, 8 aa, Mycobacterium
DGKPMSAQ

SEQ ID NO: 449316 - protein, 11 aa, Mycobacterium
DGKPNAVTPAH

SEQ ID NO: 449317 - protein, 7 aa, Mycobacterium
DGKPPVG

SEQ ID NO: 449318 - protein, 9 aa, Mycobacterium
DGKPRADGI

SEQ ID NO: 449319 - protein, 7 aa, Mycobacterium
DGKPRAV

SEQ ID NO: 449320 - protein, 7 aa, Mycobacterium
DGKPTRV

SEQ ID NO: 449321 - protein, 7 aa, Mycobacterium
DGKPVED

SEQ ID NO: 449322 - protein, 7 aa, Mycobacterium
DGKPVSR

SEQ ID NO: 449323 - protein, 10 aa, Mycobacterium
DGKQTGEMPM

SEQ ID NO: 449324 - protein, 13 aa, Mycobacterium
DGKQTTLGELAPG

SEQ ID NO: 449325 - protein, 9 aa, Mycobacterium
DGKRATSHW

SEQ ID NO: 449326 - protein, 14 aa, Mycobacterium
DGKRDAVRRVADLF

SEQ ID NO: 449327 - protein, 11 aa, Mycobacterium
DGKRDGGTDEV

SEQ ID NO: 449328 - protein, 9 aa, Mycobacterium
DGKRKGGLI

SEQ ID NO: 449329 - protein, 8 aa, Mycobacterium
DGKRSTTR

SEQ ID NO: 449330 - protein, 10 aa, Mycobacterium
DGKRTDEMPM

SEQ ID NO: 449331 - protein, 9 aa, Mycobacterium
DGKRTNEMP

SEQ ID NO: 449332 - protein, 6 aa, Mycobacterium
DGKRTR

SEQ ID NO: 449333 - protein, 10 aa, Mycobacterium
DGKRTSEMPM

SEQ ID NO: 449334 - protein, 8 aa, Mycobacterium
DGKSKRQH

SEQ ID NO: 449335 - protein, 17 aa, Mycobacterium
DGKSPHWTGGGNSPGTF

SEQ ID NO: 449336 - protein, 16 aa, Mycobacterium
DGKSTLFDGRSGEPFP

SEQ ID NO: 449337 - protein, 16 aa, Mycobacterium
DGKTGKELNRFVINGM

SEQ ID NO: 449338 - protein, 9 aa, Mycobacterium
DGKTKEDFG

SEQ ID NO: 449339 - protein, 5 aa, Mycobacterium
DGKTL

SEQ ID NO: 449340 - protein, 17 aa, Mycobacterium
DGKTPHWTGSSNSPRTF

SEQ ID NO: 449341 - protein, 9 aa, Mycobacterium
DGKTPRELP

SEQ ID NO: 449342 - protein, 7 aa, Mycobacterium
DGKTTFP

SEQ ID NO: 449343 - protein, 7 aa, Mycobacterium
DGKTVAA

SEQ ID NO: 449344 - protein, 6 aa, Mycobacterium
DGKTVK

SEQ ID NO: 449345 - protein, 6 aa, Mycobacterium
DGKTVN

SEQ ID NO: 449346 - protein, 9 aa, Mycobacterium
DGKVDPHTQ

SEQ ID NO: 449347 - protein, 11 aa, Mycobacterium
DGKVRNDLTPD

SEQ ID NO: 449348 - protein, 7 aa, Mycobacterium
DGKVRPA

SEQ ID NO: 449349 - protein, 5 aa, Mycobacterium
DGKVT

SEQ ID NO: 449350 - protein, 16 aa, Mycobacterium
DGKVTPRKYPDKEGEP

SEQ ID NO: 449351 - protein, 4 aa, Mycobacterium
DGLA

SEQ ID NO: 449352 - protein, 10 aa, Mycobacterium
DGLAASPSAN

SEQ ID NO: 449353 - protein, 5 aa, Mycobacterium
DGLAD

SEQ ID NO: 449354 - protein, 12 aa, Mycobacterium
DGLADEGRRDDL

SEQ ID NO: 449355 - protein, 11 aa, Mycobacterium
DGLAETGADLS

SEQ ID NO: 449356 - protein, 5 aa, Mycobacterium
DGLAG

SEQ ID NO: 449357 - protein, 17 aa, Mycobacterium
DGLAGGSVNYGPGSNTD

SEQ ID NO: 449358 - protein, 14 aa, Mycobacterium
DGLAPYDPGLTPTQ

SEQ ID NO: 449359 - protein, 19 aa, Mycobacterium
DGLARTAAAADEAGTAKRL

SEQ ID NO: 449360 - protein, 8 aa, Mycobacterium
DGLASELG

SEQ ID NO: 449361 - protein, 9 aa, Mycobacterium
DGLASTRNA

SEQ ID NO: 449362 - protein, 5 aa, Mycobacterium
DGLAT

SEQ ID NO: 449363 - protein, 5 aa, Mycobacterium
DGLDD

SEQ ID NO: 449364 - protein, 13 aa, Mycobacterium
DGLDGGSVPIGGP

SEQ ID NO: 449365 - protein, 8 aa, Mycobacterium
DGLDPQDP

SEQ ID NO: 449366 - protein, 8 aa, Mycobacterium
DGLDPTRD

SEQ ID NO: 449367 - protein, 32 aa, Mycobacterium
DGLDSGAGTDRIDKSQHLTPVSGGARIPSGKI

SEQ ID NO: 449368 - protein, 15 aa, Mycobacterium
DGLEAENTGDDYQAE

SEQ ID NO: 449369 - protein, 6 aa, Mycobacterium
DGLEAT

SEQ ID NO: 449370 - protein, 15 aa, Mycobacterium
DGLEDDAAVIALSVP

SEQ ID NO: 449371 - protein, 6 aa, Mycobacterium
DGLEDR

SEQ ID NO: 449372 - protein, 5 aa, Mycobacterium
DGLES

SEQ ID NO: 449373 - protein, 4 aa, Mycobacterium
DGLG

SEQ ID NO: 449374 - protein, 8 aa, Mycobacterium
DGLGATGT

SEQ ID NO: 449375 - protein, 9 aa, Mycobacterium
DGLGEDSPV

SEQ ID NO: 449376 - protein, 15 aa, Mycobacterium
DGLGEETTSDGVAPA

SEQ ID NO: 449377 - protein, 12 aa, Mycobacterium
DGLGGGSSTTSK

SEQ ID NO: 449378 - protein, 11 aa, Mycobacterium
DGLGPDAGGRF

SEQ ID NO: 449379 - protein, 9 aa, Mycobacterium
DGLGPGTDL

SEQ ID NO: 449380 - protein, 7 aa, Mycobacterium
DGLGQVP

SEQ ID NO: 449381 - protein, 5 aa, Mycobacterium
DGLGT

SEQ ID NO: 449382 - protein, 6 aa, Mycobacterium
DGLHGS

SEQ ID NO: 449383 - protein, 10 aa, Mycobacterium
DGLKASQCTN

SEQ ID NO: 449384 - protein, 11 aa, Mycobacterium
DGLPAEVRNDP

SEQ ID NO: 449385 - protein, 8 aa, Mycobacterium
DGLPANPG

SEQ ID NO: 449386 - protein, 6 aa, Mycobacterium
DGLPAY

SEQ ID NO: 449387 - protein, 8 aa, Mycobacterium
DGLPDGPP

SEQ ID NO: 449388 - protein, 9 aa, Mycobacterium
DGLPDGPPV

SEQ ID NO: 449389 - protein, 9 aa, Mycobacterium
DGLPDNPGA

SEQ ID NO: 449390 - protein, 9 aa, Mycobacterium
DGLPEDGTT

SEQ ID NO: 449391 - protein, 8 aa, Mycobacterium
DGLPESGY

SEQ ID NO: 449392 - protein, 7 aa, Mycobacterium
DGLPGVS

SEQ ID NO: 449393 - protein, 7 aa, Mycobacterium
DGLPNRP

SEQ ID NO: 449394 - protein, 9 aa, Mycobacterium
DGLPPEDAR

SEQ ID NO: 449395 - protein, 9 aa, Mycobacterium
DGLPPGAPA

SEQ ID NO: 449396 - protein, 8 aa, Mycobacterium
DGLPPNDQ

SEQ ID NO: 449397 - protein, 13 aa, Mycobacterium
DGLPPSTGATTAQ

SEQ ID NO: 449398 - protein, 5 aa, Mycobacterium
DGLPQ

SEQ ID NO: 449399 - protein, 9 aa, Mycobacterium
DGLPQKSDV

SEQ ID NO: 449400 - protein, 5 aa, Mycobacterium
DGLPS

SEQ ID NO: 449401 - protein, 11 aa, Mycobacterium
DGLPSEIREDP

SEQ ID NO: 449402 - protein, 10 aa, Mycobacterium
DGLPSPDDIE

SEQ ID NO: 449403 - protein, 11 aa, Mycobacterium
DGLPSQIREDP

SEQ ID NO: 449404 - protein, 10 aa, Mycobacterium
DGLPSTDAGE

SEQ ID NO: 449405 - protein, 16 aa, Mycobacterium
DGLPTGGEAAVTEQEE

SEQ ID NO: 449406 - protein, 7 aa, Mycobacterium
DGLPWPD

SEQ ID NO: 449407 - protein, 6 aa, Mycobacterium
DGLQDK

SEQ ID NO: 449408 - protein, 5 aa, Mycobacterium
DGLQG

SEQ ID NO: 449409 - protein, 8 aa, Mycobacterium
DGLQRGEG

SEQ ID NO: 449410 - protein, 10 aa, Mycobacterium
DGLRAEREQG

SEQ ID NO: 449411 - protein, 11 aa, Mycobacterium
DGLRGDSRDNR

SEQ ID NO: 449412 - protein, 7 aa, Mycobacterium
DGLSAQA

SEQ ID NO: 449413 - protein, 14 aa, Mycobacterium
DGLSDDSVLPAPVD

SEQ ID NO: 449414 - protein, 5 aa, Mycobacterium
DGLSG

SEQ ID NO: 449415 - protein, 12 aa, Mycobacterium
DGLSGAQAAEAA

SEQ ID NO: 449416 - protein, 18 aa, Mycobacterium
DGLSGAQLAERARRQAEK

SEQ ID NO: 449417 - protein, 7 aa, Mycobacterium
DGLSGEA

SEQ ID NO: 449418 - protein, 9 aa, Mycobacterium
DGLSPETAD

SEQ ID NO: 449419 - protein, 6 aa, Mycobacterium
DGLSPL

SEQ ID NO: 449420 - protein, 8 aa, Mycobacterium
DGLSRKTR

SEQ ID NO: 449421 - protein, 12 aa, Mycobacterium
DGLSTKARRNTP

SEQ ID NO: 449422 - protein, 5 aa, Mycobacterium
DGLTA

SEQ ID NO: 449423 - protein, 23 aa, Mycobacterium
DGLTDEDEAAAVDDGDEVSGDGA

SEQ ID NO: 449424 - protein, 18 aa, Mycobacterium
DGLTDEPRPGAPRTITDD

SEQ ID NO: 449425 - protein, 6 aa, Mycobacterium
DGLTGE

SEQ ID NO: 449426 - protein, 17 aa, Mycobacterium
DGLTGGSWRGPASASMA

SEQ ID NO: 449427 - protein, 6 aa, Mycobacterium
DGLTGP

SEQ ID NO: 449428 - protein, 8 aa, Mycobacterium
DGLTNQEI

SEQ ID NO: 449429 - protein, 6 aa, Mycobacterium
DGLTRL

SEQ ID NO: 449430 - protein, 11 aa, Mycobacterium
DGLTTKARRNA

SEQ ID NO: 449431 - protein, 9 aa, Mycobacterium
DGLTTRARR

SEQ ID NO: 449432 - protein, 10 aa, Mycobacterium
DGLTTRARRH

SEQ ID NO: 449433 - protein, 11 aa, Mycobacterium
DGLTTRQRRNT

SEQ ID NO: 449434 - protein, 13 aa, Mycobacterium
DGMAGANRDMKRG

SEQ ID NO: 449435 - protein, 21 aa, Mycobacterium
DGMAGSLGSARADAAVADDAR

SEQ ID NO: 449436 - protein, 8 aa, Mycobacterium
DGMANPAN

SEQ ID NO: 449437 - protein, 6 aa, Mycobacterium
DGMARG

SEQ ID NO: 449438 - protein, 8 aa, Mycobacterium
DGMGPQTG

SEQ ID NO: 449439 - protein, 12 aa, Mycobacterium
DGMPARKPGTAV

SEQ ID NO: 449440 - protein, 13 aa, Mycobacterium
DGMPEGYDPKETV

SEQ ID NO: 449441 - protein, 6 aa, Mycobacterium
DGMPGV

SEQ ID NO: 449442 - protein, 7 aa, Mycobacterium
DGMPQGS

SEQ ID NO: 449443 - protein, 5 aa, Mycobacterium
DGMQQ

SEQ ID NO: 449444 - protein, 4 aa, Mycobacterium
DGMS

SEQ ID NO: 449445 - protein, 19 aa, Mycobacterium
DGMSAGIGATTFDEGEART

SEQ ID NO: 449446 - protein, 15 aa, Mycobacterium
DGMSGLPEVSRSELS

SEQ ID NO: 449447 - protein, 12 aa, Mycobacterium
DGMSPGEAEREA

SEQ ID NO: 449448 - protein, 6 aa, Mycobacterium
DGMSRV

SEQ ID NO: 449449 - protein, 5 aa, Mycobacterium
DGMST

SEQ ID NO: 449450 - protein, 18 aa, Mycobacterium
DGNAAHRPQATPKGERRR

SEQ ID NO: 449451 - protein, 10 aa, Mycobacterium
DGNAEVDPAS

SEQ ID NO: 449452 - protein, 9 aa, Mycobacterium
DGNALDSND

SEQ ID NO: 449453 - protein, 13 aa, Mycobacterium
DGNAPADSSAISA

SEQ ID NO: 449454 - protein, 6 aa, Mycobacterium
DGNART

SEQ ID NO: 449455 - protein, 11 aa, Mycobacterium
DGNATDSPEEA

SEQ ID NO: 449456 - protein, 5 aa, Mycobacterium
DGNAV

SEQ ID NO: 449457 - protein, 7 aa, Mycobacterium
DGNDDVE

SEQ ID NO: 449458 - protein, 5 aa, Mycobacterium
DGNDP

SEQ ID NO: 449459 - protein, 6 aa, Mycobacterium
DGNDPL

SEQ ID NO: 449460 - protein, 7 aa, Mycobacterium
DGNDPLA

SEQ ID NO: 449461 - protein, 7 aa, Mycobacterium
DGNDVGA

SEQ ID NO: 449462 - protein, 7 aa, Mycobacterium
DGNDVQT

SEQ ID NO: 449463 - protein, 7 aa, Mycobacterium
DGNEASV

SEQ ID NO: 449464 - protein, 10 aa, Mycobacterium
DGNELPPGQA

SEQ ID NO: 449465 - protein, 11 aa, Mycobacterium
DGNELPPGQAG

SEQ ID NO: 449466 - protein, 6 aa, Mycobacterium
DGNERP

SEQ ID NO: 449467 - protein, 7 aa, Mycobacterium
DGNFGNP

SEQ ID NO: 449468 - protein, 6 aa, Mycobacterium
DGNGAH

SEQ ID NO: 449469 - protein, 5 aa, Mycobacterium
DGNGE

SEQ ID NO: 449470 - protein, 11 aa, Mycobacterium
DGNGGAGGNGG

SEQ ID NO: 449471 - protein, 8 aa, Mycobacterium
DGNGQTVG

SEQ ID NO: 449472 - protein, 17 aa, Mycobacterium
DGNGRAGAARRPLTGAG

SEQ ID NO: 449473 - protein, 9 aa, Mycobacterium
DGNGVQATT

SEQ ID NO: 449474 - protein, 12 aa, Mycobacterium
DGNGYPPPAYPP

SEQ ID NO: 449475 - protein, 12 aa, Mycobacterium
DGNHGDGPYPMD

SEQ ID NO: 449476 - protein, 7 aa, Mycobacterium
DGNHGRG

SEQ ID NO: 449477 - protein, 5 aa, Mycobacterium
DGNIQ

SEQ ID NO: 449478 - protein, 6 aa, Mycobacterium
DGNKAV

SEQ ID NO: 449479 - protein, 5 aa, Mycobacterium
DGNKF

SEQ ID NO: 449480 - protein, 6 aa, Mycobacterium
DGNKFS

SEQ ID NO: 449481 - protein, 8 aa, Mycobacterium
DGNKRTAW

SEQ ID NO: 449482 - protein, 10 aa, Mycobacterium
DGNNDPATAS

SEQ ID NO: 449483 - protein, 6 aa, Mycobacterium
DGNNNI

SEQ ID NO: 449484 - protein, 7 aa, Mycobacterium
DGNNSSF

SEQ ID NO: 449485 - protein, 4 aa, Mycobacterium
DGNP

SEQ ID NO: 449486 - protein, 9 aa, Mycobacterium
DGNPANNCR

SEQ ID NO: 449487 - protein, 7 aa, Mycobacterium
DGNPDAV

SEQ ID NO: 449488 - protein, 7 aa, Mycobacterium
DGNPDVG

SEQ ID NO: 449489 - protein, 12 aa, Mycobacterium
DGNPKASKDVRA

SEQ ID NO: 449490 - protein, 13 aa, Mycobacterium
DGNPKASKDVRKQ

SEQ ID NO: 449491 - protein, 12 aa, Mycobacterium
DGNPKASKDVRR

SEQ ID NO: 449492 - protein, 13 aa, Mycobacterium
DGNPKASKDVRRQ

SEQ ID NO: 449493 - protein, 5 aa, Mycobacterium
DGNPP

SEQ ID NO: 449494 - protein, 8 aa, Mycobacterium
DGNPRTCA

SEQ ID NO: 449495 - protein, 10 aa, Mycobacterium
DGNPSNNRRE

SEQ ID NO: 449496 - protein, 6 aa, Mycobacterium
DGNQAV

SEQ ID NO: 449497 - protein, 10 aa, Mycobacterium
DGNQTPPADW

SEQ ID NO: 449498 - protein, 4 aa, Mycobacterium
DGNR

SEQ ID NO: 449499 - protein, 7 aa, Mycobacterium
DGNRRGQ

SEQ ID NO: 449500 - protein, 5 aa, Mycobacterium
DGNRY

SEQ ID NO: 449501 - protein, 16 aa, Mycobacterium
DGNRYHPEPASRTAAK

SEQ ID NO: 449502 - protein, 16 aa, Mycobacterium
DGNRYRPRPAARTGAK

SEQ ID NO: 449503 - protein, 8 aa, Mycobacterium
DGNSLTGT

SEQ ID NO: 449504 - protein, 26 aa, Mycobacterium
DGNSNRYEGYQRRTSRRIPLVRLTPK

SEQ ID NO: 449505 - protein, 14 aa, Mycobacterium
DGNSSGWSTTSPMT

SEQ ID NO: 449506 - protein, 18 aa, Mycobacterium
DGNSVPEAVTRESAGVAA

SEQ ID NO: 449507 - protein, 4 aa, Mycobacterium
DGNT

SEQ ID NO: 449508 - protein, 5 aa, Mycobacterium
DGNTE

SEQ ID NO: 449509 - protein, 4 aa, Mycobacterium
DGNV

SEQ ID NO: 449510 - protein, 5 aa, Mycobacterium
DGNVD

SEQ ID NO: 449511 - protein, 14 aa, Mycobacterium
DGNVGTATTTTSSS

SEQ ID NO: 449512 - protein, 7 aa, Mycobacterium
DGNVRPA

SEQ ID NO: 449513 - protein, 6 aa, Mycobacterium
DGNYSR

SEQ ID NO: 449514 - protein, 7 aa, Mycobacterium
DGPAARD

SEQ ID NO: 449515 - protein, 29 aa, Mycobacterium
DGPADAGPDGASPKGPPVPAGAVSPPRSL

SEQ ID NO: 449516 - protein, 10 aa, Mycobacterium
DGPADPSAAR

SEQ ID NO: 449517 - protein, 6 aa, Mycobacterium
DGPAFA

SEQ ID NO: 449518 - protein, 11 aa, Mycobacterium
DGPAGKGKAGF

SEQ ID NO: 449519 - protein, 6 aa, Mycobacterium
DGPAGP

SEQ ID NO: 449520 - protein, 13 aa, Mycobacterium
DGPAGSAPDSSKW

SEQ ID NO: 449521 - protein, 5 aa, Mycobacterium
DGPAH

SEQ ID NO: 449522 - protein, 9 aa, Mycobacterium
DGPAPEPIK

SEQ ID NO: 449523 - protein, 8 aa, Mycobacterium
DGPAPEPL

SEQ ID NO: 449524 - protein, 10 aa, Mycobacterium
DGPAPEPVPR

SEQ ID NO: 449525 - protein, 9 aa, Mycobacterium
DGPAPEVPG

SEQ ID NO: 449526 - protein, 6 aa, Mycobacterium
DGPAPS

SEQ ID NO: 449527 - protein, 14 aa, Mycobacterium
DGPAPTDNPPTKPF

SEQ ID NO: 449528 - protein, 10 aa, Mycobacterium
DGPAPVPPTH

SEQ ID NO: 449529 - protein, 6 aa, Mycobacterium
DGPAQA

SEQ ID NO: 449530 - protein, 9 aa, Mycobacterium
DGPAQELAT

SEQ ID NO: 449531 - protein, 7 aa, Mycobacterium
DGPAQVR

SEQ ID NO: 449532 - protein, 5 aa, Mycobacterium
DGPAS

SEQ ID NO: 449533 - protein, 6 aa, Mycobacterium
DGPASA

SEQ ID NO: 449534 - protein, 9 aa, Mycobacterium
DGPATSRPL

SEQ ID NO: 449535 - protein, 46 aa, Mycobacterium
DGPAWATATQTDTPPADLQKSVGAPEMTGAAQAAQPVGEAAPEPIA

SEQ ID NO: 449536 - protein, 63 aa, Mycobacterium
DGPAWSSKTDTTEPPPPAPEPEKEAEVAPAAAEEAAPAPVAEPAPAEPAPAAPPPAPPAPRTY

SEQ ID NO: 449537 - protein, 41 aa, Mycobacterium
DGPAWSTHTETDAPPPPEPTAAAEATASDTAQRVDTTPEPV

SEQ ID NO: 449538 - protein, 10 aa, Mycobacterium
DGPAYGPSTS

SEQ ID NO: 449539 - protein, 5 aa, Mycobacterium
DGPCA

SEQ ID NO: 449540 - protein, 10 aa, Mycobacterium
DGPDADATGI

SEQ ID NO: 449541 - protein, 7 aa, Mycobacterium
DGPDAGA

SEQ ID NO: 449542 - protein, 7 aa, Mycobacterium
DGPDAGL

SEQ ID NO: 449543 - protein, 7 aa, Mycobacterium
DGPDATT

SEQ ID NO: 449544 - protein, 9 aa, Mycobacterium
DGPDDQPSA

SEQ ID NO: 449545 - protein, 6 aa, Mycobacterium
DGPDEV

SEQ ID NO: 449546 - protein, 5 aa, Mycobacterium
DGPDG

SEQ ID NO: 449547 - protein, 10 aa, Mycobacterium
DGPDGQQNWT

SEQ ID NO: 449548 - protein, 9 aa, Mycobacterium
DGPDPECVQ

SEQ ID NO: 449549 - protein, 11 aa, Mycobacterium
DGPDPECVQGH

SEQ ID NO: 449550 - protein, 7 aa, Mycobacterium
DGPDRAD

SEQ ID NO: 449551 - protein, 17 aa, Mycobacterium
DGPDREALQARTPTGLR

SEQ ID NO: 449552 - protein, 16 aa, Mycobacterium
DGPDRERLQARTPAEL

SEQ ID NO: 449553 - protein, 17 aa, Mycobacterium
DGPDRERLQARTPAGLG

SEQ ID NO: 449554 - protein, 16 aa, Mycobacterium
DGPDRERLQARTPERL

SEQ ID NO: 449555 - protein, 7 aa, Mycobacterium
DGPDRGR

SEQ ID NO: 449556 - protein, 7 aa, Mycobacterium
DGPDRPD

SEQ ID NO: 449557 - protein, 19 aa, Mycobacterium
DGPDTNTDGATLRGATPSM

SEQ ID NO: 449558 - protein, 6 aa, Mycobacterium
DGPDYD

SEQ ID NO: 449559 - protein, 7 aa, Mycobacterium
DGPDYDL

SEQ ID NO: 449560 - protein, 4 aa, Mycobacterium
DGPE

SEQ ID NO: 449561 - protein, 10 aa, Mycobacterium
DGPEAARDRV

SEQ ID NO: 449562 - protein, 16 aa, Mycobacterium
DGPEAEETLRQTSYAQ

SEQ ID NO: 449563 - protein, 13 aa, Mycobacterium
DGPEAGATSADGR

SEQ ID NO: 449564 - protein, 8 aa, Mycobacterium
DGPEAVAG

SEQ ID NO: 449565 - protein, 8 aa, Mycobacterium
DGPEHEER

SEQ ID NO: 449566 - protein, 34 aa, Mycobacterium
DGPELAPPQHHPEDQPVPGPRGRVPTDWADRLRA

SEQ ID NO: 449567 - protein, 6 aa, Mycobacterium
DGPELS

SEQ ID NO: 449568 - protein, 6 aa, Mycobacterium
DGPENA

SEQ ID NO: 449569 - protein, 9 aa, Mycobacterium
DGPENGGRI

SEQ ID NO: 449570 - protein, 5 aa, Mycobacterium
DGPEP

SEQ ID NO: 449571 - protein, 26 aa, Mycobacterium
DGPEPDDAERGRKRGVSIGRQGAEAM

SEQ ID NO: 449572 - protein, 6 aa, Mycobacterium
DGPEPL

SEQ ID NO: 449573 - protein, 12 aa, Mycobacterium
DGPEPSEKEKAT

SEQ ID NO: 449574 - protein, 7 aa, Mycobacterium
DGPEPSV

SEQ ID NO: 449575 - protein, 8 aa, Mycobacterium
DGPEPSVG

SEQ ID NO: 449576 - protein, 15 aa, Mycobacterium
DGPESPRATHTSTGA

SEQ ID NO: 449577 - protein, 7 aa, Mycobacterium
DGPESVD

SEQ ID NO: 449578 - protein, 8 aa, Mycobacterium
DGPEVESE

SEQ ID NO: 449579 - protein, 7 aa, Mycobacterium
DGPEVET

SEQ ID NO: 449580 - protein, 15 aa, Mycobacterium
DGPEVETGEITPQTC

SEQ ID NO: 449581 - protein, 6 aa, Mycobacterium
DGPEVG

SEQ ID NO: 449582 - protein, 13 aa, Mycobacterium
DGPEVLTASPFWQ

SEQ ID NO: 449583 - protein, 13 aa, Mycobacterium
DGPEVLTASPMWQ

SEQ ID NO: 449584 - protein, 13 aa, Mycobacterium
DGPEVLTASPMWR

SEQ ID NO: 449585 - protein, 5 aa, Mycobacterium
DGPFS

SEQ ID NO: 449586 - protein, 6 aa, Mycobacterium
DGPGAE

SEQ ID NO: 449587 - protein, 7 aa, Mycobacterium
DGPGDAD

SEQ ID NO: 449588 - protein, 14 aa, Mycobacterium
DGPGDVPRLVTAYP

SEQ ID NO: 449589 - protein, 6 aa, Mycobacterium
DGPGFV

SEQ ID NO: 449590 - protein, 9 aa, Mycobacterium
DGPGGQTPL

SEQ ID NO: 449591 - protein, 15 aa, Mycobacterium
DGPGGYSGIDGDEQW

SEQ ID NO: 449592 - protein, 13 aa, Mycobacterium
DGPGGYTGVEGDA

SEQ ID NO: 449593 - protein, 7 aa, Mycobacterium
DGPGIPD

SEQ ID NO: 449594 - protein, 7 aa, Mycobacterium
DGPGIPE

SEQ ID NO: 449595 - protein, 14 aa, Mycobacterium
DGPGLPVLRQRLLS

SEQ ID NO: 449596 - protein, 10 aa, Mycobacterium
DGPGPDLPGA

SEQ ID NO: 449597 - protein, 11 aa, Mycobacterium
DGPGPEGTDVP

SEQ ID NO: 449598 - protein, 12 aa, Mycobacterium
DGPGPSTERGAD

SEQ ID NO: 449599 - protein, 9 aa, Mycobacterium
DGPGQGAAL

SEQ ID NO: 449600 - protein, 5 aa, Mycobacterium
DGPGV

SEQ ID NO: 449601 - protein, 7 aa, Mycobacterium
DGPGVGA

SEQ ID NO: 449602 - protein, 14 aa, Mycobacterium
DGPGVGSALSSHPD

SEQ ID NO: 449603 - protein, 12 aa, Mycobacterium
DGPGVPTEHKKM

SEQ ID NO: 449604 - protein, 8 aa, Mycobacterium
DGPGYDLS

SEQ ID NO: 449605 - protein, 7 aa, Mycobacterium
DGPGYER

SEQ ID NO: 449606 - protein, 14 aa, Mycobacterium
DGPHERRRHGTARQ

SEQ ID NO: 449607 - protein, 5 aa, Mycobacterium
DGPHG

SEQ ID NO: 449608 - protein, 10 aa, Mycobacterium
DGPHPADRQQ

SEQ ID NO: 449609 - protein, 8 aa, Mycobacterium
DGPHRAAA

SEQ ID NO: 449610 - protein, 15 aa, Mycobacterium
DGPHRSGSTALAYHS

SEQ ID NO: 449611 - protein, 5 aa, Mycobacterium
DGPIA

SEQ ID NO: 449612 - protein, 5 aa, Mycobacterium
DGPID

SEQ ID NO: 449613 - protein, 9 aa, Mycobacterium
DGPIEPGPT

SEQ ID NO: 449614 - protein, 10 aa, Mycobacterium
DGPKADKGLR

SEQ ID NO: 449615 - protein, 8 aa, Mycobacterium
DGPKDGQV

SEQ ID NO: 449616 - protein, 7 aa, Mycobacterium
DGPKEGE

SEQ ID NO: 449617 - protein, 8 aa, Mycobacterium
DGPKPTGL

SEQ ID NO: 449618 - protein, 5 aa, Mycobacterium
DGPKR

SEQ ID NO: 449619 - protein, 6 aa, Mycobacterium
DGPLGN

SEQ ID NO: 449620 - protein, 6 aa, Mycobacterium
DGPLPP

SEQ ID NO: 449621 - protein, 9 aa, Mycobacterium
DGPLPQQGR

SEQ ID NO: 449622 - protein, 5 aa, Mycobacterium
DGPLQ

SEQ ID NO: 449623 - protein, 6 aa, Mycobacterium
DGPLQT

SEQ ID NO: 449624 - protein, 5 aa, Mycobacterium
DGPLT

SEQ ID NO: 449625 - protein, 4 aa, Mycobacterium
DGPM

SEQ ID NO: 449626 - protein, 6 aa, Mycobacterium
DGPMNE

SEQ ID NO: 449627 - protein, 7 aa, Mycobacterium
DGPMPQT

SEQ ID NO: 449628 - protein, 5 aa, Mycobacterium
DGPMT

SEQ ID NO: 449629 - protein, 6 aa, Mycobacterium
DGPNGA

SEQ ID NO: 449630 - protein, 7 aa, Mycobacterium
DGPNGPK

SEQ ID NO: 449631 - protein, 8 aa, Mycobacterium
DGPNGPKL

SEQ ID NO: 449632 - protein, 8 aa, Mycobacterium
DGPNGPVE

SEQ ID NO: 449633 - protein, 5 aa, Mycobacterium
DGPNR

SEQ ID NO: 449634 - protein, 9 aa, Mycobacterium
DGPNRGETK

SEQ ID NO: 449635 - protein, 6 aa, Mycobacterium
DGPPAQ

SEQ ID NO: 449636 - protein, 7 aa, Mycobacterium
DGPPDHP

SEQ ID NO: 449637 - protein, 13 aa, Mycobacterium
DGPPGEIVQSDQD

SEQ ID NO: 449638 - protein, 8 aa, Mycobacterium
DGPPGFKS

SEQ ID NO: 449639 - protein, 6 aa, Mycobacterium
DGPPGW

SEQ ID NO: 449640 - protein, 6 aa, Mycobacterium
DGPPNS

SEQ ID NO: 449641 - protein, 8 aa, Mycobacterium
DGPPPDEP

SEQ ID NO: 449642 - protein, 5 aa, Mycobacterium
DGPPQ

SEQ ID NO: 449643 - protein, 8 aa, Mycobacterium
DGPPRALA

SEQ ID NO: 449644 - protein, 8 aa, Mycobacterium
DGPPRDMS

SEQ ID NO: 449645 - protein, 19 aa, Mycobacterium
DGPPVAEPAEHASSVASSM

SEQ ID NO: 449646 - protein, 7 aa, Mycobacterium
DGPQARG

SEQ ID NO: 449647 - protein, 5 aa, Mycobacterium
DGPQH

SEQ ID NO: 449648 - protein, 6 aa, Mycobacterium
DGPQHK

SEQ ID NO: 449649 - protein, 5 aa, Mycobacterium
DGPQL

SEQ ID NO: 449650 - protein, 9 aa, Mycobacterium
DGPQLKPAY

SEQ ID NO: 449651 - protein, 7 aa, Mycobacterium
DGPQRRV

SEQ ID NO: 449652 - protein, 17 aa, Mycobacterium
DGPQSEARAAETAAASP

SEQ ID NO: 449653 - protein, 16 aa, Mycobacterium
DGPQSGGLGGTYGGNP

SEQ ID NO: 449654 - protein, 10 aa, Mycobacterium
DGPQYNKEQG

SEQ ID NO: 449655 - protein, 7 aa, Mycobacterium
DGPRAAR

SEQ ID NO: 449656 - protein, 6 aa, Mycobacterium
DGPRAG

SEQ ID NO: 449657 - protein, 9 aa, Mycobacterium
DGPRAGAAA

SEQ ID NO: 449658 - protein, 61 aa, Mycobacterium
DGPRARGAGQPQPDADRSGAHVGDPAGVGAAAAGAEAGRPARRAEHHPRPGRLRPSRRPRL

SEQ ID NO: 449659 - protein, 7 aa, Mycobacterium
DGPRDEQ

SEQ ID NO: 449660 - protein, 12 aa, Mycobacterium
DGPREAAVDQTD

SEQ ID NO: 449661 - protein, 8 aa, Mycobacterium
DGPREAGG

SEQ ID NO: 449662 - protein, 11 aa, Mycobacterium
DGPRERAVNDT

SEQ ID NO: 449663 - protein, 11 aa, Mycobacterium
DGPRESAADPY

SEQ ID NO: 449664 - protein, 7 aa, Mycobacterium
DGPRHTT

SEQ ID NO: 449665 - protein, 5 aa, Mycobacterium
DGPRM

SEQ ID NO: 449666 - protein, 5 aa, Mycobacterium
DGPRR

SEQ ID NO: 449667 - protein, 7 aa, Mycobacterium
DGPRRQG

SEQ ID NO: 449668 - protein, 17 aa, Mycobacterium
DGPRRTPGHPGAHTERH

SEQ ID NO: 449669 - protein, 5 aa, Mycobacterium
DGPRS

SEQ ID NO: 449670 - protein, 14 aa, Mycobacterium
DGPRTLPDDDATTQ

SEQ ID NO: 449671 - protein, 7 aa, Mycobacterium
DGPRTTR

SEQ ID NO: 449672 - protein, 13 aa, Mycobacterium
DGPSDLSSGDRSL

SEQ ID NO: 449673 - protein, 8 aa, Mycobacterium
DGPSGDTA

SEQ ID NO: 449674 - protein, 26 aa, Mycobacterium
DGPSGLRPHPTSADRAVRGTDSGQMD

SEQ ID NO: 449675 - protein, 9 aa, Mycobacterium
DGPSGPKLL

SEQ ID NO: 449676 - protein, 7 aa, Mycobacterium
DGPSGSR

SEQ ID NO: 449677 - protein, 21 aa, Mycobacterium
DGPSHAANPQSLSAAEQAGTE

SEQ ID NO: 449678 - protein, 8 aa, Mycobacterium
DGPSPVNN

SEQ ID NO: 449679 - protein, 19 aa, Mycobacterium
DGPSSASGLASAERVRPQS

SEQ ID NO: 449680 - protein, 6 aa, Mycobacterium
DGPTAM

SEQ ID NO: 449681 - protein, 7 aa, Mycobacterium
DGPTAPQ

SEQ ID NO: 449682 - protein, 7 aa, Mycobacterium
DGPTAQK

SEQ ID NO: 449683 - protein, 7 aa, Mycobacterium
DGPTATI

SEQ ID NO: 449684 - protein, 6 aa, Mycobacterium
DGPTDG

SEQ ID NO: 449685 - protein, 6 aa, Mycobacterium
DGPTDI

SEQ ID NO: 449686 - protein, 8 aa, Mycobacterium
DGPTDPQR

SEQ ID NO: 449687 - protein, 7 aa, Mycobacterium
DGPTDQF

SEQ ID NO: 449688 - protein, 11 aa, Mycobacterium
DGPTDRPTPTV

SEQ ID NO: 449689 - protein, 5 aa, Mycobacterium
DGPTE

SEQ ID NO: 449690 - protein, 9 aa, Mycobacterium
DGPTERAVD

SEQ ID NO: 449691 - protein, 7 aa, Mycobacterium
DGPTEVH

SEQ ID NO: 449692 - protein, 8 aa, Mycobacterium
DGPTEVHK

SEQ ID NO: 449693 - protein, 9 aa, Mycobacterium
DGPTEVHKT

SEQ ID NO: 449694 - protein, 7 aa, Mycobacterium
DGPTGVP

SEQ ID NO: 449695 - protein, 5 aa, Mycobacterium
DGPTI

SEQ ID NO: 449696 - protein, 6 aa, Mycobacterium
DGPTPE

SEQ ID NO: 449697 - protein, 12 aa, Mycobacterium
DGPTPKLPNWPD

SEQ ID NO: 449698 - protein, 8 aa, Mycobacterium
DGPTPSQR

SEQ ID NO: 449699 - protein, 6 aa, Mycobacterium
DGPTSH

SEQ ID NO: 449700 - protein, 7 aa, Mycobacterium
DGPTTAI

SEQ ID NO: 449701 - protein, 5 aa, Mycobacterium
DGPTY

SEQ ID NO: 449702 - protein, 5 aa, Mycobacterium
DGPVA

SEQ ID NO: 449703 - protein, 8 aa, Mycobacterium
DGPVDAGQ

SEQ ID NO: 449704 - protein, 15 aa, Mycobacterium
DGPVDDQSDGPLDGL

SEQ ID NO: 449705 - protein, 6 aa, Mycobacterium
DGPVDF

SEQ ID NO: 449706 - protein, 6 aa, Mycobacterium
DGPVEE

SEQ ID NO: 449707 - protein, 12 aa, Mycobacterium
DGPVLVESHRLW

SEQ ID NO: 449708 - protein, 8 aa, Mycobacterium
DGPVPADR

SEQ ID NO: 449709 - protein, 13 aa, Mycobacterium
DGPVPEGFDPGAV

SEQ ID NO: 449710 - protein, 16 aa, Mycobacterium
DGPVPLPARGAGPGHP

SEQ ID NO: 449711 - protein, 5 aa, Mycobacterium
DGPVS

SEQ ID NO: 449712 - protein, 5 aa, Mycobacterium
DGPVT

SEQ ID NO: 449713 - protein, 8 aa, Mycobacterium
DGPVTSPT

SEQ ID NO: 449714 - protein, 12 aa, Mycobacterium
DGPWESGRRPGI

SEQ ID NO: 449715 - protein, 5 aa, Mycobacterium
DGPWG

SEQ ID NO: 449716 - protein, 5 aa, Mycobacterium
DGPWP

SEQ ID NO: 449717 - protein, 10 aa, Mycobacterium
DGPYAEASEV

SEQ ID NO: 449718 - protein, 5 aa, Mycobacterium
DGPYH

SEQ ID NO: 449719 - protein, 8 aa, Mycobacterium
DGPYIEGT

SEQ ID NO: 449720 - protein, 7 aa, Mycobacterium
DGPYLPG

SEQ ID NO: 449721 - protein, 8 aa, Mycobacterium
DGPYRTVD

SEQ ID NO: 449722 - protein, 7 aa, Mycobacterium
DGQAADE

SEQ ID NO: 449723 - protein, 6 aa, Mycobacterium
DGQAAR

SEQ ID NO: 449724 - protein, 7 aa, Mycobacterium
DGQACGE

SEQ ID NO: 449725 - protein, 19 aa, Mycobacterium
DGQADGSIRPELSATTTAN

SEQ ID NO: 449726 - protein, 6 aa, Mycobacterium
DGQAEK

SEQ ID NO: 449727 - protein, 15 aa, Mycobacterium
DGQAEPSGDAEADIA

SEQ ID NO: 449728 - protein, 14 aa, Mycobacterium
DGQAGGSKRAELPA

SEQ ID NO: 449729 - protein, 8 aa, Mycobacterium
DGQALAPG

SEQ ID NO: 449730 - protein, 6 aa, Mycobacterium
DGQALD

SEQ ID NO: 449731 - protein, 6 aa, Mycobacterium
DGQAPG

SEQ ID NO: 449732 - protein, 19 aa, Mycobacterium
DGQAQRVESGPRGPGRPPQ

SEQ ID NO: 449733 - protein, 11 aa, Mycobacterium
DGQARAGAGDL

SEQ ID NO: 449734 - protein, 6 aa, Mycobacterium
DGQCEM

SEQ ID NO: 449735 - protein, 4 aa, Mycobacterium
DGQD

SEQ ID NO: 449736 - protein, 9 aa, Mycobacterium
DGQDADSVQ

SEQ ID NO: 449737 - protein, 12 aa, Mycobacterium
DGQDDPATLQLL

SEQ ID NO: 449738 - protein, 15 aa, Mycobacterium
DGQDFPRTASGKVQK

SEQ ID NO: 449739 - protein, 10 aa, Mycobacterium
DGQDGADAGD

SEQ ID NO: 449740 - protein, 7 aa, Mycobacterium
DGQDGRT

SEQ ID NO: 449741 - protein, 16 aa, Mycobacterium
DGQDGVATRPGPPPTV

SEQ ID NO: 449742 - protein, 5 aa, Mycobacterium
DGQDH

SEQ ID NO: 449743 - protein, 8 aa, Mycobacterium
DGQDPEPA

SEQ ID NO: 449744 - protein, 9 aa, Mycobacterium
DGQEFTEDD

SEQ ID NO: 449745 - protein, 11 aa, Mycobacterium
DGQEPARNAAR

SEQ ID NO: 449746 - protein, 4 aa, Mycobacterium
DGQF

SEQ ID NO: 449747 - protein, 14 aa, Mycobacterium
DGQFSDADRARRRG

SEQ ID NO: 449748 - protein, 6 aa, Mycobacterium
DGQGAV

SEQ ID NO: 449749 - protein, 6 aa, Mycobacterium
DGQGIE

SEQ ID NO: 449750 - protein, 16 aa, Mycobacterium
DGQGKPSERTFRSTTT

SEQ ID NO: 449751 - protein, 26 aa, Mycobacterium
DGQGQPAAPPAQQPPRHGAGTPAPTR

SEQ ID NO: 449752 - protein, 8 aa, Mycobacterium
DGQGRADD

SEQ ID NO: 449753 - protein, 6 aa, Mycobacterium
DGQGRI

SEQ ID NO: 449754 - protein, 7 aa, Mycobacterium
DGQGRQQ

SEQ ID NO: 449755 - protein, 10 aa, Mycobacterium
DGQGSKTVTA

SEQ ID NO: 449756 - protein, 5 aa, Mycobacterium
DGQGT

SEQ ID NO: 449757 - protein, 5 aa, Mycobacterium
DGQHI

SEQ ID NO: 449758 - protein, 6 aa, Mycobacterium
DGQHQV

SEQ ID NO: 449759 - protein, 5 aa, Mycobacterium
DGQHR

SEQ ID NO: 449760 - protein, 4 aa, Mycobacterium
DGQI

SEQ ID NO: 449761 - protein, 15 aa, Mycobacterium
DGQIAKRRGPDAAAT

SEQ ID NO: 449762 - protein, 5 aa, Mycobacterium
DGQIG

SEQ ID NO: 449763 - protein, 18 aa, Mycobacterium
DGQIGPVDDPRPLPDFLA

SEQ ID NO: 449764 - protein, 20 aa, Mycobacterium
DGQLAGTLTDANPDGPDTAE

SEQ ID NO: 449765 - protein, 22 aa, Mycobacterium
DGQLASAGADADAACSGAATDL

SEQ ID NO: 449766 - protein, 5 aa, Mycobacterium
DGQLG

SEQ ID NO: 449767 - protein, 14 aa, Mycobacterium
DGQLGDDEGEPGAR

SEQ ID NO: 449768 - protein, 7 aa, Mycobacterium
DGQLGGG

SEQ ID NO: 449769 - protein, 6 aa, Mycobacterium
DGQLGR

SEQ ID NO: 449770 - protein, 24 aa, Mycobacterium
DGQLPGRQPVRSERERAAAKGSDK

SEQ ID NO: 449771 - protein, 12 aa, Mycobacterium
DGQLPPDTAAWL

SEQ ID NO: 449772 - protein, 7 aa, Mycobacterium
DGQLQDA

SEQ ID NO: 449773 - protein, 15 aa, Mycobacterium
DGQNISVKGSKGTLE

SEQ ID NO: 449774 - protein, 25 aa, Mycobacterium
DGQNLSPAQLSAAQKATRPAKPEQL

SEQ ID NO: 449775 - protein, 10 aa, Mycobacterium
DGQPAQRPSW

SEQ ID NO: 449776 - protein, 7 aa, Mycobacterium
DGQPGEL

SEQ ID NO: 449777 - protein, 7 aa, Mycobacterium
DGQPGEV

SEQ ID NO: 449778 - protein, 6 aa, Mycobacterium
DGQPIS

SEQ ID NO: 449779 - protein, 20 aa, Mycobacterium
DGQPSWSSKPEVAATAEARA

SEQ ID NO: 449780 - protein, 6 aa, Mycobacterium
DGQPTE

SEQ ID NO: 449781 - protein, 20 aa, Mycobacterium
DGQPTWSRKPEVAATAEARA

SEQ ID NO: 449782 - protein, 6 aa, Mycobacterium
DGQPVG

SEQ ID NO: 449783 - protein, 6 aa, Mycobacterium
DGQRAA

SEQ ID NO: 449784 - protein, 7 aa, Mycobacterium
DGQRGAQ

SEQ ID NO: 449785 - protein, 8 aa, Mycobacterium
DGQRGAQI

SEQ ID NO: 449786 - protein, 19 aa, Mycobacterium
DGQRPGVRSTPPELGGSNR

SEQ ID NO: 449787 - protein, 6 aa, Mycobacterium
DGQRPP

SEQ ID NO: 449788 - protein, 7 aa, Mycobacterium
DGQRSPV

SEQ ID NO: 449789 - protein, 4 aa, Mycobacterium
DGQS

SEQ ID NO: 449790 - protein, 5 aa, Mycobacterium
DGQSG

SEQ ID NO: 449791 - protein, 17 aa, Mycobacterium
DGQSIGVTTSGTFSPTL

SEQ ID NO: 449792 - protein, 14 aa, Mycobacterium
DGQSTPARRGQQEW

SEQ ID NO: 449793 - protein, 4 aa, Mycobacterium
DGQT

SEQ ID NO: 449794 - protein, 9 aa, Mycobacterium
DGQTADGAP

SEQ ID NO: 449795 - protein, 7 aa, Mycobacterium
DGQTAYD

SEQ ID NO: 449796 - protein, 6 aa, Mycobacterium
DGQTLQ

SEQ ID NO: 449797 - protein, 6 aa, Mycobacterium
DGQTLT

SEQ ID NO: 449798 - protein, 15 aa, Mycobacterium
DGQTMRKRAESFENH

SEQ ID NO: 449799 - protein, 6 aa, Mycobacterium
DGQTVS

SEQ ID NO: 449800 - protein, 7 aa, Mycobacterium
DGQTVSA

SEQ ID NO: 449801 - protein, 18 aa, Mycobacterium
DGQVERVQPSRRGPGRPP

SEQ ID NO: 449802 - protein, 8 aa, Mycobacterium
DGQVGPRP

SEQ ID NO: 449803 - protein, 6 aa, Mycobacterium
DGQVSE

SEQ ID NO: 449804 - protein, 4 aa, Mycobacterium
DGQW

SEQ ID NO: 449805 - protein, 14 aa, Mycobacterium
DGQWTASPQEGHTV

SEQ ID NO: 449806 - protein, 5 aa, Mycobacterium
DGQYH

SEQ ID NO: 449807 - protein, 15 aa, Mycobacterium
DGQYRRGKAASLKEA

SEQ ID NO: 449808 - protein, 27 aa, Mycobacterium
DGQYRRGKPMPLKDAADEAVNDPDSPI

SEQ ID NO: 449809 - protein, 9 aa, Mycobacterium
DGQYRRGSA

SEQ ID NO: 449810 - protein, 5 aa, Mycobacterium
DGRAA

SEQ ID NO: 449811 - protein, 10 aa, Mycobacterium
DGRAAGVKGG

SEQ ID NO: 449812 - protein, 7 aa, Mycobacterium
DGRAALA

SEQ ID NO: 449813 - protein, 10 aa, Mycobacterium
DGRAAVAAGA

SEQ ID NO: 449814 - protein, 6 aa, Mycobacterium
DGRADH

SEQ ID NO: 449815 - protein, 7 aa, Mycobacterium
DGRADVS

SEQ ID NO: 449816 - protein, 14 aa, Mycobacterium
DGRAEEVGASGPDI

SEQ ID NO: 449817 - protein, 8 aa, Mycobacterium
DGRAEPDS

SEQ ID NO: 449818 - protein, 11 aa, Mycobacterium
DGRAESAMESE

SEQ ID NO: 449819 - protein, 9 aa, Mycobacterium
DGRAGDPAR

SEQ ID NO: 449820 - protein, 5 aa, Mycobacterium
DGRAH

SEQ ID NO: 449821 - protein, 6 aa, Mycobacterium
DGRAHA

SEQ ID NO: 449822 - protein, 7 aa, Mycobacterium
DGRAHPR

SEQ ID NO: 449823 - protein, 11 aa, Mycobacterium
DGRAKSEDAAD

SEQ ID NO: 449824 - protein, 14 aa, Mycobacterium
DGRAKTANLRRDPR

SEQ ID NO: 449825 - protein, 15 aa, Mycobacterium
DGRAKTANLRRDPRA

SEQ ID NO: 449826 - protein, 6 aa, Mycobacterium
DGRANA

SEQ ID NO: 449827 - protein, 10 aa, Mycobacterium
DGRAPGSADV

SEQ ID NO: 449828 - protein, 9 aa, Mycobacterium
DGRAPNGEQ

SEQ ID NO: 449829 - protein, 6 aa, Mycobacterium
DGRAPV

SEQ ID NO: 449830 - protein, 6 aa, Mycobacterium
DGRARE

SEQ ID NO: 449831 - protein, 7 aa, Mycobacterium
DGRARPG

SEQ ID NO: 449832 - protein, 8 aa, Mycobacterium
DGRASAAD

SEQ ID NO: 449833 - protein, 6 aa, Mycobacterium
DGRASF

SEQ ID NO: 449834 - protein, 7 aa, Mycobacterium
DGRASGT

SEQ ID NO: 449835 - protein, 6 aa, Mycobacterium
DGRASV

SEQ ID NO: 449836 - protein, 5 aa, Mycobacterium
DGRAT

SEQ ID NO: 449837 - protein, 6 aa, Mycobacterium
DGRATE

SEQ ID NO: 449838 - protein, 9 aa, Mycobacterium
DGRATIRTT

SEQ ID NO: 449839 - protein, 7 aa, Mycobacterium
DGRATTL

SEQ ID NO: 449840 - protein, 6 aa, Mycobacterium
DGRAVP

SEQ ID NO: 449841 - protein, 13 aa, Mycobacterium
DGRAVTGTVQPGA

SEQ ID NO: 449842 - protein, 12 aa, Mycobacterium
DGRAYDVRPDVT

SEQ ID NO: 449843 - protein, 4 aa, Mycobacterium
DGRC

SEQ ID NO: 449844 - protein, 13 aa, Mycobacterium
DGRDAESVERRVS

SEQ ID NO: 449845 - protein, 8 aa, Mycobacterium
DGRDDRDG

SEQ ID NO: 449846 - protein, 7 aa, Mycobacterium
DGRDDSG

SEQ ID NO: 449847 - protein, 6 aa, Mycobacterium
DGRDEE

SEQ ID NO: 449848 - protein, 5 aa, Mycobacterium
DGRDG

SEQ ID NO: 449849 - protein, 8 aa, Mycobacterium
DGRDGGLV

SEQ ID NO: 449850 - protein, 10 aa, Mycobacterium
DGRDGLTARE

SEQ ID NO: 449851 - protein, 7 aa, Mycobacterium
DGRDGQT

SEQ ID NO: 449852 - protein, 8 aa, Mycobacterium
DGRDGRPL

SEQ ID NO: 449853 - protein, 14 aa, Mycobacterium
DGRDGTAMPTPTSS

SEQ ID NO: 449854 - protein, 9 aa, Mycobacterium
DGRDLDPGT

SEQ ID NO: 449855 - protein, 7 aa, Mycobacterium
DGRDNTA

SEQ ID NO: 449856 - protein, 10 aa, Mycobacterium
DGRDPDPRAS

SEQ ID NO: 449857 - protein, 7 aa, Mycobacterium
DGRDPFA

SEQ ID NO: 449858 - protein, 9 aa, Mycobacterium
DGRDPGRLA

SEQ ID NO: 449859 - protein, 8 aa, Mycobacterium
DGRDPVAT

SEQ ID NO: 449860 - protein, 14 aa, Mycobacterium
DGRDTVSDFPADRG

SEQ ID NO: 449861 - protein, 15 aa, Mycobacterium
DGRDVESWPQATGWT

SEQ ID NO: 449862 - protein, 12 aa, Mycobacterium
DGRDVSTSIGSP

SEQ ID NO: 449863 - protein, 10 aa, Mycobacterium
DGRDVTTSIG

SEQ ID NO: 449864 - protein, 7 aa, Mycobacterium
DGRDYEL

SEQ ID NO: 449865 - protein, 10 aa, Mycobacterium
DGREARDDVE

SEQ ID NO: 449866 - protein, 7 aa, Mycobacterium
DGREERI

SEQ ID NO: 449867 - protein, 114 aa, Mycobacterium
DGREETTTSTTTESSVTTTTTTAPSTPETTMAPETTGAPAPGDPSQPGGGGSIPGGPTGSGGPEGGGGSIPGGPTGSGGPDGGGGSIPGGPTITGGPGGGSGSIPGGPTINIPV

SEQ ID NO: 449868 - protein, 20 aa, Mycobacterium
DGREFSREQDDYEGSPTRPM

SEQ ID NO: 449869 - protein, 7 aa, Mycobacterium
DGREGSV

SEQ ID NO: 449870 - protein, 5 aa, Mycobacterium
DGREH

SEQ ID NO: 449871 - protein, 10 aa, Mycobacterium
DGRELPVGES

SEQ ID NO: 449872 - protein, 19 aa, Mycobacterium
DGRELSREQTDYEGSPTRA

SEQ ID NO: 449873 - protein, 7 aa, Mycobacterium
DGREMTH

SEQ ID NO: 449874 - protein, 10 aa, Mycobacterium
DGREPNETGS

SEQ ID NO: 449875 - protein, 10 aa, Mycobacterium
DGREPNQTGS

SEQ ID NO: 449876 - protein, 6 aa, Mycobacterium
DGREQK

SEQ ID NO: 449877 - protein, 10 aa, Mycobacterium
DGREQQTNLP

SEQ ID NO: 449878 - protein, 10 aa, Mycobacterium
DGRESGLQPG

SEQ ID NO: 449879 - protein, 10 aa, Mycobacterium
DGRESGLTPG

SEQ ID NO: 449880 - protein, 12 aa, Mycobacterium
DGRETAPAAATE

SEQ ID NO: 449881 - protein, 13 aa, Mycobacterium
DGRETSKDDAERL

SEQ ID NO: 449882 - protein, 11 aa, Mycobacterium
DGREVKGRKIG

SEQ ID NO: 449883 - protein, 7 aa, Mycobacterium
DGREVRE

SEQ ID NO: 449884 - protein, 8 aa, Mycobacterium
DGREVTPA

SEQ ID NO: 449885 - protein, 8 aa, Mycobacterium
DGREVTPT

SEQ ID NO: 449886 - protein, 5 aa, Mycobacterium
DGREY

SEQ ID NO: 449887 - protein, 6 aa, Mycobacterium
DGRFRA

SEQ ID NO: 449888 - protein, 11 aa, Mycobacterium
DGRGAGTPPAT

SEQ ID NO: 449889 - protein, 12 aa, Mycobacterium
DGRGDISGLGAD

SEQ ID NO: 449890 - protein, 13 aa, Mycobacterium
DGRGDISGLGPDA

SEQ ID NO: 449891 - protein, 6 aa, Mycobacterium
DGRGDM

SEQ ID NO: 449892 - protein, 9 aa, Mycobacterium
DGRGDVSGL

SEQ ID NO: 449893 - protein, 9 aa, Mycobacterium
DGRGEPRDD

SEQ ID NO: 449894 - protein, 9 aa, Mycobacterium
DGRGEPRED

SEQ ID NO: 449895 - protein, 6 aa, Mycobacterium
DGRGFS

SEQ ID NO: 449896 - protein, 5 aa, Mycobacterium
DGRGG

SEQ ID NO: 449897 - protein, 10 aa, Mycobacterium
DGRGGAGQGM

SEQ ID NO: 449898 - protein, 12 aa, Mycobacterium
DGRGGGGQGAQR

SEQ ID NO: 449899 - protein, 22 aa, Mycobacterium
DGRGGGKPDLAQGSGKDPSRID

SEQ ID NO: 449900 - protein, 8 aa, Mycobacterium
DGRGGLSA

SEQ ID NO: 449901 - protein, 8 aa, Mycobacterium
DGRGGSDA

SEQ ID NO: 449902 - protein, 9 aa, Mycobacterium
DGRGGSREI

SEQ ID NO: 449903 - protein, 5 aa, Mycobacterium
DGRGL

SEQ ID NO: 449904 - protein, 8 aa, Mycobacterium
DGRGLPEG

SEQ ID NO: 449905 - protein, 8 aa, Mycobacterium
DGRGLPSG

SEQ ID NO: 449906 - protein, 13 aa, Mycobacterium
DGRGPDGELPPNN

SEQ ID NO: 449907 - protein, 18 aa, Mycobacterium
DGRGPTEDDTLHAGKELA

SEQ ID NO: 449908 - protein, 7 aa, Mycobacterium
DGRGRAR

SEQ ID NO: 449909 - protein, 6 aa, Mycobacterium
DGRGRD

SEQ ID NO: 449910 - protein, 15 aa, Mycobacterium
DGRGRNQRDHAGSSR

SEQ ID NO: 449911 - protein, 7 aa, Mycobacterium
DGRGSAL

SEQ ID NO: 449912 - protein, 8 aa, Mycobacterium
DGRGSRTV

SEQ ID NO: 449913 - protein, 8 aa, Mycobacterium
DGRGSTVR

SEQ ID NO: 449914 - protein, 8 aa, Mycobacterium
DGRHGQAA

SEQ ID NO: 449915 - protein, 5 aa, Mycobacterium
DGRHL

SEQ ID NO: 449916 - protein, 10 aa, Mycobacterium
DGRHSGLDPG

SEQ ID NO: 449917 - protein, 9 aa, Mycobacterium
DGRIAKPPV

SEQ ID NO: 449918 - protein, 5 aa, Mycobacterium
DGRID

SEQ ID NO: 449919 - protein, 6 aa, Mycobacterium
DGRIKR

SEQ ID NO: 449920 - protein, 6 aa, Mycobacterium
DGRIQR

SEQ ID NO: 449921 - protein, 12 aa, Mycobacterium
DGRISGSASGLA

SEQ ID NO: 449922 - protein, 5 aa, Mycobacterium
DGRIT

SEQ ID NO: 449923 - protein, 9 aa, Mycobacterium
DGRKDTRTL

SEQ ID NO: 449924 - protein, 8 aa, Mycobacterium
DGRKGGLI

SEQ ID NO: 449925 - protein, 8 aa, Mycobacterium
DGRKLEDA

SEQ ID NO: 449926 - protein, 8 aa, Mycobacterium
DGRKNGKA

SEQ ID NO: 449927 - protein, 9 aa, Mycobacterium
DGRKNGKAL

SEQ ID NO: 449928 - protein, 9 aa, Mycobacterium
DGRKPVTRK

SEQ ID NO: 449929 - protein, 9 aa, Mycobacterium
DGRLDDESV

SEQ ID NO: 449930 - protein, 7 aa, Mycobacterium
DGRLDEA

SEQ ID NO: 449931 - protein, 6 aa, Mycobacterium
DGRLED

SEQ ID NO: 449932 - protein, 8 aa, Mycobacterium
DGRLPPGV

SEQ ID NO: 449933 - protein, 7 aa, Mycobacterium
DGRLRDT

SEQ ID NO: 449934 - protein, 6 aa, Mycobacterium
DGRLSQ

SEQ ID NO: 449935 - protein, 5 aa, Mycobacterium
DGRLT

SEQ ID NO: 449936 - protein, 8 aa, Mycobacterium
DGRMTRPP

SEQ ID NO: 449937 - protein, 12 aa, Mycobacterium
DGRNAESGGSHG

SEQ ID NO: 449938 - protein, 5 aa, Mycobacterium
DGRNL

SEQ ID NO: 449939 - protein, 9 aa, Mycobacterium
DGRNLTKDA

SEQ ID NO: 449940 - protein, 10 aa, Mycobacterium
DGRNPTVTKG

SEQ ID NO: 449941 - protein, 5 aa, Mycobacterium
DGRNQ

SEQ ID NO: 449942 - protein, 22 aa, Mycobacterium
DGRNSAVRAASGLQTASESSPM

SEQ ID NO: 449943 - protein, 15 aa, Mycobacterium
DGRPAFGDDAAVGGG

SEQ ID NO: 449944 - protein, 7 aa, Mycobacterium
DGRPATT

SEQ ID NO: 449945 - protein, 11 aa, Mycobacterium
DGRPDGDVTPY

SEQ ID NO: 449946 - protein, 17 aa, Mycobacterium
DGRPDPLDGPSASGGLR

SEQ ID NO: 449947 - protein, 11 aa, Mycobacterium
DGRPDSPDVAE

SEQ ID NO: 449948 - protein, 7 aa, Mycobacterium
DGRPETL

SEQ ID NO: 449949 - protein, 5 aa, Mycobacterium
DGRPF

SEQ ID NO: 449950 - protein, 5 aa, Mycobacterium
DGRPG

SEQ ID NO: 449951 - protein, 10 aa, Mycobacterium
DGRPGEHNDQ

SEQ ID NO: 449952 - protein, 7 aa, Mycobacterium
DGRPHAL

SEQ ID NO: 449953 - protein, 6 aa, Mycobacterium
DGRPHF

SEQ ID NO: 449954 - protein, 6 aa, Mycobacterium
DGRPID

SEQ ID NO: 449955 - protein, 13 aa, Mycobacterium
DGRPLSKRDDAQA

SEQ ID NO: 449956 - protein, 26 aa, Mycobacterium
DGRPLSTDTVSRPATSYQAAAPDNTI

SEQ ID NO: 449957 - protein, 25 aa, Mycobacterium
DGRPLSTDTVTRPATSYSAAPPDNA

SEQ ID NO: 449958 - protein, 6 aa, Mycobacterium
DGRPNA

SEQ ID NO: 449959 - protein, 17 aa, Mycobacterium
DGRPNPKTVRSRPDAPN

SEQ ID NO: 449960 - protein, 9 aa, Mycobacterium
DGRPPEAAG

SEQ ID NO: 449961 - protein, 10 aa, Mycobacterium
DGRPPHPDTI

SEQ ID NO: 449962 - protein, 6 aa, Mycobacterium
DGRPPL

SEQ ID NO: 449963 - protein, 8 aa, Mycobacterium
DGRPRPDL

SEQ ID NO: 449964 - protein, 13 aa, Mycobacterium
DGRPSKTVSDTLR

SEQ ID NO: 449965 - protein, 10 aa, Mycobacterium
DGRPTAPTLD

SEQ ID NO: 449966 - protein, 8 aa, Mycobacterium
DGRPTDGS

SEQ ID NO: 449967 - protein, 9 aa, Mycobacterium
DGRPTPQSV

SEQ ID NO: 449968 - protein, 8 aa, Mycobacterium
DGRPTTLA

SEQ ID NO: 449969 - protein, 5 aa, Mycobacterium
DGRPV

SEQ ID NO: 449970 - protein, 7 aa, Mycobacterium
DGRPVAK

SEQ ID NO: 449971 - protein, 8 aa, Mycobacterium
DGRPVATA

SEQ ID NO: 449972 - protein, 5 aa, Mycobacterium
DGRPY

SEQ ID NO: 449973 - protein, 15 aa, Mycobacterium
DGRPYTGVGTPPTTN

SEQ ID NO: 449974 - protein, 4 aa, Mycobacterium
DGRQ

SEQ ID NO: 449975 - protein, 5 aa, Mycobacterium
DGRQF

SEQ ID NO: 449976 - protein, 6 aa, Mycobacterium
DGRQGA

SEQ ID NO: 449977 - protein, 7 aa, Mycobacterium
DGRQGAD

SEQ ID NO: 449978 - protein, 9 aa, Mycobacterium
DGRQGAETV

SEQ ID NO: 449979 - protein, 7 aa, Mycobacterium
DGRQGTG

SEQ ID NO: 449980 - protein, 9 aa, Mycobacterium
DGRQRHNGV

SEQ ID NO: 449981 - protein, 19 aa, Mycobacterium
DGRQTPEAHASPGSAVGVD

SEQ ID NO: 449982 - protein, 7 aa, Mycobacterium
DGRRATT

SEQ ID NO: 449983 - protein, 8 aa, Mycobacterium
DGRRATTH

SEQ ID NO: 449984 - protein, 11 aa, Mycobacterium
DGRRAVDAGAT

SEQ ID NO: 449985 - protein, 5 aa, Mycobacterium
DGRRF

SEQ ID NO: 449986 - protein, 8 aa, Mycobacterium
DGRRGVDA

SEQ ID NO: 449987 - protein, 8 aa, Mycobacterium
DGRRIPGS

SEQ ID NO: 449988 - protein, 5 aa, Mycobacterium
DGRRL

SEQ ID NO: 449989 - protein, 8 aa, Mycobacterium
DGRRLRSA

SEQ ID NO: 449990 - protein, 17 aa, Mycobacterium
DGRRPGFGDDAAVGGGL

SEQ ID NO: 449991 - protein, 7 aa, Mycobacterium
DGRRQPH

SEQ ID NO: 449992 - protein, 9 aa, Mycobacterium
DGRRRGHAV

SEQ ID NO: 449993 - protein, 8 aa, Mycobacterium
DGRRRGVT

SEQ ID NO: 449994 - protein, 19 aa, Mycobacterium
DGRRRTRPYSPANAEGEAN

SEQ ID NO: 449995 - protein, 16 aa, Mycobacterium
DGRRSTVTGHGEPGPA

SEQ ID NO: 449996 - protein, 7 aa, Mycobacterium
DGRRTGA

SEQ ID NO: 449997 - protein, 5 aa, Mycobacterium
DGRRV

SEQ ID NO: 449998 - protein, 12 aa, Mycobacterium
DGRRVDGPAVNS

SEQ ID NO: 449999 - protein, 4 aa, Mycobacterium
DGRS

SEQ ID NO: 450000 - protein, 6 aa, Mycobacterium
DGRSAI

SEQ ID NO: 450001 - protein, 28 aa, Mycobacterium
DGRSAYLQSGRRPPVATYGENSAEVTGH

SEQ ID NO: 450002 - protein, 9 aa, Mycobacterium
DGRSGEPFP

SEQ ID NO: 450003 - protein, 6 aa, Mycobacterium
DGRSGS

SEQ ID NO: 450004 - protein, 9 aa, Mycobacterium
DGRSGYESF

SEQ ID NO: 450005 - protein, 5 aa, Mycobacterium
DGRSH

SEQ ID NO: 450006 - protein, 7 aa, Mycobacterium
DGRSMAT

SEQ ID NO: 450007 - protein, 8 aa, Mycobacterium
DGRSNWGG

SEQ ID NO: 450008 - protein, 6 aa, Mycobacterium
DGRSPV

SEQ ID NO: 450009 - protein, 7 aa, Mycobacterium
DGRSSTV

SEQ ID NO: 450010 - protein, 12 aa, Mycobacterium
DGRSTEFKTGPK

SEQ ID NO: 450011 - protein, 7 aa, Mycobacterium
DGRSTTL

SEQ ID NO: 450012 - protein, 5 aa, Mycobacterium
DGRTA

SEQ ID NO: 450013 - protein, 16 aa, Mycobacterium
DGRTAAQAIEDGVEPR

SEQ ID NO: 450014 - protein, 16 aa, Mycobacterium
DGRTAAQAIEEGIEPR

SEQ ID NO: 450015 - protein, 17 aa, Mycobacterium
DGRTAASRRVDATQGER

SEQ ID NO: 450016 - protein, 7 aa, Mycobacterium
DGRTAEA

SEQ ID NO: 450017 - protein, 6 aa, Mycobacterium
DGRTAS

SEQ ID NO: 450018 - protein, 9 aa, Mycobacterium
DGRTDASTV

SEQ ID NO: 450019 - protein, 12 aa, Mycobacterium
DGRTGVSCPPRD

SEQ ID NO: 450020 - protein, 5 aa, Mycobacterium
DGRTI

SEQ ID NO: 450021 - protein, 5 aa, Mycobacterium
DGRTL

SEQ ID NO: 450022 - protein, 7 aa, Mycobacterium
DGRTLAP

SEQ ID NO: 450023 - protein, 12 aa, Mycobacterium
DGRTPDDDARAR

SEQ ID NO: 450024 - protein, 7 aa, Mycobacterium
DGRTPEQ

SEQ ID NO: 450025 - protein, 7 aa, Mycobacterium
DGRTPRA

SEQ ID NO: 450026 - protein, 7 aa, Mycobacterium
DGRTRTR

SEQ ID NO: 450027 - protein, 18 aa, Mycobacterium
DGRTSRVRKEAGLAPREY

SEQ ID NO: 450028 - protein, 6 aa, Mycobacterium
DGRTVN

SEQ ID NO: 450029 - protein, 18 aa, Mycobacterium
DGRTVSERAADAQPADGD

SEQ ID NO: 450030 - protein, 7 aa, Mycobacterium
DGRTVTN

SEQ ID NO: 450031 - protein, 9 aa, Mycobacterium
DGRVEDPVG

SEQ ID NO: 450032 - protein, 12 aa, Mycobacterium
DGRVGSDVMAVA

SEQ ID NO: 450033 - protein, 5 aa, Mycobacterium
DGRVH

SEQ ID NO: 450034 - protein, 12 aa, Mycobacterium
DGRVPLTQYRHA

SEQ ID NO: 450035 - protein, 15 aa, Mycobacterium
DGRVQDPVGSQPHVG

SEQ ID NO: 450036 - protein, 8 aa, Mycobacterium
DGRVQHEE

SEQ ID NO: 450037 - protein, 12 aa, Mycobacterium
DGRVRNDLSPDA

SEQ ID NO: 450038 - protein, 26 aa, Mycobacterium
DGRVRTPDLGGTATTEQLGTAIAEAA

SEQ ID NO: 450039 - protein, 5 aa, Mycobacterium
DGRVS

SEQ ID NO: 450040 - protein, 10 aa, Mycobacterium
DGRVSFSRTA

SEQ ID NO: 450041 - protein, 14 aa, Mycobacterium
DGRVTGIRGNRDDV

SEQ ID NO: 450042 - protein, 4 aa, Mycobacterium
DGRW

SEQ ID NO: 450043 - protein, 6 aa, Mycobacterium
DGRWRQ

SEQ ID NO: 450044 - protein, 7 aa, Mycobacterium
DGRWTDS

SEQ ID NO: 450045 - protein, 17 aa, Mycobacterium
DGRWTRSGACTAPPAAT

SEQ ID NO: 450046 - protein, 8 aa, Mycobacterium
DGRYAAEA

SEQ ID NO: 450047 - protein, 6 aa, Mycobacterium
DGRYEQ

SEQ ID NO: 450048 - protein, 6 aa, Mycobacterium
DGRYPE

SEQ ID NO: 450049 - protein, 14 aa, Mycobacterium
DGRYRTQAAEQAPD

SEQ ID NO: 450050 - protein, 14 aa, Mycobacterium
DGRYRTQAAHQAPD

SEQ ID NO: 450051 - protein, 15 aa, Mycobacterium
DGRYRTQAAHQAPDA

SEQ ID NO: 450052 - protein, 15 aa, Mycobacterium
DGRYRTQAAQQAPDA

SEQ ID NO: 450053 - protein, 6 aa, Mycobacterium
DGRYTD

SEQ ID NO: 450054 - protein, 4 aa, Mycobacterium
DGSA

SEQ ID NO: 450055 - protein, 7 aa, Mycobacterium
DGSAAAL

SEQ ID NO: 450056 - protein, 17 aa, Mycobacterium
DGSAAASGSAQLTVGEQ

SEQ ID NO: 450057 - protein, 11 aa, Mycobacterium
DGSAADADASL

SEQ ID NO: 450058 - protein, 10 aa, Mycobacterium
DGSAAPELPN

SEQ ID NO: 450059 - protein, 8 aa, Mycobacterium
DGSAAQAA

SEQ ID NO: 450060 - protein, 14 aa, Mycobacterium
DGSAASDLLRSGPD

SEQ ID NO: 450061 - protein, 7 aa, Mycobacterium
DGSAASR

SEQ ID NO: 450062 - protein, 8 aa, Mycobacterium
DGSADDFR

SEQ ID NO: 450063 - protein, 12 aa, Mycobacterium
DGSADGTGEIAR

SEQ ID NO: 450064 - protein, 9 aa, Mycobacterium
DGSAEEGTP

SEQ ID NO: 450065 - protein, 25 aa, Mycobacterium
DGSAGAAPDTAQPSVRAKSTPTDPV

SEQ ID NO: 450066 - protein, 11 aa, Mycobacterium
DGSAGADRAIK

SEQ ID NO: 450067 - protein, 8 aa, Mycobacterium
DGSAGGQA

SEQ ID NO: 450068 - protein, 10 aa, Mycobacterium
DGSAGISPAQ

SEQ ID NO: 450069 - protein, 11 aa, Mycobacterium
DGSAHATGKAQ

SEQ ID NO: 450070 - protein, 6 aa, Mycobacterium
DGSAHL

SEQ ID NO: 450071 - protein, 10 aa, Mycobacterium
DGSAKGATGW

SEQ ID NO: 450072 - protein, 18 aa, Mycobacterium
DGSAKPAGTKITNPAYAK

SEQ ID NO: 450073 - protein, 6 aa, Mycobacterium
DGSALD

SEQ ID NO: 450074 - protein, 10 aa, Mycobacterium
DGSALDDTEV

SEQ ID NO: 450075 - protein, 11 aa, Mycobacterium
DGSALTGERAA

SEQ ID NO: 450076 - protein, 6 aa, Mycobacterium
DGSAMS

SEQ ID NO: 450077 - protein, 6 aa, Mycobacterium
DGSAPV

SEQ ID NO: 450078 - protein, 9 aa, Mycobacterium
DGSAQSDAA

SEQ ID NO: 450079 - protein, 16 aa, Mycobacterium
DGSASGFANVGANNSG

SEQ ID NO: 450080 - protein, 7 aa, Mycobacterium
DGSASRD

SEQ ID NO: 450081 - protein, 15 aa, Mycobacterium
DGSASRRIGTSDDIA

SEQ ID NO: 450082 - protein, 19 aa, Mycobacterium
DGSATLSGSQIAVDRGVMK

SEQ ID NO: 450083 - protein, 8 aa, Mycobacterium
DGSCSTND

SEQ ID NO: 450084 - protein, 4 aa, Mycobacterium
DGSD

SEQ ID NO: 450085 - protein, 10 aa, Mycobacterium
DGSDAPELTG

SEQ ID NO: 450086 - protein, 9 aa, Mycobacterium
DGSDDDYER

SEQ ID NO: 450087 - protein, 10 aa, Mycobacterium
DGSDDDYERY

SEQ ID NO: 450088 - protein, 11 aa, Mycobacterium
DGSDDEDLTTG

SEQ ID NO: 450089 - protein, 9 aa, Mycobacterium
DGSDDPALA

SEQ ID NO: 450090 - protein, 7 aa, Mycobacterium
DGSDDTE

SEQ ID NO: 450091 - protein, 9 aa, Mycobacterium
DGSDEEANS

SEQ ID NO: 450092 - protein, 8 aa, Mycobacterium
DGSDEEWQ

SEQ ID NO: 450093 - protein, 6 aa, Mycobacterium
DGSDEP

SEQ ID NO: 450094 - protein, 5 aa, Mycobacterium
DGSDF

SEQ ID NO: 450095 - protein, 11 aa, Mycobacterium
DGSDGAATDGP

SEQ ID NO: 450096 - protein, 10 aa, Mycobacterium
DGSDKDYRRY

SEQ ID NO: 450097 - protein, 7 aa, Mycobacterium
DGSDLGT

SEQ ID NO: 450098 - protein, 15 aa, Mycobacterium
DGSDLSSAYDTAQAA

SEQ ID NO: 450099 - protein, 8 aa, Mycobacterium
DGSDNEGY

SEQ ID NO: 450100 - protein, 10 aa, Mycobacterium
DGSDPQAPIR

SEQ ID NO: 450101 - protein, 5 aa, Mycobacterium
DGSDR

SEQ ID NO: 450102 - protein, 22 aa, Mycobacterium
DGSDRTAAQLSPEEKDAVSHRG

SEQ ID NO: 450103 - protein, 9 aa, Mycobacterium
DGSDSAVNA

SEQ ID NO: 450104 - protein, 6 aa, Mycobacterium
DGSDSS

SEQ ID NO: 450105 - protein, 9 aa, Mycobacterium
DGSDSSLRA

SEQ ID NO: 450106 - protein, 10 aa, Mycobacterium
DGSDSSYRAV

SEQ ID NO: 450107 - protein, 5 aa, Mycobacterium
DGSDT

SEQ ID NO: 450108 - protein, 8 aa, Mycobacterium
DGSDTGYA

SEQ ID NO: 450109 - protein, 8 aa, Mycobacterium
DGSDVPAP

SEQ ID NO: 450110 - protein, 14 aa, Mycobacterium
DGSDVRRGRPSAHR

SEQ ID NO: 450111 - protein, 9 aa, Mycobacterium
DGSEADFER

SEQ ID NO: 450112 - protein, 6 aa, Mycobacterium
DGSEAL

SEQ ID NO: 450113 - protein, 9 aa, Mycobacterium
DGSEAPHLP

SEQ ID NO: 450114 - protein, 8 aa, Mycobacterium
DGSEEEYE

SEQ ID NO: 450115 - protein, 5 aa, Mycobacterium
DGSEH

SEQ ID NO: 450116 - protein, 10 aa, Mycobacterium
DGSEISAGTT

SEQ ID NO: 450117 - protein, 17 aa, Mycobacterium
DGSEKPAAVAESIIRFI

SEQ ID NO: 450118 - protein, 7 aa, Mycobacterium
DGSELRA

SEQ ID NO: 450119 - protein, 6 aa, Mycobacterium
DGSELT

SEQ ID NO: 450120 - protein, 9 aa, Mycobacterium
DGSEMTDED

SEQ ID NO: 450121 - protein, 5 aa, Mycobacterium
DGSEP

SEQ ID NO: 450122 - protein, 7 aa, Mycobacterium
DGSETRC

SEQ ID NO: 450123 - protein, 7 aa, Mycobacterium
DGSETRI

SEQ ID NO: 450124 - protein, 7 aa, Mycobacterium
DGSEVTG

SEQ ID NO: 450125 - protein, 4 aa, Mycobacterium
DGSF

SEQ ID NO: 450126 - protein, 15 aa, Mycobacterium
DGSFNTEDGGDGGLA

SEQ ID NO: 450127 - protein, 5 aa, Mycobacterium
DGSFT

SEQ ID NO: 450128 - protein, 4 aa, Mycobacterium
DGSG

SEQ ID NO: 450129 - protein, 10 aa, Mycobacterium
DGSGAADETV

SEQ ID NO: 450130 - protein, 8 aa, Mycobacterium
DGSGAGTV

SEQ ID NO: 450131 - protein, 8 aa, Mycobacterium
DGSGEAVR

SEQ ID NO: 450132 - protein, 8 aa, Mycobacterium
DGSGGPVA

SEQ ID NO: 450133 - protein, 7 aa, Mycobacterium
DGSGGST

SEQ ID NO: 450134 - protein, 10 aa, Mycobacterium
DGSGKGATGW

SEQ ID NO: 450135 - protein, 7 aa, Mycobacterium
DGSGLAA

SEQ ID NO: 450136 - protein, 6 aa, Mycobacterium
DGSGNV

SEQ ID NO: 450137 - protein, 18 aa, Mycobacterium
DGSGPAAAADDDVFSTGQ

SEQ ID NO: 450138 - protein, 8 aa, Mycobacterium
DGSGPALD

SEQ ID NO: 450139 - protein, 10 aa, Mycobacterium
DGSGPSGTDV

SEQ ID NO: 450140 - protein, 8 aa, Mycobacterium
DGSGQAVG

SEQ ID NO: 450141 - protein, 7 aa, Mycobacterium
DGSGQVQ

SEQ ID NO: 450142 - protein, 10 aa, Mycobacterium
DGSGRDPATA

SEQ ID NO: 450143 - protein, 6 aa, Mycobacterium
DGSGRH

SEQ ID NO: 450144 - protein, 7 aa, Mycobacterium
DGSGRPY

SEQ ID NO: 450145 - protein, 8 aa, Mycobacterium
DGSGRTYQ

SEQ ID NO: 450146 - protein, 6 aa, Mycobacterium
DGSGSR

SEQ ID NO: 450147 - protein, 19 aa, Mycobacterium
DGSGTLSGAQIPVDKGALK

SEQ ID NO: 450148 - protein, 19 aa, Mycobacterium
DGSGTLTGTQIPVDKGALK

SEQ ID NO: 450149 - protein, 4 aa, Mycobacterium
DGSH

SEQ ID NO: 450150 - protein, 12 aa, Mycobacterium
DGSHGGTGGGNH

SEQ ID NO: 450151 - protein, 6 aa, Mycobacterium
DGSHSS

SEQ ID NO: 450152 - protein, 4 aa, Mycobacterium
DGSI

SEQ ID NO: 450153 - protein, 8 aa, Mycobacterium
DGSIADAA

SEQ ID NO: 450154 - protein, 10 aa, Mycobacterium
DGSIDEASVS

SEQ ID NO: 450155 - protein, 19 aa, Mycobacterium
DGSKEYSTKNAKGEAAGPF

SEQ ID NO: 450156 - protein, 8 aa, Mycobacterium
DGSKHAEA

SEQ ID NO: 450157 - protein, 8 aa, Mycobacterium
DGSKVESD

SEQ ID NO: 450158 - protein, 8 aa, Mycobacterium
DGSLGARK

SEQ ID NO: 450159 - protein, 6 aa, Mycobacterium
DGSLPG

SEQ ID NO: 450160 - protein, 9 aa, Mycobacterium
DGSLPPNAG

SEQ ID NO: 450161 - protein, 5 aa, Mycobacterium
DGSLQ

SEQ ID NO: 450162 - protein, 16 aa, Mycobacterium
DGSLQSSPVTGGVDAQ

SEQ ID NO: 450163 - protein, 6 aa, Mycobacterium
DGSLQT

SEQ ID NO: 450164 - protein, 11 aa, Mycobacterium
DGSLRANGSRV

SEQ ID NO: 450165 - protein, 6 aa, Mycobacterium
DGSLRS

SEQ ID NO: 450166 - protein, 10 aa, Mycobacterium
DGSLTDRELT

SEQ ID NO: 450167 - protein, 4 aa, Mycobacterium
DGSM

SEQ ID NO: 450168 - protein, 8 aa, Mycobacterium
DGSMDAGD

SEQ ID NO: 450169 - protein, 8 aa, Mycobacterium
DGSMDAGE

SEQ ID NO: 450170 - protein, 8 aa, Mycobacterium
DGSMDGAD

SEQ ID NO: 450171 - protein, 8 aa, Mycobacterium
DGSMDPAD

SEQ ID NO: 450172 - protein, 5 aa, Mycobacterium
DGSMS

SEQ ID NO: 450173 - protein, 8 aa, Mycobacterium
DGSNLATL

SEQ ID NO: 450174 - protein, 9 aa, Mycobacterium
DGSNLPPRR

SEQ ID NO: 450175 - protein, 18 aa, Mycobacterium
DGSNPDQLMTPLFEYFHL

SEQ ID NO: 450176 - protein, 4 aa, Mycobacterium
DGSP

SEQ ID NO: 450177 - protein, 5 aa, Mycobacterium
DGSPA

SEQ ID NO: 450178 - protein, 12 aa, Mycobacterium
DGSPAGGGSAAH

SEQ ID NO: 450179 - protein, 7 aa, Mycobacterium
DGSPAKV

SEQ ID NO: 450180 - protein, 8 aa, Mycobacterium
DGSPASEA

SEQ ID NO: 450181 - protein, 9 aa, Mycobacterium
DGSPASEAA

SEQ ID NO: 450182 - protein, 10 aa, Mycobacterium
DGSPASEAAT

SEQ ID NO: 450183 - protein, 10 aa, Mycobacterium
DGSPASEDAT

SEQ ID NO: 450184 - protein, 9 aa, Mycobacterium
DGSPASEKA

SEQ ID NO: 450185 - protein, 7 aa, Mycobacterium
DGSPAST

SEQ ID NO: 450186 - protein, 8 aa, Mycobacterium
DGSPCRTA

SEQ ID NO: 450187 - protein, 10 aa, Mycobacterium
DGSPDGTGAL

SEQ ID NO: 450188 - protein, 10 aa, Mycobacterium
DGSPDGTGEL

SEQ ID NO: 450189 - protein, 20 aa, Mycobacterium
DGSPDGTGELADEAALADPD

SEQ ID NO: 450190 - protein, 6 aa, Mycobacterium
DGSPDS

SEQ ID NO: 450191 - protein, 9 aa, Mycobacterium
DGSPDSNEA

SEQ ID NO: 450192 - protein, 7 aa, Mycobacterium
DGSPEAL

SEQ ID NO: 450193 - protein, 13 aa, Mycobacterium
DGSPEGMSDTGNA

SEQ ID NO: 450194 - protein, 8 aa, Mycobacterium
DGSPESHA

SEQ ID NO: 450195 - protein, 9 aa, Mycobacterium
DGSPGSDAA

SEQ ID NO: 450196 - protein, 5 aa, Mycobacterium
DGSPI

SEQ ID NO: 450197 - protein, 6 aa, Mycobacterium
DGSPIS

SEQ ID NO: 450198 - protein, 6 aa, Mycobacterium
DGSPLR

SEQ ID NO: 450199 - protein, 7 aa, Mycobacterium
DGSPQAV

SEQ ID NO: 450200 - protein, 8 aa, Mycobacterium
DGSPQGRT

SEQ ID NO: 450201 - protein, 9 aa, Mycobacterium
DGSPSSLAA

SEQ ID NO: 450202 - protein, 8 aa, Mycobacterium
DGSPTSEL

SEQ ID NO: 450203 - protein, 9 aa, Mycobacterium
DGSPTSELA

SEQ ID NO: 450204 - protein, 8 aa, Mycobacterium
DGSPVDAP

SEQ ID NO: 450205 - protein, 11 aa, Mycobacterium
DGSPVTSGADA

SEQ ID NO: 450206 - protein, 6 aa, Mycobacterium
DGSPVV

SEQ ID NO: 450207 - protein, 14 aa, Mycobacterium
DGSPWQGDRRPPEL

SEQ ID NO: 450208 - protein, 6 aa, Mycobacterium
DGSPYR

SEQ ID NO: 450209 - protein, 7 aa, Mycobacterium
DGSQAAI

SEQ ID NO: 450210 - protein, 5 aa, Mycobacterium
DGSQF

SEQ ID NO: 450211 - protein, 6 aa, Mycobacterium
DGSQTR

SEQ ID NO: 450212 - protein, 6 aa, Mycobacterium
DGSRAA

SEQ ID NO: 450213 - protein, 9 aa, Mycobacterium
DGSRGAHSE

SEQ ID NO: 450214 - protein, 9 aa, Mycobacterium
DGSRGRAVA

SEQ ID NO: 450215 - protein, 6 aa, Mycobacterium
DGSRLG

SEQ ID NO: 450216 - protein, 11 aa, Mycobacterium
DGSRPADYPEP

SEQ ID NO: 450217 - protein, 7 aa, Mycobacterium
DGSRREG

SEQ ID NO: 450218 - protein, 5 aa, Mycobacterium
DGSRV

SEQ ID NO: 450219 - protein, 7 aa, Mycobacterium
DGSRVSA

SEQ ID NO: 450220 - protein, 4 aa, Mycobacterium
DGSS

SEQ ID NO: 450221 - protein, 7 aa, Mycobacterium
DGSSAIA

SEQ ID NO: 450222 - protein, 11 aa, Mycobacterium
DGSSCGPEDAT

SEQ ID NO: 450223 - protein, 6 aa, Mycobacterium
DGSSEA

SEQ ID NO: 450224 - protein, 6 aa, Mycobacterium
DGSSGL

SEQ ID NO: 450225 - protein, 10 aa, Mycobacterium
DGSSHYPQDI

SEQ ID NO: 450226 - protein, 25 aa, Mycobacterium
DGSSPIQSNVRTGRRQSRWSNPQAD

SEQ ID NO: 450227 - protein, 6 aa, Mycobacterium
DGSSQT

SEQ ID NO: 450228 - protein, 7 aa, Mycobacterium
DGSSQTT

SEQ ID NO: 450229 - protein, 8 aa, Mycobacterium
DGSSRAPA

SEQ ID NO: 450230 - protein, 17 aa, Mycobacterium
DGSSVGTAAKSTVHHGD

SEQ ID NO: 450231 - protein, 11 aa, Mycobacterium
DGSTAGPENAE

SEQ ID NO: 450232 - protein, 7 aa, Mycobacterium
DGSTAIA

SEQ ID NO: 450233 - protein, 30 aa, Mycobacterium
DGSTASKAEDSEKDPDNDTPDVDKSAGEPT

SEQ ID NO: 450234 - protein, 12 aa, Mycobacterium
DGSTDDTGEIAR

SEQ ID NO: 450235 - protein, 9 aa, Mycobacterium
DGSTEEATV

SEQ ID NO: 450236 - protein, 13 aa, Mycobacterium
DGSTFGQWESRGV

SEQ ID NO: 450237 - protein, 6 aa, Mycobacterium
DGSTGL

SEQ ID NO: 450238 - protein, 32 aa, Mycobacterium
DGSTGRAIAPAGASRGSGEVTDLRDGGGPFAG

SEQ ID NO: 450239 - protein, 6 aa, Mycobacterium
DGSTID

SEQ ID NO: 450240 - protein, 6 aa, Mycobacterium
DGSTIS

SEQ ID NO: 450241 - protein, 6 aa, Mycobacterium
DGSTIT

SEQ ID NO: 450242 - protein, 5 aa, Mycobacterium
DGSTL

SEQ ID NO: 450243 - protein, 6 aa, Mycobacterium
DGSTLG

SEQ ID NO: 450244 - protein, 6 aa, Mycobacterium
DGSTLR

SEQ ID NO: 450245 - protein, 6 aa, Mycobacterium
DGSTLS

SEQ ID NO: 450246 - protein, 8 aa, Mycobacterium
DGSTLTGR

SEQ ID NO: 450247 - protein, 22 aa, Mycobacterium
DGSTLTNPSAAEVKAKLAEAGA

SEQ ID NO: 450248 - protein, 21 aa, Mycobacterium
DGSTLTNPSAAQVKAKLAETG

SEQ ID NO: 450249 - protein, 21 aa, Mycobacterium
DGSTLTNPSAREVKKKMADIG

SEQ ID NO: 450250 - protein, 18 aa, Mycobacterium
DGSTLTNPTGAQVKAKLA

SEQ ID NO: 450251 - protein, 17 aa, Mycobacterium
DGSTLTNPTIKQVKAKL

SEQ ID NO: 450252 - protein, 5 aa, Mycobacterium
DGSTM

SEQ ID NO: 450253 - protein, 6 aa, Mycobacterium
DGSTQL

SEQ ID NO: 450254 - protein, 9 aa, Mycobacterium
DGSTSPSAS

SEQ ID NO: 450255 - protein, 8 aa, Mycobacterium
DGSTSPTA

SEQ ID NO: 450256 - protein, 16 aa, Mycobacterium
DGSTSQAPNAAAAEAV

SEQ ID NO: 450257 - protein, 8 aa, Mycobacterium
DGSTTGEC

SEQ ID NO: 450258 - protein, 8 aa, Mycobacterium
DGSTTVDT

SEQ ID NO: 450259 - protein, 11 aa, Mycobacterium
DGSTYHGGSGL

SEQ ID NO: 450260 - protein, 4 aa, Mycobacterium
DGSV

SEQ ID NO: 450261 - protein, 5 aa, Mycobacterium
DGSVA

SEQ ID NO: 450262 - protein, 5 aa, Mycobacterium
DGSVD

SEQ ID NO: 450263 - protein, 5 aa, Mycobacterium
DGSVE

SEQ ID NO: 450264 - protein, 9 aa, Mycobacterium
DGSVEASTL

SEQ ID NO: 450265 - protein, 12 aa, Mycobacterium
DGSVEEADTGGT

SEQ ID NO: 450266 - protein, 13 aa, Mycobacterium
DGSVEVRDDGRGI

SEQ ID NO: 450267 - protein, 8 aa, Mycobacterium
DGSVGSDT

SEQ ID NO: 450268 - protein, 5 aa, Mycobacterium
DGSVH

SEQ ID NO: 450269 - protein, 8 aa, Mycobacterium
DGSVLGNT

SEQ ID NO: 450270 - protein, 6 aa, Mycobacterium
DGSVPR

SEQ ID NO: 450271 - protein, 8 aa, Mycobacterium
DGSVRGKI

SEQ ID NO: 450272 - protein, 10 aa, Mycobacterium
DGSVSEPTVG

SEQ ID NO: 450273 - protein, 8 aa, Mycobacterium
DGSVSEQS

SEQ ID NO: 450274 - protein, 10 aa, Mycobacterium
DGSVSPPTPV

SEQ ID NO: 450275 - protein, 7 aa, Mycobacterium
DGSVSSM

SEQ ID NO: 450276 - protein, 5 aa, Mycobacterium
DGSVT

SEQ ID NO: 450277 - protein, 9 aa, Mycobacterium
DGSVTKDYQ

SEQ ID NO: 450278 - protein, 9 aa, Mycobacterium
DGSVTRDYD

SEQ ID NO: 450279 - protein, 14 aa, Mycobacterium
DGSVYDGKRIDRRA

SEQ ID NO: 450280 - protein, 15 aa, Mycobacterium
DGSWKTKRIKNTPRV

SEQ ID NO: 450281 - protein, 15 aa, Mycobacterium
DGSWKTKRINNTPRV

SEQ ID NO: 450282 - protein, 13 aa, Mycobacterium
DGSYANGYGNSKW

SEQ ID NO: 450283 - protein, 13 aa, Mycobacterium
DGSYGNGYGNSKW

SEQ ID NO: 450284 - protein, 15 aa, Mycobacterium
DGSYPSGTAAYEKRN

SEQ ID NO: 450285 - protein, 8 aa, Mycobacterium
DGSYQDRN

SEQ ID NO: 450286 - protein, 6 aa, Mycobacterium
DGSYSR

SEQ ID NO: 450287 - protein, 6 aa, Mycobacterium
DGTAAA

SEQ ID NO: 450288 - protein, 11 aa, Mycobacterium
DGTAADSEASM

SEQ ID NO: 450289 - protein, 11 aa, Mycobacterium
DGTAADSQASM

SEQ ID NO: 450290 - protein, 6 aa, Mycobacterium
DGTAAR

SEQ ID NO: 450291 - protein, 8 aa, Mycobacterium
DGTADGER

SEQ ID NO: 450292 - protein, 5 aa, Mycobacterium
DGTAE

SEQ ID NO: 450293 - protein, 19 aa, Mycobacterium
DGTAEVQCGTSDMGPGTYT

SEQ ID NO: 450294 - protein, 5 aa, Mycobacterium
DGTAG

SEQ ID NO: 450295 - protein, 15 aa, Mycobacterium
DGTAGAPGQNGGDGG

SEQ ID NO: 450296 - protein, 25 aa, Mycobacterium
DGTAGTAGVAGQAGQPGPSATWPIF

SEQ ID NO: 450297 - protein, 5 aa, Mycobacterium
DGTAI

SEQ ID NO: 450298 - protein, 13 aa, Mycobacterium
DGTAISGEAPLRN

SEQ ID NO: 450299 - protein, 6 aa, Mycobacterium
DGTAKL

SEQ ID NO: 450300 - protein, 11 aa, Mycobacterium
DGTAKQRTTIG

SEQ ID NO: 450301 - protein, 5 aa, Mycobacterium
DGTAL

SEQ ID NO: 450302 - protein, 12 aa, Mycobacterium
DGTANELKHRAG

SEQ ID NO: 450303 - protein, 10 aa, Mycobacterium
DGTAPDGSRL

SEQ ID NO: 450304 - protein, 7 aa, Mycobacterium
DGTAPDP

SEQ ID NO: 450305 - protein, 11 aa, Mycobacterium
DGTAPEALAGR

SEQ ID NO: 450306 - protein, 14 aa, Mycobacterium
DGTAPNGASGRAFG

SEQ ID NO: 450307 - protein, 7 aa, Mycobacterium
DGTAPVD

SEQ ID NO: 450308 - protein, 9 aa, Mycobacterium
DGTARAERA

SEQ ID NO: 450309 - protein, 7 aa, Mycobacterium
DGTARGR

SEQ ID NO: 450310 - protein, 14 aa, Mycobacterium
DGTASADAVGHPPG

SEQ ID NO: 450311 - protein, 8 aa, Mycobacterium
DGTASPVN

SEQ ID NO: 450312 - protein, 9 aa, Mycobacterium
DGTATGLPA

SEQ ID NO: 450313 - protein, 12 aa, Mycobacterium
DGTAVRQLIRFD

SEQ ID NO: 450314 - protein, 5 aa, Mycobacterium
DGTAW

SEQ ID NO: 450315 - protein, 7 aa, Mycobacterium
DGTCPNC

SEQ ID NO: 450316 - protein, 10 aa, Mycobacterium
DGTDESRTRI

SEQ ID NO: 450317 - protein, 6 aa, Mycobacterium
DGTDHD

SEQ ID NO: 450318 - protein, 10 aa, Mycobacterium
DGTDLRDGES

SEQ ID NO: 450319 - protein, 20 aa, Mycobacterium
DGTDMQEEQKLDDEMRCTPS

SEQ ID NO: 450320 - protein, 6 aa, Mycobacterium
DGTDNT

SEQ ID NO: 450321 - protein, 11 aa, Mycobacterium
DGTDNTVYTSE

SEQ ID NO: 450322 - protein, 8 aa, Mycobacterium
DGTDRPPF

SEQ ID NO: 450323 - protein, 9 aa, Mycobacterium
DGTDSELAG

SEQ ID NO: 450324 - protein, 5 aa, Mycobacterium
DGTDV

SEQ ID NO: 450325 - protein, 4 aa, Mycobacterium
DGTE

SEQ ID NO: 450326 - protein, 8 aa, Mycobacterium
DGTEAALQ

SEQ ID NO: 450327 - protein, 5 aa, Mycobacterium
DGTED

SEQ ID NO: 450328 - protein, 17 aa, Mycobacterium
DGTEDYWSEEYRDLIEL

SEQ ID NO: 450329 - protein, 5 aa, Mycobacterium
DGTEE

SEQ ID NO: 450330 - protein, 12 aa, Mycobacterium
DGTEFGVPGRGV

SEQ ID NO: 450331 - protein, 8 aa, Mycobacterium
DGTEIKTN

SEQ ID NO: 450332 - protein, 8 aa, Mycobacterium
DGTEKPGY

SEQ ID NO: 450333 - protein, 21 aa, Mycobacterium
DGTELARAANARERLGDPTAH

SEQ ID NO: 450334 - protein, 7 aa, Mycobacterium
DGTEMQV

SEQ ID NO: 450335 - protein, 11 aa, Mycobacterium
DGTEMSDEDWG

SEQ ID NO: 450336 - protein, 5 aa, Mycobacterium
DGTER

SEQ ID NO: 450337 - protein, 6 aa, Mycobacterium
DGTERE

SEQ ID NO: 450338 - protein, 8 aa, Mycobacterium
DGTEVSAG

SEQ ID NO: 450339 - protein, 7 aa, Mycobacterium
DGTEVTT

SEQ ID NO: 450340 - protein, 8 aa, Mycobacterium
DGTFTNAE

SEQ ID NO: 450341 - protein, 8 aa, Mycobacterium
DGTGAERY

SEQ ID NO: 450342 - protein, 15 aa, Mycobacterium
DGTGARIRDTRKTLP

SEQ ID NO: 450343 - protein, 7 aa, Mycobacterium
DGTGASV

SEQ ID NO: 450344 - protein, 8 aa, Mycobacterium
DGTGDAGA

SEQ ID NO: 450345 - protein, 6 aa, Mycobacterium
DGTGDT

SEQ ID NO: 450346 - protein, 36 aa, Mycobacterium
DGTGGAGGTGGGGGFGGIGAAGGDAGAGGAGGANQA

SEQ ID NO: 450347 - protein, 9 aa, Mycobacterium
DGTGGPSAL

SEQ ID NO: 450348 - protein, 6 aa, Mycobacterium
DGTGGT

SEQ ID NO: 450349 - protein, 9 aa, Mycobacterium
DGTGGYRGE

SEQ ID NO: 450350 - protein, 5 aa, Mycobacterium
DGTGI

SEQ ID NO: 450351 - protein, 5 aa, Mycobacterium
DGTGL

SEQ ID NO: 450352 - protein, 12 aa, Mycobacterium
DGTGPEGTDTPR

SEQ ID NO: 450353 - protein, 11 aa, Mycobacterium
DGTGPEGTDVP

SEQ ID NO: 450354 - protein, 9 aa, Mycobacterium
DGTGPSGEA

SEQ ID NO: 450355 - protein, 9 aa, Mycobacterium
DGTGQDDPA

SEQ ID NO: 450356 - protein, 7 aa, Mycobacterium
DGTGQVD

SEQ ID NO: 450357 - protein, 7 aa, Mycobacterium
DGTGQVS

SEQ ID NO: 450358 - protein, 5 aa, Mycobacterium
DGTGR

SEQ ID NO: 450359 - protein, 11 aa, Mycobacterium
DGTGRPAERAD

SEQ ID NO: 450360 - protein, 7 aa, Mycobacterium
DGTGRVQ

SEQ ID NO: 450361 - protein, 9 aa, Mycobacterium
DGTGTDPDK

SEQ ID NO: 450362 - protein, 10 aa, Mycobacterium
DGTGTIAKTD

SEQ ID NO: 450363 - protein, 10 aa, Mycobacterium
DGTGTIARTD

SEQ ID NO: 450364 - protein, 9 aa, Mycobacterium
DGTGWDSEY

SEQ ID NO: 450365 - protein, 14 aa, Mycobacterium
DGTHGTNDTAAQRI

SEQ ID NO: 450366 - protein, 17 aa, Mycobacterium
DGTHHENAAAGEAAGTL

SEQ ID NO: 450367 - protein, 8 aa, Mycobacterium
DGTHHQHE

SEQ ID NO: 450368 - protein, 12 aa, Mycobacterium
DGTHKTMPVRPD

SEQ ID NO: 450369 - protein, 12 aa, Mycobacterium
DGTHSGTGGGNH

SEQ ID NO: 450370 - protein, 12 aa, Mycobacterium
DGTHTGTGGGNH

SEQ ID NO: 450371 - protein, 6 aa, Mycobacterium
DGTIQA

SEQ ID NO: 450372 - protein, 7 aa, Mycobacterium
DGTITGG

SEQ ID NO: 450373 - protein, 22 aa, Mycobacterium
DGTKAGKELGWQPTTSLQEGTR

SEQ ID NO: 450374 - protein, 15 aa, Mycobacterium
DGTKAKVRDTRKTLP

SEQ ID NO: 450375 - protein, 6 aa, Mycobacterium
DGTKNF

SEQ ID NO: 450376 - protein, 7 aa, Mycobacterium
DGTKSAI

SEQ ID NO: 450377 - protein, 8 aa, Mycobacterium
DGTKTFPN

SEQ ID NO: 450378 - protein, 14 aa, Mycobacterium
DGTKVKANASRHKA

SEQ ID NO: 450379 - protein, 6 aa, Mycobacterium
DGTLDE

SEQ ID NO: 450380 - protein, 10 aa, Mycobacterium
DGTLERARSA

SEQ ID NO: 450381 - protein, 11 aa, Mycobacterium
DGTLGDKEIEK

SEQ ID NO: 450382 - protein, 8 aa, Mycobacterium
DGTLGGPV

SEQ ID NO: 450383 - protein, 5 aa, Mycobacterium
DGTLN

SEQ ID NO: 450384 - protein, 11 aa, Mycobacterium
DGTLPKGDAIA

SEQ ID NO: 450385 - protein, 6 aa, Mycobacterium
DGTLPN

SEQ ID NO: 450386 - protein, 8 aa, Mycobacterium
DGTLPVTT

SEQ ID NO: 450387 - protein, 5 aa, Mycobacterium
DGTLR

SEQ ID NO: 450388 - protein, 10 aa, Mycobacterium
DGTLSDQDAA

SEQ ID NO: 450389 - protein, 10 aa, Mycobacterium
DGTLSPASIG

SEQ ID NO: 450390 - protein, 14 aa, Mycobacterium
DGTLSPVATPTGLA

SEQ ID NO: 450391 - protein, 10 aa, Mycobacterium
DGTLTAAGRE

SEQ ID NO: 450392 - protein, 5 aa, Mycobacterium
DGTNE

SEQ ID NO: 450393 - protein, 8 aa, Mycobacterium
DGTNEGEV

SEQ ID NO: 450394 - protein, 6 aa, Mycobacterium
DGTNGV

SEQ ID NO: 450395 - protein, 6 aa, Mycobacterium
DGTPAI

SEQ ID NO: 450396 - protein, 6 aa, Mycobacterium
DGTPAV

SEQ ID NO: 450397 - protein, 6 aa, Mycobacterium
DGTPAY

SEQ ID NO: 450398 - protein, 8 aa, Mycobacterium
DGTPDPLA

SEQ ID NO: 450399 - protein, 7 aa, Mycobacterium
DGTPEAA

SEQ ID NO: 450400 - protein, 9 aa, Mycobacterium
DGTPEGAAA

SEQ ID NO: 450401 - protein, 10 aa, Mycobacterium
DGTPFPEGTP

SEQ ID NO: 450402 - protein, 8 aa, Mycobacterium
DGTPGRID

SEQ ID NO: 450403 - protein, 7 aa, Mycobacterium
DGTPKAV

SEQ ID NO: 450404 - protein, 8 aa, Mycobacterium
DGTPLDAE

SEQ ID NO: 450405 - protein, 9 aa, Mycobacterium
DGTPLDEPT

SEQ ID NO: 450406 - protein, 10 aa, Mycobacterium
DGTPLGPDRA

SEQ ID NO: 450407 - protein, 6 aa, Mycobacterium
DGTPLS

SEQ ID NO: 450408 - protein, 10 aa, Mycobacterium
DGTPPAPGDL

SEQ ID NO: 450409 - protein, 20 aa, Mycobacterium
DGTPPPAPAAKKKSANRSDF

SEQ ID NO: 450410 - protein, 8 aa, Mycobacterium
DGTPRPKH

SEQ ID NO: 450411 - protein, 7 aa, Mycobacterium
DGTPRTK

SEQ ID NO: 450412 - protein, 6 aa, Mycobacterium
DGTPSA

SEQ ID NO: 450413 - protein, 22 aa, Mycobacterium
DGTPSQAAIDRDTRSKAQRGHD

SEQ ID NO: 450414 - protein, 10 aa, Mycobacterium
DGTPSSSADV

SEQ ID NO: 450415 - protein, 7 aa, Mycobacterium
DGTPTQV

SEQ ID NO: 450416 - protein, 7 aa, Mycobacterium
DGTPTTV

SEQ ID NO: 450417 - protein, 5 aa, Mycobacterium
DGTPV

SEQ ID NO: 450418 - protein, 6 aa, Mycobacterium
DGTPVG

SEQ ID NO: 450419 - protein, 6 aa, Mycobacterium
DGTPVT

SEQ ID NO: 450420 - protein, 5 aa, Mycobacterium
DGTPW

SEQ ID NO: 450421 - protein, 5 aa, Mycobacterium
DGTPY

SEQ ID NO: 450422 - protein, 16 aa, Mycobacterium
DGTQDFGGTPVPDTPG

SEQ ID NO: 450423 - protein, 8 aa, Mycobacterium
DGTQEPHN

SEQ ID NO: 450424 - protein, 8 aa, Mycobacterium
DGTQQGGN

SEQ ID NO: 450425 - protein, 13 aa, Mycobacterium
DGTQQTMPKPGRP

SEQ ID NO: 450426 - protein, 5 aa, Mycobacterium
DGTQR

SEQ ID NO: 450427 - protein, 9 aa, Mycobacterium
DGTQRIAAR

SEQ ID NO: 450428 - protein, 11 aa, Mycobacterium
DGTQRIAPADE

SEQ ID NO: 450429 - protein, 13 aa, Mycobacterium
DGTQRIGAPANEF

SEQ ID NO: 450430 - protein, 17 aa, Mycobacterium
DGTQSTYNVGGANVGNH

SEQ ID NO: 450431 - protein, 5 aa, Mycobacterium
DGTRE

SEQ ID NO: 450432 - protein, 8 aa, Mycobacterium
DGTREQRD

SEQ ID NO: 450433 - protein, 37 aa, Mycobacterium
DGTRGEVTTGRLPETVRTTTTPQEPAPHITGEATGTK

SEQ ID NO: 450434 - protein, 19 aa, Mycobacterium
DGTRHEIPDPPTGAVPPAR

SEQ ID NO: 450435 - protein, 5 aa, Mycobacterium
DGTRL

SEQ ID NO: 450436 - protein, 7 aa, Mycobacterium
DGTRLER

SEQ ID NO: 450437 - protein, 7 aa, Mycobacterium
DGTRLPS

SEQ ID NO: 450438 - protein, 16 aa, Mycobacterium
DGTRLSETARSSKIDG

SEQ ID NO: 450439 - protein, 7 aa, Mycobacterium
DGTRMDA

SEQ ID NO: 450440 - protein, 10 aa, Mycobacterium
DGTRNVATDA

SEQ ID NO: 450441 - protein, 11 aa, Mycobacterium
DGTRNVATDAE

SEQ ID NO: 450442 - protein, 5 aa, Mycobacterium
DGTRR

SEQ ID NO: 450443 - protein, 6 aa, Mycobacterium
DGTRRT

SEQ ID NO: 450444 - protein, 7 aa, Mycobacterium
DGTRSSV

SEQ ID NO: 450445 - protein, 8 aa, Mycobacterium
DGTRSTVT

SEQ ID NO: 450446 - protein, 6 aa, Mycobacterium
DGTRSV

SEQ ID NO: 450447 - protein, 7 aa, Mycobacterium
DGTRTDI

SEQ ID NO: 450448 - protein, 6 aa, Mycobacterium
DGTRTE

SEQ ID NO: 450449 - protein, 5 aa, Mycobacterium
DGTRV

SEQ ID NO: 450450 - protein, 9 aa, Mycobacterium
DGTRVPGRP

SEQ ID NO: 450451 - protein, 7 aa, Mycobacterium
DGTRVTT

SEQ ID NO: 450452 - protein, 16 aa, Mycobacterium
DGTRYPVQPASRTAAK

SEQ ID NO: 450453 - protein, 7 aa, Mycobacterium
DGTSALP

SEQ ID NO: 450454 - protein, 8 aa, Mycobacterium
DGTSARTD

SEQ ID NO: 450455 - protein, 7 aa, Mycobacterium
DGTSDGI

SEQ ID NO: 450456 - protein, 5 aa, Mycobacterium
DGTSG

SEQ ID NO: 450457 - protein, 15 aa, Mycobacterium
DGTSGIQTQAYATSP

SEQ ID NO: 450458 - protein, 7 aa, Mycobacterium
DGTSGPL

SEQ ID NO: 450459 - protein, 12 aa, Mycobacterium
DGTSIGAADGPT

SEQ ID NO: 450460 - protein, 5 aa, Mycobacterium
DGTSM

SEQ ID NO: 450461 - protein, 7 aa, Mycobacterium
DGTSPVN

SEQ ID NO: 450462 - protein, 8 aa, Mycobacterium
DGTSRARG

SEQ ID NO: 450463 - protein, 10 aa, Mycobacterium
DGTSSATREQ

SEQ ID NO: 450464 - protein, 6 aa, Mycobacterium
DGTSTD

SEQ ID NO: 450465 - protein, 8 aa, Mycobacterium
DGTSTFSG

SEQ ID NO: 450466 - protein, 7 aa, Mycobacterium
DGTSVAG

SEQ ID NO: 450467 - protein, 4 aa, Mycobacterium
DGTT

SEQ ID NO: 450468 - protein, 6 aa, Mycobacterium
DGTTAD

SEQ ID NO: 450469 - protein, 6 aa, Mycobacterium
DGTTDF

SEQ ID NO: 450470 - protein, 8 aa, Mycobacterium
DGTTEFNA

SEQ ID NO: 450471 - protein, 10 aa, Mycobacterium
DGTTEGTGGI

SEQ ID NO: 450472 - protein, 8 aa, Mycobacterium
DGTTEHRR

SEQ ID NO: 450473 - protein, 6 aa, Mycobacterium
DGTTGR

SEQ ID NO: 450474 - protein, 7 aa, Mycobacterium
DGTTHEL

SEQ ID NO: 450475 - protein, 5 aa, Mycobacterium
DGTTL

SEQ ID NO: 450476 - protein, 6 aa, Mycobacterium
DGTTLS

SEQ ID NO: 450477 - protein, 7 aa, Mycobacterium
DGTTNYT

SEQ ID NO: 450478 - protein, 11 aa, Mycobacterium
DGTTPTPPDWP

SEQ ID NO: 450479 - protein, 6 aa, Mycobacterium
DGTTPV

SEQ ID NO: 450480 - protein, 7 aa, Mycobacterium
DGTTPVR

SEQ ID NO: 450481 - protein, 6 aa, Mycobacterium
DGTTQI

SEQ ID NO: 450482 - protein, 8 aa, Mycobacterium
DGTTRTGL

SEQ ID NO: 450483 - protein, 6 aa, Mycobacterium
DGTTVA

SEQ ID NO: 450484 - protein, 7 aa, Mycobacterium
DGTTVDA

SEQ ID NO: 450485 - protein, 7 aa, Mycobacterium
DGTTVQV

SEQ ID NO: 450486 - protein, 6 aa, Mycobacterium
DGTTVT

SEQ ID NO: 450487 - protein, 5 aa, Mycobacterium
DGTTY

SEQ ID NO: 450488 - protein, 6 aa, Mycobacterium
DGTVAA

SEQ ID NO: 450489 - protein, 10 aa, Mycobacterium
DGTVAEADRD

SEQ ID NO: 450490 - protein, 10 aa, Mycobacterium
DGTVAEEDRD

SEQ ID NO: 450491 - protein, 7 aa, Mycobacterium
DGTVEAS

SEQ ID NO: 450492 - protein, 10 aa, Mycobacterium
DGTVEESPAE

SEQ ID NO: 450493 - protein, 12 aa, Mycobacterium
DGTVEGTAGQEL

SEQ ID NO: 450494 - protein, 9 aa, Mycobacterium
DGTVGANKN

SEQ ID NO: 450495 - protein, 5 aa, Mycobacterium
DGTVH

SEQ ID NO: 450496 - protein, 7 aa, Mycobacterium
DGTVPGT

SEQ ID NO: 450497 - protein, 9 aa, Mycobacterium
DGTVQASTL

SEQ ID NO: 450498 - protein, 15 aa, Mycobacterium
DGTVTAGNASPLTDG

SEQ ID NO: 450499 - protein, 6 aa, Mycobacterium
DGTVTV

SEQ ID NO: 450500 - protein, 20 aa, Mycobacterium
DGTVVSKDDGPRAGTSYDKI

SEQ ID NO: 450501 - protein, 18 aa, Mycobacterium
DGTVVSKDDGPRAGTTYE

SEQ ID NO: 450502 - protein, 6 aa, Mycobacterium
DGTVVT

SEQ ID NO: 450503 - protein, 7 aa, Mycobacterium
DGTYVST

SEQ ID NO: 450504 - protein, 10 aa, Mycobacterium
DGVAAAGRRA

SEQ ID NO: 450505 - protein, 8 aa, Mycobacterium
DGVADGEA

SEQ ID NO: 450506 - protein, 7 aa, Mycobacterium
DGVAGGT

SEQ ID NO: 450507 - protein, 13 aa, Mycobacterium
DGVAKGRPTAKPQ

SEQ ID NO: 450508 - protein, 9 aa, Mycobacterium
DGVAKSPEW

SEQ ID NO: 450509 - protein, 9 aa, Mycobacterium
DGVAPDTSA

SEQ ID NO: 450510 - protein, 8 aa, Mycobacterium
DGVAPGRA

SEQ ID NO: 450511 - protein, 10 aa, Mycobacterium
DGVASAGGAT

SEQ ID NO: 450512 - protein, 7 aa, Mycobacterium
DGVASGS

SEQ ID NO: 450513 - protein, 8 aa, Mycobacterium
DGVATAQR

SEQ ID NO: 450514 - protein, 7 aa, Mycobacterium
DGVATGS

SEQ ID NO: 450515 - protein, 14 aa, Mycobacterium
DGVATSARGNADDV

SEQ ID NO: 450516 - protein, 6 aa, Mycobacterium
DGVATV

SEQ ID NO: 450517 - protein, 5 aa, Mycobacterium
DGVDA

SEQ ID NO: 450518 - protein, 8 aa, Mycobacterium
DGVDADTL

SEQ ID NO: 450519 - protein, 5 aa, Mycobacterium
DGVDD

SEQ ID NO: 450520 - protein, 8 aa, Mycobacterium
DGVDGEEI

SEQ ID NO: 450521 - protein, 14 aa, Mycobacterium
DGVDGLSARSRREL

SEQ ID NO: 450522 - protein, 8 aa, Mycobacterium
DGVDGTAG

SEQ ID NO: 450523 - protein, 12 aa, Mycobacterium
DGVDHASASLTA

SEQ ID NO: 450524 - protein, 14 aa, Mycobacterium
DGVDPAETLRDGSA

SEQ ID NO: 450525 - protein, 6 aa, Mycobacterium
DGVDPD

SEQ ID NO: 450526 - protein, 10 aa, Mycobacterium
DGVDPHRHSG

SEQ ID NO: 450527 - protein, 25 aa, Mycobacterium
DGVDSAQRRRGPQVPPKGLARGPGN

SEQ ID NO: 450528 - protein, 6 aa, Mycobacterium
DGVEES

SEQ ID NO: 450529 - protein, 7 aa, Mycobacterium
DGVEQRR

SEQ ID NO: 450530 - protein, 5 aa, Mycobacterium
DGVER

SEQ ID NO: 450531 - protein, 6 aa, Mycobacterium
DGVERP

SEQ ID NO: 450532 - protein, 13 aa, Mycobacterium
DGVERTTHAWRIA

SEQ ID NO: 450533 - protein, 5 aa, Mycobacterium
DGVES

SEQ ID NO: 450534 - protein, 19 aa, Mycobacterium
DGVESADSAAALDDARPNP

SEQ ID NO: 450535 - protein, 8 aa, Mycobacterium
DGVESEVG

SEQ ID NO: 450536 - protein, 6 aa, Mycobacterium
DGVESI

SEQ ID NO: 450537 - protein, 12 aa, Mycobacterium
DGVEVDKTKVTP

SEQ ID NO: 450538 - protein, 13 aa, Mycobacterium
DGVGAGASGGNAG

SEQ ID NO: 450539 - protein, 8 aa, Mycobacterium
DGVGAPHD

SEQ ID NO: 450540 - protein, 7 aa, Mycobacterium
DGVGEQG

SEQ ID NO: 450541 - protein, 7 aa, Mycobacterium
DGVGEQR

SEQ ID NO: 450542 - protein, 6 aa, Mycobacterium
DGVGGT

SEQ ID NO: 450543 - protein, 7 aa, Mycobacterium
DGVGGTW

SEQ ID NO: 450544 - protein, 9 aa, Mycobacterium
DGVGKSPQQ

SEQ ID NO: 450545 - protein, 10 aa, Mycobacterium
DGVGKSPQQI

SEQ ID NO: 450546 - protein, 10 aa, Mycobacterium
DGVGKSPQQL

SEQ ID NO: 450547 - protein, 10 aa, Mycobacterium
DGVGKTPRQL

SEQ ID NO: 450548 - protein, 5 aa, Mycobacterium
DGVGN

SEQ ID NO: 450549 - protein, 9 aa, Mycobacterium
DGVHEAGGY

SEQ ID NO: 450550 - protein, 9 aa, Mycobacterium
DGVHPNDAG

SEQ ID NO: 450551 - protein, 11 aa, Mycobacterium
DGVKDTPDEAR

SEQ ID NO: 450552 - protein, 4 aa, Mycobacterium
DGVM

SEQ ID NO: 450553 - protein, 17 aa, Mycobacterium
DGVNGASGTGQDGGPGG

SEQ ID NO: 450554 - protein, 7 aa, Mycobacterium
DGVNNPP

SEQ ID NO: 450555 - protein, 5 aa, Mycobacterium
DGVNP

SEQ ID NO: 450556 - protein, 7 aa, Mycobacterium
DGVPADQ

SEQ ID NO: 450557 - protein, 7 aa, Mycobacterium
DGVPASA

SEQ ID NO: 450558 - protein, 11 aa, Mycobacterium
DGVPDLTQPQI

SEQ ID NO: 450559 - protein, 6 aa, Mycobacterium
DGVPDS

SEQ ID NO: 450560 - protein, 5 aa, Mycobacterium
DGVPG

SEQ ID NO: 450561 - protein, 6 aa, Mycobacterium
DGVPGE

SEQ ID NO: 450562 - protein, 6 aa, Mycobacterium
DGVPGK

SEQ ID NO: 450563 - protein, 10 aa, Mycobacterium
DGVPGLGEHR

SEQ ID NO: 450564 - protein, 9 aa, Mycobacterium
DGVPGTDDG

SEQ ID NO: 450565 - protein, 10 aa, Mycobacterium
DGVPKSPEWA

SEQ ID NO: 450566 - protein, 10 aa, Mycobacterium
DGVPNRVTGT

SEQ ID NO: 450567 - protein, 6 aa, Mycobacterium
DGVPRS

SEQ ID NO: 450568 - protein, 7 aa, Mycobacterium
DGVPTRV

SEQ ID NO: 450569 - protein, 6 aa, Mycobacterium
DGVPTV

SEQ ID NO: 450570 - protein, 20 aa, Mycobacterium
DGVQLGPAAAETVTQERERR

SEQ ID NO: 450571 - protein, 7 aa, Mycobacterium
DGVQQPV

SEQ ID NO: 450572 - protein, 7 aa, Mycobacterium
DGVQQRD

SEQ ID NO: 450573 - protein, 5 aa, Mycobacterium
DGVRA

SEQ ID NO: 450574 - protein, 6 aa, Mycobacterium
DGVRAG

SEQ ID NO: 450575 - protein, 8 aa, Mycobacterium
DGVRDARA

SEQ ID NO: 450576 - protein, 7 aa, Mycobacterium
DGVRDAS

SEQ ID NO: 450577 - protein, 11 aa, Mycobacterium
DGVRDNPEAAR

SEQ ID NO: 450578 - protein, 7 aa, Mycobacterium
DGVRGVA

SEQ ID NO: 450579 - protein, 13 aa, Mycobacterium
DGVRPDKSRNRKG

SEQ ID NO: 450580 - protein, 5 aa, Mycobacterium
DGVRR

SEQ ID NO: 450581 - protein, 6 aa, Mycobacterium
DGVRRQ

SEQ ID NO: 450582 - protein, 14 aa, Mycobacterium
DGVRSSRFANATPK

SEQ ID NO: 450583 - protein, 14 aa, Mycobacterium
DGVRSTRFANPEPK

SEQ ID NO: 450584 - protein, 5 aa, Mycobacterium
DGVSA

SEQ ID NO: 450585 - protein, 7 aa, Mycobacterium
DGVSARS

SEQ ID NO: 450586 - protein, 19 aa, Mycobacterium
DGVSDGDIDTRKAAVSSED

SEQ ID NO: 450587 - protein, 7 aa, Mycobacterium
DGVSHSH

SEQ ID NO: 450588 - protein, 7 aa, Mycobacterium
DGVSHSY

SEQ ID NO: 450589 - protein, 6 aa, Mycobacterium
DGVSPG

SEQ ID NO: 450590 - protein, 8 aa, Mycobacterium
DGVSPSAY

SEQ ID NO: 450591 - protein, 6 aa, Mycobacterium
DGVSVP

SEQ ID NO: 450592 - protein, 8 aa, Mycobacterium
DGVTADPD

SEQ ID NO: 450593 - protein, 7 aa, Mycobacterium
DGVTAQG

SEQ ID NO: 450594 - protein, 11 aa, Mycobacterium
DGVTARGRGMA

SEQ ID NO: 450595 - protein, 8 aa, Mycobacterium
DGVTASRA

SEQ ID NO: 450596 - protein, 8 aa, Mycobacterium
DGVTATDT

SEQ ID NO: 450597 - protein, 11 aa, Mycobacterium
DGVTDVPDSAI

SEQ ID NO: 450598 - protein, 7 aa, Mycobacterium
DGVTGQG

SEQ ID NO: 450599 - protein, 9 aa, Mycobacterium
DGVTGWQEG

SEQ ID NO: 450600 - protein, 13 aa, Mycobacterium
DGVTRTTHAWRIA

SEQ ID NO: 450601 - protein, 11 aa, Mycobacterium
DGVTSATCRHR

SEQ ID NO: 450602 - protein, 7 aa, Mycobacterium
DGVTTAH

SEQ ID NO: 450603 - protein, 6 aa, Mycobacterium
DGVTTG

SEQ ID NO: 450604 - protein, 7 aa, Mycobacterium
DGVTTQG

SEQ ID NO: 450605 - protein, 13 aa, Mycobacterium
DGVTVGKDEPMSG

SEQ ID NO: 450606 - protein, 4 aa, Mycobacterium
DGVV

SEQ ID NO: 450607 - protein, 9 aa, Mycobacterium
DGVVPDRTT

SEQ ID NO: 450608 - protein, 13 aa, Mycobacterium
DGVVPTKTGSLRR

SEQ ID NO: 450609 - protein, 11 aa, Mycobacterium
DGVVTSDGIER

SEQ ID NO: 450610 - protein, 6 aa, Mycobacterium
DGVYPT

SEQ ID NO: 450611 - protein, 4 aa, Mycobacterium
DGWA

SEQ ID NO: 450612 - protein, 8 aa, Mycobacterium
DGWAGGPE

SEQ ID NO: 450613 - protein, 14 aa, Mycobacterium
DGWAGTASDAAGEF

SEQ ID NO: 450614 - protein, 5 aa, Mycobacterium
DGWDP

SEQ ID NO: 450615 - protein, 14 aa, Mycobacterium
DGWDPSHRPEAALR

SEQ ID NO: 450616 - protein, 13 aa, Mycobacterium
DGWMSTPRDEDIA

SEQ ID NO: 450617 - protein, 4 aa, Mycobacterium
DGWN

SEQ ID NO: 450618 - protein, 6 aa, Mycobacterium
DGWNKA

SEQ ID NO: 450619 - protein, 12 aa, Mycobacterium
DGWPSTPGTGDV

SEQ ID NO: 450620 - protein, 15 aa, Mycobacterium
DGWQQETYPSLDPQG

SEQ ID NO: 450621 - protein, 6 aa, Mycobacterium
DGWRAH

SEQ ID NO: 450622 - protein, 28 aa, Mycobacterium
DGWRDDRDNHWDNERDNDWDKAGPVSQE

SEQ ID NO: 450623 - protein, 12 aa, Mycobacterium
DGWRQTRGGRQC

SEQ ID NO: 450624 - protein, 13 aa, Mycobacterium
DGWRRERGRLPRN

SEQ ID NO: 450625 - protein, 10 aa, Mycobacterium
DGWSGEFPDA

SEQ ID NO: 450626 - protein, 8 aa, Mycobacterium
DGWSPEDP

SEQ ID NO: 450627 - protein, 8 aa, Mycobacterium
DGWSSSRL

SEQ ID NO: 450628 - protein, 13 aa, Mycobacterium
DGWTEVSADGRRG

SEQ ID NO: 450629 - protein, 14 aa, Mycobacterium
DGWTTRKNTNGDTQ

SEQ ID NO: 450630 - protein, 6 aa, Mycobacterium
DGYAAR

SEQ ID NO: 450631 - protein, 48 aa, Mycobacterium
DGYAAYTAASTQGAGTIGGSGAAGSAGAGPAAGLATLTGDDSGRGPTV

SEQ ID NO: 450632 - protein, 7 aa, Mycobacterium
DGYAEAI

SEQ ID NO: 450633 - protein, 6 aa, Mycobacterium
DGYAGR

SEQ ID NO: 450634 - protein, 8 aa, Mycobacterium
DGYARAGG

SEQ ID NO: 450635 - protein, 5 aa, Mycobacterium
DGYDP

SEQ ID NO: 450636 - protein, 4 aa, Mycobacterium
DGYE

SEQ ID NO: 450637 - protein, 5 aa, Mycobacterium
DGYEA

SEQ ID NO: 450638 - protein, 6 aa, Mycobacterium
DGYEKT

SEQ ID NO: 450639 - protein, 6 aa, Mycobacterium
DGYEQL

SEQ ID NO: 450640 - protein, 4 aa, Mycobacterium
DGYG

SEQ ID NO: 450641 - protein, 12 aa, Mycobacterium
DGYGATETGGGI

SEQ ID NO: 450642 - protein, 6 aa, Mycobacterium
DGYGHG

SEQ ID NO: 450643 - protein, 7 aa, Mycobacterium
DGYGHGA

SEQ ID NO: 450644 - protein, 21 aa, Mycobacterium
DGYGHGAAQTARAALAAGAAE

SEQ ID NO: 450645 - protein, 8 aa, Mycobacterium
DGYGHGAT

SEQ ID NO: 450646 - protein, 9 aa, Mycobacterium
DGYGHGATR

SEQ ID NO: 450647 - protein, 8 aa, Mycobacterium
DGYGNPDG

SEQ ID NO: 450648 - protein, 5 aa, Mycobacterium
DGYGP

SEQ ID NO: 450649 - protein, 7 aa, Mycobacterium
DGYGPSS

SEQ ID NO: 450650 - protein, 6 aa, Mycobacterium
DGYGQA

SEQ ID NO: 450651 - protein, 21 aa, Mycobacterium
DGYGRRSDDVEDADALRAGET

SEQ ID NO: 450652 - protein, 14 aa, Mycobacterium
DGYGRTGFGLAVLD

SEQ ID NO: 450653 - protein, 39 aa, Mycobacterium
DGYGRYDGDDYEDPRREPADYPPPAGYRGGYADEPRYGS

SEQ ID NO: 450654 - protein, 37 aa, Mycobacterium
DGYGRYEGRDYDDPREPADYPPPGGYRGGYGDEPRYG

SEQ ID NO: 450655 - protein, 9 aa, Mycobacterium
DGYGSPQEV

SEQ ID NO: 450656 - protein, 8 aa, Mycobacterium
DGYGSTEA

SEQ ID NO: 450657 - protein, 11 aa, Mycobacterium
DGYGSTEAGGV

SEQ ID NO: 450658 - protein, 5 aa, Mycobacterium
DGYLT

SEQ ID NO: 450659 - protein, 6 aa, Mycobacterium
DGYNGT

SEQ ID NO: 450660 - protein, 6 aa, Mycobacterium
DGYPAA

SEQ ID NO: 450661 - protein, 10 aa, Mycobacterium
DGYPDGTGAG

SEQ ID NO: 450662 - protein, 16 aa, Mycobacterium
DGYPEGQPSAGIRPGD

SEQ ID NO: 450663 - protein, 6 aa, Mycobacterium
DGYPGL

SEQ ID NO: 450664 - protein, 11 aa, Mycobacterium
DGYPPPGPPLN

SEQ ID NO: 450665 - protein, 7 aa, Mycobacterium
DGYPSQQ

SEQ ID NO: 450666 - protein, 15 aa, Mycobacterium
DGYPTAGQLAADTGW

SEQ ID NO: 450667 - protein, 14 aa, Mycobacterium
DGYPYRQRPTPIPT

SEQ ID NO: 450668 - protein, 7 aa, Mycobacterium
DGYQGRG

SEQ ID NO: 450669 - protein, 10 aa, Mycobacterium
DGYQQDPAAT

SEQ ID NO: 450670 - protein, 7 aa, Mycobacterium
DGYRGSP

SEQ ID NO: 450671 - protein, 8 aa, Mycobacterium
DGYRPEPD

SEQ ID NO: 450672 - protein, 6 aa, Mycobacterium
DGYRRY

SEQ ID NO: 450673 - protein, 5 aa, Mycobacterium
DGYSA

SEQ ID NO: 450674 - protein, 6 aa, Mycobacterium
DGYSAG

SEQ ID NO: 450675 - protein, 6 aa, Mycobacterium
DGYSEN

SEQ ID NO: 450676 - protein, 6 aa, Mycobacterium
DGYSET

SEQ ID NO: 450677 - protein, 14 aa, Mycobacterium
DGYSFEKEKRTAEQ

SEQ ID NO: 450678 - protein, 9 aa, Mycobacterium
DGYSGTLNP

SEQ ID NO: 450679 - protein, 8 aa, Mycobacterium
DGYSNTLQ

SEQ ID NO: 450680 - protein, 9 aa, Mycobacterium
DGYSPPARA

SEQ ID NO: 450681 - protein, 15 aa, Mycobacterium
DGYSREDALDAGEGL

SEQ ID NO: 450682 - protein, 12 aa, Mycobacterium
DGYTDKESSEKK

SEQ ID NO: 450683 - protein, 12 aa, Mycobacterium
DGYTDPAASEKK

SEQ ID NO: 450684 - protein, 12 aa, Mycobacterium
DGYTDPESSEKK

SEQ ID NO: 450685 - protein, 12 aa, Mycobacterium
DGYTDPTASEKK

SEQ ID NO: 450686 - protein, 12 aa, Mycobacterium
DGYTDSSATEKK

SEQ ID NO: 450687 - protein, 8 aa, Mycobacterium
DGYTECTS

SEQ ID NO: 450688 - protein, 9 aa, Mycobacterium
DGYTGGGHK

SEQ ID NO: 450689 - protein, 6 aa, Mycobacterium
DGYTGT

SEQ ID NO: 450690 - protein, 5 aa, Mycobacterium
DGYTP

SEQ ID NO: 450691 - protein, 8 aa, Mycobacterium
DGYTPEFP

SEQ ID NO: 450692 - protein, 8 aa, Mycobacterium
DGYVRGEG

SEQ ID NO: 450693 - protein, 9 aa, Mycobacterium
DGYVRGEGS

SEQ ID NO: 450694 - protein, 9 aa, Mycobacterium
DGYVRSEGG

SEQ ID NO: 450695 - protein, 5 aa, Mycobacterium
DGYVS

SEQ ID NO: 450696 - protein, 15 aa, Mycobacterium
DGYVTGTGPGTPPRI

SEQ ID NO: 450697 - protein, 12 aa, Mycobacterium
DGYVTRPAEAPV

SEQ ID NO: 450698 - protein, 6 aa, Mycobacterium
DGYYRT

SEQ ID NO: 450699 - protein, 15 aa, Mycobacterium
DHAAQRAGDIPYYGP

SEQ ID NO: 450700 - protein, 8 aa, Mycobacterium
DHAASSTD

SEQ ID NO: 450701 - protein, 4 aa, Mycobacterium
DHAD

SEQ ID NO: 450702 - protein, 22 aa, Mycobacterium
DHADDDPNAPARSQTYRDIPDE

SEQ ID NO: 450703 - protein, 7 aa, Mycobacterium
DHADSDH

SEQ ID NO: 450704 - protein, 7 aa, Mycobacterium
DHADTLG

SEQ ID NO: 450705 - protein, 7 aa, Mycobacterium
DHADTSG

SEQ ID NO: 450706 - protein, 22 aa, Mycobacterium
DHAEAPKSAEEKAAEASAPQKV

SEQ ID NO: 450707 - protein, 21 aa, Mycobacterium
DHAGGARPHEPSDPTAPAGVY

SEQ ID NO: 450708 - protein, 8 aa, Mycobacterium
DHAGNGAP

SEQ ID NO: 450709 - protein, 7 aa, Mycobacterium
DHAGTEQ

SEQ ID NO: 450710 - protein, 6 aa, Mycobacterium
DHAGTP

SEQ ID NO: 450711 - protein, 6 aa, Mycobacterium
DHAGTS

SEQ ID NO: 450712 - protein, 8 aa, Mycobacterium
DHAPGDVL

SEQ ID NO: 450713 - protein, 7 aa, Mycobacterium
DHAPPRA

SEQ ID NO: 450714 - protein, 15 aa, Mycobacterium
DHAPPTRPLIIDRIS

SEQ ID NO: 450715 - protein, 7 aa, Mycobacterium
DHAQAAR

SEQ ID NO: 450716 - protein, 5 aa, Mycobacterium
DHARR

SEQ ID NO: 450717 - protein, 7 aa, Mycobacterium
DHARTNG

SEQ ID NO: 450718 - protein, 4 aa, Mycobacterium
DHAS

SEQ ID NO: 450719 - protein, 7 aa, Mycobacterium
DHASAAE

SEQ ID NO: 450720 - protein, 5 aa, Mycobacterium
DHASP

SEQ ID NO: 450721 - protein, 9 aa, Mycobacterium
DHASPTTLT

SEQ ID NO: 450722 - protein, 7 aa, Mycobacterium
DHASRGE

SEQ ID NO: 450723 - protein, 8 aa, Mycobacterium
DHATEESV

SEQ ID NO: 450724 - protein, 13 aa, Mycobacterium
DHATESGLSKPEH

SEQ ID NO: 450725 - protein, 6 aa, Mycobacterium
DHATGS

SEQ ID NO: 450726 - protein, 9 aa, Mycobacterium
DHATPTALS

SEQ ID NO: 450727 - protein, 12 aa, Mycobacterium
DHCGGIGRMDPM

SEQ ID NO: 450728 - protein, 7 aa, Mycobacterium
DHCSQPT

SEQ ID NO: 450729 - protein, 10 aa, Mycobacterium
DHDAGDPLHP

SEQ ID NO: 450730 - protein, 5 aa, Mycobacterium
DHDDP

SEQ ID NO: 450731 - protein, 9 aa, Mycobacterium
DHDDPEALT

SEQ ID NO: 450732 - protein, 6 aa, Mycobacterium
DHDDTG

SEQ ID NO: 450733 - protein, 7 aa, Mycobacterium
DHDESKL

SEQ ID NO: 450734 - protein, 18 aa, Mycobacterium
DHDGAQAVAGEPLVWNVA

SEQ ID NO: 450735 - protein, 12 aa, Mycobacterium
DHDGDRRGDGFD

SEQ ID NO: 450736 - protein, 5 aa, Mycobacterium
DHDGG

SEQ ID NO: 450737 - protein, 9 aa, Mycobacterium
DHDGGRGVT

SEQ ID NO: 450738 - protein, 7 aa, Mycobacterium
DHDGGRS

SEQ ID NO: 450739 - protein, 7 aa, Mycobacterium
DHDGIGD

SEQ ID NO: 450740 - protein, 5 aa, Mycobacterium
DHDGR

SEQ ID NO: 450741 - protein, 6 aa, Mycobacterium
DHDGTE

SEQ ID NO: 450742 - protein, 9 aa, Mycobacterium
DHDGTGPHR

SEQ ID NO: 450743 - protein, 7 aa, Mycobacterium
DHDHDRT

SEQ ID NO: 450744 - protein, 11 aa, Mycobacterium
DHDLARRRGAH

SEQ ID NO: 450745 - protein, 9 aa, Mycobacterium
DHDLTADPA

SEQ ID NO: 450746 - protein, 9 aa, Mycobacterium
DHDNDRQAN

SEQ ID NO: 450747 - protein, 18 aa, Mycobacterium
DHDNGEHAGAQVPPLPTT

SEQ ID NO: 450748 - protein, 4 aa, Mycobacterium
DHDP

SEQ ID NO: 450749 - protein, 11 aa, Mycobacterium
DHDPADGLAGP

SEQ ID NO: 450750 - protein, 9 aa, Mycobacterium
DHDPHPVDG

SEQ ID NO: 450751 - protein, 9 aa, Mycobacterium
DHDPTSRHG

SEQ ID NO: 450752 - protein, 9 aa, Mycobacterium
DHDQETIHD

SEQ ID NO: 450753 - protein, 10 aa, Mycobacterium
DHDRAGARLH

SEQ ID NO: 450754 - protein, 12 aa, Mycobacterium
DHDRPLAPRGVR

SEQ ID NO: 450755 - protein, 8 aa, Mycobacterium
DHDSPGEA

SEQ ID NO: 450756 - protein, 10 aa, Mycobacterium
DHDVNGVRRG

SEQ ID NO: 450757 - protein, 12 aa, Mycobacterium
DHDVTGEGTGYK

SEQ ID NO: 450758 - protein, 12 aa, Mycobacterium
DHDVTGERKGYQ

SEQ ID NO: 450759 - protein, 6 aa, Mycobacterium
DHDVTR

SEQ ID NO: 450760 - protein, 5 aa, Mycobacterium
DHEDA

SEQ ID NO: 450761 - protein, 4 aa, Mycobacterium
DHEE

SEQ ID NO: 450762 - protein, 12 aa, Mycobacterium
DHEENKKAFAGP

SEQ ID NO: 450763 - protein, 7 aa, Mycobacterium
DHEGGRV

SEQ ID NO: 450764 - protein, 6 aa, Mycobacterium
DHEGPH

SEQ ID NO: 450765 - protein, 19 aa, Mycobacterium
DHEGVDGSWGAPDEPGYRT

SEQ ID NO: 450766 - protein, 7 aa, Mycobacterium
DHEHRHG

SEQ ID NO: 450767 - protein, 15 aa, Mycobacterium
DHEKAADDRDLNPDT

SEQ ID NO: 450768 - protein, 13 aa, Mycobacterium
DHEPGASHREQRF

SEQ ID NO: 450769 - protein, 6 aa, Mycobacterium
DHEPGV

SEQ ID NO: 450770 - protein, 7 aa, Mycobacterium
DHEPTFS

SEQ ID NO: 450771 - protein, 6 aa, Mycobacterium
DHEPYR

SEQ ID NO: 450772 - protein, 8 aa, Mycobacterium
DHEQYTGA

SEQ ID NO: 450773 - protein, 15 aa, Mycobacterium
DHERGKARSLREARA

SEQ ID NO: 450774 - protein, 7 aa, Mycobacterium
DHERRDV

SEQ ID NO: 450775 - protein, 11 aa, Mycobacterium
DHETAQKLTEA

SEQ ID NO: 450776 - protein, 7 aa, Mycobacterium
DHETERK

SEQ ID NO: 450777 - protein, 9 aa, Mycobacterium
DHETETDTQ

SEQ ID NO: 450778 - protein, 12 aa, Mycobacterium
DHETFSSAKGLT

SEQ ID NO: 450779 - protein, 11 aa, Mycobacterium
DHETYSSAQGL

SEQ ID NO: 450780 - protein, 4 aa, Mycobacterium
DHEV

SEQ ID NO: 450781 - protein, 10 aa, Mycobacterium
DHFSDQPDYC

SEQ ID NO: 450782 - protein, 4 aa, Mycobacterium
DHGA

SEQ ID NO: 450783 - protein, 13 aa, Mycobacterium
DHGAPSYREGRPR

SEQ ID NO: 450784 - protein, 5 aa, Mycobacterium
DHGAQ

SEQ ID NO: 450785 - protein, 11 aa, Mycobacterium
DHGAQPANDAA

SEQ ID NO: 450786 - protein, 20 aa, Mycobacterium
DHGARSNHNPPRDESVFDAE

SEQ ID NO: 450787 - protein, 8 aa, Mycobacterium
DHGATHRL

SEQ ID NO: 450788 - protein, 4 aa, Mycobacterium
DHGD

SEQ ID NO: 450789 - protein, 13 aa, Mycobacterium
DHGDDGGAAEAAN

SEQ ID NO: 450790 - protein, 14 aa, Mycobacterium
DHGDKDFSAIIETL

SEQ ID NO: 450791 - protein, 16 aa, Mycobacterium
DHGDPLGPDTESDEHV

SEQ ID NO: 450792 - protein, 5 aa, Mycobacterium
DHGDQ

SEQ ID NO: 450793 - protein, 17 aa, Mycobacterium
DHGDRDHGSEHGPPLPG

SEQ ID NO: 450794 - protein, 7 aa, Mycobacterium
DHGDRHP

SEQ ID NO: 450795 - protein, 10 aa, Mycobacterium
DHGDVDRAGL

SEQ ID NO: 450796 - protein, 6 aa, Mycobacterium
DHGEDD

SEQ ID NO: 450797 - protein, 5 aa, Mycobacterium
DHGEE

SEQ ID NO: 450798 - protein, 17 aa, Mycobacterium
DHGEELPPPSEDKGEHV

SEQ ID NO: 450799 - protein, 15 aa, Mycobacterium
DHGEFEDRAATDPLE

SEQ ID NO: 450800 - protein, 5 aa, Mycobacterium
DHGEP

SEQ ID NO: 450801 - protein, 4 aa, Mycobacterium
DHGG

SEQ ID NO: 450802 - protein, 6 aa, Mycobacterium
DHGGAG

SEQ ID NO: 450803 - protein, 17 aa, Mycobacterium
DHGGDTAAMLRSGRAAA

SEQ ID NO: 450804 - protein, 6 aa, Mycobacterium
DHGGGS

SEQ ID NO: 450805 - protein, 9 aa, Mycobacterium
DHGGHADGP

SEQ ID NO: 450806 - protein, 6 aa, Mycobacterium
DHGGNA

SEQ ID NO: 450807 - protein, 13 aa, Mycobacterium
DHGGPLADGTPSV

SEQ ID NO: 450808 - protein, 5 aa, Mycobacterium
DHGGS

SEQ ID NO: 450809 - protein, 6 aa, Mycobacterium
DHGGSF

SEQ ID NO: 450810 - protein, 6 aa, Mycobacterium
DHGGSI

SEQ ID NO: 450811 - protein, 6 aa, Mycobacterium
DHGGSL

SEQ ID NO: 450812 - protein, 12 aa, Mycobacterium
DHGIPGSAAARG

SEQ ID NO: 450813 - protein, 13 aa, Mycobacterium
DHGKGSVALRGPA

SEQ ID NO: 450814 - protein, 6 aa, Mycobacterium
DHGLTP

SEQ ID NO: 450815 - protein, 18 aa, Mycobacterium
DHGMSGPVTAAEREIAGA

SEQ ID NO: 450816 - protein, 5 aa, Mycobacterium
DHGNQ

SEQ ID NO: 450817 - protein, 21 aa, Mycobacterium
DHGNRGDVRVTDASDTGLPDA

SEQ ID NO: 450818 - protein, 5 aa, Mycobacterium
DHGPA

SEQ ID NO: 450819 - protein, 8 aa, Mycobacterium
DHGPPYSP

SEQ ID NO: 450820 - protein, 9 aa, Mycobacterium
DHGPVPRRE

SEQ ID NO: 450821 - protein, 5 aa, Mycobacterium
DHGRA

SEQ ID NO: 450822 - protein, 6 aa, Mycobacterium
DHGRAA

SEQ ID NO: 450823 - protein, 10 aa, Mycobacterium
DHGRGGGSIG

SEQ ID NO: 450824 - protein, 11 aa, Mycobacterium
DHGRIDGRVDG

SEQ ID NO: 450825 - protein, 5 aa, Mycobacterium
DHGRP

SEQ ID NO: 450826 - protein, 12 aa, Mycobacterium
DHGRPLEVGEPA

SEQ ID NO: 450827 - protein, 12 aa, Mycobacterium
DHGRPLQVGEPA

SEQ ID NO: 450828 - protein, 6 aa, Mycobacterium
DHGRTG

SEQ ID NO: 450829 - protein, 7 aa, Mycobacterium
DHGRWPQ

SEQ ID NO: 450830 - protein, 25 aa, Mycobacterium
DHGSIAGADYDPVADRYGPGTSEEA

SEQ ID NO: 450831 - protein, 4 aa, Mycobacterium
DHGT

SEQ ID NO: 450832 - protein, 11 aa, Mycobacterium
DHGTDPKTRGA

SEQ ID NO: 450833 - protein, 7 aa, Mycobacterium
DHGTEIA

SEQ ID NO: 450834 - protein, 7 aa, Mycobacterium
DHGTEVA

SEQ ID NO: 450835 - protein, 17 aa, Mycobacterium
DHGTGHGAADQRPPMAG

SEQ ID NO: 450836 - protein, 6 aa, Mycobacterium
DHGTIR

SEQ ID NO: 450837 - protein, 5 aa, Mycobacterium
DHGTP

SEQ ID NO: 450838 - protein, 4 aa, Mycobacterium
DHHG

SEQ ID NO: 450839 - protein, 11 aa, Mycobacterium
DHHGPAGDRRY

SEQ ID NO: 450840 - protein, 8 aa, Mycobacterium
DHHRPGPE

SEQ ID NO: 450841 - protein, 4 aa, Mycobacterium
DHIP

SEQ ID NO: 450842 - protein, 6 aa, Mycobacterium
DHITGG

SEQ ID NO: 450843 - protein, 9 aa, Mycobacterium
DHKATAGQI

SEQ ID NO: 450844 - protein, 7 aa, Mycobacterium
DHKPKVT

SEQ ID NO: 450845 - protein, 19 aa, Mycobacterium
DHKRVGDGDTGPNTGGMGA

SEQ ID NO: 450846 - protein, 34 aa, Mycobacterium
DHKSADKTTTSTSASTSTSSGTSSQTSAAPAAKA

SEQ ID NO: 450847 - protein, 19 aa, Mycobacterium
DHLDADDATLGSVGYPRSG

SEQ ID NO: 450848 - protein, 8 aa, Mycobacterium
DHLDPDAI

SEQ ID NO: 450849 - protein, 18 aa, Mycobacterium
DHLDSTRAVSPLRPAEDA

SEQ ID NO: 450850 - protein, 14 aa, Mycobacterium
DHLDSTRPVSPLRA

SEQ ID NO: 450851 - protein, 7 aa, Mycobacterium
DHLEAGR

SEQ ID NO: 450852 - protein, 8 aa, Mycobacterium
DHLPGRPI

SEQ ID NO: 450853 - protein, 19 aa, Mycobacterium
DHNDIRDGVRDADAAELGS

SEQ ID NO: 450854 - protein, 19 aa, Mycobacterium
DHNDIRDGVRDANAARVGT

SEQ ID NO: 450855 - protein, 6 aa, Mycobacterium
DHNEEA

SEQ ID NO: 450856 - protein, 9 aa, Mycobacterium
DHNGGPRGP

SEQ ID NO: 450857 - protein, 14 aa, Mycobacterium
DHNGPGNGSRSRHQ

SEQ ID NO: 450858 - protein, 10 aa, Mycobacterium
DHNPIHTDKS

SEQ ID NO: 450859 - protein, 5 aa, Mycobacterium
DHNPM

SEQ ID NO: 450860 - protein, 18 aa, Mycobacterium
DHNTGNFNTGQSNTGSLN

SEQ ID NO: 450861 - protein, 5 aa, Mycobacterium
DHPAH

SEQ ID NO: 450862 - protein, 7 aa, Mycobacterium
DHPAPDA

SEQ ID NO: 450863 - protein, 7 aa, Mycobacterium
DHPAPTQ

SEQ ID NO: 450864 - protein, 12 aa, Mycobacterium
DHPARPPQTAFP

SEQ ID NO: 450865 - protein, 4 aa, Mycobacterium
DHPD

SEQ ID NO: 450866 - protein, 8 aa, Mycobacterium
DHPDAAAA

SEQ ID NO: 450867 - protein, 9 aa, Mycobacterium
DHPDAEPLA

SEQ ID NO: 450868 - protein, 9 aa, Mycobacterium
DHPDARPIG

SEQ ID NO: 450869 - protein, 16 aa, Mycobacterium
DHPDARRELAADPSLI

SEQ ID NO: 450870 - protein, 9 aa, Mycobacterium
DHPDASDVD

SEQ ID NO: 450871 - protein, 5 aa, Mycobacterium
DHPDE

SEQ ID NO: 450872 - protein, 12 aa, Mycobacterium
DHPDGGGVQPRV

SEQ ID NO: 450873 - protein, 13 aa, Mycobacterium
DHPDGRLRSADHG

SEQ ID NO: 450874 - protein, 5 aa, Mycobacterium
DHPDI

SEQ ID NO: 450875 - protein, 6 aa, Mycobacterium
DHPDQR

SEQ ID NO: 450876 - protein, 16 aa, Mycobacterium
DHPDQRRELAQDPSLI

SEQ ID NO: 450877 - protein, 5 aa, Mycobacterium
DHPDR

SEQ ID NO: 450878 - protein, 7 aa, Mycobacterium
DHPDRDA

SEQ ID NO: 450879 - protein, 7 aa, Mycobacterium
DHPDRTA

SEQ ID NO: 450880 - protein, 7 aa, Mycobacterium
DHPDSGD

SEQ ID NO: 450881 - protein, 4 aa, Mycobacterium
DHPE

SEQ ID NO: 450882 - protein, 8 aa, Mycobacterium
DHPEDHRY

SEQ ID NO: 450883 - protein, 8 aa, Mycobacterium
DHPEPQVG

SEQ ID NO: 450884 - protein, 7 aa, Mycobacterium
DHPEQRR

SEQ ID NO: 450885 - protein, 6 aa, Mycobacterium
DHPERK

SEQ ID NO: 450886 - protein, 6 aa, Mycobacterium
DHPETV

SEQ ID NO: 450887 - protein, 5 aa, Mycobacterium
DHPEV

SEQ ID NO: 450888 - protein, 9 aa, Mycobacterium
DHPEYQNRD

SEQ ID NO: 450889 - protein, 24 aa, Mycobacterium
DHPGAGAVARSEARGHLIALDSDL

SEQ ID NO: 450890 - protein, 6 aa, Mycobacterium
DHPGAR

SEQ ID NO: 450891 - protein, 8 aa, Mycobacterium
DHPGARPI

SEQ ID NO: 450892 - protein, 7 aa, Mycobacterium
DHPGFSG

SEQ ID NO: 450893 - protein, 10 aa, Mycobacterium
DHPGGAGRNY

SEQ ID NO: 450894 - protein, 16 aa, Mycobacterium
DHPGGVASQQYPPDEL

SEQ ID NO: 450895 - protein, 5 aa, Mycobacterium
DHPGP

SEQ ID NO: 450896 - protein, 7 aa, Mycobacterium
DHPGPRQ

SEQ ID NO: 450897 - protein, 14 aa, Mycobacterium
DHPGQRPERTGRKG

SEQ ID NO: 450898 - protein, 5 aa, Mycobacterium
DHPGR

SEQ ID NO: 450899 - protein, 6 aa, Mycobacterium
DHPGRA

SEQ ID NO: 450900 - protein, 6 aa, Mycobacterium
DHPGRK

SEQ ID NO: 450901 - protein, 7 aa, Mycobacterium
DHPGVNV

SEQ ID NO: 450902 - protein, 5 aa, Mycobacterium
DHPGY

SEQ ID NO: 450903 - protein, 6 aa, Mycobacterium
DHPGYG

SEQ ID NO: 450904 - protein, 9 aa, Mycobacterium
DHPHADTET

SEQ ID NO: 450905 - protein, 4 aa, Mycobacterium
DHPI

SEQ ID NO: 450906 - protein, 5 aa, Mycobacterium
DHPIG

SEQ ID NO: 450907 - protein, 6 aa, Mycobacterium
DHPIGT

SEQ ID NO: 450908 - protein, 5 aa, Mycobacterium
DHPIP

SEQ ID NO: 450909 - protein, 4 aa, Mycobacterium
DHPK

SEQ ID NO: 450910 - protein, 19 aa, Mycobacterium
DHPKARDESEDPLVAADAY

SEQ ID NO: 450911 - protein, 10 aa, Mycobacterium
DHPKDLGRSR

SEQ ID NO: 450912 - protein, 4 aa, Mycobacterium
DHPL

SEQ ID NO: 450913 - protein, 25 aa, Mycobacterium
DHPLPEQPPLHPEEEEQLPPDPHAT

SEQ ID NO: 450914 - protein, 7 aa, Mycobacterium
DHPLPKG

SEQ ID NO: 450915 - protein, 16 aa, Mycobacterium
DHPLRRDTRGERQGNS

SEQ ID NO: 450916 - protein, 16 aa, Mycobacterium
DHPLRRDTRSERQRTQ

SEQ ID NO: 450917 - protein, 4 aa, Mycobacterium
DHPN

SEQ ID NO: 450918 - protein, 6 aa, Mycobacterium
DHPNGR

SEQ ID NO: 450919 - protein, 10 aa, Mycobacterium
DHPNPDPAMP

SEQ ID NO: 450920 - protein, 8 aa, Mycobacterium
DHPNPDQV

SEQ ID NO: 450921 - protein, 7 aa, Mycobacterium
DHPPADI

SEQ ID NO: 450922 - protein, 9 aa, Mycobacterium
DHPPATRQA

SEQ ID NO: 450923 - protein, 7 aa, Mycobacterium
DHPPHGD

SEQ ID NO: 450924 - protein, 8 aa, Mycobacterium
DHPPRRDH

SEQ ID NO: 450925 - protein, 10 aa, Mycobacterium
DHPPSSTSTG

SEQ ID NO: 450926 - protein, 7 aa, Mycobacterium
DHPQFSG

SEQ ID NO: 450927 - protein, 11 aa, Mycobacterium
DHPRAAHPEQP

SEQ ID NO: 450928 - protein, 12 aa, Mycobacterium
DHPRANEPTAPL

SEQ ID NO: 450929 - protein, 14 aa, Mycobacterium
DHPREPGDEALDGG

SEQ ID NO: 450930 - protein, 7 aa, Mycobacterium
DHPRTAA

SEQ ID NO: 450931 - protein, 7 aa, Mycobacterium
DHPSAKA

SEQ ID NO: 450932 - protein, 9 aa, Mycobacterium
DHPSAKASY

SEQ ID NO: 450933 - protein, 13 aa, Mycobacterium
DHPSAPAETGSID

SEQ ID NO: 450934 - protein, 6 aa, Mycobacterium
DHPSDD

SEQ ID NO: 450935 - protein, 7 aa, Mycobacterium
DHPSRDA

SEQ ID NO: 450936 - protein, 7 aa, Mycobacterium
DHPSRQG

SEQ ID NO: 450937 - protein, 8 aa, Mycobacterium
DHPSSKAS

SEQ ID NO: 450938 - protein, 9 aa, Mycobacterium
DHPSTTVDD

SEQ ID NO: 450939 - protein, 9 aa, Mycobacterium
DHPTASASE

SEQ ID NO: 450940 - protein, 9 aa, Mycobacterium
DHPTDPNGE

SEQ ID NO: 450941 - protein, 6 aa, Mycobacterium
DHPTHF

SEQ ID NO: 450942 - protein, 12 aa, Mycobacterium
DHPTKADADAAL

SEQ ID NO: 450943 - protein, 34 aa, Mycobacterium
DHPTPQAGAATAGGPAPAEPQGMSGAQRRSVEKE

SEQ ID NO: 450944 - protein, 7 aa, Mycobacterium
DHPTPRD

SEQ ID NO: 450945 - protein, 4 aa, Mycobacterium
DHPV

SEQ ID NO: 450946 - protein, 15 aa, Mycobacterium
DHPWRRAGGDGRVRD

SEQ ID NO: 450947 - protein, 8 aa, Mycobacterium
DHQAEDDA

SEQ ID NO: 450948 - protein, 31 aa, Mycobacterium
DHQAPAYTPVNGRRHRDDPGSISHTEAPNAT

SEQ ID NO: 450949 - protein, 10 aa, Mycobacterium
DHQAQERPPL

SEQ ID NO: 450950 - protein, 10 aa, Mycobacterium
DHQASEHAER

SEQ ID NO: 450951 - protein, 4 aa, Mycobacterium
DHQD

SEQ ID NO: 450952 - protein, 31 aa, Mycobacterium
DHQESSEQHHGPQPWSKSRDFTNDPQRGAAV

SEQ ID NO: 450953 - protein, 4 aa, Mycobacterium
DHQG

SEQ ID NO: 450954 - protein, 8 aa, Mycobacterium
DHQGEPEG

SEQ ID NO: 450955 - protein, 6 aa, Mycobacterium
DHQGNT

SEQ ID NO: 450956 - protein, 8 aa, Mycobacterium
DHQNASRK

SEQ ID NO: 450957 - protein, 9 aa, Mycobacterium
DHQPPDPAA

SEQ ID NO: 450958 - protein, 10 aa, Mycobacterium
DHQPPDPGAL

SEQ ID NO: 450959 - protein, 57 aa, Mycobacterium
DHQQPNTNHHPDTERGDARNSGATGHNQDHSRKNGDRNSGENRGGHDSDDGESDCQS

SEQ ID NO: 450960 - protein, 18 aa, Mycobacterium
DHQRAARSHRDQQLTERG

SEQ ID NO: 450961 - protein, 5 aa, Mycobacterium
DHQRD

SEQ ID NO: 450962 - protein, 7 aa, Mycobacterium
DHQRQGS

SEQ ID NO: 450963 - protein, 19 aa, Mycobacterium
DHQRRAGIRASDSTGQPCS

SEQ ID NO: 450964 - protein, 9 aa, Mycobacterium
DHQTFSSAQ

SEQ ID NO: 450965 - protein, 10 aa, Mycobacterium
DHQTFSSAQG

SEQ ID NO: 450966 - protein, 6 aa, Mycobacterium
DHQTYT

SEQ ID NO: 450967 - protein, 6 aa, Mycobacterium
DHQVGD

SEQ ID NO: 450968 - protein, 6 aa, Mycobacterium
DHRAAG

SEQ ID NO: 450969 - protein, 8 aa, Mycobacterium
DHRADSVD

SEQ ID NO: 450970 - protein, 14 aa, Mycobacterium
DHRAGTLPAPRATE

SEQ ID NO: 450971 - protein, 9 aa, Mycobacterium
DHRASDGHR

SEQ ID NO: 450972 - protein, 5 aa, Mycobacterium
DHRDS

SEQ ID NO: 450973 - protein, 10 aa, Mycobacterium
DHRDSTSVEA

SEQ ID NO: 450974 - protein, 11 aa, Mycobacterium
DHRDTQRTNNP

SEQ ID NO: 450975 - protein, 6 aa, Mycobacterium
DHRDTY

SEQ ID NO: 450976 - protein, 12 aa, Mycobacterium
DHREGEQGRGRG

SEQ ID NO: 450977 - protein, 12 aa, Mycobacterium
DHREGETGRGRG

SEQ ID NO: 450978 - protein, 4 aa, Mycobacterium
DHRG

SEQ ID NO: 450979 - protein, 5 aa, Mycobacterium
DHRGA

SEQ ID NO: 450980 - protein, 11 aa, Mycobacterium
DHRGRAAEADD

SEQ ID NO: 450981 - protein, 11 aa, Mycobacterium
DHRGRAAQGDD

SEQ ID NO: 450982 - protein, 12 aa, Mycobacterium
DHRGRASPGDDG

SEQ ID NO: 450983 - protein, 10 aa, Mycobacterium
DHRHDTAPDA

SEQ ID NO: 450984 - protein, 10 aa, Mycobacterium
DHRHPETPGG

SEQ ID NO: 450985 - protein, 23 aa, Mycobacterium
DHRHTGSCASQPSEQINDTRMVH

SEQ ID NO: 450986 - protein, 5 aa, Mycobacterium
DHRIG

SEQ ID NO: 450987 - protein, 7 aa, Mycobacterium
DHRKSVR

SEQ ID NO: 450988 - protein, 4 aa, Mycobacterium
DHRN

SEQ ID NO: 450989 - protein, 8 aa, Mycobacterium
DHRNTGAR

SEQ ID NO: 450990 - protein, 7 aa, Mycobacterium
DHRPPGD

SEQ ID NO: 450991 - protein, 5 aa, Mycobacterium
DHRPT

SEQ ID NO: 450992 - protein, 4 aa, Mycobacterium
DHRQ

SEQ ID NO: 450993 - protein, 5 aa, Mycobacterium
DHRQA

SEQ ID NO: 450994 - protein, 28 aa, Mycobacterium
DHRQPAGGFDPQRAQHRPGERVQPRTGV

SEQ ID NO: 450995 - protein, 6 aa, Mycobacterium
DHRRPA

SEQ ID NO: 450996 - protein, 5 aa, Mycobacterium
DHRRQ

SEQ ID NO: 450997 - protein, 6 aa, Mycobacterium
DHRRRH

SEQ ID NO: 450998 - protein, 8 aa, Mycobacterium
DHRSCTSN

SEQ ID NO: 450999 - protein, 7 aa, Mycobacterium
DHRSGQV

SEQ ID NO: 451000 - protein, 10 aa, Mycobacterium
DHRSGSGQPL

SEQ ID NO: 451001 - protein, 8 aa, Mycobacterium
DHRSSPGA

SEQ ID NO: 451002 - protein, 9 aa, Mycobacterium
DHRSYAGTV

SEQ ID NO: 451003 - protein, 8 aa, Mycobacterium
DHRTGSSF

SEQ ID NO: 451004 - protein, 9 aa, Mycobacterium
DHSADGHHP

SEQ ID NO: 451005 - protein, 7 aa, Mycobacterium
DHSAGNP

SEQ ID NO: 451006 - protein, 16 aa, Mycobacterium
DHSAPRPDPRASGRSI

SEQ ID NO: 451007 - protein, 6 aa, Mycobacterium
DHSDRV

SEQ ID NO: 451008 - protein, 4 aa, Mycobacterium
DHSG

SEQ ID NO: 451009 - protein, 17 aa, Mycobacterium
DHSGQRLASAAATDAAA

SEQ ID NO: 451010 - protein, 5 aa, Mycobacterium
DHSGR

SEQ ID NO: 451011 - protein, 6 aa, Mycobacterium
DHSNRS

SEQ ID NO: 451012 - protein, 19 aa, Mycobacterium
DHSPPVRGSGRRRGQRPHR

SEQ ID NO: 451013 - protein, 202 aa, Mycobacterium
DHSQRNTTNINDSFNTDRSTNIGSGNTTNTEIGSHNQANIGTSTSAGGSAAVGGNAGLAGNAGLAGNAGLAGNAGLAGNAGLAGNAGLAGNAGLAGNAGLAGNAGLAGNAGLAGNAGLAGNAGLAGNAGLAGNAGLAGNAGLAGNAGLAGNAGLAGNAGLAGNAGLAGNAGLAGNAGLAGNAAVAGNAAVAGNAAVAGNAAV

SEQ ID NO: 451014 - protein, 9 aa, Mycobacterium
DHSSDGHHP

SEQ ID NO: 451015 - protein, 11 aa, Mycobacterium
DHSSGPRDVGQ

SEQ ID NO: 451016 - protein, 8 aa, Mycobacterium
DHSTAEFE

SEQ ID NO: 451017 - protein, 8 aa, Mycobacterium
DHTAARRE

SEQ ID NO: 451018 - protein, 12 aa, Mycobacterium
DHTASARATLGD

SEQ ID NO: 451019 - protein, 12 aa, Mycobacterium
DHTASARSTLGQ

SEQ ID NO: 451020 - protein, 8 aa, Mycobacterium
DHTDADQV

SEQ ID NO: 451021 - protein, 15 aa, Mycobacterium
DHTDDSLSVGDRGPT

SEQ ID NO: 451022 - protein, 5 aa, Mycobacterium
DHTDP

SEQ ID NO: 451023 - protein, 7 aa, Mycobacterium
DHTDTAA

SEQ ID NO: 451024 - protein, 6 aa, Mycobacterium
DHTEAQ

SEQ ID NO: 451025 - protein, 6 aa, Mycobacterium
DHTESA

SEQ ID NO: 451026 - protein, 5 aa, Mycobacterium
DHTGA

SEQ ID NO: 451027 - protein, 8 aa, Mycobacterium
DHTGLRDD

SEQ ID NO: 451028 - protein, 7 aa, Mycobacterium
DHTGRYA

SEQ ID NO: 451029 - protein, 10 aa, Mycobacterium
DHTGRYRGRA

SEQ ID NO: 451030 - protein, 13 aa, Mycobacterium
DHTGRYRGRASAL

SEQ ID NO: 451031 - protein, 6 aa, Mycobacterium
DHTGSF

SEQ ID NO: 451032 - protein, 5 aa, Mycobacterium
DHTGV

SEQ ID NO: 451033 - protein, 5 aa, Mycobacterium
DHTLA

SEQ ID NO: 451034 - protein, 5 aa, Mycobacterium
DHTPA

SEQ ID NO: 451035 - protein, 11 aa, Mycobacterium
DHTPEDSGPIP

SEQ ID NO: 451036 - protein, 6 aa, Mycobacterium
DHTPID

SEQ ID NO: 451037 - protein, 12 aa, Mycobacterium
DHTRAADAPDDV

SEQ ID NO: 451038 - protein, 5 aa, Mycobacterium
DHTSA

SEQ ID NO: 451039 - protein, 13 aa, Mycobacterium
DHTSVARGSAVGN

SEQ ID NO: 451040 - protein, 6 aa, Mycobacterium
DHTTAT

SEQ ID NO: 451041 - protein, 10 aa, Mycobacterium
DHTTNTPAIE

SEQ ID NO: 451042 - protein, 5 aa, Mycobacterium
DHTTP

SEQ ID NO: 451043 - protein, 7 aa, Mycobacterium
DHVDGGR

SEQ ID NO: 451044 - protein, 4 aa, Mycobacterium
DHVP

SEQ ID NO: 451045 - protein, 7 aa, Mycobacterium
DHVPPDD

SEQ ID NO: 451046 - protein, 19 aa, Mycobacterium
DHYETSGRIRGSARIDGRS

SEQ ID NO: 451047 - protein, 11 aa, Mycobacterium
DHYGDPGNYVT

SEQ ID NO: 451048 - protein, 5 aa, Mycobacterium
DHYGE

SEQ ID NO: 451049 - protein, 4 aa, Mycobacterium
DHYR

SEQ ID NO: 451050 - protein, 10 aa, Mycobacterium
DHYSSGIPVS

SEQ ID NO: 451051 - protein, 4 aa, Mycobacterium
DIAA

SEQ ID NO: 451052 - protein, 7 aa, Mycobacterium
DIAAAAG

SEQ ID NO: 451053 - protein, 10 aa, Mycobacterium
DIAAASSADT

SEQ ID NO: 451054 - protein, 6 aa, Mycobacterium
DIAADA

SEQ ID NO: 451055 - protein, 4 aa, Mycobacterium
DIAD

SEQ ID NO: 451056 - protein, 12 aa, Mycobacterium
DIADGPDAVDRE

SEQ ID NO: 451057 - protein, 11 aa, Mycobacterium
DIADGPEAIDR

SEQ ID NO: 451058 - protein, 8 aa, Mycobacterium
DIADYDPD

SEQ ID NO: 451059 - protein, 8 aa, Mycobacterium
DIAEAEQT

SEQ ID NO: 451060 - protein, 13 aa, Mycobacterium
DIAEEDHSDIGPA

SEQ ID NO: 451061 - protein, 6 aa, Mycobacterium
DIAEGR

SEQ ID NO: 451062 - protein, 8 aa, Mycobacterium
DIAEPGNA

SEQ ID NO: 451063 - protein, 13 aa, Mycobacterium
DIAEQGRQAKAVA

SEQ ID NO: 451064 - protein, 5 aa, Mycobacterium
DIAES

SEQ ID NO: 451065 - protein, 9 aa, Mycobacterium
DIAGPGRAH

SEQ ID NO: 451066 - protein, 5 aa, Mycobacterium
DIAGR

SEQ ID NO: 451067 - protein, 5 aa, Mycobacterium
DIAGT

SEQ ID NO: 451068 - protein, 5 aa, Mycobacterium
DIAND

SEQ ID NO: 451069 - protein, 7 aa, Mycobacterium
DIANNQH

SEQ ID NO: 451070 - protein, 10 aa, Mycobacterium
DIANTGNKDI

SEQ ID NO: 451071 - protein, 9 aa, Mycobacterium
DIAPDAEEL

SEQ ID NO: 451072 - protein, 9 aa, Mycobacterium
DIAPDDAAI

SEQ ID NO: 451073 - protein, 6 aa, Mycobacterium
DIAPGD

SEQ ID NO: 451074 - protein, 8 aa, Mycobacterium
DIAPPDRS

SEQ ID NO: 451075 - protein, 9 aa, Mycobacterium
DIAPPRRAT

SEQ ID NO: 451076 - protein, 6 aa, Mycobacterium
DIAPQD

SEQ ID NO: 451077 - protein, 22 aa, Mycobacterium
DIAPQGPYGGYKQSGFGRTGGV

SEQ ID NO: 451078 - protein, 4 aa, Mycobacterium
DIAR

SEQ ID NO: 451079 - protein, 6 aa, Mycobacterium
DIARAA

SEQ ID NO: 451080 - protein, 5 aa, Mycobacterium
DIARG

SEQ ID NO: 451081 - protein, 17 aa, Mycobacterium
DIASNSPENHRDRRGVA

SEQ ID NO: 451082 - protein, 10 aa, Mycobacterium
DIASPDKADN

SEQ ID NO: 451083 - protein, 13 aa, Mycobacterium
DIASPPAAPGKPR

SEQ ID NO: 451084 - protein, 5 aa, Mycobacterium
DIATD

SEQ ID NO: 451085 - protein, 4 aa, Mycobacterium
DIDA

SEQ ID NO: 451086 - protein, 9 aa, Mycobacterium
DIDAARAEK

SEQ ID NO: 451087 - protein, 7 aa, Mycobacterium
DIDASNE

SEQ ID NO: 451088 - protein, 23 aa, Mycobacterium
DIDDGYEPGVTTTESKRVKELEQ

SEQ ID NO: 451089 - protein, 5 aa, Mycobacterium
DIDDP

SEQ ID NO: 451090 - protein, 8 aa, Mycobacterium
DIDDPAER

SEQ ID NO: 451091 - protein, 7 aa, Mycobacterium
DIDDTAR

SEQ ID NO: 451092 - protein, 5 aa, Mycobacterium
DIDEA

SEQ ID NO: 451093 - protein, 27 aa, Mycobacterium
DIDEDQAHGPDNRGGDLQGELARRESR

SEQ ID NO: 451094 - protein, 20 aa, Mycobacterium
DIDEKGLSETQAACPPGQVT

SEQ ID NO: 451095 - protein, 8 aa, Mycobacterium
DIDEPTAN

SEQ ID NO: 451096 - protein, 6 aa, Mycobacterium
DIDESA

SEQ ID NO: 451097 - protein, 13 aa, Mycobacterium
DIDGEGAPAAAEA

SEQ ID NO: 451098 - protein, 8 aa, Mycobacterium
DIDKTDPD

SEQ ID NO: 451099 - protein, 4 aa, Mycobacterium
DIDP

SEQ ID NO: 451100 - protein, 9 aa, Mycobacterium
DIDPDETGE

SEQ ID NO: 451101 - protein, 7 aa, Mycobacterium
DIDPESI

SEQ ID NO: 451102 - protein, 7 aa, Mycobacterium
DIDPQRV

SEQ ID NO: 451103 - protein, 34 aa, Mycobacterium
DIDPRGSTSREIRPGAGKAEPRARNDASRHWLRL

SEQ ID NO: 451104 - protein, 13 aa, Mycobacterium
DIDPSAASAYDTP

SEQ ID NO: 451105 - protein, 6 aa, Mycobacterium
DIDPTA

SEQ ID NO: 451106 - protein, 8 aa, Mycobacterium
DIDPTSPS

SEQ ID NO: 451107 - protein, 11 aa, Mycobacterium
DIDQEPGIAPD

SEQ ID NO: 451108 - protein, 5 aa, Mycobacterium
DIDRD

SEQ ID NO: 451109 - protein, 10 aa, Mycobacterium
DIDRGGATYT

SEQ ID NO: 451110 - protein, 11 aa, Mycobacterium
DIDSAKDMAAQ

SEQ ID NO: 451111 - protein, 10 aa, Mycobacterium
DIDSARSDFE

SEQ ID NO: 451112 - protein, 7 aa, Mycobacterium
DIDTAAK

SEQ ID NO: 451113 - protein, 10 aa, Mycobacterium
DIDTNASPIG

SEQ ID NO: 451114 - protein, 7 aa, Mycobacterium
DIDTPED

SEQ ID NO: 451115 - protein, 9 aa, Mycobacterium
DIDTPQSAT

SEQ ID NO: 451116 - protein, 16 aa, Mycobacterium
DIEADDLDDADPFEEG

SEQ ID NO: 451117 - protein, 6 aa, Mycobacterium
DIEAGD

SEQ ID NO: 451118 - protein, 12 aa, Mycobacterium
DIEAGDDSAAIE

SEQ ID NO: 451119 - protein, 7 aa, Mycobacterium
DIEDRTD

SEQ ID NO: 451120 - protein, 12 aa, Mycobacterium
DIEDSRGAQDAR

SEQ ID NO: 451121 - protein, 8 aa, Mycobacterium
DIEESPSG

SEQ ID NO: 451122 - protein, 11 aa, Mycobacterium
DIEGPGSPLSA

SEQ ID NO: 451123 - protein, 11 aa, Mycobacterium
DIEGRDEFAGP

SEQ ID NO: 451124 - protein, 5 aa, Mycobacterium
DIEPA

SEQ ID NO: 451125 - protein, 5 aa, Mycobacterium
DIEPD

SEQ ID NO: 451126 - protein, 7 aa, Mycobacterium
DIEPDPG

SEQ ID NO: 451127 - protein, 6 aa, Mycobacterium
DIEPGS

SEQ ID NO: 451128 - protein, 12 aa, Mycobacterium
DIEPGTPSPQAR

SEQ ID NO: 451129 - protein, 6 aa, Mycobacterium
DIEPKA

SEQ ID NO: 451130 - protein, 8 aa, Mycobacterium
DIEPSSVA

SEQ ID NO: 451131 - protein, 4 aa, Mycobacterium
DIEQ

SEQ ID NO: 451132 - protein, 7 aa, Mycobacterium
DIEQRTD

SEQ ID NO: 451133 - protein, 6 aa, Mycobacterium
DIERDG

SEQ ID NO: 451134 - protein, 9 aa, Mycobacterium
DIERTAELE

SEQ ID NO: 451135 - protein, 4 aa, Mycobacterium
DIGA

SEQ ID NO: 451136 - protein, 5 aa, Mycobacterium
DIGAG

SEQ ID NO: 451137 - protein, 7 aa, Mycobacterium
DIGASPP

SEQ ID NO: 451138 - protein, 11 aa, Mycobacterium
DIGATSKTLPE

SEQ ID NO: 451139 - protein, 10 aa, Mycobacterium
DIGATTKTLP

SEQ ID NO: 451140 - protein, 10 aa, Mycobacterium
DIGDGTPDDL

SEQ ID NO: 451141 - protein, 6 aa, Mycobacterium
DIGDNQ

SEQ ID NO: 451142 - protein, 8 aa, Mycobacterium
DIGDPNLG

SEQ ID NO: 451143 - protein, 14 aa, Mycobacterium
DIGDRERGQGVGRR

SEQ ID NO: 451144 - protein, 10 aa, Mycobacterium
DIGEHSNIGA

SEQ ID NO: 451145 - protein, 10 aa, Mycobacterium
DIGERATADE

SEQ ID NO: 451146 - protein, 10 aa, Mycobacterium
DIGEVSESVD

SEQ ID NO: 451147 - protein, 9 aa, Mycobacterium
DIGEYSNIG

SEQ ID NO: 451148 - protein, 11 aa, Mycobacterium
DIGGATSATEQ

SEQ ID NO: 451149 - protein, 9 aa, Mycobacterium
DIGGGTPDA

SEQ ID NO: 451150 - protein, 23 aa, Mycobacterium
DIGGQVSDNALGGVAAGATAVTS

SEQ ID NO: 451151 - protein, 6 aa, Mycobacterium
DIGGST

SEQ ID NO: 451152 - protein, 7 aa, Mycobacterium
DIGHPGS

SEQ ID NO: 451153 - protein, 5 aa, Mycobacterium
DIGKS

SEQ ID NO: 451154 - protein, 10 aa, Mycobacterium
DIGPASSTAR

SEQ ID NO: 451155 - protein, 10 aa, Mycobacterium
DIGPDLQSQA

SEQ ID NO: 451156 - protein, 12 aa, Mycobacterium
DIGPEGEQARDT

SEQ ID NO: 451157 - protein, 7 aa, Mycobacterium
DIGPEGT

SEQ ID NO: 451158 - protein, 5 aa, Mycobacterium
DIGPG

SEQ ID NO: 451159 - protein, 8 aa, Mycobacterium
DIGPGSAV

SEQ ID NO: 451160 - protein, 7 aa, Mycobacterium
DIGPGTY

SEQ ID NO: 451161 - protein, 7 aa, Mycobacterium
DIGQGEQ

SEQ ID NO: 451162 - protein, 18 aa, Mycobacterium
DIGQPPGDLAAPTEANLK

SEQ ID NO: 451163 - protein, 9 aa, Mycobacterium
DIGSGKSTI

SEQ ID NO: 451164 - protein, 12 aa, Mycobacterium
DIGSSGLQNYGQ

SEQ ID NO: 451165 - protein, 5 aa, Mycobacterium
DIGST

SEQ ID NO: 451166 - protein, 4 aa, Mycobacterium
DIGT

SEQ ID NO: 451167 - protein, 6 aa, Mycobacterium
DIGTSE

SEQ ID NO: 451168 - protein, 11 aa, Mycobacterium
DIHQAGGGTGY

SEQ ID NO: 451169 - protein, 8 aa, Mycobacterium
DIHSSGDL

SEQ ID NO: 451170 - protein, 7 aa, Mycobacterium
DIHTSGD

SEQ ID NO: 451171 - protein, 8 aa, Mycobacterium
DIHTSGDL

SEQ ID NO: 451172 - protein, 8 aa, Mycobacterium
DIKDTSKQ

SEQ ID NO: 451173 - protein, 4 aa, Mycobacterium
DIKG

SEQ ID NO: 451174 - protein, 20 aa, Mycobacterium
DIKPRDGRFGCGPSKVRPEQ

SEQ ID NO: 451175 - protein, 7 aa, Mycobacterium
DIKPSNL

SEQ ID NO: 451176 - protein, 17 aa, Mycobacterium
DIKPSNLGVREQKSDRA

SEQ ID NO: 451177 - protein, 11 aa, Mycobacterium
DIKRNSASGDL

SEQ ID NO: 451178 - protein, 8 aa, Mycobacterium
DINGEGEW

SEQ ID NO: 451179 - protein, 5 aa, Mycobacterium
DINGH

SEQ ID NO: 451180 - protein, 11 aa, Mycobacterium
DINPDEQAQAR

SEQ ID NO: 451181 - protein, 6 aa, Mycobacterium
DINPQD

SEQ ID NO: 451182 - protein, 8 aa, Mycobacterium
DINSLDDG

SEQ ID NO: 451183 - protein, 7 aa, Mycobacterium
DIPAARP

SEQ ID NO: 451184 - protein, 7 aa, Mycobacterium
DIPADEP

SEQ ID NO: 451185 - protein, 17 aa, Mycobacterium
DIPAEPERGEPGRDLPP

SEQ ID NO: 451186 - protein, 9 aa, Mycobacterium
DIPAGRTDE

SEQ ID NO: 451187 - protein, 16 aa, Mycobacterium
DIPAGRTDIPTLTPGT

SEQ ID NO: 451188 - protein, 10 aa, Mycobacterium
DIPAPARPSV

SEQ ID NO: 451189 - protein, 6 aa, Mycobacterium
DIPAPD

SEQ ID NO: 451190 - protein, 4 aa, Mycobacterium
DIPD

SEQ ID NO: 451191 - protein, 7 aa, Mycobacterium
DIPDDGD

SEQ ID NO: 451192 - protein, 12 aa, Mycobacterium
DIPDDGTMSGRT

SEQ ID NO: 451193 - protein, 9 aa, Mycobacterium
DIPDERRGA

SEQ ID NO: 451194 - protein, 6 aa, Mycobacterium
DIPDND

SEQ ID NO: 451195 - protein, 7 aa, Mycobacterium
DIPDQTG

SEQ ID NO: 451196 - protein, 8 aa, Mycobacterium
DIPDTDEG

SEQ ID NO: 451197 - protein, 65 aa, Mycobacterium
DIPEAEARKPQRHRPSAGASGQATGAGGTGGTAGTASPSGYSNGEIAGVTGSAVATAGARDGAAV

SEQ ID NO: 451198 - protein, 15 aa, Mycobacterium
DIPEAPPRDVPDDQR

SEQ ID NO: 451199 - protein, 6 aa, Mycobacterium
DIPEGE

SEQ ID NO: 451200 - protein, 7 aa, Mycobacterium
DIPEGGT

SEQ ID NO: 451201 - protein, 6 aa, Mycobacterium
DIPERA

SEQ ID NO: 451202 - protein, 6 aa, Mycobacterium
DIPGSA

SEQ ID NO: 451203 - protein, 6 aa, Mycobacterium
DIPGTA

SEQ ID NO: 451204 - protein, 6 aa, Mycobacterium
DIPGYP

SEQ ID NO: 451205 - protein, 6 aa, Mycobacterium
DIPPAD

SEQ ID NO: 451206 - protein, 5 aa, Mycobacterium
DIPPG

SEQ ID NO: 451207 - protein, 16 aa, Mycobacterium
DIPPVPLPSAIPPIVF

SEQ ID NO: 451208 - protein, 10 aa, Mycobacterium
DIPQGKSSYF

SEQ ID NO: 451209 - protein, 8 aa, Mycobacterium
DIPQNDPG

SEQ ID NO: 451210 - protein, 11 aa, Mycobacterium
DIPRDEEADRE

SEQ ID NO: 451211 - protein, 6 aa, Mycobacterium
DIPRED

SEQ ID NO: 451212 - protein, 12 aa, Mycobacterium
DIPRGTTALPTT

SEQ ID NO: 451213 - protein, 11 aa, Mycobacterium
DIPRRSARRCP

SEQ ID NO: 451214 - protein, 15 aa, Mycobacterium
DIPRRSARRHPDKTA

SEQ ID NO: 451215 - protein, 16 aa, Mycobacterium
DIPSDLQGSASYRSRV

SEQ ID NO: 451216 - protein, 9 aa, Mycobacterium
DIPSGPGIP

SEQ ID NO: 451217 - protein, 13 aa, Mycobacterium
DIPSTLTTPEAPA

SEQ ID NO: 451218 - protein, 5 aa, Mycobacterium
DIPTD

SEQ ID NO: 451219 - protein, 14 aa, Mycobacterium
DIPTTEDLEDMLDD

SEQ ID NO: 451220 - protein, 14 aa, Mycobacterium
DIPTTEDLEEMLDD

SEQ ID NO: 451221 - protein, 11 aa, Mycobacterium
DIPTYQSPNGR

SEQ ID NO: 451222 - protein, 13 aa, Mycobacterium
DIPVSRGAEQPLA

SEQ ID NO: 451223 - protein, 7 aa, Mycobacterium
DIQAPAA

SEQ ID NO: 451224 - protein, 13 aa, Mycobacterium
DIQAPPTATRSEN

SEQ ID NO: 451225 - protein, 10 aa, Mycobacterium
DIQDRVNNRN

SEQ ID NO: 451226 - protein, 10 aa, Mycobacterium
DIQGGTTSEG

SEQ ID NO: 451227 - protein, 13 aa, Mycobacterium
DIQSGSAGAPVPR

SEQ ID NO: 451228 - protein, 6 aa, Mycobacterium
DIRDPQ

SEQ ID NO: 451229 - protein, 10 aa, Mycobacterium
DIREGKAGLV

SEQ ID NO: 451230 - protein, 5 aa, Mycobacterium
DIREK

SEQ ID NO: 451231 - protein, 5 aa, Mycobacterium
DIRNT

SEQ ID NO: 451232 - protein, 7 aa, Mycobacterium
DIRPEEA

SEQ ID NO: 451233 - protein, 13 aa, Mycobacterium
DIRPKSLQESIER

SEQ ID NO: 451234 - protein, 16 aa, Mycobacterium
DIRPRRPREILHVREV

SEQ ID NO: 451235 - protein, 6 aa, Mycobacterium
DIRPTR

SEQ ID NO: 451236 - protein, 19 aa, Mycobacterium
DIRSGNGWPTDQSLGESVR

SEQ ID NO: 451237 - protein, 8 aa, Mycobacterium
DIRTTTEG

SEQ ID NO: 451238 - protein, 6 aa, Mycobacterium
DISAQR

SEQ ID NO: 451239 - protein, 4 aa, Mycobacterium
DISD

SEQ ID NO: 451240 - protein, 5 aa, Mycobacterium
DISDE

SEQ ID NO: 451241 - protein, 8 aa, Mycobacterium
DISDPAQR

SEQ ID NO: 451242 - protein, 7 aa, Mycobacterium
DISDTAS

SEQ ID NO: 451243 - protein, 21 aa, Mycobacterium
DISEEAREKIGGRNAQRFYNL

SEQ ID NO: 451244 - protein, 10 aa, Mycobacterium
DISERSTADE

SEQ ID NO: 451245 - protein, 10 aa, Mycobacterium
DISESATADE

SEQ ID NO: 451246 - protein, 9 aa, Mycobacterium
DISESGKQA

SEQ ID NO: 451247 - protein, 7 aa, Mycobacterium
DISGCRP

SEQ ID NO: 451248 - protein, 6 aa, Mycobacterium
DISGDG

SEQ ID NO: 451249 - protein, 9 aa, Mycobacterium
DISGGASGI

SEQ ID NO: 451250 - protein, 10 aa, Mycobacterium
DISGQQPRRW

SEQ ID NO: 451251 - protein, 10 aa, Mycobacterium
DISGSTQITA

SEQ ID NO: 451252 - protein, 4 aa, Mycobacterium
DISP

SEQ ID NO: 451253 - protein, 5 aa, Mycobacterium
DISPQ

SEQ ID NO: 451254 - protein, 13 aa, Mycobacterium
DISPQDAAQRRVT

SEQ ID NO: 451255 - protein, 8 aa, Mycobacterium
DISPQEAA

SEQ ID NO: 451256 - protein, 5 aa, Mycobacterium
DISRK

SEQ ID NO: 451257 - protein, 6 aa, Mycobacterium
DISRRD

SEQ ID NO: 451258 - protein, 5 aa, Mycobacterium
DISSA

SEQ ID NO: 451259 - protein, 8 aa, Mycobacterium
DISSEGEW

SEQ ID NO: 451260 - protein, 14 aa, Mycobacterium
DISSPGFEVSGDES

SEQ ID NO: 451261 - protein, 10 aa, Mycobacterium
DISSTPSGFR

SEQ ID NO: 451262 - protein, 12 aa, Mycobacterium
DISTANRKQLRD

SEQ ID NO: 451263 - protein, 6 aa, Mycobacterium
DISTPG

SEQ ID NO: 451264 - protein, 23 aa, Mycobacterium
DISTSAPADSAPAAAPARRGGSL

SEQ ID NO: 451265 - protein, 12 aa, Mycobacterium
DISTTDGLNEAG

SEQ ID NO: 451266 - protein, 5 aa, Mycobacterium
DITAR

SEQ ID NO: 451267 - protein, 4 aa, Mycobacterium
DITD

SEQ ID NO: 451268 - protein, 10 aa, Mycobacterium
DITDAQRARG

SEQ ID NO: 451269 - protein, 8 aa, Mycobacterium
DITDDDQV

SEQ ID NO: 451270 - protein, 10 aa, Mycobacterium
DITDEASAAN

SEQ ID NO: 451271 - protein, 6 aa, Mycobacterium
DITDGA

SEQ ID NO: 451272 - protein, 9 aa, Mycobacterium
DITDGSSLA

SEQ ID NO: 451273 - protein, 6 aa, Mycobacterium
DITDPH

SEQ ID NO: 451274 - protein, 7 aa, Mycobacterium
DITEDEY

SEQ ID NO: 451275 - protein, 4 aa, Mycobacterium
DITG

SEQ ID NO: 451276 - protein, 6 aa, Mycobacterium
DITGDP

SEQ ID NO: 451277 - protein, 7 aa, Mycobacterium
DITGEGE

SEQ ID NO: 451278 - protein, 5 aa, Mycobacterium
DITGG

SEQ ID NO: 451279 - protein, 10 aa, Mycobacterium
DITGPGRTDR

SEQ ID NO: 451280 - protein, 13 aa, Mycobacterium
DITGTDTAAEDLG

SEQ ID NO: 451281 - protein, 6 aa, Mycobacterium
DITGVS

SEQ ID NO: 451282 - protein, 4 aa, Mycobacterium
DITP

SEQ ID NO: 451283 - protein, 8 aa, Mycobacterium
DITPDGPF

SEQ ID NO: 451284 - protein, 13 aa, Mycobacterium
DITPEQAAATHVT

SEQ ID NO: 451285 - protein, 10 aa, Mycobacterium
DITPGTPGAE

SEQ ID NO: 451286 - protein, 7 aa, Mycobacterium
DITQCSP

SEQ ID NO: 451287 - protein, 7 aa, Mycobacterium
DITQPPF

SEQ ID NO: 451288 - protein, 11 aa, Mycobacterium
DITRGKPDPQG

SEQ ID NO: 451289 - protein, 12 aa, Mycobacterium
DITSAAGKSPAA

SEQ ID NO: 451290 - protein, 5 aa, Mycobacterium
DITSR

SEQ ID NO: 451291 - protein, 4 aa, Mycobacterium
DITT

SEQ ID NO: 451292 - protein, 9 aa, Mycobacterium
DITTGQQPQ

SEQ ID NO: 451293 - protein, 4 aa, Mycobacterium
DITV

SEQ ID NO: 451294 - protein, 10 aa, Mycobacterium
DIVPKPDISR

SEQ ID NO: 451295 - protein, 5 aa, Mycobacterium
DIVRS

SEQ ID NO: 451296 - protein, 6 aa, Mycobacterium
DIYGNS

SEQ ID NO: 451297 - protein, 11 aa, Mycobacterium
DIYNGSGIGNY

SEQ ID NO: 451298 - protein, 11 aa, Mycobacterium
DIYNPDRDAPG

SEQ ID NO: 451299 - protein, 11 aa, Mycobacterium
DIYNPNRDAPG

SEQ ID NO: 451300 - protein, 7 aa, Mycobacterium
DIYTDRE

SEQ ID NO: 451301 - protein, 13 aa, Mycobacterium
DKAAAAAAPSVQA

SEQ ID NO: 451302 - protein, 7 aa, Mycobacterium
DKAAAAR

SEQ ID NO: 451303 - protein, 9 aa, Mycobacterium
DKAAAEKKA

SEQ ID NO: 451304 - protein, 18 aa, Mycobacterium
DKAAEEAAERERRAEAEY

SEQ ID NO: 451305 - protein, 7 aa, Mycobacterium
DKAAEYR

SEQ ID NO: 451306 - protein, 16 aa, Mycobacterium
DKAAGKVSEREPNGRR

SEQ ID NO: 451307 - protein, 7 aa, Mycobacterium
DKAALDS

SEQ ID NO: 451308 - protein, 17 aa, Mycobacterium
DKAAQYPRRLSGGQQQR

SEQ ID NO: 451309 - protein, 8 aa, Mycobacterium
DKAATRAS

SEQ ID NO: 451310 - protein, 10 aa, Mycobacterium
DKAATTDQQA

SEQ ID NO: 451311 - protein, 5 aa, Mycobacterium
DKADA

SEQ ID NO: 451312 - protein, 8 aa, Mycobacterium
DKADAGGL

SEQ ID NO: 451313 - protein, 17 aa, Mycobacterium
DKADAYPAQLSGGQQQR

SEQ ID NO: 451314 - protein, 5 aa, Mycobacterium
DKADI

SEQ ID NO: 451315 - protein, 8 aa, Mycobacterium
DKADQTFT

SEQ ID NO: 451316 - protein, 5 aa, Mycobacterium
DKADS

SEQ ID NO: 451317 - protein, 16 aa, Mycobacterium
DKAEAAAAAGADVVGS

SEQ ID NO: 451318 - protein, 7 aa, Mycobacterium
DKAEAED

SEQ ID NO: 451319 - protein, 17 aa, Mycobacterium
DKAEAYPAQLSGGQQQR

SEQ ID NO: 451320 - protein, 16 aa, Mycobacterium
DKAEEFGRRNAVPEES

SEQ ID NO: 451321 - protein, 13 aa, Mycobacterium
DKAEGNRTGSSRF

SEQ ID NO: 451322 - protein, 9 aa, Mycobacterium
DKAEPSLGL

SEQ ID NO: 451323 - protein, 7 aa, Mycobacterium
DKAEREI

SEQ ID NO: 451324 - protein, 6 aa, Mycobacterium
DKAESV

SEQ ID NO: 451325 - protein, 11 aa, Mycobacterium
DKAETKARYGE

SEQ ID NO: 451326 - protein, 12 aa, Mycobacterium
DKAETKEKYGEE

SEQ ID NO: 451327 - protein, 33 aa, Mycobacterium
DKAFKTSGCQPWTQTTAAPTDTPTGEGAPGDLP

SEQ ID NO: 451328 - protein, 13 aa, Mycobacterium
DKAGARDRADDLA

SEQ ID NO: 451329 - protein, 22 aa, Mycobacterium
DKAGATKMDRPEDFEADPKTGK

SEQ ID NO: 451330 - protein, 8 aa, Mycobacterium
DKAGIDPE

SEQ ID NO: 451331 - protein, 6 aa, Mycobacterium
DKAGNW

SEQ ID NO: 451332 - protein, 8 aa, Mycobacterium
DKAGRPQY

SEQ ID NO: 451333 - protein, 7 aa, Mycobacterium
DKAGSEV

SEQ ID NO: 451334 - protein, 13 aa, Mycobacterium
DKAGSSASAGSSH

SEQ ID NO: 451335 - protein, 11 aa, Mycobacterium
DKAHPASRGYT

SEQ ID NO: 451336 - protein, 8 aa, Mycobacterium
DKAIASSD

SEQ ID NO: 451337 - protein, 8 aa, Mycobacterium
DKAKALGL

SEQ ID NO: 451338 - protein, 18 aa, Mycobacterium
DKAKAWPKSLSGGEAQRV

SEQ ID NO: 451339 - protein, 14 aa, Mycobacterium
DKAKKPERSETSGR

SEQ ID NO: 451340 - protein, 8 aa, Mycobacterium
DKAKLSSL

SEQ ID NO: 451341 - protein, 18 aa, Mycobacterium
DKAKSYPDQLSGGQKQRV

SEQ ID NO: 451342 - protein, 8 aa, Mycobacterium
DKAKTART

SEQ ID NO: 451343 - protein, 4 aa, Mycobacterium
DKAL

SEQ ID NO: 451344 - protein, 7 aa, Mycobacterium
DKALTDR

SEQ ID NO: 451345 - protein, 4 aa, Mycobacterium
DKAP

SEQ ID NO: 451346 - protein, 10 aa, Mycobacterium
DKAPAEAVGR

SEQ ID NO: 451347 - protein, 8 aa, Mycobacterium
DKAPKDRV

SEQ ID NO: 451348 - protein, 20 aa, Mycobacterium
DKAQDAAKNAIHKDDPQEPQ

SEQ ID NO: 451349 - protein, 13 aa, Mycobacterium
DKAQRAANVEGTR

SEQ ID NO: 451350 - protein, 18 aa, Mycobacterium
DKARAELEQAERQTSELG

SEQ ID NO: 451351 - protein, 9 aa, Mycobacterium
DKARAKAAN

SEQ ID NO: 451352 - protein, 9 aa, Mycobacterium
DKARARGAG

SEQ ID NO: 451353 - protein, 12 aa, Mycobacterium
DKAREPARKGHR

SEQ ID NO: 451354 - protein, 8 aa, Mycobacterium
DKARSELA

SEQ ID NO: 451355 - protein, 9 aa, Mycobacterium
DKARTELAA

SEQ ID NO: 451356 - protein, 14 aa, Mycobacterium
DKARTRPAGSGTVA

SEQ ID NO: 451357 - protein, 4 aa, Mycobacterium
DKAS

SEQ ID NO: 451358 - protein, 10 aa, Mycobacterium
DKASRMTESG

SEQ ID NO: 451359 - protein, 25 aa, Mycobacterium
DKATAAAAPSVQSAVGQAEAELGDT

SEQ ID NO: 451360 - protein, 8 aa, Mycobacterium
DKATAQAE

SEQ ID NO: 451361 - protein, 12 aa, Mycobacterium
DKATDPHYGEPL

SEQ ID NO: 451362 - protein, 15 aa, Mycobacterium
DKATKETFNDEESER

SEQ ID NO: 451363 - protein, 12 aa, Mycobacterium
DKATKETFSGDE

SEQ ID NO: 451364 - protein, 15 aa, Mycobacterium
DKATKQTFSDDERRP

SEQ ID NO: 451365 - protein, 13 aa, Mycobacterium
DKATLSVAAGSGL

SEQ ID NO: 451366 - protein, 7 aa, Mycobacterium
DKATYAR

SEQ ID NO: 451367 - protein, 16 aa, Mycobacterium
DKAVQRNSGKGAAKNA

SEQ ID NO: 451368 - protein, 7 aa, Mycobacterium
DKAVRAA

SEQ ID NO: 451369 - protein, 9 aa, Mycobacterium
DKAYENKDL

SEQ ID NO: 451370 - protein, 7 aa, Mycobacterium
DKAYERR

SEQ ID NO: 451371 - protein, 37 aa, Mycobacterium
DKAYREFADPDAQLPKTDALDPEAPPVTPEEKIVTLL

SEQ ID NO: 451372 - protein, 4 aa, Mycobacterium
DKCE

SEQ ID NO: 451373 - protein, 7 aa, Mycobacterium
DKDAAIA

SEQ ID NO: 451374 - protein, 8 aa, Mycobacterium
DKDADEYF

SEQ ID NO: 451375 - protein, 8 aa, Mycobacterium
DKDAEAGA

SEQ ID NO: 451376 - protein, 6 aa, Mycobacterium
DKDANG

SEQ ID NO: 451377 - protein, 7 aa, Mycobacterium
DKDAPTD

SEQ ID NO: 451378 - protein, 8 aa, Mycobacterium
DKDAQRDK

SEQ ID NO: 451379 - protein, 26 aa, Mycobacterium
DKDDEPPALNPRSGKYRQVYVDIAET

SEQ ID NO: 451380 - protein, 9 aa, Mycobacterium
DKDDGSLTD

SEQ ID NO: 451381 - protein, 6 aa, Mycobacterium
DKDDPE

SEQ ID NO: 451382 - protein, 7 aa, Mycobacterium
DKDDPEV

SEQ ID NO: 451383 - protein, 8 aa, Mycobacterium
DKDDPGLA

SEQ ID NO: 451384 - protein, 7 aa, Mycobacterium
DKDDSAS

SEQ ID NO: 451385 - protein, 7 aa, Mycobacterium
DKDENWF

SEQ ID NO: 451386 - protein, 7 aa, Mycobacterium
DKDEVQR

SEQ ID NO: 451387 - protein, 5 aa, Mycobacterium
DKDEY

SEQ ID NO: 451388 - protein, 8 aa, Mycobacterium
DKDFRGGT

SEQ ID NO: 451389 - protein, 6 aa, Mycobacterium
DKDGIS

SEQ ID NO: 451390 - protein, 11 aa, Mycobacterium
DKDGQPFPPWT

SEQ ID NO: 451391 - protein, 5 aa, Mycobacterium
DKDGR

SEQ ID NO: 451392 - protein, 9 aa, Mycobacterium
DKDGRYARA

SEQ ID NO: 451393 - protein, 6 aa, Mycobacterium
DKDGSA

SEQ ID NO: 451394 - protein, 12 aa, Mycobacterium
DKDGTPTQGGYS

SEQ ID NO: 451395 - protein, 12 aa, Mycobacterium
DKDGTSTQGGYS

SEQ ID NO: 451396 - protein, 7 aa, Mycobacterium
DKDGVDA

SEQ ID NO: 451397 - protein, 4 aa, Mycobacterium
DKDL

SEQ ID NO: 451398 - protein, 5 aa, Mycobacterium
DKDLA

SEQ ID NO: 451399 - protein, 5 aa, Mycobacterium
DKDLG

SEQ ID NO: 451400 - protein, 8 aa, Mycobacterium
DKDLPSGR

SEQ ID NO: 451401 - protein, 5 aa, Mycobacterium
DKDMT

SEQ ID NO: 451402 - protein, 8 aa, Mycobacterium
DKDPGSLG

SEQ ID NO: 451403 - protein, 20 aa, Mycobacterium
DKDPTLAYGPGRGAIGSPAT

SEQ ID NO: 451404 - protein, 6 aa, Mycobacterium
DKDPVK

SEQ ID NO: 451405 - protein, 8 aa, Mycobacterium
DKDPVKIE

SEQ ID NO: 451406 - protein, 5 aa, Mycobacterium
DKDRD

SEQ ID NO: 451407 - protein, 7 aa, Mycobacterium
DKDREAA

SEQ ID NO: 451408 - protein, 9 aa, Mycobacterium
DKDRGTALA

SEQ ID NO: 451409 - protein, 12 aa, Mycobacterium
DKDRNPKWSPAS

SEQ ID NO: 451410 - protein, 8 aa, Mycobacterium
DKDRNPQW

SEQ ID NO: 451411 - protein, 12 aa, Mycobacterium
DKDRPIPTLGFL

SEQ ID NO: 451412 - protein, 7 aa, Mycobacterium
DKDRPSL

SEQ ID NO: 451413 - protein, 6 aa, Mycobacterium
DKDRRS

SEQ ID NO: 451414 - protein, 8 aa, Mycobacterium
DKDSLEQL

SEQ ID NO: 451415 - protein, 10 aa, Mycobacterium
DKDSPASRAE

SEQ ID NO: 451416 - protein, 25 aa, Mycobacterium
DKDTAAAAPAVRTAVGDAEAELGDT

SEQ ID NO: 451417 - protein, 5 aa, Mycobacterium
DKDTF

SEQ ID NO: 451418 - protein, 14 aa, Mycobacterium
DKDTKATFSDEESE

SEQ ID NO: 451419 - protein, 8 aa, Mycobacterium
DKDVPKHK

SEQ ID NO: 451420 - protein, 8 aa, Mycobacterium
DKDVPRHK

SEQ ID NO: 451421 - protein, 8 aa, Mycobacterium
DKEADPRY

SEQ ID NO: 451422 - protein, 5 aa, Mycobacterium
DKEAV

SEQ ID NO: 451423 - protein, 7 aa, Mycobacterium
DKEDGSL

SEQ ID NO: 451424 - protein, 11 aa, Mycobacterium
DKEGADPAKIR

SEQ ID NO: 451425 - protein, 7 aa, Mycobacterium
DKEGITA

SEQ ID NO: 451426 - protein, 5 aa, Mycobacterium
DKEGK

SEQ ID NO: 451427 - protein, 15 aa, Mycobacterium
DKEHPSSVTLPVMHS

SEQ ID NO: 451428 - protein, 9 aa, Mycobacterium
DKEKTELAN

SEQ ID NO: 451429 - protein, 9 aa, Mycobacterium
DKELDGDGV

SEQ ID NO: 451430 - protein, 8 aa, Mycobacterium
DKENEAFR

SEQ ID NO: 451431 - protein, 7 aa, Mycobacterium
DKEPAFQ

SEQ ID NO: 451432 - protein, 9 aa, Mycobacterium
DKEPNPEEM

SEQ ID NO: 451433 - protein, 5 aa, Mycobacterium
DKEQP

SEQ ID NO: 451434 - protein, 6 aa, Mycobacterium
DKERRF

SEQ ID NO: 451435 - protein, 11 aa, Mycobacterium
DKERSGSLAQS

SEQ ID NO: 451436 - protein, 5 aa, Mycobacterium
DKERT

SEQ ID NO: 451437 - protein, 6 aa, Mycobacterium
DKESAV

SEQ ID NO: 451438 - protein, 8 aa, Mycobacterium
DKESDPRY

SEQ ID NO: 451439 - protein, 9 aa, Mycobacterium
DKETAETQR

SEQ ID NO: 451440 - protein, 7 aa, Mycobacterium
DKETAGR

SEQ ID NO: 451441 - protein, 7 aa, Mycobacterium
DKFAAPR

SEQ ID NO: 451442 - protein, 14 aa, Mycobacterium
DKFEPDEDADAERD

SEQ ID NO: 451443 - protein, 5 aa, Mycobacterium
DKFGG

SEQ ID NO: 451444 - protein, 6 aa, Mycobacterium
DKFGGD

SEQ ID NO: 451445 - protein, 7 aa, Mycobacterium
DKFGGDR

SEQ ID NO: 451446 - protein, 6 aa, Mycobacterium
DKFGGN

SEQ ID NO: 451447 - protein, 13 aa, Mycobacterium
DKFGGTTAFSGGG

SEQ ID NO: 451448 - protein, 9 aa, Mycobacterium
DKFSGQGLA

SEQ ID NO: 451449 - protein, 5 aa, Mycobacterium
DKGAD

SEQ ID NO: 451450 - protein, 6 aa, Mycobacterium
DKGAKA

SEQ ID NO: 451451 - protein, 6 aa, Mycobacterium
DKGAQQ

SEQ ID NO: 451452 - protein, 7 aa, Mycobacterium
DKGARTL

SEQ ID NO: 451453 - protein, 8 aa, Mycobacterium
DKGDNEVL

SEQ ID NO: 451454 - protein, 5 aa, Mycobacterium
DKGDR

SEQ ID NO: 451455 - protein, 24 aa, Mycobacterium
DKGEGWTPQFGSKKEDYDKVPLPG

SEQ ID NO: 451456 - protein, 6 aa, Mycobacterium
DKGEID

SEQ ID NO: 451457 - protein, 9 aa, Mycobacterium
DKGEYDKAN

SEQ ID NO: 451458 - protein, 13 aa, Mycobacterium
DKGGGGSLATTPN

SEQ ID NO: 451459 - protein, 13 aa, Mycobacterium
DKGGQARIADPAR

SEQ ID NO: 451460 - protein, 6 aa, Mycobacterium
DKGHSP

SEQ ID NO: 451461 - protein, 8 aa, Mycobacterium
DKGINRPA

SEQ ID NO: 451462 - protein, 8 aa, Mycobacterium
DKGIQKSE

SEQ ID NO: 451463 - protein, 8 aa, Mycobacterium
DKGISNDD

SEQ ID NO: 451464 - protein, 6 aa, Mycobacterium
DKGKAA

SEQ ID NO: 451465 - protein, 19 aa, Mycobacterium
DKGKDAAARIAAKSPGADV

SEQ ID NO: 451466 - protein, 5 aa, Mycobacterium
DKGLA

SEQ ID NO: 451467 - protein, 13 aa, Mycobacterium
DKGLGARIADPAR

SEQ ID NO: 451468 - protein, 8 aa, Mycobacterium
DKGLGKKG

SEQ ID NO: 451469 - protein, 5 aa, Mycobacterium
DKGLT

SEQ ID NO: 451470 - protein, 8 aa, Mycobacterium
DKGLTSKP

SEQ ID NO: 451471 - protein, 4 aa, Mycobacterium
DKGM

SEQ ID NO: 451472 - protein, 7 aa, Mycobacterium
DKGMPGM

SEQ ID NO: 451473 - protein, 5 aa, Mycobacterium
DKGMR

SEQ ID NO: 451474 - protein, 4 aa, Mycobacterium
DKGN

SEQ ID NO: 451475 - protein, 4 aa, Mycobacterium
DKGP

SEQ ID NO: 451476 - protein, 14 aa, Mycobacterium
DKGPDARIADPSRN

SEQ ID NO: 451477 - protein, 16 aa, Mycobacterium
DKGPEMKVAPDFVAQG

SEQ ID NO: 451478 - protein, 7 aa, Mycobacterium
DKGPTQR

SEQ ID NO: 451479 - protein, 4 aa, Mycobacterium
DKGQ

SEQ ID NO: 451480 - protein, 5 aa, Mycobacterium
DKGRA

SEQ ID NO: 451481 - protein, 13 aa, Mycobacterium
DKGRAAADSMSGD

SEQ ID NO: 451482 - protein, 14 aa, Mycobacterium
DKGRAQKEAMERGA

SEQ ID NO: 451483 - protein, 7 aa, Mycobacterium
DKGRDAV

SEQ ID NO: 451484 - protein, 5 aa, Mycobacterium
DKGRL

SEQ ID NO: 451485 - protein, 16 aa, Mycobacterium
DKGRRTERLVVIAGRR

SEQ ID NO: 451486 - protein, 9 aa, Mycobacterium
DKGRSLTAP

SEQ ID NO: 451487 - protein, 11 aa, Mycobacterium
DKGSAAEQRLG

SEQ ID NO: 451488 - protein, 14 aa, Mycobacterium
DKGSAGEKQFGPLE

SEQ ID NO: 451489 - protein, 10 aa, Mycobacterium
DKGSAGEQRF

SEQ ID NO: 451490 - protein, 11 aa, Mycobacterium
DKGSAGEQRFG

SEQ ID NO: 451491 - protein, 10 aa, Mycobacterium
DKGSAGERQF

SEQ ID NO: 451492 - protein, 10 aa, Mycobacterium
DKGSAGERRF

SEQ ID NO: 451493 - protein, 13 aa, Mycobacterium
DKGSPGEKAFGPL

SEQ ID NO: 451494 - protein, 11 aa, Mycobacterium
DKGSREATDEV

SEQ ID NO: 451495 - protein, 16 aa, Mycobacterium
DKGSRTTSVVVLRPAN

SEQ ID NO: 451496 - protein, 10 aa, Mycobacterium
DKGSWGPQSA

SEQ ID NO: 451497 - protein, 12 aa, Mycobacterium
DKGTAAAETMPG

SEQ ID NO: 451498 - protein, 7 aa, Mycobacterium
DKGTAAF

SEQ ID NO: 451499 - protein, 11 aa, Mycobacterium
DKGTAKNGHAW

SEQ ID NO: 451500 - protein, 8 aa, Mycobacterium
DKGTNRSR

SEQ ID NO: 451501 - protein, 7 aa, Mycobacterium
DKGTRSG

SEQ ID NO: 451502 - protein, 13 aa, Mycobacterium
DKGTVTAVGPPAS

SEQ ID NO: 451503 - protein, 6 aa, Mycobacterium
DKGWIP

SEQ ID NO: 451504 - protein, 19 aa, Mycobacterium
DKGWSTRKTPTATPNGYPH

SEQ ID NO: 451505 - protein, 11 aa, Mycobacterium
DKGYPGERSAV

SEQ ID NO: 451506 - protein, 7 aa, Mycobacterium
DKHGTAY

SEQ ID NO: 451507 - protein, 19 aa, Mycobacterium
DKHNEANGEDNDDGEGHNR

SEQ ID NO: 451508 - protein, 8 aa, Mycobacterium
DKHNGDDK

SEQ ID NO: 451509 - protein, 9 aa, Mycobacterium
DKHQVPLDE

SEQ ID NO: 451510 - protein, 6 aa, Mycobacterium
DKHRRA

SEQ ID NO: 451511 - protein, 12 aa, Mycobacterium
DKHSRTDVGNSG

SEQ ID NO: 451512 - protein, 12 aa, Mycobacterium
DKHSRTEVGGSG

SEQ ID NO: 451513 - protein, 10 aa, Mycobacterium
DKHSTGGVGD

SEQ ID NO: 451514 - protein, 4 aa, Mycobacterium
DKIA

SEQ ID NO: 451515 - protein, 5 aa, Mycobacterium
DKIDE

SEQ ID NO: 451516 - protein, 4 aa, Mycobacterium
DKIG

SEQ ID NO: 451517 - protein, 15 aa, Mycobacterium
DKIGPDSPVPEPGTP

SEQ ID NO: 451518 - protein, 6 aa, Mycobacterium
DKIPDA

SEQ ID NO: 451519 - protein, 11 aa, Mycobacterium
DKIRGGKVAAA

SEQ ID NO: 451520 - protein, 7 aa, Mycobacterium
DKISGDV

SEQ ID NO: 451521 - protein, 4 aa, Mycobacterium
DKIT

SEQ ID NO: 451522 - protein, 7 aa, Mycobacterium
DKITETA

SEQ ID NO: 451523 - protein, 8 aa, Mycobacterium
DKKATVAD

SEQ ID NO: 451524 - protein, 9 aa, Mycobacterium
DKKDSEEKF

SEQ ID NO: 451525 - protein, 8 aa, Mycobacterium
DKKELDQR

SEQ ID NO: 451526 - protein, 7 aa, Mycobacterium
DKKERLA

SEQ ID NO: 451527 - protein, 7 aa, Mycobacterium
DKKERNF

SEQ ID NO: 451528 - protein, 9 aa, Mycobacterium
DKKGSVGRA

SEQ ID NO: 451529 - protein, 10 aa, Mycobacterium
DKKRARRSEA

SEQ ID NO: 451530 - protein, 7 aa, Mycobacterium
DKKRTSE

SEQ ID NO: 451531 - protein, 7 aa, Mycobacterium
DKKSRAG

SEQ ID NO: 451532 - protein, 16 aa, Mycobacterium
DKLAEPGAKSPSRIAG

SEQ ID NO: 451533 - protein, 6 aa, Mycobacterium
DKLDEE

SEQ ID NO: 451534 - protein, 6 aa, Mycobacterium
DKLDET

SEQ ID NO: 451535 - protein, 7 aa, Mycobacterium
DKLDGSL

SEQ ID NO: 451536 - protein, 8 aa, Mycobacterium
DKLEDAGE

SEQ ID NO: 451537 - protein, 6 aa, Mycobacterium
DKLGDD

SEQ ID NO: 451538 - protein, 18 aa, Mycobacterium
DKLGDENKDRDQNHNGAN

SEQ ID NO: 451539 - protein, 20 aa, Mycobacterium
DKLGGQTDGLAGTWTGQAAS

SEQ ID NO: 451540 - protein, 6 aa, Mycobacterium
DKLGQS

SEQ ID NO: 451541 - protein, 7 aa, Mycobacterium
DKLGTEC

SEQ ID NO: 451542 - protein, 6 aa, Mycobacterium
DKLHPT

SEQ ID NO: 451543 - protein, 8 aa, Mycobacterium
DKLLGGPQ

SEQ ID NO: 451544 - protein, 12 aa, Mycobacterium
DKLNPVDNMPTS

SEQ ID NO: 451545 - protein, 5 aa, Mycobacterium
DKLPG

SEQ ID NO: 451546 - protein, 15 aa, Mycobacterium
DKLPGAARRAQQRDG

SEQ ID NO: 451547 - protein, 6 aa, Mycobacterium
DKLPPL

SEQ ID NO: 451548 - protein, 15 aa, Mycobacterium
DKLPPSINYAGPNPY

SEQ ID NO: 451549 - protein, 5 aa, Mycobacterium
DKLPR

SEQ ID NO: 451550 - protein, 13 aa, Mycobacterium
DKLPTGSTVSVRT

SEQ ID NO: 451551 - protein, 5 aa, Mycobacterium
DKLRA

SEQ ID NO: 451552 - protein, 17 aa, Mycobacterium
DKLRGQRSRARDGDDRR

SEQ ID NO: 451553 - protein, 12 aa, Mycobacterium
DKLRGSIGASQY

SEQ ID NO: 451554 - protein, 14 aa, Mycobacterium
DKLRSGEGLTTGDR

SEQ ID NO: 451555 - protein, 7 aa, Mycobacterium
DKLSDSE

SEQ ID NO: 451556 - protein, 8 aa, Mycobacterium
DKLSPGER

SEQ ID NO: 451557 - protein, 7 aa, Mycobacterium
DKLSQAE

SEQ ID NO: 451558 - protein, 4 aa, Mycobacterium
DKLT

SEQ ID NO: 451559 - protein, 7 aa, Mycobacterium
DKLTGDV

SEQ ID NO: 451560 - protein, 7 aa, Mycobacterium
DKLTRRT

SEQ ID NO: 451561 - protein, 6 aa, Mycobacterium
DKMARA

SEQ ID NO: 451562 - protein, 7 aa, Mycobacterium
DKMGGAY

SEQ ID NO: 451563 - protein, 14 aa, Mycobacterium
DKNAFTGAAGDQVD

SEQ ID NO: 451564 - protein, 11 aa, Mycobacterium
DKNAGLGAAAT

SEQ ID NO: 451565 - protein, 8 aa, Mycobacterium
DKNAYDGL

SEQ ID NO: 451566 - protein, 8 aa, Mycobacterium
DKNDSLEA

SEQ ID NO: 451567 - protein, 5 aa, Mycobacterium
DKNFE

SEQ ID NO: 451568 - protein, 13 aa, Mycobacterium
DKNGLRDRTRFGT

SEQ ID NO: 451569 - protein, 46 aa, Mycobacterium
DKNGTQISEDQFNNANKPREPAGPQPDDGGLTTDEQQSGKAADAVK

SEQ ID NO: 451570 - protein, 6 aa, Mycobacterium
DKNGVD

SEQ ID NO: 451571 - protein, 5 aa, Mycobacterium
DKNLA

SEQ ID NO: 451572 - protein, 6 aa, Mycobacterium
DKNLET

SEQ ID NO: 451573 - protein, 13 aa, Mycobacterium
DKNMRTKDLTDDQ

SEQ ID NO: 451574 - protein, 4 aa, Mycobacterium
DKNP

SEQ ID NO: 451575 - protein, 9 aa, Mycobacterium
DKNPQWSPA

SEQ ID NO: 451576 - protein, 8 aa, Mycobacterium
DKNTAETV

SEQ ID NO: 451577 - protein, 5 aa, Mycobacterium
DKNYD

SEQ ID NO: 451578 - protein, 8 aa, Mycobacterium
DKPAAYTR

SEQ ID NO: 451579 - protein, 18 aa, Mycobacterium
DKPADEDEHGHGHHHGHA

SEQ ID NO: 451580 - protein, 16 aa, Mycobacterium
DKPAEEADDHGHGHHH

SEQ ID NO: 451581 - protein, 23 aa, Mycobacterium
DKPAEEHDDHGHGHGHGHGHHHH

SEQ ID NO: 451582 - protein, 17 aa, Mycobacterium
DKPAEPEDDGHGHHGHA

SEQ ID NO: 451583 - protein, 6 aa, Mycobacterium
DKPAGV

SEQ ID NO: 451584 - protein, 10 aa, Mycobacterium
DKPAHAQSAA

SEQ ID NO: 451585 - protein, 5 aa, Mycobacterium
DKPAL

SEQ ID NO: 451586 - protein, 20 aa, Mycobacterium
DKPANADEHDHGHGHGHHHH

SEQ ID NO: 451587 - protein, 10 aa, Mycobacterium
DKPATTDEQA

SEQ ID NO: 451588 - protein, 13 aa, Mycobacterium
DKPAVSSRQARVN

SEQ ID NO: 451589 - protein, 6 aa, Mycobacterium
DKPDAS

SEQ ID NO: 451590 - protein, 9 aa, Mycobacterium
DKPDGEPIA

SEQ ID NO: 451591 - protein, 8 aa, Mycobacterium
DKPDPATL

SEQ ID NO: 451592 - protein, 5 aa, Mycobacterium
DKPED

SEQ ID NO: 451593 - protein, 5 aa, Mycobacterium
DKPEE

SEQ ID NO: 451594 - protein, 7 aa, Mycobacterium
DKPEHSH

SEQ ID NO: 451595 - protein, 6 aa, Mycobacterium
DKPETS

SEQ ID NO: 451596 - protein, 4 aa, Mycobacterium
DKPF

SEQ ID NO: 451597 - protein, 7 aa, Mycobacterium
DKPFTTT

SEQ ID NO: 451598 - protein, 12 aa, Mycobacterium
DKPGADTINPEQ

SEQ ID NO: 451599 - protein, 7 aa, Mycobacterium
DKPGAGH

SEQ ID NO: 451600 - protein, 7 aa, Mycobacterium
DKPGDHD

SEQ ID NO: 451601 - protein, 7 aa, Mycobacterium
DKPGDYL

SEQ ID NO: 451602 - protein, 11 aa, Mycobacterium
DKPGGAAANGI

SEQ ID NO: 451603 - protein, 8 aa, Mycobacterium
DKPGGAQA

SEQ ID NO: 451604 - protein, 10 aa, Mycobacterium
DKPGGTPANP

SEQ ID NO: 451605 - protein, 7 aa, Mycobacterium
DKPGLVS

SEQ ID NO: 451606 - protein, 5 aa, Mycobacterium
DKPGM

SEQ ID NO: 451607 - protein, 5 aa, Mycobacterium
DKPGP

SEQ ID NO: 451608 - protein, 7 aa, Mycobacterium
DKPGQGH

SEQ ID NO: 451609 - protein, 13 aa, Mycobacterium
DKPGQHGRNRTTG

SEQ ID NO: 451610 - protein, 9 aa, Mycobacterium
DKPGSKIEA

SEQ ID NO: 451611 - protein, 6 aa, Mycobacterium
DKPGTS

SEQ ID NO: 451612 - protein, 6 aa, Mycobacterium
DKPGTV

SEQ ID NO: 451613 - protein, 8 aa, Mycobacterium
DKPGYGED

SEQ ID NO: 451614 - protein, 15 aa, Mycobacterium
DKPHGSSTPVSGSSD

SEQ ID NO: 451615 - protein, 15 aa, Mycobacterium
DKPIGSDDPLATPHY

SEQ ID NO: 451616 - protein, 6 aa, Mycobacterium
DKPIRV

SEQ ID NO: 451617 - protein, 10 aa, Mycobacterium
DKPITGPQDH

SEQ ID NO: 451618 - protein, 9 aa, Mycobacterium
DKPLGTGGG

SEQ ID NO: 451619 - protein, 7 aa, Mycobacterium
DKPLPDG

SEQ ID NO: 451620 - protein, 6 aa, Mycobacterium
DKPNGF

SEQ ID NO: 451621 - protein, 7 aa, Mycobacterium
DKPNNGD

SEQ ID NO: 451622 - protein, 6 aa, Mycobacterium
DKPPYR

SEQ ID NO: 451623 - protein, 5 aa, Mycobacterium
DKPRD

SEQ ID NO: 451624 - protein, 8 aa, Mycobacterium
DKPRGATN

SEQ ID NO: 451625 - protein, 9 aa, Mycobacterium
DKPRKSLRR

SEQ ID NO: 451626 - protein, 6 aa, Mycobacterium
DKPRLD

SEQ ID NO: 451627 - protein, 4 aa, Mycobacterium
DKPS

SEQ ID NO: 451628 - protein, 9 aa, Mycobacterium
DKPSDLAER

SEQ ID NO: 451629 - protein, 13 aa, Mycobacterium
DKPSGADQGRTPS

SEQ ID NO: 451630 - protein, 9 aa, Mycobacterium
DKPSHVQSA

SEQ ID NO: 451631 - protein, 16 aa, Mycobacterium
DKPSPYNDYPATTSHE

SEQ ID NO: 451632 - protein, 8 aa, Mycobacterium
DKPTAGEI

SEQ ID NO: 451633 - protein, 9 aa, Mycobacterium
DKPTEDAVD

SEQ ID NO: 451634 - protein, 5 aa, Mycobacterium
DKPTF

SEQ ID NO: 451635 - protein, 12 aa, Mycobacterium
DKPTGAPAGLTA

SEQ ID NO: 451636 - protein, 6 aa, Mycobacterium
DKPTIA

SEQ ID NO: 451637 - protein, 5 aa, Mycobacterium
DKPTL

SEQ ID NO: 451638 - protein, 12 aa, Mycobacterium
DKPTLADRARGR

SEQ ID NO: 451639 - protein, 7 aa, Mycobacterium
DKPVPLD

SEQ ID NO: 451640 - protein, 5 aa, Mycobacterium
DKPWR

SEQ ID NO: 451641 - protein, 5 aa, Mycobacterium
DKPWS

SEQ ID NO: 451642 - protein, 7 aa, Mycobacterium
DKPYPRG

SEQ ID NO: 451643 - protein, 8 aa, Mycobacterium
DKPYPRGE

SEQ ID NO: 451644 - protein, 13 aa, Mycobacterium
DKPYRPGRALELL

SEQ ID NO: 451645 - protein, 4 aa, Mycobacterium
DKQA

SEQ ID NO: 451646 - protein, 15 aa, Mycobacterium
DKQAAAEPIAEQRQI

SEQ ID NO: 451647 - protein, 14 aa, Mycobacterium
DKQAFTGAAGDQVD

SEQ ID NO: 451648 - protein, 9 aa, Mycobacterium
DKQAGDDVG

SEQ ID NO: 451649 - protein, 6 aa, Mycobacterium
DKQAVG

SEQ ID NO: 451650 - protein, 8 aa, Mycobacterium
DKQDGSLS

SEQ ID NO: 451651 - protein, 7 aa, Mycobacterium
DKQERRY

SEQ ID NO: 451652 - protein, 5 aa, Mycobacterium
DKQGE

SEQ ID NO: 451653 - protein, 5 aa, Mycobacterium
DKQGI

SEQ ID NO: 451654 - protein, 7 aa, Mycobacterium
DKQKTRL

SEQ ID NO: 451655 - protein, 16 aa, Mycobacterium
DKQNGPKVQRKHGLLP

SEQ ID NO: 451656 - protein, 10 aa, Mycobacterium
DKQNGVPPQI

SEQ ID NO: 451657 - protein, 4 aa, Mycobacterium
DKQP

SEQ ID NO: 451658 - protein, 6 aa, Mycobacterium
DKQRAQ

SEQ ID NO: 451659 - protein, 5 aa, Mycobacterium
DKQRK

SEQ ID NO: 451660 - protein, 8 aa, Mycobacterium
DKQRKRVE

SEQ ID NO: 451661 - protein, 8 aa, Mycobacterium
DKQRPERA

SEQ ID NO: 451662 - protein, 7 aa, Mycobacterium
DKQRSQL

SEQ ID NO: 451663 - protein, 10 aa, Mycobacterium
DKQSADPDST

SEQ ID NO: 451664 - protein, 8 aa, Mycobacterium
DKQSDVTE

SEQ ID NO: 451665 - protein, 7 aa, Mycobacterium
DKQSRLV

SEQ ID NO: 451666 - protein, 33 aa, Mycobacterium
DKQTRINAADTRQSQRRKGRTGREQQESPSAPI

SEQ ID NO: 451667 - protein, 5 aa, Mycobacterium
DKRAA

SEQ ID NO: 451668 - protein, 8 aa, Mycobacterium
DKRAEAEQ

SEQ ID NO: 451669 - protein, 26 aa, Mycobacterium
DKRALPAPEFKKAGGEYRGPATAVEE

SEQ ID NO: 451670 - protein, 24 aa, Mycobacterium
DKRALPAPEYDDAARYRAPANAVE

SEQ ID NO: 451671 - protein, 25 aa, Mycobacterium
DKRALPAPEYHKRAGEYRAPSNHTE

SEQ ID NO: 451672 - protein, 27 aa, Mycobacterium
DKRALPAPEYQKRGGEYVAPSNPTEET

SEQ ID NO: 451673 - protein, 25 aa, Mycobacterium
DKRALPAPEYQKTNGEYRAPTTAVE

SEQ ID NO: 451674 - protein, 25 aa, Mycobacterium
DKRALPAPEYRSVGTDYRAPSGPVE

SEQ ID NO: 451675 - protein, 8 aa, Mycobacterium
DKRDEDSL

SEQ ID NO: 451676 - protein, 9 aa, Mycobacterium
DKRDQYPYQ

SEQ ID NO: 451677 - protein, 6 aa, Mycobacterium
DKRDTV

SEQ ID NO: 451678 - protein, 4 aa, Mycobacterium
DKRE

SEQ ID NO: 451679 - protein, 8 aa, Mycobacterium
DKREDLEQ

SEQ ID NO: 451680 - protein, 10 aa, Mycobacterium
DKRELGDTST

SEQ ID NO: 451681 - protein, 12 aa, Mycobacterium
DKRESKSRPGEG

SEQ ID NO: 451682 - protein, 4 aa, Mycobacterium
DKRG

SEQ ID NO: 451683 - protein, 5 aa, Mycobacterium
DKRGL

SEQ ID NO: 451684 - protein, 9 aa, Mycobacterium
DKRGNSADD

SEQ ID NO: 451685 - protein, 14 aa, Mycobacterium
DKRGSVGRANPGAR

SEQ ID NO: 451686 - protein, 7 aa, Mycobacterium
DKRKGGV

SEQ ID NO: 451687 - protein, 14 aa, Mycobacterium
DKRLQGKRQHVPDA

SEQ ID NO: 451688 - protein, 7 aa, Mycobacterium
DKRPEVR

SEQ ID NO: 451689 - protein, 8 aa, Mycobacterium
DKRPEVRE

SEQ ID NO: 451690 - protein, 7 aa, Mycobacterium
DKRPGVR

SEQ ID NO: 451691 - protein, 9 aa, Mycobacterium
DKRPNQTPL

SEQ ID NO: 451692 - protein, 27 aa, Mycobacterium
DKRQAPPGAEEPREESMTTHRAAKAVR

SEQ ID NO: 451693 - protein, 11 aa, Mycobacterium
DKRRADGKPWP

SEQ ID NO: 451694 - protein, 6 aa, Mycobacterium
DKRRDE

SEQ ID NO: 451695 - protein, 6 aa, Mycobacterium
DKRRDG

SEQ ID NO: 451696 - protein, 11 aa, Mycobacterium
DKRRIDPETGE

SEQ ID NO: 451697 - protein, 38 aa, Mycobacterium
DKRRIDPETGEVRQVPPGDTPGGPAPADEPAVQGEGKL

SEQ ID NO: 451698 - protein, 6 aa, Mycobacterium
DKRRNE

SEQ ID NO: 451699 - protein, 18 aa, Mycobacterium
DKRSARKRNALAARSRKR

SEQ ID NO: 451700 - protein, 8 aa, Mycobacterium
DKRSLPAP

SEQ ID NO: 451701 - protein, 7 aa, Mycobacterium
DKRSRHR

SEQ ID NO: 451702 - protein, 13 aa, Mycobacterium
DKRTPNWAPLEAD

SEQ ID NO: 451703 - protein, 11 aa, Mycobacterium
DKRVKRSPHPF

SEQ ID NO: 451704 - protein, 7 aa, Mycobacterium
DKRYADE

SEQ ID NO: 451705 - protein, 19 aa, Mycobacterium
DKRYGGGEQRQLAEPYGAT

SEQ ID NO: 451706 - protein, 19 aa, Mycobacterium
DKRYGGSNDDKRELAEPFG

SEQ ID NO: 451707 - protein, 12 aa, Mycobacterium
DKRYQDEASGVV

SEQ ID NO: 451708 - protein, 20 aa, Mycobacterium
DKRYRDEAAEVARAARSAGI

SEQ ID NO: 451709 - protein, 10 aa, Mycobacterium
DKRYSEEAGS

SEQ ID NO: 451710 - protein, 17 aa, Mycobacterium
DKRYSGERELAQPYGAT

SEQ ID NO: 451711 - protein, 17 aa, Mycobacterium
DKRYSGKRDLAEPYGAT

SEQ ID NO: 451712 - protein, 12 aa, Mycobacterium
DKSADQIAALYQ

SEQ ID NO: 451713 - protein, 9 aa, Mycobacterium
DKSAEEVRG

SEQ ID NO: 451714 - protein, 10 aa, Mycobacterium
DKSAETPQRG

SEQ ID NO: 451715 - protein, 12 aa, Mycobacterium
DKSAKQGNDATT

SEQ ID NO: 451716 - protein, 9 aa, Mycobacterium
DKSARPAAV

SEQ ID NO: 451717 - protein, 12 aa, Mycobacterium
DKSARQGGDSTT

SEQ ID NO: 451718 - protein, 9 aa, Mycobacterium
DKSARSERV

SEQ ID NO: 451719 - protein, 10 aa, Mycobacterium
DKSATTDEQA

SEQ ID NO: 451720 - protein, 6 aa, Mycobacterium
DKSDPE

SEQ ID NO: 451721 - protein, 8 aa, Mycobacterium
DKSDPTVV

SEQ ID NO: 451722 - protein, 5 aa, Mycobacterium
DKSFE

SEQ ID NO: 451723 - protein, 6 aa, Mycobacterium
DKSGAL

SEQ ID NO: 451724 - protein, 8 aa, Mycobacterium
DKSGDPDI

SEQ ID NO: 451725 - protein, 8 aa, Mycobacterium
DKSGDPSV

SEQ ID NO: 451726 - protein, 7 aa, Mycobacterium
DKSGHDV

SEQ ID NO: 451727 - protein, 6 aa, Mycobacterium
DKSGQA

SEQ ID NO: 451728 - protein, 26 aa, Mycobacterium
DKSGQKAGEAISKGVSKGATKAGQTI

SEQ ID NO: 451729 - protein, 10 aa, Mycobacterium
DKSGTIPHTA

SEQ ID NO: 451730 - protein, 14 aa, Mycobacterium
DKSGVLAGAGTVNG

SEQ ID NO: 451731 - protein, 7 aa, Mycobacterium
DKSLTQS

SEQ ID NO: 451732 - protein, 5 aa, Mycobacterium
DKSMK

SEQ ID NO: 451733 - protein, 8 aa, Mycobacterium
DKSNNPGY

SEQ ID NO: 451734 - protein, 6 aa, Mycobacterium
DKSPGI

SEQ ID NO: 451735 - protein, 8 aa, Mycobacterium
DKSQGRAA

SEQ ID NO: 451736 - protein, 5 aa, Mycobacterium
DKSQI

SEQ ID NO: 451737 - protein, 7 aa, Mycobacterium
DKSRDTF

SEQ ID NO: 451738 - protein, 6 aa, Mycobacterium
DKSRLA

SEQ ID NO: 451739 - protein, 8 aa, Mycobacterium
DKSSGPTY

SEQ ID NO: 451740 - protein, 6 aa, Mycobacterium
DKSTEL

SEQ ID NO: 451741 - protein, 15 aa, Mycobacterium
DKSTGSITKIYTQAT

SEQ ID NO: 451742 - protein, 11 aa, Mycobacterium
DKSTNSETSGR

SEQ ID NO: 451743 - protein, 12 aa, Mycobacterium
DKSTRQGADSAT

SEQ ID NO: 451744 - protein, 4 aa, Mycobacterium
DKSV

SEQ ID NO: 451745 - protein, 4 aa, Mycobacterium
DKSY

SEQ ID NO: 451746 - protein, 5 aa, Mycobacterium
DKTAA

SEQ ID NO: 451747 - protein, 10 aa, Mycobacterium
DKTAAQGTGE

SEQ ID NO: 451748 - protein, 18 aa, Mycobacterium
DKTALEDRYAQQDPATVA

SEQ ID NO: 451749 - protein, 6 aa, Mycobacterium
DKTAPR

SEQ ID NO: 451750 - protein, 7 aa, Mycobacterium
DKTARDQ

SEQ ID NO: 451751 - protein, 20 aa, Mycobacterium
DKTASLGMSEPGAGSDLAGL

SEQ ID NO: 451752 - protein, 5 aa, Mycobacterium
DKTAV

SEQ ID NO: 451753 - protein, 5 aa, Mycobacterium
DKTDG

SEQ ID NO: 451754 - protein, 8 aa, Mycobacterium
DKTDGGVR

SEQ ID NO: 451755 - protein, 7 aa, Mycobacterium
DKTDHRP

SEQ ID NO: 451756 - protein, 6 aa, Mycobacterium
DKTDNR

SEQ ID NO: 451757 - protein, 5 aa, Mycobacterium
DKTEG

SEQ ID NO: 451758 - protein, 7 aa, Mycobacterium
DKTEKQM

SEQ ID NO: 451759 - protein, 8 aa, Mycobacterium
DKTGAFAS

SEQ ID NO: 451760 - protein, 7 aa, Mycobacterium
DKTGGNP

SEQ ID NO: 451761 - protein, 6 aa, Mycobacterium
DKTGRF

SEQ ID NO: 451762 - protein, 12 aa, Mycobacterium
DKTKVNPSGGAL

SEQ ID NO: 451763 - protein, 11 aa, Mycobacterium
DKTNGQPFSDD

SEQ ID NO: 451764 - protein, 8 aa, Mycobacterium
DKTNPKPH

SEQ ID NO: 451765 - protein, 4 aa, Mycobacterium
DKTP

SEQ ID NO: 451766 - protein, 7 aa, Mycobacterium
DKTPEVV

SEQ ID NO: 451767 - protein, 11 aa, Mycobacterium
DKTPKEADRTP

SEQ ID NO: 451768 - protein, 8 aa, Mycobacterium
DKTPTQTL

SEQ ID NO: 451769 - protein, 4 aa, Mycobacterium
DKTR

SEQ ID NO: 451770 - protein, 5 aa, Mycobacterium
DKTRM

SEQ ID NO: 451771 - protein, 31 aa, Mycobacterium
DKTRPKVDKLKSAKQVAESSEQQLKGAKDKA

SEQ ID NO: 451772 - protein, 4 aa, Mycobacterium
DKTS

SEQ ID NO: 451773 - protein, 5 aa, Mycobacterium
DKTSL

SEQ ID NO: 451774 - protein, 8 aa, Mycobacterium
DKTTAEQW

SEQ ID NO: 451775 - protein, 15 aa, Mycobacterium
DKTTKETFNDEESER

SEQ ID NO: 451776 - protein, 6 aa, Mycobacterium
DKTTPA

SEQ ID NO: 451777 - protein, 13 aa, Mycobacterium
DKTTVADAPSVRD

SEQ ID NO: 451778 - protein, 13 aa, Mycobacterium
DKTTVAQAPSVRS

SEQ ID NO: 451779 - protein, 4 aa, Mycobacterium
DKTV

SEQ ID NO: 451780 - protein, 5 aa, Mycobacterium
DKTVE

SEQ ID NO: 451781 - protein, 6 aa, Mycobacterium
DKTVEQ

SEQ ID NO: 451782 - protein, 8 aa, Mycobacterium
DKVAPELR

SEQ ID NO: 451783 - protein, 15 aa, Mycobacterium
DKVATSPAFRDSAQR

SEQ ID NO: 451784 - protein, 5 aa, Mycobacterium
DKVDG

SEQ ID NO: 451785 - protein, 13 aa, Mycobacterium
DKVDTEIPAPTSG

SEQ ID NO: 451786 - protein, 10 aa, Mycobacterium
DKVDTEIPSP

SEQ ID NO: 451787 - protein, 13 aa, Mycobacterium
DKVDTEIPSPASG

SEQ ID NO: 451788 - protein, 11 aa, Mycobacterium
DKVDTEIPSPV

SEQ ID NO: 451789 - protein, 6 aa, Mycobacterium
DKVEVD

SEQ ID NO: 451790 - protein, 7 aa, Mycobacterium
DKVGGTA

SEQ ID NO: 451791 - protein, 17 aa, Mycobacterium
DKVGKDAGELAGGEPIG

SEQ ID NO: 451792 - protein, 10 aa, Mycobacterium
DKVGQPEADT

SEQ ID NO: 451793 - protein, 9 aa, Mycobacterium
DKVGRDAGE

SEQ ID NO: 451794 - protein, 25 aa, Mycobacterium
DKVGRDAGELAGGDPLGVAATDDAG

SEQ ID NO: 451795 - protein, 7 aa, Mycobacterium
DKVGRDV

SEQ ID NO: 451796 - protein, 10 aa, Mycobacterium
DKVGTDAGEL

SEQ ID NO: 451797 - protein, 6 aa, Mycobacterium
DKVGVD

SEQ ID NO: 451798 - protein, 10 aa, Mycobacterium
DKVNRPTGGP

SEQ ID NO: 451799 - protein, 12 aa, Mycobacterium
DKVPDDIREQAK

SEQ ID NO: 451800 - protein, 6 aa, Mycobacterium
DKVPYR

SEQ ID NO: 451801 - protein, 11 aa, Mycobacterium
DKVRGGYYTPA

SEQ ID NO: 451802 - protein, 8 aa, Mycobacterium
DKVSANER

SEQ ID NO: 451803 - protein, 5 aa, Mycobacterium
DKVSV

SEQ ID NO: 451804 - protein, 8 aa, Mycobacterium
DKVTGRDN

SEQ ID NO: 451805 - protein, 16 aa, Mycobacterium
DKVTSSPAFRTSAKSK

SEQ ID NO: 451806 - protein, 16 aa, Mycobacterium
DKVTTSPAFRASAKSK

SEQ ID NO: 451807 - protein, 5 aa, Mycobacterium
DKWQE

SEQ ID NO: 451808 - protein, 4 aa, Mycobacterium
DKYA

SEQ ID NO: 451809 - protein, 11 aa, Mycobacterium
DKYDWGRGQTR

SEQ ID NO: 451810 - protein, 7 aa, Mycobacterium
DKYNGLP

SEQ ID NO: 451811 - protein, 18 aa, Mycobacterium
DKYPEYKEGRSATPDEFR

SEQ ID NO: 451812 - protein, 17 aa, Mycobacterium
DKYQIATGNDADSDRHG

SEQ ID NO: 451813 - protein, 5 aa, Mycobacterium
DKYVA

SEQ ID NO: 451814 - protein, 4 aa, Mycobacterium
DLAA

SEQ ID NO: 451815 - protein, 12 aa, Mycobacterium
DLAADSDAPVRE

SEQ ID NO: 451816 - protein, 6 aa, Mycobacterium
DLAAGG

SEQ ID NO: 451817 - protein, 7 aa, Mycobacterium
DLAAGGT

SEQ ID NO: 451818 - protein, 13 aa, Mycobacterium
DLAAGKSVTIPSN

SEQ ID NO: 451819 - protein, 6 aa, Mycobacterium
DLAAPE

SEQ ID NO: 451820 - protein, 9 aa, Mycobacterium
DLAASSGIT

SEQ ID NO: 451821 - protein, 4 aa, Mycobacterium
DLAD

SEQ ID NO: 451822 - protein, 6 aa, Mycobacterium
DLADAS

SEQ ID NO: 451823 - protein, 5 aa, Mycobacterium
DLADD

SEQ ID NO: 451824 - protein, 7 aa, Mycobacterium
DLADGGA

SEQ ID NO: 451825 - protein, 8 aa, Mycobacterium
DLADGGAG

SEQ ID NO: 451826 - protein, 14 aa, Mycobacterium
DLADGGAGAIAASD

SEQ ID NO: 451827 - protein, 9 aa, Mycobacterium
DLADGGAGV

SEQ ID NO: 451828 - protein, 12 aa, Mycobacterium
DLADGPEAVDRE

SEQ ID NO: 451829 - protein, 13 aa, Mycobacterium
DLADPALSSEPKL

SEQ ID NO: 451830 - protein, 8 aa, Mycobacterium
DLADPARA

SEQ ID NO: 451831 - protein, 7 aa, Mycobacterium
DLADPDT

SEQ ID NO: 451832 - protein, 10 aa, Mycobacterium
DLADPGPAIR

SEQ ID NO: 451833 - protein, 7 aa, Mycobacterium
DLADPGR

SEQ ID NO: 451834 - protein, 12 aa, Mycobacterium
DLADPQERTKLT

SEQ ID NO: 451835 - protein, 9 aa, Mycobacterium
DLADRATKL

SEQ ID NO: 451836 - protein, 7 aa, Mycobacterium
DLADSSV

SEQ ID NO: 451837 - protein, 7 aa, Mycobacterium
DLADTDI

SEQ ID NO: 451838 - protein, 5 aa, Mycobacterium
DLAEA

SEQ ID NO: 451839 - protein, 7 aa, Mycobacterium
DLAEDPR

SEQ ID NO: 451840 - protein, 13 aa, Mycobacterium
DLAEEVSKGGKTF

SEQ ID NO: 451841 - protein, 13 aa, Mycobacterium
DLAEEVTKDGKTF

SEQ ID NO: 451842 - protein, 8 aa, Mycobacterium
DLAEPADL

SEQ ID NO: 451843 - protein, 20 aa, Mycobacterium
DLAEQAAAVSTSDPESGQAV

SEQ ID NO: 451844 - protein, 19 aa, Mycobacterium
DLAEQVKAAEAAQAEAEQA

SEQ ID NO: 451845 - protein, 19 aa, Mycobacterium
DLAEQVKTAEANQTETEAA

SEQ ID NO: 451846 - protein, 12 aa, Mycobacterium
DLAERHGRHNPH

SEQ ID NO: 451847 - protein, 17 aa, Mycobacterium
DLAERRPGELSGGQAQR

SEQ ID NO: 451848 - protein, 5 aa, Mycobacterium
DLAET

SEQ ID NO: 451849 - protein, 4 aa, Mycobacterium
DLAG

SEQ ID NO: 451850 - protein, 5 aa, Mycobacterium
DLAGA

SEQ ID NO: 451851 - protein, 16 aa, Mycobacterium
DLAGASGFSPQGPLSA

SEQ ID NO: 451852 - protein, 5 aa, Mycobacterium
DLAGG

SEQ ID NO: 451853 - protein, 22 aa, Mycobacterium
DLAGIGSSISAANAAAAAPTAG

SEQ ID NO: 451854 - protein, 22 aa, Mycobacterium
DLAGIGSSVAAANAAAAGPTTA

SEQ ID NO: 451855 - protein, 20 aa, Mycobacterium
DLAGIGSTIGAANAAAAGNV

SEQ ID NO: 451856 - protein, 11 aa, Mycobacterium
DLAGPDGLTDR

SEQ ID NO: 451857 - protein, 7 aa, Mycobacterium
DLAGPGQ

SEQ ID NO: 451858 - protein, 7 aa, Mycobacterium
DLAGPGR

SEQ ID NO: 451859 - protein, 12 aa, Mycobacterium
DLAGRLGAALAA

SEQ ID NO: 451860 - protein, 16 aa, Mycobacterium
DLAGRPRFVTAGRRET

SEQ ID NO: 451861 - protein, 15 aa, Mycobacterium
DLAGSLSRGDGPIAA

SEQ ID NO: 451862 - protein, 6 aa, Mycobacterium
DLAGST

SEQ ID NO: 451863 - protein, 10 aa, Mycobacterium
DLAGTSTRVR

SEQ ID NO: 451864 - protein, 8 aa, Mycobacterium
DLAGTTDE

SEQ ID NO: 451865 - protein, 23 aa, Mycobacterium
DLAKADPGNADSYHANAKTFGQQ

SEQ ID NO: 451866 - protein, 13 aa, Mycobacterium
DLAKGGPVHSQAE

SEQ ID NO: 451867 - protein, 20 aa, Mycobacterium
DLAKPNTDLRKKAAAAVGAS

SEQ ID NO: 451868 - protein, 10 aa, Mycobacterium
DLANSTSPIG

SEQ ID NO: 451869 - protein, 4 aa, Mycobacterium
DLAP

SEQ ID NO: 451870 - protein, 7 aa, Mycobacterium
DLAPADA

SEQ ID NO: 451871 - protein, 8 aa, Mycobacterium
DLAPAEPF

SEQ ID NO: 451872 - protein, 8 aa, Mycobacterium
DLAPDSAW

SEQ ID NO: 451873 - protein, 8 aa, Mycobacterium
DLAPEAKD

SEQ ID NO: 451874 - protein, 7 aa, Mycobacterium
DLAPGDV

SEQ ID NO: 451875 - protein, 8 aa, Mycobacterium
DLAPGGRA

SEQ ID NO: 451876 - protein, 7 aa, Mycobacterium
DLAPGQV

SEQ ID NO: 451877 - protein, 7 aa, Mycobacterium
DLAPGRR

SEQ ID NO: 451878 - protein, 6 aa, Mycobacterium
DLAPKN

SEQ ID NO: 451879 - protein, 7 aa, Mycobacterium
DLAPPEP

SEQ ID NO: 451880 - protein, 17 aa, Mycobacterium
DLAPSKDRDRTLGAGID

SEQ ID NO: 451881 - protein, 18 aa, Mycobacterium
DLAPSQLSPRVSSLLEAL

SEQ ID NO: 451882 - protein, 10 aa, Mycobacterium
DLAPSSDTAA

SEQ ID NO: 451883 - protein, 9 aa, Mycobacterium
DLAPTPGRP

SEQ ID NO: 451884 - protein, 13 aa, Mycobacterium
DLAPVSSEQFGGK

SEQ ID NO: 451885 - protein, 4 aa, Mycobacterium
DLAQ

SEQ ID NO: 451886 - protein, 18 aa, Mycobacterium
DLAQARRKRTRIKAEDDT

SEQ ID NO: 451887 - protein, 13 aa, Mycobacterium
DLAQQDGERPAVE

SEQ ID NO: 451888 - protein, 6 aa, Mycobacterium
DLARDP

SEQ ID NO: 451889 - protein, 5 aa, Mycobacterium
DLARG

SEQ ID NO: 451890 - protein, 17 aa, Mycobacterium
DLARQSAVQAQAAAGAF

SEQ ID NO: 451891 - protein, 5 aa, Mycobacterium
DLARS

SEQ ID NO: 451892 - protein, 5 aa, Mycobacterium
DLASG

SEQ ID NO: 451893 - protein, 13 aa, Mycobacterium
DLASRSANTPYES

SEQ ID NO: 451894 - protein, 9 aa, Mycobacterium
DLASSATAV

SEQ ID NO: 451895 - protein, 4 aa, Mycobacterium
DLAT

SEQ ID NO: 451896 - protein, 8 aa, Mycobacterium
DLATARST

SEQ ID NO: 451897 - protein, 7 aa, Mycobacterium
DLATGTG

SEQ ID NO: 451898 - protein, 9 aa, Mycobacterium
DLATPSLPA

SEQ ID NO: 451899 - protein, 7 aa, Mycobacterium
DLATREE

SEQ ID NO: 451900 - protein, 8 aa, Mycobacterium
DLATTGAD

SEQ ID NO: 451901 - protein, 12 aa, Mycobacterium
DLCGPGDQESGE

SEQ ID NO: 451902 - protein, 5 aa, Mycobacterium
DLDAE

SEQ ID NO: 451903 - protein, 7 aa, Mycobacterium
DLDAEAA

SEQ ID NO: 451904 - protein, 6 aa, Mycobacterium
DLDAEE

SEQ ID NO: 451905 - protein, 5 aa, Mycobacterium
DLDAG

SEQ ID NO: 451906 - protein, 6 aa, Mycobacterium
DLDAGY

SEQ ID NO: 451907 - protein, 13 aa, Mycobacterium
DLDAKSADPEHES

SEQ ID NO: 451908 - protein, 9 aa, Mycobacterium
DLDAPQATE

SEQ ID NO: 451909 - protein, 7 aa, Mycobacterium
DLDASDP

SEQ ID NO: 451910 - protein, 8 aa, Mycobacterium
DLDATGVA

SEQ ID NO: 451911 - protein, 6 aa, Mycobacterium
DLDATV

SEQ ID NO: 451912 - protein, 7 aa, Mycobacterium
DLDATVE

SEQ ID NO: 451913 - protein, 10 aa, Mycobacterium
DLDDDAHADR

SEQ ID NO: 451914 - protein, 7 aa, Mycobacterium
DLDDDGQ

SEQ ID NO: 451915 - protein, 12 aa, Mycobacterium
DLDDDTHADRTG

SEQ ID NO: 451916 - protein, 10 aa, Mycobacterium
DLDDPGSPIA

SEQ ID NO: 451917 - protein, 8 aa, Mycobacterium
DLDDPHSA

SEQ ID NO: 451918 - protein, 10 aa, Mycobacterium
DLDDRESPIA

SEQ ID NO: 451919 - protein, 8 aa, Mycobacterium
DLDDRSRI

SEQ ID NO: 451920 - protein, 10 aa, Mycobacterium
DLDDSESPIA

SEQ ID NO: 451921 - protein, 16 aa, Mycobacterium
DLDDTADASGETFDGP

SEQ ID NO: 451922 - protein, 6 aa, Mycobacterium
DLDDTH

SEQ ID NO: 451923 - protein, 5 aa, Mycobacterium
DLDEA

SEQ ID NO: 451924 - protein, 21 aa, Mycobacterium
DLDEAAKTAVTARVQNNGQSC

SEQ ID NO: 451925 - protein, 13 aa, Mycobacterium
DLDEDAQAAAEKA

SEQ ID NO: 451926 - protein, 10 aa, Mycobacterium
DLDEDSRARF

SEQ ID NO: 451927 - protein, 13 aa, Mycobacterium
DLDEEAQAAAEKA

SEQ ID NO: 451928 - protein, 14 aa, Mycobacterium
DLDEEAQKAAEDAL

SEQ ID NO: 451929 - protein, 9 aa, Mycobacterium
DLDEGTARA

SEQ ID NO: 451930 - protein, 7 aa, Mycobacterium
DLDESTL

SEQ ID NO: 451931 - protein, 5 aa, Mycobacterium
DLDEV

SEQ ID NO: 451932 - protein, 7 aa, Mycobacterium
DLDGASI

SEQ ID NO: 451933 - protein, 6 aa, Mycobacterium
DLDGDG

SEQ ID NO: 451934 - protein, 7 aa, Mycobacterium
DLDGDGR

SEQ ID NO: 451935 - protein, 8 aa, Mycobacterium
DLDGDKLT

SEQ ID NO: 451936 - protein, 8 aa, Mycobacterium
DLDGETRQ

SEQ ID NO: 451937 - protein, 8 aa, Mycobacterium
DLDGKTDN

SEQ ID NO: 451938 - protein, 15 aa, Mycobacterium
DLDGPGLDTLAARLT

SEQ ID NO: 451939 - protein, 10 aa, Mycobacterium
DLDGQQAEDR

SEQ ID NO: 451940 - protein, 9 aa, Mycobacterium
DLDGSDPTI

SEQ ID NO: 451941 - protein, 7 aa, Mycobacterium
DLDGSQR

SEQ ID NO: 451942 - protein, 6 aa, Mycobacterium
DLDGTF

SEQ ID NO: 451943 - protein, 7 aa, Mycobacterium
DLDGYSA

SEQ ID NO: 451944 - protein, 6 aa, Mycobacterium
DLDHPD

SEQ ID NO: 451945 - protein, 7 aa, Mycobacterium
DLDHPDE

SEQ ID NO: 451946 - protein, 10 aa, Mycobacterium
DLDLDGDGRL

SEQ ID NO: 451947 - protein, 7 aa, Mycobacterium
DLDPAAV

SEQ ID NO: 451948 - protein, 8 aa, Mycobacterium
DLDPAEVD

SEQ ID NO: 451949 - protein, 6 aa, Mycobacterium
DLDPEN

SEQ ID NO: 451950 - protein, 8 aa, Mycobacterium
DLDPEQRP

SEQ ID NO: 451951 - protein, 11 aa, Mycobacterium
DLDPGHEEPTR

SEQ ID NO: 451952 - protein, 42 aa, Mycobacterium
DLDPTVEDTDEVESPAVAAPGSAVDDEEEIAEPTEKDKASGD

SEQ ID NO: 451953 - protein, 6 aa, Mycobacterium
DLDPVK

SEQ ID NO: 451954 - protein, 6 aa, Mycobacterium
DLDQKT

SEQ ID NO: 451955 - protein, 7 aa, Mycobacterium
DLDQPPQ

SEQ ID NO: 451956 - protein, 9 aa, Mycobacterium
DLDQRDPDY

SEQ ID NO: 451957 - protein, 4 aa, Mycobacterium
DLDR

SEQ ID NO: 451958 - protein, 7 aa, Mycobacterium
DLDRNPV

SEQ ID NO: 451959 - protein, 17 aa, Mycobacterium
DLDRRRQNSYGMGGPER

SEQ ID NO: 451960 - protein, 4 aa, Mycobacterium
DLDS

SEQ ID NO: 451961 - protein, 9 aa, Mycobacterium
DLDSAEGRV

SEQ ID NO: 451962 - protein, 46 aa, Mycobacterium
DLDSDDDTAVEDEEEEADAATPAVATAKAADDDIDEPSEKDKASGD

SEQ ID NO: 451963 - protein, 8 aa, Mycobacterium
DLDTATES

SEQ ID NO: 451964 - protein, 8 aa, Mycobacterium
DLDTDRPW

SEQ ID NO: 451965 - protein, 8 aa, Mycobacterium
DLDTDTAR

SEQ ID NO: 451966 - protein, 9 aa, Mycobacterium
DLDTEGSPW

SEQ ID NO: 451967 - protein, 12 aa, Mycobacterium
DLDTEKTPGAVT

SEQ ID NO: 451968 - protein, 10 aa, Mycobacterium
DLDTRGATRR

SEQ ID NO: 451969 - protein, 4 aa, Mycobacterium
DLEA

SEQ ID NO: 451970 - protein, 11 aa, Mycobacterium
DLEAARDSGLA

SEQ ID NO: 451971 - protein, 16 aa, Mycobacterium
DLEAEPGEDLDVEDTD

SEQ ID NO: 451972 - protein, 14 aa, Mycobacterium
DLEARKTIGSVVLL

SEQ ID NO: 451973 - protein, 12 aa, Mycobacterium
DLEDGVDEVDRD

SEQ ID NO: 451974 - protein, 10 aa, Mycobacterium
DLEDPGSPIA

SEQ ID NO: 451975 - protein, 8 aa, Mycobacterium
DLEDPHSA

SEQ ID NO: 451976 - protein, 15 aa, Mycobacterium
DLEDRRRRTRELAQE

SEQ ID NO: 451977 - protein, 4 aa, Mycobacterium
DLEE

SEQ ID NO: 451978 - protein, 5 aa, Mycobacterium
DLEGA

SEQ ID NO: 451979 - protein, 8 aa, Mycobacterium
DLEGKTDN

SEQ ID NO: 451980 - protein, 6 aa, Mycobacterium
DLEGTV

SEQ ID NO: 451981 - protein, 11 aa, Mycobacterium
DLEKAAPEIRP

SEQ ID NO: 451982 - protein, 9 aa, Mycobacterium
DLEKPTLKD

SEQ ID NO: 451983 - protein, 10 aa, Mycobacterium
DLENGGPTIG

SEQ ID NO: 451984 - protein, 11 aa, Mycobacterium
DLENPTAADAA

SEQ ID NO: 451985 - protein, 11 aa, Mycobacterium
DLENPTEADAA

SEQ ID NO: 451986 - protein, 12 aa, Mycobacterium
DLENPTRADAEP

SEQ ID NO: 451987 - protein, 8 aa, Mycobacterium
DLENSPVR

SEQ ID NO: 451988 - protein, 13 aa, Mycobacterium
DLENTASRRPAAA

SEQ ID NO: 451989 - protein, 4 aa, Mycobacterium
DLEP

SEQ ID NO: 451990 - protein, 6 aa, Mycobacterium
DLEPDN

SEQ ID NO: 451991 - protein, 6 aa, Mycobacterium
DLEPGG

SEQ ID NO: 451992 - protein, 8 aa, Mycobacterium
DLEPGTTY

SEQ ID NO: 451993 - protein, 8 aa, Mycobacterium
DLEPLRGA

SEQ ID NO: 451994 - protein, 4 aa, Mycobacterium
DLEQ

SEQ ID NO: 451995 - protein, 11 aa, Mycobacterium
DLEQASPEIRP

SEQ ID NO: 451996 - protein, 18 aa, Mycobacterium
DLEQREGRIQRQGNQNLD

SEQ ID NO: 451997 - protein, 7 aa, Mycobacterium
DLEQSGI

SEQ ID NO: 451998 - protein, 6 aa, Mycobacterium
DLERDN

SEQ ID NO: 451999 - protein, 9 aa, Mycobacterium
DLERPGSDR

SEQ ID NO: 452000 - protein, 6 aa, Mycobacterium
DLERTG

SEQ ID NO: 452001 - protein, 6 aa, Mycobacterium
DLESAP

SEQ ID NO: 452002 - protein, 10 aa, Mycobacterium
DLESGSPELQ

SEQ ID NO: 452003 - protein, 8 aa, Mycobacterium
DLESRPAF

SEQ ID NO: 452004 - protein, 10 aa, Mycobacterium
DLESSGPLRP

SEQ ID NO: 452005 - protein, 12 aa, Mycobacterium
DLESTRDGYSAT

SEQ ID NO: 452006 - protein, 19 aa, Mycobacterium
DLETAGLPAAAADAAAQAT

SEQ ID NO: 452007 - protein, 14 aa, Mycobacterium
DLETDTSTGDQVGV

SEQ ID NO: 452008 - protein, 7 aa, Mycobacterium
DLETPDS

SEQ ID NO: 452009 - protein, 16 aa, Mycobacterium
DLETPGAQRAVGSGAN

SEQ ID NO: 452010 - protein, 17 aa, Mycobacterium
DLFPGSRGKGLSPRTQE

SEQ ID NO: 452011 - protein, 10 aa, Mycobacterium
DLGADDSALR

SEQ ID NO: 452012 - protein, 6 aa, Mycobacterium
DLGAKG

SEQ ID NO: 452013 - protein, 7 aa, Mycobacterium
DLGANGC

SEQ ID NO: 452014 - protein, 7 aa, Mycobacterium
DLGASDV

SEQ ID NO: 452015 - protein, 5 aa, Mycobacterium
DLGAT

SEQ ID NO: 452016 - protein, 7 aa, Mycobacterium
DLGATET

SEQ ID NO: 452017 - protein, 12 aa, Mycobacterium
DLGAVSSDQLDG

SEQ ID NO: 452018 - protein, 10 aa, Mycobacterium
DLGDDDNTAV

SEQ ID NO: 452019 - protein, 8 aa, Mycobacterium
DLGDPDRW

SEQ ID NO: 452020 - protein, 14 aa, Mycobacterium
DLGDPERHCKILVV

SEQ ID NO: 452021 - protein, 10 aa, Mycobacterium
DLGDPFGAST

SEQ ID NO: 452022 - protein, 8 aa, Mycobacterium
DLGDPQSG

SEQ ID NO: 452023 - protein, 5 aa, Mycobacterium
DLGDR

SEQ ID NO: 452024 - protein, 18 aa, Mycobacterium
DLGDRAGDLVEELNAELT

SEQ ID NO: 452025 - protein, 5 aa, Mycobacterium
DLGDS

SEQ ID NO: 452026 - protein, 9 aa, Mycobacterium
DLGDSDPAI

SEQ ID NO: 452027 - protein, 8 aa, Mycobacterium
DLGDTDSL

SEQ ID NO: 452028 - protein, 15 aa, Mycobacterium
DLGEDPHQVDTGDTA

SEQ ID NO: 452029 - protein, 10 aa, Mycobacterium
DLGEKESRGM

SEQ ID NO: 452030 - protein, 8 aa, Mycobacterium
DLGERESR

SEQ ID NO: 452031 - protein, 6 aa, Mycobacterium
DLGEST

SEQ ID NO: 452032 - protein, 5 aa, Mycobacterium
DLGET

SEQ ID NO: 452033 - protein, 13 aa, Mycobacterium
DLGEVTNDQFSGK

SEQ ID NO: 452034 - protein, 19 aa, Mycobacterium
DLGGAGSIDEKLGDGDTDV

SEQ ID NO: 452035 - protein, 196 aa, Mycobacterium
DLGGDLPKTDPKTSGEPSALPTREPPRPPVEAPRPAESAPSMAPAESRSAPEGSATVGSAGLHDPATPVGSRPSPAPAAGGDQMPSTTSRLTESTPAPGAAEGAPVKPASAATAPASPAPQASAPRFTESTSPTELARPGSGSPHCASDGISSNGRPPESSPHVSAGDMPGDRGSQEPPIAPGDPLHSHERSGPGW

SEQ ID NO: 452036 - protein, 9 aa, Mycobacterium
DLGGDTKRI

SEQ ID NO: 452037 - protein, 12 aa, Mycobacterium
DLGGGSISGNGV

SEQ ID NO: 452038 - protein, 12 aa, Mycobacterium
DLGGGSVSGDGV

SEQ ID NO: 452039 - protein, 10 aa, Mycobacterium
DLGGGTSDEW

SEQ ID NO: 452040 - protein, 13 aa, Mycobacterium
DLGGKAEKVNPLA

SEQ ID NO: 452041 - protein, 13 aa, Mycobacterium
DLGGKPDKVNPLA

SEQ ID NO: 452042 - protein, 19 aa, Mycobacterium
DLGGPATYPEEAPISAFQL

SEQ ID NO: 452043 - protein, 14 aa, Mycobacterium
DLGGPGQRTLAQRL

SEQ ID NO: 452044 - protein, 8 aa, Mycobacterium
DLGGQGGR

SEQ ID NO: 452045 - protein, 13 aa, Mycobacterium
DLGGQPDKVNPLA

SEQ ID NO: 452046 - protein, 7 aa, Mycobacterium
DLGGRAA

SEQ ID NO: 452047 - protein, 19 aa, Mycobacterium
DLGGRATTVRSDITEDDQV

SEQ ID NO: 452048 - protein, 19 aa, Mycobacterium
DLGGREPVRRDGARPGDTV

SEQ ID NO: 452049 - protein, 8 aa, Mycobacterium
DLGGRGLT

SEQ ID NO: 452050 - protein, 6 aa, Mycobacterium
DLGGSG

SEQ ID NO: 452051 - protein, 5 aa, Mycobacterium
DLGGT

SEQ ID NO: 452052 - protein, 8 aa, Mycobacterium
DLGGTAQE

SEQ ID NO: 452053 - protein, 5 aa, Mycobacterium
DLGHA

SEQ ID NO: 452054 - protein, 14 aa, Mycobacterium
DLGHGESADPDNYL

SEQ ID NO: 452055 - protein, 5 aa, Mycobacterium
DLGHP

SEQ ID NO: 452056 - protein, 9 aa, Mycobacterium
DLGKMGPPQ

SEQ ID NO: 452057 - protein, 10 aa, Mycobacterium
DLGKPDERDH

SEQ ID NO: 452058 - protein, 16 aa, Mycobacterium
DLGLPDSQVRPAYEDP

SEQ ID NO: 452059 - protein, 5 aa, Mycobacterium
DLGND

SEQ ID NO: 452060 - protein, 17 aa, Mycobacterium
DLGNEDAELTVGDAQDH

SEQ ID NO: 452061 - protein, 12 aa, Mycobacterium
DLGNSGPRNDVD

SEQ ID NO: 452062 - protein, 6 aa, Mycobacterium
DLGPDA

SEQ ID NO: 452063 - protein, 6 aa, Mycobacterium
DLGPDD

SEQ ID NO: 452064 - protein, 25 aa, Mycobacterium
DLGPDGATEEGRALAEKGRASTAAL

SEQ ID NO: 452065 - protein, 13 aa, Mycobacterium
DLGPEGDTEEGQV

SEQ ID NO: 452066 - protein, 16 aa, Mycobacterium
DLGPGTSTSAATSALA

SEQ ID NO: 452067 - protein, 16 aa, Mycobacterium
DLGPGTSTSEATSALT

SEQ ID NO: 452068 - protein, 16 aa, Mycobacterium
DLGPGTSTSTASAALA

SEQ ID NO: 452069 - protein, 6 aa, Mycobacterium
DLGPRA

SEQ ID NO: 452070 - protein, 10 aa, Mycobacterium
DLGPRRALTG

SEQ ID NO: 452071 - protein, 8 aa, Mycobacterium
DLGPSPFR

SEQ ID NO: 452072 - protein, 7 aa, Mycobacterium
DLGPSTQ

SEQ ID NO: 452073 - protein, 7 aa, Mycobacterium
DLGPTLT

SEQ ID NO: 452074 - protein, 10 aa, Mycobacterium
DLGPVATGYA

SEQ ID NO: 452075 - protein, 12 aa, Mycobacterium
DLGPVGSDQFRG

SEQ ID NO: 452076 - protein, 16 aa, Mycobacterium
DLGQAGTNAHHGSGST

SEQ ID NO: 452077 - protein, 10 aa, Mycobacterium
DLGQGAREKA

SEQ ID NO: 452078 - protein, 10 aa, Mycobacterium
DLGQSAREKA

SEQ ID NO: 452079 - protein, 5 aa, Mycobacterium
DLGRA

SEQ ID NO: 452080 - protein, 7 aa, Mycobacterium
DLGRAPA

SEQ ID NO: 452081 - protein, 10 aa, Mycobacterium
DLGRAPADGA

SEQ ID NO: 452082 - protein, 11 aa, Mycobacterium
DLGRASEEGSG

SEQ ID NO: 452083 - protein, 9 aa, Mycobacterium
DLGRDQART

SEQ ID NO: 452084 - protein, 15 aa, Mycobacterium
DLGRDVDSGATRRNL

SEQ ID NO: 452085 - protein, 8 aa, Mycobacterium
DLGRPEGF

SEQ ID NO: 452086 - protein, 6 aa, Mycobacterium
DLGRPS

SEQ ID NO: 452087 - protein, 6 aa, Mycobacterium
DLGRSA

SEQ ID NO: 452088 - protein, 8 aa, Mycobacterium
DLGRSAAG

SEQ ID NO: 452089 - protein, 11 aa, Mycobacterium
DLGRSTSPGLV

SEQ ID NO: 452090 - protein, 13 aa, Mycobacterium
DLGSAAAADAPGL

SEQ ID NO: 452091 - protein, 5 aa, Mycobacterium
DLGSI

SEQ ID NO: 452092 - protein, 8 aa, Mycobacterium
DLGTASNR

SEQ ID NO: 452093 - protein, 13 aa, Mycobacterium
DLGTGEQSAVASE

SEQ ID NO: 452094 - protein, 13 aa, Mycobacterium
DLGTGEQVSVSTD

SEQ ID NO: 452095 - protein, 13 aa, Mycobacterium
DLGTKGGLRTDTA

SEQ ID NO: 452096 - protein, 17 aa, Mycobacterium
DLGTRSLQAGATAVSSV

SEQ ID NO: 452097 - protein, 12 aa, Mycobacterium
DLGTVSDEQFRG

SEQ ID NO: 452098 - protein, 11 aa, Mycobacterium
DLGTVSSDQFR

SEQ ID NO: 452099 - protein, 33 aa, Mycobacterium
DLGVTPKLTKNDGVPTLSAEDQPQKSKDFTSDQ

SEQ ID NO: 452100 - protein, 6 aa, Mycobacterium
DLHDRP

SEQ ID NO: 452101 - protein, 8 aa, Mycobacterium
DLHDSPQY

SEQ ID NO: 452102 - protein, 12 aa, Mycobacterium
DLKDGEGSVGTF

SEQ ID NO: 452103 - protein, 7 aa, Mycobacterium
DLKDKAP

SEQ ID NO: 452104 - protein, 19 aa, Mycobacterium
DLKDTSRDAALGPLSPHEL

SEQ ID NO: 452105 - protein, 8 aa, Mycobacterium
DLKPDDAA

SEQ ID NO: 452106 - protein, 8 aa, Mycobacterium
DLKPGSLG

SEQ ID NO: 452107 - protein, 20 aa, Mycobacterium
DLKPRDGRFGSGPSKVRPEQ

SEQ ID NO: 452108 - protein, 9 aa, Mycobacterium
DLKPRTRAE

SEQ ID NO: 452109 - protein, 13 aa, Mycobacterium
DLKPSDATDANGG

SEQ ID NO: 452110 - protein, 19 aa, Mycobacterium
DLKPSDGRFGCGPSKVRPA

SEQ ID NO: 452111 - protein, 7 aa, Mycobacterium
DLKPSDL

SEQ ID NO: 452112 - protein, 9 aa, Mycobacterium
DLKTEPGPR

SEQ ID NO: 452113 - protein, 15 aa, Mycobacterium
DLKTQNQPGTTDEYP

SEQ ID NO: 452114 - protein, 11 aa, Mycobacterium
DLLDGGGRGAV

SEQ ID NO: 452115 - protein, 13 aa, Mycobacterium
DLLGGGGRRAIPR

SEQ ID NO: 452116 - protein, 7 aa, Mycobacterium
DLNAAGA

SEQ ID NO: 452117 - protein, 13 aa, Mycobacterium
DLNAEAAKYPAKP

SEQ ID NO: 452118 - protein, 7 aa, Mycobacterium
DLNESRA

SEQ ID NO: 452119 - protein, 10 aa, Mycobacterium
DLNETEQARI

SEQ ID NO: 452120 - protein, 6 aa, Mycobacterium
DLNPDV

SEQ ID NO: 452121 - protein, 5 aa, Mycobacterium
DLNRP

SEQ ID NO: 452122 - protein, 9 aa, Mycobacterium
DLNRRADAA

SEQ ID NO: 452123 - protein, 5 aa, Mycobacterium
DLNTG

SEQ ID NO: 452124 - protein, 14 aa, Mycobacterium
DLNTGGGNAGSVNT

SEQ ID NO: 452125 - protein, 7 aa, Mycobacterium
DLNTGLG

SEQ ID NO: 452126 - protein, 4 aa, Mycobacterium
DLPA

SEQ ID NO: 452127 - protein, 12 aa, Mycobacterium
DLPAADADQVID

SEQ ID NO: 452128 - protein, 24 aa, Mycobacterium
DLPAAETSTTQKARKAADVRWLNR

SEQ ID NO: 452129 - protein, 6 aa, Mycobacterium
DLPAAP

SEQ ID NO: 452130 - protein, 7 aa, Mycobacterium
DLPAARD

SEQ ID NO: 452131 - protein, 6 aa, Mycobacterium
DLPADL

SEQ ID NO: 452132 - protein, 14 aa, Mycobacterium
DLPADQREAAGQER

SEQ ID NO: 452133 - protein, 7 aa, Mycobacterium
DLPADVA

SEQ ID NO: 452134 - protein, 5 aa, Mycobacterium
DLPAG

SEQ ID NO: 452135 - protein, 8 aa, Mycobacterium
DLPAGASF

SEQ ID NO: 452136 - protein, 8 aa, Mycobacterium
DLPAGDRL

SEQ ID NO: 452137 - protein, 7 aa, Mycobacterium
DLPAGGL

SEQ ID NO: 452138 - protein, 8 aa, Mycobacterium
DLPAGGSA

SEQ ID NO: 452139 - protein, 6 aa, Mycobacterium
DLPAGI

SEQ ID NO: 452140 - protein, 6 aa, Mycobacterium
DLPAGR

SEQ ID NO: 452141 - protein, 6 aa, Mycobacterium
DLPAGS

SEQ ID NO: 452142 - protein, 11 aa, Mycobacterium
DLPAHESEYAA

SEQ ID NO: 452143 - protein, 7 aa, Mycobacterium
DLPAKAQ

SEQ ID NO: 452144 - protein, 12 aa, Mycobacterium
DLPAKQGERESF

SEQ ID NO: 452145 - protein, 9 aa, Mycobacterium
DLPAPGPGE

SEQ ID NO: 452146 - protein, 7 aa, Mycobacterium
DLPAPVG

SEQ ID NO: 452147 - protein, 15 aa, Mycobacterium
DLPAPVRPGALPLAV

SEQ ID NO: 452148 - protein, 6 aa, Mycobacterium
DLPARE

SEQ ID NO: 452149 - protein, 8 aa, Mycobacterium
DLPARPGE

SEQ ID NO: 452150 - protein, 9 aa, Mycobacterium
DLPASIKPN

SEQ ID NO: 452151 - protein, 7 aa, Mycobacterium
DLPASKS

SEQ ID NO: 452152 - protein, 8 aa, Mycobacterium
DLPASTPM

SEQ ID NO: 452153 - protein, 12 aa, Mycobacterium
DLPAVTEKGSGI

SEQ ID NO: 452154 - protein, 6 aa, Mycobacterium
DLPDDA

SEQ ID NO: 452155 - protein, 19 aa, Mycobacterium
DLPDDANALEGSATALADS

SEQ ID NO: 452156 - protein, 7 aa, Mycobacterium
DLPDDEV

SEQ ID NO: 452157 - protein, 18 aa, Mycobacterium
DLPDDQQPDGNNFPTEKS

SEQ ID NO: 452158 - protein, 23 aa, Mycobacterium
DLPDDRPTRQDHGQIDGTPEDGD

SEQ ID NO: 452159 - protein, 10 aa, Mycobacterium
DLPDELGEGA

SEQ ID NO: 452160 - protein, 7 aa, Mycobacterium
DLPDEPD

SEQ ID NO: 452161 - protein, 9 aa, Mycobacterium
DLPDEPTDY

SEQ ID NO: 452162 - protein, 11 aa, Mycobacterium
DLPDGCRRTAS

SEQ ID NO: 452163 - protein, 16 aa, Mycobacterium
DLPDGSPDDPDDAETV

SEQ ID NO: 452164 - protein, 22 aa, Mycobacterium
DLPDGYDDDLGDDRPRKLRPGD

SEQ ID NO: 452165 - protein, 5 aa, Mycobacterium
DLPDK

SEQ ID NO: 452166 - protein, 9 aa, Mycobacterium
DLPDKRPDI

SEQ ID NO: 452167 - protein, 10 aa, Mycobacterium
DLPDKSVSLN

SEQ ID NO: 452168 - protein, 6 aa, Mycobacterium
DLPDPE

SEQ ID NO: 452169 - protein, 6 aa, Mycobacterium
DLPDPG

SEQ ID NO: 452170 - protein, 7 aa, Mycobacterium
DLPDSDV

SEQ ID NO: 452171 - protein, 7 aa, Mycobacterium
DLPDSTF

SEQ ID NO: 452172 - protein, 8 aa, Mycobacterium
DLPDSTQD

SEQ ID NO: 452173 - protein, 11 aa, Mycobacterium
DLPDTAPSVPG

SEQ ID NO: 452174 - protein, 11 aa, Mycobacterium
DLPDTPIDDEL

SEQ ID NO: 452175 - protein, 21 aa, Mycobacterium
DLPDVATSPVRGQGSKPAPST

SEQ ID NO: 452176 - protein, 4 aa, Mycobacterium
DLPE

SEQ ID NO: 452177 - protein, 13 aa, Mycobacterium
DLPEAARTARGQH

SEQ ID NO: 452178 - protein, 13 aa, Mycobacterium
DLPEASRTARGQH

SEQ ID NO: 452179 - protein, 9 aa, Mycobacterium
DLPEDTRAR

SEQ ID NO: 452180 - protein, 7 aa, Mycobacterium
DLPEEEA

SEQ ID NO: 452181 - protein, 7 aa, Mycobacterium
DLPEEPG

SEQ ID NO: 452182 - protein, 6 aa, Mycobacterium
DLPEGA

SEQ ID NO: 452183 - protein, 19 aa, Mycobacterium
DLPEGASTENLSLDGQGRV

SEQ ID NO: 452184 - protein, 19 aa, Mycobacterium
DLPEGASTQNLSLDGQGRV

SEQ ID NO: 452185 - protein, 6 aa, Mycobacterium
DLPEGS

SEQ ID NO: 452186 - protein, 6 aa, Mycobacterium
DLPEKV

SEQ ID NO: 452187 - protein, 8 aa, Mycobacterium
DLPEPQRD

SEQ ID NO: 452188 - protein, 6 aa, Mycobacterium
DLPEPT

SEQ ID NO: 452189 - protein, 9 aa, Mycobacterium
DLPEQAEEW

SEQ ID NO: 452190 - protein, 10 aa, Mycobacterium
DLPGARCKGR

SEQ ID NO: 452191 - protein, 13 aa, Mycobacterium
DLPGASGSSRPER

SEQ ID NO: 452192 - protein, 20 aa, Mycobacterium
DLPGASVSPRRGGNCNPAPS

SEQ ID NO: 452193 - protein, 19 aa, Mycobacterium
DLPGAVTRGRSGPCRPAPS

SEQ ID NO: 452194 - protein, 6 aa, Mycobacterium
DLPGDD

SEQ ID NO: 452195 - protein, 7 aa, Mycobacterium
DLPGDTP

SEQ ID NO: 452196 - protein, 8 aa, Mycobacterium
DLPGEATQ

SEQ ID NO: 452197 - protein, 7 aa, Mycobacterium
DLPGESP

SEQ ID NO: 452198 - protein, 5 aa, Mycobacterium
DLPGF

SEQ ID NO: 452199 - protein, 5 aa, Mycobacterium
DLPGG

SEQ ID NO: 452200 - protein, 11 aa, Mycobacterium
DLPGGAKSGLR

SEQ ID NO: 452201 - protein, 11 aa, Mycobacterium
DLPGGAPSGLN

SEQ ID NO: 452202 - protein, 10 aa, Mycobacterium
DLPGGATSGL

SEQ ID NO: 452203 - protein, 10 aa, Mycobacterium
DLPGNARSGL

SEQ ID NO: 452204 - protein, 6 aa, Mycobacterium
DLPGNT

SEQ ID NO: 452205 - protein, 7 aa, Mycobacterium
DLPGPGA

SEQ ID NO: 452206 - protein, 7 aa, Mycobacterium
DLPGQGG

SEQ ID NO: 452207 - protein, 7 aa, Mycobacterium
DLPGSPV

SEQ ID NO: 452208 - protein, 6 aa, Mycobacterium
DLPGSQ

SEQ ID NO: 452209 - protein, 13 aa, Mycobacterium
DLPGSSGSSRPER

SEQ ID NO: 452210 - protein, 7 aa, Mycobacterium
DLPGSVA

SEQ ID NO: 452211 - protein, 13 aa, Mycobacterium
DLPGTSGSSRPER

SEQ ID NO: 452212 - protein, 7 aa, Mycobacterium
DLPGTTV

SEQ ID NO: 452213 - protein, 5 aa, Mycobacterium
DLPGW

SEQ ID NO: 452214 - protein, 5 aa, Mycobacterium
DLPGY

SEQ ID NO: 452215 - protein, 5 aa, Mycobacterium
DLPHP

SEQ ID NO: 452216 - protein, 4 aa, Mycobacterium
DLPL

SEQ ID NO: 452217 - protein, 9 aa, Mycobacterium
DLPNPKRAD

SEQ ID NO: 452218 - protein, 4 aa, Mycobacterium
DLPP

SEQ ID NO: 452219 - protein, 6 aa, Mycobacterium
DLPPAA

SEQ ID NO: 452220 - protein, 61 aa, Mycobacterium
DLPPAAGPAPAKKNDKADKATDKSDKSDKADKADDAKSDDPAVIPGGPEVRPALGDPAEVA

SEQ ID NO: 452221 - protein, 14 aa, Mycobacterium
DLPPAPEPHSDEQL

SEQ ID NO: 452222 - protein, 26 aa, Mycobacterium
DLPPAPEPLSDAEVAERAGGVDGATL

SEQ ID NO: 452223 - protein, 15 aa, Mycobacterium
DLPPAPPPLSDEDVA

SEQ ID NO: 452224 - protein, 8 aa, Mycobacterium
DLPPDEPV

SEQ ID NO: 452225 - protein, 7 aa, Mycobacterium
DLPPDFP

SEQ ID NO: 452226 - protein, 9 aa, Mycobacterium
DLPPDNARK

SEQ ID NO: 452227 - protein, 6 aa, Mycobacterium
DLPPDQ

SEQ ID NO: 452228 - protein, 14 aa, Mycobacterium
DLPPDSALATEEQF

SEQ ID NO: 452229 - protein, 9 aa, Mycobacterium
DLPPEAEEL

SEQ ID NO: 452230 - protein, 9 aa, Mycobacterium
DLPPEMKSG

SEQ ID NO: 452231 - protein, 6 aa, Mycobacterium
DLPPER

SEQ ID NO: 452232 - protein, 7 aa, Mycobacterium
DLPPGGR

SEQ ID NO: 452233 - protein, 12 aa, Mycobacterium
DLPPGHKLPSEA

SEQ ID NO: 452234 - protein, 17 aa, Mycobacterium
DLPPGPGADDLDGQALG

SEQ ID NO: 452235 - protein, 6 aa, Mycobacterium
DLPPGQ

SEQ ID NO: 452236 - protein, 7 aa, Mycobacterium
DLPPGQA

SEQ ID NO: 452237 - protein, 5 aa, Mycobacterium
DLPPH

SEQ ID NO: 452238 - protein, 8 aa, Mycobacterium
DLPPIDEA

SEQ ID NO: 452239 - protein, 11 aa, Mycobacterium
DLPPIDEPDTY

SEQ ID NO: 452240 - protein, 8 aa, Mycobacterium
DLPPIEEA

SEQ ID NO: 452241 - protein, 15 aa, Mycobacterium
DLPPQLSQYPGGWGD

SEQ ID NO: 452242 - protein, 9 aa, Mycobacterium
DLPPQTTAE

SEQ ID NO: 452243 - protein, 9 aa, Mycobacterium
DLPPQTTAQ

SEQ ID NO: 452244 - protein, 6 aa, Mycobacterium
DLPPRD

SEQ ID NO: 452245 - protein, 7 aa, Mycobacterium
DLPPRDV

SEQ ID NO: 452246 - protein, 7 aa, Mycobacterium
DLPPRER

SEQ ID NO: 452247 - protein, 13 aa, Mycobacterium
DLPPRPDGSEPKT

SEQ ID NO: 452248 - protein, 5 aa, Mycobacterium
DLPPS

SEQ ID NO: 452249 - protein, 6 aa, Mycobacterium
DLPPSA

SEQ ID NO: 452250 - protein, 7 aa, Mycobacterium
DLPPSAV

SEQ ID NO: 452251 - protein, 11 aa, Mycobacterium
DLPPSSWGSGK

SEQ ID NO: 452252 - protein, 6 aa, Mycobacterium
DLPPSV

SEQ ID NO: 452253 - protein, 25 aa, Mycobacterium
DLPPVSAREKPGRRAAPSVGPAGEY

SEQ ID NO: 452254 - protein, 11 aa, Mycobacterium
DLPQPEGWNKD

SEQ ID NO: 452255 - protein, 6 aa, Mycobacterium
DLPQSP

SEQ ID NO: 452256 - protein, 9 aa, Mycobacterium
DLPRKQARL

SEQ ID NO: 452257 - protein, 11 aa, Mycobacterium
DLPRPEGWNKD

SEQ ID NO: 452258 - protein, 9 aa, Mycobacterium
DLPRTPTGK

SEQ ID NO: 452259 - protein, 5 aa, Mycobacterium
DLPSA

SEQ ID NO: 452260 - protein, 7 aa, Mycobacterium
DLPSANG

SEQ ID NO: 452261 - protein, 14 aa, Mycobacterium
DLPSDTQGALSSLR

SEQ ID NO: 452262 - protein, 25 aa, Mycobacterium
DLPSDVGSAGFTDVSSDDNPATPTG

SEQ ID NO: 452263 - protein, 7 aa, Mycobacterium
DLPSGGR

SEQ ID NO: 452264 - protein, 15 aa, Mycobacterium
DLPSGKSQIFLRVEG

SEQ ID NO: 452265 - protein, 8 aa, Mycobacterium
DLPSPDEL

SEQ ID NO: 452266 - protein, 15 aa, Mycobacterium
DLPSPVRPGTLPLAV

SEQ ID NO: 452267 - protein, 6 aa, Mycobacterium
DLPSPY

SEQ ID NO: 452268 - protein, 12 aa, Mycobacterium
DLPSRELSPNET

SEQ ID NO: 452269 - protein, 5 aa, Mycobacterium
DLPSS

SEQ ID NO: 452270 - protein, 8 aa, Mycobacterium
DLPSTATH

SEQ ID NO: 452271 - protein, 6 aa, Mycobacterium
DLPSTE

SEQ ID NO: 452272 - protein, 15 aa, Mycobacterium
DLPSTPSGRGTVPQD

SEQ ID NO: 452273 - protein, 13 aa, Mycobacterium
DLPSVTPMSIRRD

SEQ ID NO: 452274 - protein, 8 aa, Mycobacterium
DLPTAADP

SEQ ID NO: 452275 - protein, 6 aa, Mycobacterium
DLPTAD

SEQ ID NO: 452276 - protein, 11 aa, Mycobacterium
DLPTAEGDGSM

SEQ ID NO: 452277 - protein, 17 aa, Mycobacterium
DLPTAGPAYGSSTTMSV

SEQ ID NO: 452278 - protein, 9 aa, Mycobacterium
DLPTAQDPR

SEQ ID NO: 452279 - protein, 7 aa, Mycobacterium
DLPTASD

SEQ ID NO: 452280 - protein, 9 aa, Mycobacterium
DLPTDAEEW

SEQ ID NO: 452281 - protein, 13 aa, Mycobacterium
DLPTDPAARERRR

SEQ ID NO: 452282 - protein, 10 aa, Mycobacterium
DLPTDSATED

SEQ ID NO: 452283 - protein, 7 aa, Mycobacterium
DLPTDVE

SEQ ID NO: 452284 - protein, 8 aa, Mycobacterium
DLPTESGV

SEQ ID NO: 452285 - protein, 7 aa, Mycobacterium
DLPTGEV

SEQ ID NO: 452286 - protein, 7 aa, Mycobacterium
DLPTPYH

SEQ ID NO: 452287 - protein, 7 aa, Mycobacterium
DLPTQAE

SEQ ID NO: 452288 - protein, 6 aa, Mycobacterium
DLPTSE

SEQ ID NO: 452289 - protein, 9 aa, Mycobacterium
DLPTTAGFD

SEQ ID NO: 452290 - protein, 8 aa, Mycobacterium
DLPTTATN

SEQ ID NO: 452291 - protein, 4 aa, Mycobacterium
DLPV

SEQ ID NO: 452292 - protein, 10 aa, Mycobacterium
DLPVDPDPAF

SEQ ID NO: 452293 - protein, 7 aa, Mycobacterium
DLPYPRP

SEQ ID NO: 452294 - protein, 4 aa, Mycobacterium
DLQA

SEQ ID NO: 452295 - protein, 6 aa, Mycobacterium
DLQDRG

SEQ ID NO: 452296 - protein, 28 aa, Mycobacterium
DLQDSGDDDTAGDSASTSSANGQRRTEG

SEQ ID NO: 452297 - protein, 10 aa, Mycobacterium
DLQEATRRGD

SEQ ID NO: 452298 - protein, 9 aa, Mycobacterium
DLQEDKEPL

SEQ ID NO: 452299 - protein, 7 aa, Mycobacterium
DLQEEAR

SEQ ID NO: 452300 - protein, 10 aa, Mycobacterium
DLQEKADEYR

SEQ ID NO: 452301 - protein, 9 aa, Mycobacterium
DLQGSAAYR

SEQ ID NO: 452302 - protein, 11 aa, Mycobacterium
DLQPPEDETAP

SEQ ID NO: 452303 - protein, 5 aa, Mycobacterium
DLQPQ

SEQ ID NO: 452304 - protein, 6 aa, Mycobacterium
DLQPVG

SEQ ID NO: 452305 - protein, 5 aa, Mycobacterium
DLQQA

SEQ ID NO: 452306 - protein, 18 aa, Mycobacterium
DLQQARGDYPAPAGWPAD

SEQ ID NO: 452307 - protein, 5 aa, Mycobacterium
DLQSI

SEQ ID NO: 452308 - protein, 8 aa, Mycobacterium
DLQTTSAA

SEQ ID NO: 452309 - protein, 5 aa, Mycobacterium
DLRAA

SEQ ID NO: 452310 - protein, 15 aa, Mycobacterium
DLRAEPADYPPPSSY

SEQ ID NO: 452311 - protein, 17 aa, Mycobacterium
DLRAGGSVEYRMYRFVK

SEQ ID NO: 452312 - protein, 9 aa, Mycobacterium
DLRARAPRV

SEQ ID NO: 452313 - protein, 4 aa, Mycobacterium
DLRD

SEQ ID NO: 452314 - protein, 5 aa, Mycobacterium
DLRDA

SEQ ID NO: 452315 - protein, 8 aa, Mycobacterium
DLRDEPRW

SEQ ID NO: 452316 - protein, 12 aa, Mycobacterium
DLRDGVDDIPGD

SEQ ID NO: 452317 - protein, 8 aa, Mycobacterium
DLRDGVDE

SEQ ID NO: 452318 - protein, 11 aa, Mycobacterium
DLRDGVDEIPE

SEQ ID NO: 452319 - protein, 9 aa, Mycobacterium
DLRDPASAQ

SEQ ID NO: 452320 - protein, 4 aa, Mycobacterium
DLRG

SEQ ID NO: 452321 - protein, 11 aa, Mycobacterium
DLRGGGEVPEK

SEQ ID NO: 452322 - protein, 11 aa, Mycobacterium
DLRGGGPVPDK

SEQ ID NO: 452323 - protein, 7 aa, Mycobacterium
DLRGPDR

SEQ ID NO: 452324 - protein, 7 aa, Mycobacterium
DLRGPEA

SEQ ID NO: 452325 - protein, 4 aa, Mycobacterium
DLRP

SEQ ID NO: 452326 - protein, 5 aa, Mycobacterium
DLRPA

SEQ ID NO: 452327 - protein, 7 aa, Mycobacterium
DLRPARK

SEQ ID NO: 452328 - protein, 10 aa, Mycobacterium
DLRPARQAKN

SEQ ID NO: 452329 - protein, 9 aa, Mycobacterium
DLRPDADPR

SEQ ID NO: 452330 - protein, 6 aa, Mycobacterium
DLRPGN

SEQ ID NO: 452331 - protein, 19 aa, Mycobacterium
DLRPSTNHAAHRASSAPAR

SEQ ID NO: 452332 - protein, 8 aa, Mycobacterium
DLRPVTGE

SEQ ID NO: 452333 - protein, 4 aa, Mycobacterium
DLRQ

SEQ ID NO: 452334 - protein, 21 aa, Mycobacterium
DLRQRPSAYDEAREQEEFNQA

SEQ ID NO: 452335 - protein, 7 aa, Mycobacterium
DLRQTGE

SEQ ID NO: 452336 - protein, 16 aa, Mycobacterium
DLRRGSRDETIETRRH

SEQ ID NO: 452337 - protein, 5 aa, Mycobacterium
DLRRN

SEQ ID NO: 452338 - protein, 18 aa, Mycobacterium
DLRRPGRRRSSSAVALLT

SEQ ID NO: 452339 - protein, 37 aa, Mycobacterium
DLRRSQTERANRLSAAKQARLDADAAAAEAQRRQDGA

SEQ ID NO: 452340 - protein, 6 aa, Mycobacterium
DLRSAA

SEQ ID NO: 452341 - protein, 24 aa, Mycobacterium
DLRSRQAAQSAQLPASLNAATSGL

SEQ ID NO: 452342 - protein, 15 aa, Mycobacterium
DLRTDRSDASGTGYF

SEQ ID NO: 452343 - protein, 19 aa, Mycobacterium
DLRTGGGADGIAGPDRSPR

SEQ ID NO: 452344 - protein, 13 aa, Mycobacterium
DLSAEGARPLSEN

SEQ ID NO: 452345 - protein, 14 aa, Mycobacterium
DLSAEGKAAISNTT

SEQ ID NO: 452346 - protein, 9 aa, Mycobacterium
DLSAGADAL

SEQ ID NO: 452347 - protein, 7 aa, Mycobacterium
DLSANGC

SEQ ID NO: 452348 - protein, 11 aa, Mycobacterium
DLSAQNRKGLA

SEQ ID NO: 452349 - protein, 6 aa, Mycobacterium
DLSDAD

SEQ ID NO: 452350 - protein, 13 aa, Mycobacterium
DLSDDSVLPAPVD

SEQ ID NO: 452351 - protein, 8 aa, Mycobacterium
DLSDDTVE

SEQ ID NO: 452352 - protein, 8 aa, Mycobacterium
DLSDEDRA

SEQ ID NO: 452353 - protein, 14 aa, Mycobacterium
DLSDGDAASRLAGS

SEQ ID NO: 452354 - protein, 11 aa, Mycobacterium
DLSDGEVKGNE

SEQ ID NO: 452355 - protein, 9 aa, Mycobacterium
DLSDGHPPL

SEQ ID NO: 452356 - protein, 6 aa, Mycobacterium
DLSDGR

SEQ ID NO: 452357 - protein, 6 aa, Mycobacterium
DLSDQS

SEQ ID NO: 452358 - protein, 9 aa, Mycobacterium
DLSDQSPQR

SEQ ID NO: 452359 - protein, 9 aa, Mycobacterium
DLSDSDVDE

SEQ ID NO: 452360 - protein, 7 aa, Mycobacterium
DLSDTAA

SEQ ID NO: 452361 - protein, 10 aa, Mycobacterium
DLSEAGSRAE

SEQ ID NO: 452362 - protein, 13 aa, Mycobacterium
DLSEDVTKDDKTF

SEQ ID NO: 452363 - protein, 5 aa, Mycobacterium
DLSEG

SEQ ID NO: 452364 - protein, 6 aa, Mycobacterium
DLSEGG

SEQ ID NO: 452365 - protein, 19 aa, Mycobacterium
DLSEGGGAAGRSGSPPPAY

SEQ ID NO: 452366 - protein, 8 aa, Mycobacterium
DLSEHAKK

SEQ ID NO: 452367 - protein, 10 aa, Mycobacterium
DLSEKGTTIA

SEQ ID NO: 452368 - protein, 10 aa, Mycobacterium
DLSERADAAQ

SEQ ID NO: 452369 - protein, 8 aa, Mycobacterium
DLSERGKP

SEQ ID NO: 452370 - protein, 18 aa, Mycobacterium
DLSESPASGGDPAEAALG

SEQ ID NO: 452371 - protein, 11 aa, Mycobacterium
DLSESSDVAPE

SEQ ID NO: 452372 - protein, 6 aa, Mycobacterium
DLSETA

SEQ ID NO: 452373 - protein, 7 aa, Mycobacterium
DLSETDW

SEQ ID NO: 452374 - protein, 4 aa, Mycobacterium
DLSG

SEQ ID NO: 452375 - protein, 7 aa, Mycobacterium
DLSGAEL

SEQ ID NO: 452376 - protein, 16 aa, Mycobacterium
DLSGARATGARLDDAD

SEQ ID NO: 452377 - protein, 6 aa, Mycobacterium
DLSGDA

SEQ ID NO: 452378 - protein, 7 aa, Mycobacterium
DLSGDAF

SEQ ID NO: 452379 - protein, 8 aa, Mycobacterium
DLSGDPSL

SEQ ID NO: 452380 - protein, 7 aa, Mycobacterium
DLSGDTV

SEQ ID NO: 452381 - protein, 6 aa, Mycobacterium
DLSGEE

SEQ ID NO: 452382 - protein, 6 aa, Mycobacterium
DLSGER

SEQ ID NO: 452383 - protein, 10 aa, Mycobacterium
DLSGGTIKGD

SEQ ID NO: 452384 - protein, 11 aa, Mycobacterium
DLSGLGTQDGV

SEQ ID NO: 452385 - protein, 8 aa, Mycobacterium
DLSGPEPA

SEQ ID NO: 452386 - protein, 5 aa, Mycobacterium
DLSGQ

SEQ ID NO: 452387 - protein, 5 aa, Mycobacterium
DLSGT

SEQ ID NO: 452388 - protein, 9 aa, Mycobacterium
DLSGTGEPW

SEQ ID NO: 452389 - protein, 19 aa, Mycobacterium
DLSGTGEPWTKPRPSTPPF

SEQ ID NO: 452390 - protein, 8 aa, Mycobacterium
DLSGTGGM

SEQ ID NO: 452391 - protein, 20 aa, Mycobacterium
DLSGTGQPWTKATPTTPPFK

SEQ ID NO: 452392 - protein, 19 aa, Mycobacterium
DLSGTGQPWTQNKPTTPAF

SEQ ID NO: 452393 - protein, 10 aa, Mycobacterium
DLSGTRGKVT

SEQ ID NO: 452394 - protein, 4 aa, Mycobacterium
DLSI

SEQ ID NO: 452395 - protein, 11 aa, Mycobacterium
DLSKGTVKGDE

SEQ ID NO: 452396 - protein, 8 aa, Mycobacterium
DLSKPNED

SEQ ID NO: 452397 - protein, 13 aa, Mycobacterium
DLSKVDAKQPDDY

SEQ ID NO: 452398 - protein, 7 aa, Mycobacterium
DLSNPEN

SEQ ID NO: 452399 - protein, 8 aa, Mycobacterium
DLSNPGEN

SEQ ID NO: 452400 - protein, 8 aa, Mycobacterium
DLSPAEQA

SEQ ID NO: 452401 - protein, 9 aa, Mycobacterium
DLSPDTHVG

SEQ ID NO: 452402 - protein, 5 aa, Mycobacterium
DLSPE

SEQ ID NO: 452403 - protein, 10 aa, Mycobacterium
DLSPETNGTD

SEQ ID NO: 452404 - protein, 6 aa, Mycobacterium
DLSPKN

SEQ ID NO: 452405 - protein, 11 aa, Mycobacterium
DLSQGSIKGDN

SEQ ID NO: 452406 - protein, 11 aa, Mycobacterium
DLSQGTVKDDT

SEQ ID NO: 452407 - protein, 14 aa, Mycobacterium
DLSQHDSGAYTGDI

SEQ ID NO: 452408 - protein, 14 aa, Mycobacterium
DLSQHDSGAYTGEI

SEQ ID NO: 452409 - protein, 10 aa, Mycobacterium
DLSQPPPGTI

SEQ ID NO: 452410 - protein, 9 aa, Mycobacterium
DLSQSGERE

SEQ ID NO: 452411 - protein, 13 aa, Mycobacterium
DLSQSGVDLPPTF

SEQ ID NO: 452412 - protein, 17 aa, Mycobacterium
DLSRAAKDYGNKLKSVK

SEQ ID NO: 452413 - protein, 4 aa, Mycobacterium
DLSS

SEQ ID NO: 452414 - protein, 5 aa, Mycobacterium
DLSSA

SEQ ID NO: 452415 - protein, 11 aa, Mycobacterium
DLSSEGATTPI

SEQ ID NO: 452416 - protein, 12 aa, Mycobacterium
DLSSGAPDPDKF

SEQ ID NO: 452417 - protein, 7 aa, Mycobacterium
DLSSKGF

SEQ ID NO: 452418 - protein, 12 aa, Mycobacterium
DLSSLSSARDAY

SEQ ID NO: 452419 - protein, 10 aa, Mycobacterium
DLSSPANVSG

SEQ ID NO: 452420 - protein, 7 aa, Mycobacterium
DLSSQAQ

SEQ ID NO: 452421 - protein, 6 aa, Mycobacterium
DLSSTD

SEQ ID NO: 452422 - protein, 5 aa, Mycobacterium
DLSTA

SEQ ID NO: 452423 - protein, 7 aa, Mycobacterium
DLSTAAS

SEQ ID NO: 452424 - protein, 11 aa, Mycobacterium
DLSTAGDTRPQ

SEQ ID NO: 452425 - protein, 6 aa, Mycobacterium
DLSTDD

SEQ ID NO: 452426 - protein, 11 aa, Mycobacterium
DLSTEYARTGR

SEQ ID NO: 452427 - protein, 12 aa, Mycobacterium
DLSTGDQIDVPA

SEQ ID NO: 452428 - protein, 8 aa, Mycobacterium
DLSTPLEE

SEQ ID NO: 452429 - protein, 15 aa, Mycobacterium
DLSTPLKRSQDQPEH

SEQ ID NO: 452430 - protein, 6 aa, Mycobacterium
DLSTTS

SEQ ID NO: 452431 - protein, 14 aa, Mycobacterium
DLSTVENTAAQDRI

SEQ ID NO: 452432 - protein, 18 aa, Mycobacterium
DLSVETSARRSGRAPDGF

SEQ ID NO: 452433 - protein, 5 aa, Mycobacterium
DLTAG

SEQ ID NO: 452434 - protein, 5 aa, Mycobacterium
DLTAS

SEQ ID NO: 452435 - protein, 11 aa, Mycobacterium
DLTDDDELTVR

SEQ ID NO: 452436 - protein, 19 aa, Mycobacterium
DLTDDEHLGRPRTDPEVGP

SEQ ID NO: 452437 - protein, 7 aa, Mycobacterium
DLTDGLA

SEQ ID NO: 452438 - protein, 21 aa, Mycobacterium
DLTDGPDLTRADAKVAGTPVT

SEQ ID NO: 452439 - protein, 8 aa, Mycobacterium
DLTDPESA

SEQ ID NO: 452440 - protein, 13 aa, Mycobacterium
DLTDPGAARGPWT

SEQ ID NO: 452441 - protein, 8 aa, Mycobacterium
DLTDPGDI

SEQ ID NO: 452442 - protein, 7 aa, Mycobacterium
DLTDRDG

SEQ ID NO: 452443 - protein, 5 aa, Mycobacterium
DLTDT

SEQ ID NO: 452444 - protein, 9 aa, Mycobacterium
DLTEDESSE

SEQ ID NO: 452445 - protein, 7 aa, Mycobacterium
DLTEEQR

SEQ ID NO: 452446 - protein, 13 aa, Mycobacterium
DLTEEVTKGDKTF

SEQ ID NO: 452447 - protein, 5 aa, Mycobacterium
DLTEG

SEQ ID NO: 452448 - protein, 8 aa, Mycobacterium
DLTEGESR

SEQ ID NO: 452449 - protein, 6 aa, Mycobacterium
DLTEGI

SEQ ID NO: 452450 - protein, 11 aa, Mycobacterium
DLTEGLESKDI

SEQ ID NO: 452451 - protein, 7 aa, Mycobacterium
DLTERES

SEQ ID NO: 452452 - protein, 6 aa, Mycobacterium
DLTETG

SEQ ID NO: 452453 - protein, 8 aa, Mycobacterium
DLTGEAAA

SEQ ID NO: 452454 - protein, 19 aa, Mycobacterium
DLTGENGAPVRRSAGAEAA

SEQ ID NO: 452455 - protein, 19 aa, Mycobacterium
DLTGENGAPVRRSAGTEAA

SEQ ID NO: 452456 - protein, 7 aa, Mycobacterium
DLTGGRD

SEQ ID NO: 452457 - protein, 20 aa, Mycobacterium
DLTGNRAAATEGKKLAAKRR

SEQ ID NO: 452458 - protein, 20 aa, Mycobacterium
DLTGNRVTANEGRKLAAKRR

SEQ ID NO: 452459 - protein, 9 aa, Mycobacterium
DLTGPEPTI

SEQ ID NO: 452460 - protein, 8 aa, Mycobacterium
DLTGPGQR

SEQ ID NO: 452461 - protein, 8 aa, Mycobacterium
DLTGPGRY

SEQ ID NO: 452462 - protein, 16 aa, Mycobacterium
DLTGPGVPTLRSRCAP

SEQ ID NO: 452463 - protein, 6 aa, Mycobacterium
DLTGQE

SEQ ID NO: 452464 - protein, 6 aa, Mycobacterium
DLTGRP

SEQ ID NO: 452465 - protein, 16 aa, Mycobacterium
DLTGRPRFVTATRIAR

SEQ ID NO: 452466 - protein, 6 aa, Mycobacterium
DLTGSR

SEQ ID NO: 452467 - protein, 24 aa, Mycobacterium
DLTGSRVAATDGKRLPAKRRNQVD

SEQ ID NO: 452468 - protein, 11 aa, Mycobacterium
DLTGSTAPYYR

SEQ ID NO: 452469 - protein, 5 aa, Mycobacterium
DLTGT

SEQ ID NO: 452470 - protein, 6 aa, Mycobacterium
DLTKNT

SEQ ID NO: 452471 - protein, 6 aa, Mycobacterium
DLTNDP

SEQ ID NO: 452472 - protein, 6 aa, Mycobacterium
DLTNRS

SEQ ID NO: 452473 - protein, 10 aa, Mycobacterium
DLTNTAPTDV

SEQ ID NO: 452474 - protein, 4 aa, Mycobacterium
DLTP

SEQ ID NO: 452475 - protein, 7 aa, Mycobacterium
DLTPDDI

SEQ ID NO: 452476 - protein, 5 aa, Mycobacterium
DLTPE

SEQ ID NO: 452477 - protein, 9 aa, Mycobacterium
DLTPEAIGG

SEQ ID NO: 452478 - protein, 6 aa, Mycobacterium
DLTPES

SEQ ID NO: 452479 - protein, 9 aa, Mycobacterium
DLTPGPDHS

SEQ ID NO: 452480 - protein, 6 aa, Mycobacterium
DLTPGQ

SEQ ID NO: 452481 - protein, 8 aa, Mycobacterium
DLTPKNQD

SEQ ID NO: 452482 - protein, 9 aa, Mycobacterium
DLTPPEDHS

SEQ ID NO: 452483 - protein, 8 aa, Mycobacterium
DLTPQPPA

SEQ ID NO: 452484 - protein, 8 aa, Mycobacterium
DLTPQTSR

SEQ ID NO: 452485 - protein, 5 aa, Mycobacterium
DLTPR

SEQ ID NO: 452486 - protein, 15 aa, Mycobacterium
DLTPRARRAANEEDR

SEQ ID NO: 452487 - protein, 6 aa, Mycobacterium
DLTPRT

SEQ ID NO: 452488 - protein, 5 aa, Mycobacterium
DLTPT

SEQ ID NO: 452489 - protein, 10 aa, Mycobacterium
DLTQRGSPDA

SEQ ID NO: 452490 - protein, 9 aa, Mycobacterium
DLTSEGAKV

SEQ ID NO: 452491 - protein, 6 aa, Mycobacterium
DLTSRR

SEQ ID NO: 452492 - protein, 10 aa, Mycobacterium
DLTSRTGTKY

SEQ ID NO: 452493 - protein, 7 aa, Mycobacterium
DLTSSDR

SEQ ID NO: 452494 - protein, 5 aa, Mycobacterium
DLTTA

SEQ ID NO: 452495 - protein, 7 aa, Mycobacterium
DLTTANT

SEQ ID NO: 452496 - protein, 9 aa, Mycobacterium
DLTTEPGPG

SEQ ID NO: 452497 - protein, 7 aa, Mycobacterium
DLTTGDA

SEQ ID NO: 452498 - protein, 24 aa, Mycobacterium
DLTTGEQVSVPADSVAAQVLSQLR

SEQ ID NO: 452499 - protein, 6 aa, Mycobacterium
DLTTGT

SEQ ID NO: 452500 - protein, 8 aa, Mycobacterium
DLTTKAAT

SEQ ID NO: 452501 - protein, 38 aa, Mycobacterium
DLTTPPVTSPQEIPIEGGRQQSGGPGAGGNRPKGDDAW

SEQ ID NO: 452502 - protein, 23 aa, Mycobacterium
DLTTSPSTAASAAAATGGDTASI

SEQ ID NO: 452503 - protein, 23 aa, Mycobacterium
DLTTSPSTAASAAAATNGDPGSI

SEQ ID NO: 452504 - protein, 6 aa, Mycobacterium
DLTTTG

SEQ ID NO: 452505 - protein, 7 aa, Mycobacterium
DLVPGQA

SEQ ID NO: 452506 - protein, 10 aa, Mycobacterium
DLYGGNEPAR

SEQ ID NO: 452507 - protein, 6 aa, Mycobacterium
DLYPDE

SEQ ID NO: 452508 - protein, 10 aa, Mycobacterium
DMAEAKQALT

SEQ ID NO: 452509 - protein, 9 aa, Mycobacterium
DMAETKQAL

SEQ ID NO: 452510 - protein, 8 aa, Mycobacterium
DMASSTDR

SEQ ID NO: 452511 - protein, 5 aa, Mycobacterium
DMATG

SEQ ID NO: 452512 - protein, 5 aa, Mycobacterium
DMATP

SEQ ID NO: 452513 - protein, 6 aa, Mycobacterium
DMATPN

SEQ ID NO: 452514 - protein, 8 aa, Mycobacterium
DMDASAAR

SEQ ID NO: 452515 - protein, 8 aa, Mycobacterium
DMDDPRWD

SEQ ID NO: 452516 - protein, 9 aa, Mycobacterium
DMDDSDERR

SEQ ID NO: 452517 - protein, 6 aa, Mycobacterium
DMDEGT

SEQ ID NO: 452518 - protein, 13 aa, Mycobacterium
DMDGAEPATPNVA

SEQ ID NO: 452519 - protein, 6 aa, Mycobacterium
DMDGNT

SEQ ID NO: 452520 - protein, 20 aa, Mycobacterium
DMDGTGDSSVAHGPQAPSRA

SEQ ID NO: 452521 - protein, 5 aa, Mycobacterium
DMEGG

SEQ ID NO: 452522 - protein, 9 aa, Mycobacterium
DMEPAGRDL

SEQ ID NO: 452523 - protein, 24 aa, Mycobacterium
DMEPPDAGHWDDQEQTYRAGATSW

SEQ ID NO: 452524 - protein, 5 aa, Mycobacterium
DMESA

SEQ ID NO: 452525 - protein, 12 aa, Mycobacterium
DMGAETAREGRW

SEQ ID NO: 452526 - protein, 14 aa, Mycobacterium
DMGAKTGNKKAKIL

SEQ ID NO: 452527 - protein, 15 aa, Mycobacterium
DMGDHGDDLSGLDIF

SEQ ID NO: 452528 - protein, 7 aa, Mycobacterium
DMGDTTA

SEQ ID NO: 452529 - protein, 8 aa, Mycobacterium
DMGPPGDS

SEQ ID NO: 452530 - protein, 9 aa, Mycobacterium
DMGPRGGRY

SEQ ID NO: 452531 - protein, 12 aa, Mycobacterium
DMGQETAREGRW

SEQ ID NO: 452532 - protein, 5 aa, Mycobacterium
DMGRG

SEQ ID NO: 452533 - protein, 5 aa, Mycobacterium
DMGTG

SEQ ID NO: 452534 - protein, 14 aa, Mycobacterium
DMIKSGGENVASRE

SEQ ID NO: 452535 - protein, 14 aa, Mycobacterium
DMINSGGENVASRE

SEQ ID NO: 452536 - protein, 4 aa, Mycobacterium
DMKE

SEQ ID NO: 452537 - protein, 5 aa, Mycobacterium
DMLPS

SEQ ID NO: 452538 - protein, 8 aa, Mycobacterium
DMNAGGQL

SEQ ID NO: 452539 - protein, 6 aa, Mycobacterium
DMNDDT

SEQ ID NO: 452540 - protein, 10 aa, Mycobacterium
DMNGNPEATV

SEQ ID NO: 452541 - protein, 6 aa, Mycobacterium
DMPEPD

SEQ ID NO: 452542 - protein, 7 aa, Mycobacterium
DMPGELT

SEQ ID NO: 452543 - protein, 25 aa, Mycobacterium
DMPGNHPVATPTRSQAMTVWIVFAA

SEQ ID NO: 452544 - protein, 13 aa, Mycobacterium
DMPGPDGKPAGRY

SEQ ID NO: 452545 - protein, 16 aa, Mycobacterium
DMPGQPGGLRPQRGQR

SEQ ID NO: 452546 - protein, 5 aa, Mycobacterium
DMPGS

SEQ ID NO: 452547 - protein, 5 aa, Mycobacterium
DMPPG

SEQ ID NO: 452548 - protein, 7 aa, Mycobacterium
DMPPIPP

SEQ ID NO: 452549 - protein, 6 aa, Mycobacterium
DMPQPD

SEQ ID NO: 452550 - protein, 6 aa, Mycobacterium
DMPSGS

SEQ ID NO: 452551 - protein, 7 aa, Mycobacterium
DMPTTCG

SEQ ID NO: 452552 - protein, 5 aa, Mycobacterium
DMQQR

SEQ ID NO: 452553 - protein, 8 aa, Mycobacterium
DMRTDSPL

SEQ ID NO: 452554 - protein, 6 aa, Mycobacterium
DMSAHD

SEQ ID NO: 452555 - protein, 23 aa, Mycobacterium
DMSDADPFDSPTHSDFSASPVQP

SEQ ID NO: 452556 - protein, 6 aa, Mycobacterium
DMSGGR

SEQ ID NO: 452557 - protein, 22 aa, Mycobacterium
DMSGTDPSADGRNLSPQRTDGK

SEQ ID NO: 452558 - protein, 5 aa, Mycobacterium
DMSTL

SEQ ID NO: 452559 - protein, 16 aa, Mycobacterium
DMSTSPGDGDLQSTPS

SEQ ID NO: 452560 - protein, 12 aa, Mycobacterium
DMTATDAKGELT

SEQ ID NO: 452561 - protein, 5 aa, Mycobacterium
DMTEM

SEQ ID NO: 452562 - protein, 17 aa, Mycobacterium
DMTGAGNQIEGAGPALP

SEQ ID NO: 452563 - protein, 4 aa, Mycobacterium
DMTP

SEQ ID NO: 452564 - protein, 9 aa, Mycobacterium
DMTPEEEEA

SEQ ID NO: 452565 - protein, 5 aa, Mycobacterium
DMYPN

SEQ ID NO: 452566 - protein, 4 aa, Mycobacterium
DNAA

SEQ ID NO: 452567 - protein, 7 aa, Mycobacterium
DNAAALP

SEQ ID NO: 452568 - protein, 8 aa, Mycobacterium
DNAAKRLD

SEQ ID NO: 452569 - protein, 5 aa, Mycobacterium
DNAAL

SEQ ID NO: 452570 - protein, 40 aa, Mycobacterium
DNAALAAANDDLQATNRSLRNAAKATARSTRATRVAAGGE

SEQ ID NO: 452571 - protein, 8 aa, Mycobacterium
DNAAPAHP

SEQ ID NO: 452572 - protein, 5 aa, Mycobacterium
DNAAR

SEQ ID NO: 452573 - protein, 12 aa, Mycobacterium
DNADDAPETRSE

SEQ ID NO: 452574 - protein, 9 aa, Mycobacterium
DNADDATRR

SEQ ID NO: 452575 - protein, 12 aa, Mycobacterium
DNADNAPETRSE

SEQ ID NO: 452576 - protein, 7 aa, Mycobacterium
DNADSAR

SEQ ID NO: 452577 - protein, 5 aa, Mycobacterium
DNAEA

SEQ ID NO: 452578 - protein, 5 aa, Mycobacterium
DNAEE

SEQ ID NO: 452579 - protein, 21 aa, Mycobacterium
DNAERARTSSVRGWARMPVLA

SEQ ID NO: 452580 - protein, 18 aa, Mycobacterium
DNAERQRLRGDGVGAGCA

SEQ ID NO: 452581 - protein, 8 aa, Mycobacterium
DNAETRVK

SEQ ID NO: 452582 - protein, 7 aa, Mycobacterium
DNAEVDE

SEQ ID NO: 452583 - protein, 5 aa, Mycobacterium
DNAFD

SEQ ID NO: 452584 - protein, 6 aa, Mycobacterium
DNAFRA

SEQ ID NO: 452585 - protein, 7 aa, Mycobacterium
DNAGEQR

SEQ ID NO: 452586 - protein, 6 aa, Mycobacterium
DNAGFN

SEQ ID NO: 452587 - protein, 8 aa, Mycobacterium
DNAGGGAV

SEQ ID NO: 452588 - protein, 5 aa, Mycobacterium
DNAGN

SEQ ID NO: 452589 - protein, 13 aa, Mycobacterium
DNAGNISKRQSAT

SEQ ID NO: 452590 - protein, 8 aa, Mycobacterium
DNAGPDER

SEQ ID NO: 452591 - protein, 7 aa, Mycobacterium
DNAGTAR

SEQ ID NO: 452592 - protein, 14 aa, Mycobacterium
DNAGTDTLPAEPSA

SEQ ID NO: 452593 - protein, 8 aa, Mycobacterium
DNAGYPEQ

SEQ ID NO: 452594 - protein, 4 aa, Mycobacterium
DNAH

SEQ ID NO: 452595 - protein, 7 aa, Mycobacterium
DNAHANG

SEQ ID NO: 452596 - protein, 21 aa, Mycobacterium
DNAHRAPTATVRGWDSMPAIV

SEQ ID NO: 452597 - protein, 8 aa, Mycobacterium
DNAIPTRE

SEQ ID NO: 452598 - protein, 4 aa, Mycobacterium
DNAL

SEQ ID NO: 452599 - protein, 7 aa, Mycobacterium
DNANKPI

SEQ ID NO: 452600 - protein, 6 aa, Mycobacterium
DNAPAE

SEQ ID NO: 452601 - protein, 10 aa, Mycobacterium
DNAPEEKARG

SEQ ID NO: 452602 - protein, 9 aa, Mycobacterium
DNAPPSRPI

SEQ ID NO: 452603 - protein, 9 aa, Mycobacterium
DNAPRGDGF

SEQ ID NO: 452604 - protein, 5 aa, Mycobacterium
DNAPV

SEQ ID NO: 452605 - protein, 11 aa, Mycobacterium
DNAPYDPAAAE

SEQ ID NO: 452606 - protein, 6 aa, Mycobacterium
DNAQLQ

SEQ ID NO: 452607 - protein, 8 aa, Mycobacterium
DNAQRQEL

SEQ ID NO: 452608 - protein, 7 aa, Mycobacterium
DNAQSNE

SEQ ID NO: 452609 - protein, 6 aa, Mycobacterium
DNARAT

SEQ ID NO: 452610 - protein, 13 aa, Mycobacterium
DNARFGEAPLDQT

SEQ ID NO: 452611 - protein, 9 aa, Mycobacterium
DNARSSRFR

SEQ ID NO: 452612 - protein, 5 aa, Mycobacterium
DNASE

SEQ ID NO: 452613 - protein, 12 aa, Mycobacterium
DNASRARTSSVR

SEQ ID NO: 452614 - protein, 9 aa, Mycobacterium
DNASSGRYL

SEQ ID NO: 452615 - protein, 5 aa, Mycobacterium
DNASV

SEQ ID NO: 452616 - protein, 6 aa, Mycobacterium
DNATAA

SEQ ID NO: 452617 - protein, 14 aa, Mycobacterium
DNATAAPGVTDAIE

SEQ ID NO: 452618 - protein, 4 aa, Mycobacterium
DNAV

SEQ ID NO: 452619 - protein, 13 aa, Mycobacterium
DNDAGGGGQEPAL

SEQ ID NO: 452620 - protein, 9 aa, Mycobacterium
DNDAGVQAG

SEQ ID NO: 452621 - protein, 5 aa, Mycobacterium
DNDAI

SEQ ID NO: 452622 - protein, 6 aa, Mycobacterium
DNDAPH

SEQ ID NO: 452623 - protein, 6 aa, Mycobacterium
DNDAVD

SEQ ID NO: 452624 - protein, 4 aa, Mycobacterium
DNDE

SEQ ID NO: 452625 - protein, 11 aa, Mycobacterium
DNDELSAEADV

SEQ ID NO: 452626 - protein, 16 aa, Mycobacterium
DNDETGAGAATPAADD

SEQ ID NO: 452627 - protein, 4 aa, Mycobacterium
DNDG

SEQ ID NO: 452628 - protein, 5 aa, Mycobacterium
DNDGD

SEQ ID NO: 452629 - protein, 49 aa, Mycobacterium
DNDGLREEGRAQQDKAEAERDVAKKEAEAEAARAAASAAEARQESAESA

SEQ ID NO: 452630 - protein, 8 aa, Mycobacterium
DNDGPQTC

SEQ ID NO: 452631 - protein, 9 aa, Mycobacterium
DNDGRPETY

SEQ ID NO: 452632 - protein, 18 aa, Mycobacterium
DNDGTAESYFTDDGSGTW

SEQ ID NO: 452633 - protein, 9 aa, Mycobacterium
DNDGTAGLA

SEQ ID NO: 452634 - protein, 9 aa, Mycobacterium
DNDGTDDQA

SEQ ID NO: 452635 - protein, 9 aa, Mycobacterium
DNDGTPEAY

SEQ ID NO: 452636 - protein, 9 aa, Mycobacterium
DNDKANMEY

SEQ ID NO: 452637 - protein, 4 aa, Mycobacterium
DNDL

SEQ ID NO: 452638 - protein, 9 aa, Mycobacterium
DNDLAAGAG

SEQ ID NO: 452639 - protein, 15 aa, Mycobacterium
DNDLRDGVDAVPSDI

SEQ ID NO: 452640 - protein, 12 aa, Mycobacterium
DNDMHDGSVAAG

SEQ ID NO: 452641 - protein, 12 aa, Mycobacterium
DNDMQAPPAPGG

SEQ ID NO: 452642 - protein, 4 aa, Mycobacterium
DNDP

SEQ ID NO: 452643 - protein, 6 aa, Mycobacterium
DNDPAR

SEQ ID NO: 452644 - protein, 8 aa, Mycobacterium
DNDPASYE

SEQ ID NO: 452645 - protein, 6 aa, Mycobacterium
DNDPGI

SEQ ID NO: 452646 - protein, 7 aa, Mycobacterium
DNDPGLP

SEQ ID NO: 452647 - protein, 7 aa, Mycobacterium
DNDPHAK

SEQ ID NO: 452648 - protein, 6 aa, Mycobacterium
DNDPQF

SEQ ID NO: 452649 - protein, 8 aa, Mycobacterium
DNDPRGTR

SEQ ID NO: 452650 - protein, 9 aa, Mycobacterium
DNDREATGR

SEQ ID NO: 452651 - protein, 10 aa, Mycobacterium
DNDSARRTPD

SEQ ID NO: 452652 - protein, 15 aa, Mycobacterium
DNDSEPRVEVPQPTG

SEQ ID NO: 452653 - protein, 12 aa, Mycobacterium
DNDSPDDEPGEP

SEQ ID NO: 452654 - protein, 5 aa, Mycobacterium
DNDSV

SEQ ID NO: 452655 - protein, 6 aa, Mycobacterium
DNDTLN

SEQ ID NO: 452656 - protein, 6 aa, Mycobacterium
DNDTMA

SEQ ID NO: 452657 - protein, 7 aa, Mycobacterium
DNDTTYG

SEQ ID NO: 452658 - protein, 4 aa, Mycobacterium
DNDV

SEQ ID NO: 452659 - protein, 13 aa, Mycobacterium
DNDVPGATDRDRA

SEQ ID NO: 452660 - protein, 6 aa, Mycobacterium
DNEAEP

SEQ ID NO: 452661 - protein, 17 aa, Mycobacterium
DNEAGTGAAIAESGIPR

SEQ ID NO: 452662 - protein, 5 aa, Mycobacterium
DNEAI

SEQ ID NO: 452663 - protein, 5 aa, Mycobacterium
DNEAR

SEQ ID NO: 452664 - protein, 6 aa, Mycobacterium
DNEAVD

SEQ ID NO: 452665 - protein, 7 aa, Mycobacterium
DNEDAGA

SEQ ID NO: 452666 - protein, 15 aa, Mycobacterium
DNEDAVDPHDQARQL

SEQ ID NO: 452667 - protein, 9 aa, Mycobacterium
DNEDQNDLI

SEQ ID NO: 452668 - protein, 17 aa, Mycobacterium
DNEDQNDLIGTSRANAA

SEQ ID NO: 452669 - protein, 17 aa, Mycobacterium
DNEDQNDLMGTSRANAA

SEQ ID NO: 452670 - protein, 9 aa, Mycobacterium
DNEDSRKPV

SEQ ID NO: 452671 - protein, 4 aa, Mycobacterium
DNEE

SEQ ID NO: 452672 - protein, 6 aa, Mycobacterium
DNEEIE

SEQ ID NO: 452673 - protein, 6 aa, Mycobacterium
DNEFDS

SEQ ID NO: 452674 - protein, 11 aa, Mycobacterium
DNEFKSASLRG

SEQ ID NO: 452675 - protein, 4 aa, Mycobacterium
DNEG

SEQ ID NO: 452676 - protein, 11 aa, Mycobacterium
DNEGLAETERQ

SEQ ID NO: 452677 - protein, 12 aa, Mycobacterium
DNEGLAETERQI

SEQ ID NO: 452678 - protein, 6 aa, Mycobacterium
DNEHDE

SEQ ID NO: 452679 - protein, 7 aa, Mycobacterium
DNEHEDI

SEQ ID NO: 452680 - protein, 4 aa, Mycobacterium
DNEP

SEQ ID NO: 452681 - protein, 7 aa, Mycobacterium
DNEPAVP

SEQ ID NO: 452682 - protein, 10 aa, Mycobacterium
DNEPENADAT

SEQ ID NO: 452683 - protein, 6 aa, Mycobacterium
DNEQLR

SEQ ID NO: 452684 - protein, 5 aa, Mycobacterium
DNERL

SEQ ID NO: 452685 - protein, 5 aa, Mycobacterium
DNERP

SEQ ID NO: 452686 - protein, 7 aa, Mycobacterium
DNERPGH

SEQ ID NO: 452687 - protein, 17 aa, Mycobacterium
DNESQNDLMGTSRANAA

SEQ ID NO: 452688 - protein, 9 aa, Mycobacterium
DNESQNNLM

SEQ ID NO: 452689 - protein, 10 aa, Mycobacterium
DNESTALQRQ

SEQ ID NO: 452690 - protein, 6 aa, Mycobacterium
DNETAR

SEQ ID NO: 452691 - protein, 13 aa, Mycobacterium
DNEVPGATDRDRA

SEQ ID NO: 452692 - protein, 14 aa, Mycobacterium
DNEVPGATDRDRGY

SEQ ID NO: 452693 - protein, 5 aa, Mycobacterium
DNEVV

SEQ ID NO: 452694 - protein, 33 aa, Mycobacterium
DNFGNIPPARYTQKNGTPGPDEETLATGDSGKR

SEQ ID NO: 452695 - protein, 7 aa, Mycobacterium
DNFTAEE

SEQ ID NO: 452696 - protein, 10 aa, Mycobacterium
DNFTQTSDQE

SEQ ID NO: 452697 - protein, 19 aa, Mycobacterium
DNGAACNSWPDGGNHPFAR

SEQ ID NO: 452698 - protein, 13 aa, Mycobacterium
DNGADGAEVPEGI

SEQ ID NO: 452699 - protein, 15 aa, Mycobacterium
DNGAEDHLAGRGTAG

SEQ ID NO: 452700 - protein, 8 aa, Mycobacterium
DNGARSLT

SEQ ID NO: 452701 - protein, 15 aa, Mycobacterium
DNGASGEGGPNGSFN

SEQ ID NO: 452702 - protein, 15 aa, Mycobacterium
DNGASGEGGPNGSVN

SEQ ID NO: 452703 - protein, 8 aa, Mycobacterium
DNGATEVF

SEQ ID NO: 452704 - protein, 9 aa, Mycobacterium
DNGDGTSVE

SEQ ID NO: 452705 - protein, 9 aa, Mycobacterium
DNGDPGAQE

SEQ ID NO: 452706 - protein, 11 aa, Mycobacterium
DNGDTGYPYGT

SEQ ID NO: 452707 - protein, 14 aa, Mycobacterium
DNGEALPNDGQAVG

SEQ ID NO: 452708 - protein, 11 aa, Mycobacterium
DNGEAPAGASA

SEQ ID NO: 452709 - protein, 6 aa, Mycobacterium
DNGEGI

SEQ ID NO: 452710 - protein, 18 aa, Mycobacterium
DNGFGGGGFSGGSNSAEF

SEQ ID NO: 452711 - protein, 10 aa, Mycobacterium
DNGGAVETSS

SEQ ID NO: 452712 - protein, 6 aa, Mycobacterium
DNGGGH

SEQ ID NO: 452713 - protein, 11 aa, Mycobacterium
DNGGHGGVGSA

SEQ ID NO: 452714 - protein, 5 aa, Mycobacterium
DNGHM

SEQ ID NO: 452715 - protein, 9 aa, Mycobacterium
DNGHTSAPL

SEQ ID NO: 452716 - protein, 9 aa, Mycobacterium
DNGKPIRET

SEQ ID NO: 452717 - protein, 5 aa, Mycobacterium
DNGLD

SEQ ID NO: 452718 - protein, 7 aa, Mycobacterium
DNGLTEV

SEQ ID NO: 452719 - protein, 5 aa, Mycobacterium
DNGMT

SEQ ID NO: 452720 - protein, 13 aa, Mycobacterium
DNGNDLPHDGKSV

SEQ ID NO: 452721 - protein, 6 aa, Mycobacterium
DNGPET

SEQ ID NO: 452722 - protein, 5 aa, Mycobacterium
DNGPM

SEQ ID NO: 452723 - protein, 7 aa, Mycobacterium
DNGPQTY

SEQ ID NO: 452724 - protein, 15 aa, Mycobacterium
DNGPWPSTPPKERAT

SEQ ID NO: 452725 - protein, 10 aa, Mycobacterium
DNGQAHASGT

SEQ ID NO: 452726 - protein, 5 aa, Mycobacterium
DNGQE

SEQ ID NO: 452727 - protein, 4 aa, Mycobacterium
DNGR

SEQ ID NO: 452728 - protein, 13 aa, Mycobacterium
DNGRGGWGGWGGP

SEQ ID NO: 452729 - protein, 16 aa, Mycobacterium
DNGRGMPKTYTSSGLT

SEQ ID NO: 452730 - protein, 8 aa, Mycobacterium
DNGRPKQV

SEQ ID NO: 452731 - protein, 15 aa, Mycobacterium
DNGRRISEGLRGPRR

SEQ ID NO: 452732 - protein, 6 aa, Mycobacterium
DNGSAY

SEQ ID NO: 452733 - protein, 5 aa, Mycobacterium
DNGSC

SEQ ID NO: 452734 - protein, 6 aa, Mycobacterium
DNGSDR

SEQ ID NO: 452735 - protein, 8 aa, Mycobacterium
DNGSGPAI

SEQ ID NO: 452736 - protein, 17 aa, Mycobacterium
DNGSTDGAPEAAAEEPD

SEQ ID NO: 452737 - protein, 12 aa, Mycobacterium
DNGSTDGTPQAA

SEQ ID NO: 452738 - protein, 13 aa, Mycobacterium
DNGSTDGTPQAAV

SEQ ID NO: 452739 - protein, 4 aa, Mycobacterium
DNGT

SEQ ID NO: 452740 - protein, 8 aa, Mycobacterium
DNGTASPL

SEQ ID NO: 452741 - protein, 5 aa, Mycobacterium
DNGTH

SEQ ID NO: 452742 - protein, 14 aa, Mycobacterium
DNGVDRLEATRESE

SEQ ID NO: 452743 - protein, 11 aa, Mycobacterium
DNGVNGGIGSA

SEQ ID NO: 452744 - protein, 12 aa, Mycobacterium
DNGVNGGVGSAV

SEQ ID NO: 452745 - protein, 6 aa, Mycobacterium
DNHGDA

SEQ ID NO: 452746 - protein, 12 aa, Mycobacterium
DNHGSDHDVTGE

SEQ ID NO: 452747 - protein, 4 aa, Mycobacterium
DNHP

SEQ ID NO: 452748 - protein, 6 aa, Mycobacterium
DNHPDL

SEQ ID NO: 452749 - protein, 14 aa, Mycobacterium
DNHTADDERVRRFL

SEQ ID NO: 452750 - protein, 8 aa, Mycobacterium
DNIAGPDE

SEQ ID NO: 452751 - protein, 8 aa, Mycobacterium
DNIDTPDK

SEQ ID NO: 452752 - protein, 4 aa, Mycobacterium
DNIG

SEQ ID NO: 452753 - protein, 5 aa, Mycobacterium
DNIPD

SEQ ID NO: 452754 - protein, 6 aa, Mycobacterium
DNIPPG

SEQ ID NO: 452755 - protein, 8 aa, Mycobacterium
DNIPPGPS

SEQ ID NO: 452756 - protein, 16 aa, Mycobacterium
DNISTDEISPAGARAL

SEQ ID NO: 452757 - protein, 9 aa, Mycobacterium
DNISTGADG

SEQ ID NO: 452758 - protein, 7 aa, Mycobacterium
DNITDKD

SEQ ID NO: 452759 - protein, 7 aa, Mycobacterium
DNKATRD

SEQ ID NO: 452760 - protein, 7 aa, Mycobacterium
DNKEETL

SEQ ID NO: 452761 - protein, 5 aa, Mycobacterium
DNKEF

SEQ ID NO: 452762 - protein, 22 aa, Mycobacterium
DNKIPNSKEASMSKAKAGRMAS

SEQ ID NO: 452763 - protein, 7 aa, Mycobacterium
DNKNITG

SEQ ID NO: 452764 - protein, 9 aa, Mycobacterium
DNKNRAAGE

SEQ ID NO: 452765 - protein, 8 aa, Mycobacterium
DNKPPRYF

SEQ ID NO: 452766 - protein, 7 aa, Mycobacterium
DNKPVDL

SEQ ID NO: 452767 - protein, 17 aa, Mycobacterium
DNKQVELGEHSDDPAYV

SEQ ID NO: 452768 - protein, 6 aa, Mycobacterium
DNKRAD

SEQ ID NO: 452769 - protein, 10 aa, Mycobacterium
DNKSAPFAGG

SEQ ID NO: 452770 - protein, 10 aa, Mycobacterium
DNKSTSFAGG

SEQ ID NO: 452771 - protein, 5 aa, Mycobacterium
DNKTT

SEQ ID NO: 452772 - protein, 8 aa, Mycobacterium
DNLAGSSE

SEQ ID NO: 452773 - protein, 7 aa, Mycobacterium
DNLAHPK

SEQ ID NO: 452774 - protein, 9 aa, Mycobacterium
DNLGGSTEI

SEQ ID NO: 452775 - protein, 6 aa, Mycobacterium
DNLGRP

SEQ ID NO: 452776 - protein, 13 aa, Mycobacterium
DNLKSANNSEEVR

SEQ ID NO: 452777 - protein, 4 aa, Mycobacterium
DNLP

SEQ ID NO: 452778 - protein, 6 aa, Mycobacterium
DNLPAE

SEQ ID NO: 452779 - protein, 7 aa, Mycobacterium
DNLPAER

SEQ ID NO: 452780 - protein, 8 aa, Mycobacterium
DNLPSYHR

SEQ ID NO: 452781 - protein, 7 aa, Mycobacterium
DNLSAER

SEQ ID NO: 452782 - protein, 9 aa, Mycobacterium
DNLSGSPEI

SEQ ID NO: 452783 - protein, 9 aa, Mycobacterium
DNLSNAKGD

SEQ ID NO: 452784 - protein, 9 aa, Mycobacterium
DNLSTGAEG

SEQ ID NO: 452785 - protein, 7 aa, Mycobacterium
DNLTEED

SEQ ID NO: 452786 - protein, 33 aa, Mycobacterium
DNLTERPAALDEAREAQARAAEERRRAHSAAEH

SEQ ID NO: 452787 - protein, 4 aa, Mycobacterium
DNMG

SEQ ID NO: 452788 - protein, 12 aa, Mycobacterium
DNMRPDSSAEKL

SEQ ID NO: 452789 - protein, 8 aa, Mycobacterium
DNNADDVA

SEQ ID NO: 452790 - protein, 5 aa, Mycobacterium
DNNAY

SEQ ID NO: 452791 - protein, 7 aa, Mycobacterium
DNNDDAE

SEQ ID NO: 452792 - protein, 9 aa, Mycobacterium
DNNDLDDAA

SEQ ID NO: 452793 - protein, 8 aa, Mycobacterium
DNNDTTYG

SEQ ID NO: 452794 - protein, 6 aa, Mycobacterium
DNNDVE

SEQ ID NO: 452795 - protein, 10 aa, Mycobacterium
DNNGANPHVN

SEQ ID NO: 452796 - protein, 7 aa, Mycobacterium
DNNGGFP

SEQ ID NO: 452797 - protein, 8 aa, Mycobacterium
DNNGPVTR

SEQ ID NO: 452798 - protein, 10 aa, Mycobacterium
DNNGTRPDRR

SEQ ID NO: 452799 - protein, 4 aa, Mycobacterium
DNNI

SEQ ID NO: 452800 - protein, 22 aa, Mycobacterium
DNNIPNSKEASMSKAKAGRMAS

SEQ ID NO: 452801 - protein, 9 aa, Mycobacterium
DNNISQTPV

SEQ ID NO: 452802 - protein, 6 aa, Mycobacterium
DNNREA

SEQ ID NO: 452803 - protein, 7 aa, Mycobacterium
DNNRGSV

SEQ ID NO: 452804 - protein, 6 aa, Mycobacterium
DNNVSP

SEQ ID NO: 452805 - protein, 4 aa, Mycobacterium
DNPA

SEQ ID NO: 452806 - protein, 9 aa, Mycobacterium
DNPAARPLG

SEQ ID NO: 452807 - protein, 14 aa, Mycobacterium
DNPADPDADGVANV

SEQ ID NO: 452808 - protein, 7 aa, Mycobacterium
DNPAGTG

SEQ ID NO: 452809 - protein, 12 aa, Mycobacterium
DNPAPAYDELTP

SEQ ID NO: 452810 - protein, 14 aa, Mycobacterium
DNPAPTDEEIREGL

SEQ ID NO: 452811 - protein, 13 aa, Mycobacterium
DNPAPTDTEIREG

SEQ ID NO: 452812 - protein, 6 aa, Mycobacterium
DNPARL

SEQ ID NO: 452813 - protein, 8 aa, Mycobacterium
DNPASATE

SEQ ID NO: 452814 - protein, 16 aa, Mycobacterium
DNPASNVKPPRRPRTR

SEQ ID NO: 452815 - protein, 8 aa, Mycobacterium
DNPASRIA

SEQ ID NO: 452816 - protein, 6 aa, Mycobacterium
DNPDAA

SEQ ID NO: 452817 - protein, 10 aa, Mycobacterium
DNPDAAAEYQ

SEQ ID NO: 452818 - protein, 16 aa, Mycobacterium
DNPDAPSSHAAPKGRR

SEQ ID NO: 452819 - protein, 11 aa, Mycobacterium
DNPDDPNAEGV

SEQ ID NO: 452820 - protein, 6 aa, Mycobacterium
DNPDEI

SEQ ID NO: 452821 - protein, 6 aa, Mycobacterium
DNPDGP

SEQ ID NO: 452822 - protein, 12 aa, Mycobacterium
DNPDHPVPDGGF

SEQ ID NO: 452823 - protein, 14 aa, Mycobacterium
DNPDPSDEEIREGL

SEQ ID NO: 452824 - protein, 13 aa, Mycobacterium
DNPDPTDEQIREG

SEQ ID NO: 452825 - protein, 5 aa, Mycobacterium
DNPDQ

SEQ ID NO: 452826 - protein, 6 aa, Mycobacterium
DNPDRI

SEQ ID NO: 452827 - protein, 8 aa, Mycobacterium
DNPDRLRS

SEQ ID NO: 452828 - protein, 12 aa, Mycobacterium
DNPDTKTTQSAR

SEQ ID NO: 452829 - protein, 20 aa, Mycobacterium
DNPDVANGQAYNAGDDDQYT

SEQ ID NO: 452830 - protein, 12 aa, Mycobacterium
DNPDVEKLQQRA

SEQ ID NO: 452831 - protein, 7 aa, Mycobacterium
DNPDVQV

SEQ ID NO: 452832 - protein, 7 aa, Mycobacterium
DNPDYCS

SEQ ID NO: 452833 - protein, 26 aa, Mycobacterium
DNPDYEPDPSGSIGARARARGVNPME

SEQ ID NO: 452834 - protein, 12 aa, Mycobacterium
DNPEAAEEIGKQ

SEQ ID NO: 452835 - protein, 8 aa, Mycobacterium
DNPEEAAA

SEQ ID NO: 452836 - protein, 19 aa, Mycobacterium
DNPEERWTPPVGPIDPEHP

SEQ ID NO: 452837 - protein, 6 aa, Mycobacterium
DNPELG

SEQ ID NO: 452838 - protein, 7 aa, Mycobacterium
DNPERVT

SEQ ID NO: 452839 - protein, 5 aa, Mycobacterium
DNPEV

SEQ ID NO: 452840 - protein, 6 aa, Mycobacterium
DNPFQG

SEQ ID NO: 452841 - protein, 19 aa, Mycobacterium
DNPGAPSKRELYDAVLRSR

SEQ ID NO: 452842 - protein, 7 aa, Mycobacterium
DNPGEVH

SEQ ID NO: 452843 - protein, 6 aa, Mycobacterium
DNPGFS

SEQ ID NO: 452844 - protein, 12 aa, Mycobacterium
DNPGIEESAAKL

SEQ ID NO: 452845 - protein, 6 aa, Mycobacterium
DNPGRL

SEQ ID NO: 452846 - protein, 8 aa, Mycobacterium
DNPGYDAD

SEQ ID NO: 452847 - protein, 4 aa, Mycobacterium
DNPH

SEQ ID NO: 452848 - protein, 8 aa, Mycobacterium
DNPKLRAT

SEQ ID NO: 452849 - protein, 4 aa, Mycobacterium
DNPL

SEQ ID NO: 452850 - protein, 5 aa, Mycobacterium
DNPLD

SEQ ID NO: 452851 - protein, 9 aa, Mycobacterium
DNPLPPGKV

SEQ ID NO: 452852 - protein, 6 aa, Mycobacterium
DNPLTT

SEQ ID NO: 452853 - protein, 4 aa, Mycobacterium
DNPN

SEQ ID NO: 452854 - protein, 7 aa, Mycobacterium
DNPNGSL

SEQ ID NO: 452855 - protein, 14 aa, Mycobacterium
DNPNNGLPYTIPFD

SEQ ID NO: 452856 - protein, 5 aa, Mycobacterium
DNPNR

SEQ ID NO: 452857 - protein, 5 aa, Mycobacterium
DNPPI

SEQ ID NO: 452858 - protein, 6 aa, Mycobacterium
DNPQPF

SEQ ID NO: 452859 - protein, 12 aa, Mycobacterium
DNPQPSDDQIRE

SEQ ID NO: 452860 - protein, 7 aa, Mycobacterium
DNPQQTK

SEQ ID NO: 452861 - protein, 4 aa, Mycobacterium
DNPR

SEQ ID NO: 452862 - protein, 8 aa, Mycobacterium
DNPRAAAA

SEQ ID NO: 452863 - protein, 5 aa, Mycobacterium
DNPRP

SEQ ID NO: 452864 - protein, 7 aa, Mycobacterium
DNPRPGI

SEQ ID NO: 452865 - protein, 7 aa, Mycobacterium
DNPRPGL

SEQ ID NO: 452866 - protein, 7 aa, Mycobacterium
DNPRPGV

SEQ ID NO: 452867 - protein, 17 aa, Mycobacterium
DNPRRYDPTTSGDHLTS

SEQ ID NO: 452868 - protein, 5 aa, Mycobacterium
DNPRS

SEQ ID NO: 452869 - protein, 6 aa, Mycobacterium
DNPRSL

SEQ ID NO: 452870 - protein, 8 aa, Mycobacterium
DNPRTREQ

SEQ ID NO: 452871 - protein, 6 aa, Mycobacterium
DNPSLA

SEQ ID NO: 452872 - protein, 9 aa, Mycobacterium
DNPSRRYRA

SEQ ID NO: 452873 - protein, 7 aa, Mycobacterium
DNPSWNG

SEQ ID NO: 452874 - protein, 5 aa, Mycobacterium
DNPTA

SEQ ID NO: 452875 - protein, 8 aa, Mycobacterium
DNPTGTYS

SEQ ID NO: 452876 - protein, 6 aa, Mycobacterium
DNPTKK

SEQ ID NO: 452877 - protein, 7 aa, Mycobacterium
DNPTKTV

SEQ ID NO: 452878 - protein, 10 aa, Mycobacterium
DNPTSSALTQ

SEQ ID NO: 452879 - protein, 7 aa, Mycobacterium
DNPTTKI

SEQ ID NO: 452880 - protein, 17 aa, Mycobacterium
DNPTVSSIAGEYGKTAS

SEQ ID NO: 452881 - protein, 12 aa, Mycobacterium
DNPTYDEGAAQR

SEQ ID NO: 452882 - protein, 4 aa, Mycobacterium
DNPV

SEQ ID NO: 452883 - protein, 7 aa, Mycobacterium
DNPVARE

SEQ ID NO: 452884 - protein, 5 aa, Mycobacterium
DNPVN

SEQ ID NO: 452885 - protein, 7 aa, Mycobacterium
DNPVPAD

SEQ ID NO: 452886 - protein, 18 aa, Mycobacterium
DNPVPSPRRGQGLRQSQR

SEQ ID NO: 452887 - protein, 7 aa, Mycobacterium
DNPVQAE

SEQ ID NO: 452888 - protein, 4 aa, Mycobacterium
DNPY

SEQ ID NO: 452889 - protein, 7 aa, Mycobacterium
DNPYSGA

SEQ ID NO: 452890 - protein, 6 aa, Mycobacterium
DNQAAL

SEQ ID NO: 452891 - protein, 5 aa, Mycobacterium
DNQGQ

SEQ ID NO: 452892 - protein, 4 aa, Mycobacterium
DNQI

SEQ ID NO: 452893 - protein, 13 aa, Mycobacterium
DNQKGSADTPLED

SEQ ID NO: 452894 - protein, 10 aa, Mycobacterium
DNQKTRPTSY

SEQ ID NO: 452895 - protein, 6 aa, Mycobacterium
DNQLQG

SEQ ID NO: 452896 - protein, 8 aa, Mycobacterium
DNQNPTGM

SEQ ID NO: 452897 - protein, 7 aa, Mycobacterium
DNQPGGI

SEQ ID NO: 452898 - protein, 9 aa, Mycobacterium
DNQRGAPPQ

SEQ ID NO: 452899 - protein, 10 aa, Mycobacterium
DNQSRRQTSF

SEQ ID NO: 452900 - protein, 5 aa, Mycobacterium
DNQVG

SEQ ID NO: 452901 - protein, 4 aa, Mycobacterium
DNRA

SEQ ID NO: 452902 - protein, 7 aa, Mycobacterium
DNRADGS

SEQ ID NO: 452903 - protein, 6 aa, Mycobacterium
DNRAPV

SEQ ID NO: 452904 - protein, 5 aa, Mycobacterium
DNRAV

SEQ ID NO: 452905 - protein, 6 aa, Mycobacterium
DNRDEL

SEQ ID NO: 452906 - protein, 12 aa, Mycobacterium
DNRDPVPPGEPG

SEQ ID NO: 452907 - protein, 18 aa, Mycobacterium
DNRDQNDLMGTSRANAAS

SEQ ID NO: 452908 - protein, 24 aa, Mycobacterium
DNRDRTTNAVVPPEGVRRRDGDDP

SEQ ID NO: 452909 - protein, 7 aa, Mycobacterium
DNRDSWR

SEQ ID NO: 452910 - protein, 7 aa, Mycobacterium
DNRDTHT

SEQ ID NO: 452911 - protein, 6 aa, Mycobacterium
DNREEM

SEQ ID NO: 452912 - protein, 6 aa, Mycobacterium
DNRESL

SEQ ID NO: 452913 - protein, 7 aa, Mycobacterium
DNRGDRY

SEQ ID NO: 452914 - protein, 33 aa, Mycobacterium
DNRGGGRDDRGGRGRRDDRGGRGGRDDREKSNY

SEQ ID NO: 452915 - protein, 7 aa, Mycobacterium
DNRGKRS

SEQ ID NO: 452916 - protein, 4 aa, Mycobacterium
DNRI

SEQ ID NO: 452917 - protein, 6 aa, Mycobacterium
DNRNAA

SEQ ID NO: 452918 - protein, 10 aa, Mycobacterium
DNRPHQLSGG

SEQ ID NO: 452919 - protein, 10 aa, Mycobacterium
DNRPPEGPVY

SEQ ID NO: 452920 - protein, 7 aa, Mycobacterium
DNRPPSV

SEQ ID NO: 452921 - protein, 7 aa, Mycobacterium
DNRPRNV

SEQ ID NO: 452922 - protein, 9 aa, Mycobacterium
DNRQDASLQ

SEQ ID NO: 452923 - protein, 14 aa, Mycobacterium
DNRQDTNDKDPFEP

SEQ ID NO: 452924 - protein, 4 aa, Mycobacterium
DNRR

SEQ ID NO: 452925 - protein, 10 aa, Mycobacterium
DNRRDPAHAT

SEQ ID NO: 452926 - protein, 9 aa, Mycobacterium
DNRRHHRAA

SEQ ID NO: 452927 - protein, 15 aa, Mycobacterium
DNRRRAADRAGARTT

SEQ ID NO: 452928 - protein, 12 aa, Mycobacterium
DNRSAPGRPGVL

SEQ ID NO: 452929 - protein, 10 aa, Mycobacterium
DNRSPTRVDT

SEQ ID NO: 452930 - protein, 6 aa, Mycobacterium
DNRSRL

SEQ ID NO: 452931 - protein, 4 aa, Mycobacterium
DNRT

SEQ ID NO: 452932 - protein, 8 aa, Mycobacterium
DNRTARAN

SEQ ID NO: 452933 - protein, 6 aa, Mycobacterium
DNRTDL

SEQ ID NO: 452934 - protein, 5 aa, Mycobacterium
DNRVT

SEQ ID NO: 452935 - protein, 6 aa, Mycobacterium
DNRYGL

SEQ ID NO: 452936 - protein, 15 aa, Mycobacterium
DNSAAPGTLASVRLY

SEQ ID NO: 452937 - protein, 5 aa, Mycobacterium
DNSAF

SEQ ID NO: 452938 - protein, 17 aa, Mycobacterium
DNSAPADAPAAAPADAA

SEQ ID NO: 452939 - protein, 6 aa, Mycobacterium
DNSATW

SEQ ID NO: 452940 - protein, 4 aa, Mycobacterium
DNSD

SEQ ID NO: 452941 - protein, 8 aa, Mycobacterium
DNSDNALP

SEQ ID NO: 452942 - protein, 9 aa, Mycobacterium
DNSDQNDLM

SEQ ID NO: 452943 - protein, 7 aa, Mycobacterium
DNSDRLA

SEQ ID NO: 452944 - protein, 7 aa, Mycobacterium
DNSEARP

SEQ ID NO: 452945 - protein, 17 aa, Mycobacterium
DNSELTVTNPSDWPEGK

SEQ ID NO: 452946 - protein, 4 aa, Mycobacterium
DNSG

SEQ ID NO: 452947 - protein, 6 aa, Mycobacterium
DNSGHG

SEQ ID NO: 452948 - protein, 8 aa, Mycobacterium
DNSGPQTC

SEQ ID NO: 452949 - protein, 8 aa, Mycobacterium
DNSGQAMD

SEQ ID NO: 452950 - protein, 8 aa, Mycobacterium
DNSPDAVG

SEQ ID NO: 452951 - protein, 8 aa, Mycobacterium
DNSPDDSV

SEQ ID NO: 452952 - protein, 11 aa, Mycobacterium
DNSPDGTGQLA

SEQ ID NO: 452953 - protein, 10 aa, Mycobacterium
DNSPDGTGRL

SEQ ID NO: 452954 - protein, 5 aa, Mycobacterium
DNSPG

SEQ ID NO: 452955 - protein, 4 aa, Mycobacterium
DNSQ

SEQ ID NO: 452956 - protein, 8 aa, Mycobacterium
DNSQGRPM

SEQ ID NO: 452957 - protein, 7 aa, Mycobacterium
DNSQTAR

SEQ ID NO: 452958 - protein, 15 aa, Mycobacterium
DNSQTEPEATPEQGY

SEQ ID NO: 452959 - protein, 12 aa, Mycobacterium
DNSSTKEARTDI

SEQ ID NO: 452960 - protein, 13 aa, Mycobacterium
DNSTHKVPAGVSD

SEQ ID NO: 452961 - protein, 8 aa, Mycobacterium
DNSTPLGG

SEQ ID NO: 452962 - protein, 9 aa, Mycobacterium
DNSTTPSIG

SEQ ID NO: 452963 - protein, 7 aa, Mycobacterium
DNSTTWA

SEQ ID NO: 452964 - protein, 5 aa, Mycobacterium
DNSYP

SEQ ID NO: 452965 - protein, 6 aa, Mycobacterium
DNSYPG

SEQ ID NO: 452966 - protein, 7 aa, Mycobacterium
DNTAAVK

SEQ ID NO: 452967 - protein, 5 aa, Mycobacterium
DNTAR

SEQ ID NO: 452968 - protein, 8 aa, Mycobacterium
DNTARAQR

SEQ ID NO: 452969 - protein, 7 aa, Mycobacterium
DNTASRC

SEQ ID NO: 452970 - protein, 7 aa, Mycobacterium
DNTASSN

SEQ ID NO: 452971 - protein, 4 aa, Mycobacterium
DNTD

SEQ ID NO: 452972 - protein, 8 aa, Mycobacterium
DNTDGSEI

SEQ ID NO: 452973 - protein, 4 aa, Mycobacterium
DNTE

SEQ ID NO: 452974 - protein, 6 aa, Mycobacterium
DNTEVS

SEQ ID NO: 452975 - protein, 8 aa, Mycobacterium
DNTGATRI

SEQ ID NO: 452976 - protein, 6 aa, Mycobacterium
DNTGGL

SEQ ID NO: 452977 - protein, 9 aa, Mycobacterium
DNTGGSSSI

SEQ ID NO: 452978 - protein, 7 aa, Mycobacterium
DNTGPFH

SEQ ID NO: 452979 - protein, 9 aa, Mycobacterium
DNTGRGKAR

SEQ ID NO: 452980 - protein, 9 aa, Mycobacterium
DNTKDIAKN

SEQ ID NO: 452981 - protein, 5 aa, Mycobacterium
DNTKE

SEQ ID NO: 452982 - protein, 6 aa, Mycobacterium
DNTPEV

SEQ ID NO: 452983 - protein, 5 aa, Mycobacterium
DNTPG

SEQ ID NO: 452984 - protein, 10 aa, Mycobacterium
DNTPNGATVD

SEQ ID NO: 452985 - protein, 6 aa, Mycobacterium
DNTQLQ

SEQ ID NO: 452986 - protein, 4 aa, Mycobacterium
DNTR

SEQ ID NO: 452987 - protein, 6 aa, Mycobacterium
DNTREL

SEQ ID NO: 452988 - protein, 12 aa, Mycobacterium
DNTRNGIGTAPA

SEQ ID NO: 452989 - protein, 4 aa, Mycobacterium
DNTT

SEQ ID NO: 452990 - protein, 6 aa, Mycobacterium
DNTTGW

SEQ ID NO: 452991 - protein, 5 aa, Mycobacterium
DNTTP

SEQ ID NO: 452992 - protein, 5 aa, Mycobacterium
DNTTQ

SEQ ID NO: 452993 - protein, 4 aa, Mycobacterium
DNTV

SEQ ID NO: 452994 - protein, 5 aa, Mycobacterium
DNTVA

SEQ ID NO: 452995 - protein, 8 aa, Mycobacterium
DNTVGEDQ

SEQ ID NO: 452996 - protein, 6 aa, Mycobacterium
DNTVGV

SEQ ID NO: 452997 - protein, 6 aa, Mycobacterium
DNTVNA

SEQ ID NO: 452998 - protein, 12 aa, Mycobacterium
DNVAATTRSTER

SEQ ID NO: 452999 - protein, 11 aa, Mycobacterium
DNVAGKSAQNA

SEQ ID NO: 453000 - protein, 8 aa, Mycobacterium
DNVDATEL

SEQ ID NO: 453001 - protein, 15 aa, Mycobacterium
DNVDKATGAVVTPPE

SEQ ID NO: 453002 - protein, 6 aa, Mycobacterium
DNVESI

SEQ ID NO: 453003 - protein, 14 aa, Mycobacterium
DNVGEQITATRNDD

SEQ ID NO: 453004 - protein, 4 aa, Mycobacterium
DNVP

SEQ ID NO: 453005 - protein, 5 aa, Mycobacterium
DNVPP

SEQ ID NO: 453006 - protein, 6 aa, Mycobacterium
DNVRDS

SEQ ID NO: 453007 - protein, 12 aa, Mycobacterium
DNVRSTARSVAN

SEQ ID NO: 453008 - protein, 10 aa, Mycobacterium
DNVSGFNNTN

SEQ ID NO: 453009 - protein, 16 aa, Mycobacterium
DNVTAGYRTEAGFEPA

SEQ ID NO: 453010 - protein, 9 aa, Mycobacterium
DNVTDPTRI

SEQ ID NO: 453011 - protein, 14 aa, Mycobacterium
DNVVTKSDETPWYE

SEQ ID NO: 453012 - protein, 14 aa, Mycobacterium
DNVVTKSDKTPWYE

SEQ ID NO: 453013 - protein, 8 aa, Mycobacterium
DNWASETL

SEQ ID NO: 453014 - protein, 10 aa, Mycobacterium
DNWSADTPAL

SEQ ID NO: 453015 - protein, 9 aa, Mycobacterium
DNWSSTQQV

SEQ ID NO: 453016 - protein, 7 aa, Mycobacterium
DNWSTEI

SEQ ID NO: 453017 - protein, 9 aa, Mycobacterium
DNWSTEQPA

SEQ ID NO: 453018 - protein, 7 aa, Mycobacterium
DNYAERR

SEQ ID NO: 453019 - protein, 6 aa, Mycobacterium
DNYAGT

SEQ ID NO: 453020 - protein, 16 aa, Mycobacterium
DNYATSPRFSDDERAA

SEQ ID NO: 453021 - protein, 12 aa, Mycobacterium
DNYGQGSSREHA

SEQ ID NO: 453022 - protein, 11 aa, Mycobacterium
DNYPSQLSGGM

SEQ ID NO: 453023 - protein, 11 aa, Mycobacterium
DNYSATGIAGT

SEQ ID NO: 453024 - protein, 12 aa, Mycobacterium
DPAAAAHERQRA

SEQ ID NO: 453025 - protein, 7 aa, Mycobacterium
DPAAAAS

SEQ ID NO: 453026 - protein, 7 aa, Mycobacterium
DPAAADR

SEQ ID NO: 453027 - protein, 7 aa, Mycobacterium
DPAAAEL

SEQ ID NO: 453028 - protein, 13 aa, Mycobacterium
DPAAAGLIVGEQW

SEQ ID NO: 453029 - protein, 9 aa, Mycobacterium
DPAAAGSGV

SEQ ID NO: 453030 - protein, 6 aa, Mycobacterium
DPAAAL

SEQ ID NO: 453031 - protein, 9 aa, Mycobacterium
DPAAANTDA

SEQ ID NO: 453032 - protein, 16 aa, Mycobacterium
DPAAAQQRARAARERL

SEQ ID NO: 453033 - protein, 8 aa, Mycobacterium
DPAAARTR

SEQ ID NO: 453034 - protein, 40 aa, Mycobacterium
DPAADDVNDGAAVTAASVPADTDEVDDDLAARASAEESWP

SEQ ID NO: 453035 - protein, 17 aa, Mycobacterium
DPAADHPGAGFGATPLR

SEQ ID NO: 453036 - protein, 11 aa, Mycobacterium
DPAADPAPRVT

SEQ ID NO: 453037 - protein, 6 aa, Mycobacterium
DPAAER

SEQ ID NO: 453038 - protein, 13 aa, Mycobacterium
DPAAETEVAPQID

SEQ ID NO: 453039 - protein, 9 aa, Mycobacterium
DPAAGELGV

SEQ ID NO: 453040 - protein, 11 aa, Mycobacterium
DPAAGKKSRKT

SEQ ID NO: 453041 - protein, 6 aa, Mycobacterium
DPAAGR

SEQ ID NO: 453042 - protein, 7 aa, Mycobacterium
DPAAGTA

SEQ ID NO: 453043 - protein, 30 aa, Mycobacterium
DPAAHATDRQTAGPACAAQSDADADPLAEA

SEQ ID NO: 453044 - protein, 11 aa, Mycobacterium
DPAAHDPTTNI

SEQ ID NO: 453045 - protein, 6 aa, Mycobacterium
DPAAHP

SEQ ID NO: 453046 - protein, 6 aa, Mycobacterium
DPAAHV

SEQ ID NO: 453047 - protein, 8 aa, Mycobacterium
DPAAIGDN

SEQ ID NO: 453048 - protein, 11 aa, Mycobacterium
DPAAKHGREVA

SEQ ID NO: 453049 - protein, 8 aa, Mycobacterium
DPAALAET

SEQ ID NO: 453050 - protein, 6 aa, Mycobacterium
DPAALS

SEQ ID NO: 453051 - protein, 7 aa, Mycobacterium
DPAANAE

SEQ ID NO: 453052 - protein, 8 aa, Mycobacterium
DPAANAES

SEQ ID NO: 453053 - protein, 7 aa, Mycobacterium
DPAAPGA

SEQ ID NO: 453054 - protein, 18 aa, Mycobacterium
DPAAPPPPAVAAGPDTSL

SEQ ID NO: 453055 - protein, 9 aa, Mycobacterium
DPAAQGGSV

SEQ ID NO: 453056 - protein, 8 aa, Mycobacterium
DPAAQRHK

SEQ ID NO: 453057 - protein, 6 aa, Mycobacterium
DPAAQT

SEQ ID NO: 453058 - protein, 9 aa, Mycobacterium
DPAAREELR

SEQ ID NO: 453059 - protein, 7 aa, Mycobacterium
DPAAREH

SEQ ID NO: 453060 - protein, 6 aa, Mycobacterium
DPAARL

SEQ ID NO: 453061 - protein, 9 aa, Mycobacterium
DPAARPRHK

SEQ ID NO: 453062 - protein, 14 aa, Mycobacterium
DPAARSDADRARDG

SEQ ID NO: 453063 - protein, 11 aa, Mycobacterium
DPAARTPDRAG

SEQ ID NO: 453064 - protein, 19 aa, Mycobacterium
DPAASAKKIRSAVTDSERE

SEQ ID NO: 453065 - protein, 6 aa, Mycobacterium
DPAASR

SEQ ID NO: 453066 - protein, 8 aa, Mycobacterium
DPAASSWS

SEQ ID NO: 453067 - protein, 8 aa, Mycobacterium
DPAATAQR

SEQ ID NO: 453068 - protein, 8 aa, Mycobacterium
DPAATYQG

SEQ ID NO: 453069 - protein, 5 aa, Mycobacterium
DPAAV

SEQ ID NO: 453070 - protein, 17 aa, Mycobacterium
DPAAVRRSREASRDRDV

SEQ ID NO: 453071 - protein, 16 aa, Mycobacterium
DPAAVRRTRQAARDRD

SEQ ID NO: 453072 - protein, 7 aa, Mycobacterium
DPAAWGS

SEQ ID NO: 453073 - protein, 18 aa, Mycobacterium
DPAAWNPNQYSNPDNVDA

SEQ ID NO: 453074 - protein, 5 aa, Mycobacterium
DPAAY

SEQ ID NO: 453075 - protein, 6 aa, Mycobacterium
DPAAYA

SEQ ID NO: 453076 - protein, 21 aa, Mycobacterium
DPAAYGQHPHPATDRPRADRD

SEQ ID NO: 453077 - protein, 21 aa, Mycobacterium
DPAAYGQQPHPSTDQPRGDRD

SEQ ID NO: 453078 - protein, 11 aa, Mycobacterium
DPAAYSPDTAG

SEQ ID NO: 453079 - protein, 5 aa, Mycobacterium
DPACD

SEQ ID NO: 453080 - protein, 7 aa, Mycobacterium
DPACDGQ

SEQ ID NO: 453081 - protein, 5 aa, Mycobacterium
DPADA

SEQ ID NO: 453082 - protein, 6 aa, Mycobacterium
DPADAL

SEQ ID NO: 453083 - protein, 10 aa, Mycobacterium
DPADATSQFG

SEQ ID NO: 453084 - protein, 12 aa, Mycobacterium
DPADDGLADYAG

SEQ ID NO: 453085 - protein, 10 aa, Mycobacterium
DPADDTLGAR

SEQ ID NO: 453086 - protein, 9 aa, Mycobacterium
DPADEPLPG

SEQ ID NO: 453087 - protein, 9 aa, Mycobacterium
DPADEPVAE

SEQ ID NO: 453088 - protein, 9 aa, Mycobacterium
DPADEPVAQ

SEQ ID NO: 453089 - protein, 5 aa, Mycobacterium
DPADI

SEQ ID NO: 453090 - protein, 10 aa, Mycobacterium
DPADKRGQWE

SEQ ID NO: 453091 - protein, 11 aa, Mycobacterium
DPADKRTQWEE

SEQ ID NO: 453092 - protein, 9 aa, Mycobacterium
DPADKTYRL

SEQ ID NO: 453093 - protein, 5 aa, Mycobacterium
DPADL

SEQ ID NO: 453094 - protein, 18 aa, Mycobacterium
DPADLARGQDADPVAGAG

SEQ ID NO: 453095 - protein, 10 aa, Mycobacterium
DPADPADPDS

SEQ ID NO: 453096 - protein, 9 aa, Mycobacterium
DPADPAGYE

SEQ ID NO: 453097 - protein, 11 aa, Mycobacterium
DPADPDGGEAE

SEQ ID NO: 453098 - protein, 8 aa, Mycobacterium
DPADPITR

SEQ ID NO: 453099 - protein, 7 aa, Mycobacterium
DPADPLP

SEQ ID NO: 453100 - protein, 8 aa, Mycobacterium
DPADPPVA

SEQ ID NO: 453101 - protein, 6 aa, Mycobacterium
DPADPS

SEQ ID NO: 453102 - protein, 8 aa, Mycobacterium
DPADPSTY

SEQ ID NO: 453103 - protein, 11 aa, Mycobacterium
DPADPTPTIGG

SEQ ID NO: 453104 - protein, 29 aa, Mycobacterium
DPADPTPTTGGPLLSPNGGYRDDSRLAAR

SEQ ID NO: 453105 - protein, 17 aa, Mycobacterium
DPADRAKTLGVLARELG

SEQ ID NO: 453106 - protein, 7 aa, Mycobacterium
DPADRRE

SEQ ID NO: 453107 - protein, 5 aa, Mycobacterium
DPADS

SEQ ID NO: 453108 - protein, 9 aa, Mycobacterium
DPADSDAVP

SEQ ID NO: 453109 - protein, 12 aa, Mycobacterium
DPADSGEGDETG

SEQ ID NO: 453110 - protein, 12 aa, Mycobacterium
DPADSGKGDETG

SEQ ID NO: 453111 - protein, 8 aa, Mycobacterium
DPADSSFE

SEQ ID NO: 453112 - protein, 15 aa, Mycobacterium
DPADSSLETIRVTAE

SEQ ID NO: 453113 - protein, 7 aa, Mycobacterium
DPADTRD

SEQ ID NO: 453114 - protein, 5 aa, Mycobacterium
DPADV

SEQ ID NO: 453115 - protein, 7 aa, Mycobacterium
DPADVAR

SEQ ID NO: 453116 - protein, 6 aa, Mycobacterium
DPADVD

SEQ ID NO: 453117 - protein, 12 aa, Mycobacterium
DPADVPAGLEDS

SEQ ID NO: 453118 - protein, 9 aa, Mycobacterium
DPAEATRAY

SEQ ID NO: 453119 - protein, 8 aa, Mycobacterium
DPAEAVSA

SEQ ID NO: 453120 - protein, 9 aa, Mycobacterium
DPAEGDPLV

SEQ ID NO: 453121 - protein, 11 aa, Mycobacterium
DPAEIGKNRHA

SEQ ID NO: 453122 - protein, 6 aa, Mycobacterium
DPAEKF

SEQ ID NO: 453123 - protein, 9 aa, Mycobacterium
DPAELKTTV

SEQ ID NO: 453124 - protein, 8 aa, Mycobacterium
DPAELPGA

SEQ ID NO: 453125 - protein, 9 aa, Mycobacterium
DPAEQQDDL

SEQ ID NO: 453126 - protein, 7 aa, Mycobacterium
DPAERAA

SEQ ID NO: 453127 - protein, 8 aa, Mycobacterium
DPAERAEL

SEQ ID NO: 453128 - protein, 7 aa, Mycobacterium
DPAERAG

SEQ ID NO: 453129 - protein, 8 aa, Mycobacterium
DPAERDAS

SEQ ID NO: 453130 - protein, 25 aa, Mycobacterium
DPAERRKASRRNRKPTAAQAADMAR

SEQ ID NO: 453131 - protein, 8 aa, Mycobacterium
DPAERSAS

SEQ ID NO: 453132 - protein, 24 aa, Mycobacterium
DPAERVPRPPRPVRDRRARSVAND

SEQ ID NO: 453133 - protein, 7 aa, Mycobacterium
DPAESGQ

SEQ ID NO: 453134 - protein, 6 aa, Mycobacterium
DPAESR

SEQ ID NO: 453135 - protein, 14 aa, Mycobacterium
DPAESRAWITRLPG

SEQ ID NO: 453136 - protein, 5 aa, Mycobacterium
DPAEV

SEQ ID NO: 453137 - protein, 13 aa, Mycobacterium
DPAEVYTSDFLAS

SEQ ID NO: 453138 - protein, 4 aa, Mycobacterium
DPAF

SEQ ID NO: 453139 - protein, 5 aa, Mycobacterium
DPAFA

SEQ ID NO: 453140 - protein, 5 aa, Mycobacterium
DPAFP

SEQ ID NO: 453141 - protein, 5 aa, Mycobacterium
DPAFS

SEQ ID NO: 453142 - protein, 7 aa, Mycobacterium
DPAGAAE

SEQ ID NO: 453143 - protein, 8 aa, Mycobacterium
DPAGAALA

SEQ ID NO: 453144 - protein, 12 aa, Mycobacterium
DPAGAETTVRDD

SEQ ID NO: 453145 - protein, 18 aa, Mycobacterium
DPAGAPTSDSTPSPGCNF

SEQ ID NO: 453146 - protein, 7 aa, Mycobacterium
DPAGARH

SEQ ID NO: 453147 - protein, 6 aa, Mycobacterium
DPAGAT

SEQ ID NO: 453148 - protein, 9 aa, Mycobacterium
DPAGATIGS

SEQ ID NO: 453149 - protein, 16 aa, Mycobacterium
DPAGDEVLASATIRAT

SEQ ID NO: 453150 - protein, 7 aa, Mycobacterium
DPAGDGG

SEQ ID NO: 453151 - protein, 9 aa, Mycobacterium
DPAGDPDAH

SEQ ID NO: 453152 - protein, 22 aa, Mycobacterium
DPAGGPDAARGKPLAEQDEQVR

SEQ ID NO: 453153 - protein, 9 aa, Mycobacterium
DPAGGYGHP

SEQ ID NO: 453154 - protein, 14 aa, Mycobacterium
DPAGILNPDVLFAG

SEQ ID NO: 453155 - protein, 10 aa, Mycobacterium
DPAGKGARLD

SEQ ID NO: 453156 - protein, 10 aa, Mycobacterium
DPAGLTGEHT

SEQ ID NO: 453157 - protein, 18 aa, Mycobacterium
DPAGNPVGEPVTIDVQTA

SEQ ID NO: 453158 - protein, 6 aa, Mycobacterium
DPAGNS

SEQ ID NO: 453159 - protein, 6 aa, Mycobacterium
DPAGPI

SEQ ID NO: 453160 - protein, 44 aa, Mycobacterium
DPAGPVGSKIANSSAVAGNGGDGGVNGTGGASGGDGGNGGNTSV

SEQ ID NO: 453161 - protein, 6 aa, Mycobacterium
DPAGQL

SEQ ID NO: 453162 - protein, 7 aa, Mycobacterium
DPAGQSV

SEQ ID NO: 453163 - protein, 8 aa, Mycobacterium
DPAGQSVP

SEQ ID NO: 453164 - protein, 8 aa, Mycobacterium
DPAGRGVD

SEQ ID NO: 453165 - protein, 7 aa, Mycobacterium
DPAGRTG

SEQ ID NO: 453166 - protein, 9 aa, Mycobacterium
DPAGTHSSG

SEQ ID NO: 453167 - protein, 6 aa, Mycobacterium
DPAGTP

SEQ ID NO: 453168 - protein, 7 aa, Mycobacterium
DPAGTPN

SEQ ID NO: 453169 - protein, 5 aa, Mycobacterium
DPAGV

SEQ ID NO: 453170 - protein, 9 aa, Mycobacterium
DPAGYGAKD

SEQ ID NO: 453171 - protein, 4 aa, Mycobacterium
DPAH

SEQ ID NO: 453172 - protein, 5 aa, Mycobacterium
DPAHA

SEQ ID NO: 453173 - protein, 13 aa, Mycobacterium
DPAHDTPNDQHGN

SEQ ID NO: 453174 - protein, 6 aa, Mycobacterium
DPAHEE

SEQ ID NO: 453175 - protein, 9 aa, Mycobacterium
DPAHGTGKQ

SEQ ID NO: 453176 - protein, 9 aa, Mycobacterium
DPAHSAHGF

SEQ ID NO: 453177 - protein, 18 aa, Mycobacterium
DPAIDAQPATALPAPDAD

SEQ ID NO: 453178 - protein, 19 aa, Mycobacterium
DPAIDAQPCTGLRGPEPED

SEQ ID NO: 453179 - protein, 5 aa, Mycobacterium
DPAIP

SEQ ID NO: 453180 - protein, 14 aa, Mycobacterium
DPAIPAPPYLGRRR

SEQ ID NO: 453181 - protein, 9 aa, Mycobacterium
DPAKASATV

SEQ ID NO: 453182 - protein, 5 aa, Mycobacterium
DPAKE

SEQ ID NO: 453183 - protein, 6 aa, Mycobacterium
DPAKEP

SEQ ID NO: 453184 - protein, 7 aa, Mycobacterium
DPAKKKQ

SEQ ID NO: 453185 - protein, 5 aa, Mycobacterium
DPAKL

SEQ ID NO: 453186 - protein, 9 aa, Mycobacterium
DPAKQQDEL

SEQ ID NO: 453187 - protein, 5 aa, Mycobacterium
DPAKR

SEQ ID NO: 453188 - protein, 10 aa, Mycobacterium
DPAKRKPGYA

SEQ ID NO: 453189 - protein, 19 aa, Mycobacterium
DPAKTAKKIRSAVTDSERE

SEQ ID NO: 453190 - protein, 8 aa, Mycobacterium
DPAKTASV

SEQ ID NO: 453191 - protein, 8 aa, Mycobacterium
DPAKVTRS

SEQ ID NO: 453192 - protein, 9 aa, Mycobacterium
DPAKYGLSA

SEQ ID NO: 453193 - protein, 15 aa, Mycobacterium
DPALAAAGSDSPATV

SEQ ID NO: 453194 - protein, 18 aa, Mycobacterium
DPALDAQPSDPLPIPSSD

SEQ ID NO: 453195 - protein, 20 aa, Mycobacterium
DPALDTRPDGAPAAAPTADD

SEQ ID NO: 453196 - protein, 13 aa, Mycobacterium
DPALKARGHAGNR

SEQ ID NO: 453197 - protein, 12 aa, Mycobacterium
DPALPDGALPEA

SEQ ID NO: 453198 - protein, 6 aa, Mycobacterium
DPALPT

SEQ ID NO: 453199 - protein, 5 aa, Mycobacterium
DPALR

SEQ ID NO: 453200 - protein, 6 aa, Mycobacterium
DPALRP

SEQ ID NO: 453201 - protein, 6 aa, Mycobacterium
DPALTR

SEQ ID NO: 453202 - protein, 7 aa, Mycobacterium
DPAMDGS

SEQ ID NO: 453203 - protein, 7 aa, Mycobacterium
DPANAEA

SEQ ID NO: 453204 - protein, 7 aa, Mycobacterium
DPANFAS

SEQ ID NO: 453205 - protein, 5 aa, Mycobacterium
DPANG

SEQ ID NO: 453206 - protein, 17 aa, Mycobacterium
DPANGEEITAQNGRYGP

SEQ ID NO: 453207 - protein, 8 aa, Mycobacterium
DPANLTGQ

SEQ ID NO: 453208 - protein, 8 aa, Mycobacterium
DPANPNGG

SEQ ID NO: 453209 - protein, 8 aa, Mycobacterium
DPANPRHR

SEQ ID NO: 453210 - protein, 10 aa, Mycobacterium
DPANSPQTKE

SEQ ID NO: 453211 - protein, 5 aa, Mycobacterium
DPANT

SEQ ID NO: 453212 - protein, 15 aa, Mycobacterium
DPAPAAATAAASSGC

SEQ ID NO: 453213 - protein, 12 aa, Mycobacterium
DPAPADGRTVPG

SEQ ID NO: 453214 - protein, 14 aa, Mycobacterium
DPAPADVSTSGDVY

SEQ ID NO: 453215 - protein, 16 aa, Mycobacterium
DPAPAPPASTTTPPYF

SEQ ID NO: 453216 - protein, 12 aa, Mycobacterium
DPAPAPTSLPGQ

SEQ ID NO: 453217 - protein, 15 aa, Mycobacterium
DPAPARGTVPLTPDA

SEQ ID NO: 453218 - protein, 5 aa, Mycobacterium
DPAPC

SEQ ID NO: 453219 - protein, 10 aa, Mycobacterium
DPAPDDPRPR

SEQ ID NO: 453220 - protein, 6 aa, Mycobacterium
DPAPDE

SEQ ID NO: 453221 - protein, 8 aa, Mycobacterium
DPAPDETT

SEQ ID NO: 453222 - protein, 7 aa, Mycobacterium
DPAPDEV

SEQ ID NO: 453223 - protein, 9 aa, Mycobacterium
DPAPDPGKW

SEQ ID NO: 453224 - protein, 10 aa, Mycobacterium
DPAPDQGKGY

SEQ ID NO: 453225 - protein, 8 aa, Mycobacterium
DPAPDSAG

SEQ ID NO: 453226 - protein, 10 aa, Mycobacterium
DPAPEQGKGY

SEQ ID NO: 453227 - protein, 13 aa, Mycobacterium
DPAPEQGKGYQAK

SEQ ID NO: 453228 - protein, 5 aa, Mycobacterium
DPAPG

SEQ ID NO: 453229 - protein, 9 aa, Mycobacterium
DPAPGGDGV

SEQ ID NO: 453230 - protein, 5 aa, Mycobacterium
DPAPI

SEQ ID NO: 453231 - protein, 10 aa, Mycobacterium
DPAPNPPNCT

SEQ ID NO: 453232 - protein, 27 aa, Mycobacterium
DPAPPAPAAPPGTADTARTADAAGQQR

SEQ ID NO: 453233 - protein, 15 aa, Mycobacterium
DPAPPPQINHGPQAV

SEQ ID NO: 453234 - protein, 15 aa, Mycobacterium
DPAPPPQVNHGPDAV

SEQ ID NO: 453235 - protein, 17 aa, Mycobacterium
DPAPPTATSPASGGDTT

SEQ ID NO: 453236 - protein, 5 aa, Mycobacterium
DPAPR

SEQ ID NO: 453237 - protein, 8 aa, Mycobacterium
DPAPRQQA

SEQ ID NO: 453238 - protein, 7 aa, Mycobacterium
DPAPSGH

SEQ ID NO: 453239 - protein, 6 aa, Mycobacterium
DPAPTL

SEQ ID NO: 453240 - protein, 9 aa, Mycobacterium
DPAPTPRRR

SEQ ID NO: 453241 - protein, 11 aa, Mycobacterium
DPAPVAGERNP

SEQ ID NO: 453242 - protein, 6 aa, Mycobacterium
DPAPVS

SEQ ID NO: 453243 - protein, 18 aa, Mycobacterium
DPAPVSTTTPRHPAPARW

SEQ ID NO: 453244 - protein, 14 aa, Mycobacterium
DPAPVTGRSAPTVL

SEQ ID NO: 453245 - protein, 8 aa, Mycobacterium
DPAPYAPR

SEQ ID NO: 453246 - protein, 8 aa, Mycobacterium
DPAQDSPF

SEQ ID NO: 453247 - protein, 18 aa, Mycobacterium
DPAQHQNPAHIGGPDDPW

SEQ ID NO: 453248 - protein, 5 aa, Mycobacterium
DPAQL

SEQ ID NO: 453249 - protein, 7 aa, Mycobacterium
DPAQQVT

SEQ ID NO: 453250 - protein, 6 aa, Mycobacterium
DPAQRD

SEQ ID NO: 453251 - protein, 10 aa, Mycobacterium
DPAQRDELRS

SEQ ID NO: 453252 - protein, 9 aa, Mycobacterium
DPAQRQDDL

SEQ ID NO: 453253 - protein, 8 aa, Mycobacterium
DPAQRSQV

SEQ ID NO: 453254 - protein, 11 aa, Mycobacterium
DPAQSAKQALR

SEQ ID NO: 453255 - protein, 6 aa, Mycobacterium
DPAQSS

SEQ ID NO: 453256 - protein, 11 aa, Mycobacterium
DPAQTTASSSS

SEQ ID NO: 453257 - protein, 9 aa, Mycobacterium
DPAQTTGDT

SEQ ID NO: 453258 - protein, 7 aa, Mycobacterium
DPAQVGP

SEQ ID NO: 453259 - protein, 12 aa, Mycobacterium
DPARAAAMGAAG

SEQ ID NO: 453260 - protein, 8 aa, Mycobacterium
DPARAAEP

SEQ ID NO: 453261 - protein, 14 aa, Mycobacterium
DPARAAKAARSARV

SEQ ID NO: 453262 - protein, 7 aa, Mycobacterium
DPARASG

SEQ ID NO: 453263 - protein, 23 aa, Mycobacterium
DPARASPAQPARRRRVEPRRAVS

SEQ ID NO: 453264 - protein, 14 aa, Mycobacterium
DPARATAYGNAGRA

SEQ ID NO: 453265 - protein, 6 aa, Mycobacterium
DPARDG

SEQ ID NO: 453266 - protein, 17 aa, Mycobacterium
DPARDRSDGLSTGAYES

SEQ ID NO: 453267 - protein, 5 aa, Mycobacterium
DPARF

SEQ ID NO: 453268 - protein, 13 aa, Mycobacterium
DPARFPRARATTT

SEQ ID NO: 453269 - protein, 7 aa, Mycobacterium
DPARGGA

SEQ ID NO: 453270 - protein, 7 aa, Mycobacterium
DPARGGG

SEQ ID NO: 453271 - protein, 9 aa, Mycobacterium
DPARGRKDV

SEQ ID NO: 453272 - protein, 8 aa, Mycobacterium
DPARGSEL

SEQ ID NO: 453273 - protein, 8 aa, Mycobacterium
DPARHDQV

SEQ ID NO: 453274 - protein, 5 aa, Mycobacterium
DPARI

SEQ ID NO: 453275 - protein, 6 aa, Mycobacterium
DPARID

SEQ ID NO: 453276 - protein, 5 aa, Mycobacterium
DPARL

SEQ ID NO: 453277 - protein, 12 aa, Mycobacterium
DPARLTSRGRDD

SEQ ID NO: 453278 - protein, 8 aa, Mycobacterium
DPARPHGM

SEQ ID NO: 453279 - protein, 7 aa, Mycobacterium
DPARPKS

SEQ ID NO: 453280 - protein, 7 aa, Mycobacterium
DPARPLT

SEQ ID NO: 453281 - protein, 8 aa, Mycobacterium
DPARPTAE

SEQ ID NO: 453282 - protein, 9 aa, Mycobacterium
DPARQQDEL

SEQ ID NO: 453283 - protein, 13 aa, Mycobacterium
DPARRGEVTRSAE

SEQ ID NO: 453284 - protein, 6 aa, Mycobacterium
DPARRL

SEQ ID NO: 453285 - protein, 6 aa, Mycobacterium
DPARRT

SEQ ID NO: 453286 - protein, 7 aa, Mycobacterium
DPARSAH

SEQ ID NO: 453287 - protein, 6 aa, Mycobacterium
DPARSL

SEQ ID NO: 453288 - protein, 7 aa, Mycobacterium
DPARTAA

SEQ ID NO: 453289 - protein, 8 aa, Mycobacterium
DPARTAEL

SEQ ID NO: 453290 - protein, 9 aa, Mycobacterium
DPARTARAE

SEQ ID NO: 453291 - protein, 18 aa, Mycobacterium
DPARTYGDDAGDQPLTAE

SEQ ID NO: 453292 - protein, 10 aa, Mycobacterium
DPASAAATRR

SEQ ID NO: 453293 - protein, 8 aa, Mycobacterium
DPASANAT

SEQ ID NO: 453294 - protein, 6 aa, Mycobacterium
DPASAQ

SEQ ID NO: 453295 - protein, 8 aa, Mycobacterium
DPASARGS

SEQ ID NO: 453296 - protein, 9 aa, Mycobacterium
DPASATTDL

SEQ ID NO: 453297 - protein, 7 aa, Mycobacterium
DPASDIT

SEQ ID NO: 453298 - protein, 5 aa, Mycobacterium
DPASF

SEQ ID NO: 453299 - protein, 7 aa, Mycobacterium
DPASGAS

SEQ ID NO: 453300 - protein, 17 aa, Mycobacterium
DPASGEEITAQNGRYGP

SEQ ID NO: 453301 - protein, 8 aa, Mycobacterium
DPASGKIE

SEQ ID NO: 453302 - protein, 9 aa, Mycobacterium
DPASHAEAE

SEQ ID NO: 453303 - protein, 5 aa, Mycobacterium
DPASI

SEQ ID NO: 453304 - protein, 7 aa, Mycobacterium
DPASKTL

SEQ ID NO: 453305 - protein, 5 aa, Mycobacterium
DPASL

SEQ ID NO: 453306 - protein, 9 aa, Mycobacterium
DPASLSGMG

SEQ ID NO: 453307 - protein, 11 aa, Mycobacterium
DPASLSGSSTG

SEQ ID NO: 453308 - protein, 7 aa, Mycobacterium
DPASMTP

SEQ ID NO: 453309 - protein, 12 aa, Mycobacterium
DPASNADDFTRP

SEQ ID NO: 453310 - protein, 10 aa, Mycobacterium
DPASPDIEGT

SEQ ID NO: 453311 - protein, 8 aa, Mycobacterium
DPASPEYR

SEQ ID NO: 453312 - protein, 8 aa, Mycobacterium
DPASQAVD

SEQ ID NO: 453313 - protein, 11 aa, Mycobacterium
DPASQAVDDGY

SEQ ID NO: 453314 - protein, 18 aa, Mycobacterium
DPASQGQDVERDPALDPA

SEQ ID NO: 453315 - protein, 9 aa, Mycobacterium
DPASQRAAA

SEQ ID NO: 453316 - protein, 6 aa, Mycobacterium
DPASRA

SEQ ID NO: 453317 - protein, 11 aa, Mycobacterium
DPASRGPHASK

SEQ ID NO: 453318 - protein, 6 aa, Mycobacterium
DPASRI

SEQ ID NO: 453319 - protein, 14 aa, Mycobacterium
DPASSAPNRGPDRA

SEQ ID NO: 453320 - protein, 6 aa, Mycobacterium
DPASSE

SEQ ID NO: 453321 - protein, 5 aa, Mycobacterium
DPASV

SEQ ID NO: 453322 - protein, 12 aa, Mycobacterium
DPASVADDFTRP

SEQ ID NO: 453323 - protein, 8 aa, Mycobacterium
DPASVQAA

SEQ ID NO: 453324 - protein, 7 aa, Mycobacterium
DPASWGS

SEQ ID NO: 453325 - protein, 7 aa, Mycobacterium
DPASYDL

SEQ ID NO: 453326 - protein, 14 aa, Mycobacterium
DPATAAAILEHTES

SEQ ID NO: 453327 - protein, 11 aa, Mycobacterium
DPATAAATGRG

SEQ ID NO: 453328 - protein, 11 aa, Mycobacterium
DPATAEASSMP

SEQ ID NO: 453329 - protein, 13 aa, Mycobacterium
DPATAEKLTPNFG

SEQ ID NO: 453330 - protein, 24 aa, Mycobacterium
DPATAEVHSRARAGHTDAARIAED

SEQ ID NO: 453331 - protein, 10 aa, Mycobacterium
DPATASRRRY

SEQ ID NO: 453332 - protein, 9 aa, Mycobacterium
DPATESNEG

SEQ ID NO: 453333 - protein, 5 aa, Mycobacterium
DPATF

SEQ ID NO: 453334 - protein, 5 aa, Mycobacterium
DPATG

SEQ ID NO: 453335 - protein, 34 aa, Mycobacterium
DPATGAIATRSRPGHERAAGTGADAVGRFAAAML

SEQ ID NO: 453336 - protein, 8 aa, Mycobacterium
DPATGARR

SEQ ID NO: 453337 - protein, 6 aa, Mycobacterium
DPATGE

SEQ ID NO: 453338 - protein, 6 aa, Mycobacterium
DPATGF

SEQ ID NO: 453339 - protein, 7 aa, Mycobacterium
DPATGGL

SEQ ID NO: 453340 - protein, 6 aa, Mycobacterium
DPATGH

SEQ ID NO: 453341 - protein, 8 aa, Mycobacterium
DPATGLAR

SEQ ID NO: 453342 - protein, 8 aa, Mycobacterium
DPATGRED

SEQ ID NO: 453343 - protein, 8 aa, Mycobacterium
DPATGRTD

SEQ ID NO: 453344 - protein, 10 aa, Mycobacterium
DPATGSADAI

SEQ ID NO: 453345 - protein, 16 aa, Mycobacterium
DPATGTYLGPDGQVYT

SEQ ID NO: 453346 - protein, 5 aa, Mycobacterium
DPATI

SEQ ID NO: 453347 - protein, 6 aa, Mycobacterium
DPATLD

SEQ ID NO: 453348 - protein, 16 aa, Mycobacterium
DPATMTDLPAGARGGV

SEQ ID NO: 453349 - protein, 7 aa, Mycobacterium
DPATPLR

SEQ ID NO: 453350 - protein, 7 aa, Mycobacterium
DPATRAA

SEQ ID NO: 453351 - protein, 7 aa, Mycobacterium
DPATREA

SEQ ID NO: 453352 - protein, 7 aa, Mycobacterium
DPATRES

SEQ ID NO: 453353 - protein, 6 aa, Mycobacterium
DPATRK

SEQ ID NO: 453354 - protein, 6 aa, Mycobacterium
DPATRL

SEQ ID NO: 453355 - protein, 10 aa, Mycobacterium
DPATRSRCTH

SEQ ID NO: 453356 - protein, 5 aa, Mycobacterium
DPATS

SEQ ID NO: 453357 - protein, 11 aa, Mycobacterium
DPATSATADLP

SEQ ID NO: 453358 - protein, 6 aa, Mycobacterium
DPATVP

SEQ ID NO: 453359 - protein, 8 aa, Mycobacterium
DPATWTEP

SEQ ID NO: 453360 - protein, 9 aa, Mycobacterium
DPAVAAQGR

SEQ ID NO: 453361 - protein, 19 aa, Mycobacterium
DPAVADQPSSALPGPAPED

SEQ ID NO: 453362 - protein, 19 aa, Mycobacterium
DPAVATQSTDGLSPPDAEN

SEQ ID NO: 453363 - protein, 12 aa, Mycobacterium
DPAVEATDGRTF

SEQ ID NO: 453364 - protein, 18 aa, Mycobacterium
DPAVESERGHADAALPGV

SEQ ID NO: 453365 - protein, 19 aa, Mycobacterium
DPAVETQPATALPAPSAED

SEQ ID NO: 453366 - protein, 7 aa, Mycobacterium
DPAVKPI

SEQ ID NO: 453367 - protein, 5 aa, Mycobacterium
DPAVP

SEQ ID NO: 453368 - protein, 28 aa, Mycobacterium
DPAVPEGDPEATVDLGSPAAEAIWVVGA

SEQ ID NO: 453369 - protein, 8 aa, Mycobacterium
DPAVPGDE

SEQ ID NO: 453370 - protein, 8 aa, Mycobacterium
DPAVPQGR

SEQ ID NO: 453371 - protein, 7 aa, Mycobacterium
DPAVPSG

SEQ ID NO: 453372 - protein, 6 aa, Mycobacterium
DPAVQP

SEQ ID NO: 453373 - protein, 5 aa, Mycobacterium
DPAVT

SEQ ID NO: 453374 - protein, 8 aa, Mycobacterium
DPAVTANG

SEQ ID NO: 453375 - protein, 9 aa, Mycobacterium
DPAVTENES

SEQ ID NO: 453376 - protein, 18 aa, Mycobacterium
DPAVTGKPSGDDLRSGKR

SEQ ID NO: 453377 - protein, 7 aa, Mycobacterium
DPAVTPL

SEQ ID NO: 453378 - protein, 10 aa, Mycobacterium
DPAWTGSVQP

SEQ ID NO: 453379 - protein, 10 aa, Mycobacterium
DPAYADDEDY

SEQ ID NO: 453380 - protein, 11 aa, Mycobacterium
DPAYEDRAETY

SEQ ID NO: 453381 - protein, 15 aa, Mycobacterium
DPAYGWSTSPPNVPT

SEQ ID NO: 453382 - protein, 5 aa, Mycobacterium
DPAYP

SEQ ID NO: 453383 - protein, 6 aa, Mycobacterium
DPAYQT

SEQ ID NO: 453384 - protein, 5 aa, Mycobacterium
DPCDP

SEQ ID NO: 453385 - protein, 5 aa, Mycobacterium
DPDAA

SEQ ID NO: 453386 - protein, 17 aa, Mycobacterium
DPDAAARYAADPAQAIA

SEQ ID NO: 453387 - protein, 6 aa, Mycobacterium
DPDAAD

SEQ ID NO: 453388 - protein, 9 aa, Mycobacterium
DPDAADGRC

SEQ ID NO: 453389 - protein, 7 aa, Mycobacterium
DPDAAER

SEQ ID NO: 453390 - protein, 10 aa, Mycobacterium
DPDAAQRARE

SEQ ID NO: 453391 - protein, 10 aa, Mycobacterium
DPDAARGAEA

SEQ ID NO: 453392 - protein, 6 aa, Mycobacterium
DPDACR

SEQ ID NO: 453393 - protein, 8 aa, Mycobacterium
DPDADAEK

SEQ ID NO: 453394 - protein, 7 aa, Mycobacterium
DPDADAV

SEQ ID NO: 453395 - protein, 6 aa, Mycobacterium
DPDADG

SEQ ID NO: 453396 - protein, 7 aa, Mycobacterium
DPDADYQ

SEQ ID NO: 453397 - protein, 8 aa, Mycobacterium
DPDADYQQ

SEQ ID NO: 453398 - protein, 5 aa, Mycobacterium
DPDAE

SEQ ID NO: 453399 - protein, 42 aa, Mycobacterium
DPDAERARTTFREPTQPSPPQQPSQPPPPPPPSALHPRPDPW

SEQ ID NO: 453400 - protein, 7 aa, Mycobacterium
DPDAGDA

SEQ ID NO: 453401 - protein, 11 aa, Mycobacterium
DPDAGDARDLR

SEQ ID NO: 453402 - protein, 11 aa, Mycobacterium
DPDAGTVERAR

SEQ ID NO: 453403 - protein, 5 aa, Mycobacterium
DPDAI

SEQ ID NO: 453404 - protein, 6 aa, Mycobacterium
DPDAIA

SEQ ID NO: 453405 - protein, 5 aa, Mycobacterium
DPDAL

SEQ ID NO: 453406 - protein, 12 aa, Mycobacterium
DPDALIAEVSAK

SEQ ID NO: 453407 - protein, 6 aa, Mycobacterium
DPDAMP

SEQ ID NO: 453408 - protein, 7 aa, Mycobacterium
DPDAPAG

SEQ ID NO: 453409 - protein, 8 aa, Mycobacterium
DPDAPAPL

SEQ ID NO: 453410 - protein, 10 aa, Mycobacterium
DPDAPEPLAP

SEQ ID NO: 453411 - protein, 9 aa, Mycobacterium
DPDAPPPYV

SEQ ID NO: 453412 - protein, 8 aa, Mycobacterium
DPDAPPYQ

SEQ ID NO: 453413 - protein, 9 aa, Mycobacterium
DPDAPRHKG

SEQ ID NO: 453414 - protein, 7 aa, Mycobacterium
DPDAPTL

SEQ ID NO: 453415 - protein, 7 aa, Mycobacterium
DPDAPTV

SEQ ID NO: 453416 - protein, 9 aa, Mycobacterium
DPDARGGRI

SEQ ID NO: 453417 - protein, 9 aa, Mycobacterium
DPDARPQDD

SEQ ID NO: 453418 - protein, 13 aa, Mycobacterium
DPDARRRDLSDPE

SEQ ID NO: 453419 - protein, 24 aa, Mycobacterium
DPDARSLVGSSRAARLRSRGERSG

SEQ ID NO: 453420 - protein, 7 aa, Mycobacterium
DPDASLG

SEQ ID NO: 453421 - protein, 9 aa, Mycobacterium
DPDASLGAG

SEQ ID NO: 453422 - protein, 5 aa, Mycobacterium
DPDAT

SEQ ID NO: 453423 - protein, 6 aa, Mycobacterium
DPDATA

SEQ ID NO: 453424 - protein, 9 aa, Mycobacterium
DPDATDLNG

SEQ ID NO: 453425 - protein, 7 aa, Mycobacterium
DPDATMG

SEQ ID NO: 453426 - protein, 13 aa, Mycobacterium
DPDATRKTFPEID

SEQ ID NO: 453427 - protein, 7 aa, Mycobacterium
DPDAVQG

SEQ ID NO: 453428 - protein, 6 aa, Mycobacterium
DPDAVR

SEQ ID NO: 453429 - protein, 14 aa, Mycobacterium
DPDAVRRTKEALKK

SEQ ID NO: 453430 - protein, 8 aa, Mycobacterium
DPDAVSAG

SEQ ID NO: 453431 - protein, 6 aa, Mycobacterium
DPDAYD

SEQ ID NO: 453432 - protein, 7 aa, Mycobacterium
DPDAYRS

SEQ ID NO: 453433 - protein, 8 aa, Mycobacterium
DPDCDQGR

SEQ ID NO: 453434 - protein, 15 aa, Mycobacterium
DPDCPAKIDDGRATS

SEQ ID NO: 453435 - protein, 6 aa, Mycobacterium
DPDDAA

SEQ ID NO: 453436 - protein, 9 aa, Mycobacterium
DPDDAEDAT

SEQ ID NO: 453437 - protein, 11 aa, Mycobacterium
DPDDAPGDPPV

SEQ ID NO: 453438 - protein, 8 aa, Mycobacterium
DPDDAVES

SEQ ID NO: 453439 - protein, 5 aa, Mycobacterium
DPDDC

SEQ ID NO: 453440 - protein, 6 aa, Mycobacterium
DPDDDV

SEQ ID NO: 453441 - protein, 13 aa, Mycobacterium
DPDDEVNGRPHGM

SEQ ID NO: 453442 - protein, 8 aa, Mycobacterium
DPDDGEKR

SEQ ID NO: 453443 - protein, 8 aa, Mycobacterium
DPDDGSRR

SEQ ID NO: 453444 - protein, 8 aa, Mycobacterium
DPDDGTRR

SEQ ID NO: 453445 - protein, 5 aa, Mycobacterium
DPDDI

SEQ ID NO: 453446 - protein, 15 aa, Mycobacterium
DPDDLAGTAAAGREQ

SEQ ID NO: 453447 - protein, 6 aa, Mycobacterium
DPDDLE

SEQ ID NO: 453448 - protein, 9 aa, Mycobacterium
DPDDLETVT

SEQ ID NO: 453449 - protein, 8 aa, Mycobacterium
DPDDPERF

SEQ ID NO: 453450 - protein, 5 aa, Mycobacterium
DPDDQ

SEQ ID NO: 453451 - protein, 6 aa, Mycobacterium
DPDDRA

SEQ ID NO: 453452 - protein, 8 aa, Mycobacterium
DPDDRQRF

SEQ ID NO: 453453 - protein, 8 aa, Mycobacterium
DPDDSATV

SEQ ID NO: 453454 - protein, 8 aa, Mycobacterium
DPDDSDSV

SEQ ID NO: 453455 - protein, 5 aa, Mycobacterium
DPDDV

SEQ ID NO: 453456 - protein, 8 aa, Mycobacterium
DPDDVRRA

SEQ ID NO: 453457 - protein, 5 aa, Mycobacterium
DPDEA

SEQ ID NO: 453458 - protein, 6 aa, Mycobacterium
DPDEAW

SEQ ID NO: 453459 - protein, 5 aa, Mycobacterium
DPDEF

SEQ ID NO: 453460 - protein, 6 aa, Mycobacterium
DPDEFT

SEQ ID NO: 453461 - protein, 5 aa, Mycobacterium
DPDEL

SEQ ID NO: 453462 - protein, 6 aa, Mycobacterium
DPDELG

SEQ ID NO: 453463 - protein, 10 aa, Mycobacterium
DPDENPYPDF

SEQ ID NO: 453464 - protein, 5 aa, Mycobacterium
DPDEP

SEQ ID NO: 453465 - protein, 8 aa, Mycobacterium
DPDEPTYD

SEQ ID NO: 453466 - protein, 8 aa, Mycobacterium
DPDEPVES

SEQ ID NO: 453467 - protein, 7 aa, Mycobacterium
DPDEQFR

SEQ ID NO: 453468 - protein, 8 aa, Mycobacterium
DPDEQSVA

SEQ ID NO: 453469 - protein, 5 aa, Mycobacterium
DPDER

SEQ ID NO: 453470 - protein, 9 aa, Mycobacterium
DPDERAAEG

SEQ ID NO: 453471 - protein, 9 aa, Mycobacterium
DPDERADYD

SEQ ID NO: 453472 - protein, 8 aa, Mycobacterium
DPDESAPV

SEQ ID NO: 453473 - protein, 6 aa, Mycobacterium
DPDEVR

SEQ ID NO: 453474 - protein, 4 aa, Mycobacterium
DPDF

SEQ ID NO: 453475 - protein, 5 aa, Mycobacterium
DPDFA

SEQ ID NO: 453476 - protein, 5 aa, Mycobacterium
DPDFQ

SEQ ID NO: 453477 - protein, 6 aa, Mycobacterium
DPDGAH

SEQ ID NO: 453478 - protein, 21 aa, Mycobacterium
DPDGARSLADAASAAIPADAQ

SEQ ID NO: 453479 - protein, 11 aa, Mycobacterium
DPDGAYSQDPT

SEQ ID NO: 453480 - protein, 11 aa, Mycobacterium
DPDGDAENQLR

SEQ ID NO: 453481 - protein, 6 aa, Mycobacterium
DPDGDH

SEQ ID NO: 453482 - protein, 8 aa, Mycobacterium
DPDGEAGA

SEQ ID NO: 453483 - protein, 7 aa, Mycobacterium
DPDGGDQ

SEQ ID NO: 453484 - protein, 8 aa, Mycobacterium
DPDGGEPY

SEQ ID NO: 453485 - protein, 6 aa, Mycobacterium
DPDGGL

SEQ ID NO: 453486 - protein, 10 aa, Mycobacterium
DPDGGYGHPD

SEQ ID NO: 453487 - protein, 5 aa, Mycobacterium
DPDGI

SEQ ID NO: 453488 - protein, 9 aa, Mycobacterium
DPDGKQRWT

SEQ ID NO: 453489 - protein, 9 aa, Mycobacterium
DPDGLSETE

SEQ ID NO: 453490 - protein, 11 aa, Mycobacterium
DPDGNEVPRRT

SEQ ID NO: 453491 - protein, 7 aa, Mycobacterium
DPDGNNV

SEQ ID NO: 453492 - protein, 14 aa, Mycobacterium
DPDGNNVEAVFHGA

SEQ ID NO: 453493 - protein, 15 aa, Mycobacterium
DPDGNNVEAVFHGAL

SEQ ID NO: 453494 - protein, 7 aa, Mycobacterium
DPDGNQI

SEQ ID NO: 453495 - protein, 12 aa, Mycobacterium
DPDGNTATTYPG

SEQ ID NO: 453496 - protein, 12 aa, Mycobacterium
DPDGNVIEARYY

SEQ ID NO: 453497 - protein, 7 aa, Mycobacterium
DPDGPTL

SEQ ID NO: 453498 - protein, 6 aa, Mycobacterium
DPDGPV

SEQ ID NO: 453499 - protein, 5 aa, Mycobacterium
DPDGQ

SEQ ID NO: 453500 - protein, 7 aa, Mycobacterium
DPDGRAV

SEQ ID NO: 453501 - protein, 14 aa, Mycobacterium
DPDGRNYRDRLRRY

SEQ ID NO: 453502 - protein, 10 aa, Mycobacterium
DPDGRRQPGR

SEQ ID NO: 453503 - protein, 7 aa, Mycobacterium
DPDGRVT

SEQ ID NO: 453504 - protein, 6 aa, Mycobacterium
DPDGRY

SEQ ID NO: 453505 - protein, 9 aa, Mycobacterium
DPDGSAAAL

SEQ ID NO: 453506 - protein, 8 aa, Mycobacterium
DPDGSAAE

SEQ ID NO: 453507 - protein, 9 aa, Mycobacterium
DPDGSAATL

SEQ ID NO: 453508 - protein, 6 aa, Mycobacterium
DPDGSL

SEQ ID NO: 453509 - protein, 14 aa, Mycobacterium
DPDGSLRDAGLPNV

SEQ ID NO: 453510 - protein, 16 aa, Mycobacterium
DPDGSLTSDTDRARRR

SEQ ID NO: 453511 - protein, 8 aa, Mycobacterium
DPDGSRYK

SEQ ID NO: 453512 - protein, 8 aa, Mycobacterium
DPDGSRYR

SEQ ID NO: 453513 - protein, 13 aa, Mycobacterium
DPDGTAHRVGSPL

SEQ ID NO: 453514 - protein, 7 aa, Mycobacterium
DPDGTFT

SEQ ID NO: 453515 - protein, 6 aa, Mycobacterium
DPDGTL

SEQ ID NO: 453516 - protein, 7 aa, Mycobacterium
DPDGTVT

SEQ ID NO: 453517 - protein, 12 aa, Mycobacterium
DPDGVEGPVAEA

SEQ ID NO: 453518 - protein, 12 aa, Mycobacterium
DPDGYQVTLHDR

SEQ ID NO: 453519 - protein, 4 aa, Mycobacterium
DPDH

SEQ ID NO: 453520 - protein, 13 aa, Mycobacterium
DPDHNPTPRQLPP

SEQ ID NO: 453521 - protein, 5 aa, Mycobacterium
DPDHP

SEQ ID NO: 453522 - protein, 9 aa, Mycobacterium
DPDHQGRGI

SEQ ID NO: 453523 - protein, 12 aa, Mycobacterium
DPDIRRQGPVGQ

SEQ ID NO: 453524 - protein, 4 aa, Mycobacterium
DPDK

SEQ ID NO: 453525 - protein, 21 aa, Mycobacterium
DPDKGAAAADDITKGAAGSNL

SEQ ID NO: 453526 - protein, 16 aa, Mycobacterium
DPDKLNEGRTLTPTGL

SEQ ID NO: 453527 - protein, 9 aa, Mycobacterium
DPDKNKPSL

SEQ ID NO: 453528 - protein, 7 aa, Mycobacterium
DPDKTAA

SEQ ID NO: 453529 - protein, 14 aa, Mycobacterium
DPDKTASSRHPQGW

SEQ ID NO: 453530 - protein, 8 aa, Mycobacterium
DPDKTTLT

SEQ ID NO: 453531 - protein, 6 aa, Mycobacterium
DPDLDQ

SEQ ID NO: 453532 - protein, 7 aa, Mycobacterium
DPDLDRE

SEQ ID NO: 453533 - protein, 15 aa, Mycobacterium
DPDLHADAGAARKVG

SEQ ID NO: 453534 - protein, 17 aa, Mycobacterium
DPDLHSNPAEARKAGRR

SEQ ID NO: 453535 - protein, 8 aa, Mycobacterium
DPDLPDDE

SEQ ID NO: 453536 - protein, 7 aa, Mycobacterium
DPDLPEL

SEQ ID NO: 453537 - protein, 14 aa, Mycobacterium
DPDLPRKLRDGQAH

SEQ ID NO: 453538 - protein, 8 aa, Mycobacterium
DPDLSEEI

SEQ ID NO: 453539 - protein, 6 aa, Mycobacterium
DPDLSL

SEQ ID NO: 453540 - protein, 9 aa, Mycobacterium
DPDLVPPGA

SEQ ID NO: 453541 - protein, 9 aa, Mycobacterium
DPDMPPIPP

SEQ ID NO: 453542 - protein, 10 aa, Mycobacterium
DPDNGAVATE

SEQ ID NO: 453543 - protein, 6 aa, Mycobacterium
DPDNLD

SEQ ID NO: 453544 - protein, 6 aa, Mycobacterium
DPDNPE

SEQ ID NO: 453545 - protein, 15 aa, Mycobacterium
DPDNPGELKPQRANL

SEQ ID NO: 453546 - protein, 16 aa, Mycobacterium
DPDNPGEQKPQRANLK

SEQ ID NO: 453547 - protein, 8 aa, Mycobacterium
DPDNPTRQ

SEQ ID NO: 453548 - protein, 6 aa, Mycobacterium
DPDNRR

SEQ ID NO: 453549 - protein, 9 aa, Mycobacterium
DPDNRRPVD

SEQ ID NO: 453550 - protein, 13 aa, Mycobacterium
DPDNRRPVDYGAR

SEQ ID NO: 453551 - protein, 4 aa, Mycobacterium
DPDP

SEQ ID NO: 453552 - protein, 8 aa, Mycobacterium
DPDPAAGA

SEQ ID NO: 453553 - protein, 8 aa, Mycobacterium
DPDPAEPL

SEQ ID NO: 453554 - protein, 8 aa, Mycobacterium
DPDPAGPL

SEQ ID NO: 453555 - protein, 10 aa, Mycobacterium
DPDPANVGRK

SEQ ID NO: 453556 - protein, 6 aa, Mycobacterium
DPDPAR

SEQ ID NO: 453557 - protein, 12 aa, Mycobacterium
DPDPARAAAATT

SEQ ID NO: 453558 - protein, 8 aa, Mycobacterium
DPDPARTV

SEQ ID NO: 453559 - protein, 11 aa, Mycobacterium
DPDPATPGKIY

SEQ ID NO: 453560 - protein, 11 aa, Mycobacterium
DPDPAVATAAT

SEQ ID NO: 453561 - protein, 12 aa, Mycobacterium
DPDPDAAGKTYT

SEQ ID NO: 453562 - protein, 13 aa, Mycobacterium
DPDPDAAGKTYTR

SEQ ID NO: 453563 - protein, 12 aa, Mycobacterium
DPDPDAEGKTYT

SEQ ID NO: 453564 - protein, 13 aa, Mycobacterium
DPDPDAEGKTYTR

SEQ ID NO: 453565 - protein, 7 aa, Mycobacterium
DPDPDAR

SEQ ID NO: 453566 - protein, 15 aa, Mycobacterium
DPDPDAVGKSYTRSG

SEQ ID NO: 453567 - protein, 14 aa, Mycobacterium
DPDPDAVGKTYARA

SEQ ID NO: 453568 - protein, 11 aa, Mycobacterium
DPDPDHPDHDT

SEQ ID NO: 453569 - protein, 6 aa, Mycobacterium
DPDPDR

SEQ ID NO: 453570 - protein, 13 aa, Mycobacterium
DPDPDSVGKTYTR

SEQ ID NO: 453571 - protein, 15 aa, Mycobacterium
DPDPDTPGKTYSRTG

SEQ ID NO: 453572 - protein, 12 aa, Mycobacterium
DPDPDTPGKTYT

SEQ ID NO: 453573 - protein, 7 aa, Mycobacterium
DPDPEAL

SEQ ID NO: 453574 - protein, 9 aa, Mycobacterium
DPDPESAAE

SEQ ID NO: 453575 - protein, 7 aa, Mycobacterium
DPDPESV

SEQ ID NO: 453576 - protein, 9 aa, Mycobacterium
DPDPETAAE

SEQ ID NO: 453577 - protein, 11 aa, Mycobacterium
DPDPEVAGKTY

SEQ ID NO: 453578 - protein, 7 aa, Mycobacterium
DPDPGEI

SEQ ID NO: 453579 - protein, 5 aa, Mycobacterium
DPDPI

SEQ ID NO: 453580 - protein, 10 aa, Mycobacterium
DPDPLAPGRM

SEQ ID NO: 453581 - protein, 10 aa, Mycobacterium
DPDPNTVGRQ

SEQ ID NO: 453582 - protein, 7 aa, Mycobacterium
DPDPQTV

SEQ ID NO: 453583 - protein, 5 aa, Mycobacterium
DPDPS

SEQ ID NO: 453584 - protein, 8 aa, Mycobacterium
DPDPSGPV

SEQ ID NO: 453585 - protein, 8 aa, Mycobacterium
DPDPTKPA

SEQ ID NO: 453586 - protein, 6 aa, Mycobacterium
DPDPTM

SEQ ID NO: 453587 - protein, 4 aa, Mycobacterium
DPDQ

SEQ ID NO: 453588 - protein, 22 aa, Mycobacterium
DPDQIEGYRRDAAADPLAGRPR

SEQ ID NO: 453589 - protein, 6 aa, Mycobacterium
DPDQPM

SEQ ID NO: 453590 - protein, 6 aa, Mycobacterium
DPDQPS

SEQ ID NO: 453591 - protein, 7 aa, Mycobacterium
DPDQQID

SEQ ID NO: 453592 - protein, 13 aa, Mycobacterium
DPDQRHKLAPSAH

SEQ ID NO: 453593 - protein, 5 aa, Mycobacterium
DPDRA

SEQ ID NO: 453594 - protein, 13 aa, Mycobacterium
DPDRARAAAATQA

SEQ ID NO: 453595 - protein, 13 aa, Mycobacterium
DPDRARRCDPAGP

SEQ ID NO: 453596 - protein, 15 aa, Mycobacterium
DPDRARRDDPRGPLR

SEQ ID NO: 453597 - protein, 12 aa, Mycobacterium
DPDRARRSDPLR

SEQ ID NO: 453598 - protein, 6 aa, Mycobacterium
DPDRCP

SEQ ID NO: 453599 - protein, 8 aa, Mycobacterium
DPDRDDRG

SEQ ID NO: 453600 - protein, 7 aa, Mycobacterium
DPDRDEL

SEQ ID NO: 453601 - protein, 5 aa, Mycobacterium
DPDRE

SEQ ID NO: 453602 - protein, 8 aa, Mycobacterium
DPDREATA

SEQ ID NO: 453603 - protein, 18 aa, Mycobacterium
DPDRFDPDRFSPEQTAQR

SEQ ID NO: 453604 - protein, 5 aa, Mycobacterium
DPDRG

SEQ ID NO: 453605 - protein, 5 aa, Mycobacterium
DPDRH

SEQ ID NO: 453606 - protein, 9 aa, Mycobacterium
DPDRITTPL

SEQ ID NO: 453607 - protein, 7 aa, Mycobacterium
DPDRKAL

SEQ ID NO: 453608 - protein, 5 aa, Mycobacterium
DPDRM

SEQ ID NO: 453609 - protein, 7 aa, Mycobacterium
DPDRPGD

SEQ ID NO: 453610 - protein, 8 aa, Mycobacterium
DPDRPGSL

SEQ ID NO: 453611 - protein, 8 aa, Mycobacterium
DPDRPLSE

SEQ ID NO: 453612 - protein, 8 aa, Mycobacterium
DPDRPLTD

SEQ ID NO: 453613 - protein, 7 aa, Mycobacterium
DPDRQLS

SEQ ID NO: 453614 - protein, 8 aa, Mycobacterium
DPDRQLSE

SEQ ID NO: 453615 - protein, 9 aa, Mycobacterium
DPDRQVPRT

SEQ ID NO: 453616 - protein, 8 aa, Mycobacterium
DPDRRAEV

SEQ ID NO: 453617 - protein, 7 aa, Mycobacterium
DPDRREE

SEQ ID NO: 453618 - protein, 9 aa, Mycobacterium
DPDRRNAVT

SEQ ID NO: 453619 - protein, 11 aa, Mycobacterium
DPDRSAATLRE

SEQ ID NO: 453620 - protein, 8 aa, Mycobacterium
DPDRTLAE

SEQ ID NO: 453621 - protein, 13 aa, Mycobacterium
DPDRTRASAATQA

SEQ ID NO: 453622 - protein, 11 aa, Mycobacterium
DPDRVAKARES

SEQ ID NO: 453623 - protein, 7 aa, Mycobacterium
DPDRVPG

SEQ ID NO: 453624 - protein, 9 aa, Mycobacterium
DPDRVPRSI

SEQ ID NO: 453625 - protein, 11 aa, Mycobacterium
DPDRVTTPMRR

SEQ ID NO: 453626 - protein, 12 aa, Mycobacterium
DPDRYEKPRQED

SEQ ID NO: 453627 - protein, 6 aa, Mycobacterium
DPDRYP

SEQ ID NO: 453628 - protein, 4 aa, Mycobacterium
DPDS

SEQ ID NO: 453629 - protein, 5 aa, Mycobacterium
DPDSA

SEQ ID NO: 453630 - protein, 27 aa, Mycobacterium
DPDSGAARATGNVERIGEESSGVPDHD

SEQ ID NO: 453631 - protein, 8 aa, Mycobacterium
DPDSGDAV

SEQ ID NO: 453632 - protein, 12 aa, Mycobacterium
DPDSGEPVPPGA

SEQ ID NO: 453633 - protein, 9 aa, Mycobacterium
DPDSGESVD

SEQ ID NO: 453634 - protein, 8 aa, Mycobacterium
DPDSGQAP

SEQ ID NO: 453635 - protein, 10 aa, Mycobacterium
DPDSGTALST

SEQ ID NO: 453636 - protein, 7 aa, Mycobacterium
DPDSPAV

SEQ ID NO: 453637 - protein, 13 aa, Mycobacterium
DPDSVADDFTKPG

SEQ ID NO: 453638 - protein, 10 aa, Mycobacterium
DPDSVPPADV

SEQ ID NO: 453639 - protein, 6 aa, Mycobacterium
DPDSYD

SEQ ID NO: 453640 - protein, 5 aa, Mycobacterium
DPDTA

SEQ ID NO: 453641 - protein, 6 aa, Mycobacterium
DPDTAA

SEQ ID NO: 453642 - protein, 6 aa, Mycobacterium
DPDTAE

SEQ ID NO: 453643 - protein, 8 aa, Mycobacterium
DPDTAGSM

SEQ ID NO: 453644 - protein, 6 aa, Mycobacterium
DPDTCA

SEQ ID NO: 453645 - protein, 6 aa, Mycobacterium
DPDTDA

SEQ ID NO: 453646 - protein, 7 aa, Mycobacterium
DPDTDAD

SEQ ID NO: 453647 - protein, 13 aa, Mycobacterium
DPDTEVNGRPHGM

SEQ ID NO: 453648 - protein, 10 aa, Mycobacterium
DPDTGAPCAP

SEQ ID NO: 453649 - protein, 24 aa, Mycobacterium
DPDTGAPLRDDSGRVRRVPPGEPG

SEQ ID NO: 453650 - protein, 16 aa, Mycobacterium
DPDTGAPLRDESGRVR

SEQ ID NO: 453651 - protein, 12 aa, Mycobacterium
DPDTGASCPPGV

SEQ ID NO: 453652 - protein, 14 aa, Mycobacterium
DPDTGEAVTIFERH

SEQ ID NO: 453653 - protein, 24 aa, Mycobacterium
DPDTGEPVRGADGKLRKVKSGEPG

SEQ ID NO: 453654 - protein, 15 aa, Mycobacterium
DPDTGETVERGQPGE

SEQ ID NO: 453655 - protein, 12 aa, Mycobacterium
DPDTGLSTVIFE

SEQ ID NO: 453656 - protein, 12 aa, Mycobacterium
DPDTGRECPAGT

SEQ ID NO: 453657 - protein, 5 aa, Mycobacterium
DPDTH

SEQ ID NO: 453658 - protein, 6 aa, Mycobacterium
DPDTLR

SEQ ID NO: 453659 - protein, 8 aa, Mycobacterium
DPDTPTTI

SEQ ID NO: 453660 - protein, 7 aa, Mycobacterium
DPDTRKK

SEQ ID NO: 453661 - protein, 6 aa, Mycobacterium
DPDTRR

SEQ ID NO: 453662 - protein, 7 aa, Mycobacterium
DPDTRRR

SEQ ID NO: 453663 - protein, 6 aa, Mycobacterium
DPDTSG

SEQ ID NO: 453664 - protein, 6 aa, Mycobacterium
DPDTTY

SEQ ID NO: 453665 - protein, 7 aa, Mycobacterium
DPDTTYA

SEQ ID NO: 453666 - protein, 5 aa, Mycobacterium
DPDTV

SEQ ID NO: 453667 - protein, 6 aa, Mycobacterium
DPDTVA

SEQ ID NO: 453668 - protein, 7 aa, Mycobacterium
DPDTVTA

SEQ ID NO: 453669 - protein, 7 aa, Mycobacterium
DPDTYQP

SEQ ID NO: 453670 - protein, 4 aa, Mycobacterium
DPDV

SEQ ID NO: 453671 - protein, 9 aa, Mycobacterium
DPDVDTDAD

SEQ ID NO: 453672 - protein, 19 aa, Mycobacterium
DPDVRAGIENGAAARPELP

SEQ ID NO: 453673 - protein, 8 aa, Mycobacterium
DPDVRNGF

SEQ ID NO: 453674 - protein, 8 aa, Mycobacterium
DPDVRNSV

SEQ ID NO: 453675 - protein, 7 aa, Mycobacterium
DPDVRTS

SEQ ID NO: 453676 - protein, 5 aa, Mycobacterium
DPDWR

SEQ ID NO: 453677 - protein, 10 aa, Mycobacterium
DPDWSPPGRG

SEQ ID NO: 453678 - protein, 5 aa, Mycobacterium
DPEAA

SEQ ID NO: 453679 - protein, 17 aa, Mycobacterium
DPEAAARYAADPAQAIA

SEQ ID NO: 453680 - protein, 16 aa, Mycobacterium
DPEAAARYAANPAQAI

SEQ ID NO: 453681 - protein, 8 aa, Mycobacterium
DPEAAEGL

SEQ ID NO: 453682 - protein, 11 aa, Mycobacterium
DPEAAIDPTGS

SEQ ID NO: 453683 - protein, 11 aa, Mycobacterium
DPEAALDPSGA

SEQ ID NO: 453684 - protein, 11 aa, Mycobacterium
DPEAALNPKGD

SEQ ID NO: 453685 - protein, 9 aa, Mycobacterium
DPEAAQAPD

SEQ ID NO: 453686 - protein, 7 aa, Mycobacterium
DPEAARS

SEQ ID NO: 453687 - protein, 8 aa, Mycobacterium
DPEAARSA

SEQ ID NO: 453688 - protein, 5 aa, Mycobacterium
DPEAD

SEQ ID NO: 453689 - protein, 7 aa, Mycobacterium
DPEADYQ

SEQ ID NO: 453690 - protein, 8 aa, Mycobacterium
DPEAEPSV

SEQ ID NO: 453691 - protein, 5 aa, Mycobacterium
DPEAG

SEQ ID NO: 453692 - protein, 18 aa, Mycobacterium
DPEAGSVGLTADEARRRG

SEQ ID NO: 453693 - protein, 5 aa, Mycobacterium
DPEAI

SEQ ID NO: 453694 - protein, 8 aa, Mycobacterium
DPEAPPYE

SEQ ID NO: 453695 - protein, 9 aa, Mycobacterium
DPEAPRGKL

SEQ ID NO: 453696 - protein, 6 aa, Mycobacterium
DPEAQR

SEQ ID NO: 453697 - protein, 8 aa, Mycobacterium
DPEAQRHK

SEQ ID NO: 453698 - protein, 6 aa, Mycobacterium
DPEARH

SEQ ID NO: 453699 - protein, 18 aa, Mycobacterium
DPEARHTRKSKSTRRDGF

SEQ ID NO: 453700 - protein, 10 aa, Mycobacterium
DPEARKVAEE

SEQ ID NO: 453701 - protein, 10 aa, Mycobacterium
DPEARNDPAA

SEQ ID NO: 453702 - protein, 8 aa, Mycobacterium
DPEARTAD

SEQ ID NO: 453703 - protein, 11 aa, Mycobacterium
DPEATAAAIDG

SEQ ID NO: 453704 - protein, 7 aa, Mycobacterium
DPEATAE

SEQ ID NO: 453705 - protein, 11 aa, Mycobacterium
DPEATATAIDS

SEQ ID NO: 453706 - protein, 8 aa, Mycobacterium
DPEATRRT

SEQ ID NO: 453707 - protein, 6 aa, Mycobacterium
DPEAVQ

SEQ ID NO: 453708 - protein, 14 aa, Mycobacterium
DPECPAAGIDPRAA

SEQ ID NO: 453709 - protein, 7 aa, Mycobacterium
DPEDAAR

SEQ ID NO: 453710 - protein, 11 aa, Mycobacterium
DPEDDPSESQA

SEQ ID NO: 453711 - protein, 8 aa, Mycobacterium
DPEDEDFN

SEQ ID NO: 453712 - protein, 7 aa, Mycobacterium
DPEDFDP

SEQ ID NO: 453713 - protein, 5 aa, Mycobacterium
DPEDH

SEQ ID NO: 453714 - protein, 5 aa, Mycobacterium
DPEDL

SEQ ID NO: 453715 - protein, 19 aa, Mycobacterium
DPEDLARGQDVDPVAGTGY

SEQ ID NO: 453716 - protein, 7 aa, Mycobacterium
DPEDTSE

SEQ ID NO: 453717 - protein, 5 aa, Mycobacterium
DPEDV

SEQ ID NO: 453718 - protein, 6 aa, Mycobacterium
DPEDVE

SEQ ID NO: 453719 - protein, 6 aa, Mycobacterium
DPEDVS

SEQ ID NO: 453720 - protein, 18 aa, Mycobacterium
DPEDWTPPELDENTEIPG

SEQ ID NO: 453721 - protein, 4 aa, Mycobacterium
DPEE

SEQ ID NO: 453722 - protein, 7 aa, Mycobacterium
DPEEAGQ

SEQ ID NO: 453723 - protein, 6 aa, Mycobacterium
DPEEAV

SEQ ID NO: 453724 - protein, 7 aa, Mycobacterium
DPEEGSS

SEQ ID NO: 453725 - protein, 7 aa, Mycobacterium
DPEEPGD

SEQ ID NO: 453726 - protein, 9 aa, Mycobacterium
DPEERAAEG

SEQ ID NO: 453727 - protein, 8 aa, Mycobacterium
DPEERSHS

SEQ ID NO: 453728 - protein, 8 aa, Mycobacterium
DPEERTAS

SEQ ID NO: 453729 - protein, 5 aa, Mycobacterium
DPEET

SEQ ID NO: 453730 - protein, 7 aa, Mycobacterium
DPEFDTG

SEQ ID NO: 453731 - protein, 5 aa, Mycobacterium
DPEFG

SEQ ID NO: 453732 - protein, 8 aa, Mycobacterium
DPEGAAAA

SEQ ID NO: 453733 - protein, 5 aa, Mycobacterium
DPEGD

SEQ ID NO: 453734 - protein, 5 aa, Mycobacterium
DPEGF

SEQ ID NO: 453735 - protein, 5 aa, Mycobacterium
DPEGG

SEQ ID NO: 453736 - protein, 6 aa, Mycobacterium
DPEGGG

SEQ ID NO: 453737 - protein, 5 aa, Mycobacterium
DPEGN

SEQ ID NO: 453738 - protein, 13 aa, Mycobacterium
DPEGNEFCVLAAE

SEQ ID NO: 453739 - protein, 12 aa, Mycobacterium
DPEGNPVPQGEV

SEQ ID NO: 453740 - protein, 7 aa, Mycobacterium
DPEGPTL

SEQ ID NO: 453741 - protein, 13 aa, Mycobacterium
DPEGQLGPGARAR

SEQ ID NO: 453742 - protein, 5 aa, Mycobacterium
DPEGR

SEQ ID NO: 453743 - protein, 15 aa, Mycobacterium
DPEGRETLKGILAST

SEQ ID NO: 453744 - protein, 4 aa, Mycobacterium
DPEH

SEQ ID NO: 453745 - protein, 8 aa, Mycobacterium
DPEHGEAN

SEQ ID NO: 453746 - protein, 6 aa, Mycobacterium
DPEHGP

SEQ ID NO: 453747 - protein, 10 aa, Mycobacterium
DPEHREYRSP

SEQ ID NO: 453748 - protein, 7 aa, Mycobacterium
DPEHRSY

SEQ ID NO: 453749 - protein, 6 aa, Mycobacterium
DPEHRT

SEQ ID NO: 453750 - protein, 5 aa, Mycobacterium
DPEIH

SEQ ID NO: 453751 - protein, 10 aa, Mycobacterium
DPEIQDDPYP

SEQ ID NO: 453752 - protein, 13 aa, Mycobacterium
DPEISPTDSAELT

SEQ ID NO: 453753 - protein, 6 aa, Mycobacterium
DPEKAD

SEQ ID NO: 453754 - protein, 6 aa, Mycobacterium
DPEKAL

SEQ ID NO: 453755 - protein, 7 aa, Mycobacterium
DPEKAVG

SEQ ID NO: 453756 - protein, 6 aa, Mycobacterium
DPEKFD

SEQ ID NO: 453757 - protein, 8 aa, Mycobacterium
DPEKHSLG

SEQ ID NO: 453758 - protein, 5 aa, Mycobacterium
DPEKK

SEQ ID NO: 453759 - protein, 8 aa, Mycobacterium
DPEKKKAL

SEQ ID NO: 453760 - protein, 5 aa, Mycobacterium
DPEKR

SEQ ID NO: 453761 - protein, 19 aa, Mycobacterium
DPEKSPESSGRGPASQGVT

SEQ ID NO: 453762 - protein, 8 aa, Mycobacterium
DPEKTAAA

SEQ ID NO: 453763 - protein, 5 aa, Mycobacterium
DPELA

SEQ ID NO: 453764 - protein, 18 aa, Mycobacterium
DPELGKAVEEGVRAGLDA

SEQ ID NO: 453765 - protein, 16 aa, Mycobacterium
DPELHSNPGAARKAGR

SEQ ID NO: 453766 - protein, 9 aa, Mycobacterium
DPELPRDRG

SEQ ID NO: 453767 - protein, 10 aa, Mycobacterium
DPELSGPAQG

SEQ ID NO: 453768 - protein, 9 aa, Mycobacterium
DPENAERPD

SEQ ID NO: 453769 - protein, 7 aa, Mycobacterium
DPENGSS

SEQ ID NO: 453770 - protein, 10 aa, Mycobacterium
DPENNTDPYR

SEQ ID NO: 453771 - protein, 5 aa, Mycobacterium
DPENT

SEQ ID NO: 453772 - protein, 7 aa, Mycobacterium
DPENTYK

SEQ ID NO: 453773 - protein, 10 aa, Mycobacterium
DPEPDTGRAA

SEQ ID NO: 453774 - protein, 15 aa, Mycobacterium
DPEPIDGSARKPGAR

SEQ ID NO: 453775 - protein, 10 aa, Mycobacterium
DPEPPAADDP

SEQ ID NO: 453776 - protein, 13 aa, Mycobacterium
DPEPPEDARDEVE

SEQ ID NO: 453777 - protein, 12 aa, Mycobacterium
DPEPPEDAREEI

SEQ ID NO: 453778 - protein, 12 aa, Mycobacterium
DPEPPEQARPEI

SEQ ID NO: 453779 - protein, 7 aa, Mycobacterium
DPEPPKD

SEQ ID NO: 453780 - protein, 11 aa, Mycobacterium
DPEPRRSEARA

SEQ ID NO: 453781 - protein, 4 aa, Mycobacterium
DPEQ

SEQ ID NO: 453782 - protein, 7 aa, Mycobacterium
DPEQGLT

SEQ ID NO: 453783 - protein, 7 aa, Mycobacterium
DPEQGSS

SEQ ID NO: 453784 - protein, 9 aa, Mycobacterium
DPEQHTPGL

SEQ ID NO: 453785 - protein, 6 aa, Mycobacterium
DPEQIG

SEQ ID NO: 453786 - protein, 8 aa, Mycobacterium
DPEQPGRW

SEQ ID NO: 453787 - protein, 6 aa, Mycobacterium
DPEQRA

SEQ ID NO: 453788 - protein, 7 aa, Mycobacterium
DPERARE

SEQ ID NO: 453789 - protein, 7 aa, Mycobacterium
DPERDGS

SEQ ID NO: 453790 - protein, 8 aa, Mycobacterium
DPERDTGA

SEQ ID NO: 453791 - protein, 5 aa, Mycobacterium
DPERG

SEQ ID NO: 453792 - protein, 8 aa, Mycobacterium
DPERGGGV

SEQ ID NO: 453793 - protein, 7 aa, Mycobacterium
DPERGSS

SEQ ID NO: 453794 - protein, 5 aa, Mycobacterium
DPERK

SEQ ID NO: 453795 - protein, 5 aa, Mycobacterium
DPERL

SEQ ID NO: 453796 - protein, 7 aa, Mycobacterium
DPERPLA

SEQ ID NO: 453797 - protein, 8 aa, Mycobacterium
DPERPLSA

SEQ ID NO: 453798 - protein, 8 aa, Mycobacterium
DPERTAEV

SEQ ID NO: 453799 - protein, 5 aa, Mycobacterium
DPERV

SEQ ID NO: 453800 - protein, 14 aa, Mycobacterium
DPERYRRDDPAGPL

SEQ ID NO: 453801 - protein, 4 aa, Mycobacterium
DPES

SEQ ID NO: 453802 - protein, 19 aa, Mycobacterium
DPESAAVGLTSQQARDAGY

SEQ ID NO: 453803 - protein, 7 aa, Mycobacterium
DPESAFT

SEQ ID NO: 453804 - protein, 9 aa, Mycobacterium
DPESAHSVE

SEQ ID NO: 453805 - protein, 9 aa, Mycobacterium
DPESARSVE

SEQ ID NO: 453806 - protein, 11 aa, Mycobacterium
DPESDRPRDTV

SEQ ID NO: 453807 - protein, 5 aa, Mycobacterium
DPESF

SEQ ID NO: 453808 - protein, 16 aa, Mycobacterium
DPESGGLRRVTDDDNR

SEQ ID NO: 453809 - protein, 7 aa, Mycobacterium
DPESGHE

SEQ ID NO: 453810 - protein, 7 aa, Mycobacterium
DPESGPG

SEQ ID NO: 453811 - protein, 12 aa, Mycobacterium
DPESGSALGEGR

SEQ ID NO: 453812 - protein, 8 aa, Mycobacterium
DPESPLNR

SEQ ID NO: 453813 - protein, 7 aa, Mycobacterium
DPESRGL

SEQ ID NO: 453814 - protein, 6 aa, Mycobacterium
DPESRK

SEQ ID NO: 453815 - protein, 15 aa, Mycobacterium
DPESRNDEDSAASMP

SEQ ID NO: 453816 - protein, 14 aa, Mycobacterium
DPESTDDTIADAKA

SEQ ID NO: 453817 - protein, 4 aa, Mycobacterium
DPET

SEQ ID NO: 453818 - protein, 9 aa, Mycobacterium
DPETAANEA

SEQ ID NO: 453819 - protein, 16 aa, Mycobacterium
DPETAARISGRSESGH

SEQ ID NO: 453820 - protein, 11 aa, Mycobacterium
DPETAIDPSKP

SEQ ID NO: 453821 - protein, 7 aa, Mycobacterium
DPETARR

SEQ ID NO: 453822 - protein, 8 aa, Mycobacterium
DPETCEAA

SEQ ID NO: 453823 - protein, 6 aa, Mycobacterium
DPETFS

SEQ ID NO: 453824 - protein, 18 aa, Mycobacterium
DPETFSSVGGSPAPAPVR

SEQ ID NO: 453825 - protein, 7 aa, Mycobacterium
DPETGAP

SEQ ID NO: 453826 - protein, 14 aa, Mycobacterium
DPETGAPVPAGQPG

SEQ ID NO: 453827 - protein, 14 aa, Mycobacterium
DPETGASLPPGQSG

SEQ ID NO: 453828 - protein, 6 aa, Mycobacterium
DPETGE

SEQ ID NO: 453829 - protein, 13 aa, Mycobacterium
DPETGQVIRKAIG

SEQ ID NO: 453830 - protein, 8 aa, Mycobacterium
DPETGRQD

SEQ ID NO: 453831 - protein, 5 aa, Mycobacterium
DPETL

SEQ ID NO: 453832 - protein, 11 aa, Mycobacterium
DPETLDELDGP

SEQ ID NO: 453833 - protein, 6 aa, Mycobacterium
DPETPA

SEQ ID NO: 453834 - protein, 5 aa, Mycobacterium
DPETR

SEQ ID NO: 453835 - protein, 7 aa, Mycobacterium
DPETRHT

SEQ ID NO: 453836 - protein, 8 aa, Mycobacterium
DPETRSQR

SEQ ID NO: 453837 - protein, 8 aa, Mycobacterium
DPETRTAD

SEQ ID NO: 453838 - protein, 7 aa, Mycobacterium
DPETTYR

SEQ ID NO: 453839 - protein, 5 aa, Mycobacterium
DPETV

SEQ ID NO: 453840 - protein, 7 aa, Mycobacterium
DPETVTA

SEQ ID NO: 453841 - protein, 7 aa, Mycobacterium
DPETVTT

SEQ ID NO: 453842 - protein, 8 aa, Mycobacterium
DPETYRPG

SEQ ID NO: 453843 - protein, 17 aa, Mycobacterium
DPETYSSVTGGGRPYGG

SEQ ID NO: 453844 - protein, 8 aa, Mycobacterium
DPETYTRE

SEQ ID NO: 453845 - protein, 5 aa, Mycobacterium
DPEVA

SEQ ID NO: 453846 - protein, 5 aa, Mycobacterium
DPEVH

SEQ ID NO: 453847 - protein, 7 aa, Mycobacterium
DPEVPPA

SEQ ID NO: 453848 - protein, 8 aa, Mycobacterium
DPEVPPIP

SEQ ID NO: 453849 - protein, 7 aa, Mycobacterium
DPEVPTA

SEQ ID NO: 453850 - protein, 5 aa, Mycobacterium
DPEVR

SEQ ID NO: 453851 - protein, 22 aa, Mycobacterium
DPEWASDPELSTHTGRRTHHDR

SEQ ID NO: 453852 - protein, 4 aa, Mycobacterium
DPEY

SEQ ID NO: 453853 - protein, 6 aa, Mycobacterium
DPEYAA

SEQ ID NO: 453854 - protein, 12 aa, Mycobacterium
DPEYARSQGQRT

SEQ ID NO: 453855 - protein, 9 aa, Mycobacterium
DPEYGESVA

SEQ ID NO: 453856 - protein, 9 aa, Mycobacterium
DPEYGGQGA

SEQ ID NO: 453857 - protein, 5 aa, Mycobacterium
DPEYP

SEQ ID NO: 453858 - protein, 5 aa, Mycobacterium
DPEYQ

SEQ ID NO: 453859 - protein, 4 aa, Mycobacterium
DPFA

SEQ ID NO: 453860 - protein, 13 aa, Mycobacterium
DPFADDPHDPSAA

SEQ ID NO: 453861 - protein, 14 aa, Mycobacterium
DPFADDPSDPSAAL

SEQ ID NO: 453862 - protein, 13 aa, Mycobacterium
DPFADDPYDPSAA

SEQ ID NO: 453863 - protein, 5 aa, Mycobacterium
DPFAE

SEQ ID NO: 453864 - protein, 19 aa, Mycobacterium
DPFAPDGGLKTLSGNLGTS

SEQ ID NO: 453865 - protein, 4 aa, Mycobacterium
DPFD

SEQ ID NO: 453866 - protein, 5 aa, Mycobacterium
DPFDP

SEQ ID NO: 453867 - protein, 11 aa, Mycobacterium
DPFDPRPPPRR

SEQ ID NO: 453868 - protein, 4 aa, Mycobacterium
DPFE

SEQ ID NO: 453869 - protein, 5 aa, Mycobacterium
DPFES

SEQ ID NO: 453870 - protein, 23 aa, Mycobacterium
DPFGAADTEPNTTRPFASETATY

SEQ ID NO: 453871 - protein, 8 aa, Mycobacterium
DPFGPDGG

SEQ ID NO: 453872 - protein, 7 aa, Mycobacterium
DPFGPTG

SEQ ID NO: 453873 - protein, 8 aa, Mycobacterium
DPFGRTAR

SEQ ID NO: 453874 - protein, 13 aa, Mycobacterium
DPFGSGSSQTSGV

SEQ ID NO: 453875 - protein, 4 aa, Mycobacterium
DPFI

SEQ ID NO: 453876 - protein, 4 aa, Mycobacterium
DPFP

SEQ ID NO: 453877 - protein, 7 aa, Mycobacterium
DPFPAER

SEQ ID NO: 453878 - protein, 12 aa, Mycobacterium
DPFRPGTSVTAD

SEQ ID NO: 453879 - protein, 8 aa, Mycobacterium
DPFRPSQR

SEQ ID NO: 453880 - protein, 6 aa, Mycobacterium
DPFSGD

SEQ ID NO: 453881 - protein, 4 aa, Mycobacterium
DPFT

SEQ ID NO: 453882 - protein, 6 aa, Mycobacterium
DPFTGR

SEQ ID NO: 453883 - protein, 20 aa, Mycobacterium
DPFTGRTVSSSDPFAHIPVP

SEQ ID NO: 453884 - protein, 5 aa, Mycobacterium
DPGAA

SEQ ID NO: 453885 - protein, 7 aa, Mycobacterium
DPGAAAH

SEQ ID NO: 453886 - protein, 7 aa, Mycobacterium
DPGAAAL

SEQ ID NO: 453887 - protein, 8 aa, Mycobacterium
DPGAAALA

SEQ ID NO: 453888 - protein, 11 aa, Mycobacterium
DPGAAALAERT

SEQ ID NO: 453889 - protein, 12 aa, Mycobacterium
DPGAAALAERTA

SEQ ID NO: 453890 - protein, 10 aa, Mycobacterium
DPGAAEALNP

SEQ ID NO: 453891 - protein, 16 aa, Mycobacterium
DPGAAQRRARAARERL

SEQ ID NO: 453892 - protein, 10 aa, Mycobacterium
DPGAASPKET

SEQ ID NO: 453893 - protein, 7 aa, Mycobacterium
DPGACRR

SEQ ID NO: 453894 - protein, 10 aa, Mycobacterium
DPGADHADEQ

SEQ ID NO: 453895 - protein, 8 aa, Mycobacterium
DPGADRPL

SEQ ID NO: 453896 - protein, 6 aa, Mycobacterium
DPGAER

SEQ ID NO: 453897 - protein, 11 aa, Mycobacterium
DPGAESPQETR

SEQ ID NO: 453898 - protein, 19 aa, Mycobacterium
DPGAGNLAERSGRSSPSSI

SEQ ID NO: 453899 - protein, 7 aa, Mycobacterium
DPGAHVG

SEQ ID NO: 453900 - protein, 5 aa, Mycobacterium
DPGAI

SEQ ID NO: 453901 - protein, 9 aa, Mycobacterium
DPGALEPTL

SEQ ID NO: 453902 - protein, 15 aa, Mycobacterium
DPGALRRTRAAARSR

SEQ ID NO: 453903 - protein, 6 aa, Mycobacterium
DPGAPI

SEQ ID NO: 453904 - protein, 11 aa, Mycobacterium
DPGAPSPSSER

SEQ ID NO: 453905 - protein, 5 aa, Mycobacterium
DPGAR

SEQ ID NO: 453906 - protein, 17 aa, Mycobacterium
DPGARRPGEINHRDGGR

SEQ ID NO: 453907 - protein, 10 aa, Mycobacterium
DPGARSPRPA

SEQ ID NO: 453908 - protein, 14 aa, Mycobacterium
DPGASTVEVVVRAD

SEQ ID NO: 453909 - protein, 8 aa, Mycobacterium
DPGATAAV

SEQ ID NO: 453910 - protein, 8 aa, Mycobacterium
DPGATPKL

SEQ ID NO: 453911 - protein, 18 aa, Mycobacterium
DPGATRPGEINHNDGGRG

SEQ ID NO: 453912 - protein, 18 aa, Mycobacterium
DPGATRPGEVNHRDGGRG

SEQ ID NO: 453913 - protein, 4 aa, Mycobacterium
DPGC

SEQ ID NO: 453914 - protein, 6 aa, Mycobacterium
DPGCGN

SEQ ID NO: 453915 - protein, 4 aa, Mycobacterium
DPGD

SEQ ID NO: 453916 - protein, 13 aa, Mycobacterium
DPGDAERYSPAGY

SEQ ID NO: 453917 - protein, 41 aa, Mycobacterium
DPGDAPTIPPPLSEPANPARPSAAEEARTIAASTNSGTLAS

SEQ ID NO: 453918 - protein, 6 aa, Mycobacterium
DPGDAR

SEQ ID NO: 453919 - protein, 8 aa, Mycobacterium
DPGDESPV

SEQ ID NO: 453920 - protein, 9 aa, Mycobacterium
DPGDLPEEE

SEQ ID NO: 453921 - protein, 7 aa, Mycobacterium
DPGDPAD

SEQ ID NO: 453922 - protein, 7 aa, Mycobacterium
DPGDPMT

SEQ ID NO: 453923 - protein, 6 aa, Mycobacterium
DPGDRM

SEQ ID NO: 453924 - protein, 7 aa, Mycobacterium
DPGDRPH

SEQ ID NO: 453925 - protein, 8 aa, Mycobacterium
DPGDSAPV

SEQ ID NO: 453926 - protein, 8 aa, Mycobacterium
DPGEANNL

SEQ ID NO: 453927 - protein, 6 aa, Mycobacterium
DPGEGF

SEQ ID NO: 453928 - protein, 7 aa, Mycobacterium
DPGEGFS

SEQ ID NO: 453929 - protein, 5 aa, Mycobacterium
DPGEH

SEQ ID NO: 453930 - protein, 7 aa, Mycobacterium
DPGEIHP

SEQ ID NO: 453931 - protein, 12 aa, Mycobacterium
DPGELDSNAPIA

SEQ ID NO: 453932 - protein, 7 aa, Mycobacterium
DPGELPP

SEQ ID NO: 453933 - protein, 6 aa, Mycobacterium
DPGELT

SEQ ID NO: 453934 - protein, 5 aa, Mycobacterium
DPGEP

SEQ ID NO: 453935 - protein, 7 aa, Mycobacterium
DPGEPVE

SEQ ID NO: 453936 - protein, 8 aa, Mycobacterium
DPGETAEV

SEQ ID NO: 453937 - protein, 6 aa, Mycobacterium
DPGETM

SEQ ID NO: 453938 - protein, 7 aa, Mycobacterium
DPGEVPI

SEQ ID NO: 453939 - protein, 5 aa, Mycobacterium
DPGFV

SEQ ID NO: 453940 - protein, 11 aa, Mycobacterium
DPGGAHRPGNV

SEQ ID NO: 453941 - protein, 5 aa, Mycobacterium
DPGGG

SEQ ID NO: 453942 - protein, 11 aa, Mycobacterium
DPGGGYGEPEE

SEQ ID NO: 453943 - protein, 14 aa, Mycobacterium
DPGGPVPANFGPEP

SEQ ID NO: 453944 - protein, 9 aa, Mycobacterium
DPGGTPSSL

SEQ ID NO: 453945 - protein, 5 aa, Mycobacterium
DPGGV

SEQ ID NO: 453946 - protein, 6 aa, Mycobacterium
DPGGVP

SEQ ID NO: 453947 - protein, 6 aa, Mycobacterium
DPGHGL

SEQ ID NO: 453948 - protein, 9 aa, Mycobacterium
DPGIARADP

SEQ ID NO: 453949 - protein, 5 aa, Mycobacterium
DPGIT

SEQ ID NO: 453950 - protein, 4 aa, Mycobacterium
DPGK

SEQ ID NO: 453951 - protein, 5 aa, Mycobacterium
DPGKA

SEQ ID NO: 453952 - protein, 5 aa, Mycobacterium
DPGKV

SEQ ID NO: 453953 - protein, 12 aa, Mycobacterium
DPGKVAKLSSGD

SEQ ID NO: 453954 - protein, 4 aa, Mycobacterium
DPGL

SEQ ID NO: 453955 - protein, 5 aa, Mycobacterium
DPGLA

SEQ ID NO: 453956 - protein, 13 aa, Mycobacterium
DPGLDAAREVATG

SEQ ID NO: 453957 - protein, 9 aa, Mycobacterium
DPGLGASPS

SEQ ID NO: 453958 - protein, 6 aa, Mycobacterium
DPGLGR

SEQ ID NO: 453959 - protein, 24 aa, Mycobacterium
DPGLRTPIPSGREARRVSAEERNG

SEQ ID NO: 453960 - protein, 6 aa, Mycobacterium
DPGLRV

SEQ ID NO: 453961 - protein, 5 aa, Mycobacterium
DPGLT

SEQ ID NO: 453962 - protein, 5 aa, Mycobacterium
DPGMA

SEQ ID NO: 453963 - protein, 14 aa, Mycobacterium
DPGMAPPGKHAASA

SEQ ID NO: 453964 - protein, 7 aa, Mycobacterium
DPGMDGS

SEQ ID NO: 453965 - protein, 9 aa, Mycobacterium
DPGNEAVAR

SEQ ID NO: 453966 - protein, 10 aa, Mycobacterium
DPGNEAVARE

SEQ ID NO: 453967 - protein, 11 aa, Mycobacterium
DPGNEYAANTV

SEQ ID NO: 453968 - protein, 5 aa, Mycobacterium
DPGNG

SEQ ID NO: 453969 - protein, 21 aa, Mycobacterium
DPGNGRGRSAQGVTGSGSGGI

SEQ ID NO: 453970 - protein, 5 aa, Mycobacterium
DPGNR

SEQ ID NO: 453971 - protein, 5 aa, Mycobacterium
DPGNV

SEQ ID NO: 453972 - protein, 4 aa, Mycobacterium
DPGP

SEQ ID NO: 453973 - protein, 13 aa, Mycobacterium
DPGPAAAYSPTGY

SEQ ID NO: 453974 - protein, 8 aa, Mycobacterium
DPGPADDE

SEQ ID NO: 453975 - protein, 7 aa, Mycobacterium
DPGPADW

SEQ ID NO: 453976 - protein, 7 aa, Mycobacterium
DPGPAVG

SEQ ID NO: 453977 - protein, 6 aa, Mycobacterium
DPGPDA

SEQ ID NO: 453978 - protein, 8 aa, Mycobacterium
DPGPDDAE

SEQ ID NO: 453979 - protein, 11 aa, Mycobacterium
DPGPDDKDEHI

SEQ ID NO: 453980 - protein, 9 aa, Mycobacterium
DPGPGDDEH

SEQ ID NO: 453981 - protein, 8 aa, Mycobacterium
DPGPGGHV

SEQ ID NO: 453982 - protein, 7 aa, Mycobacterium
DPGPITG

SEQ ID NO: 453983 - protein, 7 aa, Mycobacterium
DPGPLTA

SEQ ID NO: 453984 - protein, 8 aa, Mycobacterium
DPGPLTPL

SEQ ID NO: 453985 - protein, 5 aa, Mycobacterium
DPGPM

SEQ ID NO: 453986 - protein, 6 aa, Mycobacterium
DPGPNV

SEQ ID NO: 453987 - protein, 9 aa, Mycobacterium
DPGPPRPGY

SEQ ID NO: 453988 - protein, 5 aa, Mycobacterium
DPGPQ

SEQ ID NO: 453989 - protein, 8 aa, Mycobacterium
DPGPRTST

SEQ ID NO: 453990 - protein, 14 aa, Mycobacterium
DPGPVDAGAASPPG

SEQ ID NO: 453991 - protein, 7 aa, Mycobacterium
DPGPVQD

SEQ ID NO: 453992 - protein, 19 aa, Mycobacterium
DPGQARDQAGWVQALAALH

SEQ ID NO: 453993 - protein, 7 aa, Mycobacterium
DPGQGEW

SEQ ID NO: 453994 - protein, 5 aa, Mycobacterium
DPGQI

SEQ ID NO: 453995 - protein, 6 aa, Mycobacterium
DPGQLS

SEQ ID NO: 453996 - protein, 11 aa, Mycobacterium
DPGQPGGNTSI

SEQ ID NO: 453997 - protein, 9 aa, Mycobacterium
DPGQPSERV

SEQ ID NO: 453998 - protein, 18 aa, Mycobacterium
DPGQRSRGIAAAAGALKG

SEQ ID NO: 453999 - protein, 7 aa, Mycobacterium
DPGQVDP

SEQ ID NO: 454000 - protein, 10 aa, Mycobacterium
DPGRADVGQQ

SEQ ID NO: 454001 - protein, 7 aa, Mycobacterium
DPGRAIP

SEQ ID NO: 454002 - protein, 6 aa, Mycobacterium
DPGRAR

SEQ ID NO: 454003 - protein, 5 aa, Mycobacterium
DPGRD

SEQ ID NO: 454004 - protein, 5 aa, Mycobacterium
DPGRF

SEQ ID NO: 454005 - protein, 19 aa, Mycobacterium
DPGRFDPSRFDEPRREDQH

SEQ ID NO: 454006 - protein, 14 aa, Mycobacterium
DPGRHDAVNGTVSI

SEQ ID NO: 454007 - protein, 8 aa, Mycobacterium
DPGRPGSD

SEQ ID NO: 454008 - protein, 8 aa, Mycobacterium
DPGRRAEV

SEQ ID NO: 454009 - protein, 21 aa, Mycobacterium
DPGRRAGGRRRFDPSAYSPPL

SEQ ID NO: 454010 - protein, 13 aa, Mycobacterium
DPGRRSEVHRSAQ

SEQ ID NO: 454011 - protein, 5 aa, Mycobacterium
DPGSA

SEQ ID NO: 454012 - protein, 22 aa, Mycobacterium
DPGSASPAQTPAPLTPPTVAAP

SEQ ID NO: 454013 - protein, 15 aa, Mycobacterium
DPGSFRRGRASRRGR

SEQ ID NO: 454014 - protein, 9 aa, Mycobacterium
DPGSGRVSA

SEQ ID NO: 454015 - protein, 7 aa, Mycobacterium
DPGSIGR

SEQ ID NO: 454016 - protein, 8 aa, Mycobacterium
DPGSLSED

SEQ ID NO: 454017 - protein, 8 aa, Mycobacterium
DPGSRGAL

SEQ ID NO: 454018 - protein, 9 aa, Mycobacterium
DPGSSDDGV

SEQ ID NO: 454019 - protein, 9 aa, Mycobacterium
DPGSSLNPR

SEQ ID NO: 454020 - protein, 19 aa, Mycobacterium
DPGSSTHPLHDPWADFSGI

SEQ ID NO: 454021 - protein, 8 aa, Mycobacterium
DPGSTTDY

SEQ ID NO: 454022 - protein, 15 aa, Mycobacterium
DPGSVAEPPTVQATA

SEQ ID NO: 454023 - protein, 7 aa, Mycobacterium
DPGSYDL

SEQ ID NO: 454024 - protein, 9 aa, Mycobacterium
DPGTDADRL

SEQ ID NO: 454025 - protein, 5 aa, Mycobacterium
DPGTG

SEQ ID NO: 454026 - protein, 8 aa, Mycobacterium
DPGTGDWP

SEQ ID NO: 454027 - protein, 13 aa, Mycobacterium
DPGTGEELGDGTV

SEQ ID NO: 454028 - protein, 23 aa, Mycobacterium
DPGTGEPAPRNAEVAAEAKDRGV

SEQ ID NO: 454029 - protein, 9 aa, Mycobacterium
DPGTGETTV

SEQ ID NO: 454030 - protein, 9 aa, Mycobacterium
DPGTGKSSV

SEQ ID NO: 454031 - protein, 15 aa, Mycobacterium
DPGTGRATAAATTPE

SEQ ID NO: 454032 - protein, 7 aa, Mycobacterium
DPGTGSL

SEQ ID NO: 454033 - protein, 6 aa, Mycobacterium
DPGTGV

SEQ ID NO: 454034 - protein, 5 aa, Mycobacterium
DPGTH

SEQ ID NO: 454035 - protein, 6 aa, Mycobacterium
DPGTIG

SEQ ID NO: 454036 - protein, 5 aa, Mycobacterium
DPGTM

SEQ ID NO: 454037 - protein, 5 aa, Mycobacterium
DPGTQ

SEQ ID NO: 454038 - protein, 7 aa, Mycobacterium
DPGVDSG

SEQ ID NO: 454039 - protein, 7 aa, Mycobacterium
DPGVERG

SEQ ID NO: 454040 - protein, 18 aa, Mycobacterium
DPGVGRDGSSSDEEGPAA

SEQ ID NO: 454041 - protein, 9 aa, Mycobacterium
DPGVGTDPV

SEQ ID NO: 454042 - protein, 5 aa, Mycobacterium
DPGVP

SEQ ID NO: 454043 - protein, 6 aa, Mycobacterium
DPGVPD

SEQ ID NO: 454044 - protein, 6 aa, Mycobacterium
DPGVPF

SEQ ID NO: 454045 - protein, 5 aa, Mycobacterium
DPGVS

SEQ ID NO: 454046 - protein, 6 aa, Mycobacterium
DPGVSA

SEQ ID NO: 454047 - protein, 5 aa, Mycobacterium
DPGWA

SEQ ID NO: 454048 - protein, 4 aa, Mycobacterium
DPGY

SEQ ID NO: 454049 - protein, 5 aa, Mycobacterium
DPGYA

SEQ ID NO: 454050 - protein, 16 aa, Mycobacterium
DPGYNDGPLRDGGQPV

SEQ ID NO: 454051 - protein, 8 aa, Mycobacterium
DPGYPITT

SEQ ID NO: 454052 - protein, 7 aa, Mycobacterium
DPGYRER

SEQ ID NO: 454053 - protein, 10 aa, Mycobacterium
DPGYSEETTQ

SEQ ID NO: 454054 - protein, 11 aa, Mycobacterium
DPGYSEETTQD

SEQ ID NO: 454055 - protein, 9 aa, Mycobacterium
DPGYSGDTA

SEQ ID NO: 454056 - protein, 6 aa, Mycobacterium
DPHAAD

SEQ ID NO: 454057 - protein, 37 aa, Mycobacterium
DPHAAGDDAPGARPPKREVPPPVWGGESDVEERRMGS

SEQ ID NO: 454058 - protein, 6 aa, Mycobacterium
DPHAAP

SEQ ID NO: 454059 - protein, 6 aa, Mycobacterium
DPHAPP

SEQ ID NO: 454060 - protein, 6 aa, Mycobacterium
DPHAVS

SEQ ID NO: 454061 - protein, 12 aa, Mycobacterium
DPHDAGAAATSI

SEQ ID NO: 454062 - protein, 8 aa, Mycobacterium
DPHDPDPE

SEQ ID NO: 454063 - protein, 10 aa, Mycobacterium
DPHDPDTDLG

SEQ ID NO: 454064 - protein, 6 aa, Mycobacterium
DPHELP

SEQ ID NO: 454065 - protein, 7 aa, Mycobacterium
DPHEPGH

SEQ ID NO: 454066 - protein, 6 aa, Mycobacterium
DPHEPS

SEQ ID NO: 454067 - protein, 5 aa, Mycobacterium
DPHGL

SEQ ID NO: 454068 - protein, 13 aa, Mycobacterium
DPHGPLDRTHPTR

SEQ ID NO: 454069 - protein, 5 aa, Mycobacterium
DPHGQ

SEQ ID NO: 454070 - protein, 7 aa, Mycobacterium
DPHGQGV

SEQ ID NO: 454071 - protein, 10 aa, Mycobacterium
DPHGRASAEQ

SEQ ID NO: 454072 - protein, 10 aa, Mycobacterium
DPHGRSDALG

SEQ ID NO: 454073 - protein, 7 aa, Mycobacterium
DPHKRAV

SEQ ID NO: 454074 - protein, 7 aa, Mycobacterium
DPHKTAV

SEQ ID NO: 454075 - protein, 11 aa, Mycobacterium
DPHLSAADRNA

SEQ ID NO: 454076 - protein, 5 aa, Mycobacterium
DPHNA

SEQ ID NO: 454077 - protein, 7 aa, Mycobacterium
DPHNPDE

SEQ ID NO: 454078 - protein, 6 aa, Mycobacterium
DPHNSE

SEQ ID NO: 454079 - protein, 5 aa, Mycobacterium
DPHNT

SEQ ID NO: 454080 - protein, 5 aa, Mycobacterium
DPHNV

SEQ ID NO: 454081 - protein, 4 aa, Mycobacterium
DPHP

SEQ ID NO: 454082 - protein, 6 aa, Mycobacterium
DPHPAD

SEQ ID NO: 454083 - protein, 5 aa, Mycobacterium
DPHPD

SEQ ID NO: 454084 - protein, 6 aa, Mycobacterium
DPHPGN

SEQ ID NO: 454085 - protein, 8 aa, Mycobacterium
DPHPGNYR

SEQ ID NO: 454086 - protein, 6 aa, Mycobacterium
DPHPRH

SEQ ID NO: 454087 - protein, 6 aa, Mycobacterium
DPHPRN

SEQ ID NO: 454088 - protein, 6 aa, Mycobacterium
DPHPVP

SEQ ID NO: 454089 - protein, 4 aa, Mycobacterium
DPHQ

SEQ ID NO: 454090 - protein, 9 aa, Mycobacterium
DPHQLGATA

SEQ ID NO: 454091 - protein, 9 aa, Mycobacterium
DPHQSGTAV

SEQ ID NO: 454092 - protein, 5 aa, Mycobacterium
DPHRA

SEQ ID NO: 454093 - protein, 7 aa, Mycobacterium
DPHRDDA

SEQ ID NO: 454094 - protein, 15 aa, Mycobacterium
DPHRQPVPGNVGRGV

SEQ ID NO: 454095 - protein, 7 aa, Mycobacterium
DPHRRPG

SEQ ID NO: 454096 - protein, 7 aa, Mycobacterium
DPHSGAS

SEQ ID NO: 454097 - protein, 8 aa, Mycobacterium
DPHSTLRA

SEQ ID NO: 454098 - protein, 4 aa, Mycobacterium
DPHT

SEQ ID NO: 454099 - protein, 11 aa, Mycobacterium
DPHTAVRRGGQ

SEQ ID NO: 454100 - protein, 8 aa, Mycobacterium
DPHTGEHG

SEQ ID NO: 454101 - protein, 5 aa, Mycobacterium
DPHTP

SEQ ID NO: 454102 - protein, 7 aa, Mycobacterium
DPHTPEV

SEQ ID NO: 454103 - protein, 7 aa, Mycobacterium
DPHTPYV

SEQ ID NO: 454104 - protein, 14 aa, Mycobacterium
DPHVPNKGTAGRGM

SEQ ID NO: 454105 - protein, 12 aa, Mycobacterium
DPIAGQGAQGGL

SEQ ID NO: 454106 - protein, 5 aa, Mycobacterium
DPIAV

SEQ ID NO: 454107 - protein, 8 aa, Mycobacterium
DPICSGGG

SEQ ID NO: 454108 - protein, 4 aa, Mycobacterium
DPID

SEQ ID NO: 454109 - protein, 6 aa, Mycobacterium
DPIDAD

SEQ ID NO: 454110 - protein, 12 aa, Mycobacterium
DPIDGATPAGAS

SEQ ID NO: 454111 - protein, 6 aa, Mycobacterium
DPIDRR

SEQ ID NO: 454112 - protein, 11 aa, Mycobacterium
DPIDSGPVSPL

SEQ ID NO: 454113 - protein, 11 aa, Mycobacterium
DPIETDNRWTD

SEQ ID NO: 454114 - protein, 11 aa, Mycobacterium
DPIETPDEYEK

SEQ ID NO: 454115 - protein, 5 aa, Mycobacterium
DPIGF

SEQ ID NO: 454116 - protein, 5 aa, Mycobacterium
DPIGP

SEQ ID NO: 454117 - protein, 7 aa, Mycobacterium
DPIGRPA

SEQ ID NO: 454118 - protein, 7 aa, Mycobacterium
DPINDEP

SEQ ID NO: 454119 - protein, 4 aa, Mycobacterium
DPIP

SEQ ID NO: 454120 - protein, 11 aa, Mycobacterium
DPIPALGQGPD

SEQ ID NO: 454121 - protein, 11 aa, Mycobacterium
DPIPARGQGPD

SEQ ID NO: 454122 - protein, 28 aa, Mycobacterium
DPIPERQGCRADEAGCSPAVKQGESEFF

SEQ ID NO: 454123 - protein, 8 aa, Mycobacterium
DPIPERQR

SEQ ID NO: 454124 - protein, 7 aa, Mycobacterium
DPIPGND

SEQ ID NO: 454125 - protein, 8 aa, Mycobacterium
DPIPGNEA

SEQ ID NO: 454126 - protein, 5 aa, Mycobacterium
DPIPL

SEQ ID NO: 454127 - protein, 6 aa, Mycobacterium
DPIPLG

SEQ ID NO: 454128 - protein, 5 aa, Mycobacterium
DPIPP

SEQ ID NO: 454129 - protein, 10 aa, Mycobacterium
DPIPPDQEAL

SEQ ID NO: 454130 - protein, 4 aa, Mycobacterium
DPIQ

SEQ ID NO: 454131 - protein, 5 aa, Mycobacterium
DPIQP

SEQ ID NO: 454132 - protein, 4 aa, Mycobacterium
DPIR

SEQ ID NO: 454133 - protein, 25 aa, Mycobacterium
DPIRAGQPTREAGDNSTVDPETDGT

SEQ ID NO: 454134 - protein, 4 aa, Mycobacterium
DPIS

SEQ ID NO: 454135 - protein, 6 aa, Mycobacterium
DPISAA

SEQ ID NO: 454136 - protein, 4 aa, Mycobacterium
DPIT

SEQ ID NO: 454137 - protein, 15 aa, Mycobacterium
DPITDDDATNPVTEG

SEQ ID NO: 454138 - protein, 15 aa, Mycobacterium
DPITDDDTTNPITEG

SEQ ID NO: 454139 - protein, 11 aa, Mycobacterium
DPITGDSEHEH

SEQ ID NO: 454140 - protein, 5 aa, Mycobacterium
DPITN

SEQ ID NO: 454141 - protein, 6 aa, Mycobacterium
DPITPA

SEQ ID NO: 454142 - protein, 20 aa, Mycobacterium
DPIWDPSGDLADTDQGKAVA

SEQ ID NO: 454143 - protein, 5 aa, Mycobacterium
DPKAA

SEQ ID NO: 454144 - protein, 19 aa, Mycobacterium
DPKAAANEAAGRKRKAEKF

SEQ ID NO: 454145 - protein, 11 aa, Mycobacterium
DPKAAVDPSGE

SEQ ID NO: 454146 - protein, 8 aa, Mycobacterium
DPKALSDT

SEQ ID NO: 454147 - protein, 9 aa, Mycobacterium
DPKAPKHKG

SEQ ID NO: 454148 - protein, 7 aa, Mycobacterium
DPKASSV

SEQ ID NO: 454149 - protein, 19 aa, Mycobacterium
DPKATAKKIRSAVTDSERE

SEQ ID NO: 454150 - protein, 18 aa, Mycobacterium
DPKAVQRNSGKGAAKTGD

SEQ ID NO: 454151 - protein, 10 aa, Mycobacterium
DPKAYADDDR

SEQ ID NO: 454152 - protein, 8 aa, Mycobacterium
DPKDVGRN

SEQ ID NO: 454153 - protein, 8 aa, Mycobacterium
DPKDVGRT

SEQ ID NO: 454154 - protein, 4 aa, Mycobacterium
DPKE

SEQ ID NO: 454155 - protein, 6 aa, Mycobacterium
DPKELA

SEQ ID NO: 454156 - protein, 9 aa, Mycobacterium
DPKEREPVN

SEQ ID NO: 454157 - protein, 9 aa, Mycobacterium
DPKERQDEL

SEQ ID NO: 454158 - protein, 15 aa, Mycobacterium
DPKFAPAREAMDDPS

SEQ ID NO: 454159 - protein, 8 aa, Mycobacterium
DPKFGGRG

SEQ ID NO: 454160 - protein, 4 aa, Mycobacterium
DPKG

SEQ ID NO: 454161 - protein, 5 aa, Mycobacterium
DPKGE

SEQ ID NO: 454162 - protein, 31 aa, Mycobacterium
DPKGLAGFPGRPCPSASRRPPETSPGSCSSG

SEQ ID NO: 454163 - protein, 10 aa, Mycobacterium
DPKGPEQGQG

SEQ ID NO: 454164 - protein, 7 aa, Mycobacterium
DPKGSSF

SEQ ID NO: 454165 - protein, 15 aa, Mycobacterium
DPKGVTPSLAAAEAA

SEQ ID NO: 454166 - protein, 17 aa, Mycobacterium
DPKHAAGAAAPPSPTPG

SEQ ID NO: 454167 - protein, 6 aa, Mycobacterium
DPKHPG

SEQ ID NO: 454168 - protein, 8 aa, Mycobacterium
DPKIRASQ

SEQ ID NO: 454169 - protein, 8 aa, Mycobacterium
DPKITEAN

SEQ ID NO: 454170 - protein, 15 aa, Mycobacterium
DPKITKAGERGDAAR

SEQ ID NO: 454171 - protein, 5 aa, Mycobacterium
DPKKG

SEQ ID NO: 454172 - protein, 26 aa, Mycobacterium
DPKLPAGQQHPPLANQRGPAKRPTDN

SEQ ID NO: 454173 - protein, 15 aa, Mycobacterium
DPKLSAQITRTIRSR

SEQ ID NO: 454174 - protein, 7 aa, Mycobacterium
DPKNPYD

SEQ ID NO: 454175 - protein, 9 aa, Mycobacterium
DPKPGEDEA

SEQ ID NO: 454176 - protein, 8 aa, Mycobacterium
DPKPGNVA

SEQ ID NO: 454177 - protein, 18 aa, Mycobacterium
DPKQPVSPHADATPTTMA

SEQ ID NO: 454178 - protein, 11 aa, Mycobacterium
DPKRAEDGDYR

SEQ ID NO: 454179 - protein, 6 aa, Mycobacterium
DPKRAV

SEQ ID NO: 454180 - protein, 8 aa, Mycobacterium
DPKRDDRG

SEQ ID NO: 454181 - protein, 5 aa, Mycobacterium
DPKRR

SEQ ID NO: 454182 - protein, 10 aa, Mycobacterium
DPKRRSAVKQ

SEQ ID NO: 454183 - protein, 8 aa, Mycobacterium
DPKRSATI

SEQ ID NO: 454184 - protein, 12 aa, Mycobacterium
DPKRSTGTDYRG

SEQ ID NO: 454185 - protein, 14 aa, Mycobacterium
DPKRTFSATALMVE

SEQ ID NO: 454186 - protein, 10 aa, Mycobacterium
DPKRVPGERT

SEQ ID NO: 454187 - protein, 9 aa, Mycobacterium
DPKSDRARA

SEQ ID NO: 454188 - protein, 38 aa, Mycobacterium
DPKSNRQASLPRPPALSSRPDPGSAAKIKQPNPMSGLG

SEQ ID NO: 454189 - protein, 8 aa, Mycobacterium
DPKSRESQ

SEQ ID NO: 454190 - protein, 12 aa, Mycobacterium
DPKSSAASPQPV

SEQ ID NO: 454191 - protein, 4 aa, Mycobacterium
DPKT

SEQ ID NO: 454192 - protein, 7 aa, Mycobacterium
DPKTADP

SEQ ID NO: 454193 - protein, 7 aa, Mycobacterium
DPKTAKN

SEQ ID NO: 454194 - protein, 16 aa, Mycobacterium
DPKTGRAIKASAPGWT

SEQ ID NO: 454195 - protein, 8 aa, Mycobacterium
DPKTQSPI

SEQ ID NO: 454196 - protein, 6 aa, Mycobacterium
DPKTSE

SEQ ID NO: 454197 - protein, 4 aa, Mycobacterium
DPKV

SEQ ID NO: 454198 - protein, 9 aa, Mycobacterium
DPKVAEAKN

SEQ ID NO: 454199 - protein, 5 aa, Mycobacterium
DPKVG

SEQ ID NO: 454200 - protein, 8 aa, Mycobacterium
DPKVRATQ

SEQ ID NO: 454201 - protein, 4 aa, Mycobacterium
DPKW

SEQ ID NO: 454202 - protein, 7 aa, Mycobacterium
DPKYAPG

SEQ ID NO: 454203 - protein, 7 aa, Mycobacterium
DPKYPAG

SEQ ID NO: 454204 - protein, 8 aa, Mycobacterium
DPLAASKE

SEQ ID NO: 454205 - protein, 5 aa, Mycobacterium
DPLAE

SEQ ID NO: 454206 - protein, 7 aa, Mycobacterium
DPLAGRE

SEQ ID NO: 454207 - protein, 14 aa, Mycobacterium
DPLAGRPSDTVGAQ

SEQ ID NO: 454208 - protein, 6 aa, Mycobacterium
DPLAPG

SEQ ID NO: 454209 - protein, 6 aa, Mycobacterium
DPLAPL

SEQ ID NO: 454210 - protein, 6 aa, Mycobacterium
DPLAPP

SEQ ID NO: 454211 - protein, 5 aa, Mycobacterium
DPLAQ

SEQ ID NO: 454212 - protein, 7 aa, Mycobacterium
DPLDAAQ

SEQ ID NO: 454213 - protein, 14 aa, Mycobacterium
DPLDGATPSGASSI

SEQ ID NO: 454214 - protein, 5 aa, Mycobacterium
DPLDP

SEQ ID NO: 454215 - protein, 10 aa, Mycobacterium
DPLDPDTDIG

SEQ ID NO: 454216 - protein, 7 aa, Mycobacterium
DPLDPGM

SEQ ID NO: 454217 - protein, 12 aa, Mycobacterium
DPLDSTSVEAPV

SEQ ID NO: 454218 - protein, 4 aa, Mycobacterium
DPLE

SEQ ID NO: 454219 - protein, 6 aa, Mycobacterium
DPLEPE

SEQ ID NO: 454220 - protein, 8 aa, Mycobacterium
DPLEPGGR

SEQ ID NO: 454221 - protein, 4 aa, Mycobacterium
DPLG

SEQ ID NO: 454222 - protein, 10 aa, Mycobacterium
DPLGAEPAEV

SEQ ID NO: 454223 - protein, 11 aa, Mycobacterium
DPLGALDSGEV

SEQ ID NO: 454224 - protein, 19 aa, Mycobacterium
DPLGHPNSEVGADPQRPYA

SEQ ID NO: 454225 - protein, 17 aa, Mycobacterium
DPLGHPNSEVGADPRRP

SEQ ID NO: 454226 - protein, 6 aa, Mycobacterium
DPLGNA

SEQ ID NO: 454227 - protein, 7 aa, Mycobacterium
DPLGNKV

SEQ ID NO: 454228 - protein, 7 aa, Mycobacterium
DPLGNPV

SEQ ID NO: 454229 - protein, 8 aa, Mycobacterium
DPLGRPVR

SEQ ID NO: 454230 - protein, 7 aa, Mycobacterium
DPLKPGD

SEQ ID NO: 454231 - protein, 8 aa, Mycobacterium
DPLKPPHQ

SEQ ID NO: 454232 - protein, 4 aa, Mycobacterium
DPLP

SEQ ID NO: 454233 - protein, 5 aa, Mycobacterium
DPLPA

SEQ ID NO: 454234 - protein, 26 aa, Mycobacterium
DPLPADGGPTRSTSPSSISTTTRWPR

SEQ ID NO: 454235 - protein, 10 aa, Mycobacterium
DPLPATPRRE

SEQ ID NO: 454236 - protein, 10 aa, Mycobacterium
DPLPATPRRN

SEQ ID NO: 454237 - protein, 10 aa, Mycobacterium
DPLPATPRRS

SEQ ID NO: 454238 - protein, 7 aa, Mycobacterium
DPLPGAA

SEQ ID NO: 454239 - protein, 6 aa, Mycobacterium
DPLPHA

SEQ ID NO: 454240 - protein, 5 aa, Mycobacterium
DPLPI

SEQ ID NO: 454241 - protein, 6 aa, Mycobacterium
DPLPIS

SEQ ID NO: 454242 - protein, 6 aa, Mycobacterium
DPLPKG

SEQ ID NO: 454243 - protein, 5 aa, Mycobacterium
DPLPL

SEQ ID NO: 454244 - protein, 9 aa, Mycobacterium
DPLPPADDV

SEQ ID NO: 454245 - protein, 21 aa, Mycobacterium
DPLPPDRRPTDLPGLSGLGDR

SEQ ID NO: 454246 - protein, 7 aa, Mycobacterium
DPLPPER

SEQ ID NO: 454247 - protein, 6 aa, Mycobacterium
DPLPPH

SEQ ID NO: 454248 - protein, 8 aa, Mycobacterium
DPLPQASE

SEQ ID NO: 454249 - protein, 8 aa, Mycobacterium
DPLPRRRA

SEQ ID NO: 454250 - protein, 8 aa, Mycobacterium
DPLPSHGR

SEQ ID NO: 454251 - protein, 10 aa, Mycobacterium
DPLPSTPRRP

SEQ ID NO: 454252 - protein, 5 aa, Mycobacterium
DPLPT

SEQ ID NO: 454253 - protein, 9 aa, Mycobacterium
DPLPTHGTE

SEQ ID NO: 454254 - protein, 6 aa, Mycobacterium
DPLPVR

SEQ ID NO: 454255 - protein, 8 aa, Mycobacterium
DPLQATTQ

SEQ ID NO: 454256 - protein, 5 aa, Mycobacterium
DPLQD

SEQ ID NO: 454257 - protein, 4 aa, Mycobacterium
DPLR

SEQ ID NO: 454258 - protein, 5 aa, Mycobacterium
DPLRD

SEQ ID NO: 454259 - protein, 6 aa, Mycobacterium
DPLRDD

SEQ ID NO: 454260 - protein, 11 aa, Mycobacterium
DPLRDEGNEYA

SEQ ID NO: 454261 - protein, 5 aa, Mycobacterium
DPLRG

SEQ ID NO: 454262 - protein, 12 aa, Mycobacterium
DPLRPDSPRSRS

SEQ ID NO: 454263 - protein, 15 aa, Mycobacterium
DPLRPTRRVNPGARY

SEQ ID NO: 454264 - protein, 5 aa, Mycobacterium
DPLRT

SEQ ID NO: 454265 - protein, 17 aa, Mycobacterium
DPLRTSGPSAEDPDATL

SEQ ID NO: 454266 - protein, 4 aa, Mycobacterium
DPLS

SEQ ID NO: 454267 - protein, 10 aa, Mycobacterium
DPLSERTQMG

SEQ ID NO: 454268 - protein, 7 aa, Mycobacterium
DPLSNDS

SEQ ID NO: 454269 - protein, 6 aa, Mycobacterium
DPLSTS

SEQ ID NO: 454270 - protein, 17 aa, Mycobacterium
DPLSTSGFGGASAVARA

SEQ ID NO: 454271 - protein, 6 aa, Mycobacterium
DPLTAT

SEQ ID NO: 454272 - protein, 15 aa, Mycobacterium
DPLTATLSGRPAPAI

SEQ ID NO: 454273 - protein, 5 aa, Mycobacterium
DPLTD

SEQ ID NO: 454274 - protein, 13 aa, Mycobacterium
DPLTDDDATNPVV

SEQ ID NO: 454275 - protein, 7 aa, Mycobacterium
DPLTGEA

SEQ ID NO: 454276 - protein, 18 aa, Mycobacterium
DPLTGSRREFISRREGIW

SEQ ID NO: 454277 - protein, 12 aa, Mycobacterium
DPLTNGAGRDTI

SEQ ID NO: 454278 - protein, 11 aa, Mycobacterium
DPLTPDTETRM

SEQ ID NO: 454279 - protein, 7 aa, Mycobacterium
DPLTTTD

SEQ ID NO: 454280 - protein, 5 aa, Mycobacterium
DPLVD

SEQ ID NO: 454281 - protein, 6 aa, Mycobacterium
DPLVPN

SEQ ID NO: 454282 - protein, 8 aa, Mycobacterium
DPLVPNQV

SEQ ID NO: 454283 - protein, 4 aa, Mycobacterium
DPLY

SEQ ID NO: 454284 - protein, 5 aa, Mycobacterium
DPMAK

SEQ ID NO: 454285 - protein, 6 aa, Mycobacterium
DPMDNN

SEQ ID NO: 454286 - protein, 6 aa, Mycobacterium
DPMDSE

SEQ ID NO: 454287 - protein, 25 aa, Mycobacterium
DPMGPDERRWDPASGQIEPGGLDGA

SEQ ID NO: 454288 - protein, 15 aa, Mycobacterium
DPMPPAPPPDGLPGL

SEQ ID NO: 454289 - protein, 6 aa, Mycobacterium
DPMPSR

SEQ ID NO: 454290 - protein, 6 aa, Mycobacterium
DPMPTR

SEQ ID NO: 454291 - protein, 11 aa, Mycobacterium
DPMSASGLTPE

SEQ ID NO: 454292 - protein, 12 aa, Mycobacterium
DPMSSRTPVPDY

SEQ ID NO: 454293 - protein, 6 aa, Mycobacterium
DPMTTR

SEQ ID NO: 454294 - protein, 6 aa, Mycobacterium
DPMVPA

SEQ ID NO: 454295 - protein, 7 aa, Mycobacterium
DPNAEPS

SEQ ID NO: 454296 - protein, 5 aa, Mycobacterium
DPNAG

SEQ ID NO: 454297 - protein, 8 aa, Mycobacterium
DPNAHVGS

SEQ ID NO: 454298 - protein, 5 aa, Mycobacterium
DPNAK

SEQ ID NO: 454299 - protein, 5 aa, Mycobacterium
DPNAL

SEQ ID NO: 454300 - protein, 10 aa, Mycobacterium
DPNAPKKQAG

SEQ ID NO: 454301 - protein, 11 aa, Mycobacterium
DPNAQFGQSAQ

SEQ ID NO: 454302 - protein, 7 aa, Mycobacterium
DPNAQPL

SEQ ID NO: 454303 - protein, 7 aa, Mycobacterium
DPNATAE

SEQ ID NO: 454304 - protein, 9 aa, Mycobacterium
DPNATTGAS

SEQ ID NO: 454305 - protein, 11 aa, Mycobacterium
DPNDPAAQVSP

SEQ ID NO: 454306 - protein, 8 aa, Mycobacterium
DPNDPADL

SEQ ID NO: 454307 - protein, 10 aa, Mycobacterium
DPNDPGESQA

SEQ ID NO: 454308 - protein, 9 aa, Mycobacterium
DPNDWTPPA

SEQ ID NO: 454309 - protein, 21 aa, Mycobacterium
DPNDYRGPGTGYRPTPERQAQ

SEQ ID NO: 454310 - protein, 8 aa, Mycobacterium
DPNENSPF

SEQ ID NO: 454311 - protein, 5 aa, Mycobacterium
DPNFT

SEQ ID NO: 454312 - protein, 5 aa, Mycobacterium
DPNGF

SEQ ID NO: 454313 - protein, 6 aa, Mycobacterium
DPNGGD

SEQ ID NO: 454314 - protein, 7 aa, Mycobacterium
DPNGGNW

SEQ ID NO: 454315 - protein, 10 aa, Mycobacterium
DPNGQGGGLR

SEQ ID NO: 454316 - protein, 11 aa, Mycobacterium
DPNHAEAKGAV

SEQ ID NO: 454317 - protein, 7 aa, Mycobacterium
DPNHELP

SEQ ID NO: 454318 - protein, 4 aa, Mycobacterium
DPNI

SEQ ID NO: 454319 - protein, 6 aa, Mycobacterium
DPNIPG

SEQ ID NO: 454320 - protein, 66 aa, Mycobacterium
DPNKPTAMPTPTPPSTTPPTTTDTTSTTSATSTTTTTETTPSSPMPGMPGGDVASSDLLGGDAGDV

SEQ ID NO: 454321 - protein, 8 aa, Mycobacterium
DPNKRKEA

SEQ ID NO: 454322 - protein, 11 aa, Mycobacterium
DPNNPNQPPYS

SEQ ID NO: 454323 - protein, 6 aa, Mycobacterium
DPNNST

SEQ ID NO: 454324 - protein, 13 aa, Mycobacterium
DPNPAAAGGAARL

SEQ ID NO: 454325 - protein, 14 aa, Mycobacterium
DPNPAAAGGAARLA

SEQ ID NO: 454326 - protein, 9 aa, Mycobacterium
DPNPANGVE

SEQ ID NO: 454327 - protein, 6 aa, Mycobacterium
DPNPDI

SEQ ID NO: 454328 - protein, 13 aa, Mycobacterium
DPNPPGPDSDYRT

SEQ ID NO: 454329 - protein, 12 aa, Mycobacterium
DPNPQAAGGAAR

SEQ ID NO: 454330 - protein, 15 aa, Mycobacterium
DPNPQAAGGAARLEE

SEQ ID NO: 454331 - protein, 9 aa, Mycobacterium
DPNPTDRSW

SEQ ID NO: 454332 - protein, 20 aa, Mycobacterium
DPNPVAAGGSARMASSGIEV

SEQ ID NO: 454333 - protein, 5 aa, Mycobacterium
DPNQT

SEQ ID NO: 454334 - protein, 4 aa, Mycobacterium
DPNR

SEQ ID NO: 454335 - protein, 14 aa, Mycobacterium
DPNRARQDDPAGPL

SEQ ID NO: 454336 - protein, 7 aa, Mycobacterium
DPNRDVD

SEQ ID NO: 454337 - protein, 10 aa, Mycobacterium
DPNRPGPKGF

SEQ ID NO: 454338 - protein, 6 aa, Mycobacterium
DPNRTA

SEQ ID NO: 454339 - protein, 4 aa, Mycobacterium
DPNS

SEQ ID NO: 454340 - protein, 17 aa, Mycobacterium
DPNSGETVQRGQSGELC

SEQ ID NO: 454341 - protein, 10 aa, Mycobacterium
DPNSSAWSPF

SEQ ID NO: 454342 - protein, 7 aa, Mycobacterium
DPNTAAT

SEQ ID NO: 454343 - protein, 7 aa, Mycobacterium
DPNTARI

SEQ ID NO: 454344 - protein, 10 aa, Mycobacterium
DPNTEGEATA

SEQ ID NO: 454345 - protein, 8 aa, Mycobacterium
DPNTKTRV

SEQ ID NO: 454346 - protein, 5 aa, Mycobacterium
DPNTR

SEQ ID NO: 454347 - protein, 7 aa, Mycobacterium
DPNVRDD

SEQ ID NO: 454348 - protein, 8 aa, Mycobacterium
DPNWETRD

SEQ ID NO: 454349 - protein, 19 aa, Mycobacterium
DPNWQGGDYHDTGLAPDTG

SEQ ID NO: 454350 - protein, 25 aa, Mycobacterium
DPNYEPAAADSIGARARARGVSPME

SEQ ID NO: 454351 - protein, 9 aa, Mycobacterium
DPNYGAPIK

SEQ ID NO: 454352 - protein, 6 aa, Mycobacterium
DPPAAA

SEQ ID NO: 454353 - protein, 17 aa, Mycobacterium
DPPAALPPAPPPEPIPD

SEQ ID NO: 454354 - protein, 6 aa, Mycobacterium
DPPAAT

SEQ ID NO: 454355 - protein, 10 aa, Mycobacterium
DPPADPDVSK

SEQ ID NO: 454356 - protein, 7 aa, Mycobacterium
DPPAFPT

SEQ ID NO: 454357 - protein, 9 aa, Mycobacterium
DPPAGTPLG

SEQ ID NO: 454358 - protein, 12 aa, Mycobacterium
DPPALPTTGASA

SEQ ID NO: 454359 - protein, 10 aa, Mycobacterium
DPPAPAPEPI

SEQ ID NO: 454360 - protein, 20 aa, Mycobacterium
DPPAPPGMSGDPDRRAAGRA

SEQ ID NO: 454361 - protein, 6 aa, Mycobacterium
DPPATL

SEQ ID NO: 454362 - protein, 5 aa, Mycobacterium
DPPAV

SEQ ID NO: 454363 - protein, 8 aa, Mycobacterium
DPPDAARR

SEQ ID NO: 454364 - protein, 6 aa, Mycobacterium
DPPDAR

SEQ ID NO: 454365 - protein, 8 aa, Mycobacterium
DPPDDGDF

SEQ ID NO: 454366 - protein, 6 aa, Mycobacterium
DPPDGA

SEQ ID NO: 454367 - protein, 9 aa, Mycobacterium
DPPDGPVSV

SEQ ID NO: 454368 - protein, 9 aa, Mycobacterium
DPPDHDRAR

SEQ ID NO: 454369 - protein, 7 aa, Mycobacterium
DPPDHGR

SEQ ID NO: 454370 - protein, 6 aa, Mycobacterium
DPPDHT

SEQ ID NO: 454371 - protein, 9 aa, Mycobacterium
DPPDHTKAR

SEQ ID NO: 454372 - protein, 9 aa, Mycobacterium
DPPDHTNAR

SEQ ID NO: 454373 - protein, 8 aa, Mycobacterium
DPPDHTRA

SEQ ID NO: 454374 - protein, 14 aa, Mycobacterium
DPPDKLRDAAQELA

SEQ ID NO: 454375 - protein, 10 aa, Mycobacterium
DPPDKRSIRD

SEQ ID NO: 454376 - protein, 12 aa, Mycobacterium
DPPDSDDSGGHD

SEQ ID NO: 454377 - protein, 6 aa, Mycobacterium
DPPDTR

SEQ ID NO: 454378 - protein, 20 aa, Mycobacterium
DPPDVASPDDEEDDGPAERS

SEQ ID NO: 454379 - protein, 4 aa, Mycobacterium
DPPE

SEQ ID NO: 454380 - protein, 9 aa, Mycobacterium
DPPEDWSEA

SEQ ID NO: 454381 - protein, 7 aa, Mycobacterium
DPPEGLP

SEQ ID NO: 454382 - protein, 8 aa, Mycobacterium
DPPEGWSE

SEQ ID NO: 454383 - protein, 6 aa, Mycobacterium
DPPEHA

SEQ ID NO: 454384 - protein, 7 aa, Mycobacterium
DPPEHAK

SEQ ID NO: 454385 - protein, 9 aa, Mycobacterium
DPPEHDRAR

SEQ ID NO: 454386 - protein, 9 aa, Mycobacterium
DPPEHTKAR

SEQ ID NO: 454387 - protein, 9 aa, Mycobacterium
DPPEHTNAR

SEQ ID NO: 454388 - protein, 7 aa, Mycobacterium
DPPERIG

SEQ ID NO: 454389 - protein, 7 aa, Mycobacterium
DPPFAGT

SEQ ID NO: 454390 - protein, 15 aa, Mycobacterium
DPPFGSAGSASAGVA

SEQ ID NO: 454391 - protein, 17 aa, Mycobacterium
DPPFGTPGTASAGVPLA

SEQ ID NO: 454392 - protein, 7 aa, Mycobacterium
DPPGDKL

SEQ ID NO: 454393 - protein, 40 aa, Mycobacterium
DPPGDPATTASGNHISHGPAAPRGGGEPRHGTGPHPGWSS

SEQ ID NO: 454394 - protein, 10 aa, Mycobacterium
DPPGDRGPFT

SEQ ID NO: 454395 - protein, 14 aa, Mycobacterium
DPPGDVKPVRPPVD

SEQ ID NO: 454396 - protein, 7 aa, Mycobacterium
DPPGETA

SEQ ID NO: 454397 - protein, 6 aa, Mycobacterium
DPPGGD

SEQ ID NO: 454398 - protein, 7 aa, Mycobacterium
DPPGGDI

SEQ ID NO: 454399 - protein, 7 aa, Mycobacterium
DPPGHTE

SEQ ID NO: 454400 - protein, 7 aa, Mycobacterium
DPPGNTD

SEQ ID NO: 454401 - protein, 8 aa, Mycobacterium
DPPGPAPA

SEQ ID NO: 454402 - protein, 7 aa, Mycobacterium
DPPGPGE

SEQ ID NO: 454403 - protein, 18 aa, Mycobacterium
DPPGPLPTPPPPEPTPDV

SEQ ID NO: 454404 - protein, 13 aa, Mycobacterium
DPPGQWQETPGAQ

SEQ ID NO: 454405 - protein, 13 aa, Mycobacterium
DPPGRWKQTPREE

SEQ ID NO: 454406 - protein, 8 aa, Mycobacterium
DPPGSGDF

SEQ ID NO: 454407 - protein, 7 aa, Mycobacterium
DPPHDEW

SEQ ID NO: 454408 - protein, 23 aa, Mycobacterium
DPPHKLATESPTAPGWTGRRGAA

SEQ ID NO: 454409 - protein, 5 aa, Mycobacterium
DPPKF

SEQ ID NO: 454410 - protein, 7 aa, Mycobacterium
DPPKHEV

SEQ ID NO: 454411 - protein, 4 aa, Mycobacterium
DPPL

SEQ ID NO: 454412 - protein, 5 aa, Mycobacterium
DPPLG

SEQ ID NO: 454413 - protein, 9 aa, Mycobacterium
DPPLPATDK

SEQ ID NO: 454414 - protein, 9 aa, Mycobacterium
DPPLPPVPE

SEQ ID NO: 454415 - protein, 6 aa, Mycobacterium
DPPNHT

SEQ ID NO: 454416 - protein, 5 aa, Mycobacterium
DPPNP

SEQ ID NO: 454417 - protein, 5 aa, Mycobacterium
DPPNQ

SEQ ID NO: 454418 - protein, 10 aa, Mycobacterium
DPPNQWRETR

SEQ ID NO: 454419 - protein, 27 aa, Mycobacterium
DPPNYEPSPSDSIGARARARGVSPLEE

SEQ ID NO: 454420 - protein, 5 aa, Mycobacterium
DPPPA

SEQ ID NO: 454421 - protein, 7 aa, Mycobacterium
DPPPEHK

SEQ ID NO: 454422 - protein, 6 aa, Mycobacterium
DPPPEM

SEQ ID NO: 454423 - protein, 17 aa, Mycobacterium
DPPPEVYEPSGAATVQP

SEQ ID NO: 454424 - protein, 6 aa, Mycobacterium
DPPPGT

SEQ ID NO: 454425 - protein, 7 aa, Mycobacterium
DPPPLPA

SEQ ID NO: 454426 - protein, 31 aa, Mycobacterium
DPPPLPATPAAAETSVAQDGSLSIGSLKGTT

SEQ ID NO: 454427 - protein, 7 aa, Mycobacterium
DPPPLPD

SEQ ID NO: 454428 - protein, 25 aa, Mycobacterium
DPPPLPGAVPDTDDTDDPDGSAPVG

SEQ ID NO: 454429 - protein, 29 aa, Mycobacterium
DPPPLPPAPAAVPTTDDGSLSIGSLKGIS

SEQ ID NO: 454430 - protein, 37 aa, Mycobacterium
DPPPLPSEDDRAEPASAPSADPVHTDGSLGIGSLKGT

SEQ ID NO: 454431 - protein, 10 aa, Mycobacterium
DPPPPAQPQG

SEQ ID NO: 454432 - protein, 8 aa, Mycobacterium
DPPPPSEV

SEQ ID NO: 454433 - protein, 7 aa, Mycobacterium
DPPPRSG

SEQ ID NO: 454434 - protein, 24 aa, Mycobacterium
DPPPSLSRARREAERPEHKHTPDE

SEQ ID NO: 454435 - protein, 13 aa, Mycobacterium
DPPPSLSRTRREA

SEQ ID NO: 454436 - protein, 13 aa, Mycobacterium
DPPPSLTRTRREA

SEQ ID NO: 454437 - protein, 24 aa, Mycobacterium
DPPPSVSRNRREAAAAEHKHTPDE

SEQ ID NO: 454438 - protein, 8 aa, Mycobacterium
DPPPTTRQ

SEQ ID NO: 454439 - protein, 9 aa, Mycobacterium
DPPPVQTPH

SEQ ID NO: 454440 - protein, 7 aa, Mycobacterium
DPPPYRR

SEQ ID NO: 454441 - protein, 8 aa, Mycobacterium
DPPQAPTI

SEQ ID NO: 454442 - protein, 9 aa, Mycobacterium
DPPQDSGRE

SEQ ID NO: 454443 - protein, 5 aa, Mycobacterium
DPPQF

SEQ ID NO: 454444 - protein, 5 aa, Mycobacterium
DPPQH

SEQ ID NO: 454445 - protein, 8 aa, Mycobacterium
DPPQSQAY

SEQ ID NO: 454446 - protein, 6 aa, Mycobacterium
DPPRAG

SEQ ID NO: 454447 - protein, 10 aa, Mycobacterium
DPPRAGAGRE

SEQ ID NO: 454448 - protein, 6 aa, Mycobacterium
DPPRER

SEQ ID NO: 454449 - protein, 6 aa, Mycobacterium
DPPREV

SEQ ID NO: 454450 - protein, 7 aa, Mycobacterium
DPPRGGE

SEQ ID NO: 454451 - protein, 8 aa, Mycobacterium
DPPRHPRA

SEQ ID NO: 454452 - protein, 6 aa, Mycobacterium
DPPRNG

SEQ ID NO: 454453 - protein, 7 aa, Mycobacterium
DPPRQQK

SEQ ID NO: 454454 - protein, 7 aa, Mycobacterium
DPPRQQQ

SEQ ID NO: 454455 - protein, 5 aa, Mycobacterium
DPPRR

SEQ ID NO: 454456 - protein, 12 aa, Mycobacterium
DPPRRVGRSAYY

SEQ ID NO: 454457 - protein, 9 aa, Mycobacterium
DPPRSGAGR

SEQ ID NO: 454458 - protein, 9 aa, Mycobacterium
DPPRTGANR

SEQ ID NO: 454459 - protein, 14 aa, Mycobacterium
DPPRVGEPETQPPI

SEQ ID NO: 454460 - protein, 6 aa, Mycobacterium
DPPSLP

SEQ ID NO: 454461 - protein, 11 aa, Mycobacterium
DPPSWEPPAAQ

SEQ ID NO: 454462 - protein, 7 aa, Mycobacterium
DPPTGAD

SEQ ID NO: 454463 - protein, 6 aa, Mycobacterium
DPPTGD

SEQ ID NO: 454464 - protein, 7 aa, Mycobacterium
DPPTGDI

SEQ ID NO: 454465 - protein, 8 aa, Mycobacterium
DPPTGPKA

SEQ ID NO: 454466 - protein, 8 aa, Mycobacterium
DPPTGTDA

SEQ ID NO: 454467 - protein, 5 aa, Mycobacterium
DPPTH

SEQ ID NO: 454468 - protein, 6 aa, Mycobacterium
DPPTLT

SEQ ID NO: 454469 - protein, 17 aa, Mycobacterium
DPPTPEGLSDDPDRRGF

SEQ ID NO: 454470 - protein, 11 aa, Mycobacterium
DPPTPVDSDAA

SEQ ID NO: 454471 - protein, 6 aa, Mycobacterium
DPPTRA

SEQ ID NO: 454472 - protein, 5 aa, Mycobacterium
DPPTS

SEQ ID NO: 454473 - protein, 15 aa, Mycobacterium
DPPTSIGGVTQSPIE

SEQ ID NO: 454474 - protein, 13 aa, Mycobacterium
DPPVAGPGSPAID

SEQ ID NO: 454475 - protein, 5 aa, Mycobacterium
DPPVE

SEQ ID NO: 454476 - protein, 5 aa, Mycobacterium
DPPVT

SEQ ID NO: 454477 - protein, 9 aa, Mycobacterium
DPPVTPEEP

SEQ ID NO: 454478 - protein, 4 aa, Mycobacterium
DPPW

SEQ ID NO: 454479 - protein, 4 aa, Mycobacterium
DPPY

SEQ ID NO: 454480 - protein, 6 aa, Mycobacterium
DPPYPS

SEQ ID NO: 454481 - protein, 8 aa, Mycobacterium
DPPYRTKS

SEQ ID NO: 454482 - protein, 11 aa, Mycobacterium
DPQAALDPSGD

SEQ ID NO: 454483 - protein, 7 aa, Mycobacterium
DPQAARS

SEQ ID NO: 454484 - protein, 7 aa, Mycobacterium
DPQAEPS

SEQ ID NO: 454485 - protein, 8 aa, Mycobacterium
DPQAERHN

SEQ ID NO: 454486 - protein, 7 aa, Mycobacterium
DPQAGAR

SEQ ID NO: 454487 - protein, 8 aa, Mycobacterium
DPQANAST

SEQ ID NO: 454488 - protein, 8 aa, Mycobacterium
DPQAPAGE

SEQ ID NO: 454489 - protein, 6 aa, Mycobacterium
DPQAPI

SEQ ID NO: 454490 - protein, 10 aa, Mycobacterium
DPQAPKRQAG

SEQ ID NO: 454491 - protein, 8 aa, Mycobacterium
DPQAPPYQ

SEQ ID NO: 454492 - protein, 9 aa, Mycobacterium
DPQAQGRGL

SEQ ID NO: 454493 - protein, 8 aa, Mycobacterium
DPQARAAA

SEQ ID NO: 454494 - protein, 5 aa, Mycobacterium
DPQAW

SEQ ID NO: 454495 - protein, 5 aa, Mycobacterium
DPQDD

SEQ ID NO: 454496 - protein, 14 aa, Mycobacterium
DPQDDPDQTDWESP

SEQ ID NO: 454497 - protein, 6 aa, Mycobacterium
DPQDDY

SEQ ID NO: 454498 - protein, 8 aa, Mycobacterium
DPQDPGLG

SEQ ID NO: 454499 - protein, 10 aa, Mycobacterium
DPQDSAGQSA

SEQ ID NO: 454500 - protein, 5 aa, Mycobacterium
DPQET

SEQ ID NO: 454501 - protein, 22 aa, Mycobacterium
DPQFAAARPDPAITAATEAPGL

SEQ ID NO: 454502 - protein, 6 aa, Mycobacterium
DPQFED

SEQ ID NO: 454503 - protein, 17 aa, Mycobacterium
DPQFGSDSSARHRRSGA

SEQ ID NO: 454504 - protein, 6 aa, Mycobacterium
DPQGAR

SEQ ID NO: 454505 - protein, 11 aa, Mycobacterium
DPQGNASTALG

SEQ ID NO: 454506 - protein, 22 aa, Mycobacterium
DPQGNASTALGADHRAGTPSSY

SEQ ID NO: 454507 - protein, 12 aa, Mycobacterium
DPQGNASTALGI

SEQ ID NO: 454508 - protein, 13 aa, Mycobacterium
DPQGNSTSMFDPD

SEQ ID NO: 454509 - protein, 6 aa, Mycobacterium
DPQGRR

SEQ ID NO: 454510 - protein, 6 aa, Mycobacterium
DPQGYD

SEQ ID NO: 454511 - protein, 11 aa, Mycobacterium
DPQHDSASGAR

SEQ ID NO: 454512 - protein, 17 aa, Mycobacterium
DPQHERTKQFLQRILNT

SEQ ID NO: 454513 - protein, 8 aa, Mycobacterium
DPQHPDGP

SEQ ID NO: 454514 - protein, 6 aa, Mycobacterium
DPQHPG

SEQ ID NO: 454515 - protein, 19 aa, Mycobacterium
DPQHRRQHHQPPITTRPRR

SEQ ID NO: 454516 - protein, 5 aa, Mycobacterium
DPQHT

SEQ ID NO: 454517 - protein, 6 aa, Mycobacterium
DPQIAA

SEQ ID NO: 454518 - protein, 9 aa, Mycobacterium
DPQKHSLGP

SEQ ID NO: 454519 - protein, 9 aa, Mycobacterium
DPQKTAEAF

SEQ ID NO: 454520 - protein, 5 aa, Mycobacterium
DPQKV

SEQ ID NO: 454521 - protein, 4 aa, Mycobacterium
DPQL

SEQ ID NO: 454522 - protein, 8 aa, Mycobacterium
DPQLDTSE

SEQ ID NO: 454523 - protein, 5 aa, Mycobacterium
DPQLQ

SEQ ID NO: 454524 - protein, 8 aa, Mycobacterium
DPQNKPGR

SEQ ID NO: 454525 - protein, 4 aa, Mycobacterium
DPQP

SEQ ID NO: 454526 - protein, 6 aa, Mycobacterium
DPQPAA

SEQ ID NO: 454527 - protein, 5 aa, Mycobacterium
DPQPE

SEQ ID NO: 454528 - protein, 7 aa, Mycobacterium
DPQPEHG

SEQ ID NO: 454529 - protein, 9 aa, Mycobacterium
DPQPGTGFE

SEQ ID NO: 454530 - protein, 11 aa, Mycobacterium
DPQPGTGFKEA

SEQ ID NO: 454531 - protein, 10 aa, Mycobacterium
DPQPGTGFTE

SEQ ID NO: 454532 - protein, 8 aa, Mycobacterium
DPQPHSGA

SEQ ID NO: 454533 - protein, 8 aa, Mycobacterium
DPQPITDT

SEQ ID NO: 454534 - protein, 18 aa, Mycobacterium
DPQPRAGRQRAPRPGVHN

SEQ ID NO: 454535 - protein, 9 aa, Mycobacterium
DPQPRQQQQ

SEQ ID NO: 454536 - protein, 6 aa, Mycobacterium
DPQPVN

SEQ ID NO: 454537 - protein, 5 aa, Mycobacterium
DPQQA

SEQ ID NO: 454538 - protein, 15 aa, Mycobacterium
DPQQGEFHSAQGAGG

SEQ ID NO: 454539 - protein, 8 aa, Mycobacterium
DPQQRRVQ

SEQ ID NO: 454540 - protein, 8 aa, Mycobacterium
DPQRESGR

SEQ ID NO: 454541 - protein, 11 aa, Mycobacterium
DPQRESPARAQ

SEQ ID NO: 454542 - protein, 9 aa, Mycobacterium
DPQREVPST

SEQ ID NO: 454543 - protein, 5 aa, Mycobacterium
DPQRF

SEQ ID NO: 454544 - protein, 6 aa, Mycobacterium
DPQRGP

SEQ ID NO: 454545 - protein, 8 aa, Mycobacterium
DPQRHPQM

SEQ ID NO: 454546 - protein, 10 aa, Mycobacterium
DPQRKAEERR

SEQ ID NO: 454547 - protein, 6 aa, Mycobacterium
DPQRKR

SEQ ID NO: 454548 - protein, 5 aa, Mycobacterium
DPQRP

SEQ ID NO: 454549 - protein, 8 aa, Mycobacterium
DPQRPGVE

SEQ ID NO: 454550 - protein, 8 aa, Mycobacterium
DPQRSLPP

SEQ ID NO: 454551 - protein, 7 aa, Mycobacterium
DPQRTAE

SEQ ID NO: 454552 - protein, 8 aa, Mycobacterium
DPQRTAEA

SEQ ID NO: 454553 - protein, 4 aa, Mycobacterium
DPQS

SEQ ID NO: 454554 - protein, 18 aa, Mycobacterium
DPQSASAAKVNDICAYEG

SEQ ID NO: 454555 - protein, 12 aa, Mycobacterium
DPQSCAGAAESI

SEQ ID NO: 454556 - protein, 13 aa, Mycobacterium
DPQSITTAAAAAR

SEQ ID NO: 454557 - protein, 6 aa, Mycobacterium
DPQSPL

SEQ ID NO: 454558 - protein, 8 aa, Mycobacterium
DPQTATQE

SEQ ID NO: 454559 - protein, 13 aa, Mycobacterium
DPQTCAQAAESIG

SEQ ID NO: 454560 - protein, 5 aa, Mycobacterium
DPQTG

SEQ ID NO: 454561 - protein, 11 aa, Mycobacterium
DPQTGDLGERN

SEQ ID NO: 454562 - protein, 17 aa, Mycobacterium
DPQTGEEITAQNGRYGP

SEQ ID NO: 454563 - protein, 9 aa, Mycobacterium
DPQTGGGFD

SEQ ID NO: 454564 - protein, 7 aa, Mycobacterium
DPQTGHE

SEQ ID NO: 454565 - protein, 7 aa, Mycobacterium
DPQTGPI

SEQ ID NO: 454566 - protein, 7 aa, Mycobacterium
DPQTGTP

SEQ ID NO: 454567 - protein, 7 aa, Mycobacterium
DPQTPDC

SEQ ID NO: 454568 - protein, 8 aa, Mycobacterium
DPQTSTVA

SEQ ID NO: 454569 - protein, 4 aa, Mycobacterium
DPQV

SEQ ID NO: 454570 - protein, 8 aa, Mycobacterium
DPQVNHNG

SEQ ID NO: 454571 - protein, 5 aa, Mycobacterium
DPQVT

SEQ ID NO: 454572 - protein, 5 aa, Mycobacterium
DPQWG

SEQ ID NO: 454573 - protein, 7 aa, Mycobacterium
DPQWNTP

SEQ ID NO: 454574 - protein, 6 aa, Mycobacterium
DPQYAP

SEQ ID NO: 454575 - protein, 9 aa, Mycobacterium
DPQYAPGDL

SEQ ID NO: 454576 - protein, 6 aa, Mycobacterium
DPQYPP

SEQ ID NO: 454577 - protein, 7 aa, Mycobacterium
DPRAAEL

SEQ ID NO: 454578 - protein, 18 aa, Mycobacterium
DPRAAELAQRTGTTRSAA

SEQ ID NO: 454579 - protein, 6 aa, Mycobacterium
DPRAAN

SEQ ID NO: 454580 - protein, 17 aa, Mycobacterium
DPRAAQQRARAARERLT

SEQ ID NO: 454581 - protein, 7 aa, Mycobacterium
DPRAATL

SEQ ID NO: 454582 - protein, 11 aa, Mycobacterium
DPRAAVDPTGD

SEQ ID NO: 454583 - protein, 11 aa, Mycobacterium
DPRAEGPPRGA

SEQ ID NO: 454584 - protein, 11 aa, Mycobacterium
DPRAESAMESE

SEQ ID NO: 454585 - protein, 11 aa, Mycobacterium
DPRAESPMESE

SEQ ID NO: 454586 - protein, 5 aa, Mycobacterium
DPRAG

SEQ ID NO: 454587 - protein, 20 aa, Mycobacterium
DPRAGAHTPDVEDPYYGTRD

SEQ ID NO: 454588 - protein, 7 aa, Mycobacterium
DPRAGHN

SEQ ID NO: 454589 - protein, 8 aa, Mycobacterium
DPRAIERK

SEQ ID NO: 454590 - protein, 5 aa, Mycobacterium
DPRAK

SEQ ID NO: 454591 - protein, 7 aa, Mycobacterium
DPRAPEL

SEQ ID NO: 454592 - protein, 8 aa, Mycobacterium
DPRARSDY

SEQ ID NO: 454593 - protein, 8 aa, Mycobacterium
DPRASRAA

SEQ ID NO: 454594 - protein, 8 aa, Mycobacterium
DPRATAAA

SEQ ID NO: 454595 - protein, 9 aa, Mycobacterium
DPRATEPAR

SEQ ID NO: 454596 - protein, 14 aa, Mycobacterium
DPRAVADAPPDTAA

SEQ ID NO: 454597 - protein, 15 aa, Mycobacterium
DPRDDSGADGGQKGE

SEQ ID NO: 454598 - protein, 14 aa, Mycobacterium
DPRDGAHDLNETKE

SEQ ID NO: 454599 - protein, 6 aa, Mycobacterium
DPRDGE

SEQ ID NO: 454600 - protein, 5 aa, Mycobacterium
DPRDM

SEQ ID NO: 454601 - protein, 12 aa, Mycobacterium
DPRDSDDCGGQE

SEQ ID NO: 454602 - protein, 6 aa, Mycobacterium
DPRDTE

SEQ ID NO: 454603 - protein, 5 aa, Mycobacterium
DPRDV

SEQ ID NO: 454604 - protein, 7 aa, Mycobacterium
DPRDWGP

SEQ ID NO: 454605 - protein, 6 aa, Mycobacterium
DPRDYA

SEQ ID NO: 454606 - protein, 6 aa, Mycobacterium
DPREFP

SEQ ID NO: 454607 - protein, 5 aa, Mycobacterium
DPREL

SEQ ID NO: 454608 - protein, 8 aa, Mycobacterium
DPRELSEE

SEQ ID NO: 454609 - protein, 27 aa, Mycobacterium
DPREPEELPPDWEPDQPTLQPLPDEPP

SEQ ID NO: 454610 - protein, 17 aa, Mycobacterium
DPRERPADREEAARQKH

SEQ ID NO: 454611 - protein, 25 aa, Mycobacterium
DPRESEELPPDWRPPPAPPVPDDPP

SEQ ID NO: 454612 - protein, 8 aa, Mycobacterium
DPRESPID

SEQ ID NO: 454613 - protein, 5 aa, Mycobacterium
DPRET

SEQ ID NO: 454614 - protein, 12 aa, Mycobacterium
DPRETSKDDAQR

SEQ ID NO: 454615 - protein, 13 aa, Mycobacterium
DPRETSKDDGERL

SEQ ID NO: 454616 - protein, 9 aa, Mycobacterium
DPRFATGEA

SEQ ID NO: 454617 - protein, 15 aa, Mycobacterium
DPRFATGEARLDNRD

SEQ ID NO: 454618 - protein, 11 aa, Mycobacterium
DPRFDNPRAPQ

SEQ ID NO: 454619 - protein, 7 aa, Mycobacterium
DPRFEEG

SEQ ID NO: 454620 - protein, 6 aa, Mycobacterium
DPRFPN

SEQ ID NO: 454621 - protein, 8 aa, Mycobacterium
DPRGEAAT

SEQ ID NO: 454622 - protein, 10 aa, Mycobacterium
DPRGGSAPVG

SEQ ID NO: 454623 - protein, 7 aa, Mycobacterium
DPRGLGD

SEQ ID NO: 454624 - protein, 18 aa, Mycobacterium
DPRGSRPGEINHNDGGRG

SEQ ID NO: 454625 - protein, 5 aa, Mycobacterium
DPRHA

SEQ ID NO: 454626 - protein, 12 aa, Mycobacterium
DPRIGDGGRGYR

SEQ ID NO: 454627 - protein, 12 aa, Mycobacterium
DPRIGKDGAAAS

SEQ ID NO: 454628 - protein, 5 aa, Mycobacterium
DPRIR

SEQ ID NO: 454629 - protein, 17 aa, Mycobacterium
DPRKNDSLSILNLPGVF

SEQ ID NO: 454630 - protein, 5 aa, Mycobacterium
DPRLG

SEQ ID NO: 454631 - protein, 6 aa, Mycobacterium
DPRLNP

SEQ ID NO: 454632 - protein, 8 aa, Mycobacterium
DPRLNTQQ

SEQ ID NO: 454633 - protein, 13 aa, Mycobacterium
DPRLPQMPATPEQ

SEQ ID NO: 454634 - protein, 14 aa, Mycobacterium
DPRLPQMPATPEQI

SEQ ID NO: 454635 - protein, 17 aa, Mycobacterium
DPRLRGGAVDASPMPIS

SEQ ID NO: 454636 - protein, 9 aa, Mycobacterium
DPRLSDSGY

SEQ ID NO: 454637 - protein, 11 aa, Mycobacterium
DPRLSGNNTDG

SEQ ID NO: 454638 - protein, 6 aa, Mycobacterium
DPRLTS

SEQ ID NO: 454639 - protein, 6 aa, Mycobacterium
DPRLTT

SEQ ID NO: 454640 - protein, 13 aa, Mycobacterium
DPRMGDGGRGYRR

SEQ ID NO: 454641 - protein, 4 aa, Mycobacterium
DPRN

SEQ ID NO: 454642 - protein, 12 aa, Mycobacterium
DPRNDYPPPDPE

SEQ ID NO: 454643 - protein, 15 aa, Mycobacterium
DPRNPAVPKIGTSTS

SEQ ID NO: 454644 - protein, 6 aa, Mycobacterium
DPRNQG

SEQ ID NO: 454645 - protein, 12 aa, Mycobacterium
DPRNREQRRADA

SEQ ID NO: 454646 - protein, 9 aa, Mycobacterium
DPRPAQTAG

SEQ ID NO: 454647 - protein, 10 aa, Mycobacterium
DPRPDDADNP

SEQ ID NO: 454648 - protein, 6 aa, Mycobacterium
DPRPDG

SEQ ID NO: 454649 - protein, 6 aa, Mycobacterium
DPRPDV

SEQ ID NO: 454650 - protein, 8 aa, Mycobacterium
DPRPEVSD

SEQ ID NO: 454651 - protein, 9 aa, Mycobacterium
DPRPEVTDV

SEQ ID NO: 454652 - protein, 8 aa, Mycobacterium
DPRPMPGA

SEQ ID NO: 454653 - protein, 8 aa, Mycobacterium
DPRPRGMR

SEQ ID NO: 454654 - protein, 6 aa, Mycobacterium
DPRPSA

SEQ ID NO: 454655 - protein, 6 aa, Mycobacterium
DPRPSV

SEQ ID NO: 454656 - protein, 16 aa, Mycobacterium
DPRPWPDHGGPRRAGV

SEQ ID NO: 454657 - protein, 6 aa, Mycobacterium
DPRPYD

SEQ ID NO: 454658 - protein, 6 aa, Mycobacterium
DPRQRD

SEQ ID NO: 454659 - protein, 5 aa, Mycobacterium
DPRQT

SEQ ID NO: 454660 - protein, 6 aa, Mycobacterium
DPRRAA

SEQ ID NO: 454661 - protein, 11 aa, Mycobacterium
DPRRADHAEYR

SEQ ID NO: 454662 - protein, 7 aa, Mycobacterium
DPRRAGQ

SEQ ID NO: 454663 - protein, 8 aa, Mycobacterium
DPRRAGQR

SEQ ID NO: 454664 - protein, 6 aa, Mycobacterium
DPRRDA

SEQ ID NO: 454665 - protein, 7 aa, Mycobacterium
DPRRDGS

SEQ ID NO: 454666 - protein, 8 aa, Mycobacterium
DPRREDQA

SEQ ID NO: 454667 - protein, 13 aa, Mycobacterium
DPRRERDAEMGGR

SEQ ID NO: 454668 - protein, 5 aa, Mycobacterium
DPRRG

SEQ ID NO: 454669 - protein, 6 aa, Mycobacterium
DPRRGS

SEQ ID NO: 454670 - protein, 15 aa, Mycobacterium
DPRRHPELDGSGTVR

SEQ ID NO: 454671 - protein, 6 aa, Mycobacterium
DPRRLA

SEQ ID NO: 454672 - protein, 6 aa, Mycobacterium
DPRRPT

SEQ ID NO: 454673 - protein, 8 aa, Mycobacterium
DPRRQAGE

SEQ ID NO: 454674 - protein, 17 aa, Mycobacterium
DPRRRSAVKQVASGRFG

SEQ ID NO: 454675 - protein, 5 aa, Mycobacterium
DPRRS

SEQ ID NO: 454676 - protein, 15 aa, Mycobacterium
DPRRVGGQRRYDDDD

SEQ ID NO: 454677 - protein, 8 aa, Mycobacterium
DPRRVPPE

SEQ ID NO: 454678 - protein, 9 aa, Mycobacterium
DPRSAATAR

SEQ ID NO: 454679 - protein, 7 aa, Mycobacterium
DPRSAPE

SEQ ID NO: 454680 - protein, 10 aa, Mycobacterium
DPRSDADALE

SEQ ID NO: 454681 - protein, 10 aa, Mycobacterium
DPRSDGLARA

SEQ ID NO: 454682 - protein, 6 aa, Mycobacterium
DPRSEL

SEQ ID NO: 454683 - protein, 9 aa, Mycobacterium
DPRSERPRR

SEQ ID NO: 454684 - protein, 5 aa, Mycobacterium
DPRSG

SEQ ID NO: 454685 - protein, 6 aa, Mycobacterium
DPRSGA

SEQ ID NO: 454686 - protein, 7 aa, Mycobacterium
DPRSGAH

SEQ ID NO: 454687 - protein, 8 aa, Mycobacterium
DPRSGEQT

SEQ ID NO: 454688 - protein, 6 aa, Mycobacterium
DPRSGL

SEQ ID NO: 454689 - protein, 9 aa, Mycobacterium
DPRSGPAVL

SEQ ID NO: 454690 - protein, 8 aa, Mycobacterium
DPRSIDNP

SEQ ID NO: 454691 - protein, 8 aa, Mycobacterium
DPRSMQSR

SEQ ID NO: 454692 - protein, 9 aa, Mycobacterium
DPRSPASRR

SEQ ID NO: 454693 - protein, 8 aa, Mycobacterium
DPRSPVGR

SEQ ID NO: 454694 - protein, 8 aa, Mycobacterium
DPRSQLGS

SEQ ID NO: 454695 - protein, 16 aa, Mycobacterium
DPRSRAYADRRTTEGL

SEQ ID NO: 454696 - protein, 7 aa, Mycobacterium
DPRSSAH

SEQ ID NO: 454697 - protein, 8 aa, Mycobacterium
DPRSSANA

SEQ ID NO: 454698 - protein, 7 aa, Mycobacterium
DPRTAAE

SEQ ID NO: 454699 - protein, 12 aa, Mycobacterium
DPRTAGQRRSDA

SEQ ID NO: 454700 - protein, 7 aa, Mycobacterium
DPRTDLT

SEQ ID NO: 454701 - protein, 10 aa, Mycobacterium
DPRTDPDGLE

SEQ ID NO: 454702 - protein, 5 aa, Mycobacterium
DPRTE

SEQ ID NO: 454703 - protein, 21 aa, Mycobacterium
DPRTGAHTPDVDDPYYGDTSD

SEQ ID NO: 454704 - protein, 8 aa, Mycobacterium
DPRTGASV

SEQ ID NO: 454705 - protein, 8 aa, Mycobacterium
DPRTGDRT

SEQ ID NO: 454706 - protein, 8 aa, Mycobacterium
DPRTGEKT

SEQ ID NO: 454707 - protein, 6 aa, Mycobacterium
DPRTGG

SEQ ID NO: 454708 - protein, 6 aa, Mycobacterium
DPRTGM

SEQ ID NO: 454709 - protein, 7 aa, Mycobacterium
DPRTHTA

SEQ ID NO: 454710 - protein, 10 aa, Mycobacterium
DPRTPSDPAA

SEQ ID NO: 454711 - protein, 10 aa, Mycobacterium
DPRTPSPDEL

SEQ ID NO: 454712 - protein, 8 aa, Mycobacterium
DPRTRPQD

SEQ ID NO: 454713 - protein, 17 aa, Mycobacterium
DPRTTAVAEDDSDERSL

SEQ ID NO: 454714 - protein, 9 aa, Mycobacterium
DPRTTSATD

SEQ ID NO: 454715 - protein, 8 aa, Mycobacterium
DPRTVAPE

SEQ ID NO: 454716 - protein, 7 aa, Mycobacterium
DPRTVPP

SEQ ID NO: 454717 - protein, 8 aa, Mycobacterium
DPRTVPPE

SEQ ID NO: 454718 - protein, 9 aa, Mycobacterium
DPRTVPPEE

SEQ ID NO: 454719 - protein, 4 aa, Mycobacterium
DPRV

SEQ ID NO: 454720 - protein, 5 aa, Mycobacterium
DPRVE

SEQ ID NO: 454721 - protein, 5 aa, Mycobacterium
DPRVG

SEQ ID NO: 454722 - protein, 6 aa, Mycobacterium
DPRVNP

SEQ ID NO: 454723 - protein, 11 aa, Mycobacterium
DPRVPADRGEM

SEQ ID NO: 454724 - protein, 5 aa, Mycobacterium
DPRVQ

SEQ ID NO: 454725 - protein, 5 aa, Mycobacterium
DPRWP

SEQ ID NO: 454726 - protein, 5 aa, Mycobacterium
DPRWR

SEQ ID NO: 454727 - protein, 5 aa, Mycobacterium
DPRWS

SEQ ID NO: 454728 - protein, 6 aa, Mycobacterium
DPRWSA

SEQ ID NO: 454729 - protein, 6 aa, Mycobacterium
DPRWTQ

SEQ ID NO: 454730 - protein, 8 aa, Mycobacterium
DPRYGEAG

SEQ ID NO: 454731 - protein, 8 aa, Mycobacterium
DPSAASAP

SEQ ID NO: 454732 - protein, 8 aa, Mycobacterium
DPSADEST

SEQ ID NO: 454733 - protein, 8 aa, Mycobacterium
DPSAEPSV

SEQ ID NO: 454734 - protein, 13 aa, Mycobacterium
DPSAFTDSRRPQY

SEQ ID NO: 454735 - protein, 9 aa, Mycobacterium
DPSAGTPVG

SEQ ID NO: 454736 - protein, 7 aa, Mycobacterium
DPSALNQ

SEQ ID NO: 454737 - protein, 8 aa, Mycobacterium
DPSALQER

SEQ ID NO: 454738 - protein, 8 aa, Mycobacterium
DPSANPYL

SEQ ID NO: 454739 - protein, 8 aa, Mycobacterium
DPSAPAPH

SEQ ID NO: 454740 - protein, 7 aa, Mycobacterium
DPSAPRI

SEQ ID NO: 454741 - protein, 9 aa, Mycobacterium
DPSAQGRGL

SEQ ID NO: 454742 - protein, 11 aa, Mycobacterium
DPSAQGRGLGQ

SEQ ID NO: 454743 - protein, 8 aa, Mycobacterium
DPSAQRHR

SEQ ID NO: 454744 - protein, 14 aa, Mycobacterium
DPSASRAWITRLSG

SEQ ID NO: 454745 - protein, 8 aa, Mycobacterium
DPSASSTF

SEQ ID NO: 454746 - protein, 5 aa, Mycobacterium
DPSAV

SEQ ID NO: 454747 - protein, 18 aa, Mycobacterium
DPSAWNPDQYSNPDNVDA

SEQ ID NO: 454748 - protein, 9 aa, Mycobacterium
DPSAYADEK

SEQ ID NO: 454749 - protein, 8 aa, Mycobacterium
DPSAYVPE

SEQ ID NO: 454750 - protein, 6 aa, Mycobacterium
DPSDDQ

SEQ ID NO: 454751 - protein, 7 aa, Mycobacterium
DPSDDTV

SEQ ID NO: 454752 - protein, 6 aa, Mycobacterium
DPSDGD

SEQ ID NO: 454753 - protein, 5 aa, Mycobacterium
DPSDL

SEQ ID NO: 454754 - protein, 5 aa, Mycobacterium
DPSDM

SEQ ID NO: 454755 - protein, 11 aa, Mycobacterium
DPSDPRADDPF

SEQ ID NO: 454756 - protein, 5 aa, Mycobacterium
DPSDS

SEQ ID NO: 454757 - protein, 13 aa, Mycobacterium
DPSDSDNCGGPEW

SEQ ID NO: 454758 - protein, 7 aa, Mycobacterium
DPSDTTW

SEQ ID NO: 454759 - protein, 6 aa, Mycobacterium
DPSDVE

SEQ ID NO: 454760 - protein, 10 aa, Mycobacterium
DPSEEGLADY

SEQ ID NO: 454761 - protein, 21 aa, Mycobacterium
DPSEFDSRRTGFTPPPSRYKT

SEQ ID NO: 454762 - protein, 5 aa, Mycobacterium
DPSEG

SEQ ID NO: 454763 - protein, 8 aa, Mycobacterium
DPSEGTGP

SEQ ID NO: 454764 - protein, 9 aa, Mycobacterium
DPSEGTVNG

SEQ ID NO: 454765 - protein, 10 aa, Mycobacterium
DPSEHAEAAE

SEQ ID NO: 454766 - protein, 7 aa, Mycobacterium
DPSEKRL

SEQ ID NO: 454767 - protein, 9 aa, Mycobacterium
DPSEKSPFG

SEQ ID NO: 454768 - protein, 8 aa, Mycobacterium
DPSEPTYD

SEQ ID NO: 454769 - protein, 8 aa, Mycobacterium
DPSEPVES

SEQ ID NO: 454770 - protein, 13 aa, Mycobacterium
DPSEREDYRTRAE

SEQ ID NO: 454771 - protein, 6 aa, Mycobacterium
DPSFDT

SEQ ID NO: 454772 - protein, 6 aa, Mycobacterium
DPSFSE

SEQ ID NO: 454773 - protein, 15 aa, Mycobacterium
DPSGAEVAPGEAGEI

SEQ ID NO: 454774 - protein, 10 aa, Mycobacterium
DPSGAPRGTL

SEQ ID NO: 454775 - protein, 16 aa, Mycobacterium
DPSGEVRYRSGGHERR

SEQ ID NO: 454776 - protein, 6 aa, Mycobacterium
DPSGFR

SEQ ID NO: 454777 - protein, 16 aa, Mycobacterium
DPSGGPSRYPGVGTSR

SEQ ID NO: 454778 - protein, 9 aa, Mycobacterium
DPSGGTTTV

SEQ ID NO: 454779 - protein, 6 aa, Mycobacterium
DPSGLA

SEQ ID NO: 454780 - protein, 6 aa, Mycobacterium
DPSGPC

SEQ ID NO: 454781 - protein, 15 aa, Mycobacterium
DPSGPSIAVPRSVLA

SEQ ID NO: 454782 - protein, 7 aa, Mycobacterium
DPSGQQL

SEQ ID NO: 454783 - protein, 6 aa, Mycobacterium
DPSGWN

SEQ ID NO: 454784 - protein, 4 aa, Mycobacterium
DPSH

SEQ ID NO: 454785 - protein, 12 aa, Mycobacterium
DPSHQGTKGLRE

SEQ ID NO: 454786 - protein, 5 aa, Mycobacterium
DPSIP

SEQ ID NO: 454787 - protein, 10 aa, Mycobacterium
DPSIPRSGSA

SEQ ID NO: 454788 - protein, 19 aa, Mycobacterium
DPSIPTDESGTRHRSAERA

SEQ ID NO: 454789 - protein, 21 aa, Mycobacterium
DPSIPTDESGTRHRSAERAAI

SEQ ID NO: 454790 - protein, 23 aa, Mycobacterium
DPSIPTDESGTRHRSAERSAIQT

SEQ ID NO: 454791 - protein, 22 aa, Mycobacterium
DPSIPTEESGTRHRSAERTAIQ

SEQ ID NO: 454792 - protein, 5 aa, Mycobacterium
DPSLC

SEQ ID NO: 454793 - protein, 5 aa, Mycobacterium
DPSLP

SEQ ID NO: 454794 - protein, 6 aa, Mycobacterium
DPSLPA

SEQ ID NO: 454795 - protein, 6 aa, Mycobacterium
DPSLPT

SEQ ID NO: 454796 - protein, 5 aa, Mycobacterium
DPSLS

SEQ ID NO: 454797 - protein, 21 aa, Mycobacterium
DPSLTVTRDGTKDAISNARPV

SEQ ID NO: 454798 - protein, 6 aa, Mycobacterium
DPSNDV

SEQ ID NO: 454799 - protein, 8 aa, Mycobacterium
DPSNGSAA

SEQ ID NO: 454800 - protein, 7 aa, Mycobacterium
DPSNRRC

SEQ ID NO: 454801 - protein, 7 aa, Mycobacterium
DPSNVSD

SEQ ID NO: 454802 - protein, 7 aa, Mycobacterium
DPSPDRV

SEQ ID NO: 454803 - protein, 8 aa, Mycobacterium
DPSPESAF

SEQ ID NO: 454804 - protein, 6 aa, Mycobacterium
DPSPGA

SEQ ID NO: 454805 - protein, 6 aa, Mycobacterium
DPSPHR

SEQ ID NO: 454806 - protein, 7 aa, Mycobacterium
DPSPNRI

SEQ ID NO: 454807 - protein, 8 aa, Mycobacterium
DPSPRPAD

SEQ ID NO: 454808 - protein, 8 aa, Mycobacterium
DPSPSDPV

SEQ ID NO: 454809 - protein, 9 aa, Mycobacterium
DPSPTNRHP

SEQ ID NO: 454810 - protein, 15 aa, Mycobacterium
DPSQKADDISGSGSY

SEQ ID NO: 454811 - protein, 8 aa, Mycobacterium
DPSQMTDL

SEQ ID NO: 454812 - protein, 16 aa, Mycobacterium
DPSQPAPYTEAAWIVH

SEQ ID NO: 454813 - protein, 8 aa, Mycobacterium
DPSQPLTS

SEQ ID NO: 454814 - protein, 6 aa, Mycobacterium
DPSQTY

SEQ ID NO: 454815 - protein, 4 aa, Mycobacterium
DPSR

SEQ ID NO: 454816 - protein, 5 aa, Mycobacterium
DPSRA

SEQ ID NO: 454817 - protein, 6 aa, Mycobacterium
DPSRAA

SEQ ID NO: 454818 - protein, 11 aa, Mycobacterium
DPSRAPKPASL

SEQ ID NO: 454819 - protein, 10 aa, Mycobacterium
DPSRASRLAD

SEQ ID NO: 454820 - protein, 8 aa, Mycobacterium
DPSREEQA

SEQ ID NO: 454821 - protein, 5 aa, Mycobacterium
DPSRL

SEQ ID NO: 454822 - protein, 5 aa, Mycobacterium
DPSRP

SEQ ID NO: 454823 - protein, 23 aa, Mycobacterium
DPSRQPSWDGNGNLASSAPGQRV

SEQ ID NO: 454824 - protein, 14 aa, Mycobacterium
DPSRVTTDLSQTRA

SEQ ID NO: 454825 - protein, 4 aa, Mycobacterium
DPSS

SEQ ID NO: 454826 - protein, 5 aa, Mycobacterium
DPSSA

SEQ ID NO: 454827 - protein, 14 aa, Mycobacterium
DPSSATTLGKENWS

SEQ ID NO: 454828 - protein, 13 aa, Mycobacterium
DPSSGDTGDNSRA

SEQ ID NO: 454829 - protein, 5 aa, Mycobacterium
DPSSL

SEQ ID NO: 454830 - protein, 9 aa, Mycobacterium
DPSSPFSGG

SEQ ID NO: 454831 - protein, 11 aa, Mycobacterium
DPSSSYVRKPP

SEQ ID NO: 454832 - protein, 7 aa, Mycobacterium
DPSSTKV

SEQ ID NO: 454833 - protein, 13 aa, Mycobacterium
DPSSTRSGGSILG

SEQ ID NO: 454834 - protein, 4 aa, Mycobacterium
DPST

SEQ ID NO: 454835 - protein, 9 aa, Mycobacterium
DPSTAPGAR

SEQ ID NO: 454836 - protein, 8 aa, Mycobacterium
DPSTDAQG

SEQ ID NO: 454837 - protein, 6 aa, Mycobacterium
DPSTDR

SEQ ID NO: 454838 - protein, 7 aa, Mycobacterium
DPSTFGR

SEQ ID NO: 454839 - protein, 13 aa, Mycobacterium
DPSTGASETVPGE

SEQ ID NO: 454840 - protein, 8 aa, Mycobacterium
DPSTGLDK

SEQ ID NO: 454841 - protein, 15 aa, Mycobacterium
DPSTQSTSSNSDKRP

SEQ ID NO: 454842 - protein, 8 aa, Mycobacterium
DPSTRDLS

SEQ ID NO: 454843 - protein, 6 aa, Mycobacterium
DPSTTL

SEQ ID NO: 454844 - protein, 5 aa, Mycobacterium
DPSTV

SEQ ID NO: 454845 - protein, 17 aa, Mycobacterium
DPSTYSQRLTSDNRKAL

SEQ ID NO: 454846 - protein, 6 aa, Mycobacterium
DPSVAA

SEQ ID NO: 454847 - protein, 10 aa, Mycobacterium
DPSVRDTEMG

SEQ ID NO: 454848 - protein, 9 aa, Mycobacterium
DPSYPADDE

SEQ ID NO: 454849 - protein, 9 aa, Mycobacterium
DPSYPADED

SEQ ID NO: 454850 - protein, 4 aa, Mycobacterium
DPTA

SEQ ID NO: 454851 - protein, 5 aa, Mycobacterium
DPTAA

SEQ ID NO: 454852 - protein, 10 aa, Mycobacterium
DPTAAARARS

SEQ ID NO: 454853 - protein, 13 aa, Mycobacterium
DPTAADAAAEAVA

SEQ ID NO: 454854 - protein, 5 aa, Mycobacterium
DPTAC

SEQ ID NO: 454855 - protein, 13 aa, Mycobacterium
DPTADAALRRTEA

SEQ ID NO: 454856 - protein, 6 aa, Mycobacterium
DPTADY

SEQ ID NO: 454857 - protein, 16 aa, Mycobacterium
DPTAFDDDTDAGEKIH

SEQ ID NO: 454858 - protein, 6 aa, Mycobacterium
DPTAGA

SEQ ID NO: 454859 - protein, 7 aa, Mycobacterium
DPTAGEF

SEQ ID NO: 454860 - protein, 8 aa, Mycobacterium
DPTAGERL

SEQ ID NO: 454861 - protein, 8 aa, Mycobacterium
DPTAGPAA

SEQ ID NO: 454862 - protein, 6 aa, Mycobacterium
DPTAGS

SEQ ID NO: 454863 - protein, 15 aa, Mycobacterium
DPTAKMSKSAESDAG

SEQ ID NO: 454864 - protein, 11 aa, Mycobacterium
DPTAPGSAGMD

SEQ ID NO: 454865 - protein, 6 aa, Mycobacterium
DPTART

SEQ ID NO: 454866 - protein, 12 aa, Mycobacterium
DPTASAAERDRA

SEQ ID NO: 454867 - protein, 8 aa, Mycobacterium
DPTASGGT

SEQ ID NO: 454868 - protein, 12 aa, Mycobacterium
DPTAVAKKSSAL

SEQ ID NO: 454869 - protein, 17 aa, Mycobacterium
DPTAVPADQQAARDAVN

SEQ ID NO: 454870 - protein, 9 aa, Mycobacterium
DPTAYADEQ

SEQ ID NO: 454871 - protein, 6 aa, Mycobacterium
DPTAYR

SEQ ID NO: 454872 - protein, 6 aa, Mycobacterium
DPTDAG

SEQ ID NO: 454873 - protein, 8 aa, Mycobacterium
DPTDGEQR

SEQ ID NO: 454874 - protein, 8 aa, Mycobacterium
DPTDGERR

SEQ ID NO: 454875 - protein, 13 aa, Mycobacterium
DPTDHSKVLIVAP

SEQ ID NO: 454876 - protein, 7 aa, Mycobacterium
DPTDPDF

SEQ ID NO: 454877 - protein, 7 aa, Mycobacterium
DPTDPRF

SEQ ID NO: 454878 - protein, 11 aa, Mycobacterium
DPTDPTPTIGG

SEQ ID NO: 454879 - protein, 5 aa, Mycobacterium
DPTDR

SEQ ID NO: 454880 - protein, 6 aa, Mycobacterium
DPTDSI

SEQ ID NO: 454881 - protein, 10 aa, Mycobacterium
DPTDSTSDYR

SEQ ID NO: 454882 - protein, 23 aa, Mycobacterium
DPTDSYTALATSGPEVGDYGEAL

SEQ ID NO: 454883 - protein, 15 aa, Mycobacterium
DPTDVTKDLSGARSA

SEQ ID NO: 454884 - protein, 8 aa, Mycobacterium
DPTEGNYD

SEQ ID NO: 454885 - protein, 8 aa, Mycobacterium
DPTELSEE

SEQ ID NO: 454886 - protein, 8 aa, Mycobacterium
DPTEPGRY

SEQ ID NO: 454887 - protein, 8 aa, Mycobacterium
DPTEPNRY

SEQ ID NO: 454888 - protein, 6 aa, Mycobacterium
DPTEVA

SEQ ID NO: 454889 - protein, 13 aa, Mycobacterium
DPTGAEDHYRPST

SEQ ID NO: 454890 - protein, 7 aa, Mycobacterium
DPTGDGA

SEQ ID NO: 454891 - protein, 15 aa, Mycobacterium
DPTGETAVNNVMRGR

SEQ ID NO: 454892 - protein, 13 aa, Mycobacterium
DPTGEYRIETGTA

SEQ ID NO: 454893 - protein, 5 aa, Mycobacterium
DPTGK

SEQ ID NO: 454894 - protein, 6 aa, Mycobacterium
DPTGLD

SEQ ID NO: 454895 - protein, 12 aa, Mycobacterium
DPTGLTAGQAYQ

SEQ ID NO: 454896 - protein, 8 aa, Mycobacterium
DPTGNFGN

SEQ ID NO: 454897 - protein, 26 aa, Mycobacterium
DPTGRGPGLRGRRHGSRRHECDPRGE

SEQ ID NO: 454898 - protein, 6 aa, Mycobacterium
DPTGRK

SEQ ID NO: 454899 - protein, 6 aa, Mycobacterium
DPTGWT

SEQ ID NO: 454900 - protein, 5 aa, Mycobacterium
DPTGY

SEQ ID NO: 454901 - protein, 7 aa, Mycobacterium
DPTHDSA

SEQ ID NO: 454902 - protein, 7 aa, Mycobacterium
DPTIGPI

SEQ ID NO: 454903 - protein, 5 aa, Mycobacterium
DPTIS

SEQ ID NO: 454904 - protein, 4 aa, Mycobacterium
DPTK

SEQ ID NO: 454905 - protein, 11 aa, Mycobacterium
DPTKANADPRS

SEQ ID NO: 454906 - protein, 16 aa, Mycobacterium
DPTKKARTYSKGNRQK

SEQ ID NO: 454907 - protein, 14 aa, Mycobacterium
DPTKTAASRDKHGW

SEQ ID NO: 454908 - protein, 14 aa, Mycobacterium
DPTKTASSRSKHGW

SEQ ID NO: 454909 - protein, 9 aa, Mycobacterium
DPTLSSPRR

SEQ ID NO: 454910 - protein, 4 aa, Mycobacterium
DPTM

SEQ ID NO: 454911 - protein, 9 aa, Mycobacterium
DPTNDAEIN

SEQ ID NO: 454912 - protein, 9 aa, Mycobacterium
DPTNDTEIT

SEQ ID NO: 454913 - protein, 4 aa, Mycobacterium
DPTP

SEQ ID NO: 454914 - protein, 8 aa, Mycobacterium
DPTPADEV

SEQ ID NO: 454915 - protein, 16 aa, Mycobacterium
DPTPADSSTSRDTYGN

SEQ ID NO: 454916 - protein, 7 aa, Mycobacterium
DPTPDQR

SEQ ID NO: 454917 - protein, 11 aa, Mycobacterium
DPTPEGHPDPL

SEQ ID NO: 454918 - protein, 22 aa, Mycobacterium
DPTPEIRPAPPDEWSPEARPSP

SEQ ID NO: 454919 - protein, 7 aa, Mycobacterium
DPTPGLD

SEQ ID NO: 454920 - protein, 6 aa, Mycobacterium
DPTPHG

SEQ ID NO: 454921 - protein, 20 aa, Mycobacterium
DPTPRGPGFNPDNVRIEWRT

SEQ ID NO: 454922 - protein, 13 aa, Mycobacterium
DPTPTDRRDSAQP

SEQ ID NO: 454923 - protein, 4 aa, Mycobacterium
DPTQ

SEQ ID NO: 454924 - protein, 9 aa, Mycobacterium
DPTQARGLA

SEQ ID NO: 454925 - protein, 11 aa, Mycobacterium
DPTQASDWGAG

SEQ ID NO: 454926 - protein, 10 aa, Mycobacterium
DPTQGKPVRQ

SEQ ID NO: 454927 - protein, 15 aa, Mycobacterium
DPTQLSAAGGALKSS

SEQ ID NO: 454928 - protein, 6 aa, Mycobacterium
DPTQNL

SEQ ID NO: 454929 - protein, 6 aa, Mycobacterium
DPTQSA

SEQ ID NO: 454930 - protein, 16 aa, Mycobacterium
DPTQTTSQDGQARQAA

SEQ ID NO: 454931 - protein, 13 aa, Mycobacterium
DPTRAPSYGVPGD

SEQ ID NO: 454932 - protein, 7 aa, Mycobacterium
DPTRDIG

SEQ ID NO: 454933 - protein, 6 aa, Mycobacterium
DPTRDW

SEQ ID NO: 454934 - protein, 13 aa, Mycobacterium
DPTRFDPDSCEER

SEQ ID NO: 454935 - protein, 12 aa, Mycobacterium
DPTRFDPQSCEQ

SEQ ID NO: 454936 - protein, 8 aa, Mycobacterium
DPTRGGPA

SEQ ID NO: 454937 - protein, 8 aa, Mycobacterium
DPTRGSMD

SEQ ID NO: 454938 - protein, 5 aa, Mycobacterium
DPTRP

SEQ ID NO: 454939 - protein, 10 aa, Mycobacterium
DPTRPPGGAY

SEQ ID NO: 454940 - protein, 12 aa, Mycobacterium
DPTRQGDPDPLN

SEQ ID NO: 454941 - protein, 6 aa, Mycobacterium
DPTRRL

SEQ ID NO: 454942 - protein, 4 aa, Mycobacterium
DPTS

SEQ ID NO: 454943 - protein, 13 aa, Mycobacterium
DPTSDAKLPEAVG

SEQ ID NO: 454944 - protein, 8 aa, Mycobacterium
DPTSDGLA

SEQ ID NO: 454945 - protein, 7 aa, Mycobacterium
DPTSDPL

SEQ ID NO: 454946 - protein, 12 aa, Mycobacterium
DPTSEAKIPQAV

SEQ ID NO: 454947 - protein, 13 aa, Mycobacterium
DPTSEAKLPEAVG

SEQ ID NO: 454948 - protein, 6 aa, Mycobacterium
DPTSGL

SEQ ID NO: 454949 - protein, 17 aa, Mycobacterium
DPTSGTLTVNGEDVTQV

SEQ ID NO: 454950 - protein, 20 aa, Mycobacterium
DPTSKSAEKVQAICGYEPAT

SEQ ID NO: 454951 - protein, 7 aa, Mycobacterium
DPTSLDA

SEQ ID NO: 454952 - protein, 9 aa, Mycobacterium
DPTSSKPPY

SEQ ID NO: 454953 - protein, 15 aa, Mycobacterium
DPTSTLRATADRSGP

SEQ ID NO: 454954 - protein, 10 aa, Mycobacterium
DPTSVEPDAL

SEQ ID NO: 454955 - protein, 8 aa, Mycobacterium
DPTSVPPT

SEQ ID NO: 454956 - protein, 5 aa, Mycobacterium
DPTSY

SEQ ID NO: 454957 - protein, 8 aa, Mycobacterium
DPTTARHR

SEQ ID NO: 454958 - protein, 6 aa, Mycobacterium
DPTTAY

SEQ ID NO: 454959 - protein, 9 aa, Mycobacterium
DPTTDADKL

SEQ ID NO: 454960 - protein, 9 aa, Mycobacterium
DPTTDADRL

SEQ ID NO: 454961 - protein, 14 aa, Mycobacterium
DPTTDVEVSGSQQD

SEQ ID NO: 454962 - protein, 7 aa, Mycobacterium
DPTTIGH

SEQ ID NO: 454963 - protein, 12 aa, Mycobacterium
DPTTPAAETGEA

SEQ ID NO: 454964 - protein, 7 aa, Mycobacterium
DPTTPRA

SEQ ID NO: 454965 - protein, 17 aa, Mycobacterium
DPTTRRAEFDPDSNGAR

SEQ ID NO: 454966 - protein, 8 aa, Mycobacterium
DPTVGPID

SEQ ID NO: 454967 - protein, 7 aa, Mycobacterium
DPTVRNG

SEQ ID NO: 454968 - protein, 9 aa, Mycobacterium
DPTVRSGTN

SEQ ID NO: 454969 - protein, 5 aa, Mycobacterium
DPTVT

SEQ ID NO: 454970 - protein, 4 aa, Mycobacterium
DPTW

SEQ ID NO: 454971 - protein, 17 aa, Mycobacterium
DPTWKRSGHTERGRDGC

SEQ ID NO: 454972 - protein, 5 aa, Mycobacterium
DPTWP

SEQ ID NO: 454973 - protein, 6 aa, Mycobacterium
DPTYDE

SEQ ID NO: 454974 - protein, 13 aa, Mycobacterium
DPVAAQAAAEEGC

SEQ ID NO: 454975 - protein, 17 aa, Mycobacterium
DPVAARQPSGSGSDRRF

SEQ ID NO: 454976 - protein, 9 aa, Mycobacterium
DPVAEANRR

SEQ ID NO: 454977 - protein, 14 aa, Mycobacterium
DPVAEPGTIGGTPG

SEQ ID NO: 454978 - protein, 10 aa, Mycobacterium
DPVAGSPGVG

SEQ ID NO: 454979 - protein, 8 aa, Mycobacterium
DPVAKKST

SEQ ID NO: 454980 - protein, 8 aa, Mycobacterium
DPVAPKHQ

SEQ ID NO: 454981 - protein, 7 aa, Mycobacterium
DPVAPKQ

SEQ ID NO: 454982 - protein, 4 aa, Mycobacterium
DPVC

SEQ ID NO: 454983 - protein, 4 aa, Mycobacterium
DPVD

SEQ ID NO: 454984 - protein, 8 aa, Mycobacterium
DPVDPADL

SEQ ID NO: 454985 - protein, 26 aa, Mycobacterium
DPVDPAQLQDGARNAPLTRPRPGHAD

SEQ ID NO: 454986 - protein, 11 aa, Mycobacterium
DPVDPIETDED

SEQ ID NO: 454987 - protein, 7 aa, Mycobacterium
DPVDRSA

SEQ ID NO: 454988 - protein, 7 aa, Mycobacterium
DPVDTAE

SEQ ID NO: 454989 - protein, 13 aa, Mycobacterium
DPVEGGNSQVTRR

SEQ ID NO: 454990 - protein, 5 aa, Mycobacterium
DPVEQ

SEQ ID NO: 454991 - protein, 11 aa, Mycobacterium
DPVESREGRVD

SEQ ID NO: 454992 - protein, 6 aa, Mycobacterium
DPVGAR

SEQ ID NO: 454993 - protein, 6 aa, Mycobacterium
DPVGAY

SEQ ID NO: 454994 - protein, 6 aa, Mycobacterium
DPVGDA

SEQ ID NO: 454995 - protein, 8 aa, Mycobacterium
DPVGDATV

SEQ ID NO: 454996 - protein, 11 aa, Mycobacterium
DPVGDGAVSPL

SEQ ID NO: 454997 - protein, 11 aa, Mycobacterium
DPVGGDLSEPA

SEQ ID NO: 454998 - protein, 5 aa, Mycobacterium
DPVGL

SEQ ID NO: 454999 - protein, 6 aa, Mycobacterium
DPVGPR

SEQ ID NO: 455000 - protein, 9 aa, Mycobacterium
DPVGTGSPL

SEQ ID NO: 455001 - protein, 12 aa, Mycobacterium
DPVGVTATSNAD

SEQ ID NO: 455002 - protein, 4 aa, Mycobacterium
DPVH

SEQ ID NO: 455003 - protein, 4 aa, Mycobacterium
DPVN

SEQ ID NO: 455004 - protein, 4 aa, Mycobacterium
DPVP

SEQ ID NO: 455005 - protein, 12 aa, Mycobacterium
DPVPADRRKVPG

SEQ ID NO: 455006 - protein, 9 aa, Mycobacterium
DPVPDGGTA

SEQ ID NO: 455007 - protein, 6 aa, Mycobacterium
DPVPDL

SEQ ID NO: 455008 - protein, 6 aa, Mycobacterium
DPVPES

SEQ ID NO: 455009 - protein, 12 aa, Mycobacterium
DPVPESEEAVAD

SEQ ID NO: 455010 - protein, 6 aa, Mycobacterium
DPVPGF

SEQ ID NO: 455011 - protein, 12 aa, Mycobacterium
DPVPTGGDDPHK

SEQ ID NO: 455012 - protein, 11 aa, Mycobacterium
DPVPTGGDNPH

SEQ ID NO: 455013 - protein, 9 aa, Mycobacterium
DPVQRDAAR

SEQ ID NO: 455014 - protein, 5 aa, Mycobacterium
DPVRA

SEQ ID NO: 455015 - protein, 6 aa, Mycobacterium
DPVRAE

SEQ ID NO: 455016 - protein, 63 aa, Mycobacterium
DPVRGADGDRGRAAGDRLGGRRGHLPGGRRRAGRTGQSGDAGPRATGDDAADRRGVDGGRLQR

SEQ ID NO: 455017 - protein, 12 aa, Mycobacterium
DPVRGKGEYRGA

SEQ ID NO: 455018 - protein, 15 aa, Mycobacterium
DPVRPQSNDAFGAER

SEQ ID NO: 455019 - protein, 9 aa, Mycobacterium
DPVRRGQRA

SEQ ID NO: 455020 - protein, 5 aa, Mycobacterium
DPVRT

SEQ ID NO: 455021 - protein, 11 aa, Mycobacterium
DPVRVAPQADL

SEQ ID NO: 455022 - protein, 8 aa, Mycobacterium
DPVSAGNW

SEQ ID NO: 455023 - protein, 6 aa, Mycobacterium
DPVSEK

SEQ ID NO: 455024 - protein, 5 aa, Mycobacterium
DPVSG

SEQ ID NO: 455025 - protein, 11 aa, Mycobacterium
DPVSRGPHATK

SEQ ID NO: 455026 - protein, 9 aa, Mycobacterium
DPVSRNDEA

SEQ ID NO: 455027 - protein, 4 aa, Mycobacterium
DPVT

SEQ ID NO: 455028 - protein, 9 aa, Mycobacterium
DPVTAPADY

SEQ ID NO: 455029 - protein, 6 aa, Mycobacterium
DPVTAV

SEQ ID NO: 455030 - protein, 10 aa, Mycobacterium
DPVTDPRTLQ

SEQ ID NO: 455031 - protein, 16 aa, Mycobacterium
DPVTGQATKMAGPGWT

SEQ ID NO: 455032 - protein, 8 aa, Mycobacterium
DPVTNTAR

SEQ ID NO: 455033 - protein, 12 aa, Mycobacterium
DPVTVPAAATDA

SEQ ID NO: 455034 - protein, 20 aa, Mycobacterium
DPVYAPNSYGGPHADPARAA

SEQ ID NO: 455035 - protein, 21 aa, Mycobacterium
DPVYAPNSYGGPHADPNQTNE

SEQ ID NO: 455036 - protein, 7 aa, Mycobacterium
DPWAPGA

SEQ ID NO: 455037 - protein, 5 aa, Mycobacterium
DPWEE

SEQ ID NO: 455038 - protein, 15 aa, Mycobacterium
DPWGEDDLPLRPWWT

SEQ ID NO: 455039 - protein, 5 aa, Mycobacterium
DPWGG

SEQ ID NO: 455040 - protein, 5 aa, Mycobacterium
DPWGS

SEQ ID NO: 455041 - protein, 14 aa, Mycobacterium
DPWPSEGAAEPWDG

SEQ ID NO: 455042 - protein, 12 aa, Mycobacterium
DPWREASGGSEF

SEQ ID NO: 455043 - protein, 6 aa, Mycobacterium
DPWSGE

SEQ ID NO: 455044 - protein, 8 aa, Mycobacterium
DPWTDGDF

SEQ ID NO: 455045 - protein, 4 aa, Mycobacterium
DPYA

SEQ ID NO: 455046 - protein, 11 aa, Mycobacterium
DPYADRPGSYR

SEQ ID NO: 455047 - protein, 10 aa, Mycobacterium
DPYAEKPRLD

SEQ ID NO: 455048 - protein, 5 aa, Mycobacterium
DPYAG

SEQ ID NO: 455049 - protein, 6 aa, Mycobacterium
DPYAGT

SEQ ID NO: 455050 - protein, 5 aa, Mycobacterium
DPYEN

SEQ ID NO: 455051 - protein, 13 aa, Mycobacterium
DPYFGGAGPDRVG

SEQ ID NO: 455052 - protein, 6 aa, Mycobacterium
DPYGGE

SEQ ID NO: 455053 - protein, 6 aa, Mycobacterium
DPYGGG

SEQ ID NO: 455054 - protein, 6 aa, Mycobacterium
DPYGHT

SEQ ID NO: 455055 - protein, 5 aa, Mycobacterium
DPYLT

SEQ ID NO: 455056 - protein, 10 aa, Mycobacterium
DPYNDDARHG

SEQ ID NO: 455057 - protein, 9 aa, Mycobacterium
DPYNPDARH

SEQ ID NO: 455058 - protein, 5 aa, Mycobacterium
DPYNS

SEQ ID NO: 455059 - protein, 6 aa, Mycobacterium
DPYPNA

SEQ ID NO: 455060 - protein, 5 aa, Mycobacterium
DPYPR

SEQ ID NO: 455061 - protein, 7 aa, Mycobacterium
DPYPRAE

SEQ ID NO: 455062 - protein, 6 aa, Mycobacterium
DPYPTY

SEQ ID NO: 455063 - protein, 4 aa, Mycobacterium
DPYQ

SEQ ID NO: 455064 - protein, 5 aa, Mycobacterium
DPYQV

SEQ ID NO: 455065 - protein, 5 aa, Mycobacterium
DPYRP

SEQ ID NO: 455066 - protein, 7 aa, Mycobacterium
DPYRTPR

SEQ ID NO: 455067 - protein, 11 aa, Mycobacterium
DPYSAAKAIGT

SEQ ID NO: 455068 - protein, 10 aa, Mycobacterium
DPYSDEARHG

SEQ ID NO: 455069 - protein, 6 aa, Mycobacterium
DPYTAA

SEQ ID NO: 455070 - protein, 22 aa, Mycobacterium
DPYTLSTDRSAEPEIGPQPDLP

SEQ ID NO: 455071 - protein, 6 aa, Mycobacterium
DPYTRR

SEQ ID NO: 455072 - protein, 5 aa, Mycobacterium
DPYYE

SEQ ID NO: 455073 - protein, 8 aa, Mycobacterium
DPYYGDAQ

SEQ ID NO: 455074 - protein, 7 aa, Mycobacterium
DPYYGGH

SEQ ID NO: 455075 - protein, 6 aa, Mycobacterium
DPYYGN

SEQ ID NO: 455076 - protein, 6 aa, Mycobacterium
DQAAAA

SEQ ID NO: 455077 - protein, 8 aa, Mycobacterium
DQAAADAL

SEQ ID NO: 455078 - protein, 8 aa, Mycobacterium
DQAAAHPT

SEQ ID NO: 455079 - protein, 6 aa, Mycobacterium
DQAAAR

SEQ ID NO: 455080 - protein, 8 aa, Mycobacterium
DQAAHAGA

SEQ ID NO: 455081 - protein, 7 aa, Mycobacterium
DQAAYDA

SEQ ID NO: 455082 - protein, 9 aa, Mycobacterium
DQADAARQA

SEQ ID NO: 455083 - protein, 11 aa, Mycobacterium
DQADDKQLAAR

SEQ ID NO: 455084 - protein, 6 aa, Mycobacterium
DQADGL

SEQ ID NO: 455085 - protein, 6 aa, Mycobacterium
DQADGP

SEQ ID NO: 455086 - protein, 7 aa, Mycobacterium
DQADPVA

SEQ ID NO: 455087 - protein, 8 aa, Mycobacterium
DQADTGEV

SEQ ID NO: 455088 - protein, 12 aa, Mycobacterium
DQAEAVEKARKT

SEQ ID NO: 455089 - protein, 8 aa, Mycobacterium
DQAEDRRY

SEQ ID NO: 455090 - protein, 6 aa, Mycobacterium
DQAEGA

SEQ ID NO: 455091 - protein, 5 aa, Mycobacterium
DQAEP

SEQ ID NO: 455092 - protein, 6 aa, Mycobacterium
DQAEPG

SEQ ID NO: 455093 - protein, 7 aa, Mycobacterium
DQAERDE

SEQ ID NO: 455094 - protein, 8 aa, Mycobacterium
DQAERDEL

SEQ ID NO: 455095 - protein, 6 aa, Mycobacterium
DQAETL

SEQ ID NO: 455096 - protein, 7 aa, Mycobacterium
DQAFRDE

SEQ ID NO: 455097 - protein, 4 aa, Mycobacterium
DQAG

SEQ ID NO: 455098 - protein, 5 aa, Mycobacterium
DQAGA

SEQ ID NO: 455099 - protein, 16 aa, Mycobacterium
DQAGADDLDDTDGFGD

SEQ ID NO: 455100 - protein, 9 aa, Mycobacterium
DQAGADGGA

SEQ ID NO: 455101 - protein, 9 aa, Mycobacterium
DQAGAHPDA

SEQ ID NO: 455102 - protein, 12 aa, Mycobacterium
DQAGGEVPQGTS

SEQ ID NO: 455103 - protein, 5 aa, Mycobacterium
DQAGR

SEQ ID NO: 455104 - protein, 7 aa, Mycobacterium
DQAGRLP

SEQ ID NO: 455105 - protein, 6 aa, Mycobacterium
DQAGRR

SEQ ID NO: 455106 - protein, 7 aa, Mycobacterium
DQAGRRR

SEQ ID NO: 455107 - protein, 16 aa, Mycobacterium
DQAGVGDDLGDTDGFG

SEQ ID NO: 455108 - protein, 6 aa, Mycobacterium
DQAHEF

SEQ ID NO: 455109 - protein, 9 aa, Mycobacterium
DQAHGTHYA

SEQ ID NO: 455110 - protein, 15 aa, Mycobacterium
DQAHPDRPGPPGFTE

SEQ ID NO: 455111 - protein, 8 aa, Mycobacterium
DQAHSTGD

SEQ ID NO: 455112 - protein, 5 aa, Mycobacterium
DQAKA

SEQ ID NO: 455113 - protein, 5 aa, Mycobacterium
DQALA

SEQ ID NO: 455114 - protein, 12 aa, Mycobacterium
DQALRSAADAVA

SEQ ID NO: 455115 - protein, 12 aa, Mycobacterium
DQALRSAADAVT

SEQ ID NO: 455116 - protein, 7 aa, Mycobacterium
DQANAAT

SEQ ID NO: 455117 - protein, 5 aa, Mycobacterium
DQANG

SEQ ID NO: 455118 - protein, 14 aa, Mycobacterium
DQANTLAHNRSGDI

SEQ ID NO: 455119 - protein, 4 aa, Mycobacterium
DQAP

SEQ ID NO: 455120 - protein, 10 aa, Mycobacterium
DQAPDEAPDV

SEQ ID NO: 455121 - protein, 20 aa, Mycobacterium
DQAPGPATQATERTARGAAQ

SEQ ID NO: 455122 - protein, 5 aa, Mycobacterium
DQAPL

SEQ ID NO: 455123 - protein, 8 aa, Mycobacterium
DQAPYEGI

SEQ ID NO: 455124 - protein, 4 aa, Mycobacterium
DQAQ

SEQ ID NO: 455125 - protein, 35 aa, Mycobacterium
DQAQNALQGMPGVGAGPSDTPLSSGMSPGQNGAAA

SEQ ID NO: 455126 - protein, 6 aa, Mycobacterium
DQAQPA

SEQ ID NO: 455127 - protein, 4 aa, Mycobacterium
DQAR

SEQ ID NO: 455128 - protein, 5 aa, Mycobacterium
DQARA

SEQ ID NO: 455129 - protein, 10 aa, Mycobacterium
DQARAEDDAA

SEQ ID NO: 455130 - protein, 18 aa, Mycobacterium
DQARAQKVTSDLSHAQNE

SEQ ID NO: 455131 - protein, 6 aa, Mycobacterium
DQARAT

SEQ ID NO: 455132 - protein, 6 aa, Mycobacterium
DQARGT

SEQ ID NO: 455133 - protein, 7 aa, Mycobacterium
DQARPVR

SEQ ID NO: 455134 - protein, 15 aa, Mycobacterium
DQARQLGRHADSDDE

SEQ ID NO: 455135 - protein, 10 aa, Mycobacterium
DQARRAVDAG

SEQ ID NO: 455136 - protein, 10 aa, Mycobacterium
DQARRDGNSA

SEQ ID NO: 455137 - protein, 6 aa, Mycobacterium
DQARRL

SEQ ID NO: 455138 - protein, 6 aa, Mycobacterium
DQASDR

SEQ ID NO: 455139 - protein, 7 aa, Mycobacterium
DQASDRT

SEQ ID NO: 455140 - protein, 7 aa, Mycobacterium
DQASDST

SEQ ID NO: 455141 - protein, 13 aa, Mycobacterium
DQASHSGTQAARD

SEQ ID NO: 455142 - protein, 5 aa, Mycobacterium
DQASL

SEQ ID NO: 455143 - protein, 8 aa, Mycobacterium
DQASPHTV

SEQ ID NO: 455144 - protein, 8 aa, Mycobacterium
DQASPNTL

SEQ ID NO: 455145 - protein, 10 aa, Mycobacterium
DQASSASAAP

SEQ ID NO: 455146 - protein, 10 aa, Mycobacterium
DQASTGGRPA

SEQ ID NO: 455147 - protein, 6 aa, Mycobacterium
DQASTV

SEQ ID NO: 455148 - protein, 5 aa, Mycobacterium
DQATA

SEQ ID NO: 455149 - protein, 19 aa, Mycobacterium
DQATAAGDAAKAAEYNNAA

SEQ ID NO: 455150 - protein, 19 aa, Mycobacterium
DQATAAGDAAKATEYNNAA

SEQ ID NO: 455151 - protein, 17 aa, Mycobacterium
DQATAAGDAAKAVEYNN

SEQ ID NO: 455152 - protein, 19 aa, Mycobacterium
DQATAAGDVAKATEYNNAA

SEQ ID NO: 455153 - protein, 9 aa, Mycobacterium
DQATAGPGV

SEQ ID NO: 455154 - protein, 11 aa, Mycobacterium
DQATDKQLAAR

SEQ ID NO: 455155 - protein, 6 aa, Mycobacterium
DQATDV

SEQ ID NO: 455156 - protein, 7 aa, Mycobacterium
DQATEKP

SEQ ID NO: 455157 - protein, 12 aa, Mycobacterium
DQATETQATEMA

SEQ ID NO: 455158 - protein, 13 aa, Mycobacterium
DQATKQTFTGEER

SEQ ID NO: 455159 - protein, 18 aa, Mycobacterium
DQATREPLAPYGSSSAAM

SEQ ID NO: 455160 - protein, 10 aa, Mycobacterium
DQATSPPASS

SEQ ID NO: 455161 - protein, 19 aa, Mycobacterium
DQATTAGDTAKATEYNNAA

SEQ ID NO: 455162 - protein, 8 aa, Mycobacterium
DQATTLAG

SEQ ID NO: 455163 - protein, 4 aa, Mycobacterium
DQAV

SEQ ID NO: 455164 - protein, 9 aa, Mycobacterium
DQAYAAREA

SEQ ID NO: 455165 - protein, 7 aa, Mycobacterium
DQCPTVN

SEQ ID NO: 455166 - protein, 6 aa, Mycobacterium
DQDAAR

SEQ ID NO: 455167 - protein, 15 aa, Mycobacterium
DQDAARDISRVFDPD

SEQ ID NO: 455168 - protein, 27 aa, Mycobacterium
DQDAEQQNTTATTAEPTCTKDPGSALL

SEQ ID NO: 455169 - protein, 8 aa, Mycobacterium
DQDAPALS

SEQ ID NO: 455170 - protein, 4 aa, Mycobacterium
DQDD

SEQ ID NO: 455171 - protein, 20 aa, Mycobacterium
DQDDKVETTAPAVGAEDDLE

SEQ ID NO: 455172 - protein, 14 aa, Mycobacterium
DQDDLDGQIRRTEG

SEQ ID NO: 455173 - protein, 9 aa, Mycobacterium
DQDDPASAE

SEQ ID NO: 455174 - protein, 6 aa, Mycobacterium
DQDEAE

SEQ ID NO: 455175 - protein, 6 aa, Mycobacterium
DQDEDG

SEQ ID NO: 455176 - protein, 18 aa, Mycobacterium
DQDEGKTEELAYSPAKTT

SEQ ID NO: 455177 - protein, 8 aa, Mycobacterium
DQDERDIA

SEQ ID NO: 455178 - protein, 6 aa, Mycobacterium
DQDESQ

SEQ ID NO: 455179 - protein, 6 aa, Mycobacterium
DQDGAV

SEQ ID NO: 455180 - protein, 10 aa, Mycobacterium
DQDGDESSRV

SEQ ID NO: 455181 - protein, 6 aa, Mycobacterium
DQDGEF

SEQ ID NO: 455182 - protein, 12 aa, Mycobacterium
DQDGSQKVIAQP

SEQ ID NO: 455183 - protein, 12 aa, Mycobacterium
DQDGSQRVIAQS

SEQ ID NO: 455184 - protein, 12 aa, Mycobacterium
DQDGSQRVIASS

SEQ ID NO: 455185 - protein, 5 aa, Mycobacterium
DQDGT

SEQ ID NO: 455186 - protein, 5 aa, Mycobacterium
DQDHA

SEQ ID NO: 455187 - protein, 5 aa, Mycobacterium
DQDHS

SEQ ID NO: 455188 - protein, 6 aa, Mycobacterium
DQDHSA

SEQ ID NO: 455189 - protein, 15 aa, Mycobacterium
DQDKDAFSDFVIAER

SEQ ID NO: 455190 - protein, 6 aa, Mycobacterium
DQDLAS

SEQ ID NO: 455191 - protein, 10 aa, Mycobacterium
DQDLGPRAAE

SEQ ID NO: 455192 - protein, 6 aa, Mycobacterium
DQDLGS

SEQ ID NO: 455193 - protein, 7 aa, Mycobacterium
DQDLNDQ

SEQ ID NO: 455194 - protein, 5 aa, Mycobacterium
DQDLS

SEQ ID NO: 455195 - protein, 7 aa, Mycobacterium
DQDLSGK

SEQ ID NO: 455196 - protein, 6 aa, Mycobacterium
DQDNGE

SEQ ID NO: 455197 - protein, 7 aa, Mycobacterium
DQDPDHM

SEQ ID NO: 455198 - protein, 8 aa, Mycobacterium
DQDPKGGR

SEQ ID NO: 455199 - protein, 7 aa, Mycobacterium
DQDPSAD

SEQ ID NO: 455200 - protein, 13 aa, Mycobacterium
DQDPSSRDSEHAD

SEQ ID NO: 455201 - protein, 20 aa, Mycobacterium
DQDQGKTEELAYSNDKTTVE

SEQ ID NO: 455202 - protein, 19 aa, Mycobacterium
DQDQQRALEAGTEAEKRAH

SEQ ID NO: 455203 - protein, 11 aa, Mycobacterium
DQDQSVQATAT

SEQ ID NO: 455204 - protein, 4 aa, Mycobacterium
DQDR

SEQ ID NO: 455205 - protein, 6 aa, Mycobacterium
DQDRFE

SEQ ID NO: 455206 - protein, 9 aa, Mycobacterium
DQDSDGLPI

SEQ ID NO: 455207 - protein, 6 aa, Mycobacterium
DQDSGE

SEQ ID NO: 455208 - protein, 7 aa, Mycobacterium
DQDSRLP

SEQ ID NO: 455209 - protein, 8 aa, Mycobacterium
DQDSVRAA

SEQ ID NO: 455210 - protein, 10 aa, Mycobacterium
DQDTAHGGWG

SEQ ID NO: 455211 - protein, 10 aa, Mycobacterium
DQDTGNAHGE

SEQ ID NO: 455212 - protein, 11 aa, Mycobacterium
DQDTGVYPSDA

SEQ ID NO: 455213 - protein, 13 aa, Mycobacterium
DQDTVCVEALAAV

SEQ ID NO: 455214 - protein, 8 aa, Mycobacterium
DQDVAQRR

SEQ ID NO: 455215 - protein, 22 aa, Mycobacterium
DQEADQVEDSPTPRLSADHPGV

SEQ ID NO: 455216 - protein, 6 aa, Mycobacterium
DQEAED

SEQ ID NO: 455217 - protein, 21 aa, Mycobacterium
DQEDGSDHGAHGGFDDQSHAL

SEQ ID NO: 455218 - protein, 6 aa, Mycobacterium
DQEEHR

SEQ ID NO: 455219 - protein, 4 aa, Mycobacterium
DQEG

SEQ ID NO: 455220 - protein, 7 aa, Mycobacterium
DQEGLAQ

SEQ ID NO: 455221 - protein, 6 aa, Mycobacterium
DQEISQ

SEQ ID NO: 455222 - protein, 5 aa, Mycobacterium
DQEKG

SEQ ID NO: 455223 - protein, 10 aa, Mycobacterium
DQELAGKHRA

SEQ ID NO: 455224 - protein, 5 aa, Mycobacterium
DQELR

SEQ ID NO: 455225 - protein, 10 aa, Mycobacterium
DQENEKNLGG

SEQ ID NO: 455226 - protein, 5 aa, Mycobacterium
DQENM

SEQ ID NO: 455227 - protein, 9 aa, Mycobacterium
DQENPKRCG

SEQ ID NO: 455228 - protein, 13 aa, Mycobacterium
DQENPSDPPPALN

SEQ ID NO: 455229 - protein, 4 aa, Mycobacterium
DQEP

SEQ ID NO: 455230 - protein, 5 aa, Mycobacterium
DQEPD

SEQ ID NO: 455231 - protein, 10 aa, Mycobacterium
DQEPEANTAQ

SEQ ID NO: 455232 - protein, 7 aa, Mycobacterium
DQEPFEP

SEQ ID NO: 455233 - protein, 8 aa, Mycobacterium
DQEPTARA

SEQ ID NO: 455234 - protein, 12 aa, Mycobacterium
DQERGLSAGEKR

SEQ ID NO: 455235 - protein, 5 aa, Mycobacterium
DQESA

SEQ ID NO: 455236 - protein, 6 aa, Mycobacterium
DQETGE

SEQ ID NO: 455237 - protein, 8 aa, Mycobacterium
DQETGQTV

SEQ ID NO: 455238 - protein, 15 aa, Mycobacterium
DQETPPHQLKADIRT

SEQ ID NO: 455239 - protein, 5 aa, Mycobacterium
DQEVE

SEQ ID NO: 455240 - protein, 7 aa, Mycobacterium
DQEWEPS

SEQ ID NO: 455241 - protein, 6 aa, Mycobacterium
DQFDGS

SEQ ID NO: 455242 - protein, 7 aa, Mycobacterium
DQFESEP

SEQ ID NO: 455243 - protein, 9 aa, Mycobacterium
DQFRGSDTA

SEQ ID NO: 455244 - protein, 4 aa, Mycobacterium
DQFS

SEQ ID NO: 455245 - protein, 6 aa, Mycobacterium
DQGATE

SEQ ID NO: 455246 - protein, 7 aa, Mycobacterium
DQGDAAD

SEQ ID NO: 455247 - protein, 6 aa, Mycobacterium
DQGDGP

SEQ ID NO: 455248 - protein, 19 aa, Mycobacterium
DQGEAGRNGPNPDKFDYVP

SEQ ID NO: 455249 - protein, 6 aa, Mycobacterium
DQGEAY

SEQ ID NO: 455250 - protein, 9 aa, Mycobacterium
DQGEFAATS

SEQ ID NO: 455251 - protein, 5 aa, Mycobacterium
DQGEI

SEQ ID NO: 455252 - protein, 14 aa, Mycobacterium
DQGESGAVKVAIDQ

SEQ ID NO: 455253 - protein, 12 aa, Mycobacterium
DQGETKGIPTAF

SEQ ID NO: 455254 - protein, 6 aa, Mycobacterium
DQGEVD

SEQ ID NO: 455255 - protein, 8 aa, Mycobacterium
DQGFTGGV

SEQ ID NO: 455256 - protein, 8 aa, Mycobacterium
DQGHEPGP

SEQ ID NO: 455257 - protein, 11 aa, Mycobacterium
DQGHPGGPRPY

SEQ ID NO: 455258 - protein, 5 aa, Mycobacterium
DQGHQ

SEQ ID NO: 455259 - protein, 18 aa, Mycobacterium
DQGHSVRDDDKRVDDLSQ

SEQ ID NO: 455260 - protein, 7 aa, Mycobacterium
DQGIASG

SEQ ID NO: 455261 - protein, 8 aa, Mycobacterium
DQGIGGDD

SEQ ID NO: 455262 - protein, 13 aa, Mycobacterium
DQGKALADEIGES

SEQ ID NO: 455263 - protein, 5 aa, Mycobacterium
DQGKS

SEQ ID NO: 455264 - protein, 10 aa, Mycobacterium
DQGLADRQKV

SEQ ID NO: 455265 - protein, 10 aa, Mycobacterium
DQGLSPQPAA

SEQ ID NO: 455266 - protein, 6 aa, Mycobacterium
DQGNPG

SEQ ID NO: 455267 - protein, 6 aa, Mycobacterium
DQGNRW

SEQ ID NO: 455268 - protein, 12 aa, Mycobacterium
DQGPEGGEPTVE

SEQ ID NO: 455269 - protein, 10 aa, Mycobacterium
DQGPPGHTVD

SEQ ID NO: 455270 - protein, 12 aa, Mycobacterium
DQGPVRENNQDA

SEQ ID NO: 455271 - protein, 6 aa, Mycobacterium
DQGRDV

SEQ ID NO: 455272 - protein, 5 aa, Mycobacterium
DQGRG

SEQ ID NO: 455273 - protein, 5 aa, Mycobacterium
DQGRR

SEQ ID NO: 455274 - protein, 8 aa, Mycobacterium
DQGRRTRA

SEQ ID NO: 455275 - protein, 9 aa, Mycobacterium
DQGRTEAEI

SEQ ID NO: 455276 - protein, 6 aa, Mycobacterium
DQGRVR

SEQ ID NO: 455277 - protein, 21 aa, Mycobacterium
DQGRWTGDSSASLRSQRRGRG

SEQ ID NO: 455278 - protein, 9 aa, Mycobacterium
DQGSDSVEV

SEQ ID NO: 455279 - protein, 10 aa, Mycobacterium
DQGSDSVEVQ

SEQ ID NO: 455280 - protein, 7 aa, Mycobacterium
DQGSRAL

SEQ ID NO: 455281 - protein, 8 aa, Mycobacterium
DQGSTSNA

SEQ ID NO: 455282 - protein, 4 aa, Mycobacterium
DQGT

SEQ ID NO: 455283 - protein, 35 aa, Mycobacterium
DQGTDETPALPPNLAAGEYDDNYYGADNDPAVPHT

SEQ ID NO: 455284 - protein, 14 aa, Mycobacterium
DQGTKKVKDHPEWA

SEQ ID NO: 455285 - protein, 18 aa, Mycobacterium
DQGTPLQNMDPRNDFPTG

SEQ ID NO: 455286 - protein, 7 aa, Mycobacterium
DQGTPRV

SEQ ID NO: 455287 - protein, 13 aa, Mycobacterium
DQGTRKVREHPDF

SEQ ID NO: 455288 - protein, 14 aa, Mycobacterium
DQGTSKAKDHPGFA

SEQ ID NO: 455289 - protein, 14 aa, Mycobacterium
DQGTSKAKDHPGFD

SEQ ID NO: 455290 - protein, 5 aa, Mycobacterium
DQGTV

SEQ ID NO: 455291 - protein, 4 aa, Mycobacterium
DQGW

SEQ ID NO: 455292 - protein, 9 aa, Mycobacterium
DQGYSPEFP

SEQ ID NO: 455293 - protein, 5 aa, Mycobacterium
DQHAQ

SEQ ID NO: 455294 - protein, 9 aa, Mycobacterium
DQHDSPAVS

SEQ ID NO: 455295 - protein, 12 aa, Mycobacterium
DQHDVYTRRTGI

SEQ ID NO: 455296 - protein, 6 aa, Mycobacterium
DQHEDG

SEQ ID NO: 455297 - protein, 11 aa, Mycobacterium
DQHGAEPKAVR

SEQ ID NO: 455298 - protein, 6 aa, Mycobacterium
DQHGNP

SEQ ID NO: 455299 - protein, 11 aa, Mycobacterium
DQHGRRAHRTG

SEQ ID NO: 455300 - protein, 5 aa, Mycobacterium
DQHGT

SEQ ID NO: 455301 - protein, 6 aa, Mycobacterium
DQHGTR

SEQ ID NO: 455302 - protein, 6 aa, Mycobacterium
DQHGVP

SEQ ID NO: 455303 - protein, 17 aa, Mycobacterium
DQHHSSAHPGPDAYAGK

SEQ ID NO: 455304 - protein, 14 aa, Mycobacterium
DQHHSSQHPGPDRY

SEQ ID NO: 455305 - protein, 11 aa, Mycobacterium
DQHPESDDARD

SEQ ID NO: 455306 - protein, 6 aa, Mycobacterium
DQHPGD

SEQ ID NO: 455307 - protein, 8 aa, Mycobacterium
DQHPPELG

SEQ ID NO: 455308 - protein, 11 aa, Mycobacterium
DQHPRQPRRPR

SEQ ID NO: 455309 - protein, 9 aa, Mycobacterium
DQHPSPRSK

SEQ ID NO: 455310 - protein, 6 aa, Mycobacterium
DQHQAA

SEQ ID NO: 455311 - protein, 6 aa, Mycobacterium
DQHRGT

SEQ ID NO: 455312 - protein, 8 aa, Mycobacterium
DQHRTRRT

SEQ ID NO: 455313 - protein, 8 aa, Mycobacterium
DQHTPGIS

SEQ ID NO: 455314 - protein, 4 aa, Mycobacterium
DQIA

SEQ ID NO: 455315 - protein, 9 aa, Mycobacterium
DQIASGDRG

SEQ ID NO: 455316 - protein, 4 aa, Mycobacterium
DQID

SEQ ID NO: 455317 - protein, 5 aa, Mycobacterium
DQIDA

SEQ ID NO: 455318 - protein, 17 aa, Mycobacterium
DQIDDGDPDAVLQEVGA

SEQ ID NO: 455319 - protein, 4 aa, Mycobacterium
DQIE

SEQ ID NO: 455320 - protein, 12 aa, Mycobacterium
DQIEPGKFTEDA

SEQ ID NO: 455321 - protein, 11 aa, Mycobacterium
DQIESPTADLG

SEQ ID NO: 455322 - protein, 6 aa, Mycobacterium
DQIGGT

SEQ ID NO: 455323 - protein, 17 aa, Mycobacterium
DQIGPNRPGPKGFRGQP

SEQ ID NO: 455324 - protein, 12 aa, Mycobacterium
DQIGTGRKRFEE

SEQ ID NO: 455325 - protein, 4 aa, Mycobacterium
DQIN

SEQ ID NO: 455326 - protein, 5 aa, Mycobacterium
DQIPG

SEQ ID NO: 455327 - protein, 8 aa, Mycobacterium
DQIPVPPQ

SEQ ID NO: 455328 - protein, 7 aa, Mycobacterium
DQIQPGE

SEQ ID NO: 455329 - protein, 8 aa, Mycobacterium
DQIQSAEA

SEQ ID NO: 455330 - protein, 7 aa, Mycobacterium
DQIRGEG

SEQ ID NO: 455331 - protein, 7 aa, Mycobacterium
DQIRSGS

SEQ ID NO: 455332 - protein, 8 aa, Mycobacterium
DQISTGQH

SEQ ID NO: 455333 - protein, 6 aa, Mycobacterium
DQITDK

SEQ ID NO: 455334 - protein, 8 aa, Mycobacterium
DQITGRDG

SEQ ID NO: 455335 - protein, 7 aa, Mycobacterium
DQITPGQ

SEQ ID NO: 455336 - protein, 11 aa, Mycobacterium
DQITSSGGEIT

SEQ ID NO: 455337 - protein, 12 aa, Mycobacterium
DQIYSEDGSQVD

SEQ ID NO: 455338 - protein, 19 aa, Mycobacterium
DQKASAANVTKSTAVARDA

SEQ ID NO: 455339 - protein, 7 aa, Mycobacterium
DQKASTT

SEQ ID NO: 455340 - protein, 6 aa, Mycobacterium
DQKERR

SEQ ID NO: 455341 - protein, 4 aa, Mycobacterium
DQKG

SEQ ID NO: 455342 - protein, 10 aa, Mycobacterium
DQKGNSDADF

SEQ ID NO: 455343 - protein, 7 aa, Mycobacterium
DQKGRGS

SEQ ID NO: 455344 - protein, 7 aa, Mycobacterium
DQKIDYK

SEQ ID NO: 455345 - protein, 7 aa, Mycobacterium
DQKKTGI

SEQ ID NO: 455346 - protein, 4 aa, Mycobacterium
DQKL

SEQ ID NO: 455347 - protein, 10 aa, Mycobacterium
DQKNARPEDF

SEQ ID NO: 455348 - protein, 12 aa, Mycobacterium
DQKPTPPPSPPR

SEQ ID NO: 455349 - protein, 5 aa, Mycobacterium
DQKQL

SEQ ID NO: 455350 - protein, 5 aa, Mycobacterium
DQKQV

SEQ ID NO: 455351 - protein, 17 aa, Mycobacterium
DQKRRVSDEWAAEPQVA

SEQ ID NO: 455352 - protein, 18 aa, Mycobacterium
DQKTREPLAPYGSSSPAM

SEQ ID NO: 455353 - protein, 5 aa, Mycobacterium
DQKTT

SEQ ID NO: 455354 - protein, 5 aa, Mycobacterium
DQKWE

SEQ ID NO: 455355 - protein, 4 aa, Mycobacterium
DQLA

SEQ ID NO: 455356 - protein, 8 aa, Mycobacterium
DQLAAPDS

SEQ ID NO: 455357 - protein, 27 aa, Mycobacterium
DQLAPGERCAATSNRNFEGRQGKGGRT

SEQ ID NO: 455358 - protein, 28 aa, Mycobacterium
DQLAPGERCASTSNRNFEGRQGKGGRTH

SEQ ID NO: 455359 - protein, 6 aa, Mycobacterium
DQLAPI

SEQ ID NO: 455360 - protein, 6 aa, Mycobacterium
DQLASN

SEQ ID NO: 455361 - protein, 7 aa, Mycobacterium
DQLDDEV

SEQ ID NO: 455362 - protein, 7 aa, Mycobacterium
DQLDDNG

SEQ ID NO: 455363 - protein, 9 aa, Mycobacterium
DQLEAETQK

SEQ ID NO: 455364 - protein, 4 aa, Mycobacterium
DQLG

SEQ ID NO: 455365 - protein, 6 aa, Mycobacterium
DQLGGS

SEQ ID NO: 455366 - protein, 5 aa, Mycobacterium
DQLGP

SEQ ID NO: 455367 - protein, 8 aa, Mycobacterium
DQLGYRAD

SEQ ID NO: 455368 - protein, 8 aa, Mycobacterium
DQLNPHSG

SEQ ID NO: 455369 - protein, 9 aa, Mycobacterium
DQLNSEGRP

SEQ ID NO: 455370 - protein, 6 aa, Mycobacterium
DQLNSG

SEQ ID NO: 455371 - protein, 6 aa, Mycobacterium
DQLPDN

SEQ ID NO: 455372 - protein, 8 aa, Mycobacterium
DQLPERTY

SEQ ID NO: 455373 - protein, 6 aa, Mycobacterium
DQLPNG

SEQ ID NO: 455374 - protein, 9 aa, Mycobacterium
DQLPPTKDN

SEQ ID NO: 455375 - protein, 7 aa, Mycobacterium
DQLPSGS

SEQ ID NO: 455376 - protein, 7 aa, Mycobacterium
DQLPTRT

SEQ ID NO: 455377 - protein, 4 aa, Mycobacterium
DQLR

SEQ ID NO: 455378 - protein, 11 aa, Mycobacterium
DQLRAKAPAGI

SEQ ID NO: 455379 - protein, 10 aa, Mycobacterium
DQLRPGEQGV

SEQ ID NO: 455380 - protein, 4 aa, Mycobacterium
DQLS

SEQ ID NO: 455381 - protein, 15 aa, Mycobacterium
DQLSDTLARLAAAVS

SEQ ID NO: 455382 - protein, 5 aa, Mycobacterium
DQLSG

SEQ ID NO: 455383 - protein, 6 aa, Mycobacterium
DQLSGD

SEQ ID NO: 455384 - protein, 5 aa, Mycobacterium
DQLSI

SEQ ID NO: 455385 - protein, 5 aa, Mycobacterium
DQLSN

SEQ ID NO: 455386 - protein, 7 aa, Mycobacterium
DQLSPEA

SEQ ID NO: 455387 - protein, 8 aa, Mycobacterium
DQLSQRPA

SEQ ID NO: 455388 - protein, 6 aa, Mycobacterium
DQLTED

SEQ ID NO: 455389 - protein, 12 aa, Mycobacterium
DQLTPDGSPDAV

SEQ ID NO: 455390 - protein, 5 aa, Mycobacterium
DQLTQ

SEQ ID NO: 455391 - protein, 4 aa, Mycobacterium
DQMD

SEQ ID NO: 455392 - protein, 14 aa, Mycobacterium
DQMKRDADEADSDV

SEQ ID NO: 455393 - protein, 19 aa, Mycobacterium
DQNGSANTHPDHDEDERIG

SEQ ID NO: 455394 - protein, 14 aa, Mycobacterium
DQNHPHPSGRPTTE

SEQ ID NO: 455395 - protein, 8 aa, Mycobacterium
DQNKARRI

SEQ ID NO: 455396 - protein, 6 aa, Mycobacterium
DQNNQV

SEQ ID NO: 455397 - protein, 8 aa, Mycobacterium
DQNNRPVT

SEQ ID NO: 455398 - protein, 8 aa, Mycobacterium
DQNPANKQ

SEQ ID NO: 455399 - protein, 5 aa, Mycobacterium
DQNPG

SEQ ID NO: 455400 - protein, 7 aa, Mycobacterium
DQNPIYA

SEQ ID NO: 455401 - protein, 7 aa, Mycobacterium
DQNRARP

SEQ ID NO: 455402 - protein, 5 aa, Mycobacterium
DQNRR

SEQ ID NO: 455403 - protein, 8 aa, Mycobacterium
DQNTRGSR

SEQ ID NO: 455404 - protein, 26 aa, Mycobacterium
DQNTSSPIGGHGQAAGTSASSTAPSV

SEQ ID NO: 455405 - protein, 5 aa, Mycobacterium
DQPAA

SEQ ID NO: 455406 - protein, 8 aa, Mycobacterium
DQPAAGDL

SEQ ID NO: 455407 - protein, 8 aa, Mycobacterium
DQPAGQTS

SEQ ID NO: 455408 - protein, 12 aa, Mycobacterium
DQPAKGFASHGE

SEQ ID NO: 455409 - protein, 6 aa, Mycobacterium
DQPALE

SEQ ID NO: 455410 - protein, 7 aa, Mycobacterium
DQPALRN

SEQ ID NO: 455411 - protein, 9 aa, Mycobacterium
DQPAPDALS

SEQ ID NO: 455412 - protein, 7 aa, Mycobacterium
DQPARRP

SEQ ID NO: 455413 - protein, 4 aa, Mycobacterium
DQPD

SEQ ID NO: 455414 - protein, 7 aa, Mycobacterium
DQPDEEV

SEQ ID NO: 455415 - protein, 5 aa, Mycobacterium
DQPDN

SEQ ID NO: 455416 - protein, 5 aa, Mycobacterium
DQPDQ

SEQ ID NO: 455417 - protein, 6 aa, Mycobacterium
DQPDRV

SEQ ID NO: 455418 - protein, 10 aa, Mycobacterium
DQPDTAIDDE

SEQ ID NO: 455419 - protein, 14 aa, Mycobacterium
DQPDTPIDDEREGD

SEQ ID NO: 455420 - protein, 11 aa, Mycobacterium
DQPEEHTDSGV

SEQ ID NO: 455421 - protein, 6 aa, Mycobacterium
DQPEGA

SEQ ID NO: 455422 - protein, 7 aa, Mycobacterium
DQPEHQW

SEQ ID NO: 455423 - protein, 10 aa, Mycobacterium
DQPELGSEGP

SEQ ID NO: 455424 - protein, 7 aa, Mycobacterium
DQPELQE

SEQ ID NO: 455425 - protein, 8 aa, Mycobacterium
DQPEPPER

SEQ ID NO: 455426 - protein, 6 aa, Mycobacterium
DQPERR

SEQ ID NO: 455427 - protein, 8 aa, Mycobacterium
DQPERRAV

SEQ ID NO: 455428 - protein, 14 aa, Mycobacterium
DQPETPIPDESEGD

SEQ ID NO: 455429 - protein, 4 aa, Mycobacterium
DQPG

SEQ ID NO: 455430 - protein, 7 aa, Mycobacterium
DQPGALG

SEQ ID NO: 455431 - protein, 8 aa, Mycobacterium
DQPGFSGY

SEQ ID NO: 455432 - protein, 18 aa, Mycobacterium
DQPGGRPRVPAPDPGSPA

SEQ ID NO: 455433 - protein, 7 aa, Mycobacterium
DQPGHPT

SEQ ID NO: 455434 - protein, 6 aa, Mycobacterium
DQPGLR

SEQ ID NO: 455435 - protein, 8 aa, Mycobacterium
DQPGPEEQ

SEQ ID NO: 455436 - protein, 5 aa, Mycobacterium
DQPGR

SEQ ID NO: 455437 - protein, 6 aa, Mycobacterium
DQPGSE

SEQ ID NO: 455438 - protein, 6 aa, Mycobacterium
DQPGST

SEQ ID NO: 455439 - protein, 6 aa, Mycobacterium
DQPGVT

SEQ ID NO: 455440 - protein, 7 aa, Mycobacterium
DQPHDEP

SEQ ID NO: 455441 - protein, 7 aa, Mycobacterium
DQPHPRG

SEQ ID NO: 455442 - protein, 5 aa, Mycobacterium
DQPIP

SEQ ID NO: 455443 - protein, 13 aa, Mycobacterium
DQPKKWHPADSPS

SEQ ID NO: 455444 - protein, 4 aa, Mycobacterium
DQPL

SEQ ID NO: 455445 - protein, 9 aa, Mycobacterium
DQPLADTAA

SEQ ID NO: 455446 - protein, 20 aa, Mycobacterium
DQPLDPRSVEGGKPPSDPAD

SEQ ID NO: 455447 - protein, 16 aa, Mycobacterium
DQPLDPVGEPAKTEDA

SEQ ID NO: 455448 - protein, 9 aa, Mycobacterium
DQPLGDTAN

SEQ ID NO: 455449 - protein, 14 aa, Mycobacterium
DQPLSDDADATKRD

SEQ ID NO: 455450 - protein, 4 aa, Mycobacterium
DQPM

SEQ ID NO: 455451 - protein, 14 aa, Mycobacterium
DQPMPTGNNVIPLH

SEQ ID NO: 455452 - protein, 7 aa, Mycobacterium
DQPNARG

SEQ ID NO: 455453 - protein, 15 aa, Mycobacterium
DQPNGRLGTHPNEGF

SEQ ID NO: 455454 - protein, 11 aa, Mycobacterium
DQPNLGGSGGY

SEQ ID NO: 455455 - protein, 6 aa, Mycobacterium
DQPNLT

SEQ ID NO: 455456 - protein, 5 aa, Mycobacterium
DQPPF

SEQ ID NO: 455457 - protein, 6 aa, Mycobacterium
DQPPFG

SEQ ID NO: 455458 - protein, 5 aa, Mycobacterium
DQPPK

SEQ ID NO: 455459 - protein, 7 aa, Mycobacterium
DQPPPLR

SEQ ID NO: 455460 - protein, 5 aa, Mycobacterium
DQPPQ

SEQ ID NO: 455461 - protein, 9 aa, Mycobacterium
DQPPQSPSE

SEQ ID NO: 455462 - protein, 9 aa, Mycobacterium
DQPPVPSSF

SEQ ID NO: 455463 - protein, 4 aa, Mycobacterium
DQPQ

SEQ ID NO: 455464 - protein, 9 aa, Mycobacterium
DQPQATAEA

SEQ ID NO: 455465 - protein, 6 aa, Mycobacterium
DQPQHA

SEQ ID NO: 455466 - protein, 6 aa, Mycobacterium
DQPQRD

SEQ ID NO: 455467 - protein, 7 aa, Mycobacterium
DQPQTAG

SEQ ID NO: 455468 - protein, 10 aa, Mycobacterium
DQPQVGDPLP

SEQ ID NO: 455469 - protein, 18 aa, Mycobacterium
DQPQYSYQQDGVSGVLSP

SEQ ID NO: 455470 - protein, 7 aa, Mycobacterium
DQPRDRA

SEQ ID NO: 455471 - protein, 8 aa, Mycobacterium
DQPRDRAE

SEQ ID NO: 455472 - protein, 6 aa, Mycobacterium
DQPRQN

SEQ ID NO: 455473 - protein, 26 aa, Mycobacterium
DQPRWSRAGTRAVATGEPFSSRCISA

SEQ ID NO: 455474 - protein, 13 aa, Mycobacterium
DQPSAGELSTDGQ

SEQ ID NO: 455475 - protein, 8 aa, Mycobacterium
DQPSGEID

SEQ ID NO: 455476 - protein, 10 aa, Mycobacterium
DQPSGGDPNA

SEQ ID NO: 455477 - protein, 8 aa, Mycobacterium
DQPSGNGV

SEQ ID NO: 455478 - protein, 8 aa, Mycobacterium
DQPSNVRG

SEQ ID NO: 455479 - protein, 9 aa, Mycobacterium
DQPSSSALT

SEQ ID NO: 455480 - protein, 8 aa, Mycobacterium
DQPTDRAE

SEQ ID NO: 455481 - protein, 6 aa, Mycobacterium
DQPTRH

SEQ ID NO: 455482 - protein, 5 aa, Mycobacterium
DQPTT

SEQ ID NO: 455483 - protein, 13 aa, Mycobacterium
DQPTTGLPVPAPD

SEQ ID NO: 455484 - protein, 7 aa, Mycobacterium
DQPVDDA

SEQ ID NO: 455485 - protein, 5 aa, Mycobacterium
DQPVG

SEQ ID NO: 455486 - protein, 9 aa, Mycobacterium
DQPVGHSGG

SEQ ID NO: 455487 - protein, 14 aa, Mycobacterium
DQPVGQLSGGNQQK

SEQ ID NO: 455488 - protein, 10 aa, Mycobacterium
DQPVTKKQNV

SEQ ID NO: 455489 - protein, 5 aa, Mycobacterium
DQPWS

SEQ ID NO: 455490 - protein, 7 aa, Mycobacterium
DQPYPRG

SEQ ID NO: 455491 - protein, 6 aa, Mycobacterium
DQPYWG

SEQ ID NO: 455492 - protein, 8 aa, Mycobacterium
DQQAARTR

SEQ ID NO: 455493 - protein, 5 aa, Mycobacterium
DQQDG

SEQ ID NO: 455494 - protein, 4 aa, Mycobacterium
DQQE

SEQ ID NO: 455495 - protein, 5 aa, Mycobacterium
DQQEA

SEQ ID NO: 455496 - protein, 4 aa, Mycobacterium
DQQG

SEQ ID NO: 455497 - protein, 5 aa, Mycobacterium
DQQHP

SEQ ID NO: 455498 - protein, 9 aa, Mycobacterium
DQQKPTAAD

SEQ ID NO: 455499 - protein, 7 aa, Mycobacterium
DQQLGTG

SEQ ID NO: 455500 - protein, 28 aa, Mycobacterium
DQQPETSDATEASEGGEGTVTAPAHDPL

SEQ ID NO: 455501 - protein, 12 aa, Mycobacterium
DQQPLGPGEQGE

SEQ ID NO: 455502 - protein, 10 aa, Mycobacterium
DQQPVRSRAG

SEQ ID NO: 455503 - protein, 18 aa, Mycobacterium
DQQQANNRNAQVSCLDKS

SEQ ID NO: 455504 - protein, 11 aa, Mycobacterium
DQQQPGQRGAA

SEQ ID NO: 455505 - protein, 4 aa, Mycobacterium
DQQR

SEQ ID NO: 455506 - protein, 9 aa, Mycobacterium
DQQRAQEAR

SEQ ID NO: 455507 - protein, 8 aa, Mycobacterium
DQQRASAV

SEQ ID NO: 455508 - protein, 9 aa, Mycobacterium
DQQRATTTA

SEQ ID NO: 455509 - protein, 10 aa, Mycobacterium
DQQRDQYAPL

SEQ ID NO: 455510 - protein, 31 aa, Mycobacterium
DQQRRKNIKKAQAEAEAGPARAEPDATPIGD

SEQ ID NO: 455511 - protein, 13 aa, Mycobacterium
DQQRSGELADEGP

SEQ ID NO: 455512 - protein, 16 aa, Mycobacterium
DQQTQRGLQFVVAAKP

SEQ ID NO: 455513 - protein, 5 aa, Mycobacterium
DQRAA

SEQ ID NO: 455514 - protein, 8 aa, Mycobacterium
DQRAAEIK

SEQ ID NO: 455515 - protein, 18 aa, Mycobacterium
DQRAENQALLEGRNHAPP

SEQ ID NO: 455516 - protein, 7 aa, Mycobacterium
DQRAKYS

SEQ ID NO: 455517 - protein, 16 aa, Mycobacterium
DQRAPQQRLGGRIYQV

SEQ ID NO: 455518 - protein, 15 aa, Mycobacterium
DQRDAVAGEADLGGT

SEQ ID NO: 455519 - protein, 7 aa, Mycobacterium
DQRDDDG

SEQ ID NO: 455520 - protein, 7 aa, Mycobacterium
DQRDNLT

SEQ ID NO: 455521 - protein, 5 aa, Mycobacterium
DQRDP

SEQ ID NO: 455522 - protein, 10 aa, Mycobacterium
DQRDPEPQTR

SEQ ID NO: 455523 - protein, 7 aa, Mycobacterium
DQRDRNR

SEQ ID NO: 455524 - protein, 7 aa, Mycobacterium
DQREVSA

SEQ ID NO: 455525 - protein, 7 aa, Mycobacterium
DQRGDDM

SEQ ID NO: 455526 - protein, 6 aa, Mycobacterium
DQRGDI

SEQ ID NO: 455527 - protein, 16 aa, Mycobacterium
DQRGTNGSAPEPNSTG

SEQ ID NO: 455528 - protein, 6 aa, Mycobacterium
DQRGVG

SEQ ID NO: 455529 - protein, 16 aa, Mycobacterium
DQRGYGGSDKPGDAGV

SEQ ID NO: 455530 - protein, 14 aa, Mycobacterium
DQRGYGGSDRPDAV

SEQ ID NO: 455531 - protein, 14 aa, Mycobacterium
DQRGYGGSSRPDAI

SEQ ID NO: 455532 - protein, 15 aa, Mycobacterium
DQRGYGGSSRPESID

SEQ ID NO: 455533 - protein, 11 aa, Mycobacterium
DQRGYGRSSMP

SEQ ID NO: 455534 - protein, 7 aa, Mycobacterium
DQRHAGQ

SEQ ID NO: 455535 - protein, 15 aa, Mycobacterium
DQRIPTRVGARQPAH

SEQ ID NO: 455536 - protein, 4 aa, Mycobacterium
DQRP

SEQ ID NO: 455537 - protein, 9 aa, Mycobacterium
DQRPAGSMP

SEQ ID NO: 455538 - protein, 22 aa, Mycobacterium
DQRPDDGGGITRIPDGDQGSHG

SEQ ID NO: 455539 - protein, 7 aa, Mycobacterium
DQRPDIS

SEQ ID NO: 455540 - protein, 5 aa, Mycobacterium
DQRPG

SEQ ID NO: 455541 - protein, 13 aa, Mycobacterium
DQRPGTKKCGHQG

SEQ ID NO: 455542 - protein, 6 aa, Mycobacterium
DQRPPF

SEQ ID NO: 455543 - protein, 12 aa, Mycobacterium
DQRPTYRDAQPA

SEQ ID NO: 455544 - protein, 16 aa, Mycobacterium
DQRPVTEDDPHNWNDG

SEQ ID NO: 455545 - protein, 7 aa, Mycobacterium
DQRRAAE

SEQ ID NO: 455546 - protein, 7 aa, Mycobacterium
DQRRAFE

SEQ ID NO: 455547 - protein, 13 aa, Mycobacterium
DQRRAGHGRPQSV

SEQ ID NO: 455548 - protein, 16 aa, Mycobacterium
DQRRDQRKNRLDPARA

SEQ ID NO: 455549 - protein, 20 aa, Mycobacterium
DQRRGPSSGTGFDAPPPNEL

SEQ ID NO: 455550 - protein, 8 aa, Mycobacterium
DQRRMQEE

SEQ ID NO: 455551 - protein, 11 aa, Mycobacterium
DQRRQRKQPPL

SEQ ID NO: 455552 - protein, 6 aa, Mycobacterium
DQRRRA

SEQ ID NO: 455553 - protein, 7 aa, Mycobacterium
DQRRRRY

SEQ ID NO: 455554 - protein, 17 aa, Mycobacterium
DQRRTDTTTTLAPGATV

SEQ ID NO: 455555 - protein, 11 aa, Mycobacterium
DQRSGSPNLPA

SEQ ID NO: 455556 - protein, 16 aa, Mycobacterium
DQRSVDPGEPAAREAV

SEQ ID NO: 455557 - protein, 5 aa, Mycobacterium
DQRTA

SEQ ID NO: 455558 - protein, 6 aa, Mycobacterium
DQRTAE

SEQ ID NO: 455559 - protein, 9 aa, Mycobacterium
DQRTDRAEL

SEQ ID NO: 455560 - protein, 7 aa, Mycobacterium
DQRTRKT

SEQ ID NO: 455561 - protein, 5 aa, Mycobacterium
DQRTV

SEQ ID NO: 455562 - protein, 6 aa, Mycobacterium
DQRTVA

SEQ ID NO: 455563 - protein, 12 aa, Mycobacterium
DQRVRDPQVGAQ

SEQ ID NO: 455564 - protein, 17 aa, Mycobacterium
DQRYGGVSPVQQRGELL

SEQ ID NO: 455565 - protein, 6 aa, Mycobacterium
DQRYGS

SEQ ID NO: 455566 - protein, 24 aa, Mycobacterium
DQSAAKPDPNRPPLDVPEGSAGIE

SEQ ID NO: 455567 - protein, 5 aa, Mycobacterium
DQSAN

SEQ ID NO: 455568 - protein, 16 aa, Mycobacterium
DQSAPCRASRAGACSV

SEQ ID NO: 455569 - protein, 10 aa, Mycobacterium
DQSAPGEPLL

SEQ ID NO: 455570 - protein, 19 aa, Mycobacterium
DQSATTLAGKTLGPIDTGP

SEQ ID NO: 455571 - protein, 18 aa, Mycobacterium
DQSDPNLLSPEGKSRRFA

SEQ ID NO: 455572 - protein, 6 aa, Mycobacterium
DQSDVR

SEQ ID NO: 455573 - protein, 7 aa, Mycobacterium
DQSEALD

SEQ ID NO: 455574 - protein, 5 aa, Mycobacterium
DQSED

SEQ ID NO: 455575 - protein, 16 aa, Mycobacterium
DQSEGASPKVRSESCD

SEQ ID NO: 455576 - protein, 10 aa, Mycobacterium
DQSERDGVTR

SEQ ID NO: 455577 - protein, 6 aa, Mycobacterium
DQSERG

SEQ ID NO: 455578 - protein, 9 aa, Mycobacterium
DQSGGAHFE

SEQ ID NO: 455579 - protein, 5 aa, Mycobacterium
DQSGP

SEQ ID NO: 455580 - protein, 7 aa, Mycobacterium
DQSGRGA

SEQ ID NO: 455581 - protein, 7 aa, Mycobacterium
DQSIDYK

SEQ ID NO: 455582 - protein, 8 aa, Mycobacterium
DQSINGDA

SEQ ID NO: 455583 - protein, 5 aa, Mycobacterium
DQSLE

SEQ ID NO: 455584 - protein, 13 aa, Mycobacterium
DQSLQAPDLQGGN

SEQ ID NO: 455585 - protein, 8 aa, Mycobacterium
DQSLTPRE

SEQ ID NO: 455586 - protein, 6 aa, Mycobacterium
DQSNAA

SEQ ID NO: 455587 - protein, 10 aa, Mycobacterium
DQSNAQRVTS

SEQ ID NO: 455588 - protein, 7 aa, Mycobacterium
DQSPAEI

SEQ ID NO: 455589 - protein, 16 aa, Mycobacterium
DQSPFTPTLPRGEARG

SEQ ID NO: 455590 - protein, 8 aa, Mycobacterium
DQSPGKSA

SEQ ID NO: 455591 - protein, 10 aa, Mycobacterium
DQSPNYNPKL

SEQ ID NO: 455592 - protein, 11 aa, Mycobacterium
DQSPQRRGSPA

SEQ ID NO: 455593 - protein, 4 aa, Mycobacterium
DQSR

SEQ ID NO: 455594 - protein, 14 aa, Mycobacterium
DQSRAAAGAQVPGL

SEQ ID NO: 455595 - protein, 10 aa, Mycobacterium
DQSRAETDAA

SEQ ID NO: 455596 - protein, 14 aa, Mycobacterium
DQSRQEHSSRRDTL

SEQ ID NO: 455597 - protein, 7 aa, Mycobacterium
DQSRSEG

SEQ ID NO: 455598 - protein, 23 aa, Mycobacterium
DQSRVRADTQDHSIQGEHRQPTG

SEQ ID NO: 455599 - protein, 6 aa, Mycobacterium
DQSSGL

SEQ ID NO: 455600 - protein, 11 aa, Mycobacterium
DQSSPGPDADY

SEQ ID NO: 455601 - protein, 5 aa, Mycobacterium
DQSSV

SEQ ID NO: 455602 - protein, 6 aa, Mycobacterium
DQSTPV

SEQ ID NO: 455603 - protein, 9 aa, Mycobacterium
DQSTRLGTA

SEQ ID NO: 455604 - protein, 7 aa, Mycobacterium
DQSTSNG

SEQ ID NO: 455605 - protein, 46 aa, Mycobacterium
DQTAANAASEEPRGDATDADAGAVDAQPATPPVKPRRSKPTLLPGR

SEQ ID NO: 455606 - protein, 7 aa, Mycobacterium
DQTAARA

SEQ ID NO: 455607 - protein, 8 aa, Mycobacterium
DQTAARSY

SEQ ID NO: 455608 - protein, 6 aa, Mycobacterium
DQTAEV

SEQ ID NO: 455609 - protein, 6 aa, Mycobacterium
DQTARS

SEQ ID NO: 455610 - protein, 6 aa, Mycobacterium
DQTAVR

SEQ ID NO: 455611 - protein, 5 aa, Mycobacterium
DQTDL

SEQ ID NO: 455612 - protein, 10 aa, Mycobacterium
DQTDTLQPDR

SEQ ID NO: 455613 - protein, 14 aa, Mycobacterium
DQTDVEELTEKTDG

SEQ ID NO: 455614 - protein, 5 aa, Mycobacterium
DQTDW

SEQ ID NO: 455615 - protein, 4 aa, Mycobacterium
DQTE

SEQ ID NO: 455616 - protein, 22 aa, Mycobacterium
DQTETGLPSDAGSASVSTVSSV

SEQ ID NO: 455617 - protein, 14 aa, Mycobacterium
DQTFDDAHEATDAI

SEQ ID NO: 455618 - protein, 4 aa, Mycobacterium
DQTG

SEQ ID NO: 455619 - protein, 7 aa, Mycobacterium
DQTGLSA

SEQ ID NO: 455620 - protein, 13 aa, Mycobacterium
DQTGLSQKAGPVT

SEQ ID NO: 455621 - protein, 8 aa, Mycobacterium
DQTGSPTY

SEQ ID NO: 455622 - protein, 8 aa, Mycobacterium
DQTGTPYE

SEQ ID NO: 455623 - protein, 6 aa, Mycobacterium
DQTGVT

SEQ ID NO: 455624 - protein, 4 aa, Mycobacterium
DQTH

SEQ ID NO: 455625 - protein, 14 aa, Mycobacterium
DQTHEPNRSGWSPN

SEQ ID NO: 455626 - protein, 6 aa, Mycobacterium
DQTHPE

SEQ ID NO: 455627 - protein, 4 aa, Mycobacterium
DQTI

SEQ ID NO: 455628 - protein, 4 aa, Mycobacterium
DQTL

SEQ ID NO: 455629 - protein, 8 aa, Mycobacterium
DQTLPNPN

SEQ ID NO: 455630 - protein, 5 aa, Mycobacterium
DQTNT

SEQ ID NO: 455631 - protein, 7 aa, Mycobacterium
DQTPAEV

SEQ ID NO: 455632 - protein, 8 aa, Mycobacterium
DQTPARGV

SEQ ID NO: 455633 - protein, 6 aa, Mycobacterium
DQTPEL

SEQ ID NO: 455634 - protein, 19 aa, Mycobacterium
DQTPGEPLGEAAEDASSAI

SEQ ID NO: 455635 - protein, 6 aa, Mycobacterium
DQTPRC

SEQ ID NO: 455636 - protein, 6 aa, Mycobacterium
DQTPTL

SEQ ID NO: 455637 - protein, 6 aa, Mycobacterium
DQTPTY

SEQ ID NO: 455638 - protein, 8 aa, Mycobacterium
DQTQRSLS

SEQ ID NO: 455639 - protein, 5 aa, Mycobacterium
DQTQV

SEQ ID NO: 455640 - protein, 4 aa, Mycobacterium
DQTR

SEQ ID NO: 455641 - protein, 18 aa, Mycobacterium
DQTRAQKVTSDLSHAQNE

SEQ ID NO: 455642 - protein, 9 aa, Mycobacterium
DQTRAQRVT

SEQ ID NO: 455643 - protein, 6 aa, Mycobacterium
DQTRMG

SEQ ID NO: 455644 - protein, 5 aa, Mycobacterium
DQTRW

SEQ ID NO: 455645 - protein, 8 aa, Mycobacterium
DQTSAHDP

SEQ ID NO: 455646 - protein, 7 aa, Mycobacterium
DQTSAPE

SEQ ID NO: 455647 - protein, 24 aa, Mycobacterium
DQTSEQWTTAADGEHKRARASDLA

SEQ ID NO: 455648 - protein, 46 aa, Mycobacterium
DQTSRHTATESSRSRQASPAKASWSPRSRSCSPPAACGCATSRWPQ

SEQ ID NO: 455649 - protein, 47 aa, Mycobacterium
DQTTADSASEEPRGDATDADASAGDAQPATPTAPKPRRSKPTLLPGR

SEQ ID NO: 455650 - protein, 48 aa, Mycobacterium
DQTTANIEETTANDADADGGRNAGNGDGDAQPPAPKPRRSKPTLLPGR

SEQ ID NO: 455651 - protein, 10 aa, Mycobacterium
DQTVADASYR

SEQ ID NO: 455652 - protein, 7 aa, Mycobacterium
DQTVPEG

SEQ ID NO: 455653 - protein, 6 aa, Mycobacterium
DQTVSG

SEQ ID NO: 455654 - protein, 9 aa, Mycobacterium
DQTYSEDGD

SEQ ID NO: 455655 - protein, 8 aa, Mycobacterium
DQVADNTS

SEQ ID NO: 455656 - protein, 13 aa, Mycobacterium
DQVADYAKRKGWT

SEQ ID NO: 455657 - protein, 8 aa, Mycobacterium
DQVAENTS

SEQ ID NO: 455658 - protein, 5 aa, Mycobacterium
DQVDP

SEQ ID NO: 455659 - protein, 9 aa, Mycobacterium
DQVDRDRSL

SEQ ID NO: 455660 - protein, 15 aa, Mycobacterium
DQVEADHASATSGPL

SEQ ID NO: 455661 - protein, 20 aa, Mycobacterium
DQVEEDRLGRPRADAGVGPR

SEQ ID NO: 455662 - protein, 4 aa, Mycobacterium
DQVG

SEQ ID NO: 455663 - protein, 8 aa, Mycobacterium
DQVGDSPL

SEQ ID NO: 455664 - protein, 10 aa, Mycobacterium
DQVGGRSAAD

SEQ ID NO: 455665 - protein, 19 aa, Mycobacterium
DQVGNRALGDRPSQNLTGG

SEQ ID NO: 455666 - protein, 20 aa, Mycobacterium
DQVGNRALGDRPSQNLTGGQ

SEQ ID NO: 455667 - protein, 17 aa, Mycobacterium
DQVGNRALGDRPSQYLT

SEQ ID NO: 455668 - protein, 20 aa, Mycobacterium
DQVGPIGQRRQRATPAPARA

SEQ ID NO: 455669 - protein, 6 aa, Mycobacterium
DQVPAG

SEQ ID NO: 455670 - protein, 8 aa, Mycobacterium
DQVPPDGQ

SEQ ID NO: 455671 - protein, 6 aa, Mycobacterium
DQVPPE

SEQ ID NO: 455672 - protein, 6 aa, Mycobacterium
DQVQSG

SEQ ID NO: 455673 - protein, 8 aa, Mycobacterium
DQVRDDQR

SEQ ID NO: 455674 - protein, 14 aa, Mycobacterium
DQVSGASGSRFHRQ

SEQ ID NO: 455675 - protein, 12 aa, Mycobacterium
DQVTPDVTAGEY

SEQ ID NO: 455676 - protein, 4 aa, Mycobacterium
DQWG

SEQ ID NO: 455677 - protein, 8 aa, Mycobacterium
DQWPPTRA

SEQ ID NO: 455678 - protein, 4 aa, Mycobacterium
DQWQ

SEQ ID NO: 455679 - protein, 7 aa, Mycobacterium
DQWRQSV

SEQ ID NO: 455680 - protein, 6 aa, Mycobacterium
DQYAGA

SEQ ID NO: 455681 - protein, 9 aa, Mycobacterium
DQYGKDGTW

SEQ ID NO: 455682 - protein, 6 aa, Mycobacterium
DQYPNA

SEQ ID NO: 455683 - protein, 7 aa, Mycobacterium
DQYRQAE

SEQ ID NO: 455684 - protein, 4 aa, Mycobacterium
DRAA

SEQ ID NO: 455685 - protein, 5 aa, Mycobacterium
DRAAA

SEQ ID NO: 455686 - protein, 8 aa, Mycobacterium
DRAAAEAL

SEQ ID NO: 455687 - protein, 7 aa, Mycobacterium
DRAAAGI

SEQ ID NO: 455688 - protein, 7 aa, Mycobacterium
DRAAAIE

SEQ ID NO: 455689 - protein, 5 aa, Mycobacterium
DRAAD

SEQ ID NO: 455690 - protein, 10 aa, Mycobacterium
DRAADDPRES

SEQ ID NO: 455691 - protein, 8 aa, Mycobacterium
DRAADRPV

SEQ ID NO: 455692 - protein, 12 aa, Mycobacterium
DRAADTDGRPGI

SEQ ID NO: 455693 - protein, 10 aa, Mycobacterium
DRAAEAISGP

SEQ ID NO: 455694 - protein, 8 aa, Mycobacterium
DRAAEKGD

SEQ ID NO: 455695 - protein, 9 aa, Mycobacterium
DRAAGEGAK

SEQ ID NO: 455696 - protein, 12 aa, Mycobacterium
DRAAGGTGGEHH

SEQ ID NO: 455697 - protein, 7 aa, Mycobacterium
DRAAGKN

SEQ ID NO: 455698 - protein, 7 aa, Mycobacterium
DRAAGKS

SEQ ID NO: 455699 - protein, 10 aa, Mycobacterium
DRAAGRRTQV

SEQ ID NO: 455700 - protein, 10 aa, Mycobacterium
DRAAGTVADP

SEQ ID NO: 455701 - protein, 9 aa, Mycobacterium
DRAAGYDRG

SEQ ID NO: 455702 - protein, 7 aa, Mycobacterium
DRAAIRD

SEQ ID NO: 455703 - protein, 8 aa, Mycobacterium
DRAALEAD

SEQ ID NO: 455704 - protein, 8 aa, Mycobacterium
DRAAPAAH

SEQ ID NO: 455705 - protein, 7 aa, Mycobacterium
DRAAQQI

SEQ ID NO: 455706 - protein, 8 aa, Mycobacterium
DRAAQTRD

SEQ ID NO: 455707 - protein, 10 aa, Mycobacterium
DRAARDAEGV

SEQ ID NO: 455708 - protein, 10 aa, Mycobacterium
DRAARMGDAG

SEQ ID NO: 455709 - protein, 6 aa, Mycobacterium
DRAARS

SEQ ID NO: 455710 - protein, 10 aa, Mycobacterium
DRAATAAEER

SEQ ID NO: 455711 - protein, 7 aa, Mycobacterium
DRAATDA

SEQ ID NO: 455712 - protein, 8 aa, Mycobacterium
DRAATDDA

SEQ ID NO: 455713 - protein, 9 aa, Mycobacterium
DRAATDPLE

SEQ ID NO: 455714 - protein, 7 aa, Mycobacterium
DRAAVTD

SEQ ID NO: 455715 - protein, 4 aa, Mycobacterium
DRAD

SEQ ID NO: 455716 - protein, 17 aa, Mycobacterium
DRADAFPAQLSGGQQQR

SEQ ID NO: 455717 - protein, 7 aa, Mycobacterium
DRADDDR

SEQ ID NO: 455718 - protein, 6 aa, Mycobacterium
DRADEL

SEQ ID NO: 455719 - protein, 7 aa, Mycobacterium
DRADGTT

SEQ ID NO: 455720 - protein, 6 aa, Mycobacterium
DRADKG

SEQ ID NO: 455721 - protein, 7 aa, Mycobacterium
DRADLDE

SEQ ID NO: 455722 - protein, 7 aa, Mycobacterium
DRADLES

SEQ ID NO: 455723 - protein, 14 aa, Mycobacterium
DRADWSEKDWEEAT

SEQ ID NO: 455724 - protein, 6 aa, Mycobacterium
DRAEAA

SEQ ID NO: 455725 - protein, 6 aa, Mycobacterium
DRAEAL

SEQ ID NO: 455726 - protein, 14 aa, Mycobacterium
DRAEASVANERNSV

SEQ ID NO: 455727 - protein, 6 aa, Mycobacterium
DRAEAV

SEQ ID NO: 455728 - protein, 7 aa, Mycobacterium
DRAEAYR

SEQ ID NO: 455729 - protein, 25 aa, Mycobacterium
DRAEDKAKGADEESPIARRRRRKDN

SEQ ID NO: 455730 - protein, 20 aa, Mycobacterium
DRAEETRTDTRSRVEESRAR

SEQ ID NO: 455731 - protein, 8 aa, Mycobacterium
DRAEFATR

SEQ ID NO: 455732 - protein, 8 aa, Mycobacterium
DRAEFGKR

SEQ ID NO: 455733 - protein, 8 aa, Mycobacterium
DRAEGRMS

SEQ ID NO: 455734 - protein, 8 aa, Mycobacterium
DRAEKGHR

SEQ ID NO: 455735 - protein, 6 aa, Mycobacterium
DRAELA

SEQ ID NO: 455736 - protein, 12 aa, Mycobacterium
DRAELERTGRRV

SEQ ID NO: 455737 - protein, 14 aa, Mycobacterium
DRAEMDSSVTQLTE

SEQ ID NO: 455738 - protein, 8 aa, Mycobacterium
DRAENQRR

SEQ ID NO: 455739 - protein, 7 aa, Mycobacterium
DRAEPAV

SEQ ID NO: 455740 - protein, 9 aa, Mycobacterium
DRAERDAAR

SEQ ID NO: 455741 - protein, 27 aa, Mycobacterium
DRAERLATRNKDGRNLQHPRAAAPKVS

SEQ ID NO: 455742 - protein, 9 aa, Mycobacterium
DRAERRETL

SEQ ID NO: 455743 - protein, 7 aa, Mycobacterium
DRAESEL

SEQ ID NO: 455744 - protein, 10 aa, Mycobacterium
DRAETELGDT

SEQ ID NO: 455745 - protein, 4 aa, Mycobacterium
DRAF

SEQ ID NO: 455746 - protein, 11 aa, Mycobacterium
DRAFGTPGFGG

SEQ ID NO: 455747 - protein, 7 aa, Mycobacterium
DRAGADV

SEQ ID NO: 455748 - protein, 6 aa, Mycobacterium
DRAGAF

SEQ ID NO: 455749 - protein, 9 aa, Mycobacterium
DRAGAGGGA

SEQ ID NO: 455750 - protein, 6 aa, Mycobacterium
DRAGAV

SEQ ID NO: 455751 - protein, 6 aa, Mycobacterium
DRAGDR

SEQ ID NO: 455752 - protein, 5 aa, Mycobacterium
DRAGG

SEQ ID NO: 455753 - protein, 6 aa, Mycobacterium
DRAGGD

SEQ ID NO: 455754 - protein, 9 aa, Mycobacterium
DRAGGDPEL

SEQ ID NO: 455755 - protein, 7 aa, Mycobacterium
DRAGGEP

SEQ ID NO: 455756 - protein, 19 aa, Mycobacterium
DRAGGIDPTSELGRRAAAA

SEQ ID NO: 455757 - protein, 12 aa, Mycobacterium
DRAGKPKGEAVE

SEQ ID NO: 455758 - protein, 5 aa, Mycobacterium
DRAGL

SEQ ID NO: 455759 - protein, 6 aa, Mycobacterium
DRAGLT

SEQ ID NO: 455760 - protein, 13 aa, Mycobacterium
DRAGNISKRQSAT

SEQ ID NO: 455761 - protein, 5 aa, Mycobacterium
DRAGR

SEQ ID NO: 455762 - protein, 14 aa, Mycobacterium
DRAGRELAGESGLR

SEQ ID NO: 455763 - protein, 6 aa, Mycobacterium
DRAGRH

SEQ ID NO: 455764 - protein, 9 aa, Mycobacterium
DRAGRPAAI

SEQ ID NO: 455765 - protein, 6 aa, Mycobacterium
DRAGRR

SEQ ID NO: 455766 - protein, 8 aa, Mycobacterium
DRAGRRAL

SEQ ID NO: 455767 - protein, 7 aa, Mycobacterium
DRAGRRR

SEQ ID NO: 455768 - protein, 8 aa, Mycobacterium
DRAGRTAE

SEQ ID NO: 455769 - protein, 5 aa, Mycobacterium
DRAGS

SEQ ID NO: 455770 - protein, 17 aa, Mycobacterium
DRAGSFPGQLSGGQQQR

SEQ ID NO: 455771 - protein, 7 aa, Mycobacterium
DRAGTDE

SEQ ID NO: 455772 - protein, 7 aa, Mycobacterium
DRAGTEV

SEQ ID NO: 455773 - protein, 7 aa, Mycobacterium
DRAGVDV

SEQ ID NO: 455774 - protein, 7 aa, Mycobacterium
DRAGVTK

SEQ ID NO: 455775 - protein, 7 aa, Mycobacterium
DRAHAEG

SEQ ID NO: 455776 - protein, 7 aa, Mycobacterium
DRAHGTD

SEQ ID NO: 455777 - protein, 13 aa, Mycobacterium
DRAHRYAPTHGRD

SEQ ID NO: 455778 - protein, 5 aa, Mycobacterium
DRAIP

SEQ ID NO: 455779 - protein, 20 aa, Mycobacterium
DRAIPTGDTSPWAGGTETLG

SEQ ID NO: 455780 - protein, 4 aa, Mycobacterium
DRAK

SEQ ID NO: 455781 - protein, 11 aa, Mycobacterium
DRAKGIASTSS

SEQ ID NO: 455782 - protein, 7 aa, Mycobacterium
DRAKGVE

SEQ ID NO: 455783 - protein, 10 aa, Mycobacterium
DRAKNPGPDI

SEQ ID NO: 455784 - protein, 9 aa, Mycobacterium
DRAKNPGQD

SEQ ID NO: 455785 - protein, 9 aa, Mycobacterium
DRAKRTGEK

SEQ ID NO: 455786 - protein, 13 aa, Mycobacterium
DRAKTRPEGSGTV

SEQ ID NO: 455787 - protein, 9 aa, Mycobacterium
DRALGDQSL

SEQ ID NO: 455788 - protein, 6 aa, Mycobacterium
DRALSD

SEQ ID NO: 455789 - protein, 5 aa, Mycobacterium
DRALT

SEQ ID NO: 455790 - protein, 6 aa, Mycobacterium
DRANGM

SEQ ID NO: 455791 - protein, 143 aa, Mycobacterium
DRANGTPAAAEPTSDSGEQKSSASTEAPAVNEATKDAPQQEQNASSGDTVRRERRRSSRDSGTSSRDGADSAGGSPDKRGKRAAGGDADNNQKAPEKAQEDAKTDGGAAESGGDQGAGQQGSGGQQSRGEDDGEGRQGRRGRR

SEQ ID NO: 455792 - protein, 5 aa, Mycobacterium
DRANR

SEQ ID NO: 455793 - protein, 6 aa, Mycobacterium
DRAPAA

SEQ ID NO: 455794 - protein, 11 aa, Mycobacterium
DRAPAGADGQR

SEQ ID NO: 455795 - protein, 6 aa, Mycobacterium
DRAPAY

SEQ ID NO: 455796 - protein, 8 aa, Mycobacterium
DRAPDGIT

SEQ ID NO: 455797 - protein, 8 aa, Mycobacterium
DRAPEGDV

SEQ ID NO: 455798 - protein, 11 aa, Mycobacterium
DRAPGDTRGNA

SEQ ID NO: 455799 - protein, 9 aa, Mycobacterium
DRAPKTPYH

SEQ ID NO: 455800 - protein, 10 aa, Mycobacterium
DRAPLRRTDA

SEQ ID NO: 455801 - protein, 8 aa, Mycobacterium
DRAPMTGA

SEQ ID NO: 455802 - protein, 6 aa, Mycobacterium
DRAPQA

SEQ ID NO: 455803 - protein, 8 aa, Mycobacterium
DRAPRTSY

SEQ ID NO: 455804 - protein, 6 aa, Mycobacterium
DRAPRY

SEQ ID NO: 455805 - protein, 8 aa, Mycobacterium
DRAPVTGA

SEQ ID NO: 455806 - protein, 16 aa, Mycobacterium
DRAPYDPYSIGDPNAG

SEQ ID NO: 455807 - protein, 4 aa, Mycobacterium
DRAQ

SEQ ID NO: 455808 - protein, 5 aa, Mycobacterium
DRAQK

SEQ ID NO: 455809 - protein, 6 aa, Mycobacterium
DRAQPM

SEQ ID NO: 455810 - protein, 8 aa, Mycobacterium
DRAQPQTY

SEQ ID NO: 455811 - protein, 8 aa, Mycobacterium
DRAQRPPA

SEQ ID NO: 455812 - protein, 8 aa, Mycobacterium
DRAQRTGD

SEQ ID NO: 455813 - protein, 10 aa, Mycobacterium
DRAQSQTDLT

SEQ ID NO: 455814 - protein, 13 aa, Mycobacterium
DRAQSRAAGADDD

SEQ ID NO: 455815 - protein, 4 aa, Mycobacterium
DRAR

SEQ ID NO: 455816 - protein, 5 aa, Mycobacterium
DRARD

SEQ ID NO: 455817 - protein, 7 aa, Mycobacterium
DRARDAH

SEQ ID NO: 455818 - protein, 6 aa, Mycobacterium
DRAREE

SEQ ID NO: 455819 - protein, 9 aa, Mycobacterium
DRARELRDN

SEQ ID NO: 455820 - protein, 14 aa, Mycobacterium
DRARETAGGTSHPV

SEQ ID NO: 455821 - protein, 9 aa, Mycobacterium
DRARETRPD

SEQ ID NO: 455822 - protein, 7 aa, Mycobacterium
DRARGVD

SEQ ID NO: 455823 - protein, 6 aa, Mycobacterium
DRARNG

SEQ ID NO: 455824 - protein, 5 aa, Mycobacterium
DRARP

SEQ ID NO: 455825 - protein, 16 aa, Mycobacterium
DRARRAGTRPRSDRTI

SEQ ID NO: 455826 - protein, 8 aa, Mycobacterium
DRARRRGG

SEQ ID NO: 455827 - protein, 13 aa, Mycobacterium
DRARSAARHAATN

SEQ ID NO: 455828 - protein, 16 aa, Mycobacterium
DRARSHGDLESGPLKA

SEQ ID NO: 455829 - protein, 5 aa, Mycobacterium
DRART

SEQ ID NO: 455830 - protein, 6 aa, Mycobacterium
DRARTC

SEQ ID NO: 455831 - protein, 6 aa, Mycobacterium
DRARTG

SEQ ID NO: 455832 - protein, 13 aa, Mycobacterium
DRARTRPAGSATV

SEQ ID NO: 455833 - protein, 13 aa, Mycobacterium
DRARTRPPGSATV

SEQ ID NO: 455834 - protein, 6 aa, Mycobacterium
DRARTT

SEQ ID NO: 455835 - protein, 7 aa, Mycobacterium
DRARYLP

SEQ ID NO: 455836 - protein, 4 aa, Mycobacterium
DRAS

SEQ ID NO: 455837 - protein, 16 aa, Mycobacterium
DRASGAVVSNGNNSTI

SEQ ID NO: 455838 - protein, 7 aa, Mycobacterium
DRASGRF

SEQ ID NO: 455839 - protein, 9 aa, Mycobacterium
DRASLEADG

SEQ ID NO: 455840 - protein, 5 aa, Mycobacterium
DRASQ

SEQ ID NO: 455841 - protein, 8 aa, Mycobacterium
DRASRLRN

SEQ ID NO: 455842 - protein, 6 aa, Mycobacterium
DRASTL

SEQ ID NO: 455843 - protein, 6 aa, Mycobacterium
DRASVG

SEQ ID NO: 455844 - protein, 7 aa, Mycobacterium
DRASVRN

SEQ ID NO: 455845 - protein, 7 aa, Mycobacterium
DRASYNP

SEQ ID NO: 455846 - protein, 7 aa, Mycobacterium
DRATAQA

SEQ ID NO: 455847 - protein, 25 aa, Mycobacterium
DRATARAEAATSTHTASQSALTERR

SEQ ID NO: 455848 - protein, 22 aa, Mycobacterium
DRATATPPAASVPSTDRERGPQ

SEQ ID NO: 455849 - protein, 9 aa, Mycobacterium
DRATEQLAG

SEQ ID NO: 455850 - protein, 8 aa, Mycobacterium
DRATESEI

SEQ ID NO: 455851 - protein, 6 aa, Mycobacterium
DRATGR

SEQ ID NO: 455852 - protein, 8 aa, Mycobacterium
DRATGTAK

SEQ ID NO: 455853 - protein, 5 aa, Mycobacterium
DRATK

SEQ ID NO: 455854 - protein, 17 aa, Mycobacterium
DRATRKDERPTAAEQAQ

SEQ ID NO: 455855 - protein, 7 aa, Mycobacterium
DRATSGH

SEQ ID NO: 455856 - protein, 5 aa, Mycobacterium
DRATT

SEQ ID NO: 455857 - protein, 4 aa, Mycobacterium
DRAV

SEQ ID NO: 455858 - protein, 6 aa, Mycobacterium
DRAVAP

SEQ ID NO: 455859 - protein, 5 aa, Mycobacterium
DRAVG

SEQ ID NO: 455860 - protein, 6 aa, Mycobacterium
DRAVTT

SEQ ID NO: 455861 - protein, 7 aa, Mycobacterium
DRAVTTT

SEQ ID NO: 455862 - protein, 10 aa, Mycobacterium
DRAYKAKKPV

SEQ ID NO: 455863 - protein, 8 aa, Mycobacterium
DRAYRDAG

SEQ ID NO: 455864 - protein, 6 aa, Mycobacterium
DRAYRG

SEQ ID NO: 455865 - protein, 9 aa, Mycobacterium
DRAYRSDGT

SEQ ID NO: 455866 - protein, 13 aa, Mycobacterium
DRCEPAKVSDDDA

SEQ ID NO: 455867 - protein, 11 aa, Mycobacterium
DRCGGPGLAGD

SEQ ID NO: 455868 - protein, 7 aa, Mycobacterium
DRCGPSR

SEQ ID NO: 455869 - protein, 8 aa, Mycobacterium
DRCGPVGA

SEQ ID NO: 455870 - protein, 4 aa, Mycobacterium
DRCR

SEQ ID NO: 455871 - protein, 5 aa, Mycobacterium
DRDAA

SEQ ID NO: 455872 - protein, 9 aa, Mycobacterium
DRDAAARAQ

SEQ ID NO: 455873 - protein, 9 aa, Mycobacterium
DRDAASREV

SEQ ID NO: 455874 - protein, 12 aa, Mycobacterium
DRDAATPDRTRA

SEQ ID NO: 455875 - protein, 5 aa, Mycobacterium
DRDAE

SEQ ID NO: 455876 - protein, 8 aa, Mycobacterium
DRDAESFG

SEQ ID NO: 455877 - protein, 7 aa, Mycobacterium
DRDAGQH

SEQ ID NO: 455878 - protein, 5 aa, Mycobacterium
DRDAL

SEQ ID NO: 455879 - protein, 11 aa, Mycobacterium
DRDALPQPEIA

SEQ ID NO: 455880 - protein, 6 aa, Mycobacterium
DRDAMS

SEQ ID NO: 455881 - protein, 22 aa, Mycobacterium
DRDARAAEKLAKDHADRNRTTT

SEQ ID NO: 455882 - protein, 6 aa, Mycobacterium
DRDDAA

SEQ ID NO: 455883 - protein, 6 aa, Mycobacterium
DRDDEA

SEQ ID NO: 455884 - protein, 11 aa, Mycobacterium
DRDDFQRRSAR

SEQ ID NO: 455885 - protein, 15 aa, Mycobacterium
DRDDGQLKMSKVDFL

SEQ ID NO: 455886 - protein, 12 aa, Mycobacterium
DRDDPKKAVEGL

SEQ ID NO: 455887 - protein, 8 aa, Mycobacterium
DRDDPPLT

SEQ ID NO: 455888 - protein, 7 aa, Mycobacterium
DRDDPQV

SEQ ID NO: 455889 - protein, 7 aa, Mycobacterium
DRDDPRV

SEQ ID NO: 455890 - protein, 14 aa, Mycobacterium
DRDDPYYAPENAGP

SEQ ID NO: 455891 - protein, 6 aa, Mycobacterium
DRDDQL

SEQ ID NO: 455892 - protein, 14 aa, Mycobacterium
DRDDQPYKESYGMA

SEQ ID NO: 455893 - protein, 7 aa, Mycobacterium
DRDDTAS

SEQ ID NO: 455894 - protein, 9 aa, Mycobacterium
DRDDTGLAT

SEQ ID NO: 455895 - protein, 7 aa, Mycobacterium
DRDDTGY

SEQ ID NO: 455896 - protein, 13 aa, Mycobacterium
DRDDYTRDTEGRF

SEQ ID NO: 455897 - protein, 13 aa, Mycobacterium
DRDEERDNEREAV

SEQ ID NO: 455898 - protein, 7 aa, Mycobacterium
DRDELGA

SEQ ID NO: 455899 - protein, 8 aa, Mycobacterium
DRDEPVSA

SEQ ID NO: 455900 - protein, 7 aa, Mycobacterium
DRDEQGL

SEQ ID NO: 455901 - protein, 9 aa, Mycobacterium
DRDEQRSTQ

SEQ ID NO: 455902 - protein, 6 aa, Mycobacterium
DRDEQS

SEQ ID NO: 455903 - protein, 6 aa, Mycobacterium
DRDERG

SEQ ID NO: 455904 - protein, 7 aa, Mycobacterium
DRDESAS

SEQ ID NO: 455905 - protein, 10 aa, Mycobacterium
DRDETGPHST

SEQ ID NO: 455906 - protein, 7 aa, Mycobacterium
DRDEYAA

SEQ ID NO: 455907 - protein, 5 aa, Mycobacterium
DRDGA

SEQ ID NO: 455908 - protein, 7 aa, Mycobacterium
DRDGAEV

SEQ ID NO: 455909 - protein, 7 aa, Mycobacterium
DRDGAGL

SEQ ID NO: 455910 - protein, 16 aa, Mycobacterium
DRDGAGRRHDAPPQSA

SEQ ID NO: 455911 - protein, 7 aa, Mycobacterium
DRDGASA

SEQ ID NO: 455912 - protein, 7 aa, Mycobacterium
DRDGDKI

SEQ ID NO: 455913 - protein, 11 aa, Mycobacterium
DRDGDRPTAAS

SEQ ID NO: 455914 - protein, 11 aa, Mycobacterium
DRDGEPEPTGL

SEQ ID NO: 455915 - protein, 6 aa, Mycobacterium
DRDGER

SEQ ID NO: 455916 - protein, 5 aa, Mycobacterium
DRDGH

SEQ ID NO: 455917 - protein, 9 aa, Mycobacterium
DRDGPGRGA

SEQ ID NO: 455918 - protein, 6 aa, Mycobacterium
DRDGQL

SEQ ID NO: 455919 - protein, 18 aa, Mycobacterium
DRDGREVGGDILVAVRGD

SEQ ID NO: 455920 - protein, 16 aa, Mycobacterium
DRDGRPLPAWNTPDEA

SEQ ID NO: 455921 - protein, 8 aa, Mycobacterium
DRDGSLPV

SEQ ID NO: 455922 - protein, 7 aa, Mycobacterium
DRDGSTE

SEQ ID NO: 455923 - protein, 8 aa, Mycobacterium
DRDGSVRV

SEQ ID NO: 455924 - protein, 9 aa, Mycobacterium
DRDGTKAGF

SEQ ID NO: 455925 - protein, 7 aa, Mycobacterium
DRDGVGG

SEQ ID NO: 455926 - protein, 7 aa, Mycobacterium
DRDHAPA

SEQ ID NO: 455927 - protein, 8 aa, Mycobacterium
DRDIEAGT

SEQ ID NO: 455928 - protein, 12 aa, Mycobacterium
DRDIEQERRAGN

SEQ ID NO: 455929 - protein, 11 aa, Mycobacterium
DRDKAQAKGSK

SEQ ID NO: 455930 - protein, 8 aa, Mycobacterium
DRDKTYSL

SEQ ID NO: 455931 - protein, 4 aa, Mycobacterium
DRDL

SEQ ID NO: 455932 - protein, 7 aa, Mycobacterium
DRDLGRE

SEQ ID NO: 455933 - protein, 14 aa, Mycobacterium
DRDLPAEARGEDGR

SEQ ID NO: 455934 - protein, 13 aa, Mycobacterium
DRDLPAEARNDDG

SEQ ID NO: 455935 - protein, 18 aa, Mycobacterium
DRDLTDAQRKAFADEGRR

SEQ ID NO: 455936 - protein, 12 aa, Mycobacterium
DRDMDADARKAA

SEQ ID NO: 455937 - protein, 5 aa, Mycobacterium
DRDNL

SEQ ID NO: 455938 - protein, 7 aa, Mycobacterium
DRDNPYG

SEQ ID NO: 455939 - protein, 11 aa, Mycobacterium
DRDPDPDEQTI

SEQ ID NO: 455940 - protein, 9 aa, Mycobacterium
DRDPENARK

SEQ ID NO: 455941 - protein, 17 aa, Mycobacterium
DRDPERGFSATALMESR

SEQ ID NO: 455942 - protein, 9 aa, Mycobacterium
DRDPFGPDF

SEQ ID NO: 455943 - protein, 7 aa, Mycobacterium
DRDPGAT

SEQ ID NO: 455944 - protein, 6 aa, Mycobacterium
DRDPGL

SEQ ID NO: 455945 - protein, 8 aa, Mycobacterium
DRDPHEAT

SEQ ID NO: 455946 - protein, 10 aa, Mycobacterium
DRDPNPSAAA

SEQ ID NO: 455947 - protein, 5 aa, Mycobacterium
DRDPR

SEQ ID NO: 455948 - protein, 4 aa, Mycobacterium
DRDQ

SEQ ID NO: 455949 - protein, 5 aa, Mycobacterium
DRDQL

SEQ ID NO: 455950 - protein, 36 aa, Mycobacterium
DRDQPQLSAPTTQTAATAPVENYDDSPTGVIEVPKQ

SEQ ID NO: 455951 - protein, 5 aa, Mycobacterium
DRDQR

SEQ ID NO: 455952 - protein, 18 aa, Mycobacterium
DRDQYGSGQVDALFGGPD

SEQ ID NO: 455953 - protein, 4 aa, Mycobacterium
DRDR

SEQ ID NO: 455954 - protein, 11 aa, Mycobacterium
DRDRAAAMGAA

SEQ ID NO: 455955 - protein, 9 aa, Mycobacterium
DRDRAHTRV

SEQ ID NO: 455956 - protein, 8 aa, Mycobacterium
DRDRAKVD

SEQ ID NO: 455957 - protein, 7 aa, Mycobacterium
DRDRDDV

SEQ ID NO: 455958 - protein, 15 aa, Mycobacterium
DRDRDWDGDAAEKRV

SEQ ID NO: 455959 - protein, 7 aa, Mycobacterium
DRDRGAT

SEQ ID NO: 455960 - protein, 8 aa, Mycobacterium
DRDRGHQP

SEQ ID NO: 455961 - protein, 6 aa, Mycobacterium
DRDRLR

SEQ ID NO: 455962 - protein, 5 aa, Mycobacterium
DRDRM

SEQ ID NO: 455963 - protein, 23 aa, Mycobacterium
DRDRPHPGPRHPDPGGRGQAEPA

SEQ ID NO: 455964 - protein, 8 aa, Mycobacterium
DRDRPSRN

SEQ ID NO: 455965 - protein, 6 aa, Mycobacterium
DRDRPT

SEQ ID NO: 455966 - protein, 12 aa, Mycobacterium
DRDRRDPEGPCG

SEQ ID NO: 455967 - protein, 7 aa, Mycobacterium
DRDRRLP

SEQ ID NO: 455968 - protein, 18 aa, Mycobacterium
DRDRRSAMGAAGRERARA

SEQ ID NO: 455969 - protein, 6 aa, Mycobacterium
DRDRRV

SEQ ID NO: 455970 - protein, 9 aa, Mycobacterium
DRDRSEAQN

SEQ ID NO: 455971 - protein, 9 aa, Mycobacterium
DRDRVPAGA

SEQ ID NO: 455972 - protein, 7 aa, Mycobacterium
DRDSDGL

SEQ ID NO: 455973 - protein, 10 aa, Mycobacterium
DRDSGAASFD

SEQ ID NO: 455974 - protein, 19 aa, Mycobacterium
DRDSGQRARDEIAAASGAD

SEQ ID NO: 455975 - protein, 9 aa, Mycobacterium
DRDSGVPGW

SEQ ID NO: 455976 - protein, 5 aa, Mycobacterium
DRDSR

SEQ ID NO: 455977 - protein, 4 aa, Mycobacterium
DRDT

SEQ ID NO: 455978 - protein, 9 aa, Mycobacterium
DRDTAEARP

SEQ ID NO: 455979 - protein, 6 aa, Mycobacterium
DRDTAL

SEQ ID NO: 455980 - protein, 5 aa, Mycobacterium
DRDTC

SEQ ID NO: 455981 - protein, 8 aa, Mycobacterium
DRDTDPVG

SEQ ID NO: 455982 - protein, 6 aa, Mycobacterium
DRDTGA

SEQ ID NO: 455983 - protein, 10 aa, Mycobacterium
DRDTGAAEAI

SEQ ID NO: 455984 - protein, 5 aa, Mycobacterium
DRDTH

SEQ ID NO: 455985 - protein, 28 aa, Mycobacterium
DRDTPDPKGAKYGRDADGELDGTAEETG

SEQ ID NO: 455986 - protein, 10 aa, Mycobacterium
DRDTPDPVPG

SEQ ID NO: 455987 - protein, 11 aa, Mycobacterium
DRDTQADQRHH

SEQ ID NO: 455988 - protein, 9 aa, Mycobacterium
DRDTQRASD

SEQ ID NO: 455989 - protein, 4 aa, Mycobacterium
DRDV

SEQ ID NO: 455990 - protein, 6 aa, Mycobacterium
DRDVDQ

SEQ ID NO: 455991 - protein, 7 aa, Mycobacterium
DRDVPPN

SEQ ID NO: 455992 - protein, 20 aa, Mycobacterium
DRDVTDTGRGQPACRGPATS

SEQ ID NO: 455993 - protein, 20 aa, Mycobacterium
DRDVTESGRGQPACRGPATS

SEQ ID NO: 455994 - protein, 20 aa, Mycobacterium
DRDVTTTGHGQPACRGPATS

SEQ ID NO: 455995 - protein, 5 aa, Mycobacterium
DRDYG

SEQ ID NO: 455996 - protein, 5 aa, Mycobacterium
DRDYP

SEQ ID NO: 455997 - protein, 5 aa, Mycobacterium
DRDYQ

SEQ ID NO: 455998 - protein, 7 aa, Mycobacterium
DRDYTQP

SEQ ID NO: 455999 - protein, 4 aa, Mycobacterium
DREA

SEQ ID NO: 456000 - protein, 7 aa, Mycobacterium
DREAADR

SEQ ID NO: 456001 - protein, 7 aa, Mycobacterium
DREADYS

SEQ ID NO: 456002 - protein, 6 aa, Mycobacterium
DREAFG

SEQ ID NO: 456003 - protein, 7 aa, Mycobacterium
DREAHRG

SEQ ID NO: 456004 - protein, 7 aa, Mycobacterium
DREAHRH

SEQ ID NO: 456005 - protein, 12 aa, Mycobacterium
DREALGRLIRKE

SEQ ID NO: 456006 - protein, 7 aa, Mycobacterium
DREAMPD

SEQ ID NO: 456007 - protein, 12 aa, Mycobacterium
DREATRRPHGQH

SEQ ID NO: 456008 - protein, 9 aa, Mycobacterium
DREAVRAQG

SEQ ID NO: 456009 - protein, 15 aa, Mycobacterium
DREDAPALADVELTH

SEQ ID NO: 456010 - protein, 18 aa, Mycobacterium
DREDGRGQPASPADADDM

SEQ ID NO: 456011 - protein, 9 aa, Mycobacterium
DREDTGRAF

SEQ ID NO: 456012 - protein, 14 aa, Mycobacterium
DREEAATALRAADN

SEQ ID NO: 456013 - protein, 8 aa, Mycobacterium
DREEASAD

SEQ ID NO: 456014 - protein, 9 aa, Mycobacterium
DREESDDEK

SEQ ID NO: 456015 - protein, 6 aa, Mycobacterium
DREEVD

SEQ ID NO: 456016 - protein, 7 aa, Mycobacterium
DREFRET

SEQ ID NO: 456017 - protein, 5 aa, Mycobacterium
DREGA

SEQ ID NO: 456018 - protein, 8 aa, Mycobacterium
DREGAGMQ

SEQ ID NO: 456019 - protein, 11 aa, Mycobacterium
DREGEVPWSAD

SEQ ID NO: 456020 - protein, 6 aa, Mycobacterium
DREGHA

SEQ ID NO: 456021 - protein, 11 aa, Mycobacterium
DREGISGKLGY

SEQ ID NO: 456022 - protein, 13 aa, Mycobacterium
DREGITLNEDLHA

SEQ ID NO: 456023 - protein, 5 aa, Mycobacterium
DREGL

SEQ ID NO: 456024 - protein, 8 aa, Mycobacterium
DREGNHAV

SEQ ID NO: 456025 - protein, 9 aa, Mycobacterium
DREGNVNSS

SEQ ID NO: 456026 - protein, 7 aa, Mycobacterium
DREGRAL

SEQ ID NO: 456027 - protein, 7 aa, Mycobacterium
DREGREP

SEQ ID NO: 456028 - protein, 11 aa, Mycobacterium
DREGRLESSRR

SEQ ID NO: 456029 - protein, 8 aa, Mycobacterium
DREGRPEK

SEQ ID NO: 456030 - protein, 8 aa, Mycobacterium
DREGRPRS

SEQ ID NO: 456031 - protein, 14 aa, Mycobacterium
DREGSDGKTVAEGI

SEQ ID NO: 456032 - protein, 7 aa, Mycobacterium
DREHTRT

SEQ ID NO: 456033 - protein, 21 aa, Mycobacterium
DREHVSTGYTDLRGNQTQRRL

SEQ ID NO: 456034 - protein, 8 aa, Mycobacterium
DREIGEGN

SEQ ID NO: 456035 - protein, 7 aa, Mycobacterium
DREKHGA

SEQ ID NO: 456036 - protein, 5 aa, Mycobacterium
DREKY

SEQ ID NO: 456037 - protein, 6 aa, Mycobacterium
DRELQA

SEQ ID NO: 456038 - protein, 6 aa, Mycobacterium
DRELRT

SEQ ID NO: 456039 - protein, 10 aa, Mycobacterium
DRELTTDDVP

SEQ ID NO: 456040 - protein, 11 aa, Mycobacterium
DRENRGDTNAR

SEQ ID NO: 456041 - protein, 5 aa, Mycobacterium
DREPA

SEQ ID NO: 456042 - protein, 8 aa, Mycobacterium
DREPDEVA

SEQ ID NO: 456043 - protein, 15 aa, Mycobacterium
DREPELASPKRPQAP

SEQ ID NO: 456044 - protein, 9 aa, Mycobacterium
DREPHPLPT

SEQ ID NO: 456045 - protein, 19 aa, Mycobacterium
DREPLNANEEMKKAGNPLD

SEQ ID NO: 456046 - protein, 19 aa, Mycobacterium
DREPLNPNEEMKRAGAPLD

SEQ ID NO: 456047 - protein, 18 aa, Mycobacterium
DREPRAIGRGYGQRAGGF

SEQ ID NO: 456048 - protein, 10 aa, Mycobacterium
DREPRKAAIA

SEQ ID NO: 456049 - protein, 14 aa, Mycobacterium
DREPSGGPVTGTPT

SEQ ID NO: 456050 - protein, 7 aa, Mycobacterium
DREPTRA

SEQ ID NO: 456051 - protein, 6 aa, Mycobacterium
DREPTT

SEQ ID NO: 456052 - protein, 5 aa, Mycobacterium
DREPV

SEQ ID NO: 456053 - protein, 5 aa, Mycobacterium
DREQI

SEQ ID NO: 456054 - protein, 7 aa, Mycobacterium
DREQRGA

SEQ ID NO: 456055 - protein, 4 aa, Mycobacterium
DRER

SEQ ID NO: 456056 - protein, 11 aa, Mycobacterium
DRERAAAMGAA

SEQ ID NO: 456057 - protein, 13 aa, Mycobacterium
DRERERGQDYGLE

SEQ ID NO: 456058 - protein, 6 aa, Mycobacterium
DRERPR

SEQ ID NO: 456059 - protein, 5 aa, Mycobacterium
DRERR

SEQ ID NO: 456060 - protein, 8 aa, Mycobacterium
DRERRRQG

SEQ ID NO: 456061 - protein, 25 aa, Mycobacterium
DRERSGERQSDGEASGFGGGAQGST

SEQ ID NO: 456062 - protein, 7 aa, Mycobacterium
DRERSRR

SEQ ID NO: 456063 - protein, 8 aa, Mycobacterium
DRERTGTL

SEQ ID NO: 456064 - protein, 10 aa, Mycobacterium
DRERTNVHGS

SEQ ID NO: 456065 - protein, 4 aa, Mycobacterium
DRES

SEQ ID NO: 456066 - protein, 9 aa, Mycobacterium
DRESELPSR

SEQ ID NO: 456067 - protein, 9 aa, Mycobacterium
DRESGSGLE

SEQ ID NO: 456068 - protein, 7 aa, Mycobacterium
DRESPLQ

SEQ ID NO: 456069 - protein, 10 aa, Mycobacterium
DRESPTAVES

SEQ ID NO: 456070 - protein, 9 aa, Mycobacterium
DRESQGEEV

SEQ ID NO: 456071 - protein, 11 aa, Mycobacterium
DRESSSAMPPS

SEQ ID NO: 456072 - protein, 5 aa, Mycobacterium
DRETA

SEQ ID NO: 456073 - protein, 5 aa, Mycobacterium
DRETF

SEQ ID NO: 456074 - protein, 7 aa, Mycobacterium
DRETGDA

SEQ ID NO: 456075 - protein, 12 aa, Mycobacterium
DRETGGEAGERL

SEQ ID NO: 456076 - protein, 12 aa, Mycobacterium
DRETGGKAGEAL

SEQ ID NO: 456077 - protein, 16 aa, Mycobacterium
DRETGGPEDSSPGPVD

SEQ ID NO: 456078 - protein, 6 aa, Mycobacterium
DRETPR

SEQ ID NO: 456079 - protein, 10 aa, Mycobacterium
DRETQRGNGS

SEQ ID NO: 456080 - protein, 5 aa, Mycobacterium
DRETR

SEQ ID NO: 456081 - protein, 12 aa, Mycobacterium
DRETTEAGRSAH

SEQ ID NO: 456082 - protein, 7 aa, Mycobacterium
DREVSPA

SEQ ID NO: 456083 - protein, 13 aa, Mycobacterium
DRFAPDPDARARM

SEQ ID NO: 456084 - protein, 6 aa, Mycobacterium
DRFATN

SEQ ID NO: 456085 - protein, 5 aa, Mycobacterium
DRFDP

SEQ ID NO: 456086 - protein, 16 aa, Mycobacterium
DRFDPSTGGHGGYDTP

SEQ ID NO: 456087 - protein, 18 aa, Mycobacterium
DRFENTTGTLAPGAAVPA

SEQ ID NO: 456088 - protein, 6 aa, Mycobacterium
DRFGDA

SEQ ID NO: 456089 - protein, 5 aa, Mycobacterium
DRFGN

SEQ ID NO: 456090 - protein, 12 aa, Mycobacterium
DRFRPDPAARAE

SEQ ID NO: 456091 - protein, 12 aa, Mycobacterium
DRFSPENSRERD

SEQ ID NO: 456092 - protein, 8 aa, Mycobacterium
DRFTPTPA

SEQ ID NO: 456093 - protein, 4 aa, Mycobacterium
DRGA

SEQ ID NO: 456094 - protein, 9 aa, Mycobacterium
DRGAASLTD

SEQ ID NO: 456095 - protein, 6 aa, Mycobacterium
DRGAAT

SEQ ID NO: 456096 - protein, 12 aa, Mycobacterium
DRGAATATTDSD

SEQ ID NO: 456097 - protein, 11 aa, Mycobacterium
DRGADGGEAPQ

SEQ ID NO: 456098 - protein, 9 aa, Mycobacterium
DRGADSAGV

SEQ ID NO: 456099 - protein, 8 aa, Mycobacterium
DRGAELTY

SEQ ID NO: 456100 - protein, 8 aa, Mycobacterium
DRGAEQAA

SEQ ID NO: 456101 - protein, 6 aa, Mycobacterium
DRGAES

SEQ ID NO: 456102 - protein, 22 aa, Mycobacterium
DRGAGRPTKRDRRLLDKWLAQQ

SEQ ID NO: 456103 - protein, 22 aa, Mycobacterium
DRGAGRPTKRDRRLLDKWRSGQ

SEQ ID NO: 456104 - protein, 12 aa, Mycobacterium
DRGAHRRVQRFV

SEQ ID NO: 456105 - protein, 5 aa, Mycobacterium
DRGAI

SEQ ID NO: 456106 - protein, 7 aa, Mycobacterium
DRGAPDL

SEQ ID NO: 456107 - protein, 17 aa, Mycobacterium
DRGAPVPTVSATPDQNR

SEQ ID NO: 456108 - protein, 8 aa, Mycobacterium
DRGATEAL

SEQ ID NO: 456109 - protein, 9 aa, Mycobacterium
DRGATSLTE

SEQ ID NO: 456110 - protein, 4 aa, Mycobacterium
DRGC

SEQ ID NO: 456111 - protein, 12 aa, Mycobacterium
DRGCPEPAPLSP

SEQ ID NO: 456112 - protein, 10 aa, Mycobacterium
DRGCPEPKPL

SEQ ID NO: 456113 - protein, 9 aa, Mycobacterium
DRGCPEPQP

SEQ ID NO: 456114 - protein, 10 aa, Mycobacterium
DRGCSAPGCD

SEQ ID NO: 456115 - protein, 10 aa, Mycobacterium
DRGCSAPGCT

SEQ ID NO: 456116 - protein, 5 aa, Mycobacterium
DRGDD

SEQ ID NO: 456117 - protein, 13 aa, Mycobacterium
DRGDDTARRSFPG

SEQ ID NO: 456118 - protein, 16 aa, Mycobacterium
DRGDDTLSEDSDRGEG

SEQ ID NO: 456119 - protein, 35 aa, Mycobacterium
DRGDGVSGEAGAAGVSTGRAGCRDSGGGAFGGDGT

SEQ ID NO: 456120 - protein, 8 aa, Mycobacterium
DRGDIGGL

SEQ ID NO: 456121 - protein, 9 aa, Mycobacterium
DRGDIGGVS

SEQ ID NO: 456122 - protein, 16 aa, Mycobacterium
DRGDIGGVSTAVGPVD

SEQ ID NO: 456123 - protein, 11 aa, Mycobacterium
DRGDQTHRREG

SEQ ID NO: 456124 - protein, 16 aa, Mycobacterium
DRGDRSVTLRPEGTAS

SEQ ID NO: 456125 - protein, 5 aa, Mycobacterium
DRGDS

SEQ ID NO: 456126 - protein, 7 aa, Mycobacterium
DRGDSGR

SEQ ID NO: 456127 - protein, 8 aa, Mycobacterium
DRGDSRLQ

SEQ ID NO: 456128 - protein, 16 aa, Mycobacterium
DRGDTQLTEDSTRGDG

SEQ ID NO: 456129 - protein, 8 aa, Mycobacterium
DRGEAGQR

SEQ ID NO: 456130 - protein, 7 aa, Mycobacterium
DRGEAGR

SEQ ID NO: 456131 - protein, 8 aa, Mycobacterium
DRGEARRT

SEQ ID NO: 456132 - protein, 17 aa, Mycobacterium
DRGEELGRFPAPRSPHW

SEQ ID NO: 456133 - protein, 10 aa, Mycobacterium
DRGEENPVGG

SEQ ID NO: 456134 - protein, 6 aa, Mycobacterium
DRGEFD

SEQ ID NO: 456135 - protein, 6 aa, Mycobacterium
DRGEGT

SEQ ID NO: 456136 - protein, 6 aa, Mycobacterium
DRGEGV

SEQ ID NO: 456137 - protein, 5 aa, Mycobacterium
DRGEH

SEQ ID NO: 456138 - protein, 9 aa, Mycobacterium
DRGEIDGAA

SEQ ID NO: 456139 - protein, 8 aa, Mycobacterium
DRGELPAK

SEQ ID NO: 456140 - protein, 8 aa, Mycobacterium
DRGELPDN

SEQ ID NO: 456141 - protein, 16 aa, Mycobacterium
DRGEQVTDADPDDCGV

SEQ ID NO: 456142 - protein, 7 aa, Mycobacterium
DRGERSV

SEQ ID NO: 456143 - protein, 5 aa, Mycobacterium
DRGES

SEQ ID NO: 456144 - protein, 6 aa, Mycobacterium
DRGETL

SEQ ID NO: 456145 - protein, 7 aa, Mycobacterium
DRGEVRP

SEQ ID NO: 456146 - protein, 8 aa, Mycobacterium
DRGEYATP

SEQ ID NO: 456147 - protein, 4 aa, Mycobacterium
DRGF

SEQ ID NO: 456148 - protein, 10 aa, Mycobacterium
DRGGATIGSG

SEQ ID NO: 456149 - protein, 11 aa, Mycobacterium
DRGGATYTKDT

SEQ ID NO: 456150 - protein, 5 aa, Mycobacterium
DRGGC

SEQ ID NO: 456151 - protein, 8 aa, Mycobacterium
DRGGDDVE

SEQ ID NO: 456152 - protein, 6 aa, Mycobacterium
DRGGGA

SEQ ID NO: 456153 - protein, 6 aa, Mycobacterium
DRGGGR

SEQ ID NO: 456154 - protein, 7 aa, Mycobacterium
DRGGPAI

SEQ ID NO: 456155 - protein, 7 aa, Mycobacterium
DRGGPAL

SEQ ID NO: 456156 - protein, 9 aa, Mycobacterium
DRGGPAPAA

SEQ ID NO: 456157 - protein, 5 aa, Mycobacterium
DRGGQ

SEQ ID NO: 456158 - protein, 8 aa, Mycobacterium
DRGGSSLT

SEQ ID NO: 456159 - protein, 6 aa, Mycobacterium
DRGGVR

SEQ ID NO: 456160 - protein, 7 aa, Mycobacterium
DRGGWYG

SEQ ID NO: 456161 - protein, 10 aa, Mycobacterium
DRGHAAGNAG

SEQ ID NO: 456162 - protein, 5 aa, Mycobacterium
DRGHE

SEQ ID NO: 456163 - protein, 7 aa, Mycobacterium
DRGHGTV

SEQ ID NO: 456164 - protein, 9 aa, Mycobacterium
DRGHIQPNH

SEQ ID NO: 456165 - protein, 8 aa, Mycobacterium
DRGHVETG

SEQ ID NO: 456166 - protein, 15 aa, Mycobacterium
DRGIPRATAEVAGEA

SEQ ID NO: 456167 - protein, 7 aa, Mycobacterium
DRGISND

SEQ ID NO: 456168 - protein, 8 aa, Mycobacterium
DRGISNDD

SEQ ID NO: 456169 - protein, 9 aa, Mycobacterium
DRGKEAHEK

SEQ ID NO: 456170 - protein, 10 aa, Mycobacterium
DRGKEAHEKW

SEQ ID NO: 456171 - protein, 5 aa, Mycobacterium
DRGKG

SEQ ID NO: 456172 - protein, 4 aa, Mycobacterium
DRGL

SEQ ID NO: 456173 - protein, 9 aa, Mycobacterium
DRGLGTANS

SEQ ID NO: 456174 - protein, 7 aa, Mycobacterium
DRGLKGA

SEQ ID NO: 456175 - protein, 5 aa, Mycobacterium
DRGLR

SEQ ID NO: 456176 - protein, 10 aa, Mycobacterium
DRGLSGEKMP

SEQ ID NO: 456177 - protein, 10 aa, Mycobacterium
DRGLSPDDER

SEQ ID NO: 456178 - protein, 4 aa, Mycobacterium
DRGM

SEQ ID NO: 456179 - protein, 7 aa, Mycobacterium
DRGMNRD

SEQ ID NO: 456180 - protein, 5 aa, Mycobacterium
DRGMP

SEQ ID NO: 456181 - protein, 6 aa, Mycobacterium
DRGNSR

SEQ ID NO: 456182 - protein, 15 aa, Mycobacterium
DRGNVARGDDYETSV

SEQ ID NO: 456183 - protein, 14 aa, Mycobacterium
DRGPADAASDDTVA

SEQ ID NO: 456184 - protein, 14 aa, Mycobacterium
DRGPARAIGARPTV

SEQ ID NO: 456185 - protein, 26 aa, Mycobacterium
DRGPARKPGQLSWGTGSTPTYFGPTG

SEQ ID NO: 456186 - protein, 7 aa, Mycobacterium
DRGPAVT

SEQ ID NO: 456187 - protein, 10 aa, Mycobacterium
DRGPDGRRSA

SEQ ID NO: 456188 - protein, 6 aa, Mycobacterium
DRGPGT

SEQ ID NO: 456189 - protein, 13 aa, Mycobacterium
DRGPNVDGRAPNE

SEQ ID NO: 456190 - protein, 14 aa, Mycobacterium
DRGPNVDGRTPNEK

SEQ ID NO: 456191 - protein, 4 aa, Mycobacterium
DRGQ

SEQ ID NO: 456192 - protein, 5 aa, Mycobacterium
DRGQA

SEQ ID NO: 456193 - protein, 8 aa, Mycobacterium
DRGQAQAR

SEQ ID NO: 456194 - protein, 5 aa, Mycobacterium
DRGQF

SEQ ID NO: 456195 - protein, 10 aa, Mycobacterium
DRGQPRTNPY

SEQ ID NO: 456196 - protein, 11 aa, Mycobacterium
DRGQPRTNPYH

SEQ ID NO: 456197 - protein, 11 aa, Mycobacterium
DRGQPRTNTYH

SEQ ID NO: 456198 - protein, 22 aa, Mycobacterium
DRGQRPGGVGGHGGQHVLQARD

SEQ ID NO: 456199 - protein, 8 aa, Mycobacterium
DRGQTAKR

SEQ ID NO: 456200 - protein, 5 aa, Mycobacterium
DRGQV

SEQ ID NO: 456201 - protein, 9 aa, Mycobacterium
DRGREQAAA

SEQ ID NO: 456202 - protein, 7 aa, Mycobacterium
DRGRGFE

SEQ ID NO: 456203 - protein, 7 aa, Mycobacterium
DRGRGGL

SEQ ID NO: 456204 - protein, 8 aa, Mycobacterium
DRGRGKSH

SEQ ID NO: 456205 - protein, 7 aa, Mycobacterium
DRGRPEL

SEQ ID NO: 456206 - protein, 9 aa, Mycobacterium
DRGRPPFTK

SEQ ID NO: 456207 - protein, 11 aa, Mycobacterium
DRGRPVESTGE

SEQ ID NO: 456208 - protein, 6 aa, Mycobacterium
DRGRRE

SEQ ID NO: 456209 - protein, 12 aa, Mycobacterium
DRGRSDDVPWAG

SEQ ID NO: 456210 - protein, 11 aa, Mycobacterium
DRGRSPGDDFS

SEQ ID NO: 456211 - protein, 7 aa, Mycobacterium
DRGRSRR

SEQ ID NO: 456212 - protein, 8 aa, Mycobacterium
DRGRSYVP

SEQ ID NO: 456213 - protein, 10 aa, Mycobacterium
DRGRTESSQL

SEQ ID NO: 456214 - protein, 7 aa, Mycobacterium
DRGRTGV

SEQ ID NO: 456215 - protein, 9 aa, Mycobacterium
DRGSAEAGV

SEQ ID NO: 456216 - protein, 10 aa, Mycobacterium
DRGSAEPTVN

SEQ ID NO: 456217 - protein, 6 aa, Mycobacterium
DRGSAG

SEQ ID NO: 456218 - protein, 9 aa, Mycobacterium
DRGSAPATV

SEQ ID NO: 456219 - protein, 8 aa, Mycobacterium
DRGSATPK

SEQ ID NO: 456220 - protein, 5 aa, Mycobacterium
DRGSN

SEQ ID NO: 456221 - protein, 15 aa, Mycobacterium
DRGSPRMPPRSPDAH

SEQ ID NO: 456222 - protein, 5 aa, Mycobacterium
DRGSQ

SEQ ID NO: 456223 - protein, 7 aa, Mycobacterium
DRGSQTF

SEQ ID NO: 456224 - protein, 11 aa, Mycobacterium
DRGSRGREQRR

SEQ ID NO: 456225 - protein, 5 aa, Mycobacterium
DRGSS

SEQ ID NO: 456226 - protein, 30 aa, Mycobacterium
DRGSSSAEPEAPAAAAPKAPELADDDGDEL

SEQ ID NO: 456227 - protein, 7 aa, Mycobacterium
DRGSTAA

SEQ ID NO: 456228 - protein, 4 aa, Mycobacterium
DRGT

SEQ ID NO: 456229 - protein, 10 aa, Mycobacterium
DRGTAEDLTS

SEQ ID NO: 456230 - protein, 15 aa, Mycobacterium
DRGTQLQRARAGEIT

SEQ ID NO: 456231 - protein, 8 aa, Mycobacterium
DRGTTDEW

SEQ ID NO: 456232 - protein, 8 aa, Mycobacterium
DRGTTTTP

SEQ ID NO: 456233 - protein, 7 aa, Mycobacterium
DRGTWTP

SEQ ID NO: 456234 - protein, 6 aa, Mycobacterium
DRGVEG

SEQ ID NO: 456235 - protein, 8 aa, Mycobacterium
DRGVGGEV

SEQ ID NO: 456236 - protein, 7 aa, Mycobacterium
DRGVRSG

SEQ ID NO: 456237 - protein, 6 aa, Mycobacterium
DRGWPD

SEQ ID NO: 456238 - protein, 15 aa, Mycobacterium
DRGYETSYGENHPGI

SEQ ID NO: 456239 - protein, 6 aa, Mycobacterium
DRGYGG

SEQ ID NO: 456240 - protein, 6 aa, Mycobacterium
DRGYTE

SEQ ID NO: 456241 - protein, 4 aa, Mycobacterium
DRHA

SEQ ID NO: 456242 - protein, 8 aa, Mycobacterium
DRHAGHTD

SEQ ID NO: 456243 - protein, 6 aa, Mycobacterium
DRHAHR

SEQ ID NO: 456244 - protein, 10 aa, Mycobacterium
DRHATADSDA

SEQ ID NO: 456245 - protein, 11 aa, Mycobacterium
DRHATETAEAA

SEQ ID NO: 456246 - protein, 10 aa, Mycobacterium
DRHDDGIPEA

SEQ ID NO: 456247 - protein, 8 aa, Mycobacterium
DRHDPPAA

SEQ ID NO: 456248 - protein, 11 aa, Mycobacterium
DRHEAAGTITH

SEQ ID NO: 456249 - protein, 11 aa, Mycobacterium
DRHEAGRDRPW

SEQ ID NO: 456250 - protein, 12 aa, Mycobacterium
DRHESGSAQLPL

SEQ ID NO: 456251 - protein, 7 aa, Mycobacterium
DRHGADR

SEQ ID NO: 456252 - protein, 24 aa, Mycobacterium
DRHGAGYRAGPTQPHQEVGPGELV

SEQ ID NO: 456253 - protein, 7 aa, Mycobacterium
DRHGDRH

SEQ ID NO: 456254 - protein, 11 aa, Mycobacterium
DRHGGSTLEEK

SEQ ID NO: 456255 - protein, 8 aa, Mycobacterium
DRHGHRAG

SEQ ID NO: 456256 - protein, 10 aa, Mycobacterium
DRHGKTRGFP

SEQ ID NO: 456257 - protein, 11 aa, Mycobacterium
DRHGKTRGFPL

SEQ ID NO: 456258 - protein, 13 aa, Mycobacterium
DRHGPADDRRYTY

SEQ ID NO: 456259 - protein, 8 aa, Mycobacterium
DRHGTGTS

SEQ ID NO: 456260 - protein, 16 aa, Mycobacterium
DRHNHRPIAGDTPEVE

SEQ ID NO: 456261 - protein, 15 aa, Mycobacterium
DRHNHRPLAGDSAEV

SEQ ID NO: 456262 - protein, 10 aa, Mycobacterium
DRHPAAAERL

SEQ ID NO: 456263 - protein, 11 aa, Mycobacterium
DRHPESDAARD

SEQ ID NO: 456264 - protein, 6 aa, Mycobacterium
DRHPGT

SEQ ID NO: 456265 - protein, 17 aa, Mycobacterium
DRHPLGNAGGPRGVDEV

SEQ ID NO: 456266 - protein, 9 aa, Mycobacterium
DRHPSKPDC

SEQ ID NO: 456267 - protein, 4 aa, Mycobacterium
DRHR

SEQ ID NO: 456268 - protein, 6 aa, Mycobacterium
DRHRDT

SEQ ID NO: 456269 - protein, 8 aa, Mycobacterium
DRHRGARG

SEQ ID NO: 456270 - protein, 9 aa, Mycobacterium
DRHRPGSLA

SEQ ID NO: 456271 - protein, 7 aa, Mycobacterium
DRHSPEK

SEQ ID NO: 456272 - protein, 4 aa, Mycobacterium
DRHT

SEQ ID NO: 456273 - protein, 5 aa, Mycobacterium
DRHTD

SEQ ID NO: 456274 - protein, 9 aa, Mycobacterium
DRHTDQAPQ

SEQ ID NO: 456275 - protein, 5 aa, Mycobacterium
DRHTE

SEQ ID NO: 456276 - protein, 14 aa, Mycobacterium
DRHTVTGRRPQPCP

SEQ ID NO: 456277 - protein, 6 aa, Mycobacterium
DRHYTR

SEQ ID NO: 456278 - protein, 5 aa, Mycobacterium
DRIAN

SEQ ID NO: 456279 - protein, 4 aa, Mycobacterium
DRID

SEQ ID NO: 456280 - protein, 5 aa, Mycobacterium
DRIDE

SEQ ID NO: 456281 - protein, 7 aa, Mycobacterium
DRIDPDE

SEQ ID NO: 456282 - protein, 4 aa, Mycobacterium
DRIG

SEQ ID NO: 456283 - protein, 6 aa, Mycobacterium
DRIGPT

SEQ ID NO: 456284 - protein, 5 aa, Mycobacterium
DRIGQ

SEQ ID NO: 456285 - protein, 4 aa, Mycobacterium
DRIP

SEQ ID NO: 456286 - protein, 7 aa, Mycobacterium
DRIPDGK

SEQ ID NO: 456287 - protein, 6 aa, Mycobacterium
DRIPDT

SEQ ID NO: 456288 - protein, 7 aa, Mycobacterium
DRIPDTA

SEQ ID NO: 456289 - protein, 7 aa, Mycobacterium
DRIPGAA

SEQ ID NO: 456290 - protein, 13 aa, Mycobacterium
DRIPGDTLPSERA

SEQ ID NO: 456291 - protein, 6 aa, Mycobacterium
DRIPGE

SEQ ID NO: 456292 - protein, 8 aa, Mycobacterium
DRIPGTAA

SEQ ID NO: 456293 - protein, 8 aa, Mycobacterium
DRIPGTSA

SEQ ID NO: 456294 - protein, 7 aa, Mycobacterium
DRIPKQR

SEQ ID NO: 456295 - protein, 4 aa, Mycobacterium
DRIR

SEQ ID NO: 456296 - protein, 11 aa, Mycobacterium
DRIREGKATGL

SEQ ID NO: 456297 - protein, 11 aa, Mycobacterium
DRIRTDTGSRA

SEQ ID NO: 456298 - protein, 8 aa, Mycobacterium
DRKAFGQS

SEQ ID NO: 456299 - protein, 8 aa, Mycobacterium
DRKAGRFT

SEQ ID NO: 456300 - protein, 23 aa, Mycobacterium
DRKAKQDGIPDTESAVTPDLLED

SEQ ID NO: 456301 - protein, 23 aa, Mycobacterium
DRKAKQEGIPDTESAVTPDLLDD

SEQ ID NO: 456302 - protein, 23 aa, Mycobacterium
DRKAKTEGIPDTESAVTPELLEE

SEQ ID NO: 456303 - protein, 8 aa, Mycobacterium
DRKARKGD

SEQ ID NO: 456304 - protein, 10 aa, Mycobacterium
DRKARNDAKM

SEQ ID NO: 456305 - protein, 5 aa, Mycobacterium
DRKGE

SEQ ID NO: 456306 - protein, 6 aa, Mycobacterium
DRKGLP

SEQ ID NO: 456307 - protein, 9 aa, Mycobacterium
DRKGPIGSG

SEQ ID NO: 456308 - protein, 10 aa, Mycobacterium
DRKGRSHNVT

SEQ ID NO: 456309 - protein, 5 aa, Mycobacterium
DRKLS

SEQ ID NO: 456310 - protein, 37 aa, Mycobacterium
DRKNSKAGSAADHKDTGSKPTHAHGRAGSHREFRRKS

SEQ ID NO: 456311 - protein, 14 aa, Mycobacterium
DRKQQIARASAEAF

SEQ ID NO: 456312 - protein, 7 aa, Mycobacterium
DRKRGGM

SEQ ID NO: 456313 - protein, 22 aa, Mycobacterium
DRKRRERGGDGGGGERDTELRE

SEQ ID NO: 456314 - protein, 8 aa, Mycobacterium
DRKSGRFT

SEQ ID NO: 456315 - protein, 10 aa, Mycobacterium
DRKTRRALAG

SEQ ID NO: 456316 - protein, 39 aa, Mycobacterium
DRLADQRDRIADDREEVADERERRADEREGAPDDRERAR

SEQ ID NO: 456317 - protein, 16 aa, Mycobacterium
DRLAGADTVVLLAQGL

SEQ ID NO: 456318 - protein, 44 aa, Mycobacterium
DRLAQEAKAQQDKADAQRQAAKKEAAAESARAGAKAARERQQAN

SEQ ID NO: 456319 - protein, 5 aa, Mycobacterium
DRLAR

SEQ ID NO: 456320 - protein, 7 aa, Mycobacterium
DRLDAGE

SEQ ID NO: 456321 - protein, 8 aa, Mycobacterium
DRLDETAE

SEQ ID NO: 456322 - protein, 10 aa, Mycobacterium
DRLDPGRQLS

SEQ ID NO: 456323 - protein, 4 aa, Mycobacterium
DRLE

SEQ ID NO: 456324 - protein, 7 aa, Mycobacterium
DRLGDSP

SEQ ID NO: 456325 - protein, 5 aa, Mycobacterium
DRLGE

SEQ ID NO: 456326 - protein, 6 aa, Mycobacterium
DRLGEV

SEQ ID NO: 456327 - protein, 19 aa, Mycobacterium
DRLGGHDPYSASKAGAELA

SEQ ID NO: 456328 - protein, 5 aa, Mycobacterium
DRLGN

SEQ ID NO: 456329 - protein, 8 aa, Mycobacterium
DRLGPGPD

SEQ ID NO: 456330 - protein, 9 aa, Mycobacterium
DRLGPQSGR

SEQ ID NO: 456331 - protein, 5 aa, Mycobacterium
DRLGQ

SEQ ID NO: 456332 - protein, 7 aa, Mycobacterium
DRLGQPY

SEQ ID NO: 456333 - protein, 6 aa, Mycobacterium
DRLPAA

SEQ ID NO: 456334 - protein, 6 aa, Mycobacterium
DRLPDV

SEQ ID NO: 456335 - protein, 10 aa, Mycobacterium
DRLPEEHRGA

SEQ ID NO: 456336 - protein, 28 aa, Mycobacterium
DRLPGQAVPVDADPPRLAHPGDGDARQL

SEQ ID NO: 456337 - protein, 11 aa, Mycobacterium
DRLPGTHPAAR

SEQ ID NO: 456338 - protein, 5 aa, Mycobacterium
DRLPP

SEQ ID NO: 456339 - protein, 8 aa, Mycobacterium
DRLPPERA

SEQ ID NO: 456340 - protein, 7 aa, Mycobacterium
DRLPPRG

SEQ ID NO: 456341 - protein, 10 aa, Mycobacterium
DRLPQDPTVN

SEQ ID NO: 456342 - protein, 4 aa, Mycobacterium
DRLQ

SEQ ID NO: 456343 - protein, 11 aa, Mycobacterium
DRLRAKASQGI

SEQ ID NO: 456344 - protein, 9 aa, Mycobacterium
DRLRPGGPA

SEQ ID NO: 456345 - protein, 6 aa, Mycobacterium
DRLRRP

SEQ ID NO: 456346 - protein, 12 aa, Mycobacterium
DRLSAADRETFT

SEQ ID NO: 456347 - protein, 12 aa, Mycobacterium
DRLSAQDLGTEQ

SEQ ID NO: 456348 - protein, 5 aa, Mycobacterium
DRLSD

SEQ ID NO: 456349 - protein, 10 aa, Mycobacterium
DRLSDRRSER

SEQ ID NO: 456350 - protein, 13 aa, Mycobacterium
DRLSHAEKSFTSD

SEQ ID NO: 456351 - protein, 8 aa, Mycobacterium
DRLTEGAG

SEQ ID NO: 456352 - protein, 9 aa, Mycobacterium
DRLTEQGVP

SEQ ID NO: 456353 - protein, 8 aa, Mycobacterium
DRLTPADG

SEQ ID NO: 456354 - protein, 6 aa, Mycobacterium
DRLTRG

SEQ ID NO: 456355 - protein, 10 aa, Mycobacterium
DRLTRSDTRS

SEQ ID NO: 456356 - protein, 11 aa, Mycobacterium
DRLTRTDTSSY

SEQ ID NO: 456357 - protein, 11 aa, Mycobacterium
DRLTRTDTSTY

SEQ ID NO: 456358 - protein, 7 aa, Mycobacterium
DRLTTAA

SEQ ID NO: 456359 - protein, 6 aa, Mycobacterium
DRMDRE

SEQ ID NO: 456360 - protein, 7 aa, Mycobacterium
DRMEPSE

SEQ ID NO: 456361 - protein, 4 aa, Mycobacterium
DRMG

SEQ ID NO: 456362 - protein, 5 aa, Mycobacterium
DRMGG

SEQ ID NO: 456363 - protein, 9 aa, Mycobacterium
DRMGKPAQL

SEQ ID NO: 456364 - protein, 6 aa, Mycobacterium
DRMGQV

SEQ ID NO: 456365 - protein, 11 aa, Mycobacterium
DRMSAEDRDTF

SEQ ID NO: 456366 - protein, 12 aa, Mycobacterium
DRMSAEDRDTFS

SEQ ID NO: 456367 - protein, 4 aa, Mycobacterium
DRMT

SEQ ID NO: 456368 - protein, 20 aa, Mycobacterium
DRMTGGSAAQRAARQAQAQA

SEQ ID NO: 456369 - protein, 12 aa, Mycobacterium
DRNAAGRSRGNK

SEQ ID NO: 456370 - protein, 12 aa, Mycobacterium
DRNAAPRSRGNK

SEQ ID NO: 456371 - protein, 9 aa, Mycobacterium
DRNAGTVTC

SEQ ID NO: 456372 - protein, 10 aa, Mycobacterium
DRNAKPGPWT

SEQ ID NO: 456373 - protein, 7 aa, Mycobacterium
DRNARKN

SEQ ID NO: 456374 - protein, 9 aa, Mycobacterium
DRNDDGLTT

SEQ ID NO: 456375 - protein, 17 aa, Mycobacterium
DRNDKNLAVGPRREGIS

SEQ ID NO: 456376 - protein, 6 aa, Mycobacterium
DRNDTA

SEQ ID NO: 456377 - protein, 4 aa, Mycobacterium
DRNE

SEQ ID NO: 456378 - protein, 5 aa, Mycobacterium
DRNEV

SEQ ID NO: 456379 - protein, 4 aa, Mycobacterium
DRNF

SEQ ID NO: 456380 - protein, 4 aa, Mycobacterium
DRNG

SEQ ID NO: 456381 - protein, 7 aa, Mycobacterium
DRNGEGL

SEQ ID NO: 456382 - protein, 10 aa, Mycobacterium
DRNGEKVTLR

SEQ ID NO: 456383 - protein, 8 aa, Mycobacterium
DRNGESAT

SEQ ID NO: 456384 - protein, 10 aa, Mycobacterium
DRNGEVPWTA

SEQ ID NO: 456385 - protein, 7 aa, Mycobacterium
DRNGGYT

SEQ ID NO: 456386 - protein, 5 aa, Mycobacterium
DRNGR

SEQ ID NO: 456387 - protein, 7 aa, Mycobacterium
DRNITAG

SEQ ID NO: 456388 - protein, 7 aa, Mycobacterium
DRNKEQR

SEQ ID NO: 456389 - protein, 7 aa, Mycobacterium
DRNKQQR

SEQ ID NO: 456390 - protein, 6 aa, Mycobacterium
DRNLDT

SEQ ID NO: 456391 - protein, 8 aa, Mycobacterium
DRNPDEPE

SEQ ID NO: 456392 - protein, 8 aa, Mycobacterium
DRNPDGHA

SEQ ID NO: 456393 - protein, 11 aa, Mycobacterium
DRNPDPDEQTI

SEQ ID NO: 456394 - protein, 19 aa, Mycobacterium
DRNPFPTTGVTRGVDGVPR

SEQ ID NO: 456395 - protein, 19 aa, Mycobacterium
DRNPGNKAAEDRYKAVSEA

SEQ ID NO: 456396 - protein, 7 aa, Mycobacterium
DRNPGVT

SEQ ID NO: 456397 - protein, 7 aa, Mycobacterium
DRNPLHS

SEQ ID NO: 456398 - protein, 6 aa, Mycobacterium
DRNPNS

SEQ ID NO: 456399 - protein, 24 aa, Mycobacterium
DRNPPKEVQDSAPQNLFVSAVRAG

SEQ ID NO: 456400 - protein, 7 aa, Mycobacterium
DRNPPVF

SEQ ID NO: 456401 - protein, 15 aa, Mycobacterium
DRNPSPESLDEAQAK

SEQ ID NO: 456402 - protein, 23 aa, Mycobacterium
DRNPSPQSLDEAQAKIKKALSEL

SEQ ID NO: 456403 - protein, 12 aa, Mycobacterium
DRNPTGSIKDRP

SEQ ID NO: 456404 - protein, 7 aa, Mycobacterium
DRNPTNY

SEQ ID NO: 456405 - protein, 4 aa, Mycobacterium
DRNQ

SEQ ID NO: 456406 - protein, 5 aa, Mycobacterium
DRNQE

SEQ ID NO: 456407 - protein, 5 aa, Mycobacterium
DRNQQ

SEQ ID NO: 456408 - protein, 15 aa, Mycobacterium
DRNQRSLREDVPATG

SEQ ID NO: 456409 - protein, 8 aa, Mycobacterium
DRNRTDPG

SEQ ID NO: 456410 - protein, 7 aa, Mycobacterium
DRNRTIA

SEQ ID NO: 456411 - protein, 14 aa, Mycobacterium
DRNRVGAGDPTRHP

SEQ ID NO: 456412 - protein, 11 aa, Mycobacterium
DRNSGEQARDE

SEQ ID NO: 456413 - protein, 8 aa, Mycobacterium
DRNSPHRL

SEQ ID NO: 456414 - protein, 8 aa, Mycobacterium
DRNSSGGS

SEQ ID NO: 456415 - protein, 8 aa, Mycobacterium
DRNSYADR

SEQ ID NO: 456416 - protein, 18 aa, Mycobacterium
DRNTLRRKRTQLTDKPEG

SEQ ID NO: 456417 - protein, 5 aa, Mycobacterium
DRNTP

SEQ ID NO: 456418 - protein, 4 aa, Mycobacterium
DRNV

SEQ ID NO: 456419 - protein, 5 aa, Mycobacterium
DRPAA

SEQ ID NO: 456420 - protein, 14 aa, Mycobacterium
DRPAAAKRAADAEK

SEQ ID NO: 456421 - protein, 12 aa, Mycobacterium
DRPAAGPPCRPT

SEQ ID NO: 456422 - protein, 6 aa, Mycobacterium
DRPAAH

SEQ ID NO: 456423 - protein, 5 aa, Mycobacterium
DRPAC

SEQ ID NO: 456424 - protein, 7 aa, Mycobacterium
DRPADSG

SEQ ID NO: 456425 - protein, 5 aa, Mycobacterium
DRPAE

SEQ ID NO: 456426 - protein, 14 aa, Mycobacterium
DRPAEDPREGVSDR

SEQ ID NO: 456427 - protein, 9 aa, Mycobacterium
DRPAGDAGA

SEQ ID NO: 456428 - protein, 8 aa, Mycobacterium
DRPAGKGH

SEQ ID NO: 456429 - protein, 9 aa, Mycobacterium
DRPALSPGS

SEQ ID NO: 456430 - protein, 6 aa, Mycobacterium
DRPANL

SEQ ID NO: 456431 - protein, 5 aa, Mycobacterium
DRPAP

SEQ ID NO: 456432 - protein, 7 aa, Mycobacterium
DRPAPAG

SEQ ID NO: 456433 - protein, 15 aa, Mycobacterium
DRPAPKLAQSGLFQV

SEQ ID NO: 456434 - protein, 18 aa, Mycobacterium
DRPAPPQTEEHRAPAAHG

SEQ ID NO: 456435 - protein, 5 aa, Mycobacterium
DRPAQ

SEQ ID NO: 456436 - protein, 5 aa, Mycobacterium
DRPAR

SEQ ID NO: 456437 - protein, 6 aa, Mycobacterium
DRPATA

SEQ ID NO: 456438 - protein, 9 aa, Mycobacterium
DRPATDERF

SEQ ID NO: 456439 - protein, 15 aa, Mycobacterium
DRPATDPDEIASPSA

SEQ ID NO: 456440 - protein, 9 aa, Mycobacterium
DRPATQRFT

SEQ ID NO: 456441 - protein, 7 aa, Mycobacterium
DRPATSC

SEQ ID NO: 456442 - protein, 10 aa, Mycobacterium
DRPATTSVQA

SEQ ID NO: 456443 - protein, 4 aa, Mycobacterium
DRPC

SEQ ID NO: 456444 - protein, 12 aa, Mycobacterium
DRPCRSAGRIGG

SEQ ID NO: 456445 - protein, 17 aa, Mycobacterium
DRPDAGRVELDGRPVTA

SEQ ID NO: 456446 - protein, 23 aa, Mycobacterium
DRPDAGSVTINGRDVTGVPPQRR

SEQ ID NO: 456447 - protein, 9 aa, Mycobacterium
DRPDATRDA

SEQ ID NO: 456448 - protein, 7 aa, Mycobacterium
DRPDGAI

SEQ ID NO: 456449 - protein, 21 aa, Mycobacterium
DRPDGGTVTVDGRAPGGDPNQ

SEQ ID NO: 456450 - protein, 7 aa, Mycobacterium
DRPDGSQ

SEQ ID NO: 456451 - protein, 6 aa, Mycobacterium
DRPDIQ

SEQ ID NO: 456452 - protein, 7 aa, Mycobacterium
DRPDNQH

SEQ ID NO: 456453 - protein, 6 aa, Mycobacterium
DRPDNV

SEQ ID NO: 456454 - protein, 6 aa, Mycobacterium
DRPDRV

SEQ ID NO: 456455 - protein, 9 aa, Mycobacterium
DRPDSERPL

SEQ ID NO: 456456 - protein, 7 aa, Mycobacterium
DRPDSGG

SEQ ID NO: 456457 - protein, 7 aa, Mycobacterium
DRPDSLN

SEQ ID NO: 456458 - protein, 5 aa, Mycobacterium
DRPDT

SEQ ID NO: 456459 - protein, 7 aa, Mycobacterium
DRPDTRV

SEQ ID NO: 456460 - protein, 8 aa, Mycobacterium
DRPDYSTF

SEQ ID NO: 456461 - protein, 4 aa, Mycobacterium
DRPE

SEQ ID NO: 456462 - protein, 14 aa, Mycobacterium
DRPEAGQGGSRTAR

SEQ ID NO: 456463 - protein, 6 aa, Mycobacterium
DRPEAP

SEQ ID NO: 456464 - protein, 7 aa, Mycobacterium
DRPEARW

SEQ ID NO: 456465 - protein, 6 aa, Mycobacterium
DRPEDE

SEQ ID NO: 456466 - protein, 6 aa, Mycobacterium
DRPEDH

SEQ ID NO: 456467 - protein, 8 aa, Mycobacterium
DRPEDRWE

SEQ ID NO: 456468 - protein, 9 aa, Mycobacterium
DRPEGPWSD

SEQ ID NO: 456469 - protein, 8 aa, Mycobacterium
DRPEHEWA

SEQ ID NO: 456470 - protein, 8 aa, Mycobacterium
DRPEHTWT

SEQ ID NO: 456471 - protein, 8 aa, Mycobacterium
DRPEKGNA

SEQ ID NO: 456472 - protein, 7 aa, Mycobacterium
DRPENQR

SEQ ID NO: 456473 - protein, 9 aa, Mycobacterium
DRPEPADET

SEQ ID NO: 456474 - protein, 15 aa, Mycobacterium
DRPEPQYRSQRTVEE

SEQ ID NO: 456475 - protein, 8 aa, Mycobacterium
DRPEQRWP

SEQ ID NO: 456476 - protein, 6 aa, Mycobacterium
DRPERF

SEQ ID NO: 456477 - protein, 9 aa, Mycobacterium
DRPESLNSL

SEQ ID NO: 456478 - protein, 10 aa, Mycobacterium
DRPESRRGGG

SEQ ID NO: 456479 - protein, 5 aa, Mycobacterium
DRPEV

SEQ ID NO: 456480 - protein, 13 aa, Mycobacterium
DRPFTPSDPPPLF

SEQ ID NO: 456481 - protein, 4 aa, Mycobacterium
DRPG

SEQ ID NO: 456482 - protein, 5 aa, Mycobacterium
DRPGA

SEQ ID NO: 456483 - protein, 7 aa, Mycobacterium
DRPGAAL

SEQ ID NO: 456484 - protein, 9 aa, Mycobacterium
DRPGAGAER

SEQ ID NO: 456485 - protein, 5 aa, Mycobacterium
DRPGC

SEQ ID NO: 456486 - protein, 5 aa, Mycobacterium
DRPGD

SEQ ID NO: 456487 - protein, 7 aa, Mycobacterium
DRPGDIA

SEQ ID NO: 456488 - protein, 7 aa, Mycobacterium
DRPGDID

SEQ ID NO: 456489 - protein, 17 aa, Mycobacterium
DRPGDPNAAPDPGRGRR

SEQ ID NO: 456490 - protein, 5 aa, Mycobacterium
DRPGG

SEQ ID NO: 456491 - protein, 11 aa, Mycobacterium
DRPGGITAPEA

SEQ ID NO: 456492 - protein, 8 aa, Mycobacterium
DRPGGKGH

SEQ ID NO: 456493 - protein, 5 aa, Mycobacterium
DRPGH

SEQ ID NO: 456494 - protein, 7 aa, Mycobacterium
DRPGKAA

SEQ ID NO: 456495 - protein, 8 aa, Mycobacterium
DRPGKAKA

SEQ ID NO: 456496 - protein, 9 aa, Mycobacterium
DRPGKATAL

SEQ ID NO: 456497 - protein, 8 aa, Mycobacterium
DRPGPVDD

SEQ ID NO: 456498 - protein, 16 aa, Mycobacterium
DRPGQQRQRGVPGRAA

SEQ ID NO: 456499 - protein, 7 aa, Mycobacterium
DRPGRVS

SEQ ID NO: 456500 - protein, 5 aa, Mycobacterium
DRPGT

SEQ ID NO: 456501 - protein, 7 aa, Mycobacterium
DRPGTLT

SEQ ID NO: 456502 - protein, 6 aa, Mycobacterium
DRPGTV

SEQ ID NO: 456503 - protein, 5 aa, Mycobacterium
DRPGV

SEQ ID NO: 456504 - protein, 12 aa, Mycobacterium
DRPGVAGHDGAA

SEQ ID NO: 456505 - protein, 9 aa, Mycobacterium
DRPGWGRRR

SEQ ID NO: 456506 - protein, 5 aa, Mycobacterium
DRPGY

SEQ ID NO: 456507 - protein, 4 aa, Mycobacterium
DRPH

SEQ ID NO: 456508 - protein, 9 aa, Mycobacterium
DRPHAPKGQ

SEQ ID NO: 456509 - protein, 13 aa, Mycobacterium
DRPHDPDELTPAY

SEQ ID NO: 456510 - protein, 13 aa, Mycobacterium
DRPHDPGERVPPY

SEQ ID NO: 456511 - protein, 12 aa, Mycobacterium
DRPHDTAEHRRA

SEQ ID NO: 456512 - protein, 10 aa, Mycobacterium
DRPHGSPRNA

SEQ ID NO: 456513 - protein, 6 aa, Mycobacterium
DRPHNG

SEQ ID NO: 456514 - protein, 7 aa, Mycobacterium
DRPHPQT

SEQ ID NO: 456515 - protein, 12 aa, Mycobacterium
DRPHQQRADKRP

SEQ ID NO: 456516 - protein, 7 aa, Mycobacterium
DRPHRQV

SEQ ID NO: 456517 - protein, 4 aa, Mycobacterium
DRPI

SEQ ID NO: 456518 - protein, 12 aa, Mycobacterium
DRPIDKDSAVEG

SEQ ID NO: 456519 - protein, 6 aa, Mycobacterium
DRPIEN

SEQ ID NO: 456520 - protein, 8 aa, Mycobacterium
DRPIPPGP

SEQ ID NO: 456521 - protein, 12 aa, Mycobacterium
DRPISKSDAIEG

SEQ ID NO: 456522 - protein, 12 aa, Mycobacterium
DRPISKSDAVEG

SEQ ID NO: 456523 - protein, 14 aa, Mycobacterium
DRPKDVNATSGANY

SEQ ID NO: 456524 - protein, 7 aa, Mycobacterium
DRPKESY

SEQ ID NO: 456525 - protein, 20 aa, Mycobacterium
DRPKPAPKFGHGATATLTTA

SEQ ID NO: 456526 - protein, 8 aa, Mycobacterium
DRPLDTNA

SEQ ID NO: 456527 - protein, 5 aa, Mycobacterium
DRPLG

SEQ ID NO: 456528 - protein, 6 aa, Mycobacterium
DRPLGQ

SEQ ID NO: 456529 - protein, 7 aa, Mycobacterium
DRPLGTG

SEQ ID NO: 456530 - protein, 7 aa, Mycobacterium
DRPLHGT

SEQ ID NO: 456531 - protein, 11 aa, Mycobacterium
DRPLPDFAPGT

SEQ ID NO: 456532 - protein, 9 aa, Mycobacterium
DRPLPPAAE

SEQ ID NO: 456533 - protein, 7 aa, Mycobacterium
DRPLTDD

SEQ ID NO: 456534 - protein, 9 aa, Mycobacterium
DRPNRGRRI

SEQ ID NO: 456535 - protein, 9 aa, Mycobacterium
DRPNRGRRM

SEQ ID NO: 456536 - protein, 10 aa, Mycobacterium
DRPPAGPDDP

SEQ ID NO: 456537 - protein, 6 aa, Mycobacterium
DRPPAN

SEQ ID NO: 456538 - protein, 17 aa, Mycobacterium
DRPPAQDPDVIDDPSER

SEQ ID NO: 456539 - protein, 17 aa, Mycobacterium
DRPPAQDPDVIDDPSQR

SEQ ID NO: 456540 - protein, 7 aa, Mycobacterium
DRPPDHH

SEQ ID NO: 456541 - protein, 6 aa, Mycobacterium
DRPPGV

SEQ ID NO: 456542 - protein, 6 aa, Mycobacterium
DRPPPD

SEQ ID NO: 456543 - protein, 21 aa, Mycobacterium
DRPPPIDPVPGEALDGAGGRV

SEQ ID NO: 456544 - protein, 5 aa, Mycobacterium
DRPPR

SEQ ID NO: 456545 - protein, 9 aa, Mycobacterium
DRPPYRARN

SEQ ID NO: 456546 - protein, 4 aa, Mycobacterium
DRPQ

SEQ ID NO: 456547 - protein, 7 aa, Mycobacterium
DRPQGAS

SEQ ID NO: 456548 - protein, 6 aa, Mycobacterium
DRPQGV

SEQ ID NO: 456549 - protein, 5 aa, Mycobacterium
DRPQR

SEQ ID NO: 456550 - protein, 6 aa, Mycobacterium
DRPQRV

SEQ ID NO: 456551 - protein, 5 aa, Mycobacterium
DRPQT

SEQ ID NO: 456552 - protein, 11 aa, Mycobacterium
DRPQWRGASGA

SEQ ID NO: 456553 - protein, 7 aa, Mycobacterium
DRPRADL

SEQ ID NO: 456554 - protein, 5 aa, Mycobacterium
DRPRE

SEQ ID NO: 456555 - protein, 8 aa, Mycobacterium
DRPRGTGD

SEQ ID NO: 456556 - protein, 5 aa, Mycobacterium
DRPRL

SEQ ID NO: 456557 - protein, 6 aa, Mycobacterium
DRPRPT

SEQ ID NO: 456558 - protein, 6 aa, Mycobacterium
DRPRQP

SEQ ID NO: 456559 - protein, 5 aa, Mycobacterium
DRPRS

SEQ ID NO: 456560 - protein, 12 aa, Mycobacterium
DRPRSPSDVTFG

SEQ ID NO: 456561 - protein, 4 aa, Mycobacterium
DRPS

SEQ ID NO: 456562 - protein, 5 aa, Mycobacterium
DRPSD

SEQ ID NO: 456563 - protein, 6 aa, Mycobacterium
DRPSPH

SEQ ID NO: 456564 - protein, 6 aa, Mycobacterium
DRPSPR

SEQ ID NO: 456565 - protein, 8 aa, Mycobacterium
DRPSPRGH

SEQ ID NO: 456566 - protein, 17 aa, Mycobacterium
DRPSPSKDEFTTTPGFD

SEQ ID NO: 456567 - protein, 8 aa, Mycobacterium
DRPSQPAD

SEQ ID NO: 456568 - protein, 14 aa, Mycobacterium
DRPSSSAGGRGGGV

SEQ ID NO: 456569 - protein, 5 aa, Mycobacterium
DRPTA

SEQ ID NO: 456570 - protein, 12 aa, Mycobacterium
DRPTASRSEFRA

SEQ ID NO: 456571 - protein, 20 aa, Mycobacterium
DRPTGSKSEFRTSPAFDGEG

SEQ ID NO: 456572 - protein, 7 aa, Mycobacterium
DRPTKGN

SEQ ID NO: 456573 - protein, 21 aa, Mycobacterium
DRPTKGTVKISGQDTAQLTES

SEQ ID NO: 456574 - protein, 5 aa, Mycobacterium
DRPTL

SEQ ID NO: 456575 - protein, 5 aa, Mycobacterium
DRPTP

SEQ ID NO: 456576 - protein, 18 aa, Mycobacterium
DRPTPRNPHAEMEAPGPA

SEQ ID NO: 456577 - protein, 12 aa, Mycobacterium
DRPTQRGSGTPL

SEQ ID NO: 456578 - protein, 9 aa, Mycobacterium
DRPTRSKRE

SEQ ID NO: 456579 - protein, 8 aa, Mycobacterium
DRPTTSNE

SEQ ID NO: 456580 - protein, 13 aa, Mycobacterium
DRPVAARGDASAV

SEQ ID NO: 456581 - protein, 6 aa, Mycobacterium
DRPVAD

SEQ ID NO: 456582 - protein, 6 aa, Mycobacterium
DRPVAT

SEQ ID NO: 456583 - protein, 7 aa, Mycobacterium
DRPVDDA

SEQ ID NO: 456584 - protein, 7 aa, Mycobacterium
DRPVGPR

SEQ ID NO: 456585 - protein, 11 aa, Mycobacterium
DRPVRSTRGWS

SEQ ID NO: 456586 - protein, 7 aa, Mycobacterium
DRPVYSA

SEQ ID NO: 456587 - protein, 4 aa, Mycobacterium
DRPW

SEQ ID NO: 456588 - protein, 7 aa, Mycobacterium
DRPWASG

SEQ ID NO: 456589 - protein, 7 aa, Mycobacterium
DRPWPEE

SEQ ID NO: 456590 - protein, 7 aa, Mycobacterium
DRPYPRG

SEQ ID NO: 456591 - protein, 7 aa, Mycobacterium
DRQAAKA

SEQ ID NO: 456592 - protein, 8 aa, Mycobacterium
DRQAQAQA

SEQ ID NO: 456593 - protein, 8 aa, Mycobacterium
DRQASVRR

SEQ ID NO: 456594 - protein, 17 aa, Mycobacterium
DRQDGGDRASTPSAVAD

SEQ ID NO: 456595 - protein, 9 aa, Mycobacterium
DRQDLGHQP

SEQ ID NO: 456596 - protein, 20 aa, Mycobacterium
DRQDLPPDRPVAQRPGGGAF

SEQ ID NO: 456597 - protein, 6 aa, Mycobacterium
DRQDVD

SEQ ID NO: 456598 - protein, 7 aa, Mycobacterium
DRQELQS

SEQ ID NO: 456599 - protein, 14 aa, Mycobacterium
DRQETGNSLSPLAR

SEQ ID NO: 456600 - protein, 14 aa, Mycobacterium
DRQETVAAAEAARA

SEQ ID NO: 456601 - protein, 6 aa, Mycobacterium
DRQEVA

SEQ ID NO: 456602 - protein, 15 aa, Mycobacterium
DRQEVDNALNQAAKE

SEQ ID NO: 456603 - protein, 5 aa, Mycobacterium
DRQEY

SEQ ID NO: 456604 - protein, 5 aa, Mycobacterium
DRQFP

SEQ ID NO: 456605 - protein, 4 aa, Mycobacterium
DRQG

SEQ ID NO: 456606 - protein, 10 aa, Mycobacterium
DRQGAERARD

SEQ ID NO: 456607 - protein, 8 aa, Mycobacterium
DRQGELTD

SEQ ID NO: 456608 - protein, 6 aa, Mycobacterium
DRQGGR

SEQ ID NO: 456609 - protein, 8 aa, Mycobacterium
DRQGRSIT

SEQ ID NO: 456610 - protein, 5 aa, Mycobacterium
DRQGV

SEQ ID NO: 456611 - protein, 8 aa, Mycobacterium
DRQHPYAS

SEQ ID NO: 456612 - protein, 9 aa, Mycobacterium
DRQKNGTFE

SEQ ID NO: 456613 - protein, 20 aa, Mycobacterium
DRQLKRGNDLTDVLTSECGL

SEQ ID NO: 456614 - protein, 5 aa, Mycobacterium
DRQLQ

SEQ ID NO: 456615 - protein, 5 aa, Mycobacterium
DRQPP

SEQ ID NO: 456616 - protein, 9 aa, Mycobacterium
DRQQRADTA

SEQ ID NO: 456617 - protein, 4 aa, Mycobacterium
DRQR

SEQ ID NO: 456618 - protein, 8 aa, Mycobacterium
DRQRERNR

SEQ ID NO: 456619 - protein, 6 aa, Mycobacterium
DRQRGP

SEQ ID NO: 456620 - protein, 20 aa, Mycobacterium
DRQRLAQEETDRITARLAAL

SEQ ID NO: 456621 - protein, 20 aa, Mycobacterium
DRQRLAQEETERINARLAGL

SEQ ID NO: 456622 - protein, 8 aa, Mycobacterium
DRQRPGTE

SEQ ID NO: 456623 - protein, 10 aa, Mycobacterium
DRQRRSQRQQ

SEQ ID NO: 456624 - protein, 5 aa, Mycobacterium
DRQRV

SEQ ID NO: 456625 - protein, 20 aa, Mycobacterium
DRQRVAQDETDRINARLAGL

SEQ ID NO: 456626 - protein, 9 aa, Mycobacterium
DRQRVPEEP

SEQ ID NO: 456627 - protein, 4 aa, Mycobacterium
DRQS

SEQ ID NO: 456628 - protein, 8 aa, Mycobacterium
DRQSDALS

SEQ ID NO: 456629 - protein, 10 aa, Mycobacterium
DRQSGTPSSY

SEQ ID NO: 456630 - protein, 5 aa, Mycobacterium
DRQSR

SEQ ID NO: 456631 - protein, 6 aa, Mycobacterium
DRQTPR

SEQ ID NO: 456632 - protein, 7 aa, Mycobacterium
DRQTQDG

SEQ ID NO: 456633 - protein, 5 aa, Mycobacterium
DRQTY

SEQ ID NO: 456634 - protein, 5 aa, Mycobacterium
DRQYE

SEQ ID NO: 456635 - protein, 4 aa, Mycobacterium
DRRA

SEQ ID NO: 456636 - protein, 13 aa, Mycobacterium
DRRAADPDLSGPF

SEQ ID NO: 456637 - protein, 7 aa, Mycobacterium
DRRAAEA

SEQ ID NO: 456638 - protein, 8 aa, Mycobacterium
DRRADGDR

SEQ ID NO: 456639 - protein, 15 aa, Mycobacterium
DRRADHVGAGGPDIL

SEQ ID NO: 456640 - protein, 8 aa, Mycobacterium
DRRADPDL

SEQ ID NO: 456641 - protein, 15 aa, Mycobacterium
DRRADRLSPGGPDIV

SEQ ID NO: 456642 - protein, 15 aa, Mycobacterium
DRRAEQIRAGGPDIL

SEQ ID NO: 456643 - protein, 15 aa, Mycobacterium
DRRAEQLAAAGPSVL

SEQ ID NO: 456644 - protein, 15 aa, Mycobacterium
DRRAEQLRTTGPTIV

SEQ ID NO: 456645 - protein, 15 aa, Mycobacterium
DRRAEQLSSAGPDIL

SEQ ID NO: 456646 - protein, 5 aa, Mycobacterium
DRRAG

SEQ ID NO: 456647 - protein, 6 aa, Mycobacterium
DRRAGP

SEQ ID NO: 456648 - protein, 6 aa, Mycobacterium
DRRAHD

SEQ ID NO: 456649 - protein, 7 aa, Mycobacterium
DRRAHDE

SEQ ID NO: 456650 - protein, 15 aa, Mycobacterium
DRRAPGQMDGMRCRP

SEQ ID NO: 456651 - protein, 10 aa, Mycobacterium
DRRAQPTARD

SEQ ID NO: 456652 - protein, 15 aa, Mycobacterium
DRRARAGDRPGLSGG

SEQ ID NO: 456653 - protein, 13 aa, Mycobacterium
DRRARDVKRTAGV

SEQ ID NO: 456654 - protein, 22 aa, Mycobacterium
DRRARSGKRHELPGSSPRYLMK

SEQ ID NO: 456655 - protein, 7 aa, Mycobacterium
DRRATQG

SEQ ID NO: 456656 - protein, 9 aa, Mycobacterium
DRRATQGNY

SEQ ID NO: 456657 - protein, 8 aa, Mycobacterium
DRRDDGYH

SEQ ID NO: 456658 - protein, 9 aa, Mycobacterium
DRRDEEDAL

SEQ ID NO: 456659 - protein, 6 aa, Mycobacterium
DRRDFD

SEQ ID NO: 456660 - protein, 31 aa, Mycobacterium
DRRDGRRRRRPSRQSRRRDLERQPSVGGAGR

SEQ ID NO: 456661 - protein, 13 aa, Mycobacterium
DRRDLPPVSTQSQ

SEQ ID NO: 456662 - protein, 5 aa, Mycobacterium
DRRDN

SEQ ID NO: 456663 - protein, 14 aa, Mycobacterium
DRRDPAQTLRDGSA

SEQ ID NO: 456664 - protein, 7 aa, Mycobacterium
DRRDPDQ

SEQ ID NO: 456665 - protein, 14 aa, Mycobacterium
DRRDPKPAGAGTPI

SEQ ID NO: 456666 - protein, 7 aa, Mycobacterium
DRRDPYR

SEQ ID NO: 456667 - protein, 10 aa, Mycobacterium
DRRDRRLRGK

SEQ ID NO: 456668 - protein, 6 aa, Mycobacterium
DRRDTN

SEQ ID NO: 456669 - protein, 4 aa, Mycobacterium
DRRE

SEQ ID NO: 456670 - protein, 6 aa, Mycobacterium
DRREAG

SEQ ID NO: 456671 - protein, 7 aa, Mycobacterium
DRREAVD

SEQ ID NO: 456672 - protein, 6 aa, Mycobacterium
DRREDF

SEQ ID NO: 456673 - protein, 7 aa, Mycobacterium
DRREDGY

SEQ ID NO: 456674 - protein, 8 aa, Mycobacterium
DRREDGYH

SEQ ID NO: 456675 - protein, 9 aa, Mycobacterium
DRREPGPAV

SEQ ID NO: 456676 - protein, 5 aa, Mycobacterium
DRRER

SEQ ID NO: 456677 - protein, 9 aa, Mycobacterium
DRRERGTGE

SEQ ID NO: 456678 - protein, 7 aa, Mycobacterium
DRRETDL

SEQ ID NO: 456679 - protein, 12 aa, Mycobacterium
DRREVTDPTKRH

SEQ ID NO: 456680 - protein, 8 aa, Mycobacterium
DRRGDGYH

SEQ ID NO: 456681 - protein, 8 aa, Mycobacterium
DRRGEPTA

SEQ ID NO: 456682 - protein, 12 aa, Mycobacterium
DRRGEVPWSADS

SEQ ID NO: 456683 - protein, 13 aa, Mycobacterium
DRRGGAANPYRLD

SEQ ID NO: 456684 - protein, 7 aa, Mycobacterium
DRRGHER

SEQ ID NO: 456685 - protein, 11 aa, Mycobacterium
DRRGKRRWTAD

SEQ ID NO: 456686 - protein, 12 aa, Mycobacterium
DRRGPGDTTPSL

SEQ ID NO: 456687 - protein, 12 aa, Mycobacterium
DRRGPGETPPTL

SEQ ID NO: 456688 - protein, 5 aa, Mycobacterium
DRRGQ

SEQ ID NO: 456689 - protein, 16 aa, Mycobacterium
DRRGQTPQTPLGPGAL

SEQ ID NO: 456690 - protein, 5 aa, Mycobacterium
DRRGR

SEQ ID NO: 456691 - protein, 6 aa, Mycobacterium
DRRGSD

SEQ ID NO: 456692 - protein, 21 aa, Mycobacterium
DRRGSQQGRRRVAGARDRQAR

SEQ ID NO: 456693 - protein, 8 aa, Mycobacterium
DRRGTERG

SEQ ID NO: 456694 - protein, 5 aa, Mycobacterium
DRRGY

SEQ ID NO: 456695 - protein, 8 aa, Mycobacterium
DRRHGPEL

SEQ ID NO: 456696 - protein, 6 aa, Mycobacterium
DRRHRP

SEQ ID NO: 456697 - protein, 7 aa, Mycobacterium
DRRIAPS

SEQ ID NO: 456698 - protein, 8 aa, Mycobacterium
DRRIPRNP

SEQ ID NO: 456699 - protein, 9 aa, Mycobacterium
DRRKGDREV

SEQ ID NO: 456700 - protein, 5 aa, Mycobacterium
DRRKL

SEQ ID NO: 456701 - protein, 14 aa, Mycobacterium
DRRLEQKRQHVPDA

SEQ ID NO: 456702 - protein, 9 aa, Mycobacterium
DRRLGPQAR

SEQ ID NO: 456703 - protein, 5 aa, Mycobacterium
DRRLR

SEQ ID NO: 456704 - protein, 12 aa, Mycobacterium
DRRLSEAEAPGM

SEQ ID NO: 456705 - protein, 5 aa, Mycobacterium
DRRMS

SEQ ID NO: 456706 - protein, 11 aa, Mycobacterium
DRRNDAELGKR

SEQ ID NO: 456707 - protein, 10 aa, Mycobacterium
DRRNQAQEAH

SEQ ID NO: 456708 - protein, 4 aa, Mycobacterium
DRRP

SEQ ID NO: 456709 - protein, 14 aa, Mycobacterium
DRRPAQLSGGQAQR

SEQ ID NO: 456710 - protein, 6 aa, Mycobacterium
DRRPAW

SEQ ID NO: 456711 - protein, 10 aa, Mycobacterium
DRRPDLPSGK

SEQ ID NO: 456712 - protein, 12 aa, Mycobacterium
DRRPDTYGPIIA

SEQ ID NO: 456713 - protein, 12 aa, Mycobacterium
DRRPESYETIPA

SEQ ID NO: 456714 - protein, 13 aa, Mycobacterium
DRRPGGLRPQRPG

SEQ ID NO: 456715 - protein, 7 aa, Mycobacterium
DRRPHAR

SEQ ID NO: 456716 - protein, 9 aa, Mycobacterium
DRRPHARGG

SEQ ID NO: 456717 - protein, 7 aa, Mycobacterium
DRRPIGP

SEQ ID NO: 456718 - protein, 6 aa, Mycobacterium
DRRPKI

SEQ ID NO: 456719 - protein, 7 aa, Mycobacterium
DRRPPHE

SEQ ID NO: 456720 - protein, 7 aa, Mycobacterium
DRRPPRA

SEQ ID NO: 456721 - protein, 8 aa, Mycobacterium
DRRPTTAD

SEQ ID NO: 456722 - protein, 6 aa, Mycobacterium
DRRPYN

SEQ ID NO: 456723 - protein, 4 aa, Mycobacterium
DRRQ

SEQ ID NO: 456724 - protein, 7 aa, Mycobacterium
DRRQAQA

SEQ ID NO: 456725 - protein, 7 aa, Mycobacterium
DRRQARY

SEQ ID NO: 456726 - protein, 6 aa, Mycobacterium
DRRQAT

SEQ ID NO: 456727 - protein, 5 aa, Mycobacterium
DRRQD

SEQ ID NO: 456728 - protein, 8 aa, Mycobacterium
DRRQDGYH

SEQ ID NO: 456729 - protein, 5 aa, Mycobacterium
DRRQG

SEQ ID NO: 456730 - protein, 5 aa, Mycobacterium
DRRQP

SEQ ID NO: 456731 - protein, 7 aa, Mycobacterium
DRRQRAQ

SEQ ID NO: 456732 - protein, 6 aa, Mycobacterium
DRRQRS

SEQ ID NO: 456733 - protein, 5 aa, Mycobacterium
DRRRA

SEQ ID NO: 456734 - protein, 5 aa, Mycobacterium
DRRRF

SEQ ID NO: 456735 - protein, 7 aa, Mycobacterium
DRRRGDR

SEQ ID NO: 456736 - protein, 7 aa, Mycobacterium
DRRRGEK

SEQ ID NO: 456737 - protein, 7 aa, Mycobacterium
DRRRGER

SEQ ID NO: 456738 - protein, 7 aa, Mycobacterium
DRRRGNP

SEQ ID NO: 456739 - protein, 11 aa, Mycobacterium
DRRRGQPPRDD

SEQ ID NO: 456740 - protein, 15 aa, Mycobacterium
DRRRGRARSMGGPER

SEQ ID NO: 456741 - protein, 9 aa, Mycobacterium
DRRRNRAAT

SEQ ID NO: 456742 - protein, 6 aa, Mycobacterium
DRRRQR

SEQ ID NO: 456743 - protein, 11 aa, Mycobacterium
DRRRRESAQTL

SEQ ID NO: 456744 - protein, 20 aa, Mycobacterium
DRRRRGERGGEGGNDTELRE

SEQ ID NO: 456745 - protein, 19 aa, Mycobacterium
DRRRRGERSGDGAEAEVRE

SEQ ID NO: 456746 - protein, 19 aa, Mycobacterium
DRRRRGERSGDGGDTELRE

SEQ ID NO: 456747 - protein, 19 aa, Mycobacterium
DRRRRGERSGDGSDAELRE

SEQ ID NO: 456748 - protein, 20 aa, Mycobacterium
DRRRRGERSGEGGDAELRED

SEQ ID NO: 456749 - protein, 7 aa, Mycobacterium
DRRRSRR

SEQ ID NO: 456750 - protein, 12 aa, Mycobacterium
DRRRTRGLPSPT

SEQ ID NO: 456751 - protein, 17 aa, Mycobacterium
DRRSARKRNALAARSRK

SEQ ID NO: 456752 - protein, 17 aa, Mycobacterium
DRRSARKRNALAARTRK

SEQ ID NO: 456753 - protein, 18 aa, Mycobacterium
DRRSARKRNAMAARSRKR

SEQ ID NO: 456754 - protein, 10 aa, Mycobacterium
DRRSARRVSR

SEQ ID NO: 456755 - protein, 8 aa, Mycobacterium
DRRSEGAE

SEQ ID NO: 456756 - protein, 8 aa, Mycobacterium
DRRSGSRE

SEQ ID NO: 456757 - protein, 9 aa, Mycobacterium
DRRSNPRED

SEQ ID NO: 456758 - protein, 7 aa, Mycobacterium
DRRSQQR

SEQ ID NO: 456759 - protein, 7 aa, Mycobacterium
DRRSRAA

SEQ ID NO: 456760 - protein, 10 aa, Mycobacterium
DRRSREAGWG

SEQ ID NO: 456761 - protein, 9 aa, Mycobacterium
DRRTATVGR

SEQ ID NO: 456762 - protein, 12 aa, Mycobacterium
DRRTDPDLATRT

SEQ ID NO: 456763 - protein, 6 aa, Mycobacterium
DRRTEL

SEQ ID NO: 456764 - protein, 6 aa, Mycobacterium
DRRTHE

SEQ ID NO: 456765 - protein, 6 aa, Mycobacterium
DRRTHG

SEQ ID NO: 456766 - protein, 9 aa, Mycobacterium
DRRTREQRL

SEQ ID NO: 456767 - protein, 7 aa, Mycobacterium
DRRTRQQ

SEQ ID NO: 456768 - protein, 10 aa, Mycobacterium
DRRTTAPDHV

SEQ ID NO: 456769 - protein, 7 aa, Mycobacterium
DRRTVER

SEQ ID NO: 456770 - protein, 4 aa, Mycobacterium
DRRV

SEQ ID NO: 456771 - protein, 8 aa, Mycobacterium
DRRVAPSA

SEQ ID NO: 456772 - protein, 20 aa, Mycobacterium
DRRVDAQAKYPAAPRQRKGA

SEQ ID NO: 456773 - protein, 20 aa, Mycobacterium
DRRVSQGADPHTADAEARAE

SEQ ID NO: 456774 - protein, 9 aa, Mycobacterium
DRRYPGSPI

SEQ ID NO: 456775 - protein, 6 aa, Mycobacterium
DRRYTA

SEQ ID NO: 456776 - protein, 4 aa, Mycobacterium
DRSA

SEQ ID NO: 456777 - protein, 30 aa, Mycobacterium
DRSAKKEIKQVKPTNADVGSEVTAEISSGP

SEQ ID NO: 456778 - protein, 43 aa, Mycobacterium
DRSAKPPPEDPPGGGLTSETPPENGSADPGAKTRYQPIPVSLQ

SEQ ID NO: 456779 - protein, 12 aa, Mycobacterium
DRSASALGGSGW

SEQ ID NO: 456780 - protein, 8 aa, Mycobacterium
DRSASETQ

SEQ ID NO: 456781 - protein, 7 aa, Mycobacterium
DRSASEV

SEQ ID NO: 456782 - protein, 6 aa, Mycobacterium
DRSAVD

SEQ ID NO: 456783 - protein, 8 aa, Mycobacterium
DRSAVDPA

SEQ ID NO: 456784 - protein, 9 aa, Mycobacterium
DRSDASPVR

SEQ ID NO: 456785 - protein, 14 aa, Mycobacterium
DRSDAYLSGTGARP

SEQ ID NO: 456786 - protein, 6 aa, Mycobacterium
DRSDEP

SEQ ID NO: 456787 - protein, 6 aa, Mycobacterium
DRSDGR

SEQ ID NO: 456788 - protein, 26 aa, Mycobacterium
DRSDLEPPPSEDFGRQPPQDAAAEQA

SEQ ID NO: 456789 - protein, 8 aa, Mycobacterium
DRSDPKLT

SEQ ID NO: 456790 - protein, 8 aa, Mycobacterium
DRSDRGPG

SEQ ID NO: 456791 - protein, 8 aa, Mycobacterium
DRSDRHDE

SEQ ID NO: 456792 - protein, 11 aa, Mycobacterium
DRSDRPGRNQV

SEQ ID NO: 456793 - protein, 6 aa, Mycobacterium
DRSDRV

SEQ ID NO: 456794 - protein, 9 aa, Mycobacterium
DRSDSRPAA

SEQ ID NO: 456795 - protein, 13 aa, Mycobacterium
DRSDTAHPLRERQ

SEQ ID NO: 456796 - protein, 5 aa, Mycobacterium
DRSEE

SEQ ID NO: 456797 - protein, 7 aa, Mycobacterium
DRSEEEV

SEQ ID NO: 456798 - protein, 6 aa, Mycobacterium
DRSEEF

SEQ ID NO: 456799 - protein, 13 aa, Mycobacterium
DRSEEGKADYSGP

SEQ ID NO: 456800 - protein, 6 aa, Mycobacterium
DRSERI

SEQ ID NO: 456801 - protein, 9 aa, Mycobacterium
DRSERRGEA

SEQ ID NO: 456802 - protein, 7 aa, Mycobacterium
DRSETAR

SEQ ID NO: 456803 - protein, 5 aa, Mycobacterium
DRSEV

SEQ ID NO: 456804 - protein, 7 aa, Mycobacterium
DRSFEGP

SEQ ID NO: 456805 - protein, 8 aa, Mycobacterium
DRSFTSAT

SEQ ID NO: 456806 - protein, 11 aa, Mycobacterium
DRSGARLGRGA

SEQ ID NO: 456807 - protein, 5 aa, Mycobacterium
DRSGE

SEQ ID NO: 456808 - protein, 15 aa, Mycobacterium
DRSGEDVRSSSGFRE

SEQ ID NO: 456809 - protein, 8 aa, Mycobacterium
DRSGEQER

SEQ ID NO: 456810 - protein, 8 aa, Mycobacterium
DRSGESTG

SEQ ID NO: 456811 - protein, 5 aa, Mycobacterium
DRSGG

SEQ ID NO: 456812 - protein, 11 aa, Mycobacterium
DRSGKHPPNAR

SEQ ID NO: 456813 - protein, 7 aa, Mycobacterium
DRSGLES

SEQ ID NO: 456814 - protein, 9 aa, Mycobacterium
DRSGLQQPG

SEQ ID NO: 456815 - protein, 8 aa, Mycobacterium
DRSGNEKF

SEQ ID NO: 456816 - protein, 5 aa, Mycobacterium
DRSGQ

SEQ ID NO: 456817 - protein, 13 aa, Mycobacterium
DRSGQWSGSPAAL

SEQ ID NO: 456818 - protein, 6 aa, Mycobacterium
DRSGRA

SEQ ID NO: 456819 - protein, 7 aa, Mycobacterium
DRSGRDD

SEQ ID NO: 456820 - protein, 6 aa, Mycobacterium
DRSGRF

SEQ ID NO: 456821 - protein, 14 aa, Mycobacterium
DRSGVLSASGTVNG

SEQ ID NO: 456822 - protein, 11 aa, Mycobacterium
DRSKAEAGDSD

SEQ ID NO: 456823 - protein, 7 aa, Mycobacterium
DRSKQQA

SEQ ID NO: 456824 - protein, 8 aa, Mycobacterium
DRSKYASG

SEQ ID NO: 456825 - protein, 4 aa, Mycobacterium
DRSP

SEQ ID NO: 456826 - protein, 8 aa, Mycobacterium
DRSPASSQ

SEQ ID NO: 456827 - protein, 8 aa, Mycobacterium
DRSPDEIG

SEQ ID NO: 456828 - protein, 7 aa, Mycobacterium
DRSPDWS

SEQ ID NO: 456829 - protein, 8 aa, Mycobacterium
DRSPEDLG

SEQ ID NO: 456830 - protein, 7 aa, Mycobacterium
DRSPSDE

SEQ ID NO: 456831 - protein, 7 aa, Mycobacterium
DRSPSDQ

SEQ ID NO: 456832 - protein, 8 aa, Mycobacterium
DRSPYARG

SEQ ID NO: 456833 - protein, 14 aa, Mycobacterium
DRSPYTLSGGEKRR

SEQ ID NO: 456834 - protein, 4 aa, Mycobacterium
DRSQ

SEQ ID NO: 456835 - protein, 8 aa, Mycobacterium
DRSQATRV

SEQ ID NO: 456836 - protein, 6 aa, Mycobacterium
DRSQEV

SEQ ID NO: 456837 - protein, 12 aa, Mycobacterium
DRSQNPREGMVE

SEQ ID NO: 456838 - protein, 7 aa, Mycobacterium
DRSQREL

SEQ ID NO: 456839 - protein, 5 aa, Mycobacterium
DRSQV

SEQ ID NO: 456840 - protein, 13 aa, Mycobacterium
DRSRAERTAETAR

SEQ ID NO: 456841 - protein, 12 aa, Mycobacterium
DRSRAKGASRWG

SEQ ID NO: 456842 - protein, 17 aa, Mycobacterium
DRSRGITGETVRPDGGF

SEQ ID NO: 456843 - protein, 13 aa, Mycobacterium
DRSRGQYVGYQAG

SEQ ID NO: 456844 - protein, 8 aa, Mycobacterium
DRSRQDPR

SEQ ID NO: 456845 - protein, 7 aa, Mycobacterium
DRSRVPQ

SEQ ID NO: 456846 - protein, 11 aa, Mycobacterium
DRSSAAAANPR

SEQ ID NO: 456847 - protein, 8 aa, Mycobacterium
DRSSAKGH

SEQ ID NO: 456848 - protein, 9 aa, Mycobacterium
DRSSAKSHL

SEQ ID NO: 456849 - protein, 10 aa, Mycobacterium
DRSSATARNA

SEQ ID NO: 456850 - protein, 7 aa, Mycobacterium
DRSSDVK

SEQ ID NO: 456851 - protein, 12 aa, Mycobacterium
DRSSERTDIDGT

SEQ ID NO: 456852 - protein, 6 aa, Mycobacterium
DRSSFA

SEQ ID NO: 456853 - protein, 13 aa, Mycobacterium
DRSSGIDLRETAD

SEQ ID NO: 456854 - protein, 11 aa, Mycobacterium
DRSSQRRGSPA

SEQ ID NO: 456855 - protein, 9 aa, Mycobacterium
DRSSRPHGC

SEQ ID NO: 456856 - protein, 4 aa, Mycobacterium
DRST

SEQ ID NO: 456857 - protein, 9 aa, Mycobacterium
DRSTAEAEE

SEQ ID NO: 456858 - protein, 8 aa, Mycobacterium
DRSTDETA

SEQ ID NO: 456859 - protein, 11 aa, Mycobacterium
DRSTGAAEAIE

SEQ ID NO: 456860 - protein, 10 aa, Mycobacterium
DRSTGAAQAV

SEQ ID NO: 456861 - protein, 6 aa, Mycobacterium
DRSTGG

SEQ ID NO: 456862 - protein, 23 aa, Mycobacterium
DRSTKKEVKQVKPTNSDVGSEVS

SEQ ID NO: 456863 - protein, 6 aa, Mycobacterium
DRSTSP

SEQ ID NO: 456864 - protein, 5 aa, Mycobacterium
DRSTV

SEQ ID NO: 456865 - protein, 7 aa, Mycobacterium
DRSTVER

SEQ ID NO: 456866 - protein, 4 aa, Mycobacterium
DRSV

SEQ ID NO: 456867 - protein, 11 aa, Mycobacterium
DRSVAARADEL

SEQ ID NO: 456868 - protein, 5 aa, Mycobacterium
DRSVP

SEQ ID NO: 456869 - protein, 6 aa, Mycobacterium
DRSVPD

SEQ ID NO: 456870 - protein, 7 aa, Mycobacterium
DRSVPNY

SEQ ID NO: 456871 - protein, 6 aa, Mycobacterium
DRTAAP

SEQ ID NO: 456872 - protein, 7 aa, Mycobacterium
DRTADQV

SEQ ID NO: 456873 - protein, 5 aa, Mycobacterium
DRTAE

SEQ ID NO: 456874 - protein, 6 aa, Mycobacterium
DRTAEK

SEQ ID NO: 456875 - protein, 16 aa, Mycobacterium
DRTAESILGYDDRGLP

SEQ ID NO: 456876 - protein, 6 aa, Mycobacterium
DRTAGL

SEQ ID NO: 456877 - protein, 10 aa, Mycobacterium
DRTALPQPQI

SEQ ID NO: 456878 - protein, 8 aa, Mycobacterium
DRTAPEPA

SEQ ID NO: 456879 - protein, 7 aa, Mycobacterium
DRTAPNV

SEQ ID NO: 456880 - protein, 8 aa, Mycobacterium
DRTAREQL

SEQ ID NO: 456881 - protein, 7 aa, Mycobacterium
DRTASGR

SEQ ID NO: 456882 - protein, 24 aa, Mycobacterium
DRTAVSPYGSGALAGSSLGLDPDA

SEQ ID NO: 456883 - protein, 7 aa, Mycobacterium
DRTDAPV

SEQ ID NO: 456884 - protein, 5 aa, Mycobacterium
DRTDG

SEQ ID NO: 456885 - protein, 6 aa, Mycobacterium
DRTDGD

SEQ ID NO: 456886 - protein, 8 aa, Mycobacterium
DRTDPARV

SEQ ID NO: 456887 - protein, 16 aa, Mycobacterium
DRTDTGHATADAQRRG

SEQ ID NO: 456888 - protein, 11 aa, Mycobacterium
DRTDTKPPRWP

SEQ ID NO: 456889 - protein, 4 aa, Mycobacterium
DRTE

SEQ ID NO: 456890 - protein, 6 aa, Mycobacterium
DRTEEA

SEQ ID NO: 456891 - protein, 8 aa, Mycobacterium
DRTEFGAR

SEQ ID NO: 456892 - protein, 5 aa, Mycobacterium
DRTEP

SEQ ID NO: 456893 - protein, 6 aa, Mycobacterium
DRTEQA

SEQ ID NO: 456894 - protein, 8 aa, Mycobacterium
DRTEQRQG

SEQ ID NO: 456895 - protein, 6 aa, Mycobacterium
DRTEVH

SEQ ID NO: 456896 - protein, 14 aa, Mycobacterium
DRTFDDPHEATDAI

SEQ ID NO: 456897 - protein, 11 aa, Mycobacterium
DRTFNDPHEAT

SEQ ID NO: 456898 - protein, 6 aa, Mycobacterium
DRTFPE

SEQ ID NO: 456899 - protein, 7 aa, Mycobacterium
DRTGAGA

SEQ ID NO: 456900 - protein, 12 aa, Mycobacterium
DRTGAPYASTVP

SEQ ID NO: 456901 - protein, 20 aa, Mycobacterium
DRTGAQLVGGESAANVGRGY

SEQ ID NO: 456902 - protein, 7 aa, Mycobacterium
DRTGDEQ

SEQ ID NO: 456903 - protein, 9 aa, Mycobacterium
DRTGDSATV

SEQ ID NO: 456904 - protein, 7 aa, Mycobacterium
DRTGEAL

SEQ ID NO: 456905 - protein, 9 aa, Mycobacterium
DRTGEGQHV

SEQ ID NO: 456906 - protein, 8 aa, Mycobacterium
DRTGEGQK

SEQ ID NO: 456907 - protein, 8 aa, Mycobacterium
DRTGEGRH

SEQ ID NO: 456908 - protein, 6 aa, Mycobacterium
DRTGGG

SEQ ID NO: 456909 - protein, 9 aa, Mycobacterium
DRTGGPRLD

SEQ ID NO: 456910 - protein, 6 aa, Mycobacterium
DRTGGR

SEQ ID NO: 456911 - protein, 7 aa, Mycobacterium
DRTGNGA

SEQ ID NO: 456912 - protein, 15 aa, Mycobacterium
DRTGPGLAAADEAAA

SEQ ID NO: 456913 - protein, 13 aa, Mycobacterium
DRTGQAQALRDKG

SEQ ID NO: 456914 - protein, 10 aa, Mycobacterium
DRTGSGPNGH

SEQ ID NO: 456915 - protein, 6 aa, Mycobacterium
DRTGSV

SEQ ID NO: 456916 - protein, 10 aa, Mycobacterium
DRTIPGPAGE

SEQ ID NO: 456917 - protein, 8 aa, Mycobacterium
DRTLDEAD

SEQ ID NO: 456918 - protein, 15 aa, Mycobacterium
DRTLGPLETAEQRES

SEQ ID NO: 456919 - protein, 6 aa, Mycobacterium
DRTLGR

SEQ ID NO: 456920 - protein, 12 aa, Mycobacterium
DRTLKDPHEATD

SEQ ID NO: 456921 - protein, 6 aa, Mycobacterium
DRTLSD

SEQ ID NO: 456922 - protein, 9 aa, Mycobacterium
DRTLSPLES

SEQ ID NO: 456923 - protein, 29 aa, Mycobacterium
DRTLTEDEASAARDAAVAAASERVGAVLR

SEQ ID NO: 456924 - protein, 13 aa, Mycobacterium
DRTLTEDEATAAR

SEQ ID NO: 456925 - protein, 15 aa, Mycobacterium
DRTLTEEEASAARDA

SEQ ID NO: 456926 - protein, 6 aa, Mycobacterium
DRTNQF

SEQ ID NO: 456927 - protein, 5 aa, Mycobacterium
DRTPA

SEQ ID NO: 456928 - protein, 6 aa, Mycobacterium
DRTPAL

SEQ ID NO: 456929 - protein, 6 aa, Mycobacterium
DRTPDA

SEQ ID NO: 456930 - protein, 7 aa, Mycobacterium
DRTPDEV

SEQ ID NO: 456931 - protein, 7 aa, Mycobacterium
DRTPFEP

SEQ ID NO: 456932 - protein, 5 aa, Mycobacterium
DRTPG

SEQ ID NO: 456933 - protein, 8 aa, Mycobacterium
DRTPGADR

SEQ ID NO: 456934 - protein, 6 aa, Mycobacterium
DRTPGF

SEQ ID NO: 456935 - protein, 8 aa, Mycobacterium
DRTPGGDG

SEQ ID NO: 456936 - protein, 15 aa, Mycobacterium
DRTPGGSSGGESAAI

SEQ ID NO: 456937 - protein, 9 aa, Mycobacterium
DRTPGNGQV

SEQ ID NO: 456938 - protein, 10 aa, Mycobacterium
DRTPGSADKM

SEQ ID NO: 456939 - protein, 8 aa, Mycobacterium
DRTPGYEH

SEQ ID NO: 456940 - protein, 7 aa, Mycobacterium
DRTPPRF

SEQ ID NO: 456941 - protein, 7 aa, Mycobacterium
DRTPQEL

SEQ ID NO: 456942 - protein, 7 aa, Mycobacterium
DRTPREL

SEQ ID NO: 456943 - protein, 8 aa, Mycobacterium
DRTPRELQ

SEQ ID NO: 456944 - protein, 14 aa, Mycobacterium
DRTPSGHREYPDTA

SEQ ID NO: 456945 - protein, 8 aa, Mycobacterium
DRTPTADR

SEQ ID NO: 456946 - protein, 6 aa, Mycobacterium
DRTPTR

SEQ ID NO: 456947 - protein, 7 aa, Mycobacterium
DRTQDGI

SEQ ID NO: 456948 - protein, 5 aa, Mycobacterium
DRTQL

SEQ ID NO: 456949 - protein, 8 aa, Mycobacterium
DRTQREGR

SEQ ID NO: 456950 - protein, 7 aa, Mycobacterium
DRTQRGK

SEQ ID NO: 456951 - protein, 10 aa, Mycobacterium
DRTRGRADTY

SEQ ID NO: 456952 - protein, 12 aa, Mycobacterium
DRTRGRADTYFD

SEQ ID NO: 456953 - protein, 6 aa, Mycobacterium
DRTRQP

SEQ ID NO: 456954 - protein, 10 aa, Mycobacterium
DRTRRYAPQG

SEQ ID NO: 456955 - protein, 6 aa, Mycobacterium
DRTRSL

SEQ ID NO: 456956 - protein, 4 aa, Mycobacterium
DRTS

SEQ ID NO: 456957 - protein, 10 aa, Mycobacterium
DRTSGRAQTY

SEQ ID NO: 456958 - protein, 12 aa, Mycobacterium
DRTSGRDDTYFD

SEQ ID NO: 456959 - protein, 11 aa, Mycobacterium
DRTSGRPDSYF

SEQ ID NO: 456960 - protein, 13 aa, Mycobacterium
DRTSPSRSGIDEA

SEQ ID NO: 456961 - protein, 7 aa, Mycobacterium
DRTSTQF

SEQ ID NO: 456962 - protein, 6 aa, Mycobacterium
DRTTPK

SEQ ID NO: 456963 - protein, 5 aa, Mycobacterium
DRTTW

SEQ ID NO: 456964 - protein, 5 aa, Mycobacterium
DRTVE

SEQ ID NO: 456965 - protein, 26 aa, Mycobacterium
DRTVGPVDRQARSEYDGRIERQVEAA

SEQ ID NO: 456966 - protein, 4 aa, Mycobacterium
DRTY

SEQ ID NO: 456967 - protein, 10 aa, Mycobacterium
DRTYKPPPDQ

SEQ ID NO: 456968 - protein, 11 aa, Mycobacterium
DRTYKPPPDQC

SEQ ID NO: 456969 - protein, 16 aa, Mycobacterium
DRTYRAPDGETELTLP

SEQ ID NO: 456970 - protein, 6 aa, Mycobacterium
DRTYRD

SEQ ID NO: 456971 - protein, 16 aa, Mycobacterium
DRTYSTPDGEGELTLP

SEQ ID NO: 456972 - protein, 11 aa, Mycobacterium
DRTYTAPHGGE

SEQ ID NO: 456973 - protein, 16 aa, Mycobacterium
DRTYTTPDGAGELTLP

SEQ ID NO: 456974 - protein, 15 aa, Mycobacterium
DRTYTTPDGGELTLP

SEQ ID NO: 456975 - protein, 4 aa, Mycobacterium
DRVA

SEQ ID NO: 456976 - protein, 5 aa, Mycobacterium
DRVAR

SEQ ID NO: 456977 - protein, 5 aa, Mycobacterium
DRVDG

SEQ ID NO: 456978 - protein, 8 aa, Mycobacterium
DRVDPAPV

SEQ ID NO: 456979 - protein, 6 aa, Mycobacterium
DRVDPR

SEQ ID NO: 456980 - protein, 10 aa, Mycobacterium
DRVEAGAESG

SEQ ID NO: 456981 - protein, 10 aa, Mycobacterium
DRVEAGAQSS

SEQ ID NO: 456982 - protein, 9 aa, Mycobacterium
DRVEAGDQA

SEQ ID NO: 456983 - protein, 4 aa, Mycobacterium
DRVG

SEQ ID NO: 456984 - protein, 13 aa, Mycobacterium
DRVGAGGVVSDPQ

SEQ ID NO: 456985 - protein, 6 aa, Mycobacterium
DRVGAL

SEQ ID NO: 456986 - protein, 9 aa, Mycobacterium
DRVGDKGPP

SEQ ID NO: 456987 - protein, 9 aa, Mycobacterium
DRVGDVRGR

SEQ ID NO: 456988 - protein, 8 aa, Mycobacterium
DRVGEEST

SEQ ID NO: 456989 - protein, 7 aa, Mycobacterium
DRVGGIP

SEQ ID NO: 456990 - protein, 8 aa, Mycobacterium
DRVGGMSR

SEQ ID NO: 456991 - protein, 12 aa, Mycobacterium
DRVGGRSLTGNV

SEQ ID NO: 456992 - protein, 12 aa, Mycobacterium
DRVGGRSLTGSV

SEQ ID NO: 456993 - protein, 17 aa, Mycobacterium
DRVGGRTFTETRPDGTW

SEQ ID NO: 456994 - protein, 7 aa, Mycobacterium
DRVGGRV

SEQ ID NO: 456995 - protein, 7 aa, Mycobacterium
DRVGGTW

SEQ ID NO: 456996 - protein, 6 aa, Mycobacterium
DRVGGV

SEQ ID NO: 456997 - protein, 7 aa, Mycobacterium
DRVGKRG

SEQ ID NO: 456998 - protein, 20 aa, Mycobacterium
DRVGSGEWPVDDNPLRGAPH

SEQ ID NO: 456999 - protein, 8 aa, Mycobacterium
DRVHGSPR

SEQ ID NO: 457000 - protein, 4 aa, Mycobacterium
DRVL

SEQ ID NO: 457001 - protein, 11 aa, Mycobacterium
DRVNVSGSGCS

SEQ ID NO: 457002 - protein, 4 aa, Mycobacterium
DRVP

SEQ ID NO: 457003 - protein, 13 aa, Mycobacterium
DRVPADDPNPEQI

SEQ ID NO: 457004 - protein, 13 aa, Mycobacterium
DRVPATDPDPEQI

SEQ ID NO: 457005 - protein, 8 aa, Mycobacterium
DRVPDDLR

SEQ ID NO: 457006 - protein, 12 aa, Mycobacterium
DRVPDDLRDEAK

SEQ ID NO: 457007 - protein, 12 aa, Mycobacterium
DRVPDDLRDQAK

SEQ ID NO: 457008 - protein, 10 aa, Mycobacterium
DRVPDPPGGL

SEQ ID NO: 457009 - protein, 15 aa, Mycobacterium
DRVPGISSPGAIPGI

SEQ ID NO: 457010 - protein, 17 aa, Mycobacterium
DRVPRTYPAGTDGPVDA

SEQ ID NO: 457011 - protein, 19 aa, Mycobacterium
DRVPSEHPRYSGRPNTWGQ

SEQ ID NO: 457012 - protein, 7 aa, Mycobacterium
DRVQGAD

SEQ ID NO: 457013 - protein, 8 aa, Mycobacterium
DRVQGGQP

SEQ ID NO: 457014 - protein, 6 aa, Mycobacterium
DRVRPG

SEQ ID NO: 457015 - protein, 10 aa, Mycobacterium
DRVRQRADGT

SEQ ID NO: 457016 - protein, 10 aa, Mycobacterium
DRVRQRPDGT

SEQ ID NO: 457017 - protein, 7 aa, Mycobacterium
DRVSADP

SEQ ID NO: 457018 - protein, 6 aa, Mycobacterium
DRVSGD

SEQ ID NO: 457019 - protein, 7 aa, Mycobacterium
DRVSGEE

SEQ ID NO: 457020 - protein, 8 aa, Mycobacterium
DRVSHDKY

SEQ ID NO: 457021 - protein, 9 aa, Mycobacterium
DRVSPRTPA

SEQ ID NO: 457022 - protein, 10 aa, Mycobacterium
DRVSRKPEVQ

SEQ ID NO: 457023 - protein, 7 aa, Mycobacterium
DRVSVDN

SEQ ID NO: 457024 - protein, 6 aa, Mycobacterium
DRVTAE

SEQ ID NO: 457025 - protein, 13 aa, Mycobacterium
DRVTGTVRRTRTH

SEQ ID NO: 457026 - protein, 5 aa, Mycobacterium
DRVTH

SEQ ID NO: 457027 - protein, 12 aa, Mycobacterium
DRVTPETVQPRP

SEQ ID NO: 457028 - protein, 5 aa, Mycobacterium
DRVTR

SEQ ID NO: 457029 - protein, 12 aa, Mycobacterium
DRWAPGYAEAGA

SEQ ID NO: 457030 - protein, 5 aa, Mycobacterium
DRWDA

SEQ ID NO: 457031 - protein, 6 aa, Mycobacterium
DRWNTT

SEQ ID NO: 457032 - protein, 5 aa, Mycobacterium
DRWPQ

SEQ ID NO: 457033 - protein, 8 aa, Mycobacterium
DRWPRQPG

SEQ ID NO: 457034 - protein, 12 aa, Mycobacterium
DRWRDRGGTRLT

SEQ ID NO: 457035 - protein, 7 aa, Mycobacterium
DRWTPPP

SEQ ID NO: 457036 - protein, 5 aa, Mycobacterium
DRYAG

SEQ ID NO: 457037 - protein, 5 aa, Mycobacterium
DRYAQ

SEQ ID NO: 457038 - protein, 5 aa, Mycobacterium
DRYAR

SEQ ID NO: 457039 - protein, 10 aa, Mycobacterium
DRYASGAARD

SEQ ID NO: 457040 - protein, 11 aa, Mycobacterium
DRYDGAVATGE

SEQ ID NO: 457041 - protein, 9 aa, Mycobacterium
DRYDGSRPE

SEQ ID NO: 457042 - protein, 18 aa, Mycobacterium
DRYDPARTLATGQVIRTV

SEQ ID NO: 457043 - protein, 12 aa, Mycobacterium
DRYEPGKSEEAL

SEQ ID NO: 457044 - protein, 10 aa, Mycobacterium
DRYEQEVDTT

SEQ ID NO: 457045 - protein, 13 aa, Mycobacterium
DRYERGDEEAAER

SEQ ID NO: 457046 - protein, 4 aa, Mycobacterium
DRYG

SEQ ID NO: 457047 - protein, 20 aa, Mycobacterium
DRYGPPPALPAQQQPYSPPE

SEQ ID NO: 457048 - protein, 15 aa, Mycobacterium
DRYPAQLSGGQQQRV

SEQ ID NO: 457049 - protein, 13 aa, Mycobacterium
DRYPDELSGGQAQ

SEQ ID NO: 457050 - protein, 5 aa, Mycobacterium
DRYPG

SEQ ID NO: 457051 - protein, 8 aa, Mycobacterium
DRYPQANR

SEQ ID NO: 457052 - protein, 14 aa, Mycobacterium
DRYPRELSGGQQQR

SEQ ID NO: 457053 - protein, 6 aa, Mycobacterium
DRYPSH

SEQ ID NO: 457054 - protein, 5 aa, Mycobacterium
DRYPT

SEQ ID NO: 457055 - protein, 6 aa, Mycobacterium
DRYRKG

SEQ ID NO: 457056 - protein, 11 aa, Mycobacterium
DRYRPGSLAQS

SEQ ID NO: 457057 - protein, 14 aa, Mycobacterium
DRYSMGTETDSGRH

SEQ ID NO: 457058 - protein, 7 aa, Mycobacterium
DRYTPDL

SEQ ID NO: 457059 - protein, 13 aa, Mycobacterium
DRYTSREYAERER

SEQ ID NO: 457060 - protein, 13 aa, Mycobacterium
DSAAALPPTPRRA

SEQ ID NO: 457061 - protein, 32 aa, Mycobacterium
DSAAAQGIAENDRVHSATRTPERKPWPPRRPV

SEQ ID NO: 457062 - protein, 8 aa, Mycobacterium
DSAAEALR

SEQ ID NO: 457063 - protein, 7 aa, Mycobacterium
DSAAEEL

SEQ ID NO: 457064 - protein, 9 aa, Mycobacterium
DSAAEPPAT

SEQ ID NO: 457065 - protein, 7 aa, Mycobacterium
DSAAEYA

SEQ ID NO: 457066 - protein, 17 aa, Mycobacterium
DSAAGALPGLDRPAAAE

SEQ ID NO: 457067 - protein, 15 aa, Mycobacterium
DSAAGALPGLSRPAA

SEQ ID NO: 457068 - protein, 10 aa, Mycobacterium
DSAAGPTGST

SEQ ID NO: 457069 - protein, 8 aa, Mycobacterium
DSAAGSFE

SEQ ID NO: 457070 - protein, 7 aa, Mycobacterium
DSAAGWE

SEQ ID NO: 457071 - protein, 19 aa, Mycobacterium
DSAAKKGNSTLYATGSEPG

SEQ ID NO: 457072 - protein, 7 aa, Mycobacterium
DSAANDY

SEQ ID NO: 457073 - protein, 20 aa, Mycobacterium
DSAAPADAPAAAPADAATAS

SEQ ID NO: 457074 - protein, 10 aa, Mycobacterium
DSAAPPAYDQ

SEQ ID NO: 457075 - protein, 17 aa, Mycobacterium
DSAAQPSEDATADVAGS

SEQ ID NO: 457076 - protein, 6 aa, Mycobacterium
DSAARA

SEQ ID NO: 457077 - protein, 12 aa, Mycobacterium
DSAARDKQLNEG

SEQ ID NO: 457078 - protein, 12 aa, Mycobacterium
DSAARGKHLNEG

SEQ ID NO: 457079 - protein, 16 aa, Mycobacterium
DSAASGPGINDNGSGV

SEQ ID NO: 457080 - protein, 10 aa, Mycobacterium
DSAASRVDDG

SEQ ID NO: 457081 - protein, 11 aa, Mycobacterium
DSAASTGPPHQ

SEQ ID NO: 457082 - protein, 7 aa, Mycobacterium
DSAASYI

SEQ ID NO: 457083 - protein, 7 aa, Mycobacterium
DSAATAY

SEQ ID NO: 457084 - protein, 13 aa, Mycobacterium
DSAATGDTTSGVV

SEQ ID NO: 457085 - protein, 6 aa, Mycobacterium
DSAATH

SEQ ID NO: 457086 - protein, 6 aa, Mycobacterium
DSAATI

SEQ ID NO: 457087 - protein, 7 aa, Mycobacterium
DSAATSY

SEQ ID NO: 457088 - protein, 6 aa, Mycobacterium
DSADAA

SEQ ID NO: 457089 - protein, 10 aa, Mycobacterium
DSADADGPIV

SEQ ID NO: 457090 - protein, 8 aa, Mycobacterium
DSADDAAT

SEQ ID NO: 457091 - protein, 7 aa, Mycobacterium
DSADDDA

SEQ ID NO: 457092 - protein, 9 aa, Mycobacterium
DSADEARQI

SEQ ID NO: 457093 - protein, 10 aa, Mycobacterium
DSADEARTIG

SEQ ID NO: 457094 - protein, 9 aa, Mycobacterium
DSADGGASW

SEQ ID NO: 457095 - protein, 5 aa, Mycobacterium
DSADI

SEQ ID NO: 457096 - protein, 6 aa, Mycobacterium
DSADID

SEQ ID NO: 457097 - protein, 8 aa, Mycobacterium
DSADPSAQ

SEQ ID NO: 457098 - protein, 59 aa, Mycobacterium
DSADQADPETDASSDEPGDRDGDGGTDAATAEDPSASAGPTTVTLPDGETVTAASPQLA

SEQ ID NO: 457099 - protein, 7 aa, Mycobacterium
DSADQAL

SEQ ID NO: 457100 - protein, 8 aa, Mycobacterium
DSADQIGE

SEQ ID NO: 457101 - protein, 9 aa, Mycobacterium
DSADQRAAL

SEQ ID NO: 457102 - protein, 5 aa, Mycobacterium
DSADT

SEQ ID NO: 457103 - protein, 5 aa, Mycobacterium
DSADV

SEQ ID NO: 457104 - protein, 4 aa, Mycobacterium
DSAE

SEQ ID NO: 457105 - protein, 6 aa, Mycobacterium
DSAEAQ

SEQ ID NO: 457106 - protein, 8 aa, Mycobacterium
DSAEARGR

SEQ ID NO: 457107 - protein, 5 aa, Mycobacterium
DSAEG

SEQ ID NO: 457108 - protein, 59 aa, Mycobacterium
DSAEGGSGAGGSQAAPQAPSEPEPQAESTPPAQPEPEPQAAAPEPEPARPSSGGGDATP

SEQ ID NO: 457109 - protein, 23 aa, Mycobacterium
DSAEIEPSASGTTVKLEWRGITR

SEQ ID NO: 457110 - protein, 6 aa, Mycobacterium
DSAELA

SEQ ID NO: 457111 - protein, 6 aa, Mycobacterium
DSAEMQ

SEQ ID NO: 457112 - protein, 10 aa, Mycobacterium
DSAEPDAPSS

SEQ ID NO: 457113 - protein, 8 aa, Mycobacterium
DSAERERA

SEQ ID NO: 457114 - protein, 6 aa, Mycobacterium
DSAERL

SEQ ID NO: 457115 - protein, 15 aa, Mycobacterium
DSAETQALQSMPGDA

SEQ ID NO: 457116 - protein, 5 aa, Mycobacterium
DSAFE

SEQ ID NO: 457117 - protein, 6 aa, Mycobacterium
DSAFGI

SEQ ID NO: 457118 - protein, 9 aa, Mycobacterium
DSAGAADVT

SEQ ID NO: 457119 - protein, 8 aa, Mycobacterium
DSAGARIQ

SEQ ID NO: 457120 - protein, 7 aa, Mycobacterium
DSAGASI

SEQ ID NO: 457121 - protein, 5 aa, Mycobacterium
DSAGD

SEQ ID NO: 457122 - protein, 15 aa, Mycobacterium
DSAGDLGDWAGPDAL

SEQ ID NO: 457123 - protein, 9 aa, Mycobacterium
DSAGDQGGR

SEQ ID NO: 457124 - protein, 10 aa, Mycobacterium
DSAGEDPHVT

SEQ ID NO: 457125 - protein, 7 aa, Mycobacterium
DSAGEPY

SEQ ID NO: 457126 - protein, 10 aa, Mycobacterium
DSAGEQQRQE

SEQ ID NO: 457127 - protein, 6 aa, Mycobacterium
DSAGEV

SEQ ID NO: 457128 - protein, 8 aa, Mycobacterium
DSAGFDAQ

SEQ ID NO: 457129 - protein, 7 aa, Mycobacterium
DSAGGAL

SEQ ID NO: 457130 - protein, 8 aa, Mycobacterium
DSAGGALA

SEQ ID NO: 457131 - protein, 6 aa, Mycobacterium
DSAGGF

SEQ ID NO: 457132 - protein, 6 aa, Mycobacterium
DSAGGG

SEQ ID NO: 457133 - protein, 23 aa, Mycobacterium
DSAGGGAGGGGGARRAGSPRAGH

SEQ ID NO: 457134 - protein, 7 aa, Mycobacterium
DSAGGGL

SEQ ID NO: 457135 - protein, 7 aa, Mycobacterium
DSAGGNL

SEQ ID NO: 457136 - protein, 8 aa, Mycobacterium
DSAGGPVL

SEQ ID NO: 457137 - protein, 8 aa, Mycobacterium
DSAGGSLS

SEQ ID NO: 457138 - protein, 17 aa, Mycobacterium
DSAGKRSAARRPVSGAD

SEQ ID NO: 457139 - protein, 10 aa, Mycobacterium
DSAGLPDTPL

SEQ ID NO: 457140 - protein, 6 aa, Mycobacterium
DSAGLS

SEQ ID NO: 457141 - protein, 8 aa, Mycobacterium
DSAGLTPV

SEQ ID NO: 457142 - protein, 6 aa, Mycobacterium
DSAGMQ

SEQ ID NO: 457143 - protein, 10 aa, Mycobacterium
DSAGNATVDE

SEQ ID NO: 457144 - protein, 10 aa, Mycobacterium
DSAGNRDVDE

SEQ ID NO: 457145 - protein, 10 aa, Mycobacterium
DSAGPKDVAG

SEQ ID NO: 457146 - protein, 7 aa, Mycobacterium
DSAGPSL

SEQ ID NO: 457147 - protein, 30 aa, Mycobacterium
DSAGPSRKPVVSPSQAQTQPIASARAGKVT

SEQ ID NO: 457148 - protein, 7 aa, Mycobacterium
DSAGRIT

SEQ ID NO: 457149 - protein, 10 aa, Mycobacterium
DSAGRTRTAS

SEQ ID NO: 457150 - protein, 17 aa, Mycobacterium
DSAGSDSVDGGAQSAAR

SEQ ID NO: 457151 - protein, 9 aa, Mycobacterium
DSAGSSRNY

SEQ ID NO: 457152 - protein, 12 aa, Mycobacterium
DSAGSWPTRAGG

SEQ ID NO: 457153 - protein, 6 aa, Mycobacterium
DSAGTL

SEQ ID NO: 457154 - protein, 7 aa, Mycobacterium
DSAGTLE

SEQ ID NO: 457155 - protein, 6 aa, Mycobacterium
DSAGVA

SEQ ID NO: 457156 - protein, 12 aa, Mycobacterium
DSAGVEPTKDDR

SEQ ID NO: 457157 - protein, 18 aa, Mycobacterium
DSAHADAHTHDPQTTAGD

SEQ ID NO: 457158 - protein, 7 aa, Mycobacterium
DSAHAST

SEQ ID NO: 457159 - protein, 7 aa, Mycobacterium
DSAHVPD

SEQ ID NO: 457160 - protein, 7 aa, Mycobacterium
DSAIDTT

SEQ ID NO: 457161 - protein, 11 aa, Mycobacterium
DSAISEPASTA

SEQ ID NO: 457162 - protein, 7 aa, Mycobacterium
DSAKEHF

SEQ ID NO: 457163 - protein, 8 aa, Mycobacterium
DSAKGADL

SEQ ID NO: 457164 - protein, 13 aa, Mycobacterium
DSAKGADLAETPY

SEQ ID NO: 457165 - protein, 7 aa, Mycobacterium
DSAKGEH

SEQ ID NO: 457166 - protein, 13 aa, Mycobacterium
DSAKGGDLAATPY

SEQ ID NO: 457167 - protein, 13 aa, Mycobacterium
DSAKGRQLAATPY

SEQ ID NO: 457168 - protein, 7 aa, Mycobacterium
DSAKGYD

SEQ ID NO: 457169 - protein, 8 aa, Mycobacterium
DSAKLTDL

SEQ ID NO: 457170 - protein, 12 aa, Mycobacterium
DSAKREGRPSDP

SEQ ID NO: 457171 - protein, 7 aa, Mycobacterium
DSAKSYD

SEQ ID NO: 457172 - protein, 6 aa, Mycobacterium
DSALRT

SEQ ID NO: 457173 - protein, 5 aa, Mycobacterium
DSANP

SEQ ID NO: 457174 - protein, 5 aa, Mycobacterium
DSANT

SEQ ID NO: 457175 - protein, 5 aa, Mycobacterium
DSAPA

SEQ ID NO: 457176 - protein, 10 aa, Mycobacterium
DSAPAEPVRE

SEQ ID NO: 457177 - protein, 7 aa, Mycobacterium
DSAPEGD

SEQ ID NO: 457178 - protein, 8 aa, Mycobacterium
DSAPEGTV

SEQ ID NO: 457179 - protein, 8 aa, Mycobacterium
DSAPEHYE

SEQ ID NO: 457180 - protein, 10 aa, Mycobacterium
DSAPGDPIDP

SEQ ID NO: 457181 - protein, 25 aa, Mycobacterium
DSAPKACCTPPGPADPSVSQTLKGG

SEQ ID NO: 457182 - protein, 14 aa, Mycobacterium
DSAPLPSFDGVGQA

SEQ ID NO: 457183 - protein, 5 aa, Mycobacterium
DSAPN

SEQ ID NO: 457184 - protein, 9 aa, Mycobacterium
DSAPNFGSS

SEQ ID NO: 457185 - protein, 10 aa, Mycobacterium
DSAPPARAGS

SEQ ID NO: 457186 - protein, 7 aa, Mycobacterium
DSAPPRW

SEQ ID NO: 457187 - protein, 13 aa, Mycobacterium
DSAPPTPEAARAF

SEQ ID NO: 457188 - protein, 8 aa, Mycobacterium
DSAPQGTS

SEQ ID NO: 457189 - protein, 7 aa, Mycobacterium
DSAPREY

SEQ ID NO: 457190 - protein, 8 aa, Mycobacterium
DSAPSRAA

SEQ ID NO: 457191 - protein, 9 aa, Mycobacterium
DSAPSRAAA

SEQ ID NO: 457192 - protein, 7 aa, Mycobacterium
DSAPTDF

SEQ ID NO: 457193 - protein, 7 aa, Mycobacterium
DSAPVDD

SEQ ID NO: 457194 - protein, 5 aa, Mycobacterium
DSAPW

SEQ ID NO: 457195 - protein, 12 aa, Mycobacterium
DSAQPEQAAANG

SEQ ID NO: 457196 - protein, 9 aa, Mycobacterium
DSAQPGTYD

SEQ ID NO: 457197 - protein, 12 aa, Mycobacterium
DSAQPREDEEES

SEQ ID NO: 457198 - protein, 8 aa, Mycobacterium
DSAQSPVS

SEQ ID NO: 457199 - protein, 4 aa, Mycobacterium
DSAR

SEQ ID NO: 457200 - protein, 7 aa, Mycobacterium
DSARAGI

SEQ ID NO: 457201 - protein, 13 aa, Mycobacterium
DSARDGTAVTPAS

SEQ ID NO: 457202 - protein, 6 aa, Mycobacterium
DSARDR

SEQ ID NO: 457203 - protein, 9 aa, Mycobacterium
DSARDTGRD

SEQ ID NO: 457204 - protein, 7 aa, Mycobacterium
DSARGFT

SEQ ID NO: 457205 - protein, 10 aa, Mycobacterium
DSARKPRSEV

SEQ ID NO: 457206 - protein, 5 aa, Mycobacterium
DSARL

SEQ ID NO: 457207 - protein, 8 aa, Mycobacterium
DSARQTAA

SEQ ID NO: 457208 - protein, 6 aa, Mycobacterium
DSARRA

SEQ ID NO: 457209 - protein, 13 aa, Mycobacterium
DSARRYAADPSAR

SEQ ID NO: 457210 - protein, 4 aa, Mycobacterium
DSAS

SEQ ID NO: 457211 - protein, 6 aa, Mycobacterium
DSASAA

SEQ ID NO: 457212 - protein, 28 aa, Mycobacterium
DSASAADARADEAVTPGADEPAAEELEG

SEQ ID NO: 457213 - protein, 9 aa, Mycobacterium
DSASAGRDH

SEQ ID NO: 457214 - protein, 9 aa, Mycobacterium
DSASDEGPL

SEQ ID NO: 457215 - protein, 12 aa, Mycobacterium
DSASDSIAIPQG

SEQ ID NO: 457216 - protein, 6 aa, Mycobacterium
DSASGP

SEQ ID NO: 457217 - protein, 8 aa, Mycobacterium
DSASGPQV

SEQ ID NO: 457218 - protein, 7 aa, Mycobacterium
DSASGRL

SEQ ID NO: 457219 - protein, 8 aa, Mycobacterium
DSASGRTT

SEQ ID NO: 457220 - protein, 15 aa, Mycobacterium
DSASGSSAGDDNHPS

SEQ ID NO: 457221 - protein, 6 aa, Mycobacterium
DSASLD

SEQ ID NO: 457222 - protein, 6 aa, Mycobacterium
DSASNR

SEQ ID NO: 457223 - protein, 5 aa, Mycobacterium
DSASR

SEQ ID NO: 457224 - protein, 8 aa, Mycobacterium
DSASRMNR

SEQ ID NO: 457225 - protein, 8 aa, Mycobacterium
DSASSLKV

SEQ ID NO: 457226 - protein, 9 aa, Mycobacterium
DSASTMRPI

SEQ ID NO: 457227 - protein, 6 aa, Mycobacterium
DSASVE

SEQ ID NO: 457228 - protein, 7 aa, Mycobacterium
DSASVEH

SEQ ID NO: 457229 - protein, 5 aa, Mycobacterium
DSATA

SEQ ID NO: 457230 - protein, 8 aa, Mycobacterium
DSATARRL

SEQ ID NO: 457231 - protein, 6 aa, Mycobacterium
DSATDE

SEQ ID NO: 457232 - protein, 7 aa, Mycobacterium
DSATDGD

SEQ ID NO: 457233 - protein, 19 aa, Mycobacterium
DSATGGDSESGGRSPKQIS

SEQ ID NO: 457234 - protein, 8 aa, Mycobacterium
DSATGGRI

SEQ ID NO: 457235 - protein, 7 aa, Mycobacterium
DSATGKP

SEQ ID NO: 457236 - protein, 8 aa, Mycobacterium
DSATGRIP

SEQ ID NO: 457237 - protein, 6 aa, Mycobacterium
DSATIS

SEQ ID NO: 457238 - protein, 9 aa, Mycobacterium
DSATLDDAH

SEQ ID NO: 457239 - protein, 10 aa, Mycobacterium
DSATLDDEHR

SEQ ID NO: 457240 - protein, 4 aa, Mycobacterium
DSAV

SEQ ID NO: 457241 - protein, 8 aa, Mycobacterium
DSAVERDS

SEQ ID NO: 457242 - protein, 5 aa, Mycobacterium
DSAVP

SEQ ID NO: 457243 - protein, 8 aa, Mycobacterium
DSAVSQGR

SEQ ID NO: 457244 - protein, 16 aa, Mycobacterium
DSAVTRAAADATPKYV

SEQ ID NO: 457245 - protein, 6 aa, Mycobacterium
DSAYGL

SEQ ID NO: 457246 - protein, 13 aa, Mycobacterium
DSAYGTGKARAAY

SEQ ID NO: 457247 - protein, 8 aa, Mycobacterium
DSAYSSDK

SEQ ID NO: 457248 - protein, 7 aa, Mycobacterium
DSCETSC

SEQ ID NO: 457249 - protein, 8 aa, Mycobacterium
DSCGPAGR

SEQ ID NO: 457250 - protein, 6 aa, Mycobacterium
DSCSGH

SEQ ID NO: 457251 - protein, 7 aa, Mycobacterium
DSDADVR

SEQ ID NO: 457252 - protein, 14 aa, Mycobacterium
DSDADVRAGRAAGA

SEQ ID NO: 457253 - protein, 5 aa, Mycobacterium
DSDAG

SEQ ID NO: 457254 - protein, 8 aa, Mycobacterium
DSDAGKQV

SEQ ID NO: 457255 - protein, 10 aa, Mycobacterium
DSDAGPKNGW

SEQ ID NO: 457256 - protein, 5 aa, Mycobacterium
DSDAK

SEQ ID NO: 457257 - protein, 9 aa, Mycobacterium
DSDAPGGAG

SEQ ID NO: 457258 - protein, 16 aa, Mycobacterium
DSDATVPFEGSGKRTY

SEQ ID NO: 457259 - protein, 8 aa, Mycobacterium
DSDAVGGA

SEQ ID NO: 457260 - protein, 9 aa, Mycobacterium
DSDAVSERI

SEQ ID NO: 457261 - protein, 6 aa, Mycobacterium
DSDAYT

SEQ ID NO: 457262 - protein, 5 aa, Mycobacterium
DSDDA

SEQ ID NO: 457263 - protein, 14 aa, Mycobacterium
DSDDDASDAGEPRV

SEQ ID NO: 457264 - protein, 6 aa, Mycobacterium
DSDDDW

SEQ ID NO: 457265 - protein, 10 aa, Mycobacterium
DSDDEEFGEE

SEQ ID NO: 457266 - protein, 10 aa, Mycobacterium
DSDDPDVAEE

SEQ ID NO: 457267 - protein, 9 aa, Mycobacterium
DSDDPHKVA

SEQ ID NO: 457268 - protein, 10 aa, Mycobacterium
DSDDPTAPAL

SEQ ID NO: 457269 - protein, 16 aa, Mycobacterium
DSDDSNVPAPSYPPEL

SEQ ID NO: 457270 - protein, 11 aa, Mycobacterium
DSDDTETSGVS

SEQ ID NO: 457271 - protein, 7 aa, Mycobacterium
DSDDTKM

SEQ ID NO: 457272 - protein, 10 aa, Mycobacterium
DSDDVRQAVD

SEQ ID NO: 457273 - protein, 11 aa, Mycobacterium
DSDEADGGARA

SEQ ID NO: 457274 - protein, 6 aa, Mycobacterium
DSDEAV

SEQ ID NO: 457275 - protein, 9 aa, Mycobacterium
DSDEDETAW

SEQ ID NO: 457276 - protein, 9 aa, Mycobacterium
DSDEEARRR

SEQ ID NO: 457277 - protein, 12 aa, Mycobacterium
DSDEERDKQREV

SEQ ID NO: 457278 - protein, 13 aa, Mycobacterium
DSDEERDRQREAV

SEQ ID NO: 457279 - protein, 10 aa, Mycobacterium
DSDEGWATGR

SEQ ID NO: 457280 - protein, 10 aa, Mycobacterium
DSDEIPDDGA

SEQ ID NO: 457281 - protein, 10 aa, Mycobacterium
DSDEIPEDGA

SEQ ID NO: 457282 - protein, 6 aa, Mycobacterium
DSDELG

SEQ ID NO: 457283 - protein, 11 aa, Mycobacterium
DSDEPGRDERK

SEQ ID NO: 457284 - protein, 7 aa, Mycobacterium
DSDEPLA

SEQ ID NO: 457285 - protein, 5 aa, Mycobacterium
DSDEQ

SEQ ID NO: 457286 - protein, 7 aa, Mycobacterium
DSDERLP

SEQ ID NO: 457287 - protein, 5 aa, Mycobacterium
DSDFP

SEQ ID NO: 457288 - protein, 13 aa, Mycobacterium
DSDGAPSPQATPQ

SEQ ID NO: 457289 - protein, 6 aa, Mycobacterium
DSDGAV

SEQ ID NO: 457290 - protein, 8 aa, Mycobacterium
DSDGDGLA

SEQ ID NO: 457291 - protein, 13 aa, Mycobacterium
DSDGDGRADSAAP

SEQ ID NO: 457292 - protein, 13 aa, Mycobacterium
DSDGEAVAAELGD

SEQ ID NO: 457293 - protein, 6 aa, Mycobacterium
DSDGFA

SEQ ID NO: 457294 - protein, 11 aa, Mycobacterium
DSDGHSPKRDR

SEQ ID NO: 457295 - protein, 7 aa, Mycobacterium
DSDGHVR

SEQ ID NO: 457296 - protein, 9 aa, Mycobacterium
DSDGIDATN

SEQ ID NO: 457297 - protein, 17 aa, Mycobacterium
DSDGKVSAARRPVEGAD

SEQ ID NO: 457298 - protein, 9 aa, Mycobacterium
DSDGKYLGK

SEQ ID NO: 457299 - protein, 8 aa, Mycobacterium
DSDGNGGG

SEQ ID NO: 457300 - protein, 37 aa, Mycobacterium
DSDGPESPRIDAEEKRDPTATGKRSSAHARAARPQFP

SEQ ID NO: 457301 - protein, 7 aa, Mycobacterium
DSDGPVK

SEQ ID NO: 457302 - protein, 6 aa, Mycobacterium
DSDGQI

SEQ ID NO: 457303 - protein, 7 aa, Mycobacterium
DSDGRYL

SEQ ID NO: 457304 - protein, 9 aa, Mycobacterium
DSDGSAIEG

SEQ ID NO: 457305 - protein, 6 aa, Mycobacterium
DSDGSR

SEQ ID NO: 457306 - protein, 6 aa, Mycobacterium
DSDGSV

SEQ ID NO: 457307 - protein, 9 aa, Mycobacterium
DSDGVDDQA

SEQ ID NO: 457308 - protein, 9 aa, Mycobacterium
DSDGVDEQA

SEQ ID NO: 457309 - protein, 12 aa, Mycobacterium
DSDGVPSSLSDS

SEQ ID NO: 457310 - protein, 5 aa, Mycobacterium
DSDGY

SEQ ID NO: 457311 - protein, 13 aa, Mycobacterium
DSDHSINRLRLRK

SEQ ID NO: 457312 - protein, 11 aa, Mycobacterium
DSDKGAAGKMY

SEQ ID NO: 457313 - protein, 8 aa, Mycobacterium
DSDKPAEI

SEQ ID NO: 457314 - protein, 4 aa, Mycobacterium
DSDL

SEQ ID NO: 457315 - protein, 6 aa, Mycobacterium
DSDLAG

SEQ ID NO: 457316 - protein, 5 aa, Mycobacterium
DSDLD

SEQ ID NO: 457317 - protein, 8 aa, Mycobacterium
DSDLGQEE

SEQ ID NO: 457318 - protein, 10 aa, Mycobacterium
DSDLPDGSVD

SEQ ID NO: 457319 - protein, 20 aa, Mycobacterium
DSDLTGNRAQRRASGNRSRH

SEQ ID NO: 457320 - protein, 5 aa, Mycobacterium
DSDMD

SEQ ID NO: 457321 - protein, 7 aa, Mycobacterium
DSDNDFP

SEQ ID NO: 457322 - protein, 8 aa, Mycobacterium
DSDNGSEF

SEQ ID NO: 457323 - protein, 11 aa, Mycobacterium
DSDNPVPPGTV

SEQ ID NO: 457324 - protein, 8 aa, Mycobacterium
DSDNSGKL

SEQ ID NO: 457325 - protein, 16 aa, Mycobacterium
DSDPDESGKTPGTDLR

SEQ ID NO: 457326 - protein, 6 aa, Mycobacterium
DSDPFY

SEQ ID NO: 457327 - protein, 6 aa, Mycobacterium
DSDPHV

SEQ ID NO: 457328 - protein, 7 aa, Mycobacterium
DSDPIHP

SEQ ID NO: 457329 - protein, 5 aa, Mycobacterium
DSDPK

SEQ ID NO: 457330 - protein, 11 aa, Mycobacterium
DSDPNKVGRQF

SEQ ID NO: 457331 - protein, 7 aa, Mycobacterium
DSDPQEW

SEQ ID NO: 457332 - protein, 7 aa, Mycobacterium
DSDPQQW

SEQ ID NO: 457333 - protein, 7 aa, Mycobacterium
DSDPRQW

SEQ ID NO: 457334 - protein, 10 aa, Mycobacterium
DSDPSKPEGM

SEQ ID NO: 457335 - protein, 10 aa, Mycobacterium
DSDPSWAGGD

SEQ ID NO: 457336 - protein, 13 aa, Mycobacterium
DSDPYEGPVPDAA

SEQ ID NO: 457337 - protein, 7 aa, Mycobacterium
DSDQPLD

SEQ ID NO: 457338 - protein, 8 aa, Mycobacterium
DSDQPLTG

SEQ ID NO: 457339 - protein, 7 aa, Mycobacterium
DSDQQAQ

SEQ ID NO: 457340 - protein, 16 aa, Mycobacterium
DSDQTYRYSPAAGDPM

SEQ ID NO: 457341 - protein, 7 aa, Mycobacterium
DSDREAV

SEQ ID NO: 457342 - protein, 14 aa, Mycobacterium
DSDREGHYAAPDHQ

SEQ ID NO: 457343 - protein, 7 aa, Mycobacterium
DSDRKGL

SEQ ID NO: 457344 - protein, 8 aa, Mycobacterium
DSDRKGLS

SEQ ID NO: 457345 - protein, 9 aa, Mycobacterium
DSDRTPWEQ

SEQ ID NO: 457346 - protein, 8 aa, Mycobacterium
DSDRVPAG

SEQ ID NO: 457347 - protein, 6 aa, Mycobacterium
DSDRWG

SEQ ID NO: 457348 - protein, 4 aa, Mycobacterium
DSDS

SEQ ID NO: 457349 - protein, 9 aa, Mycobacterium
DSDSELAAT

SEQ ID NO: 457350 - protein, 11 aa, Mycobacterium
DSDSGDEAALP

SEQ ID NO: 457351 - protein, 12 aa, Mycobacterium
DSDSMEISCRTG

SEQ ID NO: 457352 - protein, 16 aa, Mycobacterium
DSDSRESGKLPGTDVR

SEQ ID NO: 457353 - protein, 8 aa, Mycobacterium
DSDSSSIE

SEQ ID NO: 457354 - protein, 6 aa, Mycobacterium
DSDSWR

SEQ ID NO: 457355 - protein, 7 aa, Mycobacterium
DSDTDAL

SEQ ID NO: 457356 - protein, 9 aa, Mycobacterium
DSDTDGDDL

SEQ ID NO: 457357 - protein, 8 aa, Mycobacterium
DSDTDTGG

SEQ ID NO: 457358 - protein, 16 aa, Mycobacterium
DSDTEQSGKLPGTDLR

SEQ ID NO: 457359 - protein, 5 aa, Mycobacterium
DSDTF

SEQ ID NO: 457360 - protein, 9 aa, Mycobacterium
DSDTGDESL

SEQ ID NO: 457361 - protein, 12 aa, Mycobacterium
DSDTGGADHAAA

SEQ ID NO: 457362 - protein, 6 aa, Mycobacterium
DSDTRA

SEQ ID NO: 457363 - protein, 5 aa, Mycobacterium
DSDTS

SEQ ID NO: 457364 - protein, 4 aa, Mycobacterium
DSDV

SEQ ID NO: 457365 - protein, 14 aa, Mycobacterium
DSDVAGASAQRGLS

SEQ ID NO: 457366 - protein, 5 aa, Mycobacterium
DSDVD

SEQ ID NO: 457367 - protein, 11 aa, Mycobacterium
DSDVGAHPRAT

SEQ ID NO: 457368 - protein, 7 aa, Mycobacterium
DSDVNGL

SEQ ID NO: 457369 - protein, 6 aa, Mycobacterium
DSDVPH

SEQ ID NO: 457370 - protein, 13 aa, Mycobacterium
DSDVPTELEADAR

SEQ ID NO: 457371 - protein, 16 aa, Mycobacterium
DSDVSPAWTLYAWEPA

SEQ ID NO: 457372 - protein, 5 aa, Mycobacterium
DSDYG

SEQ ID NO: 457373 - protein, 6 aa, Mycobacterium
DSDYQS

SEQ ID NO: 457374 - protein, 14 aa, Mycobacterium
DSDYSGAETDLGPV

SEQ ID NO: 457375 - protein, 8 aa, Mycobacterium
DSEAAAAR

SEQ ID NO: 457376 - protein, 6 aa, Mycobacterium
DSEAAL

SEQ ID NO: 457377 - protein, 9 aa, Mycobacterium
DSEADGSDF

SEQ ID NO: 457378 - protein, 8 aa, Mycobacterium
DSEADGTA

SEQ ID NO: 457379 - protein, 9 aa, Mycobacterium
DSEADGTAL

SEQ ID NO: 457380 - protein, 18 aa, Mycobacterium
DSEADGTALVAAAARDAG

SEQ ID NO: 457381 - protein, 9 aa, Mycobacterium
DSEADGTPL

SEQ ID NO: 457382 - protein, 7 aa, Mycobacterium
DSEADLP

SEQ ID NO: 457383 - protein, 19 aa, Mycobacterium
DSEADWGPYAAPTAPENAP

SEQ ID NO: 457384 - protein, 6 aa, Mycobacterium
DSEAER

SEQ ID NO: 457385 - protein, 7 aa, Mycobacterium
DSEAGAV

SEQ ID NO: 457386 - protein, 4 aa, Mycobacterium
DSED

SEQ ID NO: 457387 - protein, 7 aa, Mycobacterium
DSEDPKF

SEQ ID NO: 457388 - protein, 6 aa, Mycobacterium
DSEDPL

SEQ ID NO: 457389 - protein, 7 aa, Mycobacterium
DSEDVEE

SEQ ID NO: 457390 - protein, 11 aa, Mycobacterium
DSEEADGGATA

SEQ ID NO: 457391 - protein, 9 aa, Mycobacterium
DSEEDGPQR

SEQ ID NO: 457392 - protein, 12 aa, Mycobacterium
DSEEERAIERES

SEQ ID NO: 457393 - protein, 5 aa, Mycobacterium
DSEEG

SEQ ID NO: 457394 - protein, 10 aa, Mycobacterium
DSEEGGRANQ

SEQ ID NO: 457395 - protein, 11 aa, Mycobacterium
DSEENTADSQF

SEQ ID NO: 457396 - protein, 5 aa, Mycobacterium
DSEEV

SEQ ID NO: 457397 - protein, 6 aa, Mycobacterium
DSEFDG

SEQ ID NO: 457398 - protein, 21 aa, Mycobacterium
DSEFEKGAYTEQRKASFETGE

SEQ ID NO: 457399 - protein, 5 aa, Mycobacterium
DSEFG

SEQ ID NO: 457400 - protein, 6 aa, Mycobacterium
DSEFGP

SEQ ID NO: 457401 - protein, 8 aa, Mycobacterium
DSEGDGTA

SEQ ID NO: 457402 - protein, 12 aa, Mycobacterium
DSEGGAERSSAQ

SEQ ID NO: 457403 - protein, 6 aa, Mycobacterium
DSEGIA

SEQ ID NO: 457404 - protein, 19 aa, Mycobacterium
DSEGPESRRATHSSTGARL

SEQ ID NO: 457405 - protein, 8 aa, Mycobacterium
DSEGPQEL

SEQ ID NO: 457406 - protein, 7 aa, Mycobacterium
DSEGRAV

SEQ ID NO: 457407 - protein, 16 aa, Mycobacterium
DSEGRLTETRSDLGSA

SEQ ID NO: 457408 - protein, 14 aa, Mycobacterium
DSEGRNTDTRSDLA

SEQ ID NO: 457409 - protein, 8 aa, Mycobacterium
DSEHSAAR

SEQ ID NO: 457410 - protein, 6 aa, Mycobacterium
DSEHTQ

SEQ ID NO: 457411 - protein, 8 aa, Mycobacterium
DSEISSTA

SEQ ID NO: 457412 - protein, 8 aa, Mycobacterium
DSEKSGVA

SEQ ID NO: 457413 - protein, 4 aa, Mycobacterium
DSEL

SEQ ID NO: 457414 - protein, 5 aa, Mycobacterium
DSELD

SEQ ID NO: 457415 - protein, 7 aa, Mycobacterium
DSELGQQ

SEQ ID NO: 457416 - protein, 9 aa, Mycobacterium
DSELPDGSF

SEQ ID NO: 457417 - protein, 9 aa, Mycobacterium
DSELPDGSI

SEQ ID NO: 457418 - protein, 10 aa, Mycobacterium
DSENDGVGDM

SEQ ID NO: 457419 - protein, 7 aa, Mycobacterium
DSENGPV

SEQ ID NO: 457420 - protein, 7 aa, Mycobacterium
DSENNRV

SEQ ID NO: 457421 - protein, 19 aa, Mycobacterium
DSENSSGAGFFEQGVLHRV

SEQ ID NO: 457422 - protein, 4 aa, Mycobacterium
DSEP

SEQ ID NO: 457423 - protein, 22 aa, Mycobacterium
DSEPEMSSGRDPDALEAEAEEV

SEQ ID NO: 457424 - protein, 9 aa, Mycobacterium
DSEPGRGTA

SEQ ID NO: 457425 - protein, 9 aa, Mycobacterium
DSEPGSQNW

SEQ ID NO: 457426 - protein, 9 aa, Mycobacterium
DSEPTVDEQ

SEQ ID NO: 457427 - protein, 5 aa, Mycobacterium
DSEQA

SEQ ID NO: 457428 - protein, 5 aa, Mycobacterium
DSEQL

SEQ ID NO: 457429 - protein, 7 aa, Mycobacterium
DSEQLPA

SEQ ID NO: 457430 - protein, 5 aa, Mycobacterium
DSEQP

SEQ ID NO: 457431 - protein, 7 aa, Mycobacterium
DSEQRKG

SEQ ID NO: 457432 - protein, 10 aa, Mycobacterium
DSEQVPVPPG

SEQ ID NO: 457433 - protein, 4 aa, Mycobacterium
DSER

SEQ ID NO: 457434 - protein, 6 aa, Mycobacterium
DSERAA

SEQ ID NO: 457435 - protein, 5 aa, Mycobacterium
DSERE

SEQ ID NO: 457436 - protein, 13 aa, Mycobacterium
DSEREDGRHPGLT

SEQ ID NO: 457437 - protein, 13 aa, Mycobacterium
DSERKSGSRRPTF

SEQ ID NO: 457438 - protein, 7 aa, Mycobacterium
DSERKTH

SEQ ID NO: 457439 - protein, 6 aa, Mycobacterium
DSERPL

SEQ ID NO: 457440 - protein, 8 aa, Mycobacterium
DSERTLAE

SEQ ID NO: 457441 - protein, 4 aa, Mycobacterium
DSES

SEQ ID NO: 457442 - protein, 16 aa, Mycobacterium
DSESDESGKVPGTDLR

SEQ ID NO: 457443 - protein, 5 aa, Mycobacterium
DSESF

SEQ ID NO: 457444 - protein, 13 aa, Mycobacterium
DSESGNGRLKSER

SEQ ID NO: 457445 - protein, 12 aa, Mycobacterium
DSESGNGRLKTE

SEQ ID NO: 457446 - protein, 14 aa, Mycobacterium
DSESGNGRLKTERE

SEQ ID NO: 457447 - protein, 8 aa, Mycobacterium
DSESGYAT

SEQ ID NO: 457448 - protein, 5 aa, Mycobacterium
DSESL

SEQ ID NO: 457449 - protein, 5 aa, Mycobacterium
DSESP

SEQ ID NO: 457450 - protein, 21 aa, Mycobacterium
DSESRTRRRVRNADQTEAAEQ

SEQ ID NO: 457451 - protein, 8 aa, Mycobacterium
DSESSARM

SEQ ID NO: 457452 - protein, 8 aa, Mycobacterium
DSETADMD

SEQ ID NO: 457453 - protein, 6 aa, Mycobacterium
DSETFL

SEQ ID NO: 457454 - protein, 31 aa, Mycobacterium
DSETFSSTEYTNIAGNGGVPLPPLDTDPPLQ

SEQ ID NO: 457455 - protein, 6 aa, Mycobacterium
DSETGA

SEQ ID NO: 457456 - protein, 7 aa, Mycobacterium
DSETGTA

SEQ ID NO: 457457 - protein, 20 aa, Mycobacterium
DSETGTDAHDVGADARRGAD

SEQ ID NO: 457458 - protein, 5 aa, Mycobacterium
DSETN

SEQ ID NO: 457459 - protein, 8 aa, Mycobacterium
DSETPLSA

SEQ ID NO: 457460 - protein, 9 aa, Mycobacterium
DSETPPGKL

SEQ ID NO: 457461 - protein, 6 aa, Mycobacterium
DSETTE

SEQ ID NO: 457462 - protein, 26 aa, Mycobacterium
DSEVAPPLPADRFSGPGIARQGYSEF

SEQ ID NO: 457463 - protein, 5 aa, Mycobacterium
DSEVG

SEQ ID NO: 457464 - protein, 10 aa, Mycobacterium
DSEVPPPAEG

SEQ ID NO: 457465 - protein, 8 aa, Mycobacterium
DSEVPRGK

SEQ ID NO: 457466 - protein, 4 aa, Mycobacterium
DSEY

SEQ ID NO: 457467 - protein, 5 aa, Mycobacterium
DSEYG

SEQ ID NO: 457468 - protein, 9 aa, Mycobacterium
DSEYGKATR

SEQ ID NO: 457469 - protein, 6 aa, Mycobacterium
DSEYNG

SEQ ID NO: 457470 - protein, 8 aa, Mycobacterium
DSFADQTH

SEQ ID NO: 457471 - protein, 14 aa, Mycobacterium
DSFAEGDRNPPVFD

SEQ ID NO: 457472 - protein, 4 aa, Mycobacterium
DSFE

SEQ ID NO: 457473 - protein, 5 aa, Mycobacterium
DSFGE

SEQ ID NO: 457474 - protein, 6 aa, Mycobacterium
DSFGGK

SEQ ID NO: 457475 - protein, 10 aa, Mycobacterium
DSFPDSPGLE

SEQ ID NO: 457476 - protein, 6 aa, Mycobacterium
DSFQED

SEQ ID NO: 457477 - protein, 19 aa, Mycobacterium
DSFSAANVGRSSAEATSQI

SEQ ID NO: 457478 - protein, 5 aa, Mycobacterium
DSFSD

SEQ ID NO: 457479 - protein, 6 aa, Mycobacterium
DSFSDG

SEQ ID NO: 457480 - protein, 9 aa, Mycobacterium
DSFSDGGRY

SEQ ID NO: 457481 - protein, 15 aa, Mycobacterium
DSFSDGGRYLDPDKA

SEQ ID NO: 457482 - protein, 9 aa, Mycobacterium
DSFTAEEAS

SEQ ID NO: 457483 - protein, 5 aa, Mycobacterium
DSFTH

SEQ ID NO: 457484 - protein, 5 aa, Mycobacterium
DSGAA

SEQ ID NO: 457485 - protein, 8 aa, Mycobacterium
DSGAAATW

SEQ ID NO: 457486 - protein, 6 aa, Mycobacterium
DSGAAE

SEQ ID NO: 457487 - protein, 6 aa, Mycobacterium
DSGAAL

SEQ ID NO: 457488 - protein, 9 aa, Mycobacterium
DSGADAKTV

SEQ ID NO: 457489 - protein, 8 aa, Mycobacterium
DSGADYAT

SEQ ID NO: 457490 - protein, 9 aa, Mycobacterium
DSGAGESTA

SEQ ID NO: 457491 - protein, 21 aa, Mycobacterium
DSGAGLDLAPDSPLPEGPPYV

SEQ ID NO: 457492 - protein, 34 aa, Mycobacterium
DSGAGPTDSEGPRDGEPPREPKPAPQPPRDLTAQ

SEQ ID NO: 457493 - protein, 6 aa, Mycobacterium
DSGAGQ

SEQ ID NO: 457494 - protein, 8 aa, Mycobacterium
DSGAGRKA

SEQ ID NO: 457495 - protein, 8 aa, Mycobacterium
DSGAKDRK

SEQ ID NO: 457496 - protein, 11 aa, Mycobacterium
DSGALADNHPA

SEQ ID NO: 457497 - protein, 8 aa, Mycobacterium
DSGALPEG

SEQ ID NO: 457498 - protein, 13 aa, Mycobacterium
DSGANLTIAAAQQ

SEQ ID NO: 457499 - protein, 6 aa, Mycobacterium
DSGAQG

SEQ ID NO: 457500 - protein, 11 aa, Mycobacterium
DSGARRLEDGR

SEQ ID NO: 457501 - protein, 7 aa, Mycobacterium
DSGARSL

SEQ ID NO: 457502 - protein, 7 aa, Mycobacterium
DSGAVPA

SEQ ID NO: 457503 - protein, 8 aa, Mycobacterium
DSGAVPAG

SEQ ID NO: 457504 - protein, 6 aa, Mycobacterium
DSGCSE

SEQ ID NO: 457505 - protein, 7 aa, Mycobacterium
DSGCSGW

SEQ ID NO: 457506 - protein, 11 aa, Mycobacterium
DSGDAFPDLAG

SEQ ID NO: 457507 - protein, 14 aa, Mycobacterium
DSGDDASETEPKPQ

SEQ ID NO: 457508 - protein, 5 aa, Mycobacterium
DSGDI

SEQ ID NO: 457509 - protein, 16 aa, Mycobacterium
DSGDLGALSKAARARL

SEQ ID NO: 457510 - protein, 9 aa, Mycobacterium
DSGDLTSPA

SEQ ID NO: 457511 - protein, 9 aa, Mycobacterium
DSGDRYRDT

SEQ ID NO: 457512 - protein, 7 aa, Mycobacterium
DSGDSAR

SEQ ID NO: 457513 - protein, 10 aa, Mycobacterium
DSGDSPTGAI

SEQ ID NO: 457514 - protein, 9 aa, Mycobacterium
DSGDTPPGA

SEQ ID NO: 457515 - protein, 7 aa, Mycobacterium
DSGEATS

SEQ ID NO: 457516 - protein, 8 aa, Mycobacterium
DSGEDRQA

SEQ ID NO: 457517 - protein, 5 aa, Mycobacterium
DSGEE

SEQ ID NO: 457518 - protein, 7 aa, Mycobacterium
DSGEETA

SEQ ID NO: 457519 - protein, 7 aa, Mycobacterium
DSGEGPR

SEQ ID NO: 457520 - protein, 5 aa, Mycobacterium
DSGEP

SEQ ID NO: 457521 - protein, 18 aa, Mycobacterium
DSGEPTGDSAPQAPAEPQ

SEQ ID NO: 457522 - protein, 6 aa, Mycobacterium
DSGEQI

SEQ ID NO: 457523 - protein, 16 aa, Mycobacterium
DSGEQITDTGPDDCGV

SEQ ID NO: 457524 - protein, 9 aa, Mycobacterium
DSGESATGA

SEQ ID NO: 457525 - protein, 10 aa, Mycobacterium
DSGESGESGE

SEQ ID NO: 457526 - protein, 8 aa, Mycobacterium
DSGETARW

SEQ ID NO: 457527 - protein, 4 aa, Mycobacterium
DSGF

SEQ ID NO: 457528 - protein, 9 aa, Mycobacterium
DSGFASPSH

SEQ ID NO: 457529 - protein, 5 aa, Mycobacterium
DSGFD

SEQ ID NO: 457530 - protein, 12 aa, Mycobacterium
DSGFDPAKPSAW

SEQ ID NO: 457531 - protein, 6 aa, Mycobacterium
DSGFDS

SEQ ID NO: 457532 - protein, 13 aa, Mycobacterium
DSGFDVQPDGRGG

SEQ ID NO: 457533 - protein, 5 aa, Mycobacterium
DSGFE

SEQ ID NO: 457534 - protein, 5 aa, Mycobacterium
DSGFR

SEQ ID NO: 457535 - protein, 5 aa, Mycobacterium
DSGGA

SEQ ID NO: 457536 - protein, 26 aa, Mycobacterium
DSGGADAPAAGGTPIPLGRKGEASDI

SEQ ID NO: 457537 - protein, 6 aa, Mycobacterium
DSGGAR

SEQ ID NO: 457538 - protein, 8 aa, Mycobacterium
DSGGASLH

SEQ ID NO: 457539 - protein, 8 aa, Mycobacterium
DSGGAVRV

SEQ ID NO: 457540 - protein, 9 aa, Mycobacterium
DSGGDDRGA

SEQ ID NO: 457541 - protein, 7 aa, Mycobacterium
DSGGDEN

SEQ ID NO: 457542 - protein, 7 aa, Mycobacterium
DSGGERA

SEQ ID NO: 457543 - protein, 7 aa, Mycobacterium
DSGGETE

SEQ ID NO: 457544 - protein, 8 aa, Mycobacterium
DSGGGARV

SEQ ID NO: 457545 - protein, 163 aa, Mycobacterium
DSGGGEGGSGGFGGTGLTTGGEGGRGGIGGAGDGSSGGAGGRGGDGGAGITGAGGQGGAGGDGGLSGANSAGARGGAGGAGGAGITGGAGGAGGAGSNGDGTSNQVEGQPGGDGGSGGIGGTGTAGAGGTGGAGGDGGAGGNTTVGTGGSGGNGGRGGDGGAF

SEQ ID NO: 457546 - protein, 16 aa, Mycobacterium
DSGGGGGGGGTGGNGG

SEQ ID NO: 457547 - protein, 8 aa, Mycobacterium
DSGGGLNH

SEQ ID NO: 457548 - protein, 9 aa, Mycobacterium
DSGGGSSRR

SEQ ID NO: 457549 - protein, 5 aa, Mycobacterium
DSGGH

SEQ ID NO: 457550 - protein, 15 aa, Mycobacterium
DSGGKVSAARKPVVG

SEQ ID NO: 457551 - protein, 13 aa, Mycobacterium
DSGGKVSAARRPV

SEQ ID NO: 457552 - protein, 9 aa, Mycobacterium
DSGGNHGTI

SEQ ID NO: 457553 - protein, 10 aa, Mycobacterium
DSGGQPITPE

SEQ ID NO: 457554 - protein, 6 aa, Mycobacterium
DSGGRL

SEQ ID NO: 457555 - protein, 6 aa, Mycobacterium
DSGGTL

SEQ ID NO: 457556 - protein, 5 aa, Mycobacterium
DSGGV

SEQ ID NO: 457557 - protein, 10 aa, Mycobacterium
DSGGVGGTIP

SEQ ID NO: 457558 - protein, 7 aa, Mycobacterium
DSGGVPI

SEQ ID NO: 457559 - protein, 6 aa, Mycobacterium
DSGGYV

SEQ ID NO: 457560 - protein, 4 aa, Mycobacterium
DSGH

SEQ ID NO: 457561 - protein, 8 aa, Mycobacterium
DSGHAGAR

SEQ ID NO: 457562 - protein, 7 aa, Mycobacterium
DSGHAPC

SEQ ID NO: 457563 - protein, 12 aa, Mycobacterium
DSGHSVQSDQPR

SEQ ID NO: 457564 - protein, 17 aa, Mycobacterium
DSGITEADRHQLRSALL

SEQ ID NO: 457565 - protein, 7 aa, Mycobacterium
DSGITKG

SEQ ID NO: 457566 - protein, 4 aa, Mycobacterium
DSGK

SEQ ID NO: 457567 - protein, 11 aa, Mycobacterium
DSGKLPEEAEN

SEQ ID NO: 457568 - protein, 5 aa, Mycobacterium
DSGKP

SEQ ID NO: 457569 - protein, 14 aa, Mycobacterium
DSGKPFERAVSGSD

SEQ ID NO: 457570 - protein, 8 aa, Mycobacterium
DSGKSYID

SEQ ID NO: 457571 - protein, 9 aa, Mycobacterium
DSGKWTKEQ

SEQ ID NO: 457572 - protein, 6 aa, Mycobacterium
DSGLEA

SEQ ID NO: 457573 - protein, 7 aa, Mycobacterium
DSGLLPD

SEQ ID NO: 457574 - protein, 9 aa, Mycobacterium
DSGLPVPAG

SEQ ID NO: 457575 - protein, 8 aa, Mycobacterium
DSGLSAAE

SEQ ID NO: 457576 - protein, 4 aa, Mycobacterium
DSGN

SEQ ID NO: 457577 - protein, 18 aa, Mycobacterium
DSGNASYDKAVQEGIKEQ

SEQ ID NO: 457578 - protein, 6 aa, Mycobacterium
DSGNNR

SEQ ID NO: 457579 - protein, 19 aa, Mycobacterium
DSGPDSNPDAGVAGSPDQH

SEQ ID NO: 457580 - protein, 8 aa, Mycobacterium
DSGPESVG

SEQ ID NO: 457581 - protein, 9 aa, Mycobacterium
DSGPGIPHE

SEQ ID NO: 457582 - protein, 10 aa, Mycobacterium
DSGPGNPDGF

SEQ ID NO: 457583 - protein, 6 aa, Mycobacterium
DSGPGS

SEQ ID NO: 457584 - protein, 10 aa, Mycobacterium
DSGPGSPYDV

SEQ ID NO: 457585 - protein, 11 aa, Mycobacterium
DSGPGTPTVTD

SEQ ID NO: 457586 - protein, 6 aa, Mycobacterium
DSGPII

SEQ ID NO: 457587 - protein, 6 aa, Mycobacterium
DSGPLA

SEQ ID NO: 457588 - protein, 10 aa, Mycobacterium
DSGPRYNASA

SEQ ID NO: 457589 - protein, 10 aa, Mycobacterium
DSGPTNQHGF

SEQ ID NO: 457590 - protein, 5 aa, Mycobacterium
DSGPV

SEQ ID NO: 457591 - protein, 7 aa, Mycobacterium
DSGPVKE

SEQ ID NO: 457592 - protein, 13 aa, Mycobacterium
DSGQSLTSNNGAY

SEQ ID NO: 457593 - protein, 5 aa, Mycobacterium
DSGRF

SEQ ID NO: 457594 - protein, 5 aa, Mycobacterium
DSGRG

SEQ ID NO: 457595 - protein, 18 aa, Mycobacterium
DSGRGALDAPQHDPGVAD

SEQ ID NO: 457596 - protein, 8 aa, Mycobacterium
DSGRGPFL

SEQ ID NO: 457597 - protein, 5 aa, Mycobacterium
DSGRH

SEQ ID NO: 457598 - protein, 5 aa, Mycobacterium
DSGRI

SEQ ID NO: 457599 - protein, 5 aa, Mycobacterium
DSGRK

SEQ ID NO: 457600 - protein, 8 aa, Mycobacterium
DSGRPAVV

SEQ ID NO: 457601 - protein, 6 aa, Mycobacterium
DSGRPY

SEQ ID NO: 457602 - protein, 6 aa, Mycobacterium
DSGRSV

SEQ ID NO: 457603 - protein, 19 aa, Mycobacterium
DSGRTGPRPPGRLRPHRPE

SEQ ID NO: 457604 - protein, 21 aa, Mycobacterium
DSGRWAGDSSASLRSQRRGRG

SEQ ID NO: 457605 - protein, 9 aa, Mycobacterium
DSGSGLNRP

SEQ ID NO: 457606 - protein, 10 aa, Mycobacterium
DSGSGSEDSV

SEQ ID NO: 457607 - protein, 9 aa, Mycobacterium
DSGSLPNLS

SEQ ID NO: 457608 - protein, 9 aa, Mycobacterium
DSGSPPAFA

SEQ ID NO: 457609 - protein, 6 aa, Mycobacterium
DSGSSA

SEQ ID NO: 457610 - protein, 15 aa, Mycobacterium
DSGSVRRRRVDQRRR

SEQ ID NO: 457611 - protein, 21 aa, Mycobacterium
DSGSVVRTASSPHPGGTEVDP

SEQ ID NO: 457612 - protein, 5 aa, Mycobacterium
DSGTA

SEQ ID NO: 457613 - protein, 12 aa, Mycobacterium
DSGTADEYNGPA

SEQ ID NO: 457614 - protein, 6 aa, Mycobacterium
DSGTAI

SEQ ID NO: 457615 - protein, 17 aa, Mycobacterium
DSGTFETASAAAHARGR

SEQ ID NO: 457616 - protein, 7 aa, Mycobacterium
DSGTGKS

SEQ ID NO: 457617 - protein, 9 aa, Mycobacterium
DSGTLPPVR

SEQ ID NO: 457618 - protein, 9 aa, Mycobacterium
DSGTPRPGM

SEQ ID NO: 457619 - protein, 11 aa, Mycobacterium
DSGTRAPSDGT

SEQ ID NO: 457620 - protein, 7 aa, Mycobacterium
DSGTRRT

SEQ ID NO: 457621 - protein, 12 aa, Mycobacterium
DSGTSTGSTAPP

SEQ ID NO: 457622 - protein, 13 aa, Mycobacterium
DSGTTRTPGTPSF

SEQ ID NO: 457623 - protein, 14 aa, Mycobacterium
DSGVEGTHHGGGRK

SEQ ID NO: 457624 - protein, 8 aa, Mycobacterium
DSGVGKST

SEQ ID NO: 457625 - protein, 8 aa, Mycobacterium
DSGVPAAN

SEQ ID NO: 457626 - protein, 6 aa, Mycobacterium
DSGVSR

SEQ ID NO: 457627 - protein, 7 aa, Mycobacterium
DSGVTDG

SEQ ID NO: 457628 - protein, 5 aa, Mycobacterium
DSGYA

SEQ ID NO: 457629 - protein, 16 aa, Mycobacterium
DSGYAEERDPAARTAR

SEQ ID NO: 457630 - protein, 5 aa, Mycobacterium
DSGYG

SEQ ID NO: 457631 - protein, 15 aa, Mycobacterium
DSGYSKQQATRPQTL

SEQ ID NO: 457632 - protein, 7 aa, Mycobacterium
DSGYSRY

SEQ ID NO: 457633 - protein, 7 aa, Mycobacterium
DSHAPPW

SEQ ID NO: 457634 - protein, 6 aa, Mycobacterium
DSHDAA

SEQ ID NO: 457635 - protein, 6 aa, Mycobacterium
DSHDEV

SEQ ID NO: 457636 - protein, 14 aa, Mycobacterium
DSHEVARAGEPISL

SEQ ID NO: 457637 - protein, 8 aa, Mycobacterium
DSHEVTRD

SEQ ID NO: 457638 - protein, 8 aa, Mycobacterium
DSHEVTRG

SEQ ID NO: 457639 - protein, 12 aa, Mycobacterium
DSHEVTRGGDPI

SEQ ID NO: 457640 - protein, 8 aa, Mycobacterium
DSHGASNR

SEQ ID NO: 457641 - protein, 10 aa, Mycobacterium
DSHGGPGERT

SEQ ID NO: 457642 - protein, 5 aa, Mycobacterium
DSHGN

SEQ ID NO: 457643 - protein, 7 aa, Mycobacterium
DSHGPSA

SEQ ID NO: 457644 - protein, 17 aa, Mycobacterium
DSHGSGAGAGAAAGLSQ

SEQ ID NO: 457645 - protein, 16 aa, Mycobacterium
DSHITGPAGPDHPTPG

SEQ ID NO: 457646 - protein, 16 aa, Mycobacterium
DSHITGPAGPGHPTGG

SEQ ID NO: 457647 - protein, 16 aa, Mycobacterium
DSHITGPAGPGHPTPG

SEQ ID NO: 457648 - protein, 4 aa, Mycobacterium
DSHK

SEQ ID NO: 457649 - protein, 10 aa, Mycobacterium
DSHPCSAGAA

SEQ ID NO: 457650 - protein, 8 aa, Mycobacterium
DSHPERDI

SEQ ID NO: 457651 - protein, 7 aa, Mycobacterium
DSHRDPR

SEQ ID NO: 457652 - protein, 5 aa, Mycobacterium
DSHRG

SEQ ID NO: 457653 - protein, 10 aa, Mycobacterium
DSHRGGKQIS

SEQ ID NO: 457654 - protein, 9 aa, Mycobacterium
DSHRPRDSE

SEQ ID NO: 457655 - protein, 8 aa, Mycobacterium
DSHSPGLD

SEQ ID NO: 457656 - protein, 15 aa, Mycobacterium
DSHVTGPAGDGHPTA

SEQ ID NO: 457657 - protein, 16 aa, Mycobacterium
DSHVTGPAGPGHPTGG

SEQ ID NO: 457658 - protein, 16 aa, Mycobacterium
DSHVTGPAGPGHSTPG

SEQ ID NO: 457659 - protein, 5 aa, Mycobacterium
DSIAG

SEQ ID NO: 457660 - protein, 16 aa, Mycobacterium
DSIAKSSTVPSGSEAA

SEQ ID NO: 457661 - protein, 7 aa, Mycobacterium
DSIAREE

SEQ ID NO: 457662 - protein, 7 aa, Mycobacterium
DSIDKSD

SEQ ID NO: 457663 - protein, 5 aa, Mycobacterium
DSIDP

SEQ ID NO: 457664 - protein, 4 aa, Mycobacterium
DSIE

SEQ ID NO: 457665 - protein, 4 aa, Mycobacterium
DSIG

SEQ ID NO: 457666 - protein, 5 aa, Mycobacterium
DSIGE

SEQ ID NO: 457667 - protein, 11 aa, Mycobacterium
DSIGKPDNEGM

SEQ ID NO: 457668 - protein, 8 aa, Mycobacterium
DSIGPTST

SEQ ID NO: 457669 - protein, 6 aa, Mycobacterium
DSIKAN

SEQ ID NO: 457670 - protein, 12 aa, Mycobacterium
DSIKRKDPSGVT

SEQ ID NO: 457671 - protein, 6 aa, Mycobacterium
DSIKTN

SEQ ID NO: 457672 - protein, 6 aa, Mycobacterium
DSIPDD

SEQ ID NO: 457673 - protein, 6 aa, Mycobacterium
DSIPDF

SEQ ID NO: 457674 - protein, 15 aa, Mycobacterium
DSIPGEPDSLAGDSL

SEQ ID NO: 457675 - protein, 26 aa, Mycobacterium
DSIREAMDQKSAEFAEQGNRVYLPLT

SEQ ID NO: 457676 - protein, 5 aa, Mycobacterium
DSIRR

SEQ ID NO: 457677 - protein, 18 aa, Mycobacterium
DSIRTDSRFTEDGRRREL

SEQ ID NO: 457678 - protein, 11 aa, Mycobacterium
DSISDSLNAPG

SEQ ID NO: 457679 - protein, 6 aa, Mycobacterium
DSISGP

SEQ ID NO: 457680 - protein, 13 aa, Mycobacterium
DSITQPSFGPFRS

SEQ ID NO: 457681 - protein, 12 aa, Mycobacterium
DSITSPDGRPVN

SEQ ID NO: 457682 - protein, 18 aa, Mycobacterium
DSKAIGDRNDALADRRPD

SEQ ID NO: 457683 - protein, 11 aa, Mycobacterium
DSKATNPHAAA

SEQ ID NO: 457684 - protein, 11 aa, Mycobacterium
DSKATNPHAAQ

SEQ ID NO: 457685 - protein, 9 aa, Mycobacterium
DSKDAKPRI

SEQ ID NO: 457686 - protein, 7 aa, Mycobacterium
DSKDALA

SEQ ID NO: 457687 - protein, 7 aa, Mycobacterium
DSKFGPM

SEQ ID NO: 457688 - protein, 6 aa, Mycobacterium
DSKGYG

SEQ ID NO: 457689 - protein, 8 aa, Mycobacterium
DSKITDYP

SEQ ID NO: 457690 - protein, 10 aa, Mycobacterium
DSKLAGTAHT

SEQ ID NO: 457691 - protein, 15 aa, Mycobacterium
DSKLPPAKMSGGTVT

SEQ ID NO: 457692 - protein, 10 aa, Mycobacterium
DSKLTDAERA

SEQ ID NO: 457693 - protein, 10 aa, Mycobacterium
DSKPAPNANK

SEQ ID NO: 457694 - protein, 8 aa, Mycobacterium
DSKPTVSQ

SEQ ID NO: 457695 - protein, 7 aa, Mycobacterium
DSKSIKG

SEQ ID NO: 457696 - protein, 9 aa, Mycobacterium
DSKSLNEGA

SEQ ID NO: 457697 - protein, 5 aa, Mycobacterium
DSKSM

SEQ ID NO: 457698 - protein, 7 aa, Mycobacterium
DSKTEVG

SEQ ID NO: 457699 - protein, 7 aa, Mycobacterium
DSKYGLA

SEQ ID NO: 457700 - protein, 14 aa, Mycobacterium
DSKYPYTPDGNREF

SEQ ID NO: 457701 - protein, 14 aa, Mycobacterium
DSKYSSNANPGGQV

SEQ ID NO: 457702 - protein, 4 aa, Mycobacterium
DSLA

SEQ ID NO: 457703 - protein, 12 aa, Mycobacterium
DSLAAAKSKSAL

SEQ ID NO: 457704 - protein, 15 aa, Mycobacterium
DSLAAQSKRNPDGTG

SEQ ID NO: 457705 - protein, 6 aa, Mycobacterium
DSLADD

SEQ ID NO: 457706 - protein, 8 aa, Mycobacterium
DSLAERDS

SEQ ID NO: 457707 - protein, 16 aa, Mycobacterium
DSLARQSRRNPDGTGV

SEQ ID NO: 457708 - protein, 7 aa, Mycobacterium
DSLDDLR

SEQ ID NO: 457709 - protein, 6 aa, Mycobacterium
DSLDEP

SEQ ID NO: 457710 - protein, 19 aa, Mycobacterium
DSLDGYAQEAGRAARQRDL

SEQ ID NO: 457711 - protein, 6 aa, Mycobacterium
DSLEDR

SEQ ID NO: 457712 - protein, 13 aa, Mycobacterium
DSLGERYRGRRGI

SEQ ID NO: 457713 - protein, 12 aa, Mycobacterium
DSLGGDNPGSTP

SEQ ID NO: 457714 - protein, 11 aa, Mycobacterium
DSLGNDSDGNP

SEQ ID NO: 457715 - protein, 9 aa, Mycobacterium
DSLGPETTK

SEQ ID NO: 457716 - protein, 30 aa, Mycobacterium
DSLHAEPDPDFHGDTPPATHAEHTQAEAEA

SEQ ID NO: 457717 - protein, 58 aa, Mycobacterium
DSLHAEPDPDFHGDTPPATHAEHTQAEAQAREAGVEAEDGTAAEQAHAEVEADQAEVE

SEQ ID NO: 457718 - protein, 8 aa, Mycobacterium
DSLKEGSV

SEQ ID NO: 457719 - protein, 6 aa, Mycobacterium
DSLKRE

SEQ ID NO: 457720 - protein, 9 aa, Mycobacterium
DSLKSHGAQ

SEQ ID NO: 457721 - protein, 11 aa, Mycobacterium
DSLPEGRRNTF

SEQ ID NO: 457722 - protein, 10 aa, Mycobacterium
DSLPGDQRRR

SEQ ID NO: 457723 - protein, 9 aa, Mycobacterium
DSLPGEPPF

SEQ ID NO: 457724 - protein, 6 aa, Mycobacterium
DSLPNG

SEQ ID NO: 457725 - protein, 6 aa, Mycobacterium
DSLPRD

SEQ ID NO: 457726 - protein, 10 aa, Mycobacterium
DSLPSPLPTA

SEQ ID NO: 457727 - protein, 10 aa, Mycobacterium
DSLPVDAQTR

SEQ ID NO: 457728 - protein, 11 aa, Mycobacterium
DSLQDSGGDSI

SEQ ID NO: 457729 - protein, 8 aa, Mycobacterium
DSLQPELG

SEQ ID NO: 457730 - protein, 5 aa, Mycobacterium
DSLRA

SEQ ID NO: 457731 - protein, 6 aa, Mycobacterium
DSLRDR

SEQ ID NO: 457732 - protein, 14 aa, Mycobacterium
DSLRQGQELPPVPQ

SEQ ID NO: 457733 - protein, 13 aa, Mycobacterium
DSLRRRGENVSSV

SEQ ID NO: 457734 - protein, 14 aa, Mycobacterium
DSLRSAAADAVSAG

SEQ ID NO: 457735 - protein, 18 aa, Mycobacterium
DSLRSAAASGRAPAARQV

SEQ ID NO: 457736 - protein, 10 aa, Mycobacterium
DSLRSELKGD

SEQ ID NO: 457737 - protein, 5 aa, Mycobacterium
DSLSA

SEQ ID NO: 457738 - protein, 6 aa, Mycobacterium
DSLSDS

SEQ ID NO: 457739 - protein, 8 aa, Mycobacterium
DSLSEDEI

SEQ ID NO: 457740 - protein, 6 aa, Mycobacterium
DSLSGL

SEQ ID NO: 457741 - protein, 6 aa, Mycobacterium
DSLSPR

SEQ ID NO: 457742 - protein, 9 aa, Mycobacterium
DSLSRGFKG

SEQ ID NO: 457743 - protein, 11 aa, Mycobacterium
DSLSSAGVASS

SEQ ID NO: 457744 - protein, 10 aa, Mycobacterium
DSLSSRRRGL

SEQ ID NO: 457745 - protein, 15 aa, Mycobacterium
DSLSVQSRRNPDGTG

SEQ ID NO: 457746 - protein, 7 aa, Mycobacterium
DSLTDRQ

SEQ ID NO: 457747 - protein, 22 aa, Mycobacterium
DSLTEQVKGRKRIAQADEIRDE

SEQ ID NO: 457748 - protein, 6 aa, Mycobacterium
DSLTPR

SEQ ID NO: 457749 - protein, 7 aa, Mycobacterium
DSMAGRD

SEQ ID NO: 457750 - protein, 4 aa, Mycobacterium
DSMP

SEQ ID NO: 457751 - protein, 7 aa, Mycobacterium
DSMPDKE

SEQ ID NO: 457752 - protein, 6 aa, Mycobacterium
DSMPTY

SEQ ID NO: 457753 - protein, 7 aa, Mycobacterium
DSMRSNK

SEQ ID NO: 457754 - protein, 4 aa, Mycobacterium
DSMV

SEQ ID NO: 457755 - protein, 13 aa, Mycobacterium
DSNAARGTPSKGA

SEQ ID NO: 457756 - protein, 8 aa, Mycobacterium
DSNERAAS

SEQ ID NO: 457757 - protein, 4 aa, Mycobacterium
DSNG

SEQ ID NO: 457758 - protein, 14 aa, Mycobacterium
DSNGRPDKDFEPLT

SEQ ID NO: 457759 - protein, 20 aa, Mycobacterium
DSNGSEPSRGFLQRRIAECQ

SEQ ID NO: 457760 - protein, 24 aa, Mycobacterium
DSNGSSDSDGDGDGDESESNGGSP

SEQ ID NO: 457761 - protein, 8 aa, Mycobacterium
DSNGTRSQ

SEQ ID NO: 457762 - protein, 14 aa, Mycobacterium
DSNLQASPTPEALR

SEQ ID NO: 457763 - protein, 5 aa, Mycobacterium
DSNPP

SEQ ID NO: 457764 - protein, 5 aa, Mycobacterium
DSNRF

SEQ ID NO: 457765 - protein, 6 aa, Mycobacterium
DSNSGR

SEQ ID NO: 457766 - protein, 21 aa, Mycobacterium
DSNSWVPGKPDAATPVIPGPV

SEQ ID NO: 457767 - protein, 9 aa, Mycobacterium
DSNTISEED

SEQ ID NO: 457768 - protein, 8 aa, Mycobacterium
DSNTLEAT

SEQ ID NO: 457769 - protein, 4 aa, Mycobacterium
DSNY

SEQ ID NO: 457770 - protein, 4 aa, Mycobacterium
DSPA

SEQ ID NO: 457771 - protein, 7 aa, Mycobacterium
DSPAAEH

SEQ ID NO: 457772 - protein, 7 aa, Mycobacterium
DSPAAKE

SEQ ID NO: 457773 - protein, 6 aa, Mycobacterium
DSPAAL

SEQ ID NO: 457774 - protein, 12 aa, Mycobacterium
DSPAEPGKRSDE

SEQ ID NO: 457775 - protein, 16 aa, Mycobacterium
DSPAERRRLGAAGRQR

SEQ ID NO: 457776 - protein, 15 aa, Mycobacterium
DSPAGAGDTESDLDL

SEQ ID NO: 457777 - protein, 10 aa, Mycobacterium
DSPAGDGELT

SEQ ID NO: 457778 - protein, 24 aa, Mycobacterium
DSPAGRRYGRTSGDLTVTNDSSSR

SEQ ID NO: 457779 - protein, 9 aa, Mycobacterium
DSPAGSTAF

SEQ ID NO: 457780 - protein, 9 aa, Mycobacterium
DSPAGTPGF

SEQ ID NO: 457781 - protein, 7 aa, Mycobacterium
DSPAIDE

SEQ ID NO: 457782 - protein, 15 aa, Mycobacterium
DSPALPKPAQSPRPP

SEQ ID NO: 457783 - protein, 7 aa, Mycobacterium
DSPANDA

SEQ ID NO: 457784 - protein, 18 aa, Mycobacterium
DSPAPSEDFGRQPPQDLA

SEQ ID NO: 457785 - protein, 10 aa, Mycobacterium
DSPAQGLSRT

SEQ ID NO: 457786 - protein, 6 aa, Mycobacterium
DSPASG

SEQ ID NO: 457787 - protein, 10 aa, Mycobacterium
DSPATNGQAQ

SEQ ID NO: 457788 - protein, 5 aa, Mycobacterium
DSPDA

SEQ ID NO: 457789 - protein, 7 aa, Mycobacterium
DSPDAAA

SEQ ID NO: 457790 - protein, 17 aa, Mycobacterium
DSPDALAAADPSDFADD

SEQ ID NO: 457791 - protein, 8 aa, Mycobacterium
DSPDDPDN

SEQ ID NO: 457792 - protein, 8 aa, Mycobacterium
DSPDEAIS

SEQ ID NO: 457793 - protein, 8 aa, Mycobacterium
DSPDEGWR

SEQ ID NO: 457794 - protein, 9 aa, Mycobacterium
DSPDESRPP

SEQ ID NO: 457795 - protein, 5 aa, Mycobacterium
DSPDF

SEQ ID NO: 457796 - protein, 7 aa, Mycobacterium
DSPDGTY

SEQ ID NO: 457797 - protein, 16 aa, Mycobacterium
DSPDKRRSLGEAGRQR

SEQ ID NO: 457798 - protein, 26 aa, Mycobacterium
DSPDPDQEDNARRAAAACPALAIEIH

SEQ ID NO: 457799 - protein, 7 aa, Mycobacterium
DSPDPDR

SEQ ID NO: 457800 - protein, 16 aa, Mycobacterium
DSPDSEATLQQTSYAQ

SEQ ID NO: 457801 - protein, 9 aa, Mycobacterium
DSPDSGSIA

SEQ ID NO: 457802 - protein, 5 aa, Mycobacterium
DSPDV

SEQ ID NO: 457803 - protein, 10 aa, Mycobacterium
DSPEAAPARQ

SEQ ID NO: 457804 - protein, 6 aa, Mycobacterium
DSPEGR

SEQ ID NO: 457805 - protein, 16 aa, Mycobacterium
DSPEGRASSLESIGRS

SEQ ID NO: 457806 - protein, 16 aa, Mycobacterium
DSPEKRRNLGRAGRTR

SEQ ID NO: 457807 - protein, 16 aa, Mycobacterium
DSPEKRRRLGKAGRTR

SEQ ID NO: 457808 - protein, 16 aa, Mycobacterium
DSPELAKRSQRLATGA

SEQ ID NO: 457809 - protein, 8 aa, Mycobacterium
DSPELGAD

SEQ ID NO: 457810 - protein, 19 aa, Mycobacterium
DSPEPSVPHAPPPAPRQAP

SEQ ID NO: 457811 - protein, 6 aa, Mycobacterium
DSPEQL

SEQ ID NO: 457812 - protein, 6 aa, Mycobacterium
DSPERR

SEQ ID NO: 457813 - protein, 16 aa, Mycobacterium
DSPERVAQSLQTAMGA

SEQ ID NO: 457814 - protein, 14 aa, Mycobacterium
DSPERVRQSQRSAF

SEQ ID NO: 457815 - protein, 9 aa, Mycobacterium
DSPETSPRD

SEQ ID NO: 457816 - protein, 15 aa, Mycobacterium
DSPETVGKVLLTVRR

SEQ ID NO: 457817 - protein, 7 aa, Mycobacterium
DSPFGGF

SEQ ID NO: 457818 - protein, 8 aa, Mycobacterium
DSPGAAAT

SEQ ID NO: 457819 - protein, 6 aa, Mycobacterium
DSPGED

SEQ ID NO: 457820 - protein, 7 aa, Mycobacterium
DSPGFRR

SEQ ID NO: 457821 - protein, 8 aa, Mycobacterium
DSPGGHGD

SEQ ID NO: 457822 - protein, 7 aa, Mycobacterium
DSPGGPQ

SEQ ID NO: 457823 - protein, 12 aa, Mycobacterium
DSPGGSVNGSET

SEQ ID NO: 457824 - protein, 11 aa, Mycobacterium
DSPGGSVTASE

SEQ ID NO: 457825 - protein, 12 aa, Mycobacterium
DSPGGSVTGSET

SEQ ID NO: 457826 - protein, 6 aa, Mycobacterium
DSPGIG

SEQ ID NO: 457827 - protein, 10 aa, Mycobacterium
DSPGINSYAD

SEQ ID NO: 457828 - protein, 6 aa, Mycobacterium
DSPGLE

SEQ ID NO: 457829 - protein, 7 aa, Mycobacterium
DSPGNDA

SEQ ID NO: 457830 - protein, 9 aa, Mycobacterium
DSPGPTDVY

SEQ ID NO: 457831 - protein, 10 aa, Mycobacterium
DSPGSKYDKA

SEQ ID NO: 457832 - protein, 14 aa, Mycobacterium
DSPGSLPSDPGADR

SEQ ID NO: 457833 - protein, 9 aa, Mycobacterium
DSPGSNSAL

SEQ ID NO: 457834 - protein, 5 aa, Mycobacterium
DSPGT

SEQ ID NO: 457835 - protein, 6 aa, Mycobacterium
DSPGTG

SEQ ID NO: 457836 - protein, 5 aa, Mycobacterium
DSPGV

SEQ ID NO: 457837 - protein, 8 aa, Mycobacterium
DSPGVGAN

SEQ ID NO: 457838 - protein, 20 aa, Mycobacterium
DSPGVGPWEGPWPDDPRYDP

SEQ ID NO: 457839 - protein, 6 aa, Mycobacterium
DSPHDA

SEQ ID NO: 457840 - protein, 6 aa, Mycobacterium
DSPHEI

SEQ ID NO: 457841 - protein, 7 aa, Mycobacterium
DSPHKPI

SEQ ID NO: 457842 - protein, 10 aa, Mycobacterium
DSPHNRNALS

SEQ ID NO: 457843 - protein, 8 aa, Mycobacterium
DSPHPRGE

SEQ ID NO: 457844 - protein, 5 aa, Mycobacterium
DSPID

SEQ ID NO: 457845 - protein, 12 aa, Mycobacterium
DSPIGSTDKAGI

SEQ ID NO: 457846 - protein, 8 aa, Mycobacterium
DSPKELDP

SEQ ID NO: 457847 - protein, 7 aa, Mycobacterium
DSPKFEG

SEQ ID NO: 457848 - protein, 11 aa, Mycobacterium
DSPKPLPSPTE

SEQ ID NO: 457849 - protein, 9 aa, Mycobacterium
DSPLDGQAA

SEQ ID NO: 457850 - protein, 6 aa, Mycobacterium
DSPLEQ

SEQ ID NO: 457851 - protein, 5 aa, Mycobacterium
DSPLG

SEQ ID NO: 457852 - protein, 6 aa, Mycobacterium
DSPLGD

SEQ ID NO: 457853 - protein, 7 aa, Mycobacterium
DSPLLGD

SEQ ID NO: 457854 - protein, 5 aa, Mycobacterium
DSPLN

SEQ ID NO: 457855 - protein, 11 aa, Mycobacterium
DSPLPRDGSSP

SEQ ID NO: 457856 - protein, 9 aa, Mycobacterium
DSPLPVDAA

SEQ ID NO: 457857 - protein, 5 aa, Mycobacterium
DSPLR

SEQ ID NO: 457858 - protein, 13 aa, Mycobacterium
DSPLSSDAVTASP

SEQ ID NO: 457859 - protein, 7 aa, Mycobacterium
DSPMNPA

SEQ ID NO: 457860 - protein, 5 aa, Mycobacterium
DSPNA

SEQ ID NO: 457861 - protein, 7 aa, Mycobacterium
DSPNSAG

SEQ ID NO: 457862 - protein, 7 aa, Mycobacterium
DSPPGRA

SEQ ID NO: 457863 - protein, 7 aa, Mycobacterium
DSPPGRI

SEQ ID NO: 457864 - protein, 13 aa, Mycobacterium
DSPPGVSSGTYSS

SEQ ID NO: 457865 - protein, 13 aa, Mycobacterium
DSPPHSSSVTSCR

SEQ ID NO: 457866 - protein, 7 aa, Mycobacterium
DSPPLAK

SEQ ID NO: 457867 - protein, 7 aa, Mycobacterium
DSPPNTM

SEQ ID NO: 457868 - protein, 6 aa, Mycobacterium
DSPPPE

SEQ ID NO: 457869 - protein, 8 aa, Mycobacterium
DSPPTDTR

SEQ ID NO: 457870 - protein, 8 aa, Mycobacterium
DSPPTGRI

SEQ ID NO: 457871 - protein, 6 aa, Mycobacterium
DSPPYH

SEQ ID NO: 457872 - protein, 31 aa, Mycobacterium
DSPQHGDGQSEETVPSSHGVDPAQRNDSAQS

SEQ ID NO: 457873 - protein, 6 aa, Mycobacterium
DSPQMT

SEQ ID NO: 457874 - protein, 6 aa, Mycobacterium
DSPQRH

SEQ ID NO: 457875 - protein, 5 aa, Mycobacterium
DSPRA

SEQ ID NO: 457876 - protein, 8 aa, Mycobacterium
DSPRGGSV

SEQ ID NO: 457877 - protein, 23 aa, Mycobacterium
DSPRGSKQALDRKHPSPKHPAPI

SEQ ID NO: 457878 - protein, 9 aa, Mycobacterium
DSPRKHGYD

SEQ ID NO: 457879 - protein, 19 aa, Mycobacterium
DSPRLASQQPQPTERPVRE

SEQ ID NO: 457880 - protein, 6 aa, Mycobacterium
DSPRLS

SEQ ID NO: 457881 - protein, 6 aa, Mycobacterium
DSPRPW

SEQ ID NO: 457882 - protein, 10 aa, Mycobacterium
DSPRPWKDEP

SEQ ID NO: 457883 - protein, 6 aa, Mycobacterium
DSPRQF

SEQ ID NO: 457884 - protein, 8 aa, Mycobacterium
DSPRSGSA

SEQ ID NO: 457885 - protein, 5 aa, Mycobacterium
DSPRT

SEQ ID NO: 457886 - protein, 8 aa, Mycobacterium
DSPSAYRG

SEQ ID NO: 457887 - protein, 7 aa, Mycobacterium
DSPSEPE

SEQ ID NO: 457888 - protein, 7 aa, Mycobacterium
DSPSFDG

SEQ ID NO: 457889 - protein, 6 aa, Mycobacterium
DSPSGP

SEQ ID NO: 457890 - protein, 9 aa, Mycobacterium
DSPSKAAGY

SEQ ID NO: 457891 - protein, 7 aa, Mycobacterium
DSPSPHV

SEQ ID NO: 457892 - protein, 8 aa, Mycobacterium
DSPSPRVD

SEQ ID NO: 457893 - protein, 8 aa, Mycobacterium
DSPSRLRH

SEQ ID NO: 457894 - protein, 9 aa, Mycobacterium
DSPSSPSVA

SEQ ID NO: 457895 - protein, 11 aa, Mycobacterium
DSPSSRSGASN

SEQ ID NO: 457896 - protein, 7 aa, Mycobacterium
DSPSYDG

SEQ ID NO: 457897 - protein, 5 aa, Mycobacterium
DSPTA

SEQ ID NO: 457898 - protein, 8 aa, Mycobacterium
DSPTDLPE

SEQ ID NO: 457899 - protein, 7 aa, Mycobacterium
DSPTGAI

SEQ ID NO: 457900 - protein, 12 aa, Mycobacterium
DSPTGEHGGDGL

SEQ ID NO: 457901 - protein, 9 aa, Mycobacterium
DSPTLPKPL

SEQ ID NO: 457902 - protein, 7 aa, Mycobacterium
DSPTQLV

SEQ ID NO: 457903 - protein, 6 aa, Mycobacterium
DSPTRL

SEQ ID NO: 457904 - protein, 7 aa, Mycobacterium
DSPTRSV

SEQ ID NO: 457905 - protein, 6 aa, Mycobacterium
DSPTYD

SEQ ID NO: 457906 - protein, 5 aa, Mycobacterium
DSPVA

SEQ ID NO: 457907 - protein, 5 aa, Mycobacterium
DSPVD

SEQ ID NO: 457908 - protein, 24 aa, Mycobacterium
DSPVGAGTGWPGDPATPQTPVAAD

SEQ ID NO: 457909 - protein, 18 aa, Mycobacterium
DSPVKSDSRLARKRTTVG

SEQ ID NO: 457910 - protein, 19 aa, Mycobacterium
DSPVKSDSRLARKSTSIGG

SEQ ID NO: 457911 - protein, 17 aa, Mycobacterium
DSPVKSDSRLARRATTV

SEQ ID NO: 457912 - protein, 5 aa, Mycobacterium
DSPVP

SEQ ID NO: 457913 - protein, 14 aa, Mycobacterium
DSPVSGGVAGAERG

SEQ ID NO: 457914 - protein, 15 aa, Mycobacterium
DSPVSGGVGGAEKGT

SEQ ID NO: 457915 - protein, 11 aa, Mycobacterium
DSPVTDEDLDP

SEQ ID NO: 457916 - protein, 5 aa, Mycobacterium
DSPWR

SEQ ID NO: 457917 - protein, 6 aa, Mycobacterium
DSPWRA

SEQ ID NO: 457918 - protein, 5 aa, Mycobacterium
DSPYE

SEQ ID NO: 457919 - protein, 6 aa, Mycobacterium
DSPYGL

SEQ ID NO: 457920 - protein, 7 aa, Mycobacterium
DSPYPDY

SEQ ID NO: 457921 - protein, 12 aa, Mycobacterium
DSPYQPPADPDL

SEQ ID NO: 457922 - protein, 13 aa, Mycobacterium
DSPYQPPANPDLR

SEQ ID NO: 457923 - protein, 10 aa, Mycobacterium
DSPYQRPKHP

SEQ ID NO: 457924 - protein, 11 aa, Mycobacterium
DSPYQRPKHPD

SEQ ID NO: 457925 - protein, 6 aa, Mycobacterium
DSQAAA

SEQ ID NO: 457926 - protein, 6 aa, Mycobacterium
DSQAEA

SEQ ID NO: 457927 - protein, 6 aa, Mycobacterium
DSQAMG

SEQ ID NO: 457928 - protein, 7 aa, Mycobacterium
DSQDENP

SEQ ID NO: 457929 - protein, 5 aa, Mycobacterium
DSQDR

SEQ ID NO: 457930 - protein, 7 aa, Mycobacterium
DSQDSFG

SEQ ID NO: 457931 - protein, 6 aa, Mycobacterium
DSQDSI

SEQ ID NO: 457932 - protein, 7 aa, Mycobacterium
DSQDYSR

SEQ ID NO: 457933 - protein, 6 aa, Mycobacterium
DSQEAI

SEQ ID NO: 457934 - protein, 7 aa, Mycobacterium
DSQEGAV

SEQ ID NO: 457935 - protein, 6 aa, Mycobacterium
DSQESS

SEQ ID NO: 457936 - protein, 4 aa, Mycobacterium
DSQG

SEQ ID NO: 457937 - protein, 5 aa, Mycobacterium
DSQGC

SEQ ID NO: 457938 - protein, 5 aa, Mycobacterium
DSQGF

SEQ ID NO: 457939 - protein, 7 aa, Mycobacterium
DSQGLSA

SEQ ID NO: 457940 - protein, 8 aa, Mycobacterium
DSQGQRYG

SEQ ID NO: 457941 - protein, 6 aa, Mycobacterium
DSQGRG

SEQ ID NO: 457942 - protein, 15 aa, Mycobacterium
DSQHEGGDGELTENA

SEQ ID NO: 457943 - protein, 6 aa, Mycobacterium
DSQIDG

SEQ ID NO: 457944 - protein, 4 aa, Mycobacterium
DSQK

SEQ ID NO: 457945 - protein, 8 aa, Mycobacterium
DSQNGDVR

SEQ ID NO: 457946 - protein, 8 aa, Mycobacterium
DSQPDRDV

SEQ ID NO: 457947 - protein, 23 aa, Mycobacterium
DSQPGSDHGARGEFDDESHTHSP

SEQ ID NO: 457948 - protein, 8 aa, Mycobacterium
DSQPLGGR

SEQ ID NO: 457949 - protein, 10 aa, Mycobacterium
DSQPRGGRFD

SEQ ID NO: 457950 - protein, 18 aa, Mycobacterium
DSQQTWTPDDADRRYSTY

SEQ ID NO: 457951 - protein, 12 aa, Mycobacterium
DSQRAGREALRA

SEQ ID NO: 457952 - protein, 21 aa, Mycobacterium
DSQRGNWPPGFPDDKRPSYSL

SEQ ID NO: 457953 - protein, 26 aa, Mycobacterium
DSQRGTIPNEQGRVKDSSTGQAHPGT

SEQ ID NO: 457954 - protein, 6 aa, Mycobacterium
DSQRPW

SEQ ID NO: 457955 - protein, 7 aa, Mycobacterium
DSQSPDF

SEQ ID NO: 457956 - protein, 17 aa, Mycobacterium
DSQSQGHTVGEVLHIDA

SEQ ID NO: 457957 - protein, 8 aa, Mycobacterium
DSQTLDDA

SEQ ID NO: 457958 - protein, 10 aa, Mycobacterium
DSQTLDDDHR

SEQ ID NO: 457959 - protein, 9 aa, Mycobacterium
DSQTPIGRG

SEQ ID NO: 457960 - protein, 10 aa, Mycobacterium
DSQTPIGRGQ

SEQ ID NO: 457961 - protein, 14 aa, Mycobacterium
DSQTQVDLPSGQSY

SEQ ID NO: 457962 - protein, 5 aa, Mycobacterium
DSQTR

SEQ ID NO: 457963 - protein, 8 aa, Mycobacterium
DSQTRGPD

SEQ ID NO: 457964 - protein, 15 aa, Mycobacterium
DSQTTGTTVHMNTRI

SEQ ID NO: 457965 - protein, 4 aa, Mycobacterium
DSQY

SEQ ID NO: 457966 - protein, 15 aa, Mycobacterium
DSRAAALRDTAPAPV

SEQ ID NO: 457967 - protein, 7 aa, Mycobacterium
DSRAGVD

SEQ ID NO: 457968 - protein, 16 aa, Mycobacterium
DSRAIDHAPTAEGDRY

SEQ ID NO: 457969 - protein, 5 aa, Mycobacterium
DSRAR

SEQ ID NO: 457970 - protein, 19 aa, Mycobacterium
DSRATPGFDGSREDGEALQ

SEQ ID NO: 457971 - protein, 4 aa, Mycobacterium
DSRD

SEQ ID NO: 457972 - protein, 15 aa, Mycobacterium
DSRDAAGSGADRHAN

SEQ ID NO: 457973 - protein, 21 aa, Mycobacterium
DSRDAAGSGADRHANFGTGQI

SEQ ID NO: 457974 - protein, 23 aa, Mycobacterium
DSRDAAGSGADRHANIGNGRIDP

SEQ ID NO: 457975 - protein, 15 aa, Mycobacterium
DSRDAAGSGRDRHAN

SEQ ID NO: 457976 - protein, 11 aa, Mycobacterium
DSRDPDPRASD

SEQ ID NO: 457977 - protein, 4 aa, Mycobacterium
DSRE

SEQ ID NO: 457978 - protein, 5 aa, Mycobacterium
DSREL

SEQ ID NO: 457979 - protein, 11 aa, Mycobacterium
DSRESFDDNGL

SEQ ID NO: 457980 - protein, 4 aa, Mycobacterium
DSRG

SEQ ID NO: 457981 - protein, 14 aa, Mycobacterium
DSRGCGRSEGTGKL

SEQ ID NO: 457982 - protein, 13 aa, Mycobacterium
DSRGCGRSNGTGR

SEQ ID NO: 457983 - protein, 6 aa, Mycobacterium
DSRGLA

SEQ ID NO: 457984 - protein, 10 aa, Mycobacterium
DSRGNAAYTG

SEQ ID NO: 457985 - protein, 19 aa, Mycobacterium
DSRGRVPGAAQQPLPSVGE

SEQ ID NO: 457986 - protein, 16 aa, Mycobacterium
DSRGSANIRARRGETH

SEQ ID NO: 457987 - protein, 6 aa, Mycobacterium
DSRGVL

SEQ ID NO: 457988 - protein, 6 aa, Mycobacterium
DSRHGS

SEQ ID NO: 457989 - protein, 4 aa, Mycobacterium
DSRI

SEQ ID NO: 457990 - protein, 6 aa, Mycobacterium
DSRIDT

SEQ ID NO: 457991 - protein, 6 aa, Mycobacterium
DSRIEP

SEQ ID NO: 457992 - protein, 7 aa, Mycobacterium
DSRIETR

SEQ ID NO: 457993 - protein, 5 aa, Mycobacterium
DSRLA

SEQ ID NO: 457994 - protein, 7 aa, Mycobacterium
DSRLRAS

SEQ ID NO: 457995 - protein, 8 aa, Mycobacterium
DSRNPDTE

SEQ ID NO: 457996 - protein, 11 aa, Mycobacterium
DSRNPRRDNPL

SEQ ID NO: 457997 - protein, 4 aa, Mycobacterium
DSRP

SEQ ID NO: 457998 - protein, 9 aa, Mycobacterium
DSRPDRADA

SEQ ID NO: 457999 - protein, 13 aa, Mycobacterium
DSRPLTDYDETGA

SEQ ID NO: 458000 - protein, 7 aa, Mycobacterium
DSRPSKW

SEQ ID NO: 458001 - protein, 10 aa, Mycobacterium
DSRPTTHDDP

SEQ ID NO: 458002 - protein, 13 aa, Mycobacterium
DSRPTTHDEPTYT

SEQ ID NO: 458003 - protein, 11 aa, Mycobacterium
DSRPTTHTSPT

SEQ ID NO: 458004 - protein, 8 aa, Mycobacterium
DSRPVRVG

SEQ ID NO: 458005 - protein, 6 aa, Mycobacterium
DSRQAA

SEQ ID NO: 458006 - protein, 9 aa, Mycobacterium
DSRQFPPDG

SEQ ID NO: 458007 - protein, 13 aa, Mycobacterium
DSRQLPNIDPDGR

SEQ ID NO: 458008 - protein, 5 aa, Mycobacterium
DSRQQ

SEQ ID NO: 458009 - protein, 5 aa, Mycobacterium
DSRQR

SEQ ID NO: 458010 - protein, 8 aa, Mycobacterium
DSRRIGRR

SEQ ID NO: 458011 - protein, 5 aa, Mycobacterium
DSRRP

SEQ ID NO: 458012 - protein, 8 aa, Mycobacterium
DSRRSFAT

SEQ ID NO: 458013 - protein, 13 aa, Mycobacterium
DSRRYRAATRDTI

SEQ ID NO: 458014 - protein, 9 aa, Mycobacterium
DSRSARPIL

SEQ ID NO: 458015 - protein, 8 aa, Mycobacterium
DSRSDQIS

SEQ ID NO: 458016 - protein, 14 aa, Mycobacterium
DSRSKTHKRTPTDW

SEQ ID NO: 458017 - protein, 6 aa, Mycobacterium
DSRSTD

SEQ ID NO: 458018 - protein, 5 aa, Mycobacterium
DSRSV

SEQ ID NO: 458019 - protein, 9 aa, Mycobacterium
DSRTAASAE

SEQ ID NO: 458020 - protein, 9 aa, Mycobacterium
DSRTGEIDK

SEQ ID NO: 458021 - protein, 8 aa, Mycobacterium
DSRTGEMD

SEQ ID NO: 458022 - protein, 10 aa, Mycobacterium
DSRTGEMDKA

SEQ ID NO: 458023 - protein, 11 aa, Mycobacterium
DSRTGETQKFD

SEQ ID NO: 458024 - protein, 10 aa, Mycobacterium
DSRTLADGPS

SEQ ID NO: 458025 - protein, 7 aa, Mycobacterium
DSRTNGS

SEQ ID NO: 458026 - protein, 6 aa, Mycobacterium
DSRTQT

SEQ ID NO: 458027 - protein, 9 aa, Mycobacterium
DSRTRSVDQ

SEQ ID NO: 458028 - protein, 7 aa, Mycobacterium
DSRTRYP

SEQ ID NO: 458029 - protein, 13 aa, Mycobacterium
DSRTSVDDRLPGY

SEQ ID NO: 458030 - protein, 8 aa, Mycobacterium
DSRVGPTR

SEQ ID NO: 458031 - protein, 13 aa, Mycobacterium
DSRWRPARGVSKV

SEQ ID NO: 458032 - protein, 10 aa, Mycobacterium
DSRYDGGRSK

SEQ ID NO: 458033 - protein, 6 aa, Mycobacterium
DSRYGS

SEQ ID NO: 458034 - protein, 6 aa, Mycobacterium
DSRYIT

SEQ ID NO: 458035 - protein, 17 aa, Mycobacterium
DSRYPELKKPDGAGIGR

SEQ ID NO: 458036 - protein, 5 aa, Mycobacterium
DSRYV

SEQ ID NO: 458037 - protein, 5 aa, Mycobacterium
DSSAA

SEQ ID NO: 458038 - protein, 8 aa, Mycobacterium
DSSAAGQV

SEQ ID NO: 458039 - protein, 7 aa, Mycobacterium
DSSAEAL

SEQ ID NO: 458040 - protein, 9 aa, Mycobacterium
DSSAESDAA

SEQ ID NO: 458041 - protein, 22 aa, Mycobacterium
DSSAKTRTSTPSAKSSRSDEPI

SEQ ID NO: 458042 - protein, 7 aa, Mycobacterium
DSSAPLT

SEQ ID NO: 458043 - protein, 6 aa, Mycobacterium
DSSARS

SEQ ID NO: 458044 - protein, 14 aa, Mycobacterium
DSSASLRSRRRGRG

SEQ ID NO: 458045 - protein, 19 aa, Mycobacterium
DSSATISGSQIAVDRGTMK

SEQ ID NO: 458046 - protein, 6 aa, Mycobacterium
DSSATR

SEQ ID NO: 458047 - protein, 11 aa, Mycobacterium
DSSATRRGEPT

SEQ ID NO: 458048 - protein, 10 aa, Mycobacterium
DSSATTTGGL

SEQ ID NO: 458049 - protein, 8 aa, Mycobacterium
DSSCTDVP

SEQ ID NO: 458050 - protein, 7 aa, Mycobacterium
DSSDAGL

SEQ ID NO: 458051 - protein, 9 aa, Mycobacterium
DSSDESHEF

SEQ ID NO: 458052 - protein, 5 aa, Mycobacterium
DSSDL

SEQ ID NO: 458053 - protein, 6 aa, Mycobacterium
DSSDRI

SEQ ID NO: 458054 - protein, 8 aa, Mycobacterium
DSSDSPVP

SEQ ID NO: 458055 - protein, 4 aa, Mycobacterium
DSSE

SEQ ID NO: 458056 - protein, 6 aa, Mycobacterium
DSSEEM

SEQ ID NO: 458057 - protein, 7 aa, Mycobacterium
DSSEESI

SEQ ID NO: 458058 - protein, 13 aa, Mycobacterium
DSSEKYKLPADDR

SEQ ID NO: 458059 - protein, 6 aa, Mycobacterium
DSSERI

SEQ ID NO: 458060 - protein, 7 aa, Mycobacterium
DSSERVH

SEQ ID NO: 458061 - protein, 7 aa, Mycobacterium
DSSETLN

SEQ ID NO: 458062 - protein, 6 aa, Mycobacterium
DSSFRA

SEQ ID NO: 458063 - protein, 13 aa, Mycobacterium
DSSGAERDDDGSV

SEQ ID NO: 458064 - protein, 13 aa, Mycobacterium
DSSGAQRDDDGSV

SEQ ID NO: 458065 - protein, 8 aa, Mycobacterium
DSSGEIRD

SEQ ID NO: 458066 - protein, 7 aa, Mycobacterium
DSSGHHD

SEQ ID NO: 458067 - protein, 8 aa, Mycobacterium
DSSGKHHS

SEQ ID NO: 458068 - protein, 6 aa, Mycobacterium
DSSGLD

SEQ ID NO: 458069 - protein, 10 aa, Mycobacterium
DSSGLPDTPL

SEQ ID NO: 458070 - protein, 10 aa, Mycobacterium
DSSGPATEDQ

SEQ ID NO: 458071 - protein, 6 aa, Mycobacterium
DSSGPC

SEQ ID NO: 458072 - protein, 14 aa, Mycobacterium
DSSGPIGNSGFANT

SEQ ID NO: 458073 - protein, 20 aa, Mycobacterium
DSSGQRPGRIGADTEASSYA

SEQ ID NO: 458074 - protein, 20 aa, Mycobacterium
DSSGQRPGRIGTDTEASSYA

SEQ ID NO: 458075 - protein, 24 aa, Mycobacterium
DSSGSPVEPDGPAAREVGEPAADD

SEQ ID NO: 458076 - protein, 7 aa, Mycobacterium
DSSGTLT

SEQ ID NO: 458077 - protein, 9 aa, Mycobacterium
DSSHLTPSD

SEQ ID NO: 458078 - protein, 9 aa, Mycobacterium
DSSIGGKDH

SEQ ID NO: 458079 - protein, 8 aa, Mycobacterium
DSSIPAGS

SEQ ID NO: 458080 - protein, 16 aa, Mycobacterium
DSSIPATTVKNEKYGN

SEQ ID NO: 458081 - protein, 7 aa, Mycobacterium
DSSIPEA

SEQ ID NO: 458082 - protein, 9 aa, Mycobacterium
DSSKARQTF

SEQ ID NO: 458083 - protein, 8 aa, Mycobacterium
DSSKVGRE

SEQ ID NO: 458084 - protein, 4 aa, Mycobacterium
DSSL

SEQ ID NO: 458085 - protein, 5 aa, Mycobacterium
DSSLT

SEQ ID NO: 458086 - protein, 9 aa, Mycobacterium
DSSNGRTRY

SEQ ID NO: 458087 - protein, 6 aa, Mycobacterium
DSSNNR

SEQ ID NO: 458088 - protein, 6 aa, Mycobacterium
DSSNSL

SEQ ID NO: 458089 - protein, 8 aa, Mycobacterium
DSSNTPQI

SEQ ID NO: 458090 - protein, 41 aa, Mycobacterium
DSSPAATADGHAGGSSVIQSPSAHADPSAAAAGQSAGSVDA

SEQ ID NO: 458091 - protein, 6 aa, Mycobacterium
DSSPAL

SEQ ID NO: 458092 - protein, 10 aa, Mycobacterium
DSSPARARRA

SEQ ID NO: 458093 - protein, 11 aa, Mycobacterium
DSSPDGTGELA

SEQ ID NO: 458094 - protein, 10 aa, Mycobacterium
DSSPDGTGQL

SEQ ID NO: 458095 - protein, 6 aa, Mycobacterium
DSSPDL

SEQ ID NO: 458096 - protein, 7 aa, Mycobacterium
DSSPDLR

SEQ ID NO: 458097 - protein, 6 aa, Mycobacterium
DSSPEM

SEQ ID NO: 458098 - protein, 8 aa, Mycobacterium
DSSPERDF

SEQ ID NO: 458099 - protein, 7 aa, Mycobacterium
DSSPGIV

SEQ ID NO: 458100 - protein, 10 aa, Mycobacterium
DSSPGNADGF

SEQ ID NO: 458101 - protein, 9 aa, Mycobacterium
DSSPGNVGG

SEQ ID NO: 458102 - protein, 6 aa, Mycobacterium
DSSPGV

SEQ ID NO: 458103 - protein, 6 aa, Mycobacterium
DSSPRH

SEQ ID NO: 458104 - protein, 6 aa, Mycobacterium
DSSPVG

SEQ ID NO: 458105 - protein, 7 aa, Mycobacterium
DSSQSAV

SEQ ID NO: 458106 - protein, 10 aa, Mycobacterium
DSSRAASAPG

SEQ ID NO: 458107 - protein, 6 aa, Mycobacterium
DSSRLR

SEQ ID NO: 458108 - protein, 24 aa, Mycobacterium
DSSSGLADPRQLAGYTGAAEAPNS

SEQ ID NO: 458109 - protein, 9 aa, Mycobacterium
DSSSRMSRL

SEQ ID NO: 458110 - protein, 10 aa, Mycobacterium
DSSSTAAQVA

SEQ ID NO: 458111 - protein, 9 aa, Mycobacterium
DSSSTRHYD

SEQ ID NO: 458112 - protein, 10 aa, Mycobacterium
DSSTDPADFT

SEQ ID NO: 458113 - protein, 10 aa, Mycobacterium
DSSTDREKAL

SEQ ID NO: 458114 - protein, 17 aa, Mycobacterium
DSSTGNPETGEVPIDQD

SEQ ID NO: 458115 - protein, 7 aa, Mycobacterium
DSSTPMD

SEQ ID NO: 458116 - protein, 7 aa, Mycobacterium
DSSTPVA

SEQ ID NO: 458117 - protein, 11 aa, Mycobacterium
DSSTTAASNAK

SEQ ID NO: 458118 - protein, 7 aa, Mycobacterium
DSSTVRD

SEQ ID NO: 458119 - protein, 10 aa, Mycobacterium
DSSVAPATVR

SEQ ID NO: 458120 - protein, 5 aa, Mycobacterium
DSSVG

SEQ ID NO: 458121 - protein, 9 aa, Mycobacterium
DSSVNGTRW

SEQ ID NO: 458122 - protein, 9 aa, Mycobacterium
DSSVPDGVK

SEQ ID NO: 458123 - protein, 8 aa, Mycobacterium
DSSVPPDT

SEQ ID NO: 458124 - protein, 5 aa, Mycobacterium
DSSVR

SEQ ID NO: 458125 - protein, 7 aa, Mycobacterium
DSSVSAG

SEQ ID NO: 458126 - protein, 7 aa, Mycobacterium
DSSYNGV

SEQ ID NO: 458127 - protein, 5 aa, Mycobacterium
DSTAA

SEQ ID NO: 458128 - protein, 7 aa, Mycobacterium
DSTAALR

SEQ ID NO: 458129 - protein, 10 aa, Mycobacterium
DSTADERREA

SEQ ID NO: 458130 - protein, 8 aa, Mycobacterium
DSTADHAE

SEQ ID NO: 458131 - protein, 5 aa, Mycobacterium
DSTAE

SEQ ID NO: 458132 - protein, 5 aa, Mycobacterium
DSTAL

SEQ ID NO: 458133 - protein, 7 aa, Mycobacterium
DSTALRP

SEQ ID NO: 458134 - protein, 7 aa, Mycobacterium
DSTALTR

SEQ ID NO: 458135 - protein, 7 aa, Mycobacterium
DSTAMAK

SEQ ID NO: 458136 - protein, 6 aa, Mycobacterium
DSTAQR

SEQ ID NO: 458137 - protein, 14 aa, Mycobacterium
DSTARGRTLNPGQA

SEQ ID NO: 458138 - protein, 5 aa, Mycobacterium
DSTAT

SEQ ID NO: 458139 - protein, 7 aa, Mycobacterium
DSTATGY

SEQ ID NO: 458140 - protein, 7 aa, Mycobacterium
DSTATVD

SEQ ID NO: 458141 - protein, 8 aa, Mycobacterium
DSTATVER

SEQ ID NO: 458142 - protein, 7 aa, Mycobacterium
DSTCDHA

SEQ ID NO: 458143 - protein, 4 aa, Mycobacterium
DSTD

SEQ ID NO: 458144 - protein, 8 aa, Mycobacterium
DSTDDDAH

SEQ ID NO: 458145 - protein, 12 aa, Mycobacterium
DSTDDRTGAARD

SEQ ID NO: 458146 - protein, 7 aa, Mycobacterium
DSTDHRP

SEQ ID NO: 458147 - protein, 16 aa, Mycobacterium
DSTDRQLRVTSRRLAP

SEQ ID NO: 458148 - protein, 6 aa, Mycobacterium
DSTEGG

SEQ ID NO: 458149 - protein, 5 aa, Mycobacterium
DSTEH

SEQ ID NO: 458150 - protein, 11 aa, Mycobacterium
DSTEHPHGLPD

SEQ ID NO: 458151 - protein, 7 aa, Mycobacterium
DSTELTE

SEQ ID NO: 458152 - protein, 8 aa, Mycobacterium
DSTESDFH

SEQ ID NO: 458153 - protein, 6 aa, Mycobacterium
DSTEVP

SEQ ID NO: 458154 - protein, 6 aa, Mycobacterium
DSTEVS

SEQ ID NO: 458155 - protein, 5 aa, Mycobacterium
DSTFT

SEQ ID NO: 458156 - protein, 12 aa, Mycobacterium
DSTFTAGRRGVG

SEQ ID NO: 458157 - protein, 4 aa, Mycobacterium
DSTG

SEQ ID NO: 458158 - protein, 11 aa, Mycobacterium
DSTGADYASAL

SEQ ID NO: 458159 - protein, 11 aa, Mycobacterium
DSTGADYDTAL

SEQ ID NO: 458160 - protein, 11 aa, Mycobacterium
DSTGADYESAL

SEQ ID NO: 458161 - protein, 7 aa, Mycobacterium
DSTGGAT

SEQ ID NO: 458162 - protein, 6 aa, Mycobacterium
DSTGGL

SEQ ID NO: 458163 - protein, 11 aa, Mycobacterium
DSTGKPPQYPI

SEQ ID NO: 458164 - protein, 10 aa, Mycobacterium
DSTGLPDSPV

SEQ ID NO: 458165 - protein, 10 aa, Mycobacterium
DSTGLPDTPL

SEQ ID NO: 458166 - protein, 10 aa, Mycobacterium
DSTGLPDTPV

SEQ ID NO: 458167 - protein, 23 aa, Mycobacterium
DSTGNRKDRVPGAARSGLNTTTS

SEQ ID NO: 458168 - protein, 10 aa, Mycobacterium
DSTGPNTGEF

SEQ ID NO: 458169 - protein, 14 aa, Mycobacterium
DSTGPQLSADHPGV

SEQ ID NO: 458170 - protein, 8 aa, Mycobacterium
DSTGQDVA

SEQ ID NO: 458171 - protein, 8 aa, Mycobacterium
DSTLADKN

SEQ ID NO: 458172 - protein, 10 aa, Mycobacterium
DSTLGGADDR

SEQ ID NO: 458173 - protein, 6 aa, Mycobacterium
DSTLGR

SEQ ID NO: 458174 - protein, 7 aa, Mycobacterium
DSTLSLQ

SEQ ID NO: 458175 - protein, 8 aa, Mycobacterium
DSTNDARV

SEQ ID NO: 458176 - protein, 26 aa, Mycobacterium
DSTPAASTGADAEGAVKSKTKVKVTD

SEQ ID NO: 458177 - protein, 8 aa, Mycobacterium
DSTPEAEI

SEQ ID NO: 458178 - protein, 10 aa, Mycobacterium
DSTPNNPTVK

SEQ ID NO: 458179 - protein, 7 aa, Mycobacterium
DSTPPPW

SEQ ID NO: 458180 - protein, 7 aa, Mycobacterium
DSTPQDF

SEQ ID NO: 458181 - protein, 8 aa, Mycobacterium
DSTPVTPS

SEQ ID NO: 458182 - protein, 20 aa, Mycobacterium
DSTQIPAVPDRDSRATSSAL

SEQ ID NO: 458183 - protein, 5 aa, Mycobacterium
DSTQL

SEQ ID NO: 458184 - protein, 4 aa, Mycobacterium
DSTR

SEQ ID NO: 458185 - protein, 14 aa, Mycobacterium
DSTRPRLPADHPGV

SEQ ID NO: 458186 - protein, 7 aa, Mycobacterium
DSTRYQA

SEQ ID NO: 458187 - protein, 40 aa, Mycobacterium
DSTSDEEKANEPDASRQAPEADTPEGEPREASQKSSVDPS

SEQ ID NO: 458188 - protein, 8 aa, Mycobacterium
DSTSEAVG

SEQ ID NO: 458189 - protein, 8 aa, Mycobacterium
DSTSEDVA

SEQ ID NO: 458190 - protein, 8 aa, Mycobacterium
DSTSETPL

SEQ ID NO: 458191 - protein, 9 aa, Mycobacterium
DSTSGDVAE

SEQ ID NO: 458192 - protein, 5 aa, Mycobacterium
DSTSI

SEQ ID NO: 458193 - protein, 13 aa, Mycobacterium
DSTSRPVAAHDDD

SEQ ID NO: 458194 - protein, 9 aa, Mycobacterium
DSTSRRPFR

SEQ ID NO: 458195 - protein, 11 aa, Mycobacterium
DSTSRRPLRGG

SEQ ID NO: 458196 - protein, 7 aa, Mycobacterium
DSTSVEH

SEQ ID NO: 458197 - protein, 8 aa, Mycobacterium
DSTTAGRV

SEQ ID NO: 458198 - protein, 7 aa, Mycobacterium
DSTTETG

SEQ ID NO: 458199 - protein, 20 aa, Mycobacterium
DSTTLSDSALQAARSQAAEL

SEQ ID NO: 458200 - protein, 8 aa, Mycobacterium
DSTTLSES

SEQ ID NO: 458201 - protein, 9 aa, Mycobacterium
DSTTLSQSA

SEQ ID NO: 458202 - protein, 19 aa, Mycobacterium
DSTTLSQSAIDAARNQARQ

SEQ ID NO: 458203 - protein, 19 aa, Mycobacterium
DSTTLSQSAINAARNQARQ

SEQ ID NO: 458204 - protein, 8 aa, Mycobacterium
DSTTPVTR

SEQ ID NO: 458205 - protein, 15 aa, Mycobacterium
DSTTTGGDGGDGGNA

SEQ ID NO: 458206 - protein, 7 aa, Mycobacterium
DSTTYRE

SEQ ID NO: 458207 - protein, 4 aa, Mycobacterium
DSTV

SEQ ID NO: 458208 - protein, 5 aa, Mycobacterium
DSTVA

SEQ ID NO: 458209 - protein, 5 aa, Mycobacterium
DSTVN

SEQ ID NO: 458210 - protein, 6 aa, Mycobacterium
DSTVNT

SEQ ID NO: 458211 - protein, 7 aa, Mycobacterium
DSTVPEA

SEQ ID NO: 458212 - protein, 5 aa, Mycobacterium
DSTVR

SEQ ID NO: 458213 - protein, 10 aa, Mycobacterium
DSTVRNDGHG

SEQ ID NO: 458214 - protein, 6 aa, Mycobacterium
DSTVTR

SEQ ID NO: 458215 - protein, 7 aa, Mycobacterium
DSTYRPM

SEQ ID NO: 458216 - protein, 5 aa, Mycobacterium
DSTYV

SEQ ID NO: 458217 - protein, 4 aa, Mycobacterium
DSVA

SEQ ID NO: 458218 - protein, 8 aa, Mycobacterium
DSVAAARR

SEQ ID NO: 458219 - protein, 12 aa, Mycobacterium
DSVADGSEDEIL

SEQ ID NO: 458220 - protein, 7 aa, Mycobacterium
DSVADRV

SEQ ID NO: 458221 - protein, 19 aa, Mycobacterium
DSVADTETLTGGPGSAGHR

SEQ ID NO: 458222 - protein, 11 aa, Mycobacterium
DSVAESEGAEN

SEQ ID NO: 458223 - protein, 6 aa, Mycobacterium
DSVAGP

SEQ ID NO: 458224 - protein, 11 aa, Mycobacterium
DSVAPDAATTS

SEQ ID NO: 458225 - protein, 8 aa, Mycobacterium
DSVAPGSP

SEQ ID NO: 458226 - protein, 6 aa, Mycobacterium
DSVARD

SEQ ID NO: 458227 - protein, 5 aa, Mycobacterium
DSVAS

SEQ ID NO: 458228 - protein, 4 aa, Mycobacterium
DSVD

SEQ ID NO: 458229 - protein, 5 aa, Mycobacterium
DSVDA

SEQ ID NO: 458230 - protein, 7 aa, Mycobacterium
DSVDDSA

SEQ ID NO: 458231 - protein, 8 aa, Mycobacterium
DSVDDSTL

SEQ ID NO: 458232 - protein, 5 aa, Mycobacterium
DSVDG

SEQ ID NO: 458233 - protein, 6 aa, Mycobacterium
DSVDRE

SEQ ID NO: 458234 - protein, 6 aa, Mycobacterium
DSVDRT

SEQ ID NO: 458235 - protein, 11 aa, Mycobacterium
DSVDSAAGGQA

SEQ ID NO: 458236 - protein, 8 aa, Mycobacterium
DSVDSKER

SEQ ID NO: 458237 - protein, 11 aa, Mycobacterium
DSVDTPAGGQA

SEQ ID NO: 458238 - protein, 7 aa, Mycobacterium
DSVEPPI

SEQ ID NO: 458239 - protein, 4 aa, Mycobacterium
DSVG

SEQ ID NO: 458240 - protein, 13 aa, Mycobacterium
DSVGASASASAGT

SEQ ID NO: 458241 - protein, 9 aa, Mycobacterium
DSVGATPTW

SEQ ID NO: 458242 - protein, 13 aa, Mycobacterium
DSVGEKPTDQNVE

SEQ ID NO: 458243 - protein, 14 aa, Mycobacterium
DSVGFDPQQPGRTY

SEQ ID NO: 458244 - protein, 16 aa, Mycobacterium
DSVGGGVRSGAATGPG

SEQ ID NO: 458245 - protein, 12 aa, Mycobacterium
DSVGKPAPSVSQ

SEQ ID NO: 458246 - protein, 15 aa, Mycobacterium
DSVGLGTAARERNIT

SEQ ID NO: 458247 - protein, 5 aa, Mycobacterium
DSVGQ

SEQ ID NO: 458248 - protein, 7 aa, Mycobacterium
DSVGSAN

SEQ ID NO: 458249 - protein, 17 aa, Mycobacterium
DSVGVTPKDQLRNEFGG

SEQ ID NO: 458250 - protein, 9 aa, Mycobacterium
DSVLGQPPL

SEQ ID NO: 458251 - protein, 6 aa, Mycobacterium
DSVNDK

SEQ ID NO: 458252 - protein, 5 aa, Mycobacterium
DSVPD

SEQ ID NO: 458253 - protein, 10 aa, Mycobacterium
DSVPGEPESL

SEQ ID NO: 458254 - protein, 10 aa, Mycobacterium
DSVPGLGEHR

SEQ ID NO: 458255 - protein, 6 aa, Mycobacterium
DSVPLP

SEQ ID NO: 458256 - protein, 12 aa, Mycobacterium
DSVPSGGAFDGP

SEQ ID NO: 458257 - protein, 7 aa, Mycobacterium
DSVPTAE

SEQ ID NO: 458258 - protein, 7 aa, Mycobacterium
DSVPTAL

SEQ ID NO: 458259 - protein, 4 aa, Mycobacterium
DSVQ

SEQ ID NO: 458260 - protein, 4 aa, Mycobacterium
DSVR

SEQ ID NO: 458261 - protein, 9 aa, Mycobacterium
DSVRAQAPQ

SEQ ID NO: 458262 - protein, 10 aa, Mycobacterium
DSVRDCGGDS

SEQ ID NO: 458263 - protein, 9 aa, Mycobacterium
DSVREPDGA

SEQ ID NO: 458264 - protein, 6 aa, Mycobacterium
DSVRGP

SEQ ID NO: 458265 - protein, 14 aa, Mycobacterium
DSVRGTRDPGNYAD

SEQ ID NO: 458266 - protein, 5 aa, Mycobacterium
DSVRR

SEQ ID NO: 458267 - protein, 6 aa, Mycobacterium
DSVRTP

SEQ ID NO: 458268 - protein, 9 aa, Mycobacterium
DSVSDEIAA

SEQ ID NO: 458269 - protein, 11 aa, Mycobacterium
DSVSDTGDGVR

SEQ ID NO: 458270 - protein, 6 aa, Mycobacterium
DSVSRG

SEQ ID NO: 458271 - protein, 9 aa, Mycobacterium
DSVSVRPGG

SEQ ID NO: 458272 - protein, 7 aa, Mycobacterium
DSVTAKS

SEQ ID NO: 458273 - protein, 8 aa, Mycobacterium
DSVTDETL

SEQ ID NO: 458274 - protein, 12 aa, Mycobacterium
DSVTGTAAAERA

SEQ ID NO: 458275 - protein, 16 aa, Mycobacterium
DSVTKSKFDNKYGTRH

SEQ ID NO: 458276 - protein, 8 aa, Mycobacterium
DSVTKTRE

SEQ ID NO: 458277 - protein, 5 aa, Mycobacterium
DSVTQ

SEQ ID NO: 458278 - protein, 7 aa, Mycobacterium
DSVTQAA

SEQ ID NO: 458279 - protein, 23 aa, Mycobacterium
DSVTTDHISPAGAIKADSPAGKY

SEQ ID NO: 458280 - protein, 7 aa, Mycobacterium
DSVVPGK

SEQ ID NO: 458281 - protein, 7 aa, Mycobacterium
DSVVQSG

SEQ ID NO: 458282 - protein, 12 aa, Mycobacterium
DSWAPDAPNQRD

SEQ ID NO: 458283 - protein, 4 aa, Mycobacterium
DSWD

SEQ ID NO: 458284 - protein, 4 aa, Mycobacterium
DSWE

SEQ ID NO: 458285 - protein, 11 aa, Mycobacterium
DSWESQSRTAI

SEQ ID NO: 458286 - protein, 5 aa, Mycobacterium
DSWGP

SEQ ID NO: 458287 - protein, 5 aa, Mycobacterium
DSWRP

SEQ ID NO: 458288 - protein, 10 aa, Mycobacterium
DSYAAGAAGD

SEQ ID NO: 458289 - protein, 6 aa, Mycobacterium
DSYADD

SEQ ID NO: 458290 - protein, 12 aa, Mycobacterium
DSYAENANLREA

SEQ ID NO: 458291 - protein, 5 aa, Mycobacterium
DSYAK

SEQ ID NO: 458292 - protein, 12 aa, Mycobacterium
DSYANGYGNSKW

SEQ ID NO: 458293 - protein, 14 aa, Mycobacterium
DSYDATARRHAAGA

SEQ ID NO: 458294 - protein, 8 aa, Mycobacterium
DSYDDQGN

SEQ ID NO: 458295 - protein, 14 aa, Mycobacterium
DSYDGTARQHAAGA

SEQ ID NO: 458296 - protein, 6 aa, Mycobacterium
DSYDKS

SEQ ID NO: 458297 - protein, 9 aa, Mycobacterium
DSYDPSGEK

SEQ ID NO: 458298 - protein, 12 aa, Mycobacterium
DSYDQVSRHPEV

SEQ ID NO: 458299 - protein, 8 aa, Mycobacterium
DSYEGKKI

SEQ ID NO: 458300 - protein, 6 aa, Mycobacterium
DSYEPH

SEQ ID NO: 458301 - protein, 6 aa, Mycobacterium
DSYEYA

SEQ ID NO: 458302 - protein, 5 aa, Mycobacterium
DSYGA

SEQ ID NO: 458303 - protein, 7 aa, Mycobacterium
DSYGEDL

SEQ ID NO: 458304 - protein, 5 aa, Mycobacterium
DSYGG

SEQ ID NO: 458305 - protein, 8 aa, Mycobacterium
DSYGGKKI

SEQ ID NO: 458306 - protein, 8 aa, Mycobacterium
DSYGPHPA

SEQ ID NO: 458307 - protein, 7 aa, Mycobacterium
DSYGSNG

SEQ ID NO: 458308 - protein, 8 aa, Mycobacterium
DSYHSRTS

SEQ ID NO: 458309 - protein, 5 aa, Mycobacterium
DSYLR

SEQ ID NO: 458310 - protein, 5 aa, Mycobacterium
DSYLT

SEQ ID NO: 458311 - protein, 6 aa, Mycobacterium
DSYLTP

SEQ ID NO: 458312 - protein, 5 aa, Mycobacterium
DSYPA

SEQ ID NO: 458313 - protein, 8 aa, Mycobacterium
DSYPNNTN

SEQ ID NO: 458314 - protein, 9 aa, Mycobacterium
DSYRADKPE

SEQ ID NO: 458315 - protein, 5 aa, Mycobacterium
DSYRE

SEQ ID NO: 458316 - protein, 5 aa, Mycobacterium
DSYRI

SEQ ID NO: 458317 - protein, 7 aa, Mycobacterium
DSYRRND

SEQ ID NO: 458318 - protein, 9 aa, Mycobacterium
DSYRSDSPD

SEQ ID NO: 458319 - protein, 12 aa, Mycobacterium
DSYSAQRRAYGD

SEQ ID NO: 458320 - protein, 18 aa, Mycobacterium
DSYSGANFPAGEQTLNAS

SEQ ID NO: 458321 - protein, 21 aa, Mycobacterium
DSYSNSVATIDEKSPRSAAAD

SEQ ID NO: 458322 - protein, 9 aa, Mycobacterium
DSYSPAGER

SEQ ID NO: 458323 - protein, 9 aa, Mycobacterium
DSYTDEHGE

SEQ ID NO: 458324 - protein, 6 aa, Mycobacterium
DSYTGQ

SEQ ID NO: 458325 - protein, 7 aa, Mycobacterium
DSYYEDP

SEQ ID NO: 458326 - protein, 5 aa, Mycobacterium
DTAAA

SEQ ID NO: 458327 - protein, 6 aa, Mycobacterium
DTAAAA

SEQ ID NO: 458328 - protein, 8 aa, Mycobacterium
DTAAAEAI

SEQ ID NO: 458329 - protein, 8 aa, Mycobacterium
DTAAAQAA

SEQ ID NO: 458330 - protein, 9 aa, Mycobacterium
DTAAATEQV

SEQ ID NO: 458331 - protein, 19 aa, Mycobacterium
DTAADAVNGTASFSEKQPI

SEQ ID NO: 458332 - protein, 10 aa, Mycobacterium
DTAADRPKPP

SEQ ID NO: 458333 - protein, 23 aa, Mycobacterium
DTAAEIGAAEGDAVTVSTSRGSI

SEQ ID NO: 458334 - protein, 10 aa, Mycobacterium
DTAAGPPLDA

SEQ ID NO: 458335 - protein, 8 aa, Mycobacterium
DTAAGPRL

SEQ ID NO: 458336 - protein, 7 aa, Mycobacterium
DTAAPGD

SEQ ID NO: 458337 - protein, 8 aa, Mycobacterium
DTAAPVAR

SEQ ID NO: 458338 - protein, 16 aa, Mycobacterium
DTAAQKSTIPDPNGRR

SEQ ID NO: 458339 - protein, 5 aa, Mycobacterium
DTAAR

SEQ ID NO: 458340 - protein, 12 aa, Mycobacterium
DTAARADSDAAE

SEQ ID NO: 458341 - protein, 16 aa, Mycobacterium
DTAARNVPTATRKSPS

SEQ ID NO: 458342 - protein, 8 aa, Mycobacterium
DTAARTKD

SEQ ID NO: 458343 - protein, 16 aa, Mycobacterium
DTAATEEFSSSDPTAK

SEQ ID NO: 458344 - protein, 10 aa, Mycobacterium
DTAATNSALD

SEQ ID NO: 458345 - protein, 6 aa, Mycobacterium
DTAAVA

SEQ ID NO: 458346 - protein, 10 aa, Mycobacterium
DTAAYRNSHP

SEQ ID NO: 458347 - protein, 6 aa, Mycobacterium
DTACSS

SEQ ID NO: 458348 - protein, 5 aa, Mycobacterium
DTADA

SEQ ID NO: 458349 - protein, 15 aa, Mycobacterium
DTADAPENSEDAREQ

SEQ ID NO: 458350 - protein, 11 aa, Mycobacterium
DTADDTPDLDD

SEQ ID NO: 458351 - protein, 8 aa, Mycobacterium
DTADFTDD

SEQ ID NO: 458352 - protein, 6 aa, Mycobacterium
DTADGR

SEQ ID NO: 458353 - protein, 9 aa, Mycobacterium
DTADISDRE

SEQ ID NO: 458354 - protein, 5 aa, Mycobacterium
DTADP

SEQ ID NO: 458355 - protein, 17 aa, Mycobacterium
DTADPDSSEWLVAAPRT

SEQ ID NO: 458356 - protein, 8 aa, Mycobacterium
DTADPDWA

SEQ ID NO: 458357 - protein, 11 aa, Mycobacterium
DTADPGPGHEE

SEQ ID NO: 458358 - protein, 9 aa, Mycobacterium
DTADPVGNS

SEQ ID NO: 458359 - protein, 17 aa, Mycobacterium
DTADRLTSTAQAESEKM

SEQ ID NO: 458360 - protein, 10 aa, Mycobacterium
DTADRQGEST

SEQ ID NO: 458361 - protein, 8 aa, Mycobacterium
DTADSDQL

SEQ ID NO: 458362 - protein, 8 aa, Mycobacterium
DTADTGGQ

SEQ ID NO: 458363 - protein, 10 aa, Mycobacterium
DTADVESARY

SEQ ID NO: 458364 - protein, 11 aa, Mycobacterium
DTAEATNVATT

SEQ ID NO: 458365 - protein, 7 aa, Mycobacterium
DTAEEAL

SEQ ID NO: 458366 - protein, 9 aa, Mycobacterium
DTAEERTDF

SEQ ID NO: 458367 - protein, 5 aa, Mycobacterium
DTAEF

SEQ ID NO: 458368 - protein, 5 aa, Mycobacterium
DTAEG

SEQ ID NO: 458369 - protein, 20 aa, Mycobacterium
DTAEGPKRLGPAAWPPVGRP

SEQ ID NO: 458370 - protein, 8 aa, Mycobacterium
DTAEPGIA

SEQ ID NO: 458371 - protein, 12 aa, Mycobacterium
DTAEQFSDQDPF

SEQ ID NO: 458372 - protein, 7 aa, Mycobacterium
DTAEQTA

SEQ ID NO: 458373 - protein, 5 aa, Mycobacterium
DTAER

SEQ ID NO: 458374 - protein, 8 aa, Mycobacterium
DTAESDCG

SEQ ID NO: 458375 - protein, 6 aa, Mycobacterium
DTAESF

SEQ ID NO: 458376 - protein, 9 aa, Mycobacterium
DTAESTQAP

SEQ ID NO: 458377 - protein, 8 aa, Mycobacterium
DTAETRPN

SEQ ID NO: 458378 - protein, 4 aa, Mycobacterium
DTAG

SEQ ID NO: 458379 - protein, 7 aa, Mycobacterium
DTAGAAW

SEQ ID NO: 458380 - protein, 6 aa, Mycobacterium
DTAGAG

SEQ ID NO: 458381 - protein, 7 aa, Mycobacterium
DTAGAGD

SEQ ID NO: 458382 - protein, 8 aa, Mycobacterium
DTAGATGA

SEQ ID NO: 458383 - protein, 19 aa, Mycobacterium
DTAGDDPDRDLVSAADRLA

SEQ ID NO: 458384 - protein, 11 aa, Mycobacterium
DTAGEPADPAR

SEQ ID NO: 458385 - protein, 8 aa, Mycobacterium
DTAGEVDA

SEQ ID NO: 458386 - protein, 15 aa, Mycobacterium
DTAGGLARPASAAEL

SEQ ID NO: 458387 - protein, 7 aa, Mycobacterium
DTAGGNS

SEQ ID NO: 458388 - protein, 25 aa, Mycobacterium
DTAGKEAKKVSKEAKKQAKKQQRRV

SEQ ID NO: 458389 - protein, 7 aa, Mycobacterium
DTAGKPA

SEQ ID NO: 458390 - protein, 8 aa, Mycobacterium
DTAGKPAA

SEQ ID NO: 458391 - protein, 6 aa, Mycobacterium
DTAGLG

SEQ ID NO: 458392 - protein, 12 aa, Mycobacterium
DTAGLSPDQARA

SEQ ID NO: 458393 - protein, 16 aa, Mycobacterium
DTAGRIARQAGSLRRS

SEQ ID NO: 458394 - protein, 7 aa, Mycobacterium
DTAGRRF

SEQ ID NO: 458395 - protein, 19 aa, Mycobacterium
DTAGRTAGGGERRDRESGG

SEQ ID NO: 458396 - protein, 13 aa, Mycobacterium
DTAGTAPAPLTKE

SEQ ID NO: 458397 - protein, 13 aa, Mycobacterium
DTAGTAPPPLSRE

SEQ ID NO: 458398 - protein, 13 aa, Mycobacterium
DTAGTAPPPLSRQ

SEQ ID NO: 458399 - protein, 7 aa, Mycobacterium
DTAGTSR

SEQ ID NO: 458400 - protein, 9 aa, Mycobacterium
DTAGVDPTT

SEQ ID NO: 458401 - protein, 8 aa, Mycobacterium
DTAGVSAA

SEQ ID NO: 458402 - protein, 23 aa, Mycobacterium
DTAHEARVEGAADPLDAQGAGDQ

SEQ ID NO: 458403 - protein, 6 aa, Mycobacterium
DTAHER

SEQ ID NO: 458404 - protein, 23 aa, Mycobacterium
DTAHETRVEGAADPLDAQGAGDQ

SEQ ID NO: 458405 - protein, 23 aa, Mycobacterium
DTAHETRVEGAADPLDSQGAGDQ

SEQ ID NO: 458406 - protein, 23 aa, Mycobacterium
DTAHETRVGGAADPLDSQGAGDQ

SEQ ID NO: 458407 - protein, 4 aa, Mycobacterium
DTAI

SEQ ID NO: 458408 - protein, 5 aa, Mycobacterium
DTAIE

SEQ ID NO: 458409 - protein, 10 aa, Mycobacterium
DTAKAAAALG

SEQ ID NO: 458410 - protein, 10 aa, Mycobacterium
DTAKAEAARA

SEQ ID NO: 458411 - protein, 8 aa, Mycobacterium
DTAKAGDN

SEQ ID NO: 458412 - protein, 21 aa, Mycobacterium
DTAKGRRPSWNAAAPAAAAEP

SEQ ID NO: 458413 - protein, 20 aa, Mycobacterium
DTAKGRRPSWNAAAPGPVAE

SEQ ID NO: 458414 - protein, 6 aa, Mycobacterium
DTAKQH

SEQ ID NO: 458415 - protein, 5 aa, Mycobacterium
DTALA

SEQ ID NO: 458416 - protein, 9 aa, Mycobacterium
DTALPDGDP

SEQ ID NO: 458417 - protein, 8 aa, Mycobacterium
DTALPPRA

SEQ ID NO: 458418 - protein, 16 aa, Mycobacterium
DTALQRARAAASARNM

SEQ ID NO: 458419 - protein, 19 aa, Mycobacterium
DTALTGASPERRITGRSSD

SEQ ID NO: 458420 - protein, 6 aa, Mycobacterium
DTANET

SEQ ID NO: 458421 - protein, 16 aa, Mycobacterium
DTANHHAGRDAEASEA

SEQ ID NO: 458422 - protein, 6 aa, Mycobacterium
DTANPT

SEQ ID NO: 458423 - protein, 8 aa, Mycobacterium
DTAPAERY

SEQ ID NO: 458424 - protein, 7 aa, Mycobacterium
DTAPDAA

SEQ ID NO: 458425 - protein, 7 aa, Mycobacterium
DTAPDAR

SEQ ID NO: 458426 - protein, 7 aa, Mycobacterium
DTAPDRL

SEQ ID NO: 458427 - protein, 9 aa, Mycobacterium
DTAPDSPTL

SEQ ID NO: 458428 - protein, 9 aa, Mycobacterium
DTAPGLTSQ

SEQ ID NO: 458429 - protein, 9 aa, Mycobacterium
DTAPGRPPW

SEQ ID NO: 458430 - protein, 6 aa, Mycobacterium
DTAPHQ

SEQ ID NO: 458431 - protein, 8 aa, Mycobacterium
DTAPNAGH

SEQ ID NO: 458432 - protein, 9 aa, Mycobacterium
DTAPNPGHR

SEQ ID NO: 458433 - protein, 7 aa, Mycobacterium
DTAPPVL

SEQ ID NO: 458434 - protein, 7 aa, Mycobacterium
DTAPRTL

SEQ ID NO: 458435 - protein, 9 aa, Mycobacterium
DTAPTGSVT

SEQ ID NO: 458436 - protein, 11 aa, Mycobacterium
DTAQADPEQAA

SEQ ID NO: 458437 - protein, 6 aa, Mycobacterium
DTAQGL

SEQ ID NO: 458438 - protein, 23 aa, Mycobacterium
DTAQHRPARDNDQGDDPAAPAVD

SEQ ID NO: 458439 - protein, 6 aa, Mycobacterium
DTAQIE

SEQ ID NO: 458440 - protein, 20 aa, Mycobacterium
DTAQPGQPQTRNPTTPGDLP

SEQ ID NO: 458441 - protein, 6 aa, Mycobacterium
DTAQQP

SEQ ID NO: 458442 - protein, 14 aa, Mycobacterium
DTAQVEGGDLLAVV

SEQ ID NO: 458443 - protein, 21 aa, Mycobacterium
DTARAAGAAAADAQRAGGGLG

SEQ ID NO: 458444 - protein, 8 aa, Mycobacterium
DTARAPEE

SEQ ID NO: 458445 - protein, 9 aa, Mycobacterium
DTARARGGY

SEQ ID NO: 458446 - protein, 8 aa, Mycobacterium
DTARAVSD

SEQ ID NO: 458447 - protein, 7 aa, Mycobacterium
DTARDRG

SEQ ID NO: 458448 - protein, 6 aa, Mycobacterium
DTAREK

SEQ ID NO: 458449 - protein, 10 aa, Mycobacterium
DTARFSRPPV

SEQ ID NO: 458450 - protein, 6 aa, Mycobacterium
DTARGC

SEQ ID NO: 458451 - protein, 6 aa, Mycobacterium
DTARLS

SEQ ID NO: 458452 - protein, 5 aa, Mycobacterium
DTARQ

SEQ ID NO: 458453 - protein, 9 aa, Mycobacterium
DTARQLSSQ

SEQ ID NO: 458454 - protein, 5 aa, Mycobacterium
DTARR

SEQ ID NO: 458455 - protein, 34 aa, Mycobacterium
DTARRAAISTADTLRAEQKAASKKVGKATPEERP

SEQ ID NO: 458456 - protein, 8 aa, Mycobacterium
DTARRCRE

SEQ ID NO: 458457 - protein, 31 aa, Mycobacterium
DTARRGSRRARNRTRDNTRHGTFGPQHRSDS

SEQ ID NO: 458458 - protein, 8 aa, Mycobacterium
DTARRNAR

SEQ ID NO: 458459 - protein, 7 aa, Mycobacterium
DTARRQL

SEQ ID NO: 458460 - protein, 35 aa, Mycobacterium
DTARRSAVSAADNLRAEQKAASKLVGKASPDERPA

SEQ ID NO: 458461 - protein, 35 aa, Mycobacterium
DTARRTAISTADSLRAEQKAASKGVGGASPEERPA

SEQ ID NO: 458462 - protein, 5 aa, Mycobacterium
DTARS

SEQ ID NO: 458463 - protein, 29 aa, Mycobacterium
DTASAAARSRAASAAAAYTKSAAAKVAGT

SEQ ID NO: 458464 - protein, 11 aa, Mycobacterium
DTASAASAQER

SEQ ID NO: 458465 - protein, 15 aa, Mycobacterium
DTASAAVQGGDTTEY

SEQ ID NO: 458466 - protein, 5 aa, Mycobacterium
DTASD

SEQ ID NO: 458467 - protein, 6 aa, Mycobacterium
DTASGR

SEQ ID NO: 458468 - protein, 8 aa, Mycobacterium
DTASIAAA

SEQ ID NO: 458469 - protein, 8 aa, Mycobacterium
DTASPGIK

SEQ ID NO: 458470 - protein, 17 aa, Mycobacterium
DTASQRRRTRDQDHGLD

SEQ ID NO: 458471 - protein, 19 aa, Mycobacterium
DTASREVTRGDTAVSLSST

SEQ ID NO: 458472 - protein, 5 aa, Mycobacterium
DTASV

SEQ ID NO: 458473 - protein, 10 aa, Mycobacterium
DTATAEEVSR

SEQ ID NO: 458474 - protein, 8 aa, Mycobacterium
DTATAGSG

SEQ ID NO: 458475 - protein, 7 aa, Mycobacterium
DTATARG

SEQ ID NO: 458476 - protein, 10 aa, Mycobacterium
DTATELPDDQ

SEQ ID NO: 458477 - protein, 10 aa, Mycobacterium
DTATELPDGQ

SEQ ID NO: 458478 - protein, 5 aa, Mycobacterium
DTATG

SEQ ID NO: 458479 - protein, 11 aa, Mycobacterium
DTATGEESTLP

SEQ ID NO: 458480 - protein, 6 aa, Mycobacterium
DTATGK

SEQ ID NO: 458481 - protein, 15 aa, Mycobacterium
DTATGKRRNLSYEDD

SEQ ID NO: 458482 - protein, 7 aa, Mycobacterium
DTATGPA

SEQ ID NO: 458483 - protein, 12 aa, Mycobacterium
DTATGTSAPEEQ

SEQ ID NO: 458484 - protein, 6 aa, Mycobacterium
DTATNR

SEQ ID NO: 458485 - protein, 7 aa, Mycobacterium
DTATQND

SEQ ID NO: 458486 - protein, 6 aa, Mycobacterium
DTATRS

SEQ ID NO: 458487 - protein, 6 aa, Mycobacterium
DTATTA

SEQ ID NO: 458488 - protein, 8 aa, Mycobacterium
DTATTDAA

SEQ ID NO: 458489 - protein, 8 aa, Mycobacterium
DTATTTGM

SEQ ID NO: 458490 - protein, 6 aa, Mycobacterium
DTAVDG

SEQ ID NO: 458491 - protein, 13 aa, Mycobacterium
DTAVGAAAAAARP

SEQ ID NO: 458492 - protein, 5 aa, Mycobacterium
DTAVT

SEQ ID NO: 458493 - protein, 5 aa, Mycobacterium
DTAWR

SEQ ID NO: 458494 - protein, 4 aa, Mycobacterium
DTCP

SEQ ID NO: 458495 - protein, 10 aa, Mycobacterium
DTCTEEPSVA

SEQ ID NO: 458496 - protein, 5 aa, Mycobacterium
DTDAA

SEQ ID NO: 458497 - protein, 6 aa, Mycobacterium
DTDAAL

SEQ ID NO: 458498 - protein, 16 aa, Mycobacterium
DTDAATTAGRTLGPID

SEQ ID NO: 458499 - protein, 5 aa, Mycobacterium
DTDAD

SEQ ID NO: 458500 - protein, 8 aa, Mycobacterium
DTDAEAAD

SEQ ID NO: 458501 - protein, 19 aa, Mycobacterium
DTDAEENQVRQRRDGLASS

SEQ ID NO: 458502 - protein, 10 aa, Mycobacterium
DTDAEPELAG

SEQ ID NO: 458503 - protein, 7 aa, Mycobacterium
DTDAGPQ

SEQ ID NO: 458504 - protein, 12 aa, Mycobacterium
DTDAGSPPAGRS

SEQ ID NO: 458505 - protein, 5 aa, Mycobacterium
DTDAM

SEQ ID NO: 458506 - protein, 8 aa, Mycobacterium
DTDAPAAL

SEQ ID NO: 458507 - protein, 6 aa, Mycobacterium
DTDAQL

SEQ ID NO: 458508 - protein, 5 aa, Mycobacterium
DTDAR

SEQ ID NO: 458509 - protein, 11 aa, Mycobacterium
DTDASESSEPR

SEQ ID NO: 458510 - protein, 6 aa, Mycobacterium
DTDASM

SEQ ID NO: 458511 - protein, 7 aa, Mycobacterium
DTDASRS

SEQ ID NO: 458512 - protein, 5 aa, Mycobacterium
DTDAT

SEQ ID NO: 458513 - protein, 7 aa, Mycobacterium
DTDATAQ

SEQ ID NO: 458514 - protein, 7 aa, Mycobacterium
DTDATRP

SEQ ID NO: 458515 - protein, 9 aa, Mycobacterium
DTDATSTGA

SEQ ID NO: 458516 - protein, 9 aa, Mycobacterium
DTDAVKESK

SEQ ID NO: 458517 - protein, 8 aa, Mycobacterium
DTDAVRET

SEQ ID NO: 458518 - protein, 19 aa, Mycobacterium
DTDAVSHDTGAFGSAGTTV

SEQ ID NO: 458519 - protein, 6 aa, Mycobacterium
DTDDAA

SEQ ID NO: 458520 - protein, 14 aa, Mycobacterium
DTDDAIGNGSMPQA

SEQ ID NO: 458521 - protein, 11 aa, Mycobacterium
DTDDATARNQL

SEQ ID NO: 458522 - protein, 6 aa, Mycobacterium
DTDDCD

SEQ ID NO: 458523 - protein, 8 aa, Mycobacterium
DTDDGGQT

SEQ ID NO: 458524 - protein, 11 aa, Mycobacterium
DTDDGTARDQL

SEQ ID NO: 458525 - protein, 7 aa, Mycobacterium
DTDDGTW

SEQ ID NO: 458526 - protein, 5 aa, Mycobacterium
DTDDL

SEQ ID NO: 458527 - protein, 7 aa, Mycobacterium
DTDDPRT

SEQ ID NO: 458528 - protein, 16 aa, Mycobacterium
DTDDPSAIDELVRRAA

SEQ ID NO: 458529 - protein, 9 aa, Mycobacterium
DTDDSPPGA

SEQ ID NO: 458530 - protein, 9 aa, Mycobacterium
DTDDTAPGA

SEQ ID NO: 458531 - protein, 6 aa, Mycobacterium
DTDDYP

SEQ ID NO: 458532 - protein, 4 aa, Mycobacterium
DTDE

SEQ ID NO: 458533 - protein, 14 aa, Mycobacterium
DTDEAAGRAWPSRR

SEQ ID NO: 458534 - protein, 5 aa, Mycobacterium
DTDEE

SEQ ID NO: 458535 - protein, 7 aa, Mycobacterium
DTDEEQR

SEQ ID NO: 458536 - protein, 9 aa, Mycobacterium
DTDEERHRE

SEQ ID NO: 458537 - protein, 12 aa, Mycobacterium
DTDEGVRRGTTV

SEQ ID NO: 458538 - protein, 11 aa, Mycobacterium
DTDEPAERGID

SEQ ID NO: 458539 - protein, 11 aa, Mycobacterium
DTDEPSERGIE

SEQ ID NO: 458540 - protein, 7 aa, Mycobacterium
DTDEQAR

SEQ ID NO: 458541 - protein, 7 aa, Mycobacterium
DTDEQAW

SEQ ID NO: 458542 - protein, 28 aa, Mycobacterium
DTDFASHNPIASGNQVMSPSGNVDSFNR

SEQ ID NO: 458543 - protein, 6 aa, Mycobacterium
DTDFDT

SEQ ID NO: 458544 - protein, 19 aa, Mycobacterium
DTDGAAAQEISDPPVQETD

SEQ ID NO: 458545 - protein, 5 aa, Mycobacterium
DTDGD

SEQ ID NO: 458546 - protein, 6 aa, Mycobacterium
DTDGDA

SEQ ID NO: 458547 - protein, 7 aa, Mycobacterium
DTDGDGH

SEQ ID NO: 458548 - protein, 8 aa, Mycobacterium
DTDGDGLA

SEQ ID NO: 458549 - protein, 26 aa, Mycobacterium
DTDGDGLADQVHSDGSAHVDTDRDGR

SEQ ID NO: 458550 - protein, 7 aa, Mycobacterium
DTDGDGQ

SEQ ID NO: 458551 - protein, 8 aa, Mycobacterium
DTDGDGRW

SEQ ID NO: 458552 - protein, 8 aa, Mycobacterium
DTDGDGVA

SEQ ID NO: 458553 - protein, 7 aa, Mycobacterium
DTDGDWP

SEQ ID NO: 458554 - protein, 6 aa, Mycobacterium
DTDGEN

SEQ ID NO: 458555 - protein, 16 aa, Mycobacterium
DTDGGLLDGDDELDRA

SEQ ID NO: 458556 - protein, 9 aa, Mycobacterium
DTDGGNHSI

SEQ ID NO: 458557 - protein, 12 aa, Mycobacterium
DTDGMRSIRIRG

SEQ ID NO: 458558 - protein, 18 aa, Mycobacterium
DTDGSTKVAGQRMGDGTT

SEQ ID NO: 458559 - protein, 5 aa, Mycobacterium
DTDGT

SEQ ID NO: 458560 - protein, 9 aa, Mycobacterium
DTDGTDDQA

SEQ ID NO: 458561 - protein, 7 aa, Mycobacterium
DTDGTVA

SEQ ID NO: 458562 - protein, 8 aa, Mycobacterium
DTDGTVAT

SEQ ID NO: 458563 - protein, 5 aa, Mycobacterium
DTDGY

SEQ ID NO: 458564 - protein, 7 aa, Mycobacterium
DTDHATN

SEQ ID NO: 458565 - protein, 9 aa, Mycobacterium
DTDHGAAAY

SEQ ID NO: 458566 - protein, 7 aa, Mycobacterium
DTDHGTI

SEQ ID NO: 458567 - protein, 12 aa, Mycobacterium
DTDHKNPARGRG

SEQ ID NO: 458568 - protein, 7 aa, Mycobacterium
DTDHPDE

SEQ ID NO: 458569 - protein, 12 aa, Mycobacterium
DTDIEGANAAKL

SEQ ID NO: 458570 - protein, 7 aa, Mycobacterium
DTDIPPG

SEQ ID NO: 458571 - protein, 12 aa, Mycobacterium
DTDISGANGAGL

SEQ ID NO: 458572 - protein, 9 aa, Mycobacterium
DTDKASRGV

SEQ ID NO: 458573 - protein, 9 aa, Mycobacterium
DTDKIEASY

SEQ ID NO: 458574 - protein, 7 aa, Mycobacterium
DTDKPVA

SEQ ID NO: 458575 - protein, 9 aa, Mycobacterium
DTDKVPAGA

SEQ ID NO: 458576 - protein, 9 aa, Mycobacterium
DTDKWTARP

SEQ ID NO: 458577 - protein, 5 aa, Mycobacterium
DTDLD

SEQ ID NO: 458578 - protein, 18 aa, Mycobacterium
DTDLDGGAEAAGYGVTST

SEQ ID NO: 458579 - protein, 25 aa, Mycobacterium
DTDLETQAAAEDTVQGDAEEGDDLE

SEQ ID NO: 458580 - protein, 19 aa, Mycobacterium
DTDLPEASVAGGSSGITSW

SEQ ID NO: 458581 - protein, 12 aa, Mycobacterium
DTDLTGRPFTER

SEQ ID NO: 458582 - protein, 9 aa, Mycobacterium
DTDMSSAEE

SEQ ID NO: 458583 - protein, 18 aa, Mycobacterium
DTDMTSGFDAPKNDPRQV

SEQ ID NO: 458584 - protein, 11 aa, Mycobacterium
DTDNAPETRSE

SEQ ID NO: 458585 - protein, 14 aa, Mycobacterium
DTDNAYTPGTGRRA

SEQ ID NO: 458586 - protein, 5 aa, Mycobacterium
DTDND

SEQ ID NO: 458587 - protein, 7 aa, Mycobacterium
DTDNDFP

SEQ ID NO: 458588 - protein, 14 aa, Mycobacterium
DTDNDKDIEKFDPG

SEQ ID NO: 458589 - protein, 6 aa, Mycobacterium
DTDNNR

SEQ ID NO: 458590 - protein, 5 aa, Mycobacterium
DTDNT

SEQ ID NO: 458591 - protein, 4 aa, Mycobacterium
DTDP

SEQ ID NO: 458592 - protein, 13 aa, Mycobacterium
DTDPARYQPAAPA

SEQ ID NO: 458593 - protein, 9 aa, Mycobacterium
DTDPASSLQ

SEQ ID NO: 458594 - protein, 8 aa, Mycobacterium
DTDPDWAG

SEQ ID NO: 458595 - protein, 8 aa, Mycobacterium
DTDPEEVA

SEQ ID NO: 458596 - protein, 7 aa, Mycobacterium
DTDPEGV

SEQ ID NO: 458597 - protein, 49 aa, Mycobacterium
DTDPEPDFEDAAPEAPAAAAPAEAAPAEAAPAAPAPAAAPSGGPRPEDL

SEQ ID NO: 458598 - protein, 16 aa, Mycobacterium
DTDPEPEPEADEPIGE

SEQ ID NO: 458599 - protein, 47 aa, Mycobacterium
DTDPEPEPEADEPTADAPAEAAPAAAAAPAPVAAPAAPSGGPRPDDI

SEQ ID NO: 458600 - protein, 24 aa, Mycobacterium
DTDPEPEPEEVADEPAAPQGAAAL

SEQ ID NO: 458601 - protein, 44 aa, Mycobacterium
DTDPEPEPEPEAEEPAAEAGDAAAAPAPAAAPAAPSGGPRPDDI

SEQ ID NO: 458602 - protein, 10 aa, Mycobacterium
DTDPEPEPEV

SEQ ID NO: 458603 - protein, 14 aa, Mycobacterium
DTDPGDLPSSFDLF

SEQ ID NO: 458604 - protein, 7 aa, Mycobacterium
DTDPGRV

SEQ ID NO: 458605 - protein, 18 aa, Mycobacterium
DTDPNTKATAAPKIQRND

SEQ ID NO: 458606 - protein, 7 aa, Mycobacterium
DTDPQRV

SEQ ID NO: 458607 - protein, 9 aa, Mycobacterium
DTDPSRRAL

SEQ ID NO: 458608 - protein, 11 aa, Mycobacterium
DTDPSSAAPRR

SEQ ID NO: 458609 - protein, 8 aa, Mycobacterium
DTDPTDRR

SEQ ID NO: 458610 - protein, 12 aa, Mycobacterium
DTDPYSPHGGYP

SEQ ID NO: 458611 - protein, 26 aa, Mycobacterium
DTDQPRAGVGMDPNRSRIQPGTRRDG

SEQ ID NO: 458612 - protein, 7 aa, Mycobacterium
DTDQQIE

SEQ ID NO: 458613 - protein, 6 aa, Mycobacterium
DTDQSV

SEQ ID NO: 458614 - protein, 14 aa, Mycobacterium
DTDRAGRPVPAAEN

SEQ ID NO: 458615 - protein, 8 aa, Mycobacterium
DTDRDPIA

SEQ ID NO: 458616 - protein, 5 aa, Mycobacterium
DTDRF

SEQ ID NO: 458617 - protein, 14 aa, Mycobacterium
DTDRPVTPAPTVPA

SEQ ID NO: 458618 - protein, 5 aa, Mycobacterium
DTDRR

SEQ ID NO: 458619 - protein, 5 aa, Mycobacterium
DTDRV

SEQ ID NO: 458620 - protein, 6 aa, Mycobacterium
DTDRVP

SEQ ID NO: 458621 - protein, 4 aa, Mycobacterium
DTDS

SEQ ID NO: 458622 - protein, 10 aa, Mycobacterium
DTDSADEALT

SEQ ID NO: 458623 - protein, 8 aa, Mycobacterium
DTDSAEAA

SEQ ID NO: 458624 - protein, 7 aa, Mycobacterium
DTDSDTY

SEQ ID NO: 458625 - protein, 5 aa, Mycobacterium
DTDSE

SEQ ID NO: 458626 - protein, 9 aa, Mycobacterium
DTDSEAASL

SEQ ID NO: 458627 - protein, 7 aa, Mycobacterium
DTDSGIR

SEQ ID NO: 458628 - protein, 7 aa, Mycobacterium
DTDSHPK

SEQ ID NO: 458629 - protein, 8 aa, Mycobacterium
DTDSRNTQ

SEQ ID NO: 458630 - protein, 13 aa, Mycobacterium
DTDTFTSSKGNTL

SEQ ID NO: 458631 - protein, 8 aa, Mycobacterium
DTDTGDRM

SEQ ID NO: 458632 - protein, 8 aa, Mycobacterium
DTDTSTRQ

SEQ ID NO: 458633 - protein, 7 aa, Mycobacterium
DTDTTPD

SEQ ID NO: 458634 - protein, 16 aa, Mycobacterium
DTDTVPAAAPKKVPRR

SEQ ID NO: 458635 - protein, 6 aa, Mycobacterium
DTDTVT

SEQ ID NO: 458636 - protein, 4 aa, Mycobacterium
DTDV

SEQ ID NO: 458637 - protein, 10 aa, Mycobacterium
DTDVAARRDA

SEQ ID NO: 458638 - protein, 34 aa, Mycobacterium
DTDVGDQSGARDVGDADGGGTPRRQGLAQPAQPV

SEQ ID NO: 458639 - protein, 5 aa, Mycobacterium
DTDVV

SEQ ID NO: 458640 - protein, 4 aa, Mycobacterium
DTDY

SEQ ID NO: 458641 - protein, 4 aa, Mycobacterium
DTEA

SEQ ID NO: 458642 - protein, 7 aa, Mycobacterium
DTEAAVR

SEQ ID NO: 458643 - protein, 16 aa, Mycobacterium
DTEADGIAAANDTPYG

SEQ ID NO: 458644 - protein, 9 aa, Mycobacterium
DTEADVAPV

SEQ ID NO: 458645 - protein, 7 aa, Mycobacterium
DTEAEAR

SEQ ID NO: 458646 - protein, 8 aa, Mycobacterium
DTEAEQEL

SEQ ID NO: 458647 - protein, 9 aa, Mycobacterium
DTEAGLDEQ

SEQ ID NO: 458648 - protein, 7 aa, Mycobacterium
DTEAGPQ

SEQ ID NO: 458649 - protein, 6 aa, Mycobacterium
DTEALN

SEQ ID NO: 458650 - protein, 5 aa, Mycobacterium
DTEAN

SEQ ID NO: 458651 - protein, 5 aa, Mycobacterium
DTEAP

SEQ ID NO: 458652 - protein, 5 aa, Mycobacterium
DTEAQ

SEQ ID NO: 458653 - protein, 5 aa, Mycobacterium
DTEAR

SEQ ID NO: 458654 - protein, 6 aa, Mycobacterium
DTEATV

SEQ ID NO: 458655 - protein, 5 aa, Mycobacterium
DTEDA

SEQ ID NO: 458656 - protein, 7 aa, Mycobacterium
DTEDAAI

SEQ ID NO: 458657 - protein, 10 aa, Mycobacterium
DTEDEADAFG

SEQ ID NO: 458658 - protein, 15 aa, Mycobacterium
DTEEEGIAAANDTEY

SEQ ID NO: 458659 - protein, 5 aa, Mycobacterium
DTEEH

SEQ ID NO: 458660 - protein, 7 aa, Mycobacterium
DTEFGPT

SEQ ID NO: 458661 - protein, 18 aa, Mycobacterium
DTEFGRKTRIDQASCNKD

SEQ ID NO: 458662 - protein, 18 aa, Mycobacterium
DTEFGRKTRIDQTSCNTD

SEQ ID NO: 458663 - protein, 14 aa, Mycobacterium
DTEFSGGCAGRSCE

SEQ ID NO: 458664 - protein, 14 aa, Mycobacterium
DTEGDPQKATGVAP

SEQ ID NO: 458665 - protein, 7 aa, Mycobacterium
DTEGHVP

SEQ ID NO: 458666 - protein, 5 aa, Mycobacterium
DTEGK

SEQ ID NO: 458667 - protein, 10 aa, Mycobacterium
DTEGKPSLGW

SEQ ID NO: 458668 - protein, 6 aa, Mycobacterium
DTEGLT

SEQ ID NO: 458669 - protein, 13 aa, Mycobacterium
DTEGLTFGKPEEK

SEQ ID NO: 458670 - protein, 5 aa, Mycobacterium
DTEGR

SEQ ID NO: 458671 - protein, 15 aa, Mycobacterium
DTEGRCTEARSDLDS

SEQ ID NO: 458672 - protein, 15 aa, Mycobacterium
DTEGRPTGDCAAGET

SEQ ID NO: 458673 - protein, 5 aa, Mycobacterium
DTEGS

SEQ ID NO: 458674 - protein, 7 aa, Mycobacterium
DTEGSTD

SEQ ID NO: 458675 - protein, 5 aa, Mycobacterium
DTEGW

SEQ ID NO: 458676 - protein, 6 aa, Mycobacterium
DTEHPD

SEQ ID NO: 458677 - protein, 8 aa, Mycobacterium
DTEHPGGY

SEQ ID NO: 458678 - protein, 9 aa, Mycobacterium
DTEHRDPEA

SEQ ID NO: 458679 - protein, 4 aa, Mycobacterium
DTEI

SEQ ID NO: 458680 - protein, 8 aa, Mycobacterium
DTEIDAEA

SEQ ID NO: 458681 - protein, 5 aa, Mycobacterium
DTEIP

SEQ ID NO: 458682 - protein, 7 aa, Mycobacterium
DTEIPGE

SEQ ID NO: 458683 - protein, 10 aa, Mycobacterium
DTEKAAANAP

SEQ ID NO: 458684 - protein, 10 aa, Mycobacterium
DTEKDRRAGL

SEQ ID NO: 458685 - protein, 8 aa, Mycobacterium
DTEKEAKE

SEQ ID NO: 458686 - protein, 14 aa, Mycobacterium
DTEKGKAAAERMPG

SEQ ID NO: 458687 - protein, 6 aa, Mycobacterium
DTELDG

SEQ ID NO: 458688 - protein, 4 aa, Mycobacterium
DTEM

SEQ ID NO: 458689 - protein, 7 aa, Mycobacterium
DTENHPN

SEQ ID NO: 458690 - protein, 9 aa, Mycobacterium
DTEPAARER

SEQ ID NO: 458691 - protein, 10 aa, Mycobacterium
DTEPADATAL

SEQ ID NO: 458692 - protein, 8 aa, Mycobacterium
DTEPAPRR

SEQ ID NO: 458693 - protein, 9 aa, Mycobacterium
DTEPARGEA

SEQ ID NO: 458694 - protein, 9 aa, Mycobacterium
DTEPATRER

SEQ ID NO: 458695 - protein, 9 aa, Mycobacterium
DTEPDPIPV

SEQ ID NO: 458696 - protein, 6 aa, Mycobacterium
DTEPGL

SEQ ID NO: 458697 - protein, 8 aa, Mycobacterium
DTEPNPLE

SEQ ID NO: 458698 - protein, 9 aa, Mycobacterium
DTEPSSDAD

SEQ ID NO: 458699 - protein, 10 aa, Mycobacterium
DTEPTLAPGA

SEQ ID NO: 458700 - protein, 8 aa, Mycobacterium
DTEPTVAE

SEQ ID NO: 458701 - protein, 10 aa, Mycobacterium
DTEPYAGRPP

SEQ ID NO: 458702 - protein, 10 aa, Mycobacterium
DTEPYEGRPP

SEQ ID NO: 458703 - protein, 10 aa, Mycobacterium
DTEPYEGRRP

SEQ ID NO: 458704 - protein, 14 aa, Mycobacterium
DTEQAQSKDSAESK

SEQ ID NO: 458705 - protein, 7 aa, Mycobacterium
DTEQEAI

SEQ ID NO: 458706 - protein, 22 aa, Mycobacterium
DTEQKVTEKPEPDEKDKEKAAE

SEQ ID NO: 458707 - protein, 9 aa, Mycobacterium
DTEQQIQQT

SEQ ID NO: 458708 - protein, 6 aa, Mycobacterium
DTEQRQ

SEQ ID NO: 458709 - protein, 6 aa, Mycobacterium
DTEQVK

SEQ ID NO: 458710 - protein, 6 aa, Mycobacterium
DTEQYP

SEQ ID NO: 458711 - protein, 6 aa, Mycobacterium
DTERAA

SEQ ID NO: 458712 - protein, 7 aa, Mycobacterium
DTERAER

SEQ ID NO: 458713 - protein, 7 aa, Mycobacterium
DTERAGE

SEQ ID NO: 458714 - protein, 6 aa, Mycobacterium
DTERAR

SEQ ID NO: 458715 - protein, 7 aa, Mycobacterium
DTERDPR

SEQ ID NO: 458716 - protein, 8 aa, Mycobacterium
DTEREHGG

SEQ ID NO: 458717 - protein, 9 aa, Mycobacterium
DTERGDATI

SEQ ID NO: 458718 - protein, 9 aa, Mycobacterium
DTERGTGGN

SEQ ID NO: 458719 - protein, 5 aa, Mycobacterium
DTERL

SEQ ID NO: 458720 - protein, 13 aa, Mycobacterium
DTERPASAGPREE

SEQ ID NO: 458721 - protein, 13 aa, Mycobacterium
DTERPQSTPALET

SEQ ID NO: 458722 - protein, 6 aa, Mycobacterium
DTERQA

SEQ ID NO: 458723 - protein, 10 aa, Mycobacterium
DTERQRAQGR

SEQ ID NO: 458724 - protein, 17 aa, Mycobacterium
DTERSVTDEHGTELDPD

SEQ ID NO: 458725 - protein, 12 aa, Mycobacterium
DTESFTAADGPL

SEQ ID NO: 458726 - protein, 10 aa, Mycobacterium
DTESGAETEV

SEQ ID NO: 458727 - protein, 8 aa, Mycobacterium
DTESGPVT

SEQ ID NO: 458728 - protein, 7 aa, Mycobacterium
DTESHPA

SEQ ID NO: 458729 - protein, 7 aa, Mycobacterium
DTESHPK

SEQ ID NO: 458730 - protein, 6 aa, Mycobacterium
DTESLY

SEQ ID NO: 458731 - protein, 12 aa, Mycobacterium
DTESPVAQSVRK

SEQ ID NO: 458732 - protein, 20 aa, Mycobacterium
DTESRRKEIENQAAAESTQW

SEQ ID NO: 458733 - protein, 6 aa, Mycobacterium
DTESVQ

SEQ ID NO: 458734 - protein, 4 aa, Mycobacterium
DTET

SEQ ID NO: 458735 - protein, 12 aa, Mycobacterium
DTETADGHADRL

SEQ ID NO: 458736 - protein, 12 aa, Mycobacterium
DTETADGHAERL

SEQ ID NO: 458737 - protein, 13 aa, Mycobacterium
DTETAKWRDPTGT

SEQ ID NO: 458738 - protein, 14 aa, Mycobacterium
DTETDTETGAGPRI

SEQ ID NO: 458739 - protein, 16 aa, Mycobacterium
DTETEAREREKTELAE

SEQ ID NO: 458740 - protein, 5 aa, Mycobacterium
DTETF

SEQ ID NO: 458741 - protein, 9 aa, Mycobacterium
DTETGRARD

SEQ ID NO: 458742 - protein, 9 aa, Mycobacterium
DTETGRTRE

SEQ ID NO: 458743 - protein, 8 aa, Mycobacterium
DTETGVTR

SEQ ID NO: 458744 - protein, 6 aa, Mycobacterium
DTETTR

SEQ ID NO: 458745 - protein, 9 aa, Mycobacterium
DTETYPRKS

SEQ ID NO: 458746 - protein, 4 aa, Mycobacterium
DTEV

SEQ ID NO: 458747 - protein, 5 aa, Mycobacterium
DTEVA

SEQ ID NO: 458748 - protein, 6 aa, Mycobacterium
DTEVAE

SEQ ID NO: 458749 - protein, 7 aa, Mycobacterium
DTEVDEA

SEQ ID NO: 458750 - protein, 5 aa, Mycobacterium
DTEVP

SEQ ID NO: 458751 - protein, 7 aa, Mycobacterium
DTEVPAG

SEQ ID NO: 458752 - protein, 15 aa, Mycobacterium
DTEWSKSGKHTGRTD

SEQ ID NO: 458753 - protein, 15 aa, Mycobacterium
DTEWSNSGQHTGRTD

SEQ ID NO: 458754 - protein, 5 aa, Mycobacterium
DTEWT

SEQ ID NO: 458755 - protein, 4 aa, Mycobacterium
DTEY

SEQ ID NO: 458756 - protein, 5 aa, Mycobacterium
DTEYG

SEQ ID NO: 458757 - protein, 7 aa, Mycobacterium
DTEYGDK

SEQ ID NO: 458758 - protein, 6 aa, Mycobacterium
DTEYTA

SEQ ID NO: 458759 - protein, 6 aa, Mycobacterium
DTFDSA

SEQ ID NO: 458760 - protein, 6 aa, Mycobacterium
DTFDVD

SEQ ID NO: 458761 - protein, 5 aa, Mycobacterium
DTFEE

SEQ ID NO: 458762 - protein, 11 aa, Mycobacterium
DTFEGRPRSRS

SEQ ID NO: 458763 - protein, 7 aa, Mycobacterium
DTFGQDG

SEQ ID NO: 458764 - protein, 7 aa, Mycobacterium
DTFKERA

SEQ ID NO: 458765 - protein, 4 aa, Mycobacterium
DTFP

SEQ ID NO: 458766 - protein, 11 aa, Mycobacterium
DTFPASDPATL

SEQ ID NO: 458767 - protein, 4 aa, Mycobacterium
DTFR

SEQ ID NO: 458768 - protein, 19 aa, Mycobacterium
DTFSADGAGAAARKKLPSV

SEQ ID NO: 458769 - protein, 18 aa, Mycobacterium
DTFSEANVGRTSAEATHQ

SEQ ID NO: 458770 - protein, 6 aa, Mycobacterium
DTFSGR

SEQ ID NO: 458771 - protein, 18 aa, Mycobacterium
DTFSQANVGRTSAQATEA

SEQ ID NO: 458772 - protein, 19 aa, Mycobacterium
DTFSSDGEGEGARKKLPSV

SEQ ID NO: 458773 - protein, 12 aa, Mycobacterium
DTFSSGRKGAIP

SEQ ID NO: 458774 - protein, 4 aa, Mycobacterium
DTFT

SEQ ID NO: 458775 - protein, 12 aa, Mycobacterium
DTFTSTNTVKAG

SEQ ID NO: 458776 - protein, 24 aa, Mycobacterium
DTGAAGQTGKPPTVSDGADEPIVT

SEQ ID NO: 458777 - protein, 9 aa, Mycobacterium
DTGAATADY

SEQ ID NO: 458778 - protein, 7 aa, Mycobacterium
DTGADAK

SEQ ID NO: 458779 - protein, 7 aa, Mycobacterium
DTGADCP

SEQ ID NO: 458780 - protein, 13 aa, Mycobacterium
DTGADEAKLNPLG

SEQ ID NO: 458781 - protein, 14 aa, Mycobacterium
DTGADLSKTNVNGG

SEQ ID NO: 458782 - protein, 5 aa, Mycobacterium
DTGAF

SEQ ID NO: 458783 - protein, 8 aa, Mycobacterium
DTGAGKSS

SEQ ID NO: 458784 - protein, 10 aa, Mycobacterium
DTGALAPTQQ

SEQ ID NO: 458785 - protein, 13 aa, Mycobacterium
DTGANLTNPIAAV

SEQ ID NO: 458786 - protein, 7 aa, Mycobacterium
DTGAPGP

SEQ ID NO: 458787 - protein, 6 aa, Mycobacterium
DTGAPI

SEQ ID NO: 458788 - protein, 10 aa, Mycobacterium
DTGAPLTGTH

SEQ ID NO: 458789 - protein, 8 aa, Mycobacterium
DTGAREEL

SEQ ID NO: 458790 - protein, 10 aa, Mycobacterium
DTGARKVEKA

SEQ ID NO: 458791 - protein, 7 aa, Mycobacterium
DTGATAQ

SEQ ID NO: 458792 - protein, 4 aa, Mycobacterium
DTGD

SEQ ID NO: 458793 - protein, 8 aa, Mycobacterium
DTGDDESV

SEQ ID NO: 458794 - protein, 6 aa, Mycobacterium
DTGDDV

SEQ ID NO: 458795 - protein, 8 aa, Mycobacterium
DTGDFPPA

SEQ ID NO: 458796 - protein, 6 aa, Mycobacterium
DTGDGE

SEQ ID NO: 458797 - protein, 8 aa, Mycobacterium
DTGDGEGA

SEQ ID NO: 458798 - protein, 7 aa, Mycobacterium
DTGDHAD

SEQ ID NO: 458799 - protein, 8 aa, Mycobacterium
DTGDPATA

SEQ ID NO: 458800 - protein, 10 aa, Mycobacterium
DTGDPATSPL

SEQ ID NO: 458801 - protein, 10 aa, Mycobacterium
DTGDPVAPGV

SEQ ID NO: 458802 - protein, 5 aa, Mycobacterium
DTGDT

SEQ ID NO: 458803 - protein, 6 aa, Mycobacterium
DTGDTE

SEQ ID NO: 458804 - protein, 7 aa, Mycobacterium
DTGDVEA

SEQ ID NO: 458805 - protein, 16 aa, Mycobacterium
DTGDVPRELTAGEQVG

SEQ ID NO: 458806 - protein, 14 aa, Mycobacterium
DTGEAPAGASATAV

SEQ ID NO: 458807 - protein, 8 aa, Mycobacterium
DTGEATHA

SEQ ID NO: 458808 - protein, 8 aa, Mycobacterium
DTGEGSQL

SEQ ID NO: 458809 - protein, 11 aa, Mycobacterium
DTGEIHPNTDI

SEQ ID NO: 458810 - protein, 10 aa, Mycobacterium
DTGELPDGSA

SEQ ID NO: 458811 - protein, 13 aa, Mycobacterium
DTGERPGRLVRGV

SEQ ID NO: 458812 - protein, 8 aa, Mycobacterium
DTGETPTI

SEQ ID NO: 458813 - protein, 8 aa, Mycobacterium
DTGFDPEP

SEQ ID NO: 458814 - protein, 12 aa, Mycobacterium
DTGFGDDPATLA

SEQ ID NO: 458815 - protein, 9 aa, Mycobacterium
DTGFGEDAT

SEQ ID NO: 458816 - protein, 12 aa, Mycobacterium
DTGFGEDPGTLA

SEQ ID NO: 458817 - protein, 11 aa, Mycobacterium
DTGFGEDPTTL

SEQ ID NO: 458818 - protein, 11 aa, Mycobacterium
DTGFGENPATL

SEQ ID NO: 458819 - protein, 7 aa, Mycobacterium
DTGFGGD

SEQ ID NO: 458820 - protein, 9 aa, Mycobacterium
DTGFGNGGS

SEQ ID NO: 458821 - protein, 8 aa, Mycobacterium
DTGGAGRP

SEQ ID NO: 458822 - protein, 10 aa, Mycobacterium
DTGGAPPSPA

SEQ ID NO: 458823 - protein, 7 aa, Mycobacterium
DTGGAVD

SEQ ID NO: 458824 - protein, 6 aa, Mycobacterium
DTGGDS

SEQ ID NO: 458825 - protein, 7 aa, Mycobacterium
DTGGDVD

SEQ ID NO: 458826 - protein, 5 aa, Mycobacterium
DTGGE

SEQ ID NO: 458827 - protein, 18 aa, Mycobacterium
DTGGERGGGCDDGSGDRG

SEQ ID NO: 458828 - protein, 5 aa, Mycobacterium
DTGGF

SEQ ID NO: 458829 - protein, 7 aa, Mycobacterium
DTGGGFG

SEQ ID NO: 458830 - protein, 5 aa, Mycobacterium
DTGGH

SEQ ID NO: 458831 - protein, 5 aa, Mycobacterium
DTGGP

SEQ ID NO: 458832 - protein, 6 aa, Mycobacterium
DTGGPF

SEQ ID NO: 458833 - protein, 7 aa, Mycobacterium
DTGGPYA

SEQ ID NO: 458834 - protein, 10 aa, Mycobacterium
DTGGQGGTPV

SEQ ID NO: 458835 - protein, 9 aa, Mycobacterium
DTGGSGPAR

SEQ ID NO: 458836 - protein, 8 aa, Mycobacterium
DTGGSVDA

SEQ ID NO: 458837 - protein, 31 aa, Mycobacterium
DTGGSVTGTGSDAQAANAVSEEIRGQGGEAV

SEQ ID NO: 458838 - protein, 6 aa, Mycobacterium
DTGGTI

SEQ ID NO: 458839 - protein, 5 aa, Mycobacterium
DTGGV

SEQ ID NO: 458840 - protein, 4 aa, Mycobacterium
DTGH

SEQ ID NO: 458841 - protein, 6 aa, Mycobacterium
DTGHDA

SEQ ID NO: 458842 - protein, 13 aa, Mycobacterium
DTGHDHGAGDTLA

SEQ ID NO: 458843 - protein, 9 aa, Mycobacterium
DTGHPDLQP

SEQ ID NO: 458844 - protein, 4 aa, Mycobacterium
DTGI

SEQ ID NO: 458845 - protein, 8 aa, Mycobacterium
DTGIPRPG

SEQ ID NO: 458846 - protein, 8 aa, Mycobacterium
DTGIQDAP

SEQ ID NO: 458847 - protein, 4 aa, Mycobacterium
DTGK

SEQ ID NO: 458848 - protein, 6 aa, Mycobacterium
DTGKNQ

SEQ ID NO: 458849 - protein, 10 aa, Mycobacterium
DTGKVSNRRT

SEQ ID NO: 458850 - protein, 10 aa, Mycobacterium
DTGLDAGEVR

SEQ ID NO: 458851 - protein, 12 aa, Mycobacterium
DTGLNRNGVPPA

SEQ ID NO: 458852 - protein, 9 aa, Mycobacterium
DTGLYKDSD

SEQ ID NO: 458853 - protein, 11 aa, Mycobacterium
DTGLYKDSDRL

SEQ ID NO: 458854 - protein, 7 aa, Mycobacterium
DTGNAKR

SEQ ID NO: 458855 - protein, 9 aa, Mycobacterium
DTGNCGNRQ

SEQ ID NO: 458856 - protein, 8 aa, Mycobacterium
DTGNESIG

SEQ ID NO: 458857 - protein, 9 aa, Mycobacterium
DTGNGPYGP

SEQ ID NO: 458858 - protein, 7 aa, Mycobacterium
DTGNGVG

SEQ ID NO: 458859 - protein, 8 aa, Mycobacterium
DTGNNGNA

SEQ ID NO: 458860 - protein, 8 aa, Mycobacterium
DTGNPLPA

SEQ ID NO: 458861 - protein, 7 aa, Mycobacterium
DTGNPVT

SEQ ID NO: 458862 - protein, 5 aa, Mycobacterium
DTGNR

SEQ ID NO: 458863 - protein, 6 aa, Mycobacterium
DTGPDA

SEQ ID NO: 458864 - protein, 8 aa, Mycobacterium
DTGPDADR

SEQ ID NO: 458865 - protein, 8 aa, Mycobacterium
DTGPDGAR

SEQ ID NO: 458866 - protein, 48 aa, Mycobacterium
DTGPGGDTDGPGPGPGDDGPGPGPDETPPTSGPGAGPGRYQPIPVTVE

SEQ ID NO: 458867 - protein, 7 aa, Mycobacterium
DTGPGIT

SEQ ID NO: 458868 - protein, 5 aa, Mycobacterium
DTGPL

SEQ ID NO: 458869 - protein, 7 aa, Mycobacterium
DTGPLTK

SEQ ID NO: 458870 - protein, 11 aa, Mycobacterium
DTGPQNYSDDG

SEQ ID NO: 458871 - protein, 10 aa, Mycobacterium
DTGPRGVGKT

SEQ ID NO: 458872 - protein, 14 aa, Mycobacterium
DTGPSASDAVSATA

SEQ ID NO: 458873 - protein, 7 aa, Mycobacterium
DTGPSPA

SEQ ID NO: 458874 - protein, 9 aa, Mycobacterium
DTGPVGGEV

SEQ ID NO: 458875 - protein, 4 aa, Mycobacterium
DTGQ

SEQ ID NO: 458876 - protein, 7 aa, Mycobacterium
DTGQQDR

SEQ ID NO: 458877 - protein, 8 aa, Mycobacterium
DTGQTRVD

SEQ ID NO: 458878 - protein, 4 aa, Mycobacterium
DTGR

SEQ ID NO: 458879 - protein, 11 aa, Mycobacterium
DTGRAGSGDIT

SEQ ID NO: 458880 - protein, 6 aa, Mycobacterium
DTGRDR

SEQ ID NO: 458881 - protein, 7 aa, Mycobacterium
DTGRDRL

SEQ ID NO: 458882 - protein, 5 aa, Mycobacterium
DTGRF

SEQ ID NO: 458883 - protein, 5 aa, Mycobacterium
DTGRG

SEQ ID NO: 458884 - protein, 14 aa, Mycobacterium
DTGRGFGPEVSEET

SEQ ID NO: 458885 - protein, 6 aa, Mycobacterium
DTGRLD

SEQ ID NO: 458886 - protein, 10 aa, Mycobacterium
DTGRPEPPIG

SEQ ID NO: 458887 - protein, 7 aa, Mycobacterium
DTGRPVT

SEQ ID NO: 458888 - protein, 7 aa, Mycobacterium
DTGRTIG

SEQ ID NO: 458889 - protein, 6 aa, Mycobacterium
DTGSAD

SEQ ID NO: 458890 - protein, 10 aa, Mycobacterium
DTGSAERSLR

SEQ ID NO: 458891 - protein, 8 aa, Mycobacterium
DTGSDTVA

SEQ ID NO: 458892 - protein, 11 aa, Mycobacterium
DTGSEDQKKQH

SEQ ID NO: 458893 - protein, 10 aa, Mycobacterium
DTGSEDQKRR

SEQ ID NO: 458894 - protein, 8 aa, Mycobacterium
DTGSFTDA

SEQ ID NO: 458895 - protein, 7 aa, Mycobacterium
DTGSGDV

SEQ ID NO: 458896 - protein, 11 aa, Mycobacterium
DTGSGSDHHDP

SEQ ID NO: 458897 - protein, 7 aa, Mycobacterium
DTGSGSI

SEQ ID NO: 458898 - protein, 17 aa, Mycobacterium
DTGSKDPGAAARRDRWR

SEQ ID NO: 458899 - protein, 6 aa, Mycobacterium
DTGSLH

SEQ ID NO: 458900 - protein, 11 aa, Mycobacterium
DTGSNWQRRRS

SEQ ID NO: 458901 - protein, 8 aa, Mycobacterium
DTGSPVAP

SEQ ID NO: 458902 - protein, 10 aa, Mycobacterium
DTGSQSPKES

SEQ ID NO: 458903 - protein, 9 aa, Mycobacterium
DTGSTPEEA

SEQ ID NO: 458904 - protein, 8 aa, Mycobacterium
DTGSVPSL

SEQ ID NO: 458905 - protein, 17 aa, Mycobacterium
DTGSWKPPQPASFPHRG

SEQ ID NO: 458906 - protein, 18 aa, Mycobacterium
DTGSWKPPRPPRDSHRGR

SEQ ID NO: 458907 - protein, 12 aa, Mycobacterium
DTGSYSTVPTLT

SEQ ID NO: 458908 - protein, 17 aa, Mycobacterium
DTGSYTTAPALPQTREE

SEQ ID NO: 458909 - protein, 9 aa, Mycobacterium
DTGTAALGQ

SEQ ID NO: 458910 - protein, 26 aa, Mycobacterium
DTGTALAGRASWQSSDGTPVTGEATV

SEQ ID NO: 458911 - protein, 6 aa, Mycobacterium
DTGTDR

SEQ ID NO: 458912 - protein, 13 aa, Mycobacterium
DTGTEAQDKARHI

SEQ ID NO: 458913 - protein, 7 aa, Mycobacterium
DTGTGQR

SEQ ID NO: 458914 - protein, 5 aa, Mycobacterium
DTGTL

SEQ ID NO: 458915 - protein, 7 aa, Mycobacterium
DTGTPTD

SEQ ID NO: 458916 - protein, 6 aa, Mycobacterium
DTGTQF

SEQ ID NO: 458917 - protein, 5 aa, Mycobacterium
DTGTT

SEQ ID NO: 458918 - protein, 6 aa, Mycobacterium
DTGTVD

SEQ ID NO: 458919 - protein, 7 aa, Mycobacterium
DTGTYKR

SEQ ID NO: 458920 - protein, 12 aa, Mycobacterium
DTGVAGIPELSG

SEQ ID NO: 458921 - protein, 6 aa, Mycobacterium
DTGVDA

SEQ ID NO: 458922 - protein, 6 aa, Mycobacterium
DTGVGD

SEQ ID NO: 458923 - protein, 21 aa, Mycobacterium
DTGVGEPALAPIKPGDVDGRS

SEQ ID NO: 458924 - protein, 7 aa, Mycobacterium
DTGVGVP

SEQ ID NO: 458925 - protein, 8 aa, Mycobacterium
DTGVPRPG

SEQ ID NO: 458926 - protein, 5 aa, Mycobacterium
DTGVR

SEQ ID NO: 458927 - protein, 14 aa, Mycobacterium
DTGVRIGPADVSTV

SEQ ID NO: 458928 - protein, 6 aa, Mycobacterium
DTGVRY

SEQ ID NO: 458929 - protein, 16 aa, Mycobacterium
DTGYADERDPAARTAR

SEQ ID NO: 458930 - protein, 6 aa, Mycobacterium
DTGYGD

SEQ ID NO: 458931 - protein, 8 aa, Mycobacterium
DTGYGRAQ

SEQ ID NO: 458932 - protein, 10 aa, Mycobacterium
DTGYGTKRGW

SEQ ID NO: 458933 - protein, 9 aa, Mycobacterium
DTGYNERTI

SEQ ID NO: 458934 - protein, 6 aa, Mycobacterium
DTGYPC

SEQ ID NO: 458935 - protein, 6 aa, Mycobacterium
DTGYTT

SEQ ID NO: 458936 - protein, 7 aa, Mycobacterium
DTHAGAD

SEQ ID NO: 458937 - protein, 10 aa, Mycobacterium
DTHARTRTGA

SEQ ID NO: 458938 - protein, 7 aa, Mycobacterium
DTHATPD

SEQ ID NO: 458939 - protein, 11 aa, Mycobacterium
DTHDSAERRRQ

SEQ ID NO: 458940 - protein, 4 aa, Mycobacterium
DTHE

SEQ ID NO: 458941 - protein, 5 aa, Mycobacterium
DTHEY

SEQ ID NO: 458942 - protein, 4 aa, Mycobacterium
DTHG

SEQ ID NO: 458943 - protein, 23 aa, Mycobacterium
DTHGAAAASREAVRAAERGGQTA

SEQ ID NO: 458944 - protein, 6 aa, Mycobacterium
DTHGST

SEQ ID NO: 458945 - protein, 14 aa, Mycobacterium
DTHHGPAPLDHPSP

SEQ ID NO: 458946 - protein, 7 aa, Mycobacterium
DTHPAVT

SEQ ID NO: 458947 - protein, 14 aa, Mycobacterium
DTHPGTGYRRAPLP

SEQ ID NO: 458948 - protein, 5 aa, Mycobacterium
DTHPL

SEQ ID NO: 458949 - protein, 10 aa, Mycobacterium
DTHPSGPGFK

SEQ ID NO: 458950 - protein, 13 aa, Mycobacterium
DTHRGDPLEWMRR

SEQ ID NO: 458951 - protein, 5 aa, Mycobacterium
DTHRH

SEQ ID NO: 458952 - protein, 44 aa, Mycobacterium
DTHRPTAEAEADRAHRQAQRADALAAKADRKAAAASAAWESEQR

SEQ ID NO: 458953 - protein, 6 aa, Mycobacterium
DTHRRR

SEQ ID NO: 458954 - protein, 7 aa, Mycobacterium
DTHSPRQ

SEQ ID NO: 458955 - protein, 6 aa, Mycobacterium
DTHSVG

SEQ ID NO: 458956 - protein, 67 aa, Mycobacterium
DTHTSYTDNSSTYESSIGSGNQTAIASGNETAFGSGNETNTALASGNSYDTTDIDTNVASPSLELDA

SEQ ID NO: 458957 - protein, 18 aa, Mycobacterium
DTHTVEDDHHGFGLDPHF

SEQ ID NO: 458958 - protein, 6 aa, Mycobacterium
DTIAAT

SEQ ID NO: 458959 - protein, 10 aa, Mycobacterium
DTIATGGSIT

SEQ ID NO: 458960 - protein, 4 aa, Mycobacterium
DTID

SEQ ID NO: 458961 - protein, 5 aa, Mycobacterium
DTIGA

SEQ ID NO: 458962 - protein, 6 aa, Mycobacterium
DTIGGY

SEQ ID NO: 458963 - protein, 14 aa, Mycobacterium
DTIGNPKFHGGDDQ

SEQ ID NO: 458964 - protein, 7 aa, Mycobacterium
DTIGPER

SEQ ID NO: 458965 - protein, 5 aa, Mycobacterium
DTIIG

SEQ ID NO: 458966 - protein, 4 aa, Mycobacterium
DTIP

SEQ ID NO: 458967 - protein, 5 aa, Mycobacterium
DTIPD

SEQ ID NO: 458968 - protein, 6 aa, Mycobacterium
DTIPDG

SEQ ID NO: 458969 - protein, 5 aa, Mycobacterium
DTIPG

SEQ ID NO: 458970 - protein, 7 aa, Mycobacterium
DTIPSDA

SEQ ID NO: 458971 - protein, 13 aa, Mycobacterium
DTIRTRKNNRRIG

SEQ ID NO: 458972 - protein, 11 aa, Mycobacterium
DTITAGAPQAP

SEQ ID NO: 458973 - protein, 10 aa, Mycobacterium
DTITGTPQGG

SEQ ID NO: 458974 - protein, 12 aa, Mycobacterium
DTITPPPPREPG

SEQ ID NO: 458975 - protein, 4 aa, Mycobacterium
DTKA

SEQ ID NO: 458976 - protein, 8 aa, Mycobacterium
DTKADLPA

SEQ ID NO: 458977 - protein, 15 aa, Mycobacterium
DTKAKVAESPAELAA

SEQ ID NO: 458978 - protein, 8 aa, Mycobacterium
DTKAPKEN

SEQ ID NO: 458979 - protein, 6 aa, Mycobacterium
DTKAVA

SEQ ID NO: 458980 - protein, 7 aa, Mycobacterium
DTKGDLP

SEQ ID NO: 458981 - protein, 7 aa, Mycobacterium
DTKGYSR

SEQ ID NO: 458982 - protein, 4 aa, Mycobacterium
DTKH

SEQ ID NO: 458983 - protein, 7 aa, Mycobacterium
DTKHTGD

SEQ ID NO: 458984 - protein, 53 aa, Mycobacterium
DTKNDDADDDRDAKAGADGAGAAPGSQTLGGAPIEGGTGTTADNQSAGPDVTV

SEQ ID NO: 458985 - protein, 7 aa, Mycobacterium
DTKPAIR

SEQ ID NO: 458986 - protein, 9 aa, Mycobacterium
DTKPAKPNL

SEQ ID NO: 458987 - protein, 7 aa, Mycobacterium
DTKPGTV

SEQ ID NO: 458988 - protein, 7 aa, Mycobacterium
DTKPLTP

SEQ ID NO: 458989 - protein, 10 aa, Mycobacterium
DTKPRTGAEP

SEQ ID NO: 458990 - protein, 6 aa, Mycobacterium
DTKPYQ

SEQ ID NO: 458991 - protein, 12 aa, Mycobacterium
DTKQANRAAEDA

SEQ ID NO: 458992 - protein, 11 aa, Mycobacterium
DTKQANRAAEN

SEQ ID NO: 458993 - protein, 15 aa, Mycobacterium
DTKQANRAAENATLE

SEQ ID NO: 458994 - protein, 7 aa, Mycobacterium
DTKRTAD

SEQ ID NO: 458995 - protein, 7 aa, Mycobacterium
DTKSHPA

SEQ ID NO: 458996 - protein, 7 aa, Mycobacterium
DTKTNSE

SEQ ID NO: 458997 - protein, 4 aa, Mycobacterium
DTKV

SEQ ID NO: 458998 - protein, 4 aa, Mycobacterium
DTLA

SEQ ID NO: 458999 - protein, 5 aa, Mycobacterium
DTLAH

SEQ ID NO: 459000 - protein, 7 aa, Mycobacterium
DTLAPGA

SEQ ID NO: 459001 - protein, 7 aa, Mycobacterium
DTLAPNE

SEQ ID NO: 459002 - protein, 14 aa, Mycobacterium
DTLASPTARGRFTG

SEQ ID NO: 459003 - protein, 11 aa, Mycobacterium
DTLATGGSING

SEQ ID NO: 459004 - protein, 4 aa, Mycobacterium
DTLD

SEQ ID NO: 459005 - protein, 5 aa, Mycobacterium
DTLDA

SEQ ID NO: 459006 - protein, 5 aa, Mycobacterium
DTLDE

SEQ ID NO: 459007 - protein, 6 aa, Mycobacterium
DTLDND

SEQ ID NO: 459008 - protein, 6 aa, Mycobacterium
DTLDNQ

SEQ ID NO: 459009 - protein, 12 aa, Mycobacterium
DTLEGAQAAGRS

SEQ ID NO: 459010 - protein, 6 aa, Mycobacterium
DTLESK

SEQ ID NO: 459011 - protein, 7 aa, Mycobacterium
DTLGDGA

SEQ ID NO: 459012 - protein, 14 aa, Mycobacterium
DTLGDPTQLSPSEQ

SEQ ID NO: 459013 - protein, 5 aa, Mycobacterium
DTLGE

SEQ ID NO: 459014 - protein, 8 aa, Mycobacterium
DTLGESAR

SEQ ID NO: 459015 - protein, 11 aa, Mycobacterium
DTLGGAGASFA

SEQ ID NO: 459016 - protein, 9 aa, Mycobacterium
DTLGPDGGK

SEQ ID NO: 459017 - protein, 6 aa, Mycobacterium
DTLGPR

SEQ ID NO: 459018 - protein, 5 aa, Mycobacterium
DTLGS

SEQ ID NO: 459019 - protein, 5 aa, Mycobacterium
DTLNP

SEQ ID NO: 459020 - protein, 13 aa, Mycobacterium
DTLNSAPDSADHR

SEQ ID NO: 459021 - protein, 10 aa, Mycobacterium
DTLPDNEAAT

SEQ ID NO: 459022 - protein, 6 aa, Mycobacterium
DTLPEG

SEQ ID NO: 459023 - protein, 6 aa, Mycobacterium
DTLPKT

SEQ ID NO: 459024 - protein, 7 aa, Mycobacterium
DTLPPGA

SEQ ID NO: 459025 - protein, 19 aa, Mycobacterium
DTLPQPQEIDEPQRWIDRV

SEQ ID NO: 459026 - protein, 10 aa, Mycobacterium
DTLSATDAAP

SEQ ID NO: 459027 - protein, 9 aa, Mycobacterium
DTLSDGETQ

SEQ ID NO: 459028 - protein, 10 aa, Mycobacterium
DTLSDPAVPV

SEQ ID NO: 459029 - protein, 19 aa, Mycobacterium
DTLSPSESLDSDEVRNDDG

SEQ ID NO: 459030 - protein, 7 aa, Mycobacterium
DTLSPTI

SEQ ID NO: 459031 - protein, 8 aa, Mycobacterium
DTLSRTAG

SEQ ID NO: 459032 - protein, 8 aa, Mycobacterium
DTLTEPGQ

SEQ ID NO: 459033 - protein, 7 aa, Mycobacterium
DTLTGET

SEQ ID NO: 459034 - protein, 10 aa, Mycobacterium
DTLTREVSED

SEQ ID NO: 459035 - protein, 5 aa, Mycobacterium
DTLTT

SEQ ID NO: 459036 - protein, 4 aa, Mycobacterium
DTMM

SEQ ID NO: 459037 - protein, 5 aa, Mycobacterium
DTMME

SEQ ID NO: 459038 - protein, 5 aa, Mycobacterium
DTNAA

SEQ ID NO: 459039 - protein, 6 aa, Mycobacterium
DTNAGD

SEQ ID NO: 459040 - protein, 6 aa, Mycobacterium
DTNAPA

SEQ ID NO: 459041 - protein, 8 aa, Mycobacterium
DTNAPKRI

SEQ ID NO: 459042 - protein, 6 aa, Mycobacterium
DTNDDF

SEQ ID NO: 459043 - protein, 11 aa, Mycobacterium
DTNDPAGLKEV

SEQ ID NO: 459044 - protein, 17 aa, Mycobacterium
DTNDTHDTAVPTDATGA

SEQ ID NO: 459045 - protein, 11 aa, Mycobacterium
DTNEAVSHGPV

SEQ ID NO: 459046 - protein, 5 aa, Mycobacterium
DTNEI

SEQ ID NO: 459047 - protein, 18 aa, Mycobacterium
DTNEPTGSKEGADQVVTA

SEQ ID NO: 459048 - protein, 6 aa, Mycobacterium
DTNGAG

SEQ ID NO: 459049 - protein, 7 aa, Mycobacterium
DTNGNLG

SEQ ID NO: 459050 - protein, 6 aa, Mycobacterium
DTNGTY

SEQ ID NO: 459051 - protein, 10 aa, Mycobacterium
DTNIECPQGT

SEQ ID NO: 459052 - protein, 4 aa, Mycobacterium
DTNL

SEQ ID NO: 459053 - protein, 5 aa, Mycobacterium
DTNLR

SEQ ID NO: 459054 - protein, 10 aa, Mycobacterium
DTNNSGHYSA

SEQ ID NO: 459055 - protein, 15 aa, Mycobacterium
DTNNSSGDADQQVHA

SEQ ID NO: 459056 - protein, 7 aa, Mycobacterium
DTNPASA

SEQ ID NO: 459057 - protein, 11 aa, Mycobacterium
DTNPATAGPTL

SEQ ID NO: 459058 - protein, 11 aa, Mycobacterium
DTNPFDAEPTD

SEQ ID NO: 459059 - protein, 9 aa, Mycobacterium
DTNPGGLPK

SEQ ID NO: 459060 - protein, 15 aa, Mycobacterium
DTNPHRKRMRNRINA

SEQ ID NO: 459061 - protein, 10 aa, Mycobacterium
DTNPPADPVA

SEQ ID NO: 459062 - protein, 7 aa, Mycobacterium
DTNRSRE

SEQ ID NO: 459063 - protein, 9 aa, Mycobacterium
DTNSPDLDG

SEQ ID NO: 459064 - protein, 7 aa, Mycobacterium
DTNTEAG

SEQ ID NO: 459065 - protein, 6 aa, Mycobacterium
DTNTGI

SEQ ID NO: 459066 - protein, 11 aa, Mycobacterium
DTNVPPGESEQ

SEQ ID NO: 459067 - protein, 5 aa, Mycobacterium
DTNYA

SEQ ID NO: 459068 - protein, 4 aa, Mycobacterium
DTPA

SEQ ID NO: 459069 - protein, 7 aa, Mycobacterium
DTPAAAQ

SEQ ID NO: 459070 - protein, 10 aa, Mycobacterium
DTPAAPEVSF

SEQ ID NO: 459071 - protein, 14 aa, Mycobacterium
DTPAAPRRTRKKGN

SEQ ID NO: 459072 - protein, 10 aa, Mycobacterium
DTPAAPSVSF

SEQ ID NO: 459073 - protein, 7 aa, Mycobacterium
DTPADQY

SEQ ID NO: 459074 - protein, 14 aa, Mycobacterium
DTPAGAKNACARTR

SEQ ID NO: 459075 - protein, 6 aa, Mycobacterium
DTPAGD

SEQ ID NO: 459076 - protein, 8 aa, Mycobacterium
DTPAGEQT

SEQ ID NO: 459077 - protein, 10 aa, Mycobacterium
DTPAGPDGST

SEQ ID NO: 459078 - protein, 10 aa, Mycobacterium
DTPAGPPDST

SEQ ID NO: 459079 - protein, 10 aa, Mycobacterium
DTPAGPPGAT

SEQ ID NO: 459080 - protein, 10 aa, Mycobacterium
DTPAGPPGST

SEQ ID NO: 459081 - protein, 9 aa, Mycobacterium
DTPAGPTTY

SEQ ID NO: 459082 - protein, 7 aa, Mycobacterium
DTPAGRV

SEQ ID NO: 459083 - protein, 16 aa, Mycobacterium
DTPAIRGPRSIPMRFQ

SEQ ID NO: 459084 - protein, 12 aa, Mycobacterium
DTPALGKAGPVE

SEQ ID NO: 459085 - protein, 6 aa, Mycobacterium
DTPALR

SEQ ID NO: 459086 - protein, 13 aa, Mycobacterium
DTPAPEVPAPAPG

SEQ ID NO: 459087 - protein, 13 aa, Mycobacterium
DTPAPPSESFGDD

SEQ ID NO: 459088 - protein, 12 aa, Mycobacterium
DTPAPPYDELTP

SEQ ID NO: 459089 - protein, 7 aa, Mycobacterium
DTPAPVR

SEQ ID NO: 459090 - protein, 15 aa, Mycobacterium
DTPAQIAGSPAELAA

SEQ ID NO: 459091 - protein, 8 aa, Mycobacterium
DTPARQEV

SEQ ID NO: 459092 - protein, 10 aa, Mycobacterium
DTPARRIGTA

SEQ ID NO: 459093 - protein, 6 aa, Mycobacterium
DTPARV

SEQ ID NO: 459094 - protein, 8 aa, Mycobacterium
DTPASDGH

SEQ ID NO: 459095 - protein, 7 aa, Mycobacterium
DTPATPW

SEQ ID NO: 459096 - protein, 5 aa, Mycobacterium
DTPAW

SEQ ID NO: 459097 - protein, 7 aa, Mycobacterium
DTPDDLA

SEQ ID NO: 459098 - protein, 12 aa, Mycobacterium
DTPDEMSPYAPR

SEQ ID NO: 459099 - protein, 5 aa, Mycobacterium
DTPDG

SEQ ID NO: 459100 - protein, 7 aa, Mycobacterium
DTPDGRI

SEQ ID NO: 459101 - protein, 17 aa, Mycobacterium
DTPDGTPPPGAPGLSPE

SEQ ID NO: 459102 - protein, 9 aa, Mycobacterium
DTPDPVSME

SEQ ID NO: 459103 - protein, 7 aa, Mycobacterium
DTPDRLP

SEQ ID NO: 459104 - protein, 8 aa, Mycobacterium
DTPDSIDA

SEQ ID NO: 459105 - protein, 8 aa, Mycobacterium
DTPDTPTI

SEQ ID NO: 459106 - protein, 26 aa, Mycobacterium
DTPDYEPDPATSIGARARARGVDPME

SEQ ID NO: 459107 - protein, 6 aa, Mycobacterium
DTPEAT

SEQ ID NO: 459108 - protein, 9 aa, Mycobacterium
DTPEDRAAH

SEQ ID NO: 459109 - protein, 6 aa, Mycobacterium
DTPEEI

SEQ ID NO: 459110 - protein, 21 aa, Mycobacterium
DTPEESDDLAAEAETKVLGSD

SEQ ID NO: 459111 - protein, 14 aa, Mycobacterium
DTPEGAKNACARTR

SEQ ID NO: 459112 - protein, 15 aa, Mycobacterium
DTPEGAKNARGRTRK

SEQ ID NO: 459113 - protein, 6 aa, Mycobacterium
DTPEGF

SEQ ID NO: 459114 - protein, 13 aa, Mycobacterium
DTPEINPQTLPPG

SEQ ID NO: 459115 - protein, 6 aa, Mycobacterium
DTPERA

SEQ ID NO: 459116 - protein, 11 aa, Mycobacterium
DTPERALGHPA

SEQ ID NO: 459117 - protein, 20 aa, Mycobacterium
DTPERLNSSAAAAAARLAPS

SEQ ID NO: 459118 - protein, 6 aa, Mycobacterium
DTPERM

SEQ ID NO: 459119 - protein, 6 aa, Mycobacterium
DTPEYK

SEQ ID NO: 459120 - protein, 4 aa, Mycobacterium
DTPF

SEQ ID NO: 459121 - protein, 6 aa, Mycobacterium
DTPFAS

SEQ ID NO: 459122 - protein, 14 aa, Mycobacterium
DTPFPKRETTETAY

SEQ ID NO: 459123 - protein, 4 aa, Mycobacterium
DTPG

SEQ ID NO: 459124 - protein, 8 aa, Mycobacterium
DTPGAAIE

SEQ ID NO: 459125 - protein, 7 aa, Mycobacterium
DTPGAEF

SEQ ID NO: 459126 - protein, 8 aa, Mycobacterium
DTPGEADY

SEQ ID NO: 459127 - protein, 9 aa, Mycobacterium
DTPGEADYY

SEQ ID NO: 459128 - protein, 5 aa, Mycobacterium
DTPGF

SEQ ID NO: 459129 - protein, 9 aa, Mycobacterium
DTPGFDGPA

SEQ ID NO: 459130 - protein, 6 aa, Mycobacterium
DTPGFE

SEQ ID NO: 459131 - protein, 8 aa, Mycobacterium
DTPGFRRG

SEQ ID NO: 459132 - protein, 10 aa, Mycobacterium
DTPGFSRGRN

SEQ ID NO: 459133 - protein, 7 aa, Mycobacterium
DTPGFTA

SEQ ID NO: 459134 - protein, 8 aa, Mycobacterium
DTPGGETV

SEQ ID NO: 459135 - protein, 7 aa, Mycobacterium
DTPGGSA

SEQ ID NO: 459136 - protein, 8 aa, Mycobacterium
DTPGGSAV

SEQ ID NO: 459137 - protein, 7 aa, Mycobacterium
DTPGLSF

SEQ ID NO: 459138 - protein, 6 aa, Mycobacterium
DTPGLT

SEQ ID NO: 459139 - protein, 8 aa, Mycobacterium
DTPGPMAR

SEQ ID NO: 459140 - protein, 8 aa, Mycobacterium
DTPGRTDY

SEQ ID NO: 459141 - protein, 6 aa, Mycobacterium
DTPGRW

SEQ ID NO: 459142 - protein, 6 aa, Mycobacterium
DTPGSE

SEQ ID NO: 459143 - protein, 6 aa, Mycobacterium
DTPGSH

SEQ ID NO: 459144 - protein, 15 aa, Mycobacterium
DTPGTSSLARDTSER

SEQ ID NO: 459145 - protein, 14 aa, Mycobacterium
DTPGTSSLARDVSA

SEQ ID NO: 459146 - protein, 15 aa, Mycobacterium
DTPGTSSLNRDTSER

SEQ ID NO: 459147 - protein, 14 aa, Mycobacterium
DTPGTSSLSKDVSA

SEQ ID NO: 459148 - protein, 15 aa, Mycobacterium
DTPGTSSLSQDVSER

SEQ ID NO: 459149 - protein, 15 aa, Mycobacterium
DTPGTSSLSTDVSER

SEQ ID NO: 459150 - protein, 19 aa, Mycobacterium
DTPGVDIGAKDKKMGQEGA

SEQ ID NO: 459151 - protein, 20 aa, Mycobacterium
DTPGVEVGPKDAKMGQEGAW

SEQ ID NO: 459152 - protein, 6 aa, Mycobacterium
DTPGVT

SEQ ID NO: 459153 - protein, 5 aa, Mycobacterium
DTPGY

SEQ ID NO: 459154 - protein, 13 aa, Mycobacterium
DTPHARNVQERSQ

SEQ ID NO: 459155 - protein, 7 aa, Mycobacterium
DTPHGPV

SEQ ID NO: 459156 - protein, 10 aa, Mycobacterium
DTPHTRPVPV

SEQ ID NO: 459157 - protein, 19 aa, Mycobacterium
DTPHTRPVPVSGTAYSPEA

SEQ ID NO: 459158 - protein, 12 aa, Mycobacterium
DTPIAAEAEQAT

SEQ ID NO: 459159 - protein, 7 aa, Mycobacterium
DTPIDPT

SEQ ID NO: 459160 - protein, 17 aa, Mycobacterium
DTPIDSVDSGGIRTAGA

SEQ ID NO: 459161 - protein, 14 aa, Mycobacterium
DTPIGESARPDQRY

SEQ ID NO: 459162 - protein, 7 aa, Mycobacterium
DTPIPEG

SEQ ID NO: 459163 - protein, 5 aa, Mycobacterium
DTPIQ

SEQ ID NO: 459164 - protein, 15 aa, Mycobacterium
DTPKPQIREEASRRG

SEQ ID NO: 459165 - protein, 4 aa, Mycobacterium
DTPL

SEQ ID NO: 459166 - protein, 7 aa, Mycobacterium
DTPLAER

SEQ ID NO: 459167 - protein, 12 aa, Mycobacterium
DTPLNPPGRPRS

SEQ ID NO: 459168 - protein, 10 aa, Mycobacterium
DTPLPDGQPY

SEQ ID NO: 459169 - protein, 11 aa, Mycobacterium
DTPLPPERRGS

SEQ ID NO: 459170 - protein, 6 aa, Mycobacterium
DTPMGA

SEQ ID NO: 459171 - protein, 4 aa, Mycobacterium
DTPN

SEQ ID NO: 459172 - protein, 5 aa, Mycobacterium
DTPNH

SEQ ID NO: 459173 - protein, 6 aa, Mycobacterium
DTPNQW

SEQ ID NO: 459174 - protein, 5 aa, Mycobacterium
DTPPD

SEQ ID NO: 459175 - protein, 9 aa, Mycobacterium
DTPPEESFD

SEQ ID NO: 459176 - protein, 7 aa, Mycobacterium
DTPPEQP

SEQ ID NO: 459177 - protein, 7 aa, Mycobacterium
DTPPGLY

SEQ ID NO: 459178 - protein, 8 aa, Mycobacterium
DTPPGVIP

SEQ ID NO: 459179 - protein, 10 aa, Mycobacterium
DTPPLGKTGA

SEQ ID NO: 459180 - protein, 11 aa, Mycobacterium
DTPPLGKTGPV

SEQ ID NO: 459181 - protein, 7 aa, Mycobacterium
DTPPPFE

SEQ ID NO: 459182 - protein, 6 aa, Mycobacterium
DTPPTI

SEQ ID NO: 459183 - protein, 6 aa, Mycobacterium
DTPPVA

SEQ ID NO: 459184 - protein, 7 aa, Mycobacterium
DTPQGPV

SEQ ID NO: 459185 - protein, 6 aa, Mycobacterium
DTPQLQ

SEQ ID NO: 459186 - protein, 11 aa, Mycobacterium
DTPQPATPEAV

SEQ ID NO: 459187 - protein, 11 aa, Mycobacterium
DTPQPPEETSA

SEQ ID NO: 459188 - protein, 7 aa, Mycobacterium
DTPQSFA

SEQ ID NO: 459189 - protein, 7 aa, Mycobacterium
DTPQSGR

SEQ ID NO: 459190 - protein, 6 aa, Mycobacterium
DTPREL

SEQ ID NO: 459191 - protein, 6 aa, Mycobacterium
DTPRFE

SEQ ID NO: 459192 - protein, 15 aa, Mycobacterium
DTPRGPGAAPPWRHD

SEQ ID NO: 459193 - protein, 6 aa, Mycobacterium
DTPRHT

SEQ ID NO: 459194 - protein, 5 aa, Mycobacterium
DTPRS

SEQ ID NO: 459195 - protein, 6 aa, Mycobacterium
DTPRTG

SEQ ID NO: 459196 - protein, 6 aa, Mycobacterium
DTPRTR

SEQ ID NO: 459197 - protein, 12 aa, Mycobacterium
DTPRVTSNRAQA

SEQ ID NO: 459198 - protein, 6 aa, Mycobacterium
DTPRYR

SEQ ID NO: 459199 - protein, 7 aa, Mycobacterium
DTPRYRD

SEQ ID NO: 459200 - protein, 10 aa, Mycobacterium
DTPSAPEISF

SEQ ID NO: 459201 - protein, 20 aa, Mycobacterium
DTPSARPAAEADSYDPQQPQ

SEQ ID NO: 459202 - protein, 9 aa, Mycobacterium
DTPSERAEN

SEQ ID NO: 459203 - protein, 5 aa, Mycobacterium
DTPSG

SEQ ID NO: 459204 - protein, 18 aa, Mycobacterium
DTPSGLDVTSGEAPGDVV

SEQ ID NO: 459205 - protein, 8 aa, Mycobacterium
DTPSPAHI

SEQ ID NO: 459206 - protein, 7 aa, Mycobacterium
DTPTATR

SEQ ID NO: 459207 - protein, 7 aa, Mycobacterium
DTPTDAS

SEQ ID NO: 459208 - protein, 7 aa, Mycobacterium
DTPTDLA

SEQ ID NO: 459209 - protein, 10 aa, Mycobacterium
DTPTDNPTQL

SEQ ID NO: 459210 - protein, 6 aa, Mycobacterium
DTPTGA

SEQ ID NO: 459211 - protein, 9 aa, Mycobacterium
DTPTGPGVR

SEQ ID NO: 459212 - protein, 13 aa, Mycobacterium
DTPTINPETLPPG

SEQ ID NO: 459213 - protein, 5 aa, Mycobacterium
DTPTP

SEQ ID NO: 459214 - protein, 9 aa, Mycobacterium
DTPTSDPRP

SEQ ID NO: 459215 - protein, 8 aa, Mycobacterium
DTPTSGDV

SEQ ID NO: 459216 - protein, 5 aa, Mycobacterium
DTPVA

SEQ ID NO: 459217 - protein, 8 aa, Mycobacterium
DTPVPAGV

SEQ ID NO: 459218 - protein, 6 aa, Mycobacterium
DTPVQG

SEQ ID NO: 459219 - protein, 7 aa, Mycobacterium
DTPVSGE

SEQ ID NO: 459220 - protein, 9 aa, Mycobacterium
DTPVTGRDG

SEQ ID NO: 459221 - protein, 5 aa, Mycobacterium
DTPWR

SEQ ID NO: 459222 - protein, 12 aa, Mycobacterium
DTPYGPPSAPVT

SEQ ID NO: 459223 - protein, 9 aa, Mycobacterium
DTQAARVTK

SEQ ID NO: 459224 - protein, 9 aa, Mycobacterium
DTQAEPELA

SEQ ID NO: 459225 - protein, 11 aa, Mycobacterium
DTQAGPAITSA

SEQ ID NO: 459226 - protein, 11 aa, Mycobacterium
DTQAQPATIPP

SEQ ID NO: 459227 - protein, 10 aa, Mycobacterium
DTQAQTGALP

SEQ ID NO: 459228 - protein, 12 aa, Mycobacterium
DTQDEEPAGGLT

SEQ ID NO: 459229 - protein, 7 aa, Mycobacterium
DTQEAIA

SEQ ID NO: 459230 - protein, 5 aa, Mycobacterium
DTQEQ

SEQ ID NO: 459231 - protein, 7 aa, Mycobacterium
DTQHERD

SEQ ID NO: 459232 - protein, 5 aa, Mycobacterium
DTQIA

SEQ ID NO: 459233 - protein, 4 aa, Mycobacterium
DTQK

SEQ ID NO: 459234 - protein, 7 aa, Mycobacterium
DTQLATP

SEQ ID NO: 459235 - protein, 6 aa, Mycobacterium
DTQLGE

SEQ ID NO: 459236 - protein, 7 aa, Mycobacterium
DTQMPSR

SEQ ID NO: 459237 - protein, 4 aa, Mycobacterium
DTQP

SEQ ID NO: 459238 - protein, 24 aa, Mycobacterium
DTQPDAPPPGEGPSWEPEALPSTA

SEQ ID NO: 459239 - protein, 13 aa, Mycobacterium
DTQPEVDAEPTTD

SEQ ID NO: 459240 - protein, 26 aa, Mycobacterium
DTQPIDNRHAGTDGSAVQEDSPHGGV

SEQ ID NO: 459241 - protein, 25 aa, Mycobacterium
DTQPLTASVDPPPNEHNSGSSRSMS

SEQ ID NO: 459242 - protein, 8 aa, Mycobacterium
DTQPNAGH

SEQ ID NO: 459243 - protein, 10 aa, Mycobacterium
DTQPQERMSA

SEQ ID NO: 459244 - protein, 18 aa, Mycobacterium
DTQPSGVAAARLLAPVLF

SEQ ID NO: 459245 - protein, 6 aa, Mycobacterium
DTQQNR

SEQ ID NO: 459246 - protein, 10 aa, Mycobacterium
DTQQSGGGED

SEQ ID NO: 459247 - protein, 15 aa, Mycobacterium
DTQRPIGDPIGDRAR

SEQ ID NO: 459248 - protein, 6 aa, Mycobacterium
DTQRSD

SEQ ID NO: 459249 - protein, 6 aa, Mycobacterium
DTQSED

SEQ ID NO: 459250 - protein, 17 aa, Mycobacterium
DTQSTYPYSPTGQSHLP

SEQ ID NO: 459251 - protein, 5 aa, Mycobacterium
DTQTA

SEQ ID NO: 459252 - protein, 6 aa, Mycobacterium
DTQTDL

SEQ ID NO: 459253 - protein, 6 aa, Mycobacterium
DTQTGK

SEQ ID NO: 459254 - protein, 8 aa, Mycobacterium
DTQTGRTS

SEQ ID NO: 459255 - protein, 6 aa, Mycobacterium
DTQTQD

SEQ ID NO: 459256 - protein, 6 aa, Mycobacterium
DTQTRA

SEQ ID NO: 459257 - protein, 8 aa, Mycobacterium
DTQTRARI

SEQ ID NO: 459258 - protein, 6 aa, Mycobacterium
DTQTRE

SEQ ID NO: 459259 - protein, 9 aa, Mycobacterium
DTQVTDGDA

SEQ ID NO: 459260 - protein, 8 aa, Mycobacterium
DTRAALAG

SEQ ID NO: 459261 - protein, 7 aa, Mycobacterium
DTRAASL

SEQ ID NO: 459262 - protein, 9 aa, Mycobacterium
DTRADAEQR

SEQ ID NO: 459263 - protein, 9 aa, Mycobacterium
DTRAFDGNL

SEQ ID NO: 459264 - protein, 9 aa, Mycobacterium
DTRAFDGNV

SEQ ID NO: 459265 - protein, 6 aa, Mycobacterium
DTRAGS

SEQ ID NO: 459266 - protein, 13 aa, Mycobacterium
DTRAHEAALPGWI

SEQ ID NO: 459267 - protein, 25 aa, Mycobacterium
DTRALPAPAYTDGDGYRPPATPVEE

SEQ ID NO: 459268 - protein, 23 aa, Mycobacterium
DTRALPAPDYQEGGEYRAPATPV

SEQ ID NO: 459269 - protein, 24 aa, Mycobacterium
DTRALPAPDYRDTANYRAPATATE

SEQ ID NO: 459270 - protein, 10 aa, Mycobacterium
DTRALPAPEY

SEQ ID NO: 459271 - protein, 11 aa, Mycobacterium
DTRALPAPEYH

SEQ ID NO: 459272 - protein, 24 aa, Mycobacterium
DTRALPAPEYHGTGYRAPSTPTEE

SEQ ID NO: 459273 - protein, 11 aa, Mycobacterium
DTRALSDGLEG

SEQ ID NO: 459274 - protein, 8 aa, Mycobacterium
DTRAPDVA

SEQ ID NO: 459275 - protein, 6 aa, Mycobacterium
DTRASP

SEQ ID NO: 459276 - protein, 14 aa, Mycobacterium
DTRATASALPGWVP

SEQ ID NO: 459277 - protein, 12 aa, Mycobacterium
DTRDDAPETRSE

SEQ ID NO: 459278 - protein, 9 aa, Mycobacterium
DTRDDGLAD

SEQ ID NO: 459279 - protein, 14 aa, Mycobacterium
DTRDDSSLAADTDR

SEQ ID NO: 459280 - protein, 5 aa, Mycobacterium
DTRDE

SEQ ID NO: 459281 - protein, 14 aa, Mycobacterium
DTRDESSRAADTDR

SEQ ID NO: 459282 - protein, 5 aa, Mycobacterium
DTRDQ

SEQ ID NO: 459283 - protein, 16 aa, Mycobacterium
DTRDQPSRAADTDRIQ

SEQ ID NO: 459284 - protein, 14 aa, Mycobacterium
DTRDRAVAAGRRRE

SEQ ID NO: 459285 - protein, 7 aa, Mycobacterium
DTRDTQN

SEQ ID NO: 459286 - protein, 5 aa, Mycobacterium
DTRED

SEQ ID NO: 459287 - protein, 6 aa, Mycobacterium
DTREQD

SEQ ID NO: 459288 - protein, 8 aa, Mycobacterium
DTRESDQL

SEQ ID NO: 459289 - protein, 8 aa, Mycobacterium
DTRESGQF

SEQ ID NO: 459290 - protein, 5 aa, Mycobacterium
DTRFR

SEQ ID NO: 459291 - protein, 4 aa, Mycobacterium
DTRG

SEQ ID NO: 459292 - protein, 5 aa, Mycobacterium
DTRGD

SEQ ID NO: 459293 - protein, 5 aa, Mycobacterium
DTRGG

SEQ ID NO: 459294 - protein, 6 aa, Mycobacterium
DTRGGG

SEQ ID NO: 459295 - protein, 16 aa, Mycobacterium
DTRGHGDSDWDPDGRY

SEQ ID NO: 459296 - protein, 8 aa, Mycobacterium
DTRGPDAI

SEQ ID NO: 459297 - protein, 10 aa, Mycobacterium
DTRHNSSDDG

SEQ ID NO: 459298 - protein, 7 aa, Mycobacterium
DTRHRLA

SEQ ID NO: 459299 - protein, 7 aa, Mycobacterium
DTRIETV

SEQ ID NO: 459300 - protein, 7 aa, Mycobacterium
DTRKPEH

SEQ ID NO: 459301 - protein, 7 aa, Mycobacterium
DTRKRIS

SEQ ID NO: 459302 - protein, 9 aa, Mycobacterium
DTRKRSGAK

SEQ ID NO: 459303 - protein, 6 aa, Mycobacterium
DTRKSF

SEQ ID NO: 459304 - protein, 7 aa, Mycobacterium
DTRKSIE

SEQ ID NO: 459305 - protein, 8 aa, Mycobacterium
DTRKSIEK

SEQ ID NO: 459306 - protein, 4 aa, Mycobacterium
DTRL

SEQ ID NO: 459307 - protein, 12 aa, Mycobacterium
DTRLPDTEPGAL

SEQ ID NO: 459308 - protein, 21 aa, Mycobacterium
DTRPADQHGNRGDELDDDLRW

SEQ ID NO: 459309 - protein, 6 aa, Mycobacterium
DTRPDA

SEQ ID NO: 459310 - protein, 13 aa, Mycobacterium
DTRPDPALPGPDG

SEQ ID NO: 459311 - protein, 8 aa, Mycobacterium
DTRPGSEA

SEQ ID NO: 459312 - protein, 23 aa, Mycobacterium
DTRPKADSRVKTAHGEKTGANAS

SEQ ID NO: 459313 - protein, 10 aa, Mycobacterium
DTRPPGAELT

SEQ ID NO: 459314 - protein, 18 aa, Mycobacterium
DTRPPGTALTPLGREQAR

SEQ ID NO: 459315 - protein, 6 aa, Mycobacterium
DTRPPQ

SEQ ID NO: 459316 - protein, 7 aa, Mycobacterium
DTRPPTL

SEQ ID NO: 459317 - protein, 6 aa, Mycobacterium
DTRPSD

SEQ ID NO: 459318 - protein, 7 aa, Mycobacterium
DTRPTAE

SEQ ID NO: 459319 - protein, 6 aa, Mycobacterium
DTRQPS

SEQ ID NO: 459320 - protein, 10 aa, Mycobacterium
DTRQSGGGED

SEQ ID NO: 459321 - protein, 4 aa, Mycobacterium
DTRR

SEQ ID NO: 459322 - protein, 60 aa, Mycobacterium
DTRRARGRLGGRAGPGTGCGTGRRARAGRGARGGRRGCARGRRGGACTRRGRLRSGRLGR

SEQ ID NO: 459323 - protein, 7 aa, Mycobacterium
DTRREEH

SEQ ID NO: 459324 - protein, 6 aa, Mycobacterium
DTRRPD

SEQ ID NO: 459325 - protein, 10 aa, Mycobacterium
DTRRQLAGDE

SEQ ID NO: 459326 - protein, 10 aa, Mycobacterium
DTRRSFSTTD

SEQ ID NO: 459327 - protein, 16 aa, Mycobacterium
DTRRSPGDPSPATERY

SEQ ID NO: 459328 - protein, 6 aa, Mycobacterium
DTRRSR

SEQ ID NO: 459329 - protein, 8 aa, Mycobacterium
DTRRTLSE

SEQ ID NO: 459330 - protein, 4 aa, Mycobacterium
DTRS

SEQ ID NO: 459331 - protein, 6 aa, Mycobacterium
DTRSED

SEQ ID NO: 459332 - protein, 8 aa, Mycobacterium
DTRSVQTS

SEQ ID NO: 459333 - protein, 4 aa, Mycobacterium
DTRT

SEQ ID NO: 459334 - protein, 6 aa, Mycobacterium
DTRTAR

SEQ ID NO: 459335 - protein, 8 aa, Mycobacterium
DTRTARTD

SEQ ID NO: 459336 - protein, 7 aa, Mycobacterium
DTRTRAA

SEQ ID NO: 459337 - protein, 10 aa, Mycobacterium
DTRTRQARQR

SEQ ID NO: 459338 - protein, 22 aa, Mycobacterium
DTRTRSAHVTQDDLTNSYSLQL

SEQ ID NO: 459339 - protein, 7 aa, Mycobacterium
DTRTRTR

SEQ ID NO: 459340 - protein, 11 aa, Mycobacterium
DTRTSSAVAQR

SEQ ID NO: 459341 - protein, 5 aa, Mycobacterium
DTRTV

SEQ ID NO: 459342 - protein, 4 aa, Mycobacterium
DTRV

SEQ ID NO: 459343 - protein, 7 aa, Mycobacterium
DTRYART

SEQ ID NO: 459344 - protein, 55 aa, Mycobacterium
DTSAAAAALSPWGAGPQGNSAGSGQSGTSEMPASGRGPVASAISAGSSAAAGTNI

SEQ ID NO: 459345 - protein, 17 aa, Mycobacterium
DTSAADAAGSAADAAGL

SEQ ID NO: 459346 - protein, 7 aa, Mycobacterium
DTSAARS

SEQ ID NO: 459347 - protein, 11 aa, Mycobacterium
DTSAARYRRPA

SEQ ID NO: 459348 - protein, 10 aa, Mycobacterium
DTSAEDLTAA

SEQ ID NO: 459349 - protein, 7 aa, Mycobacterium
DTSAGDV

SEQ ID NO: 459350 - protein, 9 aa, Mycobacterium
DTSAGPVDT

SEQ ID NO: 459351 - protein, 16 aa, Mycobacterium
DTSAKLPRPTTGDELK

SEQ ID NO: 459352 - protein, 10 aa, Mycobacterium
DTSAPGGAGL

SEQ ID NO: 459353 - protein, 6 aa, Mycobacterium
DTSAPR

SEQ ID NO: 459354 - protein, 8 aa, Mycobacterium
DTSAQAWA

SEQ ID NO: 459355 - protein, 13 aa, Mycobacterium
DTSAQGRITEQTP

SEQ ID NO: 459356 - protein, 15 aa, Mycobacterium
DTSASLPRPATGEEL

SEQ ID NO: 459357 - protein, 9 aa, Mycobacterium
DTSASMPGR

SEQ ID NO: 459358 - protein, 6 aa, Mycobacterium
DTSASV

SEQ ID NO: 459359 - protein, 6 aa, Mycobacterium
DTSATG

SEQ ID NO: 459360 - protein, 5 aa, Mycobacterium
DTSAV

SEQ ID NO: 459361 - protein, 7 aa, Mycobacterium
DTSCSSA

SEQ ID NO: 459362 - protein, 4 aa, Mycobacterium
DTSD

SEQ ID NO: 459363 - protein, 9 aa, Mycobacterium
DTSDAPLAA

SEQ ID NO: 459364 - protein, 8 aa, Mycobacterium
DTSDDGRV

SEQ ID NO: 459365 - protein, 7 aa, Mycobacterium
DTSDDRM

SEQ ID NO: 459366 - protein, 5 aa, Mycobacterium
DTSDE

SEQ ID NO: 459367 - protein, 7 aa, Mycobacterium
DTSDGDL

SEQ ID NO: 459368 - protein, 19 aa, Mycobacterium
DTSDLDDASALDASAPGAV

SEQ ID NO: 459369 - protein, 8 aa, Mycobacterium
DTSDPAAV

SEQ ID NO: 459370 - protein, 6 aa, Mycobacterium
DTSDPV

SEQ ID NO: 459371 - protein, 7 aa, Mycobacterium
DTSDRSI

SEQ ID NO: 459372 - protein, 8 aa, Mycobacterium
DTSDSARS

SEQ ID NO: 459373 - protein, 5 aa, Mycobacterium
DTSDY

SEQ ID NO: 459374 - protein, 4 aa, Mycobacterium
DTSE

SEQ ID NO: 459375 - protein, 5 aa, Mycobacterium
DTSEA

SEQ ID NO: 459376 - protein, 7 aa, Mycobacterium
DTSENGW

SEQ ID NO: 459377 - protein, 10 aa, Mycobacterium
DTSEQAWRDA

SEQ ID NO: 459378 - protein, 6 aa, Mycobacterium
DTSETA

SEQ ID NO: 459379 - protein, 4 aa, Mycobacterium
DTSF

SEQ ID NO: 459380 - protein, 7 aa, Mycobacterium
DTSFGKL

SEQ ID NO: 459381 - protein, 7 aa, Mycobacterium
DTSGAPY

SEQ ID NO: 459382 - protein, 22 aa, Mycobacterium
DTSGDASGGDGRHGRDAQKVSL

SEQ ID NO: 459383 - protein, 15 aa, Mycobacterium
DTSGGGAADGATVDA

SEQ ID NO: 459384 - protein, 7 aa, Mycobacterium
DTSGKGG

SEQ ID NO: 459385 - protein, 6 aa, Mycobacterium
DTSGQL

SEQ ID NO: 459386 - protein, 8 aa, Mycobacterium
DTSGSTQV

SEQ ID NO: 459387 - protein, 15 aa, Mycobacterium
DTSGTVDVEAERRRL

SEQ ID NO: 459388 - protein, 8 aa, Mycobacterium
DTSHFTTP

SEQ ID NO: 459389 - protein, 5 aa, Mycobacterium
DTSID

SEQ ID NO: 459390 - protein, 15 aa, Mycobacterium
DTSISTTISGTLDPP

SEQ ID NO: 459391 - protein, 12 aa, Mycobacterium
DTSLRDGSHHKR

SEQ ID NO: 459392 - protein, 7 aa, Mycobacterium
DTSMSQA

SEQ ID NO: 459393 - protein, 4 aa, Mycobacterium
DTSN

SEQ ID NO: 459394 - protein, 8 aa, Mycobacterium
DTSNPDEL

SEQ ID NO: 459395 - protein, 7 aa, Mycobacterium
DTSNRTH

SEQ ID NO: 459396 - protein, 8 aa, Mycobacterium
DTSNRTNA

SEQ ID NO: 459397 - protein, 6 aa, Mycobacterium
DTSPEM

SEQ ID NO: 459398 - protein, 6 aa, Mycobacterium
DTSPFN

SEQ ID NO: 459399 - protein, 6 aa, Mycobacterium
DTSPGV

SEQ ID NO: 459400 - protein, 6 aa, Mycobacterium
DTSPTV

SEQ ID NO: 459401 - protein, 10 aa, Mycobacterium
DTSQAKPIAP

SEQ ID NO: 459402 - protein, 9 aa, Mycobacterium
DTSQSDCGD

SEQ ID NO: 459403 - protein, 4 aa, Mycobacterium
DTSR

SEQ ID NO: 459404 - protein, 5 aa, Mycobacterium
DTSRA

SEQ ID NO: 459405 - protein, 11 aa, Mycobacterium
DTSRADGGRTL

SEQ ID NO: 459406 - protein, 6 aa, Mycobacterium
DTSRCG

SEQ ID NO: 459407 - protein, 8 aa, Mycobacterium
DTSRDAEQ

SEQ ID NO: 459408 - protein, 20 aa, Mycobacterium
DTSRDVKAALAGPVGELVLT

SEQ ID NO: 459409 - protein, 16 aa, Mycobacterium
DTSRGASRSARAALGD

SEQ ID NO: 459410 - protein, 14 aa, Mycobacterium
DTSRGSSRSARAAL

SEQ ID NO: 459411 - protein, 7 aa, Mycobacterium
DTSRLTA

SEQ ID NO: 459412 - protein, 5 aa, Mycobacterium
DTSRP

SEQ ID NO: 459413 - protein, 9 aa, Mycobacterium
DTSRPGAQI

SEQ ID NO: 459414 - protein, 20 aa, Mycobacterium
DTSRPLRESVTEAQRVCCLA

SEQ ID NO: 459415 - protein, 8 aa, Mycobacterium
DTSRRDTQ

SEQ ID NO: 459416 - protein, 7 aa, Mycobacterium
DTSRRRA

SEQ ID NO: 459417 - protein, 6 aa, Mycobacterium
DTSRSR

SEQ ID NO: 459418 - protein, 6 aa, Mycobacterium
DTSSQL

SEQ ID NO: 459419 - protein, 7 aa, Mycobacterium
DTSSQLV

SEQ ID NO: 459420 - protein, 7 aa, Mycobacterium
DTSTAGG

SEQ ID NO: 459421 - protein, 5 aa, Mycobacterium
DTSTG

SEQ ID NO: 459422 - protein, 14 aa, Mycobacterium
DTSTLANDPNETEL

SEQ ID NO: 459423 - protein, 5 aa, Mycobacterium
DTSTN

SEQ ID NO: 459424 - protein, 7 aa, Mycobacterium
DTSTNGT

SEQ ID NO: 459425 - protein, 7 aa, Mycobacterium
DTSTPQW

SEQ ID NO: 459426 - protein, 5 aa, Mycobacterium
DTSTR

SEQ ID NO: 459427 - protein, 7 aa, Mycobacterium
DTSTSTL

SEQ ID NO: 459428 - protein, 8 aa, Mycobacterium
DTSTTETG

SEQ ID NO: 459429 - protein, 10 aa, Mycobacterium
DTSTTGASAL

SEQ ID NO: 459430 - protein, 10 aa, Mycobacterium
DTSTTGGSAL

SEQ ID NO: 459431 - protein, 9 aa, Mycobacterium
DTSTTGNSA

SEQ ID NO: 459432 - protein, 8 aa, Mycobacterium
DTSTVPGG

SEQ ID NO: 459433 - protein, 4 aa, Mycobacterium
DTSV

SEQ ID NO: 459434 - protein, 7 aa, Mycobacterium
DTSVGET

SEQ ID NO: 459435 - protein, 8 aa, Mycobacterium
DTSVTDAD

SEQ ID NO: 459436 - protein, 5 aa, Mycobacterium
DTSYD

SEQ ID NO: 459437 - protein, 7 aa, Mycobacterium
DTSYSGV

SEQ ID NO: 459438 - protein, 7 aa, Mycobacterium
DTTAAQR

SEQ ID NO: 459439 - protein, 9 aa, Mycobacterium
DTTAATSLT

SEQ ID NO: 459440 - protein, 5 aa, Mycobacterium
DTTAD

SEQ ID NO: 459441 - protein, 8 aa, Mycobacterium
DTTADDVE

SEQ ID NO: 459442 - protein, 10 aa, Mycobacterium
DTTADGRPGF

SEQ ID NO: 459443 - protein, 6 aa, Mycobacterium
DTTAED

SEQ ID NO: 459444 - protein, 11 aa, Mycobacterium
DTTAGDDAEPR

SEQ ID NO: 459445 - protein, 5 aa, Mycobacterium
DTTAN

SEQ ID NO: 459446 - protein, 5 aa, Mycobacterium
DTTAR

SEQ ID NO: 459447 - protein, 8 aa, Mycobacterium
DTTARGRA

SEQ ID NO: 459448 - protein, 11 aa, Mycobacterium
DTTARHRPSTA

SEQ ID NO: 459449 - protein, 7 aa, Mycobacterium
DTTARPD

SEQ ID NO: 459450 - protein, 6 aa, Mycobacterium
DTTARS

SEQ ID NO: 459451 - protein, 6 aa, Mycobacterium
DTTAYP

SEQ ID NO: 459452 - protein, 11 aa, Mycobacterium
DTTDAALPPAA

SEQ ID NO: 459453 - protein, 8 aa, Mycobacterium
DTTDGPRI

SEQ ID NO: 459454 - protein, 7 aa, Mycobacterium
DTTDGTN

SEQ ID NO: 459455 - protein, 5 aa, Mycobacterium
DTTDI

SEQ ID NO: 459456 - protein, 21 aa, Mycobacterium
DTTDMGKPITDTRGNDVPRSA

SEQ ID NO: 459457 - protein, 12 aa, Mycobacterium
DTTDVASDRYPP

SEQ ID NO: 459458 - protein, 10 aa, Mycobacterium
DTTDVDAAAA

SEQ ID NO: 459459 - protein, 7 aa, Mycobacterium
DTTDVDG

SEQ ID NO: 459460 - protein, 7 aa, Mycobacterium
DTTDVEA

SEQ ID NO: 459461 - protein, 11 aa, Mycobacterium
DTTDWSTDKEL

SEQ ID NO: 459462 - protein, 4 aa, Mycobacterium
DTTE

SEQ ID NO: 459463 - protein, 9 aa, Mycobacterium
DTTEDTHWR

SEQ ID NO: 459464 - protein, 12 aa, Mycobacterium
DTTEERSGAARD

SEQ ID NO: 459465 - protein, 12 aa, Mycobacterium
DTTEKSKHTVRA

SEQ ID NO: 459466 - protein, 6 aa, Mycobacterium
DTTEPA

SEQ ID NO: 459467 - protein, 7 aa, Mycobacterium
DTTETFN

SEQ ID NO: 459468 - protein, 5 aa, Mycobacterium
DTTEV

SEQ ID NO: 459469 - protein, 28 aa, Mycobacterium
DTTEVSDRGIEATPAHRDRDCPQPGPDN

SEQ ID NO: 459470 - protein, 15 aa, Mycobacterium
DTTEVSDRGIEATPG

SEQ ID NO: 459471 - protein, 4 aa, Mycobacterium
DTTG

SEQ ID NO: 459472 - protein, 6 aa, Mycobacterium
DTTGAE

SEQ ID NO: 459473 - protein, 7 aa, Mycobacterium
DTTGAGD

SEQ ID NO: 459474 - protein, 9 aa, Mycobacterium
DTTGASPVS

SEQ ID NO: 459475 - protein, 13 aa, Mycobacterium
DTTGGTFWLCSVD

SEQ ID NO: 459476 - protein, 5 aa, Mycobacterium
DTTGL

SEQ ID NO: 459477 - protein, 15 aa, Mycobacterium
DTTGQARQAEAELTP

SEQ ID NO: 459478 - protein, 7 aa, Mycobacterium
DTTGRAR

SEQ ID NO: 459479 - protein, 6 aa, Mycobacterium
DTTGRH

SEQ ID NO: 459480 - protein, 8 aa, Mycobacterium
DTTGRPEV

SEQ ID NO: 459481 - protein, 10 aa, Mycobacterium
DTTGRSTNRY

SEQ ID NO: 459482 - protein, 8 aa, Mycobacterium
DTTGVPST

SEQ ID NO: 459483 - protein, 19 aa, Mycobacterium
DTTHDRDAAGPPAAHGTQL

SEQ ID NO: 459484 - protein, 7 aa, Mycobacterium
DTTHGND

SEQ ID NO: 459485 - protein, 11 aa, Mycobacterium
DTTHPDQTGLP

SEQ ID NO: 459486 - protein, 10 aa, Mycobacterium
DTTIPGPPQR

SEQ ID NO: 459487 - protein, 9 aa, Mycobacterium
DTTLGSPPH

SEQ ID NO: 459488 - protein, 10 aa, Mycobacterium
DTTLRPRTEN

SEQ ID NO: 459489 - protein, 4 aa, Mycobacterium
DTTM

SEQ ID NO: 459490 - protein, 7 aa, Mycobacterium
DTTNDDL

SEQ ID NO: 459491 - protein, 11 aa, Mycobacterium
DTTNGQAAWGG

SEQ ID NO: 459492 - protein, 6 aa, Mycobacterium
DTTNGV

SEQ ID NO: 459493 - protein, 11 aa, Mycobacterium
DTTNPAPADVQ

SEQ ID NO: 459494 - protein, 9 aa, Mycobacterium
DTTNPASLS

SEQ ID NO: 459495 - protein, 22 aa, Mycobacterium
DTTNRPAHVTQDDLSNSYSLEV

SEQ ID NO: 459496 - protein, 19 aa, Mycobacterium
DTTPEITGGSPSEGQHRPG

SEQ ID NO: 459497 - protein, 14 aa, Mycobacterium
DTTPEQVAAELRDV

SEQ ID NO: 459498 - protein, 8 aa, Mycobacterium
DTTPGDIT

SEQ ID NO: 459499 - protein, 7 aa, Mycobacterium
DTTPPDY

SEQ ID NO: 459500 - protein, 9 aa, Mycobacterium
DTTPPDYRV

SEQ ID NO: 459501 - protein, 6 aa, Mycobacterium
DTTPPG

SEQ ID NO: 459502 - protein, 7 aa, Mycobacterium
DTTPPGL

SEQ ID NO: 459503 - protein, 6 aa, Mycobacterium
DTTPPL

SEQ ID NO: 459504 - protein, 16 aa, Mycobacterium
DTTPSDPQAAAARTEA

SEQ ID NO: 459505 - protein, 14 aa, Mycobacterium
DTTPTARDHRDRHQ

SEQ ID NO: 459506 - protein, 5 aa, Mycobacterium
DTTQG

SEQ ID NO: 459507 - protein, 8 aa, Mycobacterium
DTTQVSER

SEQ ID NO: 459508 - protein, 4 aa, Mycobacterium
DTTR

SEQ ID NO: 459509 - protein, 7 aa, Mycobacterium
DTTRGAL

SEQ ID NO: 459510 - protein, 7 aa, Mycobacterium
DTTRGNS

SEQ ID NO: 459511 - protein, 7 aa, Mycobacterium
DTTRKQL

SEQ ID NO: 459512 - protein, 7 aa, Mycobacterium
DTTRKTL

SEQ ID NO: 459513 - protein, 10 aa, Mycobacterium
DTTRLSSAKG

SEQ ID NO: 459514 - protein, 7 aa, Mycobacterium
DTTRPAT

SEQ ID NO: 459515 - protein, 9 aa, Mycobacterium
DTTRPGEAW

SEQ ID NO: 459516 - protein, 17 aa, Mycobacterium
DTTRPRHSRHPGGAAPV

SEQ ID NO: 459517 - protein, 17 aa, Mycobacterium
DTTRRADEAGNDIVEED

SEQ ID NO: 459518 - protein, 10 aa, Mycobacterium
DTTRRERDRL

SEQ ID NO: 459519 - protein, 6 aa, Mycobacterium
DTTRSA

SEQ ID NO: 459520 - protein, 7 aa, Mycobacterium
DTTSDTG

SEQ ID NO: 459521 - protein, 6 aa, Mycobacterium
DTTSGF

SEQ ID NO: 459522 - protein, 11 aa, Mycobacterium
DTTSLRRAGTP

SEQ ID NO: 459523 - protein, 5 aa, Mycobacterium
DTTST

SEQ ID NO: 459524 - protein, 7 aa, Mycobacterium
DTTSTAT

SEQ ID NO: 459525 - protein, 6 aa, Mycobacterium
DTTSTT

SEQ ID NO: 459526 - protein, 4 aa, Mycobacterium
DTTT

SEQ ID NO: 459527 - protein, 6 aa, Mycobacterium
DTTTAE

SEQ ID NO: 459528 - protein, 6 aa, Mycobacterium
DTTTDD

SEQ ID NO: 459529 - protein, 16 aa, Mycobacterium
DTTTERFPDPASQDQL

SEQ ID NO: 459530 - protein, 13 aa, Mycobacterium
DTTTGDTLSDPNN

SEQ ID NO: 459531 - protein, 6 aa, Mycobacterium
DTTTGE

SEQ ID NO: 459532 - protein, 9 aa, Mycobacterium
DTTTKTTVT

SEQ ID NO: 459533 - protein, 6 aa, Mycobacterium
DTTTPD

SEQ ID NO: 459534 - protein, 7 aa, Mycobacterium
DTTTPEQ

SEQ ID NO: 459535 - protein, 9 aa, Mycobacterium
DTTTPTQRA

SEQ ID NO: 459536 - protein, 5 aa, Mycobacterium
DTTTQ

SEQ ID NO: 459537 - protein, 22 aa, Mycobacterium
DTTTQTKAGGGVGDGAGTRGGV

SEQ ID NO: 459538 - protein, 7 aa, Mycobacterium
DTTTSHL

SEQ ID NO: 459539 - protein, 7 aa, Mycobacterium
DTTTSTG

SEQ ID NO: 459540 - protein, 9 aa, Mycobacterium
DTTTSTTTT

SEQ ID NO: 459541 - protein, 6 aa, Mycobacterium
DTTTTA

SEQ ID NO: 459542 - protein, 5 aa, Mycobacterium
DTTVA

SEQ ID NO: 459543 - protein, 10 aa, Mycobacterium
DTTVGDDKSD

SEQ ID NO: 459544 - protein, 10 aa, Mycobacterium
DTTVGDNKRD

SEQ ID NO: 459545 - protein, 5 aa, Mycobacterium
DTTYG

SEQ ID NO: 459546 - protein, 6 aa, Mycobacterium
DTTYGG

SEQ ID NO: 459547 - protein, 6 aa, Mycobacterium
DTTYTP

SEQ ID NO: 459548 - protein, 10 aa, Mycobacterium
DTVAEHSHSE

SEQ ID NO: 459549 - protein, 5 aa, Mycobacterium
DTVAG

SEQ ID NO: 459550 - protein, 10 aa, Mycobacterium
DTVAGRRKRL

SEQ ID NO: 459551 - protein, 5 aa, Mycobacterium
DTVAH

SEQ ID NO: 459552 - protein, 21 aa, Mycobacterium
DTVAHTGTGPPAGTALAEGEK

SEQ ID NO: 459553 - protein, 9 aa, Mycobacterium
DTVATGGSI

SEQ ID NO: 459554 - protein, 5 aa, Mycobacterium
DTVDD

SEQ ID NO: 459555 - protein, 6 aa, Mycobacterium
DTVDDA

SEQ ID NO: 459556 - protein, 9 aa, Mycobacterium
DTVENPPQE

SEQ ID NO: 459557 - protein, 8 aa, Mycobacterium
DTVEPTSW

SEQ ID NO: 459558 - protein, 11 aa, Mycobacterium
DTVERSDGSDV

SEQ ID NO: 459559 - protein, 10 aa, Mycobacterium
DTVESGAGEV

SEQ ID NO: 459560 - protein, 15 aa, Mycobacterium
DTVETARAASTGDWR

SEQ ID NO: 459561 - protein, 5 aa, Mycobacterium
DTVEV

SEQ ID NO: 459562 - protein, 10 aa, Mycobacterium
DTVEVKDGYG

SEQ ID NO: 459563 - protein, 4 aa, Mycobacterium
DTVG

SEQ ID NO: 459564 - protein, 9 aa, Mycobacterium
DTVGAREQL

SEQ ID NO: 459565 - protein, 12 aa, Mycobacterium
DTVGDSSVGTEE

SEQ ID NO: 459566 - protein, 5 aa, Mycobacterium
DTVGG

SEQ ID NO: 459567 - protein, 13 aa, Mycobacterium
DTVGGGARSGELT

SEQ ID NO: 459568 - protein, 6 aa, Mycobacterium
DTVGRD

SEQ ID NO: 459569 - protein, 7 aa, Mycobacterium
DTVGSNN

SEQ ID NO: 459570 - protein, 8 aa, Mycobacterium
DTVGTNGV

SEQ ID NO: 459571 - protein, 4 aa, Mycobacterium
DTVH

SEQ ID NO: 459572 - protein, 8 aa, Mycobacterium
DTVLPDDE

SEQ ID NO: 459573 - protein, 9 aa, Mycobacterium
DTVNTMPEK

SEQ ID NO: 459574 - protein, 6 aa, Mycobacterium
DTVPAG

SEQ ID NO: 459575 - protein, 14 aa, Mycobacterium
DTVPALAGAGIPDD

SEQ ID NO: 459576 - protein, 16 aa, Mycobacterium
DTVPARRDRPLGDERS

SEQ ID NO: 459577 - protein, 7 aa, Mycobacterium
DTVPDAA

SEQ ID NO: 459578 - protein, 24 aa, Mycobacterium
DTVPDEGAAAADPAESGDNRGASG

SEQ ID NO: 459579 - protein, 6 aa, Mycobacterium
DTVPDG

SEQ ID NO: 459580 - protein, 6 aa, Mycobacterium
DTVPSH

SEQ ID NO: 459581 - protein, 18 aa, Mycobacterium
DTVQGKEDIPSEPPKLPK

SEQ ID NO: 459582 - protein, 15 aa, Mycobacterium
DTVRPTVAGADERPG

SEQ ID NO: 459583 - protein, 13 aa, Mycobacterium
DTVSAGAARAGVT

SEQ ID NO: 459584 - protein, 9 aa, Mycobacterium
DTVSAGQAF

SEQ ID NO: 459585 - protein, 7 aa, Mycobacterium
DTVSGEW

SEQ ID NO: 459586 - protein, 16 aa, Mycobacterium
DTVSSTRQLEPPVPQH

SEQ ID NO: 459587 - protein, 16 aa, Mycobacterium
DTVSVPGRSLILLRKT

SEQ ID NO: 459588 - protein, 4 aa, Mycobacterium
DTVT

SEQ ID NO: 459589 - protein, 90 aa, Mycobacterium
DTVTAAQHAATTTNTPDDAPADTPAADTEPAEPAEPAEPAEPAEPAEPAEPAEPVEPVDDPDIAPAASATETATDTTASPTGTDCDPESV

SEQ ID NO: 459590 - protein, 83 aa, Mycobacterium
DTVTAAQHAATTTNTPDDAPSDTPAADTEPAEPAEPAEPVDDPDIAPAATATETATDTEPDAPAPTDTADSAATETDCDPESV

SEQ ID NO: 459591 - protein, 6 aa, Mycobacterium
DTVTAG

SEQ ID NO: 459592 - protein, 9 aa, Mycobacterium
DTVTPAGQM

SEQ ID NO: 459593 - protein, 7 aa, Mycobacterium
DTVTPEV

SEQ ID NO: 459594 - protein, 16 aa, Mycobacterium
DTVTTEASSQPALADD

SEQ ID NO: 459595 - protein, 7 aa, Mycobacterium
DTVTTEE

SEQ ID NO: 459596 - protein, 4 aa, Mycobacterium
DTVV

SEQ ID NO: 459597 - protein, 4 aa, Mycobacterium
DTVY

SEQ ID NO: 459598 - protein, 4 aa, Mycobacterium
DTWA

SEQ ID NO: 459599 - protein, 4 aa, Mycobacterium
DTWP

SEQ ID NO: 459600 - protein, 13 aa, Mycobacterium
DTWSERKLSDGDF

SEQ ID NO: 459601 - protein, 8 aa, Mycobacterium
DTYADASP

SEQ ID NO: 459602 - protein, 6 aa, Mycobacterium
DTYAKG

SEQ ID NO: 459603 - protein, 5 aa, Mycobacterium
DTYDG

SEQ ID NO: 459604 - protein, 6 aa, Mycobacterium
DTYDGQ

SEQ ID NO: 459605 - protein, 5 aa, Mycobacterium
DTYGG

SEQ ID NO: 459606 - protein, 9 aa, Mycobacterium
DTYGHDTGD

SEQ ID NO: 459607 - protein, 6 aa, Mycobacterium
DTYGRE

SEQ ID NO: 459608 - protein, 9 aa, Mycobacterium
DTYGRHPEI

SEQ ID NO: 459609 - protein, 4 aa, Mycobacterium
DTYH

SEQ ID NO: 459610 - protein, 6 aa, Mycobacterium
DTYHPT

SEQ ID NO: 459611 - protein, 14 aa, Mycobacterium
DTYIEKDSSINDDV

SEQ ID NO: 459612 - protein, 6 aa, Mycobacterium
DTYKNL

SEQ ID NO: 459613 - protein, 10 aa, Mycobacterium
DTYPGREKEI

SEQ ID NO: 459614 - protein, 7 aa, Mycobacterium
DTYPGRV

SEQ ID NO: 459615 - protein, 12 aa, Mycobacterium
DTYQQERKPHTR

SEQ ID NO: 459616 - protein, 5 aa, Mycobacterium
DTYSE

SEQ ID NO: 459617 - protein, 6 aa, Mycobacterium
DTYSGG

SEQ ID NO: 459618 - protein, 11 aa, Mycobacterium
DTYTGGGTKDV

SEQ ID NO: 459619 - protein, 6 aa, Mycobacterium
DTYTVN

SEQ ID NO: 459620 - protein, 6 aa, Mycobacterium
DVAAGD

SEQ ID NO: 459621 - protein, 8 aa, Mycobacterium
DVAAGDLD

SEQ ID NO: 459622 - protein, 6 aa, Mycobacterium
DVAAGK

SEQ ID NO: 459623 - protein, 11 aa, Mycobacterium
DVAAGREPGEV

SEQ ID NO: 459624 - protein, 6 aa, Mycobacterium
DVAAGY

SEQ ID NO: 459625 - protein, 7 aa, Mycobacterium
DVAAGYE

SEQ ID NO: 459626 - protein, 10 aa, Mycobacterium
DVAAKAKNRP

SEQ ID NO: 459627 - protein, 8 aa, Mycobacterium
DVAASSAR

SEQ ID NO: 459628 - protein, 6 aa, Mycobacterium
DVADDD

SEQ ID NO: 459629 - protein, 9 aa, Mycobacterium
DVADDGRSL

SEQ ID NO: 459630 - protein, 6 aa, Mycobacterium
DVADGH

SEQ ID NO: 459631 - protein, 13 aa, Mycobacterium
DVADGTALGVQGT

SEQ ID NO: 459632 - protein, 7 aa, Mycobacterium
DVADPDR

SEQ ID NO: 459633 - protein, 6 aa, Mycobacterium
DVADTD

SEQ ID NO: 459634 - protein, 14 aa, Mycobacterium
DVADTDPRVSPLRT

SEQ ID NO: 459635 - protein, 13 aa, Mycobacterium
DVADTPRPPLAER

SEQ ID NO: 459636 - protein, 4 aa, Mycobacterium
DVAE

SEQ ID NO: 459637 - protein, 5 aa, Mycobacterium
DVAEA

SEQ ID NO: 459638 - protein, 5 aa, Mycobacterium
DVAED

SEQ ID NO: 459639 - protein, 8 aa, Mycobacterium
DVAEQQRG

SEQ ID NO: 459640 - protein, 15 aa, Mycobacterium
DVAEQQRGRERRGPR

SEQ ID NO: 459641 - protein, 10 aa, Mycobacterium
DVAESDEHQQ

SEQ ID NO: 459642 - protein, 7 aa, Mycobacterium
DVAESEE

SEQ ID NO: 459643 - protein, 8 aa, Mycobacterium
DVAESEEV

SEQ ID NO: 459644 - protein, 15 aa, Mycobacterium
DVAGAISTARPNSGT

SEQ ID NO: 459645 - protein, 12 aa, Mycobacterium
DVAGASAQRGLS

SEQ ID NO: 459646 - protein, 16 aa, Mycobacterium
DVAGEAPDLEATDPRM

SEQ ID NO: 459647 - protein, 10 aa, Mycobacterium
DVAGEPDAFG

SEQ ID NO: 459648 - protein, 7 aa, Mycobacterium
DVAGGDN

SEQ ID NO: 459649 - protein, 10 aa, Mycobacterium
DVAGGRTGRP

SEQ ID NO: 459650 - protein, 21 aa, Mycobacterium
DVAGIGSSVGAANAAAVGATT

SEQ ID NO: 459651 - protein, 6 aa, Mycobacterium
DVAGPG

SEQ ID NO: 459652 - protein, 9 aa, Mycobacterium
DVAGPQTQR

SEQ ID NO: 459653 - protein, 8 aa, Mycobacterium
DVAGPSAV

SEQ ID NO: 459654 - protein, 11 aa, Mycobacterium
DVAGQPSMHGS

SEQ ID NO: 459655 - protein, 16 aa, Mycobacterium
DVAGRAASLPVPKSTS

SEQ ID NO: 459656 - protein, 8 aa, Mycobacterium
DVAGRRAV

SEQ ID NO: 459657 - protein, 8 aa, Mycobacterium
DVAGRSAA

SEQ ID NO: 459658 - protein, 9 aa, Mycobacterium
DVANDQERH

SEQ ID NO: 459659 - protein, 5 aa, Mycobacterium
DVANR

SEQ ID NO: 459660 - protein, 19 aa, Mycobacterium
DVAPATKDYETFSSAKGAT

SEQ ID NO: 459661 - protein, 15 aa, Mycobacterium
DVAPDGTYSSPIDNA

SEQ ID NO: 459662 - protein, 16 aa, Mycobacterium
DVAPDGTYSSPIENPN

SEQ ID NO: 459663 - protein, 15 aa, Mycobacterium
DVAPDGTYSSPIENT

SEQ ID NO: 459664 - protein, 8 aa, Mycobacterium
DVAPEHDH

SEQ ID NO: 459665 - protein, 24 aa, Mycobacterium
DVAPERKAHLGGGESRGLGPGSVT

SEQ ID NO: 459666 - protein, 5 aa, Mycobacterium
DVAPG

SEQ ID NO: 459667 - protein, 17 aa, Mycobacterium
DVAPTPPKSCHMSGHQE

SEQ ID NO: 459668 - protein, 16 aa, Mycobacterium
DVAQPGGQRGRRGIAG

SEQ ID NO: 459669 - protein, 13 aa, Mycobacterium
DVAQTARDLETAG

SEQ ID NO: 459670 - protein, 7 aa, Mycobacterium
DVARDQF

SEQ ID NO: 459671 - protein, 5 aa, Mycobacterium
DVARE

SEQ ID NO: 459672 - protein, 8 aa, Mycobacterium
DVAREDED

SEQ ID NO: 459673 - protein, 20 aa, Mycobacterium
DVARGGFSNSPSGAPKFPPS

SEQ ID NO: 459674 - protein, 7 aa, Mycobacterium
DVARQRR

SEQ ID NO: 459675 - protein, 5 aa, Mycobacterium
DVARS

SEQ ID NO: 459676 - protein, 9 aa, Mycobacterium
DVASRDADG

SEQ ID NO: 459677 - protein, 11 aa, Mycobacterium
DVASSDATNMA

SEQ ID NO: 459678 - protein, 8 aa, Mycobacterium
DVATANPA

SEQ ID NO: 459679 - protein, 14 aa, Mycobacterium
DVATEAARALHLYG

SEQ ID NO: 459680 - protein, 37 aa, Mycobacterium
DVATEAARATADLRPKIGRARPLAERSVGTPDAGATS

SEQ ID NO: 459681 - protein, 12 aa, Mycobacterium
DVATGAEFTPNT

SEQ ID NO: 459682 - protein, 8 aa, Mycobacterium
DVATGSID

SEQ ID NO: 459683 - protein, 12 aa, Mycobacterium
DVATPTPGNASA

SEQ ID NO: 459684 - protein, 16 aa, Mycobacterium
DVATSHPSTGAERRLA

SEQ ID NO: 459685 - protein, 9 aa, Mycobacterium
DVATTTGTK

SEQ ID NO: 459686 - protein, 6 aa, Mycobacterium
DVDAAA

SEQ ID NO: 459687 - protein, 26 aa, Mycobacterium
DVDAAAKAVEASGGGIVKGPYDDAHE

SEQ ID NO: 459688 - protein, 14 aa, Mycobacterium
DVDAAAKEIEATGG

SEQ ID NO: 459689 - protein, 9 aa, Mycobacterium
DVDAAEAER

SEQ ID NO: 459690 - protein, 12 aa, Mycobacterium
DVDAAELAARLL

SEQ ID NO: 459691 - protein, 8 aa, Mycobacterium
DVDAATAR

SEQ ID NO: 459692 - protein, 9 aa, Mycobacterium
DVDADEAER

SEQ ID NO: 459693 - protein, 6 aa, Mycobacterium
DVDADG

SEQ ID NO: 459694 - protein, 5 aa, Mycobacterium
DVDAE

SEQ ID NO: 459695 - protein, 9 aa, Mycobacterium
DVDAEEAER

SEQ ID NO: 459696 - protein, 8 aa, Mycobacterium
DVDAEGGA

SEQ ID NO: 459697 - protein, 6 aa, Mycobacterium
DVDAER

SEQ ID NO: 459698 - protein, 8 aa, Mycobacterium
DVDAESAL

SEQ ID NO: 459699 - protein, 9 aa, Mycobacterium
DVDAQSVKA

SEQ ID NO: 459700 - protein, 6 aa, Mycobacterium
DVDASN

SEQ ID NO: 459701 - protein, 5 aa, Mycobacterium
DVDDE

SEQ ID NO: 459702 - protein, 6 aa, Mycobacterium
DVDDGA

SEQ ID NO: 459703 - protein, 16 aa, Mycobacterium
DVDDGAKPGTSRTESV

SEQ ID NO: 459704 - protein, 21 aa, Mycobacterium
DVDDGAKPGTTTSESSELREA

SEQ ID NO: 459705 - protein, 7 aa, Mycobacterium
DVDDGQL

SEQ ID NO: 459706 - protein, 5 aa, Mycobacterium
DVDDP

SEQ ID NO: 459707 - protein, 8 aa, Mycobacterium
DVDDPAER

SEQ ID NO: 459708 - protein, 11 aa, Mycobacterium
DVDDPASFGPL

SEQ ID NO: 459709 - protein, 11 aa, Mycobacterium
DVDDPDDPRLD

SEQ ID NO: 459710 - protein, 9 aa, Mycobacterium
DVDDPYPIS

SEQ ID NO: 459711 - protein, 6 aa, Mycobacterium
DVDDRG

SEQ ID NO: 459712 - protein, 18 aa, Mycobacterium
DVDDVERGSQDSDWDPVK

SEQ ID NO: 459713 - protein, 8 aa, Mycobacterium
DVDEAEQA

SEQ ID NO: 459714 - protein, 7 aa, Mycobacterium
DVDEAKA

SEQ ID NO: 459715 - protein, 18 aa, Mycobacterium
DVDEGAKPGKSTNDSADL

SEQ ID NO: 459716 - protein, 8 aa, Mycobacterium
DVDEGESG

SEQ ID NO: 459717 - protein, 13 aa, Mycobacterium
DVDEPAVKEAGAD

SEQ ID NO: 459718 - protein, 9 aa, Mycobacterium
DVDEPGAPE

SEQ ID NO: 459719 - protein, 9 aa, Mycobacterium
DVDERDKPF

SEQ ID NO: 459720 - protein, 8 aa, Mycobacterium
DVDERDRP

SEQ ID NO: 459721 - protein, 8 aa, Mycobacterium
DVDESASV

SEQ ID NO: 459722 - protein, 10 aa, Mycobacterium
DVDESTQAEQ

SEQ ID NO: 459723 - protein, 12 aa, Mycobacterium
DVDGAETDEAGA

SEQ ID NO: 459724 - protein, 15 aa, Mycobacterium
DVDGDEKRWKKSRFW

SEQ ID NO: 459725 - protein, 6 aa, Mycobacterium
DVDGER

SEQ ID NO: 459726 - protein, 6 aa, Mycobacterium
DVDGEV

SEQ ID NO: 459727 - protein, 7 aa, Mycobacterium
DVDGGDV

SEQ ID NO: 459728 - protein, 6 aa, Mycobacterium
DVDGNT

SEQ ID NO: 459729 - protein, 6 aa, Mycobacterium
DVDGQD

SEQ ID NO: 459730 - protein, 8 aa, Mycobacterium
DVDGTTRT

SEQ ID NO: 459731 - protein, 9 aa, Mycobacterium
DVDHEDEPI

SEQ ID NO: 459732 - protein, 14 aa, Mycobacterium
DVDKPRNLAKSVTV

SEQ ID NO: 459733 - protein, 21 aa, Mycobacterium
DVDLGGDGDVAGRIVENLNFV

SEQ ID NO: 459734 - protein, 7 aa, Mycobacterium
DVDNAQR

SEQ ID NO: 459735 - protein, 10 aa, Mycobacterium
DVDNSASPIG

SEQ ID NO: 459736 - protein, 6 aa, Mycobacterium
DVDPAA

SEQ ID NO: 459737 - protein, 7 aa, Mycobacterium
DVDPAIK

SEQ ID NO: 459738 - protein, 9 aa, Mycobacterium
DVDPAVSGL

SEQ ID NO: 459739 - protein, 6 aa, Mycobacterium
DVDPDD

SEQ ID NO: 459740 - protein, 10 aa, Mycobacterium
DVDPDGAPTA

SEQ ID NO: 459741 - protein, 17 aa, Mycobacterium
DVDPDRLAATLTASNER

SEQ ID NO: 459742 - protein, 6 aa, Mycobacterium
DVDPED

SEQ ID NO: 459743 - protein, 10 aa, Mycobacterium
DVDPERAADQ

SEQ ID NO: 459744 - protein, 19 aa, Mycobacterium
DVDPETDVTDETDDAPAVE

SEQ ID NO: 459745 - protein, 7 aa, Mycobacterium
DVDPGAV

SEQ ID NO: 459746 - protein, 13 aa, Mycobacterium
DVDPGGLAASLMA

SEQ ID NO: 459747 - protein, 6 aa, Mycobacterium
DVDPGR

SEQ ID NO: 459748 - protein, 8 aa, Mycobacterium
DVDPGRDR

SEQ ID NO: 459749 - protein, 6 aa, Mycobacterium
DVDPNI

SEQ ID NO: 459750 - protein, 6 aa, Mycobacterium
DVDPSW

SEQ ID NO: 459751 - protein, 11 aa, Mycobacterium
DVDQESADRGW

SEQ ID NO: 459752 - protein, 9 aa, Mycobacterium
DVDQQAGNA

SEQ ID NO: 459753 - protein, 6 aa, Mycobacterium
DVDQRV

SEQ ID NO: 459754 - protein, 4 aa, Mycobacterium
DVDR

SEQ ID NO: 459755 - protein, 13 aa, Mycobacterium
DVDRPEAHDEEAD

SEQ ID NO: 459756 - protein, 5 aa, Mycobacterium
DVDRR

SEQ ID NO: 459757 - protein, 8 aa, Mycobacterium
DVDRSRED

SEQ ID NO: 459758 - protein, 12 aa, Mycobacterium
DVDRSVRNLAAL

SEQ ID NO: 459759 - protein, 14 aa, Mycobacterium
DVDSAVGRADGTDA

SEQ ID NO: 459760 - protein, 5 aa, Mycobacterium
DVDSE

SEQ ID NO: 459761 - protein, 10 aa, Mycobacterium
DVDSNASPIG

SEQ ID NO: 459762 - protein, 11 aa, Mycobacterium
DVDSNTASTLD

SEQ ID NO: 459763 - protein, 8 aa, Mycobacterium
DVDSPDTV

SEQ ID NO: 459764 - protein, 7 aa, Mycobacterium
DVDSPRL

SEQ ID NO: 459765 - protein, 5 aa, Mycobacterium
DVDSS

SEQ ID NO: 459766 - protein, 5 aa, Mycobacterium
DVDTD

SEQ ID NO: 459767 - protein, 8 aa, Mycobacterium
DVDTPAEV

SEQ ID NO: 459768 - protein, 6 aa, Mycobacterium
DVDTQA

SEQ ID NO: 459769 - protein, 5 aa, Mycobacterium
DVDTS

SEQ ID NO: 459770 - protein, 9 aa, Mycobacterium
DVDTYETAK

SEQ ID NO: 459771 - protein, 12 aa, Mycobacterium
DVDVDEDRPGDH

SEQ ID NO: 459772 - protein, 7 aa, Mycobacterium
DVDVTGG

SEQ ID NO: 459773 - protein, 10 aa, Mycobacterium
DVDYGTNPMA

SEQ ID NO: 459774 - protein, 10 aa, Mycobacterium
DVEAAAATVA

SEQ ID NO: 459775 - protein, 9 aa, Mycobacterium
DVEAADPAT

SEQ ID NO: 459776 - protein, 11 aa, Mycobacterium
DVEDGPASPVR

SEQ ID NO: 459777 - protein, 7 aa, Mycobacterium
DVEDPAD

SEQ ID NO: 459778 - protein, 9 aa, Mycobacterium
DVEESAGAY

SEQ ID NO: 459779 - protein, 12 aa, Mycobacterium
DVEESRGERDAR

SEQ ID NO: 459780 - protein, 9 aa, Mycobacterium
DVEGHAPNT

SEQ ID NO: 459781 - protein, 5 aa, Mycobacterium
DVEGN

SEQ ID NO: 459782 - protein, 9 aa, Mycobacterium
DVEGPRTEV

SEQ ID NO: 459783 - protein, 9 aa, Mycobacterium
DVEGRTAAS

SEQ ID NO: 459784 - protein, 10 aa, Mycobacterium
DVEGSTTDVP

SEQ ID NO: 459785 - protein, 8 aa, Mycobacterium
DVEKPKVK

SEQ ID NO: 459786 - protein, 12 aa, Mycobacterium
DVEKSVKNLAAL

SEQ ID NO: 459787 - protein, 21 aa, Mycobacterium
DVELGGDKDVAGQIVEHLNFV

SEQ ID NO: 459788 - protein, 12 aa, Mycobacterium
DVELGSRNERPM

SEQ ID NO: 459789 - protein, 5 aa, Mycobacterium
DVELS

SEQ ID NO: 459790 - protein, 5 aa, Mycobacterium
DVEPA

SEQ ID NO: 459791 - protein, 45 aa, Mycobacterium
DVEPDTHQARSRAAAGEDDGSYVGAAGSDDSFDAGESGAEARSER

SEQ ID NO: 459792 - protein, 45 aa, Mycobacterium
DVEPEAHESRSRAAAGEAGGSYVGAAGSDDSFDAGETGAEARSQQ

SEQ ID NO: 459793 - protein, 5 aa, Mycobacterium
DVEPG

SEQ ID NO: 459794 - protein, 8 aa, Mycobacterium
DVEPGAPA

SEQ ID NO: 459795 - protein, 8 aa, Mycobacterium
DVEPGASV

SEQ ID NO: 459796 - protein, 12 aa, Mycobacterium
DVEPGTPTPQAR

SEQ ID NO: 459797 - protein, 8 aa, Mycobacterium
DVEPTSYT

SEQ ID NO: 459798 - protein, 14 aa, Mycobacterium
DVEPVEDSDGTDGR

SEQ ID NO: 459799 - protein, 14 aa, Mycobacterium
DVEPVEGSDGTDGH

SEQ ID NO: 459800 - protein, 15 aa, Mycobacterium
DVEPVEGSDGTDGQW

SEQ ID NO: 459801 - protein, 7 aa, Mycobacterium
DVEPVSA

SEQ ID NO: 459802 - protein, 7 aa, Mycobacterium
DVERARR

SEQ ID NO: 459803 - protein, 6 aa, Mycobacterium
DVERGA

SEQ ID NO: 459804 - protein, 8 aa, Mycobacterium
DVERQKAQ

SEQ ID NO: 459805 - protein, 7 aa, Mycobacterium
DVERSQE

SEQ ID NO: 459806 - protein, 7 aa, Mycobacterium
DVERTGA

SEQ ID NO: 459807 - protein, 5 aa, Mycobacterium
DVESE

SEQ ID NO: 459808 - protein, 8 aa, Mycobacterium
DVESPSAW

SEQ ID NO: 459809 - protein, 8 aa, Mycobacterium
DVESSGLN

SEQ ID NO: 459810 - protein, 8 aa, Mycobacterium
DVESTGAT

SEQ ID NO: 459811 - protein, 5 aa, Mycobacterium
DVETS

SEQ ID NO: 459812 - protein, 6 aa, Mycobacterium
DVETTG

SEQ ID NO: 459813 - protein, 6 aa, Mycobacterium
DVEVTA

SEQ ID NO: 459814 - protein, 6 aa, Mycobacterium
DVEVTD

SEQ ID NO: 459815 - protein, 23 aa, Mycobacterium
DVEYSAGAGDDKKGAASQLPDSV

SEQ ID NO: 459816 - protein, 8 aa, Mycobacterium
DVFSSPAA

SEQ ID NO: 459817 - protein, 4 aa, Mycobacterium
DVGA

SEQ ID NO: 459818 - protein, 10 aa, Mycobacterium
DVGAADRQQV

SEQ ID NO: 459819 - protein, 9 aa, Mycobacterium
DVGADPDAL

SEQ ID NO: 459820 - protein, 7 aa, Mycobacterium
DVGAGKS

SEQ ID NO: 459821 - protein, 11 aa, Mycobacterium
DVGAKTTDGVR

SEQ ID NO: 459822 - protein, 8 aa, Mycobacterium
DVGAPPAV

SEQ ID NO: 459823 - protein, 8 aa, Mycobacterium
DVGAPPSV

SEQ ID NO: 459824 - protein, 9 aa, Mycobacterium
DVGAPPSVS

SEQ ID NO: 459825 - protein, 13 aa, Mycobacterium
DVGASNGKRRPAY

SEQ ID NO: 459826 - protein, 7 aa, Mycobacterium
DVGATAA

SEQ ID NO: 459827 - protein, 4 aa, Mycobacterium
DVGD

SEQ ID NO: 459828 - protein, 10 aa, Mycobacterium
DVGDAGTSVR

SEQ ID NO: 459829 - protein, 7 aa, Mycobacterium
DVGDATD

SEQ ID NO: 459830 - protein, 7 aa, Mycobacterium
DVGDATL

SEQ ID NO: 459831 - protein, 7 aa, Mycobacterium
DVGDDDV

SEQ ID NO: 459832 - protein, 8 aa, Mycobacterium
DVGDGQLG

SEQ ID NO: 459833 - protein, 5 aa, Mycobacterium
DVGDP

SEQ ID NO: 459834 - protein, 10 aa, Mycobacterium
DVGDTADFGR

SEQ ID NO: 459835 - protein, 6 aa, Mycobacterium
DVGEDD

SEQ ID NO: 459836 - protein, 14 aa, Mycobacterium
DVGEDRVDPAPVDD

SEQ ID NO: 459837 - protein, 6 aa, Mycobacterium
DVGEPT

SEQ ID NO: 459838 - protein, 22 aa, Mycobacterium
DVGERADSRRRTQDFLSSLCPE

SEQ ID NO: 459839 - protein, 14 aa, Mycobacterium
DVGESDAVPSPPRM

SEQ ID NO: 459840 - protein, 8 aa, Mycobacterium
DVGESPLE

SEQ ID NO: 459841 - protein, 9 aa, Mycobacterium
DVGESPPFH

SEQ ID NO: 459842 - protein, 4 aa, Mycobacterium
DVGG

SEQ ID NO: 459843 - protein, 13 aa, Mycobacterium
DVGGDDTAPPATA

SEQ ID NO: 459844 - protein, 10 aa, Mycobacterium
DVGGGDGADV

SEQ ID NO: 459845 - protein, 5 aa, Mycobacterium
DVGGR

SEQ ID NO: 459846 - protein, 7 aa, Mycobacterium
DVGGSEL

SEQ ID NO: 459847 - protein, 7 aa, Mycobacterium
DVGGSGF

SEQ ID NO: 459848 - protein, 13 aa, Mycobacterium
DVGGTTLSTTADG

SEQ ID NO: 459849 - protein, 10 aa, Mycobacterium
DVGGVPTTAA

SEQ ID NO: 459850 - protein, 7 aa, Mycobacterium
DVGKIDA

SEQ ID NO: 459851 - protein, 17 aa, Mycobacterium
DVGLSSKTQRVSSGQPL

SEQ ID NO: 459852 - protein, 18 aa, Mycobacterium
DVGLSSKTQYGSSGQPLA

SEQ ID NO: 459853 - protein, 7 aa, Mycobacterium
DVGNEIE

SEQ ID NO: 459854 - protein, 7 aa, Mycobacterium
DVGNIQP

SEQ ID NO: 459855 - protein, 5 aa, Mycobacterium
DVGPD

SEQ ID NO: 459856 - protein, 5 aa, Mycobacterium
DVGPH

SEQ ID NO: 459857 - protein, 13 aa, Mycobacterium
DVGPSLRARRGEA

SEQ ID NO: 459858 - protein, 7 aa, Mycobacterium
DVGPTAV

SEQ ID NO: 459859 - protein, 4 aa, Mycobacterium
DVGQ

SEQ ID NO: 459860 - protein, 6 aa, Mycobacterium
DVGQPG

SEQ ID NO: 459861 - protein, 10 aa, Mycobacterium
DVGQQDIDES

SEQ ID NO: 459862 - protein, 8 aa, Mycobacterium
DVGQSAGP

SEQ ID NO: 459863 - protein, 7 aa, Mycobacterium
DVGQSRI

SEQ ID NO: 459864 - protein, 6 aa, Mycobacterium
DVGRAL

SEQ ID NO: 459865 - protein, 13 aa, Mycobacterium
DVGRDPATLETST

SEQ ID NO: 459866 - protein, 6 aa, Mycobacterium
DVGREI

SEQ ID NO: 459867 - protein, 8 aa, Mycobacterium
DVGRGRDG

SEQ ID NO: 459868 - protein, 6 aa, Mycobacterium
DVGRID

SEQ ID NO: 459869 - protein, 7 aa, Mycobacterium
DVGRIDG

SEQ ID NO: 459870 - protein, 6 aa, Mycobacterium
DVGRLD

SEQ ID NO: 459871 - protein, 7 aa, Mycobacterium
DVGRLDD

SEQ ID NO: 459872 - protein, 13 aa, Mycobacterium
DVGRPEAEHEEAD

SEQ ID NO: 459873 - protein, 9 aa, Mycobacterium
DVGRPRAGV

SEQ ID NO: 459874 - protein, 15 aa, Mycobacterium
DVGRRGGAREEAMAA

SEQ ID NO: 459875 - protein, 15 aa, Mycobacterium
DVGRRPGSEKSQAEQ

SEQ ID NO: 459876 - protein, 6 aa, Mycobacterium
DVGRTV

SEQ ID NO: 459877 - protein, 7 aa, Mycobacterium
DVGRVDE

SEQ ID NO: 459878 - protein, 12 aa, Mycobacterium
DVGSAAAGIAEA

SEQ ID NO: 459879 - protein, 9 aa, Mycobacterium
DVGSTSSRL

SEQ ID NO: 459880 - protein, 13 aa, Mycobacterium
DVGSVGRPLPGNE

SEQ ID NO: 459881 - protein, 9 aa, Mycobacterium
DVGTDIDPG

SEQ ID NO: 459882 - protein, 7 aa, Mycobacterium
DVGTLDG

SEQ ID NO: 459883 - protein, 11 aa, Mycobacterium
DVGTNSQGGVQ

SEQ ID NO: 459884 - protein, 6 aa, Mycobacterium
DVGVPE

SEQ ID NO: 459885 - protein, 5 aa, Mycobacterium
DVHAN

SEQ ID NO: 459886 - protein, 7 aa, Mycobacterium
DVHGPDE

SEQ ID NO: 459887 - protein, 18 aa, Mycobacterium
DVHGQKMAETAAKEGIPA

SEQ ID NO: 459888 - protein, 7 aa, Mycobacterium
DVHGSTW

SEQ ID NO: 459889 - protein, 12 aa, Mycobacterium
DVHGTGQARDPQ

SEQ ID NO: 459890 - protein, 5 aa, Mycobacterium
DVHPD

SEQ ID NO: 459891 - protein, 7 aa, Mycobacterium
DVHQPRD

SEQ ID NO: 459892 - protein, 13 aa, Mycobacterium
DVHSDSDGRPLEV

SEQ ID NO: 459893 - protein, 5 aa, Mycobacterium
DVHTA

SEQ ID NO: 459894 - protein, 8 aa, Mycobacterium
DVIDSTKG

SEQ ID NO: 459895 - protein, 17 aa, Mycobacterium
DVIESGANADIKPGNNL

SEQ ID NO: 459896 - protein, 8 aa, Mycobacterium
DVIGRPDE

SEQ ID NO: 459897 - protein, 32 aa, Mycobacterium
DVKDGETAEDRGPAKHTKTTEHTETTTEPRRK

SEQ ID NO: 459898 - protein, 4 aa, Mycobacterium
DVKE

SEQ ID NO: 459899 - protein, 5 aa, Mycobacterium
DVKEV

SEQ ID NO: 459900 - protein, 8 aa, Mycobacterium
DVKGYQAA

SEQ ID NO: 459901 - protein, 25 aa, Mycobacterium
DVKNDPDGHKDGTGLRPGVQERADA

SEQ ID NO: 459902 - protein, 13 aa, Mycobacterium
DVKPPTPSRRLPK

SEQ ID NO: 459903 - protein, 14 aa, Mycobacterium
DVKRGRQRWRATKP

SEQ ID NO: 459904 - protein, 14 aa, Mycobacterium
DVKRRDRETGDNFD

SEQ ID NO: 459905 - protein, 7 aa, Mycobacterium
DVKSNPV

SEQ ID NO: 459906 - protein, 9 aa, Mycobacterium
DVKSRGGQA

SEQ ID NO: 459907 - protein, 9 aa, Mycobacterium
DVKTGTTQS

SEQ ID NO: 459908 - protein, 4 aa, Mycobacterium
DVLD

SEQ ID NO: 459909 - protein, 20 aa, Mycobacterium
DVLPTGRQLRSTPGLRAQPG

SEQ ID NO: 459910 - protein, 5 aa, Mycobacterium
DVLTG

SEQ ID NO: 459911 - protein, 4 aa, Mycobacterium
DVNA

SEQ ID NO: 459912 - protein, 12 aa, Mycobacterium
DVNAGDVCLALL

SEQ ID NO: 459913 - protein, 8 aa, Mycobacterium
DVNDPQPG

SEQ ID NO: 459914 - protein, 7 aa, Mycobacterium
DVNEPAE

SEQ ID NO: 459915 - protein, 12 aa, Mycobacterium
DVNGAAANREID

SEQ ID NO: 459916 - protein, 6 aa, Mycobacterium
DVNGDW

SEQ ID NO: 459917 - protein, 6 aa, Mycobacterium
DVNGTM

SEQ ID NO: 459918 - protein, 5 aa, Mycobacterium
DVNKK

SEQ ID NO: 459919 - protein, 10 aa, Mycobacterium
DVNPDEAAQA

SEQ ID NO: 459920 - protein, 5 aa, Mycobacterium
DVNPV

SEQ ID NO: 459921 - protein, 4 aa, Mycobacterium
DVNR

SEQ ID NO: 459922 - protein, 5 aa, Mycobacterium
DVNRS

SEQ ID NO: 459923 - protein, 5 aa, Mycobacterium
DVNSG

SEQ ID NO: 459924 - protein, 59 aa, Mycobacterium
DVNSGTQVDGDYGSGNVEDNSTNTSVQTDIATSTESSIEDNSSTYESNIGSGNETSTEL

SEQ ID NO: 459925 - protein, 18 aa, Mycobacterium
DVNSNPARFDQKKADAIN

SEQ ID NO: 459926 - protein, 4 aa, Mycobacterium
DVNT

SEQ ID NO: 459927 - protein, 14 aa, Mycobacterium
DVNTGAANRGDYNT

SEQ ID NO: 459928 - protein, 25 aa, Mycobacterium
DVNTGVGATTDSGLATSGFGNTGEV

SEQ ID NO: 459929 - protein, 6 aa, Mycobacterium
DVNTIG

SEQ ID NO: 459930 - protein, 15 aa, Mycobacterium
DVNTSIGSTTDSGLV

SEQ ID NO: 459931 - protein, 4 aa, Mycobacterium
DVPA

SEQ ID NO: 459932 - protein, 5 aa, Mycobacterium
DVPAA

SEQ ID NO: 459933 - protein, 9 aa, Mycobacterium
DVPAADVTH

SEQ ID NO: 459934 - protein, 6 aa, Mycobacterium
DVPAAH

SEQ ID NO: 459935 - protein, 9 aa, Mycobacterium
DVPAAQAAD

SEQ ID NO: 459936 - protein, 9 aa, Mycobacterium
DVPAARAAE

SEQ ID NO: 459937 - protein, 9 aa, Mycobacterium
DVPADDEIR

SEQ ID NO: 459938 - protein, 7 aa, Mycobacterium
DVPADQD

SEQ ID NO: 459939 - protein, 6 aa, Mycobacterium
DVPAED

SEQ ID NO: 459940 - protein, 5 aa, Mycobacterium
DVPAG

SEQ ID NO: 459941 - protein, 15 aa, Mycobacterium
DVPAGAAAVAGSPEH

SEQ ID NO: 459942 - protein, 6 aa, Mycobacterium
DVPAGD

SEQ ID NO: 459943 - protein, 10 aa, Mycobacterium
DVPAGDTGVG

SEQ ID NO: 459944 - protein, 12 aa, Mycobacterium
DVPAGGAVDPVG

SEQ ID NO: 459945 - protein, 6 aa, Mycobacterium
DVPAGT

SEQ ID NO: 459946 - protein, 9 aa, Mycobacterium
DVPAGTPTA

SEQ ID NO: 459947 - protein, 5 aa, Mycobacterium
DVPAN

SEQ ID NO: 459948 - protein, 69 aa, Mycobacterium
DVPAPADLPPAPEDLPPAPEDLAPPAPADLPPAPEDLPPAPQDLPPAPEDVAAPAPADLPPAPEDVAPP

SEQ ID NO: 459949 - protein, 11 aa, Mycobacterium
DVPAPEDLPSV

SEQ ID NO: 459950 - protein, 12 aa, Mycobacterium
DVPAPTPAARPA

SEQ ID NO: 459951 - protein, 11 aa, Mycobacterium
DVPARGSPEHC

SEQ ID NO: 459952 - protein, 9 aa, Mycobacterium
DVPASRAAE

SEQ ID NO: 459953 - protein, 19 aa, Mycobacterium
DVPATPPGACAHPHTKAAH

SEQ ID NO: 459954 - protein, 4 aa, Mycobacterium
DVPD

SEQ ID NO: 459955 - protein, 7 aa, Mycobacterium
DVPDDEI

SEQ ID NO: 459956 - protein, 6 aa, Mycobacterium
DVPDDI

SEQ ID NO: 459957 - protein, 9 aa, Mycobacterium
DVPDDPLDG

SEQ ID NO: 459958 - protein, 6 aa, Mycobacterium
DVPDDV

SEQ ID NO: 459959 - protein, 7 aa, Mycobacterium
DVPDEAR

SEQ ID NO: 459960 - protein, 8 aa, Mycobacterium
DVPDESDM

SEQ ID NO: 459961 - protein, 6 aa, Mycobacterium
DVPDGE

SEQ ID NO: 459962 - protein, 25 aa, Mycobacterium
DVPDGPGGSAGSGVSPALGGPGRVE

SEQ ID NO: 459963 - protein, 19 aa, Mycobacterium
DVPDGPGGSAGSTVAPALG

SEQ ID NO: 459964 - protein, 6 aa, Mycobacterium
DVPDND

SEQ ID NO: 459965 - protein, 5 aa, Mycobacterium
DVPDP

SEQ ID NO: 459966 - protein, 8 aa, Mycobacterium
DVPDQSGR

SEQ ID NO: 459967 - protein, 28 aa, Mycobacterium
DVPDVAAPGGNSEPGSATTPGSARPEQQ

SEQ ID NO: 459968 - protein, 6 aa, Mycobacterium
DVPEDV

SEQ ID NO: 459969 - protein, 5 aa, Mycobacterium
DVPEE

SEQ ID NO: 459970 - protein, 11 aa, Mycobacterium
DVPEGATPVAQ

SEQ ID NO: 459971 - protein, 6 aa, Mycobacterium
DVPEGG

SEQ ID NO: 459972 - protein, 7 aa, Mycobacterium
DVPEGRA

SEQ ID NO: 459973 - protein, 7 aa, Mycobacterium
DVPENEH

SEQ ID NO: 459974 - protein, 8 aa, Mycobacterium
DVPENEHD

SEQ ID NO: 459975 - protein, 13 aa, Mycobacterium
DVPEPAEGDSVER

SEQ ID NO: 459976 - protein, 11 aa, Mycobacterium
DVPEPDCAPDE

SEQ ID NO: 459977 - protein, 9 aa, Mycobacterium
DVPEPGSGQ

SEQ ID NO: 459978 - protein, 6 aa, Mycobacterium
DVPESL

SEQ ID NO: 459979 - protein, 12 aa, Mycobacterium
DVPGDALAPELG

SEQ ID NO: 459980 - protein, 7 aa, Mycobacterium
DVPGDVR

SEQ ID NO: 459981 - protein, 6 aa, Mycobacterium
DVPGEC

SEQ ID NO: 459982 - protein, 17 aa, Mycobacterium
DVPGETGAAGAEPDNPV

SEQ ID NO: 459983 - protein, 14 aa, Mycobacterium
DVPGGAIQETSTPE

SEQ ID NO: 459984 - protein, 7 aa, Mycobacterium
DVPGGPF

SEQ ID NO: 459985 - protein, 12 aa, Mycobacterium
DVPGGSAQNSEW

SEQ ID NO: 459986 - protein, 7 aa, Mycobacterium
DVPGGVT

SEQ ID NO: 459987 - protein, 15 aa, Mycobacterium
DVPGKPSATHPNTGA

SEQ ID NO: 459988 - protein, 12 aa, Mycobacterium
DVPGPNGEDRLV

SEQ ID NO: 459989 - protein, 5 aa, Mycobacterium
DVPGQ

SEQ ID NO: 459990 - protein, 8 aa, Mycobacterium
DVPGRPGL

SEQ ID NO: 459991 - protein, 11 aa, Mycobacterium
DVPGRYSTATN

SEQ ID NO: 459992 - protein, 6 aa, Mycobacterium
DVPGSD

SEQ ID NO: 459993 - protein, 8 aa, Mycobacterium
DVPGSPVP

SEQ ID NO: 459994 - protein, 6 aa, Mycobacterium
DVPGSS

SEQ ID NO: 459995 - protein, 8 aa, Mycobacterium
DVPGTGDV

SEQ ID NO: 459996 - protein, 17 aa, Mycobacterium
DVPHGGAGNMRTGPDVV

SEQ ID NO: 459997 - protein, 9 aa, Mycobacterium
DVPHPPDRW

SEQ ID NO: 459998 - protein, 5 aa, Mycobacterium
DVPHS

SEQ ID NO: 459999 - protein, 12 aa, Mycobacterium
DVPKADARSTVD

SEQ ID NO: 460000 - protein, 5 aa, Mycobacterium
DVPKP

SEQ ID NO: 460001 - protein, 8 aa, Mycobacterium
DVPKPIAP

SEQ ID NO: 460002 - protein, 8 aa, Mycobacterium
DVPKTRPA

SEQ ID NO: 460003 - protein, 5 aa, Mycobacterium
DVPMP

SEQ ID NO: 460004 - protein, 8 aa, Mycobacterium
DVPNDTQV

SEQ ID NO: 460005 - protein, 8 aa, Mycobacterium
DVPNESQV

SEQ ID NO: 460006 - protein, 8 aa, Mycobacterium
DVPNETQV

SEQ ID NO: 460007 - protein, 7 aa, Mycobacterium
DVPNEVR

SEQ ID NO: 460008 - protein, 9 aa, Mycobacterium
DVPPDAPIS

SEQ ID NO: 460009 - protein, 6 aa, Mycobacterium
DVPPEL

SEQ ID NO: 460010 - protein, 7 aa, Mycobacterium
DVPPGPV

SEQ ID NO: 460011 - protein, 7 aa, Mycobacterium
DVPPGTL

SEQ ID NO: 460012 - protein, 9 aa, Mycobacterium
DVPPIPPHA

SEQ ID NO: 460013 - protein, 7 aa, Mycobacterium
DVPPNSG

SEQ ID NO: 460014 - protein, 7 aa, Mycobacterium
DVPPPGE

SEQ ID NO: 460015 - protein, 9 aa, Mycobacterium
DVPPREPFP

SEQ ID NO: 460016 - protein, 13 aa, Mycobacterium
DVPPSVSAGGPLA

SEQ ID NO: 460017 - protein, 5 aa, Mycobacterium
DVPPT

SEQ ID NO: 460018 - protein, 9 aa, Mycobacterium
DVPPTPTQL

SEQ ID NO: 460019 - protein, 5 aa, Mycobacterium
DVPQG

SEQ ID NO: 460020 - protein, 5 aa, Mycobacterium
DVPQS

SEQ ID NO: 460021 - protein, 4 aa, Mycobacterium
DVPR

SEQ ID NO: 460022 - protein, 5 aa, Mycobacterium
DVPRN

SEQ ID NO: 460023 - protein, 8 aa, Mycobacterium
DVPRPGPS

SEQ ID NO: 460024 - protein, 12 aa, Mycobacterium
DVPRPNEAPAAS

SEQ ID NO: 460025 - protein, 6 aa, Mycobacterium
DVPRSA

SEQ ID NO: 460026 - protein, 15 aa, Mycobacterium
DVPRTDEANGSETAH

SEQ ID NO: 460027 - protein, 6 aa, Mycobacterium
DVPRTV

SEQ ID NO: 460028 - protein, 6 aa, Mycobacterium
DVPSAA

SEQ ID NO: 460029 - protein, 10 aa, Mycobacterium
DVPSNGGDPV

SEQ ID NO: 460030 - protein, 16 aa, Mycobacterium
DVPSPESVSATDTVGH

SEQ ID NO: 460031 - protein, 11 aa, Mycobacterium
DVPSPTPGEGQ

SEQ ID NO: 460032 - protein, 9 aa, Mycobacterium
DVPSRPSAV

SEQ ID NO: 460033 - protein, 8 aa, Mycobacterium
DVPSTGVG

SEQ ID NO: 460034 - protein, 4 aa, Mycobacterium
DVPT

SEQ ID NO: 460035 - protein, 7 aa, Mycobacterium
DVPTATS

SEQ ID NO: 460036 - protein, 10 aa, Mycobacterium
DVPTATSVRA

SEQ ID NO: 460037 - protein, 10 aa, Mycobacterium
DVPTEPVTGE

SEQ ID NO: 460038 - protein, 9 aa, Mycobacterium
DVPTEQSRR

SEQ ID NO: 460039 - protein, 8 aa, Mycobacterium
DVPTGQPA

SEQ ID NO: 460040 - protein, 9 aa, Mycobacterium
DVPTTPTEG

SEQ ID NO: 460041 - protein, 9 aa, Mycobacterium
DVPTTVRGA

SEQ ID NO: 460042 - protein, 14 aa, Mycobacterium
DVPVTGEDVPVTGE

SEQ ID NO: 460043 - protein, 13 aa, Mycobacterium
DVPWTTDADGGSA

SEQ ID NO: 460044 - protein, 15 aa, Mycobacterium
DVPWTTDAEGGPALT

SEQ ID NO: 460045 - protein, 7 aa, Mycobacterium
DVQASNV

SEQ ID NO: 460046 - protein, 7 aa, Mycobacterium
DVQGGGS

SEQ ID NO: 460047 - protein, 4 aa, Mycobacterium
DVQN

SEQ ID NO: 460048 - protein, 4 aa, Mycobacterium
DVQP

SEQ ID NO: 460049 - protein, 7 aa, Mycobacterium
DVQRDAE

SEQ ID NO: 460050 - protein, 7 aa, Mycobacterium
DVQRSAA

SEQ ID NO: 460051 - protein, 6 aa, Mycobacterium
DVQTGK

SEQ ID NO: 460052 - protein, 13 aa, Mycobacterium
DVRADAGAAVDPS

SEQ ID NO: 460053 - protein, 10 aa, Mycobacterium
DVRAESAKRV

SEQ ID NO: 460054 - protein, 11 aa, Mycobacterium
DVRAGADGALD

SEQ ID NO: 460055 - protein, 10 aa, Mycobacterium
DVRAGESASL

SEQ ID NO: 460056 - protein, 8 aa, Mycobacterium
DVRAGGGA

SEQ ID NO: 460057 - protein, 6 aa, Mycobacterium
DVRAKA

SEQ ID NO: 460058 - protein, 7 aa, Mycobacterium
DVRAKEQ

SEQ ID NO: 460059 - protein, 6 aa, Mycobacterium
DVRAQQ

SEQ ID NO: 460060 - protein, 8 aa, Mycobacterium
DVRAQQGS

SEQ ID NO: 460061 - protein, 8 aa, Mycobacterium
DVRDEPEL

SEQ ID NO: 460062 - protein, 7 aa, Mycobacterium
DVRDGDV

SEQ ID NO: 460063 - protein, 8 aa, Mycobacterium
DVRDPDAV

SEQ ID NO: 460064 - protein, 7 aa, Mycobacterium
DVRDRAS

SEQ ID NO: 460065 - protein, 7 aa, Mycobacterium
DVRDRKT

SEQ ID NO: 460066 - protein, 4 aa, Mycobacterium
DVRE

SEQ ID NO: 460067 - protein, 11 aa, Mycobacterium
DVRGDKPPVGP

SEQ ID NO: 460068 - protein, 11 aa, Mycobacterium
DVRGGAGLKTP

SEQ ID NO: 460069 - protein, 13 aa, Mycobacterium
DVRGGAPGTRESD

SEQ ID NO: 460070 - protein, 7 aa, Mycobacterium
DVRGKKL

SEQ ID NO: 460071 - protein, 5 aa, Mycobacterium
DVRGT

SEQ ID NO: 460072 - protein, 6 aa, Mycobacterium
DVRKDR

SEQ ID NO: 460073 - protein, 9 aa, Mycobacterium
DVRKPGSDR

SEQ ID NO: 460074 - protein, 9 aa, Mycobacterium
DVRKPGTDR

SEQ ID NO: 460075 - protein, 7 aa, Mycobacterium
DVRNEAE

SEQ ID NO: 460076 - protein, 12 aa, Mycobacterium
DVRNRGKADLPL

SEQ ID NO: 460077 - protein, 4 aa, Mycobacterium
DVRP

SEQ ID NO: 460078 - protein, 7 aa, Mycobacterium
DVRPDGQ

SEQ ID NO: 460079 - protein, 15 aa, Mycobacterium
DVRPEDEQVTRDGVA

SEQ ID NO: 460080 - protein, 6 aa, Mycobacterium
DVRPGD

SEQ ID NO: 460081 - protein, 14 aa, Mycobacterium
DVRPGTLSGGQQQR

SEQ ID NO: 460082 - protein, 13 aa, Mycobacterium
DVRQTARDVPQAT

SEQ ID NO: 460083 - protein, 12 aa, Mycobacterium
DVRRGQDALSAA

SEQ ID NO: 460084 - protein, 9 aa, Mycobacterium
DVRRGSTHA

SEQ ID NO: 460085 - protein, 5 aa, Mycobacterium
DVRRR

SEQ ID NO: 460086 - protein, 6 aa, Mycobacterium
DVRRTG

SEQ ID NO: 460087 - protein, 24 aa, Mycobacterium
DVRSASPSRSLDESYASGYATSKW

SEQ ID NO: 460088 - protein, 6 aa, Mycobacterium
DVRSEA

SEQ ID NO: 460089 - protein, 10 aa, Mycobacterium
DVRSGQRPQA

SEQ ID NO: 460090 - protein, 10 aa, Mycobacterium
DVRSPNGARE

SEQ ID NO: 460091 - protein, 5 aa, Mycobacterium
DVRSR

SEQ ID NO: 460092 - protein, 13 aa, Mycobacterium
DVRSRTSRPPAEA

SEQ ID NO: 460093 - protein, 10 aa, Mycobacterium
DVRSTSAKRV

SEQ ID NO: 460094 - protein, 9 aa, Mycobacterium
DVRTPGSDR

SEQ ID NO: 460095 - protein, 13 aa, Mycobacterium
DVRTPTRASASPT

SEQ ID NO: 460096 - protein, 8 aa, Mycobacterium
DVRTRDDA

SEQ ID NO: 460097 - protein, 4 aa, Mycobacterium
DVSA

SEQ ID NO: 460098 - protein, 7 aa, Mycobacterium
DVSADIA

SEQ ID NO: 460099 - protein, 9 aa, Mycobacterium
DVSAEEAER

SEQ ID NO: 460100 - protein, 14 aa, Mycobacterium
DVSAEIRGGDVTRA

SEQ ID NO: 460101 - protein, 14 aa, Mycobacterium
DVSAGGSTDRTPGF

SEQ ID NO: 460102 - protein, 8 aa, Mycobacterium
DVSAGPGE

SEQ ID NO: 460103 - protein, 9 aa, Mycobacterium
DVSAKAATP

SEQ ID NO: 460104 - protein, 20 aa, Mycobacterium
DVSARDHQRADGQWTRAKGH

SEQ ID NO: 460105 - protein, 17 aa, Mycobacterium
DVSARDQQKSDGQWTRA

SEQ ID NO: 460106 - protein, 19 aa, Mycobacterium
DVSARDQQQSDGQWTRAKG

SEQ ID NO: 460107 - protein, 7 aa, Mycobacterium
DVSARDV

SEQ ID NO: 460108 - protein, 5 aa, Mycobacterium
DVSDA

SEQ ID NO: 460109 - protein, 8 aa, Mycobacterium
DVSDATVG

SEQ ID NO: 460110 - protein, 8 aa, Mycobacterium
DVSDGGGN

SEQ ID NO: 460111 - protein, 12 aa, Mycobacterium
DVSDGKPNPESY

SEQ ID NO: 460112 - protein, 8 aa, Mycobacterium
DVSDPDDP

SEQ ID NO: 460113 - protein, 8 aa, Mycobacterium
DVSDPEQV

SEQ ID NO: 460114 - protein, 8 aa, Mycobacterium
DVSDPRDV

SEQ ID NO: 460115 - protein, 7 aa, Mycobacterium
DVSEEAS

SEQ ID NO: 460116 - protein, 5 aa, Mycobacterium
DVSEG

SEQ ID NO: 460117 - protein, 6 aa, Mycobacterium
DVSELD

SEQ ID NO: 460118 - protein, 5 aa, Mycobacterium
DVSEP

SEQ ID NO: 460119 - protein, 5 aa, Mycobacterium
DVSGA

SEQ ID NO: 460120 - protein, 13 aa, Mycobacterium
DVSGALAPGEGDI

SEQ ID NO: 460121 - protein, 10 aa, Mycobacterium
DVSGDESPVG

SEQ ID NO: 460122 - protein, 8 aa, Mycobacterium
DVSGESLG

SEQ ID NO: 460123 - protein, 9 aa, Mycobacterium
DVSGGASGI

SEQ ID NO: 460124 - protein, 10 aa, Mycobacterium
DVSGGGRGQK

SEQ ID NO: 460125 - protein, 6 aa, Mycobacterium
DVSGGR

SEQ ID NO: 460126 - protein, 10 aa, Mycobacterium
DVSGGRADPD

SEQ ID NO: 460127 - protein, 20 aa, Mycobacterium
DVSGGTAGGGGTGGDGGRGG

SEQ ID NO: 460128 - protein, 18 aa, Mycobacterium
DVSGPAPAAPLASAPLEA

SEQ ID NO: 460129 - protein, 8 aa, Mycobacterium
DVSGPEED

SEQ ID NO: 460130 - protein, 9 aa, Mycobacterium
DVSGPPAAV

SEQ ID NO: 460131 - protein, 5 aa, Mycobacterium
DVSGR

SEQ ID NO: 460132 - protein, 6 aa, Mycobacterium
DVSGRP

SEQ ID NO: 460133 - protein, 8 aa, Mycobacterium
DVSGRSDC

SEQ ID NO: 460134 - protein, 12 aa, Mycobacterium
DVSKTPPNKRNV

SEQ ID NO: 460135 - protein, 7 aa, Mycobacterium
DVSNDAQ

SEQ ID NO: 460136 - protein, 6 aa, Mycobacterium
DVSPDE

SEQ ID NO: 460137 - protein, 5 aa, Mycobacterium
DVSPG

SEQ ID NO: 460138 - protein, 9 aa, Mycobacterium
DVSPGAPRD

SEQ ID NO: 460139 - protein, 6 aa, Mycobacterium
DVSPGD

SEQ ID NO: 460140 - protein, 7 aa, Mycobacterium
DVSPSSS

SEQ ID NO: 460141 - protein, 6 aa, Mycobacterium
DVSPTV

SEQ ID NO: 460142 - protein, 5 aa, Mycobacterium
DVSPV

SEQ ID NO: 460143 - protein, 16 aa, Mycobacterium
DVSQAYKPDPRAYQTP

SEQ ID NO: 460144 - protein, 6 aa, Mycobacterium
DVSRGE

SEQ ID NO: 460145 - protein, 27 aa, Mycobacterium
DVSRPDWDADADLGQDSQGRPNNERTA

SEQ ID NO: 460146 - protein, 5 aa, Mycobacterium
DVSRQ

SEQ ID NO: 460147 - protein, 4 aa, Mycobacterium
DVSS

SEQ ID NO: 460148 - protein, 19 aa, Mycobacterium
DVSSDERDRRLDAWAKENV

SEQ ID NO: 460149 - protein, 14 aa, Mycobacterium
DVSSEIRGDAVTGA

SEQ ID NO: 460150 - protein, 8 aa, Mycobacterium
DVSSNRVP

SEQ ID NO: 460151 - protein, 11 aa, Mycobacterium
DVSSVPANKRD

SEQ ID NO: 460152 - protein, 4 aa, Mycobacterium
DVST

SEQ ID NO: 460153 - protein, 14 aa, Mycobacterium
DVSTEIRGDAVTGA

SEQ ID NO: 460154 - protein, 7 aa, Mycobacterium
DVSTGDA

SEQ ID NO: 460155 - protein, 9 aa, Mycobacterium
DVSTPESAL

SEQ ID NO: 460156 - protein, 8 aa, Mycobacterium
DVSTRVAG

SEQ ID NO: 460157 - protein, 4 aa, Mycobacterium
DVSV

SEQ ID NO: 460158 - protein, 18 aa, Mycobacterium
DVSYDGQGCSISQAATSV

SEQ ID NO: 460159 - protein, 4 aa, Mycobacterium
DVTA

SEQ ID NO: 460160 - protein, 32 aa, Mycobacterium
DVTAADVAKARETVRPSLDPAQVESLREFAEK

SEQ ID NO: 460161 - protein, 5 aa, Mycobacterium
DVTAD

SEQ ID NO: 460162 - protein, 8 aa, Mycobacterium
DVTAEEAE

SEQ ID NO: 460163 - protein, 9 aa, Mycobacterium
DVTAEEAER

SEQ ID NO: 460164 - protein, 18 aa, Mycobacterium
DVTAEERRRIAEAGFYSY

SEQ ID NO: 460165 - protein, 18 aa, Mycobacterium
DVTAEQRRRIAEAGFYSY

SEQ ID NO: 460166 - protein, 13 aa, Mycobacterium
DVTAGKPAPEPYL

SEQ ID NO: 460167 - protein, 14 aa, Mycobacterium
DVTAGRGSHLGTGG

SEQ ID NO: 460168 - protein, 5 aa, Mycobacterium
DVTAN

SEQ ID NO: 460169 - protein, 5 aa, Mycobacterium
DVTAR

SEQ ID NO: 460170 - protein, 5 aa, Mycobacterium
DVTAS

SEQ ID NO: 460171 - protein, 4 aa, Mycobacterium
DVTD

SEQ ID NO: 460172 - protein, 7 aa, Mycobacterium
DVTDEDA

SEQ ID NO: 460173 - protein, 10 aa, Mycobacterium
DVTDKNPDEL

SEQ ID NO: 460174 - protein, 5 aa, Mycobacterium
DVTDP

SEQ ID NO: 460175 - protein, 15 aa, Mycobacterium
DVTDPEDARRTVAET

SEQ ID NO: 460176 - protein, 8 aa, Mycobacterium
DVTDPEQC

SEQ ID NO: 460177 - protein, 12 aa, Mycobacterium
DVTDPSRAHAQP

SEQ ID NO: 460178 - protein, 7 aa, Mycobacterium
DVTDRAA

SEQ ID NO: 460179 - protein, 8 aa, Mycobacterium
DVTDRPAL

SEQ ID NO: 460180 - protein, 8 aa, Mycobacterium
DVTDRSAV

SEQ ID NO: 460181 - protein, 12 aa, Mycobacterium
DVTDSAAAGQPL

SEQ ID NO: 460182 - protein, 15 aa, Mycobacterium
DVTDSLAPPLPPVPD

SEQ ID NO: 460183 - protein, 11 aa, Mycobacterium
DVTDTASVDEI

SEQ ID NO: 460184 - protein, 11 aa, Mycobacterium
DVTDVEDTHPA

SEQ ID NO: 460185 - protein, 15 aa, Mycobacterium
DVTEGTFSPYSPYNT

SEQ ID NO: 460186 - protein, 12 aa, Mycobacterium
DVTGGAAASGGF

SEQ ID NO: 460187 - protein, 7 aa, Mycobacterium
DVTGGSQ

SEQ ID NO: 460188 - protein, 5 aa, Mycobacterium
DVTGP

SEQ ID NO: 460189 - protein, 8 aa, Mycobacterium
DVTGPGRQ

SEQ ID NO: 460190 - protein, 8 aa, Mycobacterium
DVTGRPQL

SEQ ID NO: 460191 - protein, 7 aa, Mycobacterium
DVTGSGL

SEQ ID NO: 460192 - protein, 7 aa, Mycobacterium
DVTGSLD

SEQ ID NO: 460193 - protein, 13 aa, Mycobacterium
DVTGTSKGKGFAG

SEQ ID NO: 460194 - protein, 11 aa, Mycobacterium
DVTGTSRPQVR

SEQ ID NO: 460195 - protein, 7 aa, Mycobacterium
DVTGTVR

SEQ ID NO: 460196 - protein, 9 aa, Mycobacterium
DVTHRDPDE

SEQ ID NO: 460197 - protein, 4 aa, Mycobacterium
DVTN

SEQ ID NO: 460198 - protein, 5 aa, Mycobacterium
DVTNE

SEQ ID NO: 460199 - protein, 15 aa, Mycobacterium
DVTNQPQGNGQAVGN

SEQ ID NO: 460200 - protein, 11 aa, Mycobacterium
DVTPAGADPRD

SEQ ID NO: 460201 - protein, 6 aa, Mycobacterium
DVTPAW

SEQ ID NO: 460202 - protein, 18 aa, Mycobacterium
DVTPEERRRIAETGFYAY

SEQ ID NO: 460203 - protein, 6 aa, Mycobacterium
DVTPEM

SEQ ID NO: 460204 - protein, 12 aa, Mycobacterium
DVTPEQAGAHPT

SEQ ID NO: 460205 - protein, 5 aa, Mycobacterium
DVTPG

SEQ ID NO: 460206 - protein, 12 aa, Mycobacterium
DVTPGQAGAHPT

SEQ ID NO: 460207 - protein, 8 aa, Mycobacterium
DVTPGSLA

SEQ ID NO: 460208 - protein, 8 aa, Mycobacterium
DVTPGTLA

SEQ ID NO: 460209 - protein, 7 aa, Mycobacterium
DVTPSEA

SEQ ID NO: 460210 - protein, 11 aa, Mycobacterium
DVTPSGSADFT

SEQ ID NO: 460211 - protein, 8 aa, Mycobacterium
DVTPSQAI

SEQ ID NO: 460212 - protein, 5 aa, Mycobacterium
DVTPT

SEQ ID NO: 460213 - protein, 6 aa, Mycobacterium
DVTPTF

SEQ ID NO: 460214 - protein, 14 aa, Mycobacterium
DVTPYPAGGPIPPK

SEQ ID NO: 460215 - protein, 4 aa, Mycobacterium
DVTR

SEQ ID NO: 460216 - protein, 25 aa, Mycobacterium
DVTRDPMQVPNDASASQVAAAAKKH

SEQ ID NO: 460217 - protein, 5 aa, Mycobacterium
DVTRQ

SEQ ID NO: 460218 - protein, 11 aa, Mycobacterium
DVTRQPPQSLG

SEQ ID NO: 460219 - protein, 9 aa, Mycobacterium
DVTRRNPDE

SEQ ID NO: 460220 - protein, 10 aa, Mycobacterium
DVTSAADAVS

SEQ ID NO: 460221 - protein, 6 aa, Mycobacterium
DVTSAE

SEQ ID NO: 460222 - protein, 12 aa, Mycobacterium
DVTSAISNNHGV

SEQ ID NO: 460223 - protein, 6 aa, Mycobacterium
DVTSEH

SEQ ID NO: 460224 - protein, 6 aa, Mycobacterium
DVTSGA

SEQ ID NO: 460225 - protein, 7 aa, Mycobacterium
DVTSGDD

SEQ ID NO: 460226 - protein, 7 aa, Mycobacterium
DVTSGLD

SEQ ID NO: 460227 - protein, 6 aa, Mycobacterium
DVTSPD

SEQ ID NO: 460228 - protein, 8 aa, Mycobacterium
DVTSPEDC

SEQ ID NO: 460229 - protein, 8 aa, Mycobacterium
DVTSQQSV

SEQ ID NO: 460230 - protein, 8 aa, Mycobacterium
DVTSSYGR

SEQ ID NO: 460231 - protein, 11 aa, Mycobacterium
DVTTADDADAA

SEQ ID NO: 460232 - protein, 6 aa, Mycobacterium
DVTTEQ

SEQ ID NO: 460233 - protein, 6 aa, Mycobacterium
DVTTGT

SEQ ID NO: 460234 - protein, 6 aa, Mycobacterium
DVTTSP

SEQ ID NO: 460235 - protein, 18 aa, Mycobacterium
DVTVEDPDSVRRIAWAQV

SEQ ID NO: 460236 - protein, 19 aa, Mycobacterium
DVVDPDGDWTGPIRIRPTA

SEQ ID NO: 460237 - protein, 8 aa, Mycobacterium
DVVDPRTG

SEQ ID NO: 460238 - protein, 13 aa, Mycobacterium
DVVDTKDIDSAED

SEQ ID NO: 460239 - protein, 17 aa, Mycobacterium
DVVESGANADIKPGNNL

SEQ ID NO: 460240 - protein, 4 aa, Mycobacterium
DVVP

SEQ ID NO: 460241 - protein, 7 aa, Mycobacterium
DVVPARA

SEQ ID NO: 460242 - protein, 10 aa, Mycobacterium
DVVTSAQSAA

SEQ ID NO: 460243 - protein, 8 aa, Mycobacterium
DVVTTGTD

SEQ ID NO: 460244 - protein, 5 aa, Mycobacterium
DVYAD

SEQ ID NO: 460245 - protein, 9 aa, Mycobacterium
DWAEPDPRL

SEQ ID NO: 460246 - protein, 5 aa, Mycobacterium
DWAGP

SEQ ID NO: 460247 - protein, 8 aa, Mycobacterium
DWAGPGSR

SEQ ID NO: 460248 - protein, 8 aa, Mycobacterium
DWAGPSSR

SEQ ID NO: 460249 - protein, 12 aa, Mycobacterium
DWAPAGRPRRAG

SEQ ID NO: 460250 - protein, 10 aa, Mycobacterium
DWAPEDKARL

SEQ ID NO: 460251 - protein, 27 aa, Mycobacterium
DWAPETDFHESDSPADVEAADPADYPD

SEQ ID NO: 460252 - protein, 8 aa, Mycobacterium
DWARRNPQ

SEQ ID NO: 460253 - protein, 5 aa, Mycobacterium
DWDKH

SEQ ID NO: 460254 - protein, 12 aa, Mycobacterium
DWDPSDATLPRE

SEQ ID NO: 460255 - protein, 9 aa, Mycobacterium
DWDPSQATL

SEQ ID NO: 460256 - protein, 8 aa, Mycobacterium
DWDPSQTT

SEQ ID NO: 460257 - protein, 7 aa, Mycobacterium
DWDPSQV

SEQ ID NO: 460258 - protein, 7 aa, Mycobacterium
DWDPSSM

SEQ ID NO: 460259 - protein, 5 aa, Mycobacterium
DWDRT

SEQ ID NO: 460260 - protein, 8 aa, Mycobacterium
DWDSGTDS

SEQ ID NO: 460261 - protein, 7 aa, Mycobacterium
DWDTPDD

SEQ ID NO: 460262 - protein, 7 aa, Mycobacterium
DWDYEGK

SEQ ID NO: 460263 - protein, 4 aa, Mycobacterium
DWEA

SEQ ID NO: 460264 - protein, 4 aa, Mycobacterium
DWED

SEQ ID NO: 460265 - protein, 12 aa, Mycobacterium
DWEEDTDEADRI

SEQ ID NO: 460266 - protein, 4 aa, Mycobacterium
DWEG

SEQ ID NO: 460267 - protein, 9 aa, Mycobacterium
DWEGAPTRL

SEQ ID NO: 460268 - protein, 9 aa, Mycobacterium
DWEGASTRL

SEQ ID NO: 460269 - protein, 12 aa, Mycobacterium
DWEGRAEAEAEL

SEQ ID NO: 460270 - protein, 8 aa, Mycobacterium
DWEGSGEF

SEQ ID NO: 460271 - protein, 5 aa, Mycobacterium
DWEPE

SEQ ID NO: 460272 - protein, 9 aa, Mycobacterium
DWGAAEAAN

SEQ ID NO: 460273 - protein, 25 aa, Mycobacterium
DWGAPPGEGPGASTVASDHGAGPVG

SEQ ID NO: 460274 - protein, 9 aa, Mycobacterium
DWGQADEDA

SEQ ID NO: 460275 - protein, 15 aa, Mycobacterium
DWGRSDPLKTAKTAQ

SEQ ID NO: 460276 - protein, 14 aa, Mycobacterium
DWGSGQDYANIATP

SEQ ID NO: 460277 - protein, 14 aa, Mycobacterium
DWGSGQDYANVPTP

SEQ ID NO: 460278 - protein, 20 aa, Mycobacterium
DWGSGSALGDDTYERVTSSS

SEQ ID NO: 460279 - protein, 9 aa, Mycobacterium
DWGSPKIPE

SEQ ID NO: 460280 - protein, 10 aa, Mycobacterium
DWHPEESKLS

SEQ ID NO: 460281 - protein, 12 aa, Mycobacterium
DWKPEDSPLDPV

SEQ ID NO: 460282 - protein, 19 aa, Mycobacterium
DWPAPPAGPWWAPADDPHL

SEQ ID NO: 460283 - protein, 8 aa, Mycobacterium
DWPASPLP

SEQ ID NO: 460284 - protein, 9 aa, Mycobacterium
DWPATAHGP

SEQ ID NO: 460285 - protein, 14 aa, Mycobacterium
DWPDPAETLPPPEV

SEQ ID NO: 460286 - protein, 9 aa, Mycobacterium
DWPDPEAGR

SEQ ID NO: 460287 - protein, 5 aa, Mycobacterium
DWPEE

SEQ ID NO: 460288 - protein, 10 aa, Mycobacterium
DWPGSRHRGP

SEQ ID NO: 460289 - protein, 4 aa, Mycobacterium
DWPP

SEQ ID NO: 460290 - protein, 6 aa, Mycobacterium
DWPPER

SEQ ID NO: 460291 - protein, 6 aa, Mycobacterium
DWPPKR

SEQ ID NO: 460292 - protein, 9 aa, Mycobacterium
DWPRPGKAT

SEQ ID NO: 460293 - protein, 5 aa, Mycobacterium
DWPTA

SEQ ID NO: 460294 - protein, 7 aa, Mycobacterium
DWPTGSR

SEQ ID NO: 460295 - protein, 5 aa, Mycobacterium
DWPTP

SEQ ID NO: 460296 - protein, 6 aa, Mycobacterium
DWPTRD

SEQ ID NO: 460297 - protein, 20 aa, Mycobacterium
DWPTRSGSSASYTGPSTRLA

SEQ ID NO: 460298 - protein, 7 aa, Mycobacterium
DWQEGSR

SEQ ID NO: 460299 - protein, 8 aa, Mycobacterium
DWQGAPTR

SEQ ID NO: 460300 - protein, 9 aa, Mycobacterium
DWQGAPTRL

SEQ ID NO: 460301 - protein, 8 aa, Mycobacterium
DWQGASAR

SEQ ID NO: 460302 - protein, 11 aa, Mycobacterium
DWQGNAQPQDY

SEQ ID NO: 460303 - protein, 7 aa, Mycobacterium
DWQGPSA

SEQ ID NO: 460304 - protein, 8 aa, Mycobacterium
DWQNRARA

SEQ ID NO: 460305 - protein, 6 aa, Mycobacterium
DWQTDA

SEQ ID NO: 460306 - protein, 7 aa, Mycobacterium
DWQTDAP

SEQ ID NO: 460307 - protein, 8 aa, Mycobacterium
DWQTSESG

SEQ ID NO: 460308 - protein, 5 aa, Mycobacterium
DWQTV

SEQ ID NO: 460309 - protein, 4 aa, Mycobacterium
DWRA

SEQ ID NO: 460310 - protein, 14 aa, Mycobacterium
DWRGSASDTAQTHA

SEQ ID NO: 460311 - protein, 5 aa, Mycobacterium
DWSAG

SEQ ID NO: 460312 - protein, 16 aa, Mycobacterium
DWSERSAGTNAPGTAL

SEQ ID NO: 460313 - protein, 11 aa, Mycobacterium
DWSGSRPEEVE

SEQ ID NO: 460314 - protein, 4 aa, Mycobacterium
DWSN

SEQ ID NO: 460315 - protein, 6 aa, Mycobacterium
DWSSAR

SEQ ID NO: 460316 - protein, 7 aa, Mycobacterium
DWSSEDL

SEQ ID NO: 460317 - protein, 6 aa, Mycobacterium
DWSSSS

SEQ ID NO: 460318 - protein, 7 aa, Mycobacterium
DWSTAEN

SEQ ID NO: 460319 - protein, 18 aa, Mycobacterium
DWSTDGDALPLSARDPRK

SEQ ID NO: 460320 - protein, 4 aa, Mycobacterium
DWTA

SEQ ID NO: 460321 - protein, 6 aa, Mycobacterium
DWTDEE

SEQ ID NO: 460322 - protein, 8 aa, Mycobacterium
DWTENRGT

SEQ ID NO: 460323 - protein, 5 aa, Mycobacterium
DWTGP

SEQ ID NO: 460324 - protein, 10 aa, Mycobacterium
DWTGRRKPNA

SEQ ID NO: 460325 - protein, 20 aa, Mycobacterium
DWTKRSVPDGLRAALTRSGA

SEQ ID NO: 460326 - protein, 16 aa, Mycobacterium
DWTPDSDEKAAHPNSR

SEQ ID NO: 460327 - protein, 16 aa, Mycobacterium
DWTPESGEKAAHPNSR

SEQ ID NO: 460328 - protein, 6 aa, Mycobacterium
DWTPTQ

SEQ ID NO: 460329 - protein, 7 aa, Mycobacterium
DYAADAD

SEQ ID NO: 460330 - protein, 10 aa, Mycobacterium
DYAAEGEQAL

SEQ ID NO: 460331 - protein, 10 aa, Mycobacterium
DYAASDADDP

SEQ ID NO: 460332 - protein, 4 aa, Mycobacterium
DYAD

SEQ ID NO: 460333 - protein, 8 aa, Mycobacterium
DYADHKAA

SEQ ID NO: 460334 - protein, 9 aa, Mycobacterium
DYADTDKAR

SEQ ID NO: 460335 - protein, 18 aa, Mycobacterium
DYAEGRPPTVNDPDETAL

SEQ ID NO: 460336 - protein, 5 aa, Mycobacterium
DYAEK

SEQ ID NO: 460337 - protein, 5 aa, Mycobacterium
DYAEN

SEQ ID NO: 460338 - protein, 5 aa, Mycobacterium
DYAER

SEQ ID NO: 460339 - protein, 8 aa, Mycobacterium
DYAERGDH

SEQ ID NO: 460340 - protein, 4 aa, Mycobacterium
DYAG

SEQ ID NO: 460341 - protein, 22 aa, Mycobacterium
DYAGAPDGGLPVAAGSTPWDDG

SEQ ID NO: 460342 - protein, 8 aa, Mycobacterium
DYAGDTGG

SEQ ID NO: 460343 - protein, 6 aa, Mycobacterium
DYAGTD

SEQ ID NO: 460344 - protein, 11 aa, Mycobacterium
DYAHGGNTNID

SEQ ID NO: 460345 - protein, 11 aa, Mycobacterium
DYAKEGRETLG

SEQ ID NO: 460346 - protein, 10 aa, Mycobacterium
DYAKKQGSPN

SEQ ID NO: 460347 - protein, 10 aa, Mycobacterium
DYAKQQGSPN

SEQ ID NO: 460348 - protein, 8 aa, Mycobacterium
DYANLPRK

SEQ ID NO: 460349 - protein, 5 aa, Mycobacterium
DYANS

SEQ ID NO: 460350 - protein, 9 aa, Mycobacterium
DYAPAEGRN

SEQ ID NO: 460351 - protein, 6 aa, Mycobacterium
DYAPAR

SEQ ID NO: 460352 - protein, 4 aa, Mycobacterium
DYAQ

SEQ ID NO: 460353 - protein, 8 aa, Mycobacterium
DYAQAGSA

SEQ ID NO: 460354 - protein, 6 aa, Mycobacterium
DYAQKP

SEQ ID NO: 460355 - protein, 8 aa, Mycobacterium
DYARGGAA

SEQ ID NO: 460356 - protein, 10 aa, Mycobacterium
DYARGGSASQ

SEQ ID NO: 460357 - protein, 6 aa, Mycobacterium
DYARPE

SEQ ID NO: 460358 - protein, 4 aa, Mycobacterium
DYAS

SEQ ID NO: 460359 - protein, 6 aa, Mycobacterium
DYASES

SEQ ID NO: 460360 - protein, 12 aa, Mycobacterium
DYASGTSSRSSK

SEQ ID NO: 460361 - protein, 7 aa, Mycobacterium
DYASRSR

SEQ ID NO: 460362 - protein, 12 aa, Mycobacterium
DYATGSSQVAPL

SEQ ID NO: 460363 - protein, 17 aa, Mycobacterium
DYATKKPDEFTERAEES

SEQ ID NO: 460364 - protein, 6 aa, Mycobacterium
DYATPT

SEQ ID NO: 460365 - protein, 11 aa, Mycobacterium
DYATSPLYTED

SEQ ID NO: 460366 - protein, 10 aa, Mycobacterium
DYATTDAEDP

SEQ ID NO: 460367 - protein, 9 aa, Mycobacterium
DYDATPDVD

SEQ ID NO: 460368 - protein, 8 aa, Mycobacterium
DYDAYRPT

SEQ ID NO: 460369 - protein, 7 aa, Mycobacterium
DYDDEYY

SEQ ID NO: 460370 - protein, 11 aa, Mycobacterium
DYDDPGKPTIA

SEQ ID NO: 460371 - protein, 8 aa, Mycobacterium
DYDDRAER

SEQ ID NO: 460372 - protein, 7 aa, Mycobacterium
DYDEAAD

SEQ ID NO: 460373 - protein, 8 aa, Mycobacterium
DYDEEEWG

SEQ ID NO: 460374 - protein, 4 aa, Mycobacterium
DYDG

SEQ ID NO: 460375 - protein, 5 aa, Mycobacterium
DYDGD

SEQ ID NO: 460376 - protein, 16 aa, Mycobacterium
DYDGPGEDRVCFIRRI

SEQ ID NO: 460377 - protein, 17 aa, Mycobacterium
DYDGSGDRVTYWCPPCQ

SEQ ID NO: 460378 - protein, 9 aa, Mycobacterium
DYDGTGEAQ

SEQ ID NO: 460379 - protein, 4 aa, Mycobacterium
DYDQ

SEQ ID NO: 460380 - protein, 11 aa, Mycobacterium
DYDQVSNNLGG

SEQ ID NO: 460381 - protein, 4 aa, Mycobacterium
DYDR

SEQ ID NO: 460382 - protein, 6 aa, Mycobacterium
DYDRID

SEQ ID NO: 460383 - protein, 7 aa, Mycobacterium
DYDSATK

SEQ ID NO: 460384 - protein, 8 aa, Mycobacterium
DYDSATKH

SEQ ID NO: 460385 - protein, 8 aa, Mycobacterium
DYDSKYGP

SEQ ID NO: 460386 - protein, 6 aa, Mycobacterium
DYDTDA

SEQ ID NO: 460387 - protein, 11 aa, Mycobacterium
DYEDDQPPPWG

SEQ ID NO: 460388 - protein, 11 aa, Mycobacterium
DYEDKAPYTFS

SEQ ID NO: 460389 - protein, 11 aa, Mycobacterium
DYEDKAPYTFT

SEQ ID NO: 460390 - protein, 6 aa, Mycobacterium
DYEGRP

SEQ ID NO: 460391 - protein, 10 aa, Mycobacterium
DYEGTTTADI

SEQ ID NO: 460392 - protein, 7 aa, Mycobacterium
DYEGVTR

SEQ ID NO: 460393 - protein, 5 aa, Mycobacterium
DYEND

SEQ ID NO: 460394 - protein, 7 aa, Mycobacterium
DYEPDKR

SEQ ID NO: 460395 - protein, 7 aa, Mycobacterium
DYEPGSN

SEQ ID NO: 460396 - protein, 4 aa, Mycobacterium
DYER

SEQ ID NO: 460397 - protein, 8 aa, Mycobacterium
DYERPGDV

SEQ ID NO: 460398 - protein, 9 aa, Mycobacterium
DYESTSKDL

SEQ ID NO: 460399 - protein, 4 aa, Mycobacterium
DYET

SEQ ID NO: 460400 - protein, 7 aa, Mycobacterium
DYETAAE

SEQ ID NO: 460401 - protein, 5 aa, Mycobacterium
DYETS

SEQ ID NO: 460402 - protein, 11 aa, Mycobacterium
DYEVEEDRDED

SEQ ID NO: 460403 - protein, 4 aa, Mycobacterium
DYFE

SEQ ID NO: 460404 - protein, 8 aa, Mycobacterium
DYGDQPRR

SEQ ID NO: 460405 - protein, 4 aa, Mycobacterium
DYGG

SEQ ID NO: 460406 - protein, 10 aa, Mycobacterium
DYGGSDEAAD

SEQ ID NO: 460407 - protein, 9 aa, Mycobacterium
DYGNLNGTE

SEQ ID NO: 460408 - protein, 8 aa, Mycobacterium
DYGPHPAG

SEQ ID NO: 460409 - protein, 4 aa, Mycobacterium
DYGQ

SEQ ID NO: 460410 - protein, 6 aa, Mycobacterium
DYGQAA

SEQ ID NO: 460411 - protein, 7 aa, Mycobacterium
DYGRDEK

SEQ ID NO: 460412 - protein, 5 aa, Mycobacterium
DYGRR

SEQ ID NO: 460413 - protein, 10 aa, Mycobacterium
DYGSGDAEDP

SEQ ID NO: 460414 - protein, 7 aa, Mycobacterium
DYGSSVG

SEQ ID NO: 460415 - protein, 5 aa, Mycobacterium
DYGSV

SEQ ID NO: 460416 - protein, 6 aa, Mycobacterium
DYGTEV

SEQ ID NO: 460417 - protein, 8 aa, Mycobacterium
DYGTGPDA

SEQ ID NO: 460418 - protein, 9 aa, Mycobacterium
DYGTRSKAA

SEQ ID NO: 460419 - protein, 5 aa, Mycobacterium
DYGTY

SEQ ID NO: 460420 - protein, 5 aa, Mycobacterium
DYGVP

SEQ ID NO: 460421 - protein, 7 aa, Mycobacterium
DYGVPSN

SEQ ID NO: 460422 - protein, 4 aa, Mycobacterium
DYGY

SEQ ID NO: 460423 - protein, 16 aa, Mycobacterium
DYHPEAPGGSAAGRTC

SEQ ID NO: 460424 - protein, 15 aa, Mycobacterium
DYHPEEPGGSAAGRT

SEQ ID NO: 460425 - protein, 16 aa, Mycobacterium
DYHPEQPGGSAAGRTC

SEQ ID NO: 460426 - protein, 8 aa, Mycobacterium
DYHQARAD

SEQ ID NO: 460427 - protein, 6 aa, Mycobacterium
DYKAPD

SEQ ID NO: 460428 - protein, 4 aa, Mycobacterium
DYKG

SEQ ID NO: 460429 - protein, 5 aa, Mycobacterium
DYKGG

SEQ ID NO: 460430 - protein, 10 aa, Mycobacterium
DYKGKPGNAA

SEQ ID NO: 460431 - protein, 4 aa, Mycobacterium
DYKK

SEQ ID NO: 460432 - protein, 9 aa, Mycobacterium
DYKQEAENI

SEQ ID NO: 460433 - protein, 6 aa, Mycobacterium
DYLPPY

SEQ ID NO: 460434 - protein, 20 aa, Mycobacterium
DYNGRRGSGTPFRNAAPTLA

SEQ ID NO: 460435 - protein, 9 aa, Mycobacterium
DYNQRSQRQ

SEQ ID NO: 460436 - protein, 13 aa, Mycobacterium
DYNTGLANAGNYN

SEQ ID NO: 460437 - protein, 19 aa, Mycobacterium
DYPALADEPPGRVRTPEAV

SEQ ID NO: 460438 - protein, 13 aa, Mycobacterium
DYPASARAVSDGT

SEQ ID NO: 460439 - protein, 14 aa, Mycobacterium
DYPATGKRTLQDNG

SEQ ID NO: 460440 - protein, 9 aa, Mycobacterium
DYPDGTERL

SEQ ID NO: 460441 - protein, 8 aa, Mycobacterium
DYPDHEAN

SEQ ID NO: 460442 - protein, 10 aa, Mycobacterium
DYPDPTPPRG

SEQ ID NO: 460443 - protein, 5 aa, Mycobacterium
DYPDR

SEQ ID NO: 460444 - protein, 6 aa, Mycobacterium
DYPDRA

SEQ ID NO: 460445 - protein, 7 aa, Mycobacterium
DYPDRDA

SEQ ID NO: 460446 - protein, 6 aa, Mycobacterium
DYPDRE

SEQ ID NO: 460447 - protein, 9 aa, Mycobacterium
DYPDTAPAE

SEQ ID NO: 460448 - protein, 5 aa, Mycobacterium
DYPEG

SEQ ID NO: 460449 - protein, 4 aa, Mycobacterium
DYPG

SEQ ID NO: 460450 - protein, 17 aa, Mycobacterium
DYPGGAQRRAGQGPLVG

SEQ ID NO: 460451 - protein, 23 aa, Mycobacterium
DYPGNIGQATTTTSGTNTPTGGF

SEQ ID NO: 460452 - protein, 9 aa, Mycobacterium
DYPGNTTPV

SEQ ID NO: 460453 - protein, 7 aa, Mycobacterium
DYPGRDA

SEQ ID NO: 460454 - protein, 4 aa, Mycobacterium
DYPH

SEQ ID NO: 460455 - protein, 13 aa, Mycobacterium
DYPHADSTWPDTQ

SEQ ID NO: 460456 - protein, 7 aa, Mycobacterium
DYPHPEG

SEQ ID NO: 460457 - protein, 8 aa, Mycobacterium
DYPHPEGL

SEQ ID NO: 460458 - protein, 12 aa, Mycobacterium
DYPHPEGLAEPK

SEQ ID NO: 460459 - protein, 5 aa, Mycobacterium
DYPKG

SEQ ID NO: 460460 - protein, 7 aa, Mycobacterium
DYPKTDF

SEQ ID NO: 460461 - protein, 12 aa, Mycobacterium
DYPNATPDDLDE

SEQ ID NO: 460462 - protein, 7 aa, Mycobacterium
DYPNIAT

SEQ ID NO: 460463 - protein, 7 aa, Mycobacterium
DYPNRDA

SEQ ID NO: 460464 - protein, 7 aa, Mycobacterium
DYPNTAP

SEQ ID NO: 460465 - protein, 9 aa, Mycobacterium
DYPPDDELE

SEQ ID NO: 460466 - protein, 8 aa, Mycobacterium
DYPPDDQL

SEQ ID NO: 460467 - protein, 9 aa, Mycobacterium
DYPPERVRA

SEQ ID NO: 460468 - protein, 10 aa, Mycobacterium
DYPREARTQH

SEQ ID NO: 460469 - protein, 5 aa, Mycobacterium
DYPRH

SEQ ID NO: 460470 - protein, 22 aa, Mycobacterium
DYPRREDDDKAALRDDIGEAAR

SEQ ID NO: 460471 - protein, 22 aa, Mycobacterium
DYPSDTRFSRASDGDAAMRSEG

SEQ ID NO: 460472 - protein, 7 aa, Mycobacterium
DYPTELQ

SEQ ID NO: 460473 - protein, 9 aa, Mycobacterium
DYPVPGGTM

SEQ ID NO: 460474 - protein, 29 aa, Mycobacterium
DYQAEAEQKWGETAEWKESQRRATSYGKD

SEQ ID NO: 460475 - protein, 29 aa, Mycobacterium
DYQAEAERKFGDTAEWKESQRRTKSYSKG

SEQ ID NO: 460476 - protein, 32 aa, Mycobacterium
DYQGPGSGRETTPAASETGSTEEDAPPPPPSP

SEQ ID NO: 460477 - protein, 4 aa, Mycobacterium
DYQP

SEQ ID NO: 460478 - protein, 6 aa, Mycobacterium
DYQPAM

SEQ ID NO: 460479 - protein, 7 aa, Mycobacterium
DYQPAMT

SEQ ID NO: 460480 - protein, 11 aa, Mycobacterium
DYQPGEPRGTD

SEQ ID NO: 460481 - protein, 8 aa, Mycobacterium
DYQPGQPG

SEQ ID NO: 460482 - protein, 8 aa, Mycobacterium
DYQPGQSG

SEQ ID NO: 460483 - protein, 10 aa, Mycobacterium
DYQPTEDTWP

SEQ ID NO: 460484 - protein, 9 aa, Mycobacterium
DYRAPGNAV

SEQ ID NO: 460485 - protein, 9 aa, Mycobacterium
DYRAPSTRD

SEQ ID NO: 460486 - protein, 16 aa, Mycobacterium
DYRAQESKRHGSTRSG

SEQ ID NO: 460487 - protein, 5 aa, Mycobacterium
DYRDG

SEQ ID NO: 460488 - protein, 18 aa, Mycobacterium
DYRDGGDTGEVTWLSRGV

SEQ ID NO: 460489 - protein, 20 aa, Mycobacterium
DYRDKAAPTGRQIPIFRLKP

SEQ ID NO: 460490 - protein, 14 aa, Mycobacterium
DYRDPTSLSPTLTT

SEQ ID NO: 460491 - protein, 13 aa, Mycobacterium
DYRDQEEARGHSI

SEQ ID NO: 460492 - protein, 10 aa, Mycobacterium
DYRDTQRRQL

SEQ ID NO: 460493 - protein, 10 aa, Mycobacterium
DYRDTTEREF

SEQ ID NO: 460494 - protein, 5 aa, Mycobacterium
DYRDV

SEQ ID NO: 460495 - protein, 20 aa, Mycobacterium
DYREKTSVTGRDIPVFRLTP

SEQ ID NO: 460496 - protein, 8 aa, Mycobacterium
DYRGGFTR

SEQ ID NO: 460497 - protein, 6 aa, Mycobacterium
DYRGTK

SEQ ID NO: 460498 - protein, 11 aa, Mycobacterium
DYRHAGSASAV

SEQ ID NO: 460499 - protein, 4 aa, Mycobacterium
DYRP

SEQ ID NO: 460500 - protein, 8 aa, Mycobacterium
DYRPEAPL

SEQ ID NO: 460501 - protein, 20 aa, Mycobacterium
DYRPELPGGRPTGGRSLSAA

SEQ ID NO: 460502 - protein, 7 aa, Mycobacterium
DYRPGTL

SEQ ID NO: 460503 - protein, 10 aa, Mycobacterium
DYRSTTTREI

SEQ ID NO: 460504 - protein, 29 aa, Mycobacterium
DYRTARNTQNRIANDANAELAATADPVKR

SEQ ID NO: 460505 - protein, 9 aa, Mycobacterium
DYRTEDARV

SEQ ID NO: 460506 - protein, 6 aa, Mycobacterium
DYRTET

SEQ ID NO: 460507 - protein, 8 aa, Mycobacterium
DYRTKHGV

SEQ ID NO: 460508 - protein, 16 aa, Mycobacterium
DYRTQESARHGTPRAG

SEQ ID NO: 460509 - protein, 9 aa, Mycobacterium
DYRTSGKTY

SEQ ID NO: 460510 - protein, 8 aa, Mycobacterium
DYRTSGRT

SEQ ID NO: 460511 - protein, 10 aa, Mycobacterium
DYSASDADDP

SEQ ID NO: 460512 - protein, 8 aa, Mycobacterium
DYSDHEAA

SEQ ID NO: 460513 - protein, 7 aa, Mycobacterium
DYSDVSP

SEQ ID NO: 460514 - protein, 6 aa, Mycobacterium
DYSDVT

SEQ ID NO: 460515 - protein, 10 aa, Mycobacterium
DYSEDPAVDK

SEQ ID NO: 460516 - protein, 17 aa, Mycobacterium
DYSEEATVDTKLAPDTA

SEQ ID NO: 460517 - protein, 9 aa, Mycobacterium
DYSEEGTVD

SEQ ID NO: 460518 - protein, 10 aa, Mycobacterium
DYSEEGTVDK

SEQ ID NO: 460519 - protein, 18 aa, Mycobacterium
DYSEESTVDKALDPGKPL

SEQ ID NO: 460520 - protein, 30 aa, Mycobacterium
DYSEKSTIDPLHPTSPPHAPTPTDPQPHGD

SEQ ID NO: 460521 - protein, 9 aa, Mycobacterium
DYSGDPDPV

SEQ ID NO: 460522 - protein, 9 aa, Mycobacterium
DYSLGGEQS

SEQ ID NO: 460523 - protein, 8 aa, Mycobacterium
DYSPADPL

SEQ ID NO: 460524 - protein, 7 aa, Mycobacterium
DYSPDRD

SEQ ID NO: 460525 - protein, 5 aa, Mycobacterium
DYSPE

SEQ ID NO: 460526 - protein, 5 aa, Mycobacterium
DYSQA

SEQ ID NO: 460527 - protein, 5 aa, Mycobacterium
DYSQG

SEQ ID NO: 460528 - protein, 5 aa, Mycobacterium
DYSQP

SEQ ID NO: 460529 - protein, 12 aa, Mycobacterium
DYSRRGRSDHPH

SEQ ID NO: 460530 - protein, 4 aa, Mycobacterium
DYSS

SEQ ID NO: 460531 - protein, 14 aa, Mycobacterium
DYSSAGAAAGPRDE

SEQ ID NO: 460532 - protein, 9 aa, Mycobacterium
DYSSARRDL

SEQ ID NO: 460533 - protein, 12 aa, Mycobacterium
DYSSDPDDLPGY

SEQ ID NO: 460534 - protein, 13 aa, Mycobacterium
DYSTGDGQRRQKR

SEQ ID NO: 460535 - protein, 13 aa, Mycobacterium
DYSTGETTKHGDL

SEQ ID NO: 460536 - protein, 10 aa, Mycobacterium
DYTAPAGTPV

SEQ ID NO: 460537 - protein, 5 aa, Mycobacterium
DYTDA

SEQ ID NO: 460538 - protein, 10 aa, Mycobacterium
DYTDAGKPAI

SEQ ID NO: 460539 - protein, 11 aa, Mycobacterium
DYTDGAAEDEI

SEQ ID NO: 460540 - protein, 12 aa, Mycobacterium
DYTDGAAEDELS

SEQ ID NO: 460541 - protein, 9 aa, Mycobacterium
DYTDPAEAR

SEQ ID NO: 460542 - protein, 17 aa, Mycobacterium
DYTDRAEAKSDKVAGAW

SEQ ID NO: 460543 - protein, 5 aa, Mycobacterium
DYTET

SEQ ID NO: 460544 - protein, 7 aa, Mycobacterium
DYTGDPA

SEQ ID NO: 460545 - protein, 13 aa, Mycobacterium
DYTGPGAGLDGSD

SEQ ID NO: 460546 - protein, 45 aa, Mycobacterium
DYTGPGSGLDGNPALSSVDPASSSASGYADGSSEDETPPPPPSPI

SEQ ID NO: 460547 - protein, 9 aa, Mycobacterium
DYTNPNPNV

SEQ ID NO: 460548 - protein, 4 aa, Mycobacterium
DYTP

SEQ ID NO: 460549 - protein, 14 aa, Mycobacterium
DYTQKNELNARTPL

SEQ ID NO: 460550 - protein, 13 aa, Mycobacterium
DYTRDGDRWSGED

SEQ ID NO: 460551 - protein, 9 aa, Mycobacterium
DYTRERNPH

SEQ ID NO: 460552 - protein, 10 aa, Mycobacterium
DYTSLSEPQR

SEQ ID NO: 460553 - protein, 9 aa, Mycobacterium
DYTSTGHNQ

SEQ ID NO: 460554 - protein, 6 aa, Mycobacterium
DYTTRG

SEQ ID NO: 460555 - protein, 9 aa, Mycobacterium
DYVGKGLSG

SEQ ID NO: 460556 - protein, 8 aa, Mycobacterium
DYVPPDSA

SEQ ID NO: 460557 - protein, 14 aa, Mycobacterium
DYYDPEPGVPGRTV

SEQ ID NO: 460558 - protein, 8 aa, Mycobacterium
DYYPPDSA

SEQ ID NO: 460559 - protein, 13 aa, Mycobacterium
DYYTPRAEFGGRN

SEQ ID NO: 460560 - protein, 6 aa, Mycobacterium
EAAAAA

SEQ ID NO: 460561 - protein, 15 aa, Mycobacterium
EAAAAAADSTVTPRE

SEQ ID NO: 460562 - protein, 7 aa, Mycobacterium
EAAAAAN

SEQ ID NO: 460563 - protein, 11 aa, Mycobacterium
EAAAAATANEH

SEQ ID NO: 460564 - protein, 6 aa, Mycobacterium
EAAAAD

SEQ ID NO: 460565 - protein, 7 aa, Mycobacterium
EAAAAGA

SEQ ID NO: 460566 - protein, 9 aa, Mycobacterium
EAAAAGADS

SEQ ID NO: 460567 - protein, 9 aa, Mycobacterium
EAAAAGEGI

SEQ ID NO: 460568 - protein, 13 aa, Mycobacterium
EAAAAGRPEPDRE

SEQ ID NO: 460569 - protein, 12 aa, Mycobacterium
EAAAAQATESVD

SEQ ID NO: 460570 - protein, 9 aa, Mycobacterium
EAAAARTEE

SEQ ID NO: 460571 - protein, 10 aa, Mycobacterium
EAAAATAGPR

SEQ ID NO: 460572 - protein, 8 aa, Mycobacterium
EAAAATSN

SEQ ID NO: 460573 - protein, 18 aa, Mycobacterium
EAAADADKNETDASSKIE

SEQ ID NO: 460574 - protein, 7 aa, Mycobacterium
EAAADDD

SEQ ID NO: 460575 - protein, 19 aa, Mycobacterium
EAAADSQPSSALPGPAPDD

SEQ ID NO: 460576 - protein, 9 aa, Mycobacterium
EAAADTPGA

SEQ ID NO: 460577 - protein, 10 aa, Mycobacterium
EAAAEIPDYP

SEQ ID NO: 460578 - protein, 27 aa, Mycobacterium
EAAAEPEPEAEADGDDEPSEKDKASGD

SEQ ID NO: 460579 - protein, 12 aa, Mycobacterium
EAAAEVNAELHP

SEQ ID NO: 460580 - protein, 16 aa, Mycobacterium
EAAAEYRRRRGRSPAS

SEQ ID NO: 460581 - protein, 12 aa, Mycobacterium
EAAAGAEKADIA

SEQ ID NO: 460582 - protein, 7 aa, Mycobacterium
EAAAGAQ

SEQ ID NO: 460583 - protein, 8 aa, Mycobacterium
EAAAGGAN

SEQ ID NO: 460584 - protein, 12 aa, Mycobacterium
EAAAGKALTAGG

SEQ ID NO: 460585 - protein, 19 aa, Mycobacterium
EAAAGKALTGAGTLLPMSD

SEQ ID NO: 460586 - protein, 11 aa, Mycobacterium
EAAAGNSDPEV

SEQ ID NO: 460587 - protein, 9 aa, Mycobacterium
EAAAGPHDA

SEQ ID NO: 460588 - protein, 15 aa, Mycobacterium
EAAAGRARTGGGTRV

SEQ ID NO: 460589 - protein, 10 aa, Mycobacterium
EAAAGSFSSV

SEQ ID NO: 460590 - protein, 6 aa, Mycobacterium
EAAAHG

SEQ ID NO: 460591 - protein, 7 aa, Mycobacterium
EAAAHRQ

SEQ ID NO: 460592 - protein, 7 aa, Mycobacterium
EAAAIDP

SEQ ID NO: 460593 - protein, 10 aa, Mycobacterium
EAAAKRADEL

SEQ ID NO: 460594 - protein, 8 aa, Mycobacterium
EAAANDDV

SEQ ID NO: 460595 - protein, 9 aa, Mycobacterium
EAAANGEDV

SEQ ID NO: 460596 - protein, 24 aa, Mycobacterium
EAAAPDDRWQGSGANAYAAANREH

SEQ ID NO: 460597 - protein, 7 aa, Mycobacterium
EAAAPGP

SEQ ID NO: 460598 - protein, 7 aa, Mycobacterium
EAAAQAS

SEQ ID NO: 460599 - protein, 9 aa, Mycobacterium
EAAAQGREA

SEQ ID NO: 460600 - protein, 9 aa, Mycobacterium
EAAARAKNR

SEQ ID NO: 460601 - protein, 7 aa, Mycobacterium
EAAARAL

SEQ ID NO: 460602 - protein, 13 aa, Mycobacterium
EAAARARAGGGPT

SEQ ID NO: 460603 - protein, 11 aa, Mycobacterium
EAAAREEYGEI

SEQ ID NO: 460604 - protein, 12 aa, Mycobacterium
EAAARELAEETG

SEQ ID NO: 460605 - protein, 6 aa, Mycobacterium
EAAARR

SEQ ID NO: 460606 - protein, 9 aa, Mycobacterium
EAAARRAGD

SEQ ID NO: 460607 - protein, 5 aa, Mycobacterium
EAAAS

SEQ ID NO: 460608 - protein, 9 aa, Mycobacterium
EAAASDVAG

SEQ ID NO: 460609 - protein, 7 aa, Mycobacterium
EAAASHN

SEQ ID NO: 460610 - protein, 5 aa, Mycobacterium
EAAAT

SEQ ID NO: 460611 - protein, 9 aa, Mycobacterium
EAAATAGLG

SEQ ID NO: 460612 - protein, 39 aa, Mycobacterium
EAAATARAALSSEETDGLSATDSLGKARAALESTGDAKL

SEQ ID NO: 460613 - protein, 10 aa, Mycobacterium
EAAATRTEEF

SEQ ID NO: 460614 - protein, 6 aa, Mycobacterium
EAAAVT

SEQ ID NO: 460615 - protein, 15 aa, Mycobacterium
EAAAYERGRPSYPPE

SEQ ID NO: 460616 - protein, 7 aa, Mycobacterium
EAADAGA

SEQ ID NO: 460617 - protein, 12 aa, Mycobacterium
EAADDKPSDDEP

SEQ ID NO: 460618 - protein, 8 aa, Mycobacterium
EAADDPRF

SEQ ID NO: 460619 - protein, 10 aa, Mycobacterium
EAADDPRFGE

SEQ ID NO: 460620 - protein, 16 aa, Mycobacterium
EAADGGPLAGLQNGDT

SEQ ID NO: 460621 - protein, 10 aa, Mycobacterium
EAADGVRSLE

SEQ ID NO: 460622 - protein, 5 aa, Mycobacterium
EAADH

SEQ ID NO: 460623 - protein, 7 aa, Mycobacterium
EAADKAG

SEQ ID NO: 460624 - protein, 8 aa, Mycobacterium
EAADKAGF

SEQ ID NO: 460625 - protein, 10 aa, Mycobacterium
EAADKAGGNF

SEQ ID NO: 460626 - protein, 5 aa, Mycobacterium
EAADL

SEQ ID NO: 460627 - protein, 7 aa, Mycobacterium
EAADMDG

SEQ ID NO: 460628 - protein, 6 aa, Mycobacterium
EAADNR

SEQ ID NO: 460629 - protein, 15 aa, Mycobacterium
EAADNSIDATAARDF

SEQ ID NO: 460630 - protein, 16 aa, Mycobacterium
EAADPAEIAAAADEAR

SEQ ID NO: 460631 - protein, 7 aa, Mycobacterium
EAADPAT

SEQ ID NO: 460632 - protein, 10 aa, Mycobacterium
EAADPERTAE

SEQ ID NO: 460633 - protein, 8 aa, Mycobacterium
EAADPSTH

SEQ ID NO: 460634 - protein, 5 aa, Mycobacterium
EAADQ

SEQ ID NO: 460635 - protein, 10 aa, Mycobacterium
EAADRAQRTV

SEQ ID NO: 460636 - protein, 9 aa, Mycobacterium
EAADRATGL

SEQ ID NO: 460637 - protein, 6 aa, Mycobacterium
EAADRC

SEQ ID NO: 460638 - protein, 9 aa, Mycobacterium
EAADRDDAW

SEQ ID NO: 460639 - protein, 6 aa, Mycobacterium
EAADRV

SEQ ID NO: 460640 - protein, 12 aa, Mycobacterium
EAADSERARTLT

SEQ ID NO: 460641 - protein, 16 aa, Mycobacterium
EAADSSTSRDAYGNTS

SEQ ID NO: 460642 - protein, 8 aa, Mycobacterium
EAAEADPD

SEQ ID NO: 460643 - protein, 7 aa, Mycobacterium
EAAEADV

SEQ ID NO: 460644 - protein, 10 aa, Mycobacterium
EAAEAEESGY

SEQ ID NO: 460645 - protein, 9 aa, Mycobacterium
EAAEAGKDV

SEQ ID NO: 460646 - protein, 8 aa, Mycobacterium
EAAEAPAQ

SEQ ID NO: 460647 - protein, 13 aa, Mycobacterium
EAAEDGGAEGFSG

SEQ ID NO: 460648 - protein, 16 aa, Mycobacterium
EAAEEIARRSRGTPRI

SEQ ID NO: 460649 - protein, 5 aa, Mycobacterium
EAAEF

SEQ ID NO: 460650 - protein, 11 aa, Mycobacterium
EAAEGTPGGST

SEQ ID NO: 460651 - protein, 5 aa, Mycobacterium
EAAEH

SEQ ID NO: 460652 - protein, 7 aa, Mycobacterium
EAAEKAK

SEQ ID NO: 460653 - protein, 13 aa, Mycobacterium
EAAEKGKGYSEKL

SEQ ID NO: 460654 - protein, 11 aa, Mycobacterium
EAAEKSRSEAG

SEQ ID NO: 460655 - protein, 10 aa, Mycobacterium
EAAEKSSGNF

SEQ ID NO: 460656 - protein, 13 aa, Mycobacterium
EAAELADRTGGNP

SEQ ID NO: 460657 - protein, 15 aa, Mycobacterium
EAAELGDRPLTPADV

SEQ ID NO: 460658 - protein, 7 aa, Mycobacterium
EAAEPAG

SEQ ID NO: 460659 - protein, 6 aa, Mycobacterium
EAAEPG

SEQ ID NO: 460660 - protein, 7 aa, Mycobacterium
EAAEPRT

SEQ ID NO: 460661 - protein, 10 aa, Mycobacterium
EAAERASGLR

SEQ ID NO: 460662 - protein, 6 aa, Mycobacterium
EAAERD

SEQ ID NO: 460663 - protein, 9 aa, Mycobacterium
EAAERDPEL

SEQ ID NO: 460664 - protein, 22 aa, Mycobacterium
EAAERGDIRDQQQPKVRDSARH

SEQ ID NO: 460665 - protein, 13 aa, Mycobacterium
EAAERGKGYSEKI

SEQ ID NO: 460666 - protein, 6 aa, Mycobacterium
EAAERI

SEQ ID NO: 460667 - protein, 10 aa, Mycobacterium
EAAERPGFDP

SEQ ID NO: 460668 - protein, 13 aa, Mycobacterium
EAAESERKRTLTD

SEQ ID NO: 460669 - protein, 14 aa, Mycobacterium
EAAESSRGDGARGD

SEQ ID NO: 460670 - protein, 8 aa, Mycobacterium
EAAESVAQ

SEQ ID NO: 460671 - protein, 13 aa, Mycobacterium
EAAETQAGQPRAR

SEQ ID NO: 460672 - protein, 8 aa, Mycobacterium
EAAEVDEG

SEQ ID NO: 460673 - protein, 4 aa, Mycobacterium
EAAF

SEQ ID NO: 460674 - protein, 14 aa, Mycobacterium
EAAGAEAAGVPSDD

SEQ ID NO: 460675 - protein, 31 aa, Mycobacterium
EAAGAESGCVDQDAAQREADAEFDGDAEAGG

SEQ ID NO: 460676 - protein, 6 aa, Mycobacterium
EAAGAG

SEQ ID NO: 460677 - protein, 9 aa, Mycobacterium
EAAGAPTVS

SEQ ID NO: 460678 - protein, 12 aa, Mycobacterium
EAAGASRRTAVD

SEQ ID NO: 460679 - protein, 25 aa, Mycobacterium
EAAGASTTTMSAHDPRGTRSAASNP

SEQ ID NO: 460680 - protein, 10 aa, Mycobacterium
EAAGATGGTA

SEQ ID NO: 460681 - protein, 12 aa, Mycobacterium
EAAGDGRSDDVA

SEQ ID NO: 460682 - protein, 11 aa, Mycobacterium
EAAGDGSEPGW

SEQ ID NO: 460683 - protein, 8 aa, Mycobacterium
EAAGDHGA

SEQ ID NO: 460684 - protein, 9 aa, Mycobacterium
EAAGDPETW

SEQ ID NO: 460685 - protein, 12 aa, Mycobacterium
EAAGDYGKAGTY

SEQ ID NO: 460686 - protein, 6 aa, Mycobacterium
EAAGEV

SEQ ID NO: 460687 - protein, 8 aa, Mycobacterium
EAAGGKGV

SEQ ID NO: 460688 - protein, 10 aa, Mycobacterium
EAAGGLGGNE

SEQ ID NO: 460689 - protein, 7 aa, Mycobacterium
EAAGGRA

SEQ ID NO: 460690 - protein, 7 aa, Mycobacterium
EAAGGRG

SEQ ID NO: 460691 - protein, 8 aa, Mycobacterium
EAAGGRPI

SEQ ID NO: 460692 - protein, 10 aa, Mycobacterium
EAAGGSGAGF

SEQ ID NO: 460693 - protein, 12 aa, Mycobacterium
EAAGGTSAGITG

SEQ ID NO: 460694 - protein, 12 aa, Mycobacterium
EAAGGTSAGVTG

SEQ ID NO: 460695 - protein, 13 aa, Mycobacterium
EAAGGTSSGVTGA

SEQ ID NO: 460696 - protein, 31 aa, Mycobacterium
EAAGHGDNGGGSSSSSSSEKSAGGSLASDAQ

SEQ ID NO: 460697 - protein, 30 aa, Mycobacterium
EAAGHTAGEQSPGNGAPAEKAGGSLASDAQ

SEQ ID NO: 460698 - protein, 9 aa, Mycobacterium
EAAGIGPDD

SEQ ID NO: 460699 - protein, 9 aa, Mycobacterium
EAAGIGPED

SEQ ID NO: 460700 - protein, 12 aa, Mycobacterium
EAAGKSQGLTPR

SEQ ID NO: 460701 - protein, 7 aa, Mycobacterium
EAAGLQP

SEQ ID NO: 460702 - protein, 8 aa, Mycobacterium
EAAGLTPL

SEQ ID NO: 460703 - protein, 10 aa, Mycobacterium
EAAGNLPDEA

SEQ ID NO: 460704 - protein, 6 aa, Mycobacterium
EAAGPL

SEQ ID NO: 460705 - protein, 16 aa, Mycobacterium
EAAGPTTQYSFEPDAT

SEQ ID NO: 460706 - protein, 12 aa, Mycobacterium
EAAGPYGQPGSY

SEQ ID NO: 460707 - protein, 5 aa, Mycobacterium
EAAGQ

SEQ ID NO: 460708 - protein, 6 aa, Mycobacterium
EAAGRA

SEQ ID NO: 460709 - protein, 10 aa, Mycobacterium
EAAGRPPESM

SEQ ID NO: 460710 - protein, 9 aa, Mycobacterium
EAAGRRDEF

SEQ ID NO: 460711 - protein, 6 aa, Mycobacterium
EAAGRS

SEQ ID NO: 460712 - protein, 7 aa, Mycobacterium
EAAGRTV

SEQ ID NO: 460713 - protein, 9 aa, Mycobacterium
EAAGSEETW

SEQ ID NO: 460714 - protein, 9 aa, Mycobacterium
EAAGSTSGF

SEQ ID NO: 460715 - protein, 11 aa, Mycobacterium
EAAGSTSTQMS

SEQ ID NO: 460716 - protein, 7 aa, Mycobacterium
EAAGSVP

SEQ ID NO: 460717 - protein, 7 aa, Mycobacterium
EAAGTAE

SEQ ID NO: 460718 - protein, 11 aa, Mycobacterium
EAAGTTHSAEY

SEQ ID NO: 460719 - protein, 7 aa, Mycobacterium
EAAGVGK

SEQ ID NO: 460720 - protein, 5 aa, Mycobacterium
EAAGY

SEQ ID NO: 460721 - protein, 8 aa, Mycobacterium
EAAGYEAP

SEQ ID NO: 460722 - protein, 5 aa, Mycobacterium
EAAHA

SEQ ID NO: 460723 - protein, 11 aa, Mycobacterium
EAAHAAGEDTF

SEQ ID NO: 460724 - protein, 5 aa, Mycobacterium
EAAHG

SEQ ID NO: 460725 - protein, 13 aa, Mycobacterium
EAAHSCPEQAIVI

SEQ ID NO: 460726 - protein, 4 aa, Mycobacterium
EAAK

SEQ ID NO: 460727 - protein, 6 aa, Mycobacterium
EAAKAK

SEQ ID NO: 460728 - protein, 10 aa, Mycobacterium
EAAKAREFAP

SEQ ID NO: 460729 - protein, 7 aa, Mycobacterium
EAAKARR

SEQ ID NO: 460730 - protein, 6 aa, Mycobacterium
EAAKEL

SEQ ID NO: 460731 - protein, 5 aa, Mycobacterium
EAAKF

SEQ ID NO: 460732 - protein, 7 aa, Mycobacterium
EAAKKKA

SEQ ID NO: 460733 - protein, 8 aa, Mycobacterium
EAAKPGSY

SEQ ID NO: 460734 - protein, 8 aa, Mycobacterium
EAAKPRKV

SEQ ID NO: 460735 - protein, 13 aa, Mycobacterium
EAAKQAAAKIGAT

SEQ ID NO: 460736 - protein, 8 aa, Mycobacterium
EAAKVSEL

SEQ ID NO: 460737 - protein, 9 aa, Mycobacterium
EAAKYDPQP

SEQ ID NO: 460738 - protein, 10 aa, Mycobacterium
EAALDDGPAI

SEQ ID NO: 460739 - protein, 5 aa, Mycobacterium
EAALG

SEQ ID NO: 460740 - protein, 18 aa, Mycobacterium
EAALGGGSVAAGIGEASA

SEQ ID NO: 460741 - protein, 6 aa, Mycobacterium
EAALNA

SEQ ID NO: 460742 - protein, 6 aa, Mycobacterium
EAALPT

SEQ ID NO: 460743 - protein, 6 aa, Mycobacterium
EAALSS

SEQ ID NO: 460744 - protein, 7 aa, Mycobacterium
EAALTDP

SEQ ID NO: 460745 - protein, 14 aa, Mycobacterium
EAAMDNARDATQIH

SEQ ID NO: 460746 - protein, 27 aa, Mycobacterium
EAANDGQQSGRVIRPPEAGVWHGEDFS

SEQ ID NO: 460747 - protein, 17 aa, Mycobacterium
EAANERSFSPDGFYRSG

SEQ ID NO: 460748 - protein, 16 aa, Mycobacterium
EAANGPRGRQGSPSRV

SEQ ID NO: 460749 - protein, 12 aa, Mycobacterium
EAANGSGNISYE

SEQ ID NO: 460750 - protein, 15 aa, Mycobacterium
EAANGTGAISYEPTN

SEQ ID NO: 460751 - protein, 11 aa, Mycobacterium
EAANNASHEHP

SEQ ID NO: 460752 - protein, 15 aa, Mycobacterium
EAANQATDWGAPGRL

SEQ ID NO: 460753 - protein, 11 aa, Mycobacterium
EAANSASHEHP

SEQ ID NO: 460754 - protein, 9 aa, Mycobacterium
EAANTSLQQ

SEQ ID NO: 460755 - protein, 4 aa, Mycobacterium
EAAP

SEQ ID NO: 460756 - protein, 13 aa, Mycobacterium
EAAPAEAVADRHG

SEQ ID NO: 460757 - protein, 9 aa, Mycobacterium
EAAPAGVTY

SEQ ID NO: 460758 - protein, 6 aa, Mycobacterium
EAAPAP

SEQ ID NO: 460759 - protein, 21 aa, Mycobacterium
EAAPAPAPSAAPSTGPRPDDI

SEQ ID NO: 460760 - protein, 6 aa, Mycobacterium
EAAPAV

SEQ ID NO: 460761 - protein, 9 aa, Mycobacterium
EAAPDRPPW

SEQ ID NO: 460762 - protein, 13 aa, Mycobacterium
EAAPDSARDRCAN

SEQ ID NO: 460763 - protein, 6 aa, Mycobacterium
EAAPGG

SEQ ID NO: 460764 - protein, 6 aa, Mycobacterium
EAAPGH

SEQ ID NO: 460765 - protein, 7 aa, Mycobacterium
EAAPGQR

SEQ ID NO: 460766 - protein, 8 aa, Mycobacterium
EAAPGQTC

SEQ ID NO: 460767 - protein, 8 aa, Mycobacterium
EAAPGTLV

SEQ ID NO: 460768 - protein, 5 aa, Mycobacterium
EAAPH

SEQ ID NO: 460769 - protein, 6 aa, Mycobacterium
EAAPHA

SEQ ID NO: 460770 - protein, 7 aa, Mycobacterium
EAAPKKK

SEQ ID NO: 460771 - protein, 8 aa, Mycobacterium
EAAPPARA

SEQ ID NO: 460772 - protein, 82 aa, Mycobacterium
EAAPRQPDVPKPPPGPSPDVAPVTPPTGAGDGPVGPRQPQHSPKSAPVDPVQGGPGLGENLTPGPTWPPGAPDPAAPADPLT

SEQ ID NO: 460773 - protein, 8 aa, Mycobacterium
EAAPTAGL

SEQ ID NO: 460774 - protein, 6 aa, Mycobacterium
EAAPTL

SEQ ID NO: 460775 - protein, 12 aa, Mycobacterium
EAAPTPSPSTGV

SEQ ID NO: 460776 - protein, 6 aa, Mycobacterium
EAAPVG

SEQ ID NO: 460777 - protein, 18 aa, Mycobacterium
EAAPWADRKPAGWVRTDG

SEQ ID NO: 460778 - protein, 7 aa, Mycobacterium
EAAPYAA

SEQ ID NO: 460779 - protein, 7 aa, Mycobacterium
EAAPYAD

SEQ ID NO: 460780 - protein, 4 aa, Mycobacterium
EAAQ

SEQ ID NO: 460781 - protein, 10 aa, Mycobacterium
EAAQAAGSQV

SEQ ID NO: 460782 - protein, 9 aa, Mycobacterium
EAAQAGPIA

SEQ ID NO: 460783 - protein, 6 aa, Mycobacterium
EAAQAQ

SEQ ID NO: 460784 - protein, 6 aa, Mycobacterium
EAAQDM

SEQ ID NO: 460785 - protein, 12 aa, Mycobacterium
EAAQGAPQSHRS

SEQ ID NO: 460786 - protein, 11 aa, Mycobacterium
EAAQGGGPAGV

SEQ ID NO: 460787 - protein, 13 aa, Mycobacterium
EAAQKGKAYSEKI

SEQ ID NO: 460788 - protein, 30 aa, Mycobacterium
EAAQKGKGYSEKLEEKALSRGKTTQEKSSE

SEQ ID NO: 460789 - protein, 5 aa, Mycobacterium
EAAQQ

SEQ ID NO: 460790 - protein, 10 aa, Mycobacterium
EAAQQGRQAY

SEQ ID NO: 460791 - protein, 19 aa, Mycobacterium
EAAQQTFDTAPAIEDETGV

SEQ ID NO: 460792 - protein, 12 aa, Mycobacterium
EAAQRAANVDGT

SEQ ID NO: 460793 - protein, 8 aa, Mycobacterium
EAAQRDPE

SEQ ID NO: 460794 - protein, 10 aa, Mycobacterium
EAAQRGRGRG

SEQ ID NO: 460795 - protein, 10 aa, Mycobacterium
EAAQRGRQAY

SEQ ID NO: 460796 - protein, 6 aa, Mycobacterium
EAAQRI

SEQ ID NO: 460797 - protein, 8 aa, Mycobacterium
EAAQRTSR

SEQ ID NO: 460798 - protein, 9 aa, Mycobacterium
EAAQSTPQR

SEQ ID NO: 460799 - protein, 6 aa, Mycobacterium
EAAQTA

SEQ ID NO: 460800 - protein, 8 aa, Mycobacterium
EAAQTIPD

SEQ ID NO: 460801 - protein, 9 aa, Mycobacterium
EAAQVGSAR

SEQ ID NO: 460802 - protein, 7 aa, Mycobacterium
EAAQVSK

SEQ ID NO: 460803 - protein, 12 aa, Mycobacterium
EAARAAERGKQS

SEQ ID NO: 460804 - protein, 22 aa, Mycobacterium
EAARAEERQRWSDAGEFARKES

SEQ ID NO: 460805 - protein, 8 aa, Mycobacterium
EAARAGAQ

SEQ ID NO: 460806 - protein, 8 aa, Mycobacterium
EAARAKYG

SEQ ID NO: 460807 - protein, 7 aa, Mycobacterium
EAARARG

SEQ ID NO: 460808 - protein, 12 aa, Mycobacterium
EAARDEGLGGEV

SEQ ID NO: 460809 - protein, 6 aa, Mycobacterium
EAARDG

SEQ ID NO: 460810 - protein, 7 aa, Mycobacterium
EAARDNL

SEQ ID NO: 460811 - protein, 8 aa, Mycobacterium
EAARDPLQ

SEQ ID NO: 460812 - protein, 22 aa, Mycobacterium
EAARERRETRGCHNRSDHPDLD

SEQ ID NO: 460813 - protein, 5 aa, Mycobacterium
EAARG

SEQ ID NO: 460814 - protein, 8 aa, Mycobacterium
EAARGEGG

SEQ ID NO: 460815 - protein, 8 aa, Mycobacterium
EAARGGDL

SEQ ID NO: 460816 - protein, 9 aa, Mycobacterium
EAARGRGAI

SEQ ID NO: 460817 - protein, 10 aa, Mycobacterium
EAARNGRQAY

SEQ ID NO: 460818 - protein, 8 aa, Mycobacterium
EAARPEPA

SEQ ID NO: 460819 - protein, 10 aa, Mycobacterium
EAARPGNTLG

SEQ ID NO: 460820 - protein, 8 aa, Mycobacterium
EAARRGGE

SEQ ID NO: 460821 - protein, 10 aa, Mycobacterium
EAARRSPDAP

SEQ ID NO: 460822 - protein, 13 aa, Mycobacterium
EAARRYERSVDPA

SEQ ID NO: 460823 - protein, 12 aa, Mycobacterium
EAARSEAQSAAG

SEQ ID NO: 460824 - protein, 12 aa, Mycobacterium
EAARSLGRGTVG

SEQ ID NO: 460825 - protein, 23 aa, Mycobacterium
EAARTAPPRENGGNQDIKNLTKG

SEQ ID NO: 460826 - protein, 8 aa, Mycobacterium
EAARTKYG

SEQ ID NO: 460827 - protein, 12 aa, Mycobacterium
EAARVAGTGDPV

SEQ ID NO: 460828 - protein, 5 aa, Mycobacterium
EAARW

SEQ ID NO: 460829 - protein, 21 aa, Mycobacterium
EAASAARAALSGASEEAFGTG

SEQ ID NO: 460830 - protein, 8 aa, Mycobacterium
EAASANAL

SEQ ID NO: 460831 - protein, 10 aa, Mycobacterium
EAASAPADED

SEQ ID NO: 460832 - protein, 11 aa, Mycobacterium
EAASASPLQAA

SEQ ID NO: 460833 - protein, 20 aa, Mycobacterium
EAASASPLQAAASAAAGVQD

SEQ ID NO: 460834 - protein, 7 aa, Mycobacterium
EAASASR

SEQ ID NO: 460835 - protein, 8 aa, Mycobacterium
EAASDIDA

SEQ ID NO: 460836 - protein, 11 aa, Mycobacterium
EAASDSDENQV

SEQ ID NO: 460837 - protein, 6 aa, Mycobacterium
EAASHA

SEQ ID NO: 460838 - protein, 7 aa, Mycobacterium
EAASHAR

SEQ ID NO: 460839 - protein, 6 aa, Mycobacterium
EAASHG

SEQ ID NO: 460840 - protein, 7 aa, Mycobacterium
EAASPWA

SEQ ID NO: 460841 - protein, 5 aa, Mycobacterium
EAASQ

SEQ ID NO: 460842 - protein, 14 aa, Mycobacterium
EAASREAESAFGDP

SEQ ID NO: 460843 - protein, 13 aa, Mycobacterium
EAASRPGAPALPC

SEQ ID NO: 460844 - protein, 8 aa, Mycobacterium
EAASTAGK

SEQ ID NO: 460845 - protein, 9 aa, Mycobacterium
EAASTDEGW

SEQ ID NO: 460846 - protein, 9 aa, Mycobacterium
EAASTDQGW

SEQ ID NO: 460847 - protein, 9 aa, Mycobacterium
EAASTEDGW

SEQ ID NO: 460848 - protein, 9 aa, Mycobacterium
EAASTEEGW

SEQ ID NO: 460849 - protein, 16 aa, Mycobacterium
EAASVKRKSYADQPYW

SEQ ID NO: 460850 - protein, 21 aa, Mycobacterium
EAASVRSAPRSRSAGYQACTP

SEQ ID NO: 460851 - protein, 22 aa, Mycobacterium
EAASVRSIPRSKSAGYQSCTPE

SEQ ID NO: 460852 - protein, 5 aa, Mycobacterium
EAATA

SEQ ID NO: 460853 - protein, 8 aa, Mycobacterium
EAATAAVE

SEQ ID NO: 460854 - protein, 12 aa, Mycobacterium
EAATANTFPEVE

SEQ ID NO: 460855 - protein, 12 aa, Mycobacterium
EAATAPKAATVV

SEQ ID NO: 460856 - protein, 9 aa, Mycobacterium
EAATAQEAI

SEQ ID NO: 460857 - protein, 11 aa, Mycobacterium
EAATDDNEYRQ

SEQ ID NO: 460858 - protein, 8 aa, Mycobacterium
EAATDDRR

SEQ ID NO: 460859 - protein, 6 aa, Mycobacterium
EAATDQ

SEQ ID NO: 460860 - protein, 7 aa, Mycobacterium
EAATEDA

SEQ ID NO: 460861 - protein, 5 aa, Mycobacterium
EAATF

SEQ ID NO: 460862 - protein, 7 aa, Mycobacterium
EAATGAR

SEQ ID NO: 460863 - protein, 7 aa, Mycobacterium
EAATKHT

SEQ ID NO: 460864 - protein, 11 aa, Mycobacterium
EAATNPSADRA

SEQ ID NO: 460865 - protein, 12 aa, Mycobacterium
EAATPALDAGRA

SEQ ID NO: 460866 - protein, 7 aa, Mycobacterium
EAATPVL

SEQ ID NO: 460867 - protein, 11 aa, Mycobacterium
EAATQAEAERD

SEQ ID NO: 460868 - protein, 5 aa, Mycobacterium
EAATR

SEQ ID NO: 460869 - protein, 10 aa, Mycobacterium
EAATRARRDE

SEQ ID NO: 460870 - protein, 11 aa, Mycobacterium
EAATRGLGPID

SEQ ID NO: 460871 - protein, 8 aa, Mycobacterium
EAATRHSE

SEQ ID NO: 460872 - protein, 6 aa, Mycobacterium
EAATRP

SEQ ID NO: 460873 - protein, 6 aa, Mycobacterium
EAATRS

SEQ ID NO: 460874 - protein, 6 aa, Mycobacterium
EAATSA

SEQ ID NO: 460875 - protein, 5 aa, Mycobacterium
EAATT

SEQ ID NO: 460876 - protein, 6 aa, Mycobacterium
EAATVS

SEQ ID NO: 460877 - protein, 7 aa, Mycobacterium
EAAVADP

SEQ ID NO: 460878 - protein, 14 aa, Mycobacterium
EAAVDDAAARARAS

SEQ ID NO: 460879 - protein, 5 aa, Mycobacterium
EAAVT

SEQ ID NO: 460880 - protein, 5 aa, Mycobacterium
EAAYP

SEQ ID NO: 460881 - protein, 9 aa, Mycobacterium
EACEKGGAT

SEQ ID NO: 460882 - protein, 4 aa, Mycobacterium
EACG

SEQ ID NO: 460883 - protein, 17 aa, Mycobacterium
EACGPDSRFARITRAAG

SEQ ID NO: 460884 - protein, 5 aa, Mycobacterium
EACPT

SEQ ID NO: 460885 - protein, 7 aa, Mycobacterium
EACTPGY

SEQ ID NO: 460886 - protein, 17 aa, Mycobacterium
EADAADTAGENPAEDRA

SEQ ID NO: 460887 - protein, 9 aa, Mycobacterium
EADAAPARF

SEQ ID NO: 460888 - protein, 6 aa, Mycobacterium
EADAAY

SEQ ID NO: 460889 - protein, 7 aa, Mycobacterium
EADADED

SEQ ID NO: 460890 - protein, 8 aa, Mycobacterium
EADADGAC

SEQ ID NO: 460891 - protein, 7 aa, Mycobacterium
EADAELS

SEQ ID NO: 460892 - protein, 10 aa, Mycobacterium
EADAGARHVT

SEQ ID NO: 460893 - protein, 10 aa, Mycobacterium
EADAGGDELR

SEQ ID NO: 460894 - protein, 8 aa, Mycobacterium
EADALKAD

SEQ ID NO: 460895 - protein, 18 aa, Mycobacterium
EADAPAPDPVDGVGGATD

SEQ ID NO: 460896 - protein, 6 aa, Mycobacterium
EADARR

SEQ ID NO: 460897 - protein, 10 aa, Mycobacterium
EADATDSEDQ

SEQ ID NO: 460898 - protein, 9 aa, Mycobacterium
EADAVGAAS

SEQ ID NO: 460899 - protein, 6 aa, Mycobacterium
EADAYA

SEQ ID NO: 460900 - protein, 8 aa, Mycobacterium
EADDAAAA

SEQ ID NO: 460901 - protein, 10 aa, Mycobacterium
EADDAANYGG

SEQ ID NO: 460902 - protein, 7 aa, Mycobacterium
EADDDTV

SEQ ID NO: 460903 - protein, 7 aa, Mycobacterium
EADDEEA

SEQ ID NO: 460904 - protein, 24 aa, Mycobacterium
EADDEEAESDHDGYEEPLVDPLRS

SEQ ID NO: 460905 - protein, 10 aa, Mycobacterium
EADDENAVPQ

SEQ ID NO: 460906 - protein, 13 aa, Mycobacterium
EADDEQPTPPAIE

SEQ ID NO: 460907 - protein, 8 aa, Mycobacterium
EADDGAAA

SEQ ID NO: 460908 - protein, 8 aa, Mycobacterium
EADDGTAA

SEQ ID NO: 460909 - protein, 15 aa, Mycobacterium
EADDKEVLADDDTRY

SEQ ID NO: 460910 - protein, 11 aa, Mycobacterium
EADDLGRSQQE

SEQ ID NO: 460911 - protein, 10 aa, Mycobacterium
EADDPDESAL

SEQ ID NO: 460912 - protein, 18 aa, Mycobacterium
EADDQGGPAEAATARREA

SEQ ID NO: 460913 - protein, 6 aa, Mycobacterium
EADDRL

SEQ ID NO: 460914 - protein, 5 aa, Mycobacterium
EADDT

SEQ ID NO: 460915 - protein, 31 aa, Mycobacterium
EADDTEAVEIGGSGRNASRGRRAPGEPGRAV

SEQ ID NO: 460916 - protein, 31 aa, Mycobacterium
EADDTEAVEIGGSGRNASRGRRAQGAPGRAV

SEQ ID NO: 460917 - protein, 31 aa, Mycobacterium
EADDTESVEIGGSGRNSSRGRRAQGEPGRAV

SEQ ID NO: 460918 - protein, 31 aa, Mycobacterium
EADDTETVGVGGSGRNASRGRRAQGEPGRAV

SEQ ID NO: 460919 - protein, 11 aa, Mycobacterium
EADDVSEDSLE

SEQ ID NO: 460920 - protein, 14 aa, Mycobacterium
EADEARPQPARDTA

SEQ ID NO: 460921 - protein, 8 aa, Mycobacterium
EADEATRQ

SEQ ID NO: 460922 - protein, 6 aa, Mycobacterium
EADEGS

SEQ ID NO: 460923 - protein, 5 aa, Mycobacterium
EADEL

SEQ ID NO: 460924 - protein, 5 aa, Mycobacterium
EADER

SEQ ID NO: 460925 - protein, 6 aa, Mycobacterium
EADERT

SEQ ID NO: 460926 - protein, 17 aa, Mycobacterium
EADERVTESVARAADSG

SEQ ID NO: 460927 - protein, 5 aa, Mycobacterium
EADET

SEQ ID NO: 460928 - protein, 8 aa, Mycobacterium
EADETLPT

SEQ ID NO: 460929 - protein, 5 aa, Mycobacterium
EADEV

SEQ ID NO: 460930 - protein, 5 aa, Mycobacterium
EADGA

SEQ ID NO: 460931 - protein, 13 aa, Mycobacterium
EADGAGEGGNELR

SEQ ID NO: 460932 - protein, 43 aa, Mycobacterium
EADGAPTGEAIQQKKKKAPKKAEAAEAEAPAEEPAAESADAAS

SEQ ID NO: 460933 - protein, 8 aa, Mycobacterium
EADGARSR

SEQ ID NO: 460934 - protein, 8 aa, Mycobacterium
EADGATLD

SEQ ID NO: 460935 - protein, 7 aa, Mycobacterium
EADGHRP

SEQ ID NO: 460936 - protein, 21 aa, Mycobacterium
EADGPDDEGAPMPSAEDLTSA

SEQ ID NO: 460937 - protein, 6 aa, Mycobacterium
EADGRV

SEQ ID NO: 460938 - protein, 9 aa, Mycobacterium
EADGSQRYR

SEQ ID NO: 460939 - protein, 9 aa, Mycobacterium
EADGTEREG

SEQ ID NO: 460940 - protein, 7 aa, Mycobacterium
EADGTVT

SEQ ID NO: 460941 - protein, 6 aa, Mycobacterium
EADGVA

SEQ ID NO: 460942 - protein, 14 aa, Mycobacterium
EADHERTNVRGSGI

SEQ ID NO: 460943 - protein, 14 aa, Mycobacterium
EADKATGPTAAAVP

SEQ ID NO: 460944 - protein, 5 aa, Mycobacterium
EADKE

SEQ ID NO: 460945 - protein, 4 aa, Mycobacterium
EADL

SEQ ID NO: 460946 - protein, 7 aa, Mycobacterium
EADLDES

SEQ ID NO: 460947 - protein, 15 aa, Mycobacterium
EADLDTARSSGTPEA

SEQ ID NO: 460948 - protein, 5 aa, Mycobacterium
EADLG

SEQ ID NO: 460949 - protein, 7 aa, Mycobacterium
EADLGGT

SEQ ID NO: 460950 - protein, 6 aa, Mycobacterium
EADLRR

SEQ ID NO: 460951 - protein, 5 aa, Mycobacterium
EADLS

SEQ ID NO: 460952 - protein, 11 aa, Mycobacterium
EADMGGGDQWP

SEQ ID NO: 460953 - protein, 10 aa, Mycobacterium
EADNDGQELR

SEQ ID NO: 460954 - protein, 26 aa, Mycobacterium
EADNDRTAAGRRHAAAAAAARPQAAV

SEQ ID NO: 460955 - protein, 8 aa, Mycobacterium
EADNGADA

SEQ ID NO: 460956 - protein, 26 aa, Mycobacterium
EADNPSEPRGRSRPDDFSLRIGSLKG

SEQ ID NO: 460957 - protein, 8 aa, Mycobacterium
EADNQAVE

SEQ ID NO: 460958 - protein, 6 aa, Mycobacterium
EADNRG

SEQ ID NO: 460959 - protein, 6 aa, Mycobacterium
EADNYG

SEQ ID NO: 460960 - protein, 6 aa, Mycobacterium
EADPAA

SEQ ID NO: 460961 - protein, 16 aa, Mycobacterium
EADPAAATIIVIPAIE

SEQ ID NO: 460962 - protein, 16 aa, Mycobacterium
EADPAAATIIVIPALD

SEQ ID NO: 460963 - protein, 16 aa, Mycobacterium
EADPAAATIIVIPALE

SEQ ID NO: 460964 - protein, 6 aa, Mycobacterium
EADPAG

SEQ ID NO: 460965 - protein, 8 aa, Mycobacterium
EADPAPFA

SEQ ID NO: 460966 - protein, 7 aa, Mycobacterium
EADPAQR

SEQ ID NO: 460967 - protein, 9 aa, Mycobacterium
EADPAYTAE

SEQ ID NO: 460968 - protein, 5 aa, Mycobacterium
EADPD

SEQ ID NO: 460969 - protein, 9 aa, Mycobacterium
EADPDAVAA

SEQ ID NO: 460970 - protein, 14 aa, Mycobacterium
EADPDDSTGQIAED

SEQ ID NO: 460971 - protein, 8 aa, Mycobacterium
EADPDGFA

SEQ ID NO: 460972 - protein, 6 aa, Mycobacterium
EADPDL

SEQ ID NO: 460973 - protein, 10 aa, Mycobacterium
EADPDRVNVN

SEQ ID NO: 460974 - protein, 22 aa, Mycobacterium
EADPDSPAAAKGCRHDCVVFSA

SEQ ID NO: 460975 - protein, 21 aa, Mycobacterium
EADPDSPGAAKGCLHDCVVFS

SEQ ID NO: 460976 - protein, 8 aa, Mycobacterium
EADPDTFA

SEQ ID NO: 460977 - protein, 9 aa, Mycobacterium
EADPEGVSA

SEQ ID NO: 460978 - protein, 7 aa, Mycobacterium
EADPERP

SEQ ID NO: 460979 - protein, 24 aa, Mycobacterium
EADPETASDSGSDVSAASATASHH

SEQ ID NO: 460980 - protein, 8 aa, Mycobacterium
EADPFSVD

SEQ ID NO: 460981 - protein, 9 aa, Mycobacterium
EADPGGRGV

SEQ ID NO: 460982 - protein, 6 aa, Mycobacterium
EADPGR

SEQ ID NO: 460983 - protein, 7 aa, Mycobacterium
EADPLSG

SEQ ID NO: 460984 - protein, 14 aa, Mycobacterium
EADPPGSGTPPRVD

SEQ ID NO: 460985 - protein, 15 aa, Mycobacterium
EADPPPAQEYTPMSA

SEQ ID NO: 460986 - protein, 7 aa, Mycobacterium
EADPQLA

SEQ ID NO: 460987 - protein, 7 aa, Mycobacterium
EADPQPW

SEQ ID NO: 460988 - protein, 7 aa, Mycobacterium
EADPQRP

SEQ ID NO: 460989 - protein, 5 aa, Mycobacterium
EADPR

SEQ ID NO: 460990 - protein, 9 aa, Mycobacterium
EADPRKHQG

SEQ ID NO: 460991 - protein, 13 aa, Mycobacterium
EADPRRPATVESR

SEQ ID NO: 460992 - protein, 7 aa, Mycobacterium
EADPSAD

SEQ ID NO: 460993 - protein, 6 aa, Mycobacterium
EADPSI

SEQ ID NO: 460994 - protein, 7 aa, Mycobacterium
EADPTGI

SEQ ID NO: 460995 - protein, 10 aa, Mycobacterium
EADPVPAKAG

SEQ ID NO: 460996 - protein, 4 aa, Mycobacterium
EADQ

SEQ ID NO: 460997 - protein, 18 aa, Mycobacterium
EADQAGVPPLPRAERAHN

SEQ ID NO: 460998 - protein, 20 aa, Mycobacterium
EADQAGVSPPPRAERPHNYD

SEQ ID NO: 460999 - protein, 11 aa, Mycobacterium
EADQEKIRDRS

SEQ ID NO: 461000 - protein, 20 aa, Mycobacterium
EADQEPCTTEKCNELPWPSA

SEQ ID NO: 461001 - protein, 9 aa, Mycobacterium
EADQSPGVR

SEQ ID NO: 461002 - protein, 5 aa, Mycobacterium
EADRA

SEQ ID NO: 461003 - protein, 6 aa, Mycobacterium
EADRAQ

SEQ ID NO: 461004 - protein, 7 aa, Mycobacterium
EADRAQF

SEQ ID NO: 461005 - protein, 22 aa, Mycobacterium
EADRATGAVTDIGRGRHTSTQS

SEQ ID NO: 461006 - protein, 5 aa, Mycobacterium
EADRC

SEQ ID NO: 461007 - protein, 5 aa, Mycobacterium
EADRD

SEQ ID NO: 461008 - protein, 7 aa, Mycobacterium
EADRERV

SEQ ID NO: 461009 - protein, 9 aa, Mycobacterium
EADRGGRAL

SEQ ID NO: 461010 - protein, 9 aa, Mycobacterium
EADRGTPDR

SEQ ID NO: 461011 - protein, 8 aa, Mycobacterium
EADRPSLA

SEQ ID NO: 461012 - protein, 14 aa, Mycobacterium
EADRPTTGIPDEVT

SEQ ID NO: 461013 - protein, 6 aa, Mycobacterium
EADRQH

SEQ ID NO: 461014 - protein, 7 aa, Mycobacterium
EADRRGY

SEQ ID NO: 461015 - protein, 8 aa, Mycobacterium
EADSDRDR

SEQ ID NO: 461016 - protein, 5 aa, Mycobacterium
EADSG

SEQ ID NO: 461017 - protein, 18 aa, Mycobacterium
EADSLRDTIKNGKGQKKL

SEQ ID NO: 461018 - protein, 8 aa, Mycobacterium
EADSRRVE

SEQ ID NO: 461019 - protein, 10 aa, Mycobacterium
EADSSARIGT

SEQ ID NO: 461020 - protein, 5 aa, Mycobacterium
EADTA

SEQ ID NO: 461021 - protein, 13 aa, Mycobacterium
EADTAAAVAVLEE

SEQ ID NO: 461022 - protein, 9 aa, Mycobacterium
EADTAGGRI

SEQ ID NO: 461023 - protein, 13 aa, Mycobacterium
EADTCGDGRTRGQ

SEQ ID NO: 461024 - protein, 5 aa, Mycobacterium
EADTD

SEQ ID NO: 461025 - protein, 9 aa, Mycobacterium
EADTDDNEL

SEQ ID NO: 461026 - protein, 15 aa, Mycobacterium
EADTDGLSADQQQAV

SEQ ID NO: 461027 - protein, 13 aa, Mycobacterium
EADTGEPGEEYDE

SEQ ID NO: 461028 - protein, 6 aa, Mycobacterium
EADTGW

SEQ ID NO: 461029 - protein, 5 aa, Mycobacterium
EADTQ

SEQ ID NO: 461030 - protein, 12 aa, Mycobacterium
EADWQSASPLPG

SEQ ID NO: 461031 - protein, 7 aa, Mycobacterium
EAEAAPV

SEQ ID NO: 461032 - protein, 9 aa, Mycobacterium
EAEAAQRRS

SEQ ID NO: 461033 - protein, 14 aa, Mycobacterium
EAEADAIERKYQRG

SEQ ID NO: 461034 - protein, 6 aa, Mycobacterium
EAEADV

SEQ ID NO: 461035 - protein, 13 aa, Mycobacterium
EAEAEAAERKRDE

SEQ ID NO: 461036 - protein, 15 aa, Mycobacterium
EAEAEFPRAAHGDQA

SEQ ID NO: 461037 - protein, 7 aa, Mycobacterium
EAEAESM

SEQ ID NO: 461038 - protein, 6 aa, Mycobacterium
EAEAGA

SEQ ID NO: 461039 - protein, 7 aa, Mycobacterium
EAEAGGA

SEQ ID NO: 461040 - protein, 9 aa, Mycobacterium
EAEANLGPK

SEQ ID NO: 461041 - protein, 8 aa, Mycobacterium
EAEARAAG

SEQ ID NO: 461042 - protein, 8 aa, Mycobacterium
EAEARAQI

SEQ ID NO: 461043 - protein, 8 aa, Mycobacterium
EAEARARA

SEQ ID NO: 461044 - protein, 8 aa, Mycobacterium
EAEARGAN

SEQ ID NO: 461045 - protein, 11 aa, Mycobacterium
EAEARLAEQPR

SEQ ID NO: 461046 - protein, 9 aa, Mycobacterium
EAEARRARR

SEQ ID NO: 461047 - protein, 10 aa, Mycobacterium
EAEASPPSAF

SEQ ID NO: 461048 - protein, 8 aa, Mycobacterium
EAEASPSR

SEQ ID NO: 461049 - protein, 5 aa, Mycobacterium
EAEAT

SEQ ID NO: 461050 - protein, 13 aa, Mycobacterium
EAEATDYRPSLGQ

SEQ ID NO: 461051 - protein, 18 aa, Mycobacterium
EAEATPVADAVRSSTDPM

SEQ ID NO: 461052 - protein, 16 aa, Mycobacterium
EAEAVAEQSDGDKDPV

SEQ ID NO: 461053 - protein, 6 aa, Mycobacterium
EAEAVE

SEQ ID NO: 461054 - protein, 6 aa, Mycobacterium
EAEAVG

SEQ ID NO: 461055 - protein, 4 aa, Mycobacterium
EAED

SEQ ID NO: 461056 - protein, 10 aa, Mycobacterium
EAEDAAAPPP

SEQ ID NO: 461057 - protein, 8 aa, Mycobacterium
EAEDGSAA

SEQ ID NO: 461058 - protein, 31 aa, Mycobacterium
EAEDTEEVAVGGSGRNSSRGRRAQGEPGRAV

SEQ ID NO: 461059 - protein, 13 aa, Mycobacterium
EAEDTLTGSTDEL

SEQ ID NO: 461060 - protein, 13 aa, Mycobacterium
EAEDVPPAPEGLD

SEQ ID NO: 461061 - protein, 7 aa, Mycobacterium
EAEEAAE

SEQ ID NO: 461062 - protein, 9 aa, Mycobacterium
EAEEGDWPS

SEQ ID NO: 461063 - protein, 17 aa, Mycobacterium
EAEEGKAPAGRTPDLPG

SEQ ID NO: 461064 - protein, 8 aa, Mycobacterium
EAEENGEL

SEQ ID NO: 461065 - protein, 7 aa, Mycobacterium
EAEERSA

SEQ ID NO: 461066 - protein, 7 aa, Mycobacterium
EAEETWQ

SEQ ID NO: 461067 - protein, 6 aa, Mycobacterium
EAEFAS

SEQ ID NO: 461068 - protein, 9 aa, Mycobacterium
EAEGAGEHC

SEQ ID NO: 461069 - protein, 21 aa, Mycobacterium
EAEGAKADARRKVRDGGEREM

SEQ ID NO: 461070 - protein, 21 aa, Mycobacterium
EAEGAKADARRKVRDSGEREM

SEQ ID NO: 461071 - protein, 10 aa, Mycobacterium
EAEGASQSGM

SEQ ID NO: 461072 - protein, 7 aa, Mycobacterium
EAEGDFD

SEQ ID NO: 461073 - protein, 6 aa, Mycobacterium
EAEGEV

SEQ ID NO: 461074 - protein, 58 aa, Mycobacterium
EAEGGPSTEATTPKKKKAPAKKDEQPTEKAAEPAAEKAAEPAAEAPAEAAAESEAPAA

SEQ ID NO: 461075 - protein, 60 aa, Mycobacterium
EAEGGPTTEAAKPKKKAPAKKAAKAAEPEAAAEAPAETAPEAAPAEATAEGGEQAAPGAE

SEQ ID NO: 461076 - protein, 61 aa, Mycobacterium
EAEGGPTTEAAKPKKKSPAKKTAKAAEGESKAESEGAAQTAETKPAEAPTEGGEQAESTTE

SEQ ID NO: 461077 - protein, 9 aa, Mycobacterium
EAEGHGAGH

SEQ ID NO: 461078 - protein, 5 aa, Mycobacterium
EAEGP

SEQ ID NO: 461079 - protein, 5 aa, Mycobacterium
EAEGR

SEQ ID NO: 461080 - protein, 9 aa, Mycobacterium
EAEGRGKAR

SEQ ID NO: 461081 - protein, 6 aa, Mycobacterium
EAEGRK

SEQ ID NO: 461082 - protein, 8 aa, Mycobacterium
EAEGSPSR

SEQ ID NO: 461083 - protein, 6 aa, Mycobacterium
EAEGTV

SEQ ID NO: 461084 - protein, 5 aa, Mycobacterium
EAEGY

SEQ ID NO: 461085 - protein, 6 aa, Mycobacterium
EAEGYG

SEQ ID NO: 461086 - protein, 10 aa, Mycobacterium
EAEHGPPGAR

SEQ ID NO: 461087 - protein, 7 aa, Mycobacterium
EAEHGRR

SEQ ID NO: 461088 - protein, 5 aa, Mycobacterium
EAEHH

SEQ ID NO: 461089 - protein, 6 aa, Mycobacterium
EAEKAA

SEQ ID NO: 461090 - protein, 7 aa, Mycobacterium
EAEKAKR

SEQ ID NO: 461091 - protein, 8 aa, Mycobacterium
EAEKEDLR

SEQ ID NO: 461092 - protein, 6 aa, Mycobacterium
EAEKLD

SEQ ID NO: 461093 - protein, 26 aa, Mycobacterium
EAEKPSITQTSAGEPTPLAETTLTPA

SEQ ID NO: 461094 - protein, 10 aa, Mycobacterium
EAEKPSRVGE

SEQ ID NO: 461095 - protein, 5 aa, Mycobacterium
EAEKR

SEQ ID NO: 461096 - protein, 11 aa, Mycobacterium
EAEKSGYSPQV

SEQ ID NO: 461097 - protein, 15 aa, Mycobacterium
EAELDGRTEVGLPPA

SEQ ID NO: 461098 - protein, 7 aa, Mycobacterium
EAELDKQ

SEQ ID NO: 461099 - protein, 7 aa, Mycobacterium
EAELPED

SEQ ID NO: 461100 - protein, 7 aa, Mycobacterium
EAELRAS

SEQ ID NO: 461101 - protein, 8 aa, Mycobacterium
EAELRRGR

SEQ ID NO: 461102 - protein, 14 aa, Mycobacterium
EAELTARSEVGLPP

SEQ ID NO: 461103 - protein, 6 aa, Mycobacterium
EAENDV

SEQ ID NO: 461104 - protein, 4 aa, Mycobacterium
EAEP

SEQ ID NO: 461105 - protein, 6 aa, Mycobacterium
EAEPDR

SEQ ID NO: 461106 - protein, 7 aa, Mycobacterium
EAEPFPD

SEQ ID NO: 461107 - protein, 6 aa, Mycobacterium
EAEPGG

SEQ ID NO: 461108 - protein, 7 aa, Mycobacterium
EAEPGRP

SEQ ID NO: 461109 - protein, 5 aa, Mycobacterium
EAEPI

SEQ ID NO: 461110 - protein, 5 aa, Mycobacterium
EAEPQ

SEQ ID NO: 461111 - protein, 5 aa, Mycobacterium
EAEPR

SEQ ID NO: 461112 - protein, 19 aa, Mycobacterium
EAEPRAIGRGYGPRADGFH

SEQ ID NO: 461113 - protein, 7 aa, Mycobacterium
EAEPTGV

SEQ ID NO: 461114 - protein, 8 aa, Mycobacterium
EAEQDDFT

SEQ ID NO: 461115 - protein, 13 aa, Mycobacterium
EAEQEQLQSYITQ

SEQ ID NO: 461116 - protein, 8 aa, Mycobacterium
EAEQIATT

SEQ ID NO: 461117 - protein, 10 aa, Mycobacterium
EAEQKGTGRW

SEQ ID NO: 461118 - protein, 9 aa, Mycobacterium
EAEQRGDQR

SEQ ID NO: 461119 - protein, 6 aa, Mycobacterium
EAEQRI

SEQ ID NO: 461120 - protein, 28 aa, Mycobacterium
EAEQRRSDASERESEFPQRREVGRGRAG

SEQ ID NO: 461121 - protein, 6 aa, Mycobacterium
EAEQTH

SEQ ID NO: 461122 - protein, 9 aa, Mycobacterium
EAERARGYR

SEQ ID NO: 461123 - protein, 11 aa, Mycobacterium
EAERDATACEQ

SEQ ID NO: 461124 - protein, 18 aa, Mycobacterium
EAERDGTDVDKAIMAAAH

SEQ ID NO: 461125 - protein, 10 aa, Mycobacterium
EAERDKGGKV

SEQ ID NO: 461126 - protein, 7 aa, Mycobacterium
EAEREEL

SEQ ID NO: 461127 - protein, 8 aa, Mycobacterium
EAEREERE

SEQ ID NO: 461128 - protein, 6 aa, Mycobacterium
EAEREG

SEQ ID NO: 461129 - protein, 5 aa, Mycobacterium
EAERG

SEQ ID NO: 461130 - protein, 5 aa, Mycobacterium
EAERH

SEQ ID NO: 461131 - protein, 16 aa, Mycobacterium
EAERPDPGLTAEELCQ

SEQ ID NO: 461132 - protein, 23 aa, Mycobacterium
EAERPEAAAYAAATGGTIEPLPQ

SEQ ID NO: 461133 - protein, 8 aa, Mycobacterium
EAERRPAA

SEQ ID NO: 461134 - protein, 7 aa, Mycobacterium
EAERRPL

SEQ ID NO: 461135 - protein, 7 aa, Mycobacterium
EAERRPV

SEQ ID NO: 461136 - protein, 7 aa, Mycobacterium
EAERTDR

SEQ ID NO: 461137 - protein, 8 aa, Mycobacterium
EAERTGRG

SEQ ID NO: 461138 - protein, 7 aa, Mycobacterium
EAERTRR

SEQ ID NO: 461139 - protein, 5 aa, Mycobacterium
EAESG

SEQ ID NO: 461140 - protein, 44 aa, Mycobacterium
EAESGTTAAATTPKKKKAPKKDEAAEAPAEAAEAPAEAADAASE

SEQ ID NO: 461141 - protein, 13 aa, Mycobacterium
EAESRAQTHGGLS

SEQ ID NO: 461142 - protein, 9 aa, Mycobacterium
EAESRRARR

SEQ ID NO: 461143 - protein, 6 aa, Mycobacterium
EAESRV

SEQ ID NO: 461144 - protein, 13 aa, Mycobacterium
EAESTAIRAGTPD

SEQ ID NO: 461145 - protein, 9 aa, Mycobacterium
EAESYTTAA

SEQ ID NO: 461146 - protein, 7 aa, Mycobacterium
EAETAAV

SEQ ID NO: 461147 - protein, 5 aa, Mycobacterium
EAETE

SEQ ID NO: 461148 - protein, 12 aa, Mycobacterium
EAETNPDSPTWR

SEQ ID NO: 461149 - protein, 8 aa, Mycobacterium
EAETNSFA

SEQ ID NO: 461150 - protein, 13 aa, Mycobacterium
EAETREAVASFKT

SEQ ID NO: 461151 - protein, 13 aa, Mycobacterium
EAETTRLPSGEEQ

SEQ ID NO: 461152 - protein, 11 aa, Mycobacterium
EAEVKNDRGMV

SEQ ID NO: 461153 - protein, 14 aa, Mycobacterium
EAEVQEKDADGYPK

SEQ ID NO: 461154 - protein, 17 aa, Mycobacterium
EAEVQRSVERFKEHRQR

SEQ ID NO: 461155 - protein, 5 aa, Mycobacterium
EAEVR

SEQ ID NO: 461156 - protein, 10 aa, Mycobacterium
EAEYTSDEDL

SEQ ID NO: 461157 - protein, 20 aa, Mycobacterium
EAFAPAQRPRGKSVIRVIEE

SEQ ID NO: 461158 - protein, 9 aa, Mycobacterium
EAFATPGYR

SEQ ID NO: 461159 - protein, 17 aa, Mycobacterium
EAFDNGPWPQMSPTERA

SEQ ID NO: 461160 - protein, 4 aa, Mycobacterium
EAFE

SEQ ID NO: 461161 - protein, 5 aa, Mycobacterium
EAFGA

SEQ ID NO: 461162 - protein, 5 aa, Mycobacterium
EAFGE

SEQ ID NO: 461163 - protein, 13 aa, Mycobacterium
EAFGEEETEDTGI

SEQ ID NO: 461164 - protein, 6 aa, Mycobacterium
EAFGEP

SEQ ID NO: 461165 - protein, 10 aa, Mycobacterium
EAFGPDTRNG

SEQ ID NO: 461166 - protein, 14 aa, Mycobacterium
EAFGTQKRQRGMDR

SEQ ID NO: 461167 - protein, 6 aa, Mycobacterium
EAFPPA

SEQ ID NO: 461168 - protein, 8 aa, Mycobacterium
EAFRADPA

SEQ ID NO: 461169 - protein, 8 aa, Mycobacterium
EAFRNSAG

SEQ ID NO: 461170 - protein, 4 aa, Mycobacterium
EAFS

SEQ ID NO: 461171 - protein, 10 aa, Mycobacterium
EAFSKTAAEA

SEQ ID NO: 461172 - protein, 7 aa, Mycobacterium
EAFSSAR

SEQ ID NO: 461173 - protein, 8 aa, Mycobacterium
EAFSSSRG

SEQ ID NO: 461174 - protein, 4 aa, Mycobacterium
EAGA

SEQ ID NO: 461175 - protein, 12 aa, Mycobacterium
EAGAAAAAPTTA

SEQ ID NO: 461176 - protein, 6 aa, Mycobacterium
EAGAAQ

SEQ ID NO: 461177 - protein, 23 aa, Mycobacterium
EAGAARRTIEREAQAAGREIEPD

SEQ ID NO: 461178 - protein, 15 aa, Mycobacterium
EAGAAYAAAEAANVS

SEQ ID NO: 461179 - protein, 5 aa, Mycobacterium
EAGAD

SEQ ID NO: 461180 - protein, 9 aa, Mycobacterium
EAGADKLAD

SEQ ID NO: 461181 - protein, 25 aa, Mycobacterium
EAGADTRTPATALSDGVRVSLKKAA

SEQ ID NO: 461182 - protein, 5 aa, Mycobacterium
EAGAE

SEQ ID NO: 461183 - protein, 7 aa, Mycobacterium
EAGAEAM

SEQ ID NO: 461184 - protein, 10 aa, Mycobacterium
EAGAEASTVR

SEQ ID NO: 461185 - protein, 7 aa, Mycobacterium
EAGAEPM

SEQ ID NO: 461186 - protein, 9 aa, Mycobacterium
EAGAGPDQI

SEQ ID NO: 461187 - protein, 6 aa, Mycobacterium
EAGAGR

SEQ ID NO: 461188 - protein, 22 aa, Mycobacterium
EAGAGYQQKESASAQAMREVGG

SEQ ID NO: 461189 - protein, 7 aa, Mycobacterium
EAGANGV

SEQ ID NO: 461190 - protein, 7 aa, Mycobacterium
EAGANPM

SEQ ID NO: 461191 - protein, 6 aa, Mycobacterium
EAGANW

SEQ ID NO: 461192 - protein, 10 aa, Mycobacterium
EAGAQPGTVR

SEQ ID NO: 461193 - protein, 7 aa, Mycobacterium
EAGAQPM

SEQ ID NO: 461194 - protein, 6 aa, Mycobacterium
EAGAQT

SEQ ID NO: 461195 - protein, 5 aa, Mycobacterium
EAGAR

SEQ ID NO: 461196 - protein, 8 aa, Mycobacterium
EAGARKVE

SEQ ID NO: 461197 - protein, 15 aa, Mycobacterium
EAGARTPSRLQPRQA

SEQ ID NO: 461198 - protein, 8 aa, Mycobacterium
EAGASIGD

SEQ ID NO: 461199 - protein, 21 aa, Mycobacterium
EAGASSVRGKSVGDREKTAQR

SEQ ID NO: 461200 - protein, 8 aa, Mycobacterium
EAGASTPN

SEQ ID NO: 461201 - protein, 10 aa, Mycobacterium
EAGASVDAAA

SEQ ID NO: 461202 - protein, 11 aa, Mycobacterium
EAGASVYSASA

SEQ ID NO: 461203 - protein, 10 aa, Mycobacterium
EAGASYASAE

SEQ ID NO: 461204 - protein, 9 aa, Mycobacterium
EAGATGTRV

SEQ ID NO: 461205 - protein, 7 aa, Mycobacterium
EAGATIG

SEQ ID NO: 461206 - protein, 8 aa, Mycobacterium
EAGATIGD

SEQ ID NO: 461207 - protein, 8 aa, Mycobacterium
EAGATMDP

SEQ ID NO: 461208 - protein, 7 aa, Mycobacterium
EAGATPS

SEQ ID NO: 461209 - protein, 7 aa, Mycobacterium
EAGATSV

SEQ ID NO: 461210 - protein, 9 aa, Mycobacterium
EAGATVGDA

SEQ ID NO: 461211 - protein, 5 aa, Mycobacterium
EAGAV

SEQ ID NO: 461212 - protein, 6 aa, Mycobacterium
EAGAVT

SEQ ID NO: 461213 - protein, 9 aa, Mycobacterium
EAGDADTVV

SEQ ID NO: 461214 - protein, 9 aa, Mycobacterium
EAGDEPETL

SEQ ID NO: 461215 - protein, 8 aa, Mycobacterium
EAGDESWG

SEQ ID NO: 461216 - protein, 6 aa, Mycobacterium
EAGDGD

SEQ ID NO: 461217 - protein, 7 aa, Mycobacterium
EAGDGDP

SEQ ID NO: 461218 - protein, 16 aa, Mycobacterium
EAGDGGDAGQPRVTDA

SEQ ID NO: 461219 - protein, 7 aa, Mycobacterium
EAGDGPP

SEQ ID NO: 461220 - protein, 8 aa, Mycobacterium
EAGDGQEA

SEQ ID NO: 461221 - protein, 12 aa, Mycobacterium
EAGDPDPEESAR

SEQ ID NO: 461222 - protein, 19 aa, Mycobacterium
EAGDPEKADSADAVRERAG

SEQ ID NO: 461223 - protein, 8 aa, Mycobacterium
EAGDPSWG

SEQ ID NO: 461224 - protein, 9 aa, Mycobacterium
EAGDPTGKR

SEQ ID NO: 461225 - protein, 9 aa, Mycobacterium
EAGDQLTEE

SEQ ID NO: 461226 - protein, 14 aa, Mycobacterium
EAGDSEGAGRAARD

SEQ ID NO: 461227 - protein, 15 aa, Mycobacterium
EAGDVSVQGTAEEIA

SEQ ID NO: 461228 - protein, 4 aa, Mycobacterium
EAGE

SEQ ID NO: 461229 - protein, 58 aa, Mycobacterium
EAGEAAPAAPAPAPAPAAAPAPEPTPAPAPEATATAAPEPAAEPPAAAAPAGSGTSVK

SEQ ID NO: 461230 - protein, 7 aa, Mycobacterium
EAGEADG

SEQ ID NO: 461231 - protein, 6 aa, Mycobacterium
EAGEAG

SEQ ID NO: 461232 - protein, 17 aa, Mycobacterium
EAGEAPATAKGEAVKGD

SEQ ID NO: 461233 - protein, 60 aa, Mycobacterium
EAGEASAEAPSEDSAPAPEPEPEPEPEPQQTQPTAAPAESVESAPAESSAPSQGGGSATP

SEQ ID NO: 461234 - protein, 7 aa, Mycobacterium
EAGEDGA

SEQ ID NO: 461235 - protein, 9 aa, Mycobacterium
EAGEDTEDL

SEQ ID NO: 461236 - protein, 6 aa, Mycobacterium
EAGEGE

SEQ ID NO: 461237 - protein, 11 aa, Mycobacterium
EAGEGPDSERM

SEQ ID NO: 461238 - protein, 8 aa, Mycobacterium
EAGEKAGL

SEQ ID NO: 461239 - protein, 7 aa, Mycobacterium
EAGELDT

SEQ ID NO: 461240 - protein, 7 aa, Mycobacterium
EAGELTA

SEQ ID NO: 461241 - protein, 8 aa, Mycobacterium
EAGEPSLE

SEQ ID NO: 461242 - protein, 8 aa, Mycobacterium
EAGEPVTG

SEQ ID NO: 461243 - protein, 5 aa, Mycobacterium
EAGER

SEQ ID NO: 461244 - protein, 9 aa, Mycobacterium
EAGERATGL

SEQ ID NO: 461245 - protein, 7 aa, Mycobacterium
EAGERGA

SEQ ID NO: 461246 - protein, 8 aa, Mycobacterium
EAGERGNP

SEQ ID NO: 461247 - protein, 18 aa, Mycobacterium
EAGERTPQKNAGSRWNAG

SEQ ID NO: 461248 - protein, 11 aa, Mycobacterium
EAGERTPRKNE

SEQ ID NO: 461249 - protein, 16 aa, Mycobacterium
EAGERTPRKNEYSRWN

SEQ ID NO: 461250 - protein, 5 aa, Mycobacterium
EAGES

SEQ ID NO: 461251 - protein, 11 aa, Mycobacterium
EAGESAPPRVE

SEQ ID NO: 461252 - protein, 11 aa, Mycobacterium
EAGESERRRTL

SEQ ID NO: 461253 - protein, 8 aa, Mycobacterium
EAGETAIG

SEQ ID NO: 461254 - protein, 9 aa, Mycobacterium
EAGETAQQI

SEQ ID NO: 461255 - protein, 4 aa, Mycobacterium
EAGF

SEQ ID NO: 461256 - protein, 17 aa, Mycobacterium
EAGFDKATRERLTERDF

SEQ ID NO: 461257 - protein, 6 aa, Mycobacterium
EAGFKD

SEQ ID NO: 461258 - protein, 30 aa, Mycobacterium
EAGGAGRKPPGVAETGGAHRIESARAGKLT

SEQ ID NO: 461259 - protein, 9 aa, Mycobacterium
EAGGDGRVP

SEQ ID NO: 461260 - protein, 8 aa, Mycobacterium
EAGGELSP

SEQ ID NO: 461261 - protein, 7 aa, Mycobacterium
EAGGGRP

SEQ ID NO: 461262 - protein, 21 aa, Mycobacterium
EAGGGSDAGATKTTAKSDGAS

SEQ ID NO: 461263 - protein, 18 aa, Mycobacterium
EAGGGSDAGATKTTARLD

SEQ ID NO: 461264 - protein, 5 aa, Mycobacterium
EAGGK

SEQ ID NO: 461265 - protein, 10 aa, Mycobacterium
EAGGKAVAAG

SEQ ID NO: 461266 - protein, 5 aa, Mycobacterium
EAGGN

SEQ ID NO: 461267 - protein, 6 aa, Mycobacterium
EAGGND

SEQ ID NO: 461268 - protein, 13 aa, Mycobacterium
EAGGNGGGGGAGG

SEQ ID NO: 461269 - protein, 14 aa, Mycobacterium
EAGGPDEVAEADAE

SEQ ID NO: 461270 - protein, 9 aa, Mycobacterium
EAGGPPQPV

SEQ ID NO: 461271 - protein, 11 aa, Mycobacterium
EAGGPSVEEST

SEQ ID NO: 461272 - protein, 8 aa, Mycobacterium
EAGGPVRL

SEQ ID NO: 461273 - protein, 7 aa, Mycobacterium
EAGGRIA

SEQ ID NO: 461274 - protein, 6 aa, Mycobacterium
EAGGRR

SEQ ID NO: 461275 - protein, 8 aa, Mycobacterium
EAGGSSGL

SEQ ID NO: 461276 - protein, 6 aa, Mycobacterium
EAGGVT

SEQ ID NO: 461277 - protein, 10 aa, Mycobacterium
EAGGWDAEYP

SEQ ID NO: 461278 - protein, 4 aa, Mycobacterium
EAGH

SEQ ID NO: 461279 - protein, 8 aa, Mycobacterium
EAGHRNAE

SEQ ID NO: 461280 - protein, 9 aa, Mycobacterium
EAGIGPEDV

SEQ ID NO: 461281 - protein, 5 aa, Mycobacterium
EAGIS

SEQ ID NO: 461282 - protein, 11 aa, Mycobacterium
EAGITDPGTEV

SEQ ID NO: 461283 - protein, 6 aa, Mycobacterium
EAGKAA

SEQ ID NO: 461284 - protein, 10 aa, Mycobacterium
EAGKALGGTV

SEQ ID NO: 461285 - protein, 10 aa, Mycobacterium
EAGKAQGSYR

SEQ ID NO: 461286 - protein, 5 aa, Mycobacterium
EAGKQ

SEQ ID NO: 461287 - protein, 7 aa, Mycobacterium
EAGKQGY

SEQ ID NO: 461288 - protein, 7 aa, Mycobacterium
EAGKSRE

SEQ ID NO: 461289 - protein, 14 aa, Mycobacterium
EAGKTLSRAESRHG

SEQ ID NO: 461290 - protein, 18 aa, Mycobacterium
EAGKTVARGQVRLQNLPD

SEQ ID NO: 461291 - protein, 9 aa, Mycobacterium
EAGLDDPDP

SEQ ID NO: 461292 - protein, 7 aa, Mycobacterium
EAGLPAG

SEQ ID NO: 461293 - protein, 6 aa, Mycobacterium
EAGLPD

SEQ ID NO: 461294 - protein, 6 aa, Mycobacterium
EAGLPE

SEQ ID NO: 461295 - protein, 10 aa, Mycobacterium
EAGLPGKGED

SEQ ID NO: 461296 - protein, 11 aa, Mycobacterium
EAGLPGRGAPD

SEQ ID NO: 461297 - protein, 14 aa, Mycobacterium
EAGLPPARGALPGS

SEQ ID NO: 461298 - protein, 5 aa, Mycobacterium
EAGLR

SEQ ID NO: 461299 - protein, 5 aa, Mycobacterium
EAGLT

SEQ ID NO: 461300 - protein, 4 aa, Mycobacterium
EAGN

SEQ ID NO: 461301 - protein, 5 aa, Mycobacterium
EAGNA

SEQ ID NO: 461302 - protein, 10 aa, Mycobacterium
EAGNAPGKKI

SEQ ID NO: 461303 - protein, 11 aa, Mycobacterium
EAGNDSRVPPA

SEQ ID NO: 461304 - protein, 6 aa, Mycobacterium
EAGNGD

SEQ ID NO: 461305 - protein, 10 aa, Mycobacterium
EAGNGTREQA

SEQ ID NO: 461306 - protein, 8 aa, Mycobacterium
EAGNHDSV

SEQ ID NO: 461307 - protein, 36 aa, Mycobacterium
EAGNNASSATSSATSAMESATSEMTTSSSAPMADPA

SEQ ID NO: 461308 - protein, 8 aa, Mycobacterium
EAGNPDLA

SEQ ID NO: 461309 - protein, 9 aa, Mycobacterium
EAGNRRARE

SEQ ID NO: 461310 - protein, 6 aa, Mycobacterium
EAGNTT

SEQ ID NO: 461311 - protein, 4 aa, Mycobacterium
EAGP

SEQ ID NO: 461312 - protein, 39 aa, Mycobacterium
EAGPAEPAEPAEPEAPAAEAEAEAETEVADEAETPEPTF

SEQ ID NO: 461313 - protein, 9 aa, Mycobacterium
EAGPDPTPA

SEQ ID NO: 461314 - protein, 9 aa, Mycobacterium
EAGPEDGRP

SEQ ID NO: 461315 - protein, 8 aa, Mycobacterium
EAGPEGPQ

SEQ ID NO: 461316 - protein, 7 aa, Mycobacterium
EAGPERV

SEQ ID NO: 461317 - protein, 8 aa, Mycobacterium
EAGPEYGG

SEQ ID NO: 461318 - protein, 13 aa, Mycobacterium
EAGPGAGCETAPG

SEQ ID NO: 461319 - protein, 6 aa, Mycobacterium
EAGPGH

SEQ ID NO: 461320 - protein, 13 aa, Mycobacterium
EAGPLGDPQIAAA

SEQ ID NO: 461321 - protein, 8 aa, Mycobacterium
EAGPPEAV

SEQ ID NO: 461322 - protein, 7 aa, Mycobacterium
EAGPPEQ

SEQ ID NO: 461323 - protein, 7 aa, Mycobacterium
EAGPQAL

SEQ ID NO: 461324 - protein, 6 aa, Mycobacterium
EAGPQG

SEQ ID NO: 461325 - protein, 9 aa, Mycobacterium
EAGPQTEVS

SEQ ID NO: 461326 - protein, 9 aa, Mycobacterium
EAGPRDKNR

SEQ ID NO: 461327 - protein, 5 aa, Mycobacterium
EAGPS

SEQ ID NO: 461328 - protein, 8 aa, Mycobacterium
EAGPSDKN

SEQ ID NO: 461329 - protein, 13 aa, Mycobacterium
EAGPSTDTYAPGT

SEQ ID NO: 461330 - protein, 5 aa, Mycobacterium
EAGPT

SEQ ID NO: 461331 - protein, 7 aa, Mycobacterium
EAGPVSE

SEQ ID NO: 461332 - protein, 13 aa, Mycobacterium
EAGPWDEDAPSVA

SEQ ID NO: 461333 - protein, 6 aa, Mycobacterium
EAGQAR

SEQ ID NO: 461334 - protein, 5 aa, Mycobacterium
EAGQE

SEQ ID NO: 461335 - protein, 6 aa, Mycobacterium
EAGQGD

SEQ ID NO: 461336 - protein, 10 aa, Mycobacterium
EAGQGETELS

SEQ ID NO: 461337 - protein, 6 aa, Mycobacterium
EAGQLT

SEQ ID NO: 461338 - protein, 5 aa, Mycobacterium
EAGQN

SEQ ID NO: 461339 - protein, 9 aa, Mycobacterium
EAGQPQSTT

SEQ ID NO: 461340 - protein, 14 aa, Mycobacterium
EAGQQVSRGTEGEL

SEQ ID NO: 461341 - protein, 5 aa, Mycobacterium
EAGQR

SEQ ID NO: 461342 - protein, 10 aa, Mycobacterium
EAGQREPRLS

SEQ ID NO: 461343 - protein, 6 aa, Mycobacterium
EAGQSD

SEQ ID NO: 461344 - protein, 6 aa, Mycobacterium
EAGQTA

SEQ ID NO: 461345 - protein, 9 aa, Mycobacterium
EAGQTGGRI

SEQ ID NO: 461346 - protein, 6 aa, Mycobacterium
EAGQTS

SEQ ID NO: 461347 - protein, 10 aa, Mycobacterium
EAGQTTQTLG

SEQ ID NO: 461348 - protein, 8 aa, Mycobacterium
EAGQVQDT

SEQ ID NO: 461349 - protein, 5 aa, Mycobacterium
EAGRA

SEQ ID NO: 461350 - protein, 12 aa, Mycobacterium
EAGRAMADRAGA

SEQ ID NO: 461351 - protein, 6 aa, Mycobacterium
EAGRAP

SEQ ID NO: 461352 - protein, 11 aa, Mycobacterium
EAGRAPKANPA

SEQ ID NO: 461353 - protein, 7 aa, Mycobacterium
EAGRARA

SEQ ID NO: 461354 - protein, 8 aa, Mycobacterium
EAGRASAP

SEQ ID NO: 461355 - protein, 22 aa, Mycobacterium
EAGRATGEVTGVGKGRHTSTQS

SEQ ID NO: 461356 - protein, 5 aa, Mycobacterium
EAGRC

SEQ ID NO: 461357 - protein, 6 aa, Mycobacterium
EAGREA

SEQ ID NO: 461358 - protein, 6 aa, Mycobacterium
EAGREF

SEQ ID NO: 461359 - protein, 11 aa, Mycobacterium
EAGRGGPGQEA

SEQ ID NO: 461360 - protein, 8 aa, Mycobacterium
EAGRGRHR

SEQ ID NO: 461361 - protein, 7 aa, Mycobacterium
EAGRGRT

SEQ ID NO: 461362 - protein, 9 aa, Mycobacterium
EAGRHGAVT

SEQ ID NO: 461363 - protein, 10 aa, Mycobacterium
EAGRKQWDTR

SEQ ID NO: 461364 - protein, 6 aa, Mycobacterium
EAGRMP

SEQ ID NO: 461365 - protein, 11 aa, Mycobacterium
EAGRNPALPNG

SEQ ID NO: 461366 - protein, 8 aa, Mycobacterium
EAGRPGYI

SEQ ID NO: 461367 - protein, 13 aa, Mycobacterium
EAGRPIGESRARQ

SEQ ID NO: 461368 - protein, 6 aa, Mycobacterium
EAGRPT

SEQ ID NO: 461369 - protein, 5 aa, Mycobacterium
EAGRR

SEQ ID NO: 461370 - protein, 8 aa, Mycobacterium
EAGRRGAV

SEQ ID NO: 461371 - protein, 13 aa, Mycobacterium
EAGRRYERSVDPA

SEQ ID NO: 461372 - protein, 9 aa, Mycobacterium
EAGRRYERT

SEQ ID NO: 461373 - protein, 16 aa, Mycobacterium
EAGRSDPSEPRRDPEE

SEQ ID NO: 461374 - protein, 7 aa, Mycobacterium
EAGRTGL

SEQ ID NO: 461375 - protein, 10 aa, Mycobacterium
EAGRTRHTRY

SEQ ID NO: 461376 - protein, 4 aa, Mycobacterium
EAGS

SEQ ID NO: 461377 - protein, 5 aa, Mycobacterium
EAGSD

SEQ ID NO: 461378 - protein, 11 aa, Mycobacterium
EAGSEERQRTA

SEQ ID NO: 461379 - protein, 9 aa, Mycobacterium
EAGSGEGYG

SEQ ID NO: 461380 - protein, 10 aa, Mycobacterium
EAGSGVYEGE

SEQ ID NO: 461381 - protein, 11 aa, Mycobacterium
EAGSHGKDTRG

SEQ ID NO: 461382 - protein, 10 aa, Mycobacterium
EAGSKTLKDA

SEQ ID NO: 461383 - protein, 6 aa, Mycobacterium
EAGSMT

SEQ ID NO: 461384 - protein, 7 aa, Mycobacterium
EAGSPWR

SEQ ID NO: 461385 - protein, 8 aa, Mycobacterium
EAGSQPMV

SEQ ID NO: 461386 - protein, 7 aa, Mycobacterium
EAGSQPT

SEQ ID NO: 461387 - protein, 13 aa, Mycobacterium
EAGSRTPSRLQPR

SEQ ID NO: 461388 - protein, 8 aa, Mycobacterium
EAGSSDVH

SEQ ID NO: 461389 - protein, 7 aa, Mycobacterium
EAGSSNK

SEQ ID NO: 461390 - protein, 8 aa, Mycobacterium
EAGSTPVH

SEQ ID NO: 461391 - protein, 7 aa, Mycobacterium
EAGSVGE

SEQ ID NO: 461392 - protein, 8 aa, Mycobacterium
EAGSVSEA

SEQ ID NO: 461393 - protein, 10 aa, Mycobacterium
EAGSYGKDTR

SEQ ID NO: 461394 - protein, 15 aa, Mycobacterium
EAGTAASRAGTPASV

SEQ ID NO: 461395 - protein, 12 aa, Mycobacterium
EAGTAKDRPGGR

SEQ ID NO: 461396 - protein, 11 aa, Mycobacterium
EAGTDADSGAV

SEQ ID NO: 461397 - protein, 9 aa, Mycobacterium
EAGTDDESG

SEQ ID NO: 461398 - protein, 13 aa, Mycobacterium
EAGTDPDTGATTF

SEQ ID NO: 461399 - protein, 9 aa, Mycobacterium
EAGTDPGEL

SEQ ID NO: 461400 - protein, 9 aa, Mycobacterium
EAGTDYADL

SEQ ID NO: 461401 - protein, 9 aa, Mycobacterium
EAGTEPKTF

SEQ ID NO: 461402 - protein, 17 aa, Mycobacterium
EAGTGPTAPPAAGSTVP

SEQ ID NO: 461403 - protein, 9 aa, Mycobacterium
EAGTGRGVR

SEQ ID NO: 461404 - protein, 11 aa, Mycobacterium
EAGTGSDLQSV

SEQ ID NO: 461405 - protein, 9 aa, Mycobacterium
EAGTGTHED

SEQ ID NO: 461406 - protein, 14 aa, Mycobacterium
EAGTIGSSEGDTMR

SEQ ID NO: 461407 - protein, 11 aa, Mycobacterium
EAGTKALEDAG

SEQ ID NO: 461408 - protein, 5 aa, Mycobacterium
EAGTM

SEQ ID NO: 461409 - protein, 8 aa, Mycobacterium
EAGTNPAH

SEQ ID NO: 461410 - protein, 10 aa, Mycobacterium
EAGTNPAHRT

SEQ ID NO: 461411 - protein, 5 aa, Mycobacterium
EAGTP

SEQ ID NO: 461412 - protein, 6 aa, Mycobacterium
EAGTPN

SEQ ID NO: 461413 - protein, 9 aa, Mycobacterium
EAGTPPKSI

SEQ ID NO: 461414 - protein, 7 aa, Mycobacterium
EAGTPVD

SEQ ID NO: 461415 - protein, 5 aa, Mycobacterium
EAGTQ

SEQ ID NO: 461416 - protein, 8 aa, Mycobacterium
EAGTQITA

SEQ ID NO: 461417 - protein, 6 aa, Mycobacterium
EAGTQK

SEQ ID NO: 461418 - protein, 14 aa, Mycobacterium
EAGTQSGKARKALE

SEQ ID NO: 461419 - protein, 7 aa, Mycobacterium
EAGTRPL

SEQ ID NO: 461420 - protein, 16 aa, Mycobacterium
EAGTSPSKLTALIAGT

SEQ ID NO: 461421 - protein, 7 aa, Mycobacterium
EAGTSSV

SEQ ID NO: 461422 - protein, 7 aa, Mycobacterium
EAGTSVQ

SEQ ID NO: 461423 - protein, 8 aa, Mycobacterium
EAGTVGED

SEQ ID NO: 461424 - protein, 7 aa, Mycobacterium
EAGVAPN

SEQ ID NO: 461425 - protein, 10 aa, Mycobacterium
EAGVAPPQRT

SEQ ID NO: 461426 - protein, 6 aa, Mycobacterium
EAGVDT

SEQ ID NO: 461427 - protein, 17 aa, Mycobacterium
EAGVEAPDDITKAEASD

SEQ ID NO: 461428 - protein, 7 aa, Mycobacterium
EAGVGAA

SEQ ID NO: 461429 - protein, 10 aa, Mycobacterium
EAGVGEDDTL

SEQ ID NO: 461430 - protein, 6 aa, Mycobacterium
EAGVGK

SEQ ID NO: 461431 - protein, 9 aa, Mycobacterium
EAGVGPDRI

SEQ ID NO: 461432 - protein, 8 aa, Mycobacterium
EAGVGSAT

SEQ ID NO: 461433 - protein, 10 aa, Mycobacterium
EAGVPAIPYG

SEQ ID NO: 461434 - protein, 7 aa, Mycobacterium
EAGVPEV

SEQ ID NO: 461435 - protein, 10 aa, Mycobacterium
EAGVPPPQRS

SEQ ID NO: 461436 - protein, 18 aa, Mycobacterium
EAGVPSVPNTIGRAGSYD

SEQ ID NO: 461437 - protein, 7 aa, Mycobacterium
EAGVQAA

SEQ ID NO: 461438 - protein, 9 aa, Mycobacterium
EAGVRGSAH

SEQ ID NO: 461439 - protein, 7 aa, Mycobacterium
EAGVSRS

SEQ ID NO: 461440 - protein, 6 aa, Mycobacterium
EAGVTR

SEQ ID NO: 461441 - protein, 6 aa, Mycobacterium
EAGVTT

SEQ ID NO: 461442 - protein, 12 aa, Mycobacterium
EAGWEDAPWEPG

SEQ ID NO: 461443 - protein, 5 aa, Mycobacterium
EAGYI

SEQ ID NO: 461444 - protein, 18 aa, Mycobacterium
EAGYQPEYVESGAPGRGN

SEQ ID NO: 461445 - protein, 13 aa, Mycobacterium
EAGYSDSHDIAQR

SEQ ID NO: 461446 - protein, 5 aa, Mycobacterium
EAHAA

SEQ ID NO: 461447 - protein, 20 aa, Mycobacterium
EAHAAEDHKRREEADVRNQA

SEQ ID NO: 461448 - protein, 20 aa, Mycobacterium
EAHADEDKKRREEADVRNQA

SEQ ID NO: 461449 - protein, 20 aa, Mycobacterium
EAHADEDRKRREEADVRNQA

SEQ ID NO: 461450 - protein, 20 aa, Mycobacterium
EAHAEEDRQRREEADIRNQA

SEQ ID NO: 461451 - protein, 20 aa, Mycobacterium
EAHAEEDRQRREEADVRNQA

SEQ ID NO: 461452 - protein, 5 aa, Mycobacterium
EAHAN

SEQ ID NO: 461453 - protein, 14 aa, Mycobacterium
EAHDGDMPSTDTAI

SEQ ID NO: 461454 - protein, 16 aa, Mycobacterium
EAHDHAGTPAPALPSR

SEQ ID NO: 461455 - protein, 9 aa, Mycobacterium
EAHDHPSQA

SEQ ID NO: 461456 - protein, 8 aa, Mycobacterium
EAHEQRSF

SEQ ID NO: 461457 - protein, 6 aa, Mycobacterium
EAHEVS

SEQ ID NO: 461458 - protein, 10 aa, Mycobacterium
EAHGGADGTV

SEQ ID NO: 461459 - protein, 6 aa, Mycobacterium
EAHGGK

SEQ ID NO: 461460 - protein, 6 aa, Mycobacterium
EAHGGP

SEQ ID NO: 461461 - protein, 14 aa, Mycobacterium
EAHGTGTTLGDPIE

SEQ ID NO: 461462 - protein, 10 aa, Mycobacterium
EAHHDAPRAA

SEQ ID NO: 461463 - protein, 7 aa, Mycobacterium
EAHKDEA

SEQ ID NO: 461464 - protein, 8 aa, Mycobacterium
EAHNAQSR

SEQ ID NO: 461465 - protein, 8 aa, Mycobacterium
EAHQDPDG

SEQ ID NO: 461466 - protein, 5 aa, Mycobacterium
EAHRA

SEQ ID NO: 461467 - protein, 6 aa, Mycobacterium
EAHRQS

SEQ ID NO: 461468 - protein, 6 aa, Mycobacterium
EAHRSW

SEQ ID NO: 461469 - protein, 9 aa, Mycobacterium
EAHSDPRER

SEQ ID NO: 461470 - protein, 12 aa, Mycobacterium
EAHSRSDLTGEG

SEQ ID NO: 461471 - protein, 9 aa, Mycobacterium
EAHTGSDSA

SEQ ID NO: 461472 - protein, 11 aa, Mycobacterium
EAHTKTDGSPR

SEQ ID NO: 461473 - protein, 6 aa, Mycobacterium
EAHTRE

SEQ ID NO: 461474 - protein, 17 aa, Mycobacterium
EAIAKTKAELPQAVGPS

SEQ ID NO: 461475 - protein, 17 aa, Mycobacterium
EAIAQTKSELPQSVPES

SEQ ID NO: 461476 - protein, 16 aa, Mycobacterium
EAIARTKSELPQAVPQ

SEQ ID NO: 461477 - protein, 17 aa, Mycobacterium
EAIARTKSELPQAVPSS

SEQ ID NO: 461478 - protein, 6 aa, Mycobacterium
EAIDDP

SEQ ID NO: 461479 - protein, 13 aa, Mycobacterium
EAIDETDRRRAKQ

SEQ ID NO: 461480 - protein, 11 aa, Mycobacterium
EAIDKGEVDDP

SEQ ID NO: 461481 - protein, 6 aa, Mycobacterium
EAIDPA

SEQ ID NO: 461482 - protein, 11 aa, Mycobacterium
EAIEGDRVPGA

SEQ ID NO: 461483 - protein, 4 aa, Mycobacterium
EAIG

SEQ ID NO: 461484 - protein, 5 aa, Mycobacterium
EAIGA

SEQ ID NO: 461485 - protein, 6 aa, Mycobacterium
EAIGGE

SEQ ID NO: 461486 - protein, 6 aa, Mycobacterium
EAIGPL

SEQ ID NO: 461487 - protein, 5 aa, Mycobacterium
EAIGQ

SEQ ID NO: 461488 - protein, 11 aa, Mycobacterium
EAIGQSGEKFD

SEQ ID NO: 461489 - protein, 9 aa, Mycobacterium
EAIGSTTAA

SEQ ID NO: 461490 - protein, 7 aa, Mycobacterium
EAIGTTT

SEQ ID NO: 461491 - protein, 5 aa, Mycobacterium
EAIPD

SEQ ID NO: 461492 - protein, 7 aa, Mycobacterium
EAIPPNL

SEQ ID NO: 461493 - protein, 13 aa, Mycobacterium
EAIQGNGDTDFTG

SEQ ID NO: 461494 - protein, 4 aa, Mycobacterium
EAIR

SEQ ID NO: 461495 - protein, 7 aa, Mycobacterium
EAIREAE

SEQ ID NO: 461496 - protein, 8 aa, Mycobacterium
EAIREAEQ

SEQ ID NO: 461497 - protein, 19 aa, Mycobacterium
EAIRRRRSDFSAEAQERLA

SEQ ID NO: 461498 - protein, 15 aa, Mycobacterium
EAISEAKKALEGTDI

SEQ ID NO: 461499 - protein, 8 aa, Mycobacterium
EAISESGV

SEQ ID NO: 461500 - protein, 9 aa, Mycobacterium
EAISTTGGT

SEQ ID NO: 461501 - protein, 11 aa, Mycobacterium
EAITAGGRAAA

SEQ ID NO: 461502 - protein, 11 aa, Mycobacterium
EAITASGRAAA

SEQ ID NO: 461503 - protein, 6 aa, Mycobacterium
EAIYPA

SEQ ID NO: 461504 - protein, 24 aa, Mycobacterium
EAKAAMEKTHADSQSGARAPKHSY

SEQ ID NO: 461505 - protein, 9 aa, Mycobacterium
EAKAGRDAG

SEQ ID NO: 461506 - protein, 7 aa, Mycobacterium
EAKAHGV

SEQ ID NO: 461507 - protein, 8 aa, Mycobacterium
EAKAVGGL

SEQ ID NO: 461508 - protein, 27 aa, Mycobacterium
EAKDAGALTLSGSRAGDIEHYLPLFDV

SEQ ID NO: 461509 - protein, 9 aa, Mycobacterium
EAKDALASE

SEQ ID NO: 461510 - protein, 10 aa, Mycobacterium
EAKDGKDAGD

SEQ ID NO: 461511 - protein, 26 aa, Mycobacterium
EAKDPERSFPRPTEPPRVSSRPANPV

SEQ ID NO: 461512 - protein, 12 aa, Mycobacterium
EAKDPSAGGRPT

SEQ ID NO: 461513 - protein, 8 aa, Mycobacterium
EAKDTRKE

SEQ ID NO: 461514 - protein, 4 aa, Mycobacterium
EAKE

SEQ ID NO: 461515 - protein, 9 aa, Mycobacterium
EAKEEAIDS

SEQ ID NO: 461516 - protein, 13 aa, Mycobacterium
EAKEGIETTDTGE

SEQ ID NO: 461517 - protein, 21 aa, Mycobacterium
EAKERAGEEAGPLTVVDSGDD

SEQ ID NO: 461518 - protein, 5 aa, Mycobacterium
EAKEV

SEQ ID NO: 461519 - protein, 4 aa, Mycobacterium
EAKF

SEQ ID NO: 461520 - protein, 4 aa, Mycobacterium
EAKG

SEQ ID NO: 461521 - protein, 14 aa, Mycobacterium
EAKGEAREGFPAGT

SEQ ID NO: 461522 - protein, 8 aa, Mycobacterium
EAKGQRAI

SEQ ID NO: 461523 - protein, 11 aa, Mycobacterium
EAKGRNGVPHP

SEQ ID NO: 461524 - protein, 15 aa, Mycobacterium
EAKGRNGVPHPHATA

SEQ ID NO: 461525 - protein, 11 aa, Mycobacterium
EAKGRNGVPHS

SEQ ID NO: 461526 - protein, 15 aa, Mycobacterium
EAKGRNGVPPTHAAA

SEQ ID NO: 461527 - protein, 9 aa, Mycobacterium
EAKKDEAIA

SEQ ID NO: 461528 - protein, 10 aa, Mycobacterium
EAKKDQAIEI

SEQ ID NO: 461529 - protein, 7 aa, Mycobacterium
EAKKKAL

SEQ ID NO: 461530 - protein, 10 aa, Mycobacterium
EAKNDAASEE

SEQ ID NO: 461531 - protein, 9 aa, Mycobacterium
EAKNGKDVG

SEQ ID NO: 461532 - protein, 20 aa, Mycobacterium
EAKNRAAAQRLAEIRESMRE

SEQ ID NO: 461533 - protein, 8 aa, Mycobacterium
EAKNTYGT

SEQ ID NO: 461534 - protein, 6 aa, Mycobacterium
EAKPDI

SEQ ID NO: 461535 - protein, 12 aa, Mycobacterium
EAKPEGASQYAG

SEQ ID NO: 461536 - protein, 16 aa, Mycobacterium
EAKPGSQGLSKDGKVA

SEQ ID NO: 461537 - protein, 14 aa, Mycobacterium
EAKPGSQGMDGKAA

SEQ ID NO: 461538 - protein, 12 aa, Mycobacterium
EAKPGSQSIQGK

SEQ ID NO: 461539 - protein, 7 aa, Mycobacterium
EAKPGVS

SEQ ID NO: 461540 - protein, 6 aa, Mycobacterium
EAKPYP

SEQ ID NO: 461541 - protein, 5 aa, Mycobacterium
EAKQR

SEQ ID NO: 461542 - protein, 9 aa, Mycobacterium
EAKQRAELA

SEQ ID NO: 461543 - protein, 7 aa, Mycobacterium
EAKRDDL

SEQ ID NO: 461544 - protein, 8 aa, Mycobacterium
EAKRFARD

SEQ ID NO: 461545 - protein, 11 aa, Mycobacterium
EAKRQENAATA

SEQ ID NO: 461546 - protein, 6 aa, Mycobacterium
EAKRQN

SEQ ID NO: 461547 - protein, 5 aa, Mycobacterium
EAKRR

SEQ ID NO: 461548 - protein, 8 aa, Mycobacterium
EAKRRGAT

SEQ ID NO: 461549 - protein, 18 aa, Mycobacterium
EAKRTRKPVFGPKPAGMP

SEQ ID NO: 461550 - protein, 6 aa, Mycobacterium
EAKSDF

SEQ ID NO: 461551 - protein, 11 aa, Mycobacterium
EAKSSTSWEDE

SEQ ID NO: 461552 - protein, 10 aa, Mycobacterium
EAKTALGGTD

SEQ ID NO: 461553 - protein, 11 aa, Mycobacterium
EAKTALGGTDI

SEQ ID NO: 461554 - protein, 8 aa, Mycobacterium
EAKTFGQS

SEQ ID NO: 461555 - protein, 9 aa, Mycobacterium
EAKTGKRIE

SEQ ID NO: 461556 - protein, 5 aa, Mycobacterium
EAKTH

SEQ ID NO: 461557 - protein, 4 aa, Mycobacterium
EAKV

SEQ ID NO: 461558 - protein, 7 aa, Mycobacterium
EAKYAAK

SEQ ID NO: 461559 - protein, 11 aa, Mycobacterium
EALAASSADEV

SEQ ID NO: 461560 - protein, 12 aa, Mycobacterium
EALADGGYRQSK

SEQ ID NO: 461561 - protein, 25 aa, Mycobacterium
EALAGQGKTRDEFETETRAAAETDV

SEQ ID NO: 461562 - protein, 10 aa, Mycobacterium
EALASGDPNS

SEQ ID NO: 461563 - protein, 4 aa, Mycobacterium
EALD

SEQ ID NO: 461564 - protein, 5 aa, Mycobacterium
EALDA

SEQ ID NO: 461565 - protein, 21 aa, Mycobacterium
EALDESAVGQETVQVRKPAPK

SEQ ID NO: 461566 - protein, 10 aa, Mycobacterium
EALDGSQSLD

SEQ ID NO: 461567 - protein, 6 aa, Mycobacterium
EALDPA

SEQ ID NO: 461568 - protein, 10 aa, Mycobacterium
EALDSGTPVR

SEQ ID NO: 461569 - protein, 4 aa, Mycobacterium
EALE

SEQ ID NO: 461570 - protein, 8 aa, Mycobacterium
EALEGAGR

SEQ ID NO: 461571 - protein, 5 aa, Mycobacterium
EALES

SEQ ID NO: 461572 - protein, 10 aa, Mycobacterium
EALGDAPRPH

SEQ ID NO: 461573 - protein, 9 aa, Mycobacterium
EALGDDKAI

SEQ ID NO: 461574 - protein, 11 aa, Mycobacterium
EALGDKKGIRR

SEQ ID NO: 461575 - protein, 10 aa, Mycobacterium
EALGDTSRRN

SEQ ID NO: 461576 - protein, 9 aa, Mycobacterium
EALGETPTD

SEQ ID NO: 461577 - protein, 8 aa, Mycobacterium
EALGGDPQ

SEQ ID NO: 461578 - protein, 27 aa, Mycobacterium
EALGGPVPEHGEDPTATIDAQTRLSGG

SEQ ID NO: 461579 - protein, 6 aa, Mycobacterium
EALGPG

SEQ ID NO: 461580 - protein, 4 aa, Mycobacterium
EALK

SEQ ID NO: 461581 - protein, 7 aa, Mycobacterium
EALKPQA

SEQ ID NO: 461582 - protein, 6 aa, Mycobacterium
EALNGD

SEQ ID NO: 461583 - protein, 25 aa, Mycobacterium
EALNGGVNTGRTRRPAGSRKQEGTA

SEQ ID NO: 461584 - protein, 4 aa, Mycobacterium
EALP

SEQ ID NO: 461585 - protein, 6 aa, Mycobacterium
EALPAD

SEQ ID NO: 461586 - protein, 8 aa, Mycobacterium
EALPAGKA

SEQ ID NO: 461587 - protein, 8 aa, Mycobacterium
EALPDSDF

SEQ ID NO: 461588 - protein, 9 aa, Mycobacterium
EALPDSEPR

SEQ ID NO: 461589 - protein, 7 aa, Mycobacterium
EALPGEL

SEQ ID NO: 461590 - protein, 18 aa, Mycobacterium
EALPGPAEASAPPAEAPL

SEQ ID NO: 461591 - protein, 8 aa, Mycobacterium
EALPGPVA

SEQ ID NO: 461592 - protein, 16 aa, Mycobacterium
EALPGSRTTTRRGTAG

SEQ ID NO: 461593 - protein, 11 aa, Mycobacterium
EALPGTDLDPD

SEQ ID NO: 461594 - protein, 7 aa, Mycobacterium
EALPQDA

SEQ ID NO: 461595 - protein, 5 aa, Mycobacterium
EALPR

SEQ ID NO: 461596 - protein, 7 aa, Mycobacterium
EALPRNG

SEQ ID NO: 461597 - protein, 10 aa, Mycobacterium
EALPVPDAGA

SEQ ID NO: 461598 - protein, 7 aa, Mycobacterium
EALPYRP

SEQ ID NO: 461599 - protein, 11 aa, Mycobacterium
EALQGRADPSV

SEQ ID NO: 461600 - protein, 21 aa, Mycobacterium
EALQSRAGALTPPGSGLGPGV

SEQ ID NO: 461601 - protein, 9 aa, Mycobacterium
EALRKSDSW

SEQ ID NO: 461602 - protein, 7 aa, Mycobacterium
EALRNSA

SEQ ID NO: 461603 - protein, 8 aa, Mycobacterium
EALRNSAA

SEQ ID NO: 461604 - protein, 7 aa, Mycobacterium
EALRPGA

SEQ ID NO: 461605 - protein, 7 aa, Mycobacterium
EALRPSS

SEQ ID NO: 461606 - protein, 14 aa, Mycobacterium
EALRTGATAVTDNA

SEQ ID NO: 461607 - protein, 11 aa, Mycobacterium
EALSDGETQAL

SEQ ID NO: 461608 - protein, 8 aa, Mycobacterium
EALSDHEA

SEQ ID NO: 461609 - protein, 13 aa, Mycobacterium
EALSDSTDWGATS

SEQ ID NO: 461610 - protein, 6 aa, Mycobacterium
EALSPE

SEQ ID NO: 461611 - protein, 12 aa, Mycobacterium
EALSSNGSTSMG

SEQ ID NO: 461612 - protein, 7 aa, Mycobacterium
EALTANG

SEQ ID NO: 461613 - protein, 10 aa, Mycobacterium
EALTGPSDDG

SEQ ID NO: 461614 - protein, 10 aa, Mycobacterium
EALTPQQREA

SEQ ID NO: 461615 - protein, 4 aa, Mycobacterium
EAMA

SEQ ID NO: 461616 - protein, 5 aa, Mycobacterium
EAMAG

SEQ ID NO: 461617 - protein, 19 aa, Mycobacterium
EAMAKTEAGVANNPQFSGS

SEQ ID NO: 461618 - protein, 20 aa, Mycobacterium
EAMDRASGIEPKKPKEIAEI

SEQ ID NO: 461619 - protein, 8 aa, Mycobacterium
EAMEADSG

SEQ ID NO: 461620 - protein, 6 aa, Mycobacterium
EAMESA

SEQ ID NO: 461621 - protein, 10 aa, Mycobacterium
EAMETDAETL

SEQ ID NO: 461622 - protein, 10 aa, Mycobacterium
EAMGGSSDDT

SEQ ID NO: 461623 - protein, 19 aa, Mycobacterium
EAMNSRTGAPIQASERRGR

SEQ ID NO: 461624 - protein, 9 aa, Mycobacterium
EAMRGQGGR

SEQ ID NO: 461625 - protein, 6 aa, Mycobacterium
EAMSAE

SEQ ID NO: 461626 - protein, 8 aa, Mycobacterium
EAMSGARR

SEQ ID NO: 461627 - protein, 9 aa, Mycobacterium
EAMTQKPPL

SEQ ID NO: 461628 - protein, 9 aa, Mycobacterium
EANAAQAQA

SEQ ID NO: 461629 - protein, 13 aa, Mycobacterium
EANAHKLDPAEDR

SEQ ID NO: 461630 - protein, 9 aa, Mycobacterium
EANASTQAF

SEQ ID NO: 461631 - protein, 5 aa, Mycobacterium
EANDR

SEQ ID NO: 461632 - protein, 6 aa, Mycobacterium
EANDRG

SEQ ID NO: 461633 - protein, 7 aa, Mycobacterium
EANEEAR

SEQ ID NO: 461634 - protein, 8 aa, Mycobacterium
EANERAEV

SEQ ID NO: 461635 - protein, 8 aa, Mycobacterium
EANESELA

SEQ ID NO: 461636 - protein, 10 aa, Mycobacterium
EANETTGQQR

SEQ ID NO: 461637 - protein, 5 aa, Mycobacterium
EANGA

SEQ ID NO: 461638 - protein, 6 aa, Mycobacterium
EANGAP

SEQ ID NO: 461639 - protein, 17 aa, Mycobacterium
EANGAPREGFPAGTPFA

SEQ ID NO: 461640 - protein, 11 aa, Mycobacterium
EANGARQAQIT

SEQ ID NO: 461641 - protein, 6 aa, Mycobacterium
EANGGP

SEQ ID NO: 461642 - protein, 13 aa, Mycobacterium
EANGPLDQQIPPG

SEQ ID NO: 461643 - protein, 9 aa, Mycobacterium
EANGPLQEQ

SEQ ID NO: 461644 - protein, 6 aa, Mycobacterium
EANGTF

SEQ ID NO: 461645 - protein, 9 aa, Mycobacterium
EANHAGTTR

SEQ ID NO: 461646 - protein, 17 aa, Mycobacterium
EANKDAAIAATDEENYE

SEQ ID NO: 461647 - protein, 7 aa, Mycobacterium
EANKDEA

SEQ ID NO: 461648 - protein, 11 aa, Mycobacterium
EANKDKAIEIQ

SEQ ID NO: 461649 - protein, 9 aa, Mycobacterium
EANKEKAIA

SEQ ID NO: 461650 - protein, 11 aa, Mycobacterium
EANKEKAIEVT

SEQ ID NO: 461651 - protein, 9 aa, Mycobacterium
EANKNRQRV

SEQ ID NO: 461652 - protein, 5 aa, Mycobacterium
EANLQ

SEQ ID NO: 461653 - protein, 8 aa, Mycobacterium
EANPADRD

SEQ ID NO: 461654 - protein, 7 aa, Mycobacterium
EANPDDD

SEQ ID NO: 461655 - protein, 7 aa, Mycobacterium
EANPGIQ

SEQ ID NO: 461656 - protein, 11 aa, Mycobacterium
EANPKANTALT

SEQ ID NO: 461657 - protein, 7 aa, Mycobacterium
EANPKGV

SEQ ID NO: 461658 - protein, 11 aa, Mycobacterium
EANQAVSNAEA

SEQ ID NO: 461659 - protein, 7 aa, Mycobacterium
EANQDGI

SEQ ID NO: 461660 - protein, 6 aa, Mycobacterium
EANQRA

SEQ ID NO: 461661 - protein, 16 aa, Mycobacterium
EANQRNNSPSAGAGPE

SEQ ID NO: 461662 - protein, 6 aa, Mycobacterium
EANQRV

SEQ ID NO: 461663 - protein, 5 aa, Mycobacterium
EANQY

SEQ ID NO: 461664 - protein, 6 aa, Mycobacterium
EANRDR

SEQ ID NO: 461665 - protein, 5 aa, Mycobacterium
EANRE

SEQ ID NO: 461666 - protein, 6 aa, Mycobacterium
EANREE

SEQ ID NO: 461667 - protein, 6 aa, Mycobacterium
EANREK

SEQ ID NO: 461668 - protein, 5 aa, Mycobacterium
EANRG

SEQ ID NO: 461669 - protein, 6 aa, Mycobacterium
EANRLT

SEQ ID NO: 461670 - protein, 12 aa, Mycobacterium
EANRQPGKTGDN

SEQ ID NO: 461671 - protein, 4 aa, Mycobacterium
EANS

SEQ ID NO: 461672 - protein, 7 aa, Mycobacterium
EANSARL

SEQ ID NO: 461673 - protein, 9 aa, Mycobacterium
EANSPWPHQ

SEQ ID NO: 461674 - protein, 37 aa, Mycobacterium
EANSVAPTGGASGDFNSAGGHYQAPGHTGYPASGDLT

SEQ ID NO: 461675 - protein, 5 aa, Mycobacterium
EANTR

SEQ ID NO: 461676 - protein, 4 aa, Mycobacterium
EAPA

SEQ ID NO: 461677 - protein, 13 aa, Mycobacterium
EAPAAPAAPAQSP

SEQ ID NO: 461678 - protein, 9 aa, Mycobacterium
EAPADVPGD

SEQ ID NO: 461679 - protein, 6 aa, Mycobacterium
EAPAGG

SEQ ID NO: 461680 - protein, 19 aa, Mycobacterium
EAPAGPAATPHRSALLKWL

SEQ ID NO: 461681 - protein, 11 aa, Mycobacterium
EAPAGTSAPKG

SEQ ID NO: 461682 - protein, 13 aa, Mycobacterium
EAPAHGSPTGIGG

SEQ ID NO: 461683 - protein, 6 aa, Mycobacterium
EAPALG

SEQ ID NO: 461684 - protein, 5 aa, Mycobacterium
EAPAP

SEQ ID NO: 461685 - protein, 18 aa, Mycobacterium
EAPAPAAQQAAPATEDQH

SEQ ID NO: 461686 - protein, 8 aa, Mycobacterium
EAPAPDAF

SEQ ID NO: 461687 - protein, 7 aa, Mycobacterium
EAPAPVR

SEQ ID NO: 461688 - protein, 10 aa, Mycobacterium
EAPAQPSGGR

SEQ ID NO: 461689 - protein, 33 aa, Mycobacterium
EAPARDRANLGGGALGPAPVGAYPESASAYGAE

SEQ ID NO: 461690 - protein, 13 aa, Mycobacterium
EAPASAARPPARM

SEQ ID NO: 461691 - protein, 5 aa, Mycobacterium
EAPAT

SEQ ID NO: 461692 - protein, 9 aa, Mycobacterium
EAPATAGQV

SEQ ID NO: 461693 - protein, 13 aa, Mycobacterium
EAPATDSNAEKSI

SEQ ID NO: 461694 - protein, 7 aa, Mycobacterium
EAPDESA

SEQ ID NO: 461695 - protein, 7 aa, Mycobacterium
EAPDETN

SEQ ID NO: 461696 - protein, 9 aa, Mycobacterium
EAPDGDPLR

SEQ ID NO: 461697 - protein, 10 aa, Mycobacterium
EAPDNPKPLG

SEQ ID NO: 461698 - protein, 14 aa, Mycobacterium
EAPDPEPPEETDEQ

SEQ ID NO: 461699 - protein, 13 aa, Mycobacterium
EAPDPKDLDERTE

SEQ ID NO: 461700 - protein, 8 aa, Mycobacterium
EAPDPPGV

SEQ ID NO: 461701 - protein, 11 aa, Mycobacterium
EAPDRQAERRN

SEQ ID NO: 461702 - protein, 9 aa, Mycobacterium
EAPDTRGIA

SEQ ID NO: 461703 - protein, 13 aa, Mycobacterium
EAPDYGTGLADGE

SEQ ID NO: 461704 - protein, 10 aa, Mycobacterium
EAPEAGSVDA

SEQ ID NO: 461705 - protein, 10 aa, Mycobacterium
EAPEAGSVQA

SEQ ID NO: 461706 - protein, 31 aa, Mycobacterium
EAPEASGSPVEAAPAAPAPAAAASGPRPDDI

SEQ ID NO: 461707 - protein, 9 aa, Mycobacterium
EAPEDPDVR

SEQ ID NO: 461708 - protein, 12 aa, Mycobacterium
EAPEDPGAQSEV

SEQ ID NO: 461709 - protein, 8 aa, Mycobacterium
EAPEGDAV

SEQ ID NO: 461710 - protein, 9 aa, Mycobacterium
EAPENPKPL

SEQ ID NO: 461711 - protein, 13 aa, Mycobacterium
EAPEPDELDERTE

SEQ ID NO: 461712 - protein, 6 aa, Mycobacterium
EAPEPR

SEQ ID NO: 461713 - protein, 10 aa, Mycobacterium
EAPEPSTGRP

SEQ ID NO: 461714 - protein, 5 aa, Mycobacterium
EAPEQ

SEQ ID NO: 461715 - protein, 5 aa, Mycobacterium
EAPER

SEQ ID NO: 461716 - protein, 11 aa, Mycobacterium
EAPERGSPTRA

SEQ ID NO: 461717 - protein, 7 aa, Mycobacterium
EAPERPL

SEQ ID NO: 461718 - protein, 6 aa, Mycobacterium
EAPERR

SEQ ID NO: 461719 - protein, 10 aa, Mycobacterium
EAPESFPSAP

SEQ ID NO: 461720 - protein, 6 aa, Mycobacterium
EAPESI

SEQ ID NO: 461721 - protein, 5 aa, Mycobacterium
EAPFP

SEQ ID NO: 461722 - protein, 6 aa, Mycobacterium
EAPFPS

SEQ ID NO: 461723 - protein, 4 aa, Mycobacterium
EAPG

SEQ ID NO: 461724 - protein, 10 aa, Mycobacterium
EAPGAPDPLR

SEQ ID NO: 461725 - protein, 8 aa, Mycobacterium
EAPGGEAA

SEQ ID NO: 461726 - protein, 9 aa, Mycobacterium
EAPGGEAAR

SEQ ID NO: 461727 - protein, 11 aa, Mycobacterium
EAPGGIDSPGA

SEQ ID NO: 461728 - protein, 18 aa, Mycobacterium
EAPGGSPGRGVPPTLAGT

SEQ ID NO: 461729 - protein, 7 aa, Mycobacterium
EAPGHPH

SEQ ID NO: 461730 - protein, 5 aa, Mycobacterium
EAPGI

SEQ ID NO: 461731 - protein, 6 aa, Mycobacterium
EAPGLA

SEQ ID NO: 461732 - protein, 10 aa, Mycobacterium
EAPGPAGEDG

SEQ ID NO: 461733 - protein, 8 aa, Mycobacterium
EAPGPSAY

SEQ ID NO: 461734 - protein, 8 aa, Mycobacterium
EAPGQYRE

SEQ ID NO: 461735 - protein, 7 aa, Mycobacterium
EAPGREG

SEQ ID NO: 461736 - protein, 12 aa, Mycobacterium
EAPGRGSPTRAM

SEQ ID NO: 461737 - protein, 5 aa, Mycobacterium
EAPGW

SEQ ID NO: 461738 - protein, 4 aa, Mycobacterium
EAPH

SEQ ID NO: 461739 - protein, 13 aa, Mycobacterium
EAPHRRGRHKNIP

SEQ ID NO: 461740 - protein, 4 aa, Mycobacterium
EAPI

SEQ ID NO: 461741 - protein, 5 aa, Mycobacterium
EAPIE

SEQ ID NO: 461742 - protein, 11 aa, Mycobacterium
EAPKPRPPSAR

SEQ ID NO: 461743 - protein, 11 aa, Mycobacterium
EAPKPVENTPV

SEQ ID NO: 461744 - protein, 18 aa, Mycobacterium
EAPKTAGLPGTEGQHRTD

SEQ ID NO: 461745 - protein, 11 aa, Mycobacterium
EAPKTGDITRN

SEQ ID NO: 461746 - protein, 4 aa, Mycobacterium
EAPL

SEQ ID NO: 461747 - protein, 5 aa, Mycobacterium
EAPLG

SEQ ID NO: 461748 - protein, 5 aa, Mycobacterium
EAPLP

SEQ ID NO: 461749 - protein, 6 aa, Mycobacterium
EAPLPD

SEQ ID NO: 461750 - protein, 5 aa, Mycobacterium
EAPLR

SEQ ID NO: 461751 - protein, 8 aa, Mycobacterium
EAPLTGAS

SEQ ID NO: 461752 - protein, 5 aa, Mycobacterium
EAPLY

SEQ ID NO: 461753 - protein, 7 aa, Mycobacterium
EAPLYRN

SEQ ID NO: 461754 - protein, 6 aa, Mycobacterium
EAPNGA

SEQ ID NO: 461755 - protein, 8 aa, Mycobacterium
EAPNGTGQ

SEQ ID NO: 461756 - protein, 13 aa, Mycobacterium
EAPNYATDGSRGY

SEQ ID NO: 461757 - protein, 9 aa, Mycobacterium
EAPPAPQPL

SEQ ID NO: 461758 - protein, 12 aa, Mycobacterium
EAPPARLPTWPI

SEQ ID NO: 461759 - protein, 13 aa, Mycobacterium
EAPPASSDDDVRR

SEQ ID NO: 461760 - protein, 6 aa, Mycobacterium
EAPPDG

SEQ ID NO: 461761 - protein, 5 aa, Mycobacterium
EAPPE

SEQ ID NO: 461762 - protein, 18 aa, Mycobacterium
EAPPEPGAEAPPDSGAAA

SEQ ID NO: 461763 - protein, 11 aa, Mycobacterium
EAPPLNDEQRA

SEQ ID NO: 461764 - protein, 10 aa, Mycobacterium
EAPPPGIHGS

SEQ ID NO: 461765 - protein, 10 aa, Mycobacterium
EAPPPLENTP

SEQ ID NO: 461766 - protein, 11 aa, Mycobacterium
EAPPPPENTPV

SEQ ID NO: 461767 - protein, 7 aa, Mycobacterium
EAPPPTL

SEQ ID NO: 461768 - protein, 11 aa, Mycobacterium
EAPPPVENTPV

SEQ ID NO: 461769 - protein, 14 aa, Mycobacterium
EAPPRPFTYGETQD

SEQ ID NO: 461770 - protein, 14 aa, Mycobacterium
EAPPRPFTYGETQT

SEQ ID NO: 461771 - protein, 8 aa, Mycobacterium
EAPPRPQA

SEQ ID NO: 461772 - protein, 7 aa, Mycobacterium
EAPPTVH

SEQ ID NO: 461773 - protein, 26 aa, Mycobacterium
EAPPVEAPEPSPVETLKTSSSASRRV

SEQ ID NO: 461774 - protein, 5 aa, Mycobacterium
EAPPW

SEQ ID NO: 461775 - protein, 5 aa, Mycobacterium
EAPQA

SEQ ID NO: 461776 - protein, 7 aa, Mycobacterium
EAPQDAG

SEQ ID NO: 461777 - protein, 10 aa, Mycobacterium
EAPQEGTPPF

SEQ ID NO: 461778 - protein, 15 aa, Mycobacterium
EAPQEGTPPFRTSAK

SEQ ID NO: 461779 - protein, 13 aa, Mycobacterium
EAPQEGTPPFRTT

SEQ ID NO: 461780 - protein, 15 aa, Mycobacterium
EAPQESTADPSPSDV

SEQ ID NO: 461781 - protein, 9 aa, Mycobacterium
EAPQGDNAR

SEQ ID NO: 461782 - protein, 25 aa, Mycobacterium
EAPQGDSSADNFTYDPKDPTPTVGG

SEQ ID NO: 461783 - protein, 10 aa, Mycobacterium
EAPQPGRPAI

SEQ ID NO: 461784 - protein, 6 aa, Mycobacterium
EAPQVT

SEQ ID NO: 461785 - protein, 7 aa, Mycobacterium
EAPRASH

SEQ ID NO: 461786 - protein, 6 aa, Mycobacterium
EAPRDA

SEQ ID NO: 461787 - protein, 6 aa, Mycobacterium
EAPREL

SEQ ID NO: 461788 - protein, 7 aa, Mycobacterium
EAPREPD

SEQ ID NO: 461789 - protein, 6 aa, Mycobacterium
EAPRHP

SEQ ID NO: 461790 - protein, 9 aa, Mycobacterium
EAPRLTPPP

SEQ ID NO: 461791 - protein, 8 aa, Mycobacterium
EAPRPEPA

SEQ ID NO: 461792 - protein, 5 aa, Mycobacterium
EAPRQ

SEQ ID NO: 461793 - protein, 8 aa, Mycobacterium
EAPRRDDG

SEQ ID NO: 461794 - protein, 17 aa, Mycobacterium
EAPRRQPQIEASKARVT

SEQ ID NO: 461795 - protein, 6 aa, Mycobacterium
EAPRTC

SEQ ID NO: 461796 - protein, 9 aa, Mycobacterium
EAPRTGSAT

SEQ ID NO: 461797 - protein, 8 aa, Mycobacterium
EAPRTPVR

SEQ ID NO: 461798 - protein, 9 aa, Mycobacterium
EAPSDKPGA

SEQ ID NO: 461799 - protein, 15 aa, Mycobacterium
EAPSEVRADGAASGC

SEQ ID NO: 461800 - protein, 12 aa, Mycobacterium
EAPSLEDADLTP

SEQ ID NO: 461801 - protein, 5 aa, Mycobacterium
EAPSP

SEQ ID NO: 461802 - protein, 8 aa, Mycobacterium
EAPSPLLD

SEQ ID NO: 461803 - protein, 9 aa, Mycobacterium
EAPSPLLDP

SEQ ID NO: 461804 - protein, 7 aa, Mycobacterium
EAPSPLV

SEQ ID NO: 461805 - protein, 12 aa, Mycobacterium
EAPSPLVERTPG

SEQ ID NO: 461806 - protein, 8 aa, Mycobacterium
EAPSPVVD

SEQ ID NO: 461807 - protein, 15 aa, Mycobacterium
EAPSRGDDPSGGEFE

SEQ ID NO: 461808 - protein, 9 aa, Mycobacterium
EAPSTAVDP

SEQ ID NO: 461809 - protein, 4 aa, Mycobacterium
EAPT

SEQ ID NO: 461810 - protein, 6 aa, Mycobacterium
EAPTAA

SEQ ID NO: 461811 - protein, 9 aa, Mycobacterium
EAPTAPEAV

SEQ ID NO: 461812 - protein, 12 aa, Mycobacterium
EAPTDPDERDAL

SEQ ID NO: 461813 - protein, 13 aa, Mycobacterium
EAPTEELAQQPLD

SEQ ID NO: 461814 - protein, 5 aa, Mycobacterium
EAPTG

SEQ ID NO: 461815 - protein, 13 aa, Mycobacterium
EAPTGTERDAARE

SEQ ID NO: 461816 - protein, 9 aa, Mycobacterium
EAPTGTGKS

SEQ ID NO: 461817 - protein, 8 aa, Mycobacterium
EAPTPGGH

SEQ ID NO: 461818 - protein, 6 aa, Mycobacterium
EAPTTA

SEQ ID NO: 461819 - protein, 5 aa, Mycobacterium
EAPVD

SEQ ID NO: 461820 - protein, 6 aa, Mycobacterium
EAPVPA

SEQ ID NO: 461821 - protein, 22 aa, Mycobacterium
EAPVPESGASANALSARGHARR

SEQ ID NO: 461822 - protein, 6 aa, Mycobacterium
EAPVPV

SEQ ID NO: 461823 - protein, 13 aa, Mycobacterium
EAPVSDVPASYQQ

SEQ ID NO: 461824 - protein, 9 aa, Mycobacterium
EAPVSDVPP

SEQ ID NO: 461825 - protein, 7 aa, Mycobacterium
EAPWDPR

SEQ ID NO: 461826 - protein, 5 aa, Mycobacterium
EAPYD

SEQ ID NO: 461827 - protein, 8 aa, Mycobacterium
EAPYPPQA

SEQ ID NO: 461828 - protein, 7 aa, Mycobacterium
EAPYTEQ

SEQ ID NO: 461829 - protein, 4 aa, Mycobacterium
EAQA

SEQ ID NO: 461830 - protein, 10 aa, Mycobacterium
EAQAARDGLV

SEQ ID NO: 461831 - protein, 7 aa, Mycobacterium
EAQADGV

SEQ ID NO: 461832 - protein, 7 aa, Mycobacterium
EAQADYA

SEQ ID NO: 461833 - protein, 10 aa, Mycobacterium
EAQAGATISR

SEQ ID NO: 461834 - protein, 9 aa, Mycobacterium
EAQAQLEKY

SEQ ID NO: 461835 - protein, 14 aa, Mycobacterium
EAQARADATARGSD

SEQ ID NO: 461836 - protein, 9 aa, Mycobacterium
EAQARASGR

SEQ ID NO: 461837 - protein, 9 aa, Mycobacterium
EAQARESLH

SEQ ID NO: 461838 - protein, 8 aa, Mycobacterium
EAQARYGR

SEQ ID NO: 461839 - protein, 5 aa, Mycobacterium
EAQAY

SEQ ID NO: 461840 - protein, 10 aa, Mycobacterium
EAQDAGDEPF

SEQ ID NO: 461841 - protein, 6 aa, Mycobacterium
EAQDPR

SEQ ID NO: 461842 - protein, 7 aa, Mycobacterium
EAQDRFG

SEQ ID NO: 461843 - protein, 7 aa, Mycobacterium
EAQDRGL

SEQ ID NO: 461844 - protein, 4 aa, Mycobacterium
EAQE

SEQ ID NO: 461845 - protein, 12 aa, Mycobacterium
EAQEETGLDPAR

SEQ ID NO: 461846 - protein, 8 aa, Mycobacterium
EAQERDPD

SEQ ID NO: 461847 - protein, 18 aa, Mycobacterium
EAQERNERLATANTELQE

SEQ ID NO: 461848 - protein, 26 aa, Mycobacterium
EAQERSAATAAGAEEWHDPRADGKLP

SEQ ID NO: 461849 - protein, 6 aa, Mycobacterium
EAQERV

SEQ ID NO: 461850 - protein, 7 aa, Mycobacterium
EAQERYA

SEQ ID NO: 461851 - protein, 7 aa, Mycobacterium
EAQGEAV

SEQ ID NO: 461852 - protein, 8 aa, Mycobacterium
EAQGEMRE

SEQ ID NO: 461853 - protein, 7 aa, Mycobacterium
EAQGETV

SEQ ID NO: 461854 - protein, 7 aa, Mycobacterium
EAQGKRV

SEQ ID NO: 461855 - protein, 5 aa, Mycobacterium
EAQGL

SEQ ID NO: 461856 - protein, 8 aa, Mycobacterium
EAQGNGGS

SEQ ID NO: 461857 - protein, 10 aa, Mycobacterium
EAQGRNPDPI

SEQ ID NO: 461858 - protein, 5 aa, Mycobacterium
EAQGV

SEQ ID NO: 461859 - protein, 4 aa, Mycobacterium
EAQH

SEQ ID NO: 461860 - protein, 4 aa, Mycobacterium
EAQI

SEQ ID NO: 461861 - protein, 4 aa, Mycobacterium
EAQK

SEQ ID NO: 461862 - protein, 9 aa, Mycobacterium
EAQKAGAAA

SEQ ID NO: 461863 - protein, 6 aa, Mycobacterium
EAQKAT

SEQ ID NO: 461864 - protein, 16 aa, Mycobacterium
EAQKRRGVPSANARWG

SEQ ID NO: 461865 - protein, 4 aa, Mycobacterium
EAQM

SEQ ID NO: 461866 - protein, 4 aa, Mycobacterium
EAQN

SEQ ID NO: 461867 - protein, 15 aa, Mycobacterium
EAQNETNRERNRNAG

SEQ ID NO: 461868 - protein, 5 aa, Mycobacterium
EAQNY

SEQ ID NO: 461869 - protein, 12 aa, Mycobacterium
EAQPDRDKRGGQ

SEQ ID NO: 461870 - protein, 9 aa, Mycobacterium
EAQPGGPHS

SEQ ID NO: 461871 - protein, 21 aa, Mycobacterium
EAQPGTMKRPVKTKTGKQFTP

SEQ ID NO: 461872 - protein, 7 aa, Mycobacterium
EAQPGYG

SEQ ID NO: 461873 - protein, 13 aa, Mycobacterium
EAQPQYSAARREA

SEQ ID NO: 461874 - protein, 14 aa, Mycobacterium
EAQPRYSASRREAV

SEQ ID NO: 461875 - protein, 11 aa, Mycobacterium
EAQQADQELKN

SEQ ID NO: 461876 - protein, 8 aa, Mycobacterium
EAQQAGRP

SEQ ID NO: 461877 - protein, 7 aa, Mycobacterium
EAQQEGF

SEQ ID NO: 461878 - protein, 7 aa, Mycobacterium
EAQQGTW

SEQ ID NO: 461879 - protein, 9 aa, Mycobacterium
EAQQHRAPI

SEQ ID NO: 461880 - protein, 9 aa, Mycobacterium
EAQQQSDGR

SEQ ID NO: 461881 - protein, 8 aa, Mycobacterium
EAQQQSKG

SEQ ID NO: 461882 - protein, 8 aa, Mycobacterium
EAQQSGVP

SEQ ID NO: 461883 - protein, 11 aa, Mycobacterium
EAQRASTPAYD

SEQ ID NO: 461884 - protein, 25 aa, Mycobacterium
EAQRDPTAAGKRQAAAASAARPQDV

SEQ ID NO: 461885 - protein, 5 aa, Mycobacterium
EAQRE

SEQ ID NO: 461886 - protein, 6 aa, Mycobacterium
EAQREL

SEQ ID NO: 461887 - protein, 7 aa, Mycobacterium
EAQRERR

SEQ ID NO: 461888 - protein, 7 aa, Mycobacterium
EAQRGRD

SEQ ID NO: 461889 - protein, 5 aa, Mycobacterium
EAQRH

SEQ ID NO: 461890 - protein, 5 aa, Mycobacterium
EAQRP

SEQ ID NO: 461891 - protein, 7 aa, Mycobacterium
EAQRQDP

SEQ ID NO: 461892 - protein, 7 aa, Mycobacterium
EAQRQPG

SEQ ID NO: 461893 - protein, 14 aa, Mycobacterium
EAQRRISEAAAPID

SEQ ID NO: 461894 - protein, 14 aa, Mycobacterium
EAQRRQLRAELART

SEQ ID NO: 461895 - protein, 6 aa, Mycobacterium
EAQRSA

SEQ ID NO: 461896 - protein, 11 aa, Mycobacterium
EAQRSGNGEIS

SEQ ID NO: 461897 - protein, 9 aa, Mycobacterium
EAQRTHQAL

SEQ ID NO: 461898 - protein, 6 aa, Mycobacterium
EAQRTL

SEQ ID NO: 461899 - protein, 5 aa, Mycobacterium
EAQSD

SEQ ID NO: 461900 - protein, 5 aa, Mycobacterium
EAQSI

SEQ ID NO: 461901 - protein, 12 aa, Mycobacterium
EAQTFPLSDYVI

SEQ ID NO: 461902 - protein, 7 aa, Mycobacterium
EAQTGRR

SEQ ID NO: 461903 - protein, 8 aa, Mycobacterium
EAQTMDPQ

SEQ ID NO: 461904 - protein, 4 aa, Mycobacterium
EAQV

SEQ ID NO: 461905 - protein, 7 aa, Mycobacterium
EARAAAD

SEQ ID NO: 461906 - protein, 47 aa, Mycobacterium
EARAAARAQGKDAGRGRSVPPSPRRVAGQRRSWSGPGPDARDPQPLG

SEQ ID NO: 461907 - protein, 8 aa, Mycobacterium
EARAAGRT

SEQ ID NO: 461908 - protein, 8 aa, Mycobacterium
EARAAQSV

SEQ ID NO: 461909 - protein, 9 aa, Mycobacterium
EARAARPVA

SEQ ID NO: 461910 - protein, 10 aa, Mycobacterium
EARADGAQTN

SEQ ID NO: 461911 - protein, 10 aa, Mycobacterium
EARADHPNVR

SEQ ID NO: 461912 - protein, 5 aa, Mycobacterium
EARAE

SEQ ID NO: 461913 - protein, 8 aa, Mycobacterium
EARAEANG

SEQ ID NO: 461914 - protein, 7 aa, Mycobacterium
EARAEAS

SEQ ID NO: 461915 - protein, 6 aa, Mycobacterium
EARAER

SEQ ID NO: 461916 - protein, 7 aa, Mycobacterium
EARAGAR

SEQ ID NO: 461917 - protein, 10 aa, Mycobacterium
EARAGGVPKV

SEQ ID NO: 461918 - protein, 7 aa, Mycobacterium
EARAGRT

SEQ ID NO: 461919 - protein, 8 aa, Mycobacterium
EARAPSES

SEQ ID NO: 461920 - protein, 12 aa, Mycobacterium
EARASAEVHPSR

SEQ ID NO: 461921 - protein, 19 aa, Mycobacterium
EARATAEKTVTEARTKAEA

SEQ ID NO: 461922 - protein, 7 aa, Mycobacterium
EARATGR

SEQ ID NO: 461923 - protein, 4 aa, Mycobacterium
EARD

SEQ ID NO: 461924 - protein, 11 aa, Mycobacterium
EARDAARDGGH

SEQ ID NO: 461925 - protein, 7 aa, Mycobacterium
EARDASV

SEQ ID NO: 461926 - protein, 7 aa, Mycobacterium
EARDDAV

SEQ ID NO: 461927 - protein, 7 aa, Mycobacterium
EARDDRQ

SEQ ID NO: 461928 - protein, 31 aa, Mycobacterium
EARDGDSSQTRAARDRDRATPRDVSSVESDR

SEQ ID NO: 461929 - protein, 7 aa, Mycobacterium
EARDGVQ

SEQ ID NO: 461930 - protein, 9 aa, Mycobacterium
EARDNREGW

SEQ ID NO: 461931 - protein, 8 aa, Mycobacterium
EARDPAAV

SEQ ID NO: 461932 - protein, 6 aa, Mycobacterium
EARDQG

SEQ ID NO: 461933 - protein, 7 aa, Mycobacterium
EARDQGL

SEQ ID NO: 461934 - protein, 15 aa, Mycobacterium
EARDRAQAAREPGLT

SEQ ID NO: 461935 - protein, 7 aa, Mycobacterium
EARDRED

SEQ ID NO: 461936 - protein, 6 aa, Mycobacterium
EARDVT

SEQ ID NO: 461937 - protein, 6 aa, Mycobacterium
EAREDT

SEQ ID NO: 461938 - protein, 11 aa, Mycobacterium
EAREDTGALRR

SEQ ID NO: 461939 - protein, 8 aa, Mycobacterium
EAREETGI

SEQ ID NO: 461940 - protein, 20 aa, Mycobacterium
EAREQAQQEAKSGPSAIPGT

SEQ ID NO: 461941 - protein, 9 aa, Mycobacterium
EARERTAEQ

SEQ ID NO: 461942 - protein, 78 aa, Mycobacterium
EAREVSASTINRYGEGAGGVNDQVNKPGDSPRISGDGDPRLPDKPAGEIGSIDDPAAADELQSGDAAQGLGESTGQGM

SEQ ID NO: 461943 - protein, 14 aa, Mycobacterium
EAREVSDEEHQRFT

SEQ ID NO: 461944 - protein, 7 aa, Mycobacterium
EAREYAQ

SEQ ID NO: 461945 - protein, 5 aa, Mycobacterium
EARGA

SEQ ID NO: 461946 - protein, 45 aa, Mycobacterium
EARGAAKQQGKDIGRGGRSPEQRRRVAGGRRTWSGPGPDARDPQL

SEQ ID NO: 461947 - protein, 11 aa, Mycobacterium
EARGADPTAIG

SEQ ID NO: 461948 - protein, 6 aa, Mycobacterium
EARGAT

SEQ ID NO: 461949 - protein, 8 aa, Mycobacterium
EARGDADR

SEQ ID NO: 461950 - protein, 7 aa, Mycobacterium
EARGDGV

SEQ ID NO: 461951 - protein, 9 aa, Mycobacterium
EARGEDPLS

SEQ ID NO: 461952 - protein, 9 aa, Mycobacterium
EARGELGDI

SEQ ID NO: 461953 - protein, 7 aa, Mycobacterium
EARGFPP

SEQ ID NO: 461954 - protein, 8 aa, Mycobacterium
EARGGTSR

SEQ ID NO: 461955 - protein, 6 aa, Mycobacterium
EARGHQ

SEQ ID NO: 461956 - protein, 8 aa, Mycobacterium
EARGKRTD

SEQ ID NO: 461957 - protein, 9 aa, Mycobacterium
EARGKRTDE

SEQ ID NO: 461958 - protein, 5 aa, Mycobacterium
EARGQ

SEQ ID NO: 461959 - protein, 6 aa, Mycobacterium
EARGRA

SEQ ID NO: 461960 - protein, 8 aa, Mycobacterium
EARGRDSG

SEQ ID NO: 461961 - protein, 6 aa, Mycobacterium
EARGRG

SEQ ID NO: 461962 - protein, 6 aa, Mycobacterium
EARGRQ

SEQ ID NO: 461963 - protein, 6 aa, Mycobacterium
EARGRS

SEQ ID NO: 461964 - protein, 8 aa, Mycobacterium
EARGVNTD

SEQ ID NO: 461965 - protein, 8 aa, Mycobacterium
EARHPPTV

SEQ ID NO: 461966 - protein, 5 aa, Mycobacterium
EARHT

SEQ ID NO: 461967 - protein, 4 aa, Mycobacterium
EARI

SEQ ID NO: 461968 - protein, 9 aa, Mycobacterium
EARKAEAAG

SEQ ID NO: 461969 - protein, 6 aa, Mycobacterium
EARKEE

SEQ ID NO: 461970 - protein, 12 aa, Mycobacterium
EARKGLAEGGIP

SEQ ID NO: 461971 - protein, 10 aa, Mycobacterium
EARKVTDKPS

SEQ ID NO: 461972 - protein, 11 aa, Mycobacterium
EARNDPSPHAS

SEQ ID NO: 461973 - protein, 11 aa, Mycobacterium
EARNGRPPRER

SEQ ID NO: 461974 - protein, 7 aa, Mycobacterium
EARNKEY

SEQ ID NO: 461975 - protein, 6 aa, Mycobacterium
EARNTD

SEQ ID NO: 461976 - protein, 8 aa, Mycobacterium
EARPDDSM

SEQ ID NO: 461977 - protein, 6 aa, Mycobacterium
EARPDL

SEQ ID NO: 461978 - protein, 9 aa, Mycobacterium
EARPGATEA

SEQ ID NO: 461979 - protein, 28 aa, Mycobacterium
EARPGEDWTGQQQFSGDNPFGMGEGTQA

SEQ ID NO: 461980 - protein, 7 aa, Mycobacterium
EARPGMP

SEQ ID NO: 461981 - protein, 8 aa, Mycobacterium
EARPPAAG

SEQ ID NO: 461982 - protein, 6 aa, Mycobacterium
EARPQA

SEQ ID NO: 461983 - protein, 8 aa, Mycobacterium
EARPRLAE

SEQ ID NO: 461984 - protein, 13 aa, Mycobacterium
EARPRQHATPSHA

SEQ ID NO: 461985 - protein, 17 aa, Mycobacterium
EARPSDSVLSEEAADNL

SEQ ID NO: 461986 - protein, 8 aa, Mycobacterium
EARPSGET

SEQ ID NO: 461987 - protein, 18 aa, Mycobacterium
EARPWTNRRATDSSDVPG

SEQ ID NO: 461988 - protein, 6 aa, Mycobacterium
EARQEP

SEQ ID NO: 461989 - protein, 15 aa, Mycobacterium
EARQESQSVKDGKAT

SEQ ID NO: 461990 - protein, 7 aa, Mycobacterium
EARQHSE

SEQ ID NO: 461991 - protein, 7 aa, Mycobacterium
EARQPEF

SEQ ID NO: 461992 - protein, 7 aa, Mycobacterium
EARQPSF

SEQ ID NO: 461993 - protein, 5 aa, Mycobacterium
EARQR

SEQ ID NO: 461994 - protein, 17 aa, Mycobacterium
EARQTAETTVTEARQRA

SEQ ID NO: 461995 - protein, 6 aa, Mycobacterium
EARRAA

SEQ ID NO: 461996 - protein, 11 aa, Mycobacterium
EARRAAAEAGY

SEQ ID NO: 461997 - protein, 11 aa, Mycobacterium
EARRAAHRAGY

SEQ ID NO: 461998 - protein, 8 aa, Mycobacterium
EARRAQAH

SEQ ID NO: 461999 - protein, 7 aa, Mycobacterium
EARRARE

SEQ ID NO: 462000 - protein, 7 aa, Mycobacterium
EARRDEA

SEQ ID NO: 462001 - protein, 8 aa, Mycobacterium
EARRGEEL

SEQ ID NO: 462002 - protein, 6 aa, Mycobacterium
EARRHD

SEQ ID NO: 462003 - protein, 6 aa, Mycobacterium
EARRIT

SEQ ID NO: 462004 - protein, 8 aa, Mycobacterium
EARRLSRT

SEQ ID NO: 462005 - protein, 14 aa, Mycobacterium
EARRPESTAPKFDE

SEQ ID NO: 462006 - protein, 14 aa, Mycobacterium
EARRPKSTAPQFDE

SEQ ID NO: 462007 - protein, 8 aa, Mycobacterium
EARRQRLG

SEQ ID NO: 462008 - protein, 6 aa, Mycobacterium
EARRRA

SEQ ID NO: 462009 - protein, 11 aa, Mycobacterium
EARRSRKQPPL

SEQ ID NO: 462010 - protein, 15 aa, Mycobacterium
EARRSTLASQHGAVS

SEQ ID NO: 462011 - protein, 5 aa, Mycobacterium
EARSA

SEQ ID NO: 462012 - protein, 7 aa, Mycobacterium
EARSDGL

SEQ ID NO: 462013 - protein, 7 aa, Mycobacterium
EARSDQL

SEQ ID NO: 462014 - protein, 9 aa, Mycobacterium
EARSEDDRA

SEQ ID NO: 462015 - protein, 7 aa, Mycobacterium
EARSENS

SEQ ID NO: 462016 - protein, 5 aa, Mycobacterium
EARSG

SEQ ID NO: 462017 - protein, 14 aa, Mycobacterium
EARSGRGPKQRTSV

SEQ ID NO: 462018 - protein, 7 aa, Mycobacterium
EARSPQA

SEQ ID NO: 462019 - protein, 9 aa, Mycobacterium
EARSQQAAK

SEQ ID NO: 462020 - protein, 6 aa, Mycobacterium
EARSRG

SEQ ID NO: 462021 - protein, 7 aa, Mycobacterium
EARSRGI

SEQ ID NO: 462022 - protein, 18 aa, Mycobacterium
EARSTAETTVAEARQRAD

SEQ ID NO: 462023 - protein, 10 aa, Mycobacterium
EARTAAGGAL

SEQ ID NO: 462024 - protein, 8 aa, Mycobacterium
EARTAANV

SEQ ID NO: 462025 - protein, 10 aa, Mycobacterium
EARTECPAGT

SEQ ID NO: 462026 - protein, 8 aa, Mycobacterium
EARTPDAL

SEQ ID NO: 462027 - protein, 7 aa, Mycobacterium
EARTPNA

SEQ ID NO: 462028 - protein, 5 aa, Mycobacterium
EARTR

SEQ ID NO: 462029 - protein, 6 aa, Mycobacterium
EARTRN

SEQ ID NO: 462030 - protein, 5 aa, Mycobacterium
EARTT

SEQ ID NO: 462031 - protein, 13 aa, Mycobacterium
EARTTAGRAARLT

SEQ ID NO: 462032 - protein, 8 aa, Mycobacterium
EARVRDAG

SEQ ID NO: 462033 - protein, 4 aa, Mycobacterium
EASA

SEQ ID NO: 462034 - protein, 7 aa, Mycobacterium
EASAAAG

SEQ ID NO: 462035 - protein, 11 aa, Mycobacterium
EASAAGRDPAA

SEQ ID NO: 462036 - protein, 11 aa, Mycobacterium
EASAAGRDPAT

SEQ ID NO: 462037 - protein, 21 aa, Mycobacterium
EASAANVRTAEDELMRLCGVP

SEQ ID NO: 462038 - protein, 6 aa, Mycobacterium
EASAAQ

SEQ ID NO: 462039 - protein, 6 aa, Mycobacterium
EASAAR

SEQ ID NO: 462040 - protein, 14 aa, Mycobacterium
EASAAVADSTITPR

SEQ ID NO: 462041 - protein, 11 aa, Mycobacterium
EASAEENPAAP

SEQ ID NO: 462042 - protein, 11 aa, Mycobacterium
EASAELATATH

SEQ ID NO: 462043 - protein, 14 aa, Mycobacterium
EASAESFPASDPIA

SEQ ID NO: 462044 - protein, 10 aa, Mycobacterium
EASAGNAAAA

SEQ ID NO: 462045 - protein, 6 aa, Mycobacterium
EASAME

SEQ ID NO: 462046 - protein, 9 aa, Mycobacterium
EASANGLGR

SEQ ID NO: 462047 - protein, 5 aa, Mycobacterium
EASAP

SEQ ID NO: 462048 - protein, 7 aa, Mycobacterium
EASAPTI

SEQ ID NO: 462049 - protein, 7 aa, Mycobacterium
EASAQET

SEQ ID NO: 462050 - protein, 10 aa, Mycobacterium
EASASGASVL

SEQ ID NO: 462051 - protein, 19 aa, Mycobacterium
EASASGASVLTGRKNKGAM

SEQ ID NO: 462052 - protein, 19 aa, Mycobacterium
EASASGSSVLAGRKSKGAI

SEQ ID NO: 462053 - protein, 23 aa, Mycobacterium
EASASGSSVMAGRKNKGASAYGE

SEQ ID NO: 462054 - protein, 20 aa, Mycobacterium
EASASGSSVMAGRKNKGAVA

SEQ ID NO: 462055 - protein, 23 aa, Mycobacterium
EASASGSSVMSGRKNKGASAYAD

SEQ ID NO: 462056 - protein, 11 aa, Mycobacterium
EASATDESYRD

SEQ ID NO: 462057 - protein, 18 aa, Mycobacterium
EASAVPDEPGQGPGEKYL

SEQ ID NO: 462058 - protein, 5 aa, Mycobacterium
EASDA

SEQ ID NO: 462059 - protein, 6 aa, Mycobacterium
EASDAL

SEQ ID NO: 462060 - protein, 7 aa, Mycobacterium
EASDEFR

SEQ ID NO: 462061 - protein, 5 aa, Mycobacterium
EASDR

SEQ ID NO: 462062 - protein, 9 aa, Mycobacterium
EASDREDQI

SEQ ID NO: 462063 - protein, 8 aa, Mycobacterium
EASDRGAH

SEQ ID NO: 462064 - protein, 8 aa, Mycobacterium
EASDTEAS

SEQ ID NO: 462065 - protein, 11 aa, Mycobacterium
EASDVESVDGG

SEQ ID NO: 462066 - protein, 7 aa, Mycobacterium
EASDVTV

SEQ ID NO: 462067 - protein, 4 aa, Mycobacterium
EASE

SEQ ID NO: 462068 - protein, 9 aa, Mycobacterium
EASEADRRK

SEQ ID NO: 462069 - protein, 15 aa, Mycobacterium
EASEAGQLREGINPK

SEQ ID NO: 462070 - protein, 9 aa, Mycobacterium
EASEGESLD

SEQ ID NO: 462071 - protein, 9 aa, Mycobacterium
EASEPAEIN

SEQ ID NO: 462072 - protein, 10 aa, Mycobacterium
EASEPAEVNE

SEQ ID NO: 462073 - protein, 9 aa, Mycobacterium
EASEPARVN

SEQ ID NO: 462074 - protein, 15 aa, Mycobacterium
EASEQNSADEPVLVS

SEQ ID NO: 462075 - protein, 8 aa, Mycobacterium
EASERDPE

SEQ ID NO: 462076 - protein, 10 aa, Mycobacterium
EASETNPGAA

SEQ ID NO: 462077 - protein, 7 aa, Mycobacterium
EASFTGP

SEQ ID NO: 462078 - protein, 6 aa, Mycobacterium
EASGAS

SEQ ID NO: 462079 - protein, 6 aa, Mycobacterium
EASGDR

SEQ ID NO: 462080 - protein, 14 aa, Mycobacterium
EASGGKAVAHTGSV

SEQ ID NO: 462081 - protein, 8 aa, Mycobacterium
EASGGLSL

SEQ ID NO: 462082 - protein, 11 aa, Mycobacterium
EASGGSGRRLD

SEQ ID NO: 462083 - protein, 8 aa, Mycobacterium
EASGGWDG

SEQ ID NO: 462084 - protein, 7 aa, Mycobacterium
EASGHRE

SEQ ID NO: 462085 - protein, 6 aa, Mycobacterium
EASGLT

SEQ ID NO: 462086 - protein, 6 aa, Mycobacterium
EASGPV

SEQ ID NO: 462087 - protein, 12 aa, Mycobacterium
EASGQKLPRFRP

SEQ ID NO: 462088 - protein, 5 aa, Mycobacterium
EASGR

SEQ ID NO: 462089 - protein, 9 aa, Mycobacterium
EASGSETVA

SEQ ID NO: 462090 - protein, 9 aa, Mycobacterium
EASGTGAEL

SEQ ID NO: 462091 - protein, 8 aa, Mycobacterium
EASGTLTL

SEQ ID NO: 462092 - protein, 5 aa, Mycobacterium
EASGV

SEQ ID NO: 462093 - protein, 5 aa, Mycobacterium
EASHD

SEQ ID NO: 462094 - protein, 8 aa, Mycobacterium
EASHEPGH

SEQ ID NO: 462095 - protein, 6 aa, Mycobacterium
EASHGM

SEQ ID NO: 462096 - protein, 7 aa, Mycobacterium
EASHHEG

SEQ ID NO: 462097 - protein, 5 aa, Mycobacterium
EASHN

SEQ ID NO: 462098 - protein, 12 aa, Mycobacterium
EASINDTPIAET

SEQ ID NO: 462099 - protein, 5 aa, Mycobacterium
EASKQ

SEQ ID NO: 462100 - protein, 6 aa, Mycobacterium
EASKQR

SEQ ID NO: 462101 - protein, 5 aa, Mycobacterium
EASKR

SEQ ID NO: 462102 - protein, 12 aa, Mycobacterium
EASKRARADHER

SEQ ID NO: 462103 - protein, 9 aa, Mycobacterium
EASLRDRER

SEQ ID NO: 462104 - protein, 5 aa, Mycobacterium
EASMA

SEQ ID NO: 462105 - protein, 10 aa, Mycobacterium
EASNAAGLPP

SEQ ID NO: 462106 - protein, 7 aa, Mycobacterium
EASNAVE

SEQ ID NO: 462107 - protein, 4 aa, Mycobacterium
EASP

SEQ ID NO: 462108 - protein, 7 aa, Mycobacterium
EASPARR

SEQ ID NO: 462109 - protein, 5 aa, Mycobacterium
EASPD

SEQ ID NO: 462110 - protein, 8 aa, Mycobacterium
EASPEYQG

SEQ ID NO: 462111 - protein, 10 aa, Mycobacterium
EASPGNMGTV

SEQ ID NO: 462112 - protein, 8 aa, Mycobacterium
EASPIGPL

SEQ ID NO: 462113 - protein, 11 aa, Mycobacterium
EASQPEREFEE

SEQ ID NO: 462114 - protein, 9 aa, Mycobacterium
EASQPTAEE

SEQ ID NO: 462115 - protein, 8 aa, Mycobacterium
EASQRDPE

SEQ ID NO: 462116 - protein, 7 aa, Mycobacterium
EASQRGV

SEQ ID NO: 462117 - protein, 5 aa, Mycobacterium
EASQV

SEQ ID NO: 462118 - protein, 8 aa, Mycobacterium
EASQYEPN

SEQ ID NO: 462119 - protein, 5 aa, Mycobacterium
EASRA

SEQ ID NO: 462120 - protein, 18 aa, Mycobacterium
EASRASHDWARGKRDQLI

SEQ ID NO: 462121 - protein, 18 aa, Mycobacterium
EASRASHEWAKGKREDLI

SEQ ID NO: 462122 - protein, 5 aa, Mycobacterium
EASRF

SEQ ID NO: 462123 - protein, 26 aa, Mycobacterium
EASRGGNPALRGKNGPLRVGPASPVN

SEQ ID NO: 462124 - protein, 7 aa, Mycobacterium
EASRLAS

SEQ ID NO: 462125 - protein, 7 aa, Mycobacterium
EASRPED

SEQ ID NO: 462126 - protein, 5 aa, Mycobacterium
EASRR

SEQ ID NO: 462127 - protein, 7 aa, Mycobacterium
EASRRGA

SEQ ID NO: 462128 - protein, 24 aa, Mycobacterium
EASRRIKEAADLGQRHGLTGEPLP

SEQ ID NO: 462129 - protein, 42 aa, Mycobacterium
EASRRIKEARDLGPRHGLTGEPLPPALPATAAAQRAGDLGAG

SEQ ID NO: 462130 - protein, 6 aa, Mycobacterium
EASRRS

SEQ ID NO: 462131 - protein, 7 aa, Mycobacterium
EASRSDE

SEQ ID NO: 462132 - protein, 5 aa, Mycobacterium
EASSA

SEQ ID NO: 462133 - protein, 12 aa, Mycobacterium
EASSAGRDPASL

SEQ ID NO: 462134 - protein, 7 aa, Mycobacterium
EASSARV

SEQ ID NO: 462135 - protein, 10 aa, Mycobacterium
EASSDDRAGA

SEQ ID NO: 462136 - protein, 7 aa, Mycobacterium
EASSDYG

SEQ ID NO: 462137 - protein, 9 aa, Mycobacterium
EASSEAEAE

SEQ ID NO: 462138 - protein, 22 aa, Mycobacterium
EASSGNAPRPADLPTRRTGAER

SEQ ID NO: 462139 - protein, 5 aa, Mycobacterium
EASSL

SEQ ID NO: 462140 - protein, 7 aa, Mycobacterium
EASSPRA

SEQ ID NO: 462141 - protein, 30 aa, Mycobacterium
EASSRRAAQTSTAATTPGPARNLTAPTATP

SEQ ID NO: 462142 - protein, 7 aa, Mycobacterium
EASSRTK

SEQ ID NO: 462143 - protein, 10 aa, Mycobacterium
EASSSRTAMA

SEQ ID NO: 462144 - protein, 8 aa, Mycobacterium
EASTGGDE

SEQ ID NO: 462145 - protein, 7 aa, Mycobacterium
EASTGML

SEQ ID NO: 462146 - protein, 5 aa, Mycobacterium
EASTL

SEQ ID NO: 462147 - protein, 10 aa, Mycobacterium
EASTPEREFE

SEQ ID NO: 462148 - protein, 6 aa, Mycobacterium
EASTTL

SEQ ID NO: 462149 - protein, 20 aa, Mycobacterium
EASTTRSSEPGAPPASQPQA

SEQ ID NO: 462150 - protein, 4 aa, Mycobacterium
EASV

SEQ ID NO: 462151 - protein, 6 aa, Mycobacterium
EASVPG

SEQ ID NO: 462152 - protein, 5 aa, Mycobacterium
EASVR

SEQ ID NO: 462153 - protein, 5 aa, Mycobacterium
EASYI

SEQ ID NO: 462154 - protein, 7 aa, Mycobacterium
EASYPLP

SEQ ID NO: 462155 - protein, 6 aa, Mycobacterium
EASYRS

SEQ ID NO: 462156 - protein, 6 aa, Mycobacterium
EASYTA

SEQ ID NO: 462157 - protein, 4 aa, Mycobacterium
EATA

SEQ ID NO: 462158 - protein, 8 aa, Mycobacterium
EATAAAGL

SEQ ID NO: 462159 - protein, 8 aa, Mycobacterium
EATAAHAP

SEQ ID NO: 462160 - protein, 9 aa, Mycobacterium
EATAAHSPD

SEQ ID NO: 462161 - protein, 11 aa, Mycobacterium
EATAAQPAGEV

SEQ ID NO: 462162 - protein, 7 aa, Mycobacterium
EATAATV

SEQ ID NO: 462163 - protein, 15 aa, Mycobacterium
EATADEDRLPSRGEL

SEQ ID NO: 462164 - protein, 7 aa, Mycobacterium
EATAEAE

SEQ ID NO: 462165 - protein, 7 aa, Mycobacterium
EATAESV

SEQ ID NO: 462166 - protein, 7 aa, Mycobacterium
EATAHAQ

SEQ ID NO: 462167 - protein, 7 aa, Mycobacterium
EATAIDP

SEQ ID NO: 462168 - protein, 16 aa, Mycobacterium
EATAKDINDNHRNSRY

SEQ ID NO: 462169 - protein, 10 aa, Mycobacterium
EATAKDPLAG

SEQ ID NO: 462170 - protein, 10 aa, Mycobacterium
EATAPAQEAG

SEQ ID NO: 462171 - protein, 7 aa, Mycobacterium
EATAQTL

SEQ ID NO: 462172 - protein, 11 aa, Mycobacterium
EATARAAAEGA

SEQ ID NO: 462173 - protein, 11 aa, Mycobacterium
EATARAAARGG

SEQ ID NO: 462174 - protein, 11 aa, Mycobacterium
EATARQARTVR

SEQ ID NO: 462175 - protein, 5 aa, Mycobacterium
EATAS

SEQ ID NO: 462176 - protein, 16 aa, Mycobacterium
EATASDINDNHRNSRY

SEQ ID NO: 462177 - protein, 8 aa, Mycobacterium
EATASGYA

SEQ ID NO: 462178 - protein, 9 aa, Mycobacterium
EATASIPLS

SEQ ID NO: 462179 - protein, 7 aa, Mycobacterium
EATATGA

SEQ ID NO: 462180 - protein, 4 aa, Mycobacterium
EATD

SEQ ID NO: 462181 - protein, 10 aa, Mycobacterium
EATDAERDEY

SEQ ID NO: 462182 - protein, 7 aa, Mycobacterium
EATDDAT

SEQ ID NO: 462183 - protein, 10 aa, Mycobacterium
EATDDEVNAE

SEQ ID NO: 462184 - protein, 6 aa, Mycobacterium
EATDDQ

SEQ ID NO: 462185 - protein, 10 aa, Mycobacterium
EATDGGDRPI

SEQ ID NO: 462186 - protein, 7 aa, Mycobacterium
EATDNPV

SEQ ID NO: 462187 - protein, 8 aa, Mycobacterium
EATDPLTR

SEQ ID NO: 462188 - protein, 15 aa, Mycobacterium
EATDSAGKITKRGAE

SEQ ID NO: 462189 - protein, 14 aa, Mycobacterium
EATDSSGKITRRGA

SEQ ID NO: 462190 - protein, 15 aa, Mycobacterium
EATDSSGNITKRGAD

SEQ ID NO: 462191 - protein, 8 aa, Mycobacterium
EATDTETF

SEQ ID NO: 462192 - protein, 4 aa, Mycobacterium
EATE

SEQ ID NO: 462193 - protein, 14 aa, Mycobacterium
EATEAAAKQLGGGE

SEQ ID NO: 462194 - protein, 14 aa, Mycobacterium
EATEAAATALGGSD

SEQ ID NO: 462195 - protein, 7 aa, Mycobacterium
EATEAPT

SEQ ID NO: 462196 - protein, 8 aa, Mycobacterium
EATEESGI

SEQ ID NO: 462197 - protein, 9 aa, Mycobacterium
EATEESGIS

SEQ ID NO: 462198 - protein, 8 aa, Mycobacterium
EATEESGV

SEQ ID NO: 462199 - protein, 11 aa, Mycobacterium
EATEETGVDTS

SEQ ID NO: 462200 - protein, 18 aa, Mycobacterium
EATEFTEEAEALSAKAQE

SEQ ID NO: 462201 - protein, 20 aa, Mycobacterium
EATEGDGMPAPGEISEQEAA

SEQ ID NO: 462202 - protein, 6 aa, Mycobacterium
EATEGK

SEQ ID NO: 462203 - protein, 12 aa, Mycobacterium
EATEPWAHRRPT

SEQ ID NO: 462204 - protein, 6 aa, Mycobacterium
EATEYK

SEQ ID NO: 462205 - protein, 8 aa, Mycobacterium
EATGAERA

SEQ ID NO: 462206 - protein, 9 aa, Mycobacterium
EATGAERAQ

SEQ ID NO: 462207 - protein, 10 aa, Mycobacterium
EATGAERAQV

SEQ ID NO: 462208 - protein, 10 aa, Mycobacterium
EATGAPTAAH

SEQ ID NO: 462209 - protein, 11 aa, Mycobacterium
EATGASEDDDR

SEQ ID NO: 462210 - protein, 16 aa, Mycobacterium
EATGDADSTDTLIGAQ

SEQ ID NO: 462211 - protein, 9 aa, Mycobacterium
EATGDPEAF

SEQ ID NO: 462212 - protein, 9 aa, Mycobacterium
EATGDRGKI

SEQ ID NO: 462213 - protein, 11 aa, Mycobacterium
EATGDSTEDDV

SEQ ID NO: 462214 - protein, 9 aa, Mycobacterium
EATGEDQIT

SEQ ID NO: 462215 - protein, 9 aa, Mycobacterium
EATGEMTPT

SEQ ID NO: 462216 - protein, 8 aa, Mycobacterium
EATGGAGL

SEQ ID NO: 462217 - protein, 10 aa, Mycobacterium
EATGGGPDPI

SEQ ID NO: 462218 - protein, 6 aa, Mycobacterium
EATGGK

SEQ ID NO: 462219 - protein, 14 aa, Mycobacterium
EATGGLAGRCTQPD

SEQ ID NO: 462220 - protein, 6 aa, Mycobacterium
EATGGM

SEQ ID NO: 462221 - protein, 6 aa, Mycobacterium
EATGGN

SEQ ID NO: 462222 - protein, 6 aa, Mycobacterium
EATGGS

SEQ ID NO: 462223 - protein, 7 aa, Mycobacterium
EATGHGQ

SEQ ID NO: 462224 - protein, 5 aa, Mycobacterium
EATGI

SEQ ID NO: 462225 - protein, 8 aa, Mycobacterium
EATGIKSE

SEQ ID NO: 462226 - protein, 10 aa, Mycobacterium
EATGIPATTS

SEQ ID NO: 462227 - protein, 9 aa, Mycobacterium
EATGKTPAQ

SEQ ID NO: 462228 - protein, 9 aa, Mycobacterium
EATGLPKSS

SEQ ID NO: 462229 - protein, 8 aa, Mycobacterium
EATGLTPD

SEQ ID NO: 462230 - protein, 8 aa, Mycobacterium
EATGNSDA

SEQ ID NO: 462231 - protein, 7 aa, Mycobacterium
EATGQHV

SEQ ID NO: 462232 - protein, 10 aa, Mycobacterium
EATGQSDNPL

SEQ ID NO: 462233 - protein, 7 aa, Mycobacterium
EATGQTE

SEQ ID NO: 462234 - protein, 6 aa, Mycobacterium
EATGRG

SEQ ID NO: 462235 - protein, 10 aa, Mycobacterium
EATGRGPHET

SEQ ID NO: 462236 - protein, 8 aa, Mycobacterium
EATGRPVQ

SEQ ID NO: 462237 - protein, 7 aa, Mycobacterium
EATGRRG

SEQ ID NO: 462238 - protein, 10 aa, Mycobacterium
EATGRRPSAS

SEQ ID NO: 462239 - protein, 7 aa, Mycobacterium
EATGSLT

SEQ ID NO: 462240 - protein, 8 aa, Mycobacterium
EATGSPAV

SEQ ID NO: 462241 - protein, 5 aa, Mycobacterium
EATGT

SEQ ID NO: 462242 - protein, 10 aa, Mycobacterium
EATGTDTFET

SEQ ID NO: 462243 - protein, 9 aa, Mycobacterium
EATGTDTYE

SEQ ID NO: 462244 - protein, 9 aa, Mycobacterium
EATGTPEKL

SEQ ID NO: 462245 - protein, 17 aa, Mycobacterium
EATHGQENIEKVNMASF

SEQ ID NO: 462246 - protein, 7 aa, Mycobacterium
EATHRQI

SEQ ID NO: 462247 - protein, 4 aa, Mycobacterium
EATK

SEQ ID NO: 462248 - protein, 8 aa, Mycobacterium
EATKARRF

SEQ ID NO: 462249 - protein, 10 aa, Mycobacterium
EATKEEGGEI

SEQ ID NO: 462250 - protein, 7 aa, Mycobacterium
EATKENG

SEQ ID NO: 462251 - protein, 8 aa, Mycobacterium
EATKPGAR

SEQ ID NO: 462252 - protein, 4 aa, Mycobacterium
EATL

SEQ ID NO: 462253 - protein, 15 aa, Mycobacterium
EATLSLPSADNPDLS

SEQ ID NO: 462254 - protein, 7 aa, Mycobacterium
EATMGGP

SEQ ID NO: 462255 - protein, 9 aa, Mycobacterium
EATNARTEA

SEQ ID NO: 462256 - protein, 4 aa, Mycobacterium
EATP

SEQ ID NO: 462257 - protein, 5 aa, Mycobacterium
EATPA

SEQ ID NO: 462258 - protein, 8 aa, Mycobacterium
EATPAAES

SEQ ID NO: 462259 - protein, 6 aa, Mycobacterium
EATPAQ

SEQ ID NO: 462260 - protein, 7 aa, Mycobacterium
EATPARM

SEQ ID NO: 462261 - protein, 8 aa, Mycobacterium
EATPASTY

SEQ ID NO: 462262 - protein, 73 aa, Mycobacterium
EATPDTEDEHTDERDETERQSDEQEAETLEANGAGGGAGTDSSSVSAPGEMAPPSPSPPTTGNSMRFGRLNDA

SEQ ID NO: 462263 - protein, 5 aa, Mycobacterium
EATPE

SEQ ID NO: 462264 - protein, 6 aa, Mycobacterium
EATPEA

SEQ ID NO: 462265 - protein, 9 aa, Mycobacterium
EATPEERRA

SEQ ID NO: 462266 - protein, 7 aa, Mycobacterium
EATPFGG

SEQ ID NO: 462267 - protein, 7 aa, Mycobacterium
EATPGDS

SEQ ID NO: 462268 - protein, 6 aa, Mycobacterium
EATPHR

SEQ ID NO: 462269 - protein, 8 aa, Mycobacterium
EATPNQAR

SEQ ID NO: 462270 - protein, 5 aa, Mycobacterium
EATPQ

SEQ ID NO: 462271 - protein, 8 aa, Mycobacterium
EATPQDAL

SEQ ID NO: 462272 - protein, 5 aa, Mycobacterium
EATPR

SEQ ID NO: 462273 - protein, 6 aa, Mycobacterium
EATPRV

SEQ ID NO: 462274 - protein, 13 aa, Mycobacterium
EATPSEGNGREFS

SEQ ID NO: 462275 - protein, 7 aa, Mycobacterium
EATPSGA

SEQ ID NO: 462276 - protein, 5 aa, Mycobacterium
EATPT

SEQ ID NO: 462277 - protein, 11 aa, Mycobacterium
EATPTWSPQYQ

SEQ ID NO: 462278 - protein, 6 aa, Mycobacterium
EATPVA

SEQ ID NO: 462279 - protein, 7 aa, Mycobacterium
EATPVGG

SEQ ID NO: 462280 - protein, 18 aa, Mycobacterium
EATPVQAAATGTSGPANG

SEQ ID NO: 462281 - protein, 18 aa, Mycobacterium
EATPVQAAATGTTGPANG

SEQ ID NO: 462282 - protein, 15 aa, Mycobacterium
EATQAAARKLGGDGV

SEQ ID NO: 462283 - protein, 10 aa, Mycobacterium
EATQAELRGR

SEQ ID NO: 462284 - protein, 11 aa, Mycobacterium
EATQAELRGRG

SEQ ID NO: 462285 - protein, 8 aa, Mycobacterium
EATQDQRE

SEQ ID NO: 462286 - protein, 14 aa, Mycobacterium
EATQEAAEKLGGAD

SEQ ID NO: 462287 - protein, 7 aa, Mycobacterium
EATQPEH

SEQ ID NO: 462288 - protein, 8 aa, Mycobacterium
EATQRDAA

SEQ ID NO: 462289 - protein, 6 aa, Mycobacterium
EATQSA

SEQ ID NO: 462290 - protein, 8 aa, Mycobacterium
EATQTRYT

SEQ ID NO: 462291 - protein, 5 aa, Mycobacterium
EATRA

SEQ ID NO: 462292 - protein, 8 aa, Mycobacterium
EATRAATV

SEQ ID NO: 462293 - protein, 7 aa, Mycobacterium
EATRARP

SEQ ID NO: 462294 - protein, 8 aa, Mycobacterium
EATRASRK

SEQ ID NO: 462295 - protein, 9 aa, Mycobacterium
EATRDAVDG

SEQ ID NO: 462296 - protein, 6 aa, Mycobacterium
EATRDG

SEQ ID NO: 462297 - protein, 8 aa, Mycobacterium
EATRERAR

SEQ ID NO: 462298 - protein, 9 aa, Mycobacterium
EATRGRPDI

SEQ ID NO: 462299 - protein, 19 aa, Mycobacterium
EATRGRPEKSQGETGGNTR

SEQ ID NO: 462300 - protein, 9 aa, Mycobacterium
EATRHRSRD

SEQ ID NO: 462301 - protein, 7 aa, Mycobacterium
EATRIND

SEQ ID NO: 462302 - protein, 12 aa, Mycobacterium
EATRNGYSATLQ

SEQ ID NO: 462303 - protein, 7 aa, Mycobacterium
EATRNKC

SEQ ID NO: 462304 - protein, 7 aa, Mycobacterium
EATRPRF

SEQ ID NO: 462305 - protein, 6 aa, Mycobacterium
EATRQD

SEQ ID NO: 462306 - protein, 12 aa, Mycobacterium
EATRRDVDAART

SEQ ID NO: 462307 - protein, 7 aa, Mycobacterium
EATRRRG

SEQ ID NO: 462308 - protein, 7 aa, Mycobacterium
EATRTAG

SEQ ID NO: 462309 - protein, 5 aa, Mycobacterium
EATSA

SEQ ID NO: 462310 - protein, 12 aa, Mycobacterium
EATSAGDKEKAA

SEQ ID NO: 462311 - protein, 13 aa, Mycobacterium
EATSALDPETTSD

SEQ ID NO: 462312 - protein, 5 aa, Mycobacterium
EATSD

SEQ ID NO: 462313 - protein, 13 aa, Mycobacterium
EATSESRGPASVA

SEQ ID NO: 462314 - protein, 11 aa, Mycobacterium
EATSRAAARGA

SEQ ID NO: 462315 - protein, 9 aa, Mycobacterium
EATSRVAAR

SEQ ID NO: 462316 - protein, 22 aa, Mycobacterium
EATSRYLEPSGAGPLGSGTGFP

SEQ ID NO: 462317 - protein, 21 aa, Mycobacterium
EATSSAAPTLPALDGNSLAAG

SEQ ID NO: 462318 - protein, 9 aa, Mycobacterium
EATSTRDLS

SEQ ID NO: 462319 - protein, 7 aa, Mycobacterium
EATTAEH

SEQ ID NO: 462320 - protein, 5 aa, Mycobacterium
EATTI

SEQ ID NO: 462321 - protein, 10 aa, Mycobacterium
EATTLDPEQG

SEQ ID NO: 462322 - protein, 10 aa, Mycobacterium
EATTLGGAPT

SEQ ID NO: 462323 - protein, 10 aa, Mycobacterium
EATTLGPEQG

SEQ ID NO: 462324 - protein, 7 aa, Mycobacterium
EATTMTP

SEQ ID NO: 462325 - protein, 7 aa, Mycobacterium
EATTRTL

SEQ ID NO: 462326 - protein, 8 aa, Mycobacterium
EATTSPAV

SEQ ID NO: 462327 - protein, 8 aa, Mycobacterium
EATTSPQV

SEQ ID NO: 462328 - protein, 8 aa, Mycobacterium
EATTSPSV

SEQ ID NO: 462329 - protein, 26 aa, Mycobacterium
EATTTASNVEDAAQAYAATDEQNSAA

SEQ ID NO: 462330 - protein, 10 aa, Mycobacterium
EATVAKATDQ

SEQ ID NO: 462331 - protein, 10 aa, Mycobacterium
EATVEQAQAS

SEQ ID NO: 462332 - protein, 7 aa, Mycobacterium
EATVPDS

SEQ ID NO: 462333 - protein, 10 aa, Mycobacterium
EATVPPEGKD

SEQ ID NO: 462334 - protein, 5 aa, Mycobacterium
EATWA

SEQ ID NO: 462335 - protein, 20 aa, Mycobacterium
EATWAGTSARAANARVEQHT

SEQ ID NO: 462336 - protein, 10 aa, Mycobacterium
EATYRGVPPP

SEQ ID NO: 462337 - protein, 4 aa, Mycobacterium
EAVA

SEQ ID NO: 462338 - protein, 9 aa, Mycobacterium
EAVADQPSV

SEQ ID NO: 462339 - protein, 19 aa, Mycobacterium
EAVAEEQRKAFAARMKAAA

SEQ ID NO: 462340 - protein, 10 aa, Mycobacterium
EAVAGTPVGL

SEQ ID NO: 462341 - protein, 6 aa, Mycobacterium
EAVAPD

SEQ ID NO: 462342 - protein, 6 aa, Mycobacterium
EAVAPG

SEQ ID NO: 462343 - protein, 4 aa, Mycobacterium
EAVD

SEQ ID NO: 462344 - protein, 15 aa, Mycobacterium
EAVDASERAEGVPLP

SEQ ID NO: 462345 - protein, 10 aa, Mycobacterium
EAVDDPSRVD

SEQ ID NO: 462346 - protein, 6 aa, Mycobacterium
EAVDNG

SEQ ID NO: 462347 - protein, 13 aa, Mycobacterium
EAVDNPPQTTRAR

SEQ ID NO: 462348 - protein, 7 aa, Mycobacterium
EAVDRET

SEQ ID NO: 462349 - protein, 6 aa, Mycobacterium
EAVEGR

SEQ ID NO: 462350 - protein, 7 aa, Mycobacterium
EAVEGRD

SEQ ID NO: 462351 - protein, 9 aa, Mycobacterium
EAVENRPAD

SEQ ID NO: 462352 - protein, 9 aa, Mycobacterium
EAVEPPTLK

SEQ ID NO: 462353 - protein, 7 aa, Mycobacterium
EAVERAN

SEQ ID NO: 462354 - protein, 11 aa, Mycobacterium
EAVERPAERPN

SEQ ID NO: 462355 - protein, 6 aa, Mycobacterium
EAVGAA

SEQ ID NO: 462356 - protein, 12 aa, Mycobacterium
EAVGASGRVAQR

SEQ ID NO: 462357 - protein, 6 aa, Mycobacterium
EAVGDQ

SEQ ID NO: 462358 - protein, 5 aa, Mycobacterium
EAVGG

SEQ ID NO: 462359 - protein, 10 aa, Mycobacterium
EAVGKSTAAV

SEQ ID NO: 462360 - protein, 8 aa, Mycobacterium
EAVGRGDL

SEQ ID NO: 462361 - protein, 6 aa, Mycobacterium
EAVGRT

SEQ ID NO: 462362 - protein, 6 aa, Mycobacterium
EAVGSV

SEQ ID NO: 462363 - protein, 9 aa, Mycobacterium
EAVGTTTTA

SEQ ID NO: 462364 - protein, 10 aa, Mycobacterium
EAVNASPLQT

SEQ ID NO: 462365 - protein, 10 aa, Mycobacterium
EAVPADTVEA

SEQ ID NO: 462366 - protein, 6 aa, Mycobacterium
EAVPDP

SEQ ID NO: 462367 - protein, 5 aa, Mycobacterium
EAVPG

SEQ ID NO: 462368 - protein, 7 aa, Mycobacterium
EAVPGVD

SEQ ID NO: 462369 - protein, 9 aa, Mycobacterium
EAVPPDGEL

SEQ ID NO: 462370 - protein, 6 aa, Mycobacterium
EAVQGG

SEQ ID NO: 462371 - protein, 5 aa, Mycobacterium
EAVRA

SEQ ID NO: 462372 - protein, 13 aa, Mycobacterium
EAVRAADAGYERE

SEQ ID NO: 462373 - protein, 13 aa, Mycobacterium
EAVRAGAKQIDGS

SEQ ID NO: 462374 - protein, 9 aa, Mycobacterium
EAVRDGRPT

SEQ ID NO: 462375 - protein, 8 aa, Mycobacterium
EAVSASYD

SEQ ID NO: 462376 - protein, 10 aa, Mycobacterium
EAVSEHGVST

SEQ ID NO: 462377 - protein, 13 aa, Mycobacterium
EAVSGPAAGSTAH

SEQ ID NO: 462378 - protein, 13 aa, Mycobacterium
EAVSSGAGGTVEF

SEQ ID NO: 462379 - protein, 8 aa, Mycobacterium
EAVSSGHV

SEQ ID NO: 462380 - protein, 9 aa, Mycobacterium
EAVTAEAVS

SEQ ID NO: 462381 - protein, 14 aa, Mycobacterium
EAVTNPDGTGVRGK

SEQ ID NO: 462382 - protein, 5 aa, Mycobacterium
EAVTQ

SEQ ID NO: 462383 - protein, 8 aa, Mycobacterium
EAVTTEAV

SEQ ID NO: 462384 - protein, 4 aa, Mycobacterium
EAWA

SEQ ID NO: 462385 - protein, 6 aa, Mycobacterium
EAYAGA

SEQ ID NO: 462386 - protein, 13 aa, Mycobacterium
EAYASRSAGCAPD

SEQ ID NO: 462387 - protein, 7 aa, Mycobacterium
EAYDEQP

SEQ ID NO: 462388 - protein, 6 aa, Mycobacterium
EAYDGP

SEQ ID NO: 462389 - protein, 12 aa, Mycobacterium
EAYERHSDAEEA

SEQ ID NO: 462390 - protein, 9 aa, Mycobacterium
EAYGDPAGH

SEQ ID NO: 462391 - protein, 7 aa, Mycobacterium
EAYGQSK

SEQ ID NO: 462392 - protein, 8 aa, Mycobacterium
EAYPRTLD

SEQ ID NO: 462393 - protein, 4 aa, Mycobacterium
EAYQ

SEQ ID NO: 462394 - protein, 12 aa, Mycobacterium
EAYQIGEKGHPV

SEQ ID NO: 462395 - protein, 11 aa, Mycobacterium
EAYQIGETGHP

SEQ ID NO: 462396 - protein, 5 aa, Mycobacterium
EAYRS

SEQ ID NO: 462397 - protein, 8 aa, Mycobacterium
EAYSDATR

SEQ ID NO: 462398 - protein, 9 aa, Mycobacterium
EAYSGDGTM

SEQ ID NO: 462399 - protein, 16 aa, Mycobacterium
EAYSRDPRNVARKAEQ

SEQ ID NO: 462400 - protein, 12 aa, Mycobacterium
EAYTPQQAEDAR

SEQ ID NO: 462401 - protein, 13 aa, Mycobacterium
EAYYGDARPDQGV

SEQ ID NO: 462402 - protein, 9 aa, Mycobacterium
ECAADSSPR

SEQ ID NO: 462403 - protein, 4 aa, Mycobacterium
ECAD

SEQ ID NO: 462404 - protein, 8 aa, Mycobacterium
ECAEADQA

SEQ ID NO: 462405 - protein, 5 aa, Mycobacterium
ECAEP

SEQ ID NO: 462406 - protein, 4 aa, Mycobacterium
ECAG

SEQ ID NO: 462407 - protein, 18 aa, Mycobacterium
ECAPRTTPLADVMRVTFG

SEQ ID NO: 462408 - protein, 8 aa, Mycobacterium
ECARQPEL

SEQ ID NO: 462409 - protein, 8 aa, Mycobacterium
ECDDDDGV

SEQ ID NO: 462410 - protein, 8 aa, Mycobacterium
ECDEDDDV

SEQ ID NO: 462411 - protein, 11 aa, Mycobacterium
ECEKRDPKGLY

SEQ ID NO: 462412 - protein, 18 aa, Mycobacterium
ECEQATQRLTATRTAADA

SEQ ID NO: 462413 - protein, 11 aa, Mycobacterium
ECEQRDPKGLY

SEQ ID NO: 462414 - protein, 12 aa, Mycobacterium
ECETAAEASGVT

SEQ ID NO: 462415 - protein, 12 aa, Mycobacterium
ECGATADARRVG

SEQ ID NO: 462416 - protein, 4 aa, Mycobacterium
ECGG

SEQ ID NO: 462417 - protein, 7 aa, Mycobacterium
ECGGGPG

SEQ ID NO: 462418 - protein, 5 aa, Mycobacterium
ECGGP

SEQ ID NO: 462419 - protein, 11 aa, Mycobacterium
ECGGSGGTQTL

SEQ ID NO: 462420 - protein, 4 aa, Mycobacterium
ECGH

SEQ ID NO: 462421 - protein, 9 aa, Mycobacterium
ECGPDTREQ

SEQ ID NO: 462422 - protein, 6 aa, Mycobacterium
ECGRDP

SEQ ID NO: 462423 - protein, 6 aa, Mycobacterium
ECGREE

SEQ ID NO: 462424 - protein, 17 aa, Mycobacterium
ECGSDTVASGPTTAVES

SEQ ID NO: 462425 - protein, 12 aa, Mycobacterium
ECKGTGVTTRTR

SEQ ID NO: 462426 - protein, 9 aa, Mycobacterium
ECNGPRPSL

SEQ ID NO: 462427 - protein, 7 aa, Mycobacterium
ECNGSDV

SEQ ID NO: 462428 - protein, 6 aa, Mycobacterium
ECPDPT

SEQ ID NO: 462429 - protein, 6 aa, Mycobacterium
ECPGGT

SEQ ID NO: 462430 - protein, 5 aa, Mycobacterium
ECPGR

SEQ ID NO: 462431 - protein, 11 aa, Mycobacterium
ECPPDTAVTAP

SEQ ID NO: 462432 - protein, 9 aa, Mycobacterium
ECPPPTSTY

SEQ ID NO: 462433 - protein, 10 aa, Mycobacterium
ECPPPTSTYG

SEQ ID NO: 462434 - protein, 9 aa, Mycobacterium
ECPRGPRIS

SEQ ID NO: 462435 - protein, 6 aa, Mycobacterium
ECPRQA

SEQ ID NO: 462436 - protein, 4 aa, Mycobacterium
ECPY

SEQ ID NO: 462437 - protein, 4 aa, Mycobacterium
ECRG

SEQ ID NO: 462438 - protein, 6 aa, Mycobacterium
ECRGSG

SEQ ID NO: 462439 - protein, 8 aa, Mycobacterium
ECRGSGSI

SEQ ID NO: 462440 - protein, 13 aa, Mycobacterium
ECRQAAHARDDAL

SEQ ID NO: 462441 - protein, 4 aa, Mycobacterium
ECSE

SEQ ID NO: 462442 - protein, 4 aa, Mycobacterium
ECSG

SEQ ID NO: 462443 - protein, 8 aa, Mycobacterium
ECSPESSA

SEQ ID NO: 462444 - protein, 6 aa, Mycobacterium
ECSREE

SEQ ID NO: 462445 - protein, 18 aa, Mycobacterium
ECTGGAETQPRLDYPPYR

SEQ ID NO: 462446 - protein, 9 aa, Mycobacterium
ECTPETRDK

SEQ ID NO: 462447 - protein, 8 aa, Mycobacterium
ECTSGGAA

SEQ ID NO: 462448 - protein, 10 aa, Mycobacterium
ECTVSTADSL

SEQ ID NO: 462449 - protein, 8 aa, Mycobacterium
EDAAAEAL

SEQ ID NO: 462450 - protein, 5 aa, Mycobacterium
EDAAD

SEQ ID NO: 462451 - protein, 9 aa, Mycobacterium
EDAADAESI

SEQ ID NO: 462452 - protein, 19 aa, Mycobacterium
EDAADKTKTAGKSTLSGSD

SEQ ID NO: 462453 - protein, 18 aa, Mycobacterium
EDAADRGPVLAGSPERVA

SEQ ID NO: 462454 - protein, 5 aa, Mycobacterium
EDAAE

SEQ ID NO: 462455 - protein, 31 aa, Mycobacterium
EDAAGALGHDTTPAATAVDEPAPAESQAAAA

SEQ ID NO: 462456 - protein, 9 aa, Mycobacterium
EDAAGGPRG

SEQ ID NO: 462457 - protein, 22 aa, Mycobacterium
EDAALNQDTEVTDNTQASADCA

SEQ ID NO: 462458 - protein, 8 aa, Mycobacterium
EDAAQRDG

SEQ ID NO: 462459 - protein, 9 aa, Mycobacterium
EDAAQRVTG

SEQ ID NO: 462460 - protein, 5 aa, Mycobacterium
EDAAR

SEQ ID NO: 462461 - protein, 7 aa, Mycobacterium
EDAARVT

SEQ ID NO: 462462 - protein, 5 aa, Mycobacterium
EDAAS

SEQ ID NO: 462463 - protein, 6 aa, Mycobacterium
EDAASE

SEQ ID NO: 462464 - protein, 9 aa, Mycobacterium
EDAATDGSR

SEQ ID NO: 462465 - protein, 12 aa, Mycobacterium
EDAATLDEISGG

SEQ ID NO: 462466 - protein, 7 aa, Mycobacterium
EDAAVNA

SEQ ID NO: 462467 - protein, 5 aa, Mycobacterium
EDACR

SEQ ID NO: 462468 - protein, 8 aa, Mycobacterium
EDADAGAR

SEQ ID NO: 462469 - protein, 8 aa, Mycobacterium
EDADDDIR

SEQ ID NO: 462470 - protein, 7 aa, Mycobacterium
EDADEDS

SEQ ID NO: 462471 - protein, 6 aa, Mycobacterium
EDADKD

SEQ ID NO: 462472 - protein, 7 aa, Mycobacterium
EDADRAA

SEQ ID NO: 462473 - protein, 7 aa, Mycobacterium
EDADRDA

SEQ ID NO: 462474 - protein, 14 aa, Mycobacterium
EDADRLAGEDADYH

SEQ ID NO: 462475 - protein, 15 aa, Mycobacterium
EDADRLAGEDADYHQ

SEQ ID NO: 462476 - protein, 15 aa, Mycobacterium
EDADRLAGEDGDYHQ

SEQ ID NO: 462477 - protein, 6 aa, Mycobacterium
EDADRN

SEQ ID NO: 462478 - protein, 10 aa, Mycobacterium
EDADTARREA

SEQ ID NO: 462479 - protein, 8 aa, Mycobacterium
EDADTTAI

SEQ ID NO: 462480 - protein, 9 aa, Mycobacterium
EDAEAPEEV

SEQ ID NO: 462481 - protein, 8 aa, Mycobacterium
EDAEPGHH

SEQ ID NO: 462482 - protein, 9 aa, Mycobacterium
EDAEPGTQF

SEQ ID NO: 462483 - protein, 10 aa, Mycobacterium
EDAEPGTQFT

SEQ ID NO: 462484 - protein, 14 aa, Mycobacterium
EDAEPPGEPSEQDP

SEQ ID NO: 462485 - protein, 16 aa, Mycobacterium
EDAEPVSEQAAGEQDP

SEQ ID NO: 462486 - protein, 6 aa, Mycobacterium
EDAEQP

SEQ ID NO: 462487 - protein, 7 aa, Mycobacterium
EDAEQRA

SEQ ID NO: 462488 - protein, 6 aa, Mycobacterium
EDAEYT

SEQ ID NO: 462489 - protein, 4 aa, Mycobacterium
EDAG

SEQ ID NO: 462490 - protein, 6 aa, Mycobacterium
EDAGAD

SEQ ID NO: 462491 - protein, 9 aa, Mycobacterium
EDAGAGRTR

SEQ ID NO: 462492 - protein, 7 aa, Mycobacterium
EDAGARP

SEQ ID NO: 462493 - protein, 13 aa, Mycobacterium
EDAGATAVTEHGH

SEQ ID NO: 462494 - protein, 16 aa, Mycobacterium
EDAGEELADYIVKFLR

SEQ ID NO: 462495 - protein, 16 aa, Mycobacterium
EDAGEELARHIAAFLR

SEQ ID NO: 462496 - protein, 6 aa, Mycobacterium
EDAGGQ

SEQ ID NO: 462497 - protein, 10 aa, Mycobacterium
EDAGGQGGTL

SEQ ID NO: 462498 - protein, 7 aa, Mycobacterium
EDAGGRA

SEQ ID NO: 462499 - protein, 9 aa, Mycobacterium
EDAGGSGLR

SEQ ID NO: 462500 - protein, 13 aa, Mycobacterium
EDAGLSGEAPDGI

SEQ ID NO: 462501 - protein, 8 aa, Mycobacterium
EDAGQAAR

SEQ ID NO: 462502 - protein, 17 aa, Mycobacterium
EDAGQTVSVSGLSGQQL

SEQ ID NO: 462503 - protein, 9 aa, Mycobacterium
EDAGRDPAD

SEQ ID NO: 462504 - protein, 7 aa, Mycobacterium
EDAGRDT

SEQ ID NO: 462505 - protein, 7 aa, Mycobacterium
EDAGRPI

SEQ ID NO: 462506 - protein, 6 aa, Mycobacterium
EDAGVD

SEQ ID NO: 462507 - protein, 7 aa, Mycobacterium
EDAGVQE

SEQ ID NO: 462508 - protein, 5 aa, Mycobacterium
EDAGY

SEQ ID NO: 462509 - protein, 13 aa, Mycobacterium
EDAGYRAVNPSAT

SEQ ID NO: 462510 - protein, 8 aa, Mycobacterium
EDAHHPVD

SEQ ID NO: 462511 - protein, 5 aa, Mycobacterium
EDAHN

SEQ ID NO: 462512 - protein, 5 aa, Mycobacterium
EDAHR

SEQ ID NO: 462513 - protein, 14 aa, Mycobacterium
EDAIGSAAKSEPSA

SEQ ID NO: 462514 - protein, 5 aa, Mycobacterium
EDALE

SEQ ID NO: 462515 - protein, 6 aa, Mycobacterium
EDALTA

SEQ ID NO: 462516 - protein, 10 aa, Mycobacterium
EDAMDTGDDE

SEQ ID NO: 462517 - protein, 7 aa, Mycobacterium
EDAPAGY

SEQ ID NO: 462518 - protein, 15 aa, Mycobacterium
EDAPDEIAAAIIARF

SEQ ID NO: 462519 - protein, 11 aa, Mycobacterium
EDAPDQGKGYH

SEQ ID NO: 462520 - protein, 8 aa, Mycobacterium
EDAPDREV

SEQ ID NO: 462521 - protein, 15 aa, Mycobacterium
EDAPDRIAAAIVERF

SEQ ID NO: 462522 - protein, 15 aa, Mycobacterium
EDAPEEGAEIEDQTA

SEQ ID NO: 462523 - protein, 7 aa, Mycobacterium
EDAPEHP

SEQ ID NO: 462524 - protein, 7 aa, Mycobacterium
EDAPERL

SEQ ID NO: 462525 - protein, 8 aa, Mycobacterium
EDAPERLD

SEQ ID NO: 462526 - protein, 8 aa, Mycobacterium
EDAPERLP

SEQ ID NO: 462527 - protein, 6 aa, Mycobacterium
EDAPGI

SEQ ID NO: 462528 - protein, 6 aa, Mycobacterium
EDAPGL

SEQ ID NO: 462529 - protein, 17 aa, Mycobacterium
EDAPGNLSHASELPREA

SEQ ID NO: 462530 - protein, 6 aa, Mycobacterium
EDAPHH

SEQ ID NO: 462531 - protein, 8 aa, Mycobacterium
EDAPPDEL

SEQ ID NO: 462532 - protein, 15 aa, Mycobacterium
EDAPQEIAAAIIERF

SEQ ID NO: 462533 - protein, 6 aa, Mycobacterium
EDAPQL

SEQ ID NO: 462534 - protein, 11 aa, Mycobacterium
EDAPVPAPPDH

SEQ ID NO: 462535 - protein, 8 aa, Mycobacterium
EDAPVPDR

SEQ ID NO: 462536 - protein, 12 aa, Mycobacterium
EDAPYPDEGSRA

SEQ ID NO: 462537 - protein, 4 aa, Mycobacterium
EDAQ

SEQ ID NO: 462538 - protein, 5 aa, Mycobacterium
EDAQH

SEQ ID NO: 462539 - protein, 6 aa, Mycobacterium
EDAQKL

SEQ ID NO: 462540 - protein, 12 aa, Mycobacterium
EDAQRQHQALTQ

SEQ ID NO: 462541 - protein, 9 aa, Mycobacterium
EDAQSAEAL

SEQ ID NO: 462542 - protein, 12 aa, Mycobacterium
EDAQSAEAQEDI

SEQ ID NO: 462543 - protein, 23 aa, Mycobacterium
EDAQSRTAADEAAAAAASTGDPE

SEQ ID NO: 462544 - protein, 4 aa, Mycobacterium
EDAR

SEQ ID NO: 462545 - protein, 6 aa, Mycobacterium
EDARAI

SEQ ID NO: 462546 - protein, 7 aa, Mycobacterium
EDARGRT

SEQ ID NO: 462547 - protein, 7 aa, Mycobacterium
EDARGVT

SEQ ID NO: 462548 - protein, 8 aa, Mycobacterium
EDARKASR

SEQ ID NO: 462549 - protein, 12 aa, Mycobacterium
EDARQRHGRANS

SEQ ID NO: 462550 - protein, 14 aa, Mycobacterium
EDARSLGTRGISGD

SEQ ID NO: 462551 - protein, 8 aa, Mycobacterium
EDARTAEL

SEQ ID NO: 462552 - protein, 6 aa, Mycobacterium
EDARTQ

SEQ ID NO: 462553 - protein, 5 aa, Mycobacterium
EDARV

SEQ ID NO: 462554 - protein, 4 aa, Mycobacterium
EDAS

SEQ ID NO: 462555 - protein, 10 aa, Mycobacterium
EDASAPDRAA

SEQ ID NO: 462556 - protein, 11 aa, Mycobacterium
EDASEQKQARR

SEQ ID NO: 462557 - protein, 6 aa, Mycobacterium
EDASKD

SEQ ID NO: 462558 - protein, 8 aa, Mycobacterium
EDASPGRI

SEQ ID NO: 462559 - protein, 10 aa, Mycobacterium
EDASRTGEEI

SEQ ID NO: 462560 - protein, 6 aa, Mycobacterium
EDASSD

SEQ ID NO: 462561 - protein, 15 aa, Mycobacterium
EDASVQADGDGETDP

SEQ ID NO: 462562 - protein, 15 aa, Mycobacterium
EDASVTDEGHTYRGR

SEQ ID NO: 462563 - protein, 4 aa, Mycobacterium
EDAT

SEQ ID NO: 462564 - protein, 5 aa, Mycobacterium
EDATF

SEQ ID NO: 462565 - protein, 6 aa, Mycobacterium
EDATFP

SEQ ID NO: 462566 - protein, 6 aa, Mycobacterium
EDATKA

SEQ ID NO: 462567 - protein, 9 aa, Mycobacterium
EDATKTAKR

SEQ ID NO: 462568 - protein, 5 aa, Mycobacterium
EDATL

SEQ ID NO: 462569 - protein, 14 aa, Mycobacterium
EDATQATEEQRDMQ

SEQ ID NO: 462570 - protein, 13 aa, Mycobacterium
EDATQDPGVAGSD

SEQ ID NO: 462571 - protein, 10 aa, Mycobacterium
EDATREGNSS

SEQ ID NO: 462572 - protein, 8 aa, Mycobacterium
EDATSERE

SEQ ID NO: 462573 - protein, 6 aa, Mycobacterium
EDATSG

SEQ ID NO: 462574 - protein, 11 aa, Mycobacterium
EDATTADPSGL

SEQ ID NO: 462575 - protein, 7 aa, Mycobacterium
EDAVRAS

SEQ ID NO: 462576 - protein, 7 aa, Mycobacterium
EDAVREL

SEQ ID NO: 462577 - protein, 7 aa, Mycobacterium
EDAVRSR

SEQ ID NO: 462578 - protein, 4 aa, Mycobacterium
EDAY

SEQ ID NO: 462579 - protein, 6 aa, Mycobacterium
EDAYRT

SEQ ID NO: 462580 - protein, 10 aa, Mycobacterium
EDCEKAGDWT

SEQ ID NO: 462581 - protein, 6 aa, Mycobacterium
EDCNSG

SEQ ID NO: 462582 - protein, 4 aa, Mycobacterium
EDCR

SEQ ID NO: 462583 - protein, 9 aa, Mycobacterium
EDDAAARVD

SEQ ID NO: 462584 - protein, 9 aa, Mycobacterium
EDDAAGRVD

SEQ ID NO: 462585 - protein, 9 aa, Mycobacterium
EDDAASRVD

SEQ ID NO: 462586 - protein, 15 aa, Mycobacterium
EDDAEHQRLIERAES

SEQ ID NO: 462587 - protein, 9 aa, Mycobacterium
EDDAENPHV

SEQ ID NO: 462588 - protein, 9 aa, Mycobacterium
EDDAETPHV

SEQ ID NO: 462589 - protein, 6 aa, Mycobacterium
EDDAGN

SEQ ID NO: 462590 - protein, 6 aa, Mycobacterium
EDDAQA

SEQ ID NO: 462591 - protein, 4 aa, Mycobacterium
EDDD

SEQ ID NO: 462592 - protein, 8 aa, Mycobacterium
EDDDARDV

SEQ ID NO: 462593 - protein, 7 aa, Mycobacterium
EDDDARE

SEQ ID NO: 462594 - protein, 8 aa, Mycobacterium
EDDDDAVR

SEQ ID NO: 462595 - protein, 9 aa, Mycobacterium
EDDDELPAG

SEQ ID NO: 462596 - protein, 7 aa, Mycobacterium
EDDDETF

SEQ ID NO: 462597 - protein, 9 aa, Mycobacterium
EDDDGDRDV

SEQ ID NO: 462598 - protein, 11 aa, Mycobacterium
EDDDGNSFTDE

SEQ ID NO: 462599 - protein, 5 aa, Mycobacterium
EDDDL

SEQ ID NO: 462600 - protein, 9 aa, Mycobacterium
EDDDRPIEM

SEQ ID NO: 462601 - protein, 8 aa, Mycobacterium
EDDDTVRP

SEQ ID NO: 462602 - protein, 6 aa, Mycobacterium
EDDELK

SEQ ID NO: 462603 - protein, 6 aa, Mycobacterium
EDDESA

SEQ ID NO: 462604 - protein, 7 aa, Mycobacterium
EDDESIA

SEQ ID NO: 462605 - protein, 6 aa, Mycobacterium
EDDFGT

SEQ ID NO: 462606 - protein, 4 aa, Mycobacterium
EDDG

SEQ ID NO: 462607 - protein, 5 aa, Mycobacterium
EDDGA

SEQ ID NO: 462608 - protein, 10 aa, Mycobacterium
EDDGAPLTAG

SEQ ID NO: 462609 - protein, 8 aa, Mycobacterium
EDDGDCLS

SEQ ID NO: 462610 - protein, 12 aa, Mycobacterium
EDDGDDQGPATA

SEQ ID NO: 462611 - protein, 8 aa, Mycobacterium
EDDGEGGW

SEQ ID NO: 462612 - protein, 5 aa, Mycobacterium
EDDGG

SEQ ID NO: 462613 - protein, 7 aa, Mycobacterium
EDDGHAD

SEQ ID NO: 462614 - protein, 5 aa, Mycobacterium
EDDGR

SEQ ID NO: 462615 - protein, 8 aa, Mycobacterium
EDDGRPGV

SEQ ID NO: 462616 - protein, 9 aa, Mycobacterium
EDDGRPVEM

SEQ ID NO: 462617 - protein, 6 aa, Mycobacterium
EDDGSY

SEQ ID NO: 462618 - protein, 6 aa, Mycobacterium
EDDGTI

SEQ ID NO: 462619 - protein, 4 aa, Mycobacterium
EDDI

SEQ ID NO: 462620 - protein, 4 aa, Mycobacterium
EDDL

SEQ ID NO: 462621 - protein, 9 aa, Mycobacterium
EDDLAGAEE

SEQ ID NO: 462622 - protein, 5 aa, Mycobacterium
EDDLG

SEQ ID NO: 462623 - protein, 7 aa, Mycobacterium
EDDLRQT

SEQ ID NO: 462624 - protein, 5 aa, Mycobacterium
EDDLT

SEQ ID NO: 462625 - protein, 5 aa, Mycobacterium
EDDNA

SEQ ID NO: 462626 - protein, 10 aa, Mycobacterium
EDDNGDPDVN

SEQ ID NO: 462627 - protein, 16 aa, Mycobacterium
EDDPAVDELPQSERTA

SEQ ID NO: 462628 - protein, 16 aa, Mycobacterium
EDDPKAGWYDTETGEL

SEQ ID NO: 462629 - protein, 23 aa, Mycobacterium
EDDPNVTDKKLPGNPTRSYRTRE

SEQ ID NO: 462630 - protein, 7 aa, Mycobacterium
EDDPQAA

SEQ ID NO: 462631 - protein, 19 aa, Mycobacterium
EDDPQPGWYDTESGDLVDE

SEQ ID NO: 462632 - protein, 9 aa, Mycobacterium
EDDPQVAAA

SEQ ID NO: 462633 - protein, 13 aa, Mycobacterium
EDDPRTLDQRRSA

SEQ ID NO: 462634 - protein, 14 aa, Mycobacterium
EDDPRTVAQRRADA

SEQ ID NO: 462635 - protein, 26 aa, Mycobacterium
EDDQEYIRDRGNAQLRTEAGKPMDAA

SEQ ID NO: 462636 - protein, 10 aa, Mycobacterium
EDDQKPEAAN

SEQ ID NO: 462637 - protein, 8 aa, Mycobacterium
EDDQQLGG

SEQ ID NO: 462638 - protein, 6 aa, Mycobacterium
EDDRAA

SEQ ID NO: 462639 - protein, 15 aa, Mycobacterium
EDDRARPQRYRAEAE

SEQ ID NO: 462640 - protein, 9 aa, Mycobacterium
EDDRESFDD

SEQ ID NO: 462641 - protein, 9 aa, Mycobacterium
EDDRESRAR

SEQ ID NO: 462642 - protein, 9 aa, Mycobacterium
EDDSDERSL

SEQ ID NO: 462643 - protein, 7 aa, Mycobacterium
EDDSHAS

SEQ ID NO: 462644 - protein, 17 aa, Mycobacterium
EDDSPRLPRRREAVDRR

SEQ ID NO: 462645 - protein, 6 aa, Mycobacterium
EDDTAA

SEQ ID NO: 462646 - protein, 11 aa, Mycobacterium
EDDTSPHPELG

SEQ ID NO: 462647 - protein, 8 aa, Mycobacterium
EDDTVEVG

SEQ ID NO: 462648 - protein, 6 aa, Mycobacterium
EDDTVT

SEQ ID NO: 462649 - protein, 7 aa, Mycobacterium
EDDVEGD

SEQ ID NO: 462650 - protein, 6 aa, Mycobacterium
EDDYES

SEQ ID NO: 462651 - protein, 4 aa, Mycobacterium
EDEA

SEQ ID NO: 462652 - protein, 18 aa, Mycobacterium
EDEADDTPDDNALPPDDV

SEQ ID NO: 462653 - protein, 9 aa, Mycobacterium
EDEAMPEDR

SEQ ID NO: 462654 - protein, 14 aa, Mycobacterium
EDEAPNAKGGVDTR

SEQ ID NO: 462655 - protein, 13 aa, Mycobacterium
EDEAPNAKGKMEK

SEQ ID NO: 462656 - protein, 5 aa, Mycobacterium
EDEAR

SEQ ID NO: 462657 - protein, 22 aa, Mycobacterium
EDEATEDDDSDDEAAEADPVVA

SEQ ID NO: 462658 - protein, 8 aa, Mycobacterium
EDEATGAA

SEQ ID NO: 462659 - protein, 6 aa, Mycobacterium
EDEAYT

SEQ ID NO: 462660 - protein, 5 aa, Mycobacterium
EDEDA

SEQ ID NO: 462661 - protein, 6 aa, Mycobacterium
EDEDAH

SEQ ID NO: 462662 - protein, 8 aa, Mycobacterium
EDEDDAVR

SEQ ID NO: 462663 - protein, 6 aa, Mycobacterium
EDEDEI

SEQ ID NO: 462664 - protein, 7 aa, Mycobacterium
EDEDGNE

SEQ ID NO: 462665 - protein, 10 aa, Mycobacterium
EDEDGNRFTD

SEQ ID NO: 462666 - protein, 7 aa, Mycobacterium
EDEDPLG

SEQ ID NO: 462667 - protein, 10 aa, Mycobacterium
EDEDQPPAYD

SEQ ID NO: 462668 - protein, 9 aa, Mycobacterium
EDEDSGYPT

SEQ ID NO: 462669 - protein, 9 aa, Mycobacterium
EDEDVTTDE

SEQ ID NO: 462670 - protein, 5 aa, Mycobacterium
EDEEP

SEQ ID NO: 462671 - protein, 7 aa, Mycobacterium
EDEFPSD

SEQ ID NO: 462672 - protein, 12 aa, Mycobacterium
EDEGIRANTTAD

SEQ ID NO: 462673 - protein, 16 aa, Mycobacterium
EDEGIRANTTADSLGG

SEQ ID NO: 462674 - protein, 14 aa, Mycobacterium
EDEGIRANTTAESL

SEQ ID NO: 462675 - protein, 15 aa, Mycobacterium
EDEGIRANTTAESLA

SEQ ID NO: 462676 - protein, 6 aa, Mycobacterium
EDEGKK

SEQ ID NO: 462677 - protein, 20 aa, Mycobacterium
EDEGPGAEEQREQEREAFER

SEQ ID NO: 462678 - protein, 12 aa, Mycobacterium
EDEGQSRATPSF

SEQ ID NO: 462679 - protein, 7 aa, Mycobacterium
EDEGSGD

SEQ ID NO: 462680 - protein, 11 aa, Mycobacterium
EDEHGNKVVSG

SEQ ID NO: 462681 - protein, 8 aa, Mycobacterium
EDEHPYPA

SEQ ID NO: 462682 - protein, 6 aa, Mycobacterium
EDEIRS

SEQ ID NO: 462683 - protein, 5 aa, Mycobacterium
EDEIS

SEQ ID NO: 462684 - protein, 9 aa, Mycobacterium
EDEKAEATR

SEQ ID NO: 462685 - protein, 10 aa, Mycobacterium
EDELADGRTA

SEQ ID NO: 462686 - protein, 6 aa, Mycobacterium
EDELDR

SEQ ID NO: 462687 - protein, 8 aa, Mycobacterium
EDENAPLC

SEQ ID NO: 462688 - protein, 5 aa, Mycobacterium
EDENE

SEQ ID NO: 462689 - protein, 9 aa, Mycobacterium
EDENGEPAL

SEQ ID NO: 462690 - protein, 24 aa, Mycobacterium
EDEPAEGGDAYPSYDEDSYELPGI

SEQ ID NO: 462691 - protein, 27 aa, Mycobacterium
EDEPAVEDETPVADTKKASPKPLRPKV

SEQ ID NO: 462692 - protein, 11 aa, Mycobacterium
EDEPDRRRARE

SEQ ID NO: 462693 - protein, 6 aa, Mycobacterium
EDEPGL

SEQ ID NO: 462694 - protein, 9 aa, Mycobacterium
EDEPKFSRA

SEQ ID NO: 462695 - protein, 5 aa, Mycobacterium
EDEPR

SEQ ID NO: 462696 - protein, 4 aa, Mycobacterium
EDEQ

SEQ ID NO: 462697 - protein, 6 aa, Mycobacterium
EDEQDA

SEQ ID NO: 462698 - protein, 13 aa, Mycobacterium
EDEQPSDARREEI

SEQ ID NO: 462699 - protein, 14 aa, Mycobacterium
EDEQSATLSTMPSR

SEQ ID NO: 462700 - protein, 6 aa, Mycobacterium
EDERAA

SEQ ID NO: 462701 - protein, 11 aa, Mycobacterium
EDERGRALGKG

SEQ ID NO: 462702 - protein, 28 aa, Mycobacterium
EDERQRSDEAEREAEFPRHGEVGRARAG

SEQ ID NO: 462703 - protein, 7 aa, Mycobacterium
EDERSAP

SEQ ID NO: 462704 - protein, 6 aa, Mycobacterium
EDERVG

SEQ ID NO: 462705 - protein, 19 aa, Mycobacterium
EDERWSSSITDEKRAEGFA

SEQ ID NO: 462706 - protein, 5 aa, Mycobacterium
EDESA

SEQ ID NO: 462707 - protein, 10 aa, Mycobacterium
EDESARRRAR

SEQ ID NO: 462708 - protein, 8 aa, Mycobacterium
EDESELPA

SEQ ID NO: 462709 - protein, 10 aa, Mycobacterium
EDESEREQAR

SEQ ID NO: 462710 - protein, 8 aa, Mycobacterium
EDESERSR

SEQ ID NO: 462711 - protein, 10 aa, Mycobacterium
EDESPAPAVR

SEQ ID NO: 462712 - protein, 7 aa, Mycobacterium
EDESTAL

SEQ ID NO: 462713 - protein, 6 aa, Mycobacterium
EDESYE

SEQ ID NO: 462714 - protein, 11 aa, Mycobacterium
EDETGATRRLT

SEQ ID NO: 462715 - protein, 6 aa, Mycobacterium
EDETSR

SEQ ID NO: 462716 - protein, 5 aa, Mycobacterium
EDETV

SEQ ID NO: 462717 - protein, 4 aa, Mycobacterium
EDEV

SEQ ID NO: 462718 - protein, 16 aa, Mycobacterium
EDEVAARSDTTGGTDI

SEQ ID NO: 462719 - protein, 9 aa, Mycobacterium
EDEVSSETV

SEQ ID NO: 462720 - protein, 6 aa, Mycobacterium
EDEVST

SEQ ID NO: 462721 - protein, 5 aa, Mycobacterium
EDEWE

SEQ ID NO: 462722 - protein, 6 aa, Mycobacterium
EDEWED

SEQ ID NO: 462723 - protein, 25 aa, Mycobacterium
EDEYAADADQLSATTFDKGTYTGGP

SEQ ID NO: 462724 - protein, 12 aa, Mycobacterium
EDEYRTGSSAQW

SEQ ID NO: 462725 - protein, 9 aa, Mycobacterium
EDFDGRSRA

SEQ ID NO: 462726 - protein, 7 aa, Mycobacterium
EDFEDRD

SEQ ID NO: 462727 - protein, 12 aa, Mycobacterium
EDFESRPRYTDP

SEQ ID NO: 462728 - protein, 5 aa, Mycobacterium
EDFGE

SEQ ID NO: 462729 - protein, 13 aa, Mycobacterium
EDFGRGDEPYDRA

SEQ ID NO: 462730 - protein, 11 aa, Mycobacterium
EDFNPNTDLPV

SEQ ID NO: 462731 - protein, 8 aa, Mycobacterium
EDFPDPDD

SEQ ID NO: 462732 - protein, 8 aa, Mycobacterium
EDFPDPDE

SEQ ID NO: 462733 - protein, 8 aa, Mycobacterium
EDFPGDTA

SEQ ID NO: 462734 - protein, 8 aa, Mycobacterium
EDFPNPDG

SEQ ID NO: 462735 - protein, 7 aa, Mycobacterium
EDFPRPR

SEQ ID NO: 462736 - protein, 13 aa, Mycobacterium
EDFPSRAATQPDL

SEQ ID NO: 462737 - protein, 4 aa, Mycobacterium
EDGA

SEQ ID NO: 462738 - protein, 25 aa, Mycobacterium
EDGAAAGVADGQKVTVRSANGELTG

SEQ ID NO: 462739 - protein, 9 aa, Mycobacterium
EDGAAGARY

SEQ ID NO: 462740 - protein, 18 aa, Mycobacterium
EDGAARRQAAAKLAADAE

SEQ ID NO: 462741 - protein, 6 aa, Mycobacterium
EDGAAT

SEQ ID NO: 462742 - protein, 12 aa, Mycobacterium
EDGADVPAGETG

SEQ ID NO: 462743 - protein, 14 aa, Mycobacterium
EDGAEADDTAVTNP

SEQ ID NO: 462744 - protein, 6 aa, Mycobacterium
EDGAEP

SEQ ID NO: 462745 - protein, 38 aa, Mycobacterium
EDGAEPSSGDPQRAPDTESTAGGSQVQESTAAEANTPL

SEQ ID NO: 462746 - protein, 9 aa, Mycobacterium
EDGAESDAL

SEQ ID NO: 462747 - protein, 6 aa, Mycobacterium
EDGAGD

SEQ ID NO: 462748 - protein, 13 aa, Mycobacterium
EDGAGDAKAAQAQ

SEQ ID NO: 462749 - protein, 5 aa, Mycobacterium
EDGAK

SEQ ID NO: 462750 - protein, 5 aa, Mycobacterium
EDGAN

SEQ ID NO: 462751 - protein, 9 aa, Mycobacterium
EDGAPTERF

SEQ ID NO: 462752 - protein, 10 aa, Mycobacterium
EDGAQLQAGQ

SEQ ID NO: 462753 - protein, 19 aa, Mycobacterium
EDGAQQDRFPGGTQQIAEA

SEQ ID NO: 462754 - protein, 7 aa, Mycobacterium
EDGAQSV

SEQ ID NO: 462755 - protein, 5 aa, Mycobacterium
EDGAR

SEQ ID NO: 462756 - protein, 6 aa, Mycobacterium
EDGARI

SEQ ID NO: 462757 - protein, 6 aa, Mycobacterium
EDGARL

SEQ ID NO: 462758 - protein, 9 aa, Mycobacterium
EDGARPDVS

SEQ ID NO: 462759 - protein, 6 aa, Mycobacterium
EDGARR

SEQ ID NO: 462760 - protein, 9 aa, Mycobacterium
EDGATHRVT

SEQ ID NO: 462761 - protein, 10 aa, Mycobacterium
EDGAVQAPRG

SEQ ID NO: 462762 - protein, 5 aa, Mycobacterium
EDGDA

SEQ ID NO: 462763 - protein, 7 aa, Mycobacterium
EDGDEGT

SEQ ID NO: 462764 - protein, 6 aa, Mycobacterium
EDGDEL

SEQ ID NO: 462765 - protein, 8 aa, Mycobacterium
EDGDESGW

SEQ ID NO: 462766 - protein, 7 aa, Mycobacterium
EDGDGEV

SEQ ID NO: 462767 - protein, 6 aa, Mycobacterium
EDGDHY

SEQ ID NO: 462768 - protein, 16 aa, Mycobacterium
EDGDIAEDSRAALSAT

SEQ ID NO: 462769 - protein, 19 aa, Mycobacterium
EDGDKQAAAARADDAIARA

SEQ ID NO: 462770 - protein, 5 aa, Mycobacterium
EDGDR

SEQ ID NO: 462771 - protein, 8 aa, Mycobacterium
EDGDRPIE

SEQ ID NO: 462772 - protein, 6 aa, Mycobacterium
EDGDRR

SEQ ID NO: 462773 - protein, 6 aa, Mycobacterium
EDGDRS

SEQ ID NO: 462774 - protein, 4 aa, Mycobacterium
EDGE

SEQ ID NO: 462775 - protein, 8 aa, Mycobacterium
EDGEAPAA

SEQ ID NO: 462776 - protein, 6 aa, Mycobacterium
EDGEGP

SEQ ID NO: 462777 - protein, 23 aa, Mycobacterium
EDGELGEVTKSTTESGTTEGNGI

SEQ ID NO: 462778 - protein, 6 aa, Mycobacterium
EDGELR

SEQ ID NO: 462779 - protein, 5 aa, Mycobacterium
EDGEP

SEQ ID NO: 462780 - protein, 9 aa, Mycobacterium
EDGERAAQA

SEQ ID NO: 462781 - protein, 8 aa, Mycobacterium
EDGETTVS

SEQ ID NO: 462782 - protein, 6 aa, Mycobacterium
EDGEVR

SEQ ID NO: 462783 - protein, 8 aa, Mycobacterium
EDGFSSDS

SEQ ID NO: 462784 - protein, 4 aa, Mycobacterium
EDGG

SEQ ID NO: 462785 - protein, 8 aa, Mycobacterium
EDGGGIPW

SEQ ID NO: 462786 - protein, 8 aa, Mycobacterium
EDGGHQQD

SEQ ID NO: 462787 - protein, 5 aa, Mycobacterium
EDGGL

SEQ ID NO: 462788 - protein, 9 aa, Mycobacterium
EDGGQQHAY

SEQ ID NO: 462789 - protein, 6 aa, Mycobacterium
EDGHPI

SEQ ID NO: 462790 - protein, 4 aa, Mycobacterium
EDGI

SEQ ID NO: 462791 - protein, 9 aa, Mycobacterium
EDGIAPGTR

SEQ ID NO: 462792 - protein, 6 aa, Mycobacterium
EDGIAR

SEQ ID NO: 462793 - protein, 9 aa, Mycobacterium
EDGIPPNPG

SEQ ID NO: 462794 - protein, 20 aa, Mycobacterium
EDGITETSERSTDEKKDMGG

SEQ ID NO: 462795 - protein, 4 aa, Mycobacterium
EDGK

SEQ ID NO: 462796 - protein, 8 aa, Mycobacterium
EDGKSPAH

SEQ ID NO: 462797 - protein, 4 aa, Mycobacterium
EDGL

SEQ ID NO: 462798 - protein, 7 aa, Mycobacterium
EDGLAGS

SEQ ID NO: 462799 - protein, 18 aa, Mycobacterium
EDGLPHNAAYGDGEPIPE

SEQ ID NO: 462800 - protein, 18 aa, Mycobacterium
EDGLVQDKERSIHADPTK

SEQ ID NO: 462801 - protein, 5 aa, Mycobacterium
EDGMR

SEQ ID NO: 462802 - protein, 4 aa, Mycobacterium
EDGN

SEQ ID NO: 462803 - protein, 12 aa, Mycobacterium
EDGNELPAGQAG

SEQ ID NO: 462804 - protein, 12 aa, Mycobacterium
EDGNEVKPGSGV

SEQ ID NO: 462805 - protein, 12 aa, Mycobacterium
EDGNEVQPGSGV

SEQ ID NO: 462806 - protein, 11 aa, Mycobacterium
EDGNPGEPDYH

SEQ ID NO: 462807 - protein, 5 aa, Mycobacterium
EDGNY

SEQ ID NO: 462808 - protein, 8 aa, Mycobacterium
EDGPASSL

SEQ ID NO: 462809 - protein, 9 aa, Mycobacterium
EDGPGADER

SEQ ID NO: 462810 - protein, 28 aa, Mycobacterium
EDGPGRAHRGQIDGTPEDGDSLFEVVDD

SEQ ID NO: 462811 - protein, 11 aa, Mycobacterium
EDGPNLKPAYT

SEQ ID NO: 462812 - protein, 8 aa, Mycobacterium
EDGPPPDR

SEQ ID NO: 462813 - protein, 8 aa, Mycobacterium
EDGPPSKI

SEQ ID NO: 462814 - protein, 11 aa, Mycobacterium
EDGPPVVGGDG

SEQ ID NO: 462815 - protein, 8 aa, Mycobacterium
EDGPQRVA

SEQ ID NO: 462816 - protein, 8 aa, Mycobacterium
EDGPRGKF

SEQ ID NO: 462817 - protein, 8 aa, Mycobacterium
EDGPRVTL

SEQ ID NO: 462818 - protein, 7 aa, Mycobacterium
EDGPSVA

SEQ ID NO: 462819 - protein, 4 aa, Mycobacterium
EDGQ

SEQ ID NO: 462820 - protein, 6 aa, Mycobacterium
EDGQAH

SEQ ID NO: 462821 - protein, 9 aa, Mycobacterium
EDGQGLSRD

SEQ ID NO: 462822 - protein, 8 aa, Mycobacterium
EDGQPESA

SEQ ID NO: 462823 - protein, 13 aa, Mycobacterium
EDGQPVPQGEPGE

SEQ ID NO: 462824 - protein, 7 aa, Mycobacterium
EDGQRVP

SEQ ID NO: 462825 - protein, 6 aa, Mycobacterium
EDGQSW

SEQ ID NO: 462826 - protein, 11 aa, Mycobacterium
EDGQYEEPGLR

SEQ ID NO: 462827 - protein, 5 aa, Mycobacterium
EDGRD

SEQ ID NO: 462828 - protein, 6 aa, Mycobacterium
EDGREG

SEQ ID NO: 462829 - protein, 7 aa, Mycobacterium
EDGREYD

SEQ ID NO: 462830 - protein, 17 aa, Mycobacterium
EDGRLTDSRDAETAAKT

SEQ ID NO: 462831 - protein, 8 aa, Mycobacterium
EDGRPRAL

SEQ ID NO: 462832 - protein, 6 aa, Mycobacterium
EDGRPV

SEQ ID NO: 462833 - protein, 8 aa, Mycobacterium
EDGRPVRD

SEQ ID NO: 462834 - protein, 5 aa, Mycobacterium
EDGRS

SEQ ID NO: 462835 - protein, 10 aa, Mycobacterium
EDGRSDRTIR

SEQ ID NO: 462836 - protein, 7 aa, Mycobacterium
EDGRTHG

SEQ ID NO: 462837 - protein, 15 aa, Mycobacterium
EDGRTPQSRLAERTG

SEQ ID NO: 462838 - protein, 7 aa, Mycobacterium
EDGRTVE

SEQ ID NO: 462839 - protein, 8 aa, Mycobacterium
EDGRWPTD

SEQ ID NO: 462840 - protein, 18 aa, Mycobacterium
EDGSDDRAAVDAAEAGAR

SEQ ID NO: 462841 - protein, 7 aa, Mycobacterium
EDGSDID

SEQ ID NO: 462842 - protein, 11 aa, Mycobacterium
EDGSERPLADG

SEQ ID NO: 462843 - protein, 8 aa, Mycobacterium
EDGSGRGF

SEQ ID NO: 462844 - protein, 8 aa, Mycobacterium
EDGSGWAS

SEQ ID NO: 462845 - protein, 7 aa, Mycobacterium
EDGSPRL

SEQ ID NO: 462846 - protein, 16 aa, Mycobacterium
EDGSPVRGVAGGTERV

SEQ ID NO: 462847 - protein, 16 aa, Mycobacterium
EDGSPVRGVSGGTDRL

SEQ ID NO: 462848 - protein, 15 aa, Mycobacterium
EDGSPVRGVSGGTER

SEQ ID NO: 462849 - protein, 15 aa, Mycobacterium
EDGSPVRGVTGGTGR

SEQ ID NO: 462850 - protein, 16 aa, Mycobacterium
EDGSPVRGVTGGTGRL

SEQ ID NO: 462851 - protein, 10 aa, Mycobacterium
EDGSRPRTID

SEQ ID NO: 462852 - protein, 6 aa, Mycobacterium
EDGSSV

SEQ ID NO: 462853 - protein, 5 aa, Mycobacterium
EDGSY

SEQ ID NO: 462854 - protein, 17 aa, Mycobacterium
EDGSYDKAFGGDRTTGL

SEQ ID NO: 462855 - protein, 5 aa, Mycobacterium
EDGTA

SEQ ID NO: 462856 - protein, 8 aa, Mycobacterium
EDGTAAAH

SEQ ID NO: 462857 - protein, 12 aa, Mycobacterium
EDGTALPHDAES

SEQ ID NO: 462858 - protein, 7 aa, Mycobacterium
EDGTEES

SEQ ID NO: 462859 - protein, 9 aa, Mycobacterium
EDGTEGVLS

SEQ ID NO: 462860 - protein, 10 aa, Mycobacterium
EDGTELGPGQ

SEQ ID NO: 462861 - protein, 15 aa, Mycobacterium
EDGTEVARGKDLPAL

SEQ ID NO: 462862 - protein, 7 aa, Mycobacterium
EDGTKLG

SEQ ID NO: 462863 - protein, 16 aa, Mycobacterium
EDGTPPGSIGKPYPGV

SEQ ID NO: 462864 - protein, 15 aa, Mycobacterium
EDGTPPGSIGRPYPG

SEQ ID NO: 462865 - protein, 19 aa, Mycobacterium
EDGTPRTPATAKAQGRPRP

SEQ ID NO: 462866 - protein, 6 aa, Mycobacterium
EDGTPV

SEQ ID NO: 462867 - protein, 8 aa, Mycobacterium
EDGTRDLR

SEQ ID NO: 462868 - protein, 17 aa, Mycobacterium
EDGTRTEVRDELPSDLA

SEQ ID NO: 462869 - protein, 8 aa, Mycobacterium
EDGTSGFP

SEQ ID NO: 462870 - protein, 6 aa, Mycobacterium
EDGTWR

SEQ ID NO: 462871 - protein, 5 aa, Mycobacterium
EDGVA

SEQ ID NO: 462872 - protein, 8 aa, Mycobacterium
EDGVDTGP

SEQ ID NO: 462873 - protein, 5 aa, Mycobacterium
EDGVG

SEQ ID NO: 462874 - protein, 6 aa, Mycobacterium
EDGVGG

SEQ ID NO: 462875 - protein, 12 aa, Mycobacterium
EDGWSPRRVTPN

SEQ ID NO: 462876 - protein, 14 aa, Mycobacterium
EDGYTDAQREADGR

SEQ ID NO: 462877 - protein, 6 aa, Mycobacterium
EDGYVT

SEQ ID NO: 462878 - protein, 9 aa, Mycobacterium
EDHARASRN

SEQ ID NO: 462879 - protein, 11 aa, Mycobacterium
EDHATARREAG

SEQ ID NO: 462880 - protein, 7 aa, Mycobacterium
EDHDGTA

SEQ ID NO: 462881 - protein, 6 aa, Mycobacterium
EDHEHP

SEQ ID NO: 462882 - protein, 5 aa, Mycobacterium
EDHGA

SEQ ID NO: 462883 - protein, 10 aa, Mycobacterium
EDHGGAGGTI

SEQ ID NO: 462884 - protein, 9 aa, Mycobacterium
EDHGRPGAL

SEQ ID NO: 462885 - protein, 10 aa, Mycobacterium
EDHHNPGPEE

SEQ ID NO: 462886 - protein, 9 aa, Mycobacterium
EDHKRPHAD

SEQ ID NO: 462887 - protein, 9 aa, Mycobacterium
EDHKRPRAD

SEQ ID NO: 462888 - protein, 7 aa, Mycobacterium
EDHPQKV

SEQ ID NO: 462889 - protein, 7 aa, Mycobacterium
EDHPQQV

SEQ ID NO: 462890 - protein, 8 aa, Mycobacterium
EDHQQDPA

SEQ ID NO: 462891 - protein, 7 aa, Mycobacterium
EDHSGPL

SEQ ID NO: 462892 - protein, 7 aa, Mycobacterium
EDHSGRR

SEQ ID NO: 462893 - protein, 6 aa, Mycobacterium
EDHSTD

SEQ ID NO: 462894 - protein, 7 aa, Mycobacterium
EDHTGGI

SEQ ID NO: 462895 - protein, 7 aa, Mycobacterium
EDHTRAR

SEQ ID NO: 462896 - protein, 13 aa, Mycobacterium
EDHTTTDSTLSIS

SEQ ID NO: 462897 - protein, 5 aa, Mycobacterium
EDIAG

SEQ ID NO: 462898 - protein, 6 aa, Mycobacterium
EDIASG

SEQ ID NO: 462899 - protein, 12 aa, Mycobacterium
EDIATSTARAEA

SEQ ID NO: 462900 - protein, 15 aa, Mycobacterium
EDIEIGDAGGAAQGH

SEQ ID NO: 462901 - protein, 12 aa, Mycobacterium
EDIGGSLTPVGA

SEQ ID NO: 462902 - protein, 19 aa, Mycobacterium
EDIGPGLADGAAALASAET

SEQ ID NO: 462903 - protein, 6 aa, Mycobacterium
EDIKNT

SEQ ID NO: 462904 - protein, 4 aa, Mycobacterium
EDIP

SEQ ID NO: 462905 - protein, 13 aa, Mycobacterium
EDIPASGKMTGRS

SEQ ID NO: 462906 - protein, 8 aa, Mycobacterium
EDIPDTDA

SEQ ID NO: 462907 - protein, 13 aa, Mycobacterium
EDIPEGGKMAGRD

SEQ ID NO: 462908 - protein, 16 aa, Mycobacterium
EDIRGRAAAQGRNPDE

SEQ ID NO: 462909 - protein, 4 aa, Mycobacterium
EDIS

SEQ ID NO: 462910 - protein, 9 aa, Mycobacterium
EDISDTDEF

SEQ ID NO: 462911 - protein, 12 aa, Mycobacterium
EDISSGDETGFG

SEQ ID NO: 462912 - protein, 5 aa, Mycobacterium
EDISY

SEQ ID NO: 462913 - protein, 8 aa, Mycobacterium
EDKAAAAV

SEQ ID NO: 462914 - protein, 6 aa, Mycobacterium
EDKAAR

SEQ ID NO: 462915 - protein, 11 aa, Mycobacterium
EDKAKNPGDDI

SEQ ID NO: 462916 - protein, 8 aa, Mycobacterium
EDKAPGTV

SEQ ID NO: 462917 - protein, 12 aa, Mycobacterium
EDKAQHANRTFE

SEQ ID NO: 462918 - protein, 8 aa, Mycobacterium
EDKDEVRS

SEQ ID NO: 462919 - protein, 8 aa, Mycobacterium
EDKEHAHG

SEQ ID NO: 462920 - protein, 5 aa, Mycobacterium
EDKGV

SEQ ID NO: 462921 - protein, 6 aa, Mycobacterium
EDKGVT

SEQ ID NO: 462922 - protein, 11 aa, Mycobacterium
EDKHGPANDRR

SEQ ID NO: 462923 - protein, 15 aa, Mycobacterium
EDKHPTDRPAGDSPT

SEQ ID NO: 462924 - protein, 5 aa, Mycobacterium
EDKKE

SEQ ID NO: 462925 - protein, 4 aa, Mycobacterium
EDKL

SEQ ID NO: 462926 - protein, 20 aa, Mycobacterium
EDKNASEIASSRDDLPLPEE

SEQ ID NO: 462927 - protein, 4 aa, Mycobacterium
EDKP

SEQ ID NO: 462928 - protein, 6 aa, Mycobacterium
EDKPAE

SEQ ID NO: 462929 - protein, 10 aa, Mycobacterium
EDKPDEPSLR

SEQ ID NO: 462930 - protein, 5 aa, Mycobacterium
EDKPE

SEQ ID NO: 462931 - protein, 7 aa, Mycobacterium
EDKPQDV

SEQ ID NO: 462932 - protein, 7 aa, Mycobacterium
EDKSADV

SEQ ID NO: 462933 - protein, 7 aa, Mycobacterium
EDKSTVE

SEQ ID NO: 462934 - protein, 10 aa, Mycobacterium
EDKTAPRERF

SEQ ID NO: 462935 - protein, 4 aa, Mycobacterium
EDLA

SEQ ID NO: 462936 - protein, 5 aa, Mycobacterium
EDLAE

SEQ ID NO: 462937 - protein, 18 aa, Mycobacterium
EDLAERRPSQLSGGQAQR

SEQ ID NO: 462938 - protein, 8 aa, Mycobacterium
EDLANGAS

SEQ ID NO: 462939 - protein, 10 aa, Mycobacterium
EDLDDEPDLD

SEQ ID NO: 462940 - protein, 6 aa, Mycobacterium
EDLDDR

SEQ ID NO: 462941 - protein, 8 aa, Mycobacterium
EDLDDTEA

SEQ ID NO: 462942 - protein, 7 aa, Mycobacterium
EDLDETA

SEQ ID NO: 462943 - protein, 5 aa, Mycobacterium
EDLDG

SEQ ID NO: 462944 - protein, 8 aa, Mycobacterium
EDLDPDEK

SEQ ID NO: 462945 - protein, 4 aa, Mycobacterium
EDLE

SEQ ID NO: 462946 - protein, 12 aa, Mycobacterium
EDLERARARLAN

SEQ ID NO: 462947 - protein, 16 aa, Mycobacterium
EDLETARELAASDDSF

SEQ ID NO: 462948 - protein, 4 aa, Mycobacterium
EDLG

SEQ ID NO: 462949 - protein, 11 aa, Mycobacterium
EDLGDKESRGM

SEQ ID NO: 462950 - protein, 7 aa, Mycobacterium
EDLGDPE

SEQ ID NO: 462951 - protein, 29 aa, Mycobacterium
EDLGDRRALTGEPLPPKLTATAAAQRDGL

SEQ ID NO: 462952 - protein, 7 aa, Mycobacterium
EDLGDSA

SEQ ID NO: 462953 - protein, 8 aa, Mycobacterium
EDLGEPIR

SEQ ID NO: 462954 - protein, 8 aa, Mycobacterium
EDLGEPVR

SEQ ID NO: 462955 - protein, 45 aa, Mycobacterium
EDLGGRAKEAIGKATGNKDTREEGRVDQAKASLKDAGEKVKDAFR

SEQ ID NO: 462956 - protein, 45 aa, Mycobacterium
EDLGGRAKEAIGKVTGDHDTRDEGRADQAKSSLKDAGEKVKDAFK

SEQ ID NO: 462957 - protein, 8 aa, Mycobacterium
EDLGGTDR

SEQ ID NO: 462958 - protein, 7 aa, Mycobacterium
EDLGRSG

SEQ ID NO: 462959 - protein, 7 aa, Mycobacterium
EDLGSGR

SEQ ID NO: 462960 - protein, 10 aa, Mycobacterium
EDLGYGRRQT

SEQ ID NO: 462961 - protein, 57 aa, Mycobacterium
EDLKGRAKEAFGAATNNDDLKAEGQADQGIASAKQAISDAADKVKEGVEAVKDKLTG

SEQ ID NO: 462962 - protein, 5 aa, Mycobacterium
EDLPA

SEQ ID NO: 462963 - protein, 7 aa, Mycobacterium
EDLPAAE

SEQ ID NO: 462964 - protein, 6 aa, Mycobacterium
EDLPAD

SEQ ID NO: 462965 - protein, 15 aa, Mycobacterium
EDLPAHGEAIRRRFE

SEQ ID NO: 462966 - protein, 10 aa, Mycobacterium
EDLPDDPAPG

SEQ ID NO: 462967 - protein, 5 aa, Mycobacterium
EDLPF

SEQ ID NO: 462968 - protein, 8 aa, Mycobacterium
EDLPFPDE

SEQ ID NO: 462969 - protein, 8 aa, Mycobacterium
EDLPGTDH

SEQ ID NO: 462970 - protein, 6 aa, Mycobacterium
EDLPNQ

SEQ ID NO: 462971 - protein, 6 aa, Mycobacterium
EDLPPQ

SEQ ID NO: 462972 - protein, 8 aa, Mycobacterium
EDLPSDVD

SEQ ID NO: 462973 - protein, 10 aa, Mycobacterium
EDLPSGDELG

SEQ ID NO: 462974 - protein, 13 aa, Mycobacterium
EDLQTAEALADLT

SEQ ID NO: 462975 - protein, 8 aa, Mycobacterium
EDLSGKRY

SEQ ID NO: 462976 - protein, 7 aa, Mycobacterium
EDLSSVS

SEQ ID NO: 462977 - protein, 4 aa, Mycobacterium
EDLT

SEQ ID NO: 462978 - protein, 6 aa, Mycobacterium
EDLTDD

SEQ ID NO: 462979 - protein, 7 aa, Mycobacterium
EDLTDDE

SEQ ID NO: 462980 - protein, 8 aa, Mycobacterium
EDLTDDGF

SEQ ID NO: 462981 - protein, 12 aa, Mycobacterium
EDLTPDELTPEL

SEQ ID NO: 462982 - protein, 10 aa, Mycobacterium
EDLTSPGSDA

SEQ ID NO: 462983 - protein, 5 aa, Mycobacterium
EDLYA

SEQ ID NO: 462984 - protein, 7 aa, Mycobacterium
EDMAPAR

SEQ ID NO: 462985 - protein, 6 aa, Mycobacterium
EDMDPA

SEQ ID NO: 462986 - protein, 13 aa, Mycobacterium
EDMGNKTGNEKAK

SEQ ID NO: 462987 - protein, 8 aa, Mycobacterium
EDMPPDRK

SEQ ID NO: 462988 - protein, 5 aa, Mycobacterium
EDNAA

SEQ ID NO: 462989 - protein, 11 aa, Mycobacterium
EDNAKQAEAVA

SEQ ID NO: 462990 - protein, 8 aa, Mycobacterium
EDNAQTRG

SEQ ID NO: 462991 - protein, 4 aa, Mycobacterium
EDNG

SEQ ID NO: 462992 - protein, 5 aa, Mycobacterium
EDNGI

SEQ ID NO: 462993 - protein, 7 aa, Mycobacterium
EDNGRCR

SEQ ID NO: 462994 - protein, 8 aa, Mycobacterium
EDNIYQTE

SEQ ID NO: 462995 - protein, 8 aa, Mycobacterium
EDNLTDED

SEQ ID NO: 462996 - protein, 9 aa, Mycobacterium
EDNLYQTSK

SEQ ID NO: 462997 - protein, 4 aa, Mycobacterium
EDNP

SEQ ID NO: 462998 - protein, 9 aa, Mycobacterium
EDNPPDTFG

SEQ ID NO: 462999 - protein, 7 aa, Mycobacterium
EDNRGSI

SEQ ID NO: 463000 - protein, 12 aa, Mycobacterium
EDNRPARPQSAQ

SEQ ID NO: 463001 - protein, 5 aa, Mycobacterium
EDNRV

SEQ ID NO: 463002 - protein, 6 aa, Mycobacterium
EDNSRL

SEQ ID NO: 463003 - protein, 5 aa, Mycobacterium
EDNTE

SEQ ID NO: 463004 - protein, 7 aa, Mycobacterium
EDPAAGV

SEQ ID NO: 463005 - protein, 6 aa, Mycobacterium
EDPAAS

SEQ ID NO: 463006 - protein, 16 aa, Mycobacterium
EDPAAVNEHLRRFTGH

SEQ ID NO: 463007 - protein, 6 aa, Mycobacterium
EDPAER

SEQ ID NO: 463008 - protein, 9 aa, Mycobacterium
EDPAFPGDR

SEQ ID NO: 463009 - protein, 7 aa, Mycobacterium
EDPAGTS

SEQ ID NO: 463010 - protein, 19 aa, Mycobacterium
EDPAKLRDLPQKQLRRAAG

SEQ ID NO: 463011 - protein, 5 aa, Mycobacterium
EDPAL

SEQ ID NO: 463012 - protein, 11 aa, Mycobacterium
EDPAQGWQPQA

SEQ ID NO: 463013 - protein, 13 aa, Mycobacterium
EDPAQGWQPQAGR

SEQ ID NO: 463014 - protein, 10 aa, Mycobacterium
EDPAREWQPQ

SEQ ID NO: 463015 - protein, 10 aa, Mycobacterium
EDPARGWQPQ

SEQ ID NO: 463016 - protein, 12 aa, Mycobacterium
EDPARNWQPQAG

SEQ ID NO: 463017 - protein, 6 aa, Mycobacterium
EDPARV

SEQ ID NO: 463018 - protein, 15 aa, Mycobacterium
EDPARVNALLESFLF

SEQ ID NO: 463019 - protein, 7 aa, Mycobacterium
EDPASLD

SEQ ID NO: 463020 - protein, 6 aa, Mycobacterium
EDPASV

SEQ ID NO: 463021 - protein, 12 aa, Mycobacterium
EDPATASTGALA

SEQ ID NO: 463022 - protein, 10 aa, Mycobacterium
EDPATQAHSI

SEQ ID NO: 463023 - protein, 13 aa, Mycobacterium
EDPAYNTAKARQD

SEQ ID NO: 463024 - protein, 6 aa, Mycobacterium
EDPDAI

SEQ ID NO: 463025 - protein, 19 aa, Mycobacterium
EDPDAVRRSQLSRGEDPSL

SEQ ID NO: 463026 - protein, 7 aa, Mycobacterium
EDPDDLD

SEQ ID NO: 463027 - protein, 7 aa, Mycobacterium
EDPDDLE

SEQ ID NO: 463028 - protein, 9 aa, Mycobacterium
EDPDDPRLD

SEQ ID NO: 463029 - protein, 6 aa, Mycobacterium
EDPDEC

SEQ ID NO: 463030 - protein, 8 aa, Mycobacterium
EDPDGGAT

SEQ ID NO: 463031 - protein, 22 aa, Mycobacterium
EDPDKPGKKDPNSGSGGSDPFG

SEQ ID NO: 463032 - protein, 7 aa, Mycobacterium
EDPDLPE

SEQ ID NO: 463033 - protein, 5 aa, Mycobacterium
EDPDN

SEQ ID NO: 463034 - protein, 10 aa, Mycobacterium
EDPDPASGVE

SEQ ID NO: 463035 - protein, 8 aa, Mycobacterium
EDPDREGL

SEQ ID NO: 463036 - protein, 9 aa, Mycobacterium
EDPDRGREL

SEQ ID NO: 463037 - protein, 10 aa, Mycobacterium
EDPDRPPLDT

SEQ ID NO: 463038 - protein, 26 aa, Mycobacterium
EDPDYEPDPSTSIGARARAKGVEPME

SEQ ID NO: 463039 - protein, 11 aa, Mycobacterium
EDPEASPNDRY

SEQ ID NO: 463040 - protein, 6 aa, Mycobacterium
EDPEFG

SEQ ID NO: 463041 - protein, 5 aa, Mycobacterium
EDPEI

SEQ ID NO: 463042 - protein, 8 aa, Mycobacterium
EDPEPGTL

SEQ ID NO: 463043 - protein, 5 aa, Mycobacterium
EDPER

SEQ ID NO: 463044 - protein, 8 aa, Mycobacterium
EDPEREGL

SEQ ID NO: 463045 - protein, 11 aa, Mycobacterium
EDPEYRAGGYR

SEQ ID NO: 463046 - protein, 4 aa, Mycobacterium
EDPG

SEQ ID NO: 463047 - protein, 9 aa, Mycobacterium
EDPGEALSP

SEQ ID NO: 463048 - protein, 7 aa, Mycobacterium
EDPGLAD

SEQ ID NO: 463049 - protein, 9 aa, Mycobacterium
EDPGRAGRQ

SEQ ID NO: 463050 - protein, 8 aa, Mycobacterium
EDPGSQAY

SEQ ID NO: 463051 - protein, 6 aa, Mycobacterium
EDPGVA

SEQ ID NO: 463052 - protein, 6 aa, Mycobacterium
EDPGVV

SEQ ID NO: 463053 - protein, 9 aa, Mycobacterium
EDPGYAAAH

SEQ ID NO: 463054 - protein, 5 aa, Mycobacterium
EDPHE

SEQ ID NO: 463055 - protein, 6 aa, Mycobacterium
EDPHGW

SEQ ID NO: 463056 - protein, 4 aa, Mycobacterium
EDPI

SEQ ID NO: 463057 - protein, 7 aa, Mycobacterium
EDPIADP

SEQ ID NO: 463058 - protein, 20 aa, Mycobacterium
EDPIGPSAFDPEGKGHRGRA

SEQ ID NO: 463059 - protein, 20 aa, Mycobacterium
EDPIGPSAFDPEGKGHRGRD

SEQ ID NO: 463060 - protein, 9 aa, Mycobacterium
EDPIPSNKH

SEQ ID NO: 463061 - protein, 8 aa, Mycobacterium
EDPKYPPL

SEQ ID NO: 463062 - protein, 5 aa, Mycobacterium
EDPLG

SEQ ID NO: 463063 - protein, 12 aa, Mycobacterium
EDPLTPGAAISS

SEQ ID NO: 463064 - protein, 5 aa, Mycobacterium
EDPMR

SEQ ID NO: 463065 - protein, 12 aa, Mycobacterium
EDPMRDRGQAAL

SEQ ID NO: 463066 - protein, 11 aa, Mycobacterium
EDPNAPEGSRE

SEQ ID NO: 463067 - protein, 10 aa, Mycobacterium
EDPNRREKLT

SEQ ID NO: 463068 - protein, 7 aa, Mycobacterium
EDPNVRV

SEQ ID NO: 463069 - protein, 4 aa, Mycobacterium
EDPP

SEQ ID NO: 463070 - protein, 6 aa, Mycobacterium
EDPPAL

SEQ ID NO: 463071 - protein, 5 aa, Mycobacterium
EDPPE

SEQ ID NO: 463072 - protein, 9 aa, Mycobacterium
EDPPGQCRQ

SEQ ID NO: 463073 - protein, 12 aa, Mycobacterium
EDPPGRARQTNG

SEQ ID NO: 463074 - protein, 7 aa, Mycobacterium
EDPPGRR

SEQ ID NO: 463075 - protein, 8 aa, Mycobacterium
EDPPHPQL

SEQ ID NO: 463076 - protein, 5 aa, Mycobacterium
EDPPI

SEQ ID NO: 463077 - protein, 9 aa, Mycobacterium
EDPPPESVP

SEQ ID NO: 463078 - protein, 9 aa, Mycobacterium
EDPPRTAAK

SEQ ID NO: 463079 - protein, 10 aa, Mycobacterium
EDPPRTADKA

SEQ ID NO: 463080 - protein, 6 aa, Mycobacterium
EDPPSR

SEQ ID NO: 463081 - protein, 8 aa, Mycobacterium
EDPPSRTR

SEQ ID NO: 463082 - protein, 5 aa, Mycobacterium
EDPPV

SEQ ID NO: 463083 - protein, 12 aa, Mycobacterium
EDPQPGRPAQSA

SEQ ID NO: 463084 - protein, 10 aa, Mycobacterium
EDPQPGRPEM

SEQ ID NO: 463085 - protein, 7 aa, Mycobacterium
EDPQRRE

SEQ ID NO: 463086 - protein, 9 aa, Mycobacterium
EDPQTAEAL

SEQ ID NO: 463087 - protein, 9 aa, Mycobacterium
EDPRENPAA

SEQ ID NO: 463088 - protein, 5 aa, Mycobacterium
EDPRF

SEQ ID NO: 463089 - protein, 8 aa, Mycobacterium
EDPRFNNE

SEQ ID NO: 463090 - protein, 7 aa, Mycobacterium
EDPRGFG

SEQ ID NO: 463091 - protein, 7 aa, Mycobacterium
EDPRHGP

SEQ ID NO: 463092 - protein, 5 aa, Mycobacterium
EDPRL

SEQ ID NO: 463093 - protein, 6 aa, Mycobacterium
EDPRRG

SEQ ID NO: 463094 - protein, 7 aa, Mycobacterium
EDPRRGA

SEQ ID NO: 463095 - protein, 7 aa, Mycobacterium
EDPRRPL

SEQ ID NO: 463096 - protein, 6 aa, Mycobacterium
EDPRSR

SEQ ID NO: 463097 - protein, 12 aa, Mycobacterium
EDPRSTAPRGPD

SEQ ID NO: 463098 - protein, 5 aa, Mycobacterium
EDPRV

SEQ ID NO: 463099 - protein, 11 aa, Mycobacterium
EDPSAAQRGQA

SEQ ID NO: 463100 - protein, 9 aa, Mycobacterium
EDPSAQPLP

SEQ ID NO: 463101 - protein, 8 aa, Mycobacterium
EDPSARLT

SEQ ID NO: 463102 - protein, 9 aa, Mycobacterium
EDPSGPIEV

SEQ ID NO: 463103 - protein, 6 aa, Mycobacterium
EDPSHP

SEQ ID NO: 463104 - protein, 14 aa, Mycobacterium
EDPSLAGEDMPGVG

SEQ ID NO: 463105 - protein, 9 aa, Mycobacterium
EDPSPGVDG

SEQ ID NO: 463106 - protein, 10 aa, Mycobacterium
EDPSPGVDGQ

SEQ ID NO: 463107 - protein, 5 aa, Mycobacterium
EDPSR

SEQ ID NO: 463108 - protein, 7 aa, Mycobacterium
EDPSSAT

SEQ ID NO: 463109 - protein, 8 aa, Mycobacterium
EDPSTNVD

SEQ ID NO: 463110 - protein, 5 aa, Mycobacterium
EDPSV

SEQ ID NO: 463111 - protein, 7 aa, Mycobacterium
EDPTAAA

SEQ ID NO: 463112 - protein, 7 aa, Mycobacterium
EDPTAGP

SEQ ID NO: 463113 - protein, 9 aa, Mycobacterium
EDPTFPGDR

SEQ ID NO: 463114 - protein, 5 aa, Mycobacterium
EDPTS

SEQ ID NO: 463115 - protein, 25 aa, Mycobacterium
EDPTYEAASDDVNAKDAKMKARCAG

SEQ ID NO: 463116 - protein, 5 aa, Mycobacterium
EDPVE

SEQ ID NO: 463117 - protein, 6 aa, Mycobacterium
EDPVEQ

SEQ ID NO: 463118 - protein, 7 aa, Mycobacterium
EDPVGEL

SEQ ID NO: 463119 - protein, 12 aa, Mycobacterium
EDPVGPEGTFSG

SEQ ID NO: 463120 - protein, 10 aa, Mycobacterium
EDPVPSDKHL

SEQ ID NO: 463121 - protein, 13 aa, Mycobacterium
EDPVPSDKHLTSS

SEQ ID NO: 463122 - protein, 6 aa, Mycobacterium
EDPVSG

SEQ ID NO: 463123 - protein, 5 aa, Mycobacterium
EDPWA

SEQ ID NO: 463124 - protein, 4 aa, Mycobacterium
EDPY

SEQ ID NO: 463125 - protein, 15 aa, Mycobacterium
EDPYAAADRLLAPPP

SEQ ID NO: 463126 - protein, 7 aa, Mycobacterium
EDPYASP

SEQ ID NO: 463127 - protein, 10 aa, Mycobacterium
EDPYRGGGRL

SEQ ID NO: 463128 - protein, 7 aa, Mycobacterium
EDPYTEQ

SEQ ID NO: 463129 - protein, 5 aa, Mycobacterium
EDQAA

SEQ ID NO: 463130 - protein, 17 aa, Mycobacterium
EDQAGQVETVKRSEAGM

SEQ ID NO: 463131 - protein, 8 aa, Mycobacterium
EDQAGRPM

SEQ ID NO: 463132 - protein, 5 aa, Mycobacterium
EDQCR

SEQ ID NO: 463133 - protein, 4 aa, Mycobacterium
EDQD

SEQ ID NO: 463134 - protein, 7 aa, Mycobacterium
EDQEIGR

SEQ ID NO: 463135 - protein, 6 aa, Mycobacterium
EDQEKE

SEQ ID NO: 463136 - protein, 4 aa, Mycobacterium
EDQG

SEQ ID NO: 463137 - protein, 8 aa, Mycobacterium
EDQGEARI

SEQ ID NO: 463138 - protein, 8 aa, Mycobacterium
EDQGRDPV

SEQ ID NO: 463139 - protein, 7 aa, Mycobacterium
EDQGREL

SEQ ID NO: 463140 - protein, 8 aa, Mycobacterium
EDQGRNPV

SEQ ID NO: 463141 - protein, 6 aa, Mycobacterium
EDQGYR

SEQ ID NO: 463142 - protein, 4 aa, Mycobacterium
EDQL

SEQ ID NO: 463143 - protein, 37 aa, Mycobacterium
EDQLEASRQERARADSAYEAAMDKSAQATLDADDDRR

SEQ ID NO: 463144 - protein, 11 aa, Mycobacterium
EDQLKNSDAGV

SEQ ID NO: 463145 - protein, 5 aa, Mycobacterium
EDQLT

SEQ ID NO: 463146 - protein, 4 aa, Mycobacterium
EDQP

SEQ ID NO: 463147 - protein, 7 aa, Mycobacterium
EDQPAAM

SEQ ID NO: 463148 - protein, 9 aa, Mycobacterium
EDQPAGPEI

SEQ ID NO: 463149 - protein, 6 aa, Mycobacterium
EDQPDA

SEQ ID NO: 463150 - protein, 15 aa, Mycobacterium
EDQPEVMAGALREFV

SEQ ID NO: 463151 - protein, 7 aa, Mycobacterium
EDQPLGR

SEQ ID NO: 463152 - protein, 6 aa, Mycobacterium
EDQPPE

SEQ ID NO: 463153 - protein, 8 aa, Mycobacterium
EDQPVKSA

SEQ ID NO: 463154 - protein, 6 aa, Mycobacterium
EDQQPA

SEQ ID NO: 463155 - protein, 17 aa, Mycobacterium
EDQRDADEGTSSARAQL

SEQ ID NO: 463156 - protein, 9 aa, Mycobacterium
EDQRPPQEE

SEQ ID NO: 463157 - protein, 8 aa, Mycobacterium
EDQRVPDD

SEQ ID NO: 463158 - protein, 7 aa, Mycobacterium
EDQSRNA

SEQ ID NO: 463159 - protein, 7 aa, Mycobacterium
EDQSRTA

SEQ ID NO: 463160 - protein, 17 aa, Mycobacterium
EDQTRRAATGADDTLAG

SEQ ID NO: 463161 - protein, 20 aa, Mycobacterium
EDQTRRATTGSDDTLEGLRA

SEQ ID NO: 463162 - protein, 27 aa, Mycobacterium
EDQYYSPDFGQATGAAVPLDDYGYSDY

SEQ ID NO: 463163 - protein, 27 aa, Mycobacterium
EDQYYSPDFGSNTGAAVPLDDYGYSDY

SEQ ID NO: 463164 - protein, 7 aa, Mycobacterium
EDRAADR

SEQ ID NO: 463165 - protein, 7 aa, Mycobacterium
EDRADKG

SEQ ID NO: 463166 - protein, 12 aa, Mycobacterium
EDRADKVEKQFQ

SEQ ID NO: 463167 - protein, 5 aa, Mycobacterium
EDRAE

SEQ ID NO: 463168 - protein, 6 aa, Mycobacterium
EDRAEE

SEQ ID NO: 463169 - protein, 10 aa, Mycobacterium
EDRAEQRQRV

SEQ ID NO: 463170 - protein, 8 aa, Mycobacterium
EDRAPAAY

SEQ ID NO: 463171 - protein, 10 aa, Mycobacterium
EDRARANGVP

SEQ ID NO: 463172 - protein, 6 aa, Mycobacterium
EDRARR

SEQ ID NO: 463173 - protein, 5 aa, Mycobacterium
EDRAT

SEQ ID NO: 463174 - protein, 7 aa, Mycobacterium
EDRDSDV

SEQ ID NO: 463175 - protein, 5 aa, Mycobacterium
EDRDT

SEQ ID NO: 463176 - protein, 6 aa, Mycobacterium
EDRDTV

SEQ ID NO: 463177 - protein, 8 aa, Mycobacterium
EDRDYNTT

SEQ ID NO: 463178 - protein, 4 aa, Mycobacterium
EDRE

SEQ ID NO: 463179 - protein, 6 aa, Mycobacterium
EDREAE

SEQ ID NO: 463180 - protein, 7 aa, Mycobacterium
EDREPRA

SEQ ID NO: 463181 - protein, 17 aa, Mycobacterium
EDRERALAAATEVLARI

SEQ ID NO: 463182 - protein, 9 aa, Mycobacterium
EDRETAEAL

SEQ ID NO: 463183 - protein, 9 aa, Mycobacterium
EDREYSYGE

SEQ ID NO: 463184 - protein, 6 aa, Mycobacterium
EDRGAS

SEQ ID NO: 463185 - protein, 10 aa, Mycobacterium
EDRGDGGGDV

SEQ ID NO: 463186 - protein, 7 aa, Mycobacterium
EDRGDKG

SEQ ID NO: 463187 - protein, 7 aa, Mycobacterium
EDRGEAF

SEQ ID NO: 463188 - protein, 8 aa, Mycobacterium
EDRGEARI

SEQ ID NO: 463189 - protein, 6 aa, Mycobacterium
EDRGEF

SEQ ID NO: 463190 - protein, 10 aa, Mycobacterium
EDRGKTARRR

SEQ ID NO: 463191 - protein, 7 aa, Mycobacterium
EDRGPAA

SEQ ID NO: 463192 - protein, 5 aa, Mycobacterium
EDRGW

SEQ ID NO: 463193 - protein, 6 aa, Mycobacterium
EDRHDG

SEQ ID NO: 463194 - protein, 10 aa, Mycobacterium
EDRHGPPGDR

SEQ ID NO: 463195 - protein, 36 aa, Mycobacterium
EDRHQQDALAEKQPHAVKAKEQGEPAAPAPSNRGRC

SEQ ID NO: 463196 - protein, 5 aa, Mycobacterium
EDRIE

SEQ ID NO: 463197 - protein, 11 aa, Mycobacterium
EDRKGVELNPQ

SEQ ID NO: 463198 - protein, 7 aa, Mycobacterium
EDRLSKG

SEQ ID NO: 463199 - protein, 7 aa, Mycobacterium
EDRNAAI

SEQ ID NO: 463200 - protein, 13 aa, Mycobacterium
EDRNGRRKPFPVG

SEQ ID NO: 463201 - protein, 13 aa, Mycobacterium
EDRNPTGSIKDRP

SEQ ID NO: 463202 - protein, 6 aa, Mycobacterium
EDRPAD

SEQ ID NO: 463203 - protein, 6 aa, Mycobacterium
EDRPAL

SEQ ID NO: 463204 - protein, 7 aa, Mycobacterium
EDRPALK

SEQ ID NO: 463205 - protein, 6 aa, Mycobacterium
EDRPAS

SEQ ID NO: 463206 - protein, 9 aa, Mycobacterium
EDRPDEDSF

SEQ ID NO: 463207 - protein, 8 aa, Mycobacterium
EDRPDKTA

SEQ ID NO: 463208 - protein, 10 aa, Mycobacterium
EDRPDWTDPA

SEQ ID NO: 463209 - protein, 8 aa, Mycobacterium
EDRPGDRR

SEQ ID NO: 463210 - protein, 8 aa, Mycobacterium
EDRPGGKR

SEQ ID NO: 463211 - protein, 12 aa, Mycobacterium
EDRPGVQPDGET

SEQ ID NO: 463212 - protein, 7 aa, Mycobacterium
EDRPRTM

SEQ ID NO: 463213 - protein, 5 aa, Mycobacterium
EDRPV

SEQ ID NO: 463214 - protein, 25 aa, Mycobacterium
EDRQRAITDHGEETLQGTTVDSLAT

SEQ ID NO: 463215 - protein, 18 aa, Mycobacterium
EDRQRGARNLSGQKYERD

SEQ ID NO: 463216 - protein, 19 aa, Mycobacterium
EDRQRQITDHGEETLQGKT

SEQ ID NO: 463217 - protein, 4 aa, Mycobacterium
EDRR

SEQ ID NO: 463218 - protein, 8 aa, Mycobacterium
EDRRHRGE

SEQ ID NO: 463219 - protein, 10 aa, Mycobacterium
EDRRQPTTTL

SEQ ID NO: 463220 - protein, 9 aa, Mycobacterium
EDRRRDAVD

SEQ ID NO: 463221 - protein, 9 aa, Mycobacterium
EDRRRSERD

SEQ ID NO: 463222 - protein, 8 aa, Mycobacterium
EDRRSAER

SEQ ID NO: 463223 - protein, 4 aa, Mycobacterium
EDRS

SEQ ID NO: 463224 - protein, 6 aa, Mycobacterium
EDRSAR

SEQ ID NO: 463225 - protein, 10 aa, Mycobacterium
EDRSATPTLD

SEQ ID NO: 463226 - protein, 7 aa, Mycobacterium
EDRSGEA

SEQ ID NO: 463227 - protein, 8 aa, Mycobacterium
EDRSGEDD

SEQ ID NO: 463228 - protein, 11 aa, Mycobacterium
EDRSGGPELAG

SEQ ID NO: 463229 - protein, 8 aa, Mycobacterium
EDRSTAER

SEQ ID NO: 463230 - protein, 9 aa, Mycobacterium
EDRSTPERD

SEQ ID NO: 463231 - protein, 13 aa, Mycobacterium
EDRTDFQQRSARQ

SEQ ID NO: 463232 - protein, 6 aa, Mycobacterium
EDRTDT

SEQ ID NO: 463233 - protein, 29 aa, Mycobacterium
EDRTMGTAQPGSFGPPVTAAPVREHGTSQ

SEQ ID NO: 463234 - protein, 5 aa, Mycobacterium
EDRTR

SEQ ID NO: 463235 - protein, 4 aa, Mycobacterium
EDRV

SEQ ID NO: 463236 - protein, 6 aa, Mycobacterium
EDRVGD

SEQ ID NO: 463237 - protein, 5 aa, Mycobacterium
EDRVP

SEQ ID NO: 463238 - protein, 5 aa, Mycobacterium
EDRVT

SEQ ID NO: 463239 - protein, 10 aa, Mycobacterium
EDSAAAQNTA

SEQ ID NO: 463240 - protein, 14 aa, Mycobacterium
EDSARLRQTQPTEL

SEQ ID NO: 463241 - protein, 6 aa, Mycobacterium
EDSARQ

SEQ ID NO: 463242 - protein, 9 aa, Mycobacterium
EDSASFDER

SEQ ID NO: 463243 - protein, 8 aa, Mycobacterium
EDSATARY

SEQ ID NO: 463244 - protein, 6 aa, Mycobacterium
EDSATE

SEQ ID NO: 463245 - protein, 8 aa, Mycobacterium
EDSAVPRE

SEQ ID NO: 463246 - protein, 4 aa, Mycobacterium
EDSD

SEQ ID NO: 463247 - protein, 8 aa, Mycobacterium
EDSDDVQN

SEQ ID NO: 463248 - protein, 8 aa, Mycobacterium
EDSDNTQL

SEQ ID NO: 463249 - protein, 7 aa, Mycobacterium
EDSDPAV

SEQ ID NO: 463250 - protein, 7 aa, Mycobacterium
EDSDPGR

SEQ ID NO: 463251 - protein, 4 aa, Mycobacterium
EDSE

SEQ ID NO: 463252 - protein, 14 aa, Mycobacterium
EDSETAMNAGADKF

SEQ ID NO: 463253 - protein, 4 aa, Mycobacterium
EDSG

SEQ ID NO: 463254 - protein, 10 aa, Mycobacterium
EDSGEAELGA

SEQ ID NO: 463255 - protein, 5 aa, Mycobacterium
EDSGM

SEQ ID NO: 463256 - protein, 14 aa, Mycobacterium
EDSGPELAERIISW

SEQ ID NO: 463257 - protein, 18 aa, Mycobacterium
EDSGPELAERIISWRQPA

SEQ ID NO: 463258 - protein, 10 aa, Mycobacterium
EDSGSRMNRI

SEQ ID NO: 463259 - protein, 10 aa, Mycobacterium
EDSGSRMSRL

SEQ ID NO: 463260 - protein, 10 aa, Mycobacterium
EDSGSTPTGF

SEQ ID NO: 463261 - protein, 13 aa, Mycobacterium
EDSISTPEIETAT

SEQ ID NO: 463262 - protein, 9 aa, Mycobacterium
EDSKEGPKA

SEQ ID NO: 463263 - protein, 20 aa, Mycobacterium
EDSKEGPRAFAEKRKPNFQN

SEQ ID NO: 463264 - protein, 7 aa, Mycobacterium
EDSKRAV

SEQ ID NO: 463265 - protein, 5 aa, Mycobacterium
EDSKT

SEQ ID NO: 463266 - protein, 17 aa, Mycobacterium
EDSLPDLNQRTADAATD

SEQ ID NO: 463267 - protein, 8 aa, Mycobacterium
EDSLSSAA

SEQ ID NO: 463268 - protein, 7 aa, Mycobacterium
EDSNDVG

SEQ ID NO: 463269 - protein, 6 aa, Mycobacterium
EDSNQK

SEQ ID NO: 463270 - protein, 9 aa, Mycobacterium
EDSPADPEF

SEQ ID NO: 463271 - protein, 8 aa, Mycobacterium
EDSPDAIG

SEQ ID NO: 463272 - protein, 6 aa, Mycobacterium
EDSPDV

SEQ ID NO: 463273 - protein, 9 aa, Mycobacterium
EDSPGATTE

SEQ ID NO: 463274 - protein, 18 aa, Mycobacterium
EDSPSALKPGTRPRTTLS

SEQ ID NO: 463275 - protein, 12 aa, Mycobacterium
EDSQSAEATEDI

SEQ ID NO: 463276 - protein, 11 aa, Mycobacterium
EDSRPTTHDEP

SEQ ID NO: 463277 - protein, 12 aa, Mycobacterium
EDSRPTTHDEPT

SEQ ID NO: 463278 - protein, 5 aa, Mycobacterium
EDSRQ

SEQ ID NO: 463279 - protein, 9 aa, Mycobacterium
EDSRSADER

SEQ ID NO: 463280 - protein, 5 aa, Mycobacterium
EDSSA

SEQ ID NO: 463281 - protein, 6 aa, Mycobacterium
EDSSGT

SEQ ID NO: 463282 - protein, 10 aa, Mycobacterium
EDSSSRRPFR

SEQ ID NO: 463283 - protein, 6 aa, Mycobacterium
EDSSYR

SEQ ID NO: 463284 - protein, 7 aa, Mycobacterium
EDSTKAV

SEQ ID NO: 463285 - protein, 6 aa, Mycobacterium
EDSTKD

SEQ ID NO: 463286 - protein, 10 aa, Mycobacterium
EDSTSRRPFR

SEQ ID NO: 463287 - protein, 5 aa, Mycobacterium
EDSTY

SEQ ID NO: 463288 - protein, 6 aa, Mycobacterium
EDSVDV

SEQ ID NO: 463289 - protein, 9 aa, Mycobacterium
EDSVPSDAE

SEQ ID NO: 463290 - protein, 14 aa, Mycobacterium
EDSVRAAGSPEIPS

SEQ ID NO: 463291 - protein, 12 aa, Mycobacterium
EDSVTEAVNEPD

SEQ ID NO: 463292 - protein, 4 aa, Mycobacterium
EDTA

SEQ ID NO: 463293 - protein, 8 aa, Mycobacterium
EDTAAGGD

SEQ ID NO: 463294 - protein, 13 aa, Mycobacterium
EDTADNDQKPCGH

SEQ ID NO: 463295 - protein, 8 aa, Mycobacterium
EDTAESLG

SEQ ID NO: 463296 - protein, 17 aa, Mycobacterium
EDTAEVAAGSRVQVWDL

SEQ ID NO: 463297 - protein, 12 aa, Mycobacterium
EDTAGSAGDDLE

SEQ ID NO: 463298 - protein, 13 aa, Mycobacterium
EDTAPGDQPPATA

SEQ ID NO: 463299 - protein, 8 aa, Mycobacterium
EDTATARH

SEQ ID NO: 463300 - protein, 13 aa, Mycobacterium
EDTAVNDAKPCGH

SEQ ID NO: 463301 - protein, 8 aa, Mycobacterium
EDTDDEIR

SEQ ID NO: 463302 - protein, 7 aa, Mycobacterium
EDTDGGV

SEQ ID NO: 463303 - protein, 5 aa, Mycobacterium
EDTDL

SEQ ID NO: 463304 - protein, 5 aa, Mycobacterium
EDTDV

SEQ ID NO: 463305 - protein, 6 aa, Mycobacterium
EDTEGL

SEQ ID NO: 463306 - protein, 6 aa, Mycobacterium
EDTELG

SEQ ID NO: 463307 - protein, 7 aa, Mycobacterium
EDTELTG

SEQ ID NO: 463308 - protein, 10 aa, Mycobacterium
EDTEPGTQFT

SEQ ID NO: 463309 - protein, 13 aa, Mycobacterium
EDTERARTILSTQ

SEQ ID NO: 463310 - protein, 6 aa, Mycobacterium
EDTESF

SEQ ID NO: 463311 - protein, 5 aa, Mycobacterium
EDTGA

SEQ ID NO: 463312 - protein, 8 aa, Mycobacterium
EDTGAGGD

SEQ ID NO: 463313 - protein, 9 aa, Mycobacterium
EDTGELPPR

SEQ ID NO: 463314 - protein, 8 aa, Mycobacterium
EDTGETRV

SEQ ID NO: 463315 - protein, 7 aa, Mycobacterium
EDTGPTR

SEQ ID NO: 463316 - protein, 11 aa, Mycobacterium
EDTGSAQKSPI

SEQ ID NO: 463317 - protein, 6 aa, Mycobacterium
EDTHTT

SEQ ID NO: 463318 - protein, 10 aa, Mycobacterium
EDTIATGGSI

SEQ ID NO: 463319 - protein, 6 aa, Mycobacterium
EDTLDE

SEQ ID NO: 463320 - protein, 14 aa, Mycobacterium
EDTLDEAIRRLAVL

SEQ ID NO: 463321 - protein, 6 aa, Mycobacterium
EDTLEP

SEQ ID NO: 463322 - protein, 13 aa, Mycobacterium
EDTPEGDQPPATA

SEQ ID NO: 463323 - protein, 6 aa, Mycobacterium
EDTPGG

SEQ ID NO: 463324 - protein, 7 aa, Mycobacterium
EDTPQPD

SEQ ID NO: 463325 - protein, 6 aa, Mycobacterium
EDTPRA

SEQ ID NO: 463326 - protein, 8 aa, Mycobacterium
EDTPRETV

SEQ ID NO: 463327 - protein, 7 aa, Mycobacterium
EDTPTDI

SEQ ID NO: 463328 - protein, 5 aa, Mycobacterium
EDTPW

SEQ ID NO: 463329 - protein, 10 aa, Mycobacterium
EDTQPQREPA

SEQ ID NO: 463330 - protein, 7 aa, Mycobacterium
EDTRRQL

SEQ ID NO: 463331 - protein, 6 aa, Mycobacterium
EDTSAY

SEQ ID NO: 463332 - protein, 12 aa, Mycobacterium
EDTSAYDAGHIP

SEQ ID NO: 463333 - protein, 12 aa, Mycobacterium
EDTSAYDDGHIP

SEQ ID NO: 463334 - protein, 5 aa, Mycobacterium
EDTSE

SEQ ID NO: 463335 - protein, 11 aa, Mycobacterium
EDTSKAARAAD

SEQ ID NO: 463336 - protein, 9 aa, Mycobacterium
EDTSNKTNA

SEQ ID NO: 463337 - protein, 8 aa, Mycobacterium
EDTSVDAQ

SEQ ID NO: 463338 - protein, 7 aa, Mycobacterium
EDTTDAD

SEQ ID NO: 463339 - protein, 5 aa, Mycobacterium
EDTTL

SEQ ID NO: 463340 - protein, 5 aa, Mycobacterium
EDTVA

SEQ ID NO: 463341 - protein, 9 aa, Mycobacterium
EDTVGASAQ

SEQ ID NO: 463342 - protein, 10 aa, Mycobacterium
EDTVNADGGA

SEQ ID NO: 463343 - protein, 5 aa, Mycobacterium
EDTVR

SEQ ID NO: 463344 - protein, 4 aa, Mycobacterium
EDTY

SEQ ID NO: 463345 - protein, 5 aa, Mycobacterium
EDTYQ

SEQ ID NO: 463346 - protein, 23 aa, Mycobacterium
EDTYVGSEEIRRRAAERAGARTE

SEQ ID NO: 463347 - protein, 8 aa, Mycobacterium
EDVADGSF

SEQ ID NO: 463348 - protein, 14 aa, Mycobacterium
EDVADGTALGVQGT

SEQ ID NO: 463349 - protein, 10 aa, Mycobacterium
EDVAKPGSDR

SEQ ID NO: 463350 - protein, 52 aa, Mycobacterium
EDVASEDAEVESGDSEVGDDEEAPAPAAAAEPAADEDDEIAEPTEKDKASGD

SEQ ID NO: 463351 - protein, 4 aa, Mycobacterium
EDVD

SEQ ID NO: 463352 - protein, 8 aa, Mycobacterium
EDVDPAIR

SEQ ID NO: 463353 - protein, 8 aa, Mycobacterium
EDVEGPGA

SEQ ID NO: 463354 - protein, 7 aa, Mycobacterium
EDVETTG

SEQ ID NO: 463355 - protein, 11 aa, Mycobacterium
EDVGNGDGPEC

SEQ ID NO: 463356 - protein, 8 aa, Mycobacterium
EDVNRSQE

SEQ ID NO: 463357 - protein, 15 aa, Mycobacterium
EDVNSGLAYGGNKTR

SEQ ID NO: 463358 - protein, 4 aa, Mycobacterium
EDVP

SEQ ID NO: 463359 - protein, 10 aa, Mycobacterium
EDVPAPPGAV

SEQ ID NO: 463360 - protein, 7 aa, Mycobacterium
EDVPASE

SEQ ID NO: 463361 - protein, 6 aa, Mycobacterium
EDVPDL

SEQ ID NO: 463362 - protein, 5 aa, Mycobacterium
EDVPG

SEQ ID NO: 463363 - protein, 8 aa, Mycobacterium
EDVPSGAA

SEQ ID NO: 463364 - protein, 25 aa, Mycobacterium
EDVPSVARAGSNPSRQCTRATEATR

SEQ ID NO: 463365 - protein, 8 aa, Mycobacterium
EDVQRSQE

SEQ ID NO: 463366 - protein, 5 aa, Mycobacterium
EDVRA

SEQ ID NO: 463367 - protein, 8 aa, Mycobacterium
EDVRAGDT

SEQ ID NO: 463368 - protein, 5 aa, Mycobacterium
EDVRD

SEQ ID NO: 463369 - protein, 7 aa, Mycobacterium
EDVREEV

SEQ ID NO: 463370 - protein, 11 aa, Mycobacterium
EDVREGMEKTQ

SEQ ID NO: 463371 - protein, 9 aa, Mycobacterium
EDVRKSYDV

SEQ ID NO: 463372 - protein, 4 aa, Mycobacterium
EDVS

SEQ ID NO: 463373 - protein, 20 aa, Mycobacterium
EDVSKDENPNVPYGAEETAR

SEQ ID NO: 463374 - protein, 8 aa, Mycobacterium
EDVTGEQL

SEQ ID NO: 463375 - protein, 8 aa, Mycobacterium
EDVTGPAI

SEQ ID NO: 463376 - protein, 9 aa, Mycobacterium
EDVTGSTSR

SEQ ID NO: 463377 - protein, 14 aa, Mycobacterium
EDVTPEQAQKHAGY

SEQ ID NO: 463378 - protein, 12 aa, Mycobacterium
EDVTRWYSSRRA

SEQ ID NO: 463379 - protein, 6 aa, Mycobacterium
EDWPAA

SEQ ID NO: 463380 - protein, 5 aa, Mycobacterium
EDWTE

SEQ ID NO: 463381 - protein, 6 aa, Mycobacterium
EDYAEL

SEQ ID NO: 463382 - protein, 5 aa, Mycobacterium
EDYDA

SEQ ID NO: 463383 - protein, 16 aa, Mycobacterium
EDYDRVPADDPNPEQI

SEQ ID NO: 463384 - protein, 16 aa, Mycobacterium
EDYDRVPADEPNPEQI

SEQ ID NO: 463385 - protein, 16 aa, Mycobacterium
EDYDRVPAEDPNPEQI

SEQ ID NO: 463386 - protein, 9 aa, Mycobacterium
EDYEADNDR

SEQ ID NO: 463387 - protein, 10 aa, Mycobacterium
EDYFDDAGPA

SEQ ID NO: 463388 - protein, 7 aa, Mycobacterium
EDYGDRG

SEQ ID NO: 463389 - protein, 7 aa, Mycobacterium
EDYGGMG

SEQ ID NO: 463390 - protein, 9 aa, Mycobacterium
EDYPPTADS

SEQ ID NO: 463391 - protein, 8 aa, Mycobacterium
EDYPTRVT

SEQ ID NO: 463392 - protein, 9 aa, Mycobacterium
EDYRSGKGT

SEQ ID NO: 463393 - protein, 4 aa, Mycobacterium
EDYS

SEQ ID NO: 463394 - protein, 12 aa, Mycobacterium
EDYSRAKHTAAG

SEQ ID NO: 463395 - protein, 6 aa, Mycobacterium
EDYSRR

SEQ ID NO: 463396 - protein, 23 aa, Mycobacterium
EDYTPRTSTVSLDDRPPMVTLRP

SEQ ID NO: 463397 - protein, 5 aa, Mycobacterium
EEAAA

SEQ ID NO: 463398 - protein, 9 aa, Mycobacterium
EEAAADPNL

SEQ ID NO: 463399 - protein, 13 aa, Mycobacterium
EEAAAKAEHAQAE

SEQ ID NO: 463400 - protein, 29 aa, Mycobacterium
EEAADAADTLGTLTGRRARTLSSEPEAAA

SEQ ID NO: 463401 - protein, 7 aa, Mycobacterium
EEAADDL

SEQ ID NO: 463402 - protein, 9 aa, Mycobacterium
EEAAEQTIG

SEQ ID NO: 463403 - protein, 12 aa, Mycobacterium
EEAAGGERGSAE

SEQ ID NO: 463404 - protein, 5 aa, Mycobacterium
EEAAQ

SEQ ID NO: 463405 - protein, 7 aa, Mycobacterium
EEAAQLS

SEQ ID NO: 463406 - protein, 8 aa, Mycobacterium
EEAAQRAG

SEQ ID NO: 463407 - protein, 8 aa, Mycobacterium
EEAARRAG

SEQ ID NO: 463408 - protein, 23 aa, Mycobacterium
EEAARTAHGAYSEAQEANLRMAR

SEQ ID NO: 463409 - protein, 6 aa, Mycobacterium
EEAATV

SEQ ID NO: 463410 - protein, 7 aa, Mycobacterium
EEAAYDG

SEQ ID NO: 463411 - protein, 8 aa, Mycobacterium
EEADAAYD

SEQ ID NO: 463412 - protein, 6 aa, Mycobacterium
EEADAL

SEQ ID NO: 463413 - protein, 6 aa, Mycobacterium
EEADAT

SEQ ID NO: 463414 - protein, 14 aa, Mycobacterium
EEADGALTITSGGS

SEQ ID NO: 463415 - protein, 6 aa, Mycobacterium
EEADGV

SEQ ID NO: 463416 - protein, 7 aa, Mycobacterium
EEADRDD

SEQ ID NO: 463417 - protein, 7 aa, Mycobacterium
EEADTSV

SEQ ID NO: 463418 - protein, 4 aa, Mycobacterium
EEAE

SEQ ID NO: 463419 - protein, 9 aa, Mycobacterium
EEAEAENAL

SEQ ID NO: 463420 - protein, 15 aa, Mycobacterium
EEAEAENQARYGGSL

SEQ ID NO: 463421 - protein, 8 aa, Mycobacterium
EEAEARAY

SEQ ID NO: 463422 - protein, 9 aa, Mycobacterium
EEAEARSYR

SEQ ID NO: 463423 - protein, 6 aa, Mycobacterium
EEAEKA

SEQ ID NO: 463424 - protein, 12 aa, Mycobacterium
EEAEKLASDAPD

SEQ ID NO: 463425 - protein, 8 aa, Mycobacterium
EEAEQQRH

SEQ ID NO: 463426 - protein, 5 aa, Mycobacterium
EEAER

SEQ ID NO: 463427 - protein, 10 aa, Mycobacterium
EEAETAPATV

SEQ ID NO: 463428 - protein, 9 aa, Mycobacterium
EEAETAPHT

SEQ ID NO: 463429 - protein, 8 aa, Mycobacterium
EEAETPAV

SEQ ID NO: 463430 - protein, 8 aa, Mycobacterium
EEAETPPV

SEQ ID NO: 463431 - protein, 7 aa, Mycobacterium
EEAETVP

SEQ ID NO: 463432 - protein, 8 aa, Mycobacterium
EEAETVPA

SEQ ID NO: 463433 - protein, 7 aa, Mycobacterium
EEAEYDG

SEQ ID NO: 463434 - protein, 9 aa, Mycobacterium
EEAFAQPGS

SEQ ID NO: 463435 - protein, 20 aa, Mycobacterium
EEAGAATPEAPAPADAATSS

SEQ ID NO: 463436 - protein, 12 aa, Mycobacterium
EEAGAESDSMSG

SEQ ID NO: 463437 - protein, 21 aa, Mycobacterium
EEAGAEVTRPCAEGDPVSARW

SEQ ID NO: 463438 - protein, 8 aa, Mycobacterium
EEAGALGA

SEQ ID NO: 463439 - protein, 5 aa, Mycobacterium
EEAGD

SEQ ID NO: 463440 - protein, 13 aa, Mycobacterium
EEAGDSLGARTRA

SEQ ID NO: 463441 - protein, 7 aa, Mycobacterium
EEAGEPC

SEQ ID NO: 463442 - protein, 9 aa, Mycobacterium
EEAGGAGWR

SEQ ID NO: 463443 - protein, 9 aa, Mycobacterium
EEAGGATVD

SEQ ID NO: 463444 - protein, 7 aa, Mycobacterium
EEAGRAT

SEQ ID NO: 463445 - protein, 12 aa, Mycobacterium
EEAGRDPSTLET

SEQ ID NO: 463446 - protein, 9 aa, Mycobacterium
EEAGREGTS

SEQ ID NO: 463447 - protein, 13 aa, Mycobacterium
EEAGSDDFGADGW

SEQ ID NO: 463448 - protein, 13 aa, Mycobacterium
EEAGSDDFGAEGW

SEQ ID NO: 463449 - protein, 9 aa, Mycobacterium
EEAGSSSMS

SEQ ID NO: 463450 - protein, 7 aa, Mycobacterium
EEAGTET

SEQ ID NO: 463451 - protein, 5 aa, Mycobacterium
EEAGY

SEQ ID NO: 463452 - protein, 5 aa, Mycobacterium
EEAHR

SEQ ID NO: 463453 - protein, 4 aa, Mycobacterium
EEAK

SEQ ID NO: 463454 - protein, 9 aa, Mycobacterium
EEAKLRPDL

SEQ ID NO: 463455 - protein, 16 aa, Mycobacterium
EEAKTFADKARAHGLT

SEQ ID NO: 463456 - protein, 5 aa, Mycobacterium
EEAKY

SEQ ID NO: 463457 - protein, 4 aa, Mycobacterium
EEAL

SEQ ID NO: 463458 - protein, 19 aa, Mycobacterium
EEALADNDLESLKPKIADS

SEQ ID NO: 463459 - protein, 5 aa, Mycobacterium
EEALQ

SEQ ID NO: 463460 - protein, 5 aa, Mycobacterium
EEANA

SEQ ID NO: 463461 - protein, 10 aa, Mycobacterium
EEANSGSINV

SEQ ID NO: 463462 - protein, 7 aa, Mycobacterium
EEAPAAW

SEQ ID NO: 463463 - protein, 9 aa, Mycobacterium
EEAPADAGL

SEQ ID NO: 463464 - protein, 8 aa, Mycobacterium
EEAPEGTP

SEQ ID NO: 463465 - protein, 8 aa, Mycobacterium
EEAPENGF

SEQ ID NO: 463466 - protein, 7 aa, Mycobacterium
EEAPQSA

SEQ ID NO: 463467 - protein, 7 aa, Mycobacterium
EEAPSPL

SEQ ID NO: 463468 - protein, 9 aa, Mycobacterium
EEAPSPLLD

SEQ ID NO: 463469 - protein, 16 aa, Mycobacterium
EEAPSPLLDPQTRARI

SEQ ID NO: 463470 - protein, 8 aa, Mycobacterium
EEAPSPLV

SEQ ID NO: 463471 - protein, 8 aa, Mycobacterium
EEAPSYTP

SEQ ID NO: 463472 - protein, 15 aa, Mycobacterium
EEAQRNHQALSQQAA

SEQ ID NO: 463473 - protein, 12 aa, Mycobacterium
EEAQRQHQALTQ

SEQ ID NO: 463474 - protein, 8 aa, Mycobacterium
EEAQRQRG

SEQ ID NO: 463475 - protein, 6 aa, Mycobacterium
EEAQRV

SEQ ID NO: 463476 - protein, 9 aa, Mycobacterium
EEARAAGTS

SEQ ID NO: 463477 - protein, 9 aa, Mycobacterium
EEARADGKR

SEQ ID NO: 463478 - protein, 9 aa, Mycobacterium
EEARAKDDH

SEQ ID NO: 463479 - protein, 9 aa, Mycobacterium
EEARAKEDH

SEQ ID NO: 463480 - protein, 10 aa, Mycobacterium
EEARAKEDHS

SEQ ID NO: 463481 - protein, 8 aa, Mycobacterium
EEARANGD

SEQ ID NO: 463482 - protein, 9 aa, Mycobacterium
EEARANGDH

SEQ ID NO: 463483 - protein, 9 aa, Mycobacterium
EEARATGAS

SEQ ID NO: 463484 - protein, 5 aa, Mycobacterium
EEARE

SEQ ID NO: 463485 - protein, 11 aa, Mycobacterium
EEAREMDDTRI

SEQ ID NO: 463486 - protein, 8 aa, Mycobacterium
EEARERQH

SEQ ID NO: 463487 - protein, 47 aa, Mycobacterium
EEARGAARQQGKNVGQGRTAPSGSPRRGTARSRRRWSGPGPDNRDPQ

SEQ ID NO: 463488 - protein, 45 aa, Mycobacterium
EEARGAARSQGKDVGRGRSGPARRVGGNRRRRTWSGPGPDARDPQ

SEQ ID NO: 463489 - protein, 8 aa, Mycobacterium
EEARHSTA

SEQ ID NO: 463490 - protein, 5 aa, Mycobacterium
EEARP

SEQ ID NO: 463491 - protein, 5 aa, Mycobacterium
EEARQ

SEQ ID NO: 463492 - protein, 7 aa, Mycobacterium
EEARTRY

SEQ ID NO: 463493 - protein, 11 aa, Mycobacterium
EEASAPGSSTF

SEQ ID NO: 463494 - protein, 9 aa, Mycobacterium
EEASAPPPV

SEQ ID NO: 463495 - protein, 15 aa, Mycobacterium
EEASEKFEDSKQRYL

SEQ ID NO: 463496 - protein, 6 aa, Mycobacterium
EEASGR

SEQ ID NO: 463497 - protein, 13 aa, Mycobacterium
EEASPWAHRYPAP

SEQ ID NO: 463498 - protein, 5 aa, Mycobacterium
EEAST

SEQ ID NO: 463499 - protein, 7 aa, Mycobacterium
EEASYSG

SEQ ID NO: 463500 - protein, 18 aa, Mycobacterium
EEATAARKEKRPAEFRDK

SEQ ID NO: 463501 - protein, 8 aa, Mycobacterium
EEATARHN

SEQ ID NO: 463502 - protein, 14 aa, Mycobacterium
EEATGGFLPAKVSA

SEQ ID NO: 463503 - protein, 6 aa, Mycobacterium
EEATNR

SEQ ID NO: 463504 - protein, 11 aa, Mycobacterium
EEATSGGTARY

SEQ ID NO: 463505 - protein, 4 aa, Mycobacterium
EEAV

SEQ ID NO: 463506 - protein, 12 aa, Mycobacterium
EEAVDDKARLGA

SEQ ID NO: 463507 - protein, 7 aa, Mycobacterium
EEAVTED

SEQ ID NO: 463508 - protein, 5 aa, Mycobacterium
EEAYD

SEQ ID NO: 463509 - protein, 15 aa, Mycobacterium
EEAYQKARRTADDIA

SEQ ID NO: 463510 - protein, 9 aa, Mycobacterium
EECTGNGSL

SEQ ID NO: 463511 - protein, 14 aa, Mycobacterium
EEDAADALAEADAE

SEQ ID NO: 463512 - protein, 6 aa, Mycobacterium
EEDADG

SEQ ID NO: 463513 - protein, 6 aa, Mycobacterium
EEDAEG

SEQ ID NO: 463514 - protein, 5 aa, Mycobacterium
EEDAG

SEQ ID NO: 463515 - protein, 16 aa, Mycobacterium
EEDAGLADGGYRASIP

SEQ ID NO: 463516 - protein, 8 aa, Mycobacterium
EEDAPPSS

SEQ ID NO: 463517 - protein, 11 aa, Mycobacterium
EEDASFPAEQE

SEQ ID NO: 463518 - protein, 20 aa, Mycobacterium
EEDDAEPDKENAEPDEEQVS

SEQ ID NO: 463519 - protein, 7 aa, Mycobacterium
EEDDETF

SEQ ID NO: 463520 - protein, 5 aa, Mycobacterium
EEDEP

SEQ ID NO: 463521 - protein, 9 aa, Mycobacterium
EEDEPLEGG

SEQ ID NO: 463522 - protein, 8 aa, Mycobacterium
EEDEQQAA

SEQ ID NO: 463523 - protein, 8 aa, Mycobacterium
EEDGDIRT

SEQ ID NO: 463524 - protein, 5 aa, Mycobacterium
EEDGE

SEQ ID NO: 463525 - protein, 22 aa, Mycobacterium
EEDGGGPSVINAGDGTHEHPTQ

SEQ ID NO: 463526 - protein, 6 aa, Mycobacterium
EEDGPV

SEQ ID NO: 463527 - protein, 16 aa, Mycobacterium
EEDGSLEVGPGGGFGG

SEQ ID NO: 463528 - protein, 6 aa, Mycobacterium
EEDGSY

SEQ ID NO: 463529 - protein, 5 aa, Mycobacterium
EEDHA

SEQ ID NO: 463530 - protein, 7 aa, Mycobacterium
EEDHEEI

SEQ ID NO: 463531 - protein, 5 aa, Mycobacterium
EEDIR

SEQ ID NO: 463532 - protein, 6 aa, Mycobacterium
EEDKRQ

SEQ ID NO: 463533 - protein, 22 aa, Mycobacterium
EEDLAKESVQVKKEKPKQKKDK

SEQ ID NO: 463534 - protein, 8 aa, Mycobacterium
EEDLGKES

SEQ ID NO: 463535 - protein, 9 aa, Mycobacterium
EEDLSGAEE

SEQ ID NO: 463536 - protein, 9 aa, Mycobacterium
EEDLTGAED

SEQ ID NO: 463537 - protein, 7 aa, Mycobacterium
EEDPAAA

SEQ ID NO: 463538 - protein, 19 aa, Mycobacterium
EEDPAEHLNRNGKVERDGI

SEQ ID NO: 463539 - protein, 13 aa, Mycobacterium
EEDPDRWKERETR

SEQ ID NO: 463540 - protein, 7 aa, Mycobacterium
EEDPERV

SEQ ID NO: 463541 - protein, 7 aa, Mycobacterium
EEDPPEV

SEQ ID NO: 463542 - protein, 7 aa, Mycobacterium
EEDPPMG

SEQ ID NO: 463543 - protein, 9 aa, Mycobacterium
EEDPTERQR

SEQ ID NO: 463544 - protein, 6 aa, Mycobacterium
EEDPVR

SEQ ID NO: 463545 - protein, 12 aa, Mycobacterium
EEDQASIRDRGG

SEQ ID NO: 463546 - protein, 9 aa, Mycobacterium
EEDQEAARD

SEQ ID NO: 463547 - protein, 18 aa, Mycobacterium
EEDQRRVTDHGEATLQSD

SEQ ID NO: 463548 - protein, 5 aa, Mycobacterium
EEDRA

SEQ ID NO: 463549 - protein, 18 aa, Mycobacterium
EEDRIKTGRNMSNPPGRA

SEQ ID NO: 463550 - protein, 5 aa, Mycobacterium
EEDRL

SEQ ID NO: 463551 - protein, 5 aa, Mycobacterium
EEDRP

SEQ ID NO: 463552 - protein, 5 aa, Mycobacterium
EEDSD

SEQ ID NO: 463553 - protein, 9 aa, Mycobacterium
EEDSRGRTS

SEQ ID NO: 463554 - protein, 8 aa, Mycobacterium
EEDSSDEY

SEQ ID NO: 463555 - protein, 7 aa, Mycobacterium
EEDTEGL

SEQ ID NO: 463556 - protein, 6 aa, Mycobacterium
EEDTGK

SEQ ID NO: 463557 - protein, 5 aa, Mycobacterium
EEDTI

SEQ ID NO: 463558 - protein, 5 aa, Mycobacterium
EEDTL

SEQ ID NO: 463559 - protein, 7 aa, Mycobacterium
EEDYPGP

SEQ ID NO: 463560 - protein, 4 aa, Mycobacterium
EEEA

SEQ ID NO: 463561 - protein, 6 aa, Mycobacterium
EEEAAA

SEQ ID NO: 463562 - protein, 16 aa, Mycobacterium
EEEADGTGMFQPANAP

SEQ ID NO: 463563 - protein, 16 aa, Mycobacterium
EEEADSSGMFQPANAP

SEQ ID NO: 463564 - protein, 16 aa, Mycobacterium
EEEADSSGVFQPANAP

SEQ ID NO: 463565 - protein, 16 aa, Mycobacterium
EEEADSSGVFVPANAP

SEQ ID NO: 463566 - protein, 16 aa, Mycobacterium
EEEADVSGTFQPANAP

SEQ ID NO: 463567 - protein, 8 aa, Mycobacterium
EEEAHQSA

SEQ ID NO: 463568 - protein, 6 aa, Mycobacterium
EEEDPV

SEQ ID NO: 463569 - protein, 13 aa, Mycobacterium
EEEEGYQSVGSGS

SEQ ID NO: 463570 - protein, 7 aa, Mycobacterium
EEEESGM

SEQ ID NO: 463571 - protein, 4 aa, Mycobacterium
EEEG

SEQ ID NO: 463572 - protein, 16 aa, Mycobacterium
EEEGAAAGEALAEADA

SEQ ID NO: 463573 - protein, 15 aa, Mycobacterium
EEEGAGSSEAFAEAD

SEQ ID NO: 463574 - protein, 8 aa, Mycobacterium
EEEGHTGP

SEQ ID NO: 463575 - protein, 6 aa, Mycobacterium
EEEGTL

SEQ ID NO: 463576 - protein, 5 aa, Mycobacterium
EEEGV

SEQ ID NO: 463577 - protein, 12 aa, Mycobacterium
EEEHKAKQQLSE

SEQ ID NO: 463578 - protein, 8 aa, Mycobacterium
EEEIGNHE

SEQ ID NO: 463579 - protein, 9 aa, Mycobacterium
EEEKDNRVY

SEQ ID NO: 463580 - protein, 11 aa, Mycobacterium
EEEKDSRQYGA

SEQ ID NO: 463581 - protein, 10 aa, Mycobacterium
EEEKPPPLLT

SEQ ID NO: 463582 - protein, 4 aa, Mycobacterium
EEEL

SEQ ID NO: 463583 - protein, 15 aa, Mycobacterium
EEELAESPVHHPGAK

SEQ ID NO: 463584 - protein, 5 aa, Mycobacterium
EEELG

SEQ ID NO: 463585 - protein, 18 aa, Mycobacterium
EEENPEAAAAIRAQITGD

SEQ ID NO: 463586 - protein, 18 aa, Mycobacterium
EEENPEAAAALREKFAAD

SEQ ID NO: 463587 - protein, 5 aa, Mycobacterium
EEEPA

SEQ ID NO: 463588 - protein, 10 aa, Mycobacterium
EEEPAIAPGA

SEQ ID NO: 463589 - protein, 8 aa, Mycobacterium
EEEPDGAL

SEQ ID NO: 463590 - protein, 8 aa, Mycobacterium
EEEPDHDM

SEQ ID NO: 463591 - protein, 9 aa, Mycobacterium
EEEPDPAAR

SEQ ID NO: 463592 - protein, 9 aa, Mycobacterium
EEEPDPASR

SEQ ID NO: 463593 - protein, 14 aa, Mycobacterium
EEEPELPDYPKSDR

SEQ ID NO: 463594 - protein, 7 aa, Mycobacterium
EEEQDQL

SEQ ID NO: 463595 - protein, 5 aa, Mycobacterium
EEEQG

SEQ ID NO: 463596 - protein, 6 aa, Mycobacterium
EEEQRT

SEQ ID NO: 463597 - protein, 5 aa, Mycobacterium
EEERA

SEQ ID NO: 463598 - protein, 8 aa, Mycobacterium
EEEREAAN

SEQ ID NO: 463599 - protein, 7 aa, Mycobacterium
EEERGES

SEQ ID NO: 463600 - protein, 7 aa, Mycobacterium
EEERLAA

SEQ ID NO: 463601 - protein, 5 aa, Mycobacterium
EEERN

SEQ ID NO: 463602 - protein, 7 aa, Mycobacterium
EEERYQK

SEQ ID NO: 463603 - protein, 4 aa, Mycobacterium
EEES

SEQ ID NO: 463604 - protein, 10 aa, Mycobacterium
EEESGTTSIT

SEQ ID NO: 463605 - protein, 9 aa, Mycobacterium
EEETEFDDE

SEQ ID NO: 463606 - protein, 7 aa, Mycobacterium
EEETRNE

SEQ ID NO: 463607 - protein, 7 aa, Mycobacterium
EEETRSH

SEQ ID NO: 463608 - protein, 5 aa, Mycobacterium
EEETV

SEQ ID NO: 463609 - protein, 15 aa, Mycobacterium
EEETWDATVLVLCWA

SEQ ID NO: 463610 - protein, 5 aa, Mycobacterium
EEEVE

SEQ ID NO: 463611 - protein, 13 aa, Mycobacterium
EEEWRPGLPTPRD

SEQ ID NO: 463612 - protein, 13 aa, Mycobacterium
EEEYTEQKNRLLG

SEQ ID NO: 463613 - protein, 4 aa, Mycobacterium
EEFA

SEQ ID NO: 463614 - protein, 6 aa, Mycobacterium
EEFADP

SEQ ID NO: 463615 - protein, 5 aa, Mycobacterium
EEFAE

SEQ ID NO: 463616 - protein, 11 aa, Mycobacterium
EEFDDDDFDPA

SEQ ID NO: 463617 - protein, 6 aa, Mycobacterium
EEFDPE

SEQ ID NO: 463618 - protein, 6 aa, Mycobacterium
EEFEAR

SEQ ID NO: 463619 - protein, 12 aa, Mycobacterium
EEFERQKRKILG

SEQ ID NO: 463620 - protein, 7 aa, Mycobacterium
EEFGEPY

SEQ ID NO: 463621 - protein, 5 aa, Mycobacterium
EEFGG

SEQ ID NO: 463622 - protein, 6 aa, Mycobacterium
EEFGGR

SEQ ID NO: 463623 - protein, 9 aa, Mycobacterium
EEFGGSAVD

SEQ ID NO: 463624 - protein, 12 aa, Mycobacterium
EEFGGSSAGDYR

SEQ ID NO: 463625 - protein, 13 aa, Mycobacterium
EEFGVGGGPIANE

SEQ ID NO: 463626 - protein, 9 aa, Mycobacterium
EEFPTTAAG

SEQ ID NO: 463627 - protein, 12 aa, Mycobacterium
EEFTEQKQRLLP

SEQ ID NO: 463628 - protein, 7 aa, Mycobacterium
EEFTGGR

SEQ ID NO: 463629 - protein, 5 aa, Mycobacterium
EEFTR

SEQ ID NO: 463630 - protein, 7 aa, Mycobacterium
EEGAAEV

SEQ ID NO: 463631 - protein, 5 aa, Mycobacterium
EEGAD

SEQ ID NO: 463632 - protein, 16 aa, Mycobacterium
EEGAGRPEFYAPVGTA

SEQ ID NO: 463633 - protein, 5 aa, Mycobacterium
EEGAR

SEQ ID NO: 463634 - protein, 16 aa, Mycobacterium
EEGATVATGGAAAEVA

SEQ ID NO: 463635 - protein, 5 aa, Mycobacterium
EEGAV

SEQ ID NO: 463636 - protein, 8 aa, Mycobacterium
EEGDAAYD

SEQ ID NO: 463637 - protein, 10 aa, Mycobacterium
EEGDEGGALP

SEQ ID NO: 463638 - protein, 4 aa, Mycobacterium
EEGE

SEQ ID NO: 463639 - protein, 14 aa, Mycobacterium
EEGEDSSTSRDCDD

SEQ ID NO: 463640 - protein, 7 aa, Mycobacterium
EEGEGRG

SEQ ID NO: 463641 - protein, 6 aa, Mycobacterium
EEGEKL

SEQ ID NO: 463642 - protein, 16 aa, Mycobacterium
EEGEPPAPVDIPNDSP

SEQ ID NO: 463643 - protein, 6 aa, Mycobacterium
EEGEQK

SEQ ID NO: 463644 - protein, 14 aa, Mycobacterium
EEGERLRSSTAAPL

SEQ ID NO: 463645 - protein, 8 aa, Mycobacterium
EEGESAQR

SEQ ID NO: 463646 - protein, 5 aa, Mycobacterium
EEGEV

SEQ ID NO: 463647 - protein, 5 aa, Mycobacterium
EEGGA

SEQ ID NO: 463648 - protein, 19 aa, Mycobacterium
EEGGASAFKDPAEATGTLG

SEQ ID NO: 463649 - protein, 8 aa, Mycobacterium
EEGGGGPL

SEQ ID NO: 463650 - protein, 7 aa, Mycobacterium
EEGGPAT

SEQ ID NO: 463651 - protein, 5 aa, Mycobacterium
EEGGQ

SEQ ID NO: 463652 - protein, 8 aa, Mycobacterium
EEGGRMSD

SEQ ID NO: 463653 - protein, 10 aa, Mycobacterium
EEGHSDKTSQ

SEQ ID NO: 463654 - protein, 7 aa, Mycobacterium
EEGIRRE

SEQ ID NO: 463655 - protein, 11 aa, Mycobacterium
EEGKALAEEIG

SEQ ID NO: 463656 - protein, 27 aa, Mycobacterium
EEGKAPFANPRNSAAGSLRQKDPAVTA

SEQ ID NO: 463657 - protein, 28 aa, Mycobacterium
EEGKAPFANPRNSAAGSLRQKDPAVTAR

SEQ ID NO: 463658 - protein, 41 aa, Mycobacterium
EEGKAQQDKADAQRSAGKKEAAADKARGKAKAYEQRERAEQ

SEQ ID NO: 463659 - protein, 40 aa, Mycobacterium
EEGKAQQDKAQAQREAAQKEAEAEKSRAEAKSDEKRQKAH

SEQ ID NO: 463660 - protein, 9 aa, Mycobacterium
EEGKAVAAD

SEQ ID NO: 463661 - protein, 7 aa, Mycobacterium
EEGKGVK

SEQ ID NO: 463662 - protein, 6 aa, Mycobacterium
EEGKRV

SEQ ID NO: 463663 - protein, 10 aa, Mycobacterium
EEGKTTAEAT

SEQ ID NO: 463664 - protein, 8 aa, Mycobacterium
EEGLGGEA

SEQ ID NO: 463665 - protein, 11 aa, Mycobacterium
EEGMPEPGHAL

SEQ ID NO: 463666 - protein, 7 aa, Mycobacterium
EEGPDAD

SEQ ID NO: 463667 - protein, 7 aa, Mycobacterium
EEGPDGN

SEQ ID NO: 463668 - protein, 11 aa, Mycobacterium
EEGPNAEGTRA

SEQ ID NO: 463669 - protein, 5 aa, Mycobacterium
EEGPP

SEQ ID NO: 463670 - protein, 7 aa, Mycobacterium
EEGPPAE

SEQ ID NO: 463671 - protein, 6 aa, Mycobacterium
EEGPTK

SEQ ID NO: 463672 - protein, 4 aa, Mycobacterium
EEGQ

SEQ ID NO: 463673 - protein, 40 aa, Mycobacterium
EEGQAQQDKADAQRDAGKKEAEAESARAGAEAAEDREKEN

SEQ ID NO: 463674 - protein, 8 aa, Mycobacterium
EEGQEVEA

SEQ ID NO: 463675 - protein, 8 aa, Mycobacterium
EEGQEVSA

SEQ ID NO: 463676 - protein, 7 aa, Mycobacterium
EEGQEVV

SEQ ID NO: 463677 - protein, 7 aa, Mycobacterium
EEGQTVA

SEQ ID NO: 463678 - protein, 13 aa, Mycobacterium
EEGRAIGSALGPA

SEQ ID NO: 463679 - protein, 9 aa, Mycobacterium
EEGRAQAPE

SEQ ID NO: 463680 - protein, 12 aa, Mycobacterium
EEGRARLKDLLA

SEQ ID NO: 463681 - protein, 5 aa, Mycobacterium
EEGRG

SEQ ID NO: 463682 - protein, 13 aa, Mycobacterium
EEGRIPPGDSRRQ

SEQ ID NO: 463683 - protein, 20 aa, Mycobacterium
EEGRKTLAQARADRAAAINP

SEQ ID NO: 463684 - protein, 7 aa, Mycobacterium
EEGRPVV

SEQ ID NO: 463685 - protein, 5 aa, Mycobacterium
EEGRR

SEQ ID NO: 463686 - protein, 8 aa, Mycobacterium
EEGRSGEH

SEQ ID NO: 463687 - protein, 5 aa, Mycobacterium
EEGSD

SEQ ID NO: 463688 - protein, 9 aa, Mycobacterium
EEGSDAEAI

SEQ ID NO: 463689 - protein, 5 aa, Mycobacterium
EEGSE

SEQ ID NO: 463690 - protein, 8 aa, Mycobacterium
EEGSIPGG

SEQ ID NO: 463691 - protein, 14 aa, Mycobacterium
EEGSPVTTGERVSA

SEQ ID NO: 463692 - protein, 16 aa, Mycobacterium
EEGTAASGPALTGDTK

SEQ ID NO: 463693 - protein, 8 aa, Mycobacterium
EEGTNTAR

SEQ ID NO: 463694 - protein, 13 aa, Mycobacterium
EEGTPTGSIGKGF

SEQ ID NO: 463695 - protein, 7 aa, Mycobacterium
EEGTTAQ

SEQ ID NO: 463696 - protein, 5 aa, Mycobacterium
EEGVA

SEQ ID NO: 463697 - protein, 6 aa, Mycobacterium
EEGWEG

SEQ ID NO: 463698 - protein, 10 aa, Mycobacterium
EEGYQSVGSG

SEQ ID NO: 463699 - protein, 4 aa, Mycobacterium
EEHA

SEQ ID NO: 463700 - protein, 7 aa, Mycobacterium
EEHAEAE

SEQ ID NO: 463701 - protein, 14 aa, Mycobacterium
EEHAEKTGEAPSED

SEQ ID NO: 463702 - protein, 14 aa, Mycobacterium
EEHAGAKPRPVDDV

SEQ ID NO: 463703 - protein, 9 aa, Mycobacterium
EEHAGAPTF

SEQ ID NO: 463704 - protein, 8 aa, Mycobacterium
EEHAGKAG

SEQ ID NO: 463705 - protein, 10 aa, Mycobacterium
EEHAKARGAP

SEQ ID NO: 463706 - protein, 9 aa, Mycobacterium
EEHARPRAD

SEQ ID NO: 463707 - protein, 16 aa, Mycobacterium
EEHDARGSLTKPIPAP

SEQ ID NO: 463708 - protein, 5 aa, Mycobacterium
EEHDE

SEQ ID NO: 463709 - protein, 5 aa, Mycobacterium
EEHDP

SEQ ID NO: 463710 - protein, 5 aa, Mycobacterium
EEHEA

SEQ ID NO: 463711 - protein, 5 aa, Mycobacterium
EEHGE

SEQ ID NO: 463712 - protein, 10 aa, Mycobacterium
EEHGGAGGTV

SEQ ID NO: 463713 - protein, 13 aa, Mycobacterium
EEHGGGARQVTDG

SEQ ID NO: 463714 - protein, 8 aa, Mycobacterium
EEHGGKYG

SEQ ID NO: 463715 - protein, 8 aa, Mycobacterium
EEHGGRGL

SEQ ID NO: 463716 - protein, 7 aa, Mycobacterium
EEHGGRK

SEQ ID NO: 463717 - protein, 8 aa, Mycobacterium
EEHGGSGF

SEQ ID NO: 463718 - protein, 9 aa, Mycobacterium
EEHGGSGYG

SEQ ID NO: 463719 - protein, 8 aa, Mycobacterium
EEHGGSYG

SEQ ID NO: 463720 - protein, 8 aa, Mycobacterium
EEHGGTYG

SEQ ID NO: 463721 - protein, 9 aa, Mycobacterium
EEHGMDSAT

SEQ ID NO: 463722 - protein, 8 aa, Mycobacterium
EEHGRHAT

SEQ ID NO: 463723 - protein, 9 aa, Mycobacterium
EEHGTTARG

SEQ ID NO: 463724 - protein, 5 aa, Mycobacterium
EEHIA

SEQ ID NO: 463725 - protein, 7 aa, Mycobacterium
EEHKTTP

SEQ ID NO: 463726 - protein, 4 aa, Mycobacterium
EEHP

SEQ ID NO: 463727 - protein, 14 aa, Mycobacterium
EEHPVSENNVPGSV

SEQ ID NO: 463728 - protein, 17 aa, Mycobacterium
EEHRATVRGGEGQSRRA

SEQ ID NO: 463729 - protein, 8 aa, Mycobacterium
EEHRGQGL

SEQ ID NO: 463730 - protein, 9 aa, Mycobacterium
EEHRGRNGD

SEQ ID NO: 463731 - protein, 10 aa, Mycobacterium
EEHSKKTTKF

SEQ ID NO: 463732 - protein, 12 aa, Mycobacterium
EEHSPASTQRSA

SEQ ID NO: 463733 - protein, 7 aa, Mycobacterium
EEHSPFD

SEQ ID NO: 463734 - protein, 8 aa, Mycobacterium
EEHSSRAG

SEQ ID NO: 463735 - protein, 5 aa, Mycobacterium
EEHSY

SEQ ID NO: 463736 - protein, 4 aa, Mycobacterium
EEHT

SEQ ID NO: 463737 - protein, 8 aa, Mycobacterium
EEHTGGSV

SEQ ID NO: 463738 - protein, 12 aa, Mycobacterium
EEHVESRHAETS

SEQ ID NO: 463739 - protein, 9 aa, Mycobacterium
EEIAAEDDA

SEQ ID NO: 463740 - protein, 4 aa, Mycobacterium
EEID

SEQ ID NO: 463741 - protein, 11 aa, Mycobacterium
EEIEDAGGQAL

SEQ ID NO: 463742 - protein, 10 aa, Mycobacterium
EEIEEAGGQA

SEQ ID NO: 463743 - protein, 7 aa, Mycobacterium
EEIESRS

SEQ ID NO: 463744 - protein, 12 aa, Mycobacterium
EEIGAPPSLAAG

SEQ ID NO: 463745 - protein, 7 aa, Mycobacterium
EEIGGQY

SEQ ID NO: 463746 - protein, 17 aa, Mycobacterium
EEIGGSGGSYASRTLPG

SEQ ID NO: 463747 - protein, 16 aa, Mycobacterium
EEIGGVGGTYASATLP

SEQ ID NO: 463748 - protein, 18 aa, Mycobacterium
EEIGGVGGTYASGSLPGT

SEQ ID NO: 463749 - protein, 8 aa, Mycobacterium
EEIGSGQA

SEQ ID NO: 463750 - protein, 5 aa, Mycobacterium
EEIGY

SEQ ID NO: 463751 - protein, 6 aa, Mycobacterium
EEIGYG

SEQ ID NO: 463752 - protein, 9 aa, Mycobacterium
EEIKGRNPR

SEQ ID NO: 463753 - protein, 7 aa, Mycobacterium
EEIPEPS

SEQ ID NO: 463754 - protein, 17 aa, Mycobacterium
EEIPGGVRTTTESDSAD

SEQ ID NO: 463755 - protein, 5 aa, Mycobacterium
EEISP

SEQ ID NO: 463756 - protein, 14 aa, Mycobacterium
EEISRADALRDGSR

SEQ ID NO: 463757 - protein, 7 aa, Mycobacterium
EEITDGC

SEQ ID NO: 463758 - protein, 9 aa, Mycobacterium
EEITNEAER

SEQ ID NO: 463759 - protein, 8 aa, Mycobacterium
EEITPQTP

SEQ ID NO: 463760 - protein, 17 aa, Mycobacterium
EEKAKLSRKLAEKAGAG

SEQ ID NO: 463761 - protein, 10 aa, Mycobacterium
EEKAKNPGDD

SEQ ID NO: 463762 - protein, 8 aa, Mycobacterium
EEKDHHPD

SEQ ID NO: 463763 - protein, 34 aa, Mycobacterium
EEKDQRGPSDERSESGGPNPSGESAEGVDANATK

SEQ ID NO: 463764 - protein, 12 aa, Mycobacterium
EEKERIAEDPAL

SEQ ID NO: 463765 - protein, 8 aa, Mycobacterium
EEKESYRS

SEQ ID NO: 463766 - protein, 35 aa, Mycobacterium
EEKETRGPSDERARSGGPNARGKTAEGVDTSATKD

SEQ ID NO: 463767 - protein, 4 aa, Mycobacterium
EEKF

SEQ ID NO: 463768 - protein, 10 aa, Mycobacterium
EEKGTPITPA

SEQ ID NO: 463769 - protein, 9 aa, Mycobacterium
EEKKRQRAE

SEQ ID NO: 463770 - protein, 7 aa, Mycobacterium
EEKLGKE

SEQ ID NO: 463771 - protein, 14 aa, Mycobacterium
EEKPAKKTRRKVTA

SEQ ID NO: 463772 - protein, 13 aa, Mycobacterium
EEKPKTPKSNYAV

SEQ ID NO: 463773 - protein, 13 aa, Mycobacterium
EEKPYTRKPYPPF

SEQ ID NO: 463774 - protein, 7 aa, Mycobacterium
EEKTPPV

SEQ ID NO: 463775 - protein, 10 aa, Mycobacterium
EEKYGPDVDD

SEQ ID NO: 463776 - protein, 4 aa, Mycobacterium
EELA

SEQ ID NO: 463777 - protein, 19 aa, Mycobacterium
EELAERARRKARKKTDPGH

SEQ ID NO: 463778 - protein, 13 aa, Mycobacterium
EELAGAAAKPVGE

SEQ ID NO: 463779 - protein, 12 aa, Mycobacterium
EELAGGVRRRVS

SEQ ID NO: 463780 - protein, 11 aa, Mycobacterium
EELAGKKRTNI

SEQ ID NO: 463781 - protein, 10 aa, Mycobacterium
EELAGQQRTT

SEQ ID NO: 463782 - protein, 13 aa, Mycobacterium
EELAGSAAKPTGE

SEQ ID NO: 463783 - protein, 7 aa, Mycobacterium
EELAKTD

SEQ ID NO: 463784 - protein, 5 aa, Mycobacterium
EELAN

SEQ ID NO: 463785 - protein, 10 aa, Mycobacterium
EELASTSAEQ

SEQ ID NO: 463786 - protein, 5 aa, Mycobacterium
EELDD

SEQ ID NO: 463787 - protein, 11 aa, Mycobacterium
EELEDGRAQTL

SEQ ID NO: 463788 - protein, 7 aa, Mycobacterium
EELEGAR

SEQ ID NO: 463789 - protein, 5 aa, Mycobacterium
EELER

SEQ ID NO: 463790 - protein, 9 aa, Mycobacterium
EELESDRAE

SEQ ID NO: 463791 - protein, 11 aa, Mycobacterium
EELGEDAEERL

SEQ ID NO: 463792 - protein, 14 aa, Mycobacterium
EELGEKTGIDPAGL

SEQ ID NO: 463793 - protein, 8 aa, Mycobacterium
EELGGDAE

SEQ ID NO: 463794 - protein, 8 aa, Mycobacterium
EELGGGDL

SEQ ID NO: 463795 - protein, 16 aa, Mycobacterium
EELGGGDLHSKTSGVT

SEQ ID NO: 463796 - protein, 16 aa, Mycobacterium
EELGGGDLHSRTSGVT

SEQ ID NO: 463797 - protein, 17 aa, Mycobacterium
EELGGGDLHSRTSGVTD

SEQ ID NO: 463798 - protein, 6 aa, Mycobacterium
EELGGK

SEQ ID NO: 463799 - protein, 8 aa, Mycobacterium
EELGGPLD

SEQ ID NO: 463800 - protein, 10 aa, Mycobacterium
EELGGTPVPR

SEQ ID NO: 463801 - protein, 5 aa, Mycobacterium
EELGK

SEQ ID NO: 463802 - protein, 5 aa, Mycobacterium
EELGQ

SEQ ID NO: 463803 - protein, 5 aa, Mycobacterium
EELGR

SEQ ID NO: 463804 - protein, 7 aa, Mycobacterium
EELGRRD

SEQ ID NO: 463805 - protein, 32 aa, Mycobacterium
EELGRSGVGVGDSAASYVSGDAMAATSYLIAR

SEQ ID NO: 463806 - protein, 14 aa, Mycobacterium
EELGRSGVGVGEAG

SEQ ID NO: 463807 - protein, 34 aa, Mycobacterium
EELGRSGVGVGESGVSYAAGDAAAAGTYLGAGGL

SEQ ID NO: 463808 - protein, 5 aa, Mycobacterium
EELGS

SEQ ID NO: 463809 - protein, 7 aa, Mycobacterium
EELGVSD

SEQ ID NO: 463810 - protein, 11 aa, Mycobacterium
EELPDEPAPGT

SEQ ID NO: 463811 - protein, 11 aa, Mycobacterium
EELPDEPEPDT

SEQ ID NO: 463812 - protein, 11 aa, Mycobacterium
EELPDEPEPGT

SEQ ID NO: 463813 - protein, 6 aa, Mycobacterium
EELPDG

SEQ ID NO: 463814 - protein, 7 aa, Mycobacterium
EELPDGW

SEQ ID NO: 463815 - protein, 11 aa, Mycobacterium
EELPDRDDQTA

SEQ ID NO: 463816 - protein, 11 aa, Mycobacterium
EELPEEPEPGT

SEQ ID NO: 463817 - protein, 7 aa, Mycobacterium
EELPQSA

SEQ ID NO: 463818 - protein, 8 aa, Mycobacterium
EELPRKTR

SEQ ID NO: 463819 - protein, 13 aa, Mycobacterium
EELPSGKPLEVRS

SEQ ID NO: 463820 - protein, 8 aa, Mycobacterium
EELPSGLP

SEQ ID NO: 463821 - protein, 6 aa, Mycobacterium
EELPSQ

SEQ ID NO: 463822 - protein, 4 aa, Mycobacterium
EELQ

SEQ ID NO: 463823 - protein, 15 aa, Mycobacterium
EELQSQLDDAQGKVE

SEQ ID NO: 463824 - protein, 14 aa, Mycobacterium
EELQSQLDTEQKAL

SEQ ID NO: 463825 - protein, 4 aa, Mycobacterium
EELR

SEQ ID NO: 463826 - protein, 13 aa, Mycobacterium
EELRPDDQDQVTG

SEQ ID NO: 463827 - protein, 6 aa, Mycobacterium
EELRPN

SEQ ID NO: 463828 - protein, 6 aa, Mycobacterium
EELSAD

SEQ ID NO: 463829 - protein, 5 aa, Mycobacterium
EELSD

SEQ ID NO: 463830 - protein, 14 aa, Mycobacterium
EELSDSTDWAPTSA

SEQ ID NO: 463831 - protein, 14 aa, Mycobacterium
EELSDSTDWTATSA

SEQ ID NO: 463832 - protein, 5 aa, Mycobacterium
EELSE

SEQ ID NO: 463833 - protein, 5 aa, Mycobacterium
EELSG

SEQ ID NO: 463834 - protein, 8 aa, Mycobacterium
EELTGTAG

SEQ ID NO: 463835 - protein, 6 aa, Mycobacterium
EELTPP

SEQ ID NO: 463836 - protein, 7 aa, Mycobacterium
EELTRAG

SEQ ID NO: 463837 - protein, 10 aa, Mycobacterium
EELYGDSAAD

SEQ ID NO: 463838 - protein, 20 aa, Mycobacterium
EEMGAAGDGSGGPAGTVDDE

SEQ ID NO: 463839 - protein, 5 aa, Mycobacterium
EEMGQ

SEQ ID NO: 463840 - protein, 6 aa, Mycobacterium
EEMGRE

SEQ ID NO: 463841 - protein, 6 aa, Mycobacterium
EEMPER

SEQ ID NO: 463842 - protein, 5 aa, Mycobacterium
EEMPP

SEQ ID NO: 463843 - protein, 5 aa, Mycobacterium
EEMPV

SEQ ID NO: 463844 - protein, 5 aa, Mycobacterium
EEMRN

SEQ ID NO: 463845 - protein, 5 aa, Mycobacterium
EENAA

SEQ ID NO: 463846 - protein, 8 aa, Mycobacterium
EENAAGGR

SEQ ID NO: 463847 - protein, 9 aa, Mycobacterium
EENAEGGPL

SEQ ID NO: 463848 - protein, 7 aa, Mycobacterium
EENANTA

SEQ ID NO: 463849 - protein, 10 aa, Mycobacterium
EENATLGTDP

SEQ ID NO: 463850 - protein, 13 aa, Mycobacterium
EENDARQARSHTD

SEQ ID NO: 463851 - protein, 6 aa, Mycobacterium
EENDPQ

SEQ ID NO: 463852 - protein, 11 aa, Mycobacterium
EENESLRDDPI

SEQ ID NO: 463853 - protein, 15 aa, Mycobacterium
EENFSTASDESLNGI

SEQ ID NO: 463854 - protein, 9 aa, Mycobacterium
EENGLDEDG

SEQ ID NO: 463855 - protein, 8 aa, Mycobacterium
EENGNPQL

SEQ ID NO: 463856 - protein, 10 aa, Mycobacterium
EENGTPVTPA

SEQ ID NO: 463857 - protein, 12 aa, Mycobacterium
EENGVPATPRIN

SEQ ID NO: 463858 - protein, 8 aa, Mycobacterium
EENKRQRA

SEQ ID NO: 463859 - protein, 8 aa, Mycobacterium
EENKRRRA

SEQ ID NO: 463860 - protein, 18 aa, Mycobacterium
EENKSPSRRTGELDNRGS

SEQ ID NO: 463861 - protein, 7 aa, Mycobacterium
EENLSAD

SEQ ID NO: 463862 - protein, 4 aa, Mycobacterium
EENN

SEQ ID NO: 463863 - protein, 13 aa, Mycobacterium
EENPLGTGGGIAN

SEQ ID NO: 463864 - protein, 7 aa, Mycobacterium
EENPPWA

SEQ ID NO: 463865 - protein, 5 aa, Mycobacterium
EENPQ

SEQ ID NO: 463866 - protein, 9 aa, Mycobacterium
EENPSSGDI

SEQ ID NO: 463867 - protein, 9 aa, Mycobacterium
EENPTTGDI

SEQ ID NO: 463868 - protein, 8 aa, Mycobacterium
EENQESGS

SEQ ID NO: 463869 - protein, 4 aa, Mycobacterium
EENR

SEQ ID NO: 463870 - protein, 8 aa, Mycobacterium
EENSNLQR

SEQ ID NO: 463871 - protein, 11 aa, Mycobacterium
EENSPEAVEPI

SEQ ID NO: 463872 - protein, 13 aa, Mycobacterium
EENSSGRGYLPSG

SEQ ID NO: 463873 - protein, 7 aa, Mycobacterium
EENTRGL

SEQ ID NO: 463874 - protein, 5 aa, Mycobacterium
EENTT

SEQ ID NO: 463875 - protein, 12 aa, Mycobacterium
EENTYRPPNGRG

SEQ ID NO: 463876 - protein, 5 aa, Mycobacterium
EEPAA

SEQ ID NO: 463877 - protein, 5 aa, Mycobacterium
EEPAH

SEQ ID NO: 463878 - protein, 38 aa, Mycobacterium
EEPALDEPGVEEPELEEENEEDAELEEDDEAEEKPESV

SEQ ID NO: 463879 - protein, 9 aa, Mycobacterium
EEPANQGAW

SEQ ID NO: 463880 - protein, 7 aa, Mycobacterium
EEPARRL

SEQ ID NO: 463881 - protein, 7 aa, Mycobacterium
EEPARRV

SEQ ID NO: 463882 - protein, 12 aa, Mycobacterium
EEPASPNERDDR

SEQ ID NO: 463883 - protein, 4 aa, Mycobacterium
EEPC

SEQ ID NO: 463884 - protein, 4 aa, Mycobacterium
EEPD

SEQ ID NO: 463885 - protein, 7 aa, Mycobacterium
EEPDAPV

SEQ ID NO: 463886 - protein, 8 aa, Mycobacterium
EEPDGPVP

SEQ ID NO: 463887 - protein, 6 aa, Mycobacterium
EEPDGT

SEQ ID NO: 463888 - protein, 16 aa, Mycobacterium
EEPDNATGSTSSAPLG

SEQ ID NO: 463889 - protein, 10 aa, Mycobacterium
EEPDSGTVKI

SEQ ID NO: 463890 - protein, 6 aa, Mycobacterium
EEPDTR

SEQ ID NO: 463891 - protein, 5 aa, Mycobacterium
EEPDV

SEQ ID NO: 463892 - protein, 14 aa, Mycobacterium
EEPDYSRGVSDQRS

SEQ ID NO: 463893 - protein, 8 aa, Mycobacterium
EEPEGPVP

SEQ ID NO: 463894 - protein, 17 aa, Mycobacterium
EEPEPLGPNDVGALEKS

SEQ ID NO: 463895 - protein, 6 aa, Mycobacterium
EEPEQV

SEQ ID NO: 463896 - protein, 5 aa, Mycobacterium
EEPER

SEQ ID NO: 463897 - protein, 7 aa, Mycobacterium
EEPESQI

SEQ ID NO: 463898 - protein, 5 aa, Mycobacterium
EEPGD

SEQ ID NO: 463899 - protein, 11 aa, Mycobacterium
EEPGEPNAETY

SEQ ID NO: 463900 - protein, 8 aa, Mycobacterium
EEPGGDSP

SEQ ID NO: 463901 - protein, 9 aa, Mycobacterium
EEPGGRTRL

SEQ ID NO: 463902 - protein, 11 aa, Mycobacterium
EEPGPANAETR

SEQ ID NO: 463903 - protein, 10 aa, Mycobacterium
EEPGPDDGQR

SEQ ID NO: 463904 - protein, 7 aa, Mycobacterium
EEPIDHT

SEQ ID NO: 463905 - protein, 14 aa, Mycobacterium
EEPKATDERQQVSP

SEQ ID NO: 463906 - protein, 8 aa, Mycobacterium
EEPKDPWE

SEQ ID NO: 463907 - protein, 10 aa, Mycobacterium
EEPKGPGPHA

SEQ ID NO: 463908 - protein, 6 aa, Mycobacterium
EEPLAP

SEQ ID NO: 463909 - protein, 5 aa, Mycobacterium
EEPLP

SEQ ID NO: 463910 - protein, 18 aa, Mycobacterium
EEPLPSTKDLTTAAISGP

SEQ ID NO: 463911 - protein, 4 aa, Mycobacterium
EEPN

SEQ ID NO: 463912 - protein, 6 aa, Mycobacterium
EEPNWQ

SEQ ID NO: 463913 - protein, 6 aa, Mycobacterium
EEPPAS

SEQ ID NO: 463914 - protein, 6 aa, Mycobacterium
EEPPEV

SEQ ID NO: 463915 - protein, 15 aa, Mycobacterium
EEPPKAPTRRRSTSR

SEQ ID NO: 463916 - protein, 8 aa, Mycobacterium
EEPPNAQH

SEQ ID NO: 463917 - protein, 6 aa, Mycobacterium
EEPPPR

SEQ ID NO: 463918 - protein, 9 aa, Mycobacterium
EEPPRQDNP

SEQ ID NO: 463919 - protein, 7 aa, Mycobacterium
EEPPSRG

SEQ ID NO: 463920 - protein, 9 aa, Mycobacterium
EEPPTSDLG

SEQ ID NO: 463921 - protein, 7 aa, Mycobacterium
EEPPVPA

SEQ ID NO: 463922 - protein, 7 aa, Mycobacterium
EEPQSAV

SEQ ID NO: 463923 - protein, 4 aa, Mycobacterium
EEPR

SEQ ID NO: 463924 - protein, 5 aa, Mycobacterium
EEPRA

SEQ ID NO: 463925 - protein, 7 aa, Mycobacterium
EEPRDAV

SEQ ID NO: 463926 - protein, 6 aa, Mycobacterium
EEPREL

SEQ ID NO: 463927 - protein, 10 aa, Mycobacterium
EEPRHGDPIR

SEQ ID NO: 463928 - protein, 16 aa, Mycobacterium
EEPRHQGGGSSHVNPT

SEQ ID NO: 463929 - protein, 17 aa, Mycobacterium
EEPRPATALDGLGDAER

SEQ ID NO: 463930 - protein, 10 aa, Mycobacterium
EEPRSAGREL

SEQ ID NO: 463931 - protein, 4 aa, Mycobacterium
EEPS

SEQ ID NO: 463932 - protein, 7 aa, Mycobacterium
EEPSEAW

SEQ ID NO: 463933 - protein, 9 aa, Mycobacterium
EEPSTAPEI

SEQ ID NO: 463934 - protein, 7 aa, Mycobacterium
EEPSVPE

SEQ ID NO: 463935 - protein, 9 aa, Mycobacterium
EEPTPRQAM

SEQ ID NO: 463936 - protein, 7 aa, Mycobacterium
EEPTPRT

SEQ ID NO: 463937 - protein, 10 aa, Mycobacterium
EEPTRHDELP

SEQ ID NO: 463938 - protein, 14 aa, Mycobacterium
EEPVPSDKQLTSAA

SEQ ID NO: 463939 - protein, 4 aa, Mycobacterium
EEQA

SEQ ID NO: 463940 - protein, 6 aa, Mycobacterium
EEQAAA

SEQ ID NO: 463941 - protein, 8 aa, Mycobacterium
EEQAGAGA

SEQ ID NO: 463942 - protein, 15 aa, Mycobacterium
EEQAGQSEGLPPDDV

SEQ ID NO: 463943 - protein, 8 aa, Mycobacterium
EEQASLAG

SEQ ID NO: 463944 - protein, 16 aa, Mycobacterium
EEQATAKQAEVFSTRY

SEQ ID NO: 463945 - protein, 9 aa, Mycobacterium
EEQDRDSLD

SEQ ID NO: 463946 - protein, 11 aa, Mycobacterium
EEQGAPVTPAI

SEQ ID NO: 463947 - protein, 7 aa, Mycobacterium
EEQGGEV

SEQ ID NO: 463948 - protein, 8 aa, Mycobacterium
EEQGKLTD

SEQ ID NO: 463949 - protein, 9 aa, Mycobacterium
EEQGKLTDE

SEQ ID NO: 463950 - protein, 15 aa, Mycobacterium
EEQGVGTEKLAGTIQ

SEQ ID NO: 463951 - protein, 7 aa, Mycobacterium
EEQGYGQ

SEQ ID NO: 463952 - protein, 5 aa, Mycobacterium
EEQHA

SEQ ID NO: 463953 - protein, 6 aa, Mycobacterium
EEQHAD

SEQ ID NO: 463954 - protein, 7 aa, Mycobacterium
EEQKQKY

SEQ ID NO: 463955 - protein, 41 aa, Mycobacterium
EEQLDDAADKRSAAVGARAHADKLEDYSETEKLKRQAAADK

SEQ ID NO: 463956 - protein, 7 aa, Mycobacterium
EEQPAAV

SEQ ID NO: 463957 - protein, 16 aa, Mycobacterium
EEQPAEELPMAQRYFL

SEQ ID NO: 463958 - protein, 10 aa, Mycobacterium
EEQPGSGLRP

SEQ ID NO: 463959 - protein, 5 aa, Mycobacterium
EEQRD

SEQ ID NO: 463960 - protein, 6 aa, Mycobacterium
EEQRGA

SEQ ID NO: 463961 - protein, 10 aa, Mycobacterium
EEQRKPGLPA

SEQ ID NO: 463962 - protein, 6 aa, Mycobacterium
EEQRRG

SEQ ID NO: 463963 - protein, 5 aa, Mycobacterium
EEQRT

SEQ ID NO: 463964 - protein, 7 aa, Mycobacterium
EEQSGKI

SEQ ID NO: 463965 - protein, 6 aa, Mycobacterium
EEQSNR

SEQ ID NO: 463966 - protein, 8 aa, Mycobacterium
EEQTGGSV

SEQ ID NO: 463967 - protein, 5 aa, Mycobacterium
EEQVR

SEQ ID NO: 463968 - protein, 10 aa, Mycobacterium
EERAAPPYEA

SEQ ID NO: 463969 - protein, 11 aa, Mycobacterium
EERAEKVEKQF

SEQ ID NO: 463970 - protein, 12 aa, Mycobacterium
EERAEKVEKQFQ

SEQ ID NO: 463971 - protein, 16 aa, Mycobacterium
EERAGHIRASGPDVLD

SEQ ID NO: 463972 - protein, 10 aa, Mycobacterium
EERAKEASNA

SEQ ID NO: 463973 - protein, 7 aa, Mycobacterium
EERAKNG

SEQ ID NO: 463974 - protein, 11 aa, Mycobacterium
EERAKNPGDDI

SEQ ID NO: 463975 - protein, 10 aa, Mycobacterium
EERAKNPTED

SEQ ID NO: 463976 - protein, 7 aa, Mycobacterium
EERAPAA

SEQ ID NO: 463977 - protein, 8 aa, Mycobacterium
EERAPGTV

SEQ ID NO: 463978 - protein, 5 aa, Mycobacterium
EERAR

SEQ ID NO: 463979 - protein, 9 aa, Mycobacterium
EERASETEC

SEQ ID NO: 463980 - protein, 6 aa, Mycobacterium
EERASQ

SEQ ID NO: 463981 - protein, 7 aa, Mycobacterium
EEREAAS

SEQ ID NO: 463982 - protein, 7 aa, Mycobacterium
EEREAAY

SEQ ID NO: 463983 - protein, 10 aa, Mycobacterium
EEREAQPTEF

SEQ ID NO: 463984 - protein, 8 aa, Mycobacterium
EEREGTST

SEQ ID NO: 463985 - protein, 7 aa, Mycobacterium
EEREPDV

SEQ ID NO: 463986 - protein, 9 aa, Mycobacterium
EEREQAGAL

SEQ ID NO: 463987 - protein, 14 aa, Mycobacterium
EERFGGDDAVRPEF

SEQ ID NO: 463988 - protein, 19 aa, Mycobacterium
EERFGGDDAVRPEFGSPPL

SEQ ID NO: 463989 - protein, 12 aa, Mycobacterium
EERGEAPPPPEP

SEQ ID NO: 463990 - protein, 7 aa, Mycobacterium
EERGEKG

SEQ ID NO: 463991 - protein, 7 aa, Mycobacterium
EERGGSR

SEQ ID NO: 463992 - protein, 8 aa, Mycobacterium
EERGGTSR

SEQ ID NO: 463993 - protein, 7 aa, Mycobacterium
EERGIDT

SEQ ID NO: 463994 - protein, 10 aa, Mycobacterium
EERGKNPTDD

SEQ ID NO: 463995 - protein, 6 aa, Mycobacterium
EERGLT

SEQ ID NO: 463996 - protein, 9 aa, Mycobacterium
EERGNPHTS

SEQ ID NO: 463997 - protein, 6 aa, Mycobacterium
EERGRV

SEQ ID NO: 463998 - protein, 6 aa, Mycobacterium
EERGYG

SEQ ID NO: 463999 - protein, 7 aa, Mycobacterium
EERIRAA

SEQ ID NO: 464000 - protein, 10 aa, Mycobacterium
EERKARDAEA

SEQ ID NO: 464001 - protein, 7 aa, Mycobacterium
EERKDPR

SEQ ID NO: 464002 - protein, 12 aa, Mycobacterium
EERKGKAPSDHA

SEQ ID NO: 464003 - protein, 18 aa, Mycobacterium
EERKGKSPSDHAPVLVEL

SEQ ID NO: 464004 - protein, 7 aa, Mycobacterium
EERMSAQ

SEQ ID NO: 464005 - protein, 10 aa, Mycobacterium
EERNAADATT

SEQ ID NO: 464006 - protein, 7 aa, Mycobacterium
EERNAPF

SEQ ID NO: 464007 - protein, 9 aa, Mycobacterium
EERPAPGLY

SEQ ID NO: 464008 - protein, 7 aa, Mycobacterium
EERPDDA

SEQ ID NO: 464009 - protein, 11 aa, Mycobacterium
EERPGRPEDDP

SEQ ID NO: 464010 - protein, 34 aa, Mycobacterium
EERPKAAKPPSPQRKTAKSSAPRKRTRAGPSTDR

SEQ ID NO: 464011 - protein, 11 aa, Mycobacterium
EERPLGTGGGI

SEQ ID NO: 464012 - protein, 15 aa, Mycobacterium
EERPRTAAALGERGD

SEQ ID NO: 464013 - protein, 6 aa, Mycobacterium
EERPSL

SEQ ID NO: 464014 - protein, 6 aa, Mycobacterium
EERRDE

SEQ ID NO: 464015 - protein, 7 aa, Mycobacterium
EERREGD

SEQ ID NO: 464016 - protein, 17 aa, Mycobacterium
EERREGDVLGRDQSGRA

SEQ ID NO: 464017 - protein, 9 aa, Mycobacterium
EERRGTDHA

SEQ ID NO: 464018 - protein, 33 aa, Mycobacterium
EERRKISERTKEGLAKARKQGKRLGRPPRIAPD

SEQ ID NO: 464019 - protein, 12 aa, Mycobacterium
EERRNPRGAGNV

SEQ ID NO: 464020 - protein, 7 aa, Mycobacterium
EERRQQM

SEQ ID NO: 464021 - protein, 5 aa, Mycobacterium
EERRR

SEQ ID NO: 464022 - protein, 7 aa, Mycobacterium
EERRSAH

SEQ ID NO: 464023 - protein, 24 aa, Mycobacterium
EERRTAGHPAHTASPNDESTNGEN

SEQ ID NO: 464024 - protein, 7 aa, Mycobacterium
EERRTSV

SEQ ID NO: 464025 - protein, 7 aa, Mycobacterium
EERRTTV

SEQ ID NO: 464026 - protein, 4 aa, Mycobacterium
EERS

SEQ ID NO: 464027 - protein, 7 aa, Mycobacterium
EERSAPI

SEQ ID NO: 464028 - protein, 9 aa, Mycobacterium
EERSAVERS

SEQ ID NO: 464029 - protein, 15 aa, Mycobacterium
EERSRSDESAVNTTA

SEQ ID NO: 464030 - protein, 9 aa, Mycobacterium
EERSSVGTA

SEQ ID NO: 464031 - protein, 5 aa, Mycobacterium
EERST

SEQ ID NO: 464032 - protein, 11 aa, Mycobacterium
EERSWSRPEIQ

SEQ ID NO: 464033 - protein, 4 aa, Mycobacterium
EERT

SEQ ID NO: 464034 - protein, 6 aa, Mycobacterium
EERTEF

SEQ ID NO: 464035 - protein, 10 aa, Mycobacterium
EERTKSDTEL

SEQ ID NO: 464036 - protein, 7 aa, Mycobacterium
EERTPVD

SEQ ID NO: 464037 - protein, 19 aa, Mycobacterium
EERTRSVAAAADDVDILCE

SEQ ID NO: 464038 - protein, 6 aa, Mycobacterium
EERTTD

SEQ ID NO: 464039 - protein, 13 aa, Mycobacterium
EERVDDGTGSDTP

SEQ ID NO: 464040 - protein, 14 aa, Mycobacterium
EERVDDGTGSDTPK

SEQ ID NO: 464041 - protein, 5 aa, Mycobacterium
EERVG

SEQ ID NO: 464042 - protein, 18 aa, Mycobacterium
EERYGGDDAIRPEFGSPP

SEQ ID NO: 464043 - protein, 19 aa, Mycobacterium
EERYGGDDAVRPEFGSPPL

SEQ ID NO: 464044 - protein, 6 aa, Mycobacterium
EERYRK

SEQ ID NO: 464045 - protein, 4 aa, Mycobacterium
EESA

SEQ ID NO: 464046 - protein, 7 aa, Mycobacterium
EESAAAI

SEQ ID NO: 464047 - protein, 10 aa, Mycobacterium
EESADPLIDA

SEQ ID NO: 464048 - protein, 26 aa, Mycobacterium
EESAEPDASAEAAPAESLEDETGDGE

SEQ ID NO: 464049 - protein, 12 aa, Mycobacterium
EESAGEGGPGHI

SEQ ID NO: 464050 - protein, 7 aa, Mycobacterium
EESAGNV

SEQ ID NO: 464051 - protein, 6 aa, Mycobacterium
EESARR

SEQ ID NO: 464052 - protein, 11 aa, Mycobacterium
EESARSGELPD

SEQ ID NO: 464053 - protein, 7 aa, Mycobacterium
EESAVPL

SEQ ID NO: 464054 - protein, 4 aa, Mycobacterium
EESD

SEQ ID NO: 464055 - protein, 6 aa, Mycobacterium
EESDDV

SEQ ID NO: 464056 - protein, 9 aa, Mycobacterium
EESDEPNRA

SEQ ID NO: 464057 - protein, 7 aa, Mycobacterium
EESDPGV

SEQ ID NO: 464058 - protein, 5 aa, Mycobacterium
EESDQ

SEQ ID NO: 464059 - protein, 10 aa, Mycobacterium
EESDQADDQR

SEQ ID NO: 464060 - protein, 5 aa, Mycobacterium
EESEA

SEQ ID NO: 464061 - protein, 7 aa, Mycobacterium
EESEDET

SEQ ID NO: 464062 - protein, 8 aa, Mycobacterium
EESEDGCR

SEQ ID NO: 464063 - protein, 9 aa, Mycobacterium
EESEDNSVV

SEQ ID NO: 464064 - protein, 9 aa, Mycobacterium
EESEQSMSD

SEQ ID NO: 464065 - protein, 9 aa, Mycobacterium
EESERRALE

SEQ ID NO: 464066 - protein, 7 aa, Mycobacterium
EESESGK

SEQ ID NO: 464067 - protein, 8 aa, Mycobacterium
EESETPQA

SEQ ID NO: 464068 - protein, 5 aa, Mycobacterium
EESFP

SEQ ID NO: 464069 - protein, 9 aa, Mycobacterium
EESFPASDS

SEQ ID NO: 464070 - protein, 10 aa, Mycobacterium
EESGDQLTQE

SEQ ID NO: 464071 - protein, 18 aa, Mycobacterium
EESGEPCVDDQSDPAAWP

SEQ ID NO: 464072 - protein, 11 aa, Mycobacterium
EESGGAGGELA

SEQ ID NO: 464073 - protein, 9 aa, Mycobacterium
EESGGTFDP

SEQ ID NO: 464074 - protein, 8 aa, Mycobacterium
EESGKADF

SEQ ID NO: 464075 - protein, 7 aa, Mycobacterium
EESGLDP

SEQ ID NO: 464076 - protein, 8 aa, Mycobacterium
EESGPQSP

SEQ ID NO: 464077 - protein, 8 aa, Mycobacterium
EESGQGAD

SEQ ID NO: 464078 - protein, 5 aa, Mycobacterium
EESGR

SEQ ID NO: 464079 - protein, 7 aa, Mycobacterium
EESIRRE

SEQ ID NO: 464080 - protein, 5 aa, Mycobacterium
EESKH

SEQ ID NO: 464081 - protein, 7 aa, Mycobacterium
EESKKAT

SEQ ID NO: 464082 - protein, 27 aa, Mycobacterium
EESKPPFANPRNSAAGSLRQKNPAITA

SEQ ID NO: 464083 - protein, 9 aa, Mycobacterium
EESLGAADA

SEQ ID NO: 464084 - protein, 10 aa, Mycobacterium
EESLGQRDAD

SEQ ID NO: 464085 - protein, 9 aa, Mycobacterium
EESLGSRDA

SEQ ID NO: 464086 - protein, 7 aa, Mycobacterium
EESLQSA

SEQ ID NO: 464087 - protein, 5 aa, Mycobacterium
EESLR

SEQ ID NO: 464088 - protein, 4 aa, Mycobacterium
EESM

SEQ ID NO: 464089 - protein, 7 aa, Mycobacterium
EESMDPE

SEQ ID NO: 464090 - protein, 8 aa, Mycobacterium
EESMDPEA

SEQ ID NO: 464091 - protein, 5 aa, Mycobacterium
EESNG

SEQ ID NO: 464092 - protein, 6 aa, Mycobacterium
EESPGA

SEQ ID NO: 464093 - protein, 11 aa, Mycobacterium
EESPLGTGGGI

SEQ ID NO: 464094 - protein, 7 aa, Mycobacterium
EESPSGI

SEQ ID NO: 464095 - protein, 7 aa, Mycobacterium
EESPSGM

SEQ ID NO: 464096 - protein, 7 aa, Mycobacterium
EESPSGV

SEQ ID NO: 464097 - protein, 9 aa, Mycobacterium
EESPTSGDI

SEQ ID NO: 464098 - protein, 8 aa, Mycobacterium
EESQKATQ

SEQ ID NO: 464099 - protein, 24 aa, Mycobacterium
EESQRVSTESLEPGSTEPAPQTDV

SEQ ID NO: 464100 - protein, 15 aa, Mycobacterium
EESRHPESPQRPQSA

SEQ ID NO: 464101 - protein, 8 aa, Mycobacterium
EESRHTRD

SEQ ID NO: 464102 - protein, 6 aa, Mycobacterium
EESRTA

SEQ ID NO: 464103 - protein, 21 aa, Mycobacterium
EESSANAPSGTAAPADAATAS

SEQ ID NO: 464104 - protein, 9 aa, Mycobacterium
EESSGRRKH

SEQ ID NO: 464105 - protein, 5 aa, Mycobacterium
EESSI

SEQ ID NO: 464106 - protein, 7 aa, Mycobacterium
EESSTIN

SEQ ID NO: 464107 - protein, 7 aa, Mycobacterium
EESSTLE

SEQ ID NO: 464108 - protein, 8 aa, Mycobacterium
EESSTLGT

SEQ ID NO: 464109 - protein, 8 aa, Mycobacterium
EESSTLNT

SEQ ID NO: 464110 - protein, 10 aa, Mycobacterium
EESTAEERRK

SEQ ID NO: 464111 - protein, 11 aa, Mycobacterium
EESTAGGTARY

SEQ ID NO: 464112 - protein, 12 aa, Mycobacterium
EESTAGGTARYV

SEQ ID NO: 464113 - protein, 8 aa, Mycobacterium
EESTDNGS

SEQ ID NO: 464114 - protein, 8 aa, Mycobacterium
EESTGEVV

SEQ ID NO: 464115 - protein, 9 aa, Mycobacterium
EESTGGRTE

SEQ ID NO: 464116 - protein, 8 aa, Mycobacterium
EESTGRRC

SEQ ID NO: 464117 - protein, 11 aa, Mycobacterium
EESTKARAPYQ

SEQ ID NO: 464118 - protein, 10 aa, Mycobacterium
EESTPEREFE

SEQ ID NO: 464119 - protein, 11 aa, Mycobacterium
EESTPEREFEE

SEQ ID NO: 464120 - protein, 16 aa, Mycobacterium
EESTSWPGVTRATSLG

SEQ ID NO: 464121 - protein, 16 aa, Mycobacterium
EESTSWPGVTRPTSLG

SEQ ID NO: 464122 - protein, 12 aa, Mycobacterium
EESTTEGVREVP

SEQ ID NO: 464123 - protein, 13 aa, Mycobacterium
EESTTPLATDPAE

SEQ ID NO: 464124 - protein, 12 aa, Mycobacterium
EESTTPLTTDTA

SEQ ID NO: 464125 - protein, 10 aa, Mycobacterium
EESVAGDREL

SEQ ID NO: 464126 - protein, 53 aa, Mycobacterium
EESVEAVDDETDQVEETVDEESAEDGATTDDEPTDEDAPAGSDSGDDTSGSET

SEQ ID NO: 464127 - protein, 8 aa, Mycobacterium
EESVEEES

SEQ ID NO: 464128 - protein, 4 aa, Mycobacterium
EESW

SEQ ID NO: 464129 - protein, 8 aa, Mycobacterium
EESYQRRR

SEQ ID NO: 464130 - protein, 4 aa, Mycobacterium
EETA

SEQ ID NO: 464131 - protein, 7 aa, Mycobacterium
EETAALA

SEQ ID NO: 464132 - protein, 7 aa, Mycobacterium
EETAGRT

SEQ ID NO: 464133 - protein, 8 aa, Mycobacterium
EETAKTFS

SEQ ID NO: 464134 - protein, 5 aa, Mycobacterium
EETAR

SEQ ID NO: 464135 - protein, 16 aa, Mycobacterium
EETARDINDNHRNSRY

SEQ ID NO: 464136 - protein, 5 aa, Mycobacterium
EETAS

SEQ ID NO: 464137 - protein, 13 aa, Mycobacterium
EETDDGLAGEEGT

SEQ ID NO: 464138 - protein, 10 aa, Mycobacterium
EETDHNPPRL

SEQ ID NO: 464139 - protein, 10 aa, Mycobacterium
EETDRDPPRL

SEQ ID NO: 464140 - protein, 11 aa, Mycobacterium
EETDRNPPQLE

SEQ ID NO: 464141 - protein, 9 aa, Mycobacterium
EETEELDPV

SEQ ID NO: 464142 - protein, 7 aa, Mycobacterium
EETENKI

SEQ ID NO: 464143 - protein, 15 aa, Mycobacterium
EETGAVQTTSGAAIP

SEQ ID NO: 464144 - protein, 7 aa, Mycobacterium
EETGDQA

SEQ ID NO: 464145 - protein, 7 aa, Mycobacterium
EETGEPH

SEQ ID NO: 464146 - protein, 7 aa, Mycobacterium
EETGEPL

SEQ ID NO: 464147 - protein, 6 aa, Mycobacterium
EETGFT

SEQ ID NO: 464148 - protein, 6 aa, Mycobacterium
EETGIE

SEQ ID NO: 464149 - protein, 7 aa, Mycobacterium
EETGISG

SEQ ID NO: 464150 - protein, 8 aa, Mycobacterium
EETGKIRV

SEQ ID NO: 464151 - protein, 9 aa, Mycobacterium
EETGKSWGD

SEQ ID NO: 464152 - protein, 5 aa, Mycobacterium
EETGL

SEQ ID NO: 464153 - protein, 7 aa, Mycobacterium
EETGQPP

SEQ ID NO: 464154 - protein, 6 aa, Mycobacterium
EETGQQ

SEQ ID NO: 464155 - protein, 10 aa, Mycobacterium
EETGQSPGTW

SEQ ID NO: 464156 - protein, 9 aa, Mycobacterium
EETGQTAAG

SEQ ID NO: 464157 - protein, 5 aa, Mycobacterium
EETGR

SEQ ID NO: 464158 - protein, 8 aa, Mycobacterium
EETGRPVD

SEQ ID NO: 464159 - protein, 9 aa, Mycobacterium
EETGSTNAD

SEQ ID NO: 464160 - protein, 7 aa, Mycobacterium
EETGTLP

SEQ ID NO: 464161 - protein, 16 aa, Mycobacterium
EETGYTFDPNSPDLEG

SEQ ID NO: 464162 - protein, 31 aa, Mycobacterium
EETIDSRTDRWDASTAKSRDELDDDATADRR

SEQ ID NO: 464163 - protein, 11 aa, Mycobacterium
EETKSADYETR

SEQ ID NO: 464164 - protein, 5 aa, Mycobacterium
EETLS

SEQ ID NO: 464165 - protein, 6 aa, Mycobacterium
EETPAV

SEQ ID NO: 464166 - protein, 31 aa, Mycobacterium
EETPDDEPGADAPKTPRQPPSAAPLSARERE

SEQ ID NO: 464167 - protein, 7 aa, Mycobacterium
EETPERV

SEQ ID NO: 464168 - protein, 6 aa, Mycobacterium
EETPLE

SEQ ID NO: 464169 - protein, 7 aa, Mycobacterium
EETPLEQ

SEQ ID NO: 464170 - protein, 9 aa, Mycobacterium
EETPPGTRS

SEQ ID NO: 464171 - protein, 12 aa, Mycobacterium
EETPQIDPDLRT

SEQ ID NO: 464172 - protein, 14 aa, Mycobacterium
EETPQIDPDLTTPS

SEQ ID NO: 464173 - protein, 8 aa, Mycobacterium
EETPQIET

SEQ ID NO: 464174 - protein, 16 aa, Mycobacterium
EETPQIETDLTTPSQW

SEQ ID NO: 464175 - protein, 16 aa, Mycobacterium
EETRHPNSPPRPQSAD

SEQ ID NO: 464176 - protein, 8 aa, Mycobacterium
EETRPRLT

SEQ ID NO: 464177 - protein, 8 aa, Mycobacterium
EETRRRAQ

SEQ ID NO: 464178 - protein, 9 aa, Mycobacterium
EETTAGRYS

SEQ ID NO: 464179 - protein, 5 aa, Mycobacterium
EETTL

SEQ ID NO: 464180 - protein, 5 aa, Mycobacterium
EETTV

SEQ ID NO: 464181 - protein, 20 aa, Mycobacterium
EETVRKAQEGLARSQSEGQR

SEQ ID NO: 464182 - protein, 11 aa, Mycobacterium
EEVADPHSRTE

SEQ ID NO: 464183 - protein, 9 aa, Mycobacterium
EEVAQASSQ

SEQ ID NO: 464184 - protein, 13 aa, Mycobacterium
EEVDRLSRKGGTL

SEQ ID NO: 464185 - protein, 12 aa, Mycobacterium
EEVEAAQRETLR

SEQ ID NO: 464186 - protein, 6 aa, Mycobacterium
EEVERG

SEQ ID NO: 464187 - protein, 13 aa, Mycobacterium
EEVERRREISGGK

SEQ ID NO: 464188 - protein, 4 aa, Mycobacterium
EEVF

SEQ ID NO: 464189 - protein, 8 aa, Mycobacterium
EEVGGGAN

SEQ ID NO: 464190 - protein, 11 aa, Mycobacterium
EEVGGGARSSE

SEQ ID NO: 464191 - protein, 12 aa, Mycobacterium
EEVGGSGGNAID

SEQ ID NO: 464192 - protein, 10 aa, Mycobacterium
EEVGNGDGAE

SEQ ID NO: 464193 - protein, 16 aa, Mycobacterium
EEVGQAGDGSGAPAGV

SEQ ID NO: 464194 - protein, 5 aa, Mycobacterium
EEVKA

SEQ ID NO: 464195 - protein, 13 aa, Mycobacterium
EEVKGSTYPNPPV

SEQ ID NO: 464196 - protein, 12 aa, Mycobacterium
EEVKNGRGTPHG

SEQ ID NO: 464197 - protein, 7 aa, Mycobacterium
EEVNGSV

SEQ ID NO: 464198 - protein, 11 aa, Mycobacterium
EEVPETGASFE

SEQ ID NO: 464199 - protein, 19 aa, Mycobacterium
EEVPSAAAPERPQSAADVS

SEQ ID NO: 464200 - protein, 7 aa, Mycobacterium
EEVPSRT

SEQ ID NO: 464201 - protein, 5 aa, Mycobacterium
EEVQG

SEQ ID NO: 464202 - protein, 4 aa, Mycobacterium
EEVR

SEQ ID NO: 464203 - protein, 14 aa, Mycobacterium
EEVRTAKGYRQTRD

SEQ ID NO: 464204 - protein, 4 aa, Mycobacterium
EEVS

SEQ ID NO: 464205 - protein, 7 aa, Mycobacterium
EEVSHGA

SEQ ID NO: 464206 - protein, 4 aa, Mycobacterium
EEVT

SEQ ID NO: 464207 - protein, 9 aa, Mycobacterium
EEVTDATGR

SEQ ID NO: 464208 - protein, 13 aa, Mycobacterium
EEVTSDGRSDRGN

SEQ ID NO: 464209 - protein, 13 aa, Mycobacterium
EEVTSEGRSDRGN

SEQ ID NO: 464210 - protein, 8 aa, Mycobacterium
EEWAPQPA

SEQ ID NO: 464211 - protein, 8 aa, Mycobacterium
EEWGDDEY

SEQ ID NO: 464212 - protein, 10 aa, Mycobacterium
EEWGGGGQPY

SEQ ID NO: 464213 - protein, 9 aa, Mycobacterium
EEWGRDPAG

SEQ ID NO: 464214 - protein, 5 aa, Mycobacterium
EEWPE

SEQ ID NO: 464215 - protein, 11 aa, Mycobacterium
EEWSPDSESSL

SEQ ID NO: 464216 - protein, 6 aa, Mycobacterium
EEYAGP

SEQ ID NO: 464217 - protein, 7 aa, Mycobacterium
EEYAKTF

SEQ ID NO: 464218 - protein, 5 aa, Mycobacterium
EEYDA

SEQ ID NO: 464219 - protein, 10 aa, Mycobacterium
EEYDGQGADS

SEQ ID NO: 464220 - protein, 14 aa, Mycobacterium
EEYEAEQRRGADPQ

SEQ ID NO: 464221 - protein, 12 aa, Mycobacterium
EEYGDDDVETRT

SEQ ID NO: 464222 - protein, 5 aa, Mycobacterium
EEYGE

SEQ ID NO: 464223 - protein, 10 aa, Mycobacterium
EEYGGAGGDF

SEQ ID NO: 464224 - protein, 10 aa, Mycobacterium
EEYGGAGIPD

SEQ ID NO: 464225 - protein, 9 aa, Mycobacterium
EEYGGGGGG

SEQ ID NO: 464226 - protein, 11 aa, Mycobacterium
EEYGGGGGGMA

SEQ ID NO: 464227 - protein, 11 aa, Mycobacterium
EEYGGGGQPDY

SEQ ID NO: 464228 - protein, 8 aa, Mycobacterium
EEYGGHGR

SEQ ID NO: 464229 - protein, 8 aa, Mycobacterium
EEYGGSGF

SEQ ID NO: 464230 - protein, 7 aa, Mycobacterium
EEYGSHD

SEQ ID NO: 464231 - protein, 36 aa, Mycobacterium
EEYQEAAADYQEATSEAARAEAQAERLRQRANDSTP

SEQ ID NO: 464232 - protein, 5 aa, Mycobacterium
EEYRG

SEQ ID NO: 464233 - protein, 5 aa, Mycobacterium
EEYSR

SEQ ID NO: 464234 - protein, 7 aa, Mycobacterium
EFADATR

SEQ ID NO: 464235 - protein, 8 aa, Mycobacterium
EFAEAGRP

SEQ ID NO: 464236 - protein, 12 aa, Mycobacterium
EFAEDPAKYDIP

SEQ ID NO: 464237 - protein, 14 aa, Mycobacterium
EFAEGDPNKRWDTA

SEQ ID NO: 464238 - protein, 5 aa, Mycobacterium
EFAGP

SEQ ID NO: 464239 - protein, 10 aa, Mycobacterium
EFAGPDRGWG

SEQ ID NO: 464240 - protein, 6 aa, Mycobacterium
EFAPED

SEQ ID NO: 464241 - protein, 16 aa, Mycobacterium
EFAPGGPTAAVPPGSW

SEQ ID NO: 464242 - protein, 13 aa, Mycobacterium
EFARDTADIGDRE

SEQ ID NO: 464243 - protein, 9 aa, Mycobacterium
EFARDTRQR

SEQ ID NO: 464244 - protein, 9 aa, Mycobacterium
EFARNRNDQ

SEQ ID NO: 464245 - protein, 7 aa, Mycobacterium
EFARTSA

SEQ ID NO: 464246 - protein, 19 aa, Mycobacterium
EFASEARGYTATKHQREVG

SEQ ID NO: 464247 - protein, 16 aa, Mycobacterium
EFASGGGSEGGHTTPV

SEQ ID NO: 464248 - protein, 6 aa, Mycobacterium
EFDDNA

SEQ ID NO: 464249 - protein, 9 aa, Mycobacterium
EFDEPTDKA

SEQ ID NO: 464250 - protein, 12 aa, Mycobacterium
EFDGAADSGGFT

SEQ ID NO: 464251 - protein, 7 aa, Mycobacterium
EFDGDRS

SEQ ID NO: 464252 - protein, 6 aa, Mycobacterium
EFDGDT

SEQ ID NO: 464253 - protein, 7 aa, Mycobacterium
EFDGETR

SEQ ID NO: 464254 - protein, 15 aa, Mycobacterium
EFDGGVADAKKRTRK

SEQ ID NO: 464255 - protein, 8 aa, Mycobacterium
EFDGTPTT

SEQ ID NO: 464256 - protein, 17 aa, Mycobacterium
EFDNGRSQTPKAFGGTP

SEQ ID NO: 464257 - protein, 28 aa, Mycobacterium
EFDPEAPFTRNDTQKLRGVSNRKPDLHG

SEQ ID NO: 464258 - protein, 9 aa, Mycobacterium
EFDPERAGP

SEQ ID NO: 464259 - protein, 9 aa, Mycobacterium
EFDPERAGS

SEQ ID NO: 464260 - protein, 29 aa, Mycobacterium
EFDPGAPFTRSDTQKLRGVGNRKPDAHGT

SEQ ID NO: 464261 - protein, 9 aa, Mycobacterium
EFDPQRAGS

SEQ ID NO: 464262 - protein, 10 aa, Mycobacterium
EFDRPAPARL

SEQ ID NO: 464263 - protein, 8 aa, Mycobacterium
EFDTDDRE

SEQ ID NO: 464264 - protein, 7 aa, Mycobacterium
EFDTEDR

SEQ ID NO: 464265 - protein, 6 aa, Mycobacterium
EFEANR

SEQ ID NO: 464266 - protein, 9 aa, Mycobacterium
EFEARRRAQ

SEQ ID NO: 464267 - protein, 10 aa, Mycobacterium
EFEARRREQQ

SEQ ID NO: 464268 - protein, 7 aa, Mycobacterium
EFEGERP

SEQ ID NO: 464269 - protein, 5 aa, Mycobacterium
EFEGP

SEQ ID NO: 464270 - protein, 8 aa, Mycobacterium
EFEPGTDS

SEQ ID NO: 464271 - protein, 6 aa, Mycobacterium
EFEPPY

SEQ ID NO: 464272 - protein, 4 aa, Mycobacterium
EFER

SEQ ID NO: 464273 - protein, 10 aa, Mycobacterium
EFEREQREMA

SEQ ID NO: 464274 - protein, 6 aa, Mycobacterium
EFERSS

SEQ ID NO: 464275 - protein, 5 aa, Mycobacterium
EFESE

SEQ ID NO: 464276 - protein, 36 aa, Mycobacterium
EFESEIDESAAREASESDDPRIAARGRARLRAVGAI

SEQ ID NO: 464277 - protein, 6 aa, Mycobacterium
EFESRK

SEQ ID NO: 464278 - protein, 4 aa, Mycobacterium
EFGA

SEQ ID NO: 464279 - protein, 9 aa, Mycobacterium
EFGASTRAP

SEQ ID NO: 464280 - protein, 6 aa, Mycobacterium
EFGDAP

SEQ ID NO: 464281 - protein, 5 aa, Mycobacterium
EFGDD

SEQ ID NO: 464282 - protein, 8 aa, Mycobacterium
EFGDGSKL

SEQ ID NO: 464283 - protein, 5 aa, Mycobacterium
EFGEG

SEQ ID NO: 464284 - protein, 5 aa, Mycobacterium
EFGER

SEQ ID NO: 464285 - protein, 8 aa, Mycobacterium
EFGGAPVD

SEQ ID NO: 464286 - protein, 6 aa, Mycobacterium
EFGGDG

SEQ ID NO: 464287 - protein, 6 aa, Mycobacterium
EFGGDR

SEQ ID NO: 464288 - protein, 7 aa, Mycobacterium
EFGGDRG

SEQ ID NO: 464289 - protein, 8 aa, Mycobacterium
EFGGEPID

SEQ ID NO: 464290 - protein, 8 aa, Mycobacterium
EFGGGDAS

SEQ ID NO: 464291 - protein, 9 aa, Mycobacterium
EFGGGGAGM

SEQ ID NO: 464292 - protein, 9 aa, Mycobacterium
EFGGGGSDD

SEQ ID NO: 464293 - protein, 14 aa, Mycobacterium
EFGGKELATDGELA

SEQ ID NO: 464294 - protein, 9 aa, Mycobacterium
EFGGKGSTS

SEQ ID NO: 464295 - protein, 8 aa, Mycobacterium
EFGGPAVD

SEQ ID NO: 464296 - protein, 8 aa, Mycobacterium
EFGGQDRS

SEQ ID NO: 464297 - protein, 6 aa, Mycobacterium
EFGGQG

SEQ ID NO: 464298 - protein, 10 aa, Mycobacterium
EFGGQGGALT

SEQ ID NO: 464299 - protein, 9 aa, Mycobacterium
EFGGRGFGP

SEQ ID NO: 464300 - protein, 8 aa, Mycobacterium
EFGGSGAS

SEQ ID NO: 464301 - protein, 10 aa, Mycobacterium
EFGGTKEFTG

SEQ ID NO: 464302 - protein, 6 aa, Mycobacterium
EFGNGG

SEQ ID NO: 464303 - protein, 5 aa, Mycobacterium
EFGNK

SEQ ID NO: 464304 - protein, 6 aa, Mycobacterium
EFGNRN

SEQ ID NO: 464305 - protein, 5 aa, Mycobacterium
EFGNS

SEQ ID NO: 464306 - protein, 13 aa, Mycobacterium
EFGPNSPMARSTK

SEQ ID NO: 464307 - protein, 10 aa, Mycobacterium
EFGPRALGGR

SEQ ID NO: 464308 - protein, 6 aa, Mycobacterium
EFGPTH

SEQ ID NO: 464309 - protein, 4 aa, Mycobacterium
EFGR

SEQ ID NO: 464310 - protein, 11 aa, Mycobacterium
EFGRKGYEATT

SEQ ID NO: 464311 - protein, 5 aa, Mycobacterium
EFGSD

SEQ ID NO: 464312 - protein, 18 aa, Mycobacterium
EFGSDAQRAEWGAPAVAG

SEQ ID NO: 464313 - protein, 5 aa, Mycobacterium
EFGSN

SEQ ID NO: 464314 - protein, 31 aa, Mycobacterium
EFGSQRRAVTREGQVRSGERHEKDDRYRIDD

SEQ ID NO: 464315 - protein, 4 aa, Mycobacterium
EFGT

SEQ ID NO: 464316 - protein, 6 aa, Mycobacterium
EFGTAG

SEQ ID NO: 464317 - protein, 12 aa, Mycobacterium
EFGTGEGSSVAE

SEQ ID NO: 464318 - protein, 9 aa, Mycobacterium
EFGTPGGPV

SEQ ID NO: 464319 - protein, 14 aa, Mycobacterium
EFGTPQQRQRGEQA

SEQ ID NO: 464320 - protein, 7 aa, Mycobacterium
EFGTYGN

SEQ ID NO: 464321 - protein, 12 aa, Mycobacterium
EFKGKSTNGQWG

SEQ ID NO: 464322 - protein, 10 aa, Mycobacterium
EFKPGQQLSE

SEQ ID NO: 464323 - protein, 15 aa, Mycobacterium
EFKPSEVRDIEPAPV

SEQ ID NO: 464324 - protein, 11 aa, Mycobacterium
EFKRTSAPTFG

SEQ ID NO: 464325 - protein, 12 aa, Mycobacterium
EFKSSDSATTGY

SEQ ID NO: 464326 - protein, 7 aa, Mycobacterium
EFNPDRY

SEQ ID NO: 464327 - protein, 24 aa, Mycobacterium
EFNSETADVERRAARDRYAGRTGE

SEQ ID NO: 464328 - protein, 4 aa, Mycobacterium
EFPA

SEQ ID NO: 464329 - protein, 5 aa, Mycobacterium
EFPAK

SEQ ID NO: 464330 - protein, 6 aa, Mycobacterium
EFPAPK

SEQ ID NO: 464331 - protein, 5 aa, Mycobacterium
EFPAR

SEQ ID NO: 464332 - protein, 6 aa, Mycobacterium
EFPDPD

SEQ ID NO: 464333 - protein, 7 aa, Mycobacterium
EFPEADM

SEQ ID NO: 464334 - protein, 10 aa, Mycobacterium
EFPENPSEAL

SEQ ID NO: 464335 - protein, 5 aa, Mycobacterium
EFPER

SEQ ID NO: 464336 - protein, 7 aa, Mycobacterium
EFPGDTR

SEQ ID NO: 464337 - protein, 5 aa, Mycobacterium
EFPGG

SEQ ID NO: 464338 - protein, 9 aa, Mycobacterium
EFPKTTKAG

SEQ ID NO: 464339 - protein, 12 aa, Mycobacterium
EFPLGSDGDGAV

SEQ ID NO: 464340 - protein, 4 aa, Mycobacterium
EFPN

SEQ ID NO: 464341 - protein, 5 aa, Mycobacterium
EFPPE

SEQ ID NO: 464342 - protein, 16 aa, Mycobacterium
EFPPPLPYKGNRDPKV

SEQ ID NO: 464343 - protein, 6 aa, Mycobacterium
EFPPQR

SEQ ID NO: 464344 - protein, 5 aa, Mycobacterium
EFPQD

SEQ ID NO: 464345 - protein, 6 aa, Mycobacterium
EFPQQP

SEQ ID NO: 464346 - protein, 24 aa, Mycobacterium
EFPRPAPRPAYSALSGRESAAAGL

SEQ ID NO: 464347 - protein, 4 aa, Mycobacterium
EFPS

SEQ ID NO: 464348 - protein, 13 aa, Mycobacterium
EFPSSLPSARESA

SEQ ID NO: 464349 - protein, 8 aa, Mycobacterium
EFPSTNGH

SEQ ID NO: 464350 - protein, 7 aa, Mycobacterium
EFPTAGT

SEQ ID NO: 464351 - protein, 6 aa, Mycobacterium
EFPVTG

SEQ ID NO: 464352 - protein, 7 aa, Mycobacterium
EFQARSA

SEQ ID NO: 464353 - protein, 4 aa, Mycobacterium
EFQG

SEQ ID NO: 464354 - protein, 9 aa, Mycobacterium
EFQSRSAEL

SEQ ID NO: 464355 - protein, 15 aa, Mycobacterium
EFRDGYGDTVKSGRY

SEQ ID NO: 464356 - protein, 10 aa, Mycobacterium
EFRGKPQLTH

SEQ ID NO: 464357 - protein, 9 aa, Mycobacterium
EFRNPPDAV

SEQ ID NO: 464358 - protein, 4 aa, Mycobacterium
EFRP

SEQ ID NO: 464359 - protein, 6 aa, Mycobacterium
EFRPGD

SEQ ID NO: 464360 - protein, 7 aa, Mycobacterium
EFRPGDD

SEQ ID NO: 464361 - protein, 8 aa, Mycobacterium
EFRPGDDL

SEQ ID NO: 464362 - protein, 4 aa, Mycobacterium
EFRT

SEQ ID NO: 464363 - protein, 9 aa, Mycobacterium
EFSAAPSGI

SEQ ID NO: 464364 - protein, 9 aa, Mycobacterium
EFSAPPDVE

SEQ ID NO: 464365 - protein, 5 aa, Mycobacterium
EFSDG

SEQ ID NO: 464366 - protein, 8 aa, Mycobacterium
EFSEEPHD

SEQ ID NO: 464367 - protein, 9 aa, Mycobacterium
EFSGGQRQR

SEQ ID NO: 464368 - protein, 9 aa, Mycobacterium
EFSGPDAVG

SEQ ID NO: 464369 - protein, 8 aa, Mycobacterium
EFSGPEAV

SEQ ID NO: 464370 - protein, 11 aa, Mycobacterium
EFSGPRAPEAP

SEQ ID NO: 464371 - protein, 9 aa, Mycobacterium
EFSGSGDEY

SEQ ID NO: 464372 - protein, 10 aa, Mycobacterium
EFSKESGRSE

SEQ ID NO: 464373 - protein, 6 aa, Mycobacterium
EFSNGA

SEQ ID NO: 464374 - protein, 7 aa, Mycobacterium
EFSNGTS

SEQ ID NO: 464375 - protein, 17 aa, Mycobacterium
EFSPAPQTTNQSAGPMQ

SEQ ID NO: 464376 - protein, 12 aa, Mycobacterium
EFSPPADADDEL

SEQ ID NO: 464377 - protein, 15 aa, Mycobacterium
EFSPPGAGAEADGDA

SEQ ID NO: 464378 - protein, 6 aa, Mycobacterium
EFSSDP

SEQ ID NO: 464379 - protein, 20 aa, Mycobacterium
EFSSGSSRAQGPITKTGNGH

SEQ ID NO: 464380 - protein, 5 aa, Mycobacterium
EFSSR

SEQ ID NO: 464381 - protein, 7 aa, Mycobacterium
EFSTDED

SEQ ID NO: 464382 - protein, 12 aa, Mycobacterium
EFTDNSSDTPAA

SEQ ID NO: 464383 - protein, 13 aa, Mycobacterium
EFTDNSSDTPSAF

SEQ ID NO: 464384 - protein, 14 aa, Mycobacterium
EFTDTTTLDQQLAL

SEQ ID NO: 464385 - protein, 5 aa, Mycobacterium
EFTEN

SEQ ID NO: 464386 - protein, 5 aa, Mycobacterium
EFTER

SEQ ID NO: 464387 - protein, 5 aa, Mycobacterium
EFTET

SEQ ID NO: 464388 - protein, 8 aa, Mycobacterium
EFTETTAR

SEQ ID NO: 464389 - protein, 13 aa, Mycobacterium
EFTGGYSDEPYEL

SEQ ID NO: 464390 - protein, 5 aa, Mycobacterium
EFTGP

SEQ ID NO: 464391 - protein, 19 aa, Mycobacterium
EFTKTTSAGVQNIGGAQRG

SEQ ID NO: 464392 - protein, 30 aa, Mycobacterium
EFTPDGQEHRTGSPTVGAGGMAGTEEGKGF

SEQ ID NO: 464393 - protein, 5 aa, Mycobacterium
EFTPR

SEQ ID NO: 464394 - protein, 4 aa, Mycobacterium
EFTR

SEQ ID NO: 464395 - protein, 6 aa, Mycobacterium
EFTTES

SEQ ID NO: 464396 - protein, 20 aa, Mycobacterium
EFTTPTGKRYRSGAPPRIPP

SEQ ID NO: 464397 - protein, 12 aa, Mycobacterium
EGAAADATGLGL

SEQ ID NO: 464398 - protein, 8 aa, Mycobacterium
EGAADGPT

SEQ ID NO: 464399 - protein, 11 aa, Mycobacterium
EGAADGSDEHY

SEQ ID NO: 464400 - protein, 10 aa, Mycobacterium
EGAADSESDF

SEQ ID NO: 464401 - protein, 13 aa, Mycobacterium
EGAAERDQANEHP

SEQ ID NO: 464402 - protein, 8 aa, Mycobacterium
EGAAHPHG

SEQ ID NO: 464403 - protein, 12 aa, Mycobacterium
EGAAKAGRSPSD

SEQ ID NO: 464404 - protein, 10 aa, Mycobacterium
EGAAKGDEAA

SEQ ID NO: 464405 - protein, 5 aa, Mycobacterium
EGAAP

SEQ ID NO: 464406 - protein, 10 aa, Mycobacterium
EGAAPDPDSI

SEQ ID NO: 464407 - protein, 14 aa, Mycobacterium
EGAAPDPVDAPPTV

SEQ ID NO: 464408 - protein, 10 aa, Mycobacterium
EGAAPDTGSL

SEQ ID NO: 464409 - protein, 7 aa, Mycobacterium
EGAAPYG

SEQ ID NO: 464410 - protein, 14 aa, Mycobacterium
EGAASCPERAIRVE

SEQ ID NO: 464411 - protein, 5 aa, Mycobacterium
EGAAT

SEQ ID NO: 464412 - protein, 9 aa, Mycobacterium
EGAATDPAV

SEQ ID NO: 464413 - protein, 24 aa, Mycobacterium
EGADAGESADETAPEEPEDEDPAV

SEQ ID NO: 464414 - protein, 14 aa, Mycobacterium
EGADDLIADLDRAL

SEQ ID NO: 464415 - protein, 15 aa, Mycobacterium
EGADDSGEVATGGRR

SEQ ID NO: 464416 - protein, 8 aa, Mycobacterium
EGADGDHD

SEQ ID NO: 464417 - protein, 10 aa, Mycobacterium
EGADGGRWKT

SEQ ID NO: 464418 - protein, 6 aa, Mycobacterium
EGADGL

SEQ ID NO: 464419 - protein, 7 aa, Mycobacterium
EGADGPD

SEQ ID NO: 464420 - protein, 11 aa, Mycobacterium
EGADKLPTDER

SEQ ID NO: 464421 - protein, 7 aa, Mycobacterium
EGADKPL

SEQ ID NO: 464422 - protein, 7 aa, Mycobacterium
EGADPGH

SEQ ID NO: 464423 - protein, 8 aa, Mycobacterium
EGADPYTV

SEQ ID NO: 464424 - protein, 10 aa, Mycobacterium
EGADRLPTDK

SEQ ID NO: 464425 - protein, 11 aa, Mycobacterium
EGADTLPTDER

SEQ ID NO: 464426 - protein, 7 aa, Mycobacterium
EGADVRE

SEQ ID NO: 464427 - protein, 13 aa, Mycobacterium
EGAEAAGKNPDDV

SEQ ID NO: 464428 - protein, 13 aa, Mycobacterium
EGAEDQPERAADD

SEQ ID NO: 464429 - protein, 8 aa, Mycobacterium
EGAEEGTQ

SEQ ID NO: 464430 - protein, 16 aa, Mycobacterium
EGAENNVLDGSAGSET

SEQ ID NO: 464431 - protein, 7 aa, Mycobacterium
EGAEPAG

SEQ ID NO: 464432 - protein, 6 aa, Mycobacterium
EGAEPD

SEQ ID NO: 464433 - protein, 15 aa, Mycobacterium
EGAEPVGDRTGGPAV

SEQ ID NO: 464434 - protein, 5 aa, Mycobacterium
EGAEQ

SEQ ID NO: 464435 - protein, 7 aa, Mycobacterium
EGAEQAV

SEQ ID NO: 464436 - protein, 6 aa, Mycobacterium
EGAEQR

SEQ ID NO: 464437 - protein, 10 aa, Mycobacterium
EGAEQVPRGP

SEQ ID NO: 464438 - protein, 7 aa, Mycobacterium
EGAERGV

SEQ ID NO: 464439 - protein, 7 aa, Mycobacterium
EGAERLG

SEQ ID NO: 464440 - protein, 8 aa, Mycobacterium
EGAESDHD

SEQ ID NO: 464441 - protein, 16 aa, Mycobacterium
EGAESSVLDGDSGSET

SEQ ID NO: 464442 - protein, 7 aa, Mycobacterium
EGAEWDE

SEQ ID NO: 464443 - protein, 7 aa, Mycobacterium
EGAEYDI

SEQ ID NO: 464444 - protein, 7 aa, Mycobacterium
EGAFRPA

SEQ ID NO: 464445 - protein, 8 aa, Mycobacterium
EGAFRPAS

SEQ ID NO: 464446 - protein, 8 aa, Mycobacterium
EGAFRPQA

SEQ ID NO: 464447 - protein, 5 aa, Mycobacterium
EGAGA

SEQ ID NO: 464448 - protein, 7 aa, Mycobacterium
EGAGAAE

SEQ ID NO: 464449 - protein, 6 aa, Mycobacterium
EGAGAD

SEQ ID NO: 464450 - protein, 10 aa, Mycobacterium
EGAGADPRLG

SEQ ID NO: 464451 - protein, 7 aa, Mycobacterium
EGAGDVG

SEQ ID NO: 464452 - protein, 15 aa, Mycobacterium
EGAGDVKPLKPGQTI

SEQ ID NO: 464453 - protein, 5 aa, Mycobacterium
EGAGE

SEQ ID NO: 464454 - protein, 9 aa, Mycobacterium
EGAGETAEV

SEQ ID NO: 464455 - protein, 8 aa, Mycobacterium
EGAGGAAL

SEQ ID NO: 464456 - protein, 20 aa, Mycobacterium
EGAGGADAQSPGAVAGRRQQ

SEQ ID NO: 464457 - protein, 9 aa, Mycobacterium
EGAGGGHAP

SEQ ID NO: 464458 - protein, 8 aa, Mycobacterium
EGAGGSYQ

SEQ ID NO: 464459 - protein, 15 aa, Mycobacterium
EGAGGTQKLNPGGTI

SEQ ID NO: 464460 - protein, 5 aa, Mycobacterium
EGAGI

SEQ ID NO: 464461 - protein, 8 aa, Mycobacterium
EGAGPGTS

SEQ ID NO: 464462 - protein, 6 aa, Mycobacterium
EGAGQG

SEQ ID NO: 464463 - protein, 7 aa, Mycobacterium
EGAGQGL

SEQ ID NO: 464464 - protein, 10 aa, Mycobacterium
EGAGQGSDDH

SEQ ID NO: 464465 - protein, 5 aa, Mycobacterium
EGAGR

SEQ ID NO: 464466 - protein, 6 aa, Mycobacterium
EGAGRA

SEQ ID NO: 464467 - protein, 9 aa, Mycobacterium
EGAGSPAEI

SEQ ID NO: 464468 - protein, 5 aa, Mycobacterium
EGAGV

SEQ ID NO: 464469 - protein, 7 aa, Mycobacterium
EGAHDGR

SEQ ID NO: 464470 - protein, 20 aa, Mycobacterium
EGAHRGKPHGDIQPTGRTAR

SEQ ID NO: 464471 - protein, 7 aa, Mycobacterium
EGAISED

SEQ ID NO: 464472 - protein, 4 aa, Mycobacterium
EGAK

SEQ ID NO: 464473 - protein, 6 aa, Mycobacterium
EGAKAM

SEQ ID NO: 464474 - protein, 144 aa, Mycobacterium
EGAKGGGGPEGAGAPGGPGAPGAPLGPNPQQQQQEREAQLNERETKQNEREDHLNQREDEQNRREADQNAREARLNEHTGASSSASGPASSAAAPTAPAPSAPAPAAPPASAAGPSDARPAPGPVPVAPHESPRHSGGDDIAKR

SEQ ID NO: 464475 - protein, 5 aa, Mycobacterium
EGAKY

SEQ ID NO: 464476 - protein, 7 aa, Mycobacterium
EGALADG

SEQ ID NO: 464477 - protein, 5 aa, Mycobacterium
EGALK

SEQ ID NO: 464478 - protein, 6 aa, Mycobacterium
EGAMEG

SEQ ID NO: 464479 - protein, 11 aa, Mycobacterium
EGAMETDAETL

SEQ ID NO: 464480 - protein, 6 aa, Mycobacterium
EGAMTP

SEQ ID NO: 464481 - protein, 7 aa, Mycobacterium
EGAMTPG

SEQ ID NO: 464482 - protein, 16 aa, Mycobacterium
EGANGAPGTGQAGGAG

SEQ ID NO: 464483 - protein, 5 aa, Mycobacterium
EGANS

SEQ ID NO: 464484 - protein, 9 aa, Mycobacterium
EGAPAAGVP

SEQ ID NO: 464485 - protein, 7 aa, Mycobacterium
EGAPAAV

SEQ ID NO: 464486 - protein, 9 aa, Mycobacterium
EGAPAPAAV

SEQ ID NO: 464487 - protein, 5 aa, Mycobacterium
EGAPD

SEQ ID NO: 464488 - protein, 8 aa, Mycobacterium
EGAPGQQE

SEQ ID NO: 464489 - protein, 8 aa, Mycobacterium
EGAPQGTS

SEQ ID NO: 464490 - protein, 10 aa, Mycobacterium
EGAPQTYSPE

SEQ ID NO: 464491 - protein, 6 aa, Mycobacterium
EGAPRK

SEQ ID NO: 464492 - protein, 6 aa, Mycobacterium
EGAPRP

SEQ ID NO: 464493 - protein, 10 aa, Mycobacterium
EGAPRPAVGP

SEQ ID NO: 464494 - protein, 13 aa, Mycobacterium
EGAPTEPPPSTLA

SEQ ID NO: 464495 - protein, 9 aa, Mycobacterium
EGAPTPAAV

SEQ ID NO: 464496 - protein, 11 aa, Mycobacterium
EGAPVAPGEEG

SEQ ID NO: 464497 - protein, 7 aa, Mycobacterium
EGAPVER

SEQ ID NO: 464498 - protein, 4 aa, Mycobacterium
EGAQ

SEQ ID NO: 464499 - protein, 5 aa, Mycobacterium
EGAQK

SEQ ID NO: 464500 - protein, 17 aa, Mycobacterium
EGAQKVADGIKGEGGNA

SEQ ID NO: 464501 - protein, 15 aa, Mycobacterium
EGAQPITGSEKPTVR

SEQ ID NO: 464502 - protein, 8 aa, Mycobacterium
EGAQRFRG

SEQ ID NO: 464503 - protein, 14 aa, Mycobacterium
EGAQRTGAEHTGPR

SEQ ID NO: 464504 - protein, 16 aa, Mycobacterium
EGAQSAAQIIEEWIRK

SEQ ID NO: 464505 - protein, 6 aa, Mycobacterium
EGAQTT

SEQ ID NO: 464506 - protein, 4 aa, Mycobacterium
EGAR

SEQ ID NO: 464507 - protein, 5 aa, Mycobacterium
EGARA

SEQ ID NO: 464508 - protein, 11 aa, Mycobacterium
EGARAAPGYAA

SEQ ID NO: 464509 - protein, 8 aa, Mycobacterium
EGARADAE

SEQ ID NO: 464510 - protein, 11 aa, Mycobacterium
EGARATPDGPT

SEQ ID NO: 464511 - protein, 5 aa, Mycobacterium
EGARE

SEQ ID NO: 464512 - protein, 16 aa, Mycobacterium
EGARIRQGSPFTASGS

SEQ ID NO: 464513 - protein, 8 aa, Mycobacterium
EGARRAAA

SEQ ID NO: 464514 - protein, 14 aa, Mycobacterium
EGARRDGAEITAGG

SEQ ID NO: 464515 - protein, 7 aa, Mycobacterium
EGARRLP

SEQ ID NO: 464516 - protein, 10 aa, Mycobacterium
EGARSGAQRV

SEQ ID NO: 464517 - protein, 6 aa, Mycobacterium
EGARTV

SEQ ID NO: 464518 - protein, 4 aa, Mycobacterium
EGAS

SEQ ID NO: 464519 - protein, 9 aa, Mycobacterium
EGASATDDE

SEQ ID NO: 464520 - protein, 13 aa, Mycobacterium
EGASDEEEDEYDE

SEQ ID NO: 464521 - protein, 5 aa, Mycobacterium
EGASE

SEQ ID NO: 464522 - protein, 7 aa, Mycobacterium
EGASEPV

SEQ ID NO: 464523 - protein, 5 aa, Mycobacterium
EGASF

SEQ ID NO: 464524 - protein, 5 aa, Mycobacterium
EGASG

SEQ ID NO: 464525 - protein, 10 aa, Mycobacterium
EGASPAVGSV

SEQ ID NO: 464526 - protein, 33 aa, Mycobacterium
EGASPSQAGRRASAAASSTVQRLGGRPDLRGLT

SEQ ID NO: 464527 - protein, 7 aa, Mycobacterium
EGASQAE

SEQ ID NO: 464528 - protein, 8 aa, Mycobacterium
EGASVTAE

SEQ ID NO: 464529 - protein, 8 aa, Mycobacterium
EGASYGRA

SEQ ID NO: 464530 - protein, 9 aa, Mycobacterium
EGATDDPTI

SEQ ID NO: 464531 - protein, 16 aa, Mycobacterium
EGATEIDGSIPVNTDG

SEQ ID NO: 464532 - protein, 5 aa, Mycobacterium
EGATF

SEQ ID NO: 464533 - protein, 8 aa, Mycobacterium
EGATGPYL

SEQ ID NO: 464534 - protein, 10 aa, Mycobacterium
EGATPAVGSV

SEQ ID NO: 464535 - protein, 6 aa, Mycobacterium
EGATPV

SEQ ID NO: 464536 - protein, 6 aa, Mycobacterium
EGATRI

SEQ ID NO: 464537 - protein, 11 aa, Mycobacterium
EGATSAGAQAM

SEQ ID NO: 464538 - protein, 8 aa, Mycobacterium
EGATSDQW

SEQ ID NO: 464539 - protein, 7 aa, Mycobacterium
EGATSQP

SEQ ID NO: 464540 - protein, 7 aa, Mycobacterium
EGATVSA

SEQ ID NO: 464541 - protein, 11 aa, Mycobacterium
EGAVGADASEH

SEQ ID NO: 464542 - protein, 7 aa, Mycobacterium
EGAVPDD

SEQ ID NO: 464543 - protein, 8 aa, Mycobacterium
EGAVPSAE

SEQ ID NO: 464544 - protein, 7 aa, Mycobacterium
EGAVRTA

SEQ ID NO: 464545 - protein, 12 aa, Mycobacterium
EGAVVTDADGRE

SEQ ID NO: 464546 - protein, 5 aa, Mycobacterium
EGAYA

SEQ ID NO: 464547 - protein, 4 aa, Mycobacterium
EGCD

SEQ ID NO: 464548 - protein, 5 aa, Mycobacterium
EGCEG

SEQ ID NO: 464549 - protein, 14 aa, Mycobacterium
EGCGEKARADEPYR

SEQ ID NO: 464550 - protein, 8 aa, Mycobacterium
EGCGELTG

SEQ ID NO: 464551 - protein, 5 aa, Mycobacterium
EGCGQ

SEQ ID NO: 464552 - protein, 5 aa, Mycobacterium
EGCPG

SEQ ID NO: 464553 - protein, 9 aa, Mycobacterium
EGCSRGRGG

SEQ ID NO: 464554 - protein, 7 aa, Mycobacterium
EGCTDEA

SEQ ID NO: 464555 - protein, 6 aa, Mycobacterium
EGCTGK

SEQ ID NO: 464556 - protein, 4 aa, Mycobacterium
EGDA

SEQ ID NO: 464557 - protein, 9 aa, Mycobacterium
EGDAAPGTL

SEQ ID NO: 464558 - protein, 14 aa, Mycobacterium
EGDAATACEASLDQ

SEQ ID NO: 464559 - protein, 7 aa, Mycobacterium
EGDADEA

SEQ ID NO: 464560 - protein, 7 aa, Mycobacterium
EGDADNA

SEQ ID NO: 464561 - protein, 27 aa, Mycobacterium
EGDADTEPGWAQPEAPSPVEPAAPVGD

SEQ ID NO: 464562 - protein, 5 aa, Mycobacterium
EGDAE

SEQ ID NO: 464563 - protein, 9 aa, Mycobacterium
EGDAWQSDQ

SEQ ID NO: 464564 - protein, 5 aa, Mycobacterium
EGDCE

SEQ ID NO: 464565 - protein, 15 aa, Mycobacterium
EGDCGDDADENEPAP

SEQ ID NO: 464566 - protein, 7 aa, Mycobacterium
EGDDLTG

SEQ ID NO: 464567 - protein, 13 aa, Mycobacterium
EGDDPLDKRDYRA

SEQ ID NO: 464568 - protein, 7 aa, Mycobacterium
EGDDTVR

SEQ ID NO: 464569 - protein, 5 aa, Mycobacterium
EGDDY

SEQ ID NO: 464570 - protein, 4 aa, Mycobacterium
EGDE

SEQ ID NO: 464571 - protein, 6 aa, Mycobacterium
EGDEGV

SEQ ID NO: 464572 - protein, 9 aa, Mycobacterium
EGDEPSGED

SEQ ID NO: 464573 - protein, 8 aa, Mycobacterium
EGDEQQRQ

SEQ ID NO: 464574 - protein, 8 aa, Mycobacterium
EGDETIRP

SEQ ID NO: 464575 - protein, 8 aa, Mycobacterium
EGDETVRP

SEQ ID NO: 464576 - protein, 4 aa, Mycobacterium
EGDG

SEQ ID NO: 464577 - protein, 8 aa, Mycobacterium
EGDGADIE

SEQ ID NO: 464578 - protein, 11 aa, Mycobacterium
EGDGAEATSGK

SEQ ID NO: 464579 - protein, 6 aa, Mycobacterium
EGDGAQ

SEQ ID NO: 464580 - protein, 9 aa, Mycobacterium
EGDGEGSLT

SEQ ID NO: 464581 - protein, 8 aa, Mycobacterium
EGDGGDYG

SEQ ID NO: 464582 - protein, 8 aa, Mycobacterium
EGDGGEYG

SEQ ID NO: 464583 - protein, 8 aa, Mycobacterium
EGDGGGYG

SEQ ID NO: 464584 - protein, 11 aa, Mycobacterium
EGDGGVGPGEV

SEQ ID NO: 464585 - protein, 11 aa, Mycobacterium
EGDGLRQAPNR

SEQ ID NO: 464586 - protein, 7 aa, Mycobacterium
EGDGRDK

SEQ ID NO: 464587 - protein, 8 aa, Mycobacterium
EGDGSVSQ

SEQ ID NO: 464588 - protein, 6 aa, Mycobacterium
EGDGTT

SEQ ID NO: 464589 - protein, 4 aa, Mycobacterium
EGDH

SEQ ID NO: 464590 - protein, 10 aa, Mycobacterium
EGDHEGAAQQ

SEQ ID NO: 464591 - protein, 4 aa, Mycobacterium
EGDI

SEQ ID NO: 464592 - protein, 5 aa, Mycobacterium
EGDID

SEQ ID NO: 464593 - protein, 11 aa, Mycobacterium
EGDIPTGGLPG

SEQ ID NO: 464594 - protein, 14 aa, Mycobacterium
EGDKVTGERETDDG

SEQ ID NO: 464595 - protein, 15 aa, Mycobacterium
EGDLSVRDAATSLTR

SEQ ID NO: 464596 - protein, 9 aa, Mycobacterium
EGDNATART

SEQ ID NO: 464597 - protein, 6 aa, Mycobacterium
EGDNSI

SEQ ID NO: 464598 - protein, 17 aa, Mycobacterium
EGDNSISAGWDPETGQV

SEQ ID NO: 464599 - protein, 20 aa, Mycobacterium
EGDNVTDVRPPQGNNPGNIT

SEQ ID NO: 464600 - protein, 4 aa, Mycobacterium
EGDP

SEQ ID NO: 464601 - protein, 6 aa, Mycobacterium
EGDPGI

SEQ ID NO: 464602 - protein, 10 aa, Mycobacterium
EGDPGRRPFT

SEQ ID NO: 464603 - protein, 6 aa, Mycobacterium
EGDPIG

SEQ ID NO: 464604 - protein, 7 aa, Mycobacterium
EGDPKVT

SEQ ID NO: 464605 - protein, 9 aa, Mycobacterium
EGDPNPNIE

SEQ ID NO: 464606 - protein, 18 aa, Mycobacterium
EGDPNPNIEHANRGKRSL

SEQ ID NO: 464607 - protein, 7 aa, Mycobacterium
EGDPPCP

SEQ ID NO: 464608 - protein, 6 aa, Mycobacterium
EGDPRA

SEQ ID NO: 464609 - protein, 6 aa, Mycobacterium
EGDPSA

SEQ ID NO: 464610 - protein, 10 aa, Mycobacterium
EGDPVPPERD

SEQ ID NO: 464611 - protein, 7 aa, Mycobacterium
EGDPWSQ

SEQ ID NO: 464612 - protein, 6 aa, Mycobacterium
EGDPYS

SEQ ID NO: 464613 - protein, 8 aa, Mycobacterium
EGDQGLTQ

SEQ ID NO: 464614 - protein, 11 aa, Mycobacterium
EGDQHRTDRRR

SEQ ID NO: 464615 - protein, 25 aa, Mycobacterium
EGDQISVRDANDANLRTKPGTPMKV

SEQ ID NO: 464616 - protein, 8 aa, Mycobacterium
EGDQNSGE

SEQ ID NO: 464617 - protein, 18 aa, Mycobacterium
EGDQRALTAAAQAGEQTL

SEQ ID NO: 464618 - protein, 10 aa, Mycobacterium
EGDQVETGQT

SEQ ID NO: 464619 - protein, 8 aa, Mycobacterium
EGDQVGKG

SEQ ID NO: 464620 - protein, 15 aa, Mycobacterium
EGDRDKGAIGNQRST

SEQ ID NO: 464621 - protein, 8 aa, Mycobacterium
EGDRNDVA

SEQ ID NO: 464622 - protein, 14 aa, Mycobacterium
EGDRNPPEFDPKTH

SEQ ID NO: 464623 - protein, 14 aa, Mycobacterium
EGDRPTPATRPDRG

SEQ ID NO: 464624 - protein, 8 aa, Mycobacterium
EGDRQTYQ

SEQ ID NO: 464625 - protein, 5 aa, Mycobacterium
EGDRR

SEQ ID NO: 464626 - protein, 5 aa, Mycobacterium
EGDRV

SEQ ID NO: 464627 - protein, 9 aa, Mycobacterium
EGDSARSAR

SEQ ID NO: 464628 - protein, 8 aa, Mycobacterium
EGDSATFT

SEQ ID NO: 464629 - protein, 8 aa, Mycobacterium
EGDSEPHS

SEQ ID NO: 464630 - protein, 10 aa, Mycobacterium
EGDSGASGLA

SEQ ID NO: 464631 - protein, 8 aa, Mycobacterium
EGDSGEHA

SEQ ID NO: 464632 - protein, 21 aa, Mycobacterium
EGDSQQPETNGDGPESNGDSV

SEQ ID NO: 464633 - protein, 8 aa, Mycobacterium
EGDSTDLR

SEQ ID NO: 464634 - protein, 6 aa, Mycobacterium
EGDTAM

SEQ ID NO: 464635 - protein, 12 aa, Mycobacterium
EGDTAPLEESGK

SEQ ID NO: 464636 - protein, 6 aa, Mycobacterium
EGDTEL

SEQ ID NO: 464637 - protein, 13 aa, Mycobacterium
EGDTERARTILSA

SEQ ID NO: 464638 - protein, 12 aa, Mycobacterium
EGDTRDYSGARN

SEQ ID NO: 464639 - protein, 17 aa, Mycobacterium
EGDTSEQFDDFQQLPTA

SEQ ID NO: 464640 - protein, 7 aa, Mycobacterium
EGDTVDI

SEQ ID NO: 464641 - protein, 6 aa, Mycobacterium
EGDTVE

SEQ ID NO: 464642 - protein, 7 aa, Mycobacterium
EGDTVEL

SEQ ID NO: 464643 - protein, 7 aa, Mycobacterium
EGDTVEV

SEQ ID NO: 464644 - protein, 13 aa, Mycobacterium
EGDTVEVSTPRGR

SEQ ID NO: 464645 - protein, 7 aa, Mycobacterium
EGDVDGV

SEQ ID NO: 464646 - protein, 5 aa, Mycobacterium
EGDVR

SEQ ID NO: 464647 - protein, 6 aa, Mycobacterium
EGDVRD

SEQ ID NO: 464648 - protein, 7 aa, Mycobacterium
EGDYSRP

SEQ ID NO: 464649 - protein, 5 aa, Mycobacterium
EGEAA

SEQ ID NO: 464650 - protein, 6 aa, Mycobacterium
EGEAAA

SEQ ID NO: 464651 - protein, 18 aa, Mycobacterium
EGEAAARPVGVIPHSPAA

SEQ ID NO: 464652 - protein, 13 aa, Mycobacterium
EGEADREHEEQDM

SEQ ID NO: 464653 - protein, 5 aa, Mycobacterium
EGEAE

SEQ ID NO: 464654 - protein, 7 aa, Mycobacterium
EGEAGDH

SEQ ID NO: 464655 - protein, 9 aa, Mycobacterium
EGEAGSPKM

SEQ ID NO: 464656 - protein, 10 aa, Mycobacterium
EGEAKNTYGT

SEQ ID NO: 464657 - protein, 11 aa, Mycobacterium
EGEANVPTDDL

SEQ ID NO: 464658 - protein, 9 aa, Mycobacterium
EGEATLSPA

SEQ ID NO: 464659 - protein, 4 aa, Mycobacterium
EGED

SEQ ID NO: 464660 - protein, 5 aa, Mycobacterium
EGEDA

SEQ ID NO: 464661 - protein, 5 aa, Mycobacterium
EGEDD

SEQ ID NO: 464662 - protein, 8 aa, Mycobacterium
EGEDDPQQ

SEQ ID NO: 464663 - protein, 6 aa, Mycobacterium
EGEDDR

SEQ ID NO: 464664 - protein, 8 aa, Mycobacterium
EGEDDRTR

SEQ ID NO: 464665 - protein, 10 aa, Mycobacterium
EGEDERTARY

SEQ ID NO: 464666 - protein, 11 aa, Mycobacterium
EGEDGREESAI

SEQ ID NO: 464667 - protein, 6 aa, Mycobacterium
EGEDGT

SEQ ID NO: 464668 - protein, 10 aa, Mycobacterium
EGEDLGSGAD

SEQ ID NO: 464669 - protein, 10 aa, Mycobacterium
EGEDPASTNI

SEQ ID NO: 464670 - protein, 19 aa, Mycobacterium
EGEDPAVAEPEATEAGREK

SEQ ID NO: 464671 - protein, 20 aa, Mycobacterium
EGEDPTHPGTAEPPFPPPTR

SEQ ID NO: 464672 - protein, 11 aa, Mycobacterium
EGEDSYHSGPV

SEQ ID NO: 464673 - protein, 6 aa, Mycobacterium
EGEEDV

SEQ ID NO: 464674 - protein, 5 aa, Mycobacterium
EGEEG

SEQ ID NO: 464675 - protein, 8 aa, Mycobacterium
EGEEGDRG

SEQ ID NO: 464676 - protein, 6 aa, Mycobacterium
EGEEHH

SEQ ID NO: 464677 - protein, 4 aa, Mycobacterium
EGEF

SEQ ID NO: 464678 - protein, 7 aa, Mycobacterium
EGEFDGP

SEQ ID NO: 464679 - protein, 4 aa, Mycobacterium
EGEG

SEQ ID NO: 464680 - protein, 10 aa, Mycobacterium
EGEGAGQVPL

SEQ ID NO: 464681 - protein, 9 aa, Mycobacterium
EGEGEGESA

SEQ ID NO: 464682 - protein, 5 aa, Mycobacterium
EGEGF

SEQ ID NO: 464683 - protein, 7 aa, Mycobacterium
EGEGFDS

SEQ ID NO: 464684 - protein, 17 aa, Mycobacterium
EGEGGAEYLPRSHRRPE

SEQ ID NO: 464685 - protein, 8 aa, Mycobacterium
EGEGGDTF

SEQ ID NO: 464686 - protein, 8 aa, Mycobacterium
EGEGGSVP

SEQ ID NO: 464687 - protein, 5 aa, Mycobacterium
EGEGR

SEQ ID NO: 464688 - protein, 6 aa, Mycobacterium
EGEGRS

SEQ ID NO: 464689 - protein, 14 aa, Mycobacterium
EGEGSGHDSGAEKT

SEQ ID NO: 464690 - protein, 6 aa, Mycobacterium
EGEGYD

SEQ ID NO: 464691 - protein, 4 aa, Mycobacterium
EGEH

SEQ ID NO: 464692 - protein, 10 aa, Mycobacterium
EGEHATGEHA

SEQ ID NO: 464693 - protein, 5 aa, Mycobacterium
EGEHN

SEQ ID NO: 464694 - protein, 4 aa, Mycobacterium
EGEI

SEQ ID NO: 464695 - protein, 14 aa, Mycobacterium
EGEIAGARAAAAAG

SEQ ID NO: 464696 - protein, 7 aa, Mycobacterium
EGEIPGD

SEQ ID NO: 464697 - protein, 7 aa, Mycobacterium
EGEKDHA

SEQ ID NO: 464698 - protein, 9 aa, Mycobacterium
EGEKPGPVS

SEQ ID NO: 464699 - protein, 8 aa, Mycobacterium
EGEKQAAE

SEQ ID NO: 464700 - protein, 4 aa, Mycobacterium
EGEL

SEQ ID NO: 464701 - protein, 5 aa, Mycobacterium
EGELG

SEQ ID NO: 464702 - protein, 6 aa, Mycobacterium
EGELPA

SEQ ID NO: 464703 - protein, 6 aa, Mycobacterium
EGELPV

SEQ ID NO: 464704 - protein, 5 aa, Mycobacterium
EGEMG

SEQ ID NO: 464705 - protein, 8 aa, Mycobacterium
EGEMPDDP

SEQ ID NO: 464706 - protein, 6 aa, Mycobacterium
EGENDA

SEQ ID NO: 464707 - protein, 12 aa, Mycobacterium
EGENDSARGKIS

SEQ ID NO: 464708 - protein, 8 aa, Mycobacterium
EGENDSVP

SEQ ID NO: 464709 - protein, 5 aa, Mycobacterium
EGEPA

SEQ ID NO: 464710 - protein, 12 aa, Mycobacterium
EGEPADRRASHT

SEQ ID NO: 464711 - protein, 7 aa, Mycobacterium
EGEPADV

SEQ ID NO: 464712 - protein, 11 aa, Mycobacterium
EGEPAGAPGGG

SEQ ID NO: 464713 - protein, 5 aa, Mycobacterium
EGEPE

SEQ ID NO: 464714 - protein, 10 aa, Mycobacterium
EGEPEQAERA

SEQ ID NO: 464715 - protein, 7 aa, Mycobacterium
EGEPGET

SEQ ID NO: 464716 - protein, 11 aa, Mycobacterium
EGEPGLGNGGL

SEQ ID NO: 464717 - protein, 6 aa, Mycobacterium
EGEPLS

SEQ ID NO: 464718 - protein, 10 aa, Mycobacterium
EGEPQPVAGV

SEQ ID NO: 464719 - protein, 8 aa, Mycobacterium
EGEPRPME

SEQ ID NO: 464720 - protein, 5 aa, Mycobacterium
EGEPV

SEQ ID NO: 464721 - protein, 7 aa, Mycobacterium
EGEPVPD

SEQ ID NO: 464722 - protein, 9 aa, Mycobacterium
EGEPYAGSV

SEQ ID NO: 464723 - protein, 14 aa, Mycobacterium
EGEPYAGSVTRSGD

SEQ ID NO: 464724 - protein, 14 aa, Mycobacterium
EGEPYAGSVTRTGE

SEQ ID NO: 464725 - protein, 4 aa, Mycobacterium
EGEQ

SEQ ID NO: 464726 - protein, 5 aa, Mycobacterium
EGEQA

SEQ ID NO: 464727 - protein, 7 aa, Mycobacterium
EGEQGEL

SEQ ID NO: 464728 - protein, 5 aa, Mycobacterium
EGEQP

SEQ ID NO: 464729 - protein, 7 aa, Mycobacterium
EGERAQV

SEQ ID NO: 464730 - protein, 7 aa, Mycobacterium
EGERESL

SEQ ID NO: 464731 - protein, 13 aa, Mycobacterium
EGERGTRGESKFD

SEQ ID NO: 464732 - protein, 6 aa, Mycobacterium
EGERIT

SEQ ID NO: 464733 - protein, 10 aa, Mycobacterium
EGERLTDRQS

SEQ ID NO: 464734 - protein, 12 aa, Mycobacterium
EGERRGSKRPTF

SEQ ID NO: 464735 - protein, 9 aa, Mycobacterium
EGERSTHGP

SEQ ID NO: 464736 - protein, 4 aa, Mycobacterium
EGES

SEQ ID NO: 464737 - protein, 7 aa, Mycobacterium
EGESIDV

SEQ ID NO: 464738 - protein, 10 aa, Mycobacterium
EGESLADERV

SEQ ID NO: 464739 - protein, 8 aa, Mycobacterium
EGESTEAN

SEQ ID NO: 464740 - protein, 4 aa, Mycobacterium
EGET

SEQ ID NO: 464741 - protein, 14 aa, Mycobacterium
EGETAEGQQRSSLD

SEQ ID NO: 464742 - protein, 5 aa, Mycobacterium
EGETG

SEQ ID NO: 464743 - protein, 7 aa, Mycobacterium
EGETGEQ

SEQ ID NO: 464744 - protein, 13 aa, Mycobacterium
EGETKRRTAEQLG

SEQ ID NO: 464745 - protein, 5 aa, Mycobacterium
EGETL

SEQ ID NO: 464746 - protein, 18 aa, Mycobacterium
EGETQTVGGYPVTTPERT

SEQ ID NO: 464747 - protein, 14 aa, Mycobacterium
EGETSEQFDELQAA

SEQ ID NO: 464748 - protein, 14 aa, Mycobacterium
EGETSEQFEELQAA

SEQ ID NO: 464749 - protein, 6 aa, Mycobacterium
EGEYAE

SEQ ID NO: 464750 - protein, 18 aa, Mycobacterium
EGFAGAGSGSLSSEDAAE

SEQ ID NO: 464751 - protein, 12 aa, Mycobacterium
EGFAPRGNDHPD

SEQ ID NO: 464752 - protein, 6 aa, Mycobacterium
EGFDPA

SEQ ID NO: 464753 - protein, 12 aa, Mycobacterium
EGFEAQDSRAGA

SEQ ID NO: 464754 - protein, 12 aa, Mycobacterium
EGFEHQESRAGK

SEQ ID NO: 464755 - protein, 26 aa, Mycobacterium
EGFGAPKHRRGHASPDGLASLPSGTE

SEQ ID NO: 464756 - protein, 17 aa, Mycobacterium
EGFGEPAQLAGASAADV

SEQ ID NO: 464757 - protein, 33 aa, Mycobacterium
EGFGGGDVDGLAQPAGRPPAGVDHPPAQIGPLG

SEQ ID NO: 464758 - protein, 9 aa, Mycobacterium
EGFGPGGLA

SEQ ID NO: 464759 - protein, 4 aa, Mycobacterium
EGFP

SEQ ID NO: 464760 - protein, 10 aa, Mycobacterium
EGFREGEGNM

SEQ ID NO: 464761 - protein, 11 aa, Mycobacterium
EGFSKTSTTET

SEQ ID NO: 464762 - protein, 13 aa, Mycobacterium
EGFTAPVSRRPTK

SEQ ID NO: 464763 - protein, 6 aa, Mycobacterium
EGFTPA

SEQ ID NO: 464764 - protein, 9 aa, Mycobacterium
EGFTQSKPF

SEQ ID NO: 464765 - protein, 4 aa, Mycobacterium
EGGA

SEQ ID NO: 464766 - protein, 15 aa, Mycobacterium
EGGAAERPDTLAAEE

SEQ ID NO: 464767 - protein, 5 aa, Mycobacterium
EGGAG

SEQ ID NO: 464768 - protein, 7 aa, Mycobacterium
EGGAGLR

SEQ ID NO: 464769 - protein, 13 aa, Mycobacterium
EGGALDTVTPGIT

SEQ ID NO: 464770 - protein, 9 aa, Mycobacterium
EGGALEDPA

SEQ ID NO: 464771 - protein, 12 aa, Mycobacterium
EGGALGTSRPGR

SEQ ID NO: 464772 - protein, 6 aa, Mycobacterium
EGGAPA

SEQ ID NO: 464773 - protein, 10 aa, Mycobacterium
EGGAPDDPAR

SEQ ID NO: 464774 - protein, 9 aa, Mycobacterium
EGGAQQDRL

SEQ ID NO: 464775 - protein, 16 aa, Mycobacterium
EGGARRGTDDEQPEVG

SEQ ID NO: 464776 - protein, 17 aa, Mycobacterium
EGGARRGVGDERPEAGE

SEQ ID NO: 464777 - protein, 7 aa, Mycobacterium
EGGASEI

SEQ ID NO: 464778 - protein, 9 aa, Mycobacterium
EGGATAEDV

SEQ ID NO: 464779 - protein, 11 aa, Mycobacterium
EGGATDANPQA

SEQ ID NO: 464780 - protein, 8 aa, Mycobacterium
EGGATSEG

SEQ ID NO: 464781 - protein, 4 aa, Mycobacterium
EGGD

SEQ ID NO: 464782 - protein, 5 aa, Mycobacterium
EGGDA

SEQ ID NO: 464783 - protein, 6 aa, Mycobacterium
EGGDDT

SEQ ID NO: 464784 - protein, 9 aa, Mycobacterium
EGGDGTDPL

SEQ ID NO: 464785 - protein, 7 aa, Mycobacterium
EGGDHPS

SEQ ID NO: 464786 - protein, 12 aa, Mycobacterium
EGGDRQAPRTPE

SEQ ID NO: 464787 - protein, 4 aa, Mycobacterium
EGGE

SEQ ID NO: 464788 - protein, 8 aa, Mycobacterium
EGGEAANI

SEQ ID NO: 464789 - protein, 7 aa, Mycobacterium
EGGEAEA

SEQ ID NO: 464790 - protein, 8 aa, Mycobacterium
EGGEIGRA

SEQ ID NO: 464791 - protein, 10 aa, Mycobacterium
EGGEKPAETL

SEQ ID NO: 464792 - protein, 8 aa, Mycobacterium
EGGELTNE

SEQ ID NO: 464793 - protein, 17 aa, Mycobacterium
EGGEQGSRAASARKSSE

SEQ ID NO: 464794 - protein, 8 aa, Mycobacterium
EGGERTPG

SEQ ID NO: 464795 - protein, 10 aa, Mycobacterium
EGGESANVER

SEQ ID NO: 464796 - protein, 6 aa, Mycobacterium
EGGESR

SEQ ID NO: 464797 - protein, 30 aa, Mycobacterium
EGGFGDCDGDGDGARSASPLPAPPARQPDL

SEQ ID NO: 464798 - protein, 24 aa, Mycobacterium
EGGFGGEPGQRPVAPEFPDREPDA

SEQ ID NO: 464799 - protein, 24 aa, Mycobacterium
EGGFGGMPGQRPVAPEFPDREPDA

SEQ ID NO: 464800 - protein, 25 aa, Mycobacterium
EGGFGGQPGSRPTAPPVPDREPDAR

SEQ ID NO: 464801 - protein, 24 aa, Mycobacterium
EGGFGGVPGQRPIAPEFPDREPDA

SEQ ID NO: 464802 - protein, 24 aa, Mycobacterium
EGGFGGVPGQRPVAPEIPDREPDA

SEQ ID NO: 464803 - protein, 7 aa, Mycobacterium
EGGGAAK

SEQ ID NO: 464804 - protein, 13 aa, Mycobacterium
EGGGASILTRYGR

SEQ ID NO: 464805 - protein, 7 aa, Mycobacterium
EGGGASK

SEQ ID NO: 464806 - protein, 8 aa, Mycobacterium
EGGGAVRN

SEQ ID NO: 464807 - protein, 5 aa, Mycobacterium
EGGGD

SEQ ID NO: 464808 - protein, 12 aa, Mycobacterium
EGGGFKDPKGAS

SEQ ID NO: 464809 - protein, 5 aa, Mycobacterium
EGGGG

SEQ ID NO: 464810 - protein, 8 aa, Mycobacterium
EGGGGRPV

SEQ ID NO: 464811 - protein, 5 aa, Mycobacterium
EGGGL

SEQ ID NO: 464812 - protein, 6 aa, Mycobacterium
EGGGLV

SEQ ID NO: 464813 - protein, 7 aa, Mycobacterium
EGGGPAT

SEQ ID NO: 464814 - protein, 13 aa, Mycobacterium
EGGGQANATVLEL

SEQ ID NO: 464815 - protein, 13 aa, Mycobacterium
EGGGQANVTIIER

SEQ ID NO: 464816 - protein, 8 aa, Mycobacterium
EGGGQQVA

SEQ ID NO: 464817 - protein, 10 aa, Mycobacterium
EGGGRQVADS

SEQ ID NO: 464818 - protein, 15 aa, Mycobacterium
EGGGSTSGKKPKDDG

SEQ ID NO: 464819 - protein, 5 aa, Mycobacterium
EGGGT

SEQ ID NO: 464820 - protein, 15 aa, Mycobacterium
EGGGTAAQRDRGTRA

SEQ ID NO: 464821 - protein, 14 aa, Mycobacterium
EGGGTANATIVELL

SEQ ID NO: 464822 - protein, 14 aa, Mycobacterium
EGGGTANATLVELL

SEQ ID NO: 464823 - protein, 14 aa, Mycobacterium
EGGGTANATVVELM

SEQ ID NO: 464824 - protein, 14 aa, Mycobacterium
EGGGTANVTIIERL

SEQ ID NO: 464825 - protein, 6 aa, Mycobacterium
EGGGTR

SEQ ID NO: 464826 - protein, 13 aa, Mycobacterium
EGGHAGASDNPQV

SEQ ID NO: 464827 - protein, 5 aa, Mycobacterium
EGGHG

SEQ ID NO: 464828 - protein, 16 aa, Mycobacterium
EGGHGGAADNKQAAFK

SEQ ID NO: 464829 - protein, 15 aa, Mycobacterium
EGGHGGAANNEQSAF

SEQ ID NO: 464830 - protein, 12 aa, Mycobacterium
EGGHGPKQARDC

SEQ ID NO: 464831 - protein, 14 aa, Mycobacterium
EGGHHDGRRVAGGD

SEQ ID NO: 464832 - protein, 9 aa, Mycobacterium
EGGHPAGNL

SEQ ID NO: 464833 - protein, 18 aa, Mycobacterium
EGGIKGLSATEKAQVRSN

SEQ ID NO: 464834 - protein, 8 aa, Mycobacterium
EGGKAPYG

SEQ ID NO: 464835 - protein, 13 aa, Mycobacterium
EGGKRSTSVSSES

SEQ ID NO: 464836 - protein, 13 aa, Mycobacterium
EGGKVSNNKGMSL

SEQ ID NO: 464837 - protein, 14 aa, Mycobacterium
EGGKVTGERETDEG

SEQ ID NO: 464838 - protein, 9 aa, Mycobacterium
EGGLEGRGI

SEQ ID NO: 464839 - protein, 9 aa, Mycobacterium
EGGLGAKSW

SEQ ID NO: 464840 - protein, 34 aa, Mycobacterium
EGGLGGDGGGGGDTTAVGGNGGTGGVGGNGGNAS

SEQ ID NO: 464841 - protein, 7 aa, Mycobacterium
EGGLPSA

SEQ ID NO: 464842 - protein, 12 aa, Mycobacterium
EGGLTRTPGSVS

SEQ ID NO: 464843 - protein, 7 aa, Mycobacterium
EGGLTSS

SEQ ID NO: 464844 - protein, 4 aa, Mycobacterium
EGGM

SEQ ID NO: 464845 - protein, 6 aa, Mycobacterium
EGGNAI

SEQ ID NO: 464846 - protein, 6 aa, Mycobacterium
EGGNDA

SEQ ID NO: 464847 - protein, 6 aa, Mycobacterium
EGGNYD

SEQ ID NO: 464848 - protein, 21 aa, Mycobacterium
EGGPGMYDSGPFGEASGQPVP

SEQ ID NO: 464849 - protein, 8 aa, Mycobacterium
EGGPPGEI

SEQ ID NO: 464850 - protein, 8 aa, Mycobacterium
EGGPQRVA

SEQ ID NO: 464851 - protein, 5 aa, Mycobacterium
EGGPS

SEQ ID NO: 464852 - protein, 12 aa, Mycobacterium
EGGPSGRADPQV

SEQ ID NO: 464853 - protein, 15 aa, Mycobacterium
EGGPSLGKKSCGDLD

SEQ ID NO: 464854 - protein, 7 aa, Mycobacterium
EGGPSRH

SEQ ID NO: 464855 - protein, 10 aa, Mycobacterium
EGGPSRHHER

SEQ ID NO: 464856 - protein, 10 aa, Mycobacterium
EGGPSRHHQR

SEQ ID NO: 464857 - protein, 11 aa, Mycobacterium
EGGPSRNHERT

SEQ ID NO: 464858 - protein, 12 aa, Mycobacterium
EGGPTRAVGGTG

SEQ ID NO: 464859 - protein, 14 aa, Mycobacterium
EGGPVSNNKGLSLP

SEQ ID NO: 464860 - protein, 14 aa, Mycobacterium
EGGPVSNNKGVSLP

SEQ ID NO: 464861 - protein, 5 aa, Mycobacterium
EGGPW

SEQ ID NO: 464862 - protein, 5 aa, Mycobacterium
EGGQA

SEQ ID NO: 464863 - protein, 9 aa, Mycobacterium
EGGQGAGTV

SEQ ID NO: 464864 - protein, 11 aa, Mycobacterium
EGGQGPERRRR

SEQ ID NO: 464865 - protein, 7 aa, Mycobacterium
EGGQLTE

SEQ ID NO: 464866 - protein, 5 aa, Mycobacterium
EGGQS

SEQ ID NO: 464867 - protein, 8 aa, Mycobacterium
EGGQVQGP

SEQ ID NO: 464868 - protein, 9 aa, Mycobacterium
EGGRDGPRV

SEQ ID NO: 464869 - protein, 6 aa, Mycobacterium
EGGRFA

SEQ ID NO: 464870 - protein, 29 aa, Mycobacterium
EGGRGRTGKPPDSNIPVTGGFPGIGGATC

SEQ ID NO: 464871 - protein, 15 aa, Mycobacterium
EGGRLNPGSDPVAAQ

SEQ ID NO: 464872 - protein, 7 aa, Mycobacterium
EGGRNRQ

SEQ ID NO: 464873 - protein, 5 aa, Mycobacterium
EGGRR

SEQ ID NO: 464874 - protein, 6 aa, Mycobacterium
EGGRRK

SEQ ID NO: 464875 - protein, 5 aa, Mycobacterium
EGGRV

SEQ ID NO: 464876 - protein, 4 aa, Mycobacterium
EGGS

SEQ ID NO: 464877 - protein, 9 aa, Mycobacterium
EGGSAPGQA

SEQ ID NO: 464878 - protein, 6 aa, Mycobacterium
EGGSAR

SEQ ID NO: 464879 - protein, 5 aa, Mycobacterium
EGGSF

SEQ ID NO: 464880 - protein, 14 aa, Mycobacterium
EGGSGEADEEEYDE

SEQ ID NO: 464881 - protein, 11 aa, Mycobacterium
EGGSPADDAFN

SEQ ID NO: 464882 - protein, 14 aa, Mycobacterium
EGGSPVTTGDRVSA

SEQ ID NO: 464883 - protein, 25 aa, Mycobacterium
EGGSPVWASDTSGHSAGRAEVQSDG

SEQ ID NO: 464884 - protein, 6 aa, Mycobacterium
EGGSQN

SEQ ID NO: 464885 - protein, 5 aa, Mycobacterium
EGGST

SEQ ID NO: 464886 - protein, 6 aa, Mycobacterium
EGGSVV

SEQ ID NO: 464887 - protein, 4 aa, Mycobacterium
EGGT

SEQ ID NO: 464888 - protein, 8 aa, Mycobacterium
EGGTAGTV

SEQ ID NO: 464889 - protein, 5 aa, Mycobacterium
EGGTG

SEQ ID NO: 464890 - protein, 10 aa, Mycobacterium
EGGTGVSTNS

SEQ ID NO: 464891 - protein, 11 aa, Mycobacterium
EGGTKDADTLA

SEQ ID NO: 464892 - protein, 10 aa, Mycobacterium
EGGTKDAETL

SEQ ID NO: 464893 - protein, 10 aa, Mycobacterium
EGGTPEDPAR

SEQ ID NO: 464894 - protein, 6 aa, Mycobacterium
EGGTPL

SEQ ID NO: 464895 - protein, 7 aa, Mycobacterium
EGGTPLL

SEQ ID NO: 464896 - protein, 15 aa, Mycobacterium
EGGTQKDKPAAQARL

SEQ ID NO: 464897 - protein, 7 aa, Mycobacterium
EGGTTNL

SEQ ID NO: 464898 - protein, 5 aa, Mycobacterium
EGGTV

SEQ ID NO: 464899 - protein, 10 aa, Mycobacterium
EGGTVDPKQL

SEQ ID NO: 464900 - protein, 7 aa, Mycobacterium
EGGVADE

SEQ ID NO: 464901 - protein, 21 aa, Mycobacterium
EGGVGRPARAQPGGPTLTDDG

SEQ ID NO: 464902 - protein, 8 aa, Mycobacterium
EGGVPDDG

SEQ ID NO: 464903 - protein, 7 aa, Mycobacterium
EGGVPPC

SEQ ID NO: 464904 - protein, 9 aa, Mycobacterium
EGGVSEDDI

SEQ ID NO: 464905 - protein, 6 aa, Mycobacterium
EGGVTS

SEQ ID NO: 464906 - protein, 6 aa, Mycobacterium
EGGVYR

SEQ ID NO: 464907 - protein, 4 aa, Mycobacterium
EGGY

SEQ ID NO: 464908 - protein, 6 aa, Mycobacterium
EGGYPD

SEQ ID NO: 464909 - protein, 5 aa, Mycobacterium
EGGYQ

SEQ ID NO: 464910 - protein, 8 aa, Mycobacterium
EGGYQPPL

SEQ ID NO: 464911 - protein, 10 aa, Mycobacterium
EGGYTAPRSA

SEQ ID NO: 464912 - protein, 4 aa, Mycobacterium
EGHA

SEQ ID NO: 464913 - protein, 6 aa, Mycobacterium
EGHDPA

SEQ ID NO: 464914 - protein, 6 aa, Mycobacterium
EGHDQG

SEQ ID NO: 464915 - protein, 10 aa, Mycobacterium
EGHEDLPDQQ

SEQ ID NO: 464916 - protein, 5 aa, Mycobacterium
EGHEG

SEQ ID NO: 464917 - protein, 12 aa, Mycobacterium
EGHFSGGDGAGL

SEQ ID NO: 464918 - protein, 4 aa, Mycobacterium
EGHG

SEQ ID NO: 464919 - protein, 11 aa, Mycobacterium
EGHGGDARTWA

SEQ ID NO: 464920 - protein, 17 aa, Mycobacterium
EGHGGGSSTLPHKNNPV

SEQ ID NO: 464921 - protein, 6 aa, Mycobacterium
EGHGTG

SEQ ID NO: 464922 - protein, 7 aa, Mycobacterium
EGHGTGV

SEQ ID NO: 464923 - protein, 8 aa, Mycobacterium
EGHKLSDD

SEQ ID NO: 464924 - protein, 8 aa, Mycobacterium
EGHNPDGV

SEQ ID NO: 464925 - protein, 4 aa, Mycobacterium
EGHP

SEQ ID NO: 464926 - protein, 7 aa, Mycobacterium
EGHPDPM

SEQ ID NO: 464927 - protein, 46 aa, Mycobacterium
EGHPDRQAKEHRRRSRGPRRSAAAWGGGPGRCRGRRRPGRGGDAVE

SEQ ID NO: 464928 - protein, 6 aa, Mycobacterium
EGHPEI

SEQ ID NO: 464929 - protein, 5 aa, Mycobacterium
EGHPG

SEQ ID NO: 464930 - protein, 24 aa, Mycobacterium
EGHPNALGQRGESGWRAIGLPWKQ

SEQ ID NO: 464931 - protein, 14 aa, Mycobacterium
EGHPNRVGPAKRPY

SEQ ID NO: 464932 - protein, 12 aa, Mycobacterium
EGHPQRKDYPLG

SEQ ID NO: 464933 - protein, 9 aa, Mycobacterium
EGHQNSERR

SEQ ID NO: 464934 - protein, 5 aa, Mycobacterium
EGHRH

SEQ ID NO: 464935 - protein, 14 aa, Mycobacterium
EGHRPDASAITRGL

SEQ ID NO: 464936 - protein, 12 aa, Mycobacterium
EGHRPGSRGAHD

SEQ ID NO: 464937 - protein, 14 aa, Mycobacterium
EGHSAAKTGATINS

SEQ ID NO: 464938 - protein, 10 aa, Mycobacterium
EGHSDEQLQT

SEQ ID NO: 464939 - protein, 12 aa, Mycobacterium
EGHSETDDGRSI

SEQ ID NO: 464940 - protein, 13 aa, Mycobacterium
EGHSQRIASAGTG

SEQ ID NO: 464941 - protein, 7 aa, Mycobacterium
EGHTKDG

SEQ ID NO: 464942 - protein, 4 aa, Mycobacterium
EGIA

SEQ ID NO: 464943 - protein, 6 aa, Mycobacterium
EGIADP

SEQ ID NO: 464944 - protein, 12 aa, Mycobacterium
EGIAGVEQIVDK

SEQ ID NO: 464945 - protein, 6 aa, Mycobacterium
EGIAPE

SEQ ID NO: 464946 - protein, 11 aa, Mycobacterium
EGIAPLSSEQA

SEQ ID NO: 464947 - protein, 10 aa, Mycobacterium
EGIASGDRVS

SEQ ID NO: 464948 - protein, 11 aa, Mycobacterium
EGIASGDTVSA

SEQ ID NO: 464949 - protein, 7 aa, Mycobacterium
EGIATTP

SEQ ID NO: 464950 - protein, 16 aa, Mycobacterium
EGIDPLEGTPDKRTTT

SEQ ID NO: 464951 - protein, 6 aa, Mycobacterium
EGIDQR

SEQ ID NO: 464952 - protein, 6 aa, Mycobacterium
EGIDTR

SEQ ID NO: 464953 - protein, 6 aa, Mycobacterium
EGIDTS

SEQ ID NO: 464954 - protein, 4 aa, Mycobacterium
EGIE

SEQ ID NO: 464955 - protein, 6 aa, Mycobacterium
EGIERY

SEQ ID NO: 464956 - protein, 7 aa, Mycobacterium
EGIGADA

SEQ ID NO: 464957 - protein, 13 aa, Mycobacterium
EGIGEGSRLVAAN

SEQ ID NO: 464958 - protein, 10 aa, Mycobacterium
EGIGGHESFR

SEQ ID NO: 464959 - protein, 7 aa, Mycobacterium
EGIGPGD

SEQ ID NO: 464960 - protein, 9 aa, Mycobacterium
EGIGRPRVE

SEQ ID NO: 464961 - protein, 5 aa, Mycobacterium
EGIND

SEQ ID NO: 464962 - protein, 4 aa, Mycobacterium
EGIP

SEQ ID NO: 464963 - protein, 5 aa, Mycobacterium
EGIPD

SEQ ID NO: 464964 - protein, 5 aa, Mycobacterium
EGIPG

SEQ ID NO: 464965 - protein, 5 aa, Mycobacterium
EGIPR

SEQ ID NO: 464966 - protein, 5 aa, Mycobacterium
EGIPS

SEQ ID NO: 464967 - protein, 7 aa, Mycobacterium
EGIPTDG

SEQ ID NO: 464968 - protein, 4 aa, Mycobacterium
EGIR

SEQ ID NO: 464969 - protein, 12 aa, Mycobacterium
EGIRADTTAASL

SEQ ID NO: 464970 - protein, 13 aa, Mycobacterium
EGIRADTTAESLG

SEQ ID NO: 464971 - protein, 13 aa, Mycobacterium
EGIRANTTAESLA

SEQ ID NO: 464972 - protein, 13 aa, Mycobacterium
EGIRERGGTPTEI

SEQ ID NO: 464973 - protein, 12 aa, Mycobacterium
EGIRPDTTSDAL

SEQ ID NO: 464974 - protein, 9 aa, Mycobacterium
EGIRRGTTV

SEQ ID NO: 464975 - protein, 9 aa, Mycobacterium
EGIRRTGGS

SEQ ID NO: 464976 - protein, 21 aa, Mycobacterium
EGIRSSSSNPPLTLPEDPREI

SEQ ID NO: 464977 - protein, 4 aa, Mycobacterium
EGIS

SEQ ID NO: 464978 - protein, 11 aa, Mycobacterium
EGISARGRGMA

SEQ ID NO: 464979 - protein, 12 aa, Mycobacterium
EGISDATVAPTE

SEQ ID NO: 464980 - protein, 7 aa, Mycobacterium
EGISGAE

SEQ ID NO: 464981 - protein, 6 aa, Mycobacterium
EGISGR

SEQ ID NO: 464982 - protein, 12 aa, Mycobacterium
EGISPALQRADN

SEQ ID NO: 464983 - protein, 7 aa, Mycobacterium
EGISPSA

SEQ ID NO: 464984 - protein, 6 aa, Mycobacterium
EGISTE

SEQ ID NO: 464985 - protein, 4 aa, Mycobacterium
EGIT

SEQ ID NO: 464986 - protein, 6 aa, Mycobacterium
EGITAQ

SEQ ID NO: 464987 - protein, 21 aa, Mycobacterium
EGITDQATLEQQSREAGRRAT

SEQ ID NO: 464988 - protein, 5 aa, Mycobacterium
EGITS

SEQ ID NO: 464989 - protein, 5 aa, Mycobacterium
EGITT

SEQ ID NO: 464990 - protein, 14 aa, Mycobacterium
EGKAAEKARNPRES

SEQ ID NO: 464991 - protein, 10 aa, Mycobacterium
EGKAAGETAR

SEQ ID NO: 464992 - protein, 15 aa, Mycobacterium
EGKAAVRQRIKDRTC

SEQ ID NO: 464993 - protein, 6 aa, Mycobacterium
EGKADR

SEQ ID NO: 464994 - protein, 8 aa, Mycobacterium
EGKAGRDV

SEQ ID NO: 464995 - protein, 11 aa, Mycobacterium
EGKAPAEHAEL

SEQ ID NO: 464996 - protein, 5 aa, Mycobacterium
EGKAV

SEQ ID NO: 464997 - protein, 5 aa, Mycobacterium
EGKDG

SEQ ID NO: 464998 - protein, 16 aa, Mycobacterium
EGKDRPPCAAESVYLY

SEQ ID NO: 464999 - protein, 5 aa, Mycobacterium
EGKDV

SEQ ID NO: 465000 - protein, 5 aa, Mycobacterium
EGKEP

SEQ ID NO: 465001 - protein, 4 aa, Mycobacterium
EGKG

SEQ ID NO: 465002 - protein, 11 aa, Mycobacterium
EGKGENLTRDQ

SEQ ID NO: 465003 - protein, 9 aa, Mycobacterium
EGKGLTSPE

SEQ ID NO: 465004 - protein, 9 aa, Mycobacterium
EGKGPDPDA

SEQ ID NO: 465005 - protein, 9 aa, Mycobacterium
EGKGPDPGA

SEQ ID NO: 465006 - protein, 7 aa, Mycobacterium
EGKGRRA

SEQ ID NO: 465007 - protein, 8 aa, Mycobacterium
EGKGSGHE

SEQ ID NO: 465008 - protein, 4 aa, Mycobacterium
EGKI

SEQ ID NO: 465009 - protein, 5 aa, Mycobacterium
EGKIG

SEQ ID NO: 465010 - protein, 5 aa, Mycobacterium
EGKIT

SEQ ID NO: 465011 - protein, 9 aa, Mycobacterium
EGKKDGVEV

SEQ ID NO: 465012 - protein, 8 aa, Mycobacterium
EGKKLSAA

SEQ ID NO: 465013 - protein, 4 aa, Mycobacterium
EGKL

SEQ ID NO: 465014 - protein, 12 aa, Mycobacterium
EGKLPPDSAAWL

SEQ ID NO: 465015 - protein, 8 aa, Mycobacterium
EGKLSNKL

SEQ ID NO: 465016 - protein, 5 aa, Mycobacterium
EGKNA

SEQ ID NO: 465017 - protein, 10 aa, Mycobacterium
EGKNVGETTR

SEQ ID NO: 465018 - protein, 7 aa, Mycobacterium
EGKPAGV

SEQ ID NO: 465019 - protein, 12 aa, Mycobacterium
EGKPEMAAGEVE

SEQ ID NO: 465020 - protein, 5 aa, Mycobacterium
EGKPL

SEQ ID NO: 465021 - protein, 8 aa, Mycobacterium
EGKPLAQA

SEQ ID NO: 465022 - protein, 6 aa, Mycobacterium
EGKPLS

SEQ ID NO: 465023 - protein, 8 aa, Mycobacterium
EGKPLTTA

SEQ ID NO: 465024 - protein, 26 aa, Mycobacterium
EGKPPFANPRNSAAGSLRQKNPAVTA

SEQ ID NO: 465025 - protein, 27 aa, Mycobacterium
EGKPPFANPRNSAAGSLRQKNPAVTAR

SEQ ID NO: 465026 - protein, 9 aa, Mycobacterium
EGKPPREVP

SEQ ID NO: 465027 - protein, 9 aa, Mycobacterium
EGKPPRQVP

SEQ ID NO: 465028 - protein, 6 aa, Mycobacterium
EGKPSP

SEQ ID NO: 465029 - protein, 7 aa, Mycobacterium
EGKQSLT

SEQ ID NO: 465030 - protein, 4 aa, Mycobacterium
EGKR

SEQ ID NO: 465031 - protein, 6 aa, Mycobacterium
EGKRGM

SEQ ID NO: 465032 - protein, 15 aa, Mycobacterium
EGKRRAKARRERDAS

SEQ ID NO: 465033 - protein, 20 aa, Mycobacterium
EGKRRARARRKDDEAGADQT

SEQ ID NO: 465034 - protein, 7 aa, Mycobacterium
EGKRSYA

SEQ ID NO: 465035 - protein, 9 aa, Mycobacterium
EGKSADGRP

SEQ ID NO: 465036 - protein, 9 aa, Mycobacterium
EGKSVGESA

SEQ ID NO: 465037 - protein, 9 aa, Mycobacterium
EGKSVGETA

SEQ ID NO: 465038 - protein, 9 aa, Mycobacterium
EGKSVGTAA

SEQ ID NO: 465039 - protein, 6 aa, Mycobacterium
EGKSVR

SEQ ID NO: 465040 - protein, 8 aa, Mycobacterium
EGKTDPYY

SEQ ID NO: 465041 - protein, 6 aa, Mycobacterium
EGKTER

SEQ ID NO: 465042 - protein, 7 aa, Mycobacterium
EGKTKNE

SEQ ID NO: 465043 - protein, 5 aa, Mycobacterium
EGKTP

SEQ ID NO: 465044 - protein, 11 aa, Mycobacterium
EGKTPTREDAE

SEQ ID NO: 465045 - protein, 7 aa, Mycobacterium
EGKWTDS

SEQ ID NO: 465046 - protein, 12 aa, Mycobacterium
EGLAAGRDEARR

SEQ ID NO: 465047 - protein, 10 aa, Mycobacterium
EGLAKGEWTP

SEQ ID NO: 465048 - protein, 10 aa, Mycobacterium
EGLAPAADLE

SEQ ID NO: 465049 - protein, 22 aa, Mycobacterium
EGLAPNPDATSTSLPGARGADV

SEQ ID NO: 465050 - protein, 6 aa, Mycobacterium
EGLAQA

SEQ ID NO: 465051 - protein, 13 aa, Mycobacterium
EGLATGRDEAQRL

SEQ ID NO: 465052 - protein, 5 aa, Mycobacterium
EGLDP

SEQ ID NO: 465053 - protein, 8 aa, Mycobacterium
EGLEQPRS

SEQ ID NO: 465054 - protein, 8 aa, Mycobacterium
EGLEQSKG

SEQ ID NO: 465055 - protein, 5 aa, Mycobacterium
EGLES

SEQ ID NO: 465056 - protein, 4 aa, Mycobacterium
EGLG

SEQ ID NO: 465057 - protein, 11 aa, Mycobacterium
EGLGDGIDRKK

SEQ ID NO: 465058 - protein, 7 aa, Mycobacterium
EGLGDGP

SEQ ID NO: 465059 - protein, 11 aa, Mycobacterium
EGLGDRDLGAV

SEQ ID NO: 465060 - protein, 10 aa, Mycobacterium
EGLGNTPAVA

SEQ ID NO: 465061 - protein, 5 aa, Mycobacterium
EGLGY

SEQ ID NO: 465062 - protein, 11 aa, Mycobacterium
EGLKEEGNVDA

SEQ ID NO: 465063 - protein, 18 aa, Mycobacterium
EGLKSEDPQAVLSHGSGE

SEQ ID NO: 465064 - protein, 4 aa, Mycobacterium
EGLL

SEQ ID NO: 465065 - protein, 4 aa, Mycobacterium
EGLN

SEQ ID NO: 465066 - protein, 5 aa, Mycobacterium
EGLPA

SEQ ID NO: 465067 - protein, 10 aa, Mycobacterium
EGLPADSTAL

SEQ ID NO: 465068 - protein, 14 aa, Mycobacterium
EGLPDGAQADAPQA

SEQ ID NO: 465069 - protein, 17 aa, Mycobacterium
EGLPEPRHSANADSAAI

SEQ ID NO: 465070 - protein, 13 aa, Mycobacterium
EGLPESNWPPDAV

SEQ ID NO: 465071 - protein, 6 aa, Mycobacterium
EGLPGL

SEQ ID NO: 465072 - protein, 8 aa, Mycobacterium
EGLPGNAR

SEQ ID NO: 465073 - protein, 8 aa, Mycobacterium
EGLPGQTS

SEQ ID NO: 465074 - protein, 7 aa, Mycobacterium
EGLPPGE

SEQ ID NO: 465075 - protein, 4 aa, Mycobacterium
EGLQ

SEQ ID NO: 465076 - protein, 6 aa, Mycobacterium
EGLQDA

SEQ ID NO: 465077 - protein, 5 aa, Mycobacterium
EGLQE

SEQ ID NO: 465078 - protein, 6 aa, Mycobacterium
EGLRSR

SEQ ID NO: 465079 - protein, 15 aa, Mycobacterium
EGLSAQQSDEEFNST

SEQ ID NO: 465080 - protein, 20 aa, Mycobacterium
EGLSEGESALGESAATLSSA

SEQ ID NO: 465081 - protein, 10 aa, Mycobacterium
EGLSPSQDEI

SEQ ID NO: 465082 - protein, 4 aa, Mycobacterium
EGLT

SEQ ID NO: 465083 - protein, 12 aa, Mycobacterium
EGLTDDDIDGIG

SEQ ID NO: 465084 - protein, 6 aa, Mycobacterium
EGLTDE

SEQ ID NO: 465085 - protein, 18 aa, Mycobacterium
EGLTDEQVRAASVDPSQM

SEQ ID NO: 465086 - protein, 8 aa, Mycobacterium
EGLTDPEE

SEQ ID NO: 465087 - protein, 5 aa, Mycobacterium
EGLTE

SEQ ID NO: 465088 - protein, 7 aa, Mycobacterium
EGLTEEV

SEQ ID NO: 465089 - protein, 7 aa, Mycobacterium
EGLTEND

SEQ ID NO: 465090 - protein, 5 aa, Mycobacterium
EGLTI

SEQ ID NO: 465091 - protein, 18 aa, Mycobacterium
EGLTPCEPGSAANGAGTL

SEQ ID NO: 465092 - protein, 8 aa, Mycobacterium
EGLTPEGD

SEQ ID NO: 465093 - protein, 6 aa, Mycobacterium
EGLTTP

SEQ ID NO: 465094 - protein, 13 aa, Mycobacterium
EGLTTPQIRENDP

SEQ ID NO: 465095 - protein, 4 aa, Mycobacterium
EGMD

SEQ ID NO: 465096 - protein, 18 aa, Mycobacterium
EGMGGDDARSPRRGSENV

SEQ ID NO: 465097 - protein, 5 aa, Mycobacterium
EGMQQ

SEQ ID NO: 465098 - protein, 11 aa, Mycobacterium
EGMSAEAAERQ

SEQ ID NO: 465099 - protein, 18 aa, Mycobacterium
EGMTPCQPAGAANAAGTL

SEQ ID NO: 465100 - protein, 18 aa, Mycobacterium
EGNADKAVTSAAAVFDIA

SEQ ID NO: 465101 - protein, 18 aa, Mycobacterium
EGNADKAVTSAAAVFEVV

SEQ ID NO: 465102 - protein, 7 aa, Mycobacterium
EGNASTL

SEQ ID NO: 465103 - protein, 14 aa, Mycobacterium
EGNATSSPQEAEAI

SEQ ID NO: 465104 - protein, 9 aa, Mycobacterium
EGNDAGEGL

SEQ ID NO: 465105 - protein, 6 aa, Mycobacterium
EGNDDR

SEQ ID NO: 465106 - protein, 9 aa, Mycobacterium
EGNDDTGNA

SEQ ID NO: 465107 - protein, 11 aa, Mycobacterium
EGNDLNPKQQQ

SEQ ID NO: 465108 - protein, 11 aa, Mycobacterium
EGNDNAMTDRE

SEQ ID NO: 465109 - protein, 5 aa, Mycobacterium
EGNDR

SEQ ID NO: 465110 - protein, 15 aa, Mycobacterium
EGNEAARSLNRGTVG

SEQ ID NO: 465111 - protein, 7 aa, Mycobacterium
EGNGDRD

SEQ ID NO: 465112 - protein, 9 aa, Mycobacterium
EGNGPTDDV

SEQ ID NO: 465113 - protein, 5 aa, Mycobacterium
EGNGR

SEQ ID NO: 465114 - protein, 7 aa, Mycobacterium
EGNGSRR

SEQ ID NO: 465115 - protein, 5 aa, Mycobacterium
EGNIA

SEQ ID NO: 465116 - protein, 5 aa, Mycobacterium
EGNKL

SEQ ID NO: 465117 - protein, 4 aa, Mycobacterium
EGNL

SEQ ID NO: 465118 - protein, 5 aa, Mycobacterium
EGNNL

SEQ ID NO: 465119 - protein, 8 aa, Mycobacterium
EGNPPDPA

SEQ ID NO: 465120 - protein, 9 aa, Mycobacterium
EGNPPDPAV

SEQ ID NO: 465121 - protein, 11 aa, Mycobacterium
EGNRPKVAAAP

SEQ ID NO: 465122 - protein, 7 aa, Mycobacterium
EGNRYGT

SEQ ID NO: 465123 - protein, 4 aa, Mycobacterium
EGNV

SEQ ID NO: 465124 - protein, 5 aa, Mycobacterium
EGNVD

SEQ ID NO: 465125 - protein, 9 aa, Mycobacterium
EGNVDGPVK

SEQ ID NO: 465126 - protein, 25 aa, Mycobacterium
EGNYPTREACQNAGPGVKATAPGSW

SEQ ID NO: 465127 - protein, 4 aa, Mycobacterium
EGPA

SEQ ID NO: 465128 - protein, 29 aa, Mycobacterium
EGPAATGPARTQPAAPGPADPAAPVGDRP

SEQ ID NO: 465129 - protein, 7 aa, Mycobacterium
EGPAEPL

SEQ ID NO: 465130 - protein, 14 aa, Mycobacterium
EGPAEVPPVQPSPD

SEQ ID NO: 465131 - protein, 7 aa, Mycobacterium
EGPAFSA

SEQ ID NO: 465132 - protein, 8 aa, Mycobacterium
EGPAGAAW

SEQ ID NO: 465133 - protein, 6 aa, Mycobacterium
EGPAGG

SEQ ID NO: 465134 - protein, 37 aa, Mycobacterium
EGPAGGIGGLPSSAAAAPGGGGASTISSGIGSGGGLF

SEQ ID NO: 465135 - protein, 6 aa, Mycobacterium
EGPAHG

SEQ ID NO: 465136 - protein, 7 aa, Mycobacterium
EGPAPAF

SEQ ID NO: 465137 - protein, 8 aa, Mycobacterium
EGPAPDQD

SEQ ID NO: 465138 - protein, 8 aa, Mycobacterium
EGPAPTHE

SEQ ID NO: 465139 - protein, 5 aa, Mycobacterium
EGPAR

SEQ ID NO: 465140 - protein, 8 aa, Mycobacterium
EGPARATD

SEQ ID NO: 465141 - protein, 8 aa, Mycobacterium
EGPATAAQ

SEQ ID NO: 465142 - protein, 9 aa, Mycobacterium
EGPATPAQI

SEQ ID NO: 465143 - protein, 12 aa, Mycobacterium
EGPDAEGLTDRQ

SEQ ID NO: 465144 - protein, 7 aa, Mycobacterium
EGPDDDW

SEQ ID NO: 465145 - protein, 6 aa, Mycobacterium
EGPDDQ

SEQ ID NO: 465146 - protein, 5 aa, Mycobacterium
EGPDG

SEQ ID NO: 465147 - protein, 12 aa, Mycobacterium
EGPDGEPVGTTR

SEQ ID NO: 465148 - protein, 6 aa, Mycobacterium
EGPDGL

SEQ ID NO: 465149 - protein, 18 aa, Mycobacterium
EGPDGNTDFSGDPNHPKI

SEQ ID NO: 465150 - protein, 8 aa, Mycobacterium
EGPDGQRY

SEQ ID NO: 465151 - protein, 9 aa, Mycobacterium
EGPDGSPGV

SEQ ID NO: 465152 - protein, 8 aa, Mycobacterium
EGPDHNAA

SEQ ID NO: 465153 - protein, 7 aa, Mycobacterium
EGPDHSA

SEQ ID NO: 465154 - protein, 6 aa, Mycobacterium
EGPDSA

SEQ ID NO: 465155 - protein, 5 aa, Mycobacterium
EGPDV

SEQ ID NO: 465156 - protein, 6 aa, Mycobacterium
EGPDYR

SEQ ID NO: 465157 - protein, 7 aa, Mycobacterium
EGPDYSA

SEQ ID NO: 465158 - protein, 6 aa, Mycobacterium
EGPDYV

SEQ ID NO: 465159 - protein, 4 aa, Mycobacterium
EGPE

SEQ ID NO: 465160 - protein, 12 aa, Mycobacterium
EGPERDAEDGEP

SEQ ID NO: 465161 - protein, 5 aa, Mycobacterium
EGPET

SEQ ID NO: 465162 - protein, 18 aa, Mycobacterium
EGPEVDGPYGPYRQSQRT

SEQ ID NO: 465163 - protein, 8 aa, Mycobacterium
EGPEVESE

SEQ ID NO: 465164 - protein, 7 aa, Mycobacterium
EGPEVET

SEQ ID NO: 465165 - protein, 18 aa, Mycobacterium
EGPEVGGPYAPYRQSQRR

SEQ ID NO: 465166 - protein, 20 aa, Mycobacterium
EGPEVGGPYEPYRQSQRKEL

SEQ ID NO: 465167 - protein, 19 aa, Mycobacterium
EGPEVGGPYEPYRQSQRRE

SEQ ID NO: 465168 - protein, 14 aa, Mycobacterium
EGPEVGGPYGPYRQ

SEQ ID NO: 465169 - protein, 20 aa, Mycobacterium
EGPEVGGPYGPYRQSQRKDI

SEQ ID NO: 465170 - protein, 19 aa, Mycobacterium
EGPEVGGPYGPYRQSQRRE

SEQ ID NO: 465171 - protein, 11 aa, Mycobacterium
EGPFENPERRA

SEQ ID NO: 465172 - protein, 16 aa, Mycobacterium
EGPFGPDGTGETPPEV

SEQ ID NO: 465173 - protein, 4 aa, Mycobacterium
EGPG

SEQ ID NO: 465174 - protein, 15 aa, Mycobacterium
EGPGITADARAGASV

SEQ ID NO: 465175 - protein, 10 aa, Mycobacterium
EGPGITDDTR

SEQ ID NO: 465176 - protein, 15 aa, Mycobacterium
EGPGITDDTRSGATL

SEQ ID NO: 465177 - protein, 14 aa, Mycobacterium
EGPGITDDVRSGAA

SEQ ID NO: 465178 - protein, 14 aa, Mycobacterium
EGPGITPEAQAGAA

SEQ ID NO: 465179 - protein, 6 aa, Mycobacterium
EGPGLK

SEQ ID NO: 465180 - protein, 9 aa, Mycobacterium
EGPGLTERT

SEQ ID NO: 465181 - protein, 8 aa, Mycobacterium
EGPGLTPA

SEQ ID NO: 465182 - protein, 9 aa, Mycobacterium
EGPGPNGQY

SEQ ID NO: 465183 - protein, 14 aa, Mycobacterium
EGPGPSDKRGADEY

SEQ ID NO: 465184 - protein, 7 aa, Mycobacterium
EGPGPVN

SEQ ID NO: 465185 - protein, 5 aa, Mycobacterium
EGPGR

SEQ ID NO: 465186 - protein, 9 aa, Mycobacterium
EGPGTPAGK

SEQ ID NO: 465187 - protein, 14 aa, Mycobacterium
EGPGVTDASKSGAV

SEQ ID NO: 465188 - protein, 7 aa, Mycobacterium
EGPHGAP

SEQ ID NO: 465189 - protein, 9 aa, Mycobacterium
EGPKGNPIY

SEQ ID NO: 465190 - protein, 5 aa, Mycobacterium
EGPLA

SEQ ID NO: 465191 - protein, 10 aa, Mycobacterium
EGPLNRATAT

SEQ ID NO: 465192 - protein, 18 aa, Mycobacterium
EGPLPPDAVRCPPISFLC

SEQ ID NO: 465193 - protein, 15 aa, Mycobacterium
EGPLRDATAGRSVSI

SEQ ID NO: 465194 - protein, 24 aa, Mycobacterium
EGPLRPGEGPLRPGEGPLRPGEGP

SEQ ID NO: 465195 - protein, 6 aa, Mycobacterium
EGPLSA

SEQ ID NO: 465196 - protein, 9 aa, Mycobacterium
EGPNAQLHT

SEQ ID NO: 465197 - protein, 7 aa, Mycobacterium
EGPNGLE

SEQ ID NO: 465198 - protein, 8 aa, Mycobacterium
EGPNGPVE

SEQ ID NO: 465199 - protein, 10 aa, Mycobacterium
EGPNGPVPEA

SEQ ID NO: 465200 - protein, 10 aa, Mycobacterium
EGPPDDPAAA

SEQ ID NO: 465201 - protein, 6 aa, Mycobacterium
EGPPGH

SEQ ID NO: 465202 - protein, 6 aa, Mycobacterium
EGPPLY

SEQ ID NO: 465203 - protein, 6 aa, Mycobacterium
EGPPPE

SEQ ID NO: 465204 - protein, 5 aa, Mycobacterium
EGPPS

SEQ ID NO: 465205 - protein, 5 aa, Mycobacterium
EGPPT

SEQ ID NO: 465206 - protein, 8 aa, Mycobacterium
EGPPTAAV

SEQ ID NO: 465207 - protein, 6 aa, Mycobacterium
EGPQDA

SEQ ID NO: 465208 - protein, 7 aa, Mycobacterium
EGPQPDY

SEQ ID NO: 465209 - protein, 18 aa, Mycobacterium
EGPQPVTDANGLAQGGVR

SEQ ID NO: 465210 - protein, 7 aa, Mycobacterium
EGPRAAG

SEQ ID NO: 465211 - protein, 9 aa, Mycobacterium
EGPRASITN

SEQ ID NO: 465212 - protein, 6 aa, Mycobacterium
EGPRAV

SEQ ID NO: 465213 - protein, 12 aa, Mycobacterium
EGPRDGPGPGLA

SEQ ID NO: 465214 - protein, 9 aa, Mycobacterium
EGPRGGPGM

SEQ ID NO: 465215 - protein, 6 aa, Mycobacterium
EGPRNV

SEQ ID NO: 465216 - protein, 11 aa, Mycobacterium
EGPRQRSPEGL

SEQ ID NO: 465217 - protein, 6 aa, Mycobacterium
EGPRVT

SEQ ID NO: 465218 - protein, 4 aa, Mycobacterium
EGPS

SEQ ID NO: 465219 - protein, 18 aa, Mycobacterium
EGPSDDTGVNELRSRQQR

SEQ ID NO: 465220 - protein, 6 aa, Mycobacterium
EGPSEV

SEQ ID NO: 465221 - protein, 9 aa, Mycobacterium
EGPSKPPTV

SEQ ID NO: 465222 - protein, 19 aa, Mycobacterium
EGPSSASALAGAEQVRPQS

SEQ ID NO: 465223 - protein, 5 aa, Mycobacterium
EGPST

SEQ ID NO: 465224 - protein, 11 aa, Mycobacterium
EGPSYTRPPSW

SEQ ID NO: 465225 - protein, 8 aa, Mycobacterium
EGPTDDPD

SEQ ID NO: 465226 - protein, 8 aa, Mycobacterium
EGPTDGPP

SEQ ID NO: 465227 - protein, 10 aa, Mycobacterium
EGPTENGHRP

SEQ ID NO: 465228 - protein, 6 aa, Mycobacterium
EGPTEY

SEQ ID NO: 465229 - protein, 8 aa, Mycobacterium
EGPTGGVH

SEQ ID NO: 465230 - protein, 8 aa, Mycobacterium
EGPTHAAG

SEQ ID NO: 465231 - protein, 9 aa, Mycobacterium
EGPVNSTYA

SEQ ID NO: 465232 - protein, 13 aa, Mycobacterium
EGPVPKTGALGPM

SEQ ID NO: 465233 - protein, 5 aa, Mycobacterium
EGPVT

SEQ ID NO: 465234 - protein, 6 aa, Mycobacterium
EGPVTE

SEQ ID NO: 465235 - protein, 10 aa, Mycobacterium
EGPVTGTREA

SEQ ID NO: 465236 - protein, 8 aa, Mycobacterium
EGPVTSPS

SEQ ID NO: 465237 - protein, 8 aa, Mycobacterium
EGPVTSPT

SEQ ID NO: 465238 - protein, 8 aa, Mycobacterium
EGQAARNH

SEQ ID NO: 465239 - protein, 6 aa, Mycobacterium
EGQAAV

SEQ ID NO: 465240 - protein, 10 aa, Mycobacterium
EGQADGSIRP

SEQ ID NO: 465241 - protein, 11 aa, Mycobacterium
EGQADGSIRPD

SEQ ID NO: 465242 - protein, 8 aa, Mycobacterium
EGQAGDTA

SEQ ID NO: 465243 - protein, 6 aa, Mycobacterium
EGQAHG

SEQ ID NO: 465244 - protein, 12 aa, Mycobacterium
EGQAPQWDPQPV

SEQ ID NO: 465245 - protein, 6 aa, Mycobacterium
EGQAVE

SEQ ID NO: 465246 - protein, 8 aa, Mycobacterium
EGQAVEKT

SEQ ID NO: 465247 - protein, 5 aa, Mycobacterium
EGQCR

SEQ ID NO: 465248 - protein, 11 aa, Mycobacterium
EGQDADPKEQA

SEQ ID NO: 465249 - protein, 16 aa, Mycobacterium
EGQDPESLADAIGRLW

SEQ ID NO: 465250 - protein, 11 aa, Mycobacterium
EGQDPGPQASA

SEQ ID NO: 465251 - protein, 5 aa, Mycobacterium
EGQDR

SEQ ID NO: 465252 - protein, 8 aa, Mycobacterium
EGQEGDRG

SEQ ID NO: 465253 - protein, 7 aa, Mycobacterium
EGQEPPR

SEQ ID NO: 465254 - protein, 10 aa, Mycobacterium
EGQEQRAQGA

SEQ ID NO: 465255 - protein, 4 aa, Mycobacterium
EGQG

SEQ ID NO: 465256 - protein, 9 aa, Mycobacterium
EGQGERSDG

SEQ ID NO: 465257 - protein, 15 aa, Mycobacterium
EGQGISIGTPPEGLE

SEQ ID NO: 465258 - protein, 9 aa, Mycobacterium
EGQGRPGDD

SEQ ID NO: 465259 - protein, 5 aa, Mycobacterium
EGQGV

SEQ ID NO: 465260 - protein, 8 aa, Mycobacterium
EGQKSTHG

SEQ ID NO: 465261 - protein, 5 aa, Mycobacterium
EGQKT

SEQ ID NO: 465262 - protein, 8 aa, Mycobacterium
EGQKTSRR

SEQ ID NO: 465263 - protein, 6 aa, Mycobacterium
EGQPAR

SEQ ID NO: 465264 - protein, 9 aa, Mycobacterium
EGQPDRIGE

SEQ ID NO: 465265 - protein, 11 aa, Mycobacterium
EGQPFGGDTAA

SEQ ID NO: 465266 - protein, 5 aa, Mycobacterium
EGQPG

SEQ ID NO: 465267 - protein, 21 aa, Mycobacterium
EGQPGWSSSEDIEEASEARAL

SEQ ID NO: 465268 - protein, 8 aa, Mycobacterium
EGQPPAPS

SEQ ID NO: 465269 - protein, 20 aa, Mycobacterium
EGQPTWSDKPEAEAAAEARA

SEQ ID NO: 465270 - protein, 10 aa, Mycobacterium
EGQPVAGDAR

SEQ ID NO: 465271 - protein, 17 aa, Mycobacterium
EGQQRHPSDNRDEPERA

SEQ ID NO: 465272 - protein, 6 aa, Mycobacterium
EGQQTL

SEQ ID NO: 465273 - protein, 8 aa, Mycobacterium
EGQRATSH

SEQ ID NO: 465274 - protein, 17 aa, Mycobacterium
EGQRPAQEELIADYSPW

SEQ ID NO: 465275 - protein, 7 aa, Mycobacterium
EGQRPKA

SEQ ID NO: 465276 - protein, 7 aa, Mycobacterium
EGQRPRA

SEQ ID NO: 465277 - protein, 5 aa, Mycobacterium
EGQRV

SEQ ID NO: 465278 - protein, 5 aa, Mycobacterium
EGQSE

SEQ ID NO: 465279 - protein, 11 aa, Mycobacterium
EGQSPSTKSAK

SEQ ID NO: 465280 - protein, 4 aa, Mycobacterium
EGQT

SEQ ID NO: 465281 - protein, 7 aa, Mycobacterium
EGQTASQ

SEQ ID NO: 465282 - protein, 11 aa, Mycobacterium
EGQTKQGTNDD

SEQ ID NO: 465283 - protein, 12 aa, Mycobacterium
EGQTPSTKSAKT

SEQ ID NO: 465284 - protein, 13 aa, Mycobacterium
EGQVQSTEHLADG

SEQ ID NO: 465285 - protein, 6 aa, Mycobacterium
EGQYEA

SEQ ID NO: 465286 - protein, 6 aa, Mycobacterium
EGRAAA

SEQ ID NO: 465287 - protein, 12 aa, Mycobacterium
EGRAADPELRGP

SEQ ID NO: 465288 - protein, 8 aa, Mycobacterium
EGRAANPD

SEQ ID NO: 465289 - protein, 5 aa, Mycobacterium
EGRAD

SEQ ID NO: 465290 - protein, 5 aa, Mycobacterium
EGRAE

SEQ ID NO: 465291 - protein, 5 aa, Mycobacterium
EGRAG

SEQ ID NO: 465292 - protein, 5 aa, Mycobacterium
EGRAL

SEQ ID NO: 465293 - protein, 15 aa, Mycobacterium
EGRAPVRRSGATPGS

SEQ ID NO: 465294 - protein, 11 aa, Mycobacterium
EGRARPNPESI

SEQ ID NO: 465295 - protein, 6 aa, Mycobacterium
EGRARQ

SEQ ID NO: 465296 - protein, 8 aa, Mycobacterium
EGRASRED

SEQ ID NO: 465297 - protein, 16 aa, Mycobacterium
EGRASRRTQAQRSAEM

SEQ ID NO: 465298 - protein, 6 aa, Mycobacterium
EGRASV

SEQ ID NO: 465299 - protein, 7 aa, Mycobacterium
EGRAVAS

SEQ ID NO: 465300 - protein, 4 aa, Mycobacterium
EGRC

SEQ ID NO: 465301 - protein, 5 aa, Mycobacterium
EGRDA

SEQ ID NO: 465302 - protein, 7 aa, Mycobacterium
EGRDAEI

SEQ ID NO: 465303 - protein, 5 aa, Mycobacterium
EGRDD

SEQ ID NO: 465304 - protein, 8 aa, Mycobacterium
EGRDEDEV

SEQ ID NO: 465305 - protein, 5 aa, Mycobacterium
EGRDG

SEQ ID NO: 465306 - protein, 13 aa, Mycobacterium
EGRDGDPRVTDDG

SEQ ID NO: 465307 - protein, 6 aa, Mycobacterium
EGRDGQ

SEQ ID NO: 465308 - protein, 6 aa, Mycobacterium
EGRDGR

SEQ ID NO: 465309 - protein, 6 aa, Mycobacterium
EGRDGY

SEQ ID NO: 465310 - protein, 9 aa, Mycobacterium
EGRDNLPER

SEQ ID NO: 465311 - protein, 19 aa, Mycobacterium
EGRDRRGDEPESSARPLKE

SEQ ID NO: 465312 - protein, 11 aa, Mycobacterium
EGRDTASMPRA

SEQ ID NO: 465313 - protein, 11 aa, Mycobacterium
EGRDTSNMPRA

SEQ ID NO: 465314 - protein, 11 aa, Mycobacterium
EGRDTTSMPRA

SEQ ID NO: 465315 - protein, 8 aa, Mycobacterium
EGRDVESA

SEQ ID NO: 465316 - protein, 7 aa, Mycobacterium
EGREAAV

SEQ ID NO: 465317 - protein, 14 aa, Mycobacterium
EGREARARTRLTEG

SEQ ID NO: 465318 - protein, 5 aa, Mycobacterium
EGREL

SEQ ID NO: 465319 - protein, 10 aa, Mycobacterium
EGRELPPGEV

SEQ ID NO: 465320 - protein, 8 aa, Mycobacterium
EGRENDDI

SEQ ID NO: 465321 - protein, 8 aa, Mycobacterium
EGREQEHY

SEQ ID NO: 465322 - protein, 8 aa, Mycobacterium
EGRERHRA

SEQ ID NO: 465323 - protein, 11 aa, Mycobacterium
EGRESDARAEV

SEQ ID NO: 465324 - protein, 5 aa, Mycobacterium
EGREV

SEQ ID NO: 465325 - protein, 7 aa, Mycobacterium
EGREVTP

SEQ ID NO: 465326 - protein, 12 aa, Mycobacterium
EGRFTSDESRTL

SEQ ID NO: 465327 - protein, 14 aa, Mycobacterium
EGRGDSTVASPVDA

SEQ ID NO: 465328 - protein, 15 aa, Mycobacterium
EGRGEYTTGRGPTPF

SEQ ID NO: 465329 - protein, 8 aa, Mycobacterium
EGRGGRQA

SEQ ID NO: 465330 - protein, 6 aa, Mycobacterium
EGRGGS

SEQ ID NO: 465331 - protein, 9 aa, Mycobacterium
EGRGHLSAD

SEQ ID NO: 465332 - protein, 5 aa, Mycobacterium
EGRGL

SEQ ID NO: 465333 - protein, 7 aa, Mycobacterium
EGRGQEA

SEQ ID NO: 465334 - protein, 7 aa, Mycobacterium
EGRGSVN

SEQ ID NO: 465335 - protein, 6 aa, Mycobacterium
EGRGVP

SEQ ID NO: 465336 - protein, 5 aa, Mycobacterium
EGRGW

SEQ ID NO: 465337 - protein, 4 aa, Mycobacterium
EGRH

SEQ ID NO: 465338 - protein, 19 aa, Mycobacterium
EGRHDDVPTPRVNELDLRS

SEQ ID NO: 465339 - protein, 24 aa, Mycobacterium
EGRHTFGSARTRRSLSKQPDGPFG

SEQ ID NO: 465340 - protein, 4 aa, Mycobacterium
EGRI

SEQ ID NO: 465341 - protein, 22 aa, Mycobacterium
EGRIRPAGQREVDAAKADGRWD

SEQ ID NO: 465342 - protein, 4 aa, Mycobacterium
EGRK

SEQ ID NO: 465343 - protein, 18 aa, Mycobacterium
EGRKNATTARISGRARDG

SEQ ID NO: 465344 - protein, 8 aa, Mycobacterium
EGRKPGAS

SEQ ID NO: 465345 - protein, 9 aa, Mycobacterium
EGRKPGATS

SEQ ID NO: 465346 - protein, 7 aa, Mycobacterium
EGRKPGS

SEQ ID NO: 465347 - protein, 8 aa, Mycobacterium
EGRKPRSR

SEQ ID NO: 465348 - protein, 7 aa, Mycobacterium
EGRLAEP

SEQ ID NO: 465349 - protein, 5 aa, Mycobacterium
EGRLG

SEQ ID NO: 465350 - protein, 6 aa, Mycobacterium
EGRLPR

SEQ ID NO: 465351 - protein, 6 aa, Mycobacterium
EGRLSA

SEQ ID NO: 465352 - protein, 14 aa, Mycobacterium
EGRLTDTRSDLDSA

SEQ ID NO: 465353 - protein, 6 aa, Mycobacterium
EGRLTG

SEQ ID NO: 465354 - protein, 10 aa, Mycobacterium
EGRNPGTASS

SEQ ID NO: 465355 - protein, 5 aa, Mycobacterium
EGRNR

SEQ ID NO: 465356 - protein, 12 aa, Mycobacterium
EGRNTASKNTFR

SEQ ID NO: 465357 - protein, 5 aa, Mycobacterium
EGRPA

SEQ ID NO: 465358 - protein, 7 aa, Mycobacterium
EGRPDAD

SEQ ID NO: 465359 - protein, 8 aa, Mycobacterium
EGRPDDAA

SEQ ID NO: 465360 - protein, 16 aa, Mycobacterium
EGRPDPLDGPAAGAGL

SEQ ID NO: 465361 - protein, 17 aa, Mycobacterium
EGRPEDTADNDQKPCGH

SEQ ID NO: 465362 - protein, 7 aa, Mycobacterium
EGRPETL

SEQ ID NO: 465363 - protein, 5 aa, Mycobacterium
EGRPF

SEQ ID NO: 465364 - protein, 8 aa, Mycobacterium
EGRPFTGS

SEQ ID NO: 465365 - protein, 10 aa, Mycobacterium
EGRPGRRPLS

SEQ ID NO: 465366 - protein, 5 aa, Mycobacterium
EGRPL

SEQ ID NO: 465367 - protein, 5 aa, Mycobacterium
EGRPP

SEQ ID NO: 465368 - protein, 9 aa, Mycobacterium
EGRPPNGAV

SEQ ID NO: 465369 - protein, 17 aa, Mycobacterium
EGRPPVTRGGAKPGSSV

SEQ ID NO: 465370 - protein, 7 aa, Mycobacterium
EGRPQDV

SEQ ID NO: 465371 - protein, 7 aa, Mycobacterium
EGRPSTD

SEQ ID NO: 465372 - protein, 7 aa, Mycobacterium
EGRPTIK

SEQ ID NO: 465373 - protein, 6 aa, Mycobacterium
EGRPTL

SEQ ID NO: 465374 - protein, 4 aa, Mycobacterium
EGRQ

SEQ ID NO: 465375 - protein, 10 aa, Mycobacterium
EGRQLRSTDG

SEQ ID NO: 465376 - protein, 8 aa, Mycobacterium
EGRQPLPA

SEQ ID NO: 465377 - protein, 23 aa, Mycobacterium
EGRQRRPLPTGLGAPSSDPTAEL

SEQ ID NO: 465378 - protein, 23 aa, Mycobacterium
EGRQRRPLPTGLGTSSADPTAEL

SEQ ID NO: 465379 - protein, 9 aa, Mycobacterium
EGRRGAQRA

SEQ ID NO: 465380 - protein, 11 aa, Mycobacterium
EGRRGISNTPR

SEQ ID NO: 465381 - protein, 11 aa, Mycobacterium
EGRRGQPRLRP

SEQ ID NO: 465382 - protein, 8 aa, Mycobacterium
EGRRKGVS

SEQ ID NO: 465383 - protein, 5 aa, Mycobacterium
EGRRP

SEQ ID NO: 465384 - protein, 7 aa, Mycobacterium
EGRRQPH

SEQ ID NO: 465385 - protein, 15 aa, Mycobacterium
EGRRTKSVVVIRPAT

SEQ ID NO: 465386 - protein, 6 aa, Mycobacterium
EGRRTL

SEQ ID NO: 465387 - protein, 6 aa, Mycobacterium
EGRRVN

SEQ ID NO: 465388 - protein, 7 aa, Mycobacterium
EGRSDGV

SEQ ID NO: 465389 - protein, 11 aa, Mycobacterium
EGRSDIRQRRA

SEQ ID NO: 465390 - protein, 8 aa, Mycobacterium
EGRSNTGI

SEQ ID NO: 465391 - protein, 8 aa, Mycobacterium
EGRSNTNI

SEQ ID NO: 465392 - protein, 9 aa, Mycobacterium
EGRSQGEYM

SEQ ID NO: 465393 - protein, 8 aa, Mycobacterium
EGRSTATA

SEQ ID NO: 465394 - protein, 13 aa, Mycobacterium
EGRSVGEKVATGV

SEQ ID NO: 465395 - protein, 22 aa, Mycobacterium
EGRSYSRQRAETSARIIVAGLR

SEQ ID NO: 465396 - protein, 6 aa, Mycobacterium
EGRTAE

SEQ ID NO: 465397 - protein, 6 aa, Mycobacterium
EGRTAL

SEQ ID NO: 465398 - protein, 6 aa, Mycobacterium
EGRTDW

SEQ ID NO: 465399 - protein, 7 aa, Mycobacterium
EGRVAEP

SEQ ID NO: 465400 - protein, 7 aa, Mycobacterium
EGRVAPE

SEQ ID NO: 465401 - protein, 36 aa, Mycobacterium
EGRYATAQGAAELDAESAQGRSVEEQYEERERAAAE

SEQ ID NO: 465402 - protein, 11 aa, Mycobacterium
EGSAADAEASL

SEQ ID NO: 465403 - protein, 9 aa, Mycobacterium
EGSADGLRG

SEQ ID NO: 465404 - protein, 10 aa, Mycobacterium
EGSAFSAGGD

SEQ ID NO: 465405 - protein, 10 aa, Mycobacterium
EGSAGNAAAA

SEQ ID NO: 465406 - protein, 10 aa, Mycobacterium
EGSAHPNSDF

SEQ ID NO: 465407 - protein, 10 aa, Mycobacterium
EGSAPATPGV

SEQ ID NO: 465408 - protein, 5 aa, Mycobacterium
EGSAQ

SEQ ID NO: 465409 - protein, 7 aa, Mycobacterium
EGSARAR

SEQ ID NO: 465410 - protein, 7 aa, Mycobacterium
EGSAREV

SEQ ID NO: 465411 - protein, 7 aa, Mycobacterium
EGSATAV

SEQ ID NO: 465412 - protein, 6 aa, Mycobacterium
EGSAVA

SEQ ID NO: 465413 - protein, 14 aa, Mycobacterium
EGSAVPAPAVSAGA

SEQ ID NO: 465414 - protein, 6 aa, Mycobacterium
EGSCGS

SEQ ID NO: 465415 - protein, 4 aa, Mycobacterium
EGSD

SEQ ID NO: 465416 - protein, 10 aa, Mycobacterium
EGSDAREGLD

SEQ ID NO: 465417 - protein, 9 aa, Mycobacterium
EGSDSEAAH

SEQ ID NO: 465418 - protein, 4 aa, Mycobacterium
EGSE

SEQ ID NO: 465419 - protein, 18 aa, Mycobacterium
EGSEDKRISYADTQARPV

SEQ ID NO: 465420 - protein, 8 aa, Mycobacterium
EGSEEAYE

SEQ ID NO: 465421 - protein, 9 aa, Mycobacterium
EGSEERRIS

SEQ ID NO: 465422 - protein, 11 aa, Mycobacterium
EGSEGALPADV

SEQ ID NO: 465423 - protein, 23 aa, Mycobacterium
EGSERTAAELTPAEKDASSHRGR

SEQ ID NO: 465424 - protein, 6 aa, Mycobacterium
EGSESA

SEQ ID NO: 465425 - protein, 19 aa, Mycobacterium
EGSEYDQRAAHGISSEPER

SEQ ID NO: 465426 - protein, 4 aa, Mycobacterium
EGSG

SEQ ID NO: 465427 - protein, 11 aa, Mycobacterium
EGSGADEADSV

SEQ ID NO: 465428 - protein, 7 aa, Mycobacterium
EGSGARI

SEQ ID NO: 465429 - protein, 15 aa, Mycobacterium
EGSGGGSSTMPHKRN

SEQ ID NO: 465430 - protein, 16 aa, Mycobacterium
EGSGGSGGAGGSETSV

SEQ ID NO: 465431 - protein, 7 aa, Mycobacterium
EGSGLPQ

SEQ ID NO: 465432 - protein, 9 aa, Mycobacterium
EGSGLSKDE

SEQ ID NO: 465433 - protein, 9 aa, Mycobacterium
EGSGLSKEE

SEQ ID NO: 465434 - protein, 9 aa, Mycobacterium
EGSGVSETQ

SEQ ID NO: 465435 - protein, 11 aa, Mycobacterium
EGSHDRVSTTY

SEQ ID NO: 465436 - protein, 6 aa, Mycobacterium
EGSHFE

SEQ ID NO: 465437 - protein, 6 aa, Mycobacterium
EGSIAG

SEQ ID NO: 465438 - protein, 10 aa, Mycobacterium
EGSIEERAAE

SEQ ID NO: 465439 - protein, 12 aa, Mycobacterium
EGSIEETLTDED

SEQ ID NO: 465440 - protein, 6 aa, Mycobacterium
EGSITR

SEQ ID NO: 465441 - protein, 7 aa, Mycobacterium
EGSKGGL

SEQ ID NO: 465442 - protein, 4 aa, Mycobacterium
EGSL

SEQ ID NO: 465443 - protein, 9 aa, Mycobacterium
EGSLAPAGR

SEQ ID NO: 465444 - protein, 18 aa, Mycobacterium
EGSLARKDYIGGAAEHAT

SEQ ID NO: 465445 - protein, 9 aa, Mycobacterium
EGSLGERDA

SEQ ID NO: 465446 - protein, 6 aa, Mycobacterium
EGSMGG

SEQ ID NO: 465447 - protein, 8 aa, Mycobacterium
EGSNAERP

SEQ ID NO: 465448 - protein, 9 aa, Mycobacterium
EGSNERDGG

SEQ ID NO: 465449 - protein, 5 aa, Mycobacterium
EGSNG

SEQ ID NO: 465450 - protein, 10 aa, Mycobacterium
EGSPANVEPL

SEQ ID NO: 465451 - protein, 5 aa, Mycobacterium
EGSPE

SEQ ID NO: 465452 - protein, 8 aa, Mycobacterium
EGSPIGDR

SEQ ID NO: 465453 - protein, 14 aa, Mycobacterium
EGSPKFAESQTLPD

SEQ ID NO: 465454 - protein, 5 aa, Mycobacterium
EGSPL

SEQ ID NO: 465455 - protein, 6 aa, Mycobacterium
EGSPLA

SEQ ID NO: 465456 - protein, 7 aa, Mycobacterium
EGSPLSK

SEQ ID NO: 465457 - protein, 5 aa, Mycobacterium
EGSPT

SEQ ID NO: 465458 - protein, 7 aa, Mycobacterium
EGSPTFG

SEQ ID NO: 465459 - protein, 10 aa, Mycobacterium
EGSPTRRDRW

SEQ ID NO: 465460 - protein, 4 aa, Mycobacterium
EGSR

SEQ ID NO: 465461 - protein, 9 aa, Mycobacterium
EGSRDPQLH

SEQ ID NO: 465462 - protein, 8 aa, Mycobacterium
EGSRFKPS

SEQ ID NO: 465463 - protein, 14 aa, Mycobacterium
EGSRFKPSMQGSGV

SEQ ID NO: 465464 - protein, 7 aa, Mycobacterium
EGSRGAA

SEQ ID NO: 465465 - protein, 19 aa, Mycobacterium
EGSRGGDVKTPARWVGRSD

SEQ ID NO: 465466 - protein, 11 aa, Mycobacterium
EGSRGTKDRDY

SEQ ID NO: 465467 - protein, 5 aa, Mycobacterium
EGSRL

SEQ ID NO: 465468 - protein, 9 aa, Mycobacterium
EGSRRSMAA

SEQ ID NO: 465469 - protein, 21 aa, Mycobacterium
EGSRYLEPSGAGPLGSGTGFP

SEQ ID NO: 465470 - protein, 6 aa, Mycobacterium
EGSSAR

SEQ ID NO: 465471 - protein, 15 aa, Mycobacterium
EGSSSAINQIDDLVA

SEQ ID NO: 465472 - protein, 10 aa, Mycobacterium
EGSTAAWEAD

SEQ ID NO: 465473 - protein, 12 aa, Mycobacterium
EGSTAAWEAEAG

SEQ ID NO: 465474 - protein, 8 aa, Mycobacterium
EGSTAQED

SEQ ID NO: 465475 - protein, 7 aa, Mycobacterium
EGSTDYV

SEQ ID NO: 465476 - protein, 5 aa, Mycobacterium
EGSTI

SEQ ID NO: 465477 - protein, 15 aa, Mycobacterium
EGSTRLTDYPYDPYV

SEQ ID NO: 465478 - protein, 4 aa, Mycobacterium
EGSV

SEQ ID NO: 465479 - protein, 8 aa, Mycobacterium
EGSVAKYK

SEQ ID NO: 465480 - protein, 5 aa, Mycobacterium
EGSVE

SEQ ID NO: 465481 - protein, 7 aa, Mycobacterium
EGSVERL

SEQ ID NO: 465482 - protein, 7 aa, Mycobacterium
EGSVPGG

SEQ ID NO: 465483 - protein, 4 aa, Mycobacterium
EGSW

SEQ ID NO: 465484 - protein, 4 aa, Mycobacterium
EGSY

SEQ ID NO: 465485 - protein, 11 aa, Mycobacterium
EGSYGAEPLPE

SEQ ID NO: 465486 - protein, 12 aa, Mycobacterium
EGSYTEPHREAD

SEQ ID NO: 465487 - protein, 9 aa, Mycobacterium
EGTAADGAR

SEQ ID NO: 465488 - protein, 18 aa, Mycobacterium
EGTAELTAPAAAPGDDTV

SEQ ID NO: 465489 - protein, 18 aa, Mycobacterium
EGTAELTPPAAAPDDETV

SEQ ID NO: 465490 - protein, 18 aa, Mycobacterium
EGTAELTPPAAAPGDSTV

SEQ ID NO: 465491 - protein, 7 aa, Mycobacterium
EGTAEPS

SEQ ID NO: 465492 - protein, 10 aa, Mycobacterium
EGTAFSSGGS

SEQ ID NO: 465493 - protein, 13 aa, Mycobacterium
EGTALDAGGSDTL

SEQ ID NO: 465494 - protein, 12 aa, Mycobacterium
EGTANELKHRAG

SEQ ID NO: 465495 - protein, 9 aa, Mycobacterium
EGTAPYSRE

SEQ ID NO: 465496 - protein, 9 aa, Mycobacterium
EGTARQDRA

SEQ ID NO: 465497 - protein, 9 aa, Mycobacterium
EGTARTERA

SEQ ID NO: 465498 - protein, 5 aa, Mycobacterium
EGTAT

SEQ ID NO: 465499 - protein, 8 aa, Mycobacterium
EGTAVTPA

SEQ ID NO: 465500 - protein, 9 aa, Mycobacterium
EGTAVTPAS

SEQ ID NO: 465501 - protein, 10 aa, Mycobacterium
EGTAVTPASF

SEQ ID NO: 465502 - protein, 14 aa, Mycobacterium
EGTDDLIADIDRAL

SEQ ID NO: 465503 - protein, 7 aa, Mycobacterium
EGTDEAY

SEQ ID NO: 465504 - protein, 7 aa, Mycobacterium
EGTDGLE

SEQ ID NO: 465505 - protein, 10 aa, Mycobacterium
EGTDPEHPLQ

SEQ ID NO: 465506 - protein, 10 aa, Mycobacterium
EGTDSGVYGN

SEQ ID NO: 465507 - protein, 7 aa, Mycobacterium
EGTDTDV

SEQ ID NO: 465508 - protein, 4 aa, Mycobacterium
EGTE

SEQ ID NO: 465509 - protein, 14 aa, Mycobacterium
EGTEDLIADLDQAL

SEQ ID NO: 465510 - protein, 14 aa, Mycobacterium
EGTEDLIADLDRAL

SEQ ID NO: 465511 - protein, 13 aa, Mycobacterium
EGTEGPYTGNGGA

SEQ ID NO: 465512 - protein, 11 aa, Mycobacterium
EGTEGSEDLEK

SEQ ID NO: 465513 - protein, 5 aa, Mycobacterium
EGTEI

SEQ ID NO: 465514 - protein, 21 aa, Mycobacterium
EGTELARAANAREELGDPTAH

SEQ ID NO: 465515 - protein, 8 aa, Mycobacterium
EGTEMTEE

SEQ ID NO: 465516 - protein, 15 aa, Mycobacterium
EGTEPAGRPAPRTDM

SEQ ID NO: 465517 - protein, 7 aa, Mycobacterium
EGTEPYP

SEQ ID NO: 465518 - protein, 8 aa, Mycobacterium
EGTERVGE

SEQ ID NO: 465519 - protein, 7 aa, Mycobacterium
EGTESRI

SEQ ID NO: 465520 - protein, 6 aa, Mycobacterium
EGTGAT

SEQ ID NO: 465521 - protein, 8 aa, Mycobacterium
EGTGDDPA

SEQ ID NO: 465522 - protein, 13 aa, Mycobacterium
EGTGDTAPLAAGS

SEQ ID NO: 465523 - protein, 13 aa, Mycobacterium
EGTGDTPALPKGR

SEQ ID NO: 465524 - protein, 12 aa, Mycobacterium
EGTGESIPFPDN

SEQ ID NO: 465525 - protein, 9 aa, Mycobacterium
EGTGEYPTV

SEQ ID NO: 465526 - protein, 7 aa, Mycobacterium
EGTGGRP

SEQ ID NO: 465527 - protein, 5 aa, Mycobacterium
EGTGS

SEQ ID NO: 465528 - protein, 5 aa, Mycobacterium
EGTGT

SEQ ID NO: 465529 - protein, 6 aa, Mycobacterium
EGTGTA

SEQ ID NO: 465530 - protein, 8 aa, Mycobacterium
EGTGTIAA

SEQ ID NO: 465531 - protein, 5 aa, Mycobacterium
EGTGV

SEQ ID NO: 465532 - protein, 10 aa, Mycobacterium
EGTHDRVSTT

SEQ ID NO: 465533 - protein, 11 aa, Mycobacterium
EGTHDRVSTTY

SEQ ID NO: 465534 - protein, 7 aa, Mycobacterium
EGTHVRQ

SEQ ID NO: 465535 - protein, 12 aa, Mycobacterium
EGTIPKGEYGAG

SEQ ID NO: 465536 - protein, 6 aa, Mycobacterium
EGTKAQ

SEQ ID NO: 465537 - protein, 5 aa, Mycobacterium
EGTKI

SEQ ID NO: 465538 - protein, 14 aa, Mycobacterium
EGTKKLSKRDPQSN

SEQ ID NO: 465539 - protein, 5 aa, Mycobacterium
EGTKL

SEQ ID NO: 465540 - protein, 28 aa, Mycobacterium
EGTLEDDPNVTDKKFPGNPTHSYRSREP

SEQ ID NO: 465541 - protein, 8 aa, Mycobacterium
EGTLREQA

SEQ ID NO: 465542 - protein, 4 aa, Mycobacterium
EGTN

SEQ ID NO: 465543 - protein, 7 aa, Mycobacterium
EGTNSTV

SEQ ID NO: 465544 - protein, 7 aa, Mycobacterium
EGTPAGL

SEQ ID NO: 465545 - protein, 10 aa, Mycobacterium
EGTPASPTEH

SEQ ID NO: 465546 - protein, 10 aa, Mycobacterium
EGTPDSPSQH

SEQ ID NO: 465547 - protein, 10 aa, Mycobacterium
EGTPDSPTQH

SEQ ID NO: 465548 - protein, 7 aa, Mycobacterium
EGTPEDV

SEQ ID NO: 465549 - protein, 8 aa, Mycobacterium
EGTPEQRD

SEQ ID NO: 465550 - protein, 6 aa, Mycobacterium
EGTPLR

SEQ ID NO: 465551 - protein, 8 aa, Mycobacterium
EGTPPGLP

SEQ ID NO: 465552 - protein, 18 aa, Mycobacterium
EGTPPPVRAHTPPRFVAR

SEQ ID NO: 465553 - protein, 5 aa, Mycobacterium
EGTPQ

SEQ ID NO: 465554 - protein, 6 aa, Mycobacterium
EGTPQQ

SEQ ID NO: 465555 - protein, 24 aa, Mycobacterium
EGTPSALRRRAAARTASEANSPGT

SEQ ID NO: 465556 - protein, 9 aa, Mycobacterium
EGTPSISQE

SEQ ID NO: 465557 - protein, 22 aa, Mycobacterium
EGTPSQAAIDGDTRSKAQRGHD

SEQ ID NO: 465558 - protein, 10 aa, Mycobacterium
EGTPSVEADE

SEQ ID NO: 465559 - protein, 5 aa, Mycobacterium
EGTPT

SEQ ID NO: 465560 - protein, 7 aa, Mycobacterium
EGTPTEL

SEQ ID NO: 465561 - protein, 10 aa, Mycobacterium
EGTPTSPNEH

SEQ ID NO: 465562 - protein, 10 aa, Mycobacterium
EGTPTSPTEH

SEQ ID NO: 465563 - protein, 5 aa, Mycobacterium
EGTPV

SEQ ID NO: 465564 - protein, 6 aa, Mycobacterium
EGTPVD

SEQ ID NO: 465565 - protein, 15 aa, Mycobacterium
EGTPYKEATAAELAD

SEQ ID NO: 465566 - protein, 4 aa, Mycobacterium
EGTQ

SEQ ID NO: 465567 - protein, 8 aa, Mycobacterium
EGTQEQRD

SEQ ID NO: 465568 - protein, 10 aa, Mycobacterium
EGTQGAKEMA

SEQ ID NO: 465569 - protein, 5 aa, Mycobacterium
EGTQP

SEQ ID NO: 465570 - protein, 5 aa, Mycobacterium
EGTRA

SEQ ID NO: 465571 - protein, 6 aa, Mycobacterium
EGTRAA

SEQ ID NO: 465572 - protein, 11 aa, Mycobacterium
EGTREERDSAG

SEQ ID NO: 465573 - protein, 8 aa, Mycobacterium
EGTREGHE

SEQ ID NO: 465574 - protein, 12 aa, Mycobacterium
EGTRLDTTEVGE

SEQ ID NO: 465575 - protein, 13 aa, Mycobacterium
EGTRLDTTEVGPF

SEQ ID NO: 465576 - protein, 5 aa, Mycobacterium
EGTRN

SEQ ID NO: 465577 - protein, 6 aa, Mycobacterium
EGTRRT

SEQ ID NO: 465578 - protein, 5 aa, Mycobacterium
EGTRT

SEQ ID NO: 465579 - protein, 6 aa, Mycobacterium
EGTRTI

SEQ ID NO: 465580 - protein, 11 aa, Mycobacterium
EGTRTRAGQPL

SEQ ID NO: 465581 - protein, 10 aa, Mycobacterium
EGTSAEGVAR

SEQ ID NO: 465582 - protein, 7 aa, Mycobacterium
EGTSEPN

SEQ ID NO: 465583 - protein, 8 aa, Mycobacterium
EGTSPRRA

SEQ ID NO: 465584 - protein, 11 aa, Mycobacterium
EGTSQEAEASM

SEQ ID NO: 465585 - protein, 9 aa, Mycobacterium
EGTSSYGAG

SEQ ID NO: 465586 - protein, 7 aa, Mycobacterium
EGTSTIT

SEQ ID NO: 465587 - protein, 15 aa, Mycobacterium
EGTTMGSRIDEQLRG

SEQ ID NO: 465588 - protein, 8 aa, Mycobacterium
EGTTPERT

SEQ ID NO: 465589 - protein, 8 aa, Mycobacterium
EGTTSGDY

SEQ ID NO: 465590 - protein, 7 aa, Mycobacterium
EGTTSPT

SEQ ID NO: 465591 - protein, 8 aa, Mycobacterium
EGTTVSAE

SEQ ID NO: 465592 - protein, 6 aa, Mycobacterium
EGTTVT

SEQ ID NO: 465593 - protein, 7 aa, Mycobacterium
EGTTVVG

SEQ ID NO: 465594 - protein, 6 aa, Mycobacterium
EGTVNG

SEQ ID NO: 465595 - protein, 18 aa, Mycobacterium
EGTVTLTGPGTDPHGPEV

SEQ ID NO: 465596 - protein, 8 aa, Mycobacterium
EGVAAKSL

SEQ ID NO: 465597 - protein, 5 aa, Mycobacterium
EGVAD

SEQ ID NO: 465598 - protein, 7 aa, Mycobacterium
EGVADGE

SEQ ID NO: 465599 - protein, 6 aa, Mycobacterium
EGVADP

SEQ ID NO: 465600 - protein, 26 aa, Mycobacterium
EGVAEPRPVDSPWPDKPTAFAARKAA

SEQ ID NO: 465601 - protein, 5 aa, Mycobacterium
EGVAP

SEQ ID NO: 465602 - protein, 4 aa, Mycobacterium
EGVD

SEQ ID NO: 465603 - protein, 10 aa, Mycobacterium
EGVDEGGRPI

SEQ ID NO: 465604 - protein, 11 aa, Mycobacterium
EGVDEQGEPIN

SEQ ID NO: 465605 - protein, 10 aa, Mycobacterium
EGVDEQGQPI

SEQ ID NO: 465606 - protein, 8 aa, Mycobacterium
EGVDEQPQ

SEQ ID NO: 465607 - protein, 8 aa, Mycobacterium
EGVDGDSP

SEQ ID NO: 465608 - protein, 5 aa, Mycobacterium
EGVDL

SEQ ID NO: 465609 - protein, 10 aa, Mycobacterium
EGVDPERPQY

SEQ ID NO: 465610 - protein, 12 aa, Mycobacterium
EGVDRSPTEEAV

SEQ ID NO: 465611 - protein, 5 aa, Mycobacterium
EGVDT

SEQ ID NO: 465612 - protein, 4 aa, Mycobacterium
EGVE

SEQ ID NO: 465613 - protein, 5 aa, Mycobacterium
EGVEA

SEQ ID NO: 465614 - protein, 5 aa, Mycobacterium
EGVEE

SEQ ID NO: 465615 - protein, 14 aa, Mycobacterium
EGVEESEQSVNEAA

SEQ ID NO: 465616 - protein, 5 aa, Mycobacterium
EGVEL

SEQ ID NO: 465617 - protein, 12 aa, Mycobacterium
EGVGAAAAPTAA

SEQ ID NO: 465618 - protein, 9 aa, Mycobacterium
EGVGELGGL

SEQ ID NO: 465619 - protein, 7 aa, Mycobacterium
EGVGGTR

SEQ ID NO: 465620 - protein, 5 aa, Mycobacterium
EGVGP

SEQ ID NO: 465621 - protein, 7 aa, Mycobacterium
EGVGPAA

SEQ ID NO: 465622 - protein, 10 aa, Mycobacterium
EGVGRKQLGA

SEQ ID NO: 465623 - protein, 5 aa, Mycobacterium
EGVGT

SEQ ID NO: 465624 - protein, 5 aa, Mycobacterium
EGVKH

SEQ ID NO: 465625 - protein, 7 aa, Mycobacterium
EGVKTKR

SEQ ID NO: 465626 - protein, 11 aa, Mycobacterium
EGVLGDADRDH

SEQ ID NO: 465627 - protein, 6 aa, Mycobacterium
EGVPAP

SEQ ID NO: 465628 - protein, 7 aa, Mycobacterium
EGVPDDI

SEQ ID NO: 465629 - protein, 7 aa, Mycobacterium
EGVPERA

SEQ ID NO: 465630 - protein, 5 aa, Mycobacterium
EGVPG

SEQ ID NO: 465631 - protein, 8 aa, Mycobacterium
EGVPPEIT

SEQ ID NO: 465632 - protein, 15 aa, Mycobacterium
EGVPPITASTDEIRA

SEQ ID NO: 465633 - protein, 8 aa, Mycobacterium
EGVPPKPV

SEQ ID NO: 465634 - protein, 14 aa, Mycobacterium
EGVPPPDTAHYKAD

SEQ ID NO: 465635 - protein, 24 aa, Mycobacterium
EGVPPQIQATPGMPERKAVGRRQA

SEQ ID NO: 465636 - protein, 16 aa, Mycobacterium
EGVPPQLQATPGMPER

SEQ ID NO: 465637 - protein, 10 aa, Mycobacterium
EGVPPTPGVT

SEQ ID NO: 465638 - protein, 6 aa, Mycobacterium
EGVPRK

SEQ ID NO: 465639 - protein, 5 aa, Mycobacterium
EGVPT

SEQ ID NO: 465640 - protein, 6 aa, Mycobacterium
EGVPTP

SEQ ID NO: 465641 - protein, 18 aa, Mycobacterium
EGVPVTARGGGTSIAGNA

SEQ ID NO: 465642 - protein, 4 aa, Mycobacterium
EGVQ

SEQ ID NO: 465643 - protein, 14 aa, Mycobacterium
EGVQGSATHDTTEQ

SEQ ID NO: 465644 - protein, 9 aa, Mycobacterium
EGVQTEARH

SEQ ID NO: 465645 - protein, 7 aa, Mycobacterium
EGVQTRP

SEQ ID NO: 465646 - protein, 9 aa, Mycobacterium
EGVRRGTTM

SEQ ID NO: 465647 - protein, 9 aa, Mycobacterium
EGVRRGTTV

SEQ ID NO: 465648 - protein, 11 aa, Mycobacterium
EGVRRTGGSNV

SEQ ID NO: 465649 - protein, 6 aa, Mycobacterium
EGVRTR

SEQ ID NO: 465650 - protein, 10 aa, Mycobacterium
EGVRTTDGTV

SEQ ID NO: 465651 - protein, 4 aa, Mycobacterium
EGVS

SEQ ID NO: 465652 - protein, 7 aa, Mycobacterium
EGVSASA

SEQ ID NO: 465653 - protein, 6 aa, Mycobacterium
EGVSAY

SEQ ID NO: 465654 - protein, 10 aa, Mycobacterium
EGVSEAAPRD

SEQ ID NO: 465655 - protein, 5 aa, Mycobacterium
EGVSG

SEQ ID NO: 465656 - protein, 8 aa, Mycobacterium
EGVSPSAY

SEQ ID NO: 465657 - protein, 4 aa, Mycobacterium
EGVT

SEQ ID NO: 465658 - protein, 6 aa, Mycobacterium
EGVTAD

SEQ ID NO: 465659 - protein, 19 aa, Mycobacterium
EGVTDTAIPASTPEDLAET

SEQ ID NO: 465660 - protein, 12 aa, Mycobacterium
EGVTDVPPEAVE

SEQ ID NO: 465661 - protein, 5 aa, Mycobacterium
EGVTG

SEQ ID NO: 465662 - protein, 8 aa, Mycobacterium
EGVTTVEP

SEQ ID NO: 465663 - protein, 4 aa, Mycobacterium
EGWD

SEQ ID NO: 465664 - protein, 15 aa, Mycobacterium
EGWEPTDWLKPWTPK

SEQ ID NO: 465665 - protein, 4 aa, Mycobacterium
EGWP

SEQ ID NO: 465666 - protein, 14 aa, Mycobacterium
EGWPDDADEDIAAG

SEQ ID NO: 465667 - protein, 12 aa, Mycobacterium
EGWPPDGVRPSV

SEQ ID NO: 465668 - protein, 13 aa, Mycobacterium
EGWRTTETWPPPG

SEQ ID NO: 465669 - protein, 4 aa, Mycobacterium
EGYA

SEQ ID NO: 465670 - protein, 11 aa, Mycobacterium
EGYADTDEGRA

SEQ ID NO: 465671 - protein, 9 aa, Mycobacterium
EGYAGPEDA

SEQ ID NO: 465672 - protein, 9 aa, Mycobacterium
EGYAGPQDA

SEQ ID NO: 465673 - protein, 6 aa, Mycobacterium
EGYAPK

SEQ ID NO: 465674 - protein, 5 aa, Mycobacterium
EGYAV

SEQ ID NO: 465675 - protein, 7 aa, Mycobacterium
EGYDEGR

SEQ ID NO: 465676 - protein, 32 aa, Mycobacterium
EGYDPKPLAPVDAQDKPDQLQIPPPGTKPEDV

SEQ ID NO: 465677 - protein, 11 aa, Mycobacterium
EGYERDARRSS

SEQ ID NO: 465678 - protein, 10 aa, Mycobacterium
EGYEVTGTSN

SEQ ID NO: 465679 - protein, 6 aa, Mycobacterium
EGYGEE

SEQ ID NO: 465680 - protein, 6 aa, Mycobacterium
EGYGGT

SEQ ID NO: 465681 - protein, 7 aa, Mycobacterium
EGYGKTS

SEQ ID NO: 465682 - protein, 5 aa, Mycobacterium
EGYGP

SEQ ID NO: 465683 - protein, 28 aa, Mycobacterium
EGYGSSEGGAVATPDPAAPATALGRPAH

SEQ ID NO: 465684 - protein, 11 aa, Mycobacterium
EGYGSTPAQRA

SEQ ID NO: 465685 - protein, 5 aa, Mycobacterium
EGYHE

SEQ ID NO: 465686 - protein, 8 aa, Mycobacterium
EGYPTPTD

SEQ ID NO: 465687 - protein, 9 aa, Mycobacterium
EGYPTPTDK

SEQ ID NO: 465688 - protein, 9 aa, Mycobacterium
EGYPTTAPT

SEQ ID NO: 465689 - protein, 20 aa, Mycobacterium
EGYQTPTQANDEIGLVLQAL

SEQ ID NO: 465690 - protein, 12 aa, Mycobacterium
EGYRATEPTAGE

SEQ ID NO: 465691 - protein, 6 aa, Mycobacterium
EGYSGA

SEQ ID NO: 465692 - protein, 7 aa, Mycobacterium
EGYSGAQ

SEQ ID NO: 465693 - protein, 13 aa, Mycobacterium
EGYSGQGTERLGE

SEQ ID NO: 465694 - protein, 10 aa, Mycobacterium
EGYSPPERAY

SEQ ID NO: 465695 - protein, 21 aa, Mycobacterium
EGYSPPERPYAPGAFGPSETL

SEQ ID NO: 465696 - protein, 20 aa, Mycobacterium
EGYSPPERPYGRGAFGPGEN

SEQ ID NO: 465697 - protein, 12 aa, Mycobacterium
EGYSPPESPREL

SEQ ID NO: 465698 - protein, 14 aa, Mycobacterium
EGYSPTFPGAEDFG

SEQ ID NO: 465699 - protein, 5 aa, Mycobacterium
EGYTP

SEQ ID NO: 465700 - protein, 10 aa, Mycobacterium
EGYTRAKAGN

SEQ ID NO: 465701 - protein, 13 aa, Mycobacterium
EGYTRDKARALDG

SEQ ID NO: 465702 - protein, 4 aa, Mycobacterium
EHAA

SEQ ID NO: 465703 - protein, 4 aa, Mycobacterium
EHAD

SEQ ID NO: 465704 - protein, 6 aa, Mycobacterium
EHADAE

SEQ ID NO: 465705 - protein, 9 aa, Mycobacterium
EHADDAANP

SEQ ID NO: 465706 - protein, 17 aa, Mycobacterium
EHADHGRVQQQRRHQAE

SEQ ID NO: 465707 - protein, 8 aa, Mycobacterium
EHADRAAA

SEQ ID NO: 465708 - protein, 15 aa, Mycobacterium
EHADSDEGPHRPPLP

SEQ ID NO: 465709 - protein, 4 aa, Mycobacterium
EHAE

SEQ ID NO: 465710 - protein, 8 aa, Mycobacterium
EHAERGRN

SEQ ID NO: 465711 - protein, 10 aa, Mycobacterium
EHAESKDHHP

SEQ ID NO: 465712 - protein, 11 aa, Mycobacterium
EHAESKDHHPD

SEQ ID NO: 465713 - protein, 5 aa, Mycobacterium
EHAFG

SEQ ID NO: 465714 - protein, 14 aa, Mycobacterium
EHAGPGIPGHHRDA

SEQ ID NO: 465715 - protein, 31 aa, Mycobacterium
EHAGPGVPGHHRGDDGLKAVAESSNRHRSSG

SEQ ID NO: 465716 - protein, 27 aa, Mycobacterium
EHAGPGVPGHHRKAGGLKAVGDRHGAS

SEQ ID NO: 465717 - protein, 25 aa, Mycobacterium
EHAGPGVPRHHRGDGLQAVSATPDA

SEQ ID NO: 465718 - protein, 20 aa, Mycobacterium
EHAGPVPDLAPGALGTLTGQ

SEQ ID NO: 465719 - protein, 8 aa, Mycobacterium
EHAGREAE

SEQ ID NO: 465720 - protein, 6 aa, Mycobacterium
EHAGSW

SEQ ID NO: 465721 - protein, 7 aa, Mycobacterium
EHAGTDA

SEQ ID NO: 465722 - protein, 4 aa, Mycobacterium
EHAK

SEQ ID NO: 465723 - protein, 16 aa, Mycobacterium
EHAKARGANILARIMG

SEQ ID NO: 465724 - protein, 10 aa, Mycobacterium
EHAKARGATP

SEQ ID NO: 465725 - protein, 7 aa, Mycobacterium
EHAKPGT

SEQ ID NO: 465726 - protein, 6 aa, Mycobacterium
EHAPGA

SEQ ID NO: 465727 - protein, 7 aa, Mycobacterium
EHAPGAS

SEQ ID NO: 465728 - protein, 9 aa, Mycobacterium
EHAPNDVRT

SEQ ID NO: 465729 - protein, 7 aa, Mycobacterium
EHAPSDA

SEQ ID NO: 465730 - protein, 22 aa, Mycobacterium
EHAPSEDSTAVAQMPGRKEQRY

SEQ ID NO: 465731 - protein, 8 aa, Mycobacterium
EHAQGEQR

SEQ ID NO: 465732 - protein, 7 aa, Mycobacterium
EHAQQAG

SEQ ID NO: 465733 - protein, 6 aa, Mycobacterium
EHAQRA

SEQ ID NO: 465734 - protein, 8 aa, Mycobacterium
EHAQTDDV

SEQ ID NO: 465735 - protein, 5 aa, Mycobacterium
EHART

SEQ ID NO: 465736 - protein, 15 aa, Mycobacterium
EHARTDWDNDGVPRR

SEQ ID NO: 465737 - protein, 15 aa, Mycobacterium
EHARTDWDNGGVPRR

SEQ ID NO: 465738 - protein, 17 aa, Mycobacterium
EHASGAGPLRPQADDVR

SEQ ID NO: 465739 - protein, 14 aa, Mycobacterium
EHASGRMPNRRGEP

SEQ ID NO: 465740 - protein, 6 aa, Mycobacterium
EHASKE

SEQ ID NO: 465741 - protein, 23 aa, Mycobacterium
EHASNGNQQRDGVGQSLPEPAAR

SEQ ID NO: 465742 - protein, 14 aa, Mycobacterium
EHATEPLTGPSDDG

SEQ ID NO: 465743 - protein, 8 aa, Mycobacterium
EHATRPAS

SEQ ID NO: 465744 - protein, 6 aa, Mycobacterium
EHATTA

SEQ ID NO: 465745 - protein, 4 aa, Mycobacterium
EHDA

SEQ ID NO: 465746 - protein, 10 aa, Mycobacterium
EHDAATAADH

SEQ ID NO: 465747 - protein, 7 aa, Mycobacterium
EHDAERA

SEQ ID NO: 465748 - protein, 6 aa, Mycobacterium
EHDAGY

SEQ ID NO: 465749 - protein, 8 aa, Mycobacterium
EHDASPSQ

SEQ ID NO: 465750 - protein, 16 aa, Mycobacterium
EHDCGDPSYAPDRPRT

SEQ ID NO: 465751 - protein, 10 aa, Mycobacterium
EHDDTTSART

SEQ ID NO: 465752 - protein, 10 aa, Mycobacterium
EHDEATPKTW

SEQ ID NO: 465753 - protein, 11 aa, Mycobacterium
EHDEPSIGRPT

SEQ ID NO: 465754 - protein, 4 aa, Mycobacterium
EHDG

SEQ ID NO: 465755 - protein, 8 aa, Mycobacterium
EHDGDERP

SEQ ID NO: 465756 - protein, 10 aa, Mycobacterium
EHDGGTRATY

SEQ ID NO: 465757 - protein, 5 aa, Mycobacterium
EHDGP

SEQ ID NO: 465758 - protein, 5 aa, Mycobacterium
EHDGR

SEQ ID NO: 465759 - protein, 16 aa, Mycobacterium
EHDHGAPSYRPDRPRT

SEQ ID NO: 465760 - protein, 7 aa, Mycobacterium
EHDHPGP

SEQ ID NO: 465761 - protein, 5 aa, Mycobacterium
EHDPA

SEQ ID NO: 465762 - protein, 12 aa, Mycobacterium
EHDPADDLAGPL

SEQ ID NO: 465763 - protein, 11 aa, Mycobacterium
EHDPKDGDARE

SEQ ID NO: 465764 - protein, 12 aa, Mycobacterium
EHDPLRDDGARY

SEQ ID NO: 465765 - protein, 8 aa, Mycobacterium
EHDPQIDY

SEQ ID NO: 465766 - protein, 6 aa, Mycobacterium
EHDPTV

SEQ ID NO: 465767 - protein, 5 aa, Mycobacterium
EHDPV

SEQ ID NO: 465768 - protein, 5 aa, Mycobacterium
EHDRL

SEQ ID NO: 465769 - protein, 20 aa, Mycobacterium
EHDRPRPTIQNDHQYLGYRP

SEQ ID NO: 465770 - protein, 5 aa, Mycobacterium
EHDRV

SEQ ID NO: 465771 - protein, 9 aa, Mycobacterium
EHDSAHGTA

SEQ ID NO: 465772 - protein, 10 aa, Mycobacterium
EHDSDGSGAA

SEQ ID NO: 465773 - protein, 12 aa, Mycobacterium
EHDSIDDAGRKY

SEQ ID NO: 465774 - protein, 9 aa, Mycobacterium
EHDSLKNSR

SEQ ID NO: 465775 - protein, 9 aa, Mycobacterium
EHDSPGEAT

SEQ ID NO: 465776 - protein, 8 aa, Mycobacterium
EHDSPRSK

SEQ ID NO: 465777 - protein, 7 aa, Mycobacterium
EHDSSHE

SEQ ID NO: 465778 - protein, 8 aa, Mycobacterium
EHDSSHEL

SEQ ID NO: 465779 - protein, 12 aa, Mycobacterium
EHDSTGKLPQYP

SEQ ID NO: 465780 - protein, 4 aa, Mycobacterium
EHDY

SEQ ID NO: 465781 - protein, 15 aa, Mycobacterium
EHEAGAKITAATAGI

SEQ ID NO: 465782 - protein, 5 aa, Mycobacterium
EHEAN

SEQ ID NO: 465783 - protein, 9 aa, Mycobacterium
EHEASDPKL

SEQ ID NO: 465784 - protein, 10 aa, Mycobacterium
EHEASDPKLW

SEQ ID NO: 465785 - protein, 10 aa, Mycobacterium
EHEASDPQLW

SEQ ID NO: 465786 - protein, 6 aa, Mycobacterium
EHEDGD

SEQ ID NO: 465787 - protein, 9 aa, Mycobacterium
EHEDTAARL

SEQ ID NO: 465788 - protein, 17 aa, Mycobacterium
EHEEAARRAAVRAGRTA

SEQ ID NO: 465789 - protein, 6 aa, Mycobacterium
EHEEHD

SEQ ID NO: 465790 - protein, 7 aa, Mycobacterium
EHEEHDE

SEQ ID NO: 465791 - protein, 5 aa, Mycobacterium
EHEFG

SEQ ID NO: 465792 - protein, 5 aa, Mycobacterium
EHEGG

SEQ ID NO: 465793 - protein, 13 aa, Mycobacterium
EHEGQPQYRTRKH

SEQ ID NO: 465794 - protein, 6 aa, Mycobacterium
EHEGTQ

SEQ ID NO: 465795 - protein, 14 aa, Mycobacterium
EHEKSESAAKAVAS

SEQ ID NO: 465796 - protein, 4 aa, Mycobacterium
EHEP

SEQ ID NO: 465797 - protein, 5 aa, Mycobacterium
EHEPD

SEQ ID NO: 465798 - protein, 18 aa, Mycobacterium
EHERAEKQRRESEKRRYK

SEQ ID NO: 465799 - protein, 5 aa, Mycobacterium
EHERT

SEQ ID NO: 465800 - protein, 5 aa, Mycobacterium
EHERV

SEQ ID NO: 465801 - protein, 4 aa, Mycobacterium
EHET

SEQ ID NO: 465802 - protein, 5 aa, Mycobacterium
EHEYG

SEQ ID NO: 465803 - protein, 8 aa, Mycobacterium
EHFGSPEH

SEQ ID NO: 465804 - protein, 12 aa, Mycobacterium
EHFPPPNSPEGY

SEQ ID NO: 465805 - protein, 10 aa, Mycobacterium
EHFSDTPDYQ

SEQ ID NO: 465806 - protein, 7 aa, Mycobacterium
EHGAEGK

SEQ ID NO: 465807 - protein, 6 aa, Mycobacterium
EHGAGD

SEQ ID NO: 465808 - protein, 8 aa, Mycobacterium
EHGAGGPV

SEQ ID NO: 465809 - protein, 9 aa, Mycobacterium
EHGAGSDLA

SEQ ID NO: 465810 - protein, 20 aa, Mycobacterium
EHGAQRVEGRDGHGVNDNAM

SEQ ID NO: 465811 - protein, 7 aa, Mycobacterium
EHGATPY

SEQ ID NO: 465812 - protein, 6 aa, Mycobacterium
EHGATT

SEQ ID NO: 465813 - protein, 7 aa, Mycobacterium
EHGDDAA

SEQ ID NO: 465814 - protein, 8 aa, Mycobacterium
EHGDDAER

SEQ ID NO: 465815 - protein, 8 aa, Mycobacterium
EHGDDGSR

SEQ ID NO: 465816 - protein, 7 aa, Mycobacterium
EHGDERV

SEQ ID NO: 465817 - protein, 11 aa, Mycobacterium
EHGDGTVSITG

SEQ ID NO: 465818 - protein, 7 aa, Mycobacterium
EHGDPAV

SEQ ID NO: 465819 - protein, 8 aa, Mycobacterium
EHGDPLAG

SEQ ID NO: 465820 - protein, 7 aa, Mycobacterium
EHGDQPC

SEQ ID NO: 465821 - protein, 10 aa, Mycobacterium
EHGDRRRATT

SEQ ID NO: 465822 - protein, 17 aa, Mycobacterium
EHGEDDPKISGWTWGPS

SEQ ID NO: 465823 - protein, 14 aa, Mycobacterium
EHGEDDPRIANWTW

SEQ ID NO: 465824 - protein, 6 aa, Mycobacterium
EHGFGS

SEQ ID NO: 465825 - protein, 8 aa, Mycobacterium
EHGGDGKF

SEQ ID NO: 465826 - protein, 8 aa, Mycobacterium
EHGGDGNF

SEQ ID NO: 465827 - protein, 5 aa, Mycobacterium
EHGGG

SEQ ID NO: 465828 - protein, 5 aa, Mycobacterium
EHGGH

SEQ ID NO: 465829 - protein, 5 aa, Mycobacterium
EHGGM

SEQ ID NO: 465830 - protein, 6 aa, Mycobacterium
EHGGMG

SEQ ID NO: 465831 - protein, 8 aa, Mycobacterium
EHGGPGEH

SEQ ID NO: 465832 - protein, 7 aa, Mycobacterium
EHGGPSV

SEQ ID NO: 465833 - protein, 7 aa, Mycobacterium
EHGGPTA

SEQ ID NO: 465834 - protein, 12 aa, Mycobacterium
EHGGTAVERDAE

SEQ ID NO: 465835 - protein, 6 aa, Mycobacterium
EHGGTF

SEQ ID NO: 465836 - protein, 9 aa, Mycobacterium
EHGHQADRS

SEQ ID NO: 465837 - protein, 6 aa, Mycobacterium
EHGIGG

SEQ ID NO: 465838 - protein, 13 aa, Mycobacterium
EHGKGSVALRGGA

SEQ ID NO: 465839 - protein, 13 aa, Mycobacterium
EHGKGTAALRGGA

SEQ ID NO: 465840 - protein, 10 aa, Mycobacterium
EHGKPPRQCT

SEQ ID NO: 465841 - protein, 15 aa, Mycobacterium
EHGKTLADAKGDIER

SEQ ID NO: 465842 - protein, 12 aa, Mycobacterium
EHGLSTANRNGC

SEQ ID NO: 465843 - protein, 4 aa, Mycobacterium
EHGP

SEQ ID NO: 465844 - protein, 19 aa, Mycobacterium
EHGPATPKRSDRKADVSAA

SEQ ID NO: 465845 - protein, 6 aa, Mycobacterium
EHGPDA

SEQ ID NO: 465846 - protein, 11 aa, Mycobacterium
EHGPDALQTRK

SEQ ID NO: 465847 - protein, 21 aa, Mycobacterium
EHGPDALQTRKVSGAAGTSTM

SEQ ID NO: 465848 - protein, 7 aa, Mycobacterium
EHGPLGA

SEQ ID NO: 465849 - protein, 7 aa, Mycobacterium
EHGPQGA

SEQ ID NO: 465850 - protein, 4 aa, Mycobacterium
EHGQ

SEQ ID NO: 465851 - protein, 5 aa, Mycobacterium
EHGQL

SEQ ID NO: 465852 - protein, 4 aa, Mycobacterium
EHGR

SEQ ID NO: 465853 - protein, 13 aa, Mycobacterium
EHGRAQARAAADT

SEQ ID NO: 465854 - protein, 10 aa, Mycobacterium
EHGRGLKSTA

SEQ ID NO: 465855 - protein, 12 aa, Mycobacterium
EHGRNLAGDPRA

SEQ ID NO: 465856 - protein, 7 aa, Mycobacterium
EHGRSAG

SEQ ID NO: 465857 - protein, 5 aa, Mycobacterium
EHGRT

SEQ ID NO: 465858 - protein, 7 aa, Mycobacterium
EHGRTDL

SEQ ID NO: 465859 - protein, 8 aa, Mycobacterium
EHGSDGNF

SEQ ID NO: 465860 - protein, 11 aa, Mycobacterium
EHGSEGEARRT

SEQ ID NO: 465861 - protein, 8 aa, Mycobacterium
EHGSEGKF

SEQ ID NO: 465862 - protein, 8 aa, Mycobacterium
EHGSEGNF

SEQ ID NO: 465863 - protein, 7 aa, Mycobacterium
EHGSEGR

SEQ ID NO: 465864 - protein, 12 aa, Mycobacterium
EHGSNGARQTGT

SEQ ID NO: 465865 - protein, 6 aa, Mycobacterium
EHGSPG

SEQ ID NO: 465866 - protein, 8 aa, Mycobacterium
EHGSPITQ

SEQ ID NO: 465867 - protein, 17 aa, Mycobacterium
EHGTAGQWAATAQPGQP

SEQ ID NO: 465868 - protein, 6 aa, Mycobacterium
EHGTER

SEQ ID NO: 465869 - protein, 5 aa, Mycobacterium
EHGTG

SEQ ID NO: 465870 - protein, 31 aa, Mycobacterium
EHGTGVGRTKKEAELKAASAAWNALQRAHPD

SEQ ID NO: 465871 - protein, 8 aa, Mycobacterium
EHGTPESV

SEQ ID NO: 465872 - protein, 6 aa, Mycobacterium
EHGYPT

SEQ ID NO: 465873 - protein, 9 aa, Mycobacterium
EHHDPTKGS

SEQ ID NO: 465874 - protein, 4 aa, Mycobacterium
EHHE

SEQ ID NO: 465875 - protein, 8 aa, Mycobacterium
EHHGDGYG

SEQ ID NO: 465876 - protein, 5 aa, Mycobacterium
EHHGG

SEQ ID NO: 465877 - protein, 6 aa, Mycobacterium
EHHGGK

SEQ ID NO: 465878 - protein, 8 aa, Mycobacterium
EHHGLSEK

SEQ ID NO: 465879 - protein, 11 aa, Mycobacterium
EHHGPAANRDY

SEQ ID NO: 465880 - protein, 13 aa, Mycobacterium
EHHGPADNRRYTY

SEQ ID NO: 465881 - protein, 4 aa, Mycobacterium
EHHH

SEQ ID NO: 465882 - protein, 11 aa, Mycobacterium
EHHPAGGSHVQ

SEQ ID NO: 465883 - protein, 11 aa, Mycobacterium
EHHPEGGSHVQ

SEQ ID NO: 465884 - protein, 8 aa, Mycobacterium
EHHPRSGA

SEQ ID NO: 465885 - protein, 6 aa, Mycobacterium
EHHPST

SEQ ID NO: 465886 - protein, 12 aa, Mycobacterium
EHHRQKREINGA

SEQ ID NO: 465887 - protein, 9 aa, Mycobacterium
EHHSDSTES

SEQ ID NO: 465888 - protein, 4 aa, Mycobacterium
EHID

SEQ ID NO: 465889 - protein, 12 aa, Mycobacterium
EHKAPAGAQDAY

SEQ ID NO: 465890 - protein, 5 aa, Mycobacterium
EHKEI

SEQ ID NO: 465891 - protein, 7 aa, Mycobacterium
EHKGQPT

SEQ ID NO: 465892 - protein, 4 aa, Mycobacterium
EHKI

SEQ ID NO: 465893 - protein, 4 aa, Mycobacterium
EHKL

SEQ ID NO: 465894 - protein, 7 aa, Mycobacterium
EHLDGAP

SEQ ID NO: 465895 - protein, 8 aa, Mycobacterium
EHLEPSER

SEQ ID NO: 465896 - protein, 8 aa, Mycobacterium
EHLGDRSP

SEQ ID NO: 465897 - protein, 11 aa, Mycobacterium
EHMRDNGTGGR

SEQ ID NO: 465898 - protein, 15 aa, Mycobacterium
EHNADGSVRKPGQDY

SEQ ID NO: 465899 - protein, 8 aa, Mycobacterium
EHNARATA

SEQ ID NO: 465900 - protein, 6 aa, Mycobacterium
EHNDGQ

SEQ ID NO: 465901 - protein, 7 aa, Mycobacterium
EHNDSAG

SEQ ID NO: 465902 - protein, 6 aa, Mycobacterium
EHNIGG

SEQ ID NO: 465903 - protein, 7 aa, Mycobacterium
EHNLPDA

SEQ ID NO: 465904 - protein, 11 aa, Mycobacterium
EHNPAEGSHVE

SEQ ID NO: 465905 - protein, 6 aa, Mycobacterium
EHNPRA

SEQ ID NO: 465906 - protein, 12 aa, Mycobacterium
EHNRTVPAGQLS

SEQ ID NO: 465907 - protein, 7 aa, Mycobacterium
EHNTRTT

SEQ ID NO: 465908 - protein, 4 aa, Mycobacterium
EHPA

SEQ ID NO: 465909 - protein, 5 aa, Mycobacterium
EHPAD

SEQ ID NO: 465910 - protein, 7 aa, Mycobacterium
EHPADGI

SEQ ID NO: 465911 - protein, 7 aa, Mycobacterium
EHPADRT

SEQ ID NO: 465912 - protein, 5 aa, Mycobacterium
EHPAH

SEQ ID NO: 465913 - protein, 5 aa, Mycobacterium
EHPAN

SEQ ID NO: 465914 - protein, 7 aa, Mycobacterium
EHPARDG

SEQ ID NO: 465915 - protein, 31 aa, Mycobacterium
EHPASADAADLDGDGAPERLADTNGDGLADR

SEQ ID NO: 465916 - protein, 10 aa, Mycobacterium
EHPDAEDFNN

SEQ ID NO: 465917 - protein, 8 aa, Mycobacterium
EHPDEPRI

SEQ ID NO: 465918 - protein, 16 aa, Mycobacterium
EHPDGRLRSADDGWSQ

SEQ ID NO: 465919 - protein, 6 aa, Mycobacterium
EHPDGV

SEQ ID NO: 465920 - protein, 6 aa, Mycobacterium
EHPDKL

SEQ ID NO: 465921 - protein, 8 aa, Mycobacterium
EHPDLPAH

SEQ ID NO: 465922 - protein, 10 aa, Mycobacterium
EHPDLSDEAF

SEQ ID NO: 465923 - protein, 19 aa, Mycobacterium
EHPDQQATLARDRDAVQPA

SEQ ID NO: 465924 - protein, 11 aa, Mycobacterium
EHPDQRKELAE

SEQ ID NO: 465925 - protein, 14 aa, Mycobacterium
EHPDQRKELTSTPA

SEQ ID NO: 465926 - protein, 9 aa, Mycobacterium
EHPDQRRAV

SEQ ID NO: 465927 - protein, 12 aa, Mycobacterium
EHPDQRRQIEQD

SEQ ID NO: 465928 - protein, 10 aa, Mycobacterium
EHPDQRRQVH

SEQ ID NO: 465929 - protein, 6 aa, Mycobacterium
EHPDRL

SEQ ID NO: 465930 - protein, 7 aa, Mycobacterium
EHPDRTA

SEQ ID NO: 465931 - protein, 10 aa, Mycobacterium
EHPDSDDFDN

SEQ ID NO: 465932 - protein, 12 aa, Mycobacterium
EHPDTGGLEPGH

SEQ ID NO: 465933 - protein, 5 aa, Mycobacterium
EHPDV

SEQ ID NO: 465934 - protein, 6 aa, Mycobacterium
EHPDWD

SEQ ID NO: 465935 - protein, 4 aa, Mycobacterium
EHPE

SEQ ID NO: 465936 - protein, 5 aa, Mycobacterium
EHPEA

SEQ ID NO: 465937 - protein, 10 aa, Mycobacterium
EHPEGLPRAA

SEQ ID NO: 465938 - protein, 11 aa, Mycobacterium
EHPEQDNAAGA

SEQ ID NO: 465939 - protein, 8 aa, Mycobacterium
EHPESGAR

SEQ ID NO: 465940 - protein, 10 aa, Mycobacterium
EHPGDDPDRV

SEQ ID NO: 465941 - protein, 7 aa, Mycobacterium
EHPGDPV

SEQ ID NO: 465942 - protein, 6 aa, Mycobacterium
EHPGGE

SEQ ID NO: 465943 - protein, 17 aa, Mycobacterium
EHPGGTADIDGDGKPDQ

SEQ ID NO: 465944 - protein, 7 aa, Mycobacterium
EHPGRRR

SEQ ID NO: 465945 - protein, 5 aa, Mycobacterium
EHPGY

SEQ ID NO: 465946 - protein, 16 aa, Mycobacterium
EHPHRESGDDLRASFD

SEQ ID NO: 465947 - protein, 6 aa, Mycobacterium
EHPHRR

SEQ ID NO: 465948 - protein, 7 aa, Mycobacterium
EHPKAGL

SEQ ID NO: 465949 - protein, 7 aa, Mycobacterium
EHPLNDP

SEQ ID NO: 465950 - protein, 16 aa, Mycobacterium
EHPLRRDTRSERQGNS

SEQ ID NO: 465951 - protein, 5 aa, Mycobacterium
EHPLS

SEQ ID NO: 465952 - protein, 5 aa, Mycobacterium
EHPND

SEQ ID NO: 465953 - protein, 8 aa, Mycobacterium
EHPNHPQS

SEQ ID NO: 465954 - protein, 12 aa, Mycobacterium
EHPNQRREVAQD

SEQ ID NO: 465955 - protein, 5 aa, Mycobacterium
EHPNY

SEQ ID NO: 465956 - protein, 4 aa, Mycobacterium
EHPP

SEQ ID NO: 465957 - protein, 9 aa, Mycobacterium
EHPPGDETQ

SEQ ID NO: 465958 - protein, 14 aa, Mycobacterium
EHPPGGLAGDGERF

SEQ ID NO: 465959 - protein, 12 aa, Mycobacterium
EHPRADTSPESL

SEQ ID NO: 465960 - protein, 9 aa, Mycobacterium
EHPRAEDVR

SEQ ID NO: 465961 - protein, 7 aa, Mycobacterium
EHPRGDA

SEQ ID NO: 465962 - protein, 20 aa, Mycobacterium
EHPRGTRIGADRIGAQSWTC

SEQ ID NO: 465963 - protein, 5 aa, Mycobacterium
EHPRL

SEQ ID NO: 465964 - protein, 5 aa, Mycobacterium
EHPRP

SEQ ID NO: 465965 - protein, 7 aa, Mycobacterium
EHPRPSG

SEQ ID NO: 465966 - protein, 9 aa, Mycobacterium
EHPRRDTSM

SEQ ID NO: 465967 - protein, 9 aa, Mycobacterium
EHPRYGSAD

SEQ ID NO: 465968 - protein, 8 aa, Mycobacterium
EHPSARSK

SEQ ID NO: 465969 - protein, 7 aa, Mycobacterium
EHPSDDS

SEQ ID NO: 465970 - protein, 8 aa, Mycobacterium
EHPSFSQA

SEQ ID NO: 465971 - protein, 6 aa, Mycobacterium
EHPSSD

SEQ ID NO: 465972 - protein, 8 aa, Mycobacterium
EHPSSGTA

SEQ ID NO: 465973 - protein, 6 aa, Mycobacterium
EHPSTA

SEQ ID NO: 465974 - protein, 9 aa, Mycobacterium
EHPSTGAPL

SEQ ID NO: 465975 - protein, 8 aa, Mycobacterium
EHPTGPYN

SEQ ID NO: 465976 - protein, 5 aa, Mycobacterium
EHPTR

SEQ ID NO: 465977 - protein, 6 aa, Mycobacterium
EHPTSG

SEQ ID NO: 465978 - protein, 13 aa, Mycobacterium
EHPTTPDTAPALT

SEQ ID NO: 465979 - protein, 13 aa, Mycobacterium
EHPTTPDTAPTLT

SEQ ID NO: 465980 - protein, 13 aa, Mycobacterium
EHPTTPNTAPALT

SEQ ID NO: 465981 - protein, 13 aa, Mycobacterium
EHPTTPNTPPALT

SEQ ID NO: 465982 - protein, 11 aa, Mycobacterium
EHPTVEDAAEA

SEQ ID NO: 465983 - protein, 5 aa, Mycobacterium
EHPVD

SEQ ID NO: 465984 - protein, 4 aa, Mycobacterium
EHPY

SEQ ID NO: 465985 - protein, 11 aa, Mycobacterium
EHPYPAAQDDV

SEQ ID NO: 465986 - protein, 7 aa, Mycobacterium
EHPYPAG

SEQ ID NO: 465987 - protein, 7 aa, Mycobacterium
EHPYPAQ

SEQ ID NO: 465988 - protein, 6 aa, Mycobacterium
EHPYPD

SEQ ID NO: 465989 - protein, 7 aa, Mycobacterium
EHPYPTP

SEQ ID NO: 465990 - protein, 10 aa, Mycobacterium
EHQASNFGSA

SEQ ID NO: 465991 - protein, 24 aa, Mycobacterium
EHQDDDPDAPGLHQSRRDLPDEST

SEQ ID NO: 465992 - protein, 9 aa, Mycobacterium
EHQGEPLPA

SEQ ID NO: 465993 - protein, 6 aa, Mycobacterium
EHQGKR

SEQ ID NO: 465994 - protein, 6 aa, Mycobacterium
EHQGQP

SEQ ID NO: 465995 - protein, 12 aa, Mycobacterium
EHQKSTHDPMNN

SEQ ID NO: 465996 - protein, 5 aa, Mycobacterium
EHQLR

SEQ ID NO: 465997 - protein, 8 aa, Mycobacterium
EHQNDDMG

SEQ ID NO: 465998 - protein, 4 aa, Mycobacterium
EHQP

SEQ ID NO: 465999 - protein, 20 aa, Mycobacterium
EHQPDSGGAAARAALEANPR

SEQ ID NO: 466000 - protein, 6 aa, Mycobacterium
EHQPHG

SEQ ID NO: 466001 - protein, 4 aa, Mycobacterium
EHQR

SEQ ID NO: 466002 - protein, 17 aa, Mycobacterium
EHQRATERAAAHAGASA

SEQ ID NO: 466003 - protein, 76 aa, Mycobacterium
EHQSPAAPMASGAATSGKARRVRPVGEPAVAAGATSTAGAEQSRRAAGATRSPIAGADSCGGCRPRPAWPTGATVA

SEQ ID NO: 466004 - protein, 6 aa, Mycobacterium
EHQTLD

SEQ ID NO: 466005 - protein, 5 aa, Mycobacterium
EHQTS

SEQ ID NO: 466006 - protein, 6 aa, Mycobacterium
EHQTYT

SEQ ID NO: 466007 - protein, 9 aa, Mycobacterium
EHQVDGARR

SEQ ID NO: 466008 - protein, 10 aa, Mycobacterium
EHQWAGDPRV

SEQ ID NO: 466009 - protein, 6 aa, Mycobacterium
EHRADP

SEQ ID NO: 466010 - protein, 5 aa, Mycobacterium
EHRAP

SEQ ID NO: 466011 - protein, 9 aa, Mycobacterium
EHRARNGTN

SEQ ID NO: 466012 - protein, 20 aa, Mycobacterium
EHRDAELPASVSGHVDEETV

SEQ ID NO: 466013 - protein, 9 aa, Mycobacterium
EHRDAGATQ

SEQ ID NO: 466014 - protein, 10 aa, Mycobacterium
EHRDGHRVTT

SEQ ID NO: 466015 - protein, 9 aa, Mycobacterium
EHRDGHVES

SEQ ID NO: 466016 - protein, 9 aa, Mycobacterium
EHRDNPATG

SEQ ID NO: 466017 - protein, 8 aa, Mycobacterium
EHRDPAVE

SEQ ID NO: 466018 - protein, 7 aa, Mycobacterium
EHRDSAG

SEQ ID NO: 466019 - protein, 7 aa, Mycobacterium
EHRDSGG

SEQ ID NO: 466020 - protein, 7 aa, Mycobacterium
EHRDSSG

SEQ ID NO: 466021 - protein, 9 aa, Mycobacterium
EHREQAGAL

SEQ ID NO: 466022 - protein, 6 aa, Mycobacterium
EHRERR

SEQ ID NO: 466023 - protein, 5 aa, Mycobacterium
EHRGA

SEQ ID NO: 466024 - protein, 12 aa, Mycobacterium
EHRGDAAFGPGF

SEQ ID NO: 466025 - protein, 6 aa, Mycobacterium
EHRGEA

SEQ ID NO: 466026 - protein, 10 aa, Mycobacterium
EHRGRRGRRP

SEQ ID NO: 466027 - protein, 9 aa, Mycobacterium
EHRGRRPGH

SEQ ID NO: 466028 - protein, 4 aa, Mycobacterium
EHRH

SEQ ID NO: 466029 - protein, 7 aa, Mycobacterium
EHRHRAP

SEQ ID NO: 466030 - protein, 13 aa, Mycobacterium
EHRNMRDGGWQSA

SEQ ID NO: 466031 - protein, 13 aa, Mycobacterium
EHRNRTAQRWPAG

SEQ ID NO: 466032 - protein, 6 aa, Mycobacterium
EHRPAG

SEQ ID NO: 466033 - protein, 14 aa, Mycobacterium
EHRPDGAAVVLARG

SEQ ID NO: 466034 - protein, 8 aa, Mycobacterium
EHRPFTPS

SEQ ID NO: 466035 - protein, 5 aa, Mycobacterium
EHRPK

SEQ ID NO: 466036 - protein, 9 aa, Mycobacterium
EHRQPKVRR

SEQ ID NO: 466037 - protein, 4 aa, Mycobacterium
EHRR

SEQ ID NO: 466038 - protein, 10 aa, Mycobacterium
EHRRADGSLY

SEQ ID NO: 466039 - protein, 5 aa, Mycobacterium
EHRRD

SEQ ID NO: 466040 - protein, 6 aa, Mycobacterium
EHRRDD

SEQ ID NO: 466041 - protein, 5 aa, Mycobacterium
EHRRR

SEQ ID NO: 466042 - protein, 5 aa, Mycobacterium
EHRRS

SEQ ID NO: 466043 - protein, 16 aa, Mycobacterium
EHRRTRPYRPQTNGKV

SEQ ID NO: 466044 - protein, 7 aa, Mycobacterium
EHRSAES

SEQ ID NO: 466045 - protein, 7 aa, Mycobacterium
EHRSASP

SEQ ID NO: 466046 - protein, 5 aa, Mycobacterium
EHRSC

SEQ ID NO: 466047 - protein, 6 aa, Mycobacterium
EHRSRL

SEQ ID NO: 466048 - protein, 6 aa, Mycobacterium
EHRSSV

SEQ ID NO: 466049 - protein, 13 aa, Mycobacterium
EHRSTVSPYLVRQ

SEQ ID NO: 466050 - protein, 13 aa, Mycobacterium
EHRSTVSPYLVTQ

SEQ ID NO: 466051 - protein, 6 aa, Mycobacterium
EHRTAE

SEQ ID NO: 466052 - protein, 7 aa, Mycobacterium
EHRTSEG

SEQ ID NO: 466053 - protein, 4 aa, Mycobacterium
EHSA

SEQ ID NO: 466054 - protein, 15 aa, Mycobacterium
EHSADSALSEAKHAQ

SEQ ID NO: 466055 - protein, 8 aa, Mycobacterium
EHSAGAHP

SEQ ID NO: 466056 - protein, 7 aa, Mycobacterium
EHSAPGT

SEQ ID NO: 466057 - protein, 6 aa, Mycobacterium
EHSARA

SEQ ID NO: 466058 - protein, 8 aa, Mycobacterium
EHSDPGDP

SEQ ID NO: 466059 - protein, 11 aa, Mycobacterium
EHSDPKRGEQL

SEQ ID NO: 466060 - protein, 9 aa, Mycobacterium
EHSDYRADP

SEQ ID NO: 466061 - protein, 8 aa, Mycobacterium
EHSETAQQ

SEQ ID NO: 466062 - protein, 4 aa, Mycobacterium
EHSG

SEQ ID NO: 466063 - protein, 12 aa, Mycobacterium
EHSGAHGPPASL

SEQ ID NO: 466064 - protein, 5 aa, Mycobacterium
EHSGD

SEQ ID NO: 466065 - protein, 17 aa, Mycobacterium
EHSGGGVGGTGKESLAH

SEQ ID NO: 466066 - protein, 9 aa, Mycobacterium
EHSGGSSKH

SEQ ID NO: 466067 - protein, 10 aa, Mycobacterium
EHSGNDDPTI

SEQ ID NO: 466068 - protein, 14 aa, Mycobacterium
EHSHAGGGLPSYPH

SEQ ID NO: 466069 - protein, 6 aa, Mycobacterium
EHSHGL

SEQ ID NO: 466070 - protein, 13 aa, Mycobacterium
EHSHPGGGLPSYP

SEQ ID NO: 466071 - protein, 4 aa, Mycobacterium
EHSM

SEQ ID NO: 466072 - protein, 9 aa, Mycobacterium
EHSNEEGRA

SEQ ID NO: 466073 - protein, 7 aa, Mycobacterium
EHSPGGL

SEQ ID NO: 466074 - protein, 7 aa, Mycobacterium
EHSQGST

SEQ ID NO: 466075 - protein, 5 aa, Mycobacterium
EHSRR

SEQ ID NO: 466076 - protein, 5 aa, Mycobacterium
EHSSA

SEQ ID NO: 466077 - protein, 11 aa, Mycobacterium
EHSSAFGPPTS

SEQ ID NO: 466078 - protein, 10 aa, Mycobacterium
EHSTPDLSGR

SEQ ID NO: 466079 - protein, 7 aa, Mycobacterium
EHSVTEQ

SEQ ID NO: 466080 - protein, 20 aa, Mycobacterium
EHTAQVEPSKRQQREDEFSN

SEQ ID NO: 466081 - protein, 7 aa, Mycobacterium
EHTDGDK

SEQ ID NO: 466082 - protein, 8 aa, Mycobacterium
EHTEDQLT

SEQ ID NO: 466083 - protein, 10 aa, Mycobacterium
EHTGDTGGGV

SEQ ID NO: 466084 - protein, 11 aa, Mycobacterium
EHTGNTSAASV

SEQ ID NO: 466085 - protein, 5 aa, Mycobacterium
EHTGR

SEQ ID NO: 466086 - protein, 11 aa, Mycobacterium
EHTGRGKIPRA

SEQ ID NO: 466087 - protein, 7 aa, Mycobacterium
EHTGSGP

SEQ ID NO: 466088 - protein, 10 aa, Mycobacterium
EHTKRASRAE

SEQ ID NO: 466089 - protein, 7 aa, Mycobacterium
EHTNHPT

SEQ ID NO: 466090 - protein, 21 aa, Mycobacterium
EHTPDSYDEARTALEGADERG

SEQ ID NO: 466091 - protein, 5 aa, Mycobacterium
EHTPS

SEQ ID NO: 466092 - protein, 6 aa, Mycobacterium
EHTQAE

SEQ ID NO: 466093 - protein, 7 aa, Mycobacterium
EHTQESE

SEQ ID NO: 466094 - protein, 10 aa, Mycobacterium
EHTQPVPGLA

SEQ ID NO: 466095 - protein, 5 aa, Mycobacterium
EHTST

SEQ ID NO: 466096 - protein, 7 aa, Mycobacterium
EHTTKVS

SEQ ID NO: 466097 - protein, 14 aa, Mycobacterium
EHTTRTGAAPTSIA

SEQ ID NO: 466098 - protein, 9 aa, Mycobacterium
EHTVAEQDE

SEQ ID NO: 466099 - protein, 6 aa, Mycobacterium
EHTVEE

SEQ ID NO: 466100 - protein, 5 aa, Mycobacterium
EHVED

SEQ ID NO: 466101 - protein, 4 aa, Mycobacterium
EHVG

SEQ ID NO: 466102 - protein, 5 aa, Mycobacterium
EHVGE

SEQ ID NO: 466103 - protein, 4 aa, Mycobacterium
EHVN

SEQ ID NO: 466104 - protein, 12 aa, Mycobacterium
EHVPDPNAFSDE

SEQ ID NO: 466105 - protein, 12 aa, Mycobacterium
EHVQREGESVEE

SEQ ID NO: 466106 - protein, 9 aa, Mycobacterium
EHVRPTGSQ

SEQ ID NO: 466107 - protein, 4 aa, Mycobacterium
EHVS

SEQ ID NO: 466108 - protein, 5 aa, Mycobacterium
EHVTD

SEQ ID NO: 466109 - protein, 20 aa, Mycobacterium
EHYGGLDPDAVTEKFRLAWS

SEQ ID NO: 466110 - protein, 8 aa, Mycobacterium
EHYPADNP

SEQ ID NO: 466111 - protein, 6 aa, Mycobacterium
EHYTGD

SEQ ID NO: 466112 - protein, 7 aa, Mycobacterium
EHYTSEE

SEQ ID NO: 466113 - protein, 5 aa, Mycobacterium
EIAAA

SEQ ID NO: 466114 - protein, 6 aa, Mycobacterium
EIAAAS

SEQ ID NO: 466115 - protein, 9 aa, Mycobacterium
EIAAASRAD

SEQ ID NO: 466116 - protein, 7 aa, Mycobacterium
EIAAASS

SEQ ID NO: 466117 - protein, 7 aa, Mycobacterium
EIAAQRG

SEQ ID NO: 466118 - protein, 12 aa, Mycobacterium
EIAARSGGAEVG

SEQ ID NO: 466119 - protein, 9 aa, Mycobacterium
EIADEQPAA

SEQ ID NO: 466120 - protein, 11 aa, Mycobacterium
EIADGKHDDQF

SEQ ID NO: 466121 - protein, 4 aa, Mycobacterium
EIAE

SEQ ID NO: 466122 - protein, 10 aa, Mycobacterium
EIAEGKHDDQ

SEQ ID NO: 466123 - protein, 5 aa, Mycobacterium
EIAGA

SEQ ID NO: 466124 - protein, 17 aa, Mycobacterium
EIAGAARQLAGGSGPFA

SEQ ID NO: 466125 - protein, 15 aa, Mycobacterium
EIAGAGHASATGRFD

SEQ ID NO: 466126 - protein, 7 aa, Mycobacterium
EIAGAPA

SEQ ID NO: 466127 - protein, 8 aa, Mycobacterium
EIAGAPED

SEQ ID NO: 466128 - protein, 8 aa, Mycobacterium
EIAGAPSD

SEQ ID NO: 466129 - protein, 9 aa, Mycobacterium
EIAGAPSDY

SEQ ID NO: 466130 - protein, 12 aa, Mycobacterium
EIAGARAAAEAG

SEQ ID NO: 466131 - protein, 5 aa, Mycobacterium
EIAGP

SEQ ID NO: 466132 - protein, 6 aa, Mycobacterium
EIAGPD

SEQ ID NO: 466133 - protein, 9 aa, Mycobacterium
EIAGRDPGE

SEQ ID NO: 466134 - protein, 7 aa, Mycobacterium
EIAGRTA

SEQ ID NO: 466135 - protein, 10 aa, Mycobacterium
EIAKASRTAC

SEQ ID NO: 466136 - protein, 17 aa, Mycobacterium
EIAKGSPQGLATSKALT

SEQ ID NO: 466137 - protein, 19 aa, Mycobacterium
EIAPDERDTASPEDENEHD

SEQ ID NO: 466138 - protein, 5 aa, Mycobacterium
EIAPE

SEQ ID NO: 466139 - protein, 18 aa, Mycobacterium
EIAPHAADVDENARFPQE

SEQ ID NO: 466140 - protein, 18 aa, Mycobacterium
EIAPHAKDVDEKARFPQE

SEQ ID NO: 466141 - protein, 16 aa, Mycobacterium
EIAPHSHAATKDSRFT

SEQ ID NO: 466142 - protein, 9 aa, Mycobacterium
EIAPNTTDG

SEQ ID NO: 466143 - protein, 12 aa, Mycobacterium
EIAPPDATTPAT

SEQ ID NO: 466144 - protein, 17 aa, Mycobacterium
EIAPRDPEAAPDPDAGA

SEQ ID NO: 466145 - protein, 8 aa, Mycobacterium
EIAPSAPA

SEQ ID NO: 466146 - protein, 7 aa, Mycobacterium
EIAQPGD

SEQ ID NO: 466147 - protein, 13 aa, Mycobacterium
EIARGAGVRPREK

SEQ ID NO: 466148 - protein, 14 aa, Mycobacterium
EIARGGDDRPRDKF

SEQ ID NO: 466149 - protein, 22 aa, Mycobacterium
EIARGKRQRRAPTPHRNTKESA

SEQ ID NO: 466150 - protein, 4 aa, Mycobacterium
EIAS

SEQ ID NO: 466151 - protein, 6 aa, Mycobacterium
EIASAS

SEQ ID NO: 466152 - protein, 10 aa, Mycobacterium
EIASASEADT

SEQ ID NO: 466153 - protein, 10 aa, Mycobacterium
EIASGNERRT

SEQ ID NO: 466154 - protein, 13 aa, Mycobacterium
EIATRSGLAGPTL

SEQ ID NO: 466155 - protein, 4 aa, Mycobacterium
EIDA

SEQ ID NO: 466156 - protein, 11 aa, Mycobacterium
EIDAAKDRANR

SEQ ID NO: 466157 - protein, 11 aa, Mycobacterium
EIDAANARDLT

SEQ ID NO: 466158 - protein, 21 aa, Mycobacterium
EIDARTPSPASRDASRAQGRG

SEQ ID NO: 466159 - protein, 9 aa, Mycobacterium
EIDASNAER

SEQ ID NO: 466160 - protein, 14 aa, Mycobacterium
EIDDPRIRGQSHTH

SEQ ID NO: 466161 - protein, 12 aa, Mycobacterium
EIDEADEISSQI

SEQ ID NO: 466162 - protein, 7 aa, Mycobacterium
EIDEAEY

SEQ ID NO: 466163 - protein, 17 aa, Mycobacterium
EIDEKSAAKELKPESAA

SEQ ID NO: 466164 - protein, 7 aa, Mycobacterium
EIDESEQ

SEQ ID NO: 466165 - protein, 4 aa, Mycobacterium
EIDG

SEQ ID NO: 466166 - protein, 9 aa, Mycobacterium
EIDGEKLTD

SEQ ID NO: 466167 - protein, 24 aa, Mycobacterium
EIDGHRASAQNSPTTRSPRPAEAP

SEQ ID NO: 466168 - protein, 10 aa, Mycobacterium
EIDGPSGPVA

SEQ ID NO: 466169 - protein, 7 aa, Mycobacterium
EIDGRTE

SEQ ID NO: 466170 - protein, 5 aa, Mycobacterium
EIDGT

SEQ ID NO: 466171 - protein, 12 aa, Mycobacterium
EIDHDEQAQRDR

SEQ ID NO: 466172 - protein, 10 aa, Mycobacterium
EIDKTEDGYR

SEQ ID NO: 466173 - protein, 19 aa, Mycobacterium
EIDPADRDGLTEQGVEVVI

SEQ ID NO: 466174 - protein, 7 aa, Mycobacterium
EIDPGSS

SEQ ID NO: 466175 - protein, 12 aa, Mycobacterium
EIDPGTGEAPEW

SEQ ID NO: 466176 - protein, 18 aa, Mycobacterium
EIDPNDPSAIVTTSRDGL

SEQ ID NO: 466177 - protein, 6 aa, Mycobacterium
EIDPNT

SEQ ID NO: 466178 - protein, 16 aa, Mycobacterium
EIDPRNPDQYHSDGRD

SEQ ID NO: 466179 - protein, 5 aa, Mycobacterium
EIDRA

SEQ ID NO: 466180 - protein, 19 aa, Mycobacterium
EIDRATKSVLTADGQRHDY

SEQ ID NO: 466181 - protein, 10 aa, Mycobacterium
EIDRDTERAH

SEQ ID NO: 466182 - protein, 5 aa, Mycobacterium
EIDRT

SEQ ID NO: 466183 - protein, 9 aa, Mycobacterium
EIDSAETAI

SEQ ID NO: 466184 - protein, 11 aa, Mycobacterium
EIDSPESEKAK

SEQ ID NO: 466185 - protein, 9 aa, Mycobacterium
EIDSPRRKE

SEQ ID NO: 466186 - protein, 15 aa, Mycobacterium
EIDSSGATLSDGTRV

SEQ ID NO: 466187 - protein, 11 aa, Mycobacterium
EIDSTGPGQAI

SEQ ID NO: 466188 - protein, 4 aa, Mycobacterium
EIDT

SEQ ID NO: 466189 - protein, 10 aa, Mycobacterium
EIDTAKERAN

SEQ ID NO: 466190 - protein, 9 aa, Mycobacterium
EIDTNSATG

SEQ ID NO: 466191 - protein, 7 aa, Mycobacterium
EIEAAGG

SEQ ID NO: 466192 - protein, 10 aa, Mycobacterium
EIEAETGRAA

SEQ ID NO: 466193 - protein, 11 aa, Mycobacterium
EIEAETGRSAM

SEQ ID NO: 466194 - protein, 6 aa, Mycobacterium
EIEDQP

SEQ ID NO: 466195 - protein, 12 aa, Mycobacterium
EIEESRGARDAR

SEQ ID NO: 466196 - protein, 6 aa, Mycobacterium
EIEGGA

SEQ ID NO: 466197 - protein, 9 aa, Mycobacterium
EIEGNGGTA

SEQ ID NO: 466198 - protein, 18 aa, Mycobacterium
EIEGQPAPTTTAPAARPA

SEQ ID NO: 466199 - protein, 12 aa, Mycobacterium
EIEKSDSEWDRE

SEQ ID NO: 466200 - protein, 14 aa, Mycobacterium
EIENSDSDYDREKL

SEQ ID NO: 466201 - protein, 9 aa, Mycobacterium
EIENSYNPD

SEQ ID NO: 466202 - protein, 15 aa, Mycobacterium
EIEPEERQAQEVNDR

SEQ ID NO: 466203 - protein, 12 aa, Mycobacterium
EIEPGTPAPQAR

SEQ ID NO: 466204 - protein, 6 aa, Mycobacterium
EIEPNT

SEQ ID NO: 466205 - protein, 21 aa, Mycobacterium
EIEPSESVEADQQIPSKLATA

SEQ ID NO: 466206 - protein, 8 aa, Mycobacterium
EIEPSQTR

SEQ ID NO: 466207 - protein, 14 aa, Mycobacterium
EIERDEDGTYVIRI

SEQ ID NO: 466208 - protein, 9 aa, Mycobacterium
EIERGDTPI

SEQ ID NO: 466209 - protein, 8 aa, Mycobacterium
EIESARGP

SEQ ID NO: 466210 - protein, 9 aa, Mycobacterium
EIESQMTDD

SEQ ID NO: 466211 - protein, 20 aa, Mycobacterium
EIESRARADYPGAGDAEQEA

SEQ ID NO: 466212 - protein, 13 aa, Mycobacterium
EIESTDSDWDREK

SEQ ID NO: 466213 - protein, 4 aa, Mycobacterium
EIET

SEQ ID NO: 466214 - protein, 9 aa, Mycobacterium
EIETPGDGQ

SEQ ID NO: 466215 - protein, 13 aa, Mycobacterium
EIETTDSDWDREK

SEQ ID NO: 466216 - protein, 5 aa, Mycobacterium
EIGAA

SEQ ID NO: 466217 - protein, 19 aa, Mycobacterium
EIGAAGDGSGGPAGSLDDE

SEQ ID NO: 466218 - protein, 10 aa, Mycobacterium
EIGADGPSQM

SEQ ID NO: 466219 - protein, 8 aa, Mycobacterium
EIGAGNKL

SEQ ID NO: 466220 - protein, 5 aa, Mycobacterium
EIGAK

SEQ ID NO: 466221 - protein, 14 aa, Mycobacterium
EIGDSTVNPAAQQV

SEQ ID NO: 466222 - protein, 7 aa, Mycobacterium
EIGDTTA

SEQ ID NO: 466223 - protein, 4 aa, Mycobacterium
EIGE

SEQ ID NO: 466224 - protein, 4 aa, Mycobacterium
EIGG

SEQ ID NO: 466225 - protein, 20 aa, Mycobacterium
EIGGDPGRLAVGGDSAGGNL

SEQ ID NO: 466226 - protein, 8 aa, Mycobacterium
EIGGDQAE

SEQ ID NO: 466227 - protein, 6 aa, Mycobacterium
EIGGGS

SEQ ID NO: 466228 - protein, 9 aa, Mycobacterium
EIGGIDDAR

SEQ ID NO: 466229 - protein, 8 aa, Mycobacterium
EIGGKDSA

SEQ ID NO: 466230 - protein, 5 aa, Mycobacterium
EIGGP

SEQ ID NO: 466231 - protein, 12 aa, Mycobacterium
EIGGPRASNEYP

SEQ ID NO: 466232 - protein, 5 aa, Mycobacterium
EIGGQ

SEQ ID NO: 466233 - protein, 5 aa, Mycobacterium
EIGGS

SEQ ID NO: 466234 - protein, 9 aa, Mycobacterium
EIGGSGGDL

SEQ ID NO: 466235 - protein, 7 aa, Mycobacterium
EIGGSGR

SEQ ID NO: 466236 - protein, 7 aa, Mycobacterium
EIGITDD

SEQ ID NO: 466237 - protein, 5 aa, Mycobacterium
EIGKS

SEQ ID NO: 466238 - protein, 6 aa, Mycobacterium
EIGKSS

SEQ ID NO: 466239 - protein, 7 aa, Mycobacterium
EIGPESE

SEQ ID NO: 466240 - protein, 14 aa, Mycobacterium
EIGPGESTHPPTWT

SEQ ID NO: 466241 - protein, 7 aa, Mycobacterium
EIGPGYG

SEQ ID NO: 466242 - protein, 25 aa, Mycobacterium
EIGPSLPGETRRGSALDDAQQQAVS

SEQ ID NO: 466243 - protein, 12 aa, Mycobacterium
EIGPSPAEADQA

SEQ ID NO: 466244 - protein, 11 aa, Mycobacterium
EIGPYGSSRTR

SEQ ID NO: 466245 - protein, 8 aa, Mycobacterium
EIGQGAGA

SEQ ID NO: 466246 - protein, 4 aa, Mycobacterium
EIGR

SEQ ID NO: 466247 - protein, 14 aa, Mycobacterium
EIGRNISDEKTDGS

SEQ ID NO: 466248 - protein, 5 aa, Mycobacterium
EIGRQ

SEQ ID NO: 466249 - protein, 11 aa, Mycobacterium
EIGRTDEDTPL

SEQ ID NO: 466250 - protein, 9 aa, Mycobacterium
EIGRTQLGN

SEQ ID NO: 466251 - protein, 11 aa, Mycobacterium
EIGRTQQGNNN

SEQ ID NO: 466252 - protein, 4 aa, Mycobacterium
EIGS

SEQ ID NO: 466253 - protein, 6 aa, Mycobacterium
EIGSGS

SEQ ID NO: 466254 - protein, 10 aa, Mycobacterium
EIGSGSAPQR

SEQ ID NO: 466255 - protein, 7 aa, Mycobacterium
EIGSGSV

SEQ ID NO: 466256 - protein, 9 aa, Mycobacterium
EIGSGSVPQ

SEQ ID NO: 466257 - protein, 12 aa, Mycobacterium
EIGSGTAGYTAV

SEQ ID NO: 466258 - protein, 8 aa, Mycobacterium
EIGSGTVP

SEQ ID NO: 466259 - protein, 8 aa, Mycobacterium
EIGSKTTT

SEQ ID NO: 466260 - protein, 11 aa, Mycobacterium
EIGTAAQAREL

SEQ ID NO: 466261 - protein, 13 aa, Mycobacterium
EIGTTPLSDLEDA

SEQ ID NO: 466262 - protein, 13 aa, Mycobacterium
EIGTTPLSGLDDA

SEQ ID NO: 466263 - protein, 9 aa, Mycobacterium
EIKAKDPQA

SEQ ID NO: 466264 - protein, 10 aa, Mycobacterium
EIKEQQYATE

SEQ ID NO: 466265 - protein, 6 aa, Mycobacterium
EIKGGE

SEQ ID NO: 466266 - protein, 8 aa, Mycobacterium
EIKGQAPR

SEQ ID NO: 466267 - protein, 11 aa, Mycobacterium
EIKNGQRKQVN

SEQ ID NO: 466268 - protein, 10 aa, Mycobacterium
EIKPAAKANT

SEQ ID NO: 466269 - protein, 9 aa, Mycobacterium
EIKPDPRNH

SEQ ID NO: 466270 - protein, 11 aa, Mycobacterium
EIKPGGTPRAA

SEQ ID NO: 466271 - protein, 8 aa, Mycobacterium
EIKPGVTA

SEQ ID NO: 466272 - protein, 9 aa, Mycobacterium
EIKQNEARD

SEQ ID NO: 466273 - protein, 5 aa, Mycobacterium
EILGD

SEQ ID NO: 466274 - protein, 15 aa, Mycobacterium
EILGEGPSAAAADID

SEQ ID NO: 466275 - protein, 12 aa, Mycobacterium
EINDGKPADQRI

SEQ ID NO: 466276 - protein, 12 aa, Mycobacterium
EINGEEHREIPA

SEQ ID NO: 466277 - protein, 6 aa, Mycobacterium
EINPGA

SEQ ID NO: 466278 - protein, 7 aa, Mycobacterium
EINRSHP

SEQ ID NO: 466279 - protein, 12 aa, Mycobacterium
EINSGGYPAATA

SEQ ID NO: 466280 - protein, 12 aa, Mycobacterium
EINTVRGNRNRM

SEQ ID NO: 466281 - protein, 8 aa, Mycobacterium
EINTVTGN

SEQ ID NO: 466282 - protein, 8 aa, Mycobacterium
EIPAAKAS

SEQ ID NO: 466283 - protein, 10 aa, Mycobacterium
EIPADRPALE

SEQ ID NO: 466284 - protein, 12 aa, Mycobacterium
EIPAGGTSEFDP

SEQ ID NO: 466285 - protein, 7 aa, Mycobacterium
EIPAGGV

SEQ ID NO: 466286 - protein, 6 aa, Mycobacterium
EIPAGT

SEQ ID NO: 466287 - protein, 9 aa, Mycobacterium
EIPAPTTLA

SEQ ID NO: 466288 - protein, 11 aa, Mycobacterium
EIPASLEPGHY

SEQ ID NO: 466289 - protein, 4 aa, Mycobacterium
EIPD

SEQ ID NO: 466290 - protein, 9 aa, Mycobacterium
EIPDDAKPT

SEQ ID NO: 466291 - protein, 7 aa, Mycobacterium
EIPDKGR

SEQ ID NO: 466292 - protein, 10 aa, Mycobacterium
EIPDPQDPQT

SEQ ID NO: 466293 - protein, 6 aa, Mycobacterium
EIPDSH

SEQ ID NO: 466294 - protein, 5 aa, Mycobacterium
EIPDT

SEQ ID NO: 466295 - protein, 8 aa, Mycobacterium
EIPEPGTP

SEQ ID NO: 466296 - protein, 7 aa, Mycobacterium
EIPERHG

SEQ ID NO: 466297 - protein, 5 aa, Mycobacterium
EIPFP

SEQ ID NO: 466298 - protein, 5 aa, Mycobacterium
EIPGE

SEQ ID NO: 466299 - protein, 6 aa, Mycobacterium
EIPGGQ

SEQ ID NO: 466300 - protein, 15 aa, Mycobacterium
EIPGGVRTTTESDAA

SEQ ID NO: 466301 - protein, 6 aa, Mycobacterium
EIPGHG

SEQ ID NO: 466302 - protein, 8 aa, Mycobacterium
EIPGPSGT

SEQ ID NO: 466303 - protein, 5 aa, Mycobacterium
EIPGQ

SEQ ID NO: 466304 - protein, 6 aa, Mycobacterium
EIPHDG

SEQ ID NO: 466305 - protein, 6 aa, Mycobacterium
EIPHEG

SEQ ID NO: 466306 - protein, 4 aa, Mycobacterium
EIPN

SEQ ID NO: 466307 - protein, 6 aa, Mycobacterium
EIPNPH

SEQ ID NO: 466308 - protein, 9 aa, Mycobacterium
EIPPAGTRH

SEQ ID NO: 466309 - protein, 6 aa, Mycobacterium
EIPPAN

SEQ ID NO: 466310 - protein, 5 aa, Mycobacterium
EIPPD

SEQ ID NO: 466311 - protein, 9 aa, Mycobacterium
EIPPDRPAL

SEQ ID NO: 466312 - protein, 7 aa, Mycobacterium
EIPPDRW

SEQ ID NO: 466313 - protein, 7 aa, Mycobacterium
EIPPGGN

SEQ ID NO: 466314 - protein, 8 aa, Mycobacterium
EIPPQSGD

SEQ ID NO: 466315 - protein, 5 aa, Mycobacterium
EIPPR

SEQ ID NO: 466316 - protein, 5 aa, Mycobacterium
EIPPT

SEQ ID NO: 466317 - protein, 10 aa, Mycobacterium
EIPQDDPSVR

SEQ ID NO: 466318 - protein, 4 aa, Mycobacterium
EIPR

SEQ ID NO: 466319 - protein, 10 aa, Mycobacterium
EIPREKRAAA

SEQ ID NO: 466320 - protein, 11 aa, Mycobacterium
EIPSFAPPKDL

SEQ ID NO: 466321 - protein, 16 aa, Mycobacterium
EIPSFAPPKDLRPGDY

SEQ ID NO: 466322 - protein, 15 aa, Mycobacterium
EIPSFAPPKELQPGE

SEQ ID NO: 466323 - protein, 12 aa, Mycobacterium
EIPSGKRNTAIA

SEQ ID NO: 466324 - protein, 7 aa, Mycobacterium
EIPSGSQ

SEQ ID NO: 466325 - protein, 7 aa, Mycobacterium
EIPSPHA

SEQ ID NO: 466326 - protein, 6 aa, Mycobacterium
EIPSPY

SEQ ID NO: 466327 - protein, 12 aa, Mycobacterium
EIPTAGGKEAEF

SEQ ID NO: 466328 - protein, 13 aa, Mycobacterium
EIPTGDNKTYQTR

SEQ ID NO: 466329 - protein, 8 aa, Mycobacterium
EIPTTAQE

SEQ ID NO: 466330 - protein, 6 aa, Mycobacterium
EIPVPN

SEQ ID NO: 466331 - protein, 8 aa, Mycobacterium
EIQARGGN

SEQ ID NO: 466332 - protein, 15 aa, Mycobacterium
EIQGGASLTPEGGIN

SEQ ID NO: 466333 - protein, 7 aa, Mycobacterium
EIQGGQV

SEQ ID NO: 466334 - protein, 7 aa, Mycobacterium
EIQPLGR

SEQ ID NO: 466335 - protein, 5 aa, Mycobacterium
EIQQN

SEQ ID NO: 466336 - protein, 8 aa, Mycobacterium
EIQQTPTA

SEQ ID NO: 466337 - protein, 10 aa, Mycobacterium
EIQTEQESVN

SEQ ID NO: 466338 - protein, 8 aa, Mycobacterium
EIRATNPP

SEQ ID NO: 466339 - protein, 10 aa, Mycobacterium
EIRDEAEQRQ

SEQ ID NO: 466340 - protein, 11 aa, Mycobacterium
EIRDNGDPGSI

SEQ ID NO: 466341 - protein, 5 aa, Mycobacterium
EIRDR

SEQ ID NO: 466342 - protein, 11 aa, Mycobacterium
EIREDDPDDTY

SEQ ID NO: 466343 - protein, 16 aa, Mycobacterium
EIRERARGWTNATAPA

SEQ ID NO: 466344 - protein, 18 aa, Mycobacterium
EIRGGGGDVGTGASQQDG

SEQ ID NO: 466345 - protein, 12 aa, Mycobacterium
EIRGQRGYGVFR

SEQ ID NO: 466346 - protein, 5 aa, Mycobacterium
EIRPG

SEQ ID NO: 466347 - protein, 8 aa, Mycobacterium
EIRPGPDF

SEQ ID NO: 466348 - protein, 11 aa, Mycobacterium
EIRRPDGSPGV

SEQ ID NO: 466349 - protein, 4 aa, Mycobacterium
EIRS

SEQ ID NO: 466350 - protein, 12 aa, Mycobacterium
EIRSSRKAARRV

SEQ ID NO: 466351 - protein, 9 aa, Mycobacterium
EIRTGAEVT

SEQ ID NO: 466352 - protein, 4 aa, Mycobacterium
EISA

SEQ ID NO: 466353 - protein, 5 aa, Mycobacterium
EISAG

SEQ ID NO: 466354 - protein, 7 aa, Mycobacterium
EISAQRP

SEQ ID NO: 466355 - protein, 14 aa, Mycobacterium
EISARGSGEGGPRR

SEQ ID NO: 466356 - protein, 6 aa, Mycobacterium
EISDGS

SEQ ID NO: 466357 - protein, 6 aa, Mycobacterium
EISDGT

SEQ ID NO: 466358 - protein, 9 aa, Mycobacterium
EISDSDLES

SEQ ID NO: 466359 - protein, 7 aa, Mycobacterium
EISDTGL

SEQ ID NO: 466360 - protein, 5 aa, Mycobacterium
EISEE

SEQ ID NO: 466361 - protein, 7 aa, Mycobacterium
EISEQTG

SEQ ID NO: 466362 - protein, 5 aa, Mycobacterium
EISES

SEQ ID NO: 466363 - protein, 5 aa, Mycobacterium
EISET

SEQ ID NO: 466364 - protein, 7 aa, Mycobacterium
EISETAS

SEQ ID NO: 466365 - protein, 6 aa, Mycobacterium
EISETH

SEQ ID NO: 466366 - protein, 11 aa, Mycobacterium
EISGPGSDGDD

SEQ ID NO: 466367 - protein, 10 aa, Mycobacterium
EISGRAALTN

SEQ ID NO: 466368 - protein, 8 aa, Mycobacterium
EISPGGNC

SEQ ID NO: 466369 - protein, 6 aa, Mycobacterium
EISPSD

SEQ ID NO: 466370 - protein, 4 aa, Mycobacterium
EISQ

SEQ ID NO: 466371 - protein, 7 aa, Mycobacterium
EISSDGT

SEQ ID NO: 466372 - protein, 12 aa, Mycobacterium
EISSDTAQSEGL

SEQ ID NO: 466373 - protein, 13 aa, Mycobacterium
EISSTDGWQRNPE

SEQ ID NO: 466374 - protein, 6 aa, Mycobacterium
EISSTG

SEQ ID NO: 466375 - protein, 12 aa, Mycobacterium
EISTDGGGTEQV

SEQ ID NO: 466376 - protein, 5 aa, Mycobacterium
EISVP

SEQ ID NO: 466377 - protein, 6 aa, Mycobacterium
EISVPK

SEQ ID NO: 466378 - protein, 10 aa, Mycobacterium
EITAQTGRAA

SEQ ID NO: 466379 - protein, 10 aa, Mycobacterium
EITDDEGNPI

SEQ ID NO: 466380 - protein, 16 aa, Mycobacterium
EITENSPLAGTPDAVA

SEQ ID NO: 466381 - protein, 12 aa, Mycobacterium
EITERRGAIDRT

SEQ ID NO: 466382 - protein, 5 aa, Mycobacterium
EITGG

SEQ ID NO: 466383 - protein, 7 aa, Mycobacterium
EITGPLA

SEQ ID NO: 466384 - protein, 11 aa, Mycobacterium
EITGQSGRLTP

SEQ ID NO: 466385 - protein, 13 aa, Mycobacterium
EITPAAGGGSVRD

SEQ ID NO: 466386 - protein, 8 aa, Mycobacterium
EITPIGPA

SEQ ID NO: 466387 - protein, 18 aa, Mycobacterium
EITPPDDGRDAPAPESEA

SEQ ID NO: 466388 - protein, 4 aa, Mycobacterium
EITQ

SEQ ID NO: 466389 - protein, 12 aa, Mycobacterium
EITSAEPEWATW

SEQ ID NO: 466390 - protein, 10 aa, Mycobacterium
EITSATPRYD

SEQ ID NO: 466391 - protein, 10 aa, Mycobacterium
EITSPPGSQR

SEQ ID NO: 466392 - protein, 10 aa, Mycobacterium
EITSPPGSRR

SEQ ID NO: 466393 - protein, 6 aa, Mycobacterium
EITTDD

SEQ ID NO: 466394 - protein, 12 aa, Mycobacterium
EITTEANPESAW

SEQ ID NO: 466395 - protein, 6 aa, Mycobacterium
EITTRS

SEQ ID NO: 466396 - protein, 9 aa, Mycobacterium
EIVGGTPRN

SEQ ID NO: 466397 - protein, 11 aa, Mycobacterium
EIYGGTKSAWD

SEQ ID NO: 466398 - protein, 7 aa, Mycobacterium
EKAAAAM

SEQ ID NO: 466399 - protein, 12 aa, Mycobacterium
EKAAADARAVAA

SEQ ID NO: 466400 - protein, 7 aa, Mycobacterium
EKAAADV

SEQ ID NO: 466401 - protein, 11 aa, Mycobacterium
EKAAAGPYGKT

SEQ ID NO: 466402 - protein, 13 aa, Mycobacterium
EKAAAPDNSAAAT

SEQ ID NO: 466403 - protein, 8 aa, Mycobacterium
EKAAERNL

SEQ ID NO: 466404 - protein, 5 aa, Mycobacterium
EKAAG

SEQ ID NO: 466405 - protein, 6 aa, Mycobacterium
EKAAGK

SEQ ID NO: 466406 - protein, 12 aa, Mycobacterium
EKAAGVTVGRTS

SEQ ID NO: 466407 - protein, 115 aa, Mycobacterium
EKAAKKAKAQLAKASAKETPAKKAPAKKAPAKKAAAKKETSAKKAPAKKAPAKKAAAKKAPAKKATAKKAPAKKAPAKKVPESAAAKAATPATDTELPAPKPVGEASNPTEIAPE

SEQ ID NO: 466408 - protein, 8 aa, Mycobacterium
EKAAPAHV

SEQ ID NO: 466409 - protein, 8 aa, Mycobacterium
EKAAPRHV

SEQ ID NO: 466410 - protein, 10 aa, Mycobacterium
EKAARRGLTS

SEQ ID NO: 466411 - protein, 7 aa, Mycobacterium
EKAATED

SEQ ID NO: 466412 - protein, 8 aa, Mycobacterium
EKADAAVA

SEQ ID NO: 466413 - protein, 9 aa, Mycobacterium
EKADAAVAA

SEQ ID NO: 466414 - protein, 16 aa, Mycobacterium
EKADAGTTGSKDTNGT

SEQ ID NO: 466415 - protein, 9 aa, Mycobacterium
EKADDDNLR

SEQ ID NO: 466416 - protein, 12 aa, Mycobacterium
EKADITDSSVGA

SEQ ID NO: 466417 - protein, 7 aa, Mycobacterium
EKADRTY

SEQ ID NO: 466418 - protein, 8 aa, Mycobacterium
EKAEAAVA

SEQ ID NO: 466419 - protein, 19 aa, Mycobacterium
EKAEEAADELAAEDPDSLT

SEQ ID NO: 466420 - protein, 8 aa, Mycobacterium
EKAEPPVR

SEQ ID NO: 466421 - protein, 15 aa, Mycobacterium
EKAEQAQAAGADIVG

SEQ ID NO: 466422 - protein, 17 aa, Mycobacterium
EKAERGRQRARQVTTAT

SEQ ID NO: 466423 - protein, 7 aa, Mycobacterium
EKAFAAE

SEQ ID NO: 466424 - protein, 7 aa, Mycobacterium
EKAFAAG

SEQ ID NO: 466425 - protein, 12 aa, Mycobacterium
EKAGAAINATPR

SEQ ID NO: 466426 - protein, 7 aa, Mycobacterium
EKAGAQV

SEQ ID NO: 466427 - protein, 7 aa, Mycobacterium
EKAGATL

SEQ ID NO: 466428 - protein, 20 aa, Mycobacterium
EKAGAVKSGNGLDPGTTMGP

SEQ ID NO: 466429 - protein, 6 aa, Mycobacterium
EKAGFG

SEQ ID NO: 466430 - protein, 8 aa, Mycobacterium
EKAGGEPQ

SEQ ID NO: 466431 - protein, 35 aa, Mycobacterium
EKAGKGMEGAGKSLATMTTQSGSHWDGKAAQAFDD

SEQ ID NO: 466432 - protein, 7 aa, Mycobacterium
EKAGPVT

SEQ ID NO: 466433 - protein, 12 aa, Mycobacterium
EKAGQAQGLTPR

SEQ ID NO: 466434 - protein, 8 aa, Mycobacterium
EKAGTEPI

SEQ ID NO: 466435 - protein, 12 aa, Mycobacterium
EKAGTSQGLTPR

SEQ ID NO: 466436 - protein, 17 aa, Mycobacterium
EKAGVKPATLSGGQKQR

SEQ ID NO: 466437 - protein, 8 aa, Mycobacterium
EKAGVSAA

SEQ ID NO: 466438 - protein, 5 aa, Mycobacterium
EKAHG

SEQ ID NO: 466439 - protein, 11 aa, Mycobacterium
EKAKAEALSAG

SEQ ID NO: 466440 - protein, 10 aa, Mycobacterium
EKAKDSPAEL

SEQ ID NO: 466441 - protein, 7 aa, Mycobacterium
EKAKPRK

SEQ ID NO: 466442 - protein, 13 aa, Mycobacterium
EKAKTTRKAPARK

SEQ ID NO: 466443 - protein, 5 aa, Mycobacterium
EKAMA

SEQ ID NO: 466444 - protein, 13 aa, Mycobacterium
EKANAQDQKLAEE

SEQ ID NO: 466445 - protein, 15 aa, Mycobacterium
EKANGSGNISYDPAN

SEQ ID NO: 466446 - protein, 9 aa, Mycobacterium
EKANKYLPG

SEQ ID NO: 466447 - protein, 10 aa, Mycobacterium
EKAPAADGLG

SEQ ID NO: 466448 - protein, 10 aa, Mycobacterium
EKAPFPESDY

SEQ ID NO: 466449 - protein, 14 aa, Mycobacterium
EKAPGAGRPRDPRI

SEQ ID NO: 466450 - protein, 10 aa, Mycobacterium
EKAPKKDPLK

SEQ ID NO: 466451 - protein, 8 aa, Mycobacterium
EKAPSGGI

SEQ ID NO: 466452 - protein, 13 aa, Mycobacterium
EKAQPRNSNQAPV

SEQ ID NO: 466453 - protein, 14 aa, Mycobacterium
EKAQSGSTEQDKTN

SEQ ID NO: 466454 - protein, 11 aa, Mycobacterium
EKARGGYYTPA

SEQ ID NO: 466455 - protein, 85 aa, Mycobacterium
EKARKRGEELADEAADRAAPLAKKARKRSEKLAKKARKRSEKLADTARARSEELAETARKRGSHLADTARERVGGQVETRRRKLS

SEQ ID NO: 466456 - protein, 14 aa, Mycobacterium
EKARRATKQPGGRI

SEQ ID NO: 466457 - protein, 15 aa, Mycobacterium
EKASGFDPRAGWAGA

SEQ ID NO: 466458 - protein, 6 aa, Mycobacterium
EKASGH

SEQ ID NO: 466459 - protein, 10 aa, Mycobacterium
EKASGRDLSG

SEQ ID NO: 466460 - protein, 9 aa, Mycobacterium
EKASGRTFA

SEQ ID NO: 466461 - protein, 7 aa, Mycobacterium
EKASREV

SEQ ID NO: 466462 - protein, 7 aa, Mycobacterium
EKATAEA

SEQ ID NO: 466463 - protein, 12 aa, Mycobacterium
EKATNRLDTVRD

SEQ ID NO: 466464 - protein, 10 aa, Mycobacterium
EKATQVRRSG

SEQ ID NO: 466465 - protein, 7 aa, Mycobacterium
EKATRSK

SEQ ID NO: 466466 - protein, 8 aa, Mycobacterium
EKATRWEP

SEQ ID NO: 466467 - protein, 5 aa, Mycobacterium
EKATV

SEQ ID NO: 466468 - protein, 12 aa, Mycobacterium
EKAVKDKAKRLE

SEQ ID NO: 466469 - protein, 5 aa, Mycobacterium
EKAVP

SEQ ID NO: 466470 - protein, 5 aa, Mycobacterium
EKAYE

SEQ ID NO: 466471 - protein, 14 aa, Mycobacterium
EKAYRGDRGPVTVS

SEQ ID NO: 466472 - protein, 4 aa, Mycobacterium
EKCR

SEQ ID NO: 466473 - protein, 7 aa, Mycobacterium
EKCRGDQ

SEQ ID NO: 466474 - protein, 12 aa, Mycobacterium
EKDAAAKAVPDE

SEQ ID NO: 466475 - protein, 10 aa, Mycobacterium
EKDAGGDVGP

SEQ ID NO: 466476 - protein, 8 aa, Mycobacterium
EKDAKTRI

SEQ ID NO: 466477 - protein, 10 aa, Mycobacterium
EKDASDPNLW

SEQ ID NO: 466478 - protein, 16 aa, Mycobacterium
EKDATEVQWMELAEEL

SEQ ID NO: 466479 - protein, 18 aa, Mycobacterium
EKDDGVSAPGSVDVSEAN

SEQ ID NO: 466480 - protein, 15 aa, Mycobacterium
EKDDLAKANLAAGGG

SEQ ID NO: 466481 - protein, 7 aa, Mycobacterium
EKDDPEL

SEQ ID NO: 466482 - protein, 4 aa, Mycobacterium
EKDE

SEQ ID NO: 466483 - protein, 7 aa, Mycobacterium
EKDEAVK

SEQ ID NO: 466484 - protein, 9 aa, Mycobacterium
EKDERRHEQ

SEQ ID NO: 466485 - protein, 10 aa, Mycobacterium
EKDGAAPSLL

SEQ ID NO: 466486 - protein, 7 aa, Mycobacterium
EKDGTSL

SEQ ID NO: 466487 - protein, 7 aa, Mycobacterium
EKDHPGA

SEQ ID NO: 466488 - protein, 15 aa, Mycobacterium
EKDLAGKAGDFRPDQ

SEQ ID NO: 466489 - protein, 9 aa, Mycobacterium
EKDLSGAEE

SEQ ID NO: 466490 - protein, 10 aa, Mycobacterium
EKDPDPAAAT

SEQ ID NO: 466491 - protein, 8 aa, Mycobacterium
EKDPPNWA

SEQ ID NO: 466492 - protein, 14 aa, Mycobacterium
EKDPTLAYGPGRGA

SEQ ID NO: 466493 - protein, 20 aa, Mycobacterium
EKDPTLAYGPGRGAIGSPAT

SEQ ID NO: 466494 - protein, 8 aa, Mycobacterium
EKDRHNAA

SEQ ID NO: 466495 - protein, 5 aa, Mycobacterium
EKDSI

SEQ ID NO: 466496 - protein, 15 aa, Mycobacterium
EKDSRDGAEDGSPDG

SEQ ID NO: 466497 - protein, 10 aa, Mycobacterium
EKDVPSLEHP

SEQ ID NO: 466498 - protein, 12 aa, Mycobacterium
EKDYRDKSEFGL

SEQ ID NO: 466499 - protein, 11 aa, Mycobacterium
EKEAADGVEGS

SEQ ID NO: 466500 - protein, 7 aa, Mycobacterium
EKEAAPL

SEQ ID NO: 466501 - protein, 14 aa, Mycobacterium
EKEAEAAAESRRLR

SEQ ID NO: 466502 - protein, 23 aa, Mycobacterium
EKEAERIEKQYQRGALNQQERRD

SEQ ID NO: 466503 - protein, 9 aa, Mycobacterium
EKEAGPRRT

SEQ ID NO: 466504 - protein, 14 aa, Mycobacterium
EKEARTSKERRPVY

SEQ ID NO: 466505 - protein, 9 aa, Mycobacterium
EKEDLAPGL

SEQ ID NO: 466506 - protein, 19 aa, Mycobacterium
EKEDNGTAGDSKSKDTNGT

SEQ ID NO: 466507 - protein, 14 aa, Mycobacterium
EKEEAERKNKLRGG

SEQ ID NO: 466508 - protein, 14 aa, Mycobacterium
EKEEAERKSKVRGG

SEQ ID NO: 466509 - protein, 12 aa, Mycobacterium
EKEGLGDKLASS

SEQ ID NO: 466510 - protein, 8 aa, Mycobacterium
EKEGQRAF

SEQ ID NO: 466511 - protein, 9 aa, Mycobacterium
EKEGQRAYT

SEQ ID NO: 466512 - protein, 7 aa, Mycobacterium
EKEHDAA

SEQ ID NO: 466513 - protein, 30 aa, Mycobacterium
EKEKALKTSDPGLNDAQRRKQAKESATSEL

SEQ ID NO: 466514 - protein, 7 aa, Mycobacterium
EKELGRA

SEQ ID NO: 466515 - protein, 9 aa, Mycobacterium
EKELRGARR

SEQ ID NO: 466516 - protein, 28 aa, Mycobacterium
EKENRVPGADGLPPETPDRSGWSRYQRG

SEQ ID NO: 466517 - protein, 8 aa, Mycobacterium
EKEPAPED

SEQ ID NO: 466518 - protein, 8 aa, Mycobacterium
EKEPDGAL

SEQ ID NO: 466519 - protein, 13 aa, Mycobacterium
EKEPQGLPETKSF

SEQ ID NO: 466520 - protein, 20 aa, Mycobacterium
EKEQNGASQNGGAGKDTNGT

SEQ ID NO: 466521 - protein, 16 aa, Mycobacterium
EKEQNGTAAAKDTNGT

SEQ ID NO: 466522 - protein, 4 aa, Mycobacterium
EKER

SEQ ID NO: 466523 - protein, 6 aa, Mycobacterium
EKERIN

SEQ ID NO: 466524 - protein, 12 aa, Mycobacterium
EKERPTADLATA

SEQ ID NO: 466525 - protein, 6 aa, Mycobacterium
EKERRH

SEQ ID NO: 466526 - protein, 21 aa, Mycobacterium
EKESAEHHTELTSHGDGHISS

SEQ ID NO: 466527 - protein, 6 aa, Mycobacterium
EKESEY

SEQ ID NO: 466528 - protein, 6 aa, Mycobacterium
EKESTM

SEQ ID NO: 466529 - protein, 4 aa, Mycobacterium
EKET

SEQ ID NO: 466530 - protein, 9 aa, Mycobacterium
EKETRTAEQ

SEQ ID NO: 466531 - protein, 4 aa, Mycobacterium
EKEV

SEQ ID NO: 466532 - protein, 5 aa, Mycobacterium
EKEYP

SEQ ID NO: 466533 - protein, 16 aa, Mycobacterium
EKFERGKLDKKRNEKL

SEQ ID NO: 466534 - protein, 13 aa, Mycobacterium
EKFGGTTAYSGGG

SEQ ID NO: 466535 - protein, 5 aa, Mycobacterium
EKFGQ

SEQ ID NO: 466536 - protein, 6 aa, Mycobacterium
EKFGTD

SEQ ID NO: 466537 - protein, 5 aa, Mycobacterium
EKFPN

SEQ ID NO: 466538 - protein, 6 aa, Mycobacterium
EKFPTS

SEQ ID NO: 466539 - protein, 5 aa, Mycobacterium
EKFSP

SEQ ID NO: 466540 - protein, 7 aa, Mycobacterium
EKFSPEV

SEQ ID NO: 466541 - protein, 4 aa, Mycobacterium
EKGA

SEQ ID NO: 466542 - protein, 7 aa, Mycobacterium
EKGAEPN

SEQ ID NO: 466543 - protein, 18 aa, Mycobacterium
EKGAKDGSRAVLVGQHPR

SEQ ID NO: 466544 - protein, 10 aa, Mycobacterium
EKGAPGAAGI

SEQ ID NO: 466545 - protein, 14 aa, Mycobacterium
EKGAQVTVSSDDAD

SEQ ID NO: 466546 - protein, 7 aa, Mycobacterium
EKGASVS

SEQ ID NO: 466547 - protein, 26 aa, Mycobacterium
EKGAVRRPEAASSGRALPAELTTEGA

SEQ ID NO: 466548 - protein, 15 aa, Mycobacterium
EKGDKIYPAKTQEAF

SEQ ID NO: 466549 - protein, 8 aa, Mycobacterium
EKGEKTRI

SEQ ID NO: 466550 - protein, 7 aa, Mycobacterium
EKGGALQ

SEQ ID NO: 466551 - protein, 6 aa, Mycobacterium
EKGGDD

SEQ ID NO: 466552 - protein, 7 aa, Mycobacterium
EKGGDDK

SEQ ID NO: 466553 - protein, 6 aa, Mycobacterium
EKGGFL

SEQ ID NO: 466554 - protein, 8 aa, Mycobacterium
EKGGHASI

SEQ ID NO: 466555 - protein, 6 aa, Mycobacterium
EKGGLG

SEQ ID NO: 466556 - protein, 9 aa, Mycobacterium
EKGGSTREA

SEQ ID NO: 466557 - protein, 7 aa, Mycobacterium
EKGHAID

SEQ ID NO: 466558 - protein, 4 aa, Mycobacterium
EKGI

SEQ ID NO: 466559 - protein, 6 aa, Mycobacterium
EKGIET

SEQ ID NO: 466560 - protein, 12 aa, Mycobacterium
EKGKKADKRAGS

SEQ ID NO: 466561 - protein, 8 aa, Mycobacterium
EKGLASKP

SEQ ID NO: 466562 - protein, 14 aa, Mycobacterium
EKGLETPVPVPPAP

SEQ ID NO: 466563 - protein, 8 aa, Mycobacterium
EKGLGRKG

SEQ ID NO: 466564 - protein, 6 aa, Mycobacterium
EKGNAA

SEQ ID NO: 466565 - protein, 8 aa, Mycobacterium
EKGNKTRI

SEQ ID NO: 466566 - protein, 7 aa, Mycobacterium
EKGNVPA

SEQ ID NO: 466567 - protein, 6 aa, Mycobacterium
EKGPDV

SEQ ID NO: 466568 - protein, 5 aa, Mycobacterium
EKGPH

SEQ ID NO: 466569 - protein, 5 aa, Mycobacterium
EKGPR

SEQ ID NO: 466570 - protein, 4 aa, Mycobacterium
EKGQ

SEQ ID NO: 466571 - protein, 7 aa, Mycobacterium
EKGQALA

SEQ ID NO: 466572 - protein, 8 aa, Mycobacterium
EKGQERDL

SEQ ID NO: 466573 - protein, 19 aa, Mycobacterium
EKGRPIKHSSATRSVDDPY

SEQ ID NO: 466574 - protein, 8 aa, Mycobacterium
EKGSPTPV

SEQ ID NO: 466575 - protein, 7 aa, Mycobacterium
EKGTADV

SEQ ID NO: 466576 - protein, 5 aa, Mycobacterium
EKGTD

SEQ ID NO: 466577 - protein, 14 aa, Mycobacterium
EKGTGHELFDDHVD

SEQ ID NO: 466578 - protein, 14 aa, Mycobacterium
EKGTGHELFNDHVE

SEQ ID NO: 466579 - protein, 4 aa, Mycobacterium
EKGV

SEQ ID NO: 466580 - protein, 15 aa, Mycobacterium
EKGWRTRKNARGDTE

SEQ ID NO: 466581 - protein, 10 aa, Mycobacterium
EKHDEPKGPF

SEQ ID NO: 466582 - protein, 6 aa, Mycobacterium
EKHGPP

SEQ ID NO: 466583 - protein, 9 aa, Mycobacterium
EKHGSAAVT

SEQ ID NO: 466584 - protein, 7 aa, Mycobacterium
EKHPDMD

SEQ ID NO: 466585 - protein, 7 aa, Mycobacterium
EKHPSED

SEQ ID NO: 466586 - protein, 13 aa, Mycobacterium
EKHREPATSSEWE

SEQ ID NO: 466587 - protein, 14 aa, Mycobacterium
EKHTGAAAAETGAG

SEQ ID NO: 466588 - protein, 6 aa, Mycobacterium
EKHVPL

SEQ ID NO: 466589 - protein, 8 aa, Mycobacterium
EKIAGGVD

SEQ ID NO: 466590 - protein, 12 aa, Mycobacterium
EKIDTGNHDAAR

SEQ ID NO: 466591 - protein, 11 aa, Mycobacterium
EKIEDDGKQVT

SEQ ID NO: 466592 - protein, 6 aa, Mycobacterium
EKIETG

SEQ ID NO: 466593 - protein, 22 aa, Mycobacterium
EKIGDGGVDTKNDALAVICTPV

SEQ ID NO: 466594 - protein, 7 aa, Mycobacterium
EKIGPGD

SEQ ID NO: 466595 - protein, 7 aa, Mycobacterium
EKIGSAA

SEQ ID NO: 466596 - protein, 6 aa, Mycobacterium
EKIREG

SEQ ID NO: 466597 - protein, 9 aa, Mycobacterium
EKITPRTRD

SEQ ID NO: 466598 - protein, 39 aa, Mycobacterium
EKKAAEPGSAPAAATETPEAAGAAEASEAPEATDTATDA

SEQ ID NO: 466599 - protein, 9 aa, Mycobacterium
EKKGIPRAK

SEQ ID NO: 466600 - protein, 15 aa, Mycobacterium
EKKGIPRSKLTGTIQ

SEQ ID NO: 466601 - protein, 14 aa, Mycobacterium
EKKGVPREKLTGTI

SEQ ID NO: 466602 - protein, 15 aa, Mycobacterium
EKKGVPREKLTGTIQ

SEQ ID NO: 466603 - protein, 38 aa, Mycobacterium
EKKPAAPEPAAPVAEAPAAPAQETPEAPAEAAEAPAEA

SEQ ID NO: 466604 - protein, 12 aa, Mycobacterium
EKKPGDAERSNG

SEQ ID NO: 466605 - protein, 8 aa, Mycobacterium
EKKPPQEL

SEQ ID NO: 466606 - protein, 8 aa, Mycobacterium
EKKSAVSE

SEQ ID NO: 466607 - protein, 9 aa, Mycobacterium
EKKTQTVAD

SEQ ID NO: 466608 - protein, 15 aa, Mycobacterium
EKLAEAKESHSGRAA

SEQ ID NO: 466609 - protein, 14 aa, Mycobacterium
EKLAEAKQSHSGRA

SEQ ID NO: 466610 - protein, 15 aa, Mycobacterium
EKLAEAKQSHSGRAA

SEQ ID NO: 466611 - protein, 10 aa, Mycobacterium
EKLAEGRSDA

SEQ ID NO: 466612 - protein, 10 aa, Mycobacterium
EKLAQQQLDG

SEQ ID NO: 466613 - protein, 8 aa, Mycobacterium
EKLARRGA

SEQ ID NO: 466614 - protein, 13 aa, Mycobacterium
EKLDTSNHDAARA

SEQ ID NO: 466615 - protein, 11 aa, Mycobacterium
EKLDTSNLDAA

SEQ ID NO: 466616 - protein, 4 aa, Mycobacterium
EKLE

SEQ ID NO: 466617 - protein, 23 aa, Mycobacterium
EKLEQAKKIAPTRPHPDTPPNPT

SEQ ID NO: 466618 - protein, 14 aa, Mycobacterium
EKLGCGESVDRHER

SEQ ID NO: 466619 - protein, 5 aa, Mycobacterium
EKLGD

SEQ ID NO: 466620 - protein, 9 aa, Mycobacterium
EKLGKDTGF

SEQ ID NO: 466621 - protein, 18 aa, Mycobacterium
EKLGLSDTDPDESPYRDL

SEQ ID NO: 466622 - protein, 10 aa, Mycobacterium
EKLGQESQAL

SEQ ID NO: 466623 - protein, 5 aa, Mycobacterium
EKLGR

SEQ ID NO: 466624 - protein, 8 aa, Mycobacterium
EKLGRTPA

SEQ ID NO: 466625 - protein, 7 aa, Mycobacterium
EKLGSAA

SEQ ID NO: 466626 - protein, 5 aa, Mycobacterium
EKLGV

SEQ ID NO: 466627 - protein, 7 aa, Mycobacterium
EKLPDGW

SEQ ID NO: 466628 - protein, 7 aa, Mycobacterium
EKLPKKT

SEQ ID NO: 466629 - protein, 6 aa, Mycobacterium
EKLPRG

SEQ ID NO: 466630 - protein, 10 aa, Mycobacterium
EKLQPDDVGL

SEQ ID NO: 466631 - protein, 9 aa, Mycobacterium
EKLRGEYDT

SEQ ID NO: 466632 - protein, 6 aa, Mycobacterium
EKLRRN

SEQ ID NO: 466633 - protein, 8 aa, Mycobacterium
EKLSAAKK

SEQ ID NO: 466634 - protein, 9 aa, Mycobacterium
EKLSGDNAP

SEQ ID NO: 466635 - protein, 13 aa, Mycobacterium
EKLSGSTDERDRP

SEQ ID NO: 466636 - protein, 8 aa, Mycobacterium
EKLSHYSD

SEQ ID NO: 466637 - protein, 7 aa, Mycobacterium
EKLSNEQ

SEQ ID NO: 466638 - protein, 18 aa, Mycobacterium
EKLTDGEAKPCNNGDGTP

SEQ ID NO: 466639 - protein, 10 aa, Mycobacterium
EKLTEDDARV

SEQ ID NO: 466640 - protein, 6 aa, Mycobacterium
EKLTPQ

SEQ ID NO: 466641 - protein, 6 aa, Mycobacterium
EKMGGA

SEQ ID NO: 466642 - protein, 6 aa, Mycobacterium
EKMSKS

SEQ ID NO: 466643 - protein, 7 aa, Mycobacterium
EKMTENQ

SEQ ID NO: 466644 - protein, 7 aa, Mycobacterium
EKNDGPA

SEQ ID NO: 466645 - protein, 8 aa, Mycobacterium
EKNDSWRL

SEQ ID NO: 466646 - protein, 17 aa, Mycobacterium
EKNDSWTLTGQQSHSEP

SEQ ID NO: 466647 - protein, 8 aa, Mycobacterium
EKNGQNVP

SEQ ID NO: 466648 - protein, 6 aa, Mycobacterium
EKNGVD

SEQ ID NO: 466649 - protein, 8 aa, Mycobacterium
EKNHAHST

SEQ ID NO: 466650 - protein, 13 aa, Mycobacterium
EKNHTWRASQQAS

SEQ ID NO: 466651 - protein, 9 aa, Mycobacterium
EKNKLERSL

SEQ ID NO: 466652 - protein, 7 aa, Mycobacterium
EKNPAEA

SEQ ID NO: 466653 - protein, 7 aa, Mycobacterium
EKNPWTG

SEQ ID NO: 466654 - protein, 16 aa, Mycobacterium
EKNQRETAKSRDLRTT

SEQ ID NO: 466655 - protein, 7 aa, Mycobacterium
EKNQTGV

SEQ ID NO: 466656 - protein, 7 aa, Mycobacterium
EKNRFGA

SEQ ID NO: 466657 - protein, 10 aa, Mycobacterium
EKNRPTGDGV

SEQ ID NO: 466658 - protein, 6 aa, Mycobacterium
EKNRVY

SEQ ID NO: 466659 - protein, 6 aa, Mycobacterium
EKNSDI

SEQ ID NO: 466660 - protein, 7 aa, Mycobacterium
EKNSHTS

SEQ ID NO: 466661 - protein, 19 aa, Mycobacterium
EKPAEAEDDGHGHGHGHHH

SEQ ID NO: 466662 - protein, 8 aa, Mycobacterium
EKPAGVSS

SEQ ID NO: 466663 - protein, 18 aa, Mycobacterium
EKPAPKTRPAKRPRGEGQ

SEQ ID NO: 466664 - protein, 12 aa, Mycobacterium
EKPDAADEPRAF

SEQ ID NO: 466665 - protein, 6 aa, Mycobacterium
EKPDDV

SEQ ID NO: 466666 - protein, 7 aa, Mycobacterium
EKPDQQV

SEQ ID NO: 466667 - protein, 10 aa, Mycobacterium
EKPDSGRIEL

SEQ ID NO: 466668 - protein, 6 aa, Mycobacterium
EKPEAV

SEQ ID NO: 466669 - protein, 8 aa, Mycobacterium
EKPEAVED

SEQ ID NO: 466670 - protein, 8 aa, Mycobacterium
EKPEGPGA

SEQ ID NO: 466671 - protein, 6 aa, Mycobacterium
EKPERL

SEQ ID NO: 466672 - protein, 7 aa, Mycobacterium
EKPFASA

SEQ ID NO: 466673 - protein, 14 aa, Mycobacterium
EKPGGHGDRAGAAA

SEQ ID NO: 466674 - protein, 5 aa, Mycobacterium
EKPGL

SEQ ID NO: 466675 - protein, 8 aa, Mycobacterium
EKPGQDNI

SEQ ID NO: 466676 - protein, 10 aa, Mycobacterium
EKPGRDPRPA

SEQ ID NO: 466677 - protein, 12 aa, Mycobacterium
EKPGRDPRPAFS

SEQ ID NO: 466678 - protein, 12 aa, Mycobacterium
EKPGRDPRPTFT

SEQ ID NO: 466679 - protein, 6 aa, Mycobacterium
EKPGRM

SEQ ID NO: 466680 - protein, 9 aa, Mycobacterium
EKPGRNPRQ

SEQ ID NO: 466681 - protein, 9 aa, Mycobacterium
EKPGRREGW

SEQ ID NO: 466682 - protein, 6 aa, Mycobacterium
EKPGTV

SEQ ID NO: 466683 - protein, 35 aa, Mycobacterium
EKPGVGSPFHGGGGGGGGGGGAGGSGATTQVFVGA

SEQ ID NO: 466684 - protein, 5 aa, Mycobacterium
EKPGY

SEQ ID NO: 466685 - protein, 12 aa, Mycobacterium
EKPISKDDAVNA

SEQ ID NO: 466686 - protein, 11 aa, Mycobacterium
EKPKAQDAPSM

SEQ ID NO: 466687 - protein, 10 aa, Mycobacterium
EKPKPEDAPS

SEQ ID NO: 466688 - protein, 9 aa, Mycobacterium
EKPKQPALT

SEQ ID NO: 466689 - protein, 11 aa, Mycobacterium
EKPKRPKSNYA

SEQ ID NO: 466690 - protein, 15 aa, Mycobacterium
EKPKTEEAPSNYAAA

SEQ ID NO: 466691 - protein, 10 aa, Mycobacterium
EKPKTQDAPS

SEQ ID NO: 466692 - protein, 7 aa, Mycobacterium
EKPLGPG

SEQ ID NO: 466693 - protein, 9 aa, Mycobacterium
EKPLKDSVD

SEQ ID NO: 466694 - protein, 6 aa, Mycobacterium
EKPNAP

SEQ ID NO: 466695 - protein, 5 aa, Mycobacterium
EKPNI

SEQ ID NO: 466696 - protein, 4 aa, Mycobacterium
EKPP

SEQ ID NO: 466697 - protein, 5 aa, Mycobacterium
EKPPT

SEQ ID NO: 466698 - protein, 4 aa, Mycobacterium
EKPQ

SEQ ID NO: 466699 - protein, 13 aa, Mycobacterium
EKPREAIPAAGGR

SEQ ID NO: 466700 - protein, 7 aa, Mycobacterium
EKPRGPG

SEQ ID NO: 466701 - protein, 11 aa, Mycobacterium
EKPRPEDAPSH

SEQ ID NO: 466702 - protein, 4 aa, Mycobacterium
EKPS

SEQ ID NO: 466703 - protein, 4 aa, Mycobacterium
EKPT

SEQ ID NO: 466704 - protein, 8 aa, Mycobacterium
EKPTASDD

SEQ ID NO: 466705 - protein, 14 aa, Mycobacterium
EKPTASTEAVKGTD

SEQ ID NO: 466706 - protein, 6 aa, Mycobacterium
EKPTEA

SEQ ID NO: 466707 - protein, 9 aa, Mycobacterium
EKPTEDSVE

SEQ ID NO: 466708 - protein, 8 aa, Mycobacterium
EKPTEESV

SEQ ID NO: 466709 - protein, 9 aa, Mycobacterium
EKPTEESVT

SEQ ID NO: 466710 - protein, 9 aa, Mycobacterium
EKPTFGDVR

SEQ ID NO: 466711 - protein, 9 aa, Mycobacterium
EKPTPTGPF

SEQ ID NO: 466712 - protein, 9 aa, Mycobacterium
EKQDEGLPG

SEQ ID NO: 466713 - protein, 7 aa, Mycobacterium
EKQGGRT

SEQ ID NO: 466714 - protein, 8 aa, Mycobacterium
EKQGRGRE

SEQ ID NO: 466715 - protein, 7 aa, Mycobacterium
EKQGRSG

SEQ ID NO: 466716 - protein, 12 aa, Mycobacterium
EKQKEGKKRMKT

SEQ ID NO: 466717 - protein, 7 aa, Mycobacterium
EKQNPGL

SEQ ID NO: 466718 - protein, 8 aa, Mycobacterium
EKQRDRVE

SEQ ID NO: 466719 - protein, 8 aa, Mycobacterium
EKQRERVE

SEQ ID NO: 466720 - protein, 6 aa, Mycobacterium
EKQRQR

SEQ ID NO: 466721 - protein, 6 aa, Mycobacterium
EKQVRQ

SEQ ID NO: 466722 - protein, 5 aa, Mycobacterium
EKQVS

SEQ ID NO: 466723 - protein, 8 aa, Mycobacterium
EKRADRSI

SEQ ID NO: 466724 - protein, 9 aa, Mycobacterium
EKRAGRPLR

SEQ ID NO: 466725 - protein, 16 aa, Mycobacterium
EKRAPQWQPLPDVAEV

SEQ ID NO: 466726 - protein, 11 aa, Mycobacterium
EKRASAGASSD

SEQ ID NO: 466727 - protein, 4 aa, Mycobacterium
EKRD

SEQ ID NO: 466728 - protein, 7 aa, Mycobacterium
EKRDMST

SEQ ID NO: 466729 - protein, 13 aa, Mycobacterium
EKRDPDWSPFPRY

SEQ ID NO: 466730 - protein, 18 aa, Mycobacterium
EKRDSDAAGAASTRAGEV

SEQ ID NO: 466731 - protein, 9 aa, Mycobacterium
EKRDSGEAF

SEQ ID NO: 466732 - protein, 10 aa, Mycobacterium
EKREGARSLD

SEQ ID NO: 466733 - protein, 11 aa, Mycobacterium
EKREPGSIDEN

SEQ ID NO: 466734 - protein, 7 aa, Mycobacterium
EKRFGGT

SEQ ID NO: 466735 - protein, 27 aa, Mycobacterium
EKRFPKASATTADKLQESVDRLAAIVE

SEQ ID NO: 466736 - protein, 10 aa, Mycobacterium
EKRGARADDA

SEQ ID NO: 466737 - protein, 10 aa, Mycobacterium
EKRGQAEPID

SEQ ID NO: 466738 - protein, 7 aa, Mycobacterium
EKRGRPP

SEQ ID NO: 466739 - protein, 7 aa, Mycobacterium
EKRGRSG

SEQ ID NO: 466740 - protein, 16 aa, Mycobacterium
EKRHADQLRKSGDPYI

SEQ ID NO: 466741 - protein, 14 aa, Mycobacterium
EKRHTRGKIVLLPN

SEQ ID NO: 466742 - protein, 7 aa, Mycobacterium
EKRIGKP

SEQ ID NO: 466743 - protein, 5 aa, Mycobacterium
EKRLG

SEQ ID NO: 466744 - protein, 11 aa, Mycobacterium
EKRNGRPPRER

SEQ ID NO: 466745 - protein, 13 aa, Mycobacterium
EKRPPDWSRFPRY

SEQ ID NO: 466746 - protein, 8 aa, Mycobacterium
EKRPTAEA

SEQ ID NO: 466747 - protein, 11 aa, Mycobacterium
EKRRGRPARER

SEQ ID NO: 466748 - protein, 7 aa, Mycobacterium
EKRRQPD

SEQ ID NO: 466749 - protein, 34 aa, Mycobacterium
EKRSPQPHSVPAGGDGGVRNPNLPPPSRPHESDL

SEQ ID NO: 466750 - protein, 6 aa, Mycobacterium
EKRSRQ

SEQ ID NO: 466751 - protein, 7 aa, Mycobacterium
EKRTQDP

SEQ ID NO: 466752 - protein, 11 aa, Mycobacterium
EKRVKRSPHPF

SEQ ID NO: 466753 - protein, 8 aa, Mycobacterium
EKRVTDQV

SEQ ID NO: 466754 - protein, 10 aa, Mycobacterium
EKRYASAGKQ

SEQ ID NO: 466755 - protein, 6 aa, Mycobacterium
EKSACD

SEQ ID NO: 466756 - protein, 8 aa, Mycobacterium
EKSASDLG

SEQ ID NO: 466757 - protein, 9 aa, Mycobacterium
EKSATLTSL

SEQ ID NO: 466758 - protein, 9 aa, Mycobacterium
EKSATRRTA

SEQ ID NO: 466759 - protein, 11 aa, Mycobacterium
EKSDDDSGKGR

SEQ ID NO: 466760 - protein, 11 aa, Mycobacterium
EKSDGQPFSED

SEQ ID NO: 466761 - protein, 6 aa, Mycobacterium
EKSDLR

SEQ ID NO: 466762 - protein, 5 aa, Mycobacterium
EKSDR

SEQ ID NO: 466763 - protein, 10 aa, Mycobacterium
EKSDRPGRNQ

SEQ ID NO: 466764 - protein, 11 aa, Mycobacterium
EKSDRPGRNQV

SEQ ID NO: 466765 - protein, 7 aa, Mycobacterium
EKSDVQV

SEQ ID NO: 466766 - protein, 6 aa, Mycobacterium
EKSFTG

SEQ ID NO: 466767 - protein, 5 aa, Mycobacterium
EKSGA

SEQ ID NO: 466768 - protein, 8 aa, Mycobacterium
EKSGASEV

SEQ ID NO: 466769 - protein, 12 aa, Mycobacterium
EKSGATKTNIRP

SEQ ID NO: 466770 - protein, 6 aa, Mycobacterium
EKSGAW

SEQ ID NO: 466771 - protein, 14 aa, Mycobacterium
EKSGGDKKEFDPRA

SEQ ID NO: 466772 - protein, 5 aa, Mycobacterium
EKSGQ

SEQ ID NO: 466773 - protein, 8 aa, Mycobacterium
EKSGRTAV

SEQ ID NO: 466774 - protein, 7 aa, Mycobacterium
EKSHGRI

SEQ ID NO: 466775 - protein, 6 aa, Mycobacterium
EKSHGS

SEQ ID NO: 466776 - protein, 7 aa, Mycobacterium
EKSIGAG

SEQ ID NO: 466777 - protein, 12 aa, Mycobacterium
EKSLASKGAPYR

SEQ ID NO: 466778 - protein, 9 aa, Mycobacterium
EKSPDRGKY

SEQ ID NO: 466779 - protein, 6 aa, Mycobacterium
EKSPSF

SEQ ID NO: 466780 - protein, 6 aa, Mycobacterium
EKSQTY

SEQ ID NO: 466781 - protein, 13 aa, Mycobacterium
EKSQYPRRRFTVG

SEQ ID NO: 466782 - protein, 4 aa, Mycobacterium
EKSR

SEQ ID NO: 466783 - protein, 9 aa, Mycobacterium
EKSRGTTAL

SEQ ID NO: 466784 - protein, 14 aa, Mycobacterium
EKSRTAAKTGAGWQ

SEQ ID NO: 466785 - protein, 11 aa, Mycobacterium
EKSRTITSNDP

SEQ ID NO: 466786 - protein, 10 aa, Mycobacterium
EKSSGRDLSG

SEQ ID NO: 466787 - protein, 15 aa, Mycobacterium
EKSSPERDFGPRSED

SEQ ID NO: 466788 - protein, 8 aa, Mycobacterium
EKSSTADG

SEQ ID NO: 466789 - protein, 8 aa, Mycobacterium
EKSSTEPI

SEQ ID NO: 466790 - protein, 12 aa, Mycobacterium
EKSSWAPAEGEP

SEQ ID NO: 466791 - protein, 22 aa, Mycobacterium
EKSTEPRTQPDALRAKRSSQTR

SEQ ID NO: 466792 - protein, 9 aa, Mycobacterium
EKSTTATPH

SEQ ID NO: 466793 - protein, 9 aa, Mycobacterium
EKSVAAEDF

SEQ ID NO: 466794 - protein, 12 aa, Mycobacterium
EKSVQAQLDYLR

SEQ ID NO: 466795 - protein, 8 aa, Mycobacterium
EKSVVTSP

SEQ ID NO: 466796 - protein, 5 aa, Mycobacterium
EKSYA

SEQ ID NO: 466797 - protein, 13 aa, Mycobacterium
EKSYGEAGGRPQE

SEQ ID NO: 466798 - protein, 4 aa, Mycobacterium
EKTA

SEQ ID NO: 466799 - protein, 19 aa, Mycobacterium
EKTAAEDSAAWSEGHPLSE

SEQ ID NO: 466800 - protein, 7 aa, Mycobacterium
EKTAEGL

SEQ ID NO: 466801 - protein, 7 aa, Mycobacterium
EKTAESL

SEQ ID NO: 466802 - protein, 7 aa, Mycobacterium
EKTAPAA

SEQ ID NO: 466803 - protein, 5 aa, Mycobacterium
EKTDH

SEQ ID NO: 466804 - protein, 11 aa, Mycobacterium
EKTDPEDSRYG

SEQ ID NO: 466805 - protein, 4 aa, Mycobacterium
EKTG

SEQ ID NO: 466806 - protein, 9 aa, Mycobacterium
EKTGAADDP

SEQ ID NO: 466807 - protein, 7 aa, Mycobacterium
EKTGEAR

SEQ ID NO: 466808 - protein, 7 aa, Mycobacterium
EKTGLPP

SEQ ID NO: 466809 - protein, 10 aa, Mycobacterium
EKTGMGDNPP

SEQ ID NO: 466810 - protein, 7 aa, Mycobacterium
EKTGQRI

SEQ ID NO: 466811 - protein, 5 aa, Mycobacterium
EKTGT

SEQ ID NO: 466812 - protein, 8 aa, Mycobacterium
EKTIERTR

SEQ ID NO: 466813 - protein, 13 aa, Mycobacterium
EKTKAPSVTAGPT

SEQ ID NO: 466814 - protein, 15 aa, Mycobacterium
EKTKPPDYRPPDGAV

SEQ ID NO: 466815 - protein, 9 aa, Mycobacterium
EKTNGDPAA

SEQ ID NO: 466816 - protein, 11 aa, Mycobacterium
EKTNGQPFSED

SEQ ID NO: 466817 - protein, 13 aa, Mycobacterium
EKTPAPQADAHGY

SEQ ID NO: 466818 - protein, 8 aa, Mycobacterium
EKTPNVPG

SEQ ID NO: 466819 - protein, 9 aa, Mycobacterium
EKTPQSHRN

SEQ ID NO: 466820 - protein, 6 aa, Mycobacterium
EKTPSF

SEQ ID NO: 466821 - protein, 7 aa, Mycobacterium
EKTQQYR

SEQ ID NO: 466822 - protein, 9 aa, Mycobacterium
EKTRLEEER

SEQ ID NO: 466823 - protein, 4 aa, Mycobacterium
EKTS

SEQ ID NO: 466824 - protein, 9 aa, Mycobacterium
EKTSDPGSR

SEQ ID NO: 466825 - protein, 5 aa, Mycobacterium
EKTST

SEQ ID NO: 466826 - protein, 7 aa, Mycobacterium
EKTTAGL

SEQ ID NO: 466827 - protein, 16 aa, Mycobacterium
EKTTGAKLAEEPLPSV

SEQ ID NO: 466828 - protein, 7 aa, Mycobacterium
EKTVPAP

SEQ ID NO: 466829 - protein, 14 aa, Mycobacterium
EKTYGTSDPRHPGV

SEQ ID NO: 466830 - protein, 8 aa, Mycobacterium
EKTYGTTD

SEQ ID NO: 466831 - protein, 13 aa, Mycobacterium
EKVAAAVSKAGGL

SEQ ID NO: 466832 - protein, 9 aa, Mycobacterium
EKVARGEAD

SEQ ID NO: 466833 - protein, 13 aa, Mycobacterium
EKVASGARQSASA

SEQ ID NO: 466834 - protein, 4 aa, Mycobacterium
EKVD

SEQ ID NO: 466835 - protein, 8 aa, Mycobacterium
EKVEGTDF

SEQ ID NO: 466836 - protein, 4 aa, Mycobacterium
EKVN

SEQ ID NO: 466837 - protein, 11 aa, Mycobacterium
EKVNVSGSGCS

SEQ ID NO: 466838 - protein, 11 aa, Mycobacterium
EKVRAGRGFDP

SEQ ID NO: 466839 - protein, 9 aa, Mycobacterium
EKVSAEQAF

SEQ ID NO: 466840 - protein, 7 aa, Mycobacterium
EKVTQEE

SEQ ID NO: 466841 - protein, 14 aa, Mycobacterium
EKVTRNEGARQTAD

SEQ ID NO: 466842 - protein, 16 aa, Mycobacterium
EKVTTSPAFRSSAKSR

SEQ ID NO: 466843 - protein, 7 aa, Mycobacterium
EKWGSDR

SEQ ID NO: 466844 - protein, 12 aa, Mycobacterium
EKWKPGLPAPRD

SEQ ID NO: 466845 - protein, 6 aa, Mycobacterium
EKWRGD

SEQ ID NO: 466846 - protein, 12 aa, Mycobacterium
EKWSGTAGWQSF

SEQ ID NO: 466847 - protein, 7 aa, Mycobacterium
EKYAETF

SEQ ID NO: 466848 - protein, 6 aa, Mycobacterium
EKYAKG

SEQ ID NO: 466849 - protein, 8 aa, Mycobacterium
EKYDGIGA

SEQ ID NO: 466850 - protein, 9 aa, Mycobacterium
EKYDGSRPE

SEQ ID NO: 466851 - protein, 9 aa, Mycobacterium
EKYDSGERC

SEQ ID NO: 466852 - protein, 10 aa, Mycobacterium
EKYEAPLEEG

SEQ ID NO: 466853 - protein, 18 aa, Mycobacterium
EKYPEYKEGRSATPDEFR

SEQ ID NO: 466854 - protein, 14 aa, Mycobacterium
EKYPLKRGQNAGWE

SEQ ID NO: 466855 - protein, 5 aa, Mycobacterium
EKYRP

SEQ ID NO: 466856 - protein, 17 aa, Mycobacterium
EKYSAAAQAAAAGEPWG

SEQ ID NO: 466857 - protein, 8 aa, Mycobacterium
ELAAAEPG

SEQ ID NO: 466858 - protein, 7 aa, Mycobacterium
ELAAANP

SEQ ID NO: 466859 - protein, 9 aa, Mycobacterium
ELAADDASF

SEQ ID NO: 466860 - protein, 19 aa, Mycobacterium
ELAADDDSFAAEASDLESR

SEQ ID NO: 466861 - protein, 6 aa, Mycobacterium
ELAAPQ

SEQ ID NO: 466862 - protein, 14 aa, Mycobacterium
ELAAQVKSAEAEQV

SEQ ID NO: 466863 - protein, 6 aa, Mycobacterium
ELAARA

SEQ ID NO: 466864 - protein, 8 aa, Mycobacterium
ELAATERE

SEQ ID NO: 466865 - protein, 4 aa, Mycobacterium
ELAD

SEQ ID NO: 466866 - protein, 6 aa, Mycobacterium
ELADGQ

SEQ ID NO: 466867 - protein, 5 aa, Mycobacterium
ELADS

SEQ ID NO: 466868 - protein, 5 aa, Mycobacterium
ELADT

SEQ ID NO: 466869 - protein, 12 aa, Mycobacterium
ELADTAANITEA

SEQ ID NO: 466870 - protein, 9 aa, Mycobacterium
ELADTSDGE

SEQ ID NO: 466871 - protein, 4 aa, Mycobacterium
ELAE

SEQ ID NO: 466872 - protein, 7 aa, Mycobacterium
ELAEDRG

SEQ ID NO: 466873 - protein, 7 aa, Mycobacterium
ELAEDRR

SEQ ID NO: 466874 - protein, 9 aa, Mycobacterium
ELAEHDQAD

SEQ ID NO: 466875 - protein, 14 aa, Mycobacterium
ELAEKGEKLPVQQR

SEQ ID NO: 466876 - protein, 12 aa, Mycobacterium
ELAEKSDPRAAS

SEQ ID NO: 466877 - protein, 24 aa, Mycobacterium
ELAEKTQKAESNGSAVTSEKDAAH

SEQ ID NO: 466878 - protein, 6 aa, Mycobacterium
ELAENT

SEQ ID NO: 466879 - protein, 8 aa, Mycobacterium
ELAEQNQR

SEQ ID NO: 466880 - protein, 7 aa, Mycobacterium
ELAERDD

SEQ ID NO: 466881 - protein, 11 aa, Mycobacterium
ELAERDGLRGQ

SEQ ID NO: 466882 - protein, 7 aa, Mycobacterium
ELAERGR

SEQ ID NO: 466883 - protein, 5 aa, Mycobacterium
ELAGA

SEQ ID NO: 466884 - protein, 12 aa, Mycobacterium
ELAGAASSFSSV

SEQ ID NO: 466885 - protein, 6 aa, Mycobacterium
ELAGAD

SEQ ID NO: 466886 - protein, 13 aa, Mycobacterium
ELAGAQQGGCCCS

SEQ ID NO: 466887 - protein, 14 aa, Mycobacterium
ELAGDDTDDAAVPT

SEQ ID NO: 466888 - protein, 13 aa, Mycobacterium
ELAGDTAESLRAG

SEQ ID NO: 466889 - protein, 9 aa, Mycobacterium
ELAGEDGVR

SEQ ID NO: 466890 - protein, 7 aa, Mycobacterium
ELAGESD

SEQ ID NO: 466891 - protein, 9 aa, Mycobacterium
ELAGGSQLQ

SEQ ID NO: 466892 - protein, 10 aa, Mycobacterium
ELAGHDQSDH

SEQ ID NO: 466893 - protein, 10 aa, Mycobacterium
ELAGKKRGKL

SEQ ID NO: 466894 - protein, 10 aa, Mycobacterium
ELAGPGYGSK

SEQ ID NO: 466895 - protein, 6 aa, Mycobacterium
ELAGPW

SEQ ID NO: 466896 - protein, 5 aa, Mycobacterium
ELAGQ

SEQ ID NO: 466897 - protein, 9 aa, Mycobacterium
ELAGQPSRA

SEQ ID NO: 466898 - protein, 7 aa, Mycobacterium
ELAGSGR

SEQ ID NO: 466899 - protein, 16 aa, Mycobacterium
ELAGTELQPSTSPVGA

SEQ ID NO: 466900 - protein, 15 aa, Mycobacterium
ELAGTTEAELRASLG

SEQ ID NO: 466901 - protein, 7 aa, Mycobacterium
ELAGTTS

SEQ ID NO: 466902 - protein, 9 aa, Mycobacterium
ELAKGGYGG

SEQ ID NO: 466903 - protein, 9 aa, Mycobacterium
ELAKPGADR

SEQ ID NO: 466904 - protein, 12 aa, Mycobacterium
ELAKPSPDQARV

SEQ ID NO: 466905 - protein, 4 aa, Mycobacterium
ELAP

SEQ ID NO: 466906 - protein, 13 aa, Mycobacterium
ELAPAKEGDADIR

SEQ ID NO: 466907 - protein, 6 aa, Mycobacterium
ELAPDH

SEQ ID NO: 466908 - protein, 6 aa, Mycobacterium
ELAPEG

SEQ ID NO: 466909 - protein, 10 aa, Mycobacterium
ELAPESTEGI

SEQ ID NO: 466910 - protein, 9 aa, Mycobacterium
ELAPETEQR

SEQ ID NO: 466911 - protein, 7 aa, Mycobacterium
ELAPGEL

SEQ ID NO: 466912 - protein, 9 aa, Mycobacterium
ELAPGGPDS

SEQ ID NO: 466913 - protein, 7 aa, Mycobacterium
ELAPGPA

SEQ ID NO: 466914 - protein, 6 aa, Mycobacterium
ELAPGQ

SEQ ID NO: 466915 - protein, 7 aa, Mycobacterium
ELAPGQR

SEQ ID NO: 466916 - protein, 9 aa, Mycobacterium
ELAPKGTGA

SEQ ID NO: 466917 - protein, 13 aa, Mycobacterium
ELAPPEPATYPLD

SEQ ID NO: 466918 - protein, 5 aa, Mycobacterium
ELAPQ

SEQ ID NO: 466919 - protein, 13 aa, Mycobacterium
ELAPSAAADTARR

SEQ ID NO: 466920 - protein, 6 aa, Mycobacterium
ELAPSN

SEQ ID NO: 466921 - protein, 8 aa, Mycobacterium
ELAQGSTY

SEQ ID NO: 466922 - protein, 6 aa, Mycobacterium
ELAQQG

SEQ ID NO: 466923 - protein, 31 aa, Mycobacterium
ELAQQRARQREQQESDRARDTYERDSDLQQR

SEQ ID NO: 466924 - protein, 14 aa, Mycobacterium
ELAQRDRPQTGKER

SEQ ID NO: 466925 - protein, 13 aa, Mycobacterium
ELAQRPSSSASDP

SEQ ID NO: 466926 - protein, 8 aa, Mycobacterium
ELAQSSVQ

SEQ ID NO: 466927 - protein, 4 aa, Mycobacterium
ELAR

SEQ ID NO: 466928 - protein, 8 aa, Mycobacterium
ELARSNSD

SEQ ID NO: 466929 - protein, 6 aa, Mycobacterium
ELASAE

SEQ ID NO: 466930 - protein, 6 aa, Mycobacterium
ELASAG

SEQ ID NO: 466931 - protein, 7 aa, Mycobacterium
ELASARP

SEQ ID NO: 466932 - protein, 5 aa, Mycobacterium
ELASE

SEQ ID NO: 466933 - protein, 6 aa, Mycobacterium
ELASED

SEQ ID NO: 466934 - protein, 10 aa, Mycobacterium
ELASEGHSGD

SEQ ID NO: 466935 - protein, 5 aa, Mycobacterium
ELASG

SEQ ID NO: 466936 - protein, 22 aa, Mycobacterium
ELASGGGAGTTPAAAAAPTQAI

SEQ ID NO: 466937 - protein, 12 aa, Mycobacterium
ELASGPASAPRE

SEQ ID NO: 466938 - protein, 8 aa, Mycobacterium
ELASGTGG

SEQ ID NO: 466939 - protein, 8 aa, Mycobacterium
ELASPVGD

SEQ ID NO: 466940 - protein, 12 aa, Mycobacterium
ELASRSDNTPFE

SEQ ID NO: 466941 - protein, 10 aa, Mycobacterium
ELASTTAKLA

SEQ ID NO: 466942 - protein, 12 aa, Mycobacterium
ELASTTAKLANE

SEQ ID NO: 466943 - protein, 4 aa, Mycobacterium
ELAT

SEQ ID NO: 466944 - protein, 6 aa, Mycobacterium
ELATAQ

SEQ ID NO: 466945 - protein, 20 aa, Mycobacterium
ELATGAGGAAAGCGHAGDGN

SEQ ID NO: 466946 - protein, 16 aa, Mycobacterium
ELATGSVAAPATEPDR

SEQ ID NO: 466947 - protein, 23 aa, Mycobacterium
ELATREAEEASAAGQAQTALDDA

SEQ ID NO: 466948 - protein, 7 aa, Mycobacterium
ELAYTDP

SEQ ID NO: 466949 - protein, 5 aa, Mycobacterium
ELDAE

SEQ ID NO: 466950 - protein, 13 aa, Mycobacterium
ELDAHDDDDDVET

SEQ ID NO: 466951 - protein, 15 aa, Mycobacterium
ELDAPEHDETQATAV

SEQ ID NO: 466952 - protein, 9 aa, Mycobacterium
ELDAQTREL

SEQ ID NO: 466953 - protein, 8 aa, Mycobacterium
ELDATGPT

SEQ ID NO: 466954 - protein, 17 aa, Mycobacterium
ELDDDKDAFSDFVIAER

SEQ ID NO: 466955 - protein, 9 aa, Mycobacterium
ELDDDSAAE

SEQ ID NO: 466956 - protein, 12 aa, Mycobacterium
ELDDEAAQRAPG

SEQ ID NO: 466957 - protein, 8 aa, Mycobacterium
ELDDESAA

SEQ ID NO: 466958 - protein, 9 aa, Mycobacterium
ELDDESAAE

SEQ ID NO: 466959 - protein, 7 aa, Mycobacterium
ELDDGPD

SEQ ID NO: 466960 - protein, 6 aa, Mycobacterium
ELDDPA

SEQ ID NO: 466961 - protein, 9 aa, Mycobacterium
ELDDRNATV

SEQ ID NO: 466962 - protein, 10 aa, Mycobacterium
ELDDTGGSAT

SEQ ID NO: 466963 - protein, 7 aa, Mycobacterium
ELDDTQE

SEQ ID NO: 466964 - protein, 9 aa, Mycobacterium
ELDEATENA

SEQ ID NO: 466965 - protein, 8 aa, Mycobacterium
ELDEESAA

SEQ ID NO: 466966 - protein, 4 aa, Mycobacterium
ELDG

SEQ ID NO: 466967 - protein, 12 aa, Mycobacterium
ELDGDTESPLRH

SEQ ID NO: 466968 - protein, 8 aa, Mycobacterium
ELDGGAGP

SEQ ID NO: 466969 - protein, 14 aa, Mycobacterium
ELDGGPSWHEGPAT

SEQ ID NO: 466970 - protein, 8 aa, Mycobacterium
ELDGHDGS

SEQ ID NO: 466971 - protein, 10 aa, Mycobacterium
ELDGPDAGLS

SEQ ID NO: 466972 - protein, 7 aa, Mycobacterium
ELDGTEL

SEQ ID NO: 466973 - protein, 7 aa, Mycobacterium
ELDGYAG

SEQ ID NO: 466974 - protein, 6 aa, Mycobacterium
ELDHTK

SEQ ID NO: 466975 - protein, 9 aa, Mycobacterium
ELDIPPTAH

SEQ ID NO: 466976 - protein, 7 aa, Mycobacterium
ELDKPEA

SEQ ID NO: 466977 - protein, 10 aa, Mycobacterium
ELDNPDDSHG

SEQ ID NO: 466978 - protein, 9 aa, Mycobacterium
ELDNPDPTI

SEQ ID NO: 466979 - protein, 4 aa, Mycobacterium
ELDP

SEQ ID NO: 466980 - protein, 7 aa, Mycobacterium
ELDPAAG

SEQ ID NO: 466981 - protein, 7 aa, Mycobacterium
ELDPAKP

SEQ ID NO: 466982 - protein, 8 aa, Mycobacterium
ELDPAKPT

SEQ ID NO: 466983 - protein, 9 aa, Mycobacterium
ELDPATQAA

SEQ ID NO: 466984 - protein, 24 aa, Mycobacterium
ELDPATQSAIDRHEAAGTTHTAEY

SEQ ID NO: 466985 - protein, 7 aa, Mycobacterium
ELDPDLR

SEQ ID NO: 466986 - protein, 7 aa, Mycobacterium
ELDPDPR

SEQ ID NO: 466987 - protein, 13 aa, Mycobacterium
ELDPEQRAEIDDA

SEQ ID NO: 466988 - protein, 7 aa, Mycobacterium
ELDPETT

SEQ ID NO: 466989 - protein, 5 aa, Mycobacterium
ELDPG

SEQ ID NO: 466990 - protein, 12 aa, Mycobacterium
ELDPGSPDLEGT

SEQ ID NO: 466991 - protein, 6 aa, Mycobacterium
ELDPNA

SEQ ID NO: 466992 - protein, 7 aa, Mycobacterium
ELDPNDA

SEQ ID NO: 466993 - protein, 11 aa, Mycobacterium
ELDPPGGRREV

SEQ ID NO: 466994 - protein, 5 aa, Mycobacterium
ELDPQ

SEQ ID NO: 466995 - protein, 10 aa, Mycobacterium
ELDPVSQSEY

SEQ ID NO: 466996 - protein, 7 aa, Mycobacterium
ELDQGEV

SEQ ID NO: 466997 - protein, 16 aa, Mycobacterium
ELDQTRRAAEEERQRL

SEQ ID NO: 466998 - protein, 14 aa, Mycobacterium
ELDRADAQDGERDL

SEQ ID NO: 466999 - protein, 7 aa, Mycobacterium
ELDRAGV

SEQ ID NO: 467000 - protein, 13 aa, Mycobacterium
ELDRTDPRVSPAL

SEQ ID NO: 467001 - protein, 7 aa, Mycobacterium
ELDRTRE

SEQ ID NO: 467002 - protein, 5 aa, Mycobacterium
ELDSA

SEQ ID NO: 467003 - protein, 13 aa, Mycobacterium
ELDSADVDEPGAA

SEQ ID NO: 467004 - protein, 5 aa, Mycobacterium
ELDSG

SEQ ID NO: 467005 - protein, 9 aa, Mycobacterium
ELDSGPSWQ

SEQ ID NO: 467006 - protein, 8 aa, Mycobacterium
ELDSPRSR

SEQ ID NO: 467007 - protein, 11 aa, Mycobacterium
ELDSRDSVARS

SEQ ID NO: 467008 - protein, 8 aa, Mycobacterium
ELDTAARS

SEQ ID NO: 467009 - protein, 15 aa, Mycobacterium
ELDTPIANPPSDPVK

SEQ ID NO: 467010 - protein, 8 aa, Mycobacterium
ELDTSALT

SEQ ID NO: 467011 - protein, 10 aa, Mycobacterium
ELDTTAQTYE

SEQ ID NO: 467012 - protein, 8 aa, Mycobacterium
ELEADGTL

SEQ ID NO: 467013 - protein, 9 aa, Mycobacterium
ELEAEDDPL

SEQ ID NO: 467014 - protein, 7 aa, Mycobacterium
ELEAGNE

SEQ ID NO: 467015 - protein, 27 aa, Mycobacterium
ELEAKSNGSSNGATTSSTTATQKDEVN

SEQ ID NO: 467016 - protein, 12 aa, Mycobacterium
ELEASSDPQDLA

SEQ ID NO: 467017 - protein, 7 aa, Mycobacterium
ELEDRRG

SEQ ID NO: 467018 - protein, 9 aa, Mycobacterium
ELEDSDSRI

SEQ ID NO: 467019 - protein, 10 aa, Mycobacterium
ELEDVDSSEY

SEQ ID NO: 467020 - protein, 7 aa, Mycobacterium
ELEEDPP

SEQ ID NO: 467021 - protein, 23 aa, Mycobacterium
ELEEEGAKSDVRRKVRDGGEREM

SEQ ID NO: 467022 - protein, 17 aa, Mycobacterium
ELEEKSKRVGANNGHRL

SEQ ID NO: 467023 - protein, 4 aa, Mycobacterium
ELEG

SEQ ID NO: 467024 - protein, 10 aa, Mycobacterium
ELEGATSDGV

SEQ ID NO: 467025 - protein, 6 aa, Mycobacterium
ELEGEG

SEQ ID NO: 467026 - protein, 11 aa, Mycobacterium
ELEGGQKANEL

SEQ ID NO: 467027 - protein, 8 aa, Mycobacterium
ELEGPERD

SEQ ID NO: 467028 - protein, 6 aa, Mycobacterium
ELEGQG

SEQ ID NO: 467029 - protein, 8 aa, Mycobacterium
ELEHSGNR

SEQ ID NO: 467030 - protein, 5 aa, Mycobacterium
ELEKQ

SEQ ID NO: 467031 - protein, 18 aa, Mycobacterium
ELEKRQKSRQTRASRDAL

SEQ ID NO: 467032 - protein, 6 aa, Mycobacterium
ELENGG

SEQ ID NO: 467033 - protein, 4 aa, Mycobacterium
ELEP

SEQ ID NO: 467034 - protein, 6 aa, Mycobacterium
ELEPEQ

SEQ ID NO: 467035 - protein, 6 aa, Mycobacterium
ELEPEV

SEQ ID NO: 467036 - protein, 10 aa, Mycobacterium
ELEPSALGPV

SEQ ID NO: 467037 - protein, 10 aa, Mycobacterium
ELEPYRRDGG

SEQ ID NO: 467038 - protein, 4 aa, Mycobacterium
ELEQ

SEQ ID NO: 467039 - protein, 5 aa, Mycobacterium
ELEQN

SEQ ID NO: 467040 - protein, 7 aa, Mycobacterium
ELEQPDH

SEQ ID NO: 467041 - protein, 11 aa, Mycobacterium
ELEQSASSYTA

SEQ ID NO: 467042 - protein, 7 aa, Mycobacterium
ELEQTPA

SEQ ID NO: 467043 - protein, 30 aa, Mycobacterium
ELERRGEALDEREEALDEREEALDEREAAV

SEQ ID NO: 467044 - protein, 21 aa, Mycobacterium
ELERSQARASRLQRRQEANDA

SEQ ID NO: 467045 - protein, 5 aa, Mycobacterium
ELERV

SEQ ID NO: 467046 - protein, 14 aa, Mycobacterium
ELESASGKALTGGG

SEQ ID NO: 467047 - protein, 6 aa, Mycobacterium
ELESGS

SEQ ID NO: 467048 - protein, 5 aa, Mycobacterium
ELESK

SEQ ID NO: 467049 - protein, 15 aa, Mycobacterium
ELESRGAAAAVTDEI

SEQ ID NO: 467050 - protein, 11 aa, Mycobacterium
ELESSTDPQEL

SEQ ID NO: 467051 - protein, 4 aa, Mycobacterium
ELET

SEQ ID NO: 467052 - protein, 10 aa, Mycobacterium
ELETPAAAAA

SEQ ID NO: 467053 - protein, 5 aa, Mycobacterium
ELGAD

SEQ ID NO: 467054 - protein, 6 aa, Mycobacterium
ELGADG

SEQ ID NO: 467055 - protein, 11 aa, Mycobacterium
ELGADNDESPW

SEQ ID NO: 467056 - protein, 6 aa, Mycobacterium
ELGAGE

SEQ ID NO: 467057 - protein, 6 aa, Mycobacterium
ELGAGR

SEQ ID NO: 467058 - protein, 5 aa, Mycobacterium
ELGAN

SEQ ID NO: 467059 - protein, 11 aa, Mycobacterium
ELGARGAARRR

SEQ ID NO: 467060 - protein, 6 aa, Mycobacterium
ELGASP

SEQ ID NO: 467061 - protein, 4 aa, Mycobacterium
ELGD

SEQ ID NO: 467062 - protein, 12 aa, Mycobacterium
ELGDAASSFSAV

SEQ ID NO: 467063 - protein, 7 aa, Mycobacterium
ELGDDPH

SEQ ID NO: 467064 - protein, 8 aa, Mycobacterium
ELGDEPER

SEQ ID NO: 467065 - protein, 25 aa, Mycobacterium
ELGDGPEDVEDQPAAGSAGVDGFGE

SEQ ID NO: 467066 - protein, 6 aa, Mycobacterium
ELGDRD

SEQ ID NO: 467067 - protein, 8 aa, Mycobacterium
ELGDSLPE

SEQ ID NO: 467068 - protein, 6 aa, Mycobacterium
ELGDSP

SEQ ID NO: 467069 - protein, 7 aa, Mycobacterium
ELGDTGP

SEQ ID NO: 467070 - protein, 6 aa, Mycobacterium
ELGDTP

SEQ ID NO: 467071 - protein, 4 aa, Mycobacterium
ELGE

SEQ ID NO: 467072 - protein, 5 aa, Mycobacterium
ELGED

SEQ ID NO: 467073 - protein, 6 aa, Mycobacterium
ELGEEP

SEQ ID NO: 467074 - protein, 7 aa, Mycobacterium
ELGEEPT

SEQ ID NO: 467075 - protein, 17 aa, Mycobacterium
ELGEGDPDGAGDPDDYR

SEQ ID NO: 467076 - protein, 16 aa, Mycobacterium
ELGEGEPDGSDDYRAR

SEQ ID NO: 467077 - protein, 8 aa, Mycobacterium
ELGEGVEP

SEQ ID NO: 467078 - protein, 15 aa, Mycobacterium
ELGEHPYSPITPESI

SEQ ID NO: 467079 - protein, 5 aa, Mycobacterium
ELGEL

SEQ ID NO: 467080 - protein, 5 aa, Mycobacterium
ELGEQ

SEQ ID NO: 467081 - protein, 10 aa, Mycobacterium
ELGERKAATE

SEQ ID NO: 467082 - protein, 11 aa, Mycobacterium
ELGESVTEGTV

SEQ ID NO: 467083 - protein, 5 aa, Mycobacterium
ELGGA

SEQ ID NO: 467084 - protein, 6 aa, Mycobacterium
ELGGAD

SEQ ID NO: 467085 - protein, 11 aa, Mycobacterium
ELGGADAQARY

SEQ ID NO: 467086 - protein, 12 aa, Mycobacterium
ELGGADSQARYG

SEQ ID NO: 467087 - protein, 6 aa, Mycobacterium
ELGGAG

SEQ ID NO: 467088 - protein, 7 aa, Mycobacterium
ELGGDAG

SEQ ID NO: 467089 - protein, 16 aa, Mycobacterium
ELGGDAGLIGAAALAR

SEQ ID NO: 467090 - protein, 9 aa, Mycobacterium
ELGGDEHGT

SEQ ID NO: 467091 - protein, 6 aa, Mycobacterium
ELGGDG

SEQ ID NO: 467092 - protein, 6 aa, Mycobacterium
ELGGDL

SEQ ID NO: 467093 - protein, 13 aa, Mycobacterium
ELGGDPEKVNPLA

SEQ ID NO: 467094 - protein, 8 aa, Mycobacterium
ELGGDPNR

SEQ ID NO: 467095 - protein, 10 aa, Mycobacterium
ELGGGDATRI

SEQ ID NO: 467096 - protein, 7 aa, Mycobacterium
ELGGGDL

SEQ ID NO: 467097 - protein, 12 aa, Mycobacterium
ELGGGSVSESGF

SEQ ID NO: 467098 - protein, 5 aa, Mycobacterium
ELGGI

SEQ ID NO: 467099 - protein, 9 aa, Mycobacterium
ELGGKGAQL

SEQ ID NO: 467100 - protein, 6 aa, Mycobacterium
ELGGKN

SEQ ID NO: 467101 - protein, 6 aa, Mycobacterium
ELGGKS

SEQ ID NO: 467102 - protein, 7 aa, Mycobacterium
ELGGKTP

SEQ ID NO: 467103 - protein, 6 aa, Mycobacterium
ELGGPA

SEQ ID NO: 467104 - protein, 13 aa, Mycobacterium
ELGGPAGAATSPA

SEQ ID NO: 467105 - protein, 8 aa, Mycobacterium
ELGGPDAP

SEQ ID NO: 467106 - protein, 8 aa, Mycobacterium
ELGGPDEW

SEQ ID NO: 467107 - protein, 8 aa, Mycobacterium
ELGGPGYG

SEQ ID NO: 467108 - protein, 8 aa, Mycobacterium
ELGGPKAP

SEQ ID NO: 467109 - protein, 8 aa, Mycobacterium
ELGGPNAP

SEQ ID NO: 467110 - protein, 10 aa, Mycobacterium
ELGGPQDEAR

SEQ ID NO: 467111 - protein, 6 aa, Mycobacterium
ELGGPT

SEQ ID NO: 467112 - protein, 7 aa, Mycobacterium
ELGGQGF

SEQ ID NO: 467113 - protein, 11 aa, Mycobacterium
ELGGQSALPDI

SEQ ID NO: 467114 - protein, 12 aa, Mycobacterium
ELGGQSALPDIS

SEQ ID NO: 467115 - protein, 6 aa, Mycobacterium
ELGGQT

SEQ ID NO: 467116 - protein, 7 aa, Mycobacterium
ELGGRGI

SEQ ID NO: 467117 - protein, 6 aa, Mycobacterium
ELGGSA

SEQ ID NO: 467118 - protein, 11 aa, Mycobacterium
ELGGSDAQARY

SEQ ID NO: 467119 - protein, 7 aa, Mycobacterium
ELGGSGQ

SEQ ID NO: 467120 - protein, 29 aa, Mycobacterium
ELGGSQGKLGYPTSDEVDTPDGMKKSTFE

SEQ ID NO: 467121 - protein, 12 aa, Mycobacterium
ELGGSSALPDIS

SEQ ID NO: 467122 - protein, 8 aa, Mycobacterium
ELGGTAAE

SEQ ID NO: 467123 - protein, 11 aa, Mycobacterium
ELGGTAVPTAA

SEQ ID NO: 467124 - protein, 9 aa, Mycobacterium
ELGGTEPTI

SEQ ID NO: 467125 - protein, 12 aa, Mycobacterium
ELGGTSALPDIS

SEQ ID NO: 467126 - protein, 5 aa, Mycobacterium
ELGGY

SEQ ID NO: 467127 - protein, 6 aa, Mycobacterium
ELGKAD

SEQ ID NO: 467128 - protein, 6 aa, Mycobacterium
ELGKPY

SEQ ID NO: 467129 - protein, 8 aa, Mycobacterium
ELGKTPPG

SEQ ID NO: 467130 - protein, 4 aa, Mycobacterium
ELGM

SEQ ID NO: 467131 - protein, 5 aa, Mycobacterium
ELGMD

SEQ ID NO: 467132 - protein, 14 aa, Mycobacterium
ELGNPAAQSIWVVL

SEQ ID NO: 467133 - protein, 13 aa, Mycobacterium
ELGNTAAVARGSY

SEQ ID NO: 467134 - protein, 8 aa, Mycobacterium
ELGPAEDA

SEQ ID NO: 467135 - protein, 21 aa, Mycobacterium
ELGPAEKAPKGASRDGRRAST

SEQ ID NO: 467136 - protein, 7 aa, Mycobacterium
ELGPAER

SEQ ID NO: 467137 - protein, 10 aa, Mycobacterium
ELGPDGGRAE

SEQ ID NO: 467138 - protein, 7 aa, Mycobacterium
ELGPDGR

SEQ ID NO: 467139 - protein, 12 aa, Mycobacterium
ELGPDKAQQQLS

SEQ ID NO: 467140 - protein, 6 aa, Mycobacterium
ELGPDR

SEQ ID NO: 467141 - protein, 8 aa, Mycobacterium
ELGPDSRA

SEQ ID NO: 467142 - protein, 6 aa, Mycobacterium
ELGPDT

SEQ ID NO: 467143 - protein, 7 aa, Mycobacterium
ELGPEGK

SEQ ID NO: 467144 - protein, 9 aa, Mycobacterium
ELGPEGRAL

SEQ ID NO: 467145 - protein, 16 aa, Mycobacterium
ELGPEPERHLDSQTYE

SEQ ID NO: 467146 - protein, 9 aa, Mycobacterium
ELGPEPGEL

SEQ ID NO: 467147 - protein, 7 aa, Mycobacterium
ELGPGRA

SEQ ID NO: 467148 - protein, 6 aa, Mycobacterium
ELGPHG

SEQ ID NO: 467149 - protein, 19 aa, Mycobacterium
ELGPLGAKSMSESPYNPVA

SEQ ID NO: 467150 - protein, 12 aa, Mycobacterium
ELGPLGSSRTRY

SEQ ID NO: 467151 - protein, 5 aa, Mycobacterium
ELGPP

SEQ ID NO: 467152 - protein, 14 aa, Mycobacterium
ELGPPSSNSADTDS

SEQ ID NO: 467153 - protein, 9 aa, Mycobacterium
ELGPPTGYT

SEQ ID NO: 467154 - protein, 12 aa, Mycobacterium
ELGPQAHSIQSP

SEQ ID NO: 467155 - protein, 6 aa, Mycobacterium
ELGPSA

SEQ ID NO: 467156 - protein, 7 aa, Mycobacterium
ELGPSGV

SEQ ID NO: 467157 - protein, 10 aa, Mycobacterium
ELGPSSAGQI

SEQ ID NO: 467158 - protein, 7 aa, Mycobacterium
ELGPSSV

SEQ ID NO: 467159 - protein, 10 aa, Mycobacterium
ELGPSTAGQI

SEQ ID NO: 467160 - protein, 9 aa, Mycobacterium
ELGPTESTS

SEQ ID NO: 467161 - protein, 7 aa, Mycobacterium
ELGPTHT

SEQ ID NO: 467162 - protein, 10 aa, Mycobacterium
ELGPYGSSRT

SEQ ID NO: 467163 - protein, 7 aa, Mycobacterium
ELGQEGH

SEQ ID NO: 467164 - protein, 34 aa, Mycobacterium
ELGQRGSAAPVDAGASNENASKEAGFGQFNRGNN

SEQ ID NO: 467165 - protein, 27 aa, Mycobacterium
ELGQRGSAAPVDSSADAGGFEQFNRGN

SEQ ID NO: 467166 - protein, 29 aa, Mycobacterium
ELGQRGSAAPVDSSANSDASGFGQFNRGN

SEQ ID NO: 467167 - protein, 8 aa, Mycobacterium
ELGQRYPA

SEQ ID NO: 467168 - protein, 4 aa, Mycobacterium
ELGR

SEQ ID NO: 467169 - protein, 5 aa, Mycobacterium
ELGRA

SEQ ID NO: 467170 - protein, 5 aa, Mycobacterium
ELGRD

SEQ ID NO: 467171 - protein, 16 aa, Mycobacterium
ELGREKSAFAAAVTSH

SEQ ID NO: 467172 - protein, 16 aa, Mycobacterium
ELGREKSAFASAVTRH

SEQ ID NO: 467173 - protein, 16 aa, Mycobacterium
ELGREKSALAAAVTAH

SEQ ID NO: 467174 - protein, 11 aa, Mycobacterium
ELGREKSALAT

SEQ ID NO: 467175 - protein, 16 aa, Mycobacterium
ELGREKSPLAAAVTAH

SEQ ID NO: 467176 - protein, 11 aa, Mycobacterium
ELGRGAKIGEA

SEQ ID NO: 467177 - protein, 10 aa, Mycobacterium
ELGRKRGRGG

SEQ ID NO: 467178 - protein, 7 aa, Mycobacterium
ELGRPAN

SEQ ID NO: 467179 - protein, 7 aa, Mycobacterium
ELGRPEG

SEQ ID NO: 467180 - protein, 7 aa, Mycobacterium
ELGRSAA

SEQ ID NO: 467181 - protein, 7 aa, Mycobacterium
ELGRSGS

SEQ ID NO: 467182 - protein, 30 aa, Mycobacterium
ELGRSGVGVGESGLSYASGDAAAALTYGLF

SEQ ID NO: 467183 - protein, 15 aa, Mycobacterium
ELGRTQNGNNNGYCQ

SEQ ID NO: 467184 - protein, 11 aa, Mycobacterium
ELGRTQQGNNN

SEQ ID NO: 467185 - protein, 14 aa, Mycobacterium
ELGRTQYGNNNGYC

SEQ ID NO: 467186 - protein, 4 aa, Mycobacterium
ELGS

SEQ ID NO: 467187 - protein, 11 aa, Mycobacterium
ELGSAADSFAS

SEQ ID NO: 467188 - protein, 12 aa, Mycobacterium
ELGSAAESFGSV

SEQ ID NO: 467189 - protein, 12 aa, Mycobacterium
ELGSAASAFSSV

SEQ ID NO: 467190 - protein, 9 aa, Mycobacterium
ELGSAATSF

SEQ ID NO: 467191 - protein, 6 aa, Mycobacterium
ELGSDL

SEQ ID NO: 467192 - protein, 9 aa, Mycobacterium
ELGSDTLGG

SEQ ID NO: 467193 - protein, 11 aa, Mycobacterium
ELGSGDRAESL

SEQ ID NO: 467194 - protein, 10 aa, Mycobacterium
ELGSLEPGKL

SEQ ID NO: 467195 - protein, 23 aa, Mycobacterium
ELGSPPPDGPRRELTPVRQSGGK

SEQ ID NO: 467196 - protein, 8 aa, Mycobacterium
ELGSPTRH

SEQ ID NO: 467197 - protein, 7 aa, Mycobacterium
ELGSRGQ

SEQ ID NO: 467198 - protein, 16 aa, Mycobacterium
ELGSSEMADSQAAAGY

SEQ ID NO: 467199 - protein, 11 aa, Mycobacterium
ELGSSNSGQTI

SEQ ID NO: 467200 - protein, 24 aa, Mycobacterium
ELGTAAQSFTSVTSGLTGQAWQGA

SEQ ID NO: 467201 - protein, 8 aa, Mycobacterium
ELGTAARS

SEQ ID NO: 467202 - protein, 9 aa, Mycobacterium
ELGTEPVSY

SEQ ID NO: 467203 - protein, 17 aa, Mycobacterium
ELGTGPVSFRDSTSPEF

SEQ ID NO: 467204 - protein, 16 aa, Mycobacterium
ELGTGPVSFRDSTSRE

SEQ ID NO: 467205 - protein, 9 aa, Mycobacterium
ELGTGRGGP

SEQ ID NO: 467206 - protein, 19 aa, Mycobacterium
ELGTLDEAGAQFMEQYGGA

SEQ ID NO: 467207 - protein, 8 aa, Mycobacterium
ELGTLDED

SEQ ID NO: 467208 - protein, 19 aa, Mycobacterium
ELGTLPDEAAEWMAKYGGK

SEQ ID NO: 467209 - protein, 7 aa, Mycobacterium
ELGTRAG

SEQ ID NO: 467210 - protein, 6 aa, Mycobacterium
ELGTRG

SEQ ID NO: 467211 - protein, 28 aa, Mycobacterium
ELGTRGSAAPVDTGANNDGGVNQFNRGN

SEQ ID NO: 467212 - protein, 21 aa, Mycobacterium
ELGTSNEDTDIDPLDAPPGTL

SEQ ID NO: 467213 - protein, 9 aa, Mycobacterium
ELGTTAETC

SEQ ID NO: 467214 - protein, 4 aa, Mycobacterium
ELGV

SEQ ID NO: 467215 - protein, 5 aa, Mycobacterium
ELGVP

SEQ ID NO: 467216 - protein, 6 aa, Mycobacterium
ELHDKG

SEQ ID NO: 467217 - protein, 4 aa, Mycobacterium
ELHE

SEQ ID NO: 467218 - protein, 6 aa, Mycobacterium
ELHGTG

SEQ ID NO: 467219 - protein, 5 aa, Mycobacterium
ELHPD

SEQ ID NO: 467220 - protein, 8 aa, Mycobacterium
ELHSAEDT

SEQ ID NO: 467221 - protein, 16 aa, Mycobacterium
ELHSSQRDSLSAALDP

SEQ ID NO: 467222 - protein, 31 aa, Mycobacterium
ELKAAQPAAAEAAETAATSAEARASKPTHVA

SEQ ID NO: 467223 - protein, 11 aa, Mycobacterium
ELKAQDSGRGK

SEQ ID NO: 467224 - protein, 8 aa, Mycobacterium
ELKDKAPR

SEQ ID NO: 467225 - protein, 7 aa, Mycobacterium
ELKDPAP

SEQ ID NO: 467226 - protein, 19 aa, Mycobacterium
ELKDTSRASAIDDPGLESL

SEQ ID NO: 467227 - protein, 21 aa, Mycobacterium
ELKGTPTRAIKSPEDLDGLDQ

SEQ ID NO: 467228 - protein, 11 aa, Mycobacterium
ELKNQGEQAMN

SEQ ID NO: 467229 - protein, 14 aa, Mycobacterium
ELKPGDATDAGGGP

SEQ ID NO: 467230 - protein, 9 aa, Mycobacterium
ELKPGGADG

SEQ ID NO: 467231 - protein, 9 aa, Mycobacterium
ELKPGGPDG

SEQ ID NO: 467232 - protein, 15 aa, Mycobacterium
ELKPNGHFDEVQPFA

SEQ ID NO: 467233 - protein, 16 aa, Mycobacterium
ELKPNSPYAASKAAAD

SEQ ID NO: 467234 - protein, 13 aa, Mycobacterium
ELKPSDATDAHGG

SEQ ID NO: 467235 - protein, 14 aa, Mycobacterium
ELKPSDATDANGGP

SEQ ID NO: 467236 - protein, 13 aa, Mycobacterium
ELKPSDATDPRGG

SEQ ID NO: 467237 - protein, 13 aa, Mycobacterium
ELKRKESEADLAV

SEQ ID NO: 467238 - protein, 4 aa, Mycobacterium
ELLG

SEQ ID NO: 467239 - protein, 4 aa, Mycobacterium
ELNA

SEQ ID NO: 467240 - protein, 7 aa, Mycobacterium
ELNADTS

SEQ ID NO: 467241 - protein, 4 aa, Mycobacterium
ELNE

SEQ ID NO: 467242 - protein, 14 aa, Mycobacterium
ELNEAGTNAHHGSG

SEQ ID NO: 467243 - protein, 6 aa, Mycobacterium
ELNEPD

SEQ ID NO: 467244 - protein, 5 aa, Mycobacterium
ELNES

SEQ ID NO: 467245 - protein, 4 aa, Mycobacterium
ELNG

SEQ ID NO: 467246 - protein, 8 aa, Mycobacterium
ELNGIRGK

SEQ ID NO: 467247 - protein, 5 aa, Mycobacterium
ELNGR

SEQ ID NO: 467248 - protein, 6 aa, Mycobacterium
ELNGSN

SEQ ID NO: 467249 - protein, 5 aa, Mycobacterium
ELNNP

SEQ ID NO: 467250 - protein, 12 aa, Mycobacterium
ELNPETGPLGSY

SEQ ID NO: 467251 - protein, 6 aa, Mycobacterium
ELNRQG

SEQ ID NO: 467252 - protein, 7 aa, Mycobacterium
ELNSEER

SEQ ID NO: 467253 - protein, 11 aa, Mycobacterium
ELNSPGAPGSV

SEQ ID NO: 467254 - protein, 7 aa, Mycobacterium
ELNTGEK

SEQ ID NO: 467255 - protein, 13 aa, Mycobacterium
ELNTRNVNKDDPR

SEQ ID NO: 467256 - protein, 4 aa, Mycobacterium
ELPA

SEQ ID NO: 467257 - protein, 5 aa, Mycobacterium
ELPAA

SEQ ID NO: 467258 - protein, 8 aa, Mycobacterium
ELPADRDP

SEQ ID NO: 467259 - protein, 5 aa, Mycobacterium
ELPAG

SEQ ID NO: 467260 - protein, 15 aa, Mycobacterium
ELPAGAGDGRELPGG

SEQ ID NO: 467261 - protein, 15 aa, Mycobacterium
ELPAGAGDGSNLPGD

SEQ ID NO: 467262 - protein, 16 aa, Mycobacterium
ELPAGAPVSSAPYGSA

SEQ ID NO: 467263 - protein, 7 aa, Mycobacterium
ELPAGHG

SEQ ID NO: 467264 - protein, 15 aa, Mycobacterium
ELPAGPNPEVGGGAP

SEQ ID NO: 467265 - protein, 8 aa, Mycobacterium
ELPAGQGF

SEQ ID NO: 467266 - protein, 9 aa, Mycobacterium
ELPAGTTAT

SEQ ID NO: 467267 - protein, 13 aa, Mycobacterium
ELPAPQVSEAQAE

SEQ ID NO: 467268 - protein, 7 aa, Mycobacterium
ELPAQPA

SEQ ID NO: 467269 - protein, 10 aa, Mycobacterium
ELPDAEKPSL

SEQ ID NO: 467270 - protein, 8 aa, Mycobacterium
ELPDAPDI

SEQ ID NO: 467271 - protein, 7 aa, Mycobacterium
ELPDATA

SEQ ID NO: 467272 - protein, 5 aa, Mycobacterium
ELPDD

SEQ ID NO: 467273 - protein, 15 aa, Mycobacterium
ELPDDEQARLRARQG

SEQ ID NO: 467274 - protein, 12 aa, Mycobacterium
ELPDDERDATYP

SEQ ID NO: 467275 - protein, 8 aa, Mycobacterium
ELPDDKPR

SEQ ID NO: 467276 - protein, 48 aa, Mycobacterium
ELPDEAEAPAARAVDPEPAGETADVAPESAAPESPAQTPTADRQEESI

SEQ ID NO: 467277 - protein, 11 aa, Mycobacterium
ELPDELGEGSQ

SEQ ID NO: 467278 - protein, 8 aa, Mycobacterium
ELPDELSE

SEQ ID NO: 467279 - protein, 6 aa, Mycobacterium
ELPDGA

SEQ ID NO: 467280 - protein, 9 aa, Mycobacterium
ELPDGERDA

SEQ ID NO: 467281 - protein, 16 aa, Mycobacterium
ELPDGSPDDPDDAETV

SEQ ID NO: 467282 - protein, 7 aa, Mycobacterium
ELPDKAT

SEQ ID NO: 467283 - protein, 6 aa, Mycobacterium
ELPDKV

SEQ ID NO: 467284 - protein, 8 aa, Mycobacterium
ELPDPDDL

SEQ ID NO: 467285 - protein, 9 aa, Mycobacterium
ELPDPNATS

SEQ ID NO: 467286 - protein, 21 aa, Mycobacterium
ELPDPPALPTTGGRAENQSTR

SEQ ID NO: 467287 - protein, 9 aa, Mycobacterium
ELPDPSPYI

SEQ ID NO: 467288 - protein, 8 aa, Mycobacterium
ELPDPTPF

SEQ ID NO: 467289 - protein, 6 aa, Mycobacterium
ELPDQP

SEQ ID NO: 467290 - protein, 5 aa, Mycobacterium
ELPDR

SEQ ID NO: 467291 - protein, 8 aa, Mycobacterium
ELPDRDLR

SEQ ID NO: 467292 - protein, 8 aa, Mycobacterium
ELPDRPDA

SEQ ID NO: 467293 - protein, 5 aa, Mycobacterium
ELPDT

SEQ ID NO: 467294 - protein, 7 aa, Mycobacterium
ELPDTAE

SEQ ID NO: 467295 - protein, 5 aa, Mycobacterium
ELPEA

SEQ ID NO: 467296 - protein, 10 aa, Mycobacterium
ELPEADKETI

SEQ ID NO: 467297 - protein, 12 aa, Mycobacterium
ELPEGASTQNLS

SEQ ID NO: 467298 - protein, 16 aa, Mycobacterium
ELPEGGPDDPPDAETV

SEQ ID NO: 467299 - protein, 7 aa, Mycobacterium
ELPEGPT

SEQ ID NO: 467300 - protein, 7 aa, Mycobacterium
ELPEGTD

SEQ ID NO: 467301 - protein, 13 aa, Mycobacterium
ELPEHPDADERRR

SEQ ID NO: 467302 - protein, 5 aa, Mycobacterium
ELPEK

SEQ ID NO: 467303 - protein, 10 aa, Mycobacterium
ELPEPAHSEH

SEQ ID NO: 467304 - protein, 31 aa, Mycobacterium
ELPEPAPAKPATGGDEAPAAADNEAAAEPPL

SEQ ID NO: 467305 - protein, 11 aa, Mycobacterium
ELPEPDRTDAG

SEQ ID NO: 467306 - protein, 8 aa, Mycobacterium
ELPEPREN

SEQ ID NO: 467307 - protein, 7 aa, Mycobacterium
ELPEPRP

SEQ ID NO: 467308 - protein, 19 aa, Mycobacterium
ELPEPTDPDFSPKATKTLA

SEQ ID NO: 467309 - protein, 5 aa, Mycobacterium
ELPEQ

SEQ ID NO: 467310 - protein, 7 aa, Mycobacterium
ELPESDW

SEQ ID NO: 467311 - protein, 6 aa, Mycobacterium
ELPESP

SEQ ID NO: 467312 - protein, 4 aa, Mycobacterium
ELPG

SEQ ID NO: 467313 - protein, 6 aa, Mycobacterium
ELPGAD

SEQ ID NO: 467314 - protein, 14 aa, Mycobacterium
ELPGANGSAVPSTW

SEQ ID NO: 467315 - protein, 12 aa, Mycobacterium
ELPGARKRLKSA

SEQ ID NO: 467316 - protein, 7 aa, Mycobacterium
ELPGDES

SEQ ID NO: 467317 - protein, 7 aa, Mycobacterium
ELPGESP

SEQ ID NO: 467318 - protein, 8 aa, Mycobacterium
ELPGETAL

SEQ ID NO: 467319 - protein, 6 aa, Mycobacterium
ELPGGA

SEQ ID NO: 467320 - protein, 12 aa, Mycobacterium
ELPGGRDALHGT

SEQ ID NO: 467321 - protein, 13 aa, Mycobacterium
ELPGGREALKGAT

SEQ ID NO: 467322 - protein, 12 aa, Mycobacterium
ELPGGRERLRDT

SEQ ID NO: 467323 - protein, 6 aa, Mycobacterium
ELPGGS

SEQ ID NO: 467324 - protein, 9 aa, Mycobacterium
ELPGKRRNE

SEQ ID NO: 467325 - protein, 6 aa, Mycobacterium
ELPGPG

SEQ ID NO: 467326 - protein, 8 aa, Mycobacterium
ELPGPHGS

SEQ ID NO: 467327 - protein, 10 aa, Mycobacterium
ELPGPNGSVV

SEQ ID NO: 467328 - protein, 9 aa, Mycobacterium
ELPGQPPHT

SEQ ID NO: 467329 - protein, 7 aa, Mycobacterium
ELPGSAD

SEQ ID NO: 467330 - protein, 22 aa, Mycobacterium
ELPHTAKGSLDRRAVAERFARG

SEQ ID NO: 467331 - protein, 22 aa, Mycobacterium
ELPHTAKGSLDRRAVARQFGRR

SEQ ID NO: 467332 - protein, 8 aa, Mycobacterium
ELPKDKPR

SEQ ID NO: 467333 - protein, 9 aa, Mycobacterium
ELPKNGIGR

SEQ ID NO: 467334 - protein, 11 aa, Mycobacterium
ELPKQGSRKPW

SEQ ID NO: 467335 - protein, 13 aa, Mycobacterium
ELPLGKRNPSIAG

SEQ ID NO: 467336 - protein, 5 aa, Mycobacterium
ELPNG

SEQ ID NO: 467337 - protein, 6 aa, Mycobacterium
ELPNGA

SEQ ID NO: 467338 - protein, 8 aa, Mycobacterium
ELPNGHGL

SEQ ID NO: 467339 - protein, 6 aa, Mycobacterium
ELPNSG

SEQ ID NO: 467340 - protein, 5 aa, Mycobacterium
ELPNV

SEQ ID NO: 467341 - protein, 7 aa, Mycobacterium
ELPPAER

SEQ ID NO: 467342 - protein, 39 aa, Mycobacterium
ELPPAPPAIVPPSEAEPLDEAYSPAPGESGPDDGSRAVG

SEQ ID NO: 467343 - protein, 16 aa, Mycobacterium
ELPPAVNPARQPTWGQ

SEQ ID NO: 467344 - protein, 5 aa, Mycobacterium
ELPPD

SEQ ID NO: 467345 - protein, 13 aa, Mycobacterium
ELPPDAPAAPPNL

SEQ ID NO: 467346 - protein, 12 aa, Mycobacterium
ELPPDAREALTG

SEQ ID NO: 467347 - protein, 17 aa, Mycobacterium
ELPPDEAAAIPQAPTSL

SEQ ID NO: 467348 - protein, 6 aa, Mycobacterium
ELPPDG

SEQ ID NO: 467349 - protein, 6 aa, Mycobacterium
ELPPDR

SEQ ID NO: 467350 - protein, 17 aa, Mycobacterium
ELPPEEAAGIPQAPTSL

SEQ ID NO: 467351 - protein, 17 aa, Mycobacterium
ELPPEEAANIPQAPTQL

SEQ ID NO: 467352 - protein, 17 aa, Mycobacterium
ELPPEEAANIPQAPTSL

SEQ ID NO: 467353 - protein, 7 aa, Mycobacterium
ELPPGAD

SEQ ID NO: 467354 - protein, 7 aa, Mycobacterium
ELPPGFA

SEQ ID NO: 467355 - protein, 14 aa, Mycobacterium
ELPPGGDGLTDYDS

SEQ ID NO: 467356 - protein, 7 aa, Mycobacterium
ELPPGGR

SEQ ID NO: 467357 - protein, 6 aa, Mycobacterium
ELPPGL

SEQ ID NO: 467358 - protein, 11 aa, Mycobacterium
ELPPGLPPALQ

SEQ ID NO: 467359 - protein, 10 aa, Mycobacterium
ELPPGPPGAM

SEQ ID NO: 467360 - protein, 6 aa, Mycobacterium
ELPPGQ

SEQ ID NO: 467361 - protein, 8 aa, Mycobacterium
ELPPGQAG

SEQ ID NO: 467362 - protein, 6 aa, Mycobacterium
ELPPKR

SEQ ID NO: 467363 - protein, 9 aa, Mycobacterium
ELPPKRRDE

SEQ ID NO: 467364 - protein, 9 aa, Mycobacterium
ELPPPGGVA

SEQ ID NO: 467365 - protein, 7 aa, Mycobacterium
ELPPPIG

SEQ ID NO: 467366 - protein, 66 aa, Mycobacterium
ELPPPSGPLPPVADAAPKTAAAGADQPASQDAAPADAAKTAKAAEDAVIPGGPDVRPALGDPAEVA

SEQ ID NO: 467367 - protein, 6 aa, Mycobacterium
ELPPRD

SEQ ID NO: 467368 - protein, 6 aa, Mycobacterium
ELPPRE

SEQ ID NO: 467369 - protein, 7 aa, Mycobacterium
ELPPSQS

SEQ ID NO: 467370 - protein, 11 aa, Mycobacterium
ELPPSSWGSGK

SEQ ID NO: 467371 - protein, 27 aa, Mycobacterium
ELPPVDESPTAPPQRSALGDYKDAARY

SEQ ID NO: 467372 - protein, 15 aa, Mycobacterium
ELPPVGSKAPGFSLT

SEQ ID NO: 467373 - protein, 8 aa, Mycobacterium
ELPPYTRA

SEQ ID NO: 467374 - protein, 15 aa, Mycobacterium
ELPQEYRDLKGASSA

SEQ ID NO: 467375 - protein, 16 aa, Mycobacterium
ELPQGDPVSAAPYGSA

SEQ ID NO: 467376 - protein, 5 aa, Mycobacterium
ELPQH

SEQ ID NO: 467377 - protein, 11 aa, Mycobacterium
ELPQPQAPNPE

SEQ ID NO: 467378 - protein, 8 aa, Mycobacterium
ELPQPRPL

SEQ ID NO: 467379 - protein, 4 aa, Mycobacterium
ELPR

SEQ ID NO: 467380 - protein, 12 aa, Mycobacterium
ELPRARTGGLRR

SEQ ID NO: 467381 - protein, 8 aa, Mycobacterium
ELPREEPY

SEQ ID NO: 467382 - protein, 9 aa, Mycobacterium
ELPREERDS

SEQ ID NO: 467383 - protein, 16 aa, Mycobacterium
ELPRNTPVEVEAIFEV

SEQ ID NO: 467384 - protein, 13 aa, Mycobacterium
ELPRPEGSETVDA

SEQ ID NO: 467385 - protein, 9 aa, Mycobacterium
ELPRPRPPR

SEQ ID NO: 467386 - protein, 12 aa, Mycobacterium
ELPRRGTPREAD

SEQ ID NO: 467387 - protein, 6 aa, Mycobacterium
ELPRTE

SEQ ID NO: 467388 - protein, 6 aa, Mycobacterium
ELPRTV

SEQ ID NO: 467389 - protein, 12 aa, Mycobacterium
ELPSANGMSSET

SEQ ID NO: 467390 - protein, 15 aa, Mycobacterium
ELPSAPANRATVPQD

SEQ ID NO: 467391 - protein, 8 aa, Mycobacterium
ELPSDERD

SEQ ID NO: 467392 - protein, 5 aa, Mycobacterium
ELPSE

SEQ ID NO: 467393 - protein, 16 aa, Mycobacterium
ELPSGAADCTFDFGEH

SEQ ID NO: 467394 - protein, 7 aa, Mycobacterium
ELPSPAQ

SEQ ID NO: 467395 - protein, 23 aa, Mycobacterium
ELPSPDAAHSTTADYIRIATDRL

SEQ ID NO: 467396 - protein, 9 aa, Mycobacterium
ELPSPQDVE

SEQ ID NO: 467397 - protein, 8 aa, Mycobacterium
ELPSQRIG

SEQ ID NO: 467398 - protein, 5 aa, Mycobacterium
ELPSS

SEQ ID NO: 467399 - protein, 10 aa, Mycobacterium
ELPSTDAPVQ

SEQ ID NO: 467400 - protein, 4 aa, Mycobacterium
ELPT

SEQ ID NO: 467401 - protein, 10 aa, Mycobacterium
ELPTAEGQQA

SEQ ID NO: 467402 - protein, 10 aa, Mycobacterium
ELPTAGGQQA

SEQ ID NO: 467403 - protein, 9 aa, Mycobacterium
ELPTDAGDF

SEQ ID NO: 467404 - protein, 16 aa, Mycobacterium
ELPTDLSGRDREDDRK

SEQ ID NO: 467405 - protein, 6 aa, Mycobacterium
ELPTER

SEQ ID NO: 467406 - protein, 11 aa, Mycobacterium
ELPTESRDALT

SEQ ID NO: 467407 - protein, 5 aa, Mycobacterium
ELPTG

SEQ ID NO: 467408 - protein, 6 aa, Mycobacterium
ELPTGE

SEQ ID NO: 467409 - protein, 8 aa, Mycobacterium
ELPTGEDI

SEQ ID NO: 467410 - protein, 8 aa, Mycobacterium
ELPTGGTS

SEQ ID NO: 467411 - protein, 7 aa, Mycobacterium
ELPTGHP

SEQ ID NO: 467412 - protein, 8 aa, Mycobacterium
ELPTGPGA

SEQ ID NO: 467413 - protein, 12 aa, Mycobacterium
ELPTGRDLQDHT

SEQ ID NO: 467414 - protein, 8 aa, Mycobacterium
ELPTPEDV

SEQ ID NO: 467415 - protein, 12 aa, Mycobacterium
ELPTPPHDGPGI

SEQ ID NO: 467416 - protein, 8 aa, Mycobacterium
ELPTSDDG

SEQ ID NO: 467417 - protein, 7 aa, Mycobacterium
ELPTTDD

SEQ ID NO: 467418 - protein, 10 aa, Mycobacterium
ELQAAGASPI

SEQ ID NO: 467419 - protein, 9 aa, Mycobacterium
ELQAQQNTE

SEQ ID NO: 467420 - protein, 12 aa, Mycobacterium
ELQARQAAETAA

SEQ ID NO: 467421 - protein, 8 aa, Mycobacterium
ELQEEAGL

SEQ ID NO: 467422 - protein, 26 aa, Mycobacterium
ELQGKGYKLPDYPADPKTDEEKDIRN

SEQ ID NO: 467423 - protein, 10 aa, Mycobacterium
ELQGKTRTTI

SEQ ID NO: 467424 - protein, 9 aa, Mycobacterium
ELQGRGRGG

SEQ ID NO: 467425 - protein, 10 aa, Mycobacterium
ELQGRGRGGI

SEQ ID NO: 467426 - protein, 5 aa, Mycobacterium
ELQKN

SEQ ID NO: 467427 - protein, 17 aa, Mycobacterium
ELQKQQASAQAKADTIA

SEQ ID NO: 467428 - protein, 4 aa, Mycobacterium
ELQN

SEQ ID NO: 467429 - protein, 6 aa, Mycobacterium
ELQNHG

SEQ ID NO: 467430 - protein, 4 aa, Mycobacterium
ELQP

SEQ ID NO: 467431 - protein, 15 aa, Mycobacterium
ELQPATGSNRAAQQT

SEQ ID NO: 467432 - protein, 8 aa, Mycobacterium
ELQPDGTF

SEQ ID NO: 467433 - protein, 5 aa, Mycobacterium
ELQPG

SEQ ID NO: 467434 - protein, 18 aa, Mycobacterium
ELQPGKAAAAQRSFDTAG

SEQ ID NO: 467435 - protein, 5 aa, Mycobacterium
ELQQA

SEQ ID NO: 467436 - protein, 5 aa, Mycobacterium
ELQQQ

SEQ ID NO: 467437 - protein, 8 aa, Mycobacterium
ELQREGTI

SEQ ID NO: 467438 - protein, 15 aa, Mycobacterium
ELQRSDDAEREAEFP

SEQ ID NO: 467439 - protein, 8 aa, Mycobacterium
ELQSAEAS

SEQ ID NO: 467440 - protein, 14 aa, Mycobacterium
ELQSGRWQLTALQI

SEQ ID NO: 467441 - protein, 9 aa, Mycobacterium
ELQSHSGNP

SEQ ID NO: 467442 - protein, 9 aa, Mycobacterium
ELQSKQSQL

SEQ ID NO: 467443 - protein, 16 aa, Mycobacterium
ELQSSDSAASGYEFSQ

SEQ ID NO: 467444 - protein, 4 aa, Mycobacterium
ELRA

SEQ ID NO: 467445 - protein, 8 aa, Mycobacterium
ELRAAGQE

SEQ ID NO: 467446 - protein, 7 aa, Mycobacterium
ELRAGDA

SEQ ID NO: 467447 - protein, 6 aa, Mycobacterium
ELRAPM

SEQ ID NO: 467448 - protein, 5 aa, Mycobacterium
ELRAR

SEQ ID NO: 467449 - protein, 13 aa, Mycobacterium
ELRASDVDDPEAA

SEQ ID NO: 467450 - protein, 10 aa, Mycobacterium
ELRASTRKEL

SEQ ID NO: 467451 - protein, 17 aa, Mycobacterium
ELRDARDDLTRAKARYD

SEQ ID NO: 467452 - protein, 15 aa, Mycobacterium
ELRDEGRRLQNEGAG

SEQ ID NO: 467453 - protein, 5 aa, Mycobacterium
ELRDG

SEQ ID NO: 467454 - protein, 9 aa, Mycobacterium
ELRDPSRYL

SEQ ID NO: 467455 - protein, 19 aa, Mycobacterium
ELRDRARGVSADPDDPIHA

SEQ ID NO: 467456 - protein, 6 aa, Mycobacterium
ELRDRS

SEQ ID NO: 467457 - protein, 17 aa, Mycobacterium
ELREAGVSDKTLADPSY

SEQ ID NO: 467458 - protein, 6 aa, Mycobacterium
ELREET

SEQ ID NO: 467459 - protein, 8 aa, Mycobacterium
ELREETGL

SEQ ID NO: 467460 - protein, 9 aa, Mycobacterium
ELREETGLR

SEQ ID NO: 467461 - protein, 10 aa, Mycobacterium
ELREETGLSA

SEQ ID NO: 467462 - protein, 13 aa, Mycobacterium
ELREETGLTASSM

SEQ ID NO: 467463 - protein, 5 aa, Mycobacterium
ELREN

SEQ ID NO: 467464 - protein, 9 aa, Mycobacterium
ELRERRRTG

SEQ ID NO: 467465 - protein, 11 aa, Mycobacterium
ELRERSARGRR

SEQ ID NO: 467466 - protein, 6 aa, Mycobacterium
ELRGAD

SEQ ID NO: 467467 - protein, 11 aa, Mycobacterium
ELRGDDSREAK

SEQ ID NO: 467468 - protein, 12 aa, Mycobacterium
ELRGGGATSVEG

SEQ ID NO: 467469 - protein, 11 aa, Mycobacterium
ELRGGPPAQRI

SEQ ID NO: 467470 - protein, 12 aa, Mycobacterium
ELRGPGKTRALA

SEQ ID NO: 467471 - protein, 14 aa, Mycobacterium
ELRGPGKTRSLAQS

SEQ ID NO: 467472 - protein, 7 aa, Mycobacterium
ELRGSGL

SEQ ID NO: 467473 - protein, 7 aa, Mycobacterium
ELRGSGV

SEQ ID NO: 467474 - protein, 12 aa, Mycobacterium
ELRGSKRPTYAS

SEQ ID NO: 467475 - protein, 7 aa, Mycobacterium
ELRGTGV

SEQ ID NO: 467476 - protein, 22 aa, Mycobacterium
ELRGTPTHAVKSPADLDGLRGA

SEQ ID NO: 467477 - protein, 12 aa, Mycobacterium
ELRKSGDALPAD

SEQ ID NO: 467478 - protein, 8 aa, Mycobacterium
ELRNGSTA

SEQ ID NO: 467479 - protein, 5 aa, Mycobacterium
ELRPA

SEQ ID NO: 467480 - protein, 20 aa, Mycobacterium
ELRPAYSNADAAQQVAEGRV

SEQ ID NO: 467481 - protein, 5 aa, Mycobacterium
ELRQK

SEQ ID NO: 467482 - protein, 9 aa, Mycobacterium
ELRQSGSTV

SEQ ID NO: 467483 - protein, 4 aa, Mycobacterium
ELRR

SEQ ID NO: 467484 - protein, 5 aa, Mycobacterium
ELRRD

SEQ ID NO: 467485 - protein, 5 aa, Mycobacterium
ELRRG

SEQ ID NO: 467486 - protein, 6 aa, Mycobacterium
ELRRGS

SEQ ID NO: 467487 - protein, 19 aa, Mycobacterium
ELRSATAQHQRTDSAESTL

SEQ ID NO: 467488 - protein, 8 aa, Mycobacterium
ELRSEDVD

SEQ ID NO: 467489 - protein, 12 aa, Mycobacterium
ELRSEGGSSAGR

SEQ ID NO: 467490 - protein, 12 aa, Mycobacterium
ELRSNSPLVGTP

SEQ ID NO: 467491 - protein, 13 aa, Mycobacterium
ELRSNSPLVGTST

SEQ ID NO: 467492 - protein, 20 aa, Mycobacterium
ELRSRAQKIAQTAAAQGAGD

SEQ ID NO: 467493 - protein, 5 aa, Mycobacterium
ELRTA

SEQ ID NO: 467494 - protein, 26 aa, Mycobacterium
ELRTADTATLAGDARDAARTLRARAG

SEQ ID NO: 467495 - protein, 14 aa, Mycobacterium
ELRTDSSSSSGDLL

SEQ ID NO: 467496 - protein, 8 aa, Mycobacterium
ELRTEAGQ

SEQ ID NO: 467497 - protein, 9 aa, Mycobacterium
ELRTETGQD

SEQ ID NO: 467498 - protein, 8 aa, Mycobacterium
ELRTPDIT

SEQ ID NO: 467499 - protein, 11 aa, Mycobacterium
ELRTPDSPTQL

SEQ ID NO: 467500 - protein, 8 aa, Mycobacterium
ELRTPWPR

SEQ ID NO: 467501 - protein, 6 aa, Mycobacterium
ELSAAR

SEQ ID NO: 467502 - protein, 12 aa, Mycobacterium
ELSADPSRFDGW

SEQ ID NO: 467503 - protein, 9 aa, Mycobacterium
ELSAGRPPG

SEQ ID NO: 467504 - protein, 9 aa, Mycobacterium
ELSANTALR

SEQ ID NO: 467505 - protein, 10 aa, Mycobacterium
ELSAPLRTPS

SEQ ID NO: 467506 - protein, 20 aa, Mycobacterium
ELSASGPAGTARLTGDDVPA

SEQ ID NO: 467507 - protein, 7 aa, Mycobacterium
ELSDASA

SEQ ID NO: 467508 - protein, 19 aa, Mycobacterium
ELSDEERREWFDKNDNHFV

SEQ ID NO: 467509 - protein, 10 aa, Mycobacterium
ELSDETEEEG

SEQ ID NO: 467510 - protein, 17 aa, Mycobacterium
ELSDGDLAEVSSDEDGR

SEQ ID NO: 467511 - protein, 7 aa, Mycobacterium
ELSDGGK

SEQ ID NO: 467512 - protein, 14 aa, Mycobacterium
ELSDIQDDSSSAES

SEQ ID NO: 467513 - protein, 8 aa, Mycobacterium
ELSDPESA

SEQ ID NO: 467514 - protein, 5 aa, Mycobacterium
ELSDS

SEQ ID NO: 467515 - protein, 12 aa, Mycobacterium
ELSDSEAERSVS

SEQ ID NO: 467516 - protein, 13 aa, Mycobacterium
ELSDTDDAGRPAM

SEQ ID NO: 467517 - protein, 4 aa, Mycobacterium
ELSE

SEQ ID NO: 467518 - protein, 8 aa, Mycobacterium
ELSEDGTA

SEQ ID NO: 467519 - protein, 20 aa, Mycobacterium
ELSEDQRASIAHRNAQNLLH

SEQ ID NO: 467520 - protein, 7 aa, Mycobacterium
ELSEEER

SEQ ID NO: 467521 - protein, 6 aa, Mycobacterium
ELSEIG

SEQ ID NO: 467522 - protein, 7 aa, Mycobacterium
ELSELGR

SEQ ID NO: 467523 - protein, 15 aa, Mycobacterium
ELSENAANGRDRAAA

SEQ ID NO: 467524 - protein, 5 aa, Mycobacterium
ELSES

SEQ ID NO: 467525 - protein, 11 aa, Mycobacterium
ELSESGVQKHN

SEQ ID NO: 467526 - protein, 13 aa, Mycobacterium
ELSETDEEGRPIL

SEQ ID NO: 467527 - protein, 7 aa, Mycobacterium
ELSETEL

SEQ ID NO: 467528 - protein, 10 aa, Mycobacterium
ELSETVSEDR

SEQ ID NO: 467529 - protein, 4 aa, Mycobacterium
ELSG

SEQ ID NO: 467530 - protein, 8 aa, Mycobacterium
ELSGADAA

SEQ ID NO: 467531 - protein, 9 aa, Mycobacterium
ELSGADAAR

SEQ ID NO: 467532 - protein, 6 aa, Mycobacterium
ELSGAR

SEQ ID NO: 467533 - protein, 8 aa, Mycobacterium
ELSGDRGA

SEQ ID NO: 467534 - protein, 13 aa, Mycobacterium
ELSGDSGYLSAHL

SEQ ID NO: 467535 - protein, 14 aa, Mycobacterium
ELSGERRKASIDVS

SEQ ID NO: 467536 - protein, 14 aa, Mycobacterium
ELSGGEADDEERRL

SEQ ID NO: 467537 - protein, 10 aa, Mycobacterium
ELSGGQQQRV

SEQ ID NO: 467538 - protein, 8 aa, Mycobacterium
ELSGGQRR

SEQ ID NO: 467539 - protein, 25 aa, Mycobacterium
ELSGGSASDGVNDADDDWAAEDDWR

SEQ ID NO: 467540 - protein, 10 aa, Mycobacterium
ELSGGTGNAI

SEQ ID NO: 467541 - protein, 13 aa, Mycobacterium
ELSGLDDDGRATL

SEQ ID NO: 467542 - protein, 9 aa, Mycobacterium
ELSGPPADG

SEQ ID NO: 467543 - protein, 10 aa, Mycobacterium
ELSGPPADGV

SEQ ID NO: 467544 - protein, 13 aa, Mycobacterium
ELSGPPATGTADA

SEQ ID NO: 467545 - protein, 8 aa, Mycobacterium
ELSGPPCD

SEQ ID NO: 467546 - protein, 8 aa, Mycobacterium
ELSGPPCS

SEQ ID NO: 467547 - protein, 23 aa, Mycobacterium
ELSGQAQVRPAAEAGDRGGPGLT

SEQ ID NO: 467548 - protein, 6 aa, Mycobacterium
ELSGQI

SEQ ID NO: 467549 - protein, 5 aa, Mycobacterium
ELSGS

SEQ ID NO: 467550 - protein, 13 aa, Mycobacterium
ELSGSTDWTATSA

SEQ ID NO: 467551 - protein, 6 aa, Mycobacterium
ELSGTD

SEQ ID NO: 467552 - protein, 29 aa, Mycobacterium
ELSGTGSDEPTELDTDGADGSWDDQDSWR

SEQ ID NO: 467553 - protein, 7 aa, Mycobacterium
ELSGTGV

SEQ ID NO: 467554 - protein, 6 aa, Mycobacterium
ELSGTN

SEQ ID NO: 467555 - protein, 4 aa, Mycobacterium
ELSK

SEQ ID NO: 467556 - protein, 12 aa, Mycobacterium
ELSKSASADEIN

SEQ ID NO: 467557 - protein, 11 aa, Mycobacterium
ELSNTDEQERP

SEQ ID NO: 467558 - protein, 5 aa, Mycobacterium
ELSPA

SEQ ID NO: 467559 - protein, 7 aa, Mycobacterium
ELSPDRD

SEQ ID NO: 467560 - protein, 9 aa, Mycobacterium
ELSPEAQQD

SEQ ID NO: 467561 - protein, 8 aa, Mycobacterium
ELSPEAQR

SEQ ID NO: 467562 - protein, 5 aa, Mycobacterium
ELSPF

SEQ ID NO: 467563 - protein, 10 aa, Mycobacterium
ELSPGEHQQV

SEQ ID NO: 467564 - protein, 7 aa, Mycobacterium
ELSPRRD

SEQ ID NO: 467565 - protein, 18 aa, Mycobacterium
ELSPTEDSLSEPDDAERR

SEQ ID NO: 467566 - protein, 7 aa, Mycobacterium
ELSPTRD

SEQ ID NO: 467567 - protein, 10 aa, Mycobacterium
ELSPVDAAKG

SEQ ID NO: 467568 - protein, 10 aa, Mycobacterium
ELSQTGPATL

SEQ ID NO: 467569 - protein, 4 aa, Mycobacterium
ELSR

SEQ ID NO: 467570 - protein, 9 aa, Mycobacterium
ELSREEPAE

SEQ ID NO: 467571 - protein, 8 aa, Mycobacterium
ELSRGDSA

SEQ ID NO: 467572 - protein, 8 aa, Mycobacterium
ELSRSGAV

SEQ ID NO: 467573 - protein, 17 aa, Mycobacterium
ELSRSGIPGREPLVPPA

SEQ ID NO: 467574 - protein, 21 aa, Mycobacterium
ELSRSGIPGREPLVPPAPQLP

SEQ ID NO: 467575 - protein, 9 aa, Mycobacterium
ELSSAAASY

SEQ ID NO: 467576 - protein, 13 aa, Mycobacterium
ELSSAASSFGSLT

SEQ ID NO: 467577 - protein, 13 aa, Mycobacterium
ELSSADVDEPGAT

SEQ ID NO: 467578 - protein, 10 aa, Mycobacterium
ELSSARDPQI

SEQ ID NO: 467579 - protein, 9 aa, Mycobacterium
ELSSASTDL

SEQ ID NO: 467580 - protein, 10 aa, Mycobacterium
ELSSDEPLWD

SEQ ID NO: 467581 - protein, 7 aa, Mycobacterium
ELSSEAL

SEQ ID NO: 467582 - protein, 12 aa, Mycobacterium
ELSSPRDDPNYD

SEQ ID NO: 467583 - protein, 5 aa, Mycobacterium
ELSSR

SEQ ID NO: 467584 - protein, 12 aa, Mycobacterium
ELSSRGPTSWPP

SEQ ID NO: 467585 - protein, 6 aa, Mycobacterium
ELSSSH

SEQ ID NO: 467586 - protein, 7 aa, Mycobacterium
ELSSSNV

SEQ ID NO: 467587 - protein, 5 aa, Mycobacterium
ELSSW

SEQ ID NO: 467588 - protein, 5 aa, Mycobacterium
ELSTA

SEQ ID NO: 467589 - protein, 10 aa, Mycobacterium
ELSTDDSPGF

SEQ ID NO: 467590 - protein, 10 aa, Mycobacterium
ELSTDDSPSF

SEQ ID NO: 467591 - protein, 9 aa, Mycobacterium
ELSTDERDD

SEQ ID NO: 467592 - protein, 9 aa, Mycobacterium
ELSTDESPA

SEQ ID NO: 467593 - protein, 11 aa, Mycobacterium
ELSTESPTTVA

SEQ ID NO: 467594 - protein, 16 aa, Mycobacterium
ELSTGEAQRDLEVHAQ

SEQ ID NO: 467595 - protein, 8 aa, Mycobacterium
ELSTPERK

SEQ ID NO: 467596 - protein, 7 aa, Mycobacterium
ELSTPRE

SEQ ID NO: 467597 - protein, 5 aa, Mycobacterium
ELSTS

SEQ ID NO: 467598 - protein, 16 aa, Mycobacterium
ELSTTASASQSAISNL

SEQ ID NO: 467599 - protein, 13 aa, Mycobacterium
ELTADPAARGRRA

SEQ ID NO: 467600 - protein, 26 aa, Mycobacterium
ELTAEKGWGAPSYAVTSTGPDHDKEF

SEQ ID NO: 467601 - protein, 9 aa, Mycobacterium
ELTAGDARS

SEQ ID NO: 467602 - protein, 6 aa, Mycobacterium
ELTAGH

SEQ ID NO: 467603 - protein, 5 aa, Mycobacterium
ELTAP

SEQ ID NO: 467604 - protein, 11 aa, Mycobacterium
ELTAQRGEVND

SEQ ID NO: 467605 - protein, 5 aa, Mycobacterium
ELTAS

SEQ ID NO: 467606 - protein, 7 aa, Mycobacterium
ELTDGRG

SEQ ID NO: 467607 - protein, 9 aa, Mycobacterium
ELTDSHSGI

SEQ ID NO: 467608 - protein, 10 aa, Mycobacterium
ELTEADGPTV

SEQ ID NO: 467609 - protein, 6 aa, Mycobacterium
ELTEGD

SEQ ID NO: 467610 - protein, 12 aa, Mycobacterium
ELTEKERRSRRR

SEQ ID NO: 467611 - protein, 8 aa, Mycobacterium
ELTENDRA

SEQ ID NO: 467612 - protein, 9 aa, Mycobacterium
ELTENDRAM

SEQ ID NO: 467613 - protein, 10 aa, Mycobacterium
ELTERARDAG

SEQ ID NO: 467614 - protein, 9 aa, Mycobacterium
ELTERDSGI

SEQ ID NO: 467615 - protein, 6 aa, Mycobacterium
ELTERH

SEQ ID NO: 467616 - protein, 13 aa, Mycobacterium
ELTESDSSGTSRL

SEQ ID NO: 467617 - protein, 12 aa, Mycobacterium
ELTESGASATSR

SEQ ID NO: 467618 - protein, 12 aa, Mycobacterium
ELTESGTGGTSR

SEQ ID NO: 467619 - protein, 12 aa, Mycobacterium
ELTESGTSATSR

SEQ ID NO: 467620 - protein, 14 aa, Mycobacterium
ELTESGTVATGSAQ

SEQ ID NO: 467621 - protein, 6 aa, Mycobacterium
ELTETE

SEQ ID NO: 467622 - protein, 5 aa, Mycobacterium
ELTGC

SEQ ID NO: 467623 - protein, 5 aa, Mycobacterium
ELTGD

SEQ ID NO: 467624 - protein, 6 aa, Mycobacterium
ELTGDS

SEQ ID NO: 467625 - protein, 13 aa, Mycobacterium
ELTGEDAAPRARA

SEQ ID NO: 467626 - protein, 17 aa, Mycobacterium
ELTGGDAEANAASAREV

SEQ ID NO: 467627 - protein, 7 aa, Mycobacterium
ELTGGRR

SEQ ID NO: 467628 - protein, 11 aa, Mycobacterium
ELTGKKTYHGF

SEQ ID NO: 467629 - protein, 12 aa, Mycobacterium
ELTGKSLDNPRD

SEQ ID NO: 467630 - protein, 7 aa, Mycobacterium
ELTGQQQ

SEQ ID NO: 467631 - protein, 5 aa, Mycobacterium
ELTGR

SEQ ID NO: 467632 - protein, 6 aa, Mycobacterium
ELTGTD

SEQ ID NO: 467633 - protein, 7 aa, Mycobacterium
ELTGTDT

SEQ ID NO: 467634 - protein, 18 aa, Mycobacterium
ELTGTEVDATDDIEPGED

SEQ ID NO: 467635 - protein, 13 aa, Mycobacterium
ELTGTTVANTRTV

SEQ ID NO: 467636 - protein, 19 aa, Mycobacterium
ELTGTYDPAPGKPYGGEGH

SEQ ID NO: 467637 - protein, 8 aa, Mycobacterium
ELTKEEVA

SEQ ID NO: 467638 - protein, 7 aa, Mycobacterium
ELTKGHP

SEQ ID NO: 467639 - protein, 9 aa, Mycobacterium
ELTKNNSTL

SEQ ID NO: 467640 - protein, 7 aa, Mycobacterium
ELTNGRG

SEQ ID NO: 467641 - protein, 16 aa, Mycobacterium
ELTNGSFGENLTTTGV

SEQ ID NO: 467642 - protein, 5 aa, Mycobacterium
ELTPD

SEQ ID NO: 467643 - protein, 8 aa, Mycobacterium
ELTPGTPL

SEQ ID NO: 467644 - protein, 7 aa, Mycobacterium
ELTPQQR

SEQ ID NO: 467645 - protein, 10 aa, Mycobacterium
ELTPRSAFRD

SEQ ID NO: 467646 - protein, 7 aa, Mycobacterium
ELTPSKG

SEQ ID NO: 467647 - protein, 9 aa, Mycobacterium
ELTPSRGSW

SEQ ID NO: 467648 - protein, 12 aa, Mycobacterium
ELTPYREAGPDD

SEQ ID NO: 467649 - protein, 11 aa, Mycobacterium
ELTQNAENARI

SEQ ID NO: 467650 - protein, 16 aa, Mycobacterium
ELTQNASNARDRSEAI

SEQ ID NO: 467651 - protein, 7 aa, Mycobacterium
ELTRSSS

SEQ ID NO: 467652 - protein, 7 aa, Mycobacterium
ELTSDTR

SEQ ID NO: 467653 - protein, 9 aa, Mycobacterium
ELTSGATHS

SEQ ID NO: 467654 - protein, 6 aa, Mycobacterium
ELTSGI

SEQ ID NO: 467655 - protein, 5 aa, Mycobacterium
ELTSR

SEQ ID NO: 467656 - protein, 10 aa, Mycobacterium
ELTSSTEERV

SEQ ID NO: 467657 - protein, 9 aa, Mycobacterium
ELTSTSNCT

SEQ ID NO: 467658 - protein, 11 aa, Mycobacterium
ELTTERTERLR

SEQ ID NO: 467659 - protein, 5 aa, Mycobacterium
ELTTP

SEQ ID NO: 467660 - protein, 12 aa, Mycobacterium
ELTTPDPPATLT

SEQ ID NO: 467661 - protein, 7 aa, Mycobacterium
ELTTQSQ

SEQ ID NO: 467662 - protein, 9 aa, Mycobacterium
ELTTSSGTD

SEQ ID NO: 467663 - protein, 4 aa, Mycobacterium
ELVG

SEQ ID NO: 467664 - protein, 12 aa, Mycobacterium
ELVGPDDSQPWL

SEQ ID NO: 467665 - protein, 12 aa, Mycobacterium
ELVGPDDTQPWL

SEQ ID NO: 467666 - protein, 14 aa, Mycobacterium
ELVPPGGPLRPGQI

SEQ ID NO: 467667 - protein, 14 aa, Mycobacterium
ELVPPGTPLQPGQI

SEQ ID NO: 467668 - protein, 7 aa, Mycobacterium
ELVPSGQ

SEQ ID NO: 467669 - protein, 13 aa, Mycobacterium
ELYDSGARMPSTY

SEQ ID NO: 467670 - protein, 11 aa, Mycobacterium
ELYKPDNERDF

SEQ ID NO: 467671 - protein, 25 aa, Mycobacterium
EMAAEQRRKYQATLKAKTRQVSRSA

SEQ ID NO: 467672 - protein, 4 aa, Mycobacterium
EMAE

SEQ ID NO: 467673 - protein, 10 aa, Mycobacterium
EMAEQARRAI

SEQ ID NO: 467674 - protein, 17 aa, Mycobacterium
EMAGGNELEALSHELGR

SEQ ID NO: 467675 - protein, 15 aa, Mycobacterium
EMAPSGEGLTPRAGE

SEQ ID NO: 467676 - protein, 4 aa, Mycobacterium
EMAY

SEQ ID NO: 467677 - protein, 8 aa, Mycobacterium
EMDEPESR

SEQ ID NO: 467678 - protein, 6 aa, Mycobacterium
EMDGPG

SEQ ID NO: 467679 - protein, 6 aa, Mycobacterium
EMDSPR

SEQ ID NO: 467680 - protein, 7 aa, Mycobacterium
EMDTPRT

SEQ ID NO: 467681 - protein, 7 aa, Mycobacterium
EMDTQRS

SEQ ID NO: 467682 - protein, 8 aa, Mycobacterium
EMEERARR

SEQ ID NO: 467683 - protein, 13 aa, Mycobacterium
EMEPGDRLPAERD

SEQ ID NO: 467684 - protein, 13 aa, Mycobacterium
EMERAATGQPSTV

SEQ ID NO: 467685 - protein, 4 aa, Mycobacterium
EMEV

SEQ ID NO: 467686 - protein, 14 aa, Mycobacterium
EMGAPASLASGPQV

SEQ ID NO: 467687 - protein, 9 aa, Mycobacterium
EMGDASSSV

SEQ ID NO: 467688 - protein, 9 aa, Mycobacterium
EMGDEYAPT

SEQ ID NO: 467689 - protein, 7 aa, Mycobacterium
EMGDTTA

SEQ ID NO: 467690 - protein, 14 aa, Mycobacterium
EMGEAGTNAHHGSG

SEQ ID NO: 467691 - protein, 5 aa, Mycobacterium
EMGEG

SEQ ID NO: 467692 - protein, 12 aa, Mycobacterium
EMGEGNRPPWSI

SEQ ID NO: 467693 - protein, 5 aa, Mycobacterium
EMGGF

SEQ ID NO: 467694 - protein, 11 aa, Mycobacterium
EMGGGSSHRPR

SEQ ID NO: 467695 - protein, 6 aa, Mycobacterium
EMGGKN

SEQ ID NO: 467696 - protein, 8 aa, Mycobacterium
EMGGPDAP

SEQ ID NO: 467697 - protein, 11 aa, Mycobacterium
EMGGTAVPTAA

SEQ ID NO: 467698 - protein, 8 aa, Mycobacterium
EMGKYQGT

SEQ ID NO: 467699 - protein, 20 aa, Mycobacterium
EMGPSPLSPDSVPGVQSARA

SEQ ID NO: 467700 - protein, 7 aa, Mycobacterium
EMGRPQD

SEQ ID NO: 467701 - protein, 11 aa, Mycobacterium
EMGRTQQGNNN

SEQ ID NO: 467702 - protein, 6 aa, Mycobacterium
EMGTDG

SEQ ID NO: 467703 - protein, 7 aa, Mycobacterium
EMGTTPL

SEQ ID NO: 467704 - protein, 6 aa, Mycobacterium
EMKAET

SEQ ID NO: 467705 - protein, 6 aa, Mycobacterium
EMKGDR

SEQ ID NO: 467706 - protein, 7 aa, Mycobacterium
EMKSTGE

SEQ ID NO: 467707 - protein, 6 aa, Mycobacterium
EMNPNG

SEQ ID NO: 467708 - protein, 5 aa, Mycobacterium
EMNQA

SEQ ID NO: 467709 - protein, 8 aa, Mycobacterium
EMNSRGVA

SEQ ID NO: 467710 - protein, 18 aa, Mycobacterium
EMPAEPPAGVPLAPPDRE

SEQ ID NO: 467711 - protein, 5 aa, Mycobacterium
EMPDE

SEQ ID NO: 467712 - protein, 5 aa, Mycobacterium
EMPDG

SEQ ID NO: 467713 - protein, 9 aa, Mycobacterium
EMPERESGE

SEQ ID NO: 467714 - protein, 7 aa, Mycobacterium
EMPREED

SEQ ID NO: 467715 - protein, 8 aa, Mycobacterium
EMPRPGPA

SEQ ID NO: 467716 - protein, 5 aa, Mycobacterium
EMPRT

SEQ ID NO: 467717 - protein, 8 aa, Mycobacterium
EMPSAGRG

SEQ ID NO: 467718 - protein, 15 aa, Mycobacterium
EMPSGGKVPGKLASA

SEQ ID NO: 467719 - protein, 7 aa, Mycobacterium
EMPSPAH

SEQ ID NO: 467720 - protein, 6 aa, Mycobacterium
EMPVPN

SEQ ID NO: 467721 - protein, 9 aa, Mycobacterium
EMPYTPGAE

SEQ ID NO: 467722 - protein, 20 aa, Mycobacterium
EMQAESKGDEPKPATPIASE

SEQ ID NO: 467723 - protein, 7 aa, Mycobacterium
EMQATDG

SEQ ID NO: 467724 - protein, 7 aa, Mycobacterium
EMQDGAT

SEQ ID NO: 467725 - protein, 8 aa, Mycobacterium
EMQGQDIP

SEQ ID NO: 467726 - protein, 55 aa, Mycobacterium
EMQSENKGENKAEQSALDTNSASNSAPSAANPTPVQSQRVDAPAASEQGHSEARP

SEQ ID NO: 467727 - protein, 8 aa, Mycobacterium
EMRDKPGQ

SEQ ID NO: 467728 - protein, 6 aa, Mycobacterium
EMREGA

SEQ ID NO: 467729 - protein, 6 aa, Mycobacterium
EMRERP

SEQ ID NO: 467730 - protein, 5 aa, Mycobacterium
EMRNG

SEQ ID NO: 467731 - protein, 13 aa, Mycobacterium
EMRPGESLPSERR

SEQ ID NO: 467732 - protein, 9 aa, Mycobacterium
EMRRGPGNV

SEQ ID NO: 467733 - protein, 14 aa, Mycobacterium
EMRSNSPTVGTPAE

SEQ ID NO: 467734 - protein, 4 aa, Mycobacterium
EMSD

SEQ ID NO: 467735 - protein, 9 aa, Mycobacterium
EMSEESRVR

SEQ ID NO: 467736 - protein, 9 aa, Mycobacterium
EMSEETRVR

SEQ ID NO: 467737 - protein, 13 aa, Mycobacterium
EMSEKDRAQPPLS

SEQ ID NO: 467738 - protein, 7 aa, Mycobacterium
EMSNTPE

SEQ ID NO: 467739 - protein, 5 aa, Mycobacterium
EMSPD

SEQ ID NO: 467740 - protein, 6 aa, Mycobacterium
EMSPKQ

SEQ ID NO: 467741 - protein, 8 aa, Mycobacterium
EMSRETRT

SEQ ID NO: 467742 - protein, 35 aa, Mycobacterium
EMSRGGESNNNLYGRTNNPYDLTRTPGGSSGGSAA

SEQ ID NO: 467743 - protein, 6 aa, Mycobacterium
EMSSGA

SEQ ID NO: 467744 - protein, 6 aa, Mycobacterium
EMSSGR

SEQ ID NO: 467745 - protein, 5 aa, Mycobacterium
EMSSY

SEQ ID NO: 467746 - protein, 4 aa, Mycobacterium
EMST

SEQ ID NO: 467747 - protein, 6 aa, Mycobacterium
EMTEVP

SEQ ID NO: 467748 - protein, 7 aa, Mycobacterium
EMTPHPR

SEQ ID NO: 467749 - protein, 5 aa, Mycobacterium
EMTPP

SEQ ID NO: 467750 - protein, 5 aa, Mycobacterium
EMTPQ

SEQ ID NO: 467751 - protein, 10 aa, Mycobacterium
EMTPRNADGE

SEQ ID NO: 467752 - protein, 7 aa, Mycobacterium
EMTQQGE

SEQ ID NO: 467753 - protein, 9 aa, Mycobacterium
EMTSDDDEL

SEQ ID NO: 467754 - protein, 6 aa, Mycobacterium
EMTSDE

SEQ ID NO: 467755 - protein, 9 aa, Mycobacterium
EMTSEDDEI

SEQ ID NO: 467756 - protein, 9 aa, Mycobacterium
EMTTEDEEI

SEQ ID NO: 467757 - protein, 9 aa, Mycobacterium
EMTTPADSV

SEQ ID NO: 467758 - protein, 9 aa, Mycobacterium
EMVRGGGGS

SEQ ID NO: 467759 - protein, 29 aa, Mycobacterium
EMYPGPDGVVRSTNRAGGLEGGMTNGQPL

SEQ ID NO: 467760 - protein, 7 aa, Mycobacterium
EMYPGTD

SEQ ID NO: 467761 - protein, 10 aa, Mycobacterium
ENAAAEPDSQ

SEQ ID NO: 467762 - protein, 11 aa, Mycobacterium
ENAAKGFSKGM

SEQ ID NO: 467763 - protein, 8 aa, Mycobacterium
ENAAPQQA

SEQ ID NO: 467764 - protein, 7 aa, Mycobacterium
ENADEAE

SEQ ID NO: 467765 - protein, 8 aa, Mycobacterium
ENADGYQQ

SEQ ID NO: 467766 - protein, 16 aa, Mycobacterium
ENADPATESARTQLTT

SEQ ID NO: 467767 - protein, 8 aa, Mycobacterium
ENADPRAT

SEQ ID NO: 467768 - protein, 10 aa, Mycobacterium
ENAEADPGDH

SEQ ID NO: 467769 - protein, 6 aa, Mycobacterium
ENAEAV

SEQ ID NO: 467770 - protein, 6 aa, Mycobacterium
ENAEDA

SEQ ID NO: 467771 - protein, 8 aa, Mycobacterium
ENAEDRAR

SEQ ID NO: 467772 - protein, 7 aa, Mycobacterium
ENAEGLT

SEQ ID NO: 467773 - protein, 8 aa, Mycobacterium
ENAEPAEP

SEQ ID NO: 467774 - protein, 11 aa, Mycobacterium
ENAETADPSGL

SEQ ID NO: 467775 - protein, 5 aa, Mycobacterium
ENAFT

SEQ ID NO: 467776 - protein, 7 aa, Mycobacterium
ENAGEHA

SEQ ID NO: 467777 - protein, 25 aa, Mycobacterium
ENAGGKLTHDGSTSERDAASTARQQ

SEQ ID NO: 467778 - protein, 25 aa, Mycobacterium
ENAGGKLTHEGSSTEKDAASSARSA

SEQ ID NO: 467779 - protein, 13 aa, Mycobacterium
ENAGGRSAEGSGI

SEQ ID NO: 467780 - protein, 5 aa, Mycobacterium
ENAGP

SEQ ID NO: 467781 - protein, 4 aa, Mycobacterium
ENAM

SEQ ID NO: 467782 - protein, 11 aa, Mycobacterium
ENAPGSGGERI

SEQ ID NO: 467783 - protein, 19 aa, Mycobacterium
ENAPPIYGRASDTSGHDGG

SEQ ID NO: 467784 - protein, 5 aa, Mycobacterium
ENAPT

SEQ ID NO: 467785 - protein, 5 aa, Mycobacterium
ENAQA

SEQ ID NO: 467786 - protein, 10 aa, Mycobacterium
ENAQPATTQS

SEQ ID NO: 467787 - protein, 7 aa, Mycobacterium
ENAQQGH

SEQ ID NO: 467788 - protein, 8 aa, Mycobacterium
ENAQTSCS

SEQ ID NO: 467789 - protein, 5 aa, Mycobacterium
ENARA

SEQ ID NO: 467790 - protein, 8 aa, Mycobacterium
ENARGRGV

SEQ ID NO: 467791 - protein, 11 aa, Mycobacterium
ENARPDTGEVD

SEQ ID NO: 467792 - protein, 12 aa, Mycobacterium
ENARPTPDVADP

SEQ ID NO: 467793 - protein, 14 aa, Mycobacterium
ENARPTPDVADPAL

SEQ ID NO: 467794 - protein, 7 aa, Mycobacterium
ENARSHD

SEQ ID NO: 467795 - protein, 8 aa, Mycobacterium
ENASLTGE

SEQ ID NO: 467796 - protein, 14 aa, Mycobacterium
ENASRTAAKTQRPE

SEQ ID NO: 467797 - protein, 8 aa, Mycobacterium
ENASRTQA

SEQ ID NO: 467798 - protein, 18 aa, Mycobacterium
ENATDGPVEEGAVGGGTG

SEQ ID NO: 467799 - protein, 6 aa, Mycobacterium
ENATGM

SEQ ID NO: 467800 - protein, 6 aa, Mycobacterium
ENATGV

SEQ ID NO: 467801 - protein, 6 aa, Mycobacterium
ENATPT

SEQ ID NO: 467802 - protein, 6 aa, Mycobacterium
ENATTI

SEQ ID NO: 467803 - protein, 22 aa, Mycobacterium
ENAVARNTEYGKAGRPRTRYQW

SEQ ID NO: 467804 - protein, 15 aa, Mycobacterium
ENAVDKDDDLEDDDE

SEQ ID NO: 467805 - protein, 13 aa, Mycobacterium
ENCGNASGFGPQV

SEQ ID NO: 467806 - protein, 10 aa, Mycobacterium
ENCQSPVGTG

SEQ ID NO: 467807 - protein, 4 aa, Mycobacterium
ENDA

SEQ ID NO: 467808 - protein, 8 aa, Mycobacterium
ENDAAQGK

SEQ ID NO: 467809 - protein, 7 aa, Mycobacterium
ENDARRA

SEQ ID NO: 467810 - protein, 6 aa, Mycobacterium
ENDDGW

SEQ ID NO: 467811 - protein, 7 aa, Mycobacterium
ENDDTAA

SEQ ID NO: 467812 - protein, 4 aa, Mycobacterium
ENDE

SEQ ID NO: 467813 - protein, 5 aa, Mycobacterium
ENDGA

SEQ ID NO: 467814 - protein, 6 aa, Mycobacterium
ENDGAA

SEQ ID NO: 467815 - protein, 7 aa, Mycobacterium
ENDGATA

SEQ ID NO: 467816 - protein, 12 aa, Mycobacterium
ENDGNKADAAAA

SEQ ID NO: 467817 - protein, 7 aa, Mycobacterium
ENDGPID

SEQ ID NO: 467818 - protein, 9 aa, Mycobacterium
ENDGRTSEM

SEQ ID NO: 467819 - protein, 18 aa, Mycobacterium
ENDKSPSRKAGELDNRGS

SEQ ID NO: 467820 - protein, 4 aa, Mycobacterium
ENDL

SEQ ID NO: 467821 - protein, 21 aa, Mycobacterium
ENDPAPTQLGAPTTTPGPLNP

SEQ ID NO: 467822 - protein, 7 aa, Mycobacterium
ENDPDSY

SEQ ID NO: 467823 - protein, 17 aa, Mycobacterium
ENDPEAGWYDTETGELV

SEQ ID NO: 467824 - protein, 9 aa, Mycobacterium
ENDPETERR

SEQ ID NO: 467825 - protein, 17 aa, Mycobacterium
ENDPLKTPYPYVGAGQM

SEQ ID NO: 467826 - protein, 8 aa, Mycobacterium
ENDPRRRL

SEQ ID NO: 467827 - protein, 5 aa, Mycobacterium
ENDPS

SEQ ID NO: 467828 - protein, 10 aa, Mycobacterium
ENDPVATDPD

SEQ ID NO: 467829 - protein, 7 aa, Mycobacterium
ENDQRPV

SEQ ID NO: 467830 - protein, 13 aa, Mycobacterium
ENDRPVKQGEPGE

SEQ ID NO: 467831 - protein, 5 aa, Mycobacterium
ENDRT

SEQ ID NO: 467832 - protein, 4 aa, Mycobacterium
ENDS

SEQ ID NO: 467833 - protein, 9 aa, Mycobacterium
ENDSGEPQL

SEQ ID NO: 467834 - protein, 7 aa, Mycobacterium
ENDTRPV

SEQ ID NO: 467835 - protein, 7 aa, Mycobacterium
ENDYADR

SEQ ID NO: 467836 - protein, 9 aa, Mycobacterium
ENEARAAGY

SEQ ID NO: 467837 - protein, 7 aa, Mycobacterium
ENEDAIT

SEQ ID NO: 467838 - protein, 6 aa, Mycobacterium
ENEDVI

SEQ ID NO: 467839 - protein, 7 aa, Mycobacterium
ENEEAEG

SEQ ID NO: 467840 - protein, 6 aa, Mycobacterium
ENEGES

SEQ ID NO: 467841 - protein, 6 aa, Mycobacterium
ENEIEP

SEQ ID NO: 467842 - protein, 7 aa, Mycobacterium
ENELSEA

SEQ ID NO: 467843 - protein, 6 aa, Mycobacterium
ENENAG

SEQ ID NO: 467844 - protein, 8 aa, Mycobacterium
ENENGDHD

SEQ ID NO: 467845 - protein, 5 aa, Mycobacterium
ENERA

SEQ ID NO: 467846 - protein, 12 aa, Mycobacterium
ENERDGEAWLLA

SEQ ID NO: 467847 - protein, 9 aa, Mycobacterium
ENERRAGAL

SEQ ID NO: 467848 - protein, 16 aa, Mycobacterium
ENERRAGALETSKGHL

SEQ ID NO: 467849 - protein, 9 aa, Mycobacterium
ENESGRPVR

SEQ ID NO: 467850 - protein, 8 aa, Mycobacterium
ENETDGYH

SEQ ID NO: 467851 - protein, 5 aa, Mycobacterium
ENETG

SEQ ID NO: 467852 - protein, 7 aa, Mycobacterium
ENETKPE

SEQ ID NO: 467853 - protein, 14 aa, Mycobacterium
ENETKRRTAEQLGR

SEQ ID NO: 467854 - protein, 7 aa, Mycobacterium
ENEVGKE

SEQ ID NO: 467855 - protein, 7 aa, Mycobacterium
ENEVGRD

SEQ ID NO: 467856 - protein, 7 aa, Mycobacterium
ENEYEDV

SEQ ID NO: 467857 - protein, 4 aa, Mycobacterium
ENGA

SEQ ID NO: 467858 - protein, 13 aa, Mycobacterium
ENGAASPSDQPNW

SEQ ID NO: 467859 - protein, 10 aa, Mycobacterium
ENGAGTEADI

SEQ ID NO: 467860 - protein, 6 aa, Mycobacterium
ENGALS

SEQ ID NO: 467861 - protein, 15 aa, Mycobacterium
ENGAPVRRSAGAEAA

SEQ ID NO: 467862 - protein, 16 aa, Mycobacterium
ENGAQQDRFAGGTQQI

SEQ ID NO: 467863 - protein, 5 aa, Mycobacterium
ENGAR

SEQ ID NO: 467864 - protein, 7 aa, Mycobacterium
ENGATEV

SEQ ID NO: 467865 - protein, 12 aa, Mycobacterium
ENGCEGHSDGDV

SEQ ID NO: 467866 - protein, 4 aa, Mycobacterium
ENGD

SEQ ID NO: 467867 - protein, 12 aa, Mycobacterium
ENGDGLALQGTR

SEQ ID NO: 467868 - protein, 54 aa, Mycobacterium
ENGDPKAAGDRDAPAAKAKDVATAGKADGTGEWSAEENYAKDKAYNERVLKDAA

SEQ ID NO: 467869 - protein, 8 aa, Mycobacterium
ENGEAGEL

SEQ ID NO: 467870 - protein, 8 aa, Mycobacterium
ENGEGIAG

SEQ ID NO: 467871 - protein, 22 aa, Mycobacterium
ENGEPTDARPGALIRGRRPAPV

SEQ ID NO: 467872 - protein, 7 aa, Mycobacterium
ENGERVR

SEQ ID NO: 467873 - protein, 6 aa, Mycobacterium
ENGETI

SEQ ID NO: 467874 - protein, 7 aa, Mycobacterium
ENGEVMP

SEQ ID NO: 467875 - protein, 12 aa, Mycobacterium
ENGFDPAKPSAW

SEQ ID NO: 467876 - protein, 4 aa, Mycobacterium
ENGG

SEQ ID NO: 467877 - protein, 9 aa, Mycobacterium
ENGHARRAR

SEQ ID NO: 467878 - protein, 9 aa, Mycobacterium
ENGIAASAS

SEQ ID NO: 467879 - protein, 6 aa, Mycobacterium
ENGIDA

SEQ ID NO: 467880 - protein, 50 aa, Mycobacterium
ENGIGGNGGGAQLVGNGGNGGAGAGASQGGTGGTGGRGGDLFGQPGADGP

SEQ ID NO: 467881 - protein, 4 aa, Mycobacterium
ENGK

SEQ ID NO: 467882 - protein, 9 aa, Mycobacterium
ENGKATPQI

SEQ ID NO: 467883 - protein, 5 aa, Mycobacterium
ENGKL

SEQ ID NO: 467884 - protein, 9 aa, Mycobacterium
ENGKPVRLT

SEQ ID NO: 467885 - protein, 13 aa, Mycobacterium
ENGKSQADARAEV

SEQ ID NO: 467886 - protein, 14 aa, Mycobacterium
ENGKVTAERETDEG

SEQ ID NO: 467887 - protein, 6 aa, Mycobacterium
ENGLAS

SEQ ID NO: 467888 - protein, 6 aa, Mycobacterium
ENGLEE

SEQ ID NO: 467889 - protein, 6 aa, Mycobacterium
ENGLKR

SEQ ID NO: 467890 - protein, 5 aa, Mycobacterium
ENGLP

SEQ ID NO: 467891 - protein, 7 aa, Mycobacterium
ENGNPLP

SEQ ID NO: 467892 - protein, 10 aa, Mycobacterium
ENGNPLPAGE

SEQ ID NO: 467893 - protein, 6 aa, Mycobacterium
ENGPAA

SEQ ID NO: 467894 - protein, 6 aa, Mycobacterium
ENGPDA

SEQ ID NO: 467895 - protein, 5 aa, Mycobacterium
ENGPL

SEQ ID NO: 467896 - protein, 6 aa, Mycobacterium
ENGPQD

SEQ ID NO: 467897 - protein, 5 aa, Mycobacterium
ENGPR

SEQ ID NO: 467898 - protein, 10 aa, Mycobacterium
ENGPSRVAPT

SEQ ID NO: 467899 - protein, 6 aa, Mycobacterium
ENGPVA

SEQ ID NO: 467900 - protein, 5 aa, Mycobacterium
ENGPW

SEQ ID NO: 467901 - protein, 15 aa, Mycobacterium
ENGRAEVEAATSRLA

SEQ ID NO: 467902 - protein, 8 aa, Mycobacterium
ENGRGDSE

SEQ ID NO: 467903 - protein, 7 aa, Mycobacterium
ENGRHSG

SEQ ID NO: 467904 - protein, 5 aa, Mycobacterium
ENGRK

SEQ ID NO: 467905 - protein, 8 aa, Mycobacterium
ENGRPATV

SEQ ID NO: 467906 - protein, 9 aa, Mycobacterium
ENGRPEPFG

SEQ ID NO: 467907 - protein, 4 aa, Mycobacterium
ENGS

SEQ ID NO: 467908 - protein, 8 aa, Mycobacterium
ENGSGKST

SEQ ID NO: 467909 - protein, 13 aa, Mycobacterium
ENGSPAAHDGETV

SEQ ID NO: 467910 - protein, 8 aa, Mycobacterium
ENGTEEQF

SEQ ID NO: 467911 - protein, 10 aa, Mycobacterium
ENGTEKPPYE

SEQ ID NO: 467912 - protein, 4 aa, Mycobacterium
ENGV

SEQ ID NO: 467913 - protein, 6 aa, Mycobacterium
ENGVGT

SEQ ID NO: 467914 - protein, 14 aa, Mycobacterium
ENGVGTVATGVSKA

SEQ ID NO: 467915 - protein, 5 aa, Mycobacterium
ENGVP

SEQ ID NO: 467916 - protein, 9 aa, Mycobacterium
ENGVPVTPR

SEQ ID NO: 467917 - protein, 10 aa, Mycobacterium
ENGVPVTPRV

SEQ ID NO: 467918 - protein, 15 aa, Mycobacterium
ENGVTPSPQVETDSV

SEQ ID NO: 467919 - protein, 5 aa, Mycobacterium
ENGWE

SEQ ID NO: 467920 - protein, 11 aa, Mycobacterium
ENGWSGSPEQF

SEQ ID NO: 467921 - protein, 9 aa, Mycobacterium
ENGYEQTSM

SEQ ID NO: 467922 - protein, 13 aa, Mycobacterium
ENGYNAGVDETTW

SEQ ID NO: 467923 - protein, 7 aa, Mycobacterium
ENHAGTR

SEQ ID NO: 467924 - protein, 6 aa, Mycobacterium
ENHAQT

SEQ ID NO: 467925 - protein, 17 aa, Mycobacterium
ENHPSARAARAPSFGSQ

SEQ ID NO: 467926 - protein, 8 aa, Mycobacterium
ENHRGRRP

SEQ ID NO: 467927 - protein, 11 aa, Mycobacterium
ENHRTARGQEI

SEQ ID NO: 467928 - protein, 7 aa, Mycobacterium
ENHTTYA

SEQ ID NO: 467929 - protein, 7 aa, Mycobacterium
ENIAPAE

SEQ ID NO: 467930 - protein, 8 aa, Mycobacterium
ENIAPSEV

SEQ ID NO: 467931 - protein, 5 aa, Mycobacterium
ENIED

SEQ ID NO: 467932 - protein, 7 aa, Mycobacterium
ENIGTAP

SEQ ID NO: 467933 - protein, 7 aa, Mycobacterium
ENIPSEG

SEQ ID NO: 467934 - protein, 10 aa, Mycobacterium
ENIPSSGPAI

SEQ ID NO: 467935 - protein, 7 aa, Mycobacterium
ENISAKE

SEQ ID NO: 467936 - protein, 17 aa, Mycobacterium
ENISDEDAAAAGKITKN

SEQ ID NO: 467937 - protein, 8 aa, Mycobacterium
ENISPKEV

SEQ ID NO: 467938 - protein, 9 aa, Mycobacterium
ENITDPSRI

SEQ ID NO: 467939 - protein, 10 aa, Mycobacterium
ENITDPSRIA

SEQ ID NO: 467940 - protein, 16 aa, Mycobacterium
ENITRRDGADKTADAL

SEQ ID NO: 467941 - protein, 4 aa, Mycobacterium
ENKA

SEQ ID NO: 467942 - protein, 5 aa, Mycobacterium
ENKEF

SEQ ID NO: 467943 - protein, 9 aa, Mycobacterium
ENKQAHPNI

SEQ ID NO: 467944 - protein, 10 aa, Mycobacterium
ENKQPTSEWA

SEQ ID NO: 467945 - protein, 9 aa, Mycobacterium
ENKRPTDEW

SEQ ID NO: 467946 - protein, 9 aa, Mycobacterium
ENKSDPDQR

SEQ ID NO: 467947 - protein, 7 aa, Mycobacterium
ENLAPGL

SEQ ID NO: 467948 - protein, 13 aa, Mycobacterium
ENLASLSSKGLGD

SEQ ID NO: 467949 - protein, 7 aa, Mycobacterium
ENLDDDS

SEQ ID NO: 467950 - protein, 8 aa, Mycobacterium
ENLDPTIA

SEQ ID NO: 467951 - protein, 11 aa, Mycobacterium
ENLDPTRRSGR

SEQ ID NO: 467952 - protein, 9 aa, Mycobacterium
ENLGLGNSG

SEQ ID NO: 467953 - protein, 11 aa, Mycobacterium
ENLGRQDLPDL

SEQ ID NO: 467954 - protein, 8 aa, Mycobacterium
ENLGSPRD

SEQ ID NO: 467955 - protein, 7 aa, Mycobacterium
ENLGSRP

SEQ ID NO: 467956 - protein, 16 aa, Mycobacterium
ENLKAAKDSEEVPAEQ

SEQ ID NO: 467957 - protein, 4 aa, Mycobacterium
ENLP

SEQ ID NO: 467958 - protein, 16 aa, Mycobacterium
ENLPAHGEAVRRRFER

SEQ ID NO: 467959 - protein, 7 aa, Mycobacterium
ENLPDKG

SEQ ID NO: 467960 - protein, 8 aa, Mycobacterium
ENLPDSGA

SEQ ID NO: 467961 - protein, 5 aa, Mycobacterium
ENLPF

SEQ ID NO: 467962 - protein, 7 aa, Mycobacterium
ENLPFDD

SEQ ID NO: 467963 - protein, 7 aa, Mycobacterium
ENLPFPD

SEQ ID NO: 467964 - protein, 8 aa, Mycobacterium
ENLPFPDN

SEQ ID NO: 467965 - protein, 12 aa, Mycobacterium
ENLPGKPAPDTY

SEQ ID NO: 467966 - protein, 8 aa, Mycobacterium
ENLPPGAW

SEQ ID NO: 467967 - protein, 15 aa, Mycobacterium
ENLPSHGEAVRRRFE

SEQ ID NO: 467968 - protein, 11 aa, Mycobacterium
ENLPTQTPAPV

SEQ ID NO: 467969 - protein, 5 aa, Mycobacterium
ENLQR

SEQ ID NO: 467970 - protein, 7 aa, Mycobacterium
ENLSAER

SEQ ID NO: 467971 - protein, 12 aa, Mycobacterium
ENLSGKPAPDSF

SEQ ID NO: 467972 - protein, 7 aa, Mycobacterium
ENLSGRE

SEQ ID NO: 467973 - protein, 9 aa, Mycobacterium
ENLSPAEVE

SEQ ID NO: 467974 - protein, 6 aa, Mycobacterium
ENLTAA

SEQ ID NO: 467975 - protein, 7 aa, Mycobacterium
ENLTAKR

SEQ ID NO: 467976 - protein, 7 aa, Mycobacterium
ENLTAQR

SEQ ID NO: 467977 - protein, 9 aa, Mycobacterium
ENLTPRDKR

SEQ ID NO: 467978 - protein, 6 aa, Mycobacterium
ENLTSR

SEQ ID NO: 467979 - protein, 4 aa, Mycobacterium
ENMP

SEQ ID NO: 467980 - protein, 6 aa, Mycobacterium
ENMPGA

SEQ ID NO: 467981 - protein, 6 aa, Mycobacterium
ENMTAA

SEQ ID NO: 467982 - protein, 7 aa, Mycobacterium
ENNDGGW

SEQ ID NO: 467983 - protein, 8 aa, Mycobacterium
ENNGFGGD

SEQ ID NO: 467984 - protein, 5 aa, Mycobacterium
ENNGV

SEQ ID NO: 467985 - protein, 9 aa, Mycobacterium
ENNPPDPAV

SEQ ID NO: 467986 - protein, 7 aa, Mycobacterium
ENNPSDD

SEQ ID NO: 467987 - protein, 11 aa, Mycobacterium
ENNPSDTDTTC

SEQ ID NO: 467988 - protein, 9 aa, Mycobacterium
ENNRARAYE

SEQ ID NO: 467989 - protein, 8 aa, Mycobacterium
ENNRGSLP

SEQ ID NO: 467990 - protein, 8 aa, Mycobacterium
ENNRPPFD

SEQ ID NO: 467991 - protein, 17 aa, Mycobacterium
ENNRRSHPLQGGQTLAE

SEQ ID NO: 467992 - protein, 6 aa, Mycobacterium
ENNRTD

SEQ ID NO: 467993 - protein, 17 aa, Mycobacterium
ENNSAFGADGYSRATGD

SEQ ID NO: 467994 - protein, 10 aa, Mycobacterium
ENNSAGSGHP

SEQ ID NO: 467995 - protein, 4 aa, Mycobacterium
ENNT

SEQ ID NO: 467996 - protein, 4 aa, Mycobacterium
ENNV

SEQ ID NO: 467997 - protein, 14 aa, Mycobacterium
ENPAAGWQPQSGTV

SEQ ID NO: 467998 - protein, 18 aa, Mycobacterium
ENPADGPDVEEVPDELTP

SEQ ID NO: 467999 - protein, 7 aa, Mycobacterium
ENPAGPR

SEQ ID NO: 468000 - protein, 8 aa, Mycobacterium
ENPALGDE

SEQ ID NO: 468001 - protein, 9 aa, Mycobacterium
ENPALSKVD

SEQ ID NO: 468002 - protein, 6 aa, Mycobacterium
ENPANP

SEQ ID NO: 468003 - protein, 7 aa, Mycobacterium
ENPANPA

SEQ ID NO: 468004 - protein, 5 aa, Mycobacterium
ENPAP

SEQ ID NO: 468005 - protein, 8 aa, Mycobacterium
ENPAPSHS

SEQ ID NO: 468006 - protein, 5 aa, Mycobacterium
ENPAT

SEQ ID NO: 468007 - protein, 11 aa, Mycobacterium
ENPATEQVSGK

SEQ ID NO: 468008 - protein, 18 aa, Mycobacterium
ENPATERASGKISLGSAA

SEQ ID NO: 468009 - protein, 7 aa, Mycobacterium
ENPATGV

SEQ ID NO: 468010 - protein, 6 aa, Mycobacterium
ENPATL

SEQ ID NO: 468011 - protein, 5 aa, Mycobacterium
ENPAV

SEQ ID NO: 468012 - protein, 4 aa, Mycobacterium
ENPD

SEQ ID NO: 468013 - protein, 12 aa, Mycobacterium
ENPDAEPDRRRR

SEQ ID NO: 468014 - protein, 9 aa, Mycobacterium
ENPDAGTVS

SEQ ID NO: 468015 - protein, 8 aa, Mycobacterium
ENPDAGWD

SEQ ID NO: 468016 - protein, 8 aa, Mycobacterium
ENPDAGWE

SEQ ID NO: 468017 - protein, 5 aa, Mycobacterium
ENPDD

SEQ ID NO: 468018 - protein, 7 aa, Mycobacterium
ENPDDLE

SEQ ID NO: 468019 - protein, 6 aa, Mycobacterium
ENPDDV

SEQ ID NO: 468020 - protein, 7 aa, Mycobacterium
ENPDERD

SEQ ID NO: 468021 - protein, 5 aa, Mycobacterium
ENPDF

SEQ ID NO: 468022 - protein, 8 aa, Mycobacterium
ENPDGADE

SEQ ID NO: 468023 - protein, 11 aa, Mycobacterium
ENPDGGEVKVG

SEQ ID NO: 468024 - protein, 8 aa, Mycobacterium
ENPDGWPN

SEQ ID NO: 468025 - protein, 5 aa, Mycobacterium
ENPDI

SEQ ID NO: 468026 - protein, 6 aa, Mycobacterium
ENPDLA

SEQ ID NO: 468027 - protein, 13 aa, Mycobacterium
ENPDNPETAEETV

SEQ ID NO: 468028 - protein, 6 aa, Mycobacterium
ENPDPA

SEQ ID NO: 468029 - protein, 9 aa, Mycobacterium
ENPDPQNLT

SEQ ID NO: 468030 - protein, 10 aa, Mycobacterium
ENPDPQNLTK

SEQ ID NO: 468031 - protein, 10 aa, Mycobacterium
ENPDQRARLT

SEQ ID NO: 468032 - protein, 9 aa, Mycobacterium
ENPDQRERL

SEQ ID NO: 468033 - protein, 8 aa, Mycobacterium
ENPDTGWD

SEQ ID NO: 468034 - protein, 49 aa, Mycobacterium
ENPEGSAGSASSRRRRPRRRPRSRRRSAGAAAVTQTNTSGTETRERADN

SEQ ID NO: 468035 - protein, 7 aa, Mycobacterium
ENPELSR

SEQ ID NO: 468036 - protein, 6 aa, Mycobacterium
ENPEQR

SEQ ID NO: 468037 - protein, 7 aa, Mycobacterium
ENPEQRE

SEQ ID NO: 468038 - protein, 8 aa, Mycobacterium
ENPETDWD

SEQ ID NO: 468039 - protein, 5 aa, Mycobacterium
ENPEV

SEQ ID NO: 468040 - protein, 4 aa, Mycobacterium
ENPG

SEQ ID NO: 468041 - protein, 5 aa, Mycobacterium
ENPGA

SEQ ID NO: 468042 - protein, 7 aa, Mycobacterium
ENPGADI

SEQ ID NO: 468043 - protein, 5 aa, Mycobacterium
ENPGG

SEQ ID NO: 468044 - protein, 15 aa, Mycobacterium
ENPGKGNHGGLRGVL

SEQ ID NO: 468045 - protein, 8 aa, Mycobacterium
ENPGPAGM

SEQ ID NO: 468046 - protein, 7 aa, Mycobacterium
ENPGPWK

SEQ ID NO: 468047 - protein, 8 aa, Mycobacterium
ENPGQSGN

SEQ ID NO: 468048 - protein, 8 aa, Mycobacterium
ENPGRQPA

SEQ ID NO: 468049 - protein, 19 aa, Mycobacterium
ENPGRTSAELARENNVSAQ

SEQ ID NO: 468050 - protein, 32 aa, Mycobacterium
ENPGSSGGSKAASDGETTVDLGSPAAQAIWVV

SEQ ID NO: 468051 - protein, 18 aa, Mycobacterium
ENPGTANTGIGNAGQYNT

SEQ ID NO: 468052 - protein, 9 aa, Mycobacterium
ENPGTPKGL

SEQ ID NO: 468053 - protein, 7 aa, Mycobacterium
ENPHTTR

SEQ ID NO: 468054 - protein, 7 aa, Mycobacterium
ENPIGPR

SEQ ID NO: 468055 - protein, 5 aa, Mycobacterium
ENPKF

SEQ ID NO: 468056 - protein, 11 aa, Mycobacterium
ENPKGGDFARD

SEQ ID NO: 468057 - protein, 6 aa, Mycobacterium
ENPLRD

SEQ ID NO: 468058 - protein, 11 aa, Mycobacterium
ENPNAADGERE

SEQ ID NO: 468059 - protein, 11 aa, Mycobacterium
ENPNAAEGERE

SEQ ID NO: 468060 - protein, 11 aa, Mycobacterium
ENPNGKLTPLR

SEQ ID NO: 468061 - protein, 7 aa, Mycobacterium
ENPNGSM

SEQ ID NO: 468062 - protein, 7 aa, Mycobacterium
ENPPAGL

SEQ ID NO: 468063 - protein, 12 aa, Mycobacterium
ENPPAGSADAAI

SEQ ID NO: 468064 - protein, 12 aa, Mycobacterium
ENPPAGSADAAV

SEQ ID NO: 468065 - protein, 9 aa, Mycobacterium
ENPPAGSVD

SEQ ID NO: 468066 - protein, 8 aa, Mycobacterium
ENPPEEDG

SEQ ID NO: 468067 - protein, 10 aa, Mycobacterium
ENPPGPVERP

SEQ ID NO: 468068 - protein, 10 aa, Mycobacterium
ENPPGRCRQT

SEQ ID NO: 468069 - protein, 7 aa, Mycobacterium
ENPPGTV

SEQ ID NO: 468070 - protein, 5 aa, Mycobacterium
ENPPL

SEQ ID NO: 468071 - protein, 6 aa, Mycobacterium
ENPPLA

SEQ ID NO: 468072 - protein, 9 aa, Mycobacterium
ENPQAFSAA

SEQ ID NO: 468073 - protein, 7 aa, Mycobacterium
ENPQPVA

SEQ ID NO: 468074 - protein, 77 aa, Mycobacterium
ENPQQAKPVAAARTPKPGKPRRRRRPPWRRTGKNGKNGSAEPKAETAGDSGIASAATTTKVTPTPAALAARNVERHN

SEQ ID NO: 468075 - protein, 6 aa, Mycobacterium
ENPQTS

SEQ ID NO: 468076 - protein, 10 aa, Mycobacterium
ENPRAARAAA

SEQ ID NO: 468077 - protein, 6 aa, Mycobacterium
ENPRPG

SEQ ID NO: 468078 - protein, 7 aa, Mycobacterium
ENPRPGL

SEQ ID NO: 468079 - protein, 5 aa, Mycobacterium
ENPRR

SEQ ID NO: 468080 - protein, 5 aa, Mycobacterium
ENPRS

SEQ ID NO: 468081 - protein, 7 aa, Mycobacterium
ENPSGTI

SEQ ID NO: 468082 - protein, 5 aa, Mycobacterium
ENPSL

SEQ ID NO: 468083 - protein, 7 aa, Mycobacterium
ENPSNGI

SEQ ID NO: 468084 - protein, 8 aa, Mycobacterium
ENPSPIDY

SEQ ID NO: 468085 - protein, 11 aa, Mycobacterium
ENPSPVTGQPF

SEQ ID NO: 468086 - protein, 8 aa, Mycobacterium
ENPSTLGY

SEQ ID NO: 468087 - protein, 6 aa, Mycobacterium
ENPSVQ

SEQ ID NO: 468088 - protein, 9 aa, Mycobacterium
ENPTPVTGQ

SEQ ID NO: 468089 - protein, 6 aa, Mycobacterium
ENPTQT

SEQ ID NO: 468090 - protein, 6 aa, Mycobacterium
ENPWED

SEQ ID NO: 468091 - protein, 5 aa, Mycobacterium
ENQAA

SEQ ID NO: 468092 - protein, 6 aa, Mycobacterium
ENQATH

SEQ ID NO: 468093 - protein, 6 aa, Mycobacterium
ENQDQL

SEQ ID NO: 468094 - protein, 7 aa, Mycobacterium
ENQEADG

SEQ ID NO: 468095 - protein, 5 aa, Mycobacterium
ENQEF

SEQ ID NO: 468096 - protein, 25 aa, Mycobacterium
ENQGDIDKQSITGATATATHGTGAR

SEQ ID NO: 468097 - protein, 22 aa, Mycobacterium
ENQGEADGKAKVAVGGRCDTSS

SEQ ID NO: 468098 - protein, 4 aa, Mycobacterium
ENQK

SEQ ID NO: 468099 - protein, 8 aa, Mycobacterium
ENQKQHIE

SEQ ID NO: 468100 - protein, 6 aa, Mycobacterium
ENQLPL

SEQ ID NO: 468101 - protein, 4 aa, Mycobacterium
ENQP

SEQ ID NO: 468102 - protein, 5 aa, Mycobacterium
ENQTL

SEQ ID NO: 468103 - protein, 13 aa, Mycobacterium
ENQTSRTFGRGPR

SEQ ID NO: 468104 - protein, 4 aa, Mycobacterium
ENRA

SEQ ID NO: 468105 - protein, 7 aa, Mycobacterium
ENRAEQL

SEQ ID NO: 468106 - protein, 5 aa, Mycobacterium
ENRDS

SEQ ID NO: 468107 - protein, 9 aa, Mycobacterium
ENREGLDDR

SEQ ID NO: 468108 - protein, 11 aa, Mycobacterium
ENREGLPDEYR

SEQ ID NO: 468109 - protein, 11 aa, Mycobacterium
ENREGLPEQYR

SEQ ID NO: 468110 - protein, 4 aa, Mycobacterium
ENRG

SEQ ID NO: 468111 - protein, 8 aa, Mycobacterium
ENRGAPRP

SEQ ID NO: 468112 - protein, 7 aa, Mycobacterium
ENRGDEI

SEQ ID NO: 468113 - protein, 5 aa, Mycobacterium
ENRGR

SEQ ID NO: 468114 - protein, 6 aa, Mycobacterium
ENRGSP

SEQ ID NO: 468115 - protein, 7 aa, Mycobacterium
ENRGSPR

SEQ ID NO: 468116 - protein, 4 aa, Mycobacterium
ENRH

SEQ ID NO: 468117 - protein, 19 aa, Mycobacterium
ENRHRGGSGWKAVGLPWKQ

SEQ ID NO: 468118 - protein, 9 aa, Mycobacterium
ENRPAEPRV

SEQ ID NO: 468119 - protein, 13 aa, Mycobacterium
ENRPARPGTIDRP

SEQ ID NO: 468120 - protein, 10 aa, Mycobacterium
ENRPESDTEK

SEQ ID NO: 468121 - protein, 7 aa, Mycobacterium
ENRPREY

SEQ ID NO: 468122 - protein, 9 aa, Mycobacterium
ENRPRFERE

SEQ ID NO: 468123 - protein, 13 aa, Mycobacterium
ENRPSRPGSIDRP

SEQ ID NO: 468124 - protein, 9 aa, Mycobacterium
ENRPSSSVD

SEQ ID NO: 468125 - protein, 4 aa, Mycobacterium
ENRQ

SEQ ID NO: 468126 - protein, 11 aa, Mycobacterium
ENRQKAREERN

SEQ ID NO: 468127 - protein, 5 aa, Mycobacterium
ENRRA

SEQ ID NO: 468128 - protein, 6 aa, Mycobacterium
ENRRGW

SEQ ID NO: 468129 - protein, 8 aa, Mycobacterium
ENRSGAGI

SEQ ID NO: 468130 - protein, 10 aa, Mycobacterium
ENRSKPGGRT

SEQ ID NO: 468131 - protein, 7 aa, Mycobacterium
ENRSQAN

SEQ ID NO: 468132 - protein, 6 aa, Mycobacterium
ENRTDV

SEQ ID NO: 468133 - protein, 22 aa, Mycobacterium
ENRTRDTASVRTAQGSAGSGGG

SEQ ID NO: 468134 - protein, 4 aa, Mycobacterium
ENRY

SEQ ID NO: 468135 - protein, 5 aa, Mycobacterium
ENRYP

SEQ ID NO: 468136 - protein, 24 aa, Mycobacterium
ENRYTTSIGSAELASETTEGRTIE

SEQ ID NO: 468137 - protein, 4 aa, Mycobacterium
ENSA

SEQ ID NO: 468138 - protein, 12 aa, Mycobacterium
ENSAAPSTGRAA

SEQ ID NO: 468139 - protein, 8 aa, Mycobacterium
ENSALGDD

SEQ ID NO: 468140 - protein, 8 aa, Mycobacterium
ENSDALSR

SEQ ID NO: 468141 - protein, 6 aa, Mycobacterium
ENSDAV

SEQ ID NO: 468142 - protein, 17 aa, Mycobacterium
ENSDGAEVARGKDIETL

SEQ ID NO: 468143 - protein, 9 aa, Mycobacterium
ENSDPAEKA

SEQ ID NO: 468144 - protein, 4 aa, Mycobacterium
ENSE

SEQ ID NO: 468145 - protein, 7 aa, Mycobacterium
ENSEAGP

SEQ ID NO: 468146 - protein, 24 aa, Mycobacterium
ENSEGEYAGLGGRNLSGRGPGNEV

SEQ ID NO: 468147 - protein, 7 aa, Mycobacterium
ENSEPFT

SEQ ID NO: 468148 - protein, 6 aa, Mycobacterium
ENSGAA

SEQ ID NO: 468149 - protein, 7 aa, Mycobacterium
ENSGEAM

SEQ ID NO: 468150 - protein, 25 aa, Mycobacterium
ENSGGELVNEGATSEKAAASKAKNK

SEQ ID NO: 468151 - protein, 28 aa, Mycobacterium
ENSGGQLSNRDALTEKGAAARAKKKSPV

SEQ ID NO: 468152 - protein, 9 aa, Mycobacterium
ENSGGRGAA

SEQ ID NO: 468153 - protein, 6 aa, Mycobacterium
ENSITG

SEQ ID NO: 468154 - protein, 8 aa, Mycobacterium
ENSLRGED

SEQ ID NO: 468155 - protein, 10 aa, Mycobacterium
ENSPEASPAD

SEQ ID NO: 468156 - protein, 6 aa, Mycobacterium
ENSPFT

SEQ ID NO: 468157 - protein, 4 aa, Mycobacterium
ENSR

SEQ ID NO: 468158 - protein, 9 aa, Mycobacterium
ENSREPSDG

SEQ ID NO: 468159 - protein, 9 aa, Mycobacterium
ENSSDPQEL

SEQ ID NO: 468160 - protein, 5 aa, Mycobacterium
ENSSL

SEQ ID NO: 468161 - protein, 5 aa, Mycobacterium
ENSSV

SEQ ID NO: 468162 - protein, 9 aa, Mycobacterium
ENSTAAPPL

SEQ ID NO: 468163 - protein, 10 aa, Mycobacterium
ENSTAAPPLT

SEQ ID NO: 468164 - protein, 10 aa, Mycobacterium
ENSTGEPDFS

SEQ ID NO: 468165 - protein, 7 aa, Mycobacterium
ENSVSPI

SEQ ID NO: 468166 - protein, 10 aa, Mycobacterium
ENTAAEIGNS

SEQ ID NO: 468167 - protein, 7 aa, Mycobacterium
ENTAART

SEQ ID NO: 468168 - protein, 10 aa, Mycobacterium
ENTATQTRER

SEQ ID NO: 468169 - protein, 8 aa, Mycobacterium
ENTAVQQE

SEQ ID NO: 468170 - protein, 4 aa, Mycobacterium
ENTD

SEQ ID NO: 468171 - protein, 9 aa, Mycobacterium
ENTDGKPYG

SEQ ID NO: 468172 - protein, 4 aa, Mycobacterium
ENTF

SEQ ID NO: 468173 - protein, 4 aa, Mycobacterium
ENTG

SEQ ID NO: 468174 - protein, 7 aa, Mycobacterium
ENTGAGF

SEQ ID NO: 468175 - protein, 7 aa, Mycobacterium
ENTGDAN

SEQ ID NO: 468176 - protein, 7 aa, Mycobacterium
ENTGDAR

SEQ ID NO: 468177 - protein, 16 aa, Mycobacterium
ENTGETLATEDALDDD

SEQ ID NO: 468178 - protein, 6 aa, Mycobacterium
ENTGGF

SEQ ID NO: 468179 - protein, 7 aa, Mycobacterium
ENTGKPI

SEQ ID NO: 468180 - protein, 15 aa, Mycobacterium
ENTGLNPGAVDGSEA

SEQ ID NO: 468181 - protein, 7 aa, Mycobacterium
ENTGRGI

SEQ ID NO: 468182 - protein, 11 aa, Mycobacterium
ENTGRGLDTSG

SEQ ID NO: 468183 - protein, 8 aa, Mycobacterium
ENTGSSFA

SEQ ID NO: 468184 - protein, 9 aa, Mycobacterium
ENTIAKGRA

SEQ ID NO: 468185 - protein, 4 aa, Mycobacterium
ENTL

SEQ ID NO: 468186 - protein, 19 aa, Mycobacterium
ENTNAAKADTILDEVLAAA

SEQ ID NO: 468187 - protein, 6 aa, Mycobacterium
ENTPAK

SEQ ID NO: 468188 - protein, 17 aa, Mycobacterium
ENTPQKPFAGYEPRPEY

SEQ ID NO: 468189 - protein, 9 aa, Mycobacterium
ENTRARAEL

SEQ ID NO: 468190 - protein, 9 aa, Mycobacterium
ENTRRTAGP

SEQ ID NO: 468191 - protein, 8 aa, Mycobacterium
ENTSGRTR

SEQ ID NO: 468192 - protein, 5 aa, Mycobacterium
ENTSS

SEQ ID NO: 468193 - protein, 6 aa, Mycobacterium
ENTSSI

SEQ ID NO: 468194 - protein, 6 aa, Mycobacterium
ENTSTL

SEQ ID NO: 468195 - protein, 4 aa, Mycobacterium
ENTT

SEQ ID NO: 468196 - protein, 9 aa, Mycobacterium
ENTTPQAVR

SEQ ID NO: 468197 - protein, 8 aa, Mycobacterium
ENTVREAG

SEQ ID NO: 468198 - protein, 4 aa, Mycobacterium
ENTY

SEQ ID NO: 468199 - protein, 10 aa, Mycobacterium
ENTYHAEGKE

SEQ ID NO: 468200 - protein, 9 aa, Mycobacterium
ENTYTDQTT

SEQ ID NO: 468201 - protein, 4 aa, Mycobacterium
ENVA

SEQ ID NO: 468202 - protein, 7 aa, Mycobacterium
ENVAEGD

SEQ ID NO: 468203 - protein, 8 aa, Mycobacterium
ENVAPDEI

SEQ ID NO: 468204 - protein, 5 aa, Mycobacterium
ENVAS

SEQ ID NO: 468205 - protein, 7 aa, Mycobacterium
ENVGAAT

SEQ ID NO: 468206 - protein, 13 aa, Mycobacterium
ENVGERSENTRRL

SEQ ID NO: 468207 - protein, 9 aa, Mycobacterium
ENVGGPDKI

SEQ ID NO: 468208 - protein, 10 aa, Mycobacterium
ENVGQYRDDR

SEQ ID NO: 468209 - protein, 13 aa, Mycobacterium
ENVGTASAFRSSF

SEQ ID NO: 468210 - protein, 4 aa, Mycobacterium
ENVK

SEQ ID NO: 468211 - protein, 7 aa, Mycobacterium
ENVPDGQ

SEQ ID NO: 468212 - protein, 6 aa, Mycobacterium
ENVPKT

SEQ ID NO: 468213 - protein, 5 aa, Mycobacterium
ENVPT

SEQ ID NO: 468214 - protein, 5 aa, Mycobacterium
ENVSA

SEQ ID NO: 468215 - protein, 10 aa, Mycobacterium
ENVSGGHTVR

SEQ ID NO: 468216 - protein, 15 aa, Mycobacterium
ENVSPTAELLKLGAS

SEQ ID NO: 468217 - protein, 7 aa, Mycobacterium
ENVTEEQ

SEQ ID NO: 468218 - protein, 9 aa, Mycobacterium
ENVTPEQAF

SEQ ID NO: 468219 - protein, 12 aa, Mycobacterium
ENVTSASGFRDS

SEQ ID NO: 468220 - protein, 6 aa, Mycobacterium
ENVTTA

SEQ ID NO: 468221 - protein, 7 aa, Mycobacterium
ENVTTAS

SEQ ID NO: 468222 - protein, 8 aa, Mycobacterium
ENVTTASA

SEQ ID NO: 468223 - protein, 6 aa, Mycobacterium
ENVYST

SEQ ID NO: 468224 - protein, 23 aa, Mycobacterium
ENWEKSAGTDPRAGHRRHSVYHR

SEQ ID NO: 468225 - protein, 11 aa, Mycobacterium
ENWESGDEKKQ

SEQ ID NO: 468226 - protein, 4 aa, Mycobacterium
ENWG

SEQ ID NO: 468227 - protein, 4 aa, Mycobacterium
ENWP

SEQ ID NO: 468228 - protein, 4 aa, Mycobacterium
ENYA

SEQ ID NO: 468229 - protein, 8 aa, Mycobacterium
ENYAPESF

SEQ ID NO: 468230 - protein, 9 aa, Mycobacterium
ENYDDPAAE

SEQ ID NO: 468231 - protein, 14 aa, Mycobacterium
ENYPEAWGDEERRV

SEQ ID NO: 468232 - protein, 9 aa, Mycobacterium
ENYPGRPRV

SEQ ID NO: 468233 - protein, 18 aa, Mycobacterium
ENYPGRPRVGDPIHGADA

SEQ ID NO: 468234 - protein, 5 aa, Mycobacterium
EPAAA

SEQ ID NO: 468235 - protein, 8 aa, Mycobacterium
EPAAADAY

SEQ ID NO: 468236 - protein, 10 aa, Mycobacterium
EPAAAERATG

SEQ ID NO: 468237 - protein, 18 aa, Mycobacterium
EPAAAGPGWGQDDSGRHH

SEQ ID NO: 468238 - protein, 10 aa, Mycobacterium
EPAAAGQPPM

SEQ ID NO: 468239 - protein, 12 aa, Mycobacterium
EPAAAPGETVTT

SEQ ID NO: 468240 - protein, 8 aa, Mycobacterium
EPAADDGT

SEQ ID NO: 468241 - protein, 26 aa, Mycobacterium
EPAAGDEPTAEPEATPAEDEPADVAD

SEQ ID NO: 468242 - protein, 8 aa, Mycobacterium
EPAAGELG

SEQ ID NO: 468243 - protein, 10 aa, Mycobacterium
EPAAGERVGG

SEQ ID NO: 468244 - protein, 13 aa, Mycobacterium
EPAAGGEDEDPGK

SEQ ID NO: 468245 - protein, 39 aa, Mycobacterium
EPAAGTASSTGAARATRAARPAGADQPRGSTGPAGLTHP

SEQ ID NO: 468246 - protein, 6 aa, Mycobacterium
EPAANR

SEQ ID NO: 468247 - protein, 15 aa, Mycobacterium
EPAAPAATGAPTCGE

SEQ ID NO: 468248 - protein, 9 aa, Mycobacterium
EPAAQATRE

SEQ ID NO: 468249 - protein, 35 aa, Mycobacterium
EPAAQLGGQLAEGAAQAAGQLTGGLTQAATAITQG

SEQ ID NO: 468250 - protein, 7 aa, Mycobacterium
EPAAQRG

SEQ ID NO: 468251 - protein, 10 aa, Mycobacterium
EPAAQRVTED

SEQ ID NO: 468252 - protein, 14 aa, Mycobacterium
EPAARRRDRGDDHP

SEQ ID NO: 468253 - protein, 18 aa, Mycobacterium
EPAASAEPLTRSPQQRDD

SEQ ID NO: 468254 - protein, 5 aa, Mycobacterium
EPAAT

SEQ ID NO: 468255 - protein, 11 aa, Mycobacterium
EPAATADEIEA

SEQ ID NO: 468256 - protein, 9 aa, Mycobacterium
EPAATAEEI

SEQ ID NO: 468257 - protein, 11 aa, Mycobacterium
EPAATAEEIEA

SEQ ID NO: 468258 - protein, 11 aa, Mycobacterium
EPAATDQEIEA

SEQ ID NO: 468259 - protein, 10 aa, Mycobacterium
EPADAGPVPD

SEQ ID NO: 468260 - protein, 18 aa, Mycobacterium
EPADAPALPPPSRTVGAE

SEQ ID NO: 468261 - protein, 18 aa, Mycobacterium
EPADDATAAGDVAVGSGA

SEQ ID NO: 468262 - protein, 5 aa, Mycobacterium
EPADG

SEQ ID NO: 468263 - protein, 8 aa, Mycobacterium
EPADGRTA

SEQ ID NO: 468264 - protein, 9 aa, Mycobacterium
EPADHLPDT

SEQ ID NO: 468265 - protein, 5 aa, Mycobacterium
EPADL

SEQ ID NO: 468266 - protein, 13 aa, Mycobacterium
EPADPAGAGDSMT

SEQ ID NO: 468267 - protein, 12 aa, Mycobacterium
EPADPDDGGDEG

SEQ ID NO: 468268 - protein, 16 aa, Mycobacterium
EPADPNSACAHGNPNV

SEQ ID NO: 468269 - protein, 18 aa, Mycobacterium
EPADRAAVRRSDLTLELT

SEQ ID NO: 468270 - protein, 16 aa, Mycobacterium
EPADRASVRLTPLTLG

SEQ ID NO: 468271 - protein, 8 aa, Mycobacterium
EPADRDAH

SEQ ID NO: 468272 - protein, 8 aa, Mycobacterium
EPADREGV

SEQ ID NO: 468273 - protein, 7 aa, Mycobacterium
EPADTGT

SEQ ID NO: 468274 - protein, 5 aa, Mycobacterium
EPAED

SEQ ID NO: 468275 - protein, 5 aa, Mycobacterium
EPAEE

SEQ ID NO: 468276 - protein, 13 aa, Mycobacterium
EPAEFGHRPAAGD

SEQ ID NO: 468277 - protein, 11 aa, Mycobacterium
EPAEGGNAGMG

SEQ ID NO: 468278 - protein, 5 aa, Mycobacterium
EPAEN

SEQ ID NO: 468279 - protein, 12 aa, Mycobacterium
EPAEPEAEQAGL

SEQ ID NO: 468280 - protein, 12 aa, Mycobacterium
EPAEPEPEQARL

SEQ ID NO: 468281 - protein, 9 aa, Mycobacterium
EPAEPHEHD

SEQ ID NO: 468282 - protein, 6 aa, Mycobacterium
EPAERR

SEQ ID NO: 468283 - protein, 4 aa, Mycobacterium
EPAF

SEQ ID NO: 468284 - protein, 5 aa, Mycobacterium
EPAFA

SEQ ID NO: 468285 - protein, 8 aa, Mycobacterium
EPAFPDPE

SEQ ID NO: 468286 - protein, 8 aa, Mycobacterium
EPAGAGVR

SEQ ID NO: 468287 - protein, 8 aa, Mycobacterium
EPAGAQAA

SEQ ID NO: 468288 - protein, 8 aa, Mycobacterium
EPAGDDIN

SEQ ID NO: 468289 - protein, 8 aa, Mycobacterium
EPAGEGTR

SEQ ID NO: 468290 - protein, 24 aa, Mycobacterium
EPAGENRFTAPTGLAGADDRQVVE

SEQ ID NO: 468291 - protein, 6 aa, Mycobacterium
EPAGER

SEQ ID NO: 468292 - protein, 8 aa, Mycobacterium
EPAGLPES

SEQ ID NO: 468293 - protein, 6 aa, Mycobacterium
EPAGPG

SEQ ID NO: 468294 - protein, 8 aa, Mycobacterium
EPAGPGVR

SEQ ID NO: 468295 - protein, 6 aa, Mycobacterium
EPAGPI

SEQ ID NO: 468296 - protein, 6 aa, Mycobacterium
EPAGPL

SEQ ID NO: 468297 - protein, 18 aa, Mycobacterium
EPAGPPSHRPRPPCPPCA

SEQ ID NO: 468298 - protein, 7 aa, Mycobacterium
EPAGPPT

SEQ ID NO: 468299 - protein, 8 aa, Mycobacterium
EPAGQPAC

SEQ ID NO: 468300 - protein, 17 aa, Mycobacterium
EPAGRGVQRAARTHHAA

SEQ ID NO: 468301 - protein, 9 aa, Mycobacterium
EPAGRPSAR

SEQ ID NO: 468302 - protein, 7 aa, Mycobacterium
EPAGSQF

SEQ ID NO: 468303 - protein, 16 aa, Mycobacterium
EPAGSSARYETRTGDN

SEQ ID NO: 468304 - protein, 7 aa, Mycobacterium
EPAGSSL

SEQ ID NO: 468305 - protein, 5 aa, Mycobacterium
EPAGT

SEQ ID NO: 468306 - protein, 25 aa, Mycobacterium
EPAGTPGRKLTDGPADAQPAPSPDL

SEQ ID NO: 468307 - protein, 5 aa, Mycobacterium
EPAGV

SEQ ID NO: 468308 - protein, 8 aa, Mycobacterium
EPAHHEEP

SEQ ID NO: 468309 - protein, 10 aa, Mycobacterium
EPAHQGSDPR

SEQ ID NO: 468310 - protein, 12 aa, Mycobacterium
EPAIAKKRSQID

SEQ ID NO: 468311 - protein, 37 aa, Mycobacterium
EPAKPAKQAKPAKPAKQTPPAPAEQPASSRRGKPAIP

SEQ ID NO: 468312 - protein, 26 aa, Mycobacterium
EPAKPAPAPAAEPPASHRRGKPAIPA

SEQ ID NO: 468313 - protein, 12 aa, Mycobacterium
EPAKPQPEQITL

SEQ ID NO: 468314 - protein, 8 aa, Mycobacterium
EPAKTPAL

SEQ ID NO: 468315 - protein, 10 aa, Mycobacterium
EPAKTPEGYY

SEQ ID NO: 468316 - protein, 5 aa, Mycobacterium
EPALA

SEQ ID NO: 468317 - protein, 11 aa, Mycobacterium
EPALAAPDRDA

SEQ ID NO: 468318 - protein, 5 aa, Mycobacterium
EPALP

SEQ ID NO: 468319 - protein, 17 aa, Mycobacterium
EPALPQADSGTPLPAGN

SEQ ID NO: 468320 - protein, 18 aa, Mycobacterium
EPAMPPEPAVQAPPDTSL

SEQ ID NO: 468321 - protein, 5 aa, Mycobacterium
EPANA

SEQ ID NO: 468322 - protein, 8 aa, Mycobacterium
EPANAIAG

SEQ ID NO: 468323 - protein, 15 aa, Mycobacterium
EPANAPEDDAATPGR

SEQ ID NO: 468324 - protein, 47 aa, Mycobacterium
EPANRTDEPLAQDGTARPAASGQAVATPAAPPAATSPTVDNTLPEDR

SEQ ID NO: 468325 - protein, 4 aa, Mycobacterium
EPAP

SEQ ID NO: 468326 - protein, 10 aa, Mycobacterium
EPAPAAPAGY

SEQ ID NO: 468327 - protein, 10 aa, Mycobacterium
EPAPAPDMDA

SEQ ID NO: 468328 - protein, 7 aa, Mycobacterium
EPAPDAE

SEQ ID NO: 468329 - protein, 11 aa, Mycobacterium
EPAPDDLQARG

SEQ ID NO: 468330 - protein, 7 aa, Mycobacterium
EPAPDLA

SEQ ID NO: 468331 - protein, 6 aa, Mycobacterium
EPAPEA

SEQ ID NO: 468332 - protein, 11 aa, Mycobacterium
EPAPEAGEEGD

SEQ ID NO: 468333 - protein, 6 aa, Mycobacterium
EPAPEV

SEQ ID NO: 468334 - protein, 8 aa, Mycobacterium
EPAPGDTM

SEQ ID NO: 468335 - protein, 7 aa, Mycobacterium
EPAPHPR

SEQ ID NO: 468336 - protein, 15 aa, Mycobacterium
EPAPIRHGDAETAAR

SEQ ID NO: 468337 - protein, 10 aa, Mycobacterium
EPAPLENPSV

SEQ ID NO: 468338 - protein, 15 aa, Mycobacterium
EPAPLGGDAKAPNPV

SEQ ID NO: 468339 - protein, 6 aa, Mycobacterium
EPAPPE

SEQ ID NO: 468340 - protein, 7 aa, Mycobacterium
EPAPSDG

SEQ ID NO: 468341 - protein, 5 aa, Mycobacterium
EPAPT

SEQ ID NO: 468342 - protein, 13 aa, Mycobacterium
EPAPVTDVQAGGA

SEQ ID NO: 468343 - protein, 4 aa, Mycobacterium
EPAQ

SEQ ID NO: 468344 - protein, 5 aa, Mycobacterium
EPAQA

SEQ ID NO: 468345 - protein, 8 aa, Mycobacterium
EPAQEAQD

SEQ ID NO: 468346 - protein, 6 aa, Mycobacterium
EPAQQI

SEQ ID NO: 468347 - protein, 14 aa, Mycobacterium
EPARAALSNLNELL

SEQ ID NO: 468348 - protein, 8 aa, Mycobacterium
EPARAEDV

SEQ ID NO: 468349 - protein, 9 aa, Mycobacterium
EPARATASA

SEQ ID NO: 468350 - protein, 8 aa, Mycobacterium
EPAREITD

SEQ ID NO: 468351 - protein, 11 aa, Mycobacterium
EPARQGSDPRE

SEQ ID NO: 468352 - protein, 10 aa, Mycobacterium
EPASAADEYG

SEQ ID NO: 468353 - protein, 10 aa, Mycobacterium
EPASDAALTE

SEQ ID NO: 468354 - protein, 10 aa, Mycobacterium
EPASDGPGAP

SEQ ID NO: 468355 - protein, 8 aa, Mycobacterium
EPASEDLE

SEQ ID NO: 468356 - protein, 5 aa, Mycobacterium
EPASG

SEQ ID NO: 468357 - protein, 10 aa, Mycobacterium
EPASGGIDHQ

SEQ ID NO: 468358 - protein, 8 aa, Mycobacterium
EPASIGFG

SEQ ID NO: 468359 - protein, 8 aa, Mycobacterium
EPASLGAS

SEQ ID NO: 468360 - protein, 21 aa, Mycobacterium
EPASPEVPQSESPSAGAPTHG

SEQ ID NO: 468361 - protein, 6 aa, Mycobacterium
EPASRS

SEQ ID NO: 468362 - protein, 6 aa, Mycobacterium
EPASSL

SEQ ID NO: 468363 - protein, 8 aa, Mycobacterium
EPATAGEL

SEQ ID NO: 468364 - protein, 7 aa, Mycobacterium
EPATANK

SEQ ID NO: 468365 - protein, 5 aa, Mycobacterium
EPATD

SEQ ID NO: 468366 - protein, 6 aa, Mycobacterium
EPATET

SEQ ID NO: 468367 - protein, 6 aa, Mycobacterium
EPATGD

SEQ ID NO: 468368 - protein, 15 aa, Mycobacterium
EPATGSQDGEIRDGQ

SEQ ID NO: 468369 - protein, 20 aa, Mycobacterium
EPATIEQAGSQAGYPAPPLQ

SEQ ID NO: 468370 - protein, 11 aa, Mycobacterium
EPATPATASAY

SEQ ID NO: 468371 - protein, 10 aa, Mycobacterium
EPATTATKGL

SEQ ID NO: 468372 - protein, 15 aa, Mycobacterium
EPATTVTADRTIPAD

SEQ ID NO: 468373 - protein, 4 aa, Mycobacterium
EPAV

SEQ ID NO: 468374 - protein, 17 aa, Mycobacterium
EPAVADAGAGARDDHRR

SEQ ID NO: 468375 - protein, 23 aa, Mycobacterium
EPAVASSDARNIETTISRDGGDY

SEQ ID NO: 468376 - protein, 7 aa, Mycobacterium
EPAVTMD

SEQ ID NO: 468377 - protein, 8 aa, Mycobacterium
EPAYGTLT

SEQ ID NO: 468378 - protein, 18 aa, Mycobacterium
EPAYTDFPDPQPTGGAEV

SEQ ID NO: 468379 - protein, 5 aa, Mycobacterium
EPCPD

SEQ ID NO: 468380 - protein, 4 aa, Mycobacterium
EPCT

SEQ ID NO: 468381 - protein, 5 aa, Mycobacterium
EPCTD

SEQ ID NO: 468382 - protein, 8 aa, Mycobacterium
EPDAAASY

SEQ ID NO: 468383 - protein, 14 aa, Mycobacterium
EPDAADSSTSRDVY

SEQ ID NO: 468384 - protein, 8 aa, Mycobacterium
EPDAAGVR

SEQ ID NO: 468385 - protein, 6 aa, Mycobacterium
EPDADA

SEQ ID NO: 468386 - protein, 18 aa, Mycobacterium
EPDAEAPEPAPGVGGANS

SEQ ID NO: 468387 - protein, 8 aa, Mycobacterium
EPDAEAPH

SEQ ID NO: 468388 - protein, 20 aa, Mycobacterium
EPDAGSDAASIKTRATRVDG

SEQ ID NO: 468389 - protein, 14 aa, Mycobacterium
EPDAGSDAASVKTR

SEQ ID NO: 468390 - protein, 11 aa, Mycobacterium
EPDAGSDAFGG

SEQ ID NO: 468391 - protein, 15 aa, Mycobacterium
EPDAGSDASALGTRA

SEQ ID NO: 468392 - protein, 24 aa, Mycobacterium
EPDAGSDIAGVRSRGTRQDDGSWR

SEQ ID NO: 468393 - protein, 20 aa, Mycobacterium
EPDAGSDPAAMKTRARRDGS

SEQ ID NO: 468394 - protein, 21 aa, Mycobacterium
EPDAGSDPAAMKTRARRDGSD

SEQ ID NO: 468395 - protein, 21 aa, Mycobacterium
EPDAGSDVGAGRAKAFEQPDG

SEQ ID NO: 468396 - protein, 22 aa, Mycobacterium
EPDAGSDVGAGRTKAIKQDDGS

SEQ ID NO: 468397 - protein, 21 aa, Mycobacterium
EPDAGSDVGAGRTKAVEQADG

SEQ ID NO: 468398 - protein, 22 aa, Mycobacterium
EPDAGSDVGAGRTKAVEQPDGT

SEQ ID NO: 468399 - protein, 22 aa, Mycobacterium
EPDAGSDVGAGRTKAVQQEDGS

SEQ ID NO: 468400 - protein, 28 aa, Mycobacterium
EPDAGSGADPLEDPAPSIASDRGAGPLG

SEQ ID NO: 468401 - protein, 21 aa, Mycobacterium
EPDAGSNSHKITTTARRDGSD

SEQ ID NO: 468402 - protein, 10 aa, Mycobacterium
EPDAGSNSHN

SEQ ID NO: 468403 - protein, 20 aa, Mycobacterium
EPDAGSNSHNIATTAKRDGA

SEQ ID NO: 468404 - protein, 12 aa, Mycobacterium
EPDAGSNSHNIS

SEQ ID NO: 468405 - protein, 12 aa, Mycobacterium
EPDAGSNTRQIA

SEQ ID NO: 468406 - protein, 7 aa, Mycobacterium
EPDAPES

SEQ ID NO: 468407 - protein, 10 aa, Mycobacterium
EPDAQGNRPD

SEQ ID NO: 468408 - protein, 5 aa, Mycobacterium
EPDAV

SEQ ID NO: 468409 - protein, 5 aa, Mycobacterium
EPDAY

SEQ ID NO: 468410 - protein, 4 aa, Mycobacterium
EPDC

SEQ ID NO: 468411 - protein, 4 aa, Mycobacterium
EPDD

SEQ ID NO: 468412 - protein, 5 aa, Mycobacterium
EPDDD

SEQ ID NO: 468413 - protein, 10 aa, Mycobacterium
EPDDEHLAPD

SEQ ID NO: 468414 - protein, 9 aa, Mycobacterium
EPDDFADPE

SEQ ID NO: 468415 - protein, 11 aa, Mycobacterium
EPDDLDARSEA

SEQ ID NO: 468416 - protein, 10 aa, Mycobacterium
EPDDMASAGR

SEQ ID NO: 468417 - protein, 6 aa, Mycobacterium
EPDDPE

SEQ ID NO: 468418 - protein, 8 aa, Mycobacterium
EPDDQARR

SEQ ID NO: 468419 - protein, 11 aa, Mycobacterium
EPDDVASSGRV

SEQ ID NO: 468420 - protein, 6 aa, Mycobacterium
EPDDVS

SEQ ID NO: 468421 - protein, 10 aa, Mycobacterium
EPDEDGNRPD

SEQ ID NO: 468422 - protein, 5 aa, Mycobacterium
EPDEI

SEQ ID NO: 468423 - protein, 8 aa, Mycobacterium
EPDELRGP

SEQ ID NO: 468424 - protein, 9 aa, Mycobacterium
EPDEPGGGQ

SEQ ID NO: 468425 - protein, 8 aa, Mycobacterium
EPDEQNRR

SEQ ID NO: 468426 - protein, 9 aa, Mycobacterium
EPDERRELA

SEQ ID NO: 468427 - protein, 7 aa, Mycobacterium
EPDESGF

SEQ ID NO: 468428 - protein, 8 aa, Mycobacterium
EPDESGQI

SEQ ID NO: 468429 - protein, 17 aa, Mycobacterium
EPDESRAAHSASRRTPL

SEQ ID NO: 468430 - protein, 5 aa, Mycobacterium
EPDEV

SEQ ID NO: 468431 - protein, 8 aa, Mycobacterium
EPDGDGTL

SEQ ID NO: 468432 - protein, 8 aa, Mycobacterium
EPDGEGVL

SEQ ID NO: 468433 - protein, 10 aa, Mycobacterium
EPDGNGGSRV

SEQ ID NO: 468434 - protein, 8 aa, Mycobacterium
EPDGNPGQ

SEQ ID NO: 468435 - protein, 23 aa, Mycobacterium
EPDGPAARRSPRTEAEAAQQRGD

SEQ ID NO: 468436 - protein, 8 aa, Mycobacterium
EPDGPPAG

SEQ ID NO: 468437 - protein, 8 aa, Mycobacterium
EPDGQPGQ

SEQ ID NO: 468438 - protein, 8 aa, Mycobacterium
EPDGRANG

SEQ ID NO: 468439 - protein, 8 aa, Mycobacterium
EPDGRRTV

SEQ ID NO: 468440 - protein, 11 aa, Mycobacterium
EPDGTGSPADL

SEQ ID NO: 468441 - protein, 8 aa, Mycobacterium
EPDGTQRT

SEQ ID NO: 468442 - protein, 6 aa, Mycobacterium
EPDGTS

SEQ ID NO: 468443 - protein, 8 aa, Mycobacterium
EPDGTTTH

SEQ ID NO: 468444 - protein, 9 aa, Mycobacterium
EPDGTVDPA

SEQ ID NO: 468445 - protein, 5 aa, Mycobacterium
EPDGV

SEQ ID NO: 468446 - protein, 20 aa, Mycobacterium
EPDHGSDPAGMRTRATRSGD

SEQ ID NO: 468447 - protein, 8 aa, Mycobacterium
EPDHTELR

SEQ ID NO: 468448 - protein, 10 aa, Mycobacterium
EPDKVEGGME

SEQ ID NO: 468449 - protein, 5 aa, Mycobacterium
EPDLA

SEQ ID NO: 468450 - protein, 6 aa, Mycobacterium
EPDLPS

SEQ ID NO: 468451 - protein, 10 aa, Mycobacterium
EPDLSDELDG

SEQ ID NO: 468452 - protein, 4 aa, Mycobacterium
EPDM

SEQ ID NO: 468453 - protein, 5 aa, Mycobacterium
EPDMP

SEQ ID NO: 468454 - protein, 9 aa, Mycobacterium
EPDNFGPYS

SEQ ID NO: 468455 - protein, 7 aa, Mycobacterium
EPDNPAA

SEQ ID NO: 468456 - protein, 17 aa, Mycobacterium
EPDNPADTYASVERKDK

SEQ ID NO: 468457 - protein, 19 aa, Mycobacterium
EPDNPARQYRNTERSDKEQ

SEQ ID NO: 468458 - protein, 9 aa, Mycobacterium
EPDNPSKYY

SEQ ID NO: 468459 - protein, 5 aa, Mycobacterium
EPDPA

SEQ ID NO: 468460 - protein, 8 aa, Mycobacterium
EPDPANVA

SEQ ID NO: 468461 - protein, 6 aa, Mycobacterium
EPDPAT

SEQ ID NO: 468462 - protein, 9 aa, Mycobacterium
EPDPATSPV

SEQ ID NO: 468463 - protein, 8 aa, Mycobacterium
EPDPATSS

SEQ ID NO: 468464 - protein, 9 aa, Mycobacterium
EPDPATSSV

SEQ ID NO: 468465 - protein, 6 aa, Mycobacterium
EPDPET

SEQ ID NO: 468466 - protein, 10 aa, Mycobacterium
EPDPETAPTV

SEQ ID NO: 468467 - protein, 7 aa, Mycobacterium
EPDPGEM

SEQ ID NO: 468468 - protein, 5 aa, Mycobacterium
EPDPI

SEQ ID NO: 468469 - protein, 6 aa, Mycobacterium
EPDPKR

SEQ ID NO: 468470 - protein, 7 aa, Mycobacterium
EPDPNEM

SEQ ID NO: 468471 - protein, 8 aa, Mycobacterium
EPDPPARY

SEQ ID NO: 468472 - protein, 8 aa, Mycobacterium
EPDPPTAV

SEQ ID NO: 468473 - protein, 6 aa, Mycobacterium
EPDPQL

SEQ ID NO: 468474 - protein, 7 aa, Mycobacterium
EPDPREM

SEQ ID NO: 468475 - protein, 7 aa, Mycobacterium
EPDPRRR

SEQ ID NO: 468476 - protein, 15 aa, Mycobacterium
EPDPRRTRRRRTVDV

SEQ ID NO: 468477 - protein, 20 aa, Mycobacterium
EPDPSEMHAAGPPSASGRGT

SEQ ID NO: 468478 - protein, 14 aa, Mycobacterium
EPDPTNTPLETADE

SEQ ID NO: 468479 - protein, 7 aa, Mycobacterium
EPDPTTQ

SEQ ID NO: 468480 - protein, 7 aa, Mycobacterium
EPDPTYE

SEQ ID NO: 468481 - protein, 5 aa, Mycobacterium
EPDPV

SEQ ID NO: 468482 - protein, 6 aa, Mycobacterium
EPDQAI

SEQ ID NO: 468483 - protein, 9 aa, Mycobacterium
EPDQDVPDE

SEQ ID NO: 468484 - protein, 7 aa, Mycobacterium
EPDQRAT

SEQ ID NO: 468485 - protein, 7 aa, Mycobacterium
EPDQSTS

SEQ ID NO: 468486 - protein, 5 aa, Mycobacterium
EPDRP

SEQ ID NO: 468487 - protein, 5 aa, Mycobacterium
EPDSA

SEQ ID NO: 468488 - protein, 6 aa, Mycobacterium
EPDSGR

SEQ ID NO: 468489 - protein, 9 aa, Mycobacterium
EPDSKSSKS

SEQ ID NO: 468490 - protein, 5 aa, Mycobacterium
EPDSP

SEQ ID NO: 468491 - protein, 8 aa, Mycobacterium
EPDSSGGC

SEQ ID NO: 468492 - protein, 7 aa, Mycobacterium
EPDSTYR

SEQ ID NO: 468493 - protein, 10 aa, Mycobacterium
EPDSVADEAD

SEQ ID NO: 468494 - protein, 6 aa, Mycobacterium
EPDSVT

SEQ ID NO: 468495 - protein, 5 aa, Mycobacterium
EPDSW

SEQ ID NO: 468496 - protein, 5 aa, Mycobacterium
EPDTA

SEQ ID NO: 468497 - protein, 6 aa, Mycobacterium
EPDTAE

SEQ ID NO: 468498 - protein, 7 aa, Mycobacterium
EPDTEEQ

SEQ ID NO: 468499 - protein, 8 aa, Mycobacterium
EPDTLPDS

SEQ ID NO: 468500 - protein, 8 aa, Mycobacterium
EPDTPEIA

SEQ ID NO: 468501 - protein, 14 aa, Mycobacterium
EPDTPRGRALSPRD

SEQ ID NO: 468502 - protein, 6 aa, Mycobacterium
EPDTRG

SEQ ID NO: 468503 - protein, 15 aa, Mycobacterium
EPDTSAASGKHEFPS

SEQ ID NO: 468504 - protein, 5 aa, Mycobacterium
EPDTY

SEQ ID NO: 468505 - protein, 5 aa, Mycobacterium
EPDVP

SEQ ID NO: 468506 - protein, 9 aa, Mycobacterium
EPDYEDPAA

SEQ ID NO: 468507 - protein, 8 aa, Mycobacterium
EPDYEESA

SEQ ID NO: 468508 - protein, 5 aa, Mycobacterium
EPDYP

SEQ ID NO: 468509 - protein, 10 aa, Mycobacterium
EPDYPNAEEL

SEQ ID NO: 468510 - protein, 8 aa, Mycobacterium
EPEADENT

SEQ ID NO: 468511 - protein, 9 aa, Mycobacterium
EPEAPQAPF

SEQ ID NO: 468512 - protein, 7 aa, Mycobacterium
EPEAQLD

SEQ ID NO: 468513 - protein, 5 aa, Mycobacterium
EPEAR

SEQ ID NO: 468514 - protein, 7 aa, Mycobacterium
EPEARDV

SEQ ID NO: 468515 - protein, 8 aa, Mycobacterium
EPEARPEL

SEQ ID NO: 468516 - protein, 6 aa, Mycobacterium
EPEASV

SEQ ID NO: 468517 - protein, 5 aa, Mycobacterium
EPEAT

SEQ ID NO: 468518 - protein, 19 aa, Mycobacterium
EPECGSDVAAAATRAVRDG

SEQ ID NO: 468519 - protein, 4 aa, Mycobacterium
EPED

SEQ ID NO: 468520 - protein, 28 aa, Mycobacterium
EPEDGRYEDVNPATEQSIGTAPDASVAQ

SEQ ID NO: 468521 - protein, 8 aa, Mycobacterium
EPEDRSPE

SEQ ID NO: 468522 - protein, 7 aa, Mycobacterium
EPEDVPR

SEQ ID NO: 468523 - protein, 5 aa, Mycobacterium
EPEEA

SEQ ID NO: 468524 - protein, 14 aa, Mycobacterium
EPEESLDSEQTGID

SEQ ID NO: 468525 - protein, 6 aa, Mycobacterium
EPEESV

SEQ ID NO: 468526 - protein, 5 aa, Mycobacterium
EPEET

SEQ ID NO: 468527 - protein, 6 aa, Mycobacterium
EPEEVG

SEQ ID NO: 468528 - protein, 4 aa, Mycobacterium
EPEF

SEQ ID NO: 468529 - protein, 11 aa, Mycobacterium
EPEFGAPSDMP

SEQ ID NO: 468530 - protein, 7 aa, Mycobacterium
EPEGAGT

SEQ ID NO: 468531 - protein, 7 aa, Mycobacterium
EPEGGGT

SEQ ID NO: 468532 - protein, 9 aa, Mycobacterium
EPEGNGSKF

SEQ ID NO: 468533 - protein, 5 aa, Mycobacterium
EPEGT

SEQ ID NO: 468534 - protein, 4 aa, Mycobacterium
EPEH

SEQ ID NO: 468535 - protein, 6 aa, Mycobacterium
EPEHDI

SEQ ID NO: 468536 - protein, 17 aa, Mycobacterium
EPEHERTRTFLRAVLEE

SEQ ID NO: 468537 - protein, 11 aa, Mycobacterium
EPEHGSDATYM

SEQ ID NO: 468538 - protein, 13 aa, Mycobacterium
EPEHQGCGGGTPL

SEQ ID NO: 468539 - protein, 6 aa, Mycobacterium
EPEHSA

SEQ ID NO: 468540 - protein, 13 aa, Mycobacterium
EPEHTADTTGTGT

SEQ ID NO: 468541 - protein, 5 aa, Mycobacterium
EPEHY

SEQ ID NO: 468542 - protein, 13 aa, Mycobacterium
EPEHYESGPATPL

SEQ ID NO: 468543 - protein, 7 aa, Mycobacterium
EPEIATG

SEQ ID NO: 468544 - protein, 5 aa, Mycobacterium
EPEIT

SEQ ID NO: 468545 - protein, 6 aa, Mycobacterium
EPEITD

SEQ ID NO: 468546 - protein, 6 aa, Mycobacterium
EPEITE

SEQ ID NO: 468547 - protein, 8 aa, Mycobacterium
EPEITPSD

SEQ ID NO: 468548 - protein, 4 aa, Mycobacterium
EPEK

SEQ ID NO: 468549 - protein, 7 aa, Mycobacterium
EPEKNEK

SEQ ID NO: 468550 - protein, 9 aa, Mycobacterium
EPENSASAR

SEQ ID NO: 468551 - protein, 6 aa, Mycobacterium
EPEPAD

SEQ ID NO: 468552 - protein, 11 aa, Mycobacterium
EPEPADGRRAR

SEQ ID NO: 468553 - protein, 6 aa, Mycobacterium
EPEPAL

SEQ ID NO: 468554 - protein, 8 aa, Mycobacterium
EPEPATLD

SEQ ID NO: 468555 - protein, 24 aa, Mycobacterium
EPEPEPAKPAAPVASAATNEEQAM

SEQ ID NO: 468556 - protein, 31 aa, Mycobacterium
EPEPEPAPAPPQPVYEAPAQPAAPQSEDTAV

SEQ ID NO: 468557 - protein, 19 aa, Mycobacterium
EPEPEPEPEAKPEKSEADA

SEQ ID NO: 468558 - protein, 20 aa, Mycobacterium
EPEPEPVRPAPTGTNEEQAL

SEQ ID NO: 468559 - protein, 6 aa, Mycobacterium
EPEPGL

SEQ ID NO: 468560 - protein, 6 aa, Mycobacterium
EPEPLS

SEQ ID NO: 468561 - protein, 13 aa, Mycobacterium
EPEPSDRSTGRDL

SEQ ID NO: 468562 - protein, 22 aa, Mycobacterium
EPEQPTVTPSDPPRRSPVSVQG

SEQ ID NO: 468563 - protein, 22 aa, Mycobacterium
EPEQQTAIPGRPVTNRSVPTAH

SEQ ID NO: 468564 - protein, 10 aa, Mycobacterium
EPEQVDPHTL

SEQ ID NO: 468565 - protein, 6 aa, Mycobacterium
EPEQVT

SEQ ID NO: 468566 - protein, 6 aa, Mycobacterium
EPERAA

SEQ ID NO: 468567 - protein, 5 aa, Mycobacterium
EPERD

SEQ ID NO: 468568 - protein, 6 aa, Mycobacterium
EPERDK

SEQ ID NO: 468569 - protein, 6 aa, Mycobacterium
EPERDQ

SEQ ID NO: 468570 - protein, 6 aa, Mycobacterium
EPEREQ

SEQ ID NO: 468571 - protein, 5 aa, Mycobacterium
EPERF

SEQ ID NO: 468572 - protein, 18 aa, Mycobacterium
EPERMSGGGLRPGPGAPR

SEQ ID NO: 468573 - protein, 5 aa, Mycobacterium
EPERN

SEQ ID NO: 468574 - protein, 6 aa, Mycobacterium
EPERNQ

SEQ ID NO: 468575 - protein, 7 aa, Mycobacterium
EPERPAA

SEQ ID NO: 468576 - protein, 7 aa, Mycobacterium
EPERRRL

SEQ ID NO: 468577 - protein, 5 aa, Mycobacterium
EPERW

SEQ ID NO: 468578 - protein, 4 aa, Mycobacterium
EPET

SEQ ID NO: 468579 - protein, 6 aa, Mycobacterium
EPETDE

SEQ ID NO: 468580 - protein, 7 aa, Mycobacterium
EPETGLD

SEQ ID NO: 468581 - protein, 7 aa, Mycobacterium
EPETGPT

SEQ ID NO: 468582 - protein, 5 aa, Mycobacterium
EPETV

SEQ ID NO: 468583 - protein, 38 aa, Mycobacterium
EPETVAAPTPKGSEEAAAAAGEARPVTPRARTGRSLPP

SEQ ID NO: 468584 - protein, 6 aa, Mycobacterium
EPEVGA

SEQ ID NO: 468585 - protein, 5 aa, Mycobacterium
EPEVQ

SEQ ID NO: 468586 - protein, 11 aa, Mycobacterium
EPEVSSSNPRM

SEQ ID NO: 468587 - protein, 6 aa, Mycobacterium
EPEVTA

SEQ ID NO: 468588 - protein, 4 aa, Mycobacterium
EPEW

SEQ ID NO: 468589 - protein, 5 aa, Mycobacterium
EPEWG

SEQ ID NO: 468590 - protein, 12 aa, Mycobacterium
EPEWGGPTQADR

SEQ ID NO: 468591 - protein, 6 aa, Mycobacterium
EPEYPR

SEQ ID NO: 468592 - protein, 5 aa, Mycobacterium
EPEYR

SEQ ID NO: 468593 - protein, 20 aa, Mycobacterium
EPEYSNDDPDHVPAPSDTYH

SEQ ID NO: 468594 - protein, 4 aa, Mycobacterium
EPFA

SEQ ID NO: 468595 - protein, 13 aa, Mycobacterium
EPFAASAPTIGAP

SEQ ID NO: 468596 - protein, 34 aa, Mycobacterium
EPFAQGDSAFPDDAGDADETDENGEAADSAQQGW

SEQ ID NO: 468597 - protein, 11 aa, Mycobacterium
EPFDEPARTAI

SEQ ID NO: 468598 - protein, 6 aa, Mycobacterium
EPFDGP

SEQ ID NO: 468599 - protein, 9 aa, Mycobacterium
EPFGPNPHA

SEQ ID NO: 468600 - protein, 12 aa, Mycobacterium
EPFHPANREKRK

SEQ ID NO: 468601 - protein, 4 aa, Mycobacterium
EPFP

SEQ ID NO: 468602 - protein, 5 aa, Mycobacterium
EPFPM

SEQ ID NO: 468603 - protein, 4 aa, Mycobacterium
EPFR

SEQ ID NO: 468604 - protein, 19 aa, Mycobacterium
EPFRNGGDTGEMTWLNRGV

SEQ ID NO: 468605 - protein, 7 aa, Mycobacterium
EPFSEDN

SEQ ID NO: 468606 - protein, 32 aa, Mycobacterium
EPFSEPAHTASRSGLAGQTAAVAQAASTAMGG

SEQ ID NO: 468607 - protein, 4 aa, Mycobacterium
EPFT

SEQ ID NO: 468608 - protein, 8 aa, Mycobacterium
EPFTAQAR

SEQ ID NO: 468609 - protein, 6 aa, Mycobacterium
EPFTDS

SEQ ID NO: 468610 - protein, 6 aa, Mycobacterium
EPFTGG

SEQ ID NO: 468611 - protein, 18 aa, Mycobacterium
EPFTGGDPIEEEDTVPRQ

SEQ ID NO: 468612 - protein, 18 aa, Mycobacterium
EPFTGGEPLDEEDTRPRQ

SEQ ID NO: 468613 - protein, 6 aa, Mycobacterium
EPFTPE

SEQ ID NO: 468614 - protein, 7 aa, Mycobacterium
EPFTPED

SEQ ID NO: 468615 - protein, 7 aa, Mycobacterium
EPFTTPR

SEQ ID NO: 468616 - protein, 4 aa, Mycobacterium
EPGA

SEQ ID NO: 468617 - protein, 8 aa, Mycobacterium
EPGAAADV

SEQ ID NO: 468618 - protein, 8 aa, Mycobacterium
EPGAADTY

SEQ ID NO: 468619 - protein, 16 aa, Mycobacterium
EPGAAGPGGSRGRGDI

SEQ ID NO: 468620 - protein, 17 aa, Mycobacterium
EPGAAGPGGSRGRGDVS

SEQ ID NO: 468621 - protein, 15 aa, Mycobacterium
EPGAAITQGTVLAEI

SEQ ID NO: 468622 - protein, 8 aa, Mycobacterium
EPGAANAE

SEQ ID NO: 468623 - protein, 6 aa, Mycobacterium
EPGAAS

SEQ ID NO: 468624 - protein, 5 aa, Mycobacterium
EPGAD

SEQ ID NO: 468625 - protein, 9 aa, Mycobacterium
EPGAEPAEG

SEQ ID NO: 468626 - protein, 9 aa, Mycobacterium
EPGAGLDTS

SEQ ID NO: 468627 - protein, 71 aa, Mycobacterium
EPGAGQGDTPPSPTQQGADPKPTRDHPGTTHAGDVDPDTDPAGLDESLNAGDGDPAANPLAPAGTGAMPGM

SEQ ID NO: 468628 - protein, 13 aa, Mycobacterium
EPGAGSDAAALRT

SEQ ID NO: 468629 - protein, 18 aa, Mycobacterium
EPGAGSDAAAVATKATRV

SEQ ID NO: 468630 - protein, 22 aa, Mycobacterium
EPGAGSDAAAVRTSAKKVDGGW

SEQ ID NO: 468631 - protein, 21 aa, Mycobacterium
EPGAGSDASALRTKAVRSGDE

SEQ ID NO: 468632 - protein, 13 aa, Mycobacterium
EPGAGSDASALSA

SEQ ID NO: 468633 - protein, 25 aa, Mycobacterium
EPGAGSDASALSTRAVREGPGKNAD

SEQ ID NO: 468634 - protein, 21 aa, Mycobacterium
EPGAGSDLAAAATRAVRDPHR

SEQ ID NO: 468635 - protein, 21 aa, Mycobacterium
EPGAGSDLAALSTKATKVDGG

SEQ ID NO: 468636 - protein, 11 aa, Mycobacterium
EPGAGSDLAGI

SEQ ID NO: 468637 - protein, 11 aa, Mycobacterium
EPGAGSDLAGL

SEQ ID NO: 468638 - protein, 20 aa, Mycobacterium
EPGAGSDLAGLATSAVPDGD

SEQ ID NO: 468639 - protein, 14 aa, Mycobacterium
EPGAGSDLAGLSTK

SEQ ID NO: 468640 - protein, 19 aa, Mycobacterium
EPGAGSDLAGLSTKATRVD

SEQ ID NO: 468641 - protein, 20 aa, Mycobacterium
EPGAGSDLAGLTTKATRVDG

SEQ ID NO: 468642 - protein, 11 aa, Mycobacterium
EPGAGSDLAGV

SEQ ID NO: 468643 - protein, 22 aa, Mycobacterium
EPGAGSDLAGVRTRAERTTTGW

SEQ ID NO: 468644 - protein, 19 aa, Mycobacterium
EPGAGSDLAGVSTRAVRDG

SEQ ID NO: 468645 - protein, 13 aa, Mycobacterium
EPGAGSDLASLST

SEQ ID NO: 468646 - protein, 13 aa, Mycobacterium
EPGAGSDLASLTT

SEQ ID NO: 468647 - protein, 21 aa, Mycobacterium
EPGAGSDLASLTTRATKVDGG

SEQ ID NO: 468648 - protein, 11 aa, Mycobacterium
EPGAGSDLQGI

SEQ ID NO: 468649 - protein, 6 aa, Mycobacterium
EPGAIQ

SEQ ID NO: 468650 - protein, 7 aa, Mycobacterium
EPGAQRR

SEQ ID NO: 468651 - protein, 11 aa, Mycobacterium
EPGASADKPGI

SEQ ID NO: 468652 - protein, 8 aa, Mycobacterium
EPGASEEQ

SEQ ID NO: 468653 - protein, 16 aa, Mycobacterium
EPGASELETAKAAEGL

SEQ ID NO: 468654 - protein, 6 aa, Mycobacterium
EPGASR

SEQ ID NO: 468655 - protein, 5 aa, Mycobacterium
EPGAT

SEQ ID NO: 468656 - protein, 14 aa, Mycobacterium
EPGATRRVTTEADP

SEQ ID NO: 468657 - protein, 8 aa, Mycobacterium
EPGATTAT

SEQ ID NO: 468658 - protein, 5 aa, Mycobacterium
EPGCG

SEQ ID NO: 468659 - protein, 7 aa, Mycobacterium
EPGDDGY

SEQ ID NO: 468660 - protein, 6 aa, Mycobacterium
EPGDNE

SEQ ID NO: 468661 - protein, 5 aa, Mycobacterium
EPGDP

SEQ ID NO: 468662 - protein, 6 aa, Mycobacterium
EPGDSP

SEQ ID NO: 468663 - protein, 8 aa, Mycobacterium
EPGDTNEV

SEQ ID NO: 468664 - protein, 5 aa, Mycobacterium
EPGDV

SEQ ID NO: 468665 - protein, 5 aa, Mycobacterium
EPGED

SEQ ID NO: 468666 - protein, 5 aa, Mycobacterium
EPGEF

SEQ ID NO: 468667 - protein, 12 aa, Mycobacterium
EPGEGRVAGETV

SEQ ID NO: 468668 - protein, 5 aa, Mycobacterium
EPGEH

SEQ ID NO: 468669 - protein, 10 aa, Mycobacterium
EPGENTPGVR

SEQ ID NO: 468670 - protein, 8 aa, Mycobacterium
EPGEQGGV

SEQ ID NO: 468671 - protein, 8 aa, Mycobacterium
EPGEQQEV

SEQ ID NO: 468672 - protein, 8 aa, Mycobacterium
EPGERIDR

SEQ ID NO: 468673 - protein, 8 aa, Mycobacterium
EPGEYGTD

SEQ ID NO: 468674 - protein, 5 aa, Mycobacterium
EPGFA

SEQ ID NO: 468675 - protein, 7 aa, Mycobacterium
EPGFATS

SEQ ID NO: 468676 - protein, 19 aa, Mycobacterium
EPGFGSDSAAVATTATLDG

SEQ ID NO: 468677 - protein, 14 aa, Mycobacterium
EPGFGSDSAAVSTT

SEQ ID NO: 468678 - protein, 19 aa, Mycobacterium
EPGFGSDSAAVSTTATLDG

SEQ ID NO: 468679 - protein, 23 aa, Mycobacterium
EPGFREADNRAATNLATAARDAG

SEQ ID NO: 468680 - protein, 7 aa, Mycobacterium
EPGGAAD

SEQ ID NO: 468681 - protein, 7 aa, Mycobacterium
EPGGALD

SEQ ID NO: 468682 - protein, 10 aa, Mycobacterium
EPGGDSDPQF

SEQ ID NO: 468683 - protein, 5 aa, Mycobacterium
EPGGH

SEQ ID NO: 468684 - protein, 14 aa, Mycobacterium
EPGGLGPSSPYGTP

SEQ ID NO: 468685 - protein, 6 aa, Mycobacterium
EPGGNY

SEQ ID NO: 468686 - protein, 9 aa, Mycobacterium
EPGGPAGSA

SEQ ID NO: 468687 - protein, 7 aa, Mycobacterium
EPGGQAP

SEQ ID NO: 468688 - protein, 5 aa, Mycobacterium
EPGGR

SEQ ID NO: 468689 - protein, 12 aa, Mycobacterium
EPGGRTPRLPEA

SEQ ID NO: 468690 - protein, 9 aa, Mycobacterium
EPGGTRTGF

SEQ ID NO: 468691 - protein, 4 aa, Mycobacterium
EPGH

SEQ ID NO: 468692 - protein, 10 aa, Mycobacterium
EPGHATSAQA

SEQ ID NO: 468693 - protein, 8 aa, Mycobacterium
EPGHGSDA

SEQ ID NO: 468694 - protein, 15 aa, Mycobacterium
EPGHGTGADLGSSAV

SEQ ID NO: 468695 - protein, 19 aa, Mycobacterium
EPGHRTPSADISTRAVRQG

SEQ ID NO: 468696 - protein, 5 aa, Mycobacterium
EPGHT

SEQ ID NO: 468697 - protein, 4 aa, Mycobacterium
EPGI

SEQ ID NO: 468698 - protein, 6 aa, Mycobacterium
EPGIGK

SEQ ID NO: 468699 - protein, 5 aa, Mycobacterium
EPGIR

SEQ ID NO: 468700 - protein, 5 aa, Mycobacterium
EPGKA

SEQ ID NO: 468701 - protein, 6 aa, Mycobacterium
EPGKAL

SEQ ID NO: 468702 - protein, 12 aa, Mycobacterium
EPGKAPELPKGS

SEQ ID NO: 468703 - protein, 23 aa, Mycobacterium
EPGKAVYRTEASGLAGSDGSEAR

SEQ ID NO: 468704 - protein, 5 aa, Mycobacterium
EPGLA

SEQ ID NO: 468705 - protein, 7 aa, Mycobacterium
EPGLGGQ

SEQ ID NO: 468706 - protein, 5 aa, Mycobacterium
EPGLK

SEQ ID NO: 468707 - protein, 11 aa, Mycobacterium
EPGLPNPVEPP

SEQ ID NO: 468708 - protein, 14 aa, Mycobacterium
EPGLQDEPPANTGR

SEQ ID NO: 468709 - protein, 22 aa, Mycobacterium
EPGLQGDRSSAGTKPATLETGA

SEQ ID NO: 468710 - protein, 22 aa, Mycobacterium
EPGLQGDRSSAGTKPATMETGA

SEQ ID NO: 468711 - protein, 6 aa, Mycobacterium
EPGLTA

SEQ ID NO: 468712 - protein, 4 aa, Mycobacterium
EPGN

SEQ ID NO: 468713 - protein, 4 aa, Mycobacterium
EPGP

SEQ ID NO: 468714 - protein, 7 aa, Mycobacterium
EPGPAAA

SEQ ID NO: 468715 - protein, 16 aa, Mycobacterium
EPGPADAELARDPATT

SEQ ID NO: 468716 - protein, 8 aa, Mycobacterium
EPGPDAAR

SEQ ID NO: 468717 - protein, 8 aa, Mycobacterium
EPGPDGRE

SEQ ID NO: 468718 - protein, 5 aa, Mycobacterium
EPGPE

SEQ ID NO: 468719 - protein, 8 aa, Mycobacterium
EPGPGSER

SEQ ID NO: 468720 - protein, 9 aa, Mycobacterium
EPGPPRPGY

SEQ ID NO: 468721 - protein, 11 aa, Mycobacterium
EPGPSAPQPLE

SEQ ID NO: 468722 - protein, 11 aa, Mycobacterium
EPGPSTESDVA

SEQ ID NO: 468723 - protein, 14 aa, Mycobacterium
EPGPSTSANNRRSG

SEQ ID NO: 468724 - protein, 10 aa, Mycobacterium
EPGPTDDEIE

SEQ ID NO: 468725 - protein, 11 aa, Mycobacterium
EPGQAGATRLR

SEQ ID NO: 468726 - protein, 6 aa, Mycobacterium
EPGQEK

SEQ ID NO: 468727 - protein, 7 aa, Mycobacterium
EPGQGGP

SEQ ID NO: 468728 - protein, 5 aa, Mycobacterium
EPGQH

SEQ ID NO: 468729 - protein, 9 aa, Mycobacterium
EPGQPTRAA

SEQ ID NO: 468730 - protein, 6 aa, Mycobacterium
EPGQPV

SEQ ID NO: 468731 - protein, 5 aa, Mycobacterium
EPGQR

SEQ ID NO: 468732 - protein, 5 aa, Mycobacterium
EPGQS

SEQ ID NO: 468733 - protein, 9 aa, Mycobacterium
EPGRAPLQA

SEQ ID NO: 468734 - protein, 21 aa, Mycobacterium
EPGREYAEDIETGSAAAALGG

SEQ ID NO: 468735 - protein, 5 aa, Mycobacterium
EPGRF

SEQ ID NO: 468736 - protein, 8 aa, Mycobacterium
EPGRGPRR

SEQ ID NO: 468737 - protein, 8 aa, Mycobacterium
EPGRGTTL

SEQ ID NO: 468738 - protein, 7 aa, Mycobacterium
EPGRPAI

SEQ ID NO: 468739 - protein, 19 aa, Mycobacterium
EPGRPATVTTQSLSGGRPL

SEQ ID NO: 468740 - protein, 17 aa, Mycobacterium
EPGRQKPGEDAEAEARL

SEQ ID NO: 468741 - protein, 6 aa, Mycobacterium
EPGRQV

SEQ ID NO: 468742 - protein, 15 aa, Mycobacterium
EPGRRSNGTARPGAR

SEQ ID NO: 468743 - protein, 8 aa, Mycobacterium
EPGRTESE

SEQ ID NO: 468744 - protein, 6 aa, Mycobacterium
EPGRTG

SEQ ID NO: 468745 - protein, 8 aa, Mycobacterium
EPGRVRPT

SEQ ID NO: 468746 - protein, 5 aa, Mycobacterium
EPGSA

SEQ ID NO: 468747 - protein, 6 aa, Mycobacterium
EPGSAL

SEQ ID NO: 468748 - protein, 8 aa, Mycobacterium
EPGSASGY

SEQ ID NO: 468749 - protein, 7 aa, Mycobacterium
EPGSDHD

SEQ ID NO: 468750 - protein, 16 aa, Mycobacterium
EPGSERHVPPGTSGEL

SEQ ID NO: 468751 - protein, 9 aa, Mycobacterium
EPGSGTRDT

SEQ ID NO: 468752 - protein, 17 aa, Mycobacterium
EPGSPESKSTDLTAGAD

SEQ ID NO: 468753 - protein, 6 aa, Mycobacterium
EPGSPM

SEQ ID NO: 468754 - protein, 7 aa, Mycobacterium
EPGSRGL

SEQ ID NO: 468755 - protein, 13 aa, Mycobacterium
EPGSRGLQVRGPD

SEQ ID NO: 468756 - protein, 19 aa, Mycobacterium
EPGSVRRRRKSPKKSSLPP

SEQ ID NO: 468757 - protein, 11 aa, Mycobacterium
EPGSVTLNTGN

SEQ ID NO: 468758 - protein, 6 aa, Mycobacterium
EPGTAG

SEQ ID NO: 468759 - protein, 9 aa, Mycobacterium
EPGTAPKAG

SEQ ID NO: 468760 - protein, 11 aa, Mycobacterium
EPGTDADGDSV

SEQ ID NO: 468761 - protein, 7 aa, Mycobacterium
EPGTDDQ

SEQ ID NO: 468762 - protein, 7 aa, Mycobacterium
EPGTDRE

SEQ ID NO: 468763 - protein, 7 aa, Mycobacterium
EPGTEIT

SEQ ID NO: 468764 - protein, 13 aa, Mycobacterium
EPGTIRSDVGPGT

SEQ ID NO: 468765 - protein, 8 aa, Mycobacterium
EPGTITPT

SEQ ID NO: 468766 - protein, 5 aa, Mycobacterium
EPGTM

SEQ ID NO: 468767 - protein, 7 aa, Mycobacterium
EPGTPGL

SEQ ID NO: 468768 - protein, 14 aa, Mycobacterium
EPGTPKGSIGRGAD

SEQ ID NO: 468769 - protein, 14 aa, Mycobacterium
EPGTPKGSIGRGAE

SEQ ID NO: 468770 - protein, 9 aa, Mycobacterium
EPGTPPERV

SEQ ID NO: 468771 - protein, 16 aa, Mycobacterium
EPGTPPGSIGKGAPGV

SEQ ID NO: 468772 - protein, 19 aa, Mycobacterium
EPGTPSEERLRELSSLVHS

SEQ ID NO: 468773 - protein, 10 aa, Mycobacterium
EPGTPTPQTR

SEQ ID NO: 468774 - protein, 11 aa, Mycobacterium
EPGTQSEYSNS

SEQ ID NO: 468775 - protein, 6 aa, Mycobacterium
EPGTTA

SEQ ID NO: 468776 - protein, 6 aa, Mycobacterium
EPGTVG

SEQ ID NO: 468777 - protein, 13 aa, Mycobacterium
EPGTVRTEVGPGT

SEQ ID NO: 468778 - protein, 7 aa, Mycobacterium
EPGTVVP

SEQ ID NO: 468779 - protein, 5 aa, Mycobacterium
EPGTY

SEQ ID NO: 468780 - protein, 4 aa, Mycobacterium
EPGV

SEQ ID NO: 468781 - protein, 20 aa, Mycobacterium
EPGVAPIPRQPSSSCDPNYS

SEQ ID NO: 468782 - protein, 17 aa, Mycobacterium
EPGVDTGWESDLFAGVE

SEQ ID NO: 468783 - protein, 6 aa, Mycobacterium
EPGVEG

SEQ ID NO: 468784 - protein, 8 aa, Mycobacterium
EPGVGKTR

SEQ ID NO: 468785 - protein, 11 aa, Mycobacterium
EPGVSLPDHPG

SEQ ID NO: 468786 - protein, 11 aa, Mycobacterium
EPGVSQTGSAP

SEQ ID NO: 468787 - protein, 11 aa, Mycobacterium
EPGVVTTTGEI

SEQ ID NO: 468788 - protein, 13 aa, Mycobacterium
EPGYATTDVIAAG

SEQ ID NO: 468789 - protein, 15 aa, Mycobacterium
EPGYGPGTQFTSNGV

SEQ ID NO: 468790 - protein, 17 aa, Mycobacterium
EPGYRQPGVSAVWHDNP

SEQ ID NO: 468791 - protein, 10 aa, Mycobacterium
EPHAGADPTM

SEQ ID NO: 468792 - protein, 11 aa, Mycobacterium
EPHAPDGVDYQ

SEQ ID NO: 468793 - protein, 11 aa, Mycobacterium
EPHAPYQRPPL

SEQ ID NO: 468794 - protein, 5 aa, Mycobacterium
EPHDG

SEQ ID NO: 468795 - protein, 9 aa, Mycobacterium
EPHDTDGEA

SEQ ID NO: 468796 - protein, 9 aa, Mycobacterium
EPHDTELRA

SEQ ID NO: 468797 - protein, 5 aa, Mycobacterium
EPHER

SEQ ID NO: 468798 - protein, 4 aa, Mycobacterium
EPHG

SEQ ID NO: 468799 - protein, 21 aa, Mycobacterium
EPHGAAETAGAEEGVDSNGAP

SEQ ID NO: 468800 - protein, 7 aa, Mycobacterium
EPHGASH

SEQ ID NO: 468801 - protein, 12 aa, Mycobacterium
EPHGDKSRPALE

SEQ ID NO: 468802 - protein, 14 aa, Mycobacterium
EPHGEMTTNEPAKR

SEQ ID NO: 468803 - protein, 11 aa, Mycobacterium
EPHGPLAHDPA

SEQ ID NO: 468804 - protein, 8 aa, Mycobacterium
EPHKTPKT

SEQ ID NO: 468805 - protein, 28 aa, Mycobacterium
EPHNGRYDDISPSTGATIATAPDASVGQ

SEQ ID NO: 468806 - protein, 8 aa, Mycobacterium
EPHPAAPD

SEQ ID NO: 468807 - protein, 6 aa, Mycobacterium
EPHPLT

SEQ ID NO: 468808 - protein, 14 aa, Mycobacterium
EPHPRGGWQQARTE

SEQ ID NO: 468809 - protein, 7 aa, Mycobacterium
EPHPTRE

SEQ ID NO: 468810 - protein, 5 aa, Mycobacterium
EPHRA

SEQ ID NO: 468811 - protein, 38 aa, Mycobacterium
EPHRESEGDPLDGDPATKTQDEKSDLDKGFTSLGADAE

SEQ ID NO: 468812 - protein, 30 aa, Mycobacterium
EPHRPAEDPLDGDPAVRTQTEKADTDTGFT

SEQ ID NO: 468813 - protein, 8 aa, Mycobacterium
EPHRPAER

SEQ ID NO: 468814 - protein, 4 aa, Mycobacterium
EPHS

SEQ ID NO: 468815 - protein, 14 aa, Mycobacterium
EPHSIPRPRSAHKS

SEQ ID NO: 468816 - protein, 13 aa, Mycobacterium
EPHTDGSDRTRDR

SEQ ID NO: 468817 - protein, 8 aa, Mycobacterium
EPHTSGSV

SEQ ID NO: 468818 - protein, 4 aa, Mycobacterium
EPHV

SEQ ID NO: 468819 - protein, 9 aa, Mycobacterium
EPIASDQPF

SEQ ID NO: 468820 - protein, 5 aa, Mycobacterium
EPIDE

SEQ ID NO: 468821 - protein, 5 aa, Mycobacterium
EPIDP

SEQ ID NO: 468822 - protein, 16 aa, Mycobacterium
EPIDPERLDSTGWTNG

SEQ ID NO: 468823 - protein, 8 aa, Mycobacterium
EPIEGQPL

SEQ ID NO: 468824 - protein, 5 aa, Mycobacterium
EPIEP

SEQ ID NO: 468825 - protein, 7 aa, Mycobacterium
EPIEPEY

SEQ ID NO: 468826 - protein, 4 aa, Mycobacterium
EPIG

SEQ ID NO: 468827 - protein, 19 aa, Mycobacterium
EPIGAQADRARRGARGVRG

SEQ ID NO: 468828 - protein, 10 aa, Mycobacterium
EPIGPDNPHG

SEQ ID NO: 468829 - protein, 17 aa, Mycobacterium
EPIGRAPDFGGPQARTL

SEQ ID NO: 468830 - protein, 5 aa, Mycobacterium
EPIGS

SEQ ID NO: 468831 - protein, 8 aa, Mycobacterium
EPIGTDGD

SEQ ID NO: 468832 - protein, 5 aa, Mycobacterium
EPIPD

SEQ ID NO: 468833 - protein, 5 aa, Mycobacterium
EPIPG

SEQ ID NO: 468834 - protein, 6 aa, Mycobacterium
EPIPNS

SEQ ID NO: 468835 - protein, 22 aa, Mycobacterium
EPIPSDRPDEDSPTHKAYRDAR

SEQ ID NO: 468836 - protein, 14 aa, Mycobacterium
EPIPVGPDGSLPAD

SEQ ID NO: 468837 - protein, 11 aa, Mycobacterium
EPIPVGTEGGT

SEQ ID NO: 468838 - protein, 4 aa, Mycobacterium
EPIR

SEQ ID NO: 468839 - protein, 14 aa, Mycobacterium
EPIRAQSSSEVQTT

SEQ ID NO: 468840 - protein, 18 aa, Mycobacterium
EPISADDIAADDDDAVND

SEQ ID NO: 468841 - protein, 6 aa, Mycobacterium
EPISPA

SEQ ID NO: 468842 - protein, 6 aa, Mycobacterium
EPISSA

SEQ ID NO: 468843 - protein, 6 aa, Mycobacterium
EPITAA

SEQ ID NO: 468844 - protein, 7 aa, Mycobacterium
EPITASD

SEQ ID NO: 468845 - protein, 5 aa, Mycobacterium
EPITP

SEQ ID NO: 468846 - protein, 10 aa, Mycobacterium
EPKAEPENPY

SEQ ID NO: 468847 - protein, 9 aa, Mycobacterium
EPKATPTQI

SEQ ID NO: 468848 - protein, 15 aa, Mycobacterium
EPKDDAVPPPDDSTS

SEQ ID NO: 468849 - protein, 4 aa, Mycobacterium
EPKE

SEQ ID NO: 468850 - protein, 6 aa, Mycobacterium
EPKEGE

SEQ ID NO: 468851 - protein, 8 aa, Mycobacterium
EPKFDDDD

SEQ ID NO: 468852 - protein, 8 aa, Mycobacterium
EPKGRRYY

SEQ ID NO: 468853 - protein, 8 aa, Mycobacterium
EPKHGSDA

SEQ ID NO: 468854 - protein, 5 aa, Mycobacterium
EPKKE

SEQ ID NO: 468855 - protein, 20 aa, Mycobacterium
EPKKQNAADHIPTRKRGIAD

SEQ ID NO: 468856 - protein, 7 aa, Mycobacterium
EPKLDAA

SEQ ID NO: 468857 - protein, 5 aa, Mycobacterium
EPKLR

SEQ ID NO: 468858 - protein, 4 aa, Mycobacterium
EPKM

SEQ ID NO: 468859 - protein, 17 aa, Mycobacterium
EPKNHWGTGDSAAKRYQ

SEQ ID NO: 468860 - protein, 20 aa, Mycobacterium
EPKNSKSRSLRTHSQTSGWS

SEQ ID NO: 468861 - protein, 8 aa, Mycobacterium
EPKPDWKN

SEQ ID NO: 468862 - protein, 9 aa, Mycobacterium
EPKPKGFGF

SEQ ID NO: 468863 - protein, 9 aa, Mycobacterium
EPKPLPTAQ

SEQ ID NO: 468864 - protein, 5 aa, Mycobacterium
EPKPP

SEQ ID NO: 468865 - protein, 10 aa, Mycobacterium
EPKPPGAPQY

SEQ ID NO: 468866 - protein, 9 aa, Mycobacterium
EPKPSWGHP

SEQ ID NO: 468867 - protein, 8 aa, Mycobacterium
EPKPVQKP

SEQ ID NO: 468868 - protein, 7 aa, Mycobacterium
EPKPVQR

SEQ ID NO: 468869 - protein, 8 aa, Mycobacterium
EPKQRDSV

SEQ ID NO: 468870 - protein, 7 aa, Mycobacterium
EPKRGPF

SEQ ID NO: 468871 - protein, 11 aa, Mycobacterium
EPKRGSSPAGR

SEQ ID NO: 468872 - protein, 16 aa, Mycobacterium
EPKRRGRQAAAAPPLR

SEQ ID NO: 468873 - protein, 17 aa, Mycobacterium
EPKRRGRQAASAPPLRE

SEQ ID NO: 468874 - protein, 17 aa, Mycobacterium
EPKRRGRQGAAAPPLRE

SEQ ID NO: 468875 - protein, 16 aa, Mycobacterium
EPKRRGRQGAATPPLR

SEQ ID NO: 468876 - protein, 17 aa, Mycobacterium
EPKRSGRQSASAPPLRE

SEQ ID NO: 468877 - protein, 11 aa, Mycobacterium
EPKRSGYDPQK

SEQ ID NO: 468878 - protein, 6 aa, Mycobacterium
EPKSGP

SEQ ID NO: 468879 - protein, 10 aa, Mycobacterium
EPKSLDASPY

SEQ ID NO: 468880 - protein, 13 aa, Mycobacterium
EPKSTPDVATQGA

SEQ ID NO: 468881 - protein, 5 aa, Mycobacterium
EPKTD

SEQ ID NO: 468882 - protein, 6 aa, Mycobacterium
EPKTEK

SEQ ID NO: 468883 - protein, 13 aa, Mycobacterium
EPKTKTDQEKLGT

SEQ ID NO: 468884 - protein, 4 aa, Mycobacterium
EPLA

SEQ ID NO: 468885 - protein, 12 aa, Mycobacterium
EPLADDTASQAR

SEQ ID NO: 468886 - protein, 5 aa, Mycobacterium
EPLAP

SEQ ID NO: 468887 - protein, 5 aa, Mycobacterium
EPLAS

SEQ ID NO: 468888 - protein, 6 aa, Mycobacterium
EPLASG

SEQ ID NO: 468889 - protein, 6 aa, Mycobacterium
EPLCGG

SEQ ID NO: 468890 - protein, 6 aa, Mycobacterium
EPLDDD

SEQ ID NO: 468891 - protein, 20 aa, Mycobacterium
EPLDDGPVLPREDRIAQVLA

SEQ ID NO: 468892 - protein, 22 aa, Mycobacterium
EPLDDGPVLPREERVQQVLAHA

SEQ ID NO: 468893 - protein, 20 aa, Mycobacterium
EPLDETSSRGQYTAGWQGGE

SEQ ID NO: 468894 - protein, 13 aa, Mycobacterium
EPLDETTARGQYA

SEQ ID NO: 468895 - protein, 20 aa, Mycobacterium
EPLDETTSRGQYTAGWQGGE

SEQ ID NO: 468896 - protein, 5 aa, Mycobacterium
EPLDG

SEQ ID NO: 468897 - protein, 8 aa, Mycobacterium
EPLDGPWA

SEQ ID NO: 468898 - protein, 5 aa, Mycobacterium
EPLDP

SEQ ID NO: 468899 - protein, 6 aa, Mycobacterium
EPLDRD

SEQ ID NO: 468900 - protein, 22 aa, Mycobacterium
EPLDSVPADARSTVFEPDPIRA

SEQ ID NO: 468901 - protein, 8 aa, Mycobacterium
EPLDTDAL

SEQ ID NO: 468902 - protein, 5 aa, Mycobacterium
EPLEE

SEQ ID NO: 468903 - protein, 9 aa, Mycobacterium
EPLEGQPLD

SEQ ID NO: 468904 - protein, 8 aa, Mycobacterium
EPLGAATG

SEQ ID NO: 468905 - protein, 13 aa, Mycobacterium
EPLGARRADVERG

SEQ ID NO: 468906 - protein, 10 aa, Mycobacterium
EPLGDDERGV

SEQ ID NO: 468907 - protein, 6 aa, Mycobacterium
EPLGDP

SEQ ID NO: 468908 - protein, 16 aa, Mycobacterium
EPLGGTGQLESTVSDE

SEQ ID NO: 468909 - protein, 11 aa, Mycobacterium
EPLGRRGQEGL

SEQ ID NO: 468910 - protein, 5 aa, Mycobacterium
EPLGT

SEQ ID NO: 468911 - protein, 8 aa, Mycobacterium
EPLGTGGA

SEQ ID NO: 468912 - protein, 14 aa, Mycobacterium
EPLGTQSSSEARIA

SEQ ID NO: 468913 - protein, 14 aa, Mycobacterium
EPLGTSVSAGGMPD

SEQ ID NO: 468914 - protein, 11 aa, Mycobacterium
EPLKSTQSEIE

SEQ ID NO: 468915 - protein, 6 aa, Mycobacterium
EPLPAD

SEQ ID NO: 468916 - protein, 5 aa, Mycobacterium
EPLPD

SEQ ID NO: 468917 - protein, 14 aa, Mycobacterium
EPLPDEELETSTRR

SEQ ID NO: 468918 - protein, 8 aa, Mycobacterium
EPLPEAEP

SEQ ID NO: 468919 - protein, 12 aa, Mycobacterium
EPLPEAEPTAPQ

SEQ ID NO: 468920 - protein, 6 aa, Mycobacterium
EPLPED

SEQ ID NO: 468921 - protein, 7 aa, Mycobacterium
EPLPESV

SEQ ID NO: 468922 - protein, 9 aa, Mycobacterium
EPLPGDPPY

SEQ ID NO: 468923 - protein, 8 aa, Mycobacterium
EPLPGQPL

SEQ ID NO: 468924 - protein, 10 aa, Mycobacterium
EPLPPAHGGP

SEQ ID NO: 468925 - protein, 11 aa, Mycobacterium
EPLPPHPGTGY

SEQ ID NO: 468926 - protein, 22 aa, Mycobacterium
EPLPPPGEEGTIEPRRQRTGDA

SEQ ID NO: 468927 - protein, 11 aa, Mycobacterium
EPLPRADPEAP

SEQ ID NO: 468928 - protein, 6 aa, Mycobacterium
EPLPSD

SEQ ID NO: 468929 - protein, 12 aa, Mycobacterium
EPLPSQPPHTFN

SEQ ID NO: 468930 - protein, 8 aa, Mycobacterium
EPLPTTRR

SEQ ID NO: 468931 - protein, 6 aa, Mycobacterium
EPLPVK

SEQ ID NO: 468932 - protein, 4 aa, Mycobacterium
EPLQ

SEQ ID NO: 468933 - protein, 5 aa, Mycobacterium
EPLQP

SEQ ID NO: 468934 - protein, 8 aa, Mycobacterium
EPLRPSTA

SEQ ID NO: 468935 - protein, 5 aa, Mycobacterium
EPLRQ

SEQ ID NO: 468936 - protein, 10 aa, Mycobacterium
EPLRSEDRSR

SEQ ID NO: 468937 - protein, 8 aa, Mycobacterium
EPLSENEQ

SEQ ID NO: 468938 - protein, 25 aa, Mycobacterium
EPLSERTLADRRNAAAEAARRLVGI

SEQ ID NO: 468939 - protein, 7 aa, Mycobacterium
EPLSSMP

SEQ ID NO: 468940 - protein, 9 aa, Mycobacterium
EPLTADTEA

SEQ ID NO: 468941 - protein, 10 aa, Mycobacterium
EPLTAESVES

SEQ ID NO: 468942 - protein, 12 aa, Mycobacterium
EPLTEGTVTSAE

SEQ ID NO: 468943 - protein, 7 aa, Mycobacterium
EPLTGEQ

SEQ ID NO: 468944 - protein, 6 aa, Mycobacterium
EPLTGG

SEQ ID NO: 468945 - protein, 8 aa, Mycobacterium
EPLTGGSQ

SEQ ID NO: 468946 - protein, 12 aa, Mycobacterium
EPLTGGTELRPI

SEQ ID NO: 468947 - protein, 13 aa, Mycobacterium
EPLTGGTELRPVS

SEQ ID NO: 468948 - protein, 7 aa, Mycobacterium
EPLTPEQ

SEQ ID NO: 468949 - protein, 13 aa, Mycobacterium
EPLTPGGFRAPNT

SEQ ID NO: 468950 - protein, 14 aa, Mycobacterium
EPLTPGGFRAPNTN

SEQ ID NO: 468951 - protein, 10 aa, Mycobacterium
EPLTPKREDR

SEQ ID NO: 468952 - protein, 6 aa, Mycobacterium
EPLTQD

SEQ ID NO: 468953 - protein, 4 aa, Mycobacterium
EPMA

SEQ ID NO: 468954 - protein, 13 aa, Mycobacterium
EPMAATPGVGDRF

SEQ ID NO: 468955 - protein, 5 aa, Mycobacterium
EPMAG

SEQ ID NO: 468956 - protein, 7 aa, Mycobacterium
EPMDGDP

SEQ ID NO: 468957 - protein, 9 aa, Mycobacterium
EPMGEPGSR

SEQ ID NO: 468958 - protein, 6 aa, Mycobacterium
EPMPDE

SEQ ID NO: 468959 - protein, 14 aa, Mycobacterium
EPMPESAAARLRTS

SEQ ID NO: 468960 - protein, 14 aa, Mycobacterium
EPMPESAAARVKST

SEQ ID NO: 468961 - protein, 14 aa, Mycobacterium
EPMPESAAARVNAG

SEQ ID NO: 468962 - protein, 5 aa, Mycobacterium
EPMPQ

SEQ ID NO: 468963 - protein, 4 aa, Mycobacterium
EPMS

SEQ ID NO: 468964 - protein, 7 aa, Mycobacterium
EPMSPLA

SEQ ID NO: 468965 - protein, 6 aa, Mycobacterium
EPMTAS

SEQ ID NO: 468966 - protein, 6 aa, Mycobacterium
EPMTGA

SEQ ID NO: 468967 - protein, 15 aa, Mycobacterium
EPMTGAELAIALEKL

SEQ ID NO: 468968 - protein, 15 aa, Mycobacterium
EPMTGAELASALENL

SEQ ID NO: 468969 - protein, 15 aa, Mycobacterium
EPMTGAELATTLEKL

SEQ ID NO: 468970 - protein, 4 aa, Mycobacterium
EPNA

SEQ ID NO: 468971 - protein, 8 aa, Mycobacterium
EPNAAAAA

SEQ ID NO: 468972 - protein, 9 aa, Mycobacterium
EPNADGSTL

SEQ ID NO: 468973 - protein, 6 aa, Mycobacterium
EPNECE

SEQ ID NO: 468974 - protein, 7 aa, Mycobacterium
EPNEGHR

SEQ ID NO: 468975 - protein, 13 aa, Mycobacterium
EPNEIDEGEHAGV

SEQ ID NO: 468976 - protein, 10 aa, Mycobacterium
EPNENGQRPD

SEQ ID NO: 468977 - protein, 6 aa, Mycobacterium
EPNGAF

SEQ ID NO: 468978 - protein, 20 aa, Mycobacterium
EPNGEGTRVTESRHAENGVS

SEQ ID NO: 468979 - protein, 7 aa, Mycobacterium
EPNGPTH

SEQ ID NO: 468980 - protein, 8 aa, Mycobacterium
EPNHGSDA

SEQ ID NO: 468981 - protein, 8 aa, Mycobacterium
EPNHPQSE

SEQ ID NO: 468982 - protein, 7 aa, Mycobacterium
EPNLNPG

SEQ ID NO: 468983 - protein, 15 aa, Mycobacterium
EPNNPFATESGVADS

SEQ ID NO: 468984 - protein, 5 aa, Mycobacterium
EPNNV

SEQ ID NO: 468985 - protein, 9 aa, Mycobacterium
EPNPGGRRP

SEQ ID NO: 468986 - protein, 13 aa, Mycobacterium
EPNPGWTRTYSGS

SEQ ID NO: 468987 - protein, 10 aa, Mycobacterium
EPNPRFGPVG

SEQ ID NO: 468988 - protein, 8 aa, Mycobacterium
EPNPRSVS

SEQ ID NO: 468989 - protein, 4 aa, Mycobacterium
EPNQ

SEQ ID NO: 468990 - protein, 4 aa, Mycobacterium
EPNR

SEQ ID NO: 468991 - protein, 6 aa, Mycobacterium
EPNRRG

SEQ ID NO: 468992 - protein, 22 aa, Mycobacterium
EPNTDGDAGTGTTLTSPLTPQQ

SEQ ID NO: 468993 - protein, 7 aa, Mycobacterium
EPNTDLA

SEQ ID NO: 468994 - protein, 8 aa, Mycobacterium
EPNTDRPV

SEQ ID NO: 468995 - protein, 7 aa, Mycobacterium
EPNTELA

SEQ ID NO: 468996 - protein, 12 aa, Mycobacterium
EPNTSDSGTELA

SEQ ID NO: 468997 - protein, 9 aa, Mycobacterium
EPPAAAAAK

SEQ ID NO: 468998 - protein, 14 aa, Mycobacterium
EPPAARHSAETGDH

SEQ ID NO: 468999 - protein, 16 aa, Mycobacterium
EPPAATGEHNETLLGE

SEQ ID NO: 469000 - protein, 6 aa, Mycobacterium
EPPAAV

SEQ ID NO: 469001 - protein, 21 aa, Mycobacterium
EPPAEPETPEAVAAQTDDSRP

SEQ ID NO: 469002 - protein, 5 aa, Mycobacterium
EPPAG

SEQ ID NO: 469003 - protein, 6 aa, Mycobacterium
EPPAGA

SEQ ID NO: 469004 - protein, 8 aa, Mycobacterium
EPPAGEIG

SEQ ID NO: 469005 - protein, 6 aa, Mycobacterium
EPPAGL

SEQ ID NO: 469006 - protein, 7 aa, Mycobacterium
EPPAGSD

SEQ ID NO: 469007 - protein, 16 aa, Mycobacterium
EPPAGSGLKAVRGDNG

SEQ ID NO: 469008 - protein, 16 aa, Mycobacterium
EPPAGSGLKPVTGDAG

SEQ ID NO: 469009 - protein, 10 aa, Mycobacterium
EPPAHDGDGV

SEQ ID NO: 469010 - protein, 22 aa, Mycobacterium
EPPAPPGLGDGDPDRRASGSAT

SEQ ID NO: 469011 - protein, 16 aa, Mycobacterium
EPPAPSGLTDDPERRA

SEQ ID NO: 469012 - protein, 14 aa, Mycobacterium
EPPAPVQTEAPARD

SEQ ID NO: 469013 - protein, 8 aa, Mycobacterium
EPPATAAE

SEQ ID NO: 469014 - protein, 8 aa, Mycobacterium
EPPATAQE

SEQ ID NO: 469015 - protein, 6 aa, Mycobacterium
EPPATE

SEQ ID NO: 469016 - protein, 8 aa, Mycobacterium
EPPATNPA

SEQ ID NO: 469017 - protein, 18 aa, Mycobacterium
EPPATSAASPVAVPERGT

SEQ ID NO: 469018 - protein, 18 aa, Mycobacterium
EPPAVDPRSGKFRQVWSA

SEQ ID NO: 469019 - protein, 9 aa, Mycobacterium
EPPDAATAA

SEQ ID NO: 469020 - protein, 8 aa, Mycobacterium
EPPDFQDP

SEQ ID NO: 469021 - protein, 12 aa, Mycobacterium
EPPDGEISRSVG

SEQ ID NO: 469022 - protein, 5 aa, Mycobacterium
EPPDH

SEQ ID NO: 469023 - protein, 13 aa, Mycobacterium
EPPDHDAPASTDR

SEQ ID NO: 469024 - protein, 5 aa, Mycobacterium
EPPDI

SEQ ID NO: 469025 - protein, 6 aa, Mycobacterium
EPPDID

SEQ ID NO: 469026 - protein, 8 aa, Mycobacterium
EPPDPDGK

SEQ ID NO: 469027 - protein, 7 aa, Mycobacterium
EPPDPFR

SEQ ID NO: 469028 - protein, 5 aa, Mycobacterium
EPPEA

SEQ ID NO: 469029 - protein, 6 aa, Mycobacterium
EPPEAM

SEQ ID NO: 469030 - protein, 6 aa, Mycobacterium
EPPEAV

SEQ ID NO: 469031 - protein, 8 aa, Mycobacterium
EPPEDAGP

SEQ ID NO: 469032 - protein, 9 aa, Mycobacterium
EPPEDQRPM

SEQ ID NO: 469033 - protein, 7 aa, Mycobacterium
EPPEEQD

SEQ ID NO: 469034 - protein, 9 aa, Mycobacterium
EPPEGAGPD

SEQ ID NO: 469035 - protein, 8 aa, Mycobacterium
EPPEGAGR

SEQ ID NO: 469036 - protein, 11 aa, Mycobacterium
EPPEGDPLRSW

SEQ ID NO: 469037 - protein, 8 aa, Mycobacterium
EPPEGMPK

SEQ ID NO: 469038 - protein, 5 aa, Mycobacterium
EPPET

SEQ ID NO: 469039 - protein, 13 aa, Mycobacterium
EPPEVESDASQRS

SEQ ID NO: 469040 - protein, 4 aa, Mycobacterium
EPPF

SEQ ID NO: 469041 - protein, 22 aa, Mycobacterium
EPPFEGADPVGPAPVQDGGPPV

SEQ ID NO: 469042 - protein, 4 aa, Mycobacterium
EPPG

SEQ ID NO: 469043 - protein, 11 aa, Mycobacterium
EPPGDLSGKRY

SEQ ID NO: 469044 - protein, 11 aa, Mycobacterium
EPPGGEISRQV

SEQ ID NO: 469045 - protein, 12 aa, Mycobacterium
EPPGGEISRQVG

SEQ ID NO: 469046 - protein, 11 aa, Mycobacterium
EPPGGEISRTV

SEQ ID NO: 469047 - protein, 14 aa, Mycobacterium
EPPGGKFSSTASGL

SEQ ID NO: 469048 - protein, 14 aa, Mycobacterium
EPPGGKLSSTASGL

SEQ ID NO: 469049 - protein, 16 aa, Mycobacterium
EPPGGKVSTAASGLYG

SEQ ID NO: 469050 - protein, 14 aa, Mycobacterium
EPPGGKVSTTASGL

SEQ ID NO: 469051 - protein, 7 aa, Mycobacterium
EPPGGPA

SEQ ID NO: 469052 - protein, 9 aa, Mycobacterium
EPPGGPALG

SEQ ID NO: 469053 - protein, 7 aa, Mycobacterium
EPPGNTD

SEQ ID NO: 469054 - protein, 6 aa, Mycobacterium
EPPGPH

SEQ ID NO: 469055 - protein, 7 aa, Mycobacterium
EPPGSDH

SEQ ID NO: 469056 - protein, 7 aa, Mycobacterium
EPPGTDI

SEQ ID NO: 469057 - protein, 16 aa, Mycobacterium
EPPHAPLTPPGPLPPR

SEQ ID NO: 469058 - protein, 6 aa, Mycobacterium
EPPHGR

SEQ ID NO: 469059 - protein, 5 aa, Mycobacterium
EPPID

SEQ ID NO: 469060 - protein, 7 aa, Mycobacterium
EPPIGGA

SEQ ID NO: 469061 - protein, 6 aa, Mycobacterium
EPPKSI

SEQ ID NO: 469062 - protein, 11 aa, Mycobacterium
EPPKTQPRDGR

SEQ ID NO: 469063 - protein, 5 aa, Mycobacterium
EPPKV

SEQ ID NO: 469064 - protein, 6 aa, Mycobacterium
EPPKVS

SEQ ID NO: 469065 - protein, 4 aa, Mycobacterium
EPPL

SEQ ID NO: 469066 - protein, 19 aa, Mycobacterium
EPPLNDEKTVRGNVEEGLG

SEQ ID NO: 469067 - protein, 18 aa, Mycobacterium
EPPLNEEKTVRGNVEEGL

SEQ ID NO: 469068 - protein, 15 aa, Mycobacterium
EPPLPQPDRGFSPDG

SEQ ID NO: 469069 - protein, 6 aa, Mycobacterium
EPPLSA

SEQ ID NO: 469070 - protein, 32 aa, Mycobacterium
EPPPDKRRDRDRDRDDRGDRGPRKERPPREGL

SEQ ID NO: 469071 - protein, 7 aa, Mycobacterium
EPPPEIA

SEQ ID NO: 469072 - protein, 27 aa, Mycobacterium
EPPPEKRRERPERGDASPRKPRERRSD

SEQ ID NO: 469073 - protein, 12 aa, Mycobacterium
EPPPGAAGAVSR

SEQ ID NO: 469074 - protein, 10 aa, Mycobacterium
EPPPGAGRGF

SEQ ID NO: 469075 - protein, 8 aa, Mycobacterium
EPPPGASI

SEQ ID NO: 469076 - protein, 13 aa, Mycobacterium
EPPPNPLDTATAG

SEQ ID NO: 469077 - protein, 9 aa, Mycobacterium
EPPPPEEAK

SEQ ID NO: 469078 - protein, 18 aa, Mycobacterium
EPPPPQPAFTPAPSDWSP

SEQ ID NO: 469079 - protein, 17 aa, Mycobacterium
EPPPSLTKAQGRREAPV

SEQ ID NO: 469080 - protein, 23 aa, Mycobacterium
EPPPSLTKARRDAPAEHKHNPDE

SEQ ID NO: 469081 - protein, 5 aa, Mycobacterium
EPPPV

SEQ ID NO: 469082 - protein, 5 aa, Mycobacterium
EPPPW

SEQ ID NO: 469083 - protein, 18 aa, Mycobacterium
EPPQAARPRPVPKAIHMA

SEQ ID NO: 469084 - protein, 9 aa, Mycobacterium
EPPQGAGPE

SEQ ID NO: 469085 - protein, 9 aa, Mycobacterium
EPPQGDDTR

SEQ ID NO: 469086 - protein, 12 aa, Mycobacterium
EPPQGGSPGGCR

SEQ ID NO: 469087 - protein, 6 aa, Mycobacterium
EPPQNQ

SEQ ID NO: 469088 - protein, 5 aa, Mycobacterium
EPPQR

SEQ ID NO: 469089 - protein, 8 aa, Mycobacterium
EPPQRLAE

SEQ ID NO: 469090 - protein, 5 aa, Mycobacterium
EPPRL

SEQ ID NO: 469091 - protein, 20 aa, Mycobacterium
EPPRRPEPDRPSGPAAQRSA

SEQ ID NO: 469092 - protein, 33 aa, Mycobacterium
EPPRTTNADGQPGQAAAVAQATNGSAASQSHAA

SEQ ID NO: 469093 - protein, 4 aa, Mycobacterium
EPPS

SEQ ID NO: 469094 - protein, 5 aa, Mycobacterium
EPPSE

SEQ ID NO: 469095 - protein, 7 aa, Mycobacterium
EPPSGAF

SEQ ID NO: 469096 - protein, 21 aa, Mycobacterium
EPPSPTRPGRASALTDSSTRD

SEQ ID NO: 469097 - protein, 8 aa, Mycobacterium
EPPSSGLP

SEQ ID NO: 469098 - protein, 8 aa, Mycobacterium
EPPSTSSA

SEQ ID NO: 469099 - protein, 8 aa, Mycobacterium
EPPTERPV

SEQ ID NO: 469100 - protein, 8 aa, Mycobacterium
EPPTGDPA

SEQ ID NO: 469101 - protein, 9 aa, Mycobacterium
EPPTGDPGR

SEQ ID NO: 469102 - protein, 20 aa, Mycobacterium
EPPTHKINGASHAHSTRQTT

SEQ ID NO: 469103 - protein, 19 aa, Mycobacterium
EPPTPAPARDQAPAEPGMA

SEQ ID NO: 469104 - protein, 6 aa, Mycobacterium
EPPVHR

SEQ ID NO: 469105 - protein, 13 aa, Mycobacterium
EPPVTADQCASGV

SEQ ID NO: 469106 - protein, 10 aa, Mycobacterium
EPPVTAPRAR

SEQ ID NO: 469107 - protein, 7 aa, Mycobacterium
EPPYRQG

SEQ ID NO: 469108 - protein, 5 aa, Mycobacterium
EPPYT

SEQ ID NO: 469109 - protein, 27 aa, Mycobacterium
EPQADRDRAVAPATANTAKRVSRGTAQ

SEQ ID NO: 469110 - protein, 9 aa, Mycobacterium
EPQAGDPGR

SEQ ID NO: 469111 - protein, 53 aa, Mycobacterium
EPQAGLGERQRKQRRALAGHQSSGAAGAGLDPERQLRDRGGLEHGSDGQPGVQ

SEQ ID NO: 469112 - protein, 8 aa, Mycobacterium
EPQAGQAA

SEQ ID NO: 469113 - protein, 5 aa, Mycobacterium
EPQAL

SEQ ID NO: 469114 - protein, 38 aa, Mycobacterium
EPQDAASVPTHTNGATVSVGGDDGGIADDDVDVPPFMR

SEQ ID NO: 469115 - protein, 16 aa, Mycobacterium
EPQDGRYDDISPSTED

SEQ ID NO: 469116 - protein, 4 aa, Mycobacterium
EPQE

SEQ ID NO: 469117 - protein, 6 aa, Mycobacterium
EPQEDW

SEQ ID NO: 469118 - protein, 7 aa, Mycobacterium
EPQERGN

SEQ ID NO: 469119 - protein, 5 aa, Mycobacterium
EPQFA

SEQ ID NO: 469120 - protein, 15 aa, Mycobacterium
EPQFEGQTKTKLGNA

SEQ ID NO: 469121 - protein, 6 aa, Mycobacterium
EPQGAI

SEQ ID NO: 469122 - protein, 9 aa, Mycobacterium
EPQGDGSSF

SEQ ID NO: 469123 - protein, 10 aa, Mycobacterium
EPQGGSDPTL

SEQ ID NO: 469124 - protein, 10 aa, Mycobacterium
EPQGVTPGQY

SEQ ID NO: 469125 - protein, 5 aa, Mycobacterium
EPQHF

SEQ ID NO: 469126 - protein, 8 aa, Mycobacterium
EPQHGSDA

SEQ ID NO: 469127 - protein, 8 aa, Mycobacterium
EPQINTDT

SEQ ID NO: 469128 - protein, 5 aa, Mycobacterium
EPQKR

SEQ ID NO: 469129 - protein, 27 aa, Mycobacterium
EPQLGPAPPDAAPPAGAAVPSNPPAIL

SEQ ID NO: 469130 - protein, 5 aa, Mycobacterium
EPQLR

SEQ ID NO: 469131 - protein, 19 aa, Mycobacterium
EPQLRTPPGQRRNARRRPR

SEQ ID NO: 469132 - protein, 8 aa, Mycobacterium
EPQNGRAQ

SEQ ID NO: 469133 - protein, 24 aa, Mycobacterium
EPQPALGERQRDHRRPGARHQRVQ

SEQ ID NO: 469134 - protein, 7 aa, Mycobacterium
EPQPELA

SEQ ID NO: 469135 - protein, 6 aa, Mycobacterium
EPQPLP

SEQ ID NO: 469136 - protein, 10 aa, Mycobacterium
EPQPPAIATG

SEQ ID NO: 469137 - protein, 7 aa, Mycobacterium
EPQPQLN

SEQ ID NO: 469138 - protein, 16 aa, Mycobacterium
EPQPWPARDGGRRAGV

SEQ ID NO: 469139 - protein, 20 aa, Mycobacterium
EPQRPPGERGARGGQLDRPP

SEQ ID NO: 469140 - protein, 7 aa, Mycobacterium
EPQRSPQ

SEQ ID NO: 469141 - protein, 7 aa, Mycobacterium
EPQSAAE

SEQ ID NO: 469142 - protein, 9 aa, Mycobacterium
EPQSAGACG

SEQ ID NO: 469143 - protein, 10 aa, Mycobacterium
EPQSAGACSG

SEQ ID NO: 469144 - protein, 8 aa, Mycobacterium
EPQSAPDI

SEQ ID NO: 469145 - protein, 8 aa, Mycobacterium
EPQSDRRS

SEQ ID NO: 469146 - protein, 10 aa, Mycobacterium
EPQSPGACGS

SEQ ID NO: 469147 - protein, 6 aa, Mycobacterium
EPQTNF

SEQ ID NO: 469148 - protein, 8 aa, Mycobacterium
EPQTPAGV

SEQ ID NO: 469149 - protein, 7 aa, Mycobacterium
EPQTQGF

SEQ ID NO: 469150 - protein, 5 aa, Mycobacterium
EPQTY

SEQ ID NO: 469151 - protein, 4 aa, Mycobacterium
EPQV

SEQ ID NO: 469152 - protein, 13 aa, Mycobacterium
EPRAAHHREGHER

SEQ ID NO: 469153 - protein, 6 aa, Mycobacterium
EPRAET

SEQ ID NO: 469154 - protein, 7 aa, Mycobacterium
EPRAGYG

SEQ ID NO: 469155 - protein, 7 aa, Mycobacterium
EPRAQAY

SEQ ID NO: 469156 - protein, 5 aa, Mycobacterium
EPRDS

SEQ ID NO: 469157 - protein, 4 aa, Mycobacterium
EPRE

SEQ ID NO: 469158 - protein, 5 aa, Mycobacterium
EPREA

SEQ ID NO: 469159 - protein, 19 aa, Mycobacterium
EPREAEQLPIPAPAHADPD

SEQ ID NO: 469160 - protein, 5 aa, Mycobacterium
EPREE

SEQ ID NO: 469161 - protein, 11 aa, Mycobacterium
EPREGGDPQRG

SEQ ID NO: 469162 - protein, 8 aa, Mycobacterium
EPREGPID

SEQ ID NO: 469163 - protein, 5 aa, Mycobacterium
EPRFD

SEQ ID NO: 469164 - protein, 6 aa, Mycobacterium
EPRFDE

SEQ ID NO: 469165 - protein, 10 aa, Mycobacterium
EPRFSAEAQQ

SEQ ID NO: 469166 - protein, 4 aa, Mycobacterium
EPRG

SEQ ID NO: 469167 - protein, 11 aa, Mycobacterium
EPRGALDRTVP

SEQ ID NO: 469168 - protein, 11 aa, Mycobacterium
EPRGDDIGEQI

SEQ ID NO: 469169 - protein, 9 aa, Mycobacterium
EPRGDGGFG

SEQ ID NO: 469170 - protein, 7 aa, Mycobacterium
EPRGGTR

SEQ ID NO: 469171 - protein, 14 aa, Mycobacterium
EPRGPLDQTVPARR

SEQ ID NO: 469172 - protein, 5 aa, Mycobacterium
EPRHG

SEQ ID NO: 469173 - protein, 25 aa, Mycobacterium
EPRHSFGTQPYPAVPGDLASPANKR

SEQ ID NO: 469174 - protein, 12 aa, Mycobacterium
EPRKNGKTTTAA

SEQ ID NO: 469175 - protein, 9 aa, Mycobacterium
EPRKQPPGN

SEQ ID NO: 469176 - protein, 19 aa, Mycobacterium
EPRKSCPDERLGRPRVPEA

SEQ ID NO: 469177 - protein, 4 aa, Mycobacterium
EPRL

SEQ ID NO: 469178 - protein, 9 aa, Mycobacterium
EPRLTPGGL

SEQ ID NO: 469179 - protein, 5 aa, Mycobacterium
EPRMR

SEQ ID NO: 469180 - protein, 11 aa, Mycobacterium
EPRNTGSEATY

SEQ ID NO: 469181 - protein, 4 aa, Mycobacterium
EPRP

SEQ ID NO: 469182 - protein, 13 aa, Mycobacterium
EPRPDGSLAPDGP

SEQ ID NO: 469183 - protein, 10 aa, Mycobacterium
EPRPDGTRQM

SEQ ID NO: 469184 - protein, 7 aa, Mycobacterium
EPRPDQA

SEQ ID NO: 469185 - protein, 7 aa, Mycobacterium
EPRPDQT

SEQ ID NO: 469186 - protein, 7 aa, Mycobacterium
EPRPEAT

SEQ ID NO: 469187 - protein, 18 aa, Mycobacterium
EPRPEDSAPASSGPRNDL

SEQ ID NO: 469188 - protein, 25 aa, Mycobacterium
EPRPEPDPRPHAQPSITKTTNEQGS

SEQ ID NO: 469189 - protein, 23 aa, Mycobacterium
EPRPEPDSGPGPRPSITKNSDED

SEQ ID NO: 469190 - protein, 34 aa, Mycobacterium
EPRPEPEPRSESESESEPGPEIEPERSITTTATE

SEQ ID NO: 469191 - protein, 5 aa, Mycobacterium
EPRPG

SEQ ID NO: 469192 - protein, 5 aa, Mycobacterium
EPRPI

SEQ ID NO: 469193 - protein, 7 aa, Mycobacterium
EPRPPAT

SEQ ID NO: 469194 - protein, 27 aa, Mycobacterium
EPRPQPEPRPDPGPERSITTTTDEAGS

SEQ ID NO: 469195 - protein, 5 aa, Mycobacterium
EPRPS

SEQ ID NO: 469196 - protein, 7 aa, Mycobacterium
EPRPSWG

SEQ ID NO: 469197 - protein, 8 aa, Mycobacterium
EPRPSWGH

SEQ ID NO: 469198 - protein, 11 aa, Mycobacterium
EPRPSWGNPKY

SEQ ID NO: 469199 - protein, 5 aa, Mycobacterium
EPRPT

SEQ ID NO: 469200 - protein, 16 aa, Mycobacterium
EPRPTEEAARRDPQAY

SEQ ID NO: 469201 - protein, 9 aa, Mycobacterium
EPRPVNPRG

SEQ ID NO: 469202 - protein, 5 aa, Mycobacterium
EPRQM

SEQ ID NO: 469203 - protein, 6 aa, Mycobacterium
EPRQPF

SEQ ID NO: 469204 - protein, 5 aa, Mycobacterium
EPRQT

SEQ ID NO: 469205 - protein, 5 aa, Mycobacterium
EPRQV

SEQ ID NO: 469206 - protein, 8 aa, Mycobacterium
EPRRDVGR

SEQ ID NO: 469207 - protein, 8 aa, Mycobacterium
EPRRGRGS

SEQ ID NO: 469208 - protein, 11 aa, Mycobacterium
EPRRGSSPATR

SEQ ID NO: 469209 - protein, 7 aa, Mycobacterium
EPRRHRR

SEQ ID NO: 469210 - protein, 11 aa, Mycobacterium
EPRRLGTRTDT

SEQ ID NO: 469211 - protein, 5 aa, Mycobacterium
EPRRM

SEQ ID NO: 469212 - protein, 4 aa, Mycobacterium
EPRS

SEQ ID NO: 469213 - protein, 10 aa, Mycobacterium
EPRSEGRPGR

SEQ ID NO: 469214 - protein, 5 aa, Mycobacterium
EPRSS

SEQ ID NO: 469215 - protein, 9 aa, Mycobacterium
EPRSSFTGH

SEQ ID NO: 469216 - protein, 9 aa, Mycobacterium
EPRTENGYC

SEQ ID NO: 469217 - protein, 6 aa, Mycobacterium
EPRTPQ

SEQ ID NO: 469218 - protein, 6 aa, Mycobacterium
EPRTTT

SEQ ID NO: 469219 - protein, 8 aa, Mycobacterium
EPRTVAPD

SEQ ID NO: 469220 - protein, 5 aa, Mycobacterium
EPRVP

SEQ ID NO: 469221 - protein, 12 aa, Mycobacterium
EPRVPGPRSPAG

SEQ ID NO: 469222 - protein, 5 aa, Mycobacterium
EPRVT

SEQ ID NO: 469223 - protein, 14 aa, Mycobacterium
EPRYREAARRAAAG

SEQ ID NO: 469224 - protein, 12 aa, Mycobacterium
EPSACPSITQGE

SEQ ID NO: 469225 - protein, 8 aa, Mycobacterium
EPSAFTED

SEQ ID NO: 469226 - protein, 21 aa, Mycobacterium
EPSAGSDLASLTTRARRDGDD

SEQ ID NO: 469227 - protein, 6 aa, Mycobacterium
EPSAPI

SEQ ID NO: 469228 - protein, 10 aa, Mycobacterium
EPSAQAIRSA

SEQ ID NO: 469229 - protein, 6 aa, Mycobacterium
EPSARA

SEQ ID NO: 469230 - protein, 10 aa, Mycobacterium
EPSARPYRGV

SEQ ID NO: 469231 - protein, 10 aa, Mycobacterium
EPSASAPFSD

SEQ ID NO: 469232 - protein, 10 aa, Mycobacterium
EPSATGSAQQ

SEQ ID NO: 469233 - protein, 4 aa, Mycobacterium
EPSC

SEQ ID NO: 469234 - protein, 13 aa, Mycobacterium
EPSDDDEPPATAT

SEQ ID NO: 469235 - protein, 10 aa, Mycobacterium
EPSDDELIPT

SEQ ID NO: 469236 - protein, 5 aa, Mycobacterium
EPSDE

SEQ ID NO: 469237 - protein, 9 aa, Mycobacterium
EPSDEPDRY

SEQ ID NO: 469238 - protein, 8 aa, Mycobacterium
EPSDGRPD

SEQ ID NO: 469239 - protein, 5 aa, Mycobacterium
EPSDL

SEQ ID NO: 469240 - protein, 9 aa, Mycobacterium
EPSDSTERI

SEQ ID NO: 469241 - protein, 9 aa, Mycobacterium
EPSDSTERV

SEQ ID NO: 469242 - protein, 6 aa, Mycobacterium
EPSDVA

SEQ ID NO: 469243 - protein, 9 aa, Mycobacterium
EPSEPSEVR

SEQ ID NO: 469244 - protein, 9 aa, Mycobacterium
EPSFEPGQG

SEQ ID NO: 469245 - protein, 6 aa, Mycobacterium
EPSGER

SEQ ID NO: 469246 - protein, 6 aa, Mycobacterium
EPSGFA

SEQ ID NO: 469247 - protein, 6 aa, Mycobacterium
EPSGFR

SEQ ID NO: 469248 - protein, 9 aa, Mycobacterium
EPSGGSDLA

SEQ ID NO: 469249 - protein, 7 aa, Mycobacterium
EPSGPIP

SEQ ID NO: 469250 - protein, 5 aa, Mycobacterium
EPSGY

SEQ ID NO: 469251 - protein, 6 aa, Mycobacterium
EPSHAF

SEQ ID NO: 469252 - protein, 8 aa, Mycobacterium
EPSHEQRS

SEQ ID NO: 469253 - protein, 8 aa, Mycobacterium
EPSHGSDA

SEQ ID NO: 469254 - protein, 11 aa, Mycobacterium
EPSHPNSANDI

SEQ ID NO: 469255 - protein, 6 aa, Mycobacterium
EPSHPP

SEQ ID NO: 469256 - protein, 13 aa, Mycobacterium
EPSIAGPKRPQDR

SEQ ID NO: 469257 - protein, 8 aa, Mycobacterium
EPSITGGL

SEQ ID NO: 469258 - protein, 5 aa, Mycobacterium
EPSKE

SEQ ID NO: 469259 - protein, 11 aa, Mycobacterium
EPSLCGPGREE

SEQ ID NO: 469260 - protein, 7 aa, Mycobacterium
EPSLPAA

SEQ ID NO: 469261 - protein, 12 aa, Mycobacterium
EPSLPKALGGAL

SEQ ID NO: 469262 - protein, 12 aa, Mycobacterium
EPSLSQGGDMPG

SEQ ID NO: 469263 - protein, 16 aa, Mycobacterium
EPSPAEDDSDDFDEDD

SEQ ID NO: 469264 - protein, 8 aa, Mycobacterium
EPSPAPSI

SEQ ID NO: 469265 - protein, 7 aa, Mycobacterium
EPSPEAG

SEQ ID NO: 469266 - protein, 18 aa, Mycobacterium
EPSPGQPDATSYDTRGDT

SEQ ID NO: 469267 - protein, 10 aa, Mycobacterium
EPSPGTPERG

SEQ ID NO: 469268 - protein, 6 aa, Mycobacterium
EPSPHI

SEQ ID NO: 469269 - protein, 7 aa, Mycobacterium
EPSPQRT

SEQ ID NO: 469270 - protein, 8 aa, Mycobacterium
EPSPQRTP

SEQ ID NO: 469271 - protein, 7 aa, Mycobacterium
EPSPTDP

SEQ ID NO: 469272 - protein, 8 aa, Mycobacterium
EPSPTRRA

SEQ ID NO: 469273 - protein, 4 aa, Mycobacterium
EPSR

SEQ ID NO: 469274 - protein, 9 aa, Mycobacterium
EPSRGERTM

SEQ ID NO: 469275 - protein, 9 aa, Mycobacterium
EPSRGERTT

SEQ ID NO: 469276 - protein, 8 aa, Mycobacterium
EPSRREGS

SEQ ID NO: 469277 - protein, 5 aa, Mycobacterium
EPSSE

SEQ ID NO: 469278 - protein, 6 aa, Mycobacterium
EPSSGF

SEQ ID NO: 469279 - protein, 17 aa, Mycobacterium
EPSSGTVTVNGTDVSTV

SEQ ID NO: 469280 - protein, 5 aa, Mycobacterium
EPSSS

SEQ ID NO: 469281 - protein, 7 aa, Mycobacterium
EPSTALD

SEQ ID NO: 469282 - protein, 7 aa, Mycobacterium
EPSTGLD

SEQ ID NO: 469283 - protein, 11 aa, Mycobacterium
EPSTGSFAGEK

SEQ ID NO: 469284 - protein, 5 aa, Mycobacterium
EPSTN

SEQ ID NO: 469285 - protein, 31 aa, Mycobacterium
EPSTVAPGTPSSSGPATASRPAIADQPRRAP

SEQ ID NO: 469286 - protein, 6 aa, Mycobacterium
EPSTVG

SEQ ID NO: 469287 - protein, 4 aa, Mycobacterium
EPSV

SEQ ID NO: 469288 - protein, 5 aa, Mycobacterium
EPSWT

SEQ ID NO: 469289 - protein, 8 aa, Mycobacterium
EPSYLPTK

SEQ ID NO: 469290 - protein, 11 aa, Mycobacterium
EPTAAGGTRVT

SEQ ID NO: 469291 - protein, 5 aa, Mycobacterium
EPTAD

SEQ ID NO: 469292 - protein, 9 aa, Mycobacterium
EPTADGQTM

SEQ ID NO: 469293 - protein, 13 aa, Mycobacterium
EPTAFTRLHKRFL

SEQ ID NO: 469294 - protein, 7 aa, Mycobacterium
EPTAGTA

SEQ ID NO: 469295 - protein, 5 aa, Mycobacterium
EPTAH

SEQ ID NO: 469296 - protein, 16 aa, Mycobacterium
EPTAKTATSDADAARS

SEQ ID NO: 469297 - protein, 10 aa, Mycobacterium
EPTAPERGRF

SEQ ID NO: 469298 - protein, 6 aa, Mycobacterium
EPTAQT

SEQ ID NO: 469299 - protein, 6 aa, Mycobacterium
EPTARV

SEQ ID NO: 469300 - protein, 6 aa, Mycobacterium
EPTDAD

SEQ ID NO: 469301 - protein, 25 aa, Mycobacterium
EPTDEPDEKPHSRGVTVTPGRGGRA

SEQ ID NO: 469302 - protein, 8 aa, Mycobacterium
EPTDESFR

SEQ ID NO: 469303 - protein, 8 aa, Mycobacterium
EPTDGRPD

SEQ ID NO: 469304 - protein, 9 aa, Mycobacterium
EPTDGRRPD

SEQ ID NO: 469305 - protein, 9 aa, Mycobacterium
EPTDKSQVR

SEQ ID NO: 469306 - protein, 6 aa, Mycobacterium
EPTDLT

SEQ ID NO: 469307 - protein, 6 aa, Mycobacterium
EPTDNL

SEQ ID NO: 469308 - protein, 13 aa, Mycobacterium
EPTDRADRGGENR

SEQ ID NO: 469309 - protein, 4 aa, Mycobacterium
EPTE

SEQ ID NO: 469310 - protein, 8 aa, Mycobacterium
EPTEAGTR

SEQ ID NO: 469311 - protein, 16 aa, Mycobacterium
EPTEAPHAAPATQIPA

SEQ ID NO: 469312 - protein, 9 aa, Mycobacterium
EPTEDGSAT

SEQ ID NO: 469313 - protein, 5 aa, Mycobacterium
EPTEP

SEQ ID NO: 469314 - protein, 9 aa, Mycobacterium
EPTERSGLK

SEQ ID NO: 469315 - protein, 8 aa, Mycobacterium
EPTESMPG

SEQ ID NO: 469316 - protein, 17 aa, Mycobacterium
EPTESRGMSRGRTSPDW

SEQ ID NO: 469317 - protein, 23 aa, Mycobacterium
EPTETGTRVTESRHAENGTTAVS

SEQ ID NO: 469318 - protein, 9 aa, Mycobacterium
EPTEYGDEP

SEQ ID NO: 469319 - protein, 9 aa, Mycobacterium
EPTFGQDRR

SEQ ID NO: 469320 - protein, 16 aa, Mycobacterium
EPTGAATGHLASEGAT

SEQ ID NO: 469321 - protein, 16 aa, Mycobacterium
EPTGAATGNLATEGAT

SEQ ID NO: 469322 - protein, 10 aa, Mycobacterium
EPTGASPAQL

SEQ ID NO: 469323 - protein, 6 aa, Mycobacterium
EPTGGD

SEQ ID NO: 469324 - protein, 21 aa, Mycobacterium
EPTGGSDLSGIRTKAQRDGSD

SEQ ID NO: 469325 - protein, 5 aa, Mycobacterium
EPTGI

SEQ ID NO: 469326 - protein, 13 aa, Mycobacterium
EPTGNLDPETSED

SEQ ID NO: 469327 - protein, 13 aa, Mycobacterium
EPTGNLDPETSKD

SEQ ID NO: 469328 - protein, 16 aa, Mycobacterium
EPTGPPGWPGPAKGRV

SEQ ID NO: 469329 - protein, 14 aa, Mycobacterium
EPTGRDGITPGREL

SEQ ID NO: 469330 - protein, 20 aa, Mycobacterium
EPTGRKLKASQIEWSAYAEK

SEQ ID NO: 469331 - protein, 8 aa, Mycobacterium
EPTGRRLK

SEQ ID NO: 469332 - protein, 10 aa, Mycobacterium
EPTGSGLTSA

SEQ ID NO: 469333 - protein, 5 aa, Mycobacterium
EPTGT

SEQ ID NO: 469334 - protein, 8 aa, Mycobacterium
EPTGTRPD

SEQ ID NO: 469335 - protein, 15 aa, Mycobacterium
EPTGVTATDDVDSAL

SEQ ID NO: 469336 - protein, 6 aa, Mycobacterium
EPTHAE

SEQ ID NO: 469337 - protein, 8 aa, Mycobacterium
EPTHPDED

SEQ ID NO: 469338 - protein, 4 aa, Mycobacterium
EPTI

SEQ ID NO: 469339 - protein, 13 aa, Mycobacterium
EPTIPVTPQTTAK

SEQ ID NO: 469340 - protein, 6 aa, Mycobacterium
EPTKGR

SEQ ID NO: 469341 - protein, 7 aa, Mycobacterium
EPTKKKQ

SEQ ID NO: 469342 - protein, 9 aa, Mycobacterium
EPTLGSAGF

SEQ ID NO: 469343 - protein, 11 aa, Mycobacterium
EPTLPVGGTTG

SEQ ID NO: 469344 - protein, 8 aa, Mycobacterium
EPTLSESG

SEQ ID NO: 469345 - protein, 4 aa, Mycobacterium
EPTM

SEQ ID NO: 469346 - protein, 5 aa, Mycobacterium
EPTNE

SEQ ID NO: 469347 - protein, 4 aa, Mycobacterium
EPTP

SEQ ID NO: 469348 - protein, 10 aa, Mycobacterium
EPTPADPPGL

SEQ ID NO: 469349 - protein, 206 aa, Mycobacterium
EPTPAPAPAPAPAPAPAPAPAPAPAPAPAPQPAPAPGPGPQPGPADPGASPQPAPSQPGSPSTPGQPSTDPAHVKPAAATETSTAPSTQPSGPSGPAHGDDSSGGGAAAPAASAMPGGGRGVSAGSSSGLSSAGASSSTSQSAASGAGSRAASGRAPVESGGRGPNTAAPRPAAARTASPTRPAPERPKPDEKEKSEAPDAVTPSP

SEQ ID NO: 469350 - protein, 8 aa, Mycobacterium
EPTPAQAQ

SEQ ID NO: 469351 - protein, 16 aa, Mycobacterium
EPTPARTPGEPPSTDH

SEQ ID NO: 469352 - protein, 7 aa, Mycobacterium
EPTPEEQ

SEQ ID NO: 469353 - protein, 8 aa, Mycobacterium
EPTPEQPA

SEQ ID NO: 469354 - protein, 25 aa, Mycobacterium
EPTPRLTPADGTALDSAAPDGLEGE

SEQ ID NO: 469355 - protein, 9 aa, Mycobacterium
EPTPSGGTL

SEQ ID NO: 469356 - protein, 8 aa, Mycobacterium
EPTPVTDI

SEQ ID NO: 469357 - protein, 8 aa, Mycobacterium
EPTQALTG

SEQ ID NO: 469358 - protein, 6 aa, Mycobacterium
EPTQQV

SEQ ID NO: 469359 - protein, 6 aa, Mycobacterium
EPTRDK

SEQ ID NO: 469360 - protein, 16 aa, Mycobacterium
EPTRPEIAAASARENA

SEQ ID NO: 469361 - protein, 7 aa, Mycobacterium
EPTRSPD

SEQ ID NO: 469362 - protein, 10 aa, Mycobacterium
EPTSALDPDN

SEQ ID NO: 469363 - protein, 12 aa, Mycobacterium
EPTSALDPTTTQ

SEQ ID NO: 469364 - protein, 8 aa, Mycobacterium
EPTSETRA

SEQ ID NO: 469365 - protein, 7 aa, Mycobacterium
EPTSGLD

SEQ ID NO: 469366 - protein, 8 aa, Mycobacterium
EPTSGNTG

SEQ ID NO: 469367 - protein, 9 aa, Mycobacterium
EPTSGNTGI

SEQ ID NO: 469368 - protein, 15 aa, Mycobacterium
EPTSGTVTVNGTDVA

SEQ ID NO: 469369 - protein, 5 aa, Mycobacterium
EPTSP

SEQ ID NO: 469370 - protein, 10 aa, Mycobacterium
EPTSPSPVGL

SEQ ID NO: 469371 - protein, 10 aa, Mycobacterium
EPTSSLDARE

SEQ ID NO: 469372 - protein, 13 aa, Mycobacterium
EPTSSLDPTTTEK

SEQ ID NO: 469373 - protein, 7 aa, Mycobacterium
EPTTAAG

SEQ ID NO: 469374 - protein, 7 aa, Mycobacterium
EPTTGLA

SEQ ID NO: 469375 - protein, 11 aa, Mycobacterium
EPTTGLDPRSR

SEQ ID NO: 469376 - protein, 12 aa, Mycobacterium
EPTTGLDPRSRQ

SEQ ID NO: 469377 - protein, 18 aa, Mycobacterium
EPTTRRAEFDDGSGRPGR

SEQ ID NO: 469378 - protein, 12 aa, Mycobacterium
EPTTRRAEFDEG

SEQ ID NO: 469379 - protein, 20 aa, Mycobacterium
EPTTRRAEFGADSKRAGAYT

SEQ ID NO: 469380 - protein, 12 aa, Mycobacterium
EPTTRRGEFEDG

SEQ ID NO: 469381 - protein, 12 aa, Mycobacterium
EPTTRRGELSDG

SEQ ID NO: 469382 - protein, 11 aa, Mycobacterium
EPTTRRGTFDD

SEQ ID NO: 469383 - protein, 5 aa, Mycobacterium
EPTTS

SEQ ID NO: 469384 - protein, 6 aa, Mycobacterium
EPTTSQ

SEQ ID NO: 469385 - protein, 15 aa, Mycobacterium
EPTTSTAAAAEAQGI

SEQ ID NO: 469386 - protein, 6 aa, Mycobacterium
EPTTVG

SEQ ID NO: 469387 - protein, 9 aa, Mycobacterium
EPTTVGDTY

SEQ ID NO: 469388 - protein, 8 aa, Mycobacterium
EPTTVGNE

SEQ ID NO: 469389 - protein, 9 aa, Mycobacterium
EPTTVGNGY

SEQ ID NO: 469390 - protein, 5 aa, Mycobacterium
EPTVP

SEQ ID NO: 469391 - protein, 5 aa, Mycobacterium
EPTVS

SEQ ID NO: 469392 - protein, 11 aa, Mycobacterium
EPTYEDGVGDR

SEQ ID NO: 469393 - protein, 13 aa, Mycobacterium
EPTYEDGVGDRSK

SEQ ID NO: 469394 - protein, 8 aa, Mycobacterium
EPTYKPNV

SEQ ID NO: 469395 - protein, 14 aa, Mycobacterium
EPTYTEGTGDRSKV

SEQ ID NO: 469396 - protein, 4 aa, Mycobacterium
EPVA

SEQ ID NO: 469397 - protein, 5 aa, Mycobacterium
EPVAA

SEQ ID NO: 469398 - protein, 43 aa, Mycobacterium
EPVADEKPAPKRRSTRAKATSEEAATETPEEPEQPDPQTSATG

SEQ ID NO: 469399 - protein, 9 aa, Mycobacterium
EPVAGPGQI

SEQ ID NO: 469400 - protein, 5 aa, Mycobacterium
EPVAL

SEQ ID NO: 469401 - protein, 36 aa, Mycobacterium
EPVANGRHHAEAERPTEPEQVPDTHTDDDASASMEE

SEQ ID NO: 469402 - protein, 7 aa, Mycobacterium
EPVAPSA

SEQ ID NO: 469403 - protein, 9 aa, Mycobacterium
EPVAPSPEL

SEQ ID NO: 469404 - protein, 5 aa, Mycobacterium
EPVAY

SEQ ID NO: 469405 - protein, 7 aa, Mycobacterium
EPVDAAK

SEQ ID NO: 469406 - protein, 11 aa, Mycobacterium
EPVDDPASFAE

SEQ ID NO: 469407 - protein, 8 aa, Mycobacterium
EPVDGGDP

SEQ ID NO: 469408 - protein, 10 aa, Mycobacterium
EPVDGSGPSY

SEQ ID NO: 469409 - protein, 6 aa, Mycobacterium
EPVDPA

SEQ ID NO: 469410 - protein, 7 aa, Mycobacterium
EPVDPNQ

SEQ ID NO: 469411 - protein, 7 aa, Mycobacterium
EPVDQSS

SEQ ID NO: 469412 - protein, 6 aa, Mycobacterium
EPVEDD

SEQ ID NO: 469413 - protein, 11 aa, Mycobacterium
EPVEDDRAPYA

SEQ ID NO: 469414 - protein, 8 aa, Mycobacterium
EPVGDARS

SEQ ID NO: 469415 - protein, 6 aa, Mycobacterium
EPVGDH

SEQ ID NO: 469416 - protein, 15 aa, Mycobacterium
EPVGEPVPAPPELPD

SEQ ID NO: 469417 - protein, 6 aa, Mycobacterium
EPVGGE

SEQ ID NO: 469418 - protein, 8 aa, Mycobacterium
EPVGGGPR

SEQ ID NO: 469419 - protein, 9 aa, Mycobacterium
EPVGPGGSR

SEQ ID NO: 469420 - protein, 5 aa, Mycobacterium
EPVGQ

SEQ ID NO: 469421 - protein, 12 aa, Mycobacterium
EPVGTQSSSEVQ

SEQ ID NO: 469422 - protein, 4 aa, Mycobacterium
EPVH

SEQ ID NO: 469423 - protein, 51 aa, Mycobacterium
EPVKRTAAKAPAKKAPAKKATKATKPRAAKSADAPATRGRAKKATAAEPGV

SEQ ID NO: 469424 - protein, 74 aa, Mycobacterium
EPVKRTATKSPAKAGAKRPAAKTANGAAPAKRATKAAGRSTKTADATNDAEATTPKKGRTGAKAAKAPARDADA

SEQ ID NO: 469425 - protein, 7 aa, Mycobacterium
EPVKSAN

SEQ ID NO: 469426 - protein, 5 aa, Mycobacterium
EPVLG

SEQ ID NO: 469427 - protein, 22 aa, Mycobacterium
EPVNSGLGGEQPDIRPAPPIPQ

SEQ ID NO: 469428 - protein, 8 aa, Mycobacterium
EPVNTQRM

SEQ ID NO: 469429 - protein, 14 aa, Mycobacterium
EPVPADDDASGGEY

SEQ ID NO: 469430 - protein, 8 aa, Mycobacterium
EPVPDDAE

SEQ ID NO: 469431 - protein, 10 aa, Mycobacterium
EPVPGIPEAA

SEQ ID NO: 469432 - protein, 8 aa, Mycobacterium
EPVPGPVT

SEQ ID NO: 469433 - protein, 6 aa, Mycobacterium
EPVPPQ

SEQ ID NO: 469434 - protein, 7 aa, Mycobacterium
EPVPPRD

SEQ ID NO: 469435 - protein, 4 aa, Mycobacterium
EPVQ

SEQ ID NO: 469436 - protein, 21 aa, Mycobacterium
EPVQGTAAAWSNAAADLRGES

SEQ ID NO: 469437 - protein, 9 aa, Mycobacterium
EPVQPAPSW

SEQ ID NO: 469438 - protein, 10 aa, Mycobacterium
EPVRATSDRW

SEQ ID NO: 469439 - protein, 5 aa, Mycobacterium
EPVRD

SEQ ID NO: 469440 - protein, 8 aa, Mycobacterium
EPVREDTT

SEQ ID NO: 469441 - protein, 9 aa, Mycobacterium
EPVREDTTS

SEQ ID NO: 469442 - protein, 8 aa, Mycobacterium
EPVREETK

SEQ ID NO: 469443 - protein, 10 aa, Mycobacterium
EPVRHDPDRR

SEQ ID NO: 469444 - protein, 6 aa, Mycobacterium
EPVRTR

SEQ ID NO: 469445 - protein, 5 aa, Mycobacterium
EPVRV

SEQ ID NO: 469446 - protein, 6 aa, Mycobacterium
EPVSGD

SEQ ID NO: 469447 - protein, 8 aa, Mycobacterium
EPVSPENP

SEQ ID NO: 469448 - protein, 8 aa, Mycobacterium
EPVSPSAI

SEQ ID NO: 469449 - protein, 9 aa, Mycobacterium
EPVSSKGAT

SEQ ID NO: 469450 - protein, 9 aa, Mycobacterium
EPVSSRGAT

SEQ ID NO: 469451 - protein, 6 aa, Mycobacterium
EPVSTA

SEQ ID NO: 469452 - protein, 6 aa, Mycobacterium
EPVSTD

SEQ ID NO: 469453 - protein, 6 aa, Mycobacterium
EPVSTE

SEQ ID NO: 469454 - protein, 4 aa, Mycobacterium
EPVT

SEQ ID NO: 469455 - protein, 5 aa, Mycobacterium
EPVTF

SEQ ID NO: 469456 - protein, 5 aa, Mycobacterium
EPVTG

SEQ ID NO: 469457 - protein, 8 aa, Mycobacterium
EPVTGASI

SEQ ID NO: 469458 - protein, 6 aa, Mycobacterium
EPVTGG

SEQ ID NO: 469459 - protein, 5 aa, Mycobacterium
EPVTP

SEQ ID NO: 469460 - protein, 20 aa, Mycobacterium
EPVTSPPPPPPPPPPPVTER

SEQ ID NO: 469461 - protein, 6 aa, Mycobacterium
EPVTYS

SEQ ID NO: 469462 - protein, 4 aa, Mycobacterium
EPVV

SEQ ID NO: 469463 - protein, 9 aa, Mycobacterium
EPVVPQPGG

SEQ ID NO: 469464 - protein, 7 aa, Mycobacterium
EPVVSGG

SEQ ID NO: 469465 - protein, 13 aa, Mycobacterium
EPVYGHPRNPYSR

SEQ ID NO: 469466 - protein, 5 aa, Mycobacterium
EPWDT

SEQ ID NO: 469467 - protein, 5 aa, Mycobacterium
EPWNG

SEQ ID NO: 469468 - protein, 5 aa, Mycobacterium
EPWPD

SEQ ID NO: 469469 - protein, 9 aa, Mycobacterium
EPWPDEPDE

SEQ ID NO: 469470 - protein, 16 aa, Mycobacterium
EPWPDEPGEPVEESEV

SEQ ID NO: 469471 - protein, 10 aa, Mycobacterium
EPWPGGRAGR

SEQ ID NO: 469472 - protein, 22 aa, Mycobacterium
EPWPGGRAGRIDTGGYRIDTGP

SEQ ID NO: 469473 - protein, 11 aa, Mycobacterium
EPWPGGRAGRL

SEQ ID NO: 469474 - protein, 5 aa, Mycobacterium
EPWRP

SEQ ID NO: 469475 - protein, 7 aa, Mycobacterium
EPWSSAG

SEQ ID NO: 469476 - protein, 18 aa, Mycobacterium
EPWTQRARNELRAAGTAV

SEQ ID NO: 469477 - protein, 35 aa, Mycobacterium
EPWTTRPGVPLPGRAAPLHPNAAGMSAAAELVCAL

SEQ ID NO: 469478 - protein, 12 aa, Mycobacterium
EPYADSRDDYTT

SEQ ID NO: 469479 - protein, 11 aa, Mycobacterium
EPYAEDSSFRT

SEQ ID NO: 469480 - protein, 8 aa, Mycobacterium
EPYAGRDD

SEQ ID NO: 469481 - protein, 10 aa, Mycobacterium
EPYAGREKEI

SEQ ID NO: 469482 - protein, 5 aa, Mycobacterium
EPYAS

SEQ ID NO: 469483 - protein, 6 aa, Mycobacterium
EPYATR

SEQ ID NO: 469484 - protein, 10 aa, Mycobacterium
EPYEDHGART

SEQ ID NO: 469485 - protein, 5 aa, Mycobacterium
EPYFE

SEQ ID NO: 469486 - protein, 5 aa, Mycobacterium
EPYGA

SEQ ID NO: 469487 - protein, 6 aa, Mycobacterium
EPYGED

SEQ ID NO: 469488 - protein, 7 aa, Mycobacterium
EPYHADP

SEQ ID NO: 469489 - protein, 7 aa, Mycobacterium
EPYHPDP

SEQ ID NO: 469490 - protein, 4 aa, Mycobacterium
EPYN

SEQ ID NO: 469491 - protein, 4 aa, Mycobacterium
EPYP

SEQ ID NO: 469492 - protein, 11 aa, Mycobacterium
EPYRGSSPATR

SEQ ID NO: 469493 - protein, 18 aa, Mycobacterium
EPYRSGGDGAEVTWLRGV

SEQ ID NO: 469494 - protein, 7 aa, Mycobacterium
EPYRSGS

SEQ ID NO: 469495 - protein, 7 aa, Mycobacterium
EPYSKTK

SEQ ID NO: 469496 - protein, 5 aa, Mycobacterium
EQAAA

SEQ ID NO: 469497 - protein, 9 aa, Mycobacterium
EQAAAAGHS

SEQ ID NO: 469498 - protein, 10 aa, Mycobacterium
EQAAAAGHSL

SEQ ID NO: 469499 - protein, 12 aa, Mycobacterium
EQAAAGKDYDDV

SEQ ID NO: 469500 - protein, 12 aa, Mycobacterium
EQAAPWAHRTAA

SEQ ID NO: 469501 - protein, 10 aa, Mycobacterium
EQAAQAPGDY

SEQ ID NO: 469502 - protein, 9 aa, Mycobacterium
EQAARAAED

SEQ ID NO: 469503 - protein, 11 aa, Mycobacterium
EQAARAPGDYA

SEQ ID NO: 469504 - protein, 17 aa, Mycobacterium
EQAARLERTARTSRDLR

SEQ ID NO: 469505 - protein, 6 aa, Mycobacterium
EQAAVT

SEQ ID NO: 469506 - protein, 5 aa, Mycobacterium
EQADA

SEQ ID NO: 469507 - protein, 6 aa, Mycobacterium
EQADAR

SEQ ID NO: 469508 - protein, 14 aa, Mycobacterium
EQADAWSARSQQRA

SEQ ID NO: 469509 - protein, 7 aa, Mycobacterium
EQADEAG

SEQ ID NO: 469510 - protein, 6 aa, Mycobacterium
EQADGP

SEQ ID NO: 469511 - protein, 8 aa, Mycobacterium
EQADPGAV

SEQ ID NO: 469512 - protein, 6 aa, Mycobacterium
EQADRD

SEQ ID NO: 469513 - protein, 7 aa, Mycobacterium
EQADRDD

SEQ ID NO: 469514 - protein, 8 aa, Mycobacterium
EQADRDDY

SEQ ID NO: 469515 - protein, 8 aa, Mycobacterium
EQADRGLD

SEQ ID NO: 469516 - protein, 10 aa, Mycobacterium
EQADSADDRR

SEQ ID NO: 469517 - protein, 9 aa, Mycobacterium
EQADTGTVS

SEQ ID NO: 469518 - protein, 4 aa, Mycobacterium
EQAE

SEQ ID NO: 469519 - protein, 9 aa, Mycobacterium
EQAEAAGHS

SEQ ID NO: 469520 - protein, 7 aa, Mycobacterium
EQAEAAY

SEQ ID NO: 469521 - protein, 14 aa, Mycobacterium
EQAEATAAKIGSGE

SEQ ID NO: 469522 - protein, 6 aa, Mycobacterium
EQAEET

SEQ ID NO: 469523 - protein, 6 aa, Mycobacterium
EQAEHV

SEQ ID NO: 469524 - protein, 15 aa, Mycobacterium
EQAEKAGRDEPDRGN

SEQ ID NO: 469525 - protein, 19 aa, Mycobacterium
EQAEKYEQSGGTEATDMKG

SEQ ID NO: 469526 - protein, 5 aa, Mycobacterium
EQAEP

SEQ ID NO: 469527 - protein, 8 aa, Mycobacterium
EQAEPPVR

SEQ ID NO: 469528 - protein, 13 aa, Mycobacterium
EQAEQAAAKIGAG

SEQ ID NO: 469529 - protein, 17 aa, Mycobacterium
EQAEQASAQAGAAAAAY

SEQ ID NO: 469530 - protein, 9 aa, Mycobacterium
EQAERDPVA

SEQ ID NO: 469531 - protein, 8 aa, Mycobacterium
EQAESNKE

SEQ ID NO: 469532 - protein, 6 aa, Mycobacterium
EQAETR

SEQ ID NO: 469533 - protein, 4 aa, Mycobacterium
EQAG

SEQ ID NO: 469534 - protein, 8 aa, Mycobacterium
EQAGAARA

SEQ ID NO: 469535 - protein, 6 aa, Mycobacterium
EQAGAS

SEQ ID NO: 469536 - protein, 8 aa, Mycobacterium
EQAGDGER

SEQ ID NO: 469537 - protein, 9 aa, Mycobacterium
EQAGDHGAT

SEQ ID NO: 469538 - protein, 13 aa, Mycobacterium
EQAGDKFDESKQR

SEQ ID NO: 469539 - protein, 8 aa, Mycobacterium
EQAGDRVD

SEQ ID NO: 469540 - protein, 5 aa, Mycobacterium
EQAGE

SEQ ID NO: 469541 - protein, 9 aa, Mycobacterium
EQAGEASDF

SEQ ID NO: 469542 - protein, 8 aa, Mycobacterium
EQAGEEAR

SEQ ID NO: 469543 - protein, 9 aa, Mycobacterium
EQAGEPLPA

SEQ ID NO: 469544 - protein, 8 aa, Mycobacterium
EQAGERLR

SEQ ID NO: 469545 - protein, 7 aa, Mycobacterium
EQAGESA

SEQ ID NO: 469546 - protein, 9 aa, Mycobacterium
EQAGGAPWD

SEQ ID NO: 469547 - protein, 7 aa, Mycobacterium
EQAGGFG

SEQ ID NO: 469548 - protein, 16 aa, Mycobacterium
EQAGHTAAQATAAATA

SEQ ID NO: 469549 - protein, 5 aa, Mycobacterium
EQAGL

SEQ ID NO: 469550 - protein, 9 aa, Mycobacterium
EQAGLQDTN

SEQ ID NO: 469551 - protein, 9 aa, Mycobacterium
EQAGNSAHE

SEQ ID NO: 469552 - protein, 7 aa, Mycobacterium
EQAGPVS

SEQ ID NO: 469553 - protein, 7 aa, Mycobacterium
EQAGQQV

SEQ ID NO: 469554 - protein, 11 aa, Mycobacterium
EQAGQVPAPVG

SEQ ID NO: 469555 - protein, 9 aa, Mycobacterium
EQAGRVGPE

SEQ ID NO: 469556 - protein, 8 aa, Mycobacterium
EQAGSGYE

SEQ ID NO: 469557 - protein, 25 aa, Mycobacterium
EQAGTRLANPARLSDPDKLRGAVSG

SEQ ID NO: 469558 - protein, 7 aa, Mycobacterium
EQAGVTV

SEQ ID NO: 469559 - protein, 8 aa, Mycobacterium
EQAHGADI

SEQ ID NO: 469560 - protein, 8 aa, Mycobacterium
EQAHGADV

SEQ ID NO: 469561 - protein, 7 aa, Mycobacterium
EQAHGAG

SEQ ID NO: 469562 - protein, 10 aa, Mycobacterium
EQAHGPAGDR

SEQ ID NO: 469563 - protein, 12 aa, Mycobacterium
EQAIADDGPAHP

SEQ ID NO: 469564 - protein, 7 aa, Mycobacterium
EQAIDGN

SEQ ID NO: 469565 - protein, 7 aa, Mycobacterium
EQAKADM

SEQ ID NO: 469566 - protein, 9 aa, Mycobacterium
EQAKERGEQ

SEQ ID NO: 469567 - protein, 17 aa, Mycobacterium
EQAKERGEQVTAPAPMP

SEQ ID NO: 469568 - protein, 10 aa, Mycobacterium
EQAKPAAQLA

SEQ ID NO: 469569 - protein, 12 aa, Mycobacterium
EQAKPWAQRTPD

SEQ ID NO: 469570 - protein, 5 aa, Mycobacterium
EQANQ

SEQ ID NO: 469571 - protein, 7 aa, Mycobacterium
EQANTPI

SEQ ID NO: 469572 - protein, 4 aa, Mycobacterium
EQAP

SEQ ID NO: 469573 - protein, 7 aa, Mycobacterium
EQAPASV

SEQ ID NO: 469574 - protein, 5 aa, Mycobacterium
EQAPD

SEQ ID NO: 469575 - protein, 8 aa, Mycobacterium
EQAPEPAR

SEQ ID NO: 469576 - protein, 5 aa, Mycobacterium
EQAPG

SEQ ID NO: 469577 - protein, 8 aa, Mycobacterium
EQAPGPMG

SEQ ID NO: 469578 - protein, 9 aa, Mycobacterium
EQAPQSHRS

SEQ ID NO: 469579 - protein, 19 aa, Mycobacterium
EQAQAGGRGTARRPETSLE

SEQ ID NO: 469580 - protein, 14 aa, Mycobacterium
EQAQDPRTREEQAK

SEQ ID NO: 469581 - protein, 8 aa, Mycobacterium
EQAQEQHQ

SEQ ID NO: 469582 - protein, 9 aa, Mycobacterium
EQAQIDSSR

SEQ ID NO: 469583 - protein, 6 aa, Mycobacterium
EQAQPD

SEQ ID NO: 469584 - protein, 8 aa, Mycobacterium
EQAQRDGD

SEQ ID NO: 469585 - protein, 5 aa, Mycobacterium
EQARA

SEQ ID NO: 469586 - protein, 11 aa, Mycobacterium
EQARAGGVADS

SEQ ID NO: 469587 - protein, 12 aa, Mycobacterium
EQARCDARDRAA

SEQ ID NO: 469588 - protein, 6 aa, Mycobacterium
EQARDA

SEQ ID NO: 469589 - protein, 7 aa, Mycobacterium
EQAREKG

SEQ ID NO: 469590 - protein, 9 aa, Mycobacterium
EQAREQGYV

SEQ ID NO: 469591 - protein, 34 aa, Mycobacterium
EQARERGEQVTAPAPMPYDRPTQERRAKRAEREL

SEQ ID NO: 469592 - protein, 13 aa, Mycobacterium
EQARPPREEWETR

SEQ ID NO: 469593 - protein, 8 aa, Mycobacterium
EQARRARP

SEQ ID NO: 469594 - protein, 19 aa, Mycobacterium
EQARRHQRHREYREQAAQY

SEQ ID NO: 469595 - protein, 8 aa, Mycobacterium
EQARRYPG

SEQ ID NO: 469596 - protein, 40 aa, Mycobacterium
EQARTPVPEGAATPVAQPPRVPEAPPHDGSAPAGEASSPC

SEQ ID NO: 469597 - protein, 19 aa, Mycobacterium
EQASAQTGLTDFGDQGYRE

SEQ ID NO: 469598 - protein, 18 aa, Mycobacterium
EQASASSQAQGTLSTEDR

SEQ ID NO: 469599 - protein, 13 aa, Mycobacterium
EQASDKFEESKQR

SEQ ID NO: 469600 - protein, 10 aa, Mycobacterium
EQASGRDLSD

SEQ ID NO: 469601 - protein, 6 aa, Mycobacterium
EQASPI

SEQ ID NO: 469602 - protein, 10 aa, Mycobacterium
EQASRGTDSG

SEQ ID NO: 469603 - protein, 9 aa, Mycobacterium
EQASSSTHP

SEQ ID NO: 469604 - protein, 23 aa, Mycobacterium
EQASVAAADAARAASDPAADGAQ

SEQ ID NO: 469605 - protein, 14 aa, Mycobacterium
EQATAERPHQRAAQ

SEQ ID NO: 469606 - protein, 9 aa, Mycobacterium
EQATALTKQ

SEQ ID NO: 469607 - protein, 12 aa, Mycobacterium
EQATASELGAKA

SEQ ID NO: 469608 - protein, 12 aa, Mycobacterium
EQATDAGAQGLA

SEQ ID NO: 469609 - protein, 7 aa, Mycobacterium
EQATGAR

SEQ ID NO: 469610 - protein, 5 aa, Mycobacterium
EQATK

SEQ ID NO: 469611 - protein, 8 aa, Mycobacterium
EQATQQWS

SEQ ID NO: 469612 - protein, 10 aa, Mycobacterium
EQATSAQPDR

SEQ ID NO: 469613 - protein, 5 aa, Mycobacterium
EQATV

SEQ ID NO: 469614 - protein, 4 aa, Mycobacterium
EQAV

SEQ ID NO: 469615 - protein, 5 aa, Mycobacterium
EQAVA

SEQ ID NO: 469616 - protein, 8 aa, Mycobacterium
EQAVEAEK

SEQ ID NO: 469617 - protein, 9 aa, Mycobacterium
EQAYGESVT

SEQ ID NO: 469618 - protein, 9 aa, Mycobacterium
EQAYGPDVE

SEQ ID NO: 469619 - protein, 9 aa, Mycobacterium
EQAYGSDVR

SEQ ID NO: 469620 - protein, 4 aa, Mycobacterium
EQCD

SEQ ID NO: 469621 - protein, 4 aa, Mycobacterium
EQCP

SEQ ID NO: 469622 - protein, 12 aa, Mycobacterium
EQCRGQVEGGVA

SEQ ID NO: 469623 - protein, 6 aa, Mycobacterium
EQCTVT

SEQ ID NO: 469624 - protein, 4 aa, Mycobacterium
EQDA

SEQ ID NO: 469625 - protein, 15 aa, Mycobacterium
EQDAAHDFGGIVDNG

SEQ ID NO: 469626 - protein, 15 aa, Mycobacterium
EQDAARNLGGIADRG

SEQ ID NO: 469627 - protein, 6 aa, Mycobacterium
EQDAEK

SEQ ID NO: 469628 - protein, 5 aa, Mycobacterium
EQDAP

SEQ ID NO: 469629 - protein, 7 aa, Mycobacterium
EQDDEMD

SEQ ID NO: 469630 - protein, 10 aa, Mycobacterium
EQDDGENWSE

SEQ ID NO: 469631 - protein, 6 aa, Mycobacterium
EQDDGG

SEQ ID NO: 469632 - protein, 4 aa, Mycobacterium
EQDE

SEQ ID NO: 469633 - protein, 5 aa, Mycobacterium
EQDEL

SEQ ID NO: 469634 - protein, 11 aa, Mycobacterium
EQDEPADPRSV

SEQ ID NO: 469635 - protein, 5 aa, Mycobacterium
EQDET

SEQ ID NO: 469636 - protein, 7 aa, Mycobacterium
EQDFPTK

SEQ ID NO: 469637 - protein, 9 aa, Mycobacterium
EQDGQPRDY

SEQ ID NO: 469638 - protein, 6 aa, Mycobacterium
EQDGVT

SEQ ID NO: 469639 - protein, 7 aa, Mycobacterium
EQDHPGP

SEQ ID NO: 469640 - protein, 5 aa, Mycobacterium
EQDIG

SEQ ID NO: 469641 - protein, 14 aa, Mycobacterium
EQDIGGAVSGGSLL

SEQ ID NO: 469642 - protein, 11 aa, Mycobacterium
EQDKAAGDLRL

SEQ ID NO: 469643 - protein, 7 aa, Mycobacterium
EQDKTKW

SEQ ID NO: 469644 - protein, 10 aa, Mycobacterium
EQDLGPRAAE

SEQ ID NO: 469645 - protein, 11 aa, Mycobacterium
EQDLRDGVDPI

SEQ ID NO: 469646 - protein, 6 aa, Mycobacterium
EQDPAA

SEQ ID NO: 469647 - protein, 8 aa, Mycobacterium
EQDPAEKR

SEQ ID NO: 469648 - protein, 10 aa, Mycobacterium
EQDPEELARR

SEQ ID NO: 469649 - protein, 8 aa, Mycobacterium
EQDPEGGR

SEQ ID NO: 469650 - protein, 7 aa, Mycobacterium
EQDREAM

SEQ ID NO: 469651 - protein, 8 aa, Mycobacterium
EQDRPLSE

SEQ ID NO: 469652 - protein, 5 aa, Mycobacterium
EQDRS

SEQ ID NO: 469653 - protein, 7 aa, Mycobacterium
EQDRTRW

SEQ ID NO: 469654 - protein, 8 aa, Mycobacterium
EQDRTRWD

SEQ ID NO: 469655 - protein, 4 aa, Mycobacterium
EQDS

SEQ ID NO: 469656 - protein, 10 aa, Mycobacterium
EQDSAENAER

SEQ ID NO: 469657 - protein, 10 aa, Mycobacterium
EQDSAKARQQ

SEQ ID NO: 469658 - protein, 7 aa, Mycobacterium
EQDSARR

SEQ ID NO: 469659 - protein, 5 aa, Mycobacterium
EQDSV

SEQ ID NO: 469660 - protein, 7 aa, Mycobacterium
EQDTETG

SEQ ID NO: 469661 - protein, 11 aa, Mycobacterium
EQDTGVFPSDA

SEQ ID NO: 469662 - protein, 8 aa, Mycobacterium
EQDTRQRR

SEQ ID NO: 469663 - protein, 7 aa, Mycobacterium
EQDYPGP

SEQ ID NO: 469664 - protein, 6 aa, Mycobacterium
EQDYPQ

SEQ ID NO: 469665 - protein, 5 aa, Mycobacterium
EQEAA

SEQ ID NO: 469666 - protein, 15 aa, Mycobacterium
EQEAARKFGDVVDRG

SEQ ID NO: 469667 - protein, 5 aa, Mycobacterium
EQEAD

SEQ ID NO: 469668 - protein, 10 aa, Mycobacterium
EQEADTGEVE

SEQ ID NO: 469669 - protein, 12 aa, Mycobacterium
EQEAGAAEFDAS

SEQ ID NO: 469670 - protein, 7 aa, Mycobacterium
EQEAHEP

SEQ ID NO: 469671 - protein, 9 aa, Mycobacterium
EQEALRPSA

SEQ ID NO: 469672 - protein, 8 aa, Mycobacterium
EQEARRIS

SEQ ID NO: 469673 - protein, 5 aa, Mycobacterium
EQEAS

SEQ ID NO: 469674 - protein, 4 aa, Mycobacterium
EQEF

SEQ ID NO: 469675 - protein, 4 aa, Mycobacterium
EQEG

SEQ ID NO: 469676 - protein, 5 aa, Mycobacterium
EQEGA

SEQ ID NO: 469677 - protein, 5 aa, Mycobacterium
EQEGR

SEQ ID NO: 469678 - protein, 7 aa, Mycobacterium
EQEKGGI

SEQ ID NO: 469679 - protein, 6 aa, Mycobacterium
EQEKRI

SEQ ID NO: 469680 - protein, 4 aa, Mycobacterium
EQEL

SEQ ID NO: 469681 - protein, 4 aa, Mycobacterium
EQEN

SEQ ID NO: 469682 - protein, 19 aa, Mycobacterium
EQENPEAAANIRAQLEGSD

SEQ ID NO: 469683 - protein, 4 aa, Mycobacterium
EQEP

SEQ ID NO: 469684 - protein, 8 aa, Mycobacterium
EQEPDGAM

SEQ ID NO: 469685 - protein, 21 aa, Mycobacterium
EQEPSPPQPPMSREQAAAGLK

SEQ ID NO: 469686 - protein, 7 aa, Mycobacterium
EQERGGS

SEQ ID NO: 469687 - protein, 6 aa, Mycobacterium
EQERGI

SEQ ID NO: 469688 - protein, 12 aa, Mycobacterium
EQERGLSAGEKR

SEQ ID NO: 469689 - protein, 14 aa, Mycobacterium
EQERKRAADRASAR

SEQ ID NO: 469690 - protein, 6 aa, Mycobacterium
EQERPL

SEQ ID NO: 469691 - protein, 8 aa, Mycobacterium
EQERRPNK

SEQ ID NO: 469692 - protein, 8 aa, Mycobacterium
EQERYEKQ

SEQ ID NO: 469693 - protein, 4 aa, Mycobacterium
EQES

SEQ ID NO: 469694 - protein, 7 aa, Mycobacterium
EQESAAL

SEQ ID NO: 469695 - protein, 13 aa, Mycobacterium
EQESAATQAALQT

SEQ ID NO: 469696 - protein, 17 aa, Mycobacterium
EQESDPEFAGDVPTDEE

SEQ ID NO: 469697 - protein, 6 aa, Mycobacterium
EQETKG

SEQ ID NO: 469698 - protein, 7 aa, Mycobacterium
EQFAREG

SEQ ID NO: 469699 - protein, 6 aa, Mycobacterium
EQFARQ

SEQ ID NO: 469700 - protein, 28 aa, Mycobacterium
EQFEQQAAKAAAAGRTKEAEEAKANAEQ

SEQ ID NO: 469701 - protein, 28 aa, Mycobacterium
EQFERQAEKAAAAGKTKDAEKARANAEQ

SEQ ID NO: 469702 - protein, 4 aa, Mycobacterium
EQFG

SEQ ID NO: 469703 - protein, 7 aa, Mycobacterium
EQFGKPI

SEQ ID NO: 469704 - protein, 6 aa, Mycobacterium
EQFGYE

SEQ ID NO: 469705 - protein, 5 aa, Mycobacterium
EQFPR

SEQ ID NO: 469706 - protein, 24 aa, Mycobacterium
EQFTQPTQPTQSVQRTHPTQATHR

SEQ ID NO: 469707 - protein, 4 aa, Mycobacterium
EQGA

SEQ ID NO: 469708 - protein, 10 aa, Mycobacterium
EQGAKGAGLS

SEQ ID NO: 469709 - protein, 14 aa, Mycobacterium
EQGAKGPQAVGVTA

SEQ ID NO: 469710 - protein, 13 aa, Mycobacterium
EQGDATILHGKVT

SEQ ID NO: 469711 - protein, 6 aa, Mycobacterium
EQGDGG

SEQ ID NO: 469712 - protein, 11 aa, Mycobacterium
EQGDGGATSNE

SEQ ID NO: 469713 - protein, 5 aa, Mycobacterium
EQGDL

SEQ ID NO: 469714 - protein, 11 aa, Mycobacterium
EQGDPARAGER

SEQ ID NO: 469715 - protein, 16 aa, Mycobacterium
EQGDSDQVFGSPRHDY

SEQ ID NO: 469716 - protein, 8 aa, Mycobacterium
EQGDSNAP

SEQ ID NO: 469717 - protein, 8 aa, Mycobacterium
EQGDSRGV

SEQ ID NO: 469718 - protein, 17 aa, Mycobacterium
EQGEAPASAKGEAVKGD

SEQ ID NO: 469719 - protein, 7 aa, Mycobacterium
EQGEARD

SEQ ID NO: 469720 - protein, 6 aa, Mycobacterium
EQGEGP

SEQ ID NO: 469721 - protein, 11 aa, Mycobacterium
EQGEIDSASVT

SEQ ID NO: 469722 - protein, 11 aa, Mycobacterium
EQGERTDPQRV

SEQ ID NO: 469723 - protein, 7 aa, Mycobacterium
EQGESGK

SEQ ID NO: 469724 - protein, 7 aa, Mycobacterium
EQGETRD

SEQ ID NO: 469725 - protein, 16 aa, Mycobacterium
EQGFNSGDTCRVPWAT

SEQ ID NO: 469726 - protein, 17 aa, Mycobacterium
EQGFSSGDACRVPWAQQ

SEQ ID NO: 469727 - protein, 15 aa, Mycobacterium
EQGFSSGDACRVPWT

SEQ ID NO: 469728 - protein, 10 aa, Mycobacterium
EQGGDPGYKA

SEQ ID NO: 469729 - protein, 7 aa, Mycobacterium
EQGGERR

SEQ ID NO: 469730 - protein, 16 aa, Mycobacterium
EQGGGHAASGYAHATG

SEQ ID NO: 469731 - protein, 6 aa, Mycobacterium
EQGGGY

SEQ ID NO: 469732 - protein, 5 aa, Mycobacterium
EQGGL

SEQ ID NO: 469733 - protein, 6 aa, Mycobacterium
EQGGLD

SEQ ID NO: 469734 - protein, 7 aa, Mycobacterium
EQGGLSL

SEQ ID NO: 469735 - protein, 8 aa, Mycobacterium
EQGGPAGR

SEQ ID NO: 469736 - protein, 7 aa, Mycobacterium
EQGGPAT

SEQ ID NO: 469737 - protein, 7 aa, Mycobacterium
EQGGWTD

SEQ ID NO: 469738 - protein, 9 aa, Mycobacterium
EQGGWTPGD

SEQ ID NO: 469739 - protein, 4 aa, Mycobacterium
EQGH

SEQ ID NO: 469740 - protein, 4 aa, Mycobacterium
EQGI

SEQ ID NO: 469741 - protein, 6 aa, Mycobacterium
EQGIGG

SEQ ID NO: 469742 - protein, 7 aa, Mycobacterium
EQGIPAS

SEQ ID NO: 469743 - protein, 8 aa, Mycobacterium
EQGKAEWA

SEQ ID NO: 469744 - protein, 8 aa, Mycobacterium
EQGKLTDE

SEQ ID NO: 469745 - protein, 17 aa, Mycobacterium
EQGLGDAVKDNDGKFPA

SEQ ID NO: 469746 - protein, 8 aa, Mycobacterium
EQGLTGSD

SEQ ID NO: 469747 - protein, 9 aa, Mycobacterium
EQGNGASVR

SEQ ID NO: 469748 - protein, 14 aa, Mycobacterium
EQGNKGPQAVRVNA

SEQ ID NO: 469749 - protein, 9 aa, Mycobacterium
EQGNSQEVF

SEQ ID NO: 469750 - protein, 10 aa, Mycobacterium
EQGPDALQTR

SEQ ID NO: 469751 - protein, 11 aa, Mycobacterium
EQGPEGITATD

SEQ ID NO: 469752 - protein, 10 aa, Mycobacterium
EQGPQGPPLT

SEQ ID NO: 469753 - protein, 6 aa, Mycobacterium
EQGPVT

SEQ ID NO: 469754 - protein, 28 aa, Mycobacterium
EQGQGDPALTRATRQVNKRAGVFVAEIA

SEQ ID NO: 469755 - protein, 6 aa, Mycobacterium
EQGQRQ

SEQ ID NO: 469756 - protein, 15 aa, Mycobacterium
EQGREAADKIETPPW

SEQ ID NO: 469757 - protein, 7 aa, Mycobacterium
EQGREPD

SEQ ID NO: 469758 - protein, 11 aa, Mycobacterium
EQGRERSPSAQ

SEQ ID NO: 469759 - protein, 15 aa, Mycobacterium
EQGRGAAEKIETPPW

SEQ ID NO: 469760 - protein, 5 aa, Mycobacterium
EQGRL

SEQ ID NO: 469761 - protein, 9 aa, Mycobacterium
EQGRPLEVS

SEQ ID NO: 469762 - protein, 12 aa, Mycobacterium
EQGRSGSSKFRS

SEQ ID NO: 469763 - protein, 11 aa, Mycobacterium
EQGRSRSASAD

SEQ ID NO: 469764 - protein, 5 aa, Mycobacterium
EQGRT

SEQ ID NO: 469765 - protein, 7 aa, Mycobacterium
EQGRTLG

SEQ ID NO: 469766 - protein, 7 aa, Mycobacterium
EQGRTPV

SEQ ID NO: 469767 - protein, 10 aa, Mycobacterium
EQGRTQEDIG

SEQ ID NO: 469768 - protein, 12 aa, Mycobacterium
EQGRTRYRTVLA

SEQ ID NO: 469769 - protein, 12 aa, Mycobacterium
EQGRTRYRTVLT

SEQ ID NO: 469770 - protein, 5 aa, Mycobacterium
EQGSA

SEQ ID NO: 469771 - protein, 9 aa, Mycobacterium
EQGSAKSTV

SEQ ID NO: 469772 - protein, 6 aa, Mycobacterium
EQGSND

SEQ ID NO: 469773 - protein, 15 aa, Mycobacterium
EQGSPERDFGPRSED

SEQ ID NO: 469774 - protein, 15 aa, Mycobacterium
EQGSPQRDFGERSAD

SEQ ID NO: 469775 - protein, 22 aa, Mycobacterium
EQGSSREAFDAEARSASEKDVK

SEQ ID NO: 469776 - protein, 5 aa, Mycobacterium
EQGTD

SEQ ID NO: 469777 - protein, 7 aa, Mycobacterium
EQGTETL

SEQ ID NO: 469778 - protein, 14 aa, Mycobacterium
EQGTGHELFADHVD

SEQ ID NO: 469779 - protein, 14 aa, Mycobacterium
EQGTKGPQAVGVSA

SEQ ID NO: 469780 - protein, 10 aa, Mycobacterium
EQGTRGADAK

SEQ ID NO: 469781 - protein, 7 aa, Mycobacterium
EQGTTDG

SEQ ID NO: 469782 - protein, 8 aa, Mycobacterium
EQGTTDGV

SEQ ID NO: 469783 - protein, 8 aa, Mycobacterium
EQGVDPAP

SEQ ID NO: 469784 - protein, 10 aa, Mycobacterium
EQGVEPDPRI

SEQ ID NO: 469785 - protein, 7 aa, Mycobacterium
EQGVGKD

SEQ ID NO: 469786 - protein, 7 aa, Mycobacterium
EQGVNDG

SEQ ID NO: 469787 - protein, 9 aa, Mycobacterium
EQGVPPEKL

SEQ ID NO: 469788 - protein, 27 aa, Mycobacterium
EQGYDRAEQAARAAEEAVKEAKAQLRR

SEQ ID NO: 469789 - protein, 12 aa, Mycobacterium
EQGYSPKFPGAA

SEQ ID NO: 469790 - protein, 9 aa, Mycobacterium
EQGYTGKGQ

SEQ ID NO: 469791 - protein, 13 aa, Mycobacterium
EQHDAQSSDLPSA

SEQ ID NO: 469792 - protein, 6 aa, Mycobacterium
EQHERT

SEQ ID NO: 469793 - protein, 8 aa, Mycobacterium
EQHGAGAP

SEQ ID NO: 469794 - protein, 7 aa, Mycobacterium
EQHGDAA

SEQ ID NO: 469795 - protein, 8 aa, Mycobacterium
EQHGKTPA

SEQ ID NO: 469796 - protein, 13 aa, Mycobacterium
EQHIRRDKATSNI

SEQ ID NO: 469797 - protein, 9 aa, Mycobacterium
EQHKDPATF

SEQ ID NO: 469798 - protein, 7 aa, Mycobacterium
EQHPDRD

SEQ ID NO: 469799 - protein, 5 aa, Mycobacterium
EQHPL

SEQ ID NO: 469800 - protein, 5 aa, Mycobacterium
EQIAD

SEQ ID NO: 469801 - protein, 6 aa, Mycobacterium
EQIDEA

SEQ ID NO: 469802 - protein, 6 aa, Mycobacterium
EQIDPR

SEQ ID NO: 469803 - protein, 4 aa, Mycobacterium
EQIE

SEQ ID NO: 469804 - protein, 12 aa, Mycobacterium
EQIEPGAGRPPR

SEQ ID NO: 469805 - protein, 10 aa, Mycobacterium
EQIEQDSDRD

SEQ ID NO: 469806 - protein, 5 aa, Mycobacterium
EQIGD

SEQ ID NO: 469807 - protein, 27 aa, Mycobacterium
EQITDAAPVEQPGGEAPQSEPADGSPM

SEQ ID NO: 469808 - protein, 8 aa, Mycobacterium
EQITPETT

SEQ ID NO: 469809 - protein, 4 aa, Mycobacterium
EQIY

SEQ ID NO: 469810 - protein, 30 aa, Mycobacterium
EQKAEQREELQGDRERAGRKASVGEQPRVE

SEQ ID NO: 469811 - protein, 9 aa, Mycobacterium
EQKANAQSV

SEQ ID NO: 469812 - protein, 13 aa, Mycobacterium
EQKEKTGQGASIG

SEQ ID NO: 469813 - protein, 6 aa, Mycobacterium
EQKEPV

SEQ ID NO: 469814 - protein, 6 aa, Mycobacterium
EQKFQD

SEQ ID NO: 469815 - protein, 9 aa, Mycobacterium
EQKKAHPNI

SEQ ID NO: 469816 - protein, 9 aa, Mycobacterium
EQKKRGREQ

SEQ ID NO: 469817 - protein, 6 aa, Mycobacterium
EQKPIE

SEQ ID NO: 469818 - protein, 5 aa, Mycobacterium
EQKPV

SEQ ID NO: 469819 - protein, 9 aa, Mycobacterium
EQKPYTRRP

SEQ ID NO: 469820 - protein, 8 aa, Mycobacterium
EQKQPTSE

SEQ ID NO: 469821 - protein, 9 aa, Mycobacterium
EQKQPTSER

SEQ ID NO: 469822 - protein, 5 aa, Mycobacterium
EQKRP

SEQ ID NO: 469823 - protein, 6 aa, Mycobacterium
EQKRRL

SEQ ID NO: 469824 - protein, 8 aa, Mycobacterium
EQKTKNMD

SEQ ID NO: 469825 - protein, 11 aa, Mycobacterium
EQKTQQRIAPD

SEQ ID NO: 469826 - protein, 6 aa, Mycobacterium
EQLADD

SEQ ID NO: 469827 - protein, 10 aa, Mycobacterium
EQLANSDAGA

SEQ ID NO: 469828 - protein, 11 aa, Mycobacterium
EQLANSDPGAA

SEQ ID NO: 469829 - protein, 6 aa, Mycobacterium
EQLAPE

SEQ ID NO: 469830 - protein, 10 aa, Mycobacterium
EQLASGDYNP

SEQ ID NO: 469831 - protein, 4 aa, Mycobacterium
EQLD

SEQ ID NO: 469832 - protein, 10 aa, Mycobacterium
EQLDQRRVDE

SEQ ID NO: 469833 - protein, 8 aa, Mycobacterium
EQLGADPA

SEQ ID NO: 469834 - protein, 9 aa, Mycobacterium
EQLGAGKPI

SEQ ID NO: 469835 - protein, 10 aa, Mycobacterium
EQLGLSPDEV

SEQ ID NO: 469836 - protein, 5 aa, Mycobacterium
EQLGP

SEQ ID NO: 469837 - protein, 8 aa, Mycobacterium
EQLGPQAL

SEQ ID NO: 469838 - protein, 7 aa, Mycobacterium
EQLGTEP

SEQ ID NO: 469839 - protein, 9 aa, Mycobacterium
EQLNSEGRP

SEQ ID NO: 469840 - protein, 4 aa, Mycobacterium
EQLP

SEQ ID NO: 469841 - protein, 5 aa, Mycobacterium
EQLPD

SEQ ID NO: 469842 - protein, 7 aa, Mycobacterium
EQLPDGP

SEQ ID NO: 469843 - protein, 7 aa, Mycobacterium
EQLPDGW

SEQ ID NO: 469844 - protein, 17 aa, Mycobacterium
EQLPEAGTPPAVEQEQN

SEQ ID NO: 469845 - protein, 5 aa, Mycobacterium
EQLPF

SEQ ID NO: 469846 - protein, 6 aa, Mycobacterium
EQLPGS

SEQ ID NO: 469847 - protein, 7 aa, Mycobacterium
EQLPPDD

SEQ ID NO: 469848 - protein, 6 aa, Mycobacterium
EQLPTS

SEQ ID NO: 469849 - protein, 12 aa, Mycobacterium
EQLPVGDPFRGG

SEQ ID NO: 469850 - protein, 4 aa, Mycobacterium
EQLQ

SEQ ID NO: 469851 - protein, 10 aa, Mycobacterium
EQLRGLPDPL

SEQ ID NO: 469852 - protein, 5 aa, Mycobacterium
EQLRS

SEQ ID NO: 469853 - protein, 5 aa, Mycobacterium
EQLSA

SEQ ID NO: 469854 - protein, 9 aa, Mycobacterium
EQLSGDEAH

SEQ ID NO: 469855 - protein, 9 aa, Mycobacterium
EQLSNADVD

SEQ ID NO: 469856 - protein, 8 aa, Mycobacterium
EQLSPERQ

SEQ ID NO: 469857 - protein, 9 aa, Mycobacterium
EQLSPERQA

SEQ ID NO: 469858 - protein, 11 aa, Mycobacterium
EQLSRDPRPYP

SEQ ID NO: 469859 - protein, 5 aa, Mycobacterium
EQLST

SEQ ID NO: 469860 - protein, 7 aa, Mycobacterium
EQLTANQ

SEQ ID NO: 469861 - protein, 7 aa, Mycobacterium
EQLTDAG

SEQ ID NO: 469862 - protein, 14 aa, Mycobacterium
EQLTGDPTPRPAQA

SEQ ID NO: 469863 - protein, 9 aa, Mycobacterium
EQLTGEPSY

SEQ ID NO: 469864 - protein, 8 aa, Mycobacterium
EQLTGSQA

SEQ ID NO: 469865 - protein, 5 aa, Mycobacterium
EQLTP

SEQ ID NO: 469866 - protein, 10 aa, Mycobacterium
EQMDERSDEV

SEQ ID NO: 469867 - protein, 13 aa, Mycobacterium
EQMPRQQKGLRND

SEQ ID NO: 469868 - protein, 6 aa, Mycobacterium
EQMQST

SEQ ID NO: 469869 - protein, 4 aa, Mycobacterium
EQMR

SEQ ID NO: 469870 - protein, 4 aa, Mycobacterium
EQMS

SEQ ID NO: 469871 - protein, 10 aa, Mycobacterium
EQNAADPDFR

SEQ ID NO: 469872 - protein, 8 aa, Mycobacterium
EQNAEPRH

SEQ ID NO: 469873 - protein, 6 aa, Mycobacterium
EQNAGS

SEQ ID NO: 469874 - protein, 8 aa, Mycobacterium
EQNCSTST

SEQ ID NO: 469875 - protein, 7 aa, Mycobacterium
EQNEPAE

SEQ ID NO: 469876 - protein, 9 aa, Mycobacterium
EQNEPPARR

SEQ ID NO: 469877 - protein, 4 aa, Mycobacterium
EQNP

SEQ ID NO: 469878 - protein, 8 aa, Mycobacterium
EQNPANRQ

SEQ ID NO: 469879 - protein, 9 aa, Mycobacterium
EQNPPDPAV

SEQ ID NO: 469880 - protein, 6 aa, Mycobacterium
EQNPQA

SEQ ID NO: 469881 - protein, 5 aa, Mycobacterium
EQNQL

SEQ ID NO: 469882 - protein, 8 aa, Mycobacterium
EQNREQVG

SEQ ID NO: 469883 - protein, 16 aa, Mycobacterium
EQNRGSIGKASPANGG

SEQ ID NO: 469884 - protein, 10 aa, Mycobacterium
EQNRPRFERE

SEQ ID NO: 469885 - protein, 15 aa, Mycobacterium
EQNRRSHPLQGTQTL

SEQ ID NO: 469886 - protein, 5 aa, Mycobacterium
EQNRS

SEQ ID NO: 469887 - protein, 5 aa, Mycobacterium
EQNRT

SEQ ID NO: 469888 - protein, 5 aa, Mycobacterium
EQNVD

SEQ ID NO: 469889 - protein, 8 aa, Mycobacterium
EQNVPGSP

SEQ ID NO: 469890 - protein, 17 aa, Mycobacterium
EQPAAAQHPAPNGREID

SEQ ID NO: 469891 - protein, 19 aa, Mycobacterium
EQPAEEGQAEEGQQAPDAV

SEQ ID NO: 469892 - protein, 10 aa, Mycobacterium
EQPAPASNPA

SEQ ID NO: 469893 - protein, 10 aa, Mycobacterium
EQPAPKPAKG

SEQ ID NO: 469894 - protein, 7 aa, Mycobacterium
EQPARRL

SEQ ID NO: 469895 - protein, 15 aa, Mycobacterium
EQPATELPMTQRYFL

SEQ ID NO: 469896 - protein, 6 aa, Mycobacterium
EQPAVS

SEQ ID NO: 469897 - protein, 30 aa, Mycobacterium
EQPDASAHHSSQTHADHRRRQSQRQCTEAR

SEQ ID NO: 469898 - protein, 5 aa, Mycobacterium
EQPDE

SEQ ID NO: 469899 - protein, 11 aa, Mycobacterium
EQPDLQLPTEE

SEQ ID NO: 469900 - protein, 12 aa, Mycobacterium
EQPDLQLPTEEQ

SEQ ID NO: 469901 - protein, 9 aa, Mycobacterium
EQPDLSPKA

SEQ ID NO: 469902 - protein, 7 aa, Mycobacterium
EQPDPAR

SEQ ID NO: 469903 - protein, 7 aa, Mycobacterium
EQPDPVA

SEQ ID NO: 469904 - protein, 10 aa, Mycobacterium
EQPDSGTVKI

SEQ ID NO: 469905 - protein, 11 aa, Mycobacterium
EQPDSGTVKVG

SEQ ID NO: 469906 - protein, 6 aa, Mycobacterium
EQPDVN

SEQ ID NO: 469907 - protein, 27 aa, Mycobacterium
EQPEEFPDAAPQVESVQTGPSSPTTQW

SEQ ID NO: 469908 - protein, 8 aa, Mycobacterium
EQPEGYDV

SEQ ID NO: 469909 - protein, 7 aa, Mycobacterium
EQPELNS

SEQ ID NO: 469910 - protein, 6 aa, Mycobacterium
EQPEPM

SEQ ID NO: 469911 - protein, 8 aa, Mycobacterium
EQPEPTST

SEQ ID NO: 469912 - protein, 9 aa, Mycobacterium
EQPGDKEDL

SEQ ID NO: 469913 - protein, 16 aa, Mycobacterium
EQPGDQEDRAGEPFVG

SEQ ID NO: 469914 - protein, 12 aa, Mycobacterium
EQPGDREDQEGL

SEQ ID NO: 469915 - protein, 16 aa, Mycobacterium
EQPGDREDRAGEPFVG

SEQ ID NO: 469916 - protein, 8 aa, Mycobacterium
EQPGGART

SEQ ID NO: 469917 - protein, 5 aa, Mycobacterium
EQPGL

SEQ ID NO: 469918 - protein, 11 aa, Mycobacterium
EQPGPRSPTAI

SEQ ID NO: 469919 - protein, 8 aa, Mycobacterium
EQPGQDNV

SEQ ID NO: 469920 - protein, 4 aa, Mycobacterium
EQPI

SEQ ID NO: 469921 - protein, 5 aa, Mycobacterium
EQPIK

SEQ ID NO: 469922 - protein, 4 aa, Mycobacterium
EQPL

SEQ ID NO: 469923 - protein, 20 aa, Mycobacterium
EQPLEPARPLAETEAASQRA

SEQ ID NO: 469924 - protein, 12 aa, Mycobacterium
EQPLGKDKDGND

SEQ ID NO: 469925 - protein, 5 aa, Mycobacterium
EQPLH

SEQ ID NO: 469926 - protein, 9 aa, Mycobacterium
EQPLPPNRA

SEQ ID NO: 469927 - protein, 10 aa, Mycobacterium
EQPNSGGGAW

SEQ ID NO: 469928 - protein, 7 aa, Mycobacterium
EQPNVTE

SEQ ID NO: 469929 - protein, 4 aa, Mycobacterium
EQPP

SEQ ID NO: 469930 - protein, 9 aa, Mycobacterium
EQPPGYDGE

SEQ ID NO: 469931 - protein, 44 aa, Mycobacterium
EQPPPPPPPAPGQSLGDSGIYGPPVQGPGLNGDGVQVPSDSALP

SEQ ID NO: 469932 - protein, 6 aa, Mycobacterium
EQPQPV

SEQ ID NO: 469933 - protein, 12 aa, Mycobacterium
EQPQTQAPDTAL

SEQ ID NO: 469934 - protein, 16 aa, Mycobacterium
EQPRGRGRGRGQRGDV

SEQ ID NO: 469935 - protein, 9 aa, Mycobacterium
EQPRPREEL

SEQ ID NO: 469936 - protein, 11 aa, Mycobacterium
EQPSDLSEEAL

SEQ ID NO: 469937 - protein, 5 aa, Mycobacterium
EQPSH

SEQ ID NO: 469938 - protein, 9 aa, Mycobacterium
EQPSLATDI

SEQ ID NO: 469939 - protein, 6 aa, Mycobacterium
EQPTAV

SEQ ID NO: 469940 - protein, 5 aa, Mycobacterium
EQPTD

SEQ ID NO: 469941 - protein, 7 aa, Mycobacterium
EQPTGGS

SEQ ID NO: 469942 - protein, 5 aa, Mycobacterium
EQPTH

SEQ ID NO: 469943 - protein, 5 aa, Mycobacterium
EQPTI

SEQ ID NO: 469944 - protein, 10 aa, Mycobacterium
EQPTPRQQDQ

SEQ ID NO: 469945 - protein, 10 aa, Mycobacterium
EQPTSSEAQL

SEQ ID NO: 469946 - protein, 19 aa, Mycobacterium
EQPVGAGSTAGNALGTTLG

SEQ ID NO: 469947 - protein, 9 aa, Mycobacterium
EQPVSPQGY

SEQ ID NO: 469948 - protein, 10 aa, Mycobacterium
EQQAADHADL

SEQ ID NO: 469949 - protein, 9 aa, Mycobacterium
EQQAADHAN

SEQ ID NO: 469950 - protein, 8 aa, Mycobacterium
EQQAAGRL

SEQ ID NO: 469951 - protein, 25 aa, Mycobacterium
EQQAAKAAAAGKTKEAEQAKANAEQ

SEQ ID NO: 469952 - protein, 11 aa, Mycobacterium
EQQAAKAGHSL

SEQ ID NO: 469953 - protein, 9 aa, Mycobacterium
EQQADDHAD

SEQ ID NO: 469954 - protein, 10 aa, Mycobacterium
EQQADDHADI

SEQ ID NO: 469955 - protein, 5 aa, Mycobacterium
EQQAM

SEQ ID NO: 469956 - protein, 9 aa, Mycobacterium
EQQARDEGH

SEQ ID NO: 469957 - protein, 10 aa, Mycobacterium
EQQARDEGYD

SEQ ID NO: 469958 - protein, 8 aa, Mycobacterium
EQQARDQI

SEQ ID NO: 469959 - protein, 6 aa, Mycobacterium
EQQAYE

SEQ ID NO: 469960 - protein, 7 aa, Mycobacterium
EQQDSGH

SEQ ID NO: 469961 - protein, 8 aa, Mycobacterium
EQQESATT

SEQ ID NO: 469962 - protein, 8 aa, Mycobacterium
EQQETATT

SEQ ID NO: 469963 - protein, 5 aa, Mycobacterium
EQQEY

SEQ ID NO: 469964 - protein, 27 aa, Mycobacterium
EQQGAEKNLAKARAAEHQARSEAETAA

SEQ ID NO: 469965 - protein, 6 aa, Mycobacterium
EQQGPT

SEQ ID NO: 469966 - protein, 4 aa, Mycobacterium
EQQH

SEQ ID NO: 469967 - protein, 4 aa, Mycobacterium
EQQM

SEQ ID NO: 469968 - protein, 6 aa, Mycobacterium
EQQPAL

SEQ ID NO: 469969 - protein, 8 aa, Mycobacterium
EQQPDRTK

SEQ ID NO: 469970 - protein, 5 aa, Mycobacterium
EQQPI

SEQ ID NO: 469971 - protein, 40 aa, Mycobacterium
EQQPPTGSRAADAEPDDDAGKTDAGKTDAAKTDPSTADDQ

SEQ ID NO: 469972 - protein, 12 aa, Mycobacterium
EQQQHKTSFTYD

SEQ ID NO: 469973 - protein, 8 aa, Mycobacterium
EQQRAAAP

SEQ ID NO: 469974 - protein, 12 aa, Mycobacterium
EQQRAKKLPPAE

SEQ ID NO: 469975 - protein, 18 aa, Mycobacterium
EQQRANEREKKARQRAAK

SEQ ID NO: 469976 - protein, 7 aa, Mycobacterium
EQQRQRV

SEQ ID NO: 469977 - protein, 9 aa, Mycobacterium
EQQSQEGSY

SEQ ID NO: 469978 - protein, 8 aa, Mycobacterium
EQQTADAA

SEQ ID NO: 469979 - protein, 7 aa, Mycobacterium
EQQTGRA

SEQ ID NO: 469980 - protein, 5 aa, Mycobacterium
EQQTQ

SEQ ID NO: 469981 - protein, 6 aa, Mycobacterium
EQQTQR

SEQ ID NO: 469982 - protein, 5 aa, Mycobacterium
EQQTT

SEQ ID NO: 469983 - protein, 4 aa, Mycobacterium
EQQW

SEQ ID NO: 469984 - protein, 17 aa, Mycobacterium
EQQWASGDCRRDEVRES

SEQ ID NO: 469985 - protein, 16 aa, Mycobacterium
EQQWASGNCERDGVRE

SEQ ID NO: 469986 - protein, 5 aa, Mycobacterium
EQQYT

SEQ ID NO: 469987 - protein, 10 aa, Mycobacterium
EQRAAAEAAL

SEQ ID NO: 469988 - protein, 11 aa, Mycobacterium
EQRAAVTAPRG

SEQ ID NO: 469989 - protein, 12 aa, Mycobacterium
EQRADHAEHAQR

SEQ ID NO: 469990 - protein, 6 aa, Mycobacterium
EQRAEV

SEQ ID NO: 469991 - protein, 5 aa, Mycobacterium
EQRAG

SEQ ID NO: 469992 - protein, 7 aa, Mycobacterium
EQRAGGL

SEQ ID NO: 469993 - protein, 10 aa, Mycobacterium
EQRASVGDEE

SEQ ID NO: 469994 - protein, 7 aa, Mycobacterium
EQRATEP

SEQ ID NO: 469995 - protein, 6 aa, Mycobacterium
EQRATG

SEQ ID NO: 469996 - protein, 4 aa, Mycobacterium
EQRD

SEQ ID NO: 469997 - protein, 9 aa, Mycobacterium
EQRDAPALR

SEQ ID NO: 469998 - protein, 14 aa, Mycobacterium
EQRDAVQEDFDSDT

SEQ ID NO: 469999 - protein, 10 aa, Mycobacterium
EQRDDPTLRG

SEQ ID NO: 470000 - protein, 7 aa, Mycobacterium
EQRDISG

SEQ ID NO: 470001 - protein, 6 aa, Mycobacterium
EQRDTA

SEQ ID NO: 470002 - protein, 17 aa, Mycobacterium
EQREAEGGSKVPEDTLS

SEQ ID NO: 470003 - protein, 6 aa, Mycobacterium
EQREAG

SEQ ID NO: 470004 - protein, 5 aa, Mycobacterium
EQRGA

SEQ ID NO: 470005 - protein, 19 aa, Mycobacterium
EQRGAASDGGGSKVPEETL

SEQ ID NO: 470006 - protein, 6 aa, Mycobacterium
EQRGDA

SEQ ID NO: 470007 - protein, 9 aa, Mycobacterium
EQRGDAEVD

SEQ ID NO: 470008 - protein, 6 aa, Mycobacterium
EQRGDG

SEQ ID NO: 470009 - protein, 7 aa, Mycobacterium
EQRGDGH

SEQ ID NO: 470010 - protein, 11 aa, Mycobacterium
EQRGDPGYKAT

SEQ ID NO: 470011 - protein, 5 aa, Mycobacterium
EQRGF

SEQ ID NO: 470012 - protein, 7 aa, Mycobacterium
EQRGLDQ

SEQ ID NO: 470013 - protein, 17 aa, Mycobacterium
EQRGNPKVVASSEQSYN

SEQ ID NO: 470014 - protein, 5 aa, Mycobacterium
EQRGP

SEQ ID NO: 470015 - protein, 6 aa, Mycobacterium
EQRGPA

SEQ ID NO: 470016 - protein, 14 aa, Mycobacterium
EQRGPEAWRLRLIK

SEQ ID NO: 470017 - protein, 15 aa, Mycobacterium
EQRGPVTALAPGRTR

SEQ ID NO: 470018 - protein, 6 aa, Mycobacterium
EQRGQL

SEQ ID NO: 470019 - protein, 9 aa, Mycobacterium
EQRGRIDES

SEQ ID NO: 470020 - protein, 5 aa, Mycobacterium
EQRHA

SEQ ID NO: 470021 - protein, 6 aa, Mycobacterium
EQRHPD

SEQ ID NO: 470022 - protein, 7 aa, Mycobacterium
EQRHSQR

SEQ ID NO: 470023 - protein, 6 aa, Mycobacterium
EQRKDT

SEQ ID NO: 470024 - protein, 4 aa, Mycobacterium
EQRL

SEQ ID NO: 470025 - protein, 10 aa, Mycobacterium
EQRLGNNKSI

SEQ ID NO: 470026 - protein, 5 aa, Mycobacterium
EQRNA

SEQ ID NO: 470027 - protein, 32 aa, Mycobacterium
EQRNASDKFTREEQDEFAARSHQNAARGWKDG

SEQ ID NO: 470028 - protein, 14 aa, Mycobacterium
EQRNGRAVRNGNQH

SEQ ID NO: 470029 - protein, 10 aa, Mycobacterium
EQRNTPPAEL

SEQ ID NO: 470030 - protein, 12 aa, Mycobacterium
EQRNTSRGWFSR

SEQ ID NO: 470031 - protein, 6 aa, Mycobacterium
EQRPAD

SEQ ID NO: 470032 - protein, 8 aa, Mycobacterium
EQRPGTDL

SEQ ID NO: 470033 - protein, 5 aa, Mycobacterium
EQRPI

SEQ ID NO: 470034 - protein, 6 aa, Mycobacterium
EQRPPF

SEQ ID NO: 470035 - protein, 9 aa, Mycobacterium
EQRPPGANA

SEQ ID NO: 470036 - protein, 6 aa, Mycobacterium
EQRPSE

SEQ ID NO: 470037 - protein, 4 aa, Mycobacterium
EQRQ

SEQ ID NO: 470038 - protein, 8 aa, Mycobacterium
EQRQDTRE

SEQ ID NO: 470039 - protein, 5 aa, Mycobacterium
EQRRA

SEQ ID NO: 470040 - protein, 9 aa, Mycobacterium
EQRRDDTRL

SEQ ID NO: 470041 - protein, 6 aa, Mycobacterium
EQRREE

SEQ ID NO: 470042 - protein, 6 aa, Mycobacterium
EQRREQ

SEQ ID NO: 470043 - protein, 8 aa, Mycobacterium
EQRREYRR

SEQ ID NO: 470044 - protein, 30 aa, Mycobacterium
EQRRPGDRRADGNRPRPGRQRRADGHAHRG

SEQ ID NO: 470045 - protein, 9 aa, Mycobacterium
EQRRRTADS

SEQ ID NO: 470046 - protein, 8 aa, Mycobacterium
EQRRRTEL

SEQ ID NO: 470047 - protein, 14 aa, Mycobacterium
EQRRSPTGSSFLTA

SEQ ID NO: 470048 - protein, 12 aa, Mycobacterium
EQRRSRSTTRQH

SEQ ID NO: 470049 - protein, 14 aa, Mycobacterium
EQRSAGPDRDTGAA

SEQ ID NO: 470050 - protein, 7 aa, Mycobacterium
EQRSEAA

SEQ ID NO: 470051 - protein, 8 aa, Mycobacterium
EQRSLTKA

SEQ ID NO: 470052 - protein, 8 aa, Mycobacterium
EQRSMTEL

SEQ ID NO: 470053 - protein, 5 aa, Mycobacterium
EQRSS

SEQ ID NO: 470054 - protein, 15 aa, Mycobacterium
EQRSSQVSYARTRGE

SEQ ID NO: 470055 - protein, 16 aa, Mycobacterium
EQRSSQVSYARTRGEL

SEQ ID NO: 470056 - protein, 6 aa, Mycobacterium
EQRSSR

SEQ ID NO: 470057 - protein, 11 aa, Mycobacterium
EQRTDHAEHAR

SEQ ID NO: 470058 - protein, 20 aa, Mycobacterium
EQRTNFDTGAPRIDKATGQA

SEQ ID NO: 470059 - protein, 19 aa, Mycobacterium
EQRTNFDTGAPRVDKATGQ

SEQ ID NO: 470060 - protein, 5 aa, Mycobacterium
EQRTS

SEQ ID NO: 470061 - protein, 8 aa, Mycobacterium
EQRTSHYR

SEQ ID NO: 470062 - protein, 4 aa, Mycobacterium
EQRV

SEQ ID NO: 470063 - protein, 6 aa, Mycobacterium
EQRVPD

SEQ ID NO: 470064 - protein, 4 aa, Mycobacterium
EQRW

SEQ ID NO: 470065 - protein, 23 aa, Mycobacterium
EQRYSGGTRPTAETVHGAGHTEI

SEQ ID NO: 470066 - protein, 9 aa, Mycobacterium
EQSAAGGAG

SEQ ID NO: 470067 - protein, 10 aa, Mycobacterium
EQSAEQMAER

SEQ ID NO: 470068 - protein, 7 aa, Mycobacterium
EQSAGNV

SEQ ID NO: 470069 - protein, 9 aa, Mycobacterium
EQSAGRPEL

SEQ ID NO: 470070 - protein, 9 aa, Mycobacterium
EQSAKAGFT

SEQ ID NO: 470071 - protein, 14 aa, Mycobacterium
EQSALRAAAAGGRY

SEQ ID NO: 470072 - protein, 15 aa, Mycobacterium
EQSAQRLRDERWGPR

SEQ ID NO: 470073 - protein, 19 aa, Mycobacterium
EQSASGAARTTLARRTSSV

SEQ ID NO: 470074 - protein, 15 aa, Mycobacterium
EQSATDLTSKASGAA

SEQ ID NO: 470075 - protein, 14 aa, Mycobacterium
EQSATQATAAAAAY

SEQ ID NO: 470076 - protein, 10 aa, Mycobacterium
EQSDAVREQV

SEQ ID NO: 470077 - protein, 8 aa, Mycobacterium
EQSDNDIS

SEQ ID NO: 470078 - protein, 30 aa, Mycobacterium
EQSEDALEAYANGSQIQEIRPGKPPSIGGL

SEQ ID NO: 470079 - protein, 34 aa, Mycobacterium
EQSEDSKAKGQKRRGVPNPAPMPEPDSDPRLKLV

SEQ ID NO: 470080 - protein, 10 aa, Mycobacterium
EQSEGTEVDR

SEQ ID NO: 470081 - protein, 5 aa, Mycobacterium
EQSEP

SEQ ID NO: 470082 - protein, 7 aa, Mycobacterium
EQSFTGE

SEQ ID NO: 470083 - protein, 8 aa, Mycobacterium
EQSGDGRS

SEQ ID NO: 470084 - protein, 7 aa, Mycobacterium
EQSGFGT

SEQ ID NO: 470085 - protein, 7 aa, Mycobacterium
EQSGGGR

SEQ ID NO: 470086 - protein, 10 aa, Mycobacterium
EQSGGTRYRD

SEQ ID NO: 470087 - protein, 9 aa, Mycobacterium
EQSGGVDGR

SEQ ID NO: 470088 - protein, 5 aa, Mycobacterium
EQSGL

SEQ ID NO: 470089 - protein, 10 aa, Mycobacterium
EQSGPTVSQT

SEQ ID NO: 470090 - protein, 6 aa, Mycobacterium
EQSGQT

SEQ ID NO: 470091 - protein, 6 aa, Mycobacterium
EQSGRS

SEQ ID NO: 470092 - protein, 13 aa, Mycobacterium
EQSHTGATAMADR

SEQ ID NO: 470093 - protein, 8 aa, Mycobacterium
EQSKLATA

SEQ ID NO: 470094 - protein, 10 aa, Mycobacterium
EQSLADQRYD

SEQ ID NO: 470095 - protein, 7 aa, Mycobacterium
EQSLASA

SEQ ID NO: 470096 - protein, 18 aa, Mycobacterium
EQSLPGSRTTTSAGTPGL

SEQ ID NO: 470097 - protein, 7 aa, Mycobacterium
EQSMPKR

SEQ ID NO: 470098 - protein, 8 aa, Mycobacterium
EQSNNISR

SEQ ID NO: 470099 - protein, 8 aa, Mycobacterium
EQSPDDHS

SEQ ID NO: 470100 - protein, 9 aa, Mycobacterium
EQSPDEPVT

SEQ ID NO: 470101 - protein, 10 aa, Mycobacterium
EQSPERDADA

SEQ ID NO: 470102 - protein, 8 aa, Mycobacterium
EQSPGVRR

SEQ ID NO: 470103 - protein, 9 aa, Mycobacterium
EQSPPPVAT

SEQ ID NO: 470104 - protein, 18 aa, Mycobacterium
EQSPTAPATRRAASQERR

SEQ ID NO: 470105 - protein, 6 aa, Mycobacterium
EQSPVY

SEQ ID NO: 470106 - protein, 11 aa, Mycobacterium
EQSQNAGGPAM

SEQ ID NO: 470107 - protein, 5 aa, Mycobacterium
EQSRD

SEQ ID NO: 470108 - protein, 18 aa, Mycobacterium
EQSREAVPHRQRKYGTPY

SEQ ID NO: 470109 - protein, 11 aa, Mycobacterium
EQSRGRGKRPV

SEQ ID NO: 470110 - protein, 5 aa, Mycobacterium
EQSRL

SEQ ID NO: 470111 - protein, 7 aa, Mycobacterium
EQSRPEL

SEQ ID NO: 470112 - protein, 8 aa, Mycobacterium
EQSRPLSE

SEQ ID NO: 470113 - protein, 8 aa, Mycobacterium
EQSRPTSV

SEQ ID NO: 470114 - protein, 12 aa, Mycobacterium
EQSRQRGETPEE

SEQ ID NO: 470115 - protein, 12 aa, Mycobacterium
EQSRQRGTTPEE

SEQ ID NO: 470116 - protein, 8 aa, Mycobacterium
EQSRTQGA

SEQ ID NO: 470117 - protein, 8 aa, Mycobacterium
EQSRVSTK

SEQ ID NO: 470118 - protein, 4 aa, Mycobacterium
EQSS

SEQ ID NO: 470119 - protein, 15 aa, Mycobacterium
EQSSEAQPALRRQQA

SEQ ID NO: 470120 - protein, 8 aa, Mycobacterium
EQSSEPAV

SEQ ID NO: 470121 - protein, 5 aa, Mycobacterium
EQSSP

SEQ ID NO: 470122 - protein, 17 aa, Mycobacterium
EQSSPAGADGPTLTERE

SEQ ID NO: 470123 - protein, 6 aa, Mycobacterium
EQSSRW

SEQ ID NO: 470124 - protein, 7 aa, Mycobacterium
EQSTPYE

SEQ ID NO: 470125 - protein, 5 aa, Mycobacterium
EQSVE

SEQ ID NO: 470126 - protein, 7 aa, Mycobacterium
EQSVPGL

SEQ ID NO: 470127 - protein, 4 aa, Mycobacterium
EQTA

SEQ ID NO: 470128 - protein, 7 aa, Mycobacterium
EQTAAGL

SEQ ID NO: 470129 - protein, 9 aa, Mycobacterium
EQTAAQARA

SEQ ID NO: 470130 - protein, 6 aa, Mycobacterium
EQTADG

SEQ ID NO: 470131 - protein, 14 aa, Mycobacterium
EQTADGRFALAGEG

SEQ ID NO: 470132 - protein, 16 aa, Mycobacterium
EQTADGRFALAGEGDQ

SEQ ID NO: 470133 - protein, 7 aa, Mycobacterium
EQTAETF

SEQ ID NO: 470134 - protein, 8 aa, Mycobacterium
EQTAHRAD

SEQ ID NO: 470135 - protein, 7 aa, Mycobacterium
EQTAITS

SEQ ID NO: 470136 - protein, 7 aa, Mycobacterium
EQTAKNL

SEQ ID NO: 470137 - protein, 8 aa, Mycobacterium
EQTARGHD

SEQ ID NO: 470138 - protein, 9 aa, Mycobacterium
EQTARGREM

SEQ ID NO: 470139 - protein, 7 aa, Mycobacterium
EQTAVTS

SEQ ID NO: 470140 - protein, 19 aa, Mycobacterium
EQTDAAAGALPGLAQPAAK

SEQ ID NO: 470141 - protein, 19 aa, Mycobacterium
EQTDAAAGALPGLSEPAAK

SEQ ID NO: 470142 - protein, 19 aa, Mycobacterium
EQTDAAAGALPGLSQPAAK

SEQ ID NO: 470143 - protein, 5 aa, Mycobacterium
EQTDD

SEQ ID NO: 470144 - protein, 7 aa, Mycobacterium
EQTDKPW

SEQ ID NO: 470145 - protein, 9 aa, Mycobacterium
EQTDPAGPV

SEQ ID NO: 470146 - protein, 7 aa, Mycobacterium
EQTDPAR

SEQ ID NO: 470147 - protein, 6 aa, Mycobacterium
EQTDPQ

SEQ ID NO: 470148 - protein, 25 aa, Mycobacterium
EQTDRVGADERKAARKARRQSDDGE

SEQ ID NO: 470149 - protein, 10 aa, Mycobacterium
EQTDSEQMKE

SEQ ID NO: 470150 - protein, 11 aa, Mycobacterium
EQTDSEQTKER

SEQ ID NO: 470151 - protein, 5 aa, Mycobacterium
EQTDT

SEQ ID NO: 470152 - protein, 17 aa, Mycobacterium
EQTEARPADDVHAAHAT

SEQ ID NO: 470153 - protein, 17 aa, Mycobacterium
EQTEARPADDVHAAHVS

SEQ ID NO: 470154 - protein, 17 aa, Mycobacterium
EQTEARPADDVHAAHVT

SEQ ID NO: 470155 - protein, 19 aa, Mycobacterium
EQTEARPADEVRASQVATG

SEQ ID NO: 470156 - protein, 11 aa, Mycobacterium
EQTENPNPANE

SEQ ID NO: 470157 - protein, 7 aa, Mycobacterium
EQTEQTF

SEQ ID NO: 470158 - protein, 10 aa, Mycobacterium
EQTESEWAKE

SEQ ID NO: 470159 - protein, 6 aa, Mycobacterium
EQTETR

SEQ ID NO: 470160 - protein, 4 aa, Mycobacterium
EQTG

SEQ ID NO: 470161 - protein, 8 aa, Mycobacterium
EQTGETRV

SEQ ID NO: 470162 - protein, 7 aa, Mycobacterium
EQTGFDG

SEQ ID NO: 470163 - protein, 8 aa, Mycobacterium
EQTGGKPF

SEQ ID NO: 470164 - protein, 9 aa, Mycobacterium
EQTGGKPYG

SEQ ID NO: 470165 - protein, 8 aa, Mycobacterium
EQTGIPVE

SEQ ID NO: 470166 - protein, 7 aa, Mycobacterium
EQTGKTR

SEQ ID NO: 470167 - protein, 19 aa, Mycobacterium
EQTGLKTAAADLDDADGFA

SEQ ID NO: 470168 - protein, 7 aa, Mycobacterium
EQTGLTK

SEQ ID NO: 470169 - protein, 5 aa, Mycobacterium
EQTGN

SEQ ID NO: 470170 - protein, 5 aa, Mycobacterium
EQTGQ

SEQ ID NO: 470171 - protein, 5 aa, Mycobacterium
EQTHR

SEQ ID NO: 470172 - protein, 4 aa, Mycobacterium
EQTK

SEQ ID NO: 470173 - protein, 10 aa, Mycobacterium
EQTLASADDI

SEQ ID NO: 470174 - protein, 5 aa, Mycobacterium
EQTLR

SEQ ID NO: 470175 - protein, 6 aa, Mycobacterium
EQTNGV

SEQ ID NO: 470176 - protein, 18 aa, Mycobacterium
EQTNVRQASTVTARTDDP

SEQ ID NO: 470177 - protein, 9 aa, Mycobacterium
EQTPAAPAD

SEQ ID NO: 470178 - protein, 7 aa, Mycobacterium
EQTPAER

SEQ ID NO: 470179 - protein, 8 aa, Mycobacterium
EQTPAGPA

SEQ ID NO: 470180 - protein, 9 aa, Mycobacterium
EQTPAPGES

SEQ ID NO: 470181 - protein, 8 aa, Mycobacterium
EQTPDGAL

SEQ ID NO: 470182 - protein, 8 aa, Mycobacterium
EQTPGDPL

SEQ ID NO: 470183 - protein, 9 aa, Mycobacterium
EQTPQTEAA

SEQ ID NO: 470184 - protein, 6 aa, Mycobacterium
EQTPSS

SEQ ID NO: 470185 - protein, 7 aa, Mycobacterium
EQTRETF

SEQ ID NO: 470186 - protein, 5 aa, Mycobacterium
EQTSG

SEQ ID NO: 470187 - protein, 10 aa, Mycobacterium
EQTSRQRCQH

SEQ ID NO: 470188 - protein, 6 aa, Mycobacterium
EQTSRV

SEQ ID NO: 470189 - protein, 5 aa, Mycobacterium
EQTTS

SEQ ID NO: 470190 - protein, 9 aa, Mycobacterium
EQTTSPAAA

SEQ ID NO: 470191 - protein, 7 aa, Mycobacterium
EQTTTFK

SEQ ID NO: 470192 - protein, 7 aa, Mycobacterium
EQTVTEQ

SEQ ID NO: 470193 - protein, 6 aa, Mycobacterium
EQTVTR

SEQ ID NO: 470194 - protein, 4 aa, Mycobacterium
EQTY

SEQ ID NO: 470195 - protein, 5 aa, Mycobacterium
EQTYA

SEQ ID NO: 470196 - protein, 14 aa, Mycobacterium
EQVAAGSAGSNGAV

SEQ ID NO: 470197 - protein, 10 aa, Mycobacterium
EQVAKSASQH

SEQ ID NO: 470198 - protein, 8 aa, Mycobacterium
EQVASSTD

SEQ ID NO: 470199 - protein, 6 aa, Mycobacterium
EQVDGN

SEQ ID NO: 470200 - protein, 15 aa, Mycobacterium
EQVDRDDTNLSPAQA

SEQ ID NO: 470201 - protein, 4 aa, Mycobacterium
EQVE

SEQ ID NO: 470202 - protein, 9 aa, Mycobacterium
EQVEASPEV

SEQ ID NO: 470203 - protein, 7 aa, Mycobacterium
EQVEDAA

SEQ ID NO: 470204 - protein, 6 aa, Mycobacterium
EQVEDD

SEQ ID NO: 470205 - protein, 6 aa, Mycobacterium
EQVEQR

SEQ ID NO: 470206 - protein, 6 aa, Mycobacterium
EQVGAA

SEQ ID NO: 470207 - protein, 6 aa, Mycobacterium
EQVGAT

SEQ ID NO: 470208 - protein, 7 aa, Mycobacterium
EQVGESG

SEQ ID NO: 470209 - protein, 6 aa, Mycobacterium
EQVGGA

SEQ ID NO: 470210 - protein, 6 aa, Mycobacterium
EQVGGT

SEQ ID NO: 470211 - protein, 7 aa, Mycobacterium
EQVGHDG

SEQ ID NO: 470212 - protein, 7 aa, Mycobacterium
EQVGREA

SEQ ID NO: 470213 - protein, 15 aa, Mycobacterium
EQVGRTKRAQQAEAI

SEQ ID NO: 470214 - protein, 13 aa, Mycobacterium
EQVGTPTEVYDAP

SEQ ID NO: 470215 - protein, 4 aa, Mycobacterium
EQVK

SEQ ID NO: 470216 - protein, 6 aa, Mycobacterium
EQVKDG

SEQ ID NO: 470217 - protein, 4 aa, Mycobacterium
EQVP

SEQ ID NO: 470218 - protein, 6 aa, Mycobacterium
EQVPED

SEQ ID NO: 470219 - protein, 12 aa, Mycobacterium
EQVPEGPGSVAG

SEQ ID NO: 470220 - protein, 11 aa, Mycobacterium
EQVPGERYEHG

SEQ ID NO: 470221 - protein, 11 aa, Mycobacterium
EQVPGESYEHG

SEQ ID NO: 470222 - protein, 13 aa, Mycobacterium
EQVPSAGGSQVGS

SEQ ID NO: 470223 - protein, 9 aa, Mycobacterium
EQVPVPPGW

SEQ ID NO: 470224 - protein, 9 aa, Mycobacterium
EQVQASTEV

SEQ ID NO: 470225 - protein, 6 aa, Mycobacterium
EQVRAP

SEQ ID NO: 470226 - protein, 5 aa, Mycobacterium
EQVRD

SEQ ID NO: 470227 - protein, 7 aa, Mycobacterium
EQVRDSG

SEQ ID NO: 470228 - protein, 5 aa, Mycobacterium
EQVRQ

SEQ ID NO: 470229 - protein, 5 aa, Mycobacterium
EQVRR

SEQ ID NO: 470230 - protein, 13 aa, Mycobacterium
EQVRRAASGQEVR

SEQ ID NO: 470231 - protein, 8 aa, Mycobacterium
EQVSAQAG

SEQ ID NO: 470232 - protein, 10 aa, Mycobacterium
EQVSATELAE

SEQ ID NO: 470233 - protein, 9 aa, Mycobacterium
EQVSEASGV

SEQ ID NO: 470234 - protein, 6 aa, Mycobacterium
EQVSED

SEQ ID NO: 470235 - protein, 19 aa, Mycobacterium
EQVSQGDPRGRPDGGRQSD

SEQ ID NO: 470236 - protein, 8 aa, Mycobacterium
EQVTASAE

SEQ ID NO: 470237 - protein, 8 aa, Mycobacterium
EQVTGDGA

SEQ ID NO: 470238 - protein, 12 aa, Mycobacterium
EQVTGTNGHQRT

SEQ ID NO: 470239 - protein, 4 aa, Mycobacterium
EQVV

SEQ ID NO: 470240 - protein, 11 aa, Mycobacterium
EQWARNDGDPV

SEQ ID NO: 470241 - protein, 4 aa, Mycobacterium
EQWG

SEQ ID NO: 470242 - protein, 10 aa, Mycobacterium
EQWGGGGQPY

SEQ ID NO: 470243 - protein, 4 aa, Mycobacterium
EQWP

SEQ ID NO: 470244 - protein, 17 aa, Mycobacterium
EQWQDSPAGWPSRPTYS

SEQ ID NO: 470245 - protein, 4 aa, Mycobacterium
EQWS

SEQ ID NO: 470246 - protein, 4 aa, Mycobacterium
EQYA

SEQ ID NO: 470247 - protein, 6 aa, Mycobacterium
EQYDPA

SEQ ID NO: 470248 - protein, 12 aa, Mycobacterium
EQYENQGNPYYS

SEQ ID NO: 470249 - protein, 9 aa, Mycobacterium
EQYGAPSYA

SEQ ID NO: 470250 - protein, 10 aa, Mycobacterium
EQYGDTSRLS

SEQ ID NO: 470251 - protein, 11 aa, Mycobacterium
EQYGGGGGSFG

SEQ ID NO: 470252 - protein, 8 aa, Mycobacterium
EQYGGGGV

SEQ ID NO: 470253 - protein, 6 aa, Mycobacterium
EQYGSS

SEQ ID NO: 470254 - protein, 6 aa, Mycobacterium
EQYPDK

SEQ ID NO: 470255 - protein, 16 aa, Mycobacterium
EQYPELRTPDSPTQLV

SEQ ID NO: 470256 - protein, 4 aa, Mycobacterium
EQYR

SEQ ID NO: 470257 - protein, 7 aa, Mycobacterium
EQYRGTG

SEQ ID NO: 470258 - protein, 5 aa, Mycobacterium
EQYRQ

SEQ ID NO: 470259 - protein, 12 aa, Mycobacterium
EQYRQKQFVRLD

SEQ ID NO: 470260 - protein, 7 aa, Mycobacterium
EQYTETN

SEQ ID NO: 470261 - protein, 7 aa, Mycobacterium
ERAAAAA

SEQ ID NO: 470262 - protein, 7 aa, Mycobacterium
ERAAAAE

SEQ ID NO: 470263 - protein, 8 aa, Mycobacterium
ERAAADPE

SEQ ID NO: 470264 - protein, 7 aa, Mycobacterium
ERAAAGG

SEQ ID NO: 470265 - protein, 10 aa, Mycobacterium
ERAAAGPFGG

SEQ ID NO: 470266 - protein, 7 aa, Mycobacterium
ERAAASG

SEQ ID NO: 470267 - protein, 9 aa, Mycobacterium
ERAAATGST

SEQ ID NO: 470268 - protein, 6 aa, Mycobacterium
ERAAAV

SEQ ID NO: 470269 - protein, 7 aa, Mycobacterium
ERAADAG

SEQ ID NO: 470270 - protein, 6 aa, Mycobacterium
ERAADG

SEQ ID NO: 470271 - protein, 7 aa, Mycobacterium
ERAADPR

SEQ ID NO: 470272 - protein, 6 aa, Mycobacterium
ERAADQ

SEQ ID NO: 470273 - protein, 15 aa, Mycobacterium
ERAADSDAPSDADRR

SEQ ID NO: 470274 - protein, 5 aa, Mycobacterium
ERAAE

SEQ ID NO: 470275 - protein, 8 aa, Mycobacterium
ERAAEANG

SEQ ID NO: 470276 - protein, 8 aa, Mycobacterium
ERAAEGHR

SEQ ID NO: 470277 - protein, 12 aa, Mycobacterium
ERAAENTAQARR

SEQ ID NO: 470278 - protein, 11 aa, Mycobacterium
ERAAERAGRHI

SEQ ID NO: 470279 - protein, 9 aa, Mycobacterium
ERAAESSEY

SEQ ID NO: 470280 - protein, 28 aa, Mycobacterium
ERAAGAARRGADVAEELDDAPRGGITED

SEQ ID NO: 470281 - protein, 7 aa, Mycobacterium
ERAAGAG

SEQ ID NO: 470282 - protein, 7 aa, Mycobacterium
ERAAGAT

SEQ ID NO: 470283 - protein, 12 aa, Mycobacterium
ERAAGEPTGRPR

SEQ ID NO: 470284 - protein, 9 aa, Mycobacterium
ERAAGGGAT

SEQ ID NO: 470285 - protein, 7 aa, Mycobacterium
ERAAGNP

SEQ ID NO: 470286 - protein, 14 aa, Mycobacterium
ERAAGRAPDGPGPE

SEQ ID NO: 470287 - protein, 8 aa, Mycobacterium
ERAAGRQR

SEQ ID NO: 470288 - protein, 12 aa, Mycobacterium
ERAAHQREGSIR

SEQ ID NO: 470289 - protein, 14 aa, Mycobacterium
ERAAKALSDTVTPA

SEQ ID NO: 470290 - protein, 7 aa, Mycobacterium
ERAAPAE

SEQ ID NO: 470291 - protein, 8 aa, Mycobacterium
ERAAPSSW

SEQ ID NO: 470292 - protein, 11 aa, Mycobacterium
ERAAQISEATA

SEQ ID NO: 470293 - protein, 16 aa, Mycobacterium
ERAARAGLSAARSFEE

SEQ ID NO: 470294 - protein, 6 aa, Mycobacterium
ERAARE

SEQ ID NO: 470295 - protein, 11 aa, Mycobacterium
ERAARKDVYGT

SEQ ID NO: 470296 - protein, 10 aa, Mycobacterium
ERAARNADER

SEQ ID NO: 470297 - protein, 8 aa, Mycobacterium
ERAARRLN

SEQ ID NO: 470298 - protein, 7 aa, Mycobacterium
ERAARST

SEQ ID NO: 470299 - protein, 11 aa, Mycobacterium
ERAASTNDEAA

SEQ ID NO: 470300 - protein, 8 aa, Mycobacterium
ERAATDPR

SEQ ID NO: 470301 - protein, 6 aa, Mycobacterium
ERAATI

SEQ ID NO: 470302 - protein, 19 aa, Mycobacterium
ERAATIKTGDGTKDSDMGP

SEQ ID NO: 470303 - protein, 15 aa, Mycobacterium
ERAATRGDGRTGEDV

SEQ ID NO: 470304 - protein, 4 aa, Mycobacterium
ERAC

SEQ ID NO: 470305 - protein, 5 aa, Mycobacterium
ERADA

SEQ ID NO: 470306 - protein, 8 aa, Mycobacterium
ERADADEM

SEQ ID NO: 470307 - protein, 7 aa, Mycobacterium
ERADADT

SEQ ID NO: 470308 - protein, 27 aa, Mycobacterium
ERADGGESIAAPEDELASRRKHRDRKI

SEQ ID NO: 470309 - protein, 27 aa, Mycobacterium
ERADGGESIAAPEDELASRRKQRDRKI

SEQ ID NO: 470310 - protein, 10 aa, Mycobacterium
ERADGLTEAH

SEQ ID NO: 470311 - protein, 7 aa, Mycobacterium
ERADGQD

SEQ ID NO: 470312 - protein, 7 aa, Mycobacterium
ERADGVE

SEQ ID NO: 470313 - protein, 10 aa, Mycobacterium
ERADPDFAER

SEQ ID NO: 470314 - protein, 15 aa, Mycobacterium
ERADPVPDGDLAAQR

SEQ ID NO: 470315 - protein, 5 aa, Mycobacterium
ERADS

SEQ ID NO: 470316 - protein, 5 aa, Mycobacterium
ERAEA

SEQ ID NO: 470317 - protein, 13 aa, Mycobacterium
ERAEAAGESEATL

SEQ ID NO: 470318 - protein, 10 aa, Mycobacterium
ERAEAAGESM

SEQ ID NO: 470319 - protein, 8 aa, Mycobacterium
ERAEADPD

SEQ ID NO: 470320 - protein, 16 aa, Mycobacterium
ERAEADTIAAGTARCD

SEQ ID NO: 470321 - protein, 20 aa, Mycobacterium
ERAEETRADTRTRVEESRAR

SEQ ID NO: 470322 - protein, 14 aa, Mycobacterium
ERAEETRTDTRTRV

SEQ ID NO: 470323 - protein, 6 aa, Mycobacterium
ERAEEV

SEQ ID NO: 470324 - protein, 8 aa, Mycobacterium
ERAEFDGD

SEQ ID NO: 470325 - protein, 9 aa, Mycobacterium
ERAEFEAEN

SEQ ID NO: 470326 - protein, 10 aa, Mycobacterium
ERAEFESENR

SEQ ID NO: 470327 - protein, 7 aa, Mycobacterium
ERAEGAV

SEQ ID NO: 470328 - protein, 5 aa, Mycobacterium
ERAEH

SEQ ID NO: 470329 - protein, 11 aa, Mycobacterium
ERAEKVEKQFQ

SEQ ID NO: 470330 - protein, 10 aa, Mycobacterium
ERAELGGDLS

SEQ ID NO: 470331 - protein, 9 aa, Mycobacterium
ERAELTPQQ

SEQ ID NO: 470332 - protein, 8 aa, Mycobacterium
ERAEQQLQ

SEQ ID NO: 470333 - protein, 7 aa, Mycobacterium
ERAEREG

SEQ ID NO: 470334 - protein, 8 aa, Mycobacterium
ERAERTGG

SEQ ID NO: 470335 - protein, 8 aa, Mycobacterium
ERAESSDG

SEQ ID NO: 470336 - protein, 7 aa, Mycobacterium
ERAESTA

SEQ ID NO: 470337 - protein, 9 aa, Mycobacterium
ERAETRGQW

SEQ ID NO: 470338 - protein, 5 aa, Mycobacterium
ERAEV

SEQ ID NO: 470339 - protein, 4 aa, Mycobacterium
ERAG

SEQ ID NO: 470340 - protein, 8 aa, Mycobacterium
ERAGADAE

SEQ ID NO: 470341 - protein, 8 aa, Mycobacterium
ERAGADPL

SEQ ID NO: 470342 - protein, 13 aa, Mycobacterium
ERAGAGMRTAEER

SEQ ID NO: 470343 - protein, 12 aa, Mycobacterium
ERAGAQGLVTTA

SEQ ID NO: 470344 - protein, 9 aa, Mycobacterium
ERAGATPDQ

SEQ ID NO: 470345 - protein, 20 aa, Mycobacterium
ERAGDARTDAETRVEESRAR

SEQ ID NO: 470346 - protein, 9 aa, Mycobacterium
ERAGDGYRL

SEQ ID NO: 470347 - protein, 9 aa, Mycobacterium
ERAGDIAAA

SEQ ID NO: 470348 - protein, 6 aa, Mycobacterium
ERAGDN

SEQ ID NO: 470349 - protein, 13 aa, Mycobacterium
ERAGEGGSASISQ

SEQ ID NO: 470350 - protein, 13 aa, Mycobacterium
ERAGEKFARSGGK

SEQ ID NO: 470351 - protein, 7 aa, Mycobacterium
ERAGERP

SEQ ID NO: 470352 - protein, 9 aa, Mycobacterium
ERAGESDAH

SEQ ID NO: 470353 - protein, 8 aa, Mycobacterium
ERAGESKA

SEQ ID NO: 470354 - protein, 5 aa, Mycobacterium
ERAGG

SEQ ID NO: 470355 - protein, 9 aa, Mycobacterium
ERAGGDHRR

SEQ ID NO: 470356 - protein, 14 aa, Mycobacterium
ERAGGSDESDARTE

SEQ ID NO: 470357 - protein, 6 aa, Mycobacterium
ERAGLS

SEQ ID NO: 470358 - protein, 6 aa, Mycobacterium
ERAGLT

SEQ ID NO: 470359 - protein, 9 aa, Mycobacterium
ERAGPAQRS

SEQ ID NO: 470360 - protein, 5 aa, Mycobacterium
ERAGR

SEQ ID NO: 470361 - protein, 11 aa, Mycobacterium
ERAGRSSPSSI

SEQ ID NO: 470362 - protein, 15 aa, Mycobacterium
ERAGSESAVPARRNR

SEQ ID NO: 470363 - protein, 17 aa, Mycobacterium
ERAGSHPGSGAAPDSAV

SEQ ID NO: 470364 - protein, 7 aa, Mycobacterium
ERAGSTP

SEQ ID NO: 470365 - protein, 8 aa, Mycobacterium
ERAGTRNP

SEQ ID NO: 470366 - protein, 8 aa, Mycobacterium
ERAGTTKS

SEQ ID NO: 470367 - protein, 5 aa, Mycobacterium
ERAHR

SEQ ID NO: 470368 - protein, 6 aa, Mycobacterium
ERAHRK

SEQ ID NO: 470369 - protein, 4 aa, Mycobacterium
ERAI

SEQ ID NO: 470370 - protein, 8 aa, Mycobacterium
ERAKAAGA

SEQ ID NO: 470371 - protein, 11 aa, Mycobacterium
ERAKAKGKLAA

SEQ ID NO: 470372 - protein, 8 aa, Mycobacterium
ERAKGAAG

SEQ ID NO: 470373 - protein, 10 aa, Mycobacterium
ERAKGAEVSA

SEQ ID NO: 470374 - protein, 16 aa, Mycobacterium
ERAKGAEVSGALNPAQ

SEQ ID NO: 470375 - protein, 12 aa, Mycobacterium
ERAKLADAADQL

SEQ ID NO: 470376 - protein, 6 aa, Mycobacterium
ERAKNG

SEQ ID NO: 470377 - protein, 8 aa, Mycobacterium
ERAKPRKI

SEQ ID NO: 470378 - protein, 6 aa, Mycobacterium
ERAKQV

SEQ ID NO: 470379 - protein, 20 aa, Mycobacterium
ERAKQVAGGLAGAGLGPDDA

SEQ ID NO: 470380 - protein, 10 aa, Mycobacterium
ERAKSGPFGG

SEQ ID NO: 470381 - protein, 9 aa, Mycobacterium
ERAKTLRDA

SEQ ID NO: 470382 - protein, 6 aa, Mycobacterium
ERALTP

SEQ ID NO: 470383 - protein, 4 aa, Mycobacterium
ERAN

SEQ ID NO: 470384 - protein, 12 aa, Mycobacterium
ERANDAAGEPKY

SEQ ID NO: 470385 - protein, 5 aa, Mycobacterium
ERANI

SEQ ID NO: 470386 - protein, 14 aa, Mycobacterium
ERANLDGDDGVERA

SEQ ID NO: 470387 - protein, 9 aa, Mycobacterium
ERANTSRPA

SEQ ID NO: 470388 - protein, 7 aa, Mycobacterium
ERAPAEL

SEQ ID NO: 470389 - protein, 8 aa, Mycobacterium
ERAPAELE

SEQ ID NO: 470390 - protein, 9 aa, Mycobacterium
ERAPAEVGD

SEQ ID NO: 470391 - protein, 12 aa, Mycobacterium
ERAPAGAPELPT

SEQ ID NO: 470392 - protein, 6 aa, Mycobacterium
ERAPAL

SEQ ID NO: 470393 - protein, 18 aa, Mycobacterium
ERAPDPDMYPGASPDDLV

SEQ ID NO: 470394 - protein, 5 aa, Mycobacterium
ERAPE

SEQ ID NO: 470395 - protein, 7 aa, Mycobacterium
ERAPEAD

SEQ ID NO: 470396 - protein, 42 aa, Mycobacterium
ERAPEEGVAGEEGSGATRVGAPGGSGQLGEITHSGEALTSEL

SEQ ID NO: 470397 - protein, 8 aa, Mycobacterium
ERAPGDKA

SEQ ID NO: 470398 - protein, 7 aa, Mycobacterium
ERAPGQK

SEQ ID NO: 470399 - protein, 9 aa, Mycobacterium
ERAPNPAQA

SEQ ID NO: 470400 - protein, 7 aa, Mycobacterium
ERAPQLD

SEQ ID NO: 470401 - protein, 7 aa, Mycobacterium
ERAPTRI

SEQ ID NO: 470402 - protein, 9 aa, Mycobacterium
ERAPVDPGR

SEQ ID NO: 470403 - protein, 4 aa, Mycobacterium
ERAQ

SEQ ID NO: 470404 - protein, 5 aa, Mycobacterium
ERAQA

SEQ ID NO: 470405 - protein, 8 aa, Mycobacterium
ERAQAAEE

SEQ ID NO: 470406 - protein, 9 aa, Mycobacterium
ERAQATEDL

SEQ ID NO: 470407 - protein, 17 aa, Mycobacterium
ERAQEDGYLRPEASATD

SEQ ID NO: 470408 - protein, 8 aa, Mycobacterium
ERAQREAR

SEQ ID NO: 470409 - protein, 9 aa, Mycobacterium
ERAQREARL

SEQ ID NO: 470410 - protein, 7 aa, Mycobacterium
ERAQRRL

SEQ ID NO: 470411 - protein, 8 aa, Mycobacterium
ERAQTTKT

SEQ ID NO: 470412 - protein, 5 aa, Mycobacterium
ERARA

SEQ ID NO: 470413 - protein, 6 aa, Mycobacterium
ERARAD

SEQ ID NO: 470414 - protein, 8 aa, Mycobacterium
ERARAESW

SEQ ID NO: 470415 - protein, 14 aa, Mycobacterium
ERARDAKARYEQTG

SEQ ID NO: 470416 - protein, 11 aa, Mycobacterium
ERARDRGEIPA

SEQ ID NO: 470417 - protein, 6 aa, Mycobacterium
ERAREG

SEQ ID NO: 470418 - protein, 5 aa, Mycobacterium
ERARG

SEQ ID NO: 470419 - protein, 12 aa, Mycobacterium
ERARGAAPETIP

SEQ ID NO: 470420 - protein, 11 aa, Mycobacterium
ERARGAAPVTL

SEQ ID NO: 470421 - protein, 5 aa, Mycobacterium
ERARH

SEQ ID NO: 470422 - protein, 11 aa, Mycobacterium
ERARHAEASGF

SEQ ID NO: 470423 - protein, 7 aa, Mycobacterium
ERARIDA

SEQ ID NO: 470424 - protein, 15 aa, Mycobacterium
ERARKHGDLDSGPLK

SEQ ID NO: 470425 - protein, 16 aa, Mycobacterium
ERARKHGDLDSGPLKA

SEQ ID NO: 470426 - protein, 21 aa, Mycobacterium
ERARKRGYDGVTSRSSSEGGP

SEQ ID NO: 470427 - protein, 17 aa, Mycobacterium
ERARNDAHVAERNKPPP

SEQ ID NO: 470428 - protein, 7 aa, Mycobacterium
ERARPDR

SEQ ID NO: 470429 - protein, 8 aa, Mycobacterium
ERARPRAE

SEQ ID NO: 470430 - protein, 19 aa, Mycobacterium
ERARQREQARMTSPSRSRI

SEQ ID NO: 470431 - protein, 5 aa, Mycobacterium
ERARR

SEQ ID NO: 470432 - protein, 7 aa, Mycobacterium
ERARRET

SEQ ID NO: 470433 - protein, 9 aa, Mycobacterium
ERARRNPKV

SEQ ID NO: 470434 - protein, 9 aa, Mycobacterium
ERARRRQRR

SEQ ID NO: 470435 - protein, 5 aa, Mycobacterium
ERARS

SEQ ID NO: 470436 - protein, 6 aa, Mycobacterium
ERARTA

SEQ ID NO: 470437 - protein, 9 aa, Mycobacterium
ERARTGRGQ

SEQ ID NO: 470438 - protein, 9 aa, Mycobacterium
ERARTISNP

SEQ ID NO: 470439 - protein, 10 aa, Mycobacterium
ERARTPQEYH

SEQ ID NO: 470440 - protein, 13 aa, Mycobacterium
ERARTRPAGSATV

SEQ ID NO: 470441 - protein, 14 aa, Mycobacterium
ERARTRPAGSGTVA

SEQ ID NO: 470442 - protein, 13 aa, Mycobacterium
ERARTRPTGSATV

SEQ ID NO: 470443 - protein, 9 aa, Mycobacterium
ERASARVQD

SEQ ID NO: 470444 - protein, 11 aa, Mycobacterium
ERASDQSPDSG

SEQ ID NO: 470445 - protein, 11 aa, Mycobacterium
ERASDQSPEGG

SEQ ID NO: 470446 - protein, 5 aa, Mycobacterium
ERASE

SEQ ID NO: 470447 - protein, 8 aa, Mycobacterium
ERASEPHA

SEQ ID NO: 470448 - protein, 5 aa, Mycobacterium
ERASF

SEQ ID NO: 470449 - protein, 5 aa, Mycobacterium
ERASG

SEQ ID NO: 470450 - protein, 6 aa, Mycobacterium
ERASGF

SEQ ID NO: 470451 - protein, 7 aa, Mycobacterium
ERASGQD

SEQ ID NO: 470452 - protein, 8 aa, Mycobacterium
ERASHPDV

SEQ ID NO: 470453 - protein, 19 aa, Mycobacterium
ERASNGLANPATLADPDRL

SEQ ID NO: 470454 - protein, 6 aa, Mycobacterium
ERASRR

SEQ ID NO: 470455 - protein, 7 aa, Mycobacterium
ERASRRD

SEQ ID NO: 470456 - protein, 26 aa, Mycobacterium
ERASTRDGNEITTRTRSSEDSIARRP

SEQ ID NO: 470457 - protein, 5 aa, Mycobacterium
ERATG

SEQ ID NO: 470458 - protein, 8 aa, Mycobacterium
ERATGGRT

SEQ ID NO: 470459 - protein, 8 aa, Mycobacterium
ERATGTRV

SEQ ID NO: 470460 - protein, 19 aa, Mycobacterium
ERATSGAAAGKASASGSSM

SEQ ID NO: 470461 - protein, 6 aa, Mycobacterium
ERATSM

SEQ ID NO: 470462 - protein, 9 aa, Mycobacterium
ERAVNPTED

SEQ ID NO: 470463 - protein, 9 aa, Mycobacterium
ERAVPPYES

SEQ ID NO: 470464 - protein, 6 aa, Mycobacterium
ERAVTT

SEQ ID NO: 470465 - protein, 7 aa, Mycobacterium
ERAWTGD

SEQ ID NO: 470466 - protein, 5 aa, Mycobacterium
ERAYG

SEQ ID NO: 470467 - protein, 9 aa, Mycobacterium
ERAYPGGLT

SEQ ID NO: 470468 - protein, 5 aa, Mycobacterium
ERCGA

SEQ ID NO: 470469 - protein, 5 aa, Mycobacterium
ERCGH

SEQ ID NO: 470470 - protein, 6 aa, Mycobacterium
ERDAAG

SEQ ID NO: 470471 - protein, 11 aa, Mycobacterium
ERDADARRVRS

SEQ ID NO: 470472 - protein, 8 aa, Mycobacterium
ERDAEGRP

SEQ ID NO: 470473 - protein, 8 aa, Mycobacterium
ERDAEQTH

SEQ ID NO: 470474 - protein, 8 aa, Mycobacterium
ERDAERQV

SEQ ID NO: 470475 - protein, 8 aa, Mycobacterium
ERDAERRV

SEQ ID NO: 470476 - protein, 7 aa, Mycobacterium
ERDAEVS

SEQ ID NO: 470477 - protein, 8 aa, Mycobacterium
ERDAIKNA

SEQ ID NO: 470478 - protein, 10 aa, Mycobacterium
ERDANGDWRR

SEQ ID NO: 470479 - protein, 9 aa, Mycobacterium
ERDAVTAAA

SEQ ID NO: 470480 - protein, 6 aa, Mycobacterium
ERDDAR

SEQ ID NO: 470481 - protein, 8 aa, Mycobacterium
ERDDGTPL

SEQ ID NO: 470482 - protein, 6 aa, Mycobacterium
ERDDGV

SEQ ID NO: 470483 - protein, 5 aa, Mycobacterium
ERDDP

SEQ ID NO: 470484 - protein, 6 aa, Mycobacterium
ERDDPG

SEQ ID NO: 470485 - protein, 7 aa, Mycobacterium
ERDDPQR

SEQ ID NO: 470486 - protein, 17 aa, Mycobacterium
ERDDQATGADQRRDAEL

SEQ ID NO: 470487 - protein, 13 aa, Mycobacterium
ERDDSADSSRAPR

SEQ ID NO: 470488 - protein, 8 aa, Mycobacterium
ERDDSGRR

SEQ ID NO: 470489 - protein, 7 aa, Mycobacterium
ERDDTEV

SEQ ID NO: 470490 - protein, 6 aa, Mycobacterium
ERDDWQ

SEQ ID NO: 470491 - protein, 5 aa, Mycobacterium
ERDEA

SEQ ID NO: 470492 - protein, 6 aa, Mycobacterium
ERDEQE

SEQ ID NO: 470493 - protein, 5 aa, Mycobacterium
ERDET

SEQ ID NO: 470494 - protein, 6 aa, Mycobacterium
ERDETS

SEQ ID NO: 470495 - protein, 6 aa, Mycobacterium
ERDGAA

SEQ ID NO: 470496 - protein, 10 aa, Mycobacterium
ERDGADPHPD

SEQ ID NO: 470497 - protein, 6 aa, Mycobacterium
ERDGAL

SEQ ID NO: 470498 - protein, 7 aa, Mycobacterium
ERDGDKD

SEQ ID NO: 470499 - protein, 9 aa, Mycobacterium
ERDGDRVTA

SEQ ID NO: 470500 - protein, 7 aa, Mycobacterium
ERDGEGV

SEQ ID NO: 470501 - protein, 6 aa, Mycobacterium
ERDGER

SEQ ID NO: 470502 - protein, 6 aa, Mycobacterium
ERDGGI

SEQ ID NO: 470503 - protein, 5 aa, Mycobacterium
ERDGL

SEQ ID NO: 470504 - protein, 12 aa, Mycobacterium
ERDGNTLTIVVS

SEQ ID NO: 470505 - protein, 5 aa, Mycobacterium
ERDGP

SEQ ID NO: 470506 - protein, 5 aa, Mycobacterium
ERDGQ

SEQ ID NO: 470507 - protein, 17 aa, Mycobacterium
ERDGQGPQGGKHPAGDT

SEQ ID NO: 470508 - protein, 7 aa, Mycobacterium
ERDGQRN

SEQ ID NO: 470509 - protein, 12 aa, Mycobacterium
ERDGRADPFGKE

SEQ ID NO: 470510 - protein, 8 aa, Mycobacterium
ERDGRGEV

SEQ ID NO: 470511 - protein, 6 aa, Mycobacterium
ERDGRI

SEQ ID NO: 470512 - protein, 6 aa, Mycobacterium
ERDGRP

SEQ ID NO: 470513 - protein, 11 aa, Mycobacterium
ERDGRTDPFGQ

SEQ ID NO: 470514 - protein, 8 aa, Mycobacterium
ERDGSRNE

SEQ ID NO: 470515 - protein, 8 aa, Mycobacterium
ERDGTTTH

SEQ ID NO: 470516 - protein, 7 aa, Mycobacterium
ERDGTYD

SEQ ID NO: 470517 - protein, 5 aa, Mycobacterium
ERDGV

SEQ ID NO: 470518 - protein, 8 aa, Mycobacterium
ERDGVDGL

SEQ ID NO: 470519 - protein, 16 aa, Mycobacterium
ERDGYDGGWTAETSHD

SEQ ID NO: 470520 - protein, 4 aa, Mycobacterium
ERDK

SEQ ID NO: 470521 - protein, 5 aa, Mycobacterium
ERDKA

SEQ ID NO: 470522 - protein, 7 aa, Mycobacterium
ERDKRGR

SEQ ID NO: 470523 - protein, 4 aa, Mycobacterium
ERDL

SEQ ID NO: 470524 - protein, 8 aa, Mycobacterium
ERDMATPN

SEQ ID NO: 470525 - protein, 7 aa, Mycobacterium
ERDNERC

SEQ ID NO: 470526 - protein, 8 aa, Mycobacterium
ERDPASPH

SEQ ID NO: 470527 - protein, 10 aa, Mycobacterium
ERDPDADKRL

SEQ ID NO: 470528 - protein, 15 aa, Mycobacterium
ERDPEPDTPPPLPIP

SEQ ID NO: 470529 - protein, 8 aa, Mycobacterium
ERDPGDAR

SEQ ID NO: 470530 - protein, 7 aa, Mycobacterium
ERDPGHT

SEQ ID NO: 470531 - protein, 7 aa, Mycobacterium
ERDPGNT

SEQ ID NO: 470532 - protein, 8 aa, Mycobacterium
ERDPGNTR

SEQ ID NO: 470533 - protein, 17 aa, Mycobacterium
ERDPGRSFSAAMGLGDP

SEQ ID NO: 470534 - protein, 6 aa, Mycobacterium
ERDPLA

SEQ ID NO: 470535 - protein, 22 aa, Mycobacterium
ERDPTAAGKRQAAQARAARPVA

SEQ ID NO: 470536 - protein, 4 aa, Mycobacterium
ERDQ

SEQ ID NO: 470537 - protein, 5 aa, Mycobacterium
ERDQL

SEQ ID NO: 470538 - protein, 41 aa, Mycobacterium
ERDQVADERERLADERESDADERERLADEREGTAAAREQER

SEQ ID NO: 470539 - protein, 6 aa, Mycobacterium
ERDQYK

SEQ ID NO: 470540 - protein, 4 aa, Mycobacterium
ERDR

SEQ ID NO: 470541 - protein, 9 aa, Mycobacterium
ERDRAGALA

SEQ ID NO: 470542 - protein, 7 aa, Mycobacterium
ERDRLDE

SEQ ID NO: 470543 - protein, 8 aa, Mycobacterium
ERDRLTPI

SEQ ID NO: 470544 - protein, 10 aa, Mycobacterium
ERDRLTPISQ

SEQ ID NO: 470545 - protein, 11 aa, Mycobacterium
ERDRLTPISQS

SEQ ID NO: 470546 - protein, 7 aa, Mycobacterium
ERDRNFP

SEQ ID NO: 470547 - protein, 15 aa, Mycobacterium
ERDRQAAAAEAKRQN

SEQ ID NO: 470548 - protein, 9 aa, Mycobacterium
ERDRQEAAA

SEQ ID NO: 470549 - protein, 7 aa, Mycobacterium
ERDRSDP

SEQ ID NO: 470550 - protein, 13 aa, Mycobacterium
ERDRSSDHNTLSH

SEQ ID NO: 470551 - protein, 12 aa, Mycobacterium
ERDRVQKAYPQR

SEQ ID NO: 470552 - protein, 9 aa, Mycobacterium
ERDRVQRDY

SEQ ID NO: 470553 - protein, 4 aa, Mycobacterium
ERDS

SEQ ID NO: 470554 - protein, 9 aa, Mycobacterium
ERDSAPAPR

SEQ ID NO: 470555 - protein, 41 aa, Mycobacterium
ERDSARRLQRRDQKGDAIDEEKGTGRGHQRHDQDGPARSRA

SEQ ID NO: 470556 - protein, 7 aa, Mycobacterium
ERDSGWD

SEQ ID NO: 470557 - protein, 9 aa, Mycobacterium
ERDSPAGIE

SEQ ID NO: 470558 - protein, 10 aa, Mycobacterium
ERDSPRRLPS

SEQ ID NO: 470559 - protein, 6 aa, Mycobacterium
ERDTHG

SEQ ID NO: 470560 - protein, 15 aa, Mycobacterium
ERDVAERGRHQQELR

SEQ ID NO: 470561 - protein, 7 aa, Mycobacterium
ERDVDAT

SEQ ID NO: 470562 - protein, 9 aa, Mycobacterium
ERDVDTGAE

SEQ ID NO: 470563 - protein, 8 aa, Mycobacterium
ERDVETGA

SEQ ID NO: 470564 - protein, 20 aa, Mycobacterium
ERDVTATGRGQPACRGPATS

SEQ ID NO: 470565 - protein, 14 aa, Mycobacterium
EREAAERKDKVRGG

SEQ ID NO: 470566 - protein, 12 aa, Mycobacterium
EREAGQSQQRPR

SEQ ID NO: 470567 - protein, 5 aa, Mycobacterium
EREAN

SEQ ID NO: 470568 - protein, 8 aa, Mycobacterium
EREANGQF

SEQ ID NO: 470569 - protein, 7 aa, Mycobacterium
EREASAR

SEQ ID NO: 470570 - protein, 7 aa, Mycobacterium
EREASDL

SEQ ID NO: 470571 - protein, 9 aa, Mycobacterium
EREASDPQL

SEQ ID NO: 470572 - protein, 12 aa, Mycobacterium
EREDDAQRASTR

SEQ ID NO: 470573 - protein, 5 aa, Mycobacterium
EREDF

SEQ ID NO: 470574 - protein, 5 aa, Mycobacterium
EREDL

SEQ ID NO: 470575 - protein, 6 aa, Mycobacterium
EREDLT

SEQ ID NO: 470576 - protein, 7 aa, Mycobacterium
EREDPAR

SEQ ID NO: 470577 - protein, 9 aa, Mycobacterium
EREDPDASA

SEQ ID NO: 470578 - protein, 9 aa, Mycobacterium
EREDPNQAA

SEQ ID NO: 470579 - protein, 5 aa, Mycobacterium
EREDR

SEQ ID NO: 470580 - protein, 6 aa, Mycobacterium
EREDRD

SEQ ID NO: 470581 - protein, 8 aa, Mycobacterium
EREEADRL

SEQ ID NO: 470582 - protein, 11 aa, Mycobacterium
EREEEFSDPHR

SEQ ID NO: 470583 - protein, 10 aa, Mycobacterium
EREEKTRAKA

SEQ ID NO: 470584 - protein, 11 aa, Mycobacterium
EREERRAEKIT

SEQ ID NO: 470585 - protein, 6 aa, Mycobacterium
EREERS

SEQ ID NO: 470586 - protein, 7 aa, Mycobacterium
EREESLP

SEQ ID NO: 470587 - protein, 9 aa, Mycobacterium
EREEWDDEA

SEQ ID NO: 470588 - protein, 10 aa, Mycobacterium
EREGAESADR

SEQ ID NO: 470589 - protein, 8 aa, Mycobacterium
EREGASRG

SEQ ID NO: 470590 - protein, 7 aa, Mycobacterium
EREGDDD

SEQ ID NO: 470591 - protein, 8 aa, Mycobacterium
EREGDDDL

SEQ ID NO: 470592 - protein, 13 aa, Mycobacterium
EREGDGDDRRGAT

SEQ ID NO: 470593 - protein, 10 aa, Mycobacterium
EREGEPSPMS

SEQ ID NO: 470594 - protein, 7 aa, Mycobacterium
EREGESV

SEQ ID NO: 470595 - protein, 8 aa, Mycobacterium
EREGGDSV

SEQ ID NO: 470596 - protein, 7 aa, Mycobacterium
EREGIDA

SEQ ID NO: 470597 - protein, 10 aa, Mycobacterium
EREGIDPRDV

SEQ ID NO: 470598 - protein, 9 aa, Mycobacterium
EREGISPEQ

SEQ ID NO: 470599 - protein, 6 aa, Mycobacterium
EREGPD

SEQ ID NO: 470600 - protein, 4 aa, Mycobacterium
EREH

SEQ ID NO: 470601 - protein, 8 aa, Mycobacterium
EREHDTPM

SEQ ID NO: 470602 - protein, 7 aa, Mycobacterium
EREHGSD

SEQ ID NO: 470603 - protein, 9 aa, Mycobacterium
EREHSTPSV

SEQ ID NO: 470604 - protein, 6 aa, Mycobacterium
EREKGS

SEQ ID NO: 470605 - protein, 8 aa, Mycobacterium
ERELAEQH

SEQ ID NO: 470606 - protein, 4 aa, Mycobacterium
EREN

SEQ ID NO: 470607 - protein, 8 aa, Mycobacterium
ERENDRSH

SEQ ID NO: 470608 - protein, 4 aa, Mycobacterium
EREP

SEQ ID NO: 470609 - protein, 8 aa, Mycobacterium
EREPAAGD

SEQ ID NO: 470610 - protein, 8 aa, Mycobacterium
EREPAPEL

SEQ ID NO: 470611 - protein, 7 aa, Mycobacterium
EREPATL

SEQ ID NO: 470612 - protein, 8 aa, Mycobacterium
EREPGKVE

SEQ ID NO: 470613 - protein, 6 aa, Mycobacterium
EREPGQ

SEQ ID NO: 470614 - protein, 13 aa, Mycobacterium
EREPKGLSAEHAR

SEQ ID NO: 470615 - protein, 6 aa, Mycobacterium
EREPLT

SEQ ID NO: 470616 - protein, 48 aa, Mycobacterium
EREPRKSGRADKGDKSDEIQGISGSTRLEAKRQRRRDGRDAGRRRPPI

SEQ ID NO: 470617 - protein, 12 aa, Mycobacterium
EREPSTLGYSAR

SEQ ID NO: 470618 - protein, 8 aa, Mycobacterium
EREPTSVS

SEQ ID NO: 470619 - protein, 7 aa, Mycobacterium
EREPVTV

SEQ ID NO: 470620 - protein, 5 aa, Mycobacterium
EREQG

SEQ ID NO: 470621 - protein, 10 aa, Mycobacterium
EREQGGLGPG

SEQ ID NO: 470622 - protein, 5 aa, Mycobacterium
EREQL

SEQ ID NO: 470623 - protein, 14 aa, Mycobacterium
EREQLRESRRRSYD

SEQ ID NO: 470624 - protein, 4 aa, Mycobacterium
ERER

SEQ ID NO: 470625 - protein, 5 aa, Mycobacterium
ERERA

SEQ ID NO: 470626 - protein, 9 aa, Mycobacterium
ERERESAQF

SEQ ID NO: 470627 - protein, 7 aa, Mycobacterium
EREREYA

SEQ ID NO: 470628 - protein, 12 aa, Mycobacterium
ERERGAAPDTIP

SEQ ID NO: 470629 - protein, 9 aa, Mycobacterium
ERERPDAVT

SEQ ID NO: 470630 - protein, 6 aa, Mycobacterium
ERERPQ

SEQ ID NO: 470631 - protein, 6 aa, Mycobacterium
ERERPR

SEQ ID NO: 470632 - protein, 5 aa, Mycobacterium
ERERR

SEQ ID NO: 470633 - protein, 6 aa, Mycobacterium
ERERRL

SEQ ID NO: 470634 - protein, 7 aa, Mycobacterium
ERERVQG

SEQ ID NO: 470635 - protein, 5 aa, Mycobacterium
ERESG

SEQ ID NO: 470636 - protein, 6 aa, Mycobacterium
ERESPG

SEQ ID NO: 470637 - protein, 8 aa, Mycobacterium
ERESQGEE

SEQ ID NO: 470638 - protein, 9 aa, Mycobacterium
ERESRTEAH

SEQ ID NO: 470639 - protein, 11 aa, Mycobacterium
ERESSAPADEL

SEQ ID NO: 470640 - protein, 11 aa, Mycobacterium
ERESSAPSDEL

SEQ ID NO: 470641 - protein, 7 aa, Mycobacterium
ERESYSP

SEQ ID NO: 470642 - protein, 4 aa, Mycobacterium
ERET

SEQ ID NO: 470643 - protein, 15 aa, Mycobacterium
ERETAARSARGPLVG

SEQ ID NO: 470644 - protein, 12 aa, Mycobacterium
ERETAERERQLQ

SEQ ID NO: 470645 - protein, 8 aa, Mycobacterium
ERETARWT

SEQ ID NO: 470646 - protein, 7 aa, Mycobacterium
ERETGAT

SEQ ID NO: 470647 - protein, 10 aa, Mycobacterium
ERETRGADRK

SEQ ID NO: 470648 - protein, 4 aa, Mycobacterium
EREV

SEQ ID NO: 470649 - protein, 6 aa, Mycobacterium
EREVDG

SEQ ID NO: 470650 - protein, 4 aa, Mycobacterium
ERFD

SEQ ID NO: 470651 - protein, 6 aa, Mycobacterium
ERFDPD

SEQ ID NO: 470652 - protein, 18 aa, Mycobacterium
ERFDPDRFSPERSAGRNR

SEQ ID NO: 470653 - protein, 4 aa, Mycobacterium
ERFE

SEQ ID NO: 470654 - protein, 24 aa, Mycobacterium
ERFEPSDPRTGVTPADPATELDPD

SEQ ID NO: 470655 - protein, 11 aa, Mycobacterium
ERFGAGKDNSG

SEQ ID NO: 470656 - protein, 5 aa, Mycobacterium
ERFGD

SEQ ID NO: 470657 - protein, 6 aa, Mycobacterium
ERFGGT

SEQ ID NO: 470658 - protein, 5 aa, Mycobacterium
ERFGP

SEQ ID NO: 470659 - protein, 6 aa, Mycobacterium
ERFGPD

SEQ ID NO: 470660 - protein, 13 aa, Mycobacterium
ERFPKGERRSTAD

SEQ ID NO: 470661 - protein, 13 aa, Mycobacterium
ERFPKGERRSVAD

SEQ ID NO: 470662 - protein, 14 aa, Mycobacterium
ERFPNGLGNNDDQV

SEQ ID NO: 470663 - protein, 8 aa, Mycobacterium
ERFPNPNN

SEQ ID NO: 470664 - protein, 7 aa, Mycobacterium
ERFPRGE

SEQ ID NO: 470665 - protein, 10 aa, Mycobacterium
ERFPRGERRA

SEQ ID NO: 470666 - protein, 10 aa, Mycobacterium
ERFPRGNTLG

SEQ ID NO: 470667 - protein, 14 aa, Mycobacterium
ERFTDAESRAAHDD

SEQ ID NO: 470668 - protein, 4 aa, Mycobacterium
ERGA

SEQ ID NO: 470669 - protein, 13 aa, Mycobacterium
ERGAAELQDASAE

SEQ ID NO: 470670 - protein, 7 aa, Mycobacterium
ERGAAGV

SEQ ID NO: 470671 - protein, 7 aa, Mycobacterium
ERGADAV

SEQ ID NO: 470672 - protein, 7 aa, Mycobacterium
ERGADGI

SEQ ID NO: 470673 - protein, 7 aa, Mycobacterium
ERGADGV

SEQ ID NO: 470674 - protein, 7 aa, Mycobacterium
ERGADVD

SEQ ID NO: 470675 - protein, 13 aa, Mycobacterium
ERGAGDPGEQEAA

SEQ ID NO: 470676 - protein, 12 aa, Mycobacterium
ERGAGDTGGSLP

SEQ ID NO: 470677 - protein, 9 aa, Mycobacterium
ERGAGGEVQ

SEQ ID NO: 470678 - protein, 5 aa, Mycobacterium
ERGAH

SEQ ID NO: 470679 - protein, 8 aa, Mycobacterium
ERGAPAEL

SEQ ID NO: 470680 - protein, 7 aa, Mycobacterium
ERGAPTV

SEQ ID NO: 470681 - protein, 5 aa, Mycobacterium
ERGAQ

SEQ ID NO: 470682 - protein, 8 aa, Mycobacterium
ERGASDAE

SEQ ID NO: 470683 - protein, 10 aa, Mycobacterium
ERGASTHARP

SEQ ID NO: 470684 - protein, 5 aa, Mycobacterium
ERGAT

SEQ ID NO: 470685 - protein, 19 aa, Mycobacterium
ERGATDPPRPQRRRRGRTL

SEQ ID NO: 470686 - protein, 9 aa, Mycobacterium
ERGCTYPGC

SEQ ID NO: 470687 - protein, 10 aa, Mycobacterium
ERGDANFRGA

SEQ ID NO: 470688 - protein, 10 aa, Mycobacterium
ERGDAPAHGV

SEQ ID NO: 470689 - protein, 13 aa, Mycobacterium
ERGDAYRSDVDAA

SEQ ID NO: 470690 - protein, 6 aa, Mycobacterium
ERGDDV

SEQ ID NO: 470691 - protein, 13 aa, Mycobacterium
ERGDEQGGDAIRA

SEQ ID NO: 470692 - protein, 7 aa, Mycobacterium
ERGDGQA

SEQ ID NO: 470693 - protein, 7 aa, Mycobacterium
ERGDGVS

SEQ ID NO: 470694 - protein, 8 aa, Mycobacterium
ERGDIGQP

SEQ ID NO: 470695 - protein, 11 aa, Mycobacterium
ERGDKLPAAQR

SEQ ID NO: 470696 - protein, 7 aa, Mycobacterium
ERGDQRR

SEQ ID NO: 470697 - protein, 5 aa, Mycobacterium
ERGDR

SEQ ID NO: 470698 - protein, 6 aa, Mycobacterium
ERGDSR

SEQ ID NO: 470699 - protein, 5 aa, Mycobacterium
ERGEA

SEQ ID NO: 470700 - protein, 7 aa, Mycobacterium
ERGEEDA

SEQ ID NO: 470701 - protein, 8 aa, Mycobacterium
ERGEGGNL

SEQ ID NO: 470702 - protein, 7 aa, Mycobacterium
ERGEGGT

SEQ ID NO: 470703 - protein, 10 aa, Mycobacterium
ERGEGTGKED

SEQ ID NO: 470704 - protein, 10 aa, Mycobacterium
ERGEGTGKTD

SEQ ID NO: 470705 - protein, 10 aa, Mycobacterium
ERGEGTSKDD

SEQ ID NO: 470706 - protein, 10 aa, Mycobacterium
ERGEGTSKED

SEQ ID NO: 470707 - protein, 10 aa, Mycobacterium
ERGEGTSKTD

SEQ ID NO: 470708 - protein, 10 aa, Mycobacterium
ERGEGTTKED

SEQ ID NO: 470709 - protein, 11 aa, Mycobacterium
ERGEGTTKEDY

SEQ ID NO: 470710 - protein, 9 aa, Mycobacterium
ERGEKESVK

SEQ ID NO: 470711 - protein, 11 aa, Mycobacterium
ERGEKLPAAQR

SEQ ID NO: 470712 - protein, 11 aa, Mycobacterium
ERGELTTDTDI

SEQ ID NO: 470713 - protein, 5 aa, Mycobacterium
ERGES

SEQ ID NO: 470714 - protein, 12 aa, Mycobacterium
ERGESASSASNL

SEQ ID NO: 470715 - protein, 8 aa, Mycobacterium
ERGETSPY

SEQ ID NO: 470716 - protein, 5 aa, Mycobacterium
ERGEV

SEQ ID NO: 470717 - protein, 7 aa, Mycobacterium
ERGEVRP

SEQ ID NO: 470718 - protein, 7 aa, Mycobacterium
ERGGARR

SEQ ID NO: 470719 - protein, 14 aa, Mycobacterium
ERGGDPGRPGKANE

SEQ ID NO: 470720 - protein, 5 aa, Mycobacterium
ERGGE

SEQ ID NO: 470721 - protein, 9 aa, Mycobacterium
ERGGEIPDA

SEQ ID NO: 470722 - protein, 11 aa, Mycobacterium
ERGGERVNGAV

SEQ ID NO: 470723 - protein, 5 aa, Mycobacterium
ERGGG

SEQ ID NO: 470724 - protein, 7 aa, Mycobacterium
ERGGGLP

SEQ ID NO: 470725 - protein, 9 aa, Mycobacterium
ERGGGTARE

SEQ ID NO: 470726 - protein, 8 aa, Mycobacterium
ERGGKATA

SEQ ID NO: 470727 - protein, 14 aa, Mycobacterium
ERGGKDALGPGNSV

SEQ ID NO: 470728 - protein, 5 aa, Mycobacterium
ERGGL

SEQ ID NO: 470729 - protein, 6 aa, Mycobacterium
ERGGLD

SEQ ID NO: 470730 - protein, 6 aa, Mycobacterium
ERGGNK

SEQ ID NO: 470731 - protein, 5 aa, Mycobacterium
ERGGP

SEQ ID NO: 470732 - protein, 11 aa, Mycobacterium
ERGGPRPARRA

SEQ ID NO: 470733 - protein, 10 aa, Mycobacterium
ERGGPVDPSW

SEQ ID NO: 470734 - protein, 7 aa, Mycobacterium
ERGGQGA

SEQ ID NO: 470735 - protein, 5 aa, Mycobacterium
ERGGR

SEQ ID NO: 470736 - protein, 19 aa, Mycobacterium
ERGGSKGAVAPPVLGASAE

SEQ ID NO: 470737 - protein, 13 aa, Mycobacterium
ERGGSLQSGNGAY

SEQ ID NO: 470738 - protein, 7 aa, Mycobacterium
ERGGSTI

SEQ ID NO: 470739 - protein, 9 aa, Mycobacterium
ERGGTAVRS

SEQ ID NO: 470740 - protein, 10 aa, Mycobacterium
ERGGTDGAIR

SEQ ID NO: 470741 - protein, 10 aa, Mycobacterium
ERGGTDGALR

SEQ ID NO: 470742 - protein, 8 aa, Mycobacterium
ERGGTPVR

SEQ ID NO: 470743 - protein, 12 aa, Mycobacterium
ERGGVPMETEAG

SEQ ID NO: 470744 - protein, 14 aa, Mycobacterium
ERGGYGAQGHGNSV

SEQ ID NO: 470745 - protein, 5 aa, Mycobacterium
ERGHR

SEQ ID NO: 470746 - protein, 9 aa, Mycobacterium
ERGHSTPSI

SEQ ID NO: 470747 - protein, 5 aa, Mycobacterium
ERGID

SEQ ID NO: 470748 - protein, 6 aa, Mycobacterium
ERGIPY

SEQ ID NO: 470749 - protein, 7 aa, Mycobacterium
ERGISND

SEQ ID NO: 470750 - protein, 7 aa, Mycobacterium
ERGKAPL

SEQ ID NO: 470751 - protein, 8 aa, Mycobacterium
ERGKLTAR

SEQ ID NO: 470752 - protein, 10 aa, Mycobacterium
ERGKTNDPHI

SEQ ID NO: 470753 - protein, 21 aa, Mycobacterium
ERGLAAGRAAAEGSAAAVDPT

SEQ ID NO: 470754 - protein, 7 aa, Mycobacterium
ERGLAGA

SEQ ID NO: 470755 - protein, 7 aa, Mycobacterium
ERGLAPR

SEQ ID NO: 470756 - protein, 24 aa, Mycobacterium
ERGLARPAAGAPAATGQGPRMSAG

SEQ ID NO: 470757 - protein, 23 aa, Mycobacterium
ERGLARPTGAASVTTYDEPRMSA

SEQ ID NO: 470758 - protein, 6 aa, Mycobacterium
ERGLDT

SEQ ID NO: 470759 - protein, 6 aa, Mycobacterium
ERGLGT

SEQ ID NO: 470760 - protein, 12 aa, Mycobacterium
ERGLPKDGEELD

SEQ ID NO: 470761 - protein, 19 aa, Mycobacterium
ERGLVGPKRRDFPPQLHVR

SEQ ID NO: 470762 - protein, 9 aa, Mycobacterium
ERGNGNPSF

SEQ ID NO: 470763 - protein, 7 aa, Mycobacterium
ERGNPDY

SEQ ID NO: 470764 - protein, 8 aa, Mycobacterium
ERGNPPTA

SEQ ID NO: 470765 - protein, 8 aa, Mycobacterium
ERGNPREV

SEQ ID NO: 470766 - protein, 14 aa, Mycobacterium
ERGNVARDDAYATS

SEQ ID NO: 470767 - protein, 10 aa, Mycobacterium
ERGNVTRDDA

SEQ ID NO: 470768 - protein, 4 aa, Mycobacterium
ERGP

SEQ ID NO: 470769 - protein, 10 aa, Mycobacterium
ERGPAATSLR

SEQ ID NO: 470770 - protein, 7 aa, Mycobacterium
ERGPADP

SEQ ID NO: 470771 - protein, 30 aa, Mycobacterium
ERGPAGRSATNPWNPAEARAPPADRSDPAR

SEQ ID NO: 470772 - protein, 8 aa, Mycobacterium
ERGPDAGG

SEQ ID NO: 470773 - protein, 8 aa, Mycobacterium
ERGPDDPI

SEQ ID NO: 470774 - protein, 6 aa, Mycobacterium
ERGPEI

SEQ ID NO: 470775 - protein, 10 aa, Mycobacterium
ERGPHASPAA

SEQ ID NO: 470776 - protein, 8 aa, Mycobacterium
ERGPMPPY

SEQ ID NO: 470777 - protein, 9 aa, Mycobacterium
ERGPRTGTH

SEQ ID NO: 470778 - protein, 9 aa, Mycobacterium
ERGPTTARE

SEQ ID NO: 470779 - protein, 7 aa, Mycobacterium
ERGPVSN

SEQ ID NO: 470780 - protein, 21 aa, Mycobacterium
ERGPYARPPVVPTEARRRAQR

SEQ ID NO: 470781 - protein, 10 aa, Mycobacterium
ERGQAPDDLP

SEQ ID NO: 470782 - protein, 10 aa, Mycobacterium
ERGQAREDYE

SEQ ID NO: 470783 - protein, 11 aa, Mycobacterium
ERGQDRLADPA

SEQ ID NO: 470784 - protein, 7 aa, Mycobacterium
ERGQGKT

SEQ ID NO: 470785 - protein, 9 aa, Mycobacterium
ERGQSTPSI

SEQ ID NO: 470786 - protein, 13 aa, Mycobacterium
ERGRAELRDLLAG

SEQ ID NO: 470787 - protein, 10 aa, Mycobacterium
ERGRAQARSA

SEQ ID NO: 470788 - protein, 10 aa, Mycobacterium
ERGRASPVEQ

SEQ ID NO: 470789 - protein, 6 aa, Mycobacterium
ERGREF

SEQ ID NO: 470790 - protein, 27 aa, Mycobacterium
ERGRELASTAAEKGAPLAEAARRRGER

SEQ ID NO: 470791 - protein, 58 aa, Mycobacterium
ERGRELASTAAQRSAPYAETALERGRELASTAAERSKPLAKKARKRGEEWADEAADRA

SEQ ID NO: 470792 - protein, 5 aa, Mycobacterium
ERGRG

SEQ ID NO: 470793 - protein, 6 aa, Mycobacterium
ERGRGD

SEQ ID NO: 470794 - protein, 8 aa, Mycobacterium
ERGRGLGR

SEQ ID NO: 470795 - protein, 6 aa, Mycobacterium
ERGRGY

SEQ ID NO: 470796 - protein, 8 aa, Mycobacterium
ERGRHGTP

SEQ ID NO: 470797 - protein, 12 aa, Mycobacterium
ERGRKGDNSTRC

SEQ ID NO: 470798 - protein, 11 aa, Mycobacterium
ERGRLSRAGDG

SEQ ID NO: 470799 - protein, 8 aa, Mycobacterium
ERGRNGER

SEQ ID NO: 470800 - protein, 8 aa, Mycobacterium
ERGRPQVH

SEQ ID NO: 470801 - protein, 5 aa, Mycobacterium
ERGRR

SEQ ID NO: 470802 - protein, 11 aa, Mycobacterium
ERGRRGDRDDA

SEQ ID NO: 470803 - protein, 15 aa, Mycobacterium
ERGRRRRPLDPARAA

SEQ ID NO: 470804 - protein, 6 aa, Mycobacterium
ERGRSA

SEQ ID NO: 470805 - protein, 14 aa, Mycobacterium
ERGRSGLEHQAQSG

SEQ ID NO: 470806 - protein, 7 aa, Mycobacterium
ERGRSGQ

SEQ ID NO: 470807 - protein, 7 aa, Mycobacterium
ERGRTEL

SEQ ID NO: 470808 - protein, 11 aa, Mycobacterium
ERGRTTQEKGD

SEQ ID NO: 470809 - protein, 5 aa, Mycobacterium
ERGRV

SEQ ID NO: 470810 - protein, 4 aa, Mycobacterium
ERGS

SEQ ID NO: 470811 - protein, 9 aa, Mycobacterium
ERGSAEATV

SEQ ID NO: 470812 - protein, 10 aa, Mycobacterium
ERGSAEPTVN

SEQ ID NO: 470813 - protein, 6 aa, Mycobacterium
ERGSAS

SEQ ID NO: 470814 - protein, 11 aa, Mycobacterium
ERGSAVSRPAM

SEQ ID NO: 470815 - protein, 6 aa, Mycobacterium
ERGSGR

SEQ ID NO: 470816 - protein, 8 aa, Mycobacterium
ERGSLGTP

SEQ ID NO: 470817 - protein, 10 aa, Mycobacterium
ERGSNEPTVN

SEQ ID NO: 470818 - protein, 6 aa, Mycobacterium
ERGSRT

SEQ ID NO: 470819 - protein, 9 aa, Mycobacterium
ERGSSSGPV

SEQ ID NO: 470820 - protein, 5 aa, Mycobacterium
ERGSV

SEQ ID NO: 470821 - protein, 4 aa, Mycobacterium
ERGT

SEQ ID NO: 470822 - protein, 8 aa, Mycobacterium
ERGTDAQR

SEQ ID NO: 470823 - protein, 7 aa, Mycobacterium
ERGTEPD

SEQ ID NO: 470824 - protein, 5 aa, Mycobacterium
ERGTG

SEQ ID NO: 470825 - protein, 7 aa, Mycobacterium
ERGTGGN

SEQ ID NO: 470826 - protein, 6 aa, Mycobacterium
ERGTGR

SEQ ID NO: 470827 - protein, 16 aa, Mycobacterium
ERGTPKSDRTGTGTRS

SEQ ID NO: 470828 - protein, 7 aa, Mycobacterium
ERGTPPD

SEQ ID NO: 470829 - protein, 8 aa, Mycobacterium
ERGTPVGV

SEQ ID NO: 470830 - protein, 9 aa, Mycobacterium
ERGTQTATI

SEQ ID NO: 470831 - protein, 11 aa, Mycobacterium
ERGTTPRAQRN

SEQ ID NO: 470832 - protein, 7 aa, Mycobacterium
ERGVAND

SEQ ID NO: 470833 - protein, 6 aa, Mycobacterium
ERGVDA

SEQ ID NO: 470834 - protein, 6 aa, Mycobacterium
ERGVDT

SEQ ID NO: 470835 - protein, 5 aa, Mycobacterium
ERGVE

SEQ ID NO: 470836 - protein, 6 aa, Mycobacterium
ERGVEE

SEQ ID NO: 470837 - protein, 5 aa, Mycobacterium
ERGVP

SEQ ID NO: 470838 - protein, 8 aa, Mycobacterium
ERGVPARA

SEQ ID NO: 470839 - protein, 6 aa, Mycobacterium
ERGVQY

SEQ ID NO: 470840 - protein, 7 aa, Mycobacterium
ERGVRPG

SEQ ID NO: 470841 - protein, 7 aa, Mycobacterium
ERGYDGA

SEQ ID NO: 470842 - protein, 11 aa, Mycobacterium
ERGYDGTSIEE

SEQ ID NO: 470843 - protein, 6 aa, Mycobacterium
ERGYDT

SEQ ID NO: 470844 - protein, 7 aa, Mycobacterium
ERGYDTT

SEQ ID NO: 470845 - protein, 7 aa, Mycobacterium
ERGYGED

SEQ ID NO: 470846 - protein, 8 aa, Mycobacterium
ERGYGEDE

SEQ ID NO: 470847 - protein, 8 aa, Mycobacterium
ERGYGYGP

SEQ ID NO: 470848 - protein, 11 aa, Mycobacterium
ERHAEHSAHRR

SEQ ID NO: 470849 - protein, 8 aa, Mycobacterium
ERHAKGQP

SEQ ID NO: 470850 - protein, 20 aa, Mycobacterium
ERHAPRPRVDHSRGSRVSAP

SEQ ID NO: 470851 - protein, 8 aa, Mycobacterium
ERHAPSAD

SEQ ID NO: 470852 - protein, 10 aa, Mycobacterium
ERHAQKNDRP

SEQ ID NO: 470853 - protein, 12 aa, Mycobacterium
ERHAQKNERPTL

SEQ ID NO: 470854 - protein, 7 aa, Mycobacterium
ERHDPAG

SEQ ID NO: 470855 - protein, 8 aa, Mycobacterium
ERHEPADL

SEQ ID NO: 470856 - protein, 10 aa, Mycobacterium
ERHEPADTAA

SEQ ID NO: 470857 - protein, 9 aa, Mycobacterium
ERHEPADVP

SEQ ID NO: 470858 - protein, 5 aa, Mycobacterium
ERHER

SEQ ID NO: 470859 - protein, 8 aa, Mycobacterium
ERHGDDHG

SEQ ID NO: 470860 - protein, 6 aa, Mycobacterium
ERHGGS

SEQ ID NO: 470861 - protein, 6 aa, Mycobacterium
ERHGGT

SEQ ID NO: 470862 - protein, 5 aa, Mycobacterium
ERHGL

SEQ ID NO: 470863 - protein, 8 aa, Mycobacterium
ERHGRPPD

SEQ ID NO: 470864 - protein, 6 aa, Mycobacterium
ERHGRT

SEQ ID NO: 470865 - protein, 6 aa, Mycobacterium
ERHHPD

SEQ ID NO: 470866 - protein, 6 aa, Mycobacterium
ERHHPN

SEQ ID NO: 470867 - protein, 18 aa, Mycobacterium
ERHHTATGHAGHKPTPEI

SEQ ID NO: 470868 - protein, 4 aa, Mycobacterium
ERHK

SEQ ID NO: 470869 - protein, 5 aa, Mycobacterium
ERHPD

SEQ ID NO: 470870 - protein, 11 aa, Mycobacterium
ERHPGGTTSQV

SEQ ID NO: 470871 - protein, 16 aa, Mycobacterium
ERHPGGTTTHTKAAAG

SEQ ID NO: 470872 - protein, 9 aa, Mycobacterium
ERHQLSADS

SEQ ID NO: 470873 - protein, 5 aa, Mycobacterium
ERHRA

SEQ ID NO: 470874 - protein, 10 aa, Mycobacterium
ERHRGGPDCG

SEQ ID NO: 470875 - protein, 8 aa, Mycobacterium
ERHRNSRY

SEQ ID NO: 470876 - protein, 7 aa, Mycobacterium
ERHRPGA

SEQ ID NO: 470877 - protein, 6 aa, Mycobacterium
ERHRSE

SEQ ID NO: 470878 - protein, 14 aa, Mycobacterium
ERHRTKAVDLRADQ

SEQ ID NO: 470879 - protein, 9 aa, Mycobacterium
ERHSASDYL

SEQ ID NO: 470880 - protein, 10 aa, Mycobacterium
ERHSQKNERP

SEQ ID NO: 470881 - protein, 11 aa, Mycobacterium
ERHTDPLTSTL

SEQ ID NO: 470882 - protein, 4 aa, Mycobacterium
ERIA

SEQ ID NO: 470883 - protein, 8 aa, Mycobacterium
ERIAGGPD

SEQ ID NO: 470884 - protein, 8 aa, Mycobacterium
ERIAPADG

SEQ ID NO: 470885 - protein, 8 aa, Mycobacterium
ERIARGDP

SEQ ID NO: 470886 - protein, 18 aa, Mycobacterium
ERIASRSGTTSDATPEIA

SEQ ID NO: 470887 - protein, 12 aa, Mycobacterium
ERIAVQGRKDAK

SEQ ID NO: 470888 - protein, 16 aa, Mycobacterium
ERIAVQGRKDAKLQKR

SEQ ID NO: 470889 - protein, 16 aa, Mycobacterium
ERIAVTGRKDAKLQKR

SEQ ID NO: 470890 - protein, 4 aa, Mycobacterium
ERID

SEQ ID NO: 470891 - protein, 5 aa, Mycobacterium
ERIDE

SEQ ID NO: 470892 - protein, 4 aa, Mycobacterium
ERIE

SEQ ID NO: 470893 - protein, 14 aa, Mycobacterium
ERIEAAAKEAGPGA

SEQ ID NO: 470894 - protein, 14 aa, Mycobacterium
ERIGNRKRAHDDGA

SEQ ID NO: 470895 - protein, 15 aa, Mycobacterium
ERIGPTPEDLGQDDA

SEQ ID NO: 470896 - protein, 11 aa, Mycobacterium
ERIGQDGSSAV

SEQ ID NO: 470897 - protein, 6 aa, Mycobacterium
ERIGTS

SEQ ID NO: 470898 - protein, 8 aa, Mycobacterium
ERIPATAA

SEQ ID NO: 470899 - protein, 6 aa, Mycobacterium
ERIPDE

SEQ ID NO: 470900 - protein, 5 aa, Mycobacterium
ERIPE

SEQ ID NO: 470901 - protein, 6 aa, Mycobacterium
ERIPGE

SEQ ID NO: 470902 - protein, 9 aa, Mycobacterium
ERIPGTAAL

SEQ ID NO: 470903 - protein, 9 aa, Mycobacterium
ERIPPGPGQ

SEQ ID NO: 470904 - protein, 6 aa, Mycobacterium
ERIPPR

SEQ ID NO: 470905 - protein, 4 aa, Mycobacterium
ERIR

SEQ ID NO: 470906 - protein, 5 aa, Mycobacterium
ERIRE

SEQ ID NO: 470907 - protein, 16 aa, Mycobacterium
ERISSGTHSTWAPGSE

SEQ ID NO: 470908 - protein, 10 aa, Mycobacterium
ERITGRPGRT

SEQ ID NO: 470909 - protein, 5 aa, Mycobacterium
ERITR

SEQ ID NO: 470910 - protein, 7 aa, Mycobacterium
ERITRQS

SEQ ID NO: 470911 - protein, 12 aa, Mycobacterium
ERKAAEKPRKSV

SEQ ID NO: 470912 - protein, 12 aa, Mycobacterium
ERKAAEKSRNSV

SEQ ID NO: 470913 - protein, 13 aa, Mycobacterium
ERKAEEKKDRDSC

SEQ ID NO: 470914 - protein, 9 aa, Mycobacterium
ERKAGDGPC

SEQ ID NO: 470915 - protein, 5 aa, Mycobacterium
ERKAL

SEQ ID NO: 470916 - protein, 8 aa, Mycobacterium
ERKANGPF

SEQ ID NO: 470917 - protein, 25 aa, Mycobacterium
ERKAQEKKVKARASSMDDVPTGQPA

SEQ ID NO: 470918 - protein, 10 aa, Mycobacterium
ERKARNAESM

SEQ ID NO: 470919 - protein, 8 aa, Mycobacterium
ERKARNEA

SEQ ID NO: 470920 - protein, 12 aa, Mycobacterium
ERKASEKPRKSV

SEQ ID NO: 470921 - protein, 7 aa, Mycobacterium
ERKDGSA

SEQ ID NO: 470922 - protein, 15 aa, Mycobacterium
ERKETRLRPDQYNSL

SEQ ID NO: 470923 - protein, 13 aa, Mycobacterium
ERKGDNAVPPLPR

SEQ ID NO: 470924 - protein, 10 aa, Mycobacterium
ERKGRTQAEL

SEQ ID NO: 470925 - protein, 16 aa, Mycobacterium
ERKGSPGEVRPIGNPH

SEQ ID NO: 470926 - protein, 14 aa, Mycobacterium
ERKGVPRAKLTGTI

SEQ ID NO: 470927 - protein, 11 aa, Mycobacterium
ERKGWKAEVNS

SEQ ID NO: 470928 - protein, 9 aa, Mycobacterium
ERKHNRDAR

SEQ ID NO: 470929 - protein, 15 aa, Mycobacterium
ERKHNRTARLAERPS

SEQ ID NO: 470930 - protein, 37 aa, Mycobacterium
ERKKAKAAGGADHKDAGRTQPRSHGPVENRREFRRKS

SEQ ID NO: 470931 - protein, 9 aa, Mycobacterium
ERKKQRTRA

SEQ ID NO: 470932 - protein, 8 aa, Mycobacterium
ERKKREMR

SEQ ID NO: 470933 - protein, 4 aa, Mycobacterium
ERKL

SEQ ID NO: 470934 - protein, 16 aa, Mycobacterium
ERKLNDGDYTLDREAA

SEQ ID NO: 470935 - protein, 8 aa, Mycobacterium
ERKLSEGD

SEQ ID NO: 470936 - protein, 8 aa, Mycobacterium
ERKLTDGD

SEQ ID NO: 470937 - protein, 17 aa, Mycobacterium
ERKLTDGDYTLDREAAD

SEQ ID NO: 470938 - protein, 38 aa, Mycobacterium
ERKNAKAVSGSSHRDGGAKQSRGAHGPVENRREFRRKS

SEQ ID NO: 470939 - protein, 5 aa, Mycobacterium
ERKPH

SEQ ID NO: 470940 - protein, 6 aa, Mycobacterium
ERKPSA

SEQ ID NO: 470941 - protein, 7 aa, Mycobacterium
ERKPSAQ

SEQ ID NO: 470942 - protein, 5 aa, Mycobacterium
ERKPT

SEQ ID NO: 470943 - protein, 6 aa, Mycobacterium
ERKPTG

SEQ ID NO: 470944 - protein, 7 aa, Mycobacterium
ERKPTGV

SEQ ID NO: 470945 - protein, 9 aa, Mycobacterium
ERKQDPQHA

SEQ ID NO: 470946 - protein, 16 aa, Mycobacterium
ERKQKSRQTRASRDAL

SEQ ID NO: 470947 - protein, 6 aa, Mycobacterium
ERKRAA

SEQ ID NO: 470948 - protein, 10 aa, Mycobacterium
ERKRTATRQR

SEQ ID NO: 470949 - protein, 13 aa, Mycobacterium
ERKTAVANHESDG

SEQ ID NO: 470950 - protein, 8 aa, Mycobacterium
ERKTKESE

SEQ ID NO: 470951 - protein, 5 aa, Mycobacterium
ERKTT

SEQ ID NO: 470952 - protein, 7 aa, Mycobacterium
ERLAESA

SEQ ID NO: 470953 - protein, 10 aa, Mycobacterium
ERLAKSEKYP

SEQ ID NO: 470954 - protein, 9 aa, Mycobacterium
ERLATDDGI

SEQ ID NO: 470955 - protein, 6 aa, Mycobacterium
ERLATR

SEQ ID NO: 470956 - protein, 13 aa, Mycobacterium
ERLATSPPAVSRS

SEQ ID NO: 470957 - protein, 7 aa, Mycobacterium
ERLDAGE

SEQ ID NO: 470958 - protein, 11 aa, Mycobacterium
ERLDGTPENDV

SEQ ID NO: 470959 - protein, 6 aa, Mycobacterium
ERLDPD

SEQ ID NO: 470960 - protein, 10 aa, Mycobacterium
ERLDRGRGPF

SEQ ID NO: 470961 - protein, 4 aa, Mycobacterium
ERLE

SEQ ID NO: 470962 - protein, 10 aa, Mycobacterium
ERLEEGIDKG

SEQ ID NO: 470963 - protein, 9 aa, Mycobacterium
ERLEEGIER

SEQ ID NO: 470964 - protein, 12 aa, Mycobacterium
ERLEEGIERGAA

SEQ ID NO: 470965 - protein, 8 aa, Mycobacterium
ERLEPTER

SEQ ID NO: 470966 - protein, 5 aa, Mycobacterium
ERLET

SEQ ID NO: 470967 - protein, 5 aa, Mycobacterium
ERLEV

SEQ ID NO: 470968 - protein, 5 aa, Mycobacterium
ERLGA

SEQ ID NO: 470969 - protein, 21 aa, Mycobacterium
ERLGAGGGGVKRVPKAQRAEE

SEQ ID NO: 470970 - protein, 7 aa, Mycobacterium
ERLGGDG

SEQ ID NO: 470971 - protein, 8 aa, Mycobacterium
ERLGGDGV

SEQ ID NO: 470972 - protein, 10 aa, Mycobacterium
ERLNPNGSGI

SEQ ID NO: 470973 - protein, 9 aa, Mycobacterium
ERLPAETSR

SEQ ID NO: 470974 - protein, 10 aa, Mycobacterium
ERLPAGAWTN

SEQ ID NO: 470975 - protein, 6 aa, Mycobacterium
ERLPDG

SEQ ID NO: 470976 - protein, 24 aa, Mycobacterium
ERLPDRGRAGPLPPPGGVRRRRDR

SEQ ID NO: 470977 - protein, 15 aa, Mycobacterium
ERLPGGNDHGGGDTL

SEQ ID NO: 470978 - protein, 20 aa, Mycobacterium
ERLPRGADPNTHTKLGRGGL

SEQ ID NO: 470979 - protein, 11 aa, Mycobacterium
ERLQENASRVG

SEQ ID NO: 470980 - protein, 6 aa, Mycobacterium
ERLQTG

SEQ ID NO: 470981 - protein, 4 aa, Mycobacterium
ERLR

SEQ ID NO: 470982 - protein, 8 aa, Mycobacterium
ERLRESKE

SEQ ID NO: 470983 - protein, 10 aa, Mycobacterium
ERLRPDPAVR

SEQ ID NO: 470984 - protein, 15 aa, Mycobacterium
ERLSAETAESPLTTR

SEQ ID NO: 470985 - protein, 9 aa, Mycobacterium
ERLSGTNEF

SEQ ID NO: 470986 - protein, 14 aa, Mycobacterium
ERLSQRADGEIPAE

SEQ ID NO: 470987 - protein, 4 aa, Mycobacterium
ERLT

SEQ ID NO: 470988 - protein, 8 aa, Mycobacterium
ERLTPDHP

SEQ ID NO: 470989 - protein, 9 aa, Mycobacterium
ERLTPSDEF

SEQ ID NO: 470990 - protein, 22 aa, Mycobacterium
ERLVPGSAAPPPAAEIPALVAA

SEQ ID NO: 470991 - protein, 6 aa, Mycobacterium
ERMAKD

SEQ ID NO: 470992 - protein, 9 aa, Mycobacterium
ERMEGSEAV

SEQ ID NO: 470993 - protein, 4 aa, Mycobacterium
ERMG

SEQ ID NO: 470994 - protein, 5 aa, Mycobacterium
ERMGQ

SEQ ID NO: 470995 - protein, 5 aa, Mycobacterium
ERMSE

SEQ ID NO: 470996 - protein, 6 aa, Mycobacterium
ERMSRT

SEQ ID NO: 470997 - protein, 8 aa, Mycobacterium
ERNAEEAG

SEQ ID NO: 470998 - protein, 12 aa, Mycobacterium
ERNAKSASATVA

SEQ ID NO: 470999 - protein, 10 aa, Mycobacterium
ERNDKGGRAT

SEQ ID NO: 471000 - protein, 8 aa, Mycobacterium
ERNDNGPF

SEQ ID NO: 471001 - protein, 18 aa, Mycobacterium
ERNDRARTAGSGLKGVGG

SEQ ID NO: 471002 - protein, 5 aa, Mycobacterium
ERNFA

SEQ ID NO: 471003 - protein, 4 aa, Mycobacterium
ERNG

SEQ ID NO: 471004 - protein, 10 aa, Mycobacterium
ERNGEEPPAI

SEQ ID NO: 471005 - protein, 7 aa, Mycobacterium
ERNGGGA

SEQ ID NO: 471006 - protein, 7 aa, Mycobacterium
ERNGQTL

SEQ ID NO: 471007 - protein, 6 aa, Mycobacterium
ERNGYR

SEQ ID NO: 471008 - protein, 11 aa, Mycobacterium
ERNPDLPVEGP

SEQ ID NO: 471009 - protein, 8 aa, Mycobacterium
ERNPEDPR

SEQ ID NO: 471010 - protein, 14 aa, Mycobacterium
ERNPEQASVARGNM

SEQ ID NO: 471011 - protein, 13 aa, Mycobacterium
ERNPMADNTHSAA

SEQ ID NO: 471012 - protein, 7 aa, Mycobacterium
ERNPRAS

SEQ ID NO: 471013 - protein, 50 aa, Mycobacterium
ERNQAQAKLEAAKREAAARQGSGGSPASGDRWETGTPGGAAPSSGARQWD

SEQ ID NO: 471014 - protein, 17 aa, Mycobacterium
ERNREASTDAEYAQKSA

SEQ ID NO: 471015 - protein, 23 aa, Mycobacterium
ERNREQATALKSSSMQEARAEEL

SEQ ID NO: 471016 - protein, 6 aa, Mycobacterium
ERNRER

SEQ ID NO: 471017 - protein, 9 aa, Mycobacterium
ERNRGGGQA

SEQ ID NO: 471018 - protein, 5 aa, Mycobacterium
ERNRP

SEQ ID NO: 471019 - protein, 10 aa, Mycobacterium
ERNRRQRKSC

SEQ ID NO: 471020 - protein, 8 aa, Mycobacterium
ERNRYETA

SEQ ID NO: 471021 - protein, 23 aa, Mycobacterium
ERNSDPGRTASARYAERERRDGD

SEQ ID NO: 471022 - protein, 9 aa, Mycobacterium
ERNSHADRL

SEQ ID NO: 471023 - protein, 10 aa, Mycobacterium
ERNSQKSREL

SEQ ID NO: 471024 - protein, 7 aa, Mycobacterium
ERNSRGV

SEQ ID NO: 471025 - protein, 6 aa, Mycobacterium
ERNTGD

SEQ ID NO: 471026 - protein, 6 aa, Mycobacterium
ERNTQV

SEQ ID NO: 471027 - protein, 5 aa, Mycobacterium
ERNTR

SEQ ID NO: 471028 - protein, 6 aa, Mycobacterium
ERNWSR

SEQ ID NO: 471029 - protein, 5 aa, Mycobacterium
ERPAA

SEQ ID NO: 471030 - protein, 14 aa, Mycobacterium
ERPAAGPAETSAYA

SEQ ID NO: 471031 - protein, 5 aa, Mycobacterium
ERPAE

SEQ ID NO: 471032 - protein, 13 aa, Mycobacterium
ERPAEAADRAVPG

SEQ ID NO: 471033 - protein, 6 aa, Mycobacterium
ERPAEV

SEQ ID NO: 471034 - protein, 6 aa, Mycobacterium
ERPAGA

SEQ ID NO: 471035 - protein, 7 aa, Mycobacterium
ERPAGYE

SEQ ID NO: 471036 - protein, 9 aa, Mycobacterium
ERPALDPNR

SEQ ID NO: 471037 - protein, 9 aa, Mycobacterium
ERPALGERA

SEQ ID NO: 471038 - protein, 17 aa, Mycobacterium
ERPAPEAHVPGQGENPL

SEQ ID NO: 471039 - protein, 9 aa, Mycobacterium
ERPARRPAW

SEQ ID NO: 471040 - protein, 9 aa, Mycobacterium
ERPASAGDT

SEQ ID NO: 471041 - protein, 10 aa, Mycobacterium
ERPASSGESL

SEQ ID NO: 471042 - protein, 8 aa, Mycobacterium
ERPATAAD

SEQ ID NO: 471043 - protein, 11 aa, Mycobacterium
ERPATASHEAT

SEQ ID NO: 471044 - protein, 9 aa, Mycobacterium
ERPAVDPNR

SEQ ID NO: 471045 - protein, 10 aa, Mycobacterium
ERPDAEAAQD

SEQ ID NO: 471046 - protein, 8 aa, Mycobacterium
ERPDAESA

SEQ ID NO: 471047 - protein, 10 aa, Mycobacterium
ERPDAESAQD

SEQ ID NO: 471048 - protein, 7 aa, Mycobacterium
ERPDCPD

SEQ ID NO: 471049 - protein, 5 aa, Mycobacterium
ERPDD

SEQ ID NO: 471050 - protein, 12 aa, Mycobacterium
ERPDDGPDELSA

SEQ ID NO: 471051 - protein, 6 aa, Mycobacterium
ERPDDL

SEQ ID NO: 471052 - protein, 6 aa, Mycobacterium
ERPDEV

SEQ ID NO: 471053 - protein, 13 aa, Mycobacterium
ERPDFTPRNRSTV

SEQ ID NO: 471054 - protein, 6 aa, Mycobacterium
ERPDGL

SEQ ID NO: 471055 - protein, 10 aa, Mycobacterium
ERPDGRRSTV

SEQ ID NO: 471056 - protein, 5 aa, Mycobacterium
ERPDI

SEQ ID NO: 471057 - protein, 5 aa, Mycobacterium
ERPDL

SEQ ID NO: 471058 - protein, 6 aa, Mycobacterium
ERPDLQ

SEQ ID NO: 471059 - protein, 14 aa, Mycobacterium
ERPDPLSGLTDQER

SEQ ID NO: 471060 - protein, 9 aa, Mycobacterium
ERPDQLDGA

SEQ ID NO: 471061 - protein, 6 aa, Mycobacterium
ERPDQV

SEQ ID NO: 471062 - protein, 7 aa, Mycobacterium
ERPDSDG

SEQ ID NO: 471063 - protein, 9 aa, Mycobacterium
ERPDTAPDE

SEQ ID NO: 471064 - protein, 5 aa, Mycobacterium
ERPDV

SEQ ID NO: 471065 - protein, 16 aa, Mycobacterium
ERPDVDRETAEDPAPD

SEQ ID NO: 471066 - protein, 5 aa, Mycobacterium
ERPEA

SEQ ID NO: 471067 - protein, 5 aa, Mycobacterium
ERPEE

SEQ ID NO: 471068 - protein, 17 aa, Mycobacterium
ERPEEPSWPSPFGPGRP

SEQ ID NO: 471069 - protein, 8 aa, Mycobacterium
ERPEESDD

SEQ ID NO: 471070 - protein, 5 aa, Mycobacterium
ERPEL

SEQ ID NO: 471071 - protein, 6 aa, Mycobacterium
ERPENL

SEQ ID NO: 471072 - protein, 5 aa, Mycobacterium
ERPEP

SEQ ID NO: 471073 - protein, 18 aa, Mycobacterium
ERPESGPPAPALRPAGTV

SEQ ID NO: 471074 - protein, 6 aa, Mycobacterium
ERPETA

SEQ ID NO: 471075 - protein, 6 aa, Mycobacterium
ERPGAW

SEQ ID NO: 471076 - protein, 6 aa, Mycobacterium
ERPGDA

SEQ ID NO: 471077 - protein, 9 aa, Mycobacterium
ERPGDEQRR

SEQ ID NO: 471078 - protein, 17 aa, Mycobacterium
ERPGEPSWPSPFGRGRP

SEQ ID NO: 471079 - protein, 6 aa, Mycobacterium
ERPGEV

SEQ ID NO: 471080 - protein, 9 aa, Mycobacterium
ERPGGGDFA

SEQ ID NO: 471081 - protein, 11 aa, Mycobacterium
ERPGGGDVTRK

SEQ ID NO: 471082 - protein, 15 aa, Mycobacterium
ERPGKGGGVPAGDRD

SEQ ID NO: 471083 - protein, 16 aa, Mycobacterium
ERPGKGPGPATKPGGD

SEQ ID NO: 471084 - protein, 8 aa, Mycobacterium
ERPGLDQN

SEQ ID NO: 471085 - protein, 7 aa, Mycobacterium
ERPGQDR

SEQ ID NO: 471086 - protein, 10 aa, Mycobacterium
ERPGRGDEMR

SEQ ID NO: 471087 - protein, 6 aa, Mycobacterium
ERPGRP

SEQ ID NO: 471088 - protein, 5 aa, Mycobacterium
ERPGS

SEQ ID NO: 471089 - protein, 8 aa, Mycobacterium
ERPGSDVQ

SEQ ID NO: 471090 - protein, 15 aa, Mycobacterium
ERPGSGDDTRGWGPP

SEQ ID NO: 471091 - protein, 10 aa, Mycobacterium
ERPGSGRAEG

SEQ ID NO: 471092 - protein, 10 aa, Mycobacterium
ERPGSGVEER

SEQ ID NO: 471093 - protein, 6 aa, Mycobacterium
ERPGSR

SEQ ID NO: 471094 - protein, 9 aa, Mycobacterium
ERPGSRVGG

SEQ ID NO: 471095 - protein, 10 aa, Mycobacterium
ERPGSVGKPL

SEQ ID NO: 471096 - protein, 21 aa, Mycobacterium
ERPGTGDDTRQWGPPYDSTGV

SEQ ID NO: 471097 - protein, 9 aa, Mycobacterium
ERPGTGDEL

SEQ ID NO: 471098 - protein, 7 aa, Mycobacterium
ERPGVGD

SEQ ID NO: 471099 - protein, 6 aa, Mycobacterium
ERPGVT

SEQ ID NO: 471100 - protein, 8 aa, Mycobacterium
ERPHENEL

SEQ ID NO: 471101 - protein, 7 aa, Mycobacterium
ERPHPTK

SEQ ID NO: 471102 - protein, 8 aa, Mycobacterium
ERPHSTAD

SEQ ID NO: 471103 - protein, 12 aa, Mycobacterium
ERPIDKDDAVEG

SEQ ID NO: 471104 - protein, 7 aa, Mycobacterium
ERPINSA

SEQ ID NO: 471105 - protein, 6 aa, Mycobacterium
ERPKEM

SEQ ID NO: 471106 - protein, 7 aa, Mycobacterium
ERPKMPD

SEQ ID NO: 471107 - protein, 4 aa, Mycobacterium
ERPL

SEQ ID NO: 471108 - protein, 13 aa, Mycobacterium
ERPLAPRGRREAG

SEQ ID NO: 471109 - protein, 7 aa, Mycobacterium
ERPLHGT

SEQ ID NO: 471110 - protein, 5 aa, Mycobacterium
ERPLT

SEQ ID NO: 471111 - protein, 4 aa, Mycobacterium
ERPN

SEQ ID NO: 471112 - protein, 7 aa, Mycobacterium
ERPNDVD

SEQ ID NO: 471113 - protein, 28 aa, Mycobacterium
ERPPANPLPSSPAPTPGSTGTEQPPTGL

SEQ ID NO: 471114 - protein, 5 aa, Mycobacterium
ERPPE

SEQ ID NO: 471115 - protein, 5 aa, Mycobacterium
ERPPF

SEQ ID NO: 471116 - protein, 7 aa, Mycobacterium
ERPPGDL

SEQ ID NO: 471117 - protein, 9 aa, Mycobacterium
ERPPLSKVD

SEQ ID NO: 471118 - protein, 15 aa, Mycobacterium
ERPPSDDELAGPAAS

SEQ ID NO: 471119 - protein, 14 aa, Mycobacterium
ERPPTIGHWYNSDD

SEQ ID NO: 471120 - protein, 11 aa, Mycobacterium
ERPPTPAQGAQ

SEQ ID NO: 471121 - protein, 17 aa, Mycobacterium
ERPQATTSVAAGSRADA

SEQ ID NO: 471122 - protein, 11 aa, Mycobacterium
ERPQGGDFARG

SEQ ID NO: 471123 - protein, 5 aa, Mycobacterium
ERPQL

SEQ ID NO: 471124 - protein, 14 aa, Mycobacterium
ERPQPLGPSNWTGG

SEQ ID NO: 471125 - protein, 4 aa, Mycobacterium
ERPR

SEQ ID NO: 471126 - protein, 6 aa, Mycobacterium
ERPRAD

SEQ ID NO: 471127 - protein, 19 aa, Mycobacterium
ERPRRRRAAGRPAGPPIHL

SEQ ID NO: 471128 - protein, 5 aa, Mycobacterium
ERPRS

SEQ ID NO: 471129 - protein, 9 aa, Mycobacterium
ERPRSNEPP

SEQ ID NO: 471130 - protein, 9 aa, Mycobacterium
ERPRTNEPP

SEQ ID NO: 471131 - protein, 5 aa, Mycobacterium
ERPSE

SEQ ID NO: 471132 - protein, 5 aa, Mycobacterium
ERPSL

SEQ ID NO: 471133 - protein, 8 aa, Mycobacterium
ERPSTTAD

SEQ ID NO: 471134 - protein, 23 aa, Mycobacterium
ERPTEITPTQPPTDGAEQPGTEV

SEQ ID NO: 471135 - protein, 6 aa, Mycobacterium
ERPTFE

SEQ ID NO: 471136 - protein, 7 aa, Mycobacterium
ERPTFSG

SEQ ID NO: 471137 - protein, 11 aa, Mycobacterium
ERPTGAADGPT

SEQ ID NO: 471138 - protein, 27 aa, Mycobacterium
ERPTPGRNPIARASSRPRAIQTDNGSC

SEQ ID NO: 471139 - protein, 10 aa, Mycobacterium
ERPTPRQQDQ

SEQ ID NO: 471140 - protein, 7 aa, Mycobacterium
ERPTQDR

SEQ ID NO: 471141 - protein, 7 aa, Mycobacterium
ERPTSGR

SEQ ID NO: 471142 - protein, 12 aa, Mycobacterium
ERPTSGTVRVDG

SEQ ID NO: 471143 - protein, 6 aa, Mycobacterium
ERPVAA

SEQ ID NO: 471144 - protein, 12 aa, Mycobacterium
ERPVASSRGWSA

SEQ ID NO: 471145 - protein, 6 aa, Mycobacterium
ERPVDD

SEQ ID NO: 471146 - protein, 9 aa, Mycobacterium
ERPVDGTPV

SEQ ID NO: 471147 - protein, 5 aa, Mycobacterium
ERPVN

SEQ ID NO: 471148 - protein, 9 aa, Mycobacterium
ERPVPAAHP

SEQ ID NO: 471149 - protein, 11 aa, Mycobacterium
ERPVPSARGWS

SEQ ID NO: 471150 - protein, 6 aa, Mycobacterium
ERPVTT

SEQ ID NO: 471151 - protein, 7 aa, Mycobacterium
ERPYRDT

SEQ ID NO: 471152 - protein, 7 aa, Mycobacterium
ERPYTTP

SEQ ID NO: 471153 - protein, 4 aa, Mycobacterium
ERQA

SEQ ID NO: 471154 - protein, 10 aa, Mycobacterium
ERQADQRSDE

SEQ ID NO: 471155 - protein, 6 aa, Mycobacterium
ERQAEL

SEQ ID NO: 471156 - protein, 13 aa, Mycobacterium
ERQAKRAERQAAK

SEQ ID NO: 471157 - protein, 15 aa, Mycobacterium
ERQAKRAERQAAKVL

SEQ ID NO: 471158 - protein, 5 aa, Mycobacterium
ERQAM

SEQ ID NO: 471159 - protein, 7 aa, Mycobacterium
ERQAQIT

SEQ ID NO: 471160 - protein, 4 aa, Mycobacterium
ERQD

SEQ ID NO: 471161 - protein, 10 aa, Mycobacterium
ERQDEKARQI

SEQ ID NO: 471162 - protein, 13 aa, Mycobacterium
ERQDGNPIRILVQ

SEQ ID NO: 471163 - protein, 9 aa, Mycobacterium
ERQDVPDEV

SEQ ID NO: 471164 - protein, 7 aa, Mycobacterium
ERQEQRY

SEQ ID NO: 471165 - protein, 6 aa, Mycobacterium
ERQEVD

SEQ ID NO: 471166 - protein, 7 aa, Mycobacterium
ERQGDGT

SEQ ID NO: 471167 - protein, 8 aa, Mycobacterium
ERQGRSVP

SEQ ID NO: 471168 - protein, 8 aa, Mycobacterium
ERQGVPRA

SEQ ID NO: 471169 - protein, 6 aa, Mycobacterium
ERQGYS

SEQ ID NO: 471170 - protein, 4 aa, Mycobacterium
ERQL

SEQ ID NO: 471171 - protein, 6 aa, Mycobacterium
ERQLPD

SEQ ID NO: 471172 - protein, 11 aa, Mycobacterium
ERQLSDRGAER

SEQ ID NO: 471173 - protein, 8 aa, Mycobacterium
ERQPAGQH

SEQ ID NO: 471174 - protein, 6 aa, Mycobacterium
ERQPAR

SEQ ID NO: 471175 - protein, 7 aa, Mycobacterium
ERQPGEV

SEQ ID NO: 471176 - protein, 6 aa, Mycobacterium
ERQPGL

SEQ ID NO: 471177 - protein, 8 aa, Mycobacterium
ERQPGVDG

SEQ ID NO: 471178 - protein, 8 aa, Mycobacterium
ERQPTPRE

SEQ ID NO: 471179 - protein, 8 aa, Mycobacterium
ERQQDKVD

SEQ ID NO: 471180 - protein, 13 aa, Mycobacterium
ERQQGNPIRILVK

SEQ ID NO: 471181 - protein, 14 aa, Mycobacterium
ERQQRQARGQSEVP

SEQ ID NO: 471182 - protein, 9 aa, Mycobacterium
ERQRATTGV

SEQ ID NO: 471183 - protein, 60 aa, Mycobacterium
ERQRDDRRPLGGRQRLQPAAALTDPGGQLGDGGRLEHGAHREAGVEAGVDRGDQAHRGDA

SEQ ID NO: 471184 - protein, 5 aa, Mycobacterium
ERQRE

SEQ ID NO: 471185 - protein, 8 aa, Mycobacterium
ERQREAAG

SEQ ID NO: 471186 - protein, 6 aa, Mycobacterium
ERQREQ

SEQ ID NO: 471187 - protein, 18 aa, Mycobacterium
ERQRGAPAQVDALDGSEG

SEQ ID NO: 471188 - protein, 5 aa, Mycobacterium
ERQRH

SEQ ID NO: 471189 - protein, 8 aa, Mycobacterium
ERQRQRAD

SEQ ID NO: 471190 - protein, 5 aa, Mycobacterium
ERQRR

SEQ ID NO: 471191 - protein, 8 aa, Mycobacterium
ERQRRAAG

SEQ ID NO: 471192 - protein, 13 aa, Mycobacterium
ERQRRSGGAGAGF

SEQ ID NO: 471193 - protein, 11 aa, Mycobacterium
ERQRRSSARRR

SEQ ID NO: 471194 - protein, 7 aa, Mycobacterium
ERQRSHG

SEQ ID NO: 471195 - protein, 7 aa, Mycobacterium
ERQRSTH

SEQ ID NO: 471196 - protein, 7 aa, Mycobacterium
ERQRVGA

SEQ ID NO: 471197 - protein, 6 aa, Mycobacterium
ERQRVN

SEQ ID NO: 471198 - protein, 11 aa, Mycobacterium
ERQSGVEPEDL

SEQ ID NO: 471199 - protein, 7 aa, Mycobacterium
ERQSSQH

SEQ ID NO: 471200 - protein, 6 aa, Mycobacterium
ERQSTA

SEQ ID NO: 471201 - protein, 4 aa, Mycobacterium
ERQT

SEQ ID NO: 471202 - protein, 6 aa, Mycobacterium
ERQTER

SEQ ID NO: 471203 - protein, 5 aa, Mycobacterium
ERQTR

SEQ ID NO: 471204 - protein, 6 aa, Mycobacterium
ERQTSI

SEQ ID NO: 471205 - protein, 4 aa, Mycobacterium
ERQV

SEQ ID NO: 471206 - protein, 8 aa, Mycobacterium
ERQVRPGD

SEQ ID NO: 471207 - protein, 8 aa, Mycobacterium
ERRAADAG

SEQ ID NO: 471208 - protein, 7 aa, Mycobacterium
ERRAAER

SEQ ID NO: 471209 - protein, 5 aa, Mycobacterium
ERRAD

SEQ ID NO: 471210 - protein, 8 aa, Mycobacterium
ERRADGRP

SEQ ID NO: 471211 - protein, 11 aa, Mycobacterium
ERRADPGVAER

SEQ ID NO: 471212 - protein, 11 aa, Mycobacterium
ERRADPNLAER

SEQ ID NO: 471213 - protein, 11 aa, Mycobacterium
ERRADPNLTER

SEQ ID NO: 471214 - protein, 6 aa, Mycobacterium
ERRADQ

SEQ ID NO: 471215 - protein, 5 aa, Mycobacterium
ERRAE

SEQ ID NO: 471216 - protein, 8 aa, Mycobacterium
ERRAEEVE

SEQ ID NO: 471217 - protein, 15 aa, Mycobacterium
ERRAEQMAAGGPSIL

SEQ ID NO: 471218 - protein, 8 aa, Mycobacterium
ERRAETAY

SEQ ID NO: 471219 - protein, 9 aa, Mycobacterium
ERRAGDGPC

SEQ ID NO: 471220 - protein, 13 aa, Mycobacterium
ERRAGEAGDDSLD

SEQ ID NO: 471221 - protein, 7 aa, Mycobacterium
ERRAGRR

SEQ ID NO: 471222 - protein, 6 aa, Mycobacterium
ERRAHQ

SEQ ID NO: 471223 - protein, 7 aa, Mycobacterium
ERRAKDT

SEQ ID NO: 471224 - protein, 10 aa, Mycobacterium
ERRAKDTDEL

SEQ ID NO: 471225 - protein, 8 aa, Mycobacterium
ERRAKDTI

SEQ ID NO: 471226 - protein, 8 aa, Mycobacterium
ERRAKDTL

SEQ ID NO: 471227 - protein, 9 aa, Mycobacterium
ERRAKDTVE

SEQ ID NO: 471228 - protein, 8 aa, Mycobacterium
ERRAPDAV

SEQ ID NO: 471229 - protein, 8 aa, Mycobacterium
ERRAPEAV

SEQ ID NO: 471230 - protein, 9 aa, Mycobacterium
ERRAPEAVT

SEQ ID NO: 471231 - protein, 9 aa, Mycobacterium
ERRAPKQVT

SEQ ID NO: 471232 - protein, 7 aa, Mycobacterium
ERRASED

SEQ ID NO: 471233 - protein, 10 aa, Mycobacterium
ERRASEDSSV

SEQ ID NO: 471234 - protein, 12 aa, Mycobacterium
ERRASGALPSRA

SEQ ID NO: 471235 - protein, 13 aa, Mycobacterium
ERRASRYGQPGKT

SEQ ID NO: 471236 - protein, 7 aa, Mycobacterium
ERRATTH

SEQ ID NO: 471237 - protein, 7 aa, Mycobacterium
ERRDAEL

SEQ ID NO: 471238 - protein, 12 aa, Mycobacterium
ERRDAMNRTDRG

SEQ ID NO: 471239 - protein, 8 aa, Mycobacterium
ERRDDTRL

SEQ ID NO: 471240 - protein, 17 aa, Mycobacterium
ERRDERSEESDGRTYSE

SEQ ID NO: 471241 - protein, 5 aa, Mycobacterium
ERRDG

SEQ ID NO: 471242 - protein, 7 aa, Mycobacterium
ERRDGAP

SEQ ID NO: 471243 - protein, 6 aa, Mycobacterium
ERRDGD

SEQ ID NO: 471244 - protein, 30 aa, Mycobacterium
ERRDGPFGDYSQAPPELRPDPNHVIVPDGN

SEQ ID NO: 471245 - protein, 31 aa, Mycobacterium
ERRDGPFGDYSQAPPELRPDPSHVIVPDRGQ

SEQ ID NO: 471246 - protein, 30 aa, Mycobacterium
ERRDGPFGDYSQAPPELRPNPNHVIVPDRD

SEQ ID NO: 471247 - protein, 7 aa, Mycobacterium
ERRDGQD

SEQ ID NO: 471248 - protein, 8 aa, Mycobacterium
ERRDGQEF

SEQ ID NO: 471249 - protein, 9 aa, Mycobacterium
ERRDGRPIL

SEQ ID NO: 471250 - protein, 18 aa, Mycobacterium
ERRDHEAGGALDSSVGGT

SEQ ID NO: 471251 - protein, 9 aa, Mycobacterium
ERRDNPGDD

SEQ ID NO: 471252 - protein, 19 aa, Mycobacterium
ERRDSDAVSAATARAGEIQ

SEQ ID NO: 471253 - protein, 7 aa, Mycobacterium
ERREGAE

SEQ ID NO: 471254 - protein, 6 aa, Mycobacterium
ERREGD

SEQ ID NO: 471255 - protein, 8 aa, Mycobacterium
ERREPSFT

SEQ ID NO: 471256 - protein, 16 aa, Mycobacterium
ERREREAAQYPTTRAG

SEQ ID NO: 471257 - protein, 7 aa, Mycobacterium
ERREVNK

SEQ ID NO: 471258 - protein, 8 aa, Mycobacterium
ERRGDAER

SEQ ID NO: 471259 - protein, 10 aa, Mycobacterium
ERRGEAIDDG

SEQ ID NO: 471260 - protein, 202 aa, Mycobacterium
ERRGEANGSAETKKGDAPTSAPAETAAGSATDSGQAPAAAQAGQDEAAEPQPQQRRRERRGASRDQGGPSSAEQAQPQETADGAQDDAGETEGRRRRSQQDAQGGRDEARESKGADQTTADSDGGNRGDGGDQQGGGQNRNRNDNRGDSNRGNDNRGNDNRGDSNRGNDNRGNDNRGNDNRGGGGDNDDDGEGRQGRRGRRF

SEQ ID NO: 471261 - protein, 9 aa, Mycobacterium
ERRGGYGEY

SEQ ID NO: 471262 - protein, 9 aa, Mycobacterium
ERRGKRTDE

SEQ ID NO: 471263 - protein, 5 aa, Mycobacterium
ERRGP

SEQ ID NO: 471264 - protein, 17 aa, Mycobacterium
ERRGPWGPGRRAEAADA

SEQ ID NO: 471265 - protein, 9 aa, Mycobacterium
ERRGQQRTD

SEQ ID NO: 471266 - protein, 8 aa, Mycobacterium
ERRGRGTV

SEQ ID NO: 471267 - protein, 9 aa, Mycobacterium
ERRGRPIDD

SEQ ID NO: 471268 - protein, 8 aa, Mycobacterium
ERRGSGIS

SEQ ID NO: 471269 - protein, 7 aa, Mycobacterium
ERRGTGI

SEQ ID NO: 471270 - protein, 7 aa, Mycobacterium
ERRGTGP

SEQ ID NO: 471271 - protein, 19 aa, Mycobacterium
ERRIAEETAKAEGKPEAAL

SEQ ID NO: 471272 - protein, 10 aa, Mycobacterium
ERRKAARGVP

SEQ ID NO: 471273 - protein, 9 aa, Mycobacterium
ERRKKRSEV

SEQ ID NO: 471274 - protein, 5 aa, Mycobacterium
ERRKQ

SEQ ID NO: 471275 - protein, 9 aa, Mycobacterium
ERRKQRTRA

SEQ ID NO: 471276 - protein, 5 aa, Mycobacterium
ERRKR

SEQ ID NO: 471277 - protein, 9 aa, Mycobacterium
ERRKRRTRA

SEQ ID NO: 471278 - protein, 5 aa, Mycobacterium
ERRKT

SEQ ID NO: 471279 - protein, 4 aa, Mycobacterium
ERRL

SEQ ID NO: 471280 - protein, 7 aa, Mycobacterium
ERRLAGR

SEQ ID NO: 471281 - protein, 10 aa, Mycobacterium
ERRLGERDGE

SEQ ID NO: 471282 - protein, 4 aa, Mycobacterium
ERRN

SEQ ID NO: 471283 - protein, 18 aa, Mycobacterium
ERRPAKKADTAPQKVDTA

SEQ ID NO: 471284 - protein, 8 aa, Mycobacterium
ERRPAPCP

SEQ ID NO: 471285 - protein, 12 aa, Mycobacterium
ERRPDQTPIQPL

SEQ ID NO: 471286 - protein, 9 aa, Mycobacterium
ERRPEEGPG

SEQ ID NO: 471287 - protein, 6 aa, Mycobacterium
ERRPGE

SEQ ID NO: 471288 - protein, 9 aa, Mycobacterium
ERRPLPPAA

SEQ ID NO: 471289 - protein, 5 aa, Mycobacterium
ERRPQ

SEQ ID NO: 471290 - protein, 7 aa, Mycobacterium
ERRPQTA

SEQ ID NO: 471291 - protein, 6 aa, Mycobacterium
ERRPSA

SEQ ID NO: 471292 - protein, 21 aa, Mycobacterium
ERRPVEGEGPAPRVDAAATQL

SEQ ID NO: 471293 - protein, 12 aa, Mycobacterium
ERRQAREATPAP

SEQ ID NO: 471294 - protein, 9 aa, Mycobacterium
ERRQEPQDD

SEQ ID NO: 471295 - protein, 6 aa, Mycobacterium
ERRQFG

SEQ ID NO: 471296 - protein, 16 aa, Mycobacterium
ERRQKSRHTRASRDAL

SEQ ID NO: 471297 - protein, 6 aa, Mycobacterium
ERRQLG

SEQ ID NO: 471298 - protein, 8 aa, Mycobacterium
ERRQPNPI

SEQ ID NO: 471299 - protein, 5 aa, Mycobacterium
ERRQR

SEQ ID NO: 471300 - protein, 10 aa, Mycobacterium
ERRQRKQPPL

SEQ ID NO: 471301 - protein, 10 aa, Mycobacterium
ERRQSSLEDS

SEQ ID NO: 471302 - protein, 9 aa, Mycobacterium
ERRQSTPSI

SEQ ID NO: 471303 - protein, 9 aa, Mycobacterium
ERRQYHGED

SEQ ID NO: 471304 - protein, 8 aa, Mycobacterium
ERRRADGS

SEQ ID NO: 471305 - protein, 7 aa, Mycobacterium
ERRRCPA

SEQ ID NO: 471306 - protein, 7 aa, Mycobacterium
ERRRDRP

SEQ ID NO: 471307 - protein, 5 aa, Mycobacterium
ERRRE

SEQ ID NO: 471308 - protein, 6 aa, Mycobacterium
ERRREA

SEQ ID NO: 471309 - protein, 9 aa, Mycobacterium
ERRREEFGG

SEQ ID NO: 471310 - protein, 8 aa, Mycobacterium
ERRREGAR

SEQ ID NO: 471311 - protein, 10 aa, Mycobacterium
ERRRELSGGR

SEQ ID NO: 471312 - protein, 10 aa, Mycobacterium
ERRRELTGGR

SEQ ID NO: 471313 - protein, 11 aa, Mycobacterium
ERRRPADLTAA

SEQ ID NO: 471314 - protein, 6 aa, Mycobacterium
ERRRPY

SEQ ID NO: 471315 - protein, 12 aa, Mycobacterium
ERRRRRITTGNA

SEQ ID NO: 471316 - protein, 13 aa, Mycobacterium
ERRRSASTVRSGS

SEQ ID NO: 471317 - protein, 9 aa, Mycobacterium
ERRRSTPSI

SEQ ID NO: 471318 - protein, 12 aa, Mycobacterium
ERRRTAARSELR

SEQ ID NO: 471319 - protein, 7 aa, Mycobacterium
ERRSAEL

SEQ ID NO: 471320 - protein, 7 aa, Mycobacterium
ERRSGEK

SEQ ID NO: 471321 - protein, 6 aa, Mycobacterium
ERRSPD

SEQ ID NO: 471322 - protein, 15 aa, Mycobacterium
ERRSQVGGTLSGGEQ

SEQ ID NO: 471323 - protein, 5 aa, Mycobacterium
ERRSR

SEQ ID NO: 471324 - protein, 9 aa, Mycobacterium
ERRSSDSYP

SEQ ID NO: 471325 - protein, 10 aa, Mycobacterium
ERRSTDDPDL

SEQ ID NO: 471326 - protein, 12 aa, Mycobacterium
ERRTDELTAGDH

SEQ ID NO: 471327 - protein, 24 aa, Mycobacterium
ERRTEPLDPRDVRDGRPPEDPDGA

SEQ ID NO: 471328 - protein, 10 aa, Mycobacterium
ERRTGDGVDR

SEQ ID NO: 471329 - protein, 6 aa, Mycobacterium
ERRTGR

SEQ ID NO: 471330 - protein, 10 aa, Mycobacterium
ERRTGRNGGT

SEQ ID NO: 471331 - protein, 8 aa, Mycobacterium
ERRTKAKA

SEQ ID NO: 471332 - protein, 8 aa, Mycobacterium
ERRTKESD

SEQ ID NO: 471333 - protein, 18 aa, Mycobacterium
ERRTKTKALTLPGRDTYK

SEQ ID NO: 471334 - protein, 9 aa, Mycobacterium
ERRTPDTVT

SEQ ID NO: 471335 - protein, 11 aa, Mycobacterium
ERRTRNGEGDF

SEQ ID NO: 471336 - protein, 35 aa, Mycobacterium
ERRTSPVAPSAVRRDTGATPTPPTPTTKYRPPVPT

SEQ ID NO: 471337 - protein, 12 aa, Mycobacterium
ERRTTRDSSLSA

SEQ ID NO: 471338 - protein, 13 aa, Mycobacterium
ERRTVDDPAKRRA

SEQ ID NO: 471339 - protein, 10 aa, Mycobacterium
ERRTYHGETD

SEQ ID NO: 471340 - protein, 7 aa, Mycobacterium
ERRTYHH

SEQ ID NO: 471341 - protein, 10 aa, Mycobacterium
ERRVSDGQQQ

SEQ ID NO: 471342 - protein, 7 aa, Mycobacterium
ERRYADT

SEQ ID NO: 471343 - protein, 8 aa, Mycobacterium
ERRYADTR

SEQ ID NO: 471344 - protein, 5 aa, Mycobacterium
ERSAA

SEQ ID NO: 471345 - protein, 9 aa, Mycobacterium
ERSAADARA

SEQ ID NO: 471346 - protein, 7 aa, Mycobacterium
ERSAADV

SEQ ID NO: 471347 - protein, 31 aa, Mycobacterium
ERSAASIASGQTANSSAMTGASAVSAATGAT

SEQ ID NO: 471348 - protein, 22 aa, Mycobacterium
ERSAELAAATTDRLRRQTEAHR

SEQ ID NO: 471349 - protein, 28 aa, Mycobacterium
ERSAELSAATTERLRRQKQAGRLRDDVD

SEQ ID NO: 471350 - protein, 8 aa, Mycobacterium
ERSAGAHP

SEQ ID NO: 471351 - protein, 8 aa, Mycobacterium
ERSAGGLP

SEQ ID NO: 471352 - protein, 5 aa, Mycobacterium
ERSAL

SEQ ID NO: 471353 - protein, 18 aa, Mycobacterium
ERSALNAAASGGRYVAGG

SEQ ID NO: 471354 - protein, 6 aa, Mycobacterium
ERSAPA

SEQ ID NO: 471355 - protein, 13 aa, Mycobacterium
ERSAPERRAPRFD

SEQ ID NO: 471356 - protein, 9 aa, Mycobacterium
ERSAPLSEV

SEQ ID NO: 471357 - protein, 9 aa, Mycobacterium
ERSAQNHPD

SEQ ID NO: 471358 - protein, 8 aa, Mycobacterium
ERSDEEEW

SEQ ID NO: 471359 - protein, 5 aa, Mycobacterium
ERSDG

SEQ ID NO: 471360 - protein, 5 aa, Mycobacterium
ERSDH

SEQ ID NO: 471361 - protein, 7 aa, Mycobacterium
ERSDRGD

SEQ ID NO: 471362 - protein, 21 aa, Mycobacterium
ERSEEEREHRLDNSGAEEFSD

SEQ ID NO: 471363 - protein, 5 aa, Mycobacterium
ERSEH

SEQ ID NO: 471364 - protein, 7 aa, Mycobacterium
ERSEPDA

SEQ ID NO: 471365 - protein, 13 aa, Mycobacterium
ERSETGEAGPADA

SEQ ID NO: 471366 - protein, 7 aa, Mycobacterium
ERSGAKK

SEQ ID NO: 471367 - protein, 11 aa, Mycobacterium
ERSGASRVNVK

SEQ ID NO: 471368 - protein, 6 aa, Mycobacterium
ERSGAT

SEQ ID NO: 471369 - protein, 12 aa, Mycobacterium
ERSGATKTNIRP

SEQ ID NO: 471370 - protein, 7 aa, Mycobacterium
ERSGATR

SEQ ID NO: 471371 - protein, 11 aa, Mycobacterium
ERSGATRTNIK

SEQ ID NO: 471372 - protein, 8 aa, Mycobacterium
ERSGELPR

SEQ ID NO: 471373 - protein, 8 aa, Mycobacterium
ERSGGASA

SEQ ID NO: 471374 - protein, 21 aa, Mycobacterium
ERSGLGDASQLRQNRADTGRL

SEQ ID NO: 471375 - protein, 8 aa, Mycobacterium
ERSGPEAV

SEQ ID NO: 471376 - protein, 31 aa, Mycobacterium
ERSGPEVDAPKALGGQGLPPLGPAPGTYVKE

SEQ ID NO: 471377 - protein, 5 aa, Mycobacterium
ERSGQ

SEQ ID NO: 471378 - protein, 9 aa, Mycobacterium
ERSGRLDPA

SEQ ID NO: 471379 - protein, 8 aa, Mycobacterium
ERSGRSVR

SEQ ID NO: 471380 - protein, 16 aa, Mycobacterium
ERSGRVARNPDPANRR

SEQ ID NO: 471381 - protein, 8 aa, Mycobacterium
ERSGVGQQ

SEQ ID NO: 471382 - protein, 7 aa, Mycobacterium
ERSGVSD

SEQ ID NO: 471383 - protein, 6 aa, Mycobacterium
ERSHGE

SEQ ID NO: 471384 - protein, 5 aa, Mycobacterium
ERSHQ

SEQ ID NO: 471385 - protein, 5 aa, Mycobacterium
ERSHR

SEQ ID NO: 471386 - protein, 6 aa, Mycobacterium
ERSISE

SEQ ID NO: 471387 - protein, 12 aa, Mycobacterium
ERSKARGRKKYE

SEQ ID NO: 471388 - protein, 7 aa, Mycobacterium
ERSLAEG

SEQ ID NO: 471389 - protein, 5 aa, Mycobacterium
ERSLQ

SEQ ID NO: 471390 - protein, 5 aa, Mycobacterium
ERSLR

SEQ ID NO: 471391 - protein, 10 aa, Mycobacterium
ERSLSGEKLP

SEQ ID NO: 471392 - protein, 7 aa, Mycobacterium
ERSLTAE

SEQ ID NO: 471393 - protein, 5 aa, Mycobacterium
ERSMQ

SEQ ID NO: 471394 - protein, 16 aa, Mycobacterium
ERSMTGASALWLGEYR

SEQ ID NO: 471395 - protein, 4 aa, Mycobacterium
ERSN

SEQ ID NO: 471396 - protein, 5 aa, Mycobacterium
ERSNA

SEQ ID NO: 471397 - protein, 7 aa, Mycobacterium
ERSNGAD

SEQ ID NO: 471398 - protein, 18 aa, Mycobacterium
ERSNTPVSKAVVIRLVAR

SEQ ID NO: 471399 - protein, 20 aa, Mycobacterium
ERSPAGKADYRWAREQAISG

SEQ ID NO: 471400 - protein, 7 aa, Mycobacterium
ERSPDGP

SEQ ID NO: 471401 - protein, 7 aa, Mycobacterium
ERSPDTL

SEQ ID NO: 471402 - protein, 18 aa, Mycobacterium
ERSPEAARKLASRARRRI

SEQ ID NO: 471403 - protein, 6 aa, Mycobacterium
ERSPET

SEQ ID NO: 471404 - protein, 10 aa, Mycobacterium
ERSPFHDPDR

SEQ ID NO: 471405 - protein, 5 aa, Mycobacterium
ERSPL

SEQ ID NO: 471406 - protein, 7 aa, Mycobacterium
ERSPNTI

SEQ ID NO: 471407 - protein, 13 aa, Mycobacterium
ERSPQAAAAHDRA

SEQ ID NO: 471408 - protein, 9 aa, Mycobacterium
ERSPQAAAV

SEQ ID NO: 471409 - protein, 9 aa, Mycobacterium
ERSPQGSEL

SEQ ID NO: 471410 - protein, 12 aa, Mycobacterium
ERSPRAAAAHDR

SEQ ID NO: 471411 - protein, 13 aa, Mycobacterium
ERSPRAAAAHDRA

SEQ ID NO: 471412 - protein, 19 aa, Mycobacterium
ERSPSGKADYRWAREQAVN

SEQ ID NO: 471413 - protein, 14 aa, Mycobacterium
ERSPVTTHTSPSER

SEQ ID NO: 471414 - protein, 4 aa, Mycobacterium
ERSQ

SEQ ID NO: 471415 - protein, 7 aa, Mycobacterium
ERSQADY

SEQ ID NO: 471416 - protein, 15 aa, Mycobacterium
ERSQAVTTQGGRTSM

SEQ ID NO: 471417 - protein, 12 aa, Mycobacterium
ERSQRRSPQGRP

SEQ ID NO: 471418 - protein, 5 aa, Mycobacterium
ERSQT

SEQ ID NO: 471419 - protein, 23 aa, Mycobacterium
ERSRAGGVDPDIGAARSAAAAAA

SEQ ID NO: 471420 - protein, 12 aa, Mycobacterium
ERSRASGTGPQL

SEQ ID NO: 471421 - protein, 6 aa, Mycobacterium
ERSRDG

SEQ ID NO: 471422 - protein, 5 aa, Mycobacterium
ERSRF

SEQ ID NO: 471423 - protein, 9 aa, Mycobacterium
ERSRGGGQA

SEQ ID NO: 471424 - protein, 16 aa, Mycobacterium
ERSRHAGDDPDALNTA

SEQ ID NO: 471425 - protein, 6 aa, Mycobacterium
ERSRQT

SEQ ID NO: 471426 - protein, 18 aa, Mycobacterium
ERSRSFAAAADDVDGLCD

SEQ ID NO: 471427 - protein, 18 aa, Mycobacterium
ERSRSFAAAAEDVDRLCD

SEQ ID NO: 471428 - protein, 14 aa, Mycobacterium
ERSSAEPEHHEEPG

SEQ ID NO: 471429 - protein, 7 aa, Mycobacterium
ERSSDGR

SEQ ID NO: 471430 - protein, 9 aa, Mycobacterium
ERSSEAHPE

SEQ ID NO: 471431 - protein, 12 aa, Mycobacterium
ERSSNSPSAPWP

SEQ ID NO: 471432 - protein, 9 aa, Mycobacterium
ERSTDPSST

SEQ ID NO: 471433 - protein, 12 aa, Mycobacterium
ERSTEFAQASAE

SEQ ID NO: 471434 - protein, 6 aa, Mycobacterium
ERSTGV

SEQ ID NO: 471435 - protein, 17 aa, Mycobacterium
ERSTKDNKVQATDRESG

SEQ ID NO: 471436 - protein, 4 aa, Mycobacterium
ERSV

SEQ ID NO: 471437 - protein, 19 aa, Mycobacterium
ERSVGQQAATLKGEKRSGL

SEQ ID NO: 471438 - protein, 16 aa, Mycobacterium
ERSVSGASALWAGPWR

SEQ ID NO: 471439 - protein, 5 aa, Mycobacterium
ERTAA

SEQ ID NO: 471440 - protein, 13 aa, Mycobacterium
ERTAADIGARGGD

SEQ ID NO: 471441 - protein, 10 aa, Mycobacterium
ERTAADTRHD

SEQ ID NO: 471442 - protein, 11 aa, Mycobacterium
ERTAAGRPVSA

SEQ ID NO: 471443 - protein, 6 aa, Mycobacterium
ERTAAK

SEQ ID NO: 471444 - protein, 10 aa, Mycobacterium
ERTAGAAKAI

SEQ ID NO: 471445 - protein, 8 aa, Mycobacterium
ERTAGASL

SEQ ID NO: 471446 - protein, 8 aa, Mycobacterium
ERTAGDLR

SEQ ID NO: 471447 - protein, 11 aa, Mycobacterium
ERTAGEWDGGD

SEQ ID NO: 471448 - protein, 6 aa, Mycobacterium
ERTAGR

SEQ ID NO: 471449 - protein, 16 aa, Mycobacterium
ERTAGSTLGSVSAKLD

SEQ ID NO: 471450 - protein, 9 aa, Mycobacterium
ERTAGTDVG

SEQ ID NO: 471451 - protein, 5 aa, Mycobacterium
ERTAL

SEQ ID NO: 471452 - protein, 5 aa, Mycobacterium
ERTAR

SEQ ID NO: 471453 - protein, 6 aa, Mycobacterium
ERTARA

SEQ ID NO: 471454 - protein, 13 aa, Mycobacterium
ERTARAEQVGSAN

SEQ ID NO: 471455 - protein, 8 aa, Mycobacterium
ERTARRGG

SEQ ID NO: 471456 - protein, 45 aa, Mycobacterium
ERTASGAAAAQAGTGSSAMASASAASAATGATAGATSARAAEQQR

SEQ ID NO: 471457 - protein, 19 aa, Mycobacterium
ERTASLGMSEPSAGSDLAS

SEQ ID NO: 471458 - protein, 9 aa, Mycobacterium
ERTASPEAL

SEQ ID NO: 471459 - protein, 9 aa, Mycobacterium
ERTATDEAF

SEQ ID NO: 471460 - protein, 7 aa, Mycobacterium
ERTDKST

SEQ ID NO: 471461 - protein, 7 aa, Mycobacterium
ERTDRDL

SEQ ID NO: 471462 - protein, 7 aa, Mycobacterium
ERTDRST

SEQ ID NO: 471463 - protein, 9 aa, Mycobacterium
ERTEDGFGQ

SEQ ID NO: 471464 - protein, 9 aa, Mycobacterium
ERTEGAKTF

SEQ ID NO: 471465 - protein, 7 aa, Mycobacterium
ERTEKGQ

SEQ ID NO: 471466 - protein, 7 aa, Mycobacterium
ERTENTS

SEQ ID NO: 471467 - protein, 7 aa, Mycobacterium
ERTEPSF

SEQ ID NO: 471468 - protein, 19 aa, Mycobacterium
ERTESRGGHTRDDHPGMDP

SEQ ID NO: 471469 - protein, 19 aa, Mycobacterium
ERTESRGGHTRDDHPGMDS

SEQ ID NO: 471470 - protein, 8 aa, Mycobacterium
ERTETAAE

SEQ ID NO: 471471 - protein, 4 aa, Mycobacterium
ERTF

SEQ ID NO: 471472 - protein, 5 aa, Mycobacterium
ERTGA

SEQ ID NO: 471473 - protein, 10 aa, Mycobacterium
ERTGADPVAT

SEQ ID NO: 471474 - protein, 10 aa, Mycobacterium
ERTGAGARAA

SEQ ID NO: 471475 - protein, 7 aa, Mycobacterium
ERTGAGQ

SEQ ID NO: 471476 - protein, 11 aa, Mycobacterium
ERTGAPYTSTM

SEQ ID NO: 471477 - protein, 7 aa, Mycobacterium
ERTGCSH

SEQ ID NO: 471478 - protein, 6 aa, Mycobacterium
ERTGCT

SEQ ID NO: 471479 - protein, 7 aa, Mycobacterium
ERTGDAK

SEQ ID NO: 471480 - protein, 7 aa, Mycobacterium
ERTGEAV

SEQ ID NO: 471481 - protein, 7 aa, Mycobacterium
ERTGEGA

SEQ ID NO: 471482 - protein, 6 aa, Mycobacterium
ERTGEP

SEQ ID NO: 471483 - protein, 8 aa, Mycobacterium
ERTGETSV

SEQ ID NO: 471484 - protein, 7 aa, Mycobacterium
ERTGGEA

SEQ ID NO: 471485 - protein, 10 aa, Mycobacterium
ERTGGGERAR

SEQ ID NO: 471486 - protein, 7 aa, Mycobacterium
ERTGGNP

SEQ ID NO: 471487 - protein, 9 aa, Mycobacterium
ERTGGSDLG

SEQ ID NO: 471488 - protein, 5 aa, Mycobacterium
ERTGI

SEQ ID NO: 471489 - protein, 8 aa, Mycobacterium
ERTGITGV

SEQ ID NO: 471490 - protein, 7 aa, Mycobacterium
ERTGITQ

SEQ ID NO: 471491 - protein, 7 aa, Mycobacterium
ERTGKGT

SEQ ID NO: 471492 - protein, 5 aa, Mycobacterium
ERTGL

SEQ ID NO: 471493 - protein, 6 aa, Mycobacterium
ERTGLT

SEQ ID NO: 471494 - protein, 9 aa, Mycobacterium
ERTGSAAAV

SEQ ID NO: 471495 - protein, 7 aa, Mycobacterium
ERTGSGQ

SEQ ID NO: 471496 - protein, 9 aa, Mycobacterium
ERTGSPAAL

SEQ ID NO: 471497 - protein, 10 aa, Mycobacterium
ERTGTDPEHD

SEQ ID NO: 471498 - protein, 12 aa, Mycobacterium
ERTGTDPGDRYP

SEQ ID NO: 471499 - protein, 10 aa, Mycobacterium
ERTGTDPKHD

SEQ ID NO: 471500 - protein, 8 aa, Mycobacterium
ERTGTETP

SEQ ID NO: 471501 - protein, 6 aa, Mycobacterium
ERTGTG

SEQ ID NO: 471502 - protein, 10 aa, Mycobacterium
ERTGTGGAVS

SEQ ID NO: 471503 - protein, 6 aa, Mycobacterium
ERTGVL

SEQ ID NO: 471504 - protein, 7 aa, Mycobacterium
ERTGYDD

SEQ ID NO: 471505 - protein, 6 aa, Mycobacterium
ERTHGP

SEQ ID NO: 471506 - protein, 5 aa, Mycobacterium
ERTHR

SEQ ID NO: 471507 - protein, 6 aa, Mycobacterium
ERTHRG

SEQ ID NO: 471508 - protein, 6 aa, Mycobacterium
ERTHRK

SEQ ID NO: 471509 - protein, 4 aa, Mycobacterium
ERTI

SEQ ID NO: 471510 - protein, 15 aa, Mycobacterium
ERTIEERDMEPDDSM

SEQ ID NO: 471511 - protein, 7 aa, Mycobacterium
ERTIPGL

SEQ ID NO: 471512 - protein, 20 aa, Mycobacterium
ERTKAGLAAKKARGERIGRP

SEQ ID NO: 471513 - protein, 5 aa, Mycobacterium
ERTKR

SEQ ID NO: 471514 - protein, 7 aa, Mycobacterium
ERTLAGQ

SEQ ID NO: 471515 - protein, 16 aa, Mycobacterium
ERTLRSDLTEPPVGPP

SEQ ID NO: 471516 - protein, 4 aa, Mycobacterium
ERTN

SEQ ID NO: 471517 - protein, 11 aa, Mycobacterium
ERTNDDTRANA

SEQ ID NO: 471518 - protein, 5 aa, Mycobacterium
ERTNR

SEQ ID NO: 471519 - protein, 4 aa, Mycobacterium
ERTP

SEQ ID NO: 471520 - protein, 8 aa, Mycobacterium
ERTPDGVA

SEQ ID NO: 471521 - protein, 8 aa, Mycobacterium
ERTPEGGL

SEQ ID NO: 471522 - protein, 5 aa, Mycobacterium
ERTPG

SEQ ID NO: 471523 - protein, 6 aa, Mycobacterium
ERTPGD

SEQ ID NO: 471524 - protein, 7 aa, Mycobacterium
ERTPGDL

SEQ ID NO: 471525 - protein, 6 aa, Mycobacterium
ERTPGM

SEQ ID NO: 471526 - protein, 7 aa, Mycobacterium
ERTPGSA

SEQ ID NO: 471527 - protein, 5 aa, Mycobacterium
ERTPR

SEQ ID NO: 471528 - protein, 5 aa, Mycobacterium
ERTPT

SEQ ID NO: 471529 - protein, 6 aa, Mycobacterium
ERTPVD

SEQ ID NO: 471530 - protein, 6 aa, Mycobacterium
ERTPVF

SEQ ID NO: 471531 - protein, 14 aa, Mycobacterium
ERTQAAAREAGPGA

SEQ ID NO: 471532 - protein, 7 aa, Mycobacterium
ERTQALE

SEQ ID NO: 471533 - protein, 6 aa, Mycobacterium
ERTQEI

SEQ ID NO: 471534 - protein, 6 aa, Mycobacterium
ERTQFG

SEQ ID NO: 471535 - protein, 15 aa, Mycobacterium
ERTQPAMSSRAYRSG

SEQ ID NO: 471536 - protein, 9 aa, Mycobacterium
ERTQRDAES

SEQ ID NO: 471537 - protein, 9 aa, Mycobacterium
ERTQRYAPH

SEQ ID NO: 471538 - protein, 22 aa, Mycobacterium
ERTRAAAEVRSAQSSGNGSGGG

SEQ ID NO: 471539 - protein, 11 aa, Mycobacterium
ERTRDGRSFDT

SEQ ID NO: 471540 - protein, 6 aa, Mycobacterium
ERTREF

SEQ ID NO: 471541 - protein, 5 aa, Mycobacterium
ERTRI

SEQ ID NO: 471542 - protein, 6 aa, Mycobacterium
ERTRPR

SEQ ID NO: 471543 - protein, 5 aa, Mycobacterium
ERTRR

SEQ ID NO: 471544 - protein, 10 aa, Mycobacterium
ERTRSAAASQ

SEQ ID NO: 471545 - protein, 10 aa, Mycobacterium
ERTRTTHGPR

SEQ ID NO: 471546 - protein, 8 aa, Mycobacterium
ERTRVDPA

SEQ ID NO: 471547 - protein, 6 aa, Mycobacterium
ERTRVS

SEQ ID NO: 471548 - protein, 7 aa, Mycobacterium
ERTSEPD

SEQ ID NO: 471549 - protein, 12 aa, Mycobacterium
ERTSGSHQAPAR

SEQ ID NO: 471550 - protein, 9 aa, Mycobacterium
ERTSLDDSR

SEQ ID NO: 471551 - protein, 6 aa, Mycobacterium
ERTSMP

SEQ ID NO: 471552 - protein, 15 aa, Mycobacterium
ERTSMSGKKSDHGDA

SEQ ID NO: 471553 - protein, 8 aa, Mycobacterium
ERTSRQAI

SEQ ID NO: 471554 - protein, 6 aa, Mycobacterium
ERTTAD

SEQ ID NO: 471555 - protein, 6 aa, Mycobacterium
ERTTAT

SEQ ID NO: 471556 - protein, 5 aa, Mycobacterium
ERTTD

SEQ ID NO: 471557 - protein, 7 aa, Mycobacterium
ERTTGAV

SEQ ID NO: 471558 - protein, 6 aa, Mycobacterium
ERTTGD

SEQ ID NO: 471559 - protein, 6 aa, Mycobacterium
ERTTKT

SEQ ID NO: 471560 - protein, 5 aa, Mycobacterium
ERTTL

SEQ ID NO: 471561 - protein, 7 aa, Mycobacterium
ERTTNTS

SEQ ID NO: 471562 - protein, 9 aa, Mycobacterium
ERTTPPQKW

SEQ ID NO: 471563 - protein, 46 aa, Mycobacterium
ERTTQQAREPLPQTGIPEGTPNPLPQSDCDTPRPARPHDYGSDPPP

SEQ ID NO: 471564 - protein, 6 aa, Mycobacterium
ERTTRI

SEQ ID NO: 471565 - protein, 7 aa, Mycobacterium
ERTTSTR

SEQ ID NO: 471566 - protein, 12 aa, Mycobacterium
ERTTTAPESNAQ

SEQ ID NO: 471567 - protein, 7 aa, Mycobacterium
ERTTVSQ

SEQ ID NO: 471568 - protein, 8 aa, Mycobacterium
ERTTYPPI

SEQ ID NO: 471569 - protein, 11 aa, Mycobacterium
ERTVDKEPRWR

SEQ ID NO: 471570 - protein, 13 aa, Mycobacterium
ERTVTAAGAGETI

SEQ ID NO: 471571 - protein, 6 aa, Mycobacterium
ERTVTE

SEQ ID NO: 471572 - protein, 12 aa, Mycobacterium
ERTWKSAGVGER

SEQ ID NO: 471573 - protein, 4 aa, Mycobacterium
ERTY

SEQ ID NO: 471574 - protein, 5 aa, Mycobacterium
ERTYL

SEQ ID NO: 471575 - protein, 7 aa, Mycobacterium
ERTYPTD

SEQ ID NO: 471576 - protein, 4 aa, Mycobacterium
ERVA

SEQ ID NO: 471577 - protein, 9 aa, Mycobacterium
ERVARAREQ

SEQ ID NO: 471578 - protein, 8 aa, Mycobacterium
ERVDDGSR

SEQ ID NO: 471579 - protein, 5 aa, Mycobacterium
ERVDG

SEQ ID NO: 471580 - protein, 16 aa, Mycobacterium
ERVDKTARRLAHGSRR

SEQ ID NO: 471581 - protein, 6 aa, Mycobacterium
ERVDNQ

SEQ ID NO: 471582 - protein, 16 aa, Mycobacterium
ERVDPGKDADGLHPTN

SEQ ID NO: 471583 - protein, 16 aa, Mycobacterium
ERVDPNKDADGLHPTN

SEQ ID NO: 471584 - protein, 5 aa, Mycobacterium
ERVDR

SEQ ID NO: 471585 - protein, 14 aa, Mycobacterium
ERVDRDSLGVQASW

SEQ ID NO: 471586 - protein, 6 aa, Mycobacterium
ERVEGK

SEQ ID NO: 471587 - protein, 11 aa, Mycobacterium
ERVEKARRAEV

SEQ ID NO: 471588 - protein, 6 aa, Mycobacterium
ERVEQA

SEQ ID NO: 471589 - protein, 7 aa, Mycobacterium
ERVEQDE

SEQ ID NO: 471590 - protein, 6 aa, Mycobacterium
ERVESA

SEQ ID NO: 471591 - protein, 9 aa, Mycobacterium
ERVETPAGD

SEQ ID NO: 471592 - protein, 4 aa, Mycobacterium
ERVG

SEQ ID NO: 471593 - protein, 5 aa, Mycobacterium
ERVGA

SEQ ID NO: 471594 - protein, 9 aa, Mycobacterium
ERVGADADA

SEQ ID NO: 471595 - protein, 13 aa, Mycobacterium
ERVGANGTAIKDD

SEQ ID NO: 471596 - protein, 13 aa, Mycobacterium
ERVGAQGTAVKDD

SEQ ID NO: 471597 - protein, 13 aa, Mycobacterium
ERVGATGTAIKDD

SEQ ID NO: 471598 - protein, 11 aa, Mycobacterium
ERVGGRSFTGE

SEQ ID NO: 471599 - protein, 6 aa, Mycobacterium
ERVGNP

SEQ ID NO: 471600 - protein, 6 aa, Mycobacterium
ERVGSD

SEQ ID NO: 471601 - protein, 4 aa, Mycobacterium
ERVH

SEQ ID NO: 471602 - protein, 5 aa, Mycobacterium
ERVHE

SEQ ID NO: 471603 - protein, 5 aa, Mycobacterium
ERVHP

SEQ ID NO: 471604 - protein, 9 aa, Mycobacterium
ERVNAGQAP

SEQ ID NO: 471605 - protein, 12 aa, Mycobacterium
ERVNEKAPKDRD

SEQ ID NO: 471606 - protein, 6 aa, Mycobacterium
ERVNPA

SEQ ID NO: 471607 - protein, 6 aa, Mycobacterium
ERVNPG

SEQ ID NO: 471608 - protein, 13 aa, Mycobacterium
ERVNTADALGPRA

SEQ ID NO: 471609 - protein, 4 aa, Mycobacterium
ERVP

SEQ ID NO: 471610 - protein, 13 aa, Mycobacterium
ERVPADEPNPEQI

SEQ ID NO: 471611 - protein, 10 aa, Mycobacterium
ERVPESAAER

SEQ ID NO: 471612 - protein, 6 aa, Mycobacterium
ERVPRA

SEQ ID NO: 471613 - protein, 4 aa, Mycobacterium
ERVQ

SEQ ID NO: 471614 - protein, 9 aa, Mycobacterium
ERVQAGRNP

SEQ ID NO: 471615 - protein, 7 aa, Mycobacterium
ERVQGAD

SEQ ID NO: 471616 - protein, 4 aa, Mycobacterium
ERVR

SEQ ID NO: 471617 - protein, 11 aa, Mycobacterium
ERVRAGQSAVR

SEQ ID NO: 471618 - protein, 5 aa, Mycobacterium
ERVRP

SEQ ID NO: 471619 - protein, 8 aa, Mycobacterium
ERVRSTEA

SEQ ID NO: 471620 - protein, 6 aa, Mycobacterium
ERVRTE

SEQ ID NO: 471621 - protein, 9 aa, Mycobacterium
ERVRTPTTT

SEQ ID NO: 471622 - protein, 4 aa, Mycobacterium
ERVS

SEQ ID NO: 471623 - protein, 7 aa, Mycobacterium
ERVSNEE

SEQ ID NO: 471624 - protein, 10 aa, Mycobacterium
ERVSRGGEPL

SEQ ID NO: 471625 - protein, 15 aa, Mycobacterium
ERVTASKDQAADALR

SEQ ID NO: 471626 - protein, 6 aa, Mycobacterium
ERVTET

SEQ ID NO: 471627 - protein, 7 aa, Mycobacterium
ERVTPDE

SEQ ID NO: 471628 - protein, 13 aa, Mycobacterium
ERYAPSDASSVDV

SEQ ID NO: 471629 - protein, 18 aa, Mycobacterium
ERYAQDRDRPDLDGTSRM

SEQ ID NO: 471630 - protein, 6 aa, Mycobacterium
ERYART

SEQ ID NO: 471631 - protein, 6 aa, Mycobacterium
ERYATG

SEQ ID NO: 471632 - protein, 7 aa, Mycobacterium
ERYDPAG

SEQ ID NO: 471633 - protein, 9 aa, Mycobacterium
ERYDSGQRC

SEQ ID NO: 471634 - protein, 7 aa, Mycobacterium
ERYEKGQ

SEQ ID NO: 471635 - protein, 13 aa, Mycobacterium
ERYEPADSAGVDV

SEQ ID NO: 471636 - protein, 6 aa, Mycobacterium
ERYERT

SEQ ID NO: 471637 - protein, 5 aa, Mycobacterium
ERYGA

SEQ ID NO: 471638 - protein, 6 aa, Mycobacterium
ERYGAS

SEQ ID NO: 471639 - protein, 5 aa, Mycobacterium
ERYGE

SEQ ID NO: 471640 - protein, 9 aa, Mycobacterium
ERYGGTPST

SEQ ID NO: 471641 - protein, 13 aa, Mycobacterium
ERYGRESPRGAEP

SEQ ID NO: 471642 - protein, 7 aa, Mycobacterium
ERYGSSE

SEQ ID NO: 471643 - protein, 7 aa, Mycobacterium
ERYGSTE

SEQ ID NO: 471644 - protein, 14 aa, Mycobacterium
ERYKADPTDADYRA

SEQ ID NO: 471645 - protein, 5 aa, Mycobacterium
ERYPD

SEQ ID NO: 471646 - protein, 7 aa, Mycobacterium
ERYPETS

SEQ ID NO: 471647 - protein, 5 aa, Mycobacterium
ERYQA

SEQ ID NO: 471648 - protein, 14 aa, Mycobacterium
ERYRRGEFERVEVT

SEQ ID NO: 471649 - protein, 10 aa, Mycobacterium
ERYRTSRSSL

SEQ ID NO: 471650 - protein, 4 aa, Mycobacterium
ERYT

SEQ ID NO: 471651 - protein, 7 aa, Mycobacterium
ERYTEAE

SEQ ID NO: 471652 - protein, 12 aa, Mycobacterium
ERYTGDRDLENP

SEQ ID NO: 471653 - protein, 9 aa, Mycobacterium
ERYTGGGPE

SEQ ID NO: 471654 - protein, 9 aa, Mycobacterium
ESAAADRGL

SEQ ID NO: 471655 - protein, 22 aa, Mycobacterium
ESAAAGDDGDFHRGRSSYDRYY

SEQ ID NO: 471656 - protein, 12 aa, Mycobacterium
ESAAARQRHAPV

SEQ ID NO: 471657 - protein, 8 aa, Mycobacterium
ESAAATYS

SEQ ID NO: 471658 - protein, 8 aa, Mycobacterium
ESAADADT

SEQ ID NO: 471659 - protein, 7 aa, Mycobacterium
ESAAELT

SEQ ID NO: 471660 - protein, 14 aa, Mycobacterium
ESAAFAAGAEAALT

SEQ ID NO: 471661 - protein, 19 aa, Mycobacterium
ESAAGDSLRGRDAGGPPGA

SEQ ID NO: 471662 - protein, 11 aa, Mycobacterium
ESAAGTVGHGV

SEQ ID NO: 471663 - protein, 15 aa, Mycobacterium
ESAAHAGAQATASAA

SEQ ID NO: 471664 - protein, 9 aa, Mycobacterium
ESAAHRPKP

SEQ ID NO: 471665 - protein, 8 aa, Mycobacterium
ESAAKRGI

SEQ ID NO: 471666 - protein, 9 aa, Mycobacterium
ESAANIGRG

SEQ ID NO: 471667 - protein, 5 aa, Mycobacterium
ESAAP

SEQ ID NO: 471668 - protein, 6 aa, Mycobacterium
ESAAPA

SEQ ID NO: 471669 - protein, 7 aa, Mycobacterium
ESAAPEL

SEQ ID NO: 471670 - protein, 14 aa, Mycobacterium
ESAAPTSGPNAKTM

SEQ ID NO: 471671 - protein, 10 aa, Mycobacterium
ESAAQAEKKV

SEQ ID NO: 471672 - protein, 6 aa, Mycobacterium
ESAARA

SEQ ID NO: 471673 - protein, 7 aa, Mycobacterium
ESAARAA

SEQ ID NO: 471674 - protein, 8 aa, Mycobacterium
ESAARASL

SEQ ID NO: 471675 - protein, 8 aa, Mycobacterium
ESAARGAL

SEQ ID NO: 471676 - protein, 10 aa, Mycobacterium
ESAARIGTTV

SEQ ID NO: 471677 - protein, 8 aa, Mycobacterium
ESAARSRH

SEQ ID NO: 471678 - protein, 13 aa, Mycobacterium
ESACPAVLKLAPD

SEQ ID NO: 471679 - protein, 6 aa, Mycobacterium
ESADAM

SEQ ID NO: 471680 - protein, 6 aa, Mycobacterium
ESADAV

SEQ ID NO: 471681 - protein, 8 aa, Mycobacterium
ESADAVED

SEQ ID NO: 471682 - protein, 15 aa, Mycobacterium
ESADDTVAAAAPRGP

SEQ ID NO: 471683 - protein, 8 aa, Mycobacterium
ESADEGPM

SEQ ID NO: 471684 - protein, 10 aa, Mycobacterium
ESADGEVPGR

SEQ ID NO: 471685 - protein, 12 aa, Mycobacterium
ESADQPATPAIE

SEQ ID NO: 471686 - protein, 8 aa, Mycobacterium
ESADRERI

SEQ ID NO: 471687 - protein, 17 aa, Mycobacterium
ESADTTLYDSPDTERPV

SEQ ID NO: 471688 - protein, 17 aa, Mycobacterium
ESAEEALAETASSVGGT

SEQ ID NO: 471689 - protein, 7 aa, Mycobacterium
ESAELSS

SEQ ID NO: 471690 - protein, 8 aa, Mycobacterium
ESAEPREP

SEQ ID NO: 471691 - protein, 11 aa, Mycobacterium
ESAERTAVPGV

SEQ ID NO: 471692 - protein, 28 aa, Mycobacterium
ESAESAESAGDKGAEKAEGAAADVTPAE

SEQ ID NO: 471693 - protein, 9 aa, Mycobacterium
ESAETAREA

SEQ ID NO: 471694 - protein, 8 aa, Mycobacterium
ESAETTRV

SEQ ID NO: 471695 - protein, 12 aa, Mycobacterium
ESAETVAAQPVD

SEQ ID NO: 471696 - protein, 4 aa, Mycobacterium
ESAF

SEQ ID NO: 471697 - protein, 6 aa, Mycobacterium
ESAGAC

SEQ ID NO: 471698 - protein, 22 aa, Mycobacterium
ESAGAEIRQGAEVAGPEFDASG

SEQ ID NO: 471699 - protein, 6 aa, Mycobacterium
ESAGAG

SEQ ID NO: 471700 - protein, 7 aa, Mycobacterium
ESAGAGI

SEQ ID NO: 471701 - protein, 8 aa, Mycobacterium
ESAGAGID

SEQ ID NO: 471702 - protein, 7 aa, Mycobacterium
ESAGALT

SEQ ID NO: 471703 - protein, 7 aa, Mycobacterium
ESAGAQP

SEQ ID NO: 471704 - protein, 14 aa, Mycobacterium
ESAGCDPGRPRPSL

SEQ ID NO: 471705 - protein, 8 aa, Mycobacterium
ESAGDSDA

SEQ ID NO: 471706 - protein, 8 aa, Mycobacterium
ESAGGDEL

SEQ ID NO: 471707 - protein, 7 aa, Mycobacterium
ESAGGGI

SEQ ID NO: 471708 - protein, 7 aa, Mycobacterium
ESAGGGM

SEQ ID NO: 471709 - protein, 9 aa, Mycobacterium
ESAGGPVDQ

SEQ ID NO: 471710 - protein, 25 aa, Mycobacterium
ESAGGQLAHAGKSTEKSAAKSARSK

SEQ ID NO: 471711 - protein, 26 aa, Mycobacterium
ESAGGQLTHEGQSTEKGAADKARRKS

SEQ ID NO: 471712 - protein, 12 aa, Mycobacterium
ESAGGRAGPSLP

SEQ ID NO: 471713 - protein, 8 aa, Mycobacterium
ESAGGRIP

SEQ ID NO: 471714 - protein, 9 aa, Mycobacterium
ESAGGSGVE

SEQ ID NO: 471715 - protein, 5 aa, Mycobacterium
ESAGK

SEQ ID NO: 471716 - protein, 7 aa, Mycobacterium
ESAGLGI

SEQ ID NO: 471717 - protein, 9 aa, Mycobacterium
ESAGLKPGV

SEQ ID NO: 471718 - protein, 14 aa, Mycobacterium
ESAGPAVRKGKSVD

SEQ ID NO: 471719 - protein, 8 aa, Mycobacterium
ESAGPPAD

SEQ ID NO: 471720 - protein, 11 aa, Mycobacterium
ESAGQARAAGE

SEQ ID NO: 471721 - protein, 10 aa, Mycobacterium
ESAGQDPRLG

SEQ ID NO: 471722 - protein, 7 aa, Mycobacterium
ESAGSHA

SEQ ID NO: 471723 - protein, 8 aa, Mycobacterium
ESAGSLTL

SEQ ID NO: 471724 - protein, 17 aa, Mycobacterium
ESAGTDGVSSYAAPARV

SEQ ID NO: 471725 - protein, 9 aa, Mycobacterium
ESAGTDPRV

SEQ ID NO: 471726 - protein, 11 aa, Mycobacterium
ESAGTEDLTRA

SEQ ID NO: 471727 - protein, 10 aa, Mycobacterium
ESAGTQRVSV

SEQ ID NO: 471728 - protein, 12 aa, Mycobacterium
ESAGTSQGLTPR

SEQ ID NO: 471729 - protein, 21 aa, Mycobacterium
ESAGVEVRQSTEAVGPVGDGD

SEQ ID NO: 471730 - protein, 6 aa, Mycobacterium
ESAGWD

SEQ ID NO: 471731 - protein, 6 aa, Mycobacterium
ESAHET

SEQ ID NO: 471732 - protein, 6 aa, Mycobacterium
ESAHPE

SEQ ID NO: 471733 - protein, 4 aa, Mycobacterium
ESAI

SEQ ID NO: 471734 - protein, 14 aa, Mycobacterium
ESAIAYGPSDIPPE

SEQ ID NO: 471735 - protein, 6 aa, Mycobacterium
ESAIEP

SEQ ID NO: 471736 - protein, 5 aa, Mycobacterium
ESAIG

SEQ ID NO: 471737 - protein, 5 aa, Mycobacterium
ESAIP

SEQ ID NO: 471738 - protein, 5 aa, Mycobacterium
ESAIS

SEQ ID NO: 471739 - protein, 10 aa, Mycobacterium
ESAKEGSVEA

SEQ ID NO: 471740 - protein, 7 aa, Mycobacterium
ESAKGAE

SEQ ID NO: 471741 - protein, 7 aa, Mycobacterium
ESAKGTV

SEQ ID NO: 471742 - protein, 7 aa, Mycobacterium
ESAKLGL

SEQ ID NO: 471743 - protein, 21 aa, Mycobacterium
ESAKPTLNPAPTTPQPDTESS

SEQ ID NO: 471744 - protein, 8 aa, Mycobacterium
ESAKRGIP

SEQ ID NO: 471745 - protein, 4 aa, Mycobacterium
ESAL

SEQ ID NO: 471746 - protein, 12 aa, Mycobacterium
ESALAQKVSPRE

SEQ ID NO: 471747 - protein, 14 aa, Mycobacterium
ESALAYGPSDIPAE

SEQ ID NO: 471748 - protein, 4 aa, Mycobacterium
ESAM

SEQ ID NO: 471749 - protein, 10 aa, Mycobacterium
ESANASPLQA

SEQ ID NO: 471750 - protein, 7 aa, Mycobacterium
ESANELT

SEQ ID NO: 471751 - protein, 15 aa, Mycobacterium
ESANRVAQTNDPTAH

SEQ ID NO: 471752 - protein, 10 aa, Mycobacterium
ESANSSTLQT

SEQ ID NO: 471753 - protein, 10 aa, Mycobacterium
ESANTPAYSG

SEQ ID NO: 471754 - protein, 6 aa, Mycobacterium
ESAPAD

SEQ ID NO: 471755 - protein, 11 aa, Mycobacterium
ESAPADTDGKQ

SEQ ID NO: 471756 - protein, 7 aa, Mycobacterium
ESAPDAT

SEQ ID NO: 471757 - protein, 7 aa, Mycobacterium
ESAPDGI

SEQ ID NO: 471758 - protein, 6 aa, Mycobacterium
ESAPDV

SEQ ID NO: 471759 - protein, 9 aa, Mycobacterium
ESAPGGGRY

SEQ ID NO: 471760 - protein, 9 aa, Mycobacterium
ESAPGTEIP

SEQ ID NO: 471761 - protein, 5 aa, Mycobacterium
ESAPN

SEQ ID NO: 471762 - protein, 15 aa, Mycobacterium
ESAPNPEPGDEDTMK

SEQ ID NO: 471763 - protein, 14 aa, Mycobacterium
ESAPSGSAAERARG

SEQ ID NO: 471764 - protein, 5 aa, Mycobacterium
ESAPV

SEQ ID NO: 471765 - protein, 4 aa, Mycobacterium
ESAQ

SEQ ID NO: 471766 - protein, 39 aa, Mycobacterium
ESAQARADIDEAKAKTDSGSEDPRVAAQGRARLRALGQT

SEQ ID NO: 471767 - protein, 6 aa, Mycobacterium
ESAQGQ

SEQ ID NO: 471768 - protein, 8 aa, Mycobacterium
ESAQGRTD

SEQ ID NO: 471769 - protein, 9 aa, Mycobacterium
ESAQPRHRL

SEQ ID NO: 471770 - protein, 16 aa, Mycobacterium
ESAQPTTGPEKPIGTG

SEQ ID NO: 471771 - protein, 27 aa, Mycobacterium
ESARAAVAGTPTRNLTDSRSTGYRPSA

SEQ ID NO: 471772 - protein, 8 aa, Mycobacterium
ESARAGEL

SEQ ID NO: 471773 - protein, 28 aa, Mycobacterium
ESARARRSAEGAKARARAASKAKGLGTN

SEQ ID NO: 471774 - protein, 6 aa, Mycobacterium
ESARAT

SEQ ID NO: 471775 - protein, 6 aa, Mycobacterium
ESAREE

SEQ ID NO: 471776 - protein, 9 aa, Mycobacterium
ESAREFAAR

SEQ ID NO: 471777 - protein, 23 aa, Mycobacterium
ESARGDLETARELAADDESFADE

SEQ ID NO: 471778 - protein, 10 aa, Mycobacterium
ESARGSRRER

SEQ ID NO: 471779 - protein, 7 aa, Mycobacterium
ESARHDG

SEQ ID NO: 471780 - protein, 6 aa, Mycobacterium
ESARLD

SEQ ID NO: 471781 - protein, 66 aa, Mycobacterium
ESARNQLREGASTEPPVAPPDVADPNAAEPGSQPQPPTAGRPDAVDAARAAARAPAPAVPESDDQR

SEQ ID NO: 471782 - protein, 8 aa, Mycobacterium
ESARPYAD

SEQ ID NO: 471783 - protein, 12 aa, Mycobacterium
ESARQFASRSNR

SEQ ID NO: 471784 - protein, 9 aa, Mycobacterium
ESARQFATR

SEQ ID NO: 471785 - protein, 5 aa, Mycobacterium
ESARR

SEQ ID NO: 471786 - protein, 7 aa, Mycobacterium
ESARRSL

SEQ ID NO: 471787 - protein, 5 aa, Mycobacterium
ESART

SEQ ID NO: 471788 - protein, 9 aa, Mycobacterium
ESARTGAVA

SEQ ID NO: 471789 - protein, 8 aa, Mycobacterium
ESASAGVA

SEQ ID NO: 471790 - protein, 12 aa, Mycobacterium
ESASDSVSDEDL

SEQ ID NO: 471791 - protein, 10 aa, Mycobacterium
ESASEVPDGQ

SEQ ID NO: 471792 - protein, 13 aa, Mycobacterium
ESASGDATGADAA

SEQ ID NO: 471793 - protein, 8 aa, Mycobacterium
ESASHRAP

SEQ ID NO: 471794 - protein, 5 aa, Mycobacterium
ESASK

SEQ ID NO: 471795 - protein, 4 aa, Mycobacterium
ESAT

SEQ ID NO: 471796 - protein, 10 aa, Mycobacterium
ESATELPDGQ

SEQ ID NO: 471797 - protein, 8 aa, Mycobacterium
ESATETPV

SEQ ID NO: 471798 - protein, 9 aa, Mycobacterium
ESATGGAFD

SEQ ID NO: 471799 - protein, 8 aa, Mycobacterium
ESATPGPA

SEQ ID NO: 471800 - protein, 14 aa, Mycobacterium
ESATQQFGRSSRER

SEQ ID NO: 471801 - protein, 9 aa, Mycobacterium
ESATTESES

SEQ ID NO: 471802 - protein, 10 aa, Mycobacterium
ESATTYATGD

SEQ ID NO: 471803 - protein, 7 aa, Mycobacterium
ESATVPP

SEQ ID NO: 471804 - protein, 12 aa, Mycobacterium
ESAVATDELDTA

SEQ ID NO: 471805 - protein, 6 aa, Mycobacterium
ESAVPA

SEQ ID NO: 471806 - protein, 6 aa, Mycobacterium
ESAVPD

SEQ ID NO: 471807 - protein, 5 aa, Mycobacterium
ESAVT

SEQ ID NO: 471808 - protein, 8 aa, Mycobacterium
ESAVTPAG

SEQ ID NO: 471809 - protein, 14 aa, Mycobacterium
ESAWPENSPPSTAD

SEQ ID NO: 471810 - protein, 10 aa, Mycobacterium
ESAYADAGTT

SEQ ID NO: 471811 - protein, 8 aa, Mycobacterium
ESAYSNED

SEQ ID NO: 471812 - protein, 6 aa, Mycobacterium
ESCEDP

SEQ ID NO: 471813 - protein, 7 aa, Mycobacterium
ESCEDPR

SEQ ID NO: 471814 - protein, 5 aa, Mycobacterium
ESCGG

SEQ ID NO: 471815 - protein, 9 aa, Mycobacterium
ESCGGDGAT

SEQ ID NO: 471816 - protein, 6 aa, Mycobacterium
ESCGTV

SEQ ID NO: 471817 - protein, 4 aa, Mycobacterium
ESCH

SEQ ID NO: 471818 - protein, 4 aa, Mycobacterium
ESDA

SEQ ID NO: 471819 - protein, 9 aa, Mycobacterium
ESDAANRGA

SEQ ID NO: 471820 - protein, 18 aa, Mycobacterium
ESDADAWKNEKRQAQEVS

SEQ ID NO: 471821 - protein, 10 aa, Mycobacterium
ESDAGQDSHE

SEQ ID NO: 471822 - protein, 8 aa, Mycobacterium
ESDARGRE

SEQ ID NO: 471823 - protein, 15 aa, Mycobacterium
ESDASHAKATGQAAR

SEQ ID NO: 471824 - protein, 7 aa, Mycobacterium
ESDASTV

SEQ ID NO: 471825 - protein, 14 aa, Mycobacterium
ESDASVADSSLTAP

SEQ ID NO: 471826 - protein, 8 aa, Mycobacterium
ESDDGEPQ

SEQ ID NO: 471827 - protein, 14 aa, Mycobacterium
ESDDGQVLSSRTNA

SEQ ID NO: 471828 - protein, 5 aa, Mycobacterium
ESDDP

SEQ ID NO: 471829 - protein, 5 aa, Mycobacterium
ESDDV

SEQ ID NO: 471830 - protein, 7 aa, Mycobacterium
ESDDYTP

SEQ ID NO: 471831 - protein, 6 aa, Mycobacterium
ESDEDT

SEQ ID NO: 471832 - protein, 8 aa, Mycobacterium
ESDELAPG

SEQ ID NO: 471833 - protein, 6 aa, Mycobacterium
ESDELN

SEQ ID NO: 471834 - protein, 10 aa, Mycobacterium
ESDEQAEDPA

SEQ ID NO: 471835 - protein, 8 aa, Mycobacterium
ESDEREQA

SEQ ID NO: 471836 - protein, 9 aa, Mycobacterium
ESDETAQGR

SEQ ID NO: 471837 - protein, 6 aa, Mycobacterium
ESDEVA

SEQ ID NO: 471838 - protein, 7 aa, Mycobacterium
ESDFSGV

SEQ ID NO: 471839 - protein, 5 aa, Mycobacterium
ESDGG

SEQ ID NO: 471840 - protein, 8 aa, Mycobacterium
ESDGHGQA

SEQ ID NO: 471841 - protein, 7 aa, Mycobacterium
ESDGLAG

SEQ ID NO: 471842 - protein, 11 aa, Mycobacterium
ESDGPGAATGR

SEQ ID NO: 471843 - protein, 8 aa, Mycobacterium
ESDGQQRE

SEQ ID NO: 471844 - protein, 9 aa, Mycobacterium
ESDGQRRAI

SEQ ID NO: 471845 - protein, 6 aa, Mycobacterium
ESDGSY

SEQ ID NO: 471846 - protein, 5 aa, Mycobacterium
ESDGT

SEQ ID NO: 471847 - protein, 9 aa, Mycobacterium
ESDHASGAT

SEQ ID NO: 471848 - protein, 5 aa, Mycobacterium
ESDHE

SEQ ID NO: 471849 - protein, 6 aa, Mycobacterium
ESDHGG

SEQ ID NO: 471850 - protein, 10 aa, Mycobacterium
ESDHGYRPPL

SEQ ID NO: 471851 - protein, 13 aa, Mycobacterium
ESDHSHGECGSNG

SEQ ID NO: 471852 - protein, 4 aa, Mycobacterium
ESDI

SEQ ID NO: 471853 - protein, 9 aa, Mycobacterium
ESDKNRHEH

SEQ ID NO: 471854 - protein, 7 aa, Mycobacterium
ESDLAES

SEQ ID NO: 471855 - protein, 11 aa, Mycobacterium
ESDLESAEGRV

SEQ ID NO: 471856 - protein, 9 aa, Mycobacterium
ESDLETDRP

SEQ ID NO: 471857 - protein, 9 aa, Mycobacterium
ESDLQSMSD

SEQ ID NO: 471858 - protein, 15 aa, Mycobacterium
ESDLRDRVPDPPGGL

SEQ ID NO: 471859 - protein, 5 aa, Mycobacterium
ESDLS

SEQ ID NO: 471860 - protein, 7 aa, Mycobacterium
ESDLTES

SEQ ID NO: 471861 - protein, 7 aa, Mycobacterium
ESDPAAV

SEQ ID NO: 471862 - protein, 6 aa, Mycobacterium
ESDPAR

SEQ ID NO: 471863 - protein, 13 aa, Mycobacterium
ESDPAVKAQKRQQ

SEQ ID NO: 471864 - protein, 5 aa, Mycobacterium
ESDPE

SEQ ID NO: 471865 - protein, 5 aa, Mycobacterium
ESDPF

SEQ ID NO: 471866 - protein, 12 aa, Mycobacterium
ESDPLNNYYIAR

SEQ ID NO: 471867 - protein, 7 aa, Mycobacterium
ESDPPFD

SEQ ID NO: 471868 - protein, 9 aa, Mycobacterium
ESDPPKATA

SEQ ID NO: 471869 - protein, 7 aa, Mycobacterium
ESDPPRK

SEQ ID NO: 471870 - protein, 13 aa, Mycobacterium
ESDPQAKAQKRQQ

SEQ ID NO: 471871 - protein, 12 aa, Mycobacterium
ESDPQRSAQERR

SEQ ID NO: 471872 - protein, 8 aa, Mycobacterium
ESDPRVSR

SEQ ID NO: 471873 - protein, 7 aa, Mycobacterium
ESDPSAD

SEQ ID NO: 471874 - protein, 10 aa, Mycobacterium
ESDPSKTSEV

SEQ ID NO: 471875 - protein, 13 aa, Mycobacterium
ESDPTAPPAAGGA

SEQ ID NO: 471876 - protein, 11 aa, Mycobacterium
ESDPTRGERTR

SEQ ID NO: 471877 - protein, 8 aa, Mycobacterium
ESDPWPAA

SEQ ID NO: 471878 - protein, 15 aa, Mycobacterium
ESDPYTPPPDRAPIS

SEQ ID NO: 471879 - protein, 8 aa, Mycobacterium
ESDQDRDA

SEQ ID NO: 471880 - protein, 7 aa, Mycobacterium
ESDQLGS

SEQ ID NO: 471881 - protein, 5 aa, Mycobacterium
ESDQY

SEQ ID NO: 471882 - protein, 10 aa, Mycobacterium
ESDRAQSTAA

SEQ ID NO: 471883 - protein, 7 aa, Mycobacterium
ESDRDTW

SEQ ID NO: 471884 - protein, 9 aa, Mycobacterium
ESDRDYSDV

SEQ ID NO: 471885 - protein, 10 aa, Mycobacterium
ESDRGQHGRL

SEQ ID NO: 471886 - protein, 8 aa, Mycobacterium
ESDRGYDE

SEQ ID NO: 471887 - protein, 8 aa, Mycobacterium
ESDRIEAS

SEQ ID NO: 471888 - protein, 9 aa, Mycobacterium
ESDRNDPRV

SEQ ID NO: 471889 - protein, 9 aa, Mycobacterium
ESDRNTERD

SEQ ID NO: 471890 - protein, 5 aa, Mycobacterium
ESDRP

SEQ ID NO: 471891 - protein, 9 aa, Mycobacterium
ESDRPPGLE

SEQ ID NO: 471892 - protein, 6 aa, Mycobacterium
ESDRRE

SEQ ID NO: 471893 - protein, 6 aa, Mycobacterium
ESDRRG

SEQ ID NO: 471894 - protein, 4 aa, Mycobacterium
ESDS

SEQ ID NO: 471895 - protein, 8 aa, Mycobacterium
ESDSEGLP

SEQ ID NO: 471896 - protein, 12 aa, Mycobacterium
ESDSMEISCRTG

SEQ ID NO: 471897 - protein, 15 aa, Mycobacterium
ESDSVESAGAGSEGA

SEQ ID NO: 471898 - protein, 6 aa, Mycobacterium
ESDTAN

SEQ ID NO: 471899 - protein, 11 aa, Mycobacterium
ESDTAPAPEQL

SEQ ID NO: 471900 - protein, 5 aa, Mycobacterium
ESDTE

SEQ ID NO: 471901 - protein, 8 aa, Mycobacterium
ESDTSGHH

SEQ ID NO: 471902 - protein, 5 aa, Mycobacterium
ESDVD

SEQ ID NO: 471903 - protein, 13 aa, Mycobacterium
ESDVGGKRGDIAG

SEQ ID NO: 471904 - protein, 4 aa, Mycobacterium
ESDW

SEQ ID NO: 471905 - protein, 6 aa, Mycobacterium
ESDYER

SEQ ID NO: 471906 - protein, 6 aa, Mycobacterium
ESDYGL

SEQ ID NO: 471907 - protein, 12 aa, Mycobacterium
ESEAAYAAGEDT

SEQ ID NO: 471908 - protein, 9 aa, Mycobacterium
ESEADEPGR

SEQ ID NO: 471909 - protein, 8 aa, Mycobacterium
ESEARGRA

SEQ ID NO: 471910 - protein, 13 aa, Mycobacterium
ESEATARPAEQQR

SEQ ID NO: 471911 - protein, 8 aa, Mycobacterium
ESEATTAA

SEQ ID NO: 471912 - protein, 23 aa, Mycobacterium
ESECDGYSRRDEGTFTVTDDESL

SEQ ID NO: 471913 - protein, 7 aa, Mycobacterium
ESEDLAR

SEQ ID NO: 471914 - protein, 5 aa, Mycobacterium
ESEDR

SEQ ID NO: 471915 - protein, 6 aa, Mycobacterium
ESEDRE

SEQ ID NO: 471916 - protein, 9 aa, Mycobacterium
ESEDSLRKV

SEQ ID NO: 471917 - protein, 19 aa, Mycobacterium
ESEDTGKPLSQARGDAGVA

SEQ ID NO: 471918 - protein, 5 aa, Mycobacterium
ESEDV

SEQ ID NO: 471919 - protein, 13 aa, Mycobacterium
ESEEDEPRGMSPA

SEQ ID NO: 471920 - protein, 10 aa, Mycobacterium
ESEEEAVRRE

SEQ ID NO: 471921 - protein, 4 aa, Mycobacterium
ESEF

SEQ ID NO: 471922 - protein, 11 aa, Mycobacterium
ESEFSGGRSVK

SEQ ID NO: 471923 - protein, 11 aa, Mycobacterium
ESEGDDDPGAS

SEQ ID NO: 471924 - protein, 8 aa, Mycobacterium
ESEGGFNP

SEQ ID NO: 471925 - protein, 8 aa, Mycobacterium
ESEGGFSP

SEQ ID NO: 471926 - protein, 15 aa, Mycobacterium
ESEGKTELSPADRKS

SEQ ID NO: 471927 - protein, 6 aa, Mycobacterium
ESEGNG

SEQ ID NO: 471928 - protein, 7 aa, Mycobacterium
ESEGPFV

SEQ ID NO: 471929 - protein, 5 aa, Mycobacterium
ESEGR

SEQ ID NO: 471930 - protein, 8 aa, Mycobacterium
ESEGTDLP

SEQ ID NO: 471931 - protein, 25 aa, Mycobacterium
ESEGYQKAAKLRQQAADCNAVILSG

SEQ ID NO: 471932 - protein, 7 aa, Mycobacterium
ESEHARA

SEQ ID NO: 471933 - protein, 5 aa, Mycobacterium
ESEHK

SEQ ID NO: 471934 - protein, 4 aa, Mycobacterium
ESEI

SEQ ID NO: 471935 - protein, 10 aa, Mycobacterium
ESEIDGARLT

SEQ ID NO: 471936 - protein, 9 aa, Mycobacterium
ESEIQPLGR

SEQ ID NO: 471937 - protein, 6 aa, Mycobacterium
ESEITA

SEQ ID NO: 471938 - protein, 5 aa, Mycobacterium
ESEKC

SEQ ID NO: 471939 - protein, 5 aa, Mycobacterium
ESEKV

SEQ ID NO: 471940 - protein, 4 aa, Mycobacterium
ESEL

SEQ ID NO: 471941 - protein, 24 aa, Mycobacterium
ESELNPVRGGRARSRGRNGKGVAG

SEQ ID NO: 471942 - protein, 5 aa, Mycobacterium
ESELP

SEQ ID NO: 471943 - protein, 8 aa, Mycobacterium
ESENRAAA

SEQ ID NO: 471944 - protein, 7 aa, Mycobacterium
ESEPAHV

SEQ ID NO: 471945 - protein, 6 aa, Mycobacterium
ESEPER

SEQ ID NO: 471946 - protein, 18 aa, Mycobacterium
ESEPGLDGAPAPAEPMTE

SEQ ID NO: 471947 - protein, 29 aa, Mycobacterium
ESEPGLGGGGAGELGTGGGGGGGGTIPTG

SEQ ID NO: 471948 - protein, 12 aa, Mycobacterium
ESEPGRSTIDTD

SEQ ID NO: 471949 - protein, 16 aa, Mycobacterium
ESEPGRSTIDTDNALG

SEQ ID NO: 471950 - protein, 23 aa, Mycobacterium
ESEPGRSTIDTDNELTDVNGDDI

SEQ ID NO: 471951 - protein, 16 aa, Mycobacterium
ESEPHNTERDTFYSEN

SEQ ID NO: 471952 - protein, 55 aa, Mycobacterium
ESEPQTASAPQPEPEPEARPEPQPKTGPEPEPVSTPKPQPQDPPAAAESWGGGGV

SEQ ID NO: 471953 - protein, 11 aa, Mycobacterium
ESEPRRQQARE

SEQ ID NO: 471954 - protein, 10 aa, Mycobacterium
ESEPSHRPSY

SEQ ID NO: 471955 - protein, 14 aa, Mycobacterium
ESEPTYGFADGPDA

SEQ ID NO: 471956 - protein, 5 aa, Mycobacterium
ESEPV

SEQ ID NO: 471957 - protein, 14 aa, Mycobacterium
ESEPYAGSVSRNGE

SEQ ID NO: 471958 - protein, 14 aa, Mycobacterium
ESEPYAGSVTRAGE

SEQ ID NO: 471959 - protein, 14 aa, Mycobacterium
ESEPYRQTAVGQTR

SEQ ID NO: 471960 - protein, 24 aa, Mycobacterium
ESEQIGVRDANDANLRTKPGAPMK

SEQ ID NO: 471961 - protein, 13 aa, Mycobacterium
ESEQPVTEDDQRR

SEQ ID NO: 471962 - protein, 10 aa, Mycobacterium
ESEQQPDIET

SEQ ID NO: 471963 - protein, 5 aa, Mycobacterium
ESEQR

SEQ ID NO: 471964 - protein, 11 aa, Mycobacterium
ESEQRAAMATG

SEQ ID NO: 471965 - protein, 23 aa, Mycobacterium
ESEQVSVRDANDANLRTRPGAPM

SEQ ID NO: 471966 - protein, 4 aa, Mycobacterium
ESER

SEQ ID NO: 471967 - protein, 7 aa, Mycobacterium
ESERGYD

SEQ ID NO: 471968 - protein, 13 aa, Mycobacterium
ESERKSGSRRPTF

SEQ ID NO: 471969 - protein, 21 aa, Mycobacterium
ESERLPRGADPNTHTKLGRGG

SEQ ID NO: 471970 - protein, 10 aa, Mycobacterium
ESERRQQAAW

SEQ ID NO: 471971 - protein, 8 aa, Mycobacterium
ESESDRLA

SEQ ID NO: 471972 - protein, 11 aa, Mycobacterium
ESESGRGGPGV

SEQ ID NO: 471973 - protein, 9 aa, Mycobacterium
ESESHAKER

SEQ ID NO: 471974 - protein, 23 aa, Mycobacterium
ESESPPRSKNESSTPTRSSPSTW

SEQ ID NO: 471975 - protein, 10 aa, Mycobacterium
ESESQAAGTG

SEQ ID NO: 471976 - protein, 7 aa, Mycobacterium
ESETDSA

SEQ ID NO: 471977 - protein, 16 aa, Mycobacterium
ESETNARRAHAPTRTT

SEQ ID NO: 471978 - protein, 7 aa, Mycobacterium
ESETVRH

SEQ ID NO: 471979 - protein, 10 aa, Mycobacterium
ESEVASESGF

SEQ ID NO: 471980 - protein, 7 aa, Mycobacterium
ESEVPAG

SEQ ID NO: 471981 - protein, 7 aa, Mycobacterium
ESEVSPA

SEQ ID NO: 471982 - protein, 9 aa, Mycobacterium
ESEWNASNQ

SEQ ID NO: 471983 - protein, 4 aa, Mycobacterium
ESFA

SEQ ID NO: 471984 - protein, 6 aa, Mycobacterium
ESFAEK

SEQ ID NO: 471985 - protein, 6 aa, Mycobacterium
ESFASR

SEQ ID NO: 471986 - protein, 15 aa, Mycobacterium
ESFDPQSDSRSSEPA

SEQ ID NO: 471987 - protein, 4 aa, Mycobacterium
ESFG

SEQ ID NO: 471988 - protein, 9 aa, Mycobacterium
ESFGGGPRH

SEQ ID NO: 471989 - protein, 6 aa, Mycobacterium
ESFGPD

SEQ ID NO: 471990 - protein, 10 aa, Mycobacterium
ESFNAGDKKI

SEQ ID NO: 471991 - protein, 4 aa, Mycobacterium
ESFP

SEQ ID NO: 471992 - protein, 6 aa, Mycobacterium
ESFPGA

SEQ ID NO: 471993 - protein, 11 aa, Mycobacterium
ESFPSGSPAIR

SEQ ID NO: 471994 - protein, 10 aa, Mycobacterium
ESFTAEDAAK

SEQ ID NO: 471995 - protein, 11 aa, Mycobacterium
ESGAADAKQLS

SEQ ID NO: 471996 - protein, 13 aa, Mycobacterium
ESGAAKVIDPRGN

SEQ ID NO: 471997 - protein, 7 aa, Mycobacterium
ESGAARA

SEQ ID NO: 471998 - protein, 5 aa, Mycobacterium
ESGAD

SEQ ID NO: 471999 - protein, 8 aa, Mycobacterium
ESGADERR

SEQ ID NO: 472000 - protein, 6 aa, Mycobacterium
ESGAEA

SEQ ID NO: 472001 - protein, 8 aa, Mycobacterium
ESGAGATV

SEQ ID NO: 472002 - protein, 16 aa, Mycobacterium
ESGAGDPPETTTPAPD

SEQ ID NO: 472003 - protein, 10 aa, Mycobacterium
ESGAGKSAGA

SEQ ID NO: 472004 - protein, 10 aa, Mycobacterium
ESGAGKSATA

SEQ ID NO: 472005 - protein, 5 aa, Mycobacterium
ESGAI

SEQ ID NO: 472006 - protein, 14 aa, Mycobacterium
ESGALAGVTLHNIE

SEQ ID NO: 472007 - protein, 14 aa, Mycobacterium
ESGALDGDELRRRG

SEQ ID NO: 472008 - protein, 5 aa, Mycobacterium
ESGAM

SEQ ID NO: 472009 - protein, 14 aa, Mycobacterium
ESGANADIKPGNNL

SEQ ID NO: 472010 - protein, 9 aa, Mycobacterium
ESGAPADER

SEQ ID NO: 472011 - protein, 8 aa, Mycobacterium
ESGAPGRG

SEQ ID NO: 472012 - protein, 6 aa, Mycobacterium
ESGARA

SEQ ID NO: 472013 - protein, 6 aa, Mycobacterium
ESGARD

SEQ ID NO: 472014 - protein, 8 aa, Mycobacterium
ESGARPGD

SEQ ID NO: 472015 - protein, 5 aa, Mycobacterium
ESGAS

SEQ ID NO: 472016 - protein, 6 aa, Mycobacterium
ESGCGK

SEQ ID NO: 472017 - protein, 7 aa, Mycobacterium
ESGCGKS

SEQ ID NO: 472018 - protein, 9 aa, Mycobacterium
ESGCGKSMT

SEQ ID NO: 472019 - protein, 9 aa, Mycobacterium
ESGCGKSTL

SEQ ID NO: 472020 - protein, 4 aa, Mycobacterium
ESGD

SEQ ID NO: 472021 - protein, 8 aa, Mycobacterium
ESGDAFGD

SEQ ID NO: 472022 - protein, 9 aa, Mycobacterium
ESGDAGTYL

SEQ ID NO: 472023 - protein, 22 aa, Mycobacterium
ESGDAKAVPKTAADRRPPVGAG

SEQ ID NO: 472024 - protein, 10 aa, Mycobacterium
ESGDALPAGA

SEQ ID NO: 472025 - protein, 6 aa, Mycobacterium
ESGDDA

SEQ ID NO: 472026 - protein, 7 aa, Mycobacterium
ESGDEHA

SEQ ID NO: 472027 - protein, 9 aa, Mycobacterium
ESGDESAQL

SEQ ID NO: 472028 - protein, 6 aa, Mycobacterium
ESGDEV

SEQ ID NO: 472029 - protein, 7 aa, Mycobacterium
ESGDEVP

SEQ ID NO: 472030 - protein, 23 aa, Mycobacterium
ESGDGAPTPVDLGSPAARAIWVV

SEQ ID NO: 472031 - protein, 23 aa, Mycobacterium
ESGDGDETTVDLGSPAARAIWVT

SEQ ID NO: 472032 - protein, 10 aa, Mycobacterium
ESGDGDPRPI

SEQ ID NO: 472033 - protein, 8 aa, Mycobacterium
ESGDIDDG

SEQ ID NO: 472034 - protein, 6 aa, Mycobacterium
ESGDLP

SEQ ID NO: 472035 - protein, 14 aa, Mycobacterium
ESGDPDKPEQSAPV

SEQ ID NO: 472036 - protein, 8 aa, Mycobacterium
ESGDPREV

SEQ ID NO: 472037 - protein, 9 aa, Mycobacterium
ESGDRAEWA

SEQ ID NO: 472038 - protein, 8 aa, Mycobacterium
ESGDRSWS

SEQ ID NO: 472039 - protein, 7 aa, Mycobacterium
ESGDTVT

SEQ ID NO: 472040 - protein, 8 aa, Mycobacterium
ESGEDERR

SEQ ID NO: 472041 - protein, 15 aa, Mycobacterium
ESGEEFDSSWNRGES

SEQ ID NO: 472042 - protein, 9 aa, Mycobacterium
ESGEEGREQ

SEQ ID NO: 472043 - protein, 10 aa, Mycobacterium
ESGEGKAEDL

SEQ ID NO: 472044 - protein, 6 aa, Mycobacterium
ESGEGY

SEQ ID NO: 472045 - protein, 6 aa, Mycobacterium
ESGEHD

SEQ ID NO: 472046 - protein, 6 aa, Mycobacterium
ESGELD

SEQ ID NO: 472047 - protein, 6 aa, Mycobacterium
ESGEME

SEQ ID NO: 472048 - protein, 12 aa, Mycobacterium
ESGENLSLAATA

SEQ ID NO: 472049 - protein, 6 aa, Mycobacterium
ESGEPY

SEQ ID NO: 472050 - protein, 8 aa, Mycobacterium
ESGERAQW

SEQ ID NO: 472051 - protein, 7 aa, Mycobacterium
ESGEVDP

SEQ ID NO: 472052 - protein, 9 aa, Mycobacterium
ESGEYHSPA

SEQ ID NO: 472053 - protein, 11 aa, Mycobacterium
ESGFGREGGIE

SEQ ID NO: 472054 - protein, 14 aa, Mycobacterium
ESGFGREGGTEGIE

SEQ ID NO: 472055 - protein, 19 aa, Mycobacterium
ESGFGTAGADGASSTGGDN

SEQ ID NO: 472056 - protein, 15 aa, Mycobacterium
ESGGAGSDGGIGGSG

SEQ ID NO: 472057 - protein, 7 aa, Mycobacterium
ESGGALH

SEQ ID NO: 472058 - protein, 6 aa, Mycobacterium
ESGGAQ

SEQ ID NO: 472059 - protein, 8 aa, Mycobacterium
ESGGDTSR

SEQ ID NO: 472060 - protein, 8 aa, Mycobacterium
ESGGGPTR

SEQ ID NO: 472061 - protein, 12 aa, Mycobacterium
ESGGGVGAEQDA

SEQ ID NO: 472062 - protein, 6 aa, Mycobacterium
ESGGLG

SEQ ID NO: 472063 - protein, 26 aa, Mycobacterium
ESGGPELADELEENGYERFTQAAAAG

SEQ ID NO: 472064 - protein, 24 aa, Mycobacterium
ESGGPELADELEENGYVRFTQAVG

SEQ ID NO: 472065 - protein, 14 aa, Mycobacterium
ESGGPELADELEQN

SEQ ID NO: 472066 - protein, 11 aa, Mycobacterium
ESGGPTADARA

SEQ ID NO: 472067 - protein, 8 aa, Mycobacterium
ESGGSTEM

SEQ ID NO: 472068 - protein, 9 aa, Mycobacterium
ESGGTAGVG

SEQ ID NO: 472069 - protein, 8 aa, Mycobacterium
ESGGTWSC

SEQ ID NO: 472070 - protein, 5 aa, Mycobacterium
ESGGV

SEQ ID NO: 472071 - protein, 6 aa, Mycobacterium
ESGGVP

SEQ ID NO: 472072 - protein, 9 aa, Mycobacterium
ESGGVQYNG

SEQ ID NO: 472073 - protein, 13 aa, Mycobacterium
ESGHANGKMVVTL

SEQ ID NO: 472074 - protein, 14 aa, Mycobacterium
ESGHANNGATDVKG

SEQ ID NO: 472075 - protein, 10 aa, Mycobacterium
ESGHAYGKSL

SEQ ID NO: 472076 - protein, 14 aa, Mycobacterium
ESGHPPRNRRQEET

SEQ ID NO: 472077 - protein, 4 aa, Mycobacterium
ESGI

SEQ ID NO: 472078 - protein, 11 aa, Mycobacterium
ESGIDPSYQQH

SEQ ID NO: 472079 - protein, 24 aa, Mycobacterium
ESGIGREAGSEGIEEYLETKYIAL

SEQ ID NO: 472080 - protein, 7 aa, Mycobacterium
ESGIPYG

SEQ ID NO: 472081 - protein, 8 aa, Mycobacterium
ESGIQPGY

SEQ ID NO: 472082 - protein, 6 aa, Mycobacterium
ESGKAH

SEQ ID NO: 472083 - protein, 13 aa, Mycobacterium
ESGKRTLDDGRNW

SEQ ID NO: 472084 - protein, 26 aa, Mycobacterium
ESGLATGEPAEQTQVRAGERYPLSTG

SEQ ID NO: 472085 - protein, 15 aa, Mycobacterium
ESGLDANNSRVAEAA

SEQ ID NO: 472086 - protein, 10 aa, Mycobacterium
ESGLGREGGA

SEQ ID NO: 472087 - protein, 9 aa, Mycobacterium
ESGLREDPA

SEQ ID NO: 472088 - protein, 5 aa, Mycobacterium
ESGMD

SEQ ID NO: 472089 - protein, 5 aa, Mycobacterium
ESGMG

SEQ ID NO: 472090 - protein, 5 aa, Mycobacterium
ESGMR

SEQ ID NO: 472091 - protein, 7 aa, Mycobacterium
ESGMRKR

SEQ ID NO: 472092 - protein, 4 aa, Mycobacterium
ESGN

SEQ ID NO: 472093 - protein, 5 aa, Mycobacterium
ESGNA

SEQ ID NO: 472094 - protein, 7 aa, Mycobacterium
ESGPAPS

SEQ ID NO: 472095 - protein, 11 aa, Mycobacterium
ESGPASDDEAR

SEQ ID NO: 472096 - protein, 11 aa, Mycobacterium
ESGPASERYAA

SEQ ID NO: 472097 - protein, 7 aa, Mycobacterium
ESGPDGV

SEQ ID NO: 472098 - protein, 10 aa, Mycobacterium
ESGPDTGPVA

SEQ ID NO: 472099 - protein, 8 aa, Mycobacterium
ESGPKTNA

SEQ ID NO: 472100 - protein, 6 aa, Mycobacterium
ESGPLT

SEQ ID NO: 472101 - protein, 10 aa, Mycobacterium
ESGPSGSPLR

SEQ ID NO: 472102 - protein, 6 aa, Mycobacterium
ESGQAH

SEQ ID NO: 472103 - protein, 6 aa, Mycobacterium
ESGQFG

SEQ ID NO: 472104 - protein, 6 aa, Mycobacterium
ESGQID

SEQ ID NO: 472105 - protein, 5 aa, Mycobacterium
ESGQL

SEQ ID NO: 472106 - protein, 7 aa, Mycobacterium
ESGQLAD

SEQ ID NO: 472107 - protein, 10 aa, Mycobacterium
ESGQLGSHNG

SEQ ID NO: 472108 - protein, 9 aa, Mycobacterium
ESGQNSDTL

SEQ ID NO: 472109 - protein, 9 aa, Mycobacterium
ESGQTSRQR

SEQ ID NO: 472110 - protein, 8 aa, Mycobacterium
ESGRDRGE

SEQ ID NO: 472111 - protein, 8 aa, Mycobacterium
ESGRDRRQ

SEQ ID NO: 472112 - protein, 10 aa, Mycobacterium
ESGRFRSREE

SEQ ID NO: 472113 - protein, 7 aa, Mycobacterium
ESGRGRS

SEQ ID NO: 472114 - protein, 5 aa, Mycobacterium
ESGRK

SEQ ID NO: 472115 - protein, 6 aa, Mycobacterium
ESGRLG

SEQ ID NO: 472116 - protein, 8 aa, Mycobacterium
ESGRNRDE

SEQ ID NO: 472117 - protein, 8 aa, Mycobacterium
ESGRPGER

SEQ ID NO: 472118 - protein, 8 aa, Mycobacterium
ESGRPLSD

SEQ ID NO: 472119 - protein, 10 aa, Mycobacterium
ESGRPRPTGR

SEQ ID NO: 472120 - protein, 45 aa, Mycobacterium
ESGRQAAERACAQDAGDAERAEKTVPAGRALTPRPARDERPRRDP

SEQ ID NO: 472121 - protein, 11 aa, Mycobacterium
ESGRRRASLES

SEQ ID NO: 472122 - protein, 13 aa, Mycobacterium
ESGRTVLEYLARV

SEQ ID NO: 472123 - protein, 9 aa, Mycobacterium
ESGRYDAGT

SEQ ID NO: 472124 - protein, 8 aa, Mycobacterium
ESGSAAAF

SEQ ID NO: 472125 - protein, 11 aa, Mycobacterium
ESGSAETHLDE

SEQ ID NO: 472126 - protein, 9 aa, Mycobacterium
ESGSDEELA

SEQ ID NO: 472127 - protein, 6 aa, Mycobacterium
ESGSDR

SEQ ID NO: 472128 - protein, 11 aa, Mycobacterium
ESGSEAGADRS

SEQ ID NO: 472129 - protein, 12 aa, Mycobacterium
ESGSGAATGRHI

SEQ ID NO: 472130 - protein, 10 aa, Mycobacterium
ESGSGKSVTA

SEQ ID NO: 472131 - protein, 7 aa, Mycobacterium
ESGSGLE

SEQ ID NO: 472132 - protein, 10 aa, Mycobacterium
ESGSGLPNGL

SEQ ID NO: 472133 - protein, 8 aa, Mycobacterium
ESGSIEQD

SEQ ID NO: 472134 - protein, 11 aa, Mycobacterium
ESGSIPRQPIE

SEQ ID NO: 472135 - protein, 15 aa, Mycobacterium
ESGSPSEAAMLRLGA

SEQ ID NO: 472136 - protein, 8 aa, Mycobacterium
ESGSPVRG

SEQ ID NO: 472137 - protein, 7 aa, Mycobacterium
ESGSSAA

SEQ ID NO: 472138 - protein, 16 aa, Mycobacterium
ESGSYARIAPGQEPRI

SEQ ID NO: 472139 - protein, 16 aa, Mycobacterium
ESGSYARVRPGAQPQI

SEQ ID NO: 472140 - protein, 5 aa, Mycobacterium
ESGTA

SEQ ID NO: 472141 - protein, 8 aa, Mycobacterium
ESGTATAV

SEQ ID NO: 472142 - protein, 7 aa, Mycobacterium
ESGTCRP

SEQ ID NO: 472143 - protein, 11 aa, Mycobacterium
ESGTEPSQAGA

SEQ ID NO: 472144 - protein, 8 aa, Mycobacterium
ESGTERTL

SEQ ID NO: 472145 - protein, 5 aa, Mycobacterium
ESGTF

SEQ ID NO: 472146 - protein, 6 aa, Mycobacterium
ESGTGT

SEQ ID NO: 472147 - protein, 11 aa, Mycobacterium
ESGTPSPDRST

SEQ ID NO: 472148 - protein, 14 aa, Mycobacterium
ESGTPVHAPPAELA

SEQ ID NO: 472149 - protein, 8 aa, Mycobacterium
ESGTRTGF

SEQ ID NO: 472150 - protein, 11 aa, Mycobacterium
ESGTSMAAPHV

SEQ ID NO: 472151 - protein, 8 aa, Mycobacterium
ESGTTDGI

SEQ ID NO: 472152 - protein, 19 aa, Mycobacterium
ESGTTMRSRGGPNHRSKQR

SEQ ID NO: 472153 - protein, 20 aa, Mycobacterium
ESGTTMRSRGGPNRTAKAAR

SEQ ID NO: 472154 - protein, 27 aa, Mycobacterium
ESGVAAQAVESAPRVQAGERRGLAPGQ

SEQ ID NO: 472155 - protein, 5 aa, Mycobacterium
ESGVD

SEQ ID NO: 472156 - protein, 10 aa, Mycobacterium
ESGVESTGAV

SEQ ID NO: 472157 - protein, 5 aa, Mycobacterium
ESGVP

SEQ ID NO: 472158 - protein, 8 aa, Mycobacterium
ESGVPQED

SEQ ID NO: 472159 - protein, 9 aa, Mycobacterium
ESGVPSPQA

SEQ ID NO: 472160 - protein, 6 aa, Mycobacterium
ESGVPT

SEQ ID NO: 472161 - protein, 5 aa, Mycobacterium
ESGVR

SEQ ID NO: 472162 - protein, 7 aa, Mycobacterium
ESGVRGT

SEQ ID NO: 472163 - protein, 7 aa, Mycobacterium
ESGVSEA

SEQ ID NO: 472164 - protein, 23 aa, Mycobacterium
ESGVSYAAGDAAAAVTYSASGGW

SEQ ID NO: 472165 - protein, 5 aa, Mycobacterium
ESGVT

SEQ ID NO: 472166 - protein, 9 aa, Mycobacterium
ESGVTAGQL

SEQ ID NO: 472167 - protein, 10 aa, Mycobacterium
ESGVTGDPVS

SEQ ID NO: 472168 - protein, 18 aa, Mycobacterium
ESGVTGGRGGSGGVGGSA

SEQ ID NO: 472169 - protein, 11 aa, Mycobacterium
ESGVTRDHRSE

SEQ ID NO: 472170 - protein, 32 aa, Mycobacterium
ESGVTTNVASNGYDDADDNIGKNISATVEGIE

SEQ ID NO: 472171 - protein, 15 aa, Mycobacterium
ESGWPDQTPPDTADI

SEQ ID NO: 472172 - protein, 15 aa, Mycobacterium
ESGWPERTPPGTDDL

SEQ ID NO: 472173 - protein, 5 aa, Mycobacterium
ESGYA

SEQ ID NO: 472174 - protein, 6 aa, Mycobacterium
ESGYAA

SEQ ID NO: 472175 - protein, 8 aa, Mycobacterium
ESGYAGTD

SEQ ID NO: 472176 - protein, 10 aa, Mycobacterium
ESGYGESPER

SEQ ID NO: 472177 - protein, 5 aa, Mycobacterium
ESHAF

SEQ ID NO: 472178 - protein, 6 aa, Mycobacterium
ESHAPE

SEQ ID NO: 472179 - protein, 4 aa, Mycobacterium
ESHD

SEQ ID NO: 472180 - protein, 5 aa, Mycobacterium
ESHDA

SEQ ID NO: 472181 - protein, 18 aa, Mycobacterium
ESHDEAARTLAAKTGDRF

SEQ ID NO: 472182 - protein, 6 aa, Mycobacterium
ESHDRL

SEQ ID NO: 472183 - protein, 12 aa, Mycobacterium
ESHEDTHSLREG

SEQ ID NO: 472184 - protein, 7 aa, Mycobacterium
ESHESVT

SEQ ID NO: 472185 - protein, 8 aa, Mycobacterium
ESHGFDSA

SEQ ID NO: 472186 - protein, 6 aa, Mycobacterium
ESHGGT

SEQ ID NO: 472187 - protein, 7 aa, Mycobacterium
ESHGVTS

SEQ ID NO: 472188 - protein, 9 aa, Mycobacterium
ESHNGTYRG

SEQ ID NO: 472189 - protein, 5 aa, Mycobacterium
ESHPA

SEQ ID NO: 472190 - protein, 10 aa, Mycobacterium
ESHPAPGRTA

SEQ ID NO: 472191 - protein, 8 aa, Mycobacterium
ESHPDAVN

SEQ ID NO: 472192 - protein, 5 aa, Mycobacterium
ESHPE

SEQ ID NO: 472193 - protein, 7 aa, Mycobacterium
ESHPGHA

SEQ ID NO: 472194 - protein, 4 aa, Mycobacterium
ESHR

SEQ ID NO: 472195 - protein, 7 aa, Mycobacterium
ESHREPA

SEQ ID NO: 472196 - protein, 11 aa, Mycobacterium
ESHRIRQGEVG

SEQ ID NO: 472197 - protein, 13 aa, Mycobacterium
ESHRRAAQAWSEG

SEQ ID NO: 472198 - protein, 6 aa, Mycobacterium
ESHSAA

SEQ ID NO: 472199 - protein, 7 aa, Mycobacterium
ESHSGTK

SEQ ID NO: 472200 - protein, 5 aa, Mycobacterium
ESHTT

SEQ ID NO: 472201 - protein, 13 aa, Mycobacterium
ESIASGADKEPAV

SEQ ID NO: 472202 - protein, 4 aa, Mycobacterium
ESID

SEQ ID NO: 472203 - protein, 9 aa, Mycobacterium
ESIDDPAET

SEQ ID NO: 472204 - protein, 5 aa, Mycobacterium
ESIDE

SEQ ID NO: 472205 - protein, 10 aa, Mycobacterium
ESIEDPAETF

SEQ ID NO: 472206 - protein, 8 aa, Mycobacterium
ESIEGTPV

SEQ ID NO: 472207 - protein, 4 aa, Mycobacterium
ESIF

SEQ ID NO: 472208 - protein, 10 aa, Mycobacterium
ESIGENQVTG

SEQ ID NO: 472209 - protein, 9 aa, Mycobacterium
ESIGEYTRA

SEQ ID NO: 472210 - protein, 12 aa, Mycobacterium
ESIGPEEVESVC

SEQ ID NO: 472211 - protein, 7 aa, Mycobacterium
ESIGPGD

SEQ ID NO: 472212 - protein, 5 aa, Mycobacterium
ESIKA

SEQ ID NO: 472213 - protein, 5 aa, Mycobacterium
ESIPA

SEQ ID NO: 472214 - protein, 6 aa, Mycobacterium
ESIPGA

SEQ ID NO: 472215 - protein, 6 aa, Mycobacterium
ESIPND

SEQ ID NO: 472216 - protein, 5 aa, Mycobacterium
ESIPT

SEQ ID NO: 472217 - protein, 9 aa, Mycobacterium
ESIRKADDP

SEQ ID NO: 472218 - protein, 9 aa, Mycobacterium
ESIRKAEDP

SEQ ID NO: 472219 - protein, 10 aa, Mycobacterium
ESIRKAEDPL

SEQ ID NO: 472220 - protein, 11 aa, Mycobacterium
ESIRRASDPLR

SEQ ID NO: 472221 - protein, 4 aa, Mycobacterium
ESIS

SEQ ID NO: 472222 - protein, 20 aa, Mycobacterium
ESISRRSAAAPTVDRRPEQS

SEQ ID NO: 472223 - protein, 10 aa, Mycobacterium
ESITDDELER

SEQ ID NO: 472224 - protein, 6 aa, Mycobacterium
ESITNQ

SEQ ID NO: 472225 - protein, 7 aa, Mycobacterium
ESKANEV

SEQ ID NO: 472226 - protein, 8 aa, Mycobacterium
ESKAQHAM

SEQ ID NO: 472227 - protein, 10 aa, Mycobacterium
ESKASAIATT

SEQ ID NO: 472228 - protein, 14 aa, Mycobacterium
ESKDAAREELANEP

SEQ ID NO: 472229 - protein, 14 aa, Mycobacterium
ESKDQARAELANEP

SEQ ID NO: 472230 - protein, 6 aa, Mycobacterium
ESKEFT

SEQ ID NO: 472231 - protein, 7 aa, Mycobacterium
ESKETLQ

SEQ ID NO: 472232 - protein, 4 aa, Mycobacterium
ESKF

SEQ ID NO: 472233 - protein, 5 aa, Mycobacterium
ESKFD

SEQ ID NO: 472234 - protein, 4 aa, Mycobacterium
ESKG

SEQ ID NO: 472235 - protein, 9 aa, Mycobacterium
ESKGADLPD

SEQ ID NO: 472236 - protein, 9 aa, Mycobacterium
ESKNFPGGY

SEQ ID NO: 472237 - protein, 5 aa, Mycobacterium
ESKNQ

SEQ ID NO: 472238 - protein, 9 aa, Mycobacterium
ESKPGNCSP

SEQ ID NO: 472239 - protein, 6 aa, Mycobacterium
ESKPVE

SEQ ID NO: 472240 - protein, 6 aa, Mycobacterium
ESKRHD

SEQ ID NO: 472241 - protein, 6 aa, Mycobacterium
ESKSSD

SEQ ID NO: 472242 - protein, 4 aa, Mycobacterium
ESKT

SEQ ID NO: 472243 - protein, 8 aa, Mycobacterium
ESKYTANR

SEQ ID NO: 472244 - protein, 12 aa, Mycobacterium
ESLAASAPSLTH

SEQ ID NO: 472245 - protein, 15 aa, Mycobacterium
ESLAGNTQTGTGEAI

SEQ ID NO: 472246 - protein, 13 aa, Mycobacterium
ESLAGPSGRGFDG

SEQ ID NO: 472247 - protein, 10 aa, Mycobacterium
ESLANNPERL

SEQ ID NO: 472248 - protein, 7 aa, Mycobacterium
ESLAPDA

SEQ ID NO: 472249 - protein, 8 aa, Mycobacterium
ESLATPER

SEQ ID NO: 472250 - protein, 4 aa, Mycobacterium
ESLD

SEQ ID NO: 472251 - protein, 11 aa, Mycobacterium
ESLDADEKQRY

SEQ ID NO: 472252 - protein, 9 aa, Mycobacterium
ESLDAPQDP

SEQ ID NO: 472253 - protein, 8 aa, Mycobacterium
ESLDDEAD

SEQ ID NO: 472254 - protein, 16 aa, Mycobacterium
ESLDDVERRGAKKTDG

SEQ ID NO: 472255 - protein, 9 aa, Mycobacterium
ESLDPERGS

SEQ ID NO: 472256 - protein, 7 aa, Mycobacterium
ESLDPST

SEQ ID NO: 472257 - protein, 9 aa, Mycobacterium
ESLDPTTSH

SEQ ID NO: 472258 - protein, 23 aa, Mycobacterium
ESLEPGARKATPSSDAIFGWLFG

SEQ ID NO: 472259 - protein, 7 aa, Mycobacterium
ESLEPGR

SEQ ID NO: 472260 - protein, 13 aa, Mycobacterium
ESLERNGHRVRSP

SEQ ID NO: 472261 - protein, 4 aa, Mycobacterium
ESLG

SEQ ID NO: 472262 - protein, 5 aa, Mycobacterium
ESLGA

SEQ ID NO: 472263 - protein, 10 aa, Mycobacterium
ESLGAGGLGS

SEQ ID NO: 472264 - protein, 8 aa, Mycobacterium
ESLGDNAD

SEQ ID NO: 472265 - protein, 6 aa, Mycobacterium
ESLGDR

SEQ ID NO: 472266 - protein, 6 aa, Mycobacterium
ESLGEN

SEQ ID NO: 472267 - protein, 6 aa, Mycobacterium
ESLGGA

SEQ ID NO: 472268 - protein, 7 aa, Mycobacterium
ESLGGAG

SEQ ID NO: 472269 - protein, 6 aa, Mycobacterium
ESLGSD

SEQ ID NO: 472270 - protein, 8 aa, Mycobacterium
ESLGTRDA

SEQ ID NO: 472271 - protein, 63 aa, Mycobacterium
ESLKASADSYSATDQQAAGAVGSSFQPGGGSPAGSAGASSASPAAATSAQQASSAQMDGGTED

SEQ ID NO: 472272 - protein, 12 aa, Mycobacterium
ESLPAEGPDSSA

SEQ ID NO: 472273 - protein, 12 aa, Mycobacterium
ESLPGAGGTLTR

SEQ ID NO: 472274 - protein, 16 aa, Mycobacterium
ESLPGHDGDGPSRRET

SEQ ID NO: 472275 - protein, 13 aa, Mycobacterium
ESLPGSVRPLPGR

SEQ ID NO: 472276 - protein, 8 aa, Mycobacterium
ESLPPSGV

SEQ ID NO: 472277 - protein, 8 aa, Mycobacterium
ESLPPTEP

SEQ ID NO: 472278 - protein, 8 aa, Mycobacterium
ESLPRQPQ

SEQ ID NO: 472279 - protein, 15 aa, Mycobacterium
ESLQAPDDEDVPDTG

SEQ ID NO: 472280 - protein, 8 aa, Mycobacterium
ESLQPGVS

SEQ ID NO: 472281 - protein, 17 aa, Mycobacterium
ESLQTGQSLSSITPKSD

SEQ ID NO: 472282 - protein, 9 aa, Mycobacterium
ESLREAEAD

SEQ ID NO: 472283 - protein, 10 aa, Mycobacterium
ESLREAEADI

SEQ ID NO: 472284 - protein, 7 aa, Mycobacterium
ESLRGHG

SEQ ID NO: 472285 - protein, 10 aa, Mycobacterium
ESLRKEAAEV

SEQ ID NO: 472286 - protein, 5 aa, Mycobacterium
ESLRQ

SEQ ID NO: 472287 - protein, 11 aa, Mycobacterium
ESLSEGGGGTV

SEQ ID NO: 472288 - protein, 7 aa, Mycobacterium
ESLTAEG

SEQ ID NO: 472289 - protein, 12 aa, Mycobacterium
ESLTDGASSRRN

SEQ ID NO: 472290 - protein, 5 aa, Mycobacterium
ESLTG

SEQ ID NO: 472291 - protein, 6 aa, Mycobacterium
ESLTPA

SEQ ID NO: 472292 - protein, 4 aa, Mycobacterium
ESMD

SEQ ID NO: 472293 - protein, 5 aa, Mycobacterium
ESMEN

SEQ ID NO: 472294 - protein, 7 aa, Mycobacterium
ESMEPEQ

SEQ ID NO: 472295 - protein, 18 aa, Mycobacterium
ESMGQGRATRADGAPDTV

SEQ ID NO: 472296 - protein, 18 aa, Mycobacterium
ESMGQGRATRAEGAPDTV

SEQ ID NO: 472297 - protein, 18 aa, Mycobacterium
ESMGQGRVTRAEGAPDTV

SEQ ID NO: 472298 - protein, 18 aa, Mycobacterium
ESMGQSRATRADGAPDTV

SEQ ID NO: 472299 - protein, 18 aa, Mycobacterium
ESMGQSRLTRAGGAPDTV

SEQ ID NO: 472300 - protein, 6 aa, Mycobacterium
ESMKPG

SEQ ID NO: 472301 - protein, 11 aa, Mycobacterium
ESMPADPQRAI

SEQ ID NO: 472302 - protein, 4 aa, Mycobacterium
ESMR

SEQ ID NO: 472303 - protein, 10 aa, Mycobacterium
ESMSRTPMGA

SEQ ID NO: 472304 - protein, 22 aa, Mycobacterium
ESMSRTPMGSSLANGGNPYPQA

SEQ ID NO: 472305 - protein, 20 aa, Mycobacterium
ESMSRTPMGSSLANGGRPYP

SEQ ID NO: 472306 - protein, 8 aa, Mycobacterium
ESMTASQA

SEQ ID NO: 472307 - protein, 8 aa, Mycobacterium
ESNAATYS

SEQ ID NO: 472308 - protein, 8 aa, Mycobacterium
ESNAGQRV

SEQ ID NO: 472309 - protein, 19 aa, Mycobacterium
ESNARSSRDGPKYPGSKAL

SEQ ID NO: 472310 - protein, 8 aa, Mycobacterium
ESNDGGAP

SEQ ID NO: 472311 - protein, 10 aa, Mycobacterium
ESNDTPANET

SEQ ID NO: 472312 - protein, 6 aa, Mycobacterium
ESNDYE

SEQ ID NO: 472313 - protein, 4 aa, Mycobacterium
ESNF

SEQ ID NO: 472314 - protein, 18 aa, Mycobacterium
ESNGKSTRADGSPVTTDT

SEQ ID NO: 472315 - protein, 19 aa, Mycobacterium
ESNGKSTRADGTAVTTDTG

SEQ ID NO: 472316 - protein, 17 aa, Mycobacterium
ESNGKSVKADGAPVSVD

SEQ ID NO: 472317 - protein, 18 aa, Mycobacterium
ESNGKSVQADGTPVSTAT

SEQ ID NO: 472318 - protein, 19 aa, Mycobacterium
ESNGKSVRADGTPVSTDTG

SEQ ID NO: 472319 - protein, 9 aa, Mycobacterium
ESNGSEPGR

SEQ ID NO: 472320 - protein, 6 aa, Mycobacterium
ESNLDA

SEQ ID NO: 472321 - protein, 8 aa, Mycobacterium
ESNLDAPN

SEQ ID NO: 472322 - protein, 10 aa, Mycobacterium
ESNLGNSGAA

SEQ ID NO: 472323 - protein, 8 aa, Mycobacterium
ESNLKAPK

SEQ ID NO: 472324 - protein, 9 aa, Mycobacterium
ESNLSNPEA

SEQ ID NO: 472325 - protein, 9 aa, Mycobacterium
ESNLSNPQA

SEQ ID NO: 472326 - protein, 7 aa, Mycobacterium
ESNNAQM

SEQ ID NO: 472327 - protein, 4 aa, Mycobacterium
ESNP

SEQ ID NO: 472328 - protein, 8 aa, Mycobacterium
ESNPARDI

SEQ ID NO: 472329 - protein, 11 aa, Mycobacterium
ESNRGGEQARH

SEQ ID NO: 472330 - protein, 8 aa, Mycobacterium
ESNTAGIG

SEQ ID NO: 472331 - protein, 5 aa, Mycobacterium
ESNVD

SEQ ID NO: 472332 - protein, 5 aa, Mycobacterium
ESNVY

SEQ ID NO: 472333 - protein, 17 aa, Mycobacterium
ESPAAEDETWDGPDQRP

SEQ ID NO: 472334 - protein, 5 aa, Mycobacterium
ESPAE

SEQ ID NO: 472335 - protein, 6 aa, Mycobacterium
ESPAGV

SEQ ID NO: 472336 - protein, 6 aa, Mycobacterium
ESPANL

SEQ ID NO: 472337 - protein, 40 aa, Mycobacterium
ESPAPLPEPEPAVAEEHTETETTQAPAPRRSRRSKPAVPT

SEQ ID NO: 472338 - protein, 19 aa, Mycobacterium
ESPAPTSGRPRKTPAQAES

SEQ ID NO: 472339 - protein, 14 aa, Mycobacterium
ESPARPDGTRAGNA

SEQ ID NO: 472340 - protein, 18 aa, Mycobacterium
ESPASGMVSSADTAARLA

SEQ ID NO: 472341 - protein, 7 aa, Mycobacterium
ESPATEE

SEQ ID NO: 472342 - protein, 9 aa, Mycobacterium
ESPATTASW

SEQ ID NO: 472343 - protein, 7 aa, Mycobacterium
ESPAVGE

SEQ ID NO: 472344 - protein, 8 aa, Mycobacterium
ESPAVSES

SEQ ID NO: 472345 - protein, 10 aa, Mycobacterium
ESPDADDTAV

SEQ ID NO: 472346 - protein, 10 aa, Mycobacterium
ESPDESEGLP

SEQ ID NO: 472347 - protein, 16 aa, Mycobacterium
ESPDGAEVARGKDLQE

SEQ ID NO: 472348 - protein, 9 aa, Mycobacterium
ESPDGAVAP

SEQ ID NO: 472349 - protein, 6 aa, Mycobacterium
ESPDGS

SEQ ID NO: 472350 - protein, 13 aa, Mycobacterium
ESPDHAVASKRAL

SEQ ID NO: 472351 - protein, 7 aa, Mycobacterium
ESPDNAA

SEQ ID NO: 472352 - protein, 6 aa, Mycobacterium
ESPDRI

SEQ ID NO: 472353 - protein, 6 aa, Mycobacterium
ESPDRL

SEQ ID NO: 472354 - protein, 6 aa, Mycobacterium
ESPEAA

SEQ ID NO: 472355 - protein, 7 aa, Mycobacterium
ESPEAAA

SEQ ID NO: 472356 - protein, 7 aa, Mycobacterium
ESPEFSG

SEQ ID NO: 472357 - protein, 9 aa, Mycobacterium
ESPEGDPFR

SEQ ID NO: 472358 - protein, 20 aa, Mycobacterium
ESPEGHEAETLTANSPLGQA

SEQ ID NO: 472359 - protein, 5 aa, Mycobacterium
ESPEP

SEQ ID NO: 472360 - protein, 6 aa, Mycobacterium
ESPEPK

SEQ ID NO: 472361 - protein, 6 aa, Mycobacterium
ESPEPP

SEQ ID NO: 472362 - protein, 6 aa, Mycobacterium
ESPEQF

SEQ ID NO: 472363 - protein, 9 aa, Mycobacterium
ESPEQSAEI

SEQ ID NO: 472364 - protein, 7 aa, Mycobacterium
ESPFDAP

SEQ ID NO: 472365 - protein, 4 aa, Mycobacterium
ESPG

SEQ ID NO: 472366 - protein, 7 aa, Mycobacterium
ESPGASR

SEQ ID NO: 472367 - protein, 5 aa, Mycobacterium
ESPGC

SEQ ID NO: 472368 - protein, 7 aa, Mycobacterium
ESPGEPV

SEQ ID NO: 472369 - protein, 13 aa, Mycobacterium
ESPGIDAAPQFPP

SEQ ID NO: 472370 - protein, 19 aa, Mycobacterium
ESPGRLRNAGPARPGEHND

SEQ ID NO: 472371 - protein, 20 aa, Mycobacterium
ESPGRVRNAGPARPGQHNDD

SEQ ID NO: 472372 - protein, 18 aa, Mycobacterium
ESPGRVRSAGPPHPGRHN

SEQ ID NO: 472373 - protein, 10 aa, Mycobacterium
ESPGSIEPDL

SEQ ID NO: 472374 - protein, 13 aa, Mycobacterium
ESPGTGPGKADPG

SEQ ID NO: 472375 - protein, 20 aa, Mycobacterium
ESPGTIRNAGSARPGQHNDE

SEQ ID NO: 472376 - protein, 5 aa, Mycobacterium
ESPGV

SEQ ID NO: 472377 - protein, 7 aa, Mycobacterium
ESPGVHR

SEQ ID NO: 472378 - protein, 5 aa, Mycobacterium
ESPHD

SEQ ID NO: 472379 - protein, 14 aa, Mycobacterium
ESPHLQPLRKTARH

SEQ ID NO: 472380 - protein, 10 aa, Mycobacterium
ESPHPGGRST

SEQ ID NO: 472381 - protein, 11 aa, Mycobacterium
ESPHPSPLSAS

SEQ ID NO: 472382 - protein, 4 aa, Mycobacterium
ESPI

SEQ ID NO: 472383 - protein, 12 aa, Mycobacterium
ESPIGATDRAGV

SEQ ID NO: 472384 - protein, 7 aa, Mycobacterium
ESPITET

SEQ ID NO: 472385 - protein, 17 aa, Mycobacterium
ESPKEDEVTAALRIVMA

SEQ ID NO: 472386 - protein, 5 aa, Mycobacterium
ESPLD

SEQ ID NO: 472387 - protein, 6 aa, Mycobacterium
ESPLEQ

SEQ ID NO: 472388 - protein, 5 aa, Mycobacterium
ESPLL

SEQ ID NO: 472389 - protein, 6 aa, Mycobacterium
ESPLPT

SEQ ID NO: 472390 - protein, 6 aa, Mycobacterium
ESPNQY

SEQ ID NO: 472391 - protein, 6 aa, Mycobacterium
ESPNSF

SEQ ID NO: 472392 - protein, 20 aa, Mycobacterium
ESPNSFRGKYRGSDVGRYAD

SEQ ID NO: 472393 - protein, 8 aa, Mycobacterium
ESPNYPAD

SEQ ID NO: 472394 - protein, 17 aa, Mycobacterium
ESPPAPPPEPPDLQEPP

SEQ ID NO: 472395 - protein, 7 aa, Mycobacterium
ESPPDRL

SEQ ID NO: 472396 - protein, 5 aa, Mycobacterium
ESPPL

SEQ ID NO: 472397 - protein, 5 aa, Mycobacterium
ESPPM

SEQ ID NO: 472398 - protein, 10 aa, Mycobacterium
ESPPPAPPRW

SEQ ID NO: 472399 - protein, 11 aa, Mycobacterium
ESPPPAPPRWE

SEQ ID NO: 472400 - protein, 26 aa, Mycobacterium
ESPPPPPGAPAGRDIATQPEVATGYR

SEQ ID NO: 472401 - protein, 5 aa, Mycobacterium
ESPQA

SEQ ID NO: 472402 - protein, 8 aa, Mycobacterium
ESPQGDSL

SEQ ID NO: 472403 - protein, 8 aa, Mycobacterium
ESPQGPQL

SEQ ID NO: 472404 - protein, 27 aa, Mycobacterium
ESPQLGSPAIGAAPTVPAAALPAGSVE

SEQ ID NO: 472405 - protein, 10 aa, Mycobacterium
ESPQPGRPEM

SEQ ID NO: 472406 - protein, 6 aa, Mycobacterium
ESPQQF

SEQ ID NO: 472407 - protein, 9 aa, Mycobacterium
ESPQQRKRS

SEQ ID NO: 472408 - protein, 7 aa, Mycobacterium
ESPQTRG

SEQ ID NO: 472409 - protein, 6 aa, Mycobacterium
ESPQWS

SEQ ID NO: 472410 - protein, 4 aa, Mycobacterium
ESPR

SEQ ID NO: 472411 - protein, 5 aa, Mycobacterium
ESPRA

SEQ ID NO: 472412 - protein, 8 aa, Mycobacterium
ESPRATRY

SEQ ID NO: 472413 - protein, 6 aa, Mycobacterium
ESPRRA

SEQ ID NO: 472414 - protein, 15 aa, Mycobacterium
ESPRRPDGTRAGNPS

SEQ ID NO: 472415 - protein, 5 aa, Mycobacterium
ESPRW

SEQ ID NO: 472416 - protein, 5 aa, Mycobacterium
ESPRY

SEQ ID NO: 472417 - protein, 4 aa, Mycobacterium
ESPS

SEQ ID NO: 472418 - protein, 8 aa, Mycobacterium
ESPSEGAV

SEQ ID NO: 472419 - protein, 5 aa, Mycobacterium
ESPSF

SEQ ID NO: 472420 - protein, 8 aa, Mycobacterium
ESPSHTQG

SEQ ID NO: 472421 - protein, 5 aa, Mycobacterium
ESPSL

SEQ ID NO: 472422 - protein, 6 aa, Mycobacterium
ESPSPL

SEQ ID NO: 472423 - protein, 10 aa, Mycobacterium
ESPSPLAGSE

SEQ ID NO: 472424 - protein, 6 aa, Mycobacterium
ESPTAA

SEQ ID NO: 472425 - protein, 15 aa, Mycobacterium
ESPTARRAGAGGHPC

SEQ ID NO: 472426 - protein, 9 aa, Mycobacterium
ESPTDGSVD

SEQ ID NO: 472427 - protein, 7 aa, Mycobacterium
ESPTDLP

SEQ ID NO: 472428 - protein, 7 aa, Mycobacterium
ESPTEGA

SEQ ID NO: 472429 - protein, 8 aa, Mycobacterium
ESPTGEDT

SEQ ID NO: 472430 - protein, 5 aa, Mycobacterium
ESPTL

SEQ ID NO: 472431 - protein, 28 aa, Mycobacterium
ESPTTTPGSASGGTSSVRDAESDAPRYR

SEQ ID NO: 472432 - protein, 32 aa, Mycobacterium
ESPTTTPGSTSGAPSGVPSGVNDAESDAPRHR

SEQ ID NO: 472433 - protein, 7 aa, Mycobacterium
ESPTVAS

SEQ ID NO: 472434 - protein, 14 aa, Mycobacterium
ESPTYTNGSATALS

SEQ ID NO: 472435 - protein, 11 aa, Mycobacterium
ESPVADSSMGV

SEQ ID NO: 472436 - protein, 13 aa, Mycobacterium
ESPVASAGRGMGA

SEQ ID NO: 472437 - protein, 14 aa, Mycobacterium
ESPVGGDDTRGWGP

SEQ ID NO: 472438 - protein, 7 aa, Mycobacterium
ESPVGGM

SEQ ID NO: 472439 - protein, 6 aa, Mycobacterium
ESPVKG

SEQ ID NO: 472440 - protein, 17 aa, Mycobacterium
ESPVKSDSRLARRSTTV

SEQ ID NO: 472441 - protein, 4 aa, Mycobacterium
ESPW

SEQ ID NO: 472442 - protein, 9 aa, Mycobacterium
ESPWAARSP

SEQ ID NO: 472443 - protein, 4 aa, Mycobacterium
ESQA

SEQ ID NO: 472444 - protein, 7 aa, Mycobacterium
ESQALRR

SEQ ID NO: 472445 - protein, 8 aa, Mycobacterium
ESQALRRG

SEQ ID NO: 472446 - protein, 7 aa, Mycobacterium
ESQAPRG

SEQ ID NO: 472447 - protein, 8 aa, Mycobacterium
ESQDYSEA

SEQ ID NO: 472448 - protein, 18 aa, Mycobacterium
ESQEAGGDAEVGAQRDRL

SEQ ID NO: 472449 - protein, 14 aa, Mycobacterium
ESQGEVTLTPADRA

SEQ ID NO: 472450 - protein, 6 aa, Mycobacterium
ESQGRP

SEQ ID NO: 472451 - protein, 6 aa, Mycobacterium
ESQGWD

SEQ ID NO: 472452 - protein, 6 aa, Mycobacterium
ESQHGD

SEQ ID NO: 472453 - protein, 5 aa, Mycobacterium
ESQHR

SEQ ID NO: 472454 - protein, 8 aa, Mycobacterium
ESQHRGSA

SEQ ID NO: 472455 - protein, 12 aa, Mycobacterium
ESQHVGGTTIST

SEQ ID NO: 472456 - protein, 5 aa, Mycobacterium
ESQIG

SEQ ID NO: 472457 - protein, 9 aa, Mycobacterium
ESQIGTADS

SEQ ID NO: 472458 - protein, 4 aa, Mycobacterium
ESQL

SEQ ID NO: 472459 - protein, 7 aa, Mycobacterium
ESQPIRS

SEQ ID NO: 472460 - protein, 26 aa, Mycobacterium
ESQPKAASKWSRKSMAERSGLSKSTV

SEQ ID NO: 472461 - protein, 10 aa, Mycobacterium
ESQPKFPSEV

SEQ ID NO: 472462 - protein, 11 aa, Mycobacterium
ESQPSAAASGV

SEQ ID NO: 472463 - protein, 12 aa, Mycobacterium
ESQQKRAAKSAL

SEQ ID NO: 472464 - protein, 44 aa, Mycobacterium
ESQQRSAATRAEKSALTRSGQDHPPSRQGLSDLSRAESSTMAPH

SEQ ID NO: 472465 - protein, 9 aa, Mycobacterium
ESQQRTREE

SEQ ID NO: 472466 - protein, 4 aa, Mycobacterium
ESQR

SEQ ID NO: 472467 - protein, 11 aa, Mycobacterium
ESQRAADPVVG

SEQ ID NO: 472468 - protein, 6 aa, Mycobacterium
ESQRAG

SEQ ID NO: 472469 - protein, 5 aa, Mycobacterium
ESQRE

SEQ ID NO: 472470 - protein, 9 aa, Mycobacterium
ESQRGVPPQ

SEQ ID NO: 472471 - protein, 9 aa, Mycobacterium
ESQRPIPDD

SEQ ID NO: 472472 - protein, 8 aa, Mycobacterium
ESQRRQRA

SEQ ID NO: 472473 - protein, 8 aa, Mycobacterium
ESQSPEFS

SEQ ID NO: 472474 - protein, 6 aa, Mycobacterium
ESQSYR

SEQ ID NO: 472475 - protein, 4 aa, Mycobacterium
ESQT

SEQ ID NO: 472476 - protein, 20 aa, Mycobacterium
ESQTGPPRLRDLRPDPNSPP

SEQ ID NO: 472477 - protein, 6 aa, Mycobacterium
ESQTIA

SEQ ID NO: 472478 - protein, 7 aa, Mycobacterium
ESQTVAT

SEQ ID NO: 472479 - protein, 7 aa, Mycobacterium
ESQVRAR

SEQ ID NO: 472480 - protein, 5 aa, Mycobacterium
ESQWN

SEQ ID NO: 472481 - protein, 5 aa, Mycobacterium
ESRAA

SEQ ID NO: 472482 - protein, 14 aa, Mycobacterium
ESRAATSETPRKLD

SEQ ID NO: 472483 - protein, 7 aa, Mycobacterium
ESRADGV

SEQ ID NO: 472484 - protein, 10 aa, Mycobacterium
ESRAESAAAA

SEQ ID NO: 472485 - protein, 15 aa, Mycobacterium
ESRAGIGVSGGGTKL

SEQ ID NO: 472486 - protein, 10 aa, Mycobacterium
ESRAPAPKID

SEQ ID NO: 472487 - protein, 9 aa, Mycobacterium
ESRAPYGTY

SEQ ID NO: 472488 - protein, 6 aa, Mycobacterium
ESRARA

SEQ ID NO: 472489 - protein, 6 aa, Mycobacterium
ESRARQ

SEQ ID NO: 472490 - protein, 9 aa, Mycobacterium
ESRARREGR

SEQ ID NO: 472491 - protein, 11 aa, Mycobacterium
ESRDESTGGDL

SEQ ID NO: 472492 - protein, 5 aa, Mycobacterium
ESRDR

SEQ ID NO: 472493 - protein, 6 aa, Mycobacterium
ESRDVT

SEQ ID NO: 472494 - protein, 6 aa, Mycobacterium
ESREAA

SEQ ID NO: 472495 - protein, 12 aa, Mycobacterium
ESREEAGDPGDL

SEQ ID NO: 472496 - protein, 7 aa, Mycobacterium
ESREEAY

SEQ ID NO: 472497 - protein, 10 aa, Mycobacterium
ESREELNTDA

SEQ ID NO: 472498 - protein, 5 aa, Mycobacterium
ESREF

SEQ ID NO: 472499 - protein, 15 aa, Mycobacterium
ESRENGSLSVTTRAR

SEQ ID NO: 472500 - protein, 12 aa, Mycobacterium
ESREPAKRPWSD

SEQ ID NO: 472501 - protein, 8 aa, Mycobacterium
ESREPEDI

SEQ ID NO: 472502 - protein, 15 aa, Mycobacterium
ESRETFGANGLPQTA

SEQ ID NO: 472503 - protein, 4 aa, Mycobacterium
ESRF

SEQ ID NO: 472504 - protein, 7 aa, Mycobacterium
ESRFPTA

SEQ ID NO: 472505 - protein, 12 aa, Mycobacterium
ESRGALSESEKH

SEQ ID NO: 472506 - protein, 18 aa, Mycobacterium
ESRGAPREGFPAGTAWSE

SEQ ID NO: 472507 - protein, 13 aa, Mycobacterium
ESRGLPSDVAGAA

SEQ ID NO: 472508 - protein, 5 aa, Mycobacterium
ESRGR

SEQ ID NO: 472509 - protein, 5 aa, Mycobacterium
ESRGS

SEQ ID NO: 472510 - protein, 6 aa, Mycobacterium
ESRGSH

SEQ ID NO: 472511 - protein, 26 aa, Mycobacterium
ESRGTAYAVTGSGAPSGGSAPSTVAP

SEQ ID NO: 472512 - protein, 8 aa, Mycobacterium
ESRGVAEA

SEQ ID NO: 472513 - protein, 27 aa, Mycobacterium
ESRKGLPPNPDATSTSLPGARGADVDG

SEQ ID NO: 472514 - protein, 15 aa, Mycobacterium
ESRKGVGTDGPAAAT

SEQ ID NO: 472515 - protein, 11 aa, Mycobacterium
ESRKRAESAEI

SEQ ID NO: 472516 - protein, 9 aa, Mycobacterium
ESRKRGEAA

SEQ ID NO: 472517 - protein, 10 aa, Mycobacterium
ESRKRGEAAE

SEQ ID NO: 472518 - protein, 5 aa, Mycobacterium
ESRKT

SEQ ID NO: 472519 - protein, 5 aa, Mycobacterium
ESRLE

SEQ ID NO: 472520 - protein, 5 aa, Mycobacterium
ESRLN

SEQ ID NO: 472521 - protein, 7 aa, Mycobacterium
ESRMAPD

SEQ ID NO: 472522 - protein, 4 aa, Mycobacterium
ESRP

SEQ ID NO: 472523 - protein, 5 aa, Mycobacterium
ESRPA

SEQ ID NO: 472524 - protein, 11 aa, Mycobacterium
ESRPAGPVQRD

SEQ ID NO: 472525 - protein, 8 aa, Mycobacterium
ESRPDDPL

SEQ ID NO: 472526 - protein, 7 aa, Mycobacterium
ESRPDER

SEQ ID NO: 472527 - protein, 8 aa, Mycobacterium
ESRPEDRR

SEQ ID NO: 472528 - protein, 26 aa, Mycobacterium
ESRPGAGSFRTENRPVPRPGDTSWQE

SEQ ID NO: 472529 - protein, 7 aa, Mycobacterium
ESRPNDL

SEQ ID NO: 472530 - protein, 8 aa, Mycobacterium
ESRPTRTA

SEQ ID NO: 472531 - protein, 5 aa, Mycobacterium
ESRQR

SEQ ID NO: 472532 - protein, 4 aa, Mycobacterium
ESRR

SEQ ID NO: 472533 - protein, 6 aa, Mycobacterium
ESRRDD

SEQ ID NO: 472534 - protein, 12 aa, Mycobacterium
ESRRGAGWSGPS

SEQ ID NO: 472535 - protein, 5 aa, Mycobacterium
ESRRP

SEQ ID NO: 472536 - protein, 11 aa, Mycobacterium
ESRRQGSDAPL

SEQ ID NO: 472537 - protein, 11 aa, Mycobacterium
ESRRQRSVAPV

SEQ ID NO: 472538 - protein, 9 aa, Mycobacterium
ESRRRGEAA

SEQ ID NO: 472539 - protein, 11 aa, Mycobacterium
ESRSDTHDEST

SEQ ID NO: 472540 - protein, 14 aa, Mycobacterium
ESRSGDESAGPTKI

SEQ ID NO: 472541 - protein, 6 aa, Mycobacterium
ESRSGI

SEQ ID NO: 472542 - protein, 7 aa, Mycobacterium
ESRSGIA

SEQ ID NO: 472543 - protein, 7 aa, Mycobacterium
ESRSGVA

SEQ ID NO: 472544 - protein, 7 aa, Mycobacterium
ESRSGVP

SEQ ID NO: 472545 - protein, 14 aa, Mycobacterium
ESRSHPQGFTAREE

SEQ ID NO: 472546 - protein, 9 aa, Mycobacterium
ESRSKRPIL

SEQ ID NO: 472547 - protein, 5 aa, Mycobacterium
ESRSP

SEQ ID NO: 472548 - protein, 9 aa, Mycobacterium
ESRSPAPIL

SEQ ID NO: 472549 - protein, 8 aa, Mycobacterium
ESRSPDFA

SEQ ID NO: 472550 - protein, 8 aa, Mycobacterium
ESRSPRSI

SEQ ID NO: 472551 - protein, 15 aa, Mycobacterium
ESRSRADTFGPDGGE

SEQ ID NO: 472552 - protein, 17 aa, Mycobacterium
ESRSRKPILGDRTAAAA

SEQ ID NO: 472553 - protein, 9 aa, Mycobacterium
ESRSRRPIL

SEQ ID NO: 472554 - protein, 22 aa, Mycobacterium
ESRSRTDTFGPDARRGIDARGD

SEQ ID NO: 472555 - protein, 6 aa, Mycobacterium
ESRSTW

SEQ ID NO: 472556 - protein, 12 aa, Mycobacterium
ESRTPKDAWRNN

SEQ ID NO: 472557 - protein, 8 aa, Mycobacterium
ESRTPTEI

SEQ ID NO: 472558 - protein, 14 aa, Mycobacterium
ESRTQAGPHQPPAK

SEQ ID NO: 472559 - protein, 9 aa, Mycobacterium
ESRTQPTGR

SEQ ID NO: 472560 - protein, 7 aa, Mycobacterium
ESRTQRA

SEQ ID NO: 472561 - protein, 13 aa, Mycobacterium
ESRTVAPGFTPTT

SEQ ID NO: 472562 - protein, 5 aa, Mycobacterium
ESRVG

SEQ ID NO: 472563 - protein, 5 aa, Mycobacterium
ESRYI

SEQ ID NO: 472564 - protein, 5 aa, Mycobacterium
ESRYM

SEQ ID NO: 472565 - protein, 8 aa, Mycobacterium
ESSADYQD

SEQ ID NO: 472566 - protein, 6 aa, Mycobacterium
ESSAGG

SEQ ID NO: 472567 - protein, 7 aa, Mycobacterium
ESSAHNV

SEQ ID NO: 472568 - protein, 7 aa, Mycobacterium
ESSALAR

SEQ ID NO: 472569 - protein, 8 aa, Mycobacterium
ESSANLGG

SEQ ID NO: 472570 - protein, 9 aa, Mycobacterium
ESSAPGVPS

SEQ ID NO: 472571 - protein, 13 aa, Mycobacterium
ESSARRPPRDGFA

SEQ ID NO: 472572 - protein, 8 aa, Mycobacterium
ESSARSRN

SEQ ID NO: 472573 - protein, 9 aa, Mycobacterium
ESSDAPGSV

SEQ ID NO: 472574 - protein, 21 aa, Mycobacterium
ESSDFDDEERDHSPAPSDTYH

SEQ ID NO: 472575 - protein, 6 aa, Mycobacterium
ESSDRI

SEQ ID NO: 472576 - protein, 7 aa, Mycobacterium
ESSDRIG

SEQ ID NO: 472577 - protein, 8 aa, Mycobacterium
ESSEAAAF

SEQ ID NO: 472578 - protein, 8 aa, Mycobacterium
ESSEGSVQ

SEQ ID NO: 472579 - protein, 6 aa, Mycobacterium
ESSERE

SEQ ID NO: 472580 - protein, 39 aa, Mycobacterium
ESSESSEAVAPAITSAADSAPEAPPATTAPAIENPLPED

SEQ ID NO: 472581 - protein, 6 aa, Mycobacterium
ESSETV

SEQ ID NO: 472582 - protein, 5 aa, Mycobacterium
ESSEV

SEQ ID NO: 472583 - protein, 5 aa, Mycobacterium
ESSFM

SEQ ID NO: 472584 - protein, 4 aa, Mycobacterium
ESSG

SEQ ID NO: 472585 - protein, 7 aa, Mycobacterium
ESSGADS

SEQ ID NO: 472586 - protein, 7 aa, Mycobacterium
ESSGATT

SEQ ID NO: 472587 - protein, 10 aa, Mycobacterium
ESSGDESVET

SEQ ID NO: 472588 - protein, 8 aa, Mycobacterium
ESSGGLTL

SEQ ID NO: 472589 - protein, 11 aa, Mycobacterium
ESSGGVEGTTL

SEQ ID NO: 472590 - protein, 12 aa, Mycobacterium
ESSGGWSGTGWQ

SEQ ID NO: 472591 - protein, 14 aa, Mycobacterium
ESSGHGGGLGPTHG

SEQ ID NO: 472592 - protein, 5 aa, Mycobacterium
ESSGI

SEQ ID NO: 472593 - protein, 5 aa, Mycobacterium
ESSGL

SEQ ID NO: 472594 - protein, 9 aa, Mycobacterium
ESSGPTALD

SEQ ID NO: 472595 - protein, 8 aa, Mycobacterium
ESSGRQRA

SEQ ID NO: 472596 - protein, 10 aa, Mycobacterium
ESSGSALSES

SEQ ID NO: 472597 - protein, 10 aa, Mycobacterium
ESSGSALTES

SEQ ID NO: 472598 - protein, 6 aa, Mycobacterium
ESSGTA

SEQ ID NO: 472599 - protein, 9 aa, Mycobacterium
ESSGTALTD

SEQ ID NO: 472600 - protein, 9 aa, Mycobacterium
ESSGTALTE

SEQ ID NO: 472601 - protein, 10 aa, Mycobacterium
ESSGVSTRRI

SEQ ID NO: 472602 - protein, 6 aa, Mycobacterium
ESSHDE

SEQ ID NO: 472603 - protein, 29 aa, Mycobacterium
ESSHDRSYPISPGPTAGRPFGNRRAATGF

SEQ ID NO: 472604 - protein, 6 aa, Mycobacterium
ESSIAD

SEQ ID NO: 472605 - protein, 7 aa, Mycobacterium
ESSITDA

SEQ ID NO: 472606 - protein, 9 aa, Mycobacterium
ESSKPEWGL

SEQ ID NO: 472607 - protein, 4 aa, Mycobacterium
ESSL

SEQ ID NO: 472608 - protein, 5 aa, Mycobacterium
ESSLP

SEQ ID NO: 472609 - protein, 35 aa, Mycobacterium
ESSLTDDTPVALNGDKPASPEPEPESEPKPEPSRF

SEQ ID NO: 472610 - protein, 4 aa, Mycobacterium
ESSN

SEQ ID NO: 472611 - protein, 7 aa, Mycobacterium
ESSNRDA

SEQ ID NO: 472612 - protein, 29 aa, Mycobacterium
ESSPEAVEDVNPGTQPAEVQTGASTGRLQ

SEQ ID NO: 472613 - protein, 8 aa, Mycobacterium
ESSPKAVL

SEQ ID NO: 472614 - protein, 6 aa, Mycobacterium
ESSPPY

SEQ ID NO: 472615 - protein, 8 aa, Mycobacterium
ESSPQPSY

SEQ ID NO: 472616 - protein, 5 aa, Mycobacterium
ESSPV

SEQ ID NO: 472617 - protein, 14 aa, Mycobacterium
ESSPVGPAAGPVAD

SEQ ID NO: 472618 - protein, 4 aa, Mycobacterium
ESSR

SEQ ID NO: 472619 - protein, 7 aa, Mycobacterium
ESSRHGK

SEQ ID NO: 472620 - protein, 8 aa, Mycobacterium
ESSRIGRP

SEQ ID NO: 472621 - protein, 7 aa, Mycobacterium
ESSRRAY

SEQ ID NO: 472622 - protein, 6 aa, Mycobacterium
ESSRSI

SEQ ID NO: 472623 - protein, 12 aa, Mycobacterium
ESSSPDANGVNR

SEQ ID NO: 472624 - protein, 14 aa, Mycobacterium
ESSSRRRPPGEGFA

SEQ ID NO: 472625 - protein, 9 aa, Mycobacterium
ESSSSGLPM

SEQ ID NO: 472626 - protein, 11 aa, Mycobacterium
ESSSVDQRSGV

SEQ ID NO: 472627 - protein, 8 aa, Mycobacterium
ESSTAAGV

SEQ ID NO: 472628 - protein, 16 aa, Mycobacterium
ESSTAPRGVASSRKAV

SEQ ID NO: 472629 - protein, 7 aa, Mycobacterium
ESSTIGG

SEQ ID NO: 472630 - protein, 7 aa, Mycobacterium
ESSTKAT

SEQ ID NO: 472631 - protein, 5 aa, Mycobacterium
ESSTL

SEQ ID NO: 472632 - protein, 24 aa, Mycobacterium
ESSTSAAQHAAAEKAAGSDDAAGA

SEQ ID NO: 472633 - protein, 6 aa, Mycobacterium
ESSTTS

SEQ ID NO: 472634 - protein, 4 aa, Mycobacterium
ESSV

SEQ ID NO: 472635 - protein, 5 aa, Mycobacterium
ESSVA

SEQ ID NO: 472636 - protein, 5 aa, Mycobacterium
ESSVG

SEQ ID NO: 472637 - protein, 6 aa, Mycobacterium
ESSWAS

SEQ ID NO: 472638 - protein, 22 aa, Mycobacterium
ESSWRRPPRPTAHSEDGPYGER

SEQ ID NO: 472639 - protein, 4 aa, Mycobacterium
ESTA

SEQ ID NO: 472640 - protein, 5 aa, Mycobacterium
ESTAA

SEQ ID NO: 472641 - protein, 9 aa, Mycobacterium
ESTAAERRA

SEQ ID NO: 472642 - protein, 16 aa, Mycobacterium
ESTADRCAEKLSGKKV

SEQ ID NO: 472643 - protein, 13 aa, Mycobacterium
ESTAGRADRIVRV

SEQ ID NO: 472644 - protein, 12 aa, Mycobacterium
ESTAGTLDPTAV

SEQ ID NO: 472645 - protein, 10 aa, Mycobacterium
ESTAGVPGMP

SEQ ID NO: 472646 - protein, 10 aa, Mycobacterium
ESTANGKAAL

SEQ ID NO: 472647 - protein, 9 aa, Mycobacterium
ESTAQRRPS

SEQ ID NO: 472648 - protein, 6 aa, Mycobacterium
ESTARP

SEQ ID NO: 472649 - protein, 13 aa, Mycobacterium
ESTASLGTPTVSG

SEQ ID NO: 472650 - protein, 11 aa, Mycobacterium
ESTASPAPTVA

SEQ ID NO: 472651 - protein, 15 aa, Mycobacterium
ESTAVASALEKGSEP

SEQ ID NO: 472652 - protein, 5 aa, Mycobacterium
ESTAW

SEQ ID NO: 472653 - protein, 5 aa, Mycobacterium
ESTCR

SEQ ID NO: 472654 - protein, 14 aa, Mycobacterium
ESTDAGEPPAYDES

SEQ ID NO: 472655 - protein, 6 aa, Mycobacterium
ESTDAT

SEQ ID NO: 472656 - protein, 10 aa, Mycobacterium
ESTDAYEHGR

SEQ ID NO: 472657 - protein, 11 aa, Mycobacterium
ESTDAYEQGRA

SEQ ID NO: 472658 - protein, 14 aa, Mycobacterium
ESTDDLIADIDQAL

SEQ ID NO: 472659 - protein, 14 aa, Mycobacterium
ESTDDLIADLERAL

SEQ ID NO: 472660 - protein, 21 aa, Mycobacterium
ESTDFSTSPAESTSGTRTVGA

SEQ ID NO: 472661 - protein, 5 aa, Mycobacterium
ESTDG

SEQ ID NO: 472662 - protein, 6 aa, Mycobacterium
ESTDLR

SEQ ID NO: 472663 - protein, 7 aa, Mycobacterium
ESTDQPV

SEQ ID NO: 472664 - protein, 4 aa, Mycobacterium
ESTE

SEQ ID NO: 472665 - protein, 6 aa, Mycobacterium
ESTEEE

SEQ ID NO: 472666 - protein, 8 aa, Mycobacterium
ESTEESEV

SEQ ID NO: 472667 - protein, 7 aa, Mycobacterium
ESTELAS

SEQ ID NO: 472668 - protein, 7 aa, Mycobacterium
ESTEQPV

SEQ ID NO: 472669 - protein, 7 aa, Mycobacterium
ESTEYTQ

SEQ ID NO: 472670 - protein, 7 aa, Mycobacterium
ESTFTQK

SEQ ID NO: 472671 - protein, 9 aa, Mycobacterium
ESTGADRRA

SEQ ID NO: 472672 - protein, 8 aa, Mycobacterium
ESTGDIRH

SEQ ID NO: 472673 - protein, 7 aa, Mycobacterium
ESTGDLT

SEQ ID NO: 472674 - protein, 9 aa, Mycobacterium
ESTGDRSVI

SEQ ID NO: 472675 - protein, 6 aa, Mycobacterium
ESTGEF

SEQ ID NO: 472676 - protein, 5 aa, Mycobacterium
ESTGF

SEQ ID NO: 472677 - protein, 5 aa, Mycobacterium
ESTGG

SEQ ID NO: 472678 - protein, 7 aa, Mycobacterium
ESTGNGN

SEQ ID NO: 472679 - protein, 12 aa, Mycobacterium
ESTGRGTVPRED

SEQ ID NO: 472680 - protein, 6 aa, Mycobacterium
ESTGRP

SEQ ID NO: 472681 - protein, 6 aa, Mycobacterium
ESTGTD

SEQ ID NO: 472682 - protein, 5 aa, Mycobacterium
ESTGV

SEQ ID NO: 472683 - protein, 17 aa, Mycobacterium
ESTHQTPNHNDVIYPHC

SEQ ID NO: 472684 - protein, 4 aa, Mycobacterium
ESTI

SEQ ID NO: 472685 - protein, 6 aa, Mycobacterium
ESTKLD

SEQ ID NO: 472686 - protein, 13 aa, Mycobacterium
ESTLGDDEGERLR

SEQ ID NO: 472687 - protein, 13 aa, Mycobacterium
ESTLNPDPKDLTG

SEQ ID NO: 472688 - protein, 13 aa, Mycobacterium
ESTLPPKSASLQV

SEQ ID NO: 472689 - protein, 4 aa, Mycobacterium
ESTN

SEQ ID NO: 472690 - protein, 9 aa, Mycobacterium
ESTNRTYSN

SEQ ID NO: 472691 - protein, 14 aa, Mycobacterium
ESTNSMTPAHSWGP

SEQ ID NO: 472692 - protein, 4 aa, Mycobacterium
ESTP

SEQ ID NO: 472693 - protein, 7 aa, Mycobacterium
ESTPARR

SEQ ID NO: 472694 - protein, 6 aa, Mycobacterium
ESTPAV

SEQ ID NO: 472695 - protein, 7 aa, Mycobacterium
ESTPDER

SEQ ID NO: 472696 - protein, 9 aa, Mycobacterium
ESTPGGRED

SEQ ID NO: 472697 - protein, 14 aa, Mycobacterium
ESTPISATATAKSA

SEQ ID NO: 472698 - protein, 8 aa, Mycobacterium
ESTPNQER

SEQ ID NO: 472699 - protein, 29 aa, Mycobacterium
ESTPSQANPGPIYAPADDPSHANGTGGIE

SEQ ID NO: 472700 - protein, 10 aa, Mycobacterium
ESTPSWSPQY

SEQ ID NO: 472701 - protein, 7 aa, Mycobacterium
ESTPTPM

SEQ ID NO: 472702 - protein, 14 aa, Mycobacterium
ESTPTTPESPYGET

SEQ ID NO: 472703 - protein, 11 aa, Mycobacterium
ESTQEALRPSG

SEQ ID NO: 472704 - protein, 8 aa, Mycobacterium
ESTQERLA

SEQ ID NO: 472705 - protein, 6 aa, Mycobacterium
ESTQNA

SEQ ID NO: 472706 - protein, 7 aa, Mycobacterium
ESTQPQQ

SEQ ID NO: 472707 - protein, 7 aa, Mycobacterium
ESTQVGA

SEQ ID NO: 472708 - protein, 4 aa, Mycobacterium
ESTR

SEQ ID NO: 472709 - protein, 10 aa, Mycobacterium
ESTRAELGNN

SEQ ID NO: 472710 - protein, 9 aa, Mycobacterium
ESTRGRHGG

SEQ ID NO: 472711 - protein, 18 aa, Mycobacterium
ESTRGVGNSFGNNRQEGL

SEQ ID NO: 472712 - protein, 20 aa, Mycobacterium
ESTRGVGNSFGNNRQEGPDE

SEQ ID NO: 472713 - protein, 8 aa, Mycobacterium
ESTRPATR

SEQ ID NO: 472714 - protein, 13 aa, Mycobacterium
ESTRTLTDYDSAE

SEQ ID NO: 472715 - protein, 4 aa, Mycobacterium
ESTS

SEQ ID NO: 472716 - protein, 7 aa, Mycobacterium
ESTSASK

SEQ ID NO: 472717 - protein, 11 aa, Mycobacterium
ESTSDGGTTVG

SEQ ID NO: 472718 - protein, 6 aa, Mycobacterium
ESTSEA

SEQ ID NO: 472719 - protein, 11 aa, Mycobacterium
ESTSEDRKAAY

SEQ ID NO: 472720 - protein, 10 aa, Mycobacterium
ESTSEERRAA

SEQ ID NO: 472721 - protein, 10 aa, Mycobacterium
ESTSEERRDA

SEQ ID NO: 472722 - protein, 7 aa, Mycobacterium
ESTSGRY

SEQ ID NO: 472723 - protein, 11 aa, Mycobacterium
ESTSNLEAQRR

SEQ ID NO: 472724 - protein, 7 aa, Mycobacterium
ESTSQAV

SEQ ID NO: 472725 - protein, 6 aa, Mycobacterium
ESTSRY

SEQ ID NO: 472726 - protein, 10 aa, Mycobacterium
ESTSSPVPTL

SEQ ID NO: 472727 - protein, 10 aa, Mycobacterium
ESTSSPVPTV

SEQ ID NO: 472728 - protein, 9 aa, Mycobacterium
ESTSSYYPH

SEQ ID NO: 472729 - protein, 15 aa, Mycobacterium
ESTSWPGVTRPTSIG

SEQ ID NO: 472730 - protein, 20 aa, Mycobacterium
ESTTAPADYTAKVPAGLSAE

SEQ ID NO: 472731 - protein, 18 aa, Mycobacterium
ESTTGPGPDHRVMPTGVA

SEQ ID NO: 472732 - protein, 5 aa, Mycobacterium
ESTTH

SEQ ID NO: 472733 - protein, 5 aa, Mycobacterium
ESTTL

SEQ ID NO: 472734 - protein, 16 aa, Mycobacterium
ESTTNARRAHATSRTS

SEQ ID NO: 472735 - protein, 24 aa, Mycobacterium
ESTTNARRAHATSRTSLQIGPESE

SEQ ID NO: 472736 - protein, 16 aa, Mycobacterium
ESTTNSRRAHAPTRTS

SEQ ID NO: 472737 - protein, 7 aa, Mycobacterium
ESTTQRL

SEQ ID NO: 472738 - protein, 5 aa, Mycobacterium
ESTTR

SEQ ID NO: 472739 - protein, 6 aa, Mycobacterium
ESTTSG

SEQ ID NO: 472740 - protein, 4 aa, Mycobacterium
ESTV

SEQ ID NO: 472741 - protein, 5 aa, Mycobacterium
ESTVG

SEQ ID NO: 472742 - protein, 6 aa, Mycobacterium
ESTVNR

SEQ ID NO: 472743 - protein, 7 aa, Mycobacterium
ESTVTDT

SEQ ID NO: 472744 - protein, 5 aa, Mycobacterium
ESTWD

SEQ ID NO: 472745 - protein, 4 aa, Mycobacterium
ESTY

SEQ ID NO: 472746 - protein, 19 aa, Mycobacterium
ESTYAPSPQRFEAGTPMTS

SEQ ID NO: 472747 - protein, 4 aa, Mycobacterium
ESVA

SEQ ID NO: 472748 - protein, 5 aa, Mycobacterium
ESVAE

SEQ ID NO: 472749 - protein, 8 aa, Mycobacterium
ESVAPELT

SEQ ID NO: 472750 - protein, 6 aa, Mycobacterium
ESVAPL

SEQ ID NO: 472751 - protein, 10 aa, Mycobacterium
ESVARAHPRT

SEQ ID NO: 472752 - protein, 12 aa, Mycobacterium
ESVASSKIEQVD

SEQ ID NO: 472753 - protein, 5 aa, Mycobacterium
ESVDA

SEQ ID NO: 472754 - protein, 9 aa, Mycobacterium
ESVDGAGAV

SEQ ID NO: 472755 - protein, 9 aa, Mycobacterium
ESVDGREGD

SEQ ID NO: 472756 - protein, 6 aa, Mycobacterium
ESVDPP

SEQ ID NO: 472757 - protein, 7 aa, Mycobacterium
ESVDSDR

SEQ ID NO: 472758 - protein, 6 aa, Mycobacterium
ESVEPG

SEQ ID NO: 472759 - protein, 7 aa, Mycobacterium
ESVESSF

SEQ ID NO: 472760 - protein, 8 aa, Mycobacterium
ESVGADAS

SEQ ID NO: 472761 - protein, 6 aa, Mycobacterium
ESVGAT

SEQ ID NO: 472762 - protein, 5 aa, Mycobacterium
ESVGD

SEQ ID NO: 472763 - protein, 6 aa, Mycobacterium
ESVGEP

SEQ ID NO: 472764 - protein, 7 aa, Mycobacterium
ESVGGQG

SEQ ID NO: 472765 - protein, 9 aa, Mycobacterium
ESVGGSGGS

SEQ ID NO: 472766 - protein, 22 aa, Mycobacterium
ESVGRDAASIERSAGVQSDGGI

SEQ ID NO: 472767 - protein, 7 aa, Mycobacterium
ESVGTNP

SEQ ID NO: 472768 - protein, 7 aa, Mycobacterium
ESVGTTA

SEQ ID NO: 472769 - protein, 13 aa, Mycobacterium
ESVKGVTEETTTG

SEQ ID NO: 472770 - protein, 8 aa, Mycobacterium
ESVKPANL

SEQ ID NO: 472771 - protein, 15 aa, Mycobacterium
ESVNGASAQSAGGKK

SEQ ID NO: 472772 - protein, 6 aa, Mycobacterium
ESVPAR

SEQ ID NO: 472773 - protein, 8 aa, Mycobacterium
ESVPDPKI

SEQ ID NO: 472774 - protein, 13 aa, Mycobacterium
ESVPDPKIEKPTD

SEQ ID NO: 472775 - protein, 13 aa, Mycobacterium
ESVPDPKIEQPTD

SEQ ID NO: 472776 - protein, 6 aa, Mycobacterium
ESVPEG

SEQ ID NO: 472777 - protein, 9 aa, Mycobacterium
ESVPGAHPA

SEQ ID NO: 472778 - protein, 6 aa, Mycobacterium
ESVPGD

SEQ ID NO: 472779 - protein, 12 aa, Mycobacterium
ESVPPADEVGAG

SEQ ID NO: 472780 - protein, 6 aa, Mycobacterium
ESVPPT

SEQ ID NO: 472781 - protein, 17 aa, Mycobacterium
ESVPQGGGLVTENESVE

SEQ ID NO: 472782 - protein, 7 aa, Mycobacterium
ESVPRRG

SEQ ID NO: 472783 - protein, 7 aa, Mycobacterium
ESVPSGL

SEQ ID NO: 472784 - protein, 6 aa, Mycobacterium
ESVPYA

SEQ ID NO: 472785 - protein, 4 aa, Mycobacterium
ESVQ

SEQ ID NO: 472786 - protein, 9 aa, Mycobacterium
ESVQTGQAL

SEQ ID NO: 472787 - protein, 19 aa, Mycobacterium
ESVRAKDEALQELHGKVTG

SEQ ID NO: 472788 - protein, 5 aa, Mycobacterium
ESVRD

SEQ ID NO: 472789 - protein, 9 aa, Mycobacterium
ESVRKSDGG

SEQ ID NO: 472790 - protein, 6 aa, Mycobacterium
ESVSAR

SEQ ID NO: 472791 - protein, 10 aa, Mycobacterium
ESVSASLPAS

SEQ ID NO: 472792 - protein, 12 aa, Mycobacterium
ESVSDEKKTALG

SEQ ID NO: 472793 - protein, 5 aa, Mycobacterium
ESVSR

SEQ ID NO: 472794 - protein, 8 aa, Mycobacterium
ESVSSQSE

SEQ ID NO: 472795 - protein, 7 aa, Mycobacterium
ESVSSTG

SEQ ID NO: 472796 - protein, 4 aa, Mycobacterium
ESVT

SEQ ID NO: 472797 - protein, 6 aa, Mycobacterium
ESVTAP

SEQ ID NO: 472798 - protein, 7 aa, Mycobacterium
ESVTDDE

SEQ ID NO: 472799 - protein, 8 aa, Mycobacterium
ESVTDGQS

SEQ ID NO: 472800 - protein, 16 aa, Mycobacterium
ESVTEAPAVAGPAVET

SEQ ID NO: 472801 - protein, 14 aa, Mycobacterium
ESVTSSGATANSID

SEQ ID NO: 472802 - protein, 6 aa, Mycobacterium
ESVTVP

SEQ ID NO: 472803 - protein, 11 aa, Mycobacterium
ESWGDEHRREA

SEQ ID NO: 472804 - protein, 10 aa, Mycobacterium
ESWGSDERRD

SEQ ID NO: 472805 - protein, 11 aa, Mycobacterium
ESWGSDERRDL

SEQ ID NO: 472806 - protein, 4 aa, Mycobacterium
ESWP

SEQ ID NO: 472807 - protein, 7 aa, Mycobacterium
ESWRGEP

SEQ ID NO: 472808 - protein, 12 aa, Mycobacterium
ESWTGATGDAFR

SEQ ID NO: 472809 - protein, 18 aa, Mycobacterium
ESYAARRPHELSGGQQQR

SEQ ID NO: 472810 - protein, 10 aa, Mycobacterium
ESYAENADLP

SEQ ID NO: 472811 - protein, 13 aa, Mycobacterium
ESYAENADLREAT

SEQ ID NO: 472812 - protein, 10 aa, Mycobacterium
ESYAENASLE

SEQ ID NO: 472813 - protein, 5 aa, Mycobacterium
ESYDE

SEQ ID NO: 472814 - protein, 9 aa, Mycobacterium
ESYDGPVAS

SEQ ID NO: 472815 - protein, 6 aa, Mycobacterium
ESYDPP

SEQ ID NO: 472816 - protein, 5 aa, Mycobacterium
ESYDS

SEQ ID NO: 472817 - protein, 18 aa, Mycobacterium
ESYDSDLRDNYQENPRRA

SEQ ID NO: 472818 - protein, 16 aa, Mycobacterium
ESYDSTRFSGTLPAAA

SEQ ID NO: 472819 - protein, 7 aa, Mycobacterium
ESYEETE

SEQ ID NO: 472820 - protein, 7 aa, Mycobacterium
ESYEGKK

SEQ ID NO: 472821 - protein, 7 aa, Mycobacterium
ESYEQYY

SEQ ID NO: 472822 - protein, 5 aa, Mycobacterium
ESYGE

SEQ ID NO: 472823 - protein, 9 aa, Mycobacterium
ESYGGTPVS

SEQ ID NO: 472824 - protein, 6 aa, Mycobacterium
ESYHPE

SEQ ID NO: 472825 - protein, 9 aa, Mycobacterium
ESYKVSGTA

SEQ ID NO: 472826 - protein, 7 aa, Mycobacterium
ESYPADE

SEQ ID NO: 472827 - protein, 6 aa, Mycobacterium
ESYPDV

SEQ ID NO: 472828 - protein, 8 aa, Mycobacterium
ESYRDDPA

SEQ ID NO: 472829 - protein, 8 aa, Mycobacterium
ESYRRGSE

SEQ ID NO: 472830 - protein, 8 aa, Mycobacterium
ESYSPSEL

SEQ ID NO: 472831 - protein, 9 aa, Mycobacterium
ESYSTGGAR

SEQ ID NO: 472832 - protein, 9 aa, Mycobacterium
ESYTENASL

SEQ ID NO: 472833 - protein, 10 aa, Mycobacterium
ETAAAAGEIR

SEQ ID NO: 472834 - protein, 7 aa, Mycobacterium
ETAAAAR

SEQ ID NO: 472835 - protein, 7 aa, Mycobacterium
ETAAASA

SEQ ID NO: 472836 - protein, 6 aa, Mycobacterium
ETAADQ

SEQ ID NO: 472837 - protein, 22 aa, Mycobacterium
ETAADVGADTAKAIAASRQGPQ

SEQ ID NO: 472838 - protein, 8 aa, Mycobacterium
ETAAEAAA

SEQ ID NO: 472839 - protein, 8 aa, Mycobacterium
ETAAEAGF

SEQ ID NO: 472840 - protein, 12 aa, Mycobacterium
ETAAGDTPYPAA

SEQ ID NO: 472841 - protein, 8 aa, Mycobacterium
ETAAGSPI

SEQ ID NO: 472842 - protein, 13 aa, Mycobacterium
ETAAPSASPRGGP

SEQ ID NO: 472843 - protein, 9 aa, Mycobacterium
ETAAPVRAN

SEQ ID NO: 472844 - protein, 10 aa, Mycobacterium
ETAARYGASS

SEQ ID NO: 472845 - protein, 14 aa, Mycobacterium
ETAATLGTGGISAG

SEQ ID NO: 472846 - protein, 11 aa, Mycobacterium
ETAATLGTSVS

SEQ ID NO: 472847 - protein, 12 aa, Mycobacterium
ETADAGELEPGH

SEQ ID NO: 472848 - protein, 16 aa, Mycobacterium
ETADAGEPICDSGGSD

SEQ ID NO: 472849 - protein, 7 aa, Mycobacterium
ETADDRA

SEQ ID NO: 472850 - protein, 6 aa, Mycobacterium
ETADGI

SEQ ID NO: 472851 - protein, 6 aa, Mycobacterium
ETADGT

SEQ ID NO: 472852 - protein, 10 aa, Mycobacterium
ETADGTGELQ

SEQ ID NO: 472853 - protein, 6 aa, Mycobacterium
ETADGV

SEQ ID NO: 472854 - protein, 7 aa, Mycobacterium
ETADKGA

SEQ ID NO: 472855 - protein, 10 aa, Mycobacterium
ETADPIPGRG

SEQ ID NO: 472856 - protein, 6 aa, Mycobacterium
ETADPK

SEQ ID NO: 472857 - protein, 6 aa, Mycobacterium
ETADPV

SEQ ID NO: 472858 - protein, 9 aa, Mycobacterium
ETADQSELD

SEQ ID NO: 472859 - protein, 9 aa, Mycobacterium
ETADREDAV

SEQ ID NO: 472860 - protein, 6 aa, Mycobacterium
ETADSR

SEQ ID NO: 472861 - protein, 10 aa, Mycobacterium
ETAEAHYEDR

SEQ ID NO: 472862 - protein, 7 aa, Mycobacterium
ETAEASA

SEQ ID NO: 472863 - protein, 5 aa, Mycobacterium
ETAEE

SEQ ID NO: 472864 - protein, 12 aa, Mycobacterium
ETAEGFSGGEPF

SEQ ID NO: 472865 - protein, 5 aa, Mycobacterium
ETAEL

SEQ ID NO: 472866 - protein, 5 aa, Mycobacterium
ETAEP

SEQ ID NO: 472867 - protein, 9 aa, Mycobacterium
ETAEQGIGP

SEQ ID NO: 472868 - protein, 7 aa, Mycobacterium
ETAEQTA

SEQ ID NO: 472869 - protein, 6 aa, Mycobacterium
ETAERH

SEQ ID NO: 472870 - protein, 15 aa, Mycobacterium
ETAETARKRLADKGI

SEQ ID NO: 472871 - protein, 6 aa, Mycobacterium
ETAEWE

SEQ ID NO: 472872 - protein, 6 aa, Mycobacterium
ETAEYS

SEQ ID NO: 472873 - protein, 7 aa, Mycobacterium
ETAEYSL

SEQ ID NO: 472874 - protein, 7 aa, Mycobacterium
ETAGARE

SEQ ID NO: 472875 - protein, 7 aa, Mycobacterium
ETAGDFP

SEQ ID NO: 472876 - protein, 10 aa, Mycobacterium
ETAGDPDHPP

SEQ ID NO: 472877 - protein, 9 aa, Mycobacterium
ETAGDPERL

SEQ ID NO: 472878 - protein, 8 aa, Mycobacterium
ETAGERPI

SEQ ID NO: 472879 - protein, 10 aa, Mycobacterium
ETAGGTQRRE

SEQ ID NO: 472880 - protein, 12 aa, Mycobacterium
ETAGGTSSGVTG

SEQ ID NO: 472881 - protein, 10 aa, Mycobacterium
ETAGLDPKDI

SEQ ID NO: 472882 - protein, 9 aa, Mycobacterium
ETAGLDSTA

SEQ ID NO: 472883 - protein, 7 aa, Mycobacterium
ETAGQAE

SEQ ID NO: 472884 - protein, 5 aa, Mycobacterium
ETAGR

SEQ ID NO: 472885 - protein, 8 aa, Mycobacterium
ETAGRTPF

SEQ ID NO: 472886 - protein, 10 aa, Mycobacterium
ETAGSNPAPH

SEQ ID NO: 472887 - protein, 6 aa, Mycobacterium
ETAGTP

SEQ ID NO: 472888 - protein, 20 aa, Mycobacterium
ETAGVGVSSEPEVTERDDEF

SEQ ID NO: 472889 - protein, 6 aa, Mycobacterium
ETAGVS

SEQ ID NO: 472890 - protein, 8 aa, Mycobacterium
ETAHQRDT

SEQ ID NO: 472891 - protein, 10 aa, Mycobacterium
ETAKSQATSI

SEQ ID NO: 472892 - protein, 9 aa, Mycobacterium
ETAKTVRRE

SEQ ID NO: 472893 - protein, 4 aa, Mycobacterium
ETAL

SEQ ID NO: 472894 - protein, 5 aa, Mycobacterium
ETALA

SEQ ID NO: 472895 - protein, 5 aa, Mycobacterium
ETALD

SEQ ID NO: 472896 - protein, 15 aa, Mycobacterium
ETALRATDNAARARQ

SEQ ID NO: 472897 - protein, 9 aa, Mycobacterium
ETANAPQPA

SEQ ID NO: 472898 - protein, 6 aa, Mycobacterium
ETANQP

SEQ ID NO: 472899 - protein, 4 aa, Mycobacterium
ETAP

SEQ ID NO: 472900 - protein, 7 aa, Mycobacterium
ETAPAYA

SEQ ID NO: 472901 - protein, 6 aa, Mycobacterium
ETAPEG

SEQ ID NO: 472902 - protein, 18 aa, Mycobacterium
ETAPPQDEAPPAAQPEPV

SEQ ID NO: 472903 - protein, 8 aa, Mycobacterium
ETAPPRGF

SEQ ID NO: 472904 - protein, 7 aa, Mycobacterium
ETAPPVD

SEQ ID NO: 472905 - protein, 10 aa, Mycobacterium
ETAPTDATHW

SEQ ID NO: 472906 - protein, 5 aa, Mycobacterium
ETAQQ

SEQ ID NO: 472907 - protein, 10 aa, Mycobacterium
ETAQRAFGDA

SEQ ID NO: 472908 - protein, 14 aa, Mycobacterium
ETAQVEGGDLLVVI

SEQ ID NO: 472909 - protein, 4 aa, Mycobacterium
ETAR

SEQ ID NO: 472910 - protein, 20 aa, Mycobacterium
ETARAQGGTVVGGERRELGD

SEQ ID NO: 472911 - protein, 10 aa, Mycobacterium
ETARGGGNEI

SEQ ID NO: 472912 - protein, 9 aa, Mycobacterium
ETARGPRNR

SEQ ID NO: 472913 - protein, 5 aa, Mycobacterium
ETARL

SEQ ID NO: 472914 - protein, 6 aa, Mycobacterium
ETARNA

SEQ ID NO: 472915 - protein, 6 aa, Mycobacterium
ETARRA

SEQ ID NO: 472916 - protein, 10 aa, Mycobacterium
ETARRRDDGN

SEQ ID NO: 472917 - protein, 11 aa, Mycobacterium
ETARRRDDGND

SEQ ID NO: 472918 - protein, 10 aa, Mycobacterium
ETARRRDGAN

SEQ ID NO: 472919 - protein, 11 aa, Mycobacterium
ETARRRGSRAH

SEQ ID NO: 472920 - protein, 8 aa, Mycobacterium
ETASATTE

SEQ ID NO: 472921 - protein, 17 aa, Mycobacterium
ETASEEQLAGTEGVGPT

SEQ ID NO: 472922 - protein, 10 aa, Mycobacterium
ETASELPDGQ

SEQ ID NO: 472923 - protein, 8 aa, Mycobacterium
ETASESLH

SEQ ID NO: 472924 - protein, 15 aa, Mycobacterium
ETASHSDPLTGLSDQ

SEQ ID NO: 472925 - protein, 6 aa, Mycobacterium
ETASPA

SEQ ID NO: 472926 - protein, 9 aa, Mycobacterium
ETASRHGQR

SEQ ID NO: 472927 - protein, 8 aa, Mycobacterium
ETASRTQA

SEQ ID NO: 472928 - protein, 8 aa, Mycobacterium
ETASSERG

SEQ ID NO: 472929 - protein, 6 aa, Mycobacterium
ETASSK

SEQ ID NO: 472930 - protein, 11 aa, Mycobacterium
ETASSKEWNGF

SEQ ID NO: 472931 - protein, 11 aa, Mycobacterium
ETASTDDLGKT

SEQ ID NO: 472932 - protein, 5 aa, Mycobacterium
ETASV

SEQ ID NO: 472933 - protein, 5 aa, Mycobacterium
ETATA

SEQ ID NO: 472934 - protein, 8 aa, Mycobacterium
ETATADHG

SEQ ID NO: 472935 - protein, 23 aa, Mycobacterium
ETATNARDAAGAAGDSARSGVDP

SEQ ID NO: 472936 - protein, 11 aa, Mycobacterium
ETATPPARPQL

SEQ ID NO: 472937 - protein, 7 aa, Mycobacterium
ETATRKA

SEQ ID NO: 472938 - protein, 5 aa, Mycobacterium
ETATV

SEQ ID NO: 472939 - protein, 9 aa, Mycobacterium
ETATVDRRD

SEQ ID NO: 472940 - protein, 7 aa, Mycobacterium
ETATYSL

SEQ ID NO: 472941 - protein, 4 aa, Mycobacterium
ETAV

SEQ ID NO: 472942 - protein, 11 aa, Mycobacterium
ETAVGKTAVSS

SEQ ID NO: 472943 - protein, 11 aa, Mycobacterium
ETAVRQSDYGV

SEQ ID NO: 472944 - protein, 4 aa, Mycobacterium
ETAY

SEQ ID NO: 472945 - protein, 5 aa, Mycobacterium
ETAYG

SEQ ID NO: 472946 - protein, 8 aa, Mycobacterium
ETCPSSDG

SEQ ID NO: 472947 - protein, 9 aa, Mycobacterium
ETCPSSDGA

SEQ ID NO: 472948 - protein, 10 aa, Mycobacterium
ETCSPSTDST

SEQ ID NO: 472949 - protein, 5 aa, Mycobacterium
ETCTC

SEQ ID NO: 472950 - protein, 6 aa, Mycobacterium
ETCVEG

SEQ ID NO: 472951 - protein, 7 aa, Mycobacterium
ETDAAYD

SEQ ID NO: 472952 - protein, 5 aa, Mycobacterium
ETDAD

SEQ ID NO: 472953 - protein, 10 aa, Mycobacterium
ETDAEQLPEL

SEQ ID NO: 472954 - protein, 7 aa, Mycobacterium
ETDAETL

SEQ ID NO: 472955 - protein, 6 aa, Mycobacterium
ETDAGT

SEQ ID NO: 472956 - protein, 8 aa, Mycobacterium
ETDAGTSE

SEQ ID NO: 472957 - protein, 7 aa, Mycobacterium
ETDAHRD

SEQ ID NO: 472958 - protein, 9 aa, Mycobacterium
ETDALPLGP

SEQ ID NO: 472959 - protein, 9 aa, Mycobacterium
ETDATAPPE

SEQ ID NO: 472960 - protein, 8 aa, Mycobacterium
ETDDAGRA

SEQ ID NO: 472961 - protein, 7 aa, Mycobacterium
ETDDDFA

SEQ ID NO: 472962 - protein, 8 aa, Mycobacterium
ETDDDGNV

SEQ ID NO: 472963 - protein, 8 aa, Mycobacterium
ETDDDRNV

SEQ ID NO: 472964 - protein, 10 aa, Mycobacterium
ETDDESTADV

SEQ ID NO: 472965 - protein, 6 aa, Mycobacterium
ETDDPD

SEQ ID NO: 472966 - protein, 8 aa, Mycobacterium
ETDEDALA

SEQ ID NO: 472967 - protein, 11 aa, Mycobacterium
ETDEGDAFTDT

SEQ ID NO: 472968 - protein, 9 aa, Mycobacterium
ETDEGPDAQ

SEQ ID NO: 472969 - protein, 5 aa, Mycobacterium
ETDEH

SEQ ID NO: 472970 - protein, 8 aa, Mycobacterium
ETDELDPV

SEQ ID NO: 472971 - protein, 6 aa, Mycobacterium
ETDEMK

SEQ ID NO: 472972 - protein, 10 aa, Mycobacterium
ETDEQAEDPE

SEQ ID NO: 472973 - protein, 8 aa, Mycobacterium
ETDERPYV

SEQ ID NO: 472974 - protein, 7 aa, Mycobacterium
ETDEVPA

SEQ ID NO: 472975 - protein, 7 aa, Mycobacterium
ETDGAPP

SEQ ID NO: 472976 - protein, 7 aa, Mycobacterium
ETDGDWP

SEQ ID NO: 472977 - protein, 5 aa, Mycobacterium
ETDGG

SEQ ID NO: 472978 - protein, 11 aa, Mycobacterium
ETDGGDATAPH

SEQ ID NO: 472979 - protein, 8 aa, Mycobacterium
ETDGQGGG

SEQ ID NO: 472980 - protein, 7 aa, Mycobacterium
ETDGRAA

SEQ ID NO: 472981 - protein, 6 aa, Mycobacterium
ETDGSY

SEQ ID NO: 472982 - protein, 4 aa, Mycobacterium
ETDH

SEQ ID NO: 472983 - protein, 5 aa, Mycobacterium
ETDHP

SEQ ID NO: 472984 - protein, 7 aa, Mycobacterium
ETDIPPG

SEQ ID NO: 472985 - protein, 6 aa, Mycobacterium
ETDKGK

SEQ ID NO: 472986 - protein, 14 aa, Mycobacterium
ETDLAGAAASVGRG

SEQ ID NO: 472987 - protein, 7 aa, Mycobacterium
ETDLNSV

SEQ ID NO: 472988 - protein, 6 aa, Mycobacterium
ETDLTT

SEQ ID NO: 472989 - protein, 8 aa, Mycobacterium
ETDNSTRQ

SEQ ID NO: 472990 - protein, 26 aa, Mycobacterium
ETDPARDESAPVPSRSGARTRAAGGY

SEQ ID NO: 472991 - protein, 6 aa, Mycobacterium
ETDPCR

SEQ ID NO: 472992 - protein, 10 aa, Mycobacterium
ETDPDHVTRR

SEQ ID NO: 472993 - protein, 6 aa, Mycobacterium
ETDPES

SEQ ID NO: 472994 - protein, 12 aa, Mycobacterium
ETDPHGWDAGED

SEQ ID NO: 472995 - protein, 10 aa, Mycobacterium
ETDPIDPPVP

SEQ ID NO: 472996 - protein, 15 aa, Mycobacterium
ETDPLGGDDPYSASK

SEQ ID NO: 472997 - protein, 8 aa, Mycobacterium
ETDPTAQK

SEQ ID NO: 472998 - protein, 6 aa, Mycobacterium
ETDPVK

SEQ ID NO: 472999 - protein, 14 aa, Mycobacterium
ETDPYSPPLQRDPI

SEQ ID NO: 473000 - protein, 7 aa, Mycobacterium
ETDQHRE

SEQ ID NO: 473001 - protein, 6 aa, Mycobacterium
ETDQRD

SEQ ID NO: 473002 - protein, 4 aa, Mycobacterium
ETDR

SEQ ID NO: 473003 - protein, 5 aa, Mycobacterium
ETDRG

SEQ ID NO: 473004 - protein, 8 aa, Mycobacterium
ETDRGEEL

SEQ ID NO: 473005 - protein, 13 aa, Mycobacterium
ETDRGKALAASLG

SEQ ID NO: 473006 - protein, 6 aa, Mycobacterium
ETDRPR

SEQ ID NO: 473007 - protein, 6 aa, Mycobacterium
ETDRPS

SEQ ID NO: 473008 - protein, 5 aa, Mycobacterium
ETDRV

SEQ ID NO: 473009 - protein, 14 aa, Mycobacterium
ETDSGSEELDSADA

SEQ ID NO: 473010 - protein, 10 aa, Mycobacterium
ETDSPLEGDA

SEQ ID NO: 473011 - protein, 10 aa, Mycobacterium
ETDSPTEELP

SEQ ID NO: 473012 - protein, 8 aa, Mycobacterium
ETDTDPNF

SEQ ID NO: 473013 - protein, 5 aa, Mycobacterium
ETDTI

SEQ ID NO: 473014 - protein, 5 aa, Mycobacterium
ETDTP

SEQ ID NO: 473015 - protein, 6 aa, Mycobacterium
ETDTPG

SEQ ID NO: 473016 - protein, 4 aa, Mycobacterium
ETDV

SEQ ID NO: 473017 - protein, 10 aa, Mycobacterium
ETDVPEPDEG

SEQ ID NO: 473018 - protein, 8 aa, Mycobacterium
ETDWSTNR

SEQ ID NO: 473019 - protein, 6 aa, Mycobacterium
ETDYGA

SEQ ID NO: 473020 - protein, 6 aa, Mycobacterium
ETDYGL

SEQ ID NO: 473021 - protein, 8 aa, Mycobacterium
ETEAAARV

SEQ ID NO: 473022 - protein, 5 aa, Mycobacterium
ETEAD

SEQ ID NO: 473023 - protein, 5 aa, Mycobacterium
ETEAE

SEQ ID NO: 473024 - protein, 8 aa, Mycobacterium
ETEAEEMA

SEQ ID NO: 473025 - protein, 9 aa, Mycobacterium
ETEAEQMAG

SEQ ID NO: 473026 - protein, 6 aa, Mycobacterium
ETEAGP

SEQ ID NO: 473027 - protein, 8 aa, Mycobacterium
ETEANRSA

SEQ ID NO: 473028 - protein, 5 aa, Mycobacterium
ETEAQ

SEQ ID NO: 473029 - protein, 7 aa, Mycobacterium
ETEASAE

SEQ ID NO: 473030 - protein, 5 aa, Mycobacterium
ETEAT

SEQ ID NO: 473031 - protein, 20 aa, Mycobacterium
ETEAVNAAERAAGTLPGARP

SEQ ID NO: 473032 - protein, 16 aa, Mycobacterium
ETECETRRRTAAAAAR

SEQ ID NO: 473033 - protein, 4 aa, Mycobacterium
ETEE

SEQ ID NO: 473034 - protein, 7 aa, Mycobacterium
ETEEAKE

SEQ ID NO: 473035 - protein, 8 aa, Mycobacterium
ETEEPDSE

SEQ ID NO: 473036 - protein, 8 aa, Mycobacterium
ETEEPQGV

SEQ ID NO: 473037 - protein, 8 aa, Mycobacterium
ETEERDLA

SEQ ID NO: 473038 - protein, 5 aa, Mycobacterium
ETEFK

SEQ ID NO: 473039 - protein, 6 aa, Mycobacterium
ETEFPS

SEQ ID NO: 473040 - protein, 9 aa, Mycobacterium
ETEGDDDFP

SEQ ID NO: 473041 - protein, 15 aa, Mycobacterium
ETEGDPFFDFEAVGG

SEQ ID NO: 473042 - protein, 8 aa, Mycobacterium
ETEGFRSA

SEQ ID NO: 473043 - protein, 8 aa, Mycobacterium
ETEGMAEN

SEQ ID NO: 473044 - protein, 8 aa, Mycobacterium
ETEGPAYA

SEQ ID NO: 473045 - protein, 7 aa, Mycobacterium
ETEGPGE

SEQ ID NO: 473046 - protein, 5 aa, Mycobacterium
ETEGQ

SEQ ID NO: 473047 - protein, 7 aa, Mycobacterium
ETEGRPR

SEQ ID NO: 473048 - protein, 4 aa, Mycobacterium
ETEH

SEQ ID NO: 473049 - protein, 7 aa, Mycobacterium
ETEKQPT

SEQ ID NO: 473050 - protein, 4 aa, Mycobacterium
ETEL

SEQ ID NO: 473051 - protein, 18 aa, Mycobacterium
ETELGRKTRIDQSTCNTD

SEQ ID NO: 473052 - protein, 12 aa, Mycobacterium
ETELKAAREGKI

SEQ ID NO: 473053 - protein, 5 aa, Mycobacterium
ETELT

SEQ ID NO: 473054 - protein, 6 aa, Mycobacterium
ETEMPA

SEQ ID NO: 473055 - protein, 12 aa, Mycobacterium
ETEMTSEFGSTA

SEQ ID NO: 473056 - protein, 7 aa, Mycobacterium
ETENEHA

SEQ ID NO: 473057 - protein, 9 aa, Mycobacterium
ETENSRPAR

SEQ ID NO: 473058 - protein, 6 aa, Mycobacterium
ETEPAA

SEQ ID NO: 473059 - protein, 8 aa, Mycobacterium
ETEPGRKL

SEQ ID NO: 473060 - protein, 6 aa, Mycobacterium
ETEPGV

SEQ ID NO: 473061 - protein, 6 aa, Mycobacterium
ETEPKV

SEQ ID NO: 473062 - protein, 6 aa, Mycobacterium
ETEPSL

SEQ ID NO: 473063 - protein, 5 aa, Mycobacterium
ETEPT

SEQ ID NO: 473064 - protein, 8 aa, Mycobacterium
ETEPTHRP

SEQ ID NO: 473065 - protein, 14 aa, Mycobacterium
ETEPYAGSITRTGE

SEQ ID NO: 473066 - protein, 14 aa, Mycobacterium
ETEPYAGSVARAGE

SEQ ID NO: 473067 - protein, 11 aa, Mycobacterium
ETEQAGASEYR

SEQ ID NO: 473068 - protein, 8 aa, Mycobacterium
ETERAGKA

SEQ ID NO: 473069 - protein, 12 aa, Mycobacterium
ETERDRGAAPVT

SEQ ID NO: 473070 - protein, 8 aa, Mycobacterium
ETERGVVS

SEQ ID NO: 473071 - protein, 11 aa, Mycobacterium
ETESDLGGYKD

SEQ ID NO: 473072 - protein, 7 aa, Mycobacterium
ETESGPF

SEQ ID NO: 473073 - protein, 5 aa, Mycobacterium
ETESN

SEQ ID NO: 473074 - protein, 8 aa, Mycobacterium
ETESRDSG

SEQ ID NO: 473075 - protein, 50 aa, Mycobacterium
ETESSEQAAEPVAGAVTPAPAVTPERVGGKGDDAQSPPADALTAEPIPAH

SEQ ID NO: 473076 - protein, 13 aa, Mycobacterium
ETETAKWRDPTGT

SEQ ID NO: 473077 - protein, 8 aa, Mycobacterium
ETETDAAR

SEQ ID NO: 473078 - protein, 7 aa, Mycobacterium
ETETPAT

SEQ ID NO: 473079 - protein, 11 aa, Mycobacterium
ETETRAAEARY

SEQ ID NO: 473080 - protein, 8 aa, Mycobacterium
ETETTRCG

SEQ ID NO: 473081 - protein, 4 aa, Mycobacterium
ETEV

SEQ ID NO: 473082 - protein, 14 aa, Mycobacterium
ETEVLDTDSEGRVK

SEQ ID NO: 473083 - protein, 5 aa, Mycobacterium
ETEVN

SEQ ID NO: 473084 - protein, 19 aa, Mycobacterium
ETEVNGQAATPAATTEKDI

SEQ ID NO: 473085 - protein, 17 aa, Mycobacterium
ETEVTDKRESKSRPGEG

SEQ ID NO: 473086 - protein, 4 aa, Mycobacterium
ETEW

SEQ ID NO: 473087 - protein, 7 aa, Mycobacterium
ETEWPTG

SEQ ID NO: 473088 - protein, 15 aa, Mycobacterium
ETEWSASGRHTGRTD

SEQ ID NO: 473089 - protein, 15 aa, Mycobacterium
ETEWSKSGKHTSSTE

SEQ ID NO: 473090 - protein, 15 aa, Mycobacterium
ETEWSKSGQHTGRTD

SEQ ID NO: 473091 - protein, 4 aa, Mycobacterium
ETFA

SEQ ID NO: 473092 - protein, 6 aa, Mycobacterium
ETFAEK

SEQ ID NO: 473093 - protein, 12 aa, Mycobacterium
ETFAESGWAGTT

SEQ ID NO: 473094 - protein, 15 aa, Mycobacterium
ETFARKGYDAASVEE

SEQ ID NO: 473095 - protein, 6 aa, Mycobacterium
ETFDNK

SEQ ID NO: 473096 - protein, 4 aa, Mycobacterium
ETFE

SEQ ID NO: 473097 - protein, 8 aa, Mycobacterium
ETFEADGR

SEQ ID NO: 473098 - protein, 5 aa, Mycobacterium
ETFER

SEQ ID NO: 473099 - protein, 4 aa, Mycobacterium
ETFG

SEQ ID NO: 473100 - protein, 19 aa, Mycobacterium
ETFGGDEADGASRKKLPSV

SEQ ID NO: 473101 - protein, 20 aa, Mycobacterium
ETFGGDEGSGPGRKKLPSVQ

SEQ ID NO: 473102 - protein, 31 aa, Mycobacterium
ETFGGDESGAGGHEAGGGAGPSRSRKKLPSV

SEQ ID NO: 473103 - protein, 7 aa, Mycobacterium
ETFGGGR

SEQ ID NO: 473104 - protein, 5 aa, Mycobacterium
ETFGP

SEQ ID NO: 473105 - protein, 8 aa, Mycobacterium
ETFGPAAR

SEQ ID NO: 473106 - protein, 14 aa, Mycobacterium
ETFGPDRVSTAENL

SEQ ID NO: 473107 - protein, 7 aa, Mycobacterium
ETFGRPL

SEQ ID NO: 473108 - protein, 10 aa, Mycobacterium
ETFLGPDERA

SEQ ID NO: 473109 - protein, 11 aa, Mycobacterium
ETFPADNPNRQ

SEQ ID NO: 473110 - protein, 13 aa, Mycobacterium
ETFPGPGVATDDE

SEQ ID NO: 473111 - protein, 7 aa, Mycobacterium
ETFPPTM

SEQ ID NO: 473112 - protein, 10 aa, Mycobacterium
ETFSSGPGDM

SEQ ID NO: 473113 - protein, 12 aa, Mycobacterium
ETFTAADETDTV

SEQ ID NO: 473114 - protein, 4 aa, Mycobacterium
ETFY

SEQ ID NO: 473115 - protein, 11 aa, Mycobacterium
ETGAAAGRDAR

SEQ ID NO: 473116 - protein, 10 aa, Mycobacterium
ETGAASTAVP

SEQ ID NO: 473117 - protein, 6 aa, Mycobacterium
ETGACR

SEQ ID NO: 473118 - protein, 6 aa, Mycobacterium
ETGAGE

SEQ ID NO: 473119 - protein, 5 aa, Mycobacterium
ETGAI

SEQ ID NO: 473120 - protein, 52 aa, Mycobacterium
ETGAKKPDDSTKASAKKMRQGTQQAVKKAQDRVNKVAENGRKQVKAVTDGVK

SEQ ID NO: 473121 - protein, 9 aa, Mycobacterium
ETGALGNRR

SEQ ID NO: 473122 - protein, 5 aa, Mycobacterium
ETGAP

SEQ ID NO: 473123 - protein, 12 aa, Mycobacterium
ETGAPEASEPTL

SEQ ID NO: 473124 - protein, 7 aa, Mycobacterium
ETGARGL

SEQ ID NO: 473125 - protein, 11 aa, Mycobacterium
ETGASAAEQLT

SEQ ID NO: 473126 - protein, 11 aa, Mycobacterium
ETGASSGRDAR

SEQ ID NO: 473127 - protein, 8 aa, Mycobacterium
ETGATPED

SEQ ID NO: 473128 - protein, 11 aa, Mycobacterium
ETGAVKAAADA

SEQ ID NO: 473129 - protein, 6 aa, Mycobacterium
ETGAYG

SEQ ID NO: 473130 - protein, 5 aa, Mycobacterium
ETGCT

SEQ ID NO: 473131 - protein, 4 aa, Mycobacterium
ETGD

SEQ ID NO: 473132 - protein, 5 aa, Mycobacterium
ETGDD

SEQ ID NO: 473133 - protein, 6 aa, Mycobacterium
ETGDDD

SEQ ID NO: 473134 - protein, 7 aa, Mycobacterium
ETGDDSL

SEQ ID NO: 473135 - protein, 6 aa, Mycobacterium
ETGDIK

SEQ ID NO: 473136 - protein, 10 aa, Mycobacterium
ETGDPQAAAD

SEQ ID NO: 473137 - protein, 5 aa, Mycobacterium
ETGDR

SEQ ID NO: 473138 - protein, 9 aa, Mycobacterium
ETGDTGDTV

SEQ ID NO: 473139 - protein, 8 aa, Mycobacterium
ETGDTPTI

SEQ ID NO: 473140 - protein, 5 aa, Mycobacterium
ETGDV

SEQ ID NO: 473141 - protein, 5 aa, Mycobacterium
ETGED

SEQ ID NO: 473142 - protein, 6 aa, Mycobacterium
ETGEDF

SEQ ID NO: 473143 - protein, 10 aa, Mycobacterium
ETGEDHLGRS

SEQ ID NO: 473144 - protein, 9 aa, Mycobacterium
ETGEEGREQ

SEQ ID NO: 473145 - protein, 11 aa, Mycobacterium
ETGEPDGRSLT

SEQ ID NO: 473146 - protein, 7 aa, Mycobacterium
ETGEPIC

SEQ ID NO: 473147 - protein, 19 aa, Mycobacterium
ETGEPKQHRTVEQRTEDVL

SEQ ID NO: 473148 - protein, 10 aa, Mycobacterium
ETGEPQSGAE

SEQ ID NO: 473149 - protein, 11 aa, Mycobacterium
ETGEPQSGTEW

SEQ ID NO: 473150 - protein, 19 aa, Mycobacterium
ETGEPVSAGEVGEIQARST

SEQ ID NO: 473151 - protein, 7 aa, Mycobacterium
ETGEQTE

SEQ ID NO: 473152 - protein, 11 aa, Mycobacterium
ETGERTPRKNE

SEQ ID NO: 473153 - protein, 12 aa, Mycobacterium
ETGERVPHGQRG

SEQ ID NO: 473154 - protein, 6 aa, Mycobacterium
ETGEVP

SEQ ID NO: 473155 - protein, 4 aa, Mycobacterium
ETGG

SEQ ID NO: 473156 - protein, 33 aa, Mycobacterium
ETGGAETVEEGEEEAQEAAAPEPPPAPESPPVT

SEQ ID NO: 473157 - protein, 15 aa, Mycobacterium
ETGGARMGDKPDNSV

SEQ ID NO: 473158 - protein, 9 aa, Mycobacterium
ETGGQARVT

SEQ ID NO: 473159 - protein, 11 aa, Mycobacterium
ETGGQRRAVRT

SEQ ID NO: 473160 - protein, 4 aa, Mycobacterium
ETGH

SEQ ID NO: 473161 - protein, 21 aa, Mycobacterium
ETGHGSDVQSIETTATYDPAT

SEQ ID NO: 473162 - protein, 21 aa, Mycobacterium
ETGHGSDVQSLETTATYDAAT

SEQ ID NO: 473163 - protein, 21 aa, Mycobacterium
ETGHGSDVQSLETTATYDAET

SEQ ID NO: 473164 - protein, 21 aa, Mycobacterium
ETGHGSDVQSLETTATYDPAT

SEQ ID NO: 473165 - protein, 22 aa, Mycobacterium
ETGHGSDVQSLETTATYDPETE

SEQ ID NO: 473166 - protein, 8 aa, Mycobacterium
ETGHGSNV

SEQ ID NO: 473167 - protein, 6 aa, Mycobacterium
ETGIEG

SEQ ID NO: 473168 - protein, 5 aa, Mycobacterium
ETGIK

SEQ ID NO: 473169 - protein, 10 aa, Mycobacterium
ETGKGTNEDI

SEQ ID NO: 473170 - protein, 10 aa, Mycobacterium
ETGKGTREDI

SEQ ID NO: 473171 - protein, 11 aa, Mycobacterium
ETGKPASDLRL

SEQ ID NO: 473172 - protein, 16 aa, Mycobacterium
ETGKRLGPDPRTFNFT

SEQ ID NO: 473173 - protein, 11 aa, Mycobacterium
ETGKSAVDAAQ

SEQ ID NO: 473174 - protein, 11 aa, Mycobacterium
ETGKSKIDGGI

SEQ ID NO: 473175 - protein, 9 aa, Mycobacterium
ETGKTYEDA

SEQ ID NO: 473176 - protein, 4 aa, Mycobacterium
ETGL

SEQ ID NO: 473177 - protein, 5 aa, Mycobacterium
ETGLD

SEQ ID NO: 473178 - protein, 39 aa, Mycobacterium
ETGLDESLSETLDDSGLDDEARHAHQASQDALGGTAGSP

SEQ ID NO: 473179 - protein, 9 aa, Mycobacterium
ETGLEGSSQ

SEQ ID NO: 473180 - protein, 5 aa, Mycobacterium
ETGLR

SEQ ID NO: 473181 - protein, 16 aa, Mycobacterium
ETGLTASVGAGSGKQI

SEQ ID NO: 473182 - protein, 7 aa, Mycobacterium
ETGNFGN

SEQ ID NO: 473183 - protein, 9 aa, Mycobacterium
ETGNGAMRQ

SEQ ID NO: 473184 - protein, 6 aa, Mycobacterium
ETGNGH

SEQ ID NO: 473185 - protein, 4 aa, Mycobacterium
ETGP

SEQ ID NO: 473186 - protein, 5 aa, Mycobacterium
ETGPA

SEQ ID NO: 473187 - protein, 10 aa, Mycobacterium
ETGPADGEIP

SEQ ID NO: 473188 - protein, 9 aa, Mycobacterium
ETGPAGPFD

SEQ ID NO: 473189 - protein, 10 aa, Mycobacterium
ETGPDDGGFA

SEQ ID NO: 473190 - protein, 10 aa, Mycobacterium
ETGPDGRDRT

SEQ ID NO: 473191 - protein, 21 aa, Mycobacterium
ETGPHRPPHQPAGPPGTGPSI

SEQ ID NO: 473192 - protein, 8 aa, Mycobacterium
ETGPIGSG

SEQ ID NO: 473193 - protein, 6 aa, Mycobacterium
ETGPRT

SEQ ID NO: 473194 - protein, 4 aa, Mycobacterium
ETGQ

SEQ ID NO: 473195 - protein, 10 aa, Mycobacterium
ETGQGALAQP

SEQ ID NO: 473196 - protein, 7 aa, Mycobacterium
ETGQPPT

SEQ ID NO: 473197 - protein, 9 aa, Mycobacterium
ETGQPPTTV

SEQ ID NO: 473198 - protein, 7 aa, Mycobacterium
ETGQPQT

SEQ ID NO: 473199 - protein, 7 aa, Mycobacterium
ETGQPVA

SEQ ID NO: 473200 - protein, 8 aa, Mycobacterium
ETGQREEL

SEQ ID NO: 473201 - protein, 15 aa, Mycobacterium
ETGRASSSDPAEGYR

SEQ ID NO: 473202 - protein, 7 aa, Mycobacterium
ETGRDPA

SEQ ID NO: 473203 - protein, 12 aa, Mycobacterium
ETGRERPPGERG

SEQ ID NO: 473204 - protein, 8 aa, Mycobacterium
ETGRGGHD

SEQ ID NO: 473205 - protein, 9 aa, Mycobacterium
ETGRGTEAD

SEQ ID NO: 473206 - protein, 9 aa, Mycobacterium
ETGRGTHED

SEQ ID NO: 473207 - protein, 6 aa, Mycobacterium
ETGRHE

SEQ ID NO: 473208 - protein, 11 aa, Mycobacterium
ETGRIPPQPVE

SEQ ID NO: 473209 - protein, 7 aa, Mycobacterium
ETGRPEL

SEQ ID NO: 473210 - protein, 11 aa, Mycobacterium
ETGRQAVDDGY

SEQ ID NO: 473211 - protein, 14 aa, Mycobacterium
ETGRQILDRSGFAK

SEQ ID NO: 473212 - protein, 7 aa, Mycobacterium
ETGRRLG

SEQ ID NO: 473213 - protein, 11 aa, Mycobacterium
ETGRSGSDGGF

SEQ ID NO: 473214 - protein, 6 aa, Mycobacterium
ETGRTD

SEQ ID NO: 473215 - protein, 6 aa, Mycobacterium
ETGRTP

SEQ ID NO: 473216 - protein, 11 aa, Mycobacterium
ETGRVASAKQA

SEQ ID NO: 473217 - protein, 4 aa, Mycobacterium
ETGS

SEQ ID NO: 473218 - protein, 5 aa, Mycobacterium
ETGSA

SEQ ID NO: 473219 - protein, 11 aa, Mycobacterium
ETGSAGATRRH

SEQ ID NO: 473220 - protein, 11 aa, Mycobacterium
ETGSAPSPSQI

SEQ ID NO: 473221 - protein, 11 aa, Mycobacterium
ETGSGPGAGNA

SEQ ID NO: 473222 - protein, 9 aa, Mycobacterium
ETGSGSDHD

SEQ ID NO: 473223 - protein, 5 aa, Mycobacterium
ETGSH

SEQ ID NO: 473224 - protein, 7 aa, Mycobacterium
ETGSHAP

SEQ ID NO: 473225 - protein, 7 aa, Mycobacterium
ETGSHAS

SEQ ID NO: 473226 - protein, 9 aa, Mycobacterium
ETGSKTLKD

SEQ ID NO: 473227 - protein, 7 aa, Mycobacterium
ETGSPAI

SEQ ID NO: 473228 - protein, 6 aa, Mycobacterium
ETGSPT

SEQ ID NO: 473229 - protein, 7 aa, Mycobacterium
ETGSTGD

SEQ ID NO: 473230 - protein, 8 aa, Mycobacterium
ETGSTNAD

SEQ ID NO: 473231 - protein, 10 aa, Mycobacterium
ETGSVPSPSQ

SEQ ID NO: 473232 - protein, 11 aa, Mycobacterium
ETGSVPSPSQI

SEQ ID NO: 473233 - protein, 5 aa, Mycobacterium
ETGSY

SEQ ID NO: 473234 - protein, 10 aa, Mycobacterium
ETGSYDGGTY

SEQ ID NO: 473235 - protein, 23 aa, Mycobacterium
ETGTASVRVETDPAKHGNQQGTV

SEQ ID NO: 473236 - protein, 6 aa, Mycobacterium
ETGTGL

SEQ ID NO: 473237 - protein, 9 aa, Mycobacterium
ETGTGSREQ

SEQ ID NO: 473238 - protein, 7 aa, Mycobacterium
ETGTGVT

SEQ ID NO: 473239 - protein, 5 aa, Mycobacterium
ETGTH

SEQ ID NO: 473240 - protein, 20 aa, Mycobacterium
ETGTLREAAEQLSVSQSAVS

SEQ ID NO: 473241 - protein, 14 aa, Mycobacterium
ETGTPPVAGAPPPR

SEQ ID NO: 473242 - protein, 7 aa, Mycobacterium
ETGTPVT

SEQ ID NO: 473243 - protein, 7 aa, Mycobacterium
ETGTQGA

SEQ ID NO: 473244 - protein, 6 aa, Mycobacterium
ETGTTP

SEQ ID NO: 473245 - protein, 6 aa, Mycobacterium
ETGTTR

SEQ ID NO: 473246 - protein, 8 aa, Mycobacterium
ETGTTRRL

SEQ ID NO: 473247 - protein, 11 aa, Mycobacterium
ETGTVPSPSQI

SEQ ID NO: 473248 - protein, 11 aa, Mycobacterium
ETGVDQSKSAG

SEQ ID NO: 473249 - protein, 6 aa, Mycobacterium
ETGVGG

SEQ ID NO: 473250 - protein, 5 aa, Mycobacterium
ETGVK

SEQ ID NO: 473251 - protein, 23 aa, Mycobacterium
ETGVPDPEHVAEPASPDEADPTL

SEQ ID NO: 473252 - protein, 9 aa, Mycobacterium
ETGVPGDDW

SEQ ID NO: 473253 - protein, 5 aa, Mycobacterium
ETGVR

SEQ ID NO: 473254 - protein, 5 aa, Mycobacterium
ETGVS

SEQ ID NO: 473255 - protein, 6 aa, Mycobacterium
ETGWDP

SEQ ID NO: 473256 - protein, 5 aa, Mycobacterium
ETGWG

SEQ ID NO: 473257 - protein, 5 aa, Mycobacterium
ETGYP

SEQ ID NO: 473258 - protein, 5 aa, Mycobacterium
ETGYT

SEQ ID NO: 473259 - protein, 4 aa, Mycobacterium
ETHA

SEQ ID NO: 473260 - protein, 6 aa, Mycobacterium
ETHARG

SEQ ID NO: 473261 - protein, 10 aa, Mycobacterium
ETHDDPAKAL

SEQ ID NO: 473262 - protein, 18 aa, Mycobacterium
ETHDEAARTLAAKTGDRF

SEQ ID NO: 473263 - protein, 8 aa, Mycobacterium
ETHDESSF

SEQ ID NO: 473264 - protein, 5 aa, Mycobacterium
ETHGA

SEQ ID NO: 473265 - protein, 9 aa, Mycobacterium
ETHGDHRAA

SEQ ID NO: 473266 - protein, 6 aa, Mycobacterium
ETHGPF

SEQ ID NO: 473267 - protein, 11 aa, Mycobacterium
ETHGTGTRLGD

SEQ ID NO: 473268 - protein, 11 aa, Mycobacterium
ETHKEDPTGIG

SEQ ID NO: 473269 - protein, 9 aa, Mycobacterium
ETHPTPADH

SEQ ID NO: 473270 - protein, 4 aa, Mycobacterium
ETHQ

SEQ ID NO: 473271 - protein, 5 aa, Mycobacterium
ETHQR

SEQ ID NO: 473272 - protein, 13 aa, Mycobacterium
ETHQSGDRTQRAT

SEQ ID NO: 473273 - protein, 8 aa, Mycobacterium
ETHRDTSA

SEQ ID NO: 473274 - protein, 6 aa, Mycobacterium
ETHRND

SEQ ID NO: 473275 - protein, 11 aa, Mycobacterium
ETHSTPTEPPR

SEQ ID NO: 473276 - protein, 6 aa, Mycobacterium
ETIAPI

SEQ ID NO: 473277 - protein, 5 aa, Mycobacterium
ETIDA

SEQ ID NO: 473278 - protein, 8 aa, Mycobacterium
ETIDEPTK

SEQ ID NO: 473279 - protein, 4 aa, Mycobacterium
ETIE

SEQ ID NO: 473280 - protein, 12 aa, Mycobacterium
ETIGDGPGGLPE

SEQ ID NO: 473281 - protein, 9 aa, Mycobacterium
ETIGKDPAW

SEQ ID NO: 473282 - protein, 19 aa, Mycobacterium
ETIGPEGESLPDRASRKIA

SEQ ID NO: 473283 - protein, 13 aa, Mycobacterium
ETIGRRQASRPGH

SEQ ID NO: 473284 - protein, 4 aa, Mycobacterium
ETIN

SEQ ID NO: 473285 - protein, 7 aa, Mycobacterium
ETIPGTT

SEQ ID NO: 473286 - protein, 8 aa, Mycobacterium
ETIPGTTV

SEQ ID NO: 473287 - protein, 5 aa, Mycobacterium
ETIRA

SEQ ID NO: 473288 - protein, 6 aa, Mycobacterium
ETIRAG

SEQ ID NO: 473289 - protein, 10 aa, Mycobacterium
ETITPRTRDA

SEQ ID NO: 473290 - protein, 10 aa, Mycobacterium
ETITSDPAWP

SEQ ID NO: 473291 - protein, 13 aa, Mycobacterium
ETKAAAPQGAVPA

SEQ ID NO: 473292 - protein, 7 aa, Mycobacterium
ETKASPW

SEQ ID NO: 473293 - protein, 7 aa, Mycobacterium
ETKDESV

SEQ ID NO: 473294 - protein, 7 aa, Mycobacterium
ETKDSSV

SEQ ID NO: 473295 - protein, 4 aa, Mycobacterium
ETKE

SEQ ID NO: 473296 - protein, 18 aa, Mycobacterium
ETKFPGEISGGMRKRAGL

SEQ ID NO: 473297 - protein, 11 aa, Mycobacterium
ETKHDKPTVAE

SEQ ID NO: 473298 - protein, 10 aa, Mycobacterium
ETKIEPGTGR

SEQ ID NO: 473299 - protein, 9 aa, Mycobacterium
ETKIEPSTD

SEQ ID NO: 473300 - protein, 8 aa, Mycobacterium
ETKKNGND

SEQ ID NO: 473301 - protein, 14 aa, Mycobacterium
ETKKRGATTAEVKQ

SEQ ID NO: 473302 - protein, 4 aa, Mycobacterium
ETKM

SEQ ID NO: 473303 - protein, 16 aa, Mycobacterium
ETKNTTRNIPTPKADR

SEQ ID NO: 473304 - protein, 10 aa, Mycobacterium
ETKPDKGDRA

SEQ ID NO: 473305 - protein, 11 aa, Mycobacterium
ETKPNEVDEDE

SEQ ID NO: 473306 - protein, 10 aa, Mycobacterium
ETKQAGSERV

SEQ ID NO: 473307 - protein, 7 aa, Mycobacterium
ETKQPGA

SEQ ID NO: 473308 - protein, 15 aa, Mycobacterium
ETKQSLSALKDTPNE

SEQ ID NO: 473309 - protein, 9 aa, Mycobacterium
ETKQTIAAT

SEQ ID NO: 473310 - protein, 7 aa, Mycobacterium
ETKRDKA

SEQ ID NO: 473311 - protein, 10 aa, Mycobacterium
ETKSAAGRRT

SEQ ID NO: 473312 - protein, 6 aa, Mycobacterium
ETKTRT

SEQ ID NO: 473313 - protein, 15 aa, Mycobacterium
ETKVDPSDDAGDGGG

SEQ ID NO: 473314 - protein, 6 aa, Mycobacterium
ETKVSD

SEQ ID NO: 473315 - protein, 7 aa, Mycobacterium
ETLAENR

SEQ ID NO: 473316 - protein, 8 aa, Mycobacterium
ETLANGPY

SEQ ID NO: 473317 - protein, 29 aa, Mycobacterium
ETLASPDCGPASTRGVERPDPGPIKVCGG

SEQ ID NO: 473318 - protein, 13 aa, Mycobacterium
ETLATDDRKRRTL

SEQ ID NO: 473319 - protein, 5 aa, Mycobacterium
ETLDE

SEQ ID NO: 473320 - protein, 5 aa, Mycobacterium
ETLDS

SEQ ID NO: 473321 - protein, 5 aa, Mycobacterium
ETLDT

SEQ ID NO: 473322 - protein, 6 aa, Mycobacterium
ETLDTS

SEQ ID NO: 473323 - protein, 7 aa, Mycobacterium
ETLEPSS

SEQ ID NO: 473324 - protein, 13 aa, Mycobacterium
ETLGEDNRDEARV

SEQ ID NO: 473325 - protein, 10 aa, Mycobacterium
ETLGGAGARP

SEQ ID NO: 473326 - protein, 13 aa, Mycobacterium
ETLGGPDRDRVKT

SEQ ID NO: 473327 - protein, 5 aa, Mycobacterium
ETLGP

SEQ ID NO: 473328 - protein, 26 aa, Mycobacterium
ETLGPQERFGRPLGGRRPDEYGPDAG

SEQ ID NO: 473329 - protein, 19 aa, Mycobacterium
ETLGRARPELPGAGAAGGL

SEQ ID NO: 473330 - protein, 7 aa, Mycobacterium
ETLGRSG

SEQ ID NO: 473331 - protein, 5 aa, Mycobacterium
ETLGT

SEQ ID NO: 473332 - protein, 20 aa, Mycobacterium
ETLKGESDRAERDGDLGKAA

SEQ ID NO: 473333 - protein, 9 aa, Mycobacterium
ETLNAGRSW

SEQ ID NO: 473334 - protein, 10 aa, Mycobacterium
ETLPAEPAKT

SEQ ID NO: 473335 - protein, 10 aa, Mycobacterium
ETLPAEREHA

SEQ ID NO: 473336 - protein, 6 aa, Mycobacterium
ETLPAL

SEQ ID NO: 473337 - protein, 7 aa, Mycobacterium
ETLPGAE

SEQ ID NO: 473338 - protein, 12 aa, Mycobacterium
ETLPGSPSLTQG

SEQ ID NO: 473339 - protein, 6 aa, Mycobacterium
ETLPPG

SEQ ID NO: 473340 - protein, 10 aa, Mycobacterium
ETLPSGDVHR

SEQ ID NO: 473341 - protein, 10 aa, Mycobacterium
ETLPSSAAPR

SEQ ID NO: 473342 - protein, 6 aa, Mycobacterium
ETLREQ

SEQ ID NO: 473343 - protein, 5 aa, Mycobacterium
ETLRG

SEQ ID NO: 473344 - protein, 8 aa, Mycobacterium
ETLRPGKE

SEQ ID NO: 473345 - protein, 7 aa, Mycobacterium
ETLRQQA

SEQ ID NO: 473346 - protein, 7 aa, Mycobacterium
ETLSDEP

SEQ ID NO: 473347 - protein, 7 aa, Mycobacterium
ETLSEPI

SEQ ID NO: 473348 - protein, 11 aa, Mycobacterium
ETLSGGQRQGV

SEQ ID NO: 473349 - protein, 6 aa, Mycobacterium
ETLSGP

SEQ ID NO: 473350 - protein, 6 aa, Mycobacterium
ETLSGT

SEQ ID NO: 473351 - protein, 9 aa, Mycobacterium
ETLSRTARA

SEQ ID NO: 473352 - protein, 4 aa, Mycobacterium
ETLT

SEQ ID NO: 473353 - protein, 9 aa, Mycobacterium
ETLTDASAS

SEQ ID NO: 473354 - protein, 6 aa, Mycobacterium
ETLTDC

SEQ ID NO: 473355 - protein, 7 aa, Mycobacterium
ETLTRRR

SEQ ID NO: 473356 - protein, 10 aa, Mycobacterium
ETLTSADDER

SEQ ID NO: 473357 - protein, 5 aa, Mycobacterium
ETLTT

SEQ ID NO: 473358 - protein, 6 aa, Mycobacterium
ETMGED

SEQ ID NO: 473359 - protein, 12 aa, Mycobacterium
ETMPAPGAARSG

SEQ ID NO: 473360 - protein, 7 aa, Mycobacterium
ETMPESP

SEQ ID NO: 473361 - protein, 6 aa, Mycobacterium
ETMRPA

SEQ ID NO: 473362 - protein, 15 aa, Mycobacterium
ETNAPYEKTVRPEGE

SEQ ID NO: 473363 - protein, 6 aa, Mycobacterium
ETNAQI

SEQ ID NO: 473364 - protein, 8 aa, Mycobacterium
ETNAQRSG

SEQ ID NO: 473365 - protein, 8 aa, Mycobacterium
ETNARQPG

SEQ ID NO: 473366 - protein, 9 aa, Mycobacterium
ETNATTTKT

SEQ ID NO: 473367 - protein, 9 aa, Mycobacterium
ETNATTTRT

SEQ ID NO: 473368 - protein, 6 aa, Mycobacterium
ETNDEI

SEQ ID NO: 473369 - protein, 8 aa, Mycobacterium
ETNDSDEP

SEQ ID NO: 473370 - protein, 10 aa, Mycobacterium
ETNEEQLGKA

SEQ ID NO: 473371 - protein, 8 aa, Mycobacterium
ETNGAEGD

SEQ ID NO: 473372 - protein, 5 aa, Mycobacterium
ETNGG

SEQ ID NO: 473373 - protein, 7 aa, Mycobacterium
ETNKRGL

SEQ ID NO: 473374 - protein, 6 aa, Mycobacterium
ETNPGV

SEQ ID NO: 473375 - protein, 8 aa, Mycobacterium
ETNPHRAA

SEQ ID NO: 473376 - protein, 5 aa, Mycobacterium
ETNPR

SEQ ID NO: 473377 - protein, 7 aa, Mycobacterium
ETNPREY

SEQ ID NO: 473378 - protein, 4 aa, Mycobacterium
ETNQ

SEQ ID NO: 473379 - protein, 12 aa, Mycobacterium
ETNRHANDAVRG

SEQ ID NO: 473380 - protein, 16 aa, Mycobacterium
ETNRHTGERAEIDDET

SEQ ID NO: 473381 - protein, 5 aa, Mycobacterium
ETNRS

SEQ ID NO: 473382 - protein, 8 aa, Mycobacterium
ETNSADID

SEQ ID NO: 473383 - protein, 7 aa, Mycobacterium
ETNVSEQ

SEQ ID NO: 473384 - protein, 10 aa, Mycobacterium
ETPAAQQAIA

SEQ ID NO: 473385 - protein, 5 aa, Mycobacterium
ETPAE

SEQ ID NO: 473386 - protein, 7 aa, Mycobacterium
ETPAERD

SEQ ID NO: 473387 - protein, 9 aa, Mycobacterium
ETPAGRAEY

SEQ ID NO: 473388 - protein, 12 aa, Mycobacterium
ETPAKRGESKSR

SEQ ID NO: 473389 - protein, 11 aa, Mycobacterium
ETPAKRGKRPV

SEQ ID NO: 473390 - protein, 9 aa, Mycobacterium
ETPALPPTR

SEQ ID NO: 473391 - protein, 8 aa, Mycobacterium
ETPANPGL

SEQ ID NO: 473392 - protein, 7 aa, Mycobacterium
ETPAPDF

SEQ ID NO: 473393 - protein, 6 aa, Mycobacterium
ETPAPH

SEQ ID NO: 473394 - protein, 33 aa, Mycobacterium
ETPAPVAAEEAPAVVTGDSADSAEDPDNPPTTP

SEQ ID NO: 473395 - protein, 5 aa, Mycobacterium
ETPAQ

SEQ ID NO: 473396 - protein, 7 aa, Mycobacterium
ETPAQSR

SEQ ID NO: 473397 - protein, 10 aa, Mycobacterium
ETPARPGGEG

SEQ ID NO: 473398 - protein, 7 aa, Mycobacterium
ETPASPT

SEQ ID NO: 473399 - protein, 9 aa, Mycobacterium
ETPATETQI

SEQ ID NO: 473400 - protein, 6 aa, Mycobacterium
ETPATT

SEQ ID NO: 473401 - protein, 6 aa, Mycobacterium
ETPAYR

SEQ ID NO: 473402 - protein, 10 aa, Mycobacterium
ETPDAPTKDM

SEQ ID NO: 473403 - protein, 12 aa, Mycobacterium
ETPDARRSDSPV

SEQ ID NO: 473404 - protein, 5 aa, Mycobacterium
ETPDG

SEQ ID NO: 473405 - protein, 5 aa, Mycobacterium
ETPDL

SEQ ID NO: 473406 - protein, 5 aa, Mycobacterium
ETPDP

SEQ ID NO: 473407 - protein, 5 aa, Mycobacterium
ETPDS

SEQ ID NO: 473408 - protein, 7 aa, Mycobacterium
ETPDTDD

SEQ ID NO: 473409 - protein, 9 aa, Mycobacterium
ETPDVTAGP

SEQ ID NO: 473410 - protein, 5 aa, Mycobacterium
ETPDY

SEQ ID NO: 473411 - protein, 4 aa, Mycobacterium
ETPE

SEQ ID NO: 473412 - protein, 5 aa, Mycobacterium
ETPEF

SEQ ID NO: 473413 - protein, 6 aa, Mycobacterium
ETPEGE

SEQ ID NO: 473414 - protein, 13 aa, Mycobacterium
ETPEGGPAHDADQ

SEQ ID NO: 473415 - protein, 8 aa, Mycobacterium
ETPEGPRL

SEQ ID NO: 473416 - protein, 5 aa, Mycobacterium
ETPEI

SEQ ID NO: 473417 - protein, 9 aa, Mycobacterium
ETPEPTDIE

SEQ ID NO: 473418 - protein, 5 aa, Mycobacterium
ETPEY

SEQ ID NO: 473419 - protein, 5 aa, Mycobacterium
ETPFD

SEQ ID NO: 473420 - protein, 10 aa, Mycobacterium
ETPFRSGATV

SEQ ID NO: 473421 - protein, 4 aa, Mycobacterium
ETPG

SEQ ID NO: 473422 - protein, 5 aa, Mycobacterium
ETPGE

SEQ ID NO: 473423 - protein, 10 aa, Mycobacterium
ETPGESPIAP

SEQ ID NO: 473424 - protein, 14 aa, Mycobacterium
ETPGLSADSATAAR

SEQ ID NO: 473425 - protein, 11 aa, Mycobacterium
ETPGSDGRDGD

SEQ ID NO: 473426 - protein, 20 aa, Mycobacterium
ETPGTIRSAGSARPGQHNDE

SEQ ID NO: 473427 - protein, 5 aa, Mycobacterium
ETPIA

SEQ ID NO: 473428 - protein, 5 aa, Mycobacterium
ETPID

SEQ ID NO: 473429 - protein, 4 aa, Mycobacterium
ETPL

SEQ ID NO: 473430 - protein, 16 aa, Mycobacterium
ETPLANGTVRRRGQAR

SEQ ID NO: 473431 - protein, 6 aa, Mycobacterium
ETPLEQ

SEQ ID NO: 473432 - protein, 11 aa, Mycobacterium
ETPLQDPESRP

SEQ ID NO: 473433 - protein, 6 aa, Mycobacterium
ETPLSA

SEQ ID NO: 473434 - protein, 6 aa, Mycobacterium
ETPLTP

SEQ ID NO: 473435 - protein, 4 aa, Mycobacterium
ETPN

SEQ ID NO: 473436 - protein, 7 aa, Mycobacterium
ETPNGGA

SEQ ID NO: 473437 - protein, 5 aa, Mycobacterium
ETPNI

SEQ ID NO: 473438 - protein, 14 aa, Mycobacterium
ETPNSFDTESAGRA

SEQ ID NO: 473439 - protein, 5 aa, Mycobacterium
ETPPG

SEQ ID NO: 473440 - protein, 7 aa, Mycobacterium
ETPPLGG

SEQ ID NO: 473441 - protein, 10 aa, Mycobacterium
ETPPPAPPRW

SEQ ID NO: 473442 - protein, 9 aa, Mycobacterium
ETPPRPAGA

SEQ ID NO: 473443 - protein, 4 aa, Mycobacterium
ETPQ

SEQ ID NO: 473444 - protein, 10 aa, Mycobacterium
ETPQDNHDTS

SEQ ID NO: 473445 - protein, 10 aa, Mycobacterium
ETPQERAQRR

SEQ ID NO: 473446 - protein, 5 aa, Mycobacterium
ETPQH

SEQ ID NO: 473447 - protein, 4 aa, Mycobacterium
ETPR

SEQ ID NO: 473448 - protein, 14 aa, Mycobacterium
ETPRDAPSATESLN

SEQ ID NO: 473449 - protein, 9 aa, Mycobacterium
ETPRDGHRP

SEQ ID NO: 473450 - protein, 7 aa, Mycobacterium
ETPRGAH

SEQ ID NO: 473451 - protein, 8 aa, Mycobacterium
ETPRGPVA

SEQ ID NO: 473452 - protein, 16 aa, Mycobacterium
ETPRINGDDYPTPDGT

SEQ ID NO: 473453 - protein, 11 aa, Mycobacterium
ETPRNRRQEET

SEQ ID NO: 473454 - protein, 12 aa, Mycobacterium
ETPRSGPALRQQ

SEQ ID NO: 473455 - protein, 8 aa, Mycobacterium
ETPRTARV

SEQ ID NO: 473456 - protein, 8 aa, Mycobacterium
ETPSDETQ

SEQ ID NO: 473457 - protein, 7 aa, Mycobacterium
ETPSEGA

SEQ ID NO: 473458 - protein, 20 aa, Mycobacterium
ETPSLGARDLTESPSTKAAA

SEQ ID NO: 473459 - protein, 30 aa, Mycobacterium
ETPSLGARDLTESVSTKAAAHAATGGDTHN

SEQ ID NO: 473460 - protein, 8 aa, Mycobacterium
ETPSNPEL

SEQ ID NO: 473461 - protein, 8 aa, Mycobacterium
ETPSNPRL

SEQ ID NO: 473462 - protein, 10 aa, Mycobacterium
ETPSPTGEEY

SEQ ID NO: 473463 - protein, 6 aa, Mycobacterium
ETPSWT

SEQ ID NO: 473464 - protein, 6 aa, Mycobacterium
ETPTAQ

SEQ ID NO: 473465 - protein, 7 aa, Mycobacterium
ETPTEGE

SEQ ID NO: 473466 - protein, 7 aa, Mycobacterium
ETPTFSG

SEQ ID NO: 473467 - protein, 6 aa, Mycobacterium
ETPTGL

SEQ ID NO: 473468 - protein, 5 aa, Mycobacterium
ETPTH

SEQ ID NO: 473469 - protein, 7 aa, Mycobacterium
ETPTNPA

SEQ ID NO: 473470 - protein, 7 aa, Mycobacterium
ETPTPDI

SEQ ID NO: 473471 - protein, 12 aa, Mycobacterium
ETPTPNGPQGAA

SEQ ID NO: 473472 - protein, 10 aa, Mycobacterium
ETPTPRGPQA

SEQ ID NO: 473473 - protein, 8 aa, Mycobacterium
ETPTPSPF

SEQ ID NO: 473474 - protein, 11 aa, Mycobacterium
ETPTPTGTQAA

SEQ ID NO: 473475 - protein, 6 aa, Mycobacterium
ETPTQI

SEQ ID NO: 473476 - protein, 9 aa, Mycobacterium
ETPTSGSIT

SEQ ID NO: 473477 - protein, 9 aa, Mycobacterium
ETPTSGTIR

SEQ ID NO: 473478 - protein, 15 aa, Mycobacterium
ETPVGVTTSGTFSPT

SEQ ID NO: 473479 - protein, 5 aa, Mycobacterium
ETPVL

SEQ ID NO: 473480 - protein, 22 aa, Mycobacterium
ETPYRPPKPKPRKATRQAGPPI

SEQ ID NO: 473481 - protein, 11 aa, Mycobacterium
ETQAQSPELGP

SEQ ID NO: 473482 - protein, 8 aa, Mycobacterium
ETQARQRE

SEQ ID NO: 473483 - protein, 5 aa, Mycobacterium
ETQAS

SEQ ID NO: 473484 - protein, 8 aa, Mycobacterium
ETQDPASF

SEQ ID NO: 473485 - protein, 17 aa, Mycobacterium
ETQDPHQRAGEVSQQAR

SEQ ID NO: 473486 - protein, 15 aa, Mycobacterium
ETQDPQTFTQNPAWT

SEQ ID NO: 473487 - protein, 9 aa, Mycobacterium
ETQEKANLE

SEQ ID NO: 473488 - protein, 9 aa, Mycobacterium
ETQGAQPIS

SEQ ID NO: 473489 - protein, 6 aa, Mycobacterium
ETQGNP

SEQ ID NO: 473490 - protein, 14 aa, Mycobacterium
ETQGYTPESRHDID

SEQ ID NO: 473491 - protein, 7 aa, Mycobacterium
ETQMPSR

SEQ ID NO: 473492 - protein, 6 aa, Mycobacterium
ETQPEG

SEQ ID NO: 473493 - protein, 6 aa, Mycobacterium
ETQPGG

SEQ ID NO: 473494 - protein, 8 aa, Mycobacterium
ETQPNAGH

SEQ ID NO: 473495 - protein, 9 aa, Mycobacterium
ETQPPGRDE

SEQ ID NO: 473496 - protein, 7 aa, Mycobacterium
ETQRDNI

SEQ ID NO: 473497 - protein, 7 aa, Mycobacterium
ETQRGKR

SEQ ID NO: 473498 - protein, 9 aa, Mycobacterium
ETQRPGSDL

SEQ ID NO: 473499 - protein, 31 aa, Mycobacterium
ETQRPPARARGAAALRDRAKAEAKPDDPEAV

SEQ ID NO: 473500 - protein, 9 aa, Mycobacterium
ETQRRAAGL

SEQ ID NO: 473501 - protein, 11 aa, Mycobacterium
ETQRVTNTGQR

SEQ ID NO: 473502 - protein, 5 aa, Mycobacterium
ETQSR

SEQ ID NO: 473503 - protein, 8 aa, Mycobacterium
ETQTDEQL

SEQ ID NO: 473504 - protein, 21 aa, Mycobacterium
ETQTELESRGASISRAARQEP

SEQ ID NO: 473505 - protein, 10 aa, Mycobacterium
ETQTTPDLGD

SEQ ID NO: 473506 - protein, 10 aa, Mycobacterium
ETQVEPGRDN

SEQ ID NO: 473507 - protein, 8 aa, Mycobacterium
ETQWDQAS

SEQ ID NO: 473508 - protein, 9 aa, Mycobacterium
ETRADGEEL

SEQ ID NO: 473509 - protein, 7 aa, Mycobacterium
ETRAERQ

SEQ ID NO: 473510 - protein, 15 aa, Mycobacterium
ETRAGEPAPADDPAR

SEQ ID NO: 473511 - protein, 6 aa, Mycobacterium
ETRAQA

SEQ ID NO: 473512 - protein, 4 aa, Mycobacterium
ETRD

SEQ ID NO: 473513 - protein, 7 aa, Mycobacterium
ETRDAGT

SEQ ID NO: 473514 - protein, 5 aa, Mycobacterium
ETRDE

SEQ ID NO: 473515 - protein, 6 aa, Mycobacterium
ETRDEA

SEQ ID NO: 473516 - protein, 6 aa, Mycobacterium
ETRDGA

SEQ ID NO: 473517 - protein, 6 aa, Mycobacterium
ETRDGH

SEQ ID NO: 473518 - protein, 8 aa, Mycobacterium
ETRDPDSF

SEQ ID NO: 473519 - protein, 15 aa, Mycobacterium
ETRDPQSFAQNPAWT

SEQ ID NO: 473520 - protein, 8 aa, Mycobacterium
ETREKAEA

SEQ ID NO: 473521 - protein, 7 aa, Mycobacterium
ETRERAE

SEQ ID NO: 473522 - protein, 6 aa, Mycobacterium
ETRESV

SEQ ID NO: 473523 - protein, 7 aa, Mycobacterium
ETRFQPT

SEQ ID NO: 473524 - protein, 5 aa, Mycobacterium
ETRGD

SEQ ID NO: 473525 - protein, 11 aa, Mycobacterium
ETRGDQPEELE

SEQ ID NO: 473526 - protein, 9 aa, Mycobacterium
ETRGGGTRH

SEQ ID NO: 473527 - protein, 8 aa, Mycobacterium
ETRGPEHR

SEQ ID NO: 473528 - protein, 5 aa, Mycobacterium
ETRGQ

SEQ ID NO: 473529 - protein, 7 aa, Mycobacterium
ETRGTGV

SEQ ID NO: 473530 - protein, 6 aa, Mycobacterium
ETRHGD

SEQ ID NO: 473531 - protein, 5 aa, Mycobacterium
ETRHN

SEQ ID NO: 473532 - protein, 5 aa, Mycobacterium
ETRIG

SEQ ID NO: 473533 - protein, 4 aa, Mycobacterium
ETRK

SEQ ID NO: 473534 - protein, 5 aa, Mycobacterium
ETRKR

SEQ ID NO: 473535 - protein, 6 aa, Mycobacterium
ETRKSF

SEQ ID NO: 473536 - protein, 4 aa, Mycobacterium
ETRL

SEQ ID NO: 473537 - protein, 5 aa, Mycobacterium
ETRLG

SEQ ID NO: 473538 - protein, 12 aa, Mycobacterium
ETRMGQDTLQGT

SEQ ID NO: 473539 - protein, 4 aa, Mycobacterium
ETRP

SEQ ID NO: 473540 - protein, 11 aa, Mycobacterium
ETRPAAHDLPG

SEQ ID NO: 473541 - protein, 7 aa, Mycobacterium
ETRPAQA

SEQ ID NO: 473542 - protein, 5 aa, Mycobacterium
ETRPD

SEQ ID NO: 473543 - protein, 8 aa, Mycobacterium
ETRPGALR

SEQ ID NO: 473544 - protein, 19 aa, Mycobacterium
ETRPGQGYPRTYEDQEKWR

SEQ ID NO: 473545 - protein, 17 aa, Mycobacterium
ETRPGQGYPRTYEDQER

SEQ ID NO: 473546 - protein, 18 aa, Mycobacterium
ETRPGQGYPRTYEDQERW

SEQ ID NO: 473547 - protein, 19 aa, Mycobacterium
ETRPGQGYPRTYEDQERWG

SEQ ID NO: 473548 - protein, 18 aa, Mycobacterium
ETRPGQGYPRTYEDQTRW

SEQ ID NO: 473549 - protein, 18 aa, Mycobacterium
ETRPGQGYPRTYQDQERW

SEQ ID NO: 473550 - protein, 6 aa, Mycobacterium
ETRPRD

SEQ ID NO: 473551 - protein, 7 aa, Mycobacterium
ETRPRDY

SEQ ID NO: 473552 - protein, 6 aa, Mycobacterium
ETRPRE

SEQ ID NO: 473553 - protein, 8 aa, Mycobacterium
ETRQPEIA

SEQ ID NO: 473554 - protein, 7 aa, Mycobacterium
ETRRAEL

SEQ ID NO: 473555 - protein, 6 aa, Mycobacterium
ETRRDT

SEQ ID NO: 473556 - protein, 7 aa, Mycobacterium
ETRREGR

SEQ ID NO: 473557 - protein, 6 aa, Mycobacterium
ETRREH

SEQ ID NO: 473558 - protein, 6 aa, Mycobacterium
ETRRGR

SEQ ID NO: 473559 - protein, 8 aa, Mycobacterium
ETRRPAPD

SEQ ID NO: 473560 - protein, 5 aa, Mycobacterium
ETRRT

SEQ ID NO: 473561 - protein, 11 aa, Mycobacterium
ETRSAADSTIG

SEQ ID NO: 473562 - protein, 10 aa, Mycobacterium
ETRSESLASD

SEQ ID NO: 473563 - protein, 9 aa, Mycobacterium
ETRSGQEQV

SEQ ID NO: 473564 - protein, 8 aa, Mycobacterium
ETRSHQQL

SEQ ID NO: 473565 - protein, 6 aa, Mycobacterium
ETRSRS

SEQ ID NO: 473566 - protein, 6 aa, Mycobacterium
ETRSRT

SEQ ID NO: 473567 - protein, 8 aa, Mycobacterium
ETRTATRD

SEQ ID NO: 473568 - protein, 10 aa, Mycobacterium
ETRTDPASGV

SEQ ID NO: 473569 - protein, 7 aa, Mycobacterium
ETRTGDR

SEQ ID NO: 473570 - protein, 12 aa, Mycobacterium
ETRTSAGPLTGT

SEQ ID NO: 473571 - protein, 27 aa, Mycobacterium
ETRTSGPGPARTFPADSGELARANPVD

SEQ ID NO: 473572 - protein, 11 aa, Mycobacterium
ETRTTRPTMRG

SEQ ID NO: 473573 - protein, 5 aa, Mycobacterium
ETRVA

SEQ ID NO: 473574 - protein, 4 aa, Mycobacterium
ETRW

SEQ ID NO: 473575 - protein, 6 aa, Mycobacterium
ETRYSS

SEQ ID NO: 473576 - protein, 9 aa, Mycobacterium
ETSAAGGGG

SEQ ID NO: 473577 - protein, 9 aa, Mycobacterium
ETSAEIDPG

SEQ ID NO: 473578 - protein, 5 aa, Mycobacterium
ETSAG

SEQ ID NO: 473579 - protein, 15 aa, Mycobacterium
ETSAPTRAALDERAA

SEQ ID NO: 473580 - protein, 21 aa, Mycobacterium
ETSAQAKTAAVQATAAAGAYE

SEQ ID NO: 473581 - protein, 7 aa, Mycobacterium
ETSDAAH

SEQ ID NO: 473582 - protein, 10 aa, Mycobacterium
ETSDAATKAV

SEQ ID NO: 473583 - protein, 6 aa, Mycobacterium
ETSDAR

SEQ ID NO: 473584 - protein, 5 aa, Mycobacterium
ETSDD

SEQ ID NO: 473585 - protein, 5 aa, Mycobacterium
ETSDG

SEQ ID NO: 473586 - protein, 7 aa, Mycobacterium
ETSDGEH

SEQ ID NO: 473587 - protein, 7 aa, Mycobacterium
ETSDGTN

SEQ ID NO: 473588 - protein, 9 aa, Mycobacterium
ETSDREDQI

SEQ ID NO: 473589 - protein, 9 aa, Mycobacterium
ETSDTDLPD

SEQ ID NO: 473590 - protein, 16 aa, Mycobacterium
ETSEPEKAEWLVASPH

SEQ ID NO: 473591 - protein, 5 aa, Mycobacterium
ETSEV

SEQ ID NO: 473592 - protein, 16 aa, Mycobacterium
ETSEVHPGLSDGQRAH

SEQ ID NO: 473593 - protein, 6 aa, Mycobacterium
ETSEYT

SEQ ID NO: 473594 - protein, 4 aa, Mycobacterium
ETSG

SEQ ID NO: 473595 - protein, 6 aa, Mycobacterium
ETSGAG

SEQ ID NO: 473596 - protein, 10 aa, Mycobacterium
ETSGDSDDRR

SEQ ID NO: 473597 - protein, 8 aa, Mycobacterium
ETSGGDGR

SEQ ID NO: 473598 - protein, 28 aa, Mycobacterium
ETSGISADATVSAGAAVAESAELAGRAR

SEQ ID NO: 473599 - protein, 9 aa, Mycobacterium
ETSGMSSTN

SEQ ID NO: 473600 - protein, 10 aa, Mycobacterium
ETSGNRQRAH

SEQ ID NO: 473601 - protein, 6 aa, Mycobacterium
ETSGNV

SEQ ID NO: 473602 - protein, 7 aa, Mycobacterium
ETSGPDV

SEQ ID NO: 473603 - protein, 8 aa, Mycobacterium
ETSGPSDE

SEQ ID NO: 473604 - protein, 18 aa, Mycobacterium
ETSGRKATAVGKPAPEGF

SEQ ID NO: 473605 - protein, 18 aa, Mycobacterium
ETSGTVVDTGEGVEGFTA

SEQ ID NO: 473606 - protein, 4 aa, Mycobacterium
ETSI

SEQ ID NO: 473607 - protein, 6 aa, Mycobacterium
ETSIDD

SEQ ID NO: 473608 - protein, 7 aa, Mycobacterium
ETSIGAD

SEQ ID NO: 473609 - protein, 17 aa, Mycobacterium
ETSLRAAQSAIEATAAP

SEQ ID NO: 473610 - protein, 6 aa, Mycobacterium
ETSNAG

SEQ ID NO: 473611 - protein, 7 aa, Mycobacterium
ETSNREA

SEQ ID NO: 473612 - protein, 10 aa, Mycobacterium
ETSNTPGYSG

SEQ ID NO: 473613 - protein, 4 aa, Mycobacterium
ETSP

SEQ ID NO: 473614 - protein, 5 aa, Mycobacterium
ETSPD

SEQ ID NO: 473615 - protein, 8 aa, Mycobacterium
ETSPERLS

SEQ ID NO: 473616 - protein, 14 aa, Mycobacterium
ETSPGSAPPAYDES

SEQ ID NO: 473617 - protein, 9 aa, Mycobacterium
ETSPKEAAT

SEQ ID NO: 473618 - protein, 8 aa, Mycobacterium
ETSPLTRQ

SEQ ID NO: 473619 - protein, 7 aa, Mycobacterium
ETSPREY

SEQ ID NO: 473620 - protein, 9 aa, Mycobacterium
ETSPSAGFG

SEQ ID NO: 473621 - protein, 5 aa, Mycobacterium
ETSPV

SEQ ID NO: 473622 - protein, 17 aa, Mycobacterium
ETSPVATQTRSNDSLQR

SEQ ID NO: 473623 - protein, 6 aa, Mycobacterium
ETSPVS

SEQ ID NO: 473624 - protein, 18 aa, Mycobacterium
ETSPVSTQTRTGDSLERR

SEQ ID NO: 473625 - protein, 41 aa, Mycobacterium
ETSPVTEAQPDEDAWHQGDSALTAPPAATPAAISDQLPEGR

SEQ ID NO: 473626 - protein, 15 aa, Mycobacterium
ETSPWPAASGPRRAA

SEQ ID NO: 473627 - protein, 10 aa, Mycobacterium
ETSPWPTDGA

SEQ ID NO: 473628 - protein, 10 aa, Mycobacterium
ETSPWPTDTE

SEQ ID NO: 473629 - protein, 9 aa, Mycobacterium
ETSPYDAGL

SEQ ID NO: 473630 - protein, 10 aa, Mycobacterium
ETSQAARQRW

SEQ ID NO: 473631 - protein, 5 aa, Mycobacterium
ETSQD

SEQ ID NO: 473632 - protein, 8 aa, Mycobacterium
ETSQPSRL

SEQ ID NO: 473633 - protein, 4 aa, Mycobacterium
ETSR

SEQ ID NO: 473634 - protein, 9 aa, Mycobacterium
ETSRAGDPH

SEQ ID NO: 473635 - protein, 11 aa, Mycobacterium
ETSRTFGRGPR

SEQ ID NO: 473636 - protein, 6 aa, Mycobacterium
ETSRTG

SEQ ID NO: 473637 - protein, 13 aa, Mycobacterium
ETSRTRDALRSSG

SEQ ID NO: 473638 - protein, 5 aa, Mycobacterium
ETSRV

SEQ ID NO: 473639 - protein, 7 aa, Mycobacterium
ETSSDGA

SEQ ID NO: 473640 - protein, 9 aa, Mycobacterium
ETSSDKLTT

SEQ ID NO: 473641 - protein, 7 aa, Mycobacterium
ETSSDVV

SEQ ID NO: 473642 - protein, 16 aa, Mycobacterium
ETSTAPAPQRQLTLSG

SEQ ID NO: 473643 - protein, 4 aa, Mycobacterium
ETSV

SEQ ID NO: 473644 - protein, 7 aa, Mycobacterium
ETSVDRE

SEQ ID NO: 473645 - protein, 4 aa, Mycobacterium
ETSW

SEQ ID NO: 473646 - protein, 5 aa, Mycobacterium
ETSWP

SEQ ID NO: 473647 - protein, 15 aa, Mycobacterium
ETSWPDNTPPGTSDL

SEQ ID NO: 473648 - protein, 6 aa, Mycobacterium
ETSYAS

SEQ ID NO: 473649 - protein, 13 aa, Mycobacterium
ETSYGPDGIGTAA

SEQ ID NO: 473650 - protein, 7 aa, Mycobacterium
ETSYGST

SEQ ID NO: 473651 - protein, 7 aa, Mycobacterium
ETSYPKR

SEQ ID NO: 473652 - protein, 10 aa, Mycobacterium
ETTAAHPNSR

SEQ ID NO: 473653 - protein, 12 aa, Mycobacterium
ETTADDDHLSAE

SEQ ID NO: 473654 - protein, 6 aa, Mycobacterium
ETTADL

SEQ ID NO: 473655 - protein, 10 aa, Mycobacterium
ETTADTDEFT

SEQ ID NO: 473656 - protein, 5 aa, Mycobacterium
ETTAE

SEQ ID NO: 473657 - protein, 9 aa, Mycobacterium
ETTAKTLPD

SEQ ID NO: 473658 - protein, 10 aa, Mycobacterium
ETTARSRGVQ

SEQ ID NO: 473659 - protein, 10 aa, Mycobacterium
ETTATRDGDS

SEQ ID NO: 473660 - protein, 5 aa, Mycobacterium
ETTAV

SEQ ID NO: 473661 - protein, 10 aa, Mycobacterium
ETTCGGGTVS

SEQ ID NO: 473662 - protein, 6 aa, Mycobacterium
ETTDEE

SEQ ID NO: 473663 - protein, 6 aa, Mycobacterium
ETTDEL

SEQ ID NO: 473664 - protein, 5 aa, Mycobacterium
ETTDF

SEQ ID NO: 473665 - protein, 8 aa, Mycobacterium
ETTDVTGT

SEQ ID NO: 473666 - protein, 7 aa, Mycobacterium
ETTENGW

SEQ ID NO: 473667 - protein, 6 aa, Mycobacterium
ETTETG

SEQ ID NO: 473668 - protein, 6 aa, Mycobacterium
ETTEYD

SEQ ID NO: 473669 - protein, 7 aa, Mycobacterium
ETTGDRE

SEQ ID NO: 473670 - protein, 6 aa, Mycobacterium
ETTGDV

SEQ ID NO: 473671 - protein, 9 aa, Mycobacterium
ETTGGPQIH

SEQ ID NO: 473672 - protein, 14 aa, Mycobacterium
ETTGGRAKATAPGG

SEQ ID NO: 473673 - protein, 13 aa, Mycobacterium
ETTGGSAENDAIT

SEQ ID NO: 473674 - protein, 20 aa, Mycobacterium
ETTGNSAIDGYQSENPDRVD

SEQ ID NO: 473675 - protein, 10 aa, Mycobacterium
ETTGQAHSDR

SEQ ID NO: 473676 - protein, 6 aa, Mycobacterium
ETTGQR

SEQ ID NO: 473677 - protein, 7 aa, Mycobacterium
ETTGRGI

SEQ ID NO: 473678 - protein, 7 aa, Mycobacterium
ETTGSEG

SEQ ID NO: 473679 - protein, 7 aa, Mycobacterium
ETTGSVM

SEQ ID NO: 473680 - protein, 4 aa, Mycobacterium
ETTH

SEQ ID NO: 473681 - protein, 5 aa, Mycobacterium
ETTHE

SEQ ID NO: 473682 - protein, 18 aa, Mycobacterium
ETTISGYDGSKGYDENRV

SEQ ID NO: 473683 - protein, 15 aa, Mycobacterium
ETTIVEGAGDSDAIA

SEQ ID NO: 473684 - protein, 4 aa, Mycobacterium
ETTL

SEQ ID NO: 473685 - protein, 8 aa, Mycobacterium
ETTMSSAA

SEQ ID NO: 473686 - protein, 10 aa, Mycobacterium
ETTNMDDATG

SEQ ID NO: 473687 - protein, 7 aa, Mycobacterium
ETTPGGA

SEQ ID NO: 473688 - protein, 5 aa, Mycobacterium
ETTPL

SEQ ID NO: 473689 - protein, 13 aa, Mycobacterium
ETTPPDATQWSTR

SEQ ID NO: 473690 - protein, 7 aa, Mycobacterium
ETTPPGL

SEQ ID NO: 473691 - protein, 7 aa, Mycobacterium
ETTPRAI

SEQ ID NO: 473692 - protein, 7 aa, Mycobacterium
ETTQDRI

SEQ ID NO: 473693 - protein, 6 aa, Mycobacterium
ETTQSK

SEQ ID NO: 473694 - protein, 10 aa, Mycobacterium
ETTQVRDQGM

SEQ ID NO: 473695 - protein, 10 aa, Mycobacterium
ETTQVREQGM

SEQ ID NO: 473696 - protein, 4 aa, Mycobacterium
ETTR

SEQ ID NO: 473697 - protein, 5 aa, Mycobacterium
ETTRA

SEQ ID NO: 473698 - protein, 10 aa, Mycobacterium
ETTRAYKPDS

SEQ ID NO: 473699 - protein, 6 aa, Mycobacterium
ETTRER

SEQ ID NO: 473700 - protein, 17 aa, Mycobacterium
ETTRNSTGTGLQGVTSG

SEQ ID NO: 473701 - protein, 23 aa, Mycobacterium
ETTRRTEAYEPTGGSRGQSSQFG

SEQ ID NO: 473702 - protein, 7 aa, Mycobacterium
ETTRTEP

SEQ ID NO: 473703 - protein, 7 aa, Mycobacterium
ETTRVTP

SEQ ID NO: 473704 - protein, 13 aa, Mycobacterium
ETTRWGGDTVTPF

SEQ ID NO: 473705 - protein, 8 aa, Mycobacterium
ETTSATAT

SEQ ID NO: 473706 - protein, 10 aa, Mycobacterium
ETTSDLGGYK

SEQ ID NO: 473707 - protein, 5 aa, Mycobacterium
ETTSM

SEQ ID NO: 473708 - protein, 5 aa, Mycobacterium
ETTSN

SEQ ID NO: 473709 - protein, 10 aa, Mycobacterium
ETTSNKDRKQ

SEQ ID NO: 473710 - protein, 5 aa, Mycobacterium
ETTSR

SEQ ID NO: 473711 - protein, 5 aa, Mycobacterium
ETTSW

SEQ ID NO: 473712 - protein, 4 aa, Mycobacterium
ETTT

SEQ ID NO: 473713 - protein, 6 aa, Mycobacterium
ETTTAH

SEQ ID NO: 473714 - protein, 7 aa, Mycobacterium
ETTTDAM

SEQ ID NO: 473715 - protein, 7 aa, Mycobacterium
ETTTDRL

SEQ ID NO: 473716 - protein, 6 aa, Mycobacterium
ETTTEK

SEQ ID NO: 473717 - protein, 8 aa, Mycobacterium
ETTTEKLT

SEQ ID NO: 473718 - protein, 7 aa, Mycobacterium
ETTTEKM

SEQ ID NO: 473719 - protein, 10 aa, Mycobacterium
ETTTSDDQGP

SEQ ID NO: 473720 - protein, 22 aa, Mycobacterium
ETTTTAEDHYPTDQEVMPCQPT

SEQ ID NO: 473721 - protein, 9 aa, Mycobacterium
ETTTTSDLE

SEQ ID NO: 473722 - protein, 4 aa, Mycobacterium
ETTV

SEQ ID NO: 473723 - protein, 9 aa, Mycobacterium
ETTVAGEPI

SEQ ID NO: 473724 - protein, 7 aa, Mycobacterium
ETTYRAS

SEQ ID NO: 473725 - protein, 8 aa, Mycobacterium
ETTYSPLP

SEQ ID NO: 473726 - protein, 10 aa, Mycobacterium
ETTYSPLPAT

SEQ ID NO: 473727 - protein, 4 aa, Mycobacterium
ETVA

SEQ ID NO: 473728 - protein, 16 aa, Mycobacterium
ETVAAEANPGGEGRVK

SEQ ID NO: 473729 - protein, 8 aa, Mycobacterium
ETVAASAR

SEQ ID NO: 473730 - protein, 7 aa, Mycobacterium
ETVAENR

SEQ ID NO: 473731 - protein, 32 aa, Mycobacterium
ETVAPSPARPGAPIPVASAGSGGGGGAMGGGV

SEQ ID NO: 473732 - protein, 7 aa, Mycobacterium
ETVAPTA

SEQ ID NO: 473733 - protein, 6 aa, Mycobacterium
ETVASD

SEQ ID NO: 473734 - protein, 5 aa, Mycobacterium
ETVAT

SEQ ID NO: 473735 - protein, 13 aa, Mycobacterium
ETVATSPAFRGAA

SEQ ID NO: 473736 - protein, 5 aa, Mycobacterium
ETVDD

SEQ ID NO: 473737 - protein, 16 aa, Mycobacterium
ETVDHDGREWTAHSDG

SEQ ID NO: 473738 - protein, 5 aa, Mycobacterium
ETVDS

SEQ ID NO: 473739 - protein, 12 aa, Mycobacterium
ETVECDGSTPIL

SEQ ID NO: 473740 - protein, 5 aa, Mycobacterium
ETVEE

SEQ ID NO: 473741 - protein, 12 aa, Mycobacterium
ETVEPVSAAPDD

SEQ ID NO: 473742 - protein, 5 aa, Mycobacterium
ETVGG

SEQ ID NO: 473743 - protein, 14 aa, Mycobacterium
ETVGPGDADAWPAQ

SEQ ID NO: 473744 - protein, 10 aa, Mycobacterium
ETVLPESQTP

SEQ ID NO: 473745 - protein, 9 aa, Mycobacterium
ETVNADPDV

SEQ ID NO: 473746 - protein, 5 aa, Mycobacterium
ETVND

SEQ ID NO: 473747 - protein, 4 aa, Mycobacterium
ETVP

SEQ ID NO: 473748 - protein, 7 aa, Mycobacterium
ETVPEAL

SEQ ID NO: 473749 - protein, 7 aa, Mycobacterium
ETVPPSV

SEQ ID NO: 473750 - protein, 8 aa, Mycobacterium
ETVPSPAR

SEQ ID NO: 473751 - protein, 5 aa, Mycobacterium
ETVQD

SEQ ID NO: 473752 - protein, 6 aa, Mycobacterium
ETVQRR

SEQ ID NO: 473753 - protein, 12 aa, Mycobacterium
ETVRAGRGGTMG

SEQ ID NO: 473754 - protein, 19 aa, Mycobacterium
ETVRAKDAELQKRAGKLTR

SEQ ID NO: 473755 - protein, 18 aa, Mycobacterium
ETVRAKDEALQQRRGKVT

SEQ ID NO: 473756 - protein, 12 aa, Mycobacterium
ETVRAQARSPQI

SEQ ID NO: 473757 - protein, 6 aa, Mycobacterium
ETVRGA

SEQ ID NO: 473758 - protein, 4 aa, Mycobacterium
ETVS

SEQ ID NO: 473759 - protein, 11 aa, Mycobacterium
ETVSANPTIAN

SEQ ID NO: 473760 - protein, 7 aa, Mycobacterium
ETVSGRN

SEQ ID NO: 473761 - protein, 13 aa, Mycobacterium
ETVSRDAKEDSDF

SEQ ID NO: 473762 - protein, 6 aa, Mycobacterium
ETVSSG

SEQ ID NO: 473763 - protein, 13 aa, Mycobacterium
ETVTADRSGTMGD

SEQ ID NO: 473764 - protein, 5 aa, Mycobacterium
ETVTP

SEQ ID NO: 473765 - protein, 14 aa, Mycobacterium
ETVTSAAWESKPSW

SEQ ID NO: 473766 - protein, 12 aa, Mycobacterium
ETVTTGPIQGSE

SEQ ID NO: 473767 - protein, 11 aa, Mycobacterium
ETWSESPGAHH

SEQ ID NO: 473768 - protein, 13 aa, Mycobacterium
ETWSSGRSPASNN

SEQ ID NO: 473769 - protein, 5 aa, Mycobacterium
ETYAP

SEQ ID NO: 473770 - protein, 10 aa, Mycobacterium
ETYEKRDGRW

SEQ ID NO: 473771 - protein, 8 aa, Mycobacterium
ETYEKRDS

SEQ ID NO: 473772 - protein, 5 aa, Mycobacterium
ETYEP

SEQ ID NO: 473773 - protein, 7 aa, Mycobacterium
ETYESGR

SEQ ID NO: 473774 - protein, 10 aa, Mycobacterium
ETYGNTEPGC

SEQ ID NO: 473775 - protein, 13 aa, Mycobacterium
ETYGRNSAEDVAP

SEQ ID NO: 473776 - protein, 14 aa, Mycobacterium
ETYGRNSDESLPPE

SEQ ID NO: 473777 - protein, 14 aa, Mycobacterium
ETYGRNSDQNLPPE

SEQ ID NO: 473778 - protein, 5 aa, Mycobacterium
ETYNR

SEQ ID NO: 473779 - protein, 4 aa, Mycobacterium
ETYP

SEQ ID NO: 473780 - protein, 11 aa, Mycobacterium
ETYPARADAYG

SEQ ID NO: 473781 - protein, 13 aa, Mycobacterium
ETYPERAKSTPQG

SEQ ID NO: 473782 - protein, 13 aa, Mycobacterium
ETYPGPRVDSDEE

SEQ ID NO: 473783 - protein, 5 aa, Mycobacterium
ETYPS

SEQ ID NO: 473784 - protein, 10 aa, Mycobacterium
ETYRGGSSDP

SEQ ID NO: 473785 - protein, 5 aa, Mycobacterium
ETYSS

SEQ ID NO: 473786 - protein, 7 aa, Mycobacterium
ETYSSAR

SEQ ID NO: 473787 - protein, 8 aa, Mycobacterium
ETYSSARG

SEQ ID NO: 473788 - protein, 40 aa, Mycobacterium
EVAAQESHALDTAAASLRAQGIDPSVRSGGSTPTVGAADD

SEQ ID NO: 473789 - protein, 6 aa, Mycobacterium
EVAARE

SEQ ID NO: 473790 - protein, 7 aa, Mycobacterium
EVAASSA

SEQ ID NO: 473791 - protein, 16 aa, Mycobacterium
EVAATESRWLELSELL

SEQ ID NO: 473792 - protein, 7 aa, Mycobacterium
EVAATQQ

SEQ ID NO: 473793 - protein, 4 aa, Mycobacterium
EVAD

SEQ ID NO: 473794 - protein, 8 aa, Mycobacterium
EVADGSRI

SEQ ID NO: 473795 - protein, 10 aa, Mycobacterium
EVADPDHGGS

SEQ ID NO: 473796 - protein, 9 aa, Mycobacterium
EVADRARAE

SEQ ID NO: 473797 - protein, 17 aa, Mycobacterium
EVAEAAADTVDLPSAEP

SEQ ID NO: 473798 - protein, 8 aa, Mycobacterium
EVAERSAS

SEQ ID NO: 473799 - protein, 6 aa, Mycobacterium
EVAGDP

SEQ ID NO: 473800 - protein, 6 aa, Mycobacterium
EVAGGA

SEQ ID NO: 473801 - protein, 5 aa, Mycobacterium
EVAGP

SEQ ID NO: 473802 - protein, 6 aa, Mycobacterium
EVAGQD

SEQ ID NO: 473803 - protein, 11 aa, Mycobacterium
EVAGSDALPEP

SEQ ID NO: 473804 - protein, 7 aa, Mycobacterium
EVAKAQA

SEQ ID NO: 473805 - protein, 7 aa, Mycobacterium
EVAKDAG

SEQ ID NO: 473806 - protein, 5 aa, Mycobacterium
EVANA

SEQ ID NO: 473807 - protein, 4 aa, Mycobacterium
EVAP

SEQ ID NO: 473808 - protein, 8 aa, Mycobacterium
EVAPDDPR

SEQ ID NO: 473809 - protein, 5 aa, Mycobacterium
EVAPE

SEQ ID NO: 473810 - protein, 6 aa, Mycobacterium
EVAPEG

SEQ ID NO: 473811 - protein, 29 aa, Mycobacterium
EVAPGTVAPVAPAARPQLPAGALTSASAA

SEQ ID NO: 473812 - protein, 7 aa, Mycobacterium
EVAPPEL

SEQ ID NO: 473813 - protein, 8 aa, Mycobacterium
EVAPPGAV

SEQ ID NO: 473814 - protein, 5 aa, Mycobacterium
EVAPR

SEQ ID NO: 473815 - protein, 6 aa, Mycobacterium
EVAPRG

SEQ ID NO: 473816 - protein, 5 aa, Mycobacterium
EVARD

SEQ ID NO: 473817 - protein, 6 aa, Mycobacterium
EVARDQ

SEQ ID NO: 473818 - protein, 9 aa, Mycobacterium
EVARGDLGD

SEQ ID NO: 473819 - protein, 15 aa, Mycobacterium
EVARGSNDGRPRNKF

SEQ ID NO: 473820 - protein, 15 aa, Mycobacterium
EVARGSRDGRPRNKF

SEQ ID NO: 473821 - protein, 18 aa, Mycobacterium
EVARGTVTPPHREGGQAQ

SEQ ID NO: 473822 - protein, 9 aa, Mycobacterium
EVARPGSDR

SEQ ID NO: 473823 - protein, 10 aa, Mycobacterium
EVARQARAAG

SEQ ID NO: 473824 - protein, 11 aa, Mycobacterium
EVARQDAREEL

SEQ ID NO: 473825 - protein, 5 aa, Mycobacterium
EVARR

SEQ ID NO: 473826 - protein, 7 aa, Mycobacterium
EVARRED

SEQ ID NO: 473827 - protein, 11 aa, Mycobacterium
EVARRGPGLVP

SEQ ID NO: 473828 - protein, 6 aa, Mycobacterium
EVASAR

SEQ ID NO: 473829 - protein, 9 aa, Mycobacterium
EVASGPRQR

SEQ ID NO: 473830 - protein, 16 aa, Mycobacterium
EVASTEGRWLELSEAL

SEQ ID NO: 473831 - protein, 10 aa, Mycobacterium
EVATEDSGIG

SEQ ID NO: 473832 - protein, 5 aa, Mycobacterium
EVATG

SEQ ID NO: 473833 - protein, 12 aa, Mycobacterium
EVATGGSGGPRR

SEQ ID NO: 473834 - protein, 9 aa, Mycobacterium
EVATNAGEL

SEQ ID NO: 473835 - protein, 16 aa, Mycobacterium
EVATTDGDRAQKTPWN

SEQ ID NO: 473836 - protein, 8 aa, Mycobacterium
EVDAANEH

SEQ ID NO: 473837 - protein, 10 aa, Mycobacterium
EVDAARERAN

SEQ ID NO: 473838 - protein, 7 aa, Mycobacterium
EVDAGDS

SEQ ID NO: 473839 - protein, 10 aa, Mycobacterium
EVDAGPTNNW

SEQ ID NO: 473840 - protein, 12 aa, Mycobacterium
EVDANRDTAVKE

SEQ ID NO: 473841 - protein, 27 aa, Mycobacterium
EVDASQYKTATRLGRAAAAAGDTSQAV

SEQ ID NO: 473842 - protein, 12 aa, Mycobacterium
EVDATKAPIATE

SEQ ID NO: 473843 - protein, 4 aa, Mycobacterium
EVDD

SEQ ID NO: 473844 - protein, 12 aa, Mycobacterium
EVDDDPAPGGAV

SEQ ID NO: 473845 - protein, 8 aa, Mycobacterium
EVDDEGKF

SEQ ID NO: 473846 - protein, 10 aa, Mycobacterium
EVDDSAPDRW

SEQ ID NO: 473847 - protein, 6 aa, Mycobacterium
EVDEDG

SEQ ID NO: 473848 - protein, 7 aa, Mycobacterium
EVDEDNA

SEQ ID NO: 473849 - protein, 8 aa, Mycobacterium
EVDEGDDI

SEQ ID NO: 473850 - protein, 5 aa, Mycobacterium
EVDER

SEQ ID NO: 473851 - protein, 7 aa, Mycobacterium
EVDETST

SEQ ID NO: 473852 - protein, 11 aa, Mycobacterium
EVDEVADESLE

SEQ ID NO: 473853 - protein, 5 aa, Mycobacterium
EVDGD

SEQ ID NO: 473854 - protein, 9 aa, Mycobacterium
EVDGERLSD

SEQ ID NO: 473855 - protein, 12 aa, Mycobacterium
EVDGKPNVVTPA

SEQ ID NO: 473856 - protein, 7 aa, Mycobacterium
EVDGQRK

SEQ ID NO: 473857 - protein, 9 aa, Mycobacterium
EVDGTEQSL

SEQ ID NO: 473858 - protein, 21 aa, Mycobacterium
EVDLSAEGDESEAEREEQQKE

SEQ ID NO: 473859 - protein, 7 aa, Mycobacterium
EVDPASA

SEQ ID NO: 473860 - protein, 7 aa, Mycobacterium
EVDPASV

SEQ ID NO: 473861 - protein, 7 aa, Mycobacterium
EVDPEDI

SEQ ID NO: 473862 - protein, 8 aa, Mycobacterium
EVDPGTGE

SEQ ID NO: 473863 - protein, 7 aa, Mycobacterium
EVDPRSD

SEQ ID NO: 473864 - protein, 4 aa, Mycobacterium
EVDQ

SEQ ID NO: 473865 - protein, 6 aa, Mycobacterium
EVDRAE

SEQ ID NO: 473866 - protein, 8 aa, Mycobacterium
EVDRARSE

SEQ ID NO: 473867 - protein, 36 aa, Mycobacterium
EVDRGEAERDRDEARRERDRAHADRGIAERDRDSIE

SEQ ID NO: 473868 - protein, 16 aa, Mycobacterium
EVDRPATRAPAYRKTQ

SEQ ID NO: 473869 - protein, 12 aa, Mycobacterium
EVDRSADGHHPV

SEQ ID NO: 473870 - protein, 5 aa, Mycobacterium
EVDSG

SEQ ID NO: 473871 - protein, 8 aa, Mycobacterium
EVDSGEHG

SEQ ID NO: 473872 - protein, 14 aa, Mycobacterium
EVDSRQRVQGSPPS

SEQ ID NO: 473873 - protein, 5 aa, Mycobacterium
EVDSS

SEQ ID NO: 473874 - protein, 6 aa, Mycobacterium
EVDSST

SEQ ID NO: 473875 - protein, 4 aa, Mycobacterium
EVDT

SEQ ID NO: 473876 - protein, 7 aa, Mycobacterium
EVDTDAR

SEQ ID NO: 473877 - protein, 9 aa, Mycobacterium
EVDTEKAQE

SEQ ID NO: 473878 - protein, 7 aa, Mycobacterium
EVDTPGW

SEQ ID NO: 473879 - protein, 5 aa, Mycobacterium
EVDTT

SEQ ID NO: 473880 - protein, 22 aa, Mycobacterium
EVDTTHGPGHAGGTRTDTSELD

SEQ ID NO: 473881 - protein, 7 aa, Mycobacterium
EVEADGS

SEQ ID NO: 473882 - protein, 7 aa, Mycobacterium
EVEADGT

SEQ ID NO: 473883 - protein, 5 aa, Mycobacterium
EVEAG

SEQ ID NO: 473884 - protein, 9 aa, Mycobacterium
EVEAGERGV

SEQ ID NO: 473885 - protein, 10 aa, Mycobacterium
EVEANGASDG

SEQ ID NO: 473886 - protein, 29 aa, Mycobacterium
EVEAPMATPPTDVPQAPSGLTAANNAAEQ

SEQ ID NO: 473887 - protein, 4 aa, Mycobacterium
EVEE

SEQ ID NO: 473888 - protein, 11 aa, Mycobacterium
EVEEAASSDPV

SEQ ID NO: 473889 - protein, 12 aa, Mycobacterium
EVEGDDGKRTER

SEQ ID NO: 473890 - protein, 9 aa, Mycobacterium
EVEGDPECQ

SEQ ID NO: 473891 - protein, 11 aa, Mycobacterium
EVEGDPESQQA

SEQ ID NO: 473892 - protein, 12 aa, Mycobacterium
EVEGEEVEGEET

SEQ ID NO: 473893 - protein, 7 aa, Mycobacterium
EVEGGGV

SEQ ID NO: 473894 - protein, 6 aa, Mycobacterium
EVEGQD

SEQ ID NO: 473895 - protein, 8 aa, Mycobacterium
EVEGQRMS

SEQ ID NO: 473896 - protein, 19 aa, Mycobacterium
EVEGSGKPACVAESVVRYV

SEQ ID NO: 473897 - protein, 12 aa, Mycobacterium
EVEGSSTFTGCR

SEQ ID NO: 473898 - protein, 6 aa, Mycobacterium
EVEGTD

SEQ ID NO: 473899 - protein, 24 aa, Mycobacterium
EVEGTESVSEAEADEAKADSEDEA

SEQ ID NO: 473900 - protein, 12 aa, Mycobacterium
EVELGSRNERPM

SEQ ID NO: 473901 - protein, 4 aa, Mycobacterium
EVEN

SEQ ID NO: 473902 - protein, 5 aa, Mycobacterium
EVEPE

SEQ ID NO: 473903 - protein, 20 aa, Mycobacterium
EVEPPSPSSKPVPAAFSPET

SEQ ID NO: 473904 - protein, 7 aa, Mycobacterium
EVEPSEL

SEQ ID NO: 473905 - protein, 13 aa, Mycobacterium
EVEPTGDGEEGPV

SEQ ID NO: 473906 - protein, 10 aa, Mycobacterium
EVEQGKPDAW

SEQ ID NO: 473907 - protein, 12 aa, Mycobacterium
EVEQPEGHHEEA

SEQ ID NO: 473908 - protein, 10 aa, Mycobacterium
EVERGDSWDP

SEQ ID NO: 473909 - protein, 9 aa, Mycobacterium
EVERRAPDL

SEQ ID NO: 473910 - protein, 10 aa, Mycobacterium
EVERRAPELA

SEQ ID NO: 473911 - protein, 13 aa, Mycobacterium
EVERRTGLDPAAD

SEQ ID NO: 473912 - protein, 5 aa, Mycobacterium
EVERT

SEQ ID NO: 473913 - protein, 6 aa, Mycobacterium
EVESDR

SEQ ID NO: 473914 - protein, 6 aa, Mycobacterium
EVESQG

SEQ ID NO: 473915 - protein, 9 aa, Mycobacterium
EVESSGLKG

SEQ ID NO: 473916 - protein, 5 aa, Mycobacterium
EVETF

SEQ ID NO: 473917 - protein, 6 aa, Mycobacterium
EVETNA

SEQ ID NO: 473918 - protein, 5 aa, Mycobacterium
EVETP

SEQ ID NO: 473919 - protein, 4 aa, Mycobacterium
EVFP

SEQ ID NO: 473920 - protein, 14 aa, Mycobacterium
EVGAAPGRFRAGPG

SEQ ID NO: 473921 - protein, 9 aa, Mycobacterium
EVGADGAGW

SEQ ID NO: 473922 - protein, 7 aa, Mycobacterium
EVGAGKT

SEQ ID NO: 473923 - protein, 7 aa, Mycobacterium
EVGAGRS

SEQ ID NO: 473924 - protein, 5 aa, Mycobacterium
EVGAK

SEQ ID NO: 473925 - protein, 16 aa, Mycobacterium
EVGASAGPFRAAPGEL

SEQ ID NO: 473926 - protein, 7 aa, Mycobacterium
EVGATAA

SEQ ID NO: 473927 - protein, 14 aa, Mycobacterium
EVGATAAAQLPPGY

SEQ ID NO: 473928 - protein, 13 aa, Mycobacterium
EVGATAAGQLPPG

SEQ ID NO: 473929 - protein, 8 aa, Mycobacterium
EVGDDPRS

SEQ ID NO: 473930 - protein, 11 aa, Mycobacterium
EVGDEYEKATF

SEQ ID NO: 473931 - protein, 5 aa, Mycobacterium
EVGDG

SEQ ID NO: 473932 - protein, 11 aa, Mycobacterium
EVGDGSADPTA

SEQ ID NO: 473933 - protein, 6 aa, Mycobacterium
EVGDGV

SEQ ID NO: 473934 - protein, 5 aa, Mycobacterium
EVGEA

SEQ ID NO: 473935 - protein, 12 aa, Mycobacterium
EVGEAIGASTAA

SEQ ID NO: 473936 - protein, 9 aa, Mycobacterium
EVGEAPGQY

SEQ ID NO: 473937 - protein, 6 aa, Mycobacterium
EVGEAT

SEQ ID NO: 473938 - protein, 9 aa, Mycobacterium
EVGEDGVDT

SEQ ID NO: 473939 - protein, 12 aa, Mycobacterium
EVGEDRVDPAPV

SEQ ID NO: 473940 - protein, 7 aa, Mycobacterium
EVGEGYA

SEQ ID NO: 473941 - protein, 14 aa, Mycobacterium
EVGESASAGGGPRR

SEQ ID NO: 473942 - protein, 31 aa, Mycobacterium
EVGGAPGASAPGEYHGTGGGPGDHGTADGGQ

SEQ ID NO: 473943 - protein, 12 aa, Mycobacterium
EVGGDRPQRHPD

SEQ ID NO: 473944 - protein, 6 aa, Mycobacterium
EVGGEP

SEQ ID NO: 473945 - protein, 15 aa, Mycobacterium
EVGGEPAGLGARDTL

SEQ ID NO: 473946 - protein, 9 aa, Mycobacterium
EVGGEPERF

SEQ ID NO: 473947 - protein, 10 aa, Mycobacterium
EVGGQHTGQG

SEQ ID NO: 473948 - protein, 6 aa, Mycobacterium
EVGGRD

SEQ ID NO: 473949 - protein, 8 aa, Mycobacterium
EVGGRRAG

SEQ ID NO: 473950 - protein, 8 aa, Mycobacterium
EVGITDSS

SEQ ID NO: 473951 - protein, 10 aa, Mycobacterium
EVGKAPNIAA

SEQ ID NO: 473952 - protein, 14 aa, Mycobacterium
EVGNQKKGGPPGYH

SEQ ID NO: 473953 - protein, 15 aa, Mycobacterium
EVGPAGASVSPIKTA

SEQ ID NO: 473954 - protein, 5 aa, Mycobacterium
EVGPD

SEQ ID NO: 473955 - protein, 7 aa, Mycobacterium
EVGPDDI

SEQ ID NO: 473956 - protein, 13 aa, Mycobacterium
EVGPGEHAYPPKW

SEQ ID NO: 473957 - protein, 10 aa, Mycobacterium
EVGPTGGGVG

SEQ ID NO: 473958 - protein, 12 aa, Mycobacterium
EVGPTKTRESRR

SEQ ID NO: 473959 - protein, 6 aa, Mycobacterium
EVGPTR

SEQ ID NO: 473960 - protein, 9 aa, Mycobacterium
EVGQDPALR

SEQ ID NO: 473961 - protein, 5 aa, Mycobacterium
EVGQE

SEQ ID NO: 473962 - protein, 6 aa, Mycobacterium
EVGQPT

SEQ ID NO: 473963 - protein, 7 aa, Mycobacterium
EVGQSPG

SEQ ID NO: 473964 - protein, 6 aa, Mycobacterium
EVGRGA

SEQ ID NO: 473965 - protein, 7 aa, Mycobacterium
EVGRQPR

SEQ ID NO: 473966 - protein, 12 aa, Mycobacterium
EVGSDDFGAEGW

SEQ ID NO: 473967 - protein, 5 aa, Mycobacterium
EVGSG

SEQ ID NO: 473968 - protein, 8 aa, Mycobacterium
EVGSGRSL

SEQ ID NO: 473969 - protein, 8 aa, Mycobacterium
EVGSIPGV

SEQ ID NO: 473970 - protein, 12 aa, Mycobacterium
EVGSQSDHGAQS

SEQ ID NO: 473971 - protein, 13 aa, Mycobacterium
EVGSQSDHGAQSE

SEQ ID NO: 473972 - protein, 11 aa, Mycobacterium
EVGSQSPAVGQ

SEQ ID NO: 473973 - protein, 13 aa, Mycobacterium
EVGSSSDHGAQSD

SEQ ID NO: 473974 - protein, 12 aa, Mycobacterium
EVGSTSDHGAQS

SEQ ID NO: 473975 - protein, 7 aa, Mycobacterium
EVGTEID

SEQ ID NO: 473976 - protein, 7 aa, Mycobacterium
EVGTGSA

SEQ ID NO: 473977 - protein, 8 aa, Mycobacterium
EVGTPEIA

SEQ ID NO: 473978 - protein, 11 aa, Mycobacterium
EVGTTNRTSLR

SEQ ID NO: 473979 - protein, 7 aa, Mycobacterium
EVHEARE

SEQ ID NO: 473980 - protein, 6 aa, Mycobacterium
EVHEGS

SEQ ID NO: 473981 - protein, 14 aa, Mycobacterium
EVHRSGKSLYDSTI

SEQ ID NO: 473982 - protein, 19 aa, Mycobacterium
EVHTPAPPHPPVPEPGAQR

SEQ ID NO: 473983 - protein, 11 aa, Mycobacterium
EVKAGRGTPHG

SEQ ID NO: 473984 - protein, 15 aa, Mycobacterium
EVKDAATASLESGIG

SEQ ID NO: 473985 - protein, 6 aa, Mycobacterium
EVKDDS

SEQ ID NO: 473986 - protein, 8 aa, Mycobacterium
EVKDEDGK

SEQ ID NO: 473987 - protein, 8 aa, Mycobacterium
EVKDPDGT

SEQ ID NO: 473988 - protein, 5 aa, Mycobacterium
EVKED

SEQ ID NO: 473989 - protein, 8 aa, Mycobacterium
EVKEETGL

SEQ ID NO: 473990 - protein, 5 aa, Mycobacterium
EVKPA

SEQ ID NO: 473991 - protein, 10 aa, Mycobacterium
EVKPSGGDLG

SEQ ID NO: 473992 - protein, 15 aa, Mycobacterium
EVKQPSASVREDLTS

SEQ ID NO: 473993 - protein, 5 aa, Mycobacterium
EVKRR

SEQ ID NO: 473994 - protein, 9 aa, Mycobacterium
EVKSNYAER

SEQ ID NO: 473995 - protein, 6 aa, Mycobacterium
EVLSSG

SEQ ID NO: 473996 - protein, 4 aa, Mycobacterium
EVMP

SEQ ID NO: 473997 - protein, 6 aa, Mycobacterium
EVNGEV

SEQ ID NO: 473998 - protein, 11 aa, Mycobacterium
EVNGEVKQHAR

SEQ ID NO: 473999 - protein, 8 aa, Mycobacterium
EVNGPKRT

SEQ ID NO: 474000 - protein, 10 aa, Mycobacterium
EVNPANGGVA

SEQ ID NO: 474001 - protein, 7 aa, Mycobacterium
EVNPTAV

SEQ ID NO: 474002 - protein, 6 aa, Mycobacterium
EVNPTT

SEQ ID NO: 474003 - protein, 12 aa, Mycobacterium
EVNQAARRDTSQ

SEQ ID NO: 474004 - protein, 19 aa, Mycobacterium
EVNQAARRKPKEEQGPYES

SEQ ID NO: 474005 - protein, 19 aa, Mycobacterium
EVNQAARRKPRDEQRPYEN

SEQ ID NO: 474006 - protein, 17 aa, Mycobacterium
EVNRRHKREQYDEFAEK

SEQ ID NO: 474007 - protein, 7 aa, Mycobacterium
EVNTAGD

SEQ ID NO: 474008 - protein, 8 aa, Mycobacterium
EVNTAGDG

SEQ ID NO: 474009 - protein, 18 aa, Mycobacterium
EVPAAANRDWTGTTRTSW

SEQ ID NO: 474010 - protein, 9 aa, Mycobacterium
EVPAQLGTK

SEQ ID NO: 474011 - protein, 4 aa, Mycobacterium
EVPD

SEQ ID NO: 474012 - protein, 8 aa, Mycobacterium
EVPDDLTP

SEQ ID NO: 474013 - protein, 8 aa, Mycobacterium
EVPDDPWG

SEQ ID NO: 474014 - protein, 8 aa, Mycobacterium
EVPDEQAG

SEQ ID NO: 474015 - protein, 9 aa, Mycobacterium
EVPDLPRKE

SEQ ID NO: 474016 - protein, 8 aa, Mycobacterium
EVPDPQLP

SEQ ID NO: 474017 - protein, 8 aa, Mycobacterium
EVPDRGLT

SEQ ID NO: 474018 - protein, 8 aa, Mycobacterium
EVPDTTAA

SEQ ID NO: 474019 - protein, 35 aa, Mycobacterium
EVPDTTDRWDGDGIGDSVDSDGEPIDNQVGDARAG

SEQ ID NO: 474020 - protein, 6 aa, Mycobacterium
EVPEEP

SEQ ID NO: 474021 - protein, 5 aa, Mycobacterium
EVPEG

SEQ ID NO: 474022 - protein, 6 aa, Mycobacterium
EVPEGE

SEQ ID NO: 474023 - protein, 7 aa, Mycobacterium
EVPEGTD

SEQ ID NO: 474024 - protein, 6 aa, Mycobacterium
EVPERI

SEQ ID NO: 474025 - protein, 5 aa, Mycobacterium
EVPET

SEQ ID NO: 474026 - protein, 11 aa, Mycobacterium
EVPGAAGSEQW

SEQ ID NO: 474027 - protein, 15 aa, Mycobacterium
EVPGAVPTPDPTPDE

SEQ ID NO: 474028 - protein, 5 aa, Mycobacterium
EVPGD

SEQ ID NO: 474029 - protein, 5 aa, Mycobacterium
EVPGE

SEQ ID NO: 474030 - protein, 14 aa, Mycobacterium
EVPGLTSTAGPSAI

SEQ ID NO: 474031 - protein, 15 aa, Mycobacterium
EVPGPLPPSGSAKAV

SEQ ID NO: 474032 - protein, 14 aa, Mycobacterium
EVPGPLPPSGSARA

SEQ ID NO: 474033 - protein, 6 aa, Mycobacterium
EVPGPT

SEQ ID NO: 474034 - protein, 7 aa, Mycobacterium
EVPGQER

SEQ ID NO: 474035 - protein, 6 aa, Mycobacterium
EVPGRT

SEQ ID NO: 474036 - protein, 12 aa, Mycobacterium
EVPGSDGINPHD

SEQ ID NO: 474037 - protein, 7 aa, Mycobacterium
EVPGSEG

SEQ ID NO: 474038 - protein, 9 aa, Mycobacterium
EVPKSDRRY

SEQ ID NO: 474039 - protein, 11 aa, Mycobacterium
EVPKTTSGKIQ

SEQ ID NO: 474040 - protein, 4 aa, Mycobacterium
EVPL

SEQ ID NO: 474041 - protein, 7 aa, Mycobacterium
EVPLPPT

SEQ ID NO: 474042 - protein, 4 aa, Mycobacterium
EVPP

SEQ ID NO: 474043 - protein, 5 aa, Mycobacterium
EVPPD

SEQ ID NO: 474044 - protein, 6 aa, Mycobacterium
EVPPDR

SEQ ID NO: 474045 - protein, 7 aa, Mycobacterium
EVPPEQV

SEQ ID NO: 474046 - protein, 8 aa, Mycobacterium
EVPPGVGG

SEQ ID NO: 474047 - protein, 6 aa, Mycobacterium
EVPPIP

SEQ ID NO: 474048 - protein, 14 aa, Mycobacterium
EVPPPPDTPGSFSP

SEQ ID NO: 474049 - protein, 11 aa, Mycobacterium
EVPPPQNDDPL

SEQ ID NO: 474050 - protein, 8 aa, Mycobacterium
EVPPPTPP

SEQ ID NO: 474051 - protein, 20 aa, Mycobacterium
EVPPPTPRRPVDAFLEVRPR

SEQ ID NO: 474052 - protein, 9 aa, Mycobacterium
EVPPPYDDD

SEQ ID NO: 474053 - protein, 8 aa, Mycobacterium
EVPPQTAS

SEQ ID NO: 474054 - protein, 9 aa, Mycobacterium
EVPPQTASR

SEQ ID NO: 474055 - protein, 7 aa, Mycobacterium
EVPPSDA

SEQ ID NO: 474056 - protein, 13 aa, Mycobacterium
EVPRGKPAPDPYL

SEQ ID NO: 474057 - protein, 22 aa, Mycobacterium
EVPRPADGRKSLSDNYYSTAIK

SEQ ID NO: 474058 - protein, 9 aa, Mycobacterium
EVPRPGPSE

SEQ ID NO: 474059 - protein, 6 aa, Mycobacterium
EVPSDG

SEQ ID NO: 474060 - protein, 6 aa, Mycobacterium
EVPSES

SEQ ID NO: 474061 - protein, 9 aa, Mycobacterium
EVPSTIDEG

SEQ ID NO: 474062 - protein, 7 aa, Mycobacterium
EVPSTTR

SEQ ID NO: 474063 - protein, 13 aa, Mycobacterium
EVPTAETVKAGAA

SEQ ID NO: 474064 - protein, 9 aa, Mycobacterium
EVPTATSVR

SEQ ID NO: 474065 - protein, 10 aa, Mycobacterium
EVPTATSVRA

SEQ ID NO: 474066 - protein, 8 aa, Mycobacterium
EVPTGETG

SEQ ID NO: 474067 - protein, 8 aa, Mycobacterium
EVPTGGAS

SEQ ID NO: 474068 - protein, 15 aa, Mycobacterium
EVPTIQSNPSARESA

SEQ ID NO: 474069 - protein, 14 aa, Mycobacterium
EVPTPGSEGLTRSR

SEQ ID NO: 474070 - protein, 16 aa, Mycobacterium
EVPTPPIAPAPEAPRV

SEQ ID NO: 474071 - protein, 15 aa, Mycobacterium
EVPTVRTNPSARKSA

SEQ ID NO: 474072 - protein, 8 aa, Mycobacterium
EVQANPKV

SEQ ID NO: 474073 - protein, 7 aa, Mycobacterium
EVQANPR

SEQ ID NO: 474074 - protein, 13 aa, Mycobacterium
EVQGGGNITPLSK

SEQ ID NO: 474075 - protein, 15 aa, Mycobacterium
EVQGSVAGESAGRRR

SEQ ID NO: 474076 - protein, 16 aa, Mycobacterium
EVQNPEPDWPQTDGPK

SEQ ID NO: 474077 - protein, 9 aa, Mycobacterium
EVQNPPPYW

SEQ ID NO: 474078 - protein, 4 aa, Mycobacterium
EVQP

SEQ ID NO: 474079 - protein, 55 aa, Mycobacterium
EVQPDAGLPVGAPPPPEASLPPLPPPPADPMAPAPPMAGPPPVDPFAPPPPPEPA

SEQ ID NO: 474080 - protein, 16 aa, Mycobacterium
EVQPGESAVARFRIKV

SEQ ID NO: 474081 - protein, 10 aa, Mycobacterium
EVQPNDTPGV

SEQ ID NO: 474082 - protein, 8 aa, Mycobacterium
EVQPPGYG

SEQ ID NO: 474083 - protein, 9 aa, Mycobacterium
EVQQGERLA

SEQ ID NO: 474084 - protein, 17 aa, Mycobacterium
EVQSFTPPKGLKPGDYR

SEQ ID NO: 474085 - protein, 5 aa, Mycobacterium
EVQTD

SEQ ID NO: 474086 - protein, 21 aa, Mycobacterium
EVRAQRRTDQNIANGRPGDYE

SEQ ID NO: 474087 - protein, 7 aa, Mycobacterium
EVRATAA

SEQ ID NO: 474088 - protein, 4 aa, Mycobacterium
EVRD

SEQ ID NO: 474089 - protein, 15 aa, Mycobacterium
EVRDGDPSPDGAGPL

SEQ ID NO: 474090 - protein, 14 aa, Mycobacterium
EVRDGDPSPDGAGV

SEQ ID NO: 474091 - protein, 5 aa, Mycobacterium
EVREE

SEQ ID NO: 474092 - protein, 13 aa, Mycobacterium
EVREGDPSPDGAG

SEQ ID NO: 474093 - protein, 15 aa, Mycobacterium
EVREGDPSPDGAGPL

SEQ ID NO: 474094 - protein, 7 aa, Mycobacterium
EVREKEA

SEQ ID NO: 474095 - protein, 8 aa, Mycobacterium
EVRERVGA

SEQ ID NO: 474096 - protein, 11 aa, Mycobacterium
EVRGAGKDDIA

SEQ ID NO: 474097 - protein, 11 aa, Mycobacterium
EVRGDDSREAK

SEQ ID NO: 474098 - protein, 17 aa, Mycobacterium
EVRGGHERRDARTHAIA

SEQ ID NO: 474099 - protein, 6 aa, Mycobacterium
EVRGND

SEQ ID NO: 474100 - protein, 5 aa, Mycobacterium
EVRGT

SEQ ID NO: 474101 - protein, 11 aa, Mycobacterium
EVRKGERLAEA

SEQ ID NO: 474102 - protein, 7 aa, Mycobacterium
EVRKNGT

SEQ ID NO: 474103 - protein, 6 aa, Mycobacterium
EVRPEA

SEQ ID NO: 474104 - protein, 13 aa, Mycobacterium
EVRPEDEQLTRDG

SEQ ID NO: 474105 - protein, 15 aa, Mycobacterium
EVRPGDEQVTRDGVA

SEQ ID NO: 474106 - protein, 7 aa, Mycobacterium
EVRPGEL

SEQ ID NO: 474107 - protein, 7 aa, Mycobacterium
EVRPGVD

SEQ ID NO: 474108 - protein, 6 aa, Mycobacterium
EVRPQL

SEQ ID NO: 474109 - protein, 5 aa, Mycobacterium
EVRPS

SEQ ID NO: 474110 - protein, 32 aa, Mycobacterium
EVRPSLSQQQALAEAPNDAEGRFAVPRILGEP

SEQ ID NO: 474111 - protein, 5 aa, Mycobacterium
EVRRA

SEQ ID NO: 474112 - protein, 14 aa, Mycobacterium
EVRRGAPSANARWG

SEQ ID NO: 474113 - protein, 10 aa, Mycobacterium
EVRRGAPTAN

SEQ ID NO: 474114 - protein, 6 aa, Mycobacterium
EVRRGQ

SEQ ID NO: 474115 - protein, 6 aa, Mycobacterium
EVRRGR

SEQ ID NO: 474116 - protein, 10 aa, Mycobacterium
EVRRGTPTAN

SEQ ID NO: 474117 - protein, 6 aa, Mycobacterium
EVRRPR

SEQ ID NO: 474118 - protein, 14 aa, Mycobacterium
EVRRRDRETGENFS

SEQ ID NO: 474119 - protein, 8 aa, Mycobacterium
EVRRSADQ

SEQ ID NO: 474120 - protein, 8 aa, Mycobacterium
EVRRTGRK

SEQ ID NO: 474121 - protein, 5 aa, Mycobacterium
EVRSG

SEQ ID NO: 474122 - protein, 10 aa, Mycobacterium
EVRSPDSACN

SEQ ID NO: 474123 - protein, 15 aa, Mycobacterium
EVRSQRQPDDASADA

SEQ ID NO: 474124 - protein, 7 aa, Mycobacterium
EVRTGDP

SEQ ID NO: 474125 - protein, 16 aa, Mycobacterium
EVRTGETVDVAFLAQR

SEQ ID NO: 474126 - protein, 16 aa, Mycobacterium
EVRTPSGNEDPPTTQS

SEQ ID NO: 474127 - protein, 12 aa, Mycobacterium
EVRTSHAGPEHW

SEQ ID NO: 474128 - protein, 4 aa, Mycobacterium
EVSA

SEQ ID NO: 474129 - protein, 10 aa, Mycobacterium
EVSAFTDPNR

SEQ ID NO: 474130 - protein, 7 aa, Mycobacterium
EVSAGRQ

SEQ ID NO: 474131 - protein, 13 aa, Mycobacterium
EVSAGTQVQVWDL

SEQ ID NO: 474132 - protein, 9 aa, Mycobacterium
EVSAKDDEV

SEQ ID NO: 474133 - protein, 8 aa, Mycobacterium
EVSANRTQ

SEQ ID NO: 474134 - protein, 5 aa, Mycobacterium
EVSAP

SEQ ID NO: 474135 - protein, 7 aa, Mycobacterium
EVSAQRR

SEQ ID NO: 474136 - protein, 12 aa, Mycobacterium
EVSAQTGLASGE

SEQ ID NO: 474137 - protein, 5 aa, Mycobacterium
EVSAR

SEQ ID NO: 474138 - protein, 12 aa, Mycobacterium
EVSCPTGAIVVE

SEQ ID NO: 474139 - protein, 11 aa, Mycobacterium
EVSDDDVETEL

SEQ ID NO: 474140 - protein, 12 aa, Mycobacterium
EVSDDQENEASR

SEQ ID NO: 474141 - protein, 19 aa, Mycobacterium
EVSDEDPAAELAAGRTPKL

SEQ ID NO: 474142 - protein, 10 aa, Mycobacterium
EVSDEDVDAE

SEQ ID NO: 474143 - protein, 6 aa, Mycobacterium
EVSDEE

SEQ ID NO: 474144 - protein, 15 aa, Mycobacterium
EVSDEPDDPKYGPVG

SEQ ID NO: 474145 - protein, 11 aa, Mycobacterium
EVSDTDDPDID

SEQ ID NO: 474146 - protein, 14 aa, Mycobacterium
EVSEAAPAPGGPRR

SEQ ID NO: 474147 - protein, 14 aa, Mycobacterium
EVSEAQPWQQGGQT

SEQ ID NO: 474148 - protein, 20 aa, Mycobacterium
EVSEDADGADLKPRKLRPGD

SEQ ID NO: 474149 - protein, 8 aa, Mycobacterium
EVSEDDRF

SEQ ID NO: 474150 - protein, 9 aa, Mycobacterium
EVSEEANDR

SEQ ID NO: 474151 - protein, 11 aa, Mycobacterium
EVSEEKKTALG

SEQ ID NO: 474152 - protein, 5 aa, Mycobacterium
EVSEQ

SEQ ID NO: 474153 - protein, 6 aa, Mycobacterium
EVSEQL

SEQ ID NO: 474154 - protein, 10 aa, Mycobacterium
EVSETAPAYA

SEQ ID NO: 474155 - protein, 11 aa, Mycobacterium
EVSETETRTQA

SEQ ID NO: 474156 - protein, 7 aa, Mycobacterium
EVSETST

SEQ ID NO: 474157 - protein, 9 aa, Mycobacterium
EVSGAGESA

SEQ ID NO: 474158 - protein, 8 aa, Mycobacterium
EVSGGEAY

SEQ ID NO: 474159 - protein, 6 aa, Mycobacterium
EVSGGK

SEQ ID NO: 474160 - protein, 7 aa, Mycobacterium
EVSGGQT

SEQ ID NO: 474161 - protein, 6 aa, Mycobacterium
EVSGRG

SEQ ID NO: 474162 - protein, 9 aa, Mycobacterium
EVSGRGAQI

SEQ ID NO: 474163 - protein, 6 aa, Mycobacterium
EVSGSV

SEQ ID NO: 474164 - protein, 5 aa, Mycobacterium
EVSGY

SEQ ID NO: 474165 - protein, 4 aa, Mycobacterium
EVSH

SEQ ID NO: 474166 - protein, 10 aa, Mycobacterium
EVSKAANALT

SEQ ID NO: 474167 - protein, 8 aa, Mycobacterium
EVSNPDAV

SEQ ID NO: 474168 - protein, 8 aa, Mycobacterium
EVSNSDSV

SEQ ID NO: 474169 - protein, 11 aa, Mycobacterium
EVSNSTGAAEF

SEQ ID NO: 474170 - protein, 4 aa, Mycobacterium
EVSP

SEQ ID NO: 474171 - protein, 7 aa, Mycobacterium
EVSPAEP

SEQ ID NO: 474172 - protein, 7 aa, Mycobacterium
EVSPAPD

SEQ ID NO: 474173 - protein, 7 aa, Mycobacterium
EVSPDDV

SEQ ID NO: 474174 - protein, 5 aa, Mycobacterium
EVSPE

SEQ ID NO: 474175 - protein, 9 aa, Mycobacterium
EVSPEAAEQ

SEQ ID NO: 474176 - protein, 7 aa, Mycobacterium
EVSPEEI

SEQ ID NO: 474177 - protein, 14 aa, Mycobacterium
EVSPVATAARDSVA

SEQ ID NO: 474178 - protein, 10 aa, Mycobacterium
EVSQADGKGF

SEQ ID NO: 474179 - protein, 9 aa, Mycobacterium
EVSQSQSAA

SEQ ID NO: 474180 - protein, 9 aa, Mycobacterium
EVSQTGKPV

SEQ ID NO: 474181 - protein, 13 aa, Mycobacterium
EVSRDELSASAQR

SEQ ID NO: 474182 - protein, 12 aa, Mycobacterium
EVSRDQASPQFR

SEQ ID NO: 474183 - protein, 4 aa, Mycobacterium
EVSS

SEQ ID NO: 474184 - protein, 14 aa, Mycobacterium
EVSSQGELDEASWG

SEQ ID NO: 474185 - protein, 5 aa, Mycobacterium
EVSTE

SEQ ID NO: 474186 - protein, 8 aa, Mycobacterium
EVSTGAPV

SEQ ID NO: 474187 - protein, 5 aa, Mycobacterium
EVSTI

SEQ ID NO: 474188 - protein, 8 aa, Mycobacterium
EVSTPPSG

SEQ ID NO: 474189 - protein, 10 aa, Mycobacterium
EVSYEKEHRD

SEQ ID NO: 474190 - protein, 4 aa, Mycobacterium
EVTA

SEQ ID NO: 474191 - protein, 5 aa, Mycobacterium
EVTAE

SEQ ID NO: 474192 - protein, 10 aa, Mycobacterium
EVTAEQKRRA

SEQ ID NO: 474193 - protein, 10 aa, Mycobacterium
EVTAESGTEL

SEQ ID NO: 474194 - protein, 8 aa, Mycobacterium
EVTAETTS

SEQ ID NO: 474195 - protein, 9 aa, Mycobacterium
EVTARDREV

SEQ ID NO: 474196 - protein, 19 aa, Mycobacterium
EVTARDREVANKFSKDGQI

SEQ ID NO: 474197 - protein, 11 aa, Mycobacterium
EVTDAEGQPVI

SEQ ID NO: 474198 - protein, 10 aa, Mycobacterium
EVTDDEGKPV

SEQ ID NO: 474199 - protein, 8 aa, Mycobacterium
EVTDPDEH

SEQ ID NO: 474200 - protein, 17 aa, Mycobacterium
EVTDTADGPQWLLGGDG

SEQ ID NO: 474201 - protein, 18 aa, Mycobacterium
EVTDTGDGPQWSLLDGTD

SEQ ID NO: 474202 - protein, 20 aa, Mycobacterium
EVTEAPVEASEPADVAAPAE

SEQ ID NO: 474203 - protein, 12 aa, Mycobacterium
EVTEDGSPQGAR

SEQ ID NO: 474204 - protein, 9 aa, Mycobacterium
EVTEEANGR

SEQ ID NO: 474205 - protein, 6 aa, Mycobacterium
EVTEEN

SEQ ID NO: 474206 - protein, 9 aa, Mycobacterium
EVTEESVDM

SEQ ID NO: 474207 - protein, 17 aa, Mycobacterium
EVTEPEGAGAAGGGAKE

SEQ ID NO: 474208 - protein, 7 aa, Mycobacterium
EVTESTR

SEQ ID NO: 474209 - protein, 7 aa, Mycobacterium
EVTETTT

SEQ ID NO: 474210 - protein, 15 aa, Mycobacterium
EVTGDRRIHKLFVDS

SEQ ID NO: 474211 - protein, 12 aa, Mycobacterium
EVTGEDRDRIYS

SEQ ID NO: 474212 - protein, 9 aa, Mycobacterium
EVTGESGGG

SEQ ID NO: 474213 - protein, 5 aa, Mycobacterium
EVTGG

SEQ ID NO: 474214 - protein, 6 aa, Mycobacterium
EVTGGD

SEQ ID NO: 474215 - protein, 11 aa, Mycobacterium
EVTGGVARSTE

SEQ ID NO: 474216 - protein, 10 aa, Mycobacterium
EVTGPEPGSV

SEQ ID NO: 474217 - protein, 10 aa, Mycobacterium
EVTGSDGCHG

SEQ ID NO: 474218 - protein, 10 aa, Mycobacterium
EVTGSLDDGQ

SEQ ID NO: 474219 - protein, 5 aa, Mycobacterium
EVTKA

SEQ ID NO: 474220 - protein, 5 aa, Mycobacterium
EVTPA

SEQ ID NO: 474221 - protein, 7 aa, Mycobacterium
EVTPDDA

SEQ ID NO: 474222 - protein, 7 aa, Mycobacterium
EVTPENE

SEQ ID NO: 474223 - protein, 11 aa, Mycobacterium
EVTPENEADVR

SEQ ID NO: 474224 - protein, 11 aa, Mycobacterium
EVTPENEAQVK

SEQ ID NO: 474225 - protein, 10 aa, Mycobacterium
EVTPENEARV

SEQ ID NO: 474226 - protein, 8 aa, Mycobacterium
EVTPENEE

SEQ ID NO: 474227 - protein, 10 aa, Mycobacterium
EVTPENEHDV

SEQ ID NO: 474228 - protein, 12 aa, Mycobacterium
EVTPEQAGAHPT

SEQ ID NO: 474229 - protein, 8 aa, Mycobacterium
EVTPLSAN

SEQ ID NO: 474230 - protein, 10 aa, Mycobacterium
EVTPSARPPA

SEQ ID NO: 474231 - protein, 8 aa, Mycobacterium
EVTPTPAT

SEQ ID NO: 474232 - protein, 6 aa, Mycobacterium
EVTRGA

SEQ ID NO: 474233 - protein, 8 aa, Mycobacterium
EVTRGNRS

SEQ ID NO: 474234 - protein, 8 aa, Mycobacterium
EVTRGQRQ

SEQ ID NO: 474235 - protein, 47 aa, Mycobacterium
EVTRGTEATSTTRTARAADPTGATIAEQPPTGPAVTADTAVTANTAA

SEQ ID NO: 474236 - protein, 10 aa, Mycobacterium
EVTRRGAEGA

SEQ ID NO: 474237 - protein, 10 aa, Mycobacterium
EVTRSTPEKS

SEQ ID NO: 474238 - protein, 9 aa, Mycobacterium
EVTRTGNAR

SEQ ID NO: 474239 - protein, 5 aa, Mycobacterium
EVTSI

SEQ ID NO: 474240 - protein, 10 aa, Mycobacterium
EVTSPPGSRR

SEQ ID NO: 474241 - protein, 16 aa, Mycobacterium
EVTSPSPQGVRESDGC

SEQ ID NO: 474242 - protein, 8 aa, Mycobacterium
EVTSRENN

SEQ ID NO: 474243 - protein, 4 aa, Mycobacterium
EVTT

SEQ ID NO: 474244 - protein, 13 aa, Mycobacterium
EVTTAPMSDQGVE

SEQ ID NO: 474245 - protein, 12 aa, Mycobacterium
EVTTASTATTPA

SEQ ID NO: 474246 - protein, 5 aa, Mycobacterium
EVTTE

SEQ ID NO: 474247 - protein, 15 aa, Mycobacterium
EVTTFSDGQAADDGE

SEQ ID NO: 474248 - protein, 5 aa, Mycobacterium
EVTTG

SEQ ID NO: 474249 - protein, 9 aa, Mycobacterium
EVTTGRAAA

SEQ ID NO: 474250 - protein, 7 aa, Mycobacterium
EVTTGRG

SEQ ID NO: 474251 - protein, 10 aa, Mycobacterium
EVTTPTPRQQ

SEQ ID NO: 474252 - protein, 19 aa, Mycobacterium
EVTTQLAPGTGGQAVPTSN

SEQ ID NO: 474253 - protein, 5 aa, Mycobacterium
EVTTS

SEQ ID NO: 474254 - protein, 19 aa, Mycobacterium
EVTTYGSGGHRPAATSDAE

SEQ ID NO: 474255 - protein, 12 aa, Mycobacterium
EVVETAADSVTV

SEQ ID NO: 474256 - protein, 10 aa, Mycobacterium
EVVGSGDGAV

SEQ ID NO: 474257 - protein, 14 aa, Mycobacterium
EVVNPDKSKPPPRS

SEQ ID NO: 474258 - protein, 8 aa, Mycobacterium
EVVPQPGG

SEQ ID NO: 474259 - protein, 4 aa, Mycobacterium
EVVT

SEQ ID NO: 474260 - protein, 14 aa, Mycobacterium
EVYGSGGAQAAPAS

SEQ ID NO: 474261 - protein, 6 aa, Mycobacterium
EVYGTR

SEQ ID NO: 474262 - protein, 8 aa, Mycobacterium
EVYPDSTD

SEQ ID NO: 474263 - protein, 9 aa, Mycobacterium
EWAASPTDL

SEQ ID NO: 474264 - protein, 7 aa, Mycobacterium
EWADGHQ

SEQ ID NO: 474265 - protein, 8 aa, Mycobacterium
EWAETSDG

SEQ ID NO: 474266 - protein, 7 aa, Mycobacterium
EWAGPRS

SEQ ID NO: 474267 - protein, 7 aa, Mycobacterium
EWAPRPS

SEQ ID NO: 474268 - protein, 8 aa, Mycobacterium
EWATTKNT

SEQ ID NO: 474269 - protein, 5 aa, Mycobacterium
EWDAE

SEQ ID NO: 474270 - protein, 8 aa, Mycobacterium
EWDPKKPL

SEQ ID NO: 474271 - protein, 14 aa, Mycobacterium
EWDRPGRAVTNRHG

SEQ ID NO: 474272 - protein, 8 aa, Mycobacterium
EWEAPDPR

SEQ ID NO: 474273 - protein, 5 aa, Mycobacterium
EWEGE

SEQ ID NO: 474274 - protein, 8 aa, Mycobacterium
EWESPSGR

SEQ ID NO: 474275 - protein, 7 aa, Mycobacterium
EWGAPTA

SEQ ID NO: 474276 - protein, 24 aa, Mycobacterium
EWGASAAGVGPWPGEHPDDPRYDP

SEQ ID NO: 474277 - protein, 4 aa, Mycobacterium
EWGG

SEQ ID NO: 474278 - protein, 9 aa, Mycobacterium
EWGTDERDH

SEQ ID NO: 474279 - protein, 7 aa, Mycobacterium
EWHGADG

SEQ ID NO: 474280 - protein, 11 aa, Mycobacterium
EWKPSEAAENI

SEQ ID NO: 474281 - protein, 5 aa, Mycobacterium
EWKRE

SEQ ID NO: 474282 - protein, 9 aa, Mycobacterium
EWKTSESVE

SEQ ID NO: 474283 - protein, 4 aa, Mycobacterium
EWNG

SEQ ID NO: 474284 - protein, 7 aa, Mycobacterium
EWPAPET

SEQ ID NO: 474285 - protein, 6 aa, Mycobacterium
EWPDDP

SEQ ID NO: 474286 - protein, 8 aa, Mycobacterium
EWPESTKH

SEQ ID NO: 474287 - protein, 9 aa, Mycobacterium
EWPESTKHL

SEQ ID NO: 474288 - protein, 34 aa, Mycobacterium
EWPESTKHLRTRSDISEESREKIGGRNAQRFYAL

SEQ ID NO: 474289 - protein, 23 aa, Mycobacterium
EWPESTKQLRTRTDIGEQSRNKI

SEQ ID NO: 474290 - protein, 5 aa, Mycobacterium
EWPGS

SEQ ID NO: 474291 - protein, 14 aa, Mycobacterium
EWPPKTTGGARCST

SEQ ID NO: 474292 - protein, 8 aa, Mycobacterium
EWPPPAQF

SEQ ID NO: 474293 - protein, 8 aa, Mycobacterium
EWQEANAR

SEQ ID NO: 474294 - protein, 21 aa, Mycobacterium
EWQEKAAAEARSFGHDSPDID

SEQ ID NO: 474295 - protein, 4 aa, Mycobacterium
EWRQ

SEQ ID NO: 474296 - protein, 13 aa, Mycobacterium
EWRRGATQGHSGT

SEQ ID NO: 474297 - protein, 8 aa, Mycobacterium
EWSDGGAY

SEQ ID NO: 474298 - protein, 8 aa, Mycobacterium
EWSEADAT

SEQ ID NO: 474299 - protein, 11 aa, Mycobacterium
EWSPASESSAE

SEQ ID NO: 474300 - protein, 8 aa, Mycobacterium
EWSPDKVS

SEQ ID NO: 474301 - protein, 11 aa, Mycobacterium
EWSPESESSQE

SEQ ID NO: 474302 - protein, 12 aa, Mycobacterium
EWSSDPSRPVER

SEQ ID NO: 474303 - protein, 5 aa, Mycobacterium
EWSSE

SEQ ID NO: 474304 - protein, 7 aa, Mycobacterium
EWTGPTS

SEQ ID NO: 474305 - protein, 10 aa, Mycobacterium
EWTPDNRLRQ

SEQ ID NO: 474306 - protein, 27 aa, Mycobacterium
EWTPSPADDGTYVGTDRATGASKWTAS

SEQ ID NO: 474307 - protein, 5 aa, Mycobacterium
EWTQE

SEQ ID NO: 474308 - protein, 8 aa, Mycobacterium
EWTSATPR

SEQ ID NO: 474309 - protein, 14 aa, Mycobacterium
EWYGPASASMAAAA

SEQ ID NO: 474310 - protein, 4 aa, Mycobacterium
EYAA

SEQ ID NO: 474311 - protein, 6 aa, Mycobacterium
EYAAAN

SEQ ID NO: 474312 - protein, 17 aa, Mycobacterium
EYAAGYSGFEGVDRDRT

SEQ ID NO: 474313 - protein, 11 aa, Mycobacterium
EYAATASEAYQ

SEQ ID NO: 474314 - protein, 6 aa, Mycobacterium
EYADAE

SEQ ID NO: 474315 - protein, 7 aa, Mycobacterium
EYADQTD

SEQ ID NO: 474316 - protein, 6 aa, Mycobacterium
EYADSG

SEQ ID NO: 474317 - protein, 4 aa, Mycobacterium
EYAE

SEQ ID NO: 474318 - protein, 5 aa, Mycobacterium
EYAEA

SEQ ID NO: 474319 - protein, 11 aa, Mycobacterium
EYAEATGLDDA

SEQ ID NO: 474320 - protein, 6 aa, Mycobacterium
EYAGAS

SEQ ID NO: 474321 - protein, 6 aa, Mycobacterium
EYAGGR

SEQ ID NO: 474322 - protein, 6 aa, Mycobacterium
EYAGPR

SEQ ID NO: 474323 - protein, 14 aa, Mycobacterium
EYAGRAQGKWDPGG

SEQ ID NO: 474324 - protein, 5 aa, Mycobacterium
EYAGT

SEQ ID NO: 474325 - protein, 4 aa, Mycobacterium
EYAK

SEQ ID NO: 474326 - protein, 5 aa, Mycobacterium
EYAKA

SEQ ID NO: 474327 - protein, 6 aa, Mycobacterium
EYAKSI

SEQ ID NO: 474328 - protein, 6 aa, Mycobacterium
EYANTG

SEQ ID NO: 474329 - protein, 7 aa, Mycobacterium
EYAPAVD

SEQ ID NO: 474330 - protein, 5 aa, Mycobacterium
EYAPD

SEQ ID NO: 474331 - protein, 13 aa, Mycobacterium
EYAPSEPADTGAD

SEQ ID NO: 474332 - protein, 5 aa, Mycobacterium
EYAQR

SEQ ID NO: 474333 - protein, 7 aa, Mycobacterium
EYAQTTE

SEQ ID NO: 474334 - protein, 9 aa, Mycobacterium
EYAQTTEDL

SEQ ID NO: 474335 - protein, 12 aa, Mycobacterium
EYARGGEKRPEG

SEQ ID NO: 474336 - protein, 6 aa, Mycobacterium
EYARTI

SEQ ID NO: 474337 - protein, 11 aa, Mycobacterium
EYATGRGGGQV

SEQ ID NO: 474338 - protein, 13 aa, Mycobacterium
EYATPTGDEKAAT

SEQ ID NO: 474339 - protein, 4 aa, Mycobacterium
EYDA

SEQ ID NO: 474340 - protein, 5 aa, Mycobacterium
EYDAA

SEQ ID NO: 474341 - protein, 9 aa, Mycobacterium
EYDAAGDRI

SEQ ID NO: 474342 - protein, 4 aa, Mycobacterium
EYDD

SEQ ID NO: 474343 - protein, 5 aa, Mycobacterium
EYDDA

SEQ ID NO: 474344 - protein, 15 aa, Mycobacterium
EYDDDGTVRKPGQDY

SEQ ID NO: 474345 - protein, 4 aa, Mycobacterium
EYDE

SEQ ID NO: 474346 - protein, 8 aa, Mycobacterium
EYDEESAT

SEQ ID NO: 474347 - protein, 5 aa, Mycobacterium
EYDER

SEQ ID NO: 474348 - protein, 10 aa, Mycobacterium
EYDETPEHQA

SEQ ID NO: 474349 - protein, 10 aa, Mycobacterium
EYDETPERQA

SEQ ID NO: 474350 - protein, 7 aa, Mycobacterium
EYDGGDY

SEQ ID NO: 474351 - protein, 5 aa, Mycobacterium
EYDGM

SEQ ID NO: 474352 - protein, 5 aa, Mycobacterium
EYDGR

SEQ ID NO: 474353 - protein, 7 aa, Mycobacterium
EYDGRAE

SEQ ID NO: 474354 - protein, 16 aa, Mycobacterium
EYDKYRDEAGPNDHTV

SEQ ID NO: 474355 - protein, 5 aa, Mycobacterium
EYDNY

SEQ ID NO: 474356 - protein, 8 aa, Mycobacterium
EYDPVADR

SEQ ID NO: 474357 - protein, 16 aa, Mycobacterium
EYDPVAERSLGNHPQA

SEQ ID NO: 474358 - protein, 5 aa, Mycobacterium
EYDRR

SEQ ID NO: 474359 - protein, 8 aa, Mycobacterium
EYDTAATE

SEQ ID NO: 474360 - protein, 12 aa, Mycobacterium
EYEAAGADFDRR

SEQ ID NO: 474361 - protein, 5 aa, Mycobacterium
EYEDD

SEQ ID NO: 474362 - protein, 12 aa, Mycobacterium
EYEDREGVRRSS

SEQ ID NO: 474363 - protein, 6 aa, Mycobacterium
EYEEGG

SEQ ID NO: 474364 - protein, 8 aa, Mycobacterium
EYEGGPYA

SEQ ID NO: 474365 - protein, 9 aa, Mycobacterium
EYEKLGSAA

SEQ ID NO: 474366 - protein, 14 aa, Mycobacterium
EYELDRDGDGVACE

SEQ ID NO: 474367 - protein, 11 aa, Mycobacterium
EYEPGEPRGTD

SEQ ID NO: 474368 - protein, 12 aa, Mycobacterium
EYEPGEPRGTDW

SEQ ID NO: 474369 - protein, 12 aa, Mycobacterium
EYEPGEPRGTSW

SEQ ID NO: 474370 - protein, 9 aa, Mycobacterium
EYERAGDMR

SEQ ID NO: 474371 - protein, 9 aa, Mycobacterium
EYERTGDMR

SEQ ID NO: 474372 - protein, 8 aa, Mycobacterium
EYETDTDL

SEQ ID NO: 474373 - protein, 8 aa, Mycobacterium
EYETRTRG

SEQ ID NO: 474374 - protein, 11 aa, Mycobacterium
EYEVGNPASVL

SEQ ID NO: 474375 - protein, 7 aa, Mycobacterium
EYGAPTY

SEQ ID NO: 474376 - protein, 6 aa, Mycobacterium
EYGDDD

SEQ ID NO: 474377 - protein, 5 aa, Mycobacterium
EYGED

SEQ ID NO: 474378 - protein, 9 aa, Mycobacterium
EYGEGLARD

SEQ ID NO: 474379 - protein, 6 aa, Mycobacterium
EYGGAA

SEQ ID NO: 474380 - protein, 9 aa, Mycobacterium
EYGGGGGGI

SEQ ID NO: 474381 - protein, 9 aa, Mycobacterium
EYGGGGGTF

SEQ ID NO: 474382 - protein, 11 aa, Mycobacterium
EYGGHDAEAPR

SEQ ID NO: 474383 - protein, 24 aa, Mycobacterium
EYGGHDESAPTSVATAIDALLGVD

SEQ ID NO: 474384 - protein, 5 aa, Mycobacterium
EYGGR

SEQ ID NO: 474385 - protein, 9 aa, Mycobacterium
EYGGRDDYH

SEQ ID NO: 474386 - protein, 7 aa, Mycobacterium
EYGGSGL

SEQ ID NO: 474387 - protein, 5 aa, Mycobacterium
EYGIE

SEQ ID NO: 474388 - protein, 10 aa, Mycobacterium
EYGKSVVTGT

SEQ ID NO: 474389 - protein, 16 aa, Mycobacterium
EYGPRTAQADAYTGHR

SEQ ID NO: 474390 - protein, 12 aa, Mycobacterium
EYGQGPGPGENI

SEQ ID NO: 474391 - protein, 4 aa, Mycobacterium
EYGR

SEQ ID NO: 474392 - protein, 8 aa, Mycobacterium
EYGRAEQP

SEQ ID NO: 474393 - protein, 9 aa, Mycobacterium
EYGRAEQPF

SEQ ID NO: 474394 - protein, 7 aa, Mycobacterium
EYGRTPA

SEQ ID NO: 474395 - protein, 9 aa, Mycobacterium
EYGSGPDRY

SEQ ID NO: 474396 - protein, 6 aa, Mycobacterium
EYGSIT

SEQ ID NO: 474397 - protein, 6 aa, Mycobacterium
EYGSRG

SEQ ID NO: 474398 - protein, 10 aa, Mycobacterium
EYGTEGSPGT

SEQ ID NO: 474399 - protein, 4 aa, Mycobacterium
EYGV

SEQ ID NO: 474400 - protein, 8 aa, Mycobacterium
EYGVPDAQ

SEQ ID NO: 474401 - protein, 7 aa, Mycobacterium
EYGVPRG

SEQ ID NO: 474402 - protein, 13 aa, Mycobacterium
EYHPDPGSTMAER

SEQ ID NO: 474403 - protein, 13 aa, Mycobacterium
EYHPDTGSTMAQR

SEQ ID NO: 474404 - protein, 12 aa, Mycobacterium
EYHPSDPMEPKT

SEQ ID NO: 474405 - protein, 10 aa, Mycobacterium
EYHRDGVSDR

SEQ ID NO: 474406 - protein, 6 aa, Mycobacterium
EYKSPQ

SEQ ID NO: 474407 - protein, 6 aa, Mycobacterium
EYKSPR

SEQ ID NO: 474408 - protein, 8 aa, Mycobacterium
EYLGSKGD

SEQ ID NO: 474409 - protein, 15 aa, Mycobacterium
EYNEDGTVRKPGQDY

SEQ ID NO: 474410 - protein, 5 aa, Mycobacterium
EYNGS

SEQ ID NO: 474411 - protein, 6 aa, Mycobacterium
EYNGSI

SEQ ID NO: 474412 - protein, 6 aa, Mycobacterium
EYNGSM

SEQ ID NO: 474413 - protein, 7 aa, Mycobacterium
EYNGTIP

SEQ ID NO: 474414 - protein, 9 aa, Mycobacterium
EYNKTSGDV

SEQ ID NO: 474415 - protein, 5 aa, Mycobacterium
EYNPA

SEQ ID NO: 474416 - protein, 10 aa, Mycobacterium
EYNPKTGQVE

SEQ ID NO: 474417 - protein, 17 aa, Mycobacterium
EYNRPGFHPNDSDNTEL

SEQ ID NO: 474418 - protein, 19 aa, Mycobacterium
EYNTKADLEPVNPPKPPAA

SEQ ID NO: 474419 - protein, 7 aa, Mycobacterium
EYPAKTF

SEQ ID NO: 474420 - protein, 13 aa, Mycobacterium
EYPAPTIGTPNQG

SEQ ID NO: 474421 - protein, 7 aa, Mycobacterium
EYPAPYR

SEQ ID NO: 474422 - protein, 11 aa, Mycobacterium
EYPDATPEQAR

SEQ ID NO: 474423 - protein, 9 aa, Mycobacterium
EYPDGMGAQ

SEQ ID NO: 474424 - protein, 6 aa, Mycobacterium
EYPDKL

SEQ ID NO: 474425 - protein, 10 aa, Mycobacterium
EYPDNRPPRG

SEQ ID NO: 474426 - protein, 12 aa, Mycobacterium
EYPDPAPEQAAS

SEQ ID NO: 474427 - protein, 6 aa, Mycobacterium
EYPEKL

SEQ ID NO: 474428 - protein, 4 aa, Mycobacterium
EYPG

SEQ ID NO: 474429 - protein, 10 aa, Mycobacterium
EYPGASLQRD

SEQ ID NO: 474430 - protein, 5 aa, Mycobacterium
EYPGG

SEQ ID NO: 474431 - protein, 5 aa, Mycobacterium
EYPGH

SEQ ID NO: 474432 - protein, 8 aa, Mycobacterium
EYPGPEAA

SEQ ID NO: 474433 - protein, 17 aa, Mycobacterium
EYPGPFPGYSSVKPRSC

SEQ ID NO: 474434 - protein, 5 aa, Mycobacterium
EYPGR

SEQ ID NO: 474435 - protein, 14 aa, Mycobacterium
EYPGSDGTLEERRA

SEQ ID NO: 474436 - protein, 12 aa, Mycobacterium
EYPGVPGGFACI

SEQ ID NO: 474437 - protein, 6 aa, Mycobacterium
EYPHPE

SEQ ID NO: 474438 - protein, 6 aa, Mycobacterium
EYPHPK

SEQ ID NO: 474439 - protein, 6 aa, Mycobacterium
EYPKPW

SEQ ID NO: 474440 - protein, 16 aa, Mycobacterium
EYPKRIPESGGEDYAP

SEQ ID NO: 474441 - protein, 9 aa, Mycobacterium
EYPPAELEA

SEQ ID NO: 474442 - protein, 13 aa, Mycobacterium
EYPPIGTRDDPAD

SEQ ID NO: 474443 - protein, 11 aa, Mycobacterium
EYPQRSASMAN

SEQ ID NO: 474444 - protein, 6 aa, Mycobacterium
EYPQTG

SEQ ID NO: 474445 - protein, 8 aa, Mycobacterium
EYPQTPSV

SEQ ID NO: 474446 - protein, 5 aa, Mycobacterium
EYPRA

SEQ ID NO: 474447 - protein, 10 aa, Mycobacterium
EYPRSKSKGY

SEQ ID NO: 474448 - protein, 4 aa, Mycobacterium
EYPS

SEQ ID NO: 474449 - protein, 5 aa, Mycobacterium
EYPSG

SEQ ID NO: 474450 - protein, 5 aa, Mycobacterium
EYPTG

SEQ ID NO: 474451 - protein, 7 aa, Mycobacterium
EYQAKTT

SEQ ID NO: 474452 - protein, 18 aa, Mycobacterium
EYQKNTDRQIPLFVLTPV

SEQ ID NO: 474453 - protein, 8 aa, Mycobacterium
EYQPAEAS

SEQ ID NO: 474454 - protein, 11 aa, Mycobacterium
EYQPGEPRGTD

SEQ ID NO: 474455 - protein, 7 aa, Mycobacterium
EYQPGTL

SEQ ID NO: 474456 - protein, 12 aa, Mycobacterium
EYQPHPGEPGRE

SEQ ID NO: 474457 - protein, 7 aa, Mycobacterium
EYQPREA

SEQ ID NO: 474458 - protein, 18 aa, Mycobacterium
EYQQKTDRQIPVFVLTPV

SEQ ID NO: 474459 - protein, 15 aa, Mycobacterium
EYQTKTARQIPVFVL

SEQ ID NO: 474460 - protein, 18 aa, Mycobacterium
EYQTKTDRQIPVFVLTPV

SEQ ID NO: 474461 - protein, 4 aa, Mycobacterium
EYRD

SEQ ID NO: 474462 - protein, 5 aa, Mycobacterium
EYRDN

SEQ ID NO: 474463 - protein, 9 aa, Mycobacterium
EYRDPDDRR

SEQ ID NO: 474464 - protein, 9 aa, Mycobacterium
EYRDPSALG

SEQ ID NO: 474465 - protein, 4 aa, Mycobacterium
EYRE

SEQ ID NO: 474466 - protein, 8 aa, Mycobacterium
EYRGDEAL

SEQ ID NO: 474467 - protein, 13 aa, Mycobacterium
EYRGDTDHSADHS

SEQ ID NO: 474468 - protein, 5 aa, Mycobacterium
EYRHT

SEQ ID NO: 474469 - protein, 9 aa, Mycobacterium
EYRPAAEDV

SEQ ID NO: 474470 - protein, 8 aa, Mycobacterium
EYRPAEEA

SEQ ID NO: 474471 - protein, 5 aa, Mycobacterium
EYRPG

SEQ ID NO: 474472 - protein, 13 aa, Mycobacterium
EYRPTAGSVSVDG

SEQ ID NO: 474473 - protein, 6 aa, Mycobacterium
EYRRDR

SEQ ID NO: 474474 - protein, 10 aa, Mycobacterium
EYRRGADGAM

SEQ ID NO: 474475 - protein, 5 aa, Mycobacterium
EYRSH

SEQ ID NO: 474476 - protein, 6 aa, Mycobacterium
EYRTRA

SEQ ID NO: 474477 - protein, 4 aa, Mycobacterium
EYSA

SEQ ID NO: 474478 - protein, 8 aa, Mycobacterium
EYSDAVDK

SEQ ID NO: 474479 - protein, 19 aa, Mycobacterium
EYSEDDSVDAELDSDTPLG

SEQ ID NO: 474480 - protein, 5 aa, Mycobacterium
EYSGG

SEQ ID NO: 474481 - protein, 7 aa, Mycobacterium
EYSHNTT

SEQ ID NO: 474482 - protein, 8 aa, Mycobacterium
EYSPQRRG

SEQ ID NO: 474483 - protein, 12 aa, Mycobacterium
EYSRNSGRTTRG

SEQ ID NO: 474484 - protein, 6 aa, Mycobacterium
EYSSYS

SEQ ID NO: 474485 - protein, 7 aa, Mycobacterium
EYTAPAG

SEQ ID NO: 474486 - protein, 7 aa, Mycobacterium
EYTDAGD

SEQ ID NO: 474487 - protein, 11 aa, Mycobacterium
EYTDDNVPASQ

SEQ ID NO: 474488 - protein, 16 aa, Mycobacterium
EYTDDNVPASQAAFDD

SEQ ID NO: 474489 - protein, 10 aa, Mycobacterium
EYTDDNVPVS

SEQ ID NO: 474490 - protein, 8 aa, Mycobacterium
EYTDNNVP

SEQ ID NO: 474491 - protein, 8 aa, Mycobacterium
EYTKQRQQ

SEQ ID NO: 474492 - protein, 14 aa, Mycobacterium
EYTKVSEASDRGYP

SEQ ID NO: 474493 - protein, 7 aa, Mycobacterium
EYTPDAH

SEQ ID NO: 474494 - protein, 7 aa, Mycobacterium
EYTPGPA

SEQ ID NO: 474495 - protein, 8 aa, Mycobacterium
EYTPGPDV

SEQ ID NO: 474496 - protein, 8 aa, Mycobacterium
EYTPGPEV

SEQ ID NO: 474497 - protein, 13 aa, Mycobacterium
EYTQNTLRETLRE

SEQ ID NO: 474498 - protein, 16 aa, Mycobacterium
EYTRTGFNAGRKADII

SEQ ID NO: 474499 - protein, 14 aa, Mycobacterium
EYTSAQRGLSGEDL

SEQ ID NO: 474500 - protein, 10 aa, Mycobacterium
EYTSGAGTGI

SEQ ID NO: 474501 - protein, 4 aa, Mycobacterium
EYTT

SEQ ID NO: 474502 - protein, 6 aa, Mycobacterium
EYTTRA

SEQ ID NO: 474503 - protein, 6 aa, Mycobacterium
EYTTRT

SEQ ID NO: 474504 - protein, 10 aa, Mycobacterium
EYVAPQDKGP

SEQ ID NO: 474505 - protein, 12 aa, Mycobacterium
EYVGGSTARSGG

SEQ ID NO: 474506 - protein, 15 aa, Mycobacterium
EYVGKPTAREGSEPW

SEQ ID NO: 474507 - protein, 12 aa, Mycobacterium
EYYDPEPGVPDH

SEQ ID NO: 474508 - protein, 11 aa, Mycobacterium
EYYDPEPGVPG

SEQ ID NO: 474509 - protein, 12 aa, Mycobacterium
EYYDPEPGVPGR

SEQ ID NO: 474510 - protein, 11 aa, Mycobacterium
FAAAGTETREQ

SEQ ID NO: 474511 - protein, 6 aa, Mycobacterium
FAADAA

SEQ ID NO: 474512 - protein, 9 aa, Mycobacterium
FAADSPSEI

SEQ ID NO: 474513 - protein, 6 aa, Mycobacterium
FAAETG

SEQ ID NO: 474514 - protein, 11 aa, Mycobacterium
FAAGDREGERI

SEQ ID NO: 474515 - protein, 13 aa, Mycobacterium
FAAGGPHPAAPPF

SEQ ID NO: 474516 - protein, 10 aa, Mycobacterium
FAAKGGWGPG

SEQ ID NO: 474517 - protein, 7 aa, Mycobacterium
FAAPPTA

SEQ ID NO: 474518 - protein, 9 aa, Mycobacterium
FAAPREDAI

SEQ ID NO: 474519 - protein, 13 aa, Mycobacterium
FAAQGYDKTTLRE

SEQ ID NO: 474520 - protein, 20 aa, Mycobacterium
FAASGLAKAPVADAHPAVPP

SEQ ID NO: 474521 - protein, 11 aa, Mycobacterium
FAATDGSSVEV

SEQ ID NO: 474522 - protein, 6 aa, Mycobacterium
FAATPA

SEQ ID NO: 474523 - protein, 13 aa, Mycobacterium
FAATRSSVEPRQL

SEQ ID NO: 474524 - protein, 11 aa, Mycobacterium
FADAGDAPQLI

SEQ ID NO: 474525 - protein, 5 aa, Mycobacterium
FADAT

SEQ ID NO: 474526 - protein, 9 aa, Mycobacterium
FADDDPAKL

SEQ ID NO: 474527 - protein, 5 aa, Mycobacterium
FADDE

SEQ ID NO: 474528 - protein, 12 aa, Mycobacterium
FADDESGDSPEE

SEQ ID NO: 474529 - protein, 13 aa, Mycobacterium
FADEDEKALAAAS

SEQ ID NO: 474530 - protein, 13 aa, Mycobacterium
FADEDEKALAGAS

SEQ ID NO: 474531 - protein, 19 aa, Mycobacterium
FADEDERALTAVKAAAAAA

SEQ ID NO: 474532 - protein, 12 aa, Mycobacterium
FADEDRKALAAS

SEQ ID NO: 474533 - protein, 12 aa, Mycobacterium
FADESDAALPEA

SEQ ID NO: 474534 - protein, 5 aa, Mycobacterium
FADGA

SEQ ID NO: 474535 - protein, 11 aa, Mycobacterium
FADGPDAVDRD

SEQ ID NO: 474536 - protein, 9 aa, Mycobacterium
FADGPEAVD

SEQ ID NO: 474537 - protein, 9 aa, Mycobacterium
FADGPSKHE

SEQ ID NO: 474538 - protein, 6 aa, Mycobacterium
FADGSE

SEQ ID NO: 474539 - protein, 8 aa, Mycobacterium
FADGSLSR

SEQ ID NO: 474540 - protein, 8 aa, Mycobacterium
FADKPEAT

SEQ ID NO: 474541 - protein, 11 aa, Mycobacterium
FADKSGAGGHV

SEQ ID NO: 474542 - protein, 8 aa, Mycobacterium
FADNADIP

SEQ ID NO: 474543 - protein, 5 aa, Mycobacterium
FADPE

SEQ ID NO: 474544 - protein, 16 aa, Mycobacterium
FADPPPTTSEAGLTAQ

SEQ ID NO: 474545 - protein, 7 aa, Mycobacterium
FADPSTA

SEQ ID NO: 474546 - protein, 12 aa, Mycobacterium
FADPSTPRTGSA

SEQ ID NO: 474547 - protein, 8 aa, Mycobacterium
FADPTGRL

SEQ ID NO: 474548 - protein, 8 aa, Mycobacterium
FADRDRDL

SEQ ID NO: 474549 - protein, 6 aa, Mycobacterium
FADRDT

SEQ ID NO: 474550 - protein, 9 aa, Mycobacterium
FADRESPKS

SEQ ID NO: 474551 - protein, 6 aa, Mycobacterium
FADRPD

SEQ ID NO: 474552 - protein, 7 aa, Mycobacterium
FADRTGS

SEQ ID NO: 474553 - protein, 5 aa, Mycobacterium
FADSA

SEQ ID NO: 474554 - protein, 12 aa, Mycobacterium
FADSDGDGVGDI

SEQ ID NO: 474555 - protein, 10 aa, Mycobacterium
FADSEEEAKE

SEQ ID NO: 474556 - protein, 6 aa, Mycobacterium
FADSGA

SEQ ID NO: 474557 - protein, 12 aa, Mycobacterium
FADSSGDGVGDL

SEQ ID NO: 474558 - protein, 4 aa, Mycobacterium
FADT

SEQ ID NO: 474559 - protein, 13 aa, Mycobacterium
FADTNGAADGPPV

SEQ ID NO: 474560 - protein, 14 aa, Mycobacterium
FADTPEARKRGWSA

SEQ ID NO: 474561 - protein, 12 aa, Mycobacterium
FADTPEARRRGW

SEQ ID NO: 474562 - protein, 7 aa, Mycobacterium
FADTSQT

SEQ ID NO: 474563 - protein, 13 aa, Mycobacterium
FADTTNSDPQLAL

SEQ ID NO: 474564 - protein, 6 aa, Mycobacterium
FAEAGR

SEQ ID NO: 474565 - protein, 13 aa, Mycobacterium
FAEEDQRALAAAS

SEQ ID NO: 474566 - protein, 7 aa, Mycobacterium
FAEERPD

SEQ ID NO: 474567 - protein, 12 aa, Mycobacterium
FAEGDRNPPVFD

SEQ ID NO: 474568 - protein, 11 aa, Mycobacterium
FAEGGPTARAA

SEQ ID NO: 474569 - protein, 5 aa, Mycobacterium
FAEGV

SEQ ID NO: 474570 - protein, 6 aa, Mycobacterium
FAEHAA

SEQ ID NO: 474571 - protein, 9 aa, Mycobacterium
FAEKPPPEA

SEQ ID NO: 474572 - protein, 5 aa, Mycobacterium
FAENP

SEQ ID NO: 474573 - protein, 6 aa, Mycobacterium
FAENRD

SEQ ID NO: 474574 - protein, 12 aa, Mycobacterium
FAENTAAKGQHV

SEQ ID NO: 474575 - protein, 4 aa, Mycobacterium
FAEP

SEQ ID NO: 474576 - protein, 38 aa, Mycobacterium
FAEPDQTTNPGADQSGAVAQATGTAAGSTRNAVTQQSL

SEQ ID NO: 474577 - protein, 6 aa, Mycobacterium
FAEPGP

SEQ ID NO: 474578 - protein, 35 aa, Mycobacterium
FAEPPDGLGGTPQAVDSVPTAAASVATQAQSAMSD

SEQ ID NO: 474579 - protein, 14 aa, Mycobacterium
FAEPPQTTNTDSTV

SEQ ID NO: 474580 - protein, 13 aa, Mycobacterium
FAEPSPAGDQFAL

SEQ ID NO: 474581 - protein, 12 aa, Mycobacterium
FAEQGLDTAPAA

SEQ ID NO: 474582 - protein, 8 aa, Mycobacterium
FAEQPDAA

SEQ ID NO: 474583 - protein, 32 aa, Mycobacterium
FAERARRELTATGEKVRKQPVSSGDELTAQEA

SEQ ID NO: 474584 - protein, 5 aa, Mycobacterium
FAERE

SEQ ID NO: 474585 - protein, 12 aa, Mycobacterium
FAESADQSDPVG

SEQ ID NO: 474586 - protein, 6 aa, Mycobacterium
FAESAG

SEQ ID NO: 474587 - protein, 8 aa, Mycobacterium
FAESAGDA

SEQ ID NO: 474588 - protein, 6 aa, Mycobacterium
FAESTY

SEQ ID NO: 474589 - protein, 9 aa, Mycobacterium
FAETETNEY

SEQ ID NO: 474590 - protein, 5 aa, Mycobacterium
FAGAA

SEQ ID NO: 474591 - protein, 10 aa, Mycobacterium
FAGADGHRDM

SEQ ID NO: 474592 - protein, 21 aa, Mycobacterium
FAGASEATAPVTNPATGAVTG

SEQ ID NO: 474593 - protein, 9 aa, Mycobacterium
FAGDEDKPA

SEQ ID NO: 474594 - protein, 7 aa, Mycobacterium
FAGDGVN

SEQ ID NO: 474595 - protein, 5 aa, Mycobacterium
FAGEG

SEQ ID NO: 474596 - protein, 6 aa, Mycobacterium
FAGERP

SEQ ID NO: 474597 - protein, 4 aa, Mycobacterium
FAGG

SEQ ID NO: 474598 - protein, 5 aa, Mycobacterium
FAGGG

SEQ ID NO: 474599 - protein, 17 aa, Mycobacterium
FAGGGGDGGAGAVGGTG

SEQ ID NO: 474600 - protein, 17 aa, Mycobacterium
FAGGPGFGFGPDTQRRA

SEQ ID NO: 474601 - protein, 10 aa, Mycobacterium
FAGGSPGAFQ

SEQ ID NO: 474602 - protein, 4 aa, Mycobacterium
FAGI

SEQ ID NO: 474603 - protein, 15 aa, Mycobacterium
FAGNGGAGGNGGAAG

SEQ ID NO: 474604 - protein, 21 aa, Mycobacterium
FAGNPEALAETAKHAETPEFT

SEQ ID NO: 474605 - protein, 14 aa, Mycobacterium
FAGNQSGLTGGSQR

SEQ ID NO: 474606 - protein, 4 aa, Mycobacterium
FAGP

SEQ ID NO: 474607 - protein, 11 aa, Mycobacterium
FAGPDSGDGYR

SEQ ID NO: 474608 - protein, 6 aa, Mycobacterium
FAGPGA

SEQ ID NO: 474609 - protein, 6 aa, Mycobacterium
FAGPGN

SEQ ID NO: 474610 - protein, 13 aa, Mycobacterium
FAGPGSSATQFVG

SEQ ID NO: 474611 - protein, 11 aa, Mycobacterium
FAGPGSVDVDN

SEQ ID NO: 474612 - protein, 18 aa, Mycobacterium
FAGPPGGGRVAGQFAGRQ

SEQ ID NO: 474613 - protein, 5 aa, Mycobacterium
FAGQG

SEQ ID NO: 474614 - protein, 9 aa, Mycobacterium
FAGQSEEIT

SEQ ID NO: 474615 - protein, 8 aa, Mycobacterium
FAGQTNKK

SEQ ID NO: 474616 - protein, 7 aa, Mycobacterium
FAGREKD

SEQ ID NO: 474617 - protein, 5 aa, Mycobacterium
FAGRG

SEQ ID NO: 474618 - protein, 45 aa, Mycobacterium
FAGRGGGTGLSAGAPKLKPASFGGAGAASMRPPIGPDSISSQLGG

SEQ ID NO: 474619 - protein, 6 aa, Mycobacterium
FAGRSL

SEQ ID NO: 474620 - protein, 7 aa, Mycobacterium
FAGRTRS

SEQ ID NO: 474621 - protein, 4 aa, Mycobacterium
FAGS

SEQ ID NO: 474622 - protein, 6 aa, Mycobacterium
FAGSDQ

SEQ ID NO: 474623 - protein, 9 aa, Mycobacterium
FAGSDSPLA

SEQ ID NO: 474624 - protein, 19 aa, Mycobacterium
FAGSDVSDLAATARREGDE

SEQ ID NO: 474625 - protein, 16 aa, Mycobacterium
FAGSEGGGDRAHTHDH

SEQ ID NO: 474626 - protein, 6 aa, Mycobacterium
FAGSGL

SEQ ID NO: 474627 - protein, 10 aa, Mycobacterium
FAGSSAGALG

SEQ ID NO: 474628 - protein, 12 aa, Mycobacterium
FAGTDPMTGRRR

SEQ ID NO: 474629 - protein, 6 aa, Mycobacterium
FAGTDV

SEQ ID NO: 474630 - protein, 7 aa, Mycobacterium
FAGTGRM

SEQ ID NO: 474631 - protein, 16 aa, Mycobacterium
FAGTNGIGTALETGRP

SEQ ID NO: 474632 - protein, 6 aa, Mycobacterium
FAGTSL

SEQ ID NO: 474633 - protein, 4 aa, Mycobacterium
FAGY

SEQ ID NO: 474634 - protein, 7 aa, Mycobacterium
FAHGGNP

SEQ ID NO: 474635 - protein, 19 aa, Mycobacterium
FAKAKSSPAGHAAGEPGEL

SEQ ID NO: 474636 - protein, 7 aa, Mycobacterium
FAKGAAS

SEQ ID NO: 474637 - protein, 11 aa, Mycobacterium
FAKPGARRTRE

SEQ ID NO: 474638 - protein, 8 aa, Mycobacterium
FAKPGGQH

SEQ ID NO: 474639 - protein, 6 aa, Mycobacterium
FAKPSG

SEQ ID NO: 474640 - protein, 5 aa, Mycobacterium
FANAE

SEQ ID NO: 474641 - protein, 8 aa, Mycobacterium
FANAGSGN

SEQ ID NO: 474642 - protein, 5 aa, Mycobacterium
FANES

SEQ ID NO: 474643 - protein, 8 aa, Mycobacterium
FANGATSG

SEQ ID NO: 474644 - protein, 12 aa, Mycobacterium
FANPTGAQWSTE

SEQ ID NO: 474645 - protein, 7 aa, Mycobacterium
FANPTPK

SEQ ID NO: 474646 - protein, 5 aa, Mycobacterium
FANRE

SEQ ID NO: 474647 - protein, 8 aa, Mycobacterium
FANSQGSK

SEQ ID NO: 474648 - protein, 20 aa, Mycobacterium
FANSSNPSIQPASTYSPPMS

SEQ ID NO: 474649 - protein, 4 aa, Mycobacterium
FANT

SEQ ID NO: 474650 - protein, 8 aa, Mycobacterium
FANTGNNN

SEQ ID NO: 474651 - protein, 9 aa, Mycobacterium
FANTGNNNI

SEQ ID NO: 474652 - protein, 6 aa, Mycobacterium
FAPAEL

SEQ ID NO: 474653 - protein, 7 aa, Mycobacterium
FAPAPDP

SEQ ID NO: 474654 - protein, 10 aa, Mycobacterium
FAPAPHRREP

SEQ ID NO: 474655 - protein, 15 aa, Mycobacterium
FAPAPQRFEAGTPMT

SEQ ID NO: 474656 - protein, 27 aa, Mycobacterium
FAPASDGAPAGPAGPAGPAGPAGPAVE

SEQ ID NO: 474657 - protein, 12 aa, Mycobacterium
FAPDATGGIDTT

SEQ ID NO: 474658 - protein, 9 aa, Mycobacterium
FAPDDDQDE

SEQ ID NO: 474659 - protein, 13 aa, Mycobacterium
FAPDGSLDTAAAA

SEQ ID NO: 474660 - protein, 11 aa, Mycobacterium
FAPGAAGNIGA

SEQ ID NO: 474661 - protein, 11 aa, Mycobacterium
FAPGADPATVA

SEQ ID NO: 474662 - protein, 6 aa, Mycobacterium
FAPGAE

SEQ ID NO: 474663 - protein, 10 aa, Mycobacterium
FAPGAEDSAR

SEQ ID NO: 474664 - protein, 9 aa, Mycobacterium
FAPGASGNI

SEQ ID NO: 474665 - protein, 11 aa, Mycobacterium
FAPGASGNIAT

SEQ ID NO: 474666 - protein, 12 aa, Mycobacterium
FAPGASGNTSSE

SEQ ID NO: 474667 - protein, 5 aa, Mycobacterium
FAPGD

SEQ ID NO: 474668 - protein, 12 aa, Mycobacterium
FAPGGDLGQKAA

SEQ ID NO: 474669 - protein, 14 aa, Mycobacterium
FAPGGDMGGGGATD

SEQ ID NO: 474670 - protein, 15 aa, Mycobacterium
FAPGGDMGGGGGEDN

SEQ ID NO: 474671 - protein, 14 aa, Mycobacterium
FAPGGPTAAVPPEA

SEQ ID NO: 474672 - protein, 14 aa, Mycobacterium
FAPGKAVNAGGVAT

SEQ ID NO: 474673 - protein, 7 aa, Mycobacterium
FAPGKSL

SEQ ID NO: 474674 - protein, 5 aa, Mycobacterium
FAPKG

SEQ ID NO: 474675 - protein, 11 aa, Mycobacterium
FAPNQAPQPFN

SEQ ID NO: 474676 - protein, 6 aa, Mycobacterium
FAPPDG

SEQ ID NO: 474677 - protein, 9 aa, Mycobacterium
FAPPEVDES

SEQ ID NO: 474678 - protein, 5 aa, Mycobacterium
FAPPI

SEQ ID NO: 474679 - protein, 8 aa, Mycobacterium
FAPPKGIG

SEQ ID NO: 474680 - protein, 6 aa, Mycobacterium
FAPPNL

SEQ ID NO: 474681 - protein, 5 aa, Mycobacterium
FAPPP

SEQ ID NO: 474682 - protein, 16 aa, Mycobacterium
FAPPPAANGARSAVTS

SEQ ID NO: 474683 - protein, 6 aa, Mycobacterium
FAPPPD

SEQ ID NO: 474684 - protein, 24 aa, Mycobacterium
FAPPPEMTNPAGLADQAAASGQAV

SEQ ID NO: 474685 - protein, 6 aa, Mycobacterium
FAPPPG

SEQ ID NO: 474686 - protein, 24 aa, Mycobacterium
FAPPPPPVELGPAPGPAPAPAAPR

SEQ ID NO: 474687 - protein, 36 aa, Mycobacterium
FAPPPQTTNPAGVAGQAGTVTQATGIQAASKAQTAS

SEQ ID NO: 474688 - protein, 36 aa, Mycobacterium
FAPPPRTTSDAGQSGQAAAVAQATGTSTAGHAQTTV

SEQ ID NO: 474689 - protein, 6 aa, Mycobacterium
FAPPPT

SEQ ID NO: 474690 - protein, 6 aa, Mycobacterium
FAPPTG

SEQ ID NO: 474691 - protein, 11 aa, Mycobacterium
FAPQPPAEPFN

SEQ ID NO: 474692 - protein, 6 aa, Mycobacterium
FAPQQD

SEQ ID NO: 474693 - protein, 8 aa, Mycobacterium
FAPRDPSQ

SEQ ID NO: 474694 - protein, 13 aa, Mycobacterium
FAPREPGESPEQF

SEQ ID NO: 474695 - protein, 11 aa, Mycobacterium
FAPSAGHRCDP

SEQ ID NO: 474696 - protein, 10 aa, Mycobacterium
FAPSARDQRL

SEQ ID NO: 474697 - protein, 11 aa, Mycobacterium
FAPSGGGSVVP

SEQ ID NO: 474698 - protein, 10 aa, Mycobacterium
FAPSGGNRQA

SEQ ID NO: 474699 - protein, 10 aa, Mycobacterium
FAPSGGNRQG

SEQ ID NO: 474700 - protein, 11 aa, Mycobacterium
FAPSGGNRQGT

SEQ ID NO: 474701 - protein, 8 aa, Mycobacterium
FAPSKPQE

SEQ ID NO: 474702 - protein, 16 aa, Mycobacterium
FAPSNQVPGTGLSPDK

SEQ ID NO: 474703 - protein, 8 aa, Mycobacterium
FAPSPSAD

SEQ ID NO: 474704 - protein, 4 aa, Mycobacterium
FAPT

SEQ ID NO: 474705 - protein, 9 aa, Mycobacterium
FAPTAATDH

SEQ ID NO: 474706 - protein, 8 aa, Mycobacterium
FAPTPEQM

SEQ ID NO: 474707 - protein, 8 aa, Mycobacterium
FAPTPGGR

SEQ ID NO: 474708 - protein, 13 aa, Mycobacterium
FAPTPSGKTRTYE

SEQ ID NO: 474709 - protein, 10 aa, Mycobacterium
FAQDGVGGLR

SEQ ID NO: 474710 - protein, 11 aa, Mycobacterium
FAQDGVGGLRG

SEQ ID NO: 474711 - protein, 15 aa, Mycobacterium
FAQEGAKAAAEAAKE

SEQ ID NO: 474712 - protein, 16 aa, Mycobacterium
FAQGDGESCGAAVETT

SEQ ID NO: 474713 - protein, 8 aa, Mycobacterium
FAQGTPEA

SEQ ID NO: 474714 - protein, 4 aa, Mycobacterium
FAQK

SEQ ID NO: 474715 - protein, 6 aa, Mycobacterium
FAQPDR

SEQ ID NO: 474716 - protein, 9 aa, Mycobacterium
FAQPRPVDS

SEQ ID NO: 474717 - protein, 6 aa, Mycobacterium
FAQPTE

SEQ ID NO: 474718 - protein, 9 aa, Mycobacterium
FAQRPEAGE

SEQ ID NO: 474719 - protein, 4 aa, Mycobacterium
FARD

SEQ ID NO: 474720 - protein, 5 aa, Mycobacterium
FARDT

SEQ ID NO: 474721 - protein, 13 aa, Mycobacterium
FARDTADISDREN

SEQ ID NO: 474722 - protein, 5 aa, Mycobacterium
FARGD

SEQ ID NO: 474723 - protein, 19 aa, Mycobacterium
FARNRAEAARVASAADAAG

SEQ ID NO: 474724 - protein, 4 aa, Mycobacterium
FARP

SEQ ID NO: 474725 - protein, 11 aa, Mycobacterium
FARPGARRSRA

SEQ ID NO: 474726 - protein, 8 aa, Mycobacterium
FARQSKTG

SEQ ID NO: 474727 - protein, 17 aa, Mycobacterium
FARSEPAAETPESEAAG

SEQ ID NO: 474728 - protein, 19 aa, Mycobacterium
FARSGKFGAPQPVAEDAPA

SEQ ID NO: 474729 - protein, 10 aa, Mycobacterium
FASADSEPSM

SEQ ID NO: 474730 - protein, 6 aa, Mycobacterium
FASAES

SEQ ID NO: 474731 - protein, 11 aa, Mycobacterium
FASAPSRGQHV

SEQ ID NO: 474732 - protein, 11 aa, Mycobacterium
FASATPDTAVT

SEQ ID NO: 474733 - protein, 9 aa, Mycobacterium
FASATPDTV

SEQ ID NO: 474734 - protein, 11 aa, Mycobacterium
FASDPSDPEPV

SEQ ID NO: 474735 - protein, 14 aa, Mycobacterium
FASGAGSEGGHATP

SEQ ID NO: 474736 - protein, 11 aa, Mycobacterium
FASGGSAGYDH

SEQ ID NO: 474737 - protein, 5 aa, Mycobacterium
FASGQ

SEQ ID NO: 474738 - protein, 6 aa, Mycobacterium
FASGQT

SEQ ID NO: 474739 - protein, 14 aa, Mycobacterium
FASGRGTLAPLNPD

SEQ ID NO: 474740 - protein, 17 aa, Mycobacterium
FASGTAKRDDVAGQENS

SEQ ID NO: 474741 - protein, 6 aa, Mycobacterium
FASKGF

SEQ ID NO: 474742 - protein, 14 aa, Mycobacterium
FASPPGNPGTAAAG

SEQ ID NO: 474743 - protein, 19 aa, Mycobacterium
FASPPNTTTPDARTAQAAA

SEQ ID NO: 474744 - protein, 8 aa, Mycobacterium
FASPPTEL

SEQ ID NO: 474745 - protein, 17 aa, Mycobacterium
FASPQPDTNPAGRSAQH

SEQ ID NO: 474746 - protein, 7 aa, Mycobacterium
FASQDEA

SEQ ID NO: 474747 - protein, 7 aa, Mycobacterium
FASQDRD

SEQ ID NO: 474748 - protein, 18 aa, Mycobacterium
FASQSDAPVGAPRQFGST

SEQ ID NO: 474749 - protein, 7 aa, Mycobacterium
FASRDGT

SEQ ID NO: 474750 - protein, 4 aa, Mycobacterium
FASS

SEQ ID NO: 474751 - protein, 8 aa, Mycobacterium
FASSASLG

SEQ ID NO: 474752 - protein, 15 aa, Mycobacterium
FASSDSASSGYEFSQ

SEQ ID NO: 474753 - protein, 17 aa, Mycobacterium
FASSEGLRATSITQTLD

SEQ ID NO: 474754 - protein, 20 aa, Mycobacterium
FASSGLAKPPEADANPAVPP

SEQ ID NO: 474755 - protein, 10 aa, Mycobacterium
FASSTGESVV

SEQ ID NO: 474756 - protein, 4 aa, Mycobacterium
FAST

SEQ ID NO: 474757 - protein, 7 aa, Mycobacterium
FASTTAA

SEQ ID NO: 474758 - protein, 4 aa, Mycobacterium
FASV

SEQ ID NO: 474759 - protein, 17 aa, Mycobacterium
FASYKSSAAVSAIGEAT

SEQ ID NO: 474760 - protein, 6 aa, Mycobacterium
FATAGA

SEQ ID NO: 474761 - protein, 18 aa, Mycobacterium
FATARDGNKMTVVGDFAA

SEQ ID NO: 474762 - protein, 6 aa, Mycobacterium
FATAST

SEQ ID NO: 474763 - protein, 6 aa, Mycobacterium
FATDDP

SEQ ID NO: 474764 - protein, 9 aa, Mycobacterium
FATDNGARA

SEQ ID NO: 474765 - protein, 10 aa, Mycobacterium
FATEARQMTG

SEQ ID NO: 474766 - protein, 11 aa, Mycobacterium
FATEASPDGYI

SEQ ID NO: 474767 - protein, 16 aa, Mycobacterium
FATEGVSEAAQAGRKR

SEQ ID NO: 474768 - protein, 8 aa, Mycobacterium
FATGEPIA

SEQ ID NO: 474769 - protein, 10 aa, Mycobacterium
FATGEPIEDE

SEQ ID NO: 474770 - protein, 14 aa, Mycobacterium
FATGGATNFIQTGR

SEQ ID NO: 474771 - protein, 11 aa, Mycobacterium
FATGPKPDLKR

SEQ ID NO: 474772 - protein, 11 aa, Mycobacterium
FATGPQPSLTD

SEQ ID NO: 474773 - protein, 11 aa, Mycobacterium
FATGRARAANA

SEQ ID NO: 474774 - protein, 9 aa, Mycobacterium
FATNNTKNQ

SEQ ID NO: 474775 - protein, 6 aa, Mycobacterium
FATPSQ

SEQ ID NO: 474776 - protein, 7 aa, Mycobacterium
FATQGAR

SEQ ID NO: 474777 - protein, 12 aa, Mycobacterium
FATQPSDAFKAA

SEQ ID NO: 474778 - protein, 11 aa, Mycobacterium
FATQPSDAFRA

SEQ ID NO: 474779 - protein, 20 aa, Mycobacterium
FATRPEASVARAADQLRRRG

SEQ ID NO: 474780 - protein, 5 aa, Mycobacterium
FATRQ

SEQ ID NO: 474781 - protein, 6 aa, Mycobacterium
FATRST

SEQ ID NO: 474782 - protein, 4 aa, Mycobacterium
FATS

SEQ ID NO: 474783 - protein, 20 aa, Mycobacterium
FATSAGAESYRAEHPDADAV

SEQ ID NO: 474784 - protein, 9 aa, Mycobacterium
FATSNTPRF

SEQ ID NO: 474785 - protein, 9 aa, Mycobacterium
FATSQTRPE

SEQ ID NO: 474786 - protein, 8 aa, Mycobacterium
FATYGTKR

SEQ ID NO: 474787 - protein, 5 aa, Mycobacterium
FAYPG

SEQ ID NO: 474788 - protein, 6 aa, Mycobacterium
FDAARN

SEQ ID NO: 474789 - protein, 4 aa, Mycobacterium
FDAD

SEQ ID NO: 474790 - protein, 6 aa, Mycobacterium
FDADAA

SEQ ID NO: 474791 - protein, 10 aa, Mycobacterium
FDAEKLTENY

SEQ ID NO: 474792 - protein, 10 aa, Mycobacterium
FDAEPDHSNP

SEQ ID NO: 474793 - protein, 8 aa, Mycobacterium
FDAGESGQ

SEQ ID NO: 474794 - protein, 8 aa, Mycobacterium
FDAGQPTA

SEQ ID NO: 474795 - protein, 8 aa, Mycobacterium
FDAGTTRS

SEQ ID NO: 474796 - protein, 10 aa, Mycobacterium
FDAPATAGLG

SEQ ID NO: 474797 - protein, 19 aa, Mycobacterium
FDAPEADSAESQPETPTEA

SEQ ID NO: 474798 - protein, 11 aa, Mycobacterium
FDAPKNDPRQV

SEQ ID NO: 474799 - protein, 7 aa, Mycobacterium
FDAPPED

SEQ ID NO: 474800 - protein, 6 aa, Mycobacterium
FDAPRA

SEQ ID NO: 474801 - protein, 8 aa, Mycobacterium
FDAPRTSA

SEQ ID NO: 474802 - protein, 6 aa, Mycobacterium
FDAPSH

SEQ ID NO: 474803 - protein, 6 aa, Mycobacterium
FDARPE

SEQ ID NO: 474804 - protein, 11 aa, Mycobacterium
FDASAPSAWSA

SEQ ID NO: 474805 - protein, 14 aa, Mycobacterium
FDASGELADLRAAE

SEQ ID NO: 474806 - protein, 10 aa, Mycobacterium
FDASGSAGGW

SEQ ID NO: 474807 - protein, 11 aa, Mycobacterium
FDASKPTAWSA

SEQ ID NO: 474808 - protein, 4 aa, Mycobacterium
FDAT

SEQ ID NO: 474809 - protein, 8 aa, Mycobacterium
FDATQPTG

SEQ ID NO: 474810 - protein, 7 aa, Mycobacterium
FDATRPT

SEQ ID NO: 474811 - protein, 5 aa, Mycobacterium
FDATT

SEQ ID NO: 474812 - protein, 4 aa, Mycobacterium
FDDA

SEQ ID NO: 474813 - protein, 7 aa, Mycobacterium
FDDADAA

SEQ ID NO: 474814 - protein, 5 aa, Mycobacterium
FDDAS

SEQ ID NO: 474815 - protein, 8 aa, Mycobacterium
FDDDDDDF

SEQ ID NO: 474816 - protein, 9 aa, Mycobacterium
FDDDDDDLP

SEQ ID NO: 474817 - protein, 17 aa, Mycobacterium
FDDDDPDNWDDTDDPDL

SEQ ID NO: 474818 - protein, 7 aa, Mycobacterium
FDDDDSF

SEQ ID NO: 474819 - protein, 6 aa, Mycobacterium
FDDDEA

SEQ ID NO: 474820 - protein, 7 aa, Mycobacterium
FDDDESF

SEQ ID NO: 474821 - protein, 6 aa, Mycobacterium
FDDDNG

SEQ ID NO: 474822 - protein, 7 aa, Mycobacterium
FDDEAET

SEQ ID NO: 474823 - protein, 9 aa, Mycobacterium
FDDEDDDLP

SEQ ID NO: 474824 - protein, 9 aa, Mycobacterium
FDDGPASPM

SEQ ID NO: 474825 - protein, 15 aa, Mycobacterium
FDDGPWPRTSPRDRA

SEQ ID NO: 474826 - protein, 9 aa, Mycobacterium
FDDGSGRSI

SEQ ID NO: 474827 - protein, 11 aa, Mycobacterium
FDDPARDLGRT

SEQ ID NO: 474828 - protein, 5 aa, Mycobacterium
FDDPG

SEQ ID NO: 474829 - protein, 17 aa, Mycobacterium
FDDPKGLGAAGDKRSNT

SEQ ID NO: 474830 - protein, 6 aa, Mycobacterium
FDDPQG

SEQ ID NO: 474831 - protein, 12 aa, Mycobacterium
FDDQGAKYDGDG

SEQ ID NO: 474832 - protein, 13 aa, Mycobacterium
FDDQGSKYDGDGN

SEQ ID NO: 474833 - protein, 13 aa, Mycobacterium
FDDQSVTASVRKT

SEQ ID NO: 474834 - protein, 12 aa, Mycobacterium
FDDRGARADDAL

SEQ ID NO: 474835 - protein, 5 aa, Mycobacterium
FDDSG

SEQ ID NO: 474836 - protein, 8 aa, Mycobacterium
FDDSGAAV

SEQ ID NO: 474837 - protein, 14 aa, Mycobacterium
FDDTDSDLNALFGI

SEQ ID NO: 474838 - protein, 5 aa, Mycobacterium
FDDTG

SEQ ID NO: 474839 - protein, 8 aa, Mycobacterium
FDDTPGFE

SEQ ID NO: 474840 - protein, 11 aa, Mycobacterium
FDEAPETGATF

SEQ ID NO: 474841 - protein, 13 aa, Mycobacterium
FDEDDVYRWQRWR

SEQ ID NO: 474842 - protein, 11 aa, Mycobacterium
FDEDGADLRGE

SEQ ID NO: 474843 - protein, 52 aa, Mycobacterium
FDEDHTEAPPAAPATAHTPIGAGPGMGVGPAYSARSQTPDVPDAPAADPAAE

SEQ ID NO: 474844 - protein, 8 aa, Mycobacterium
FDEDSTTM

SEQ ID NO: 474845 - protein, 4 aa, Mycobacterium
FDEE

SEQ ID NO: 474846 - protein, 5 aa, Mycobacterium
FDEEA

SEQ ID NO: 474847 - protein, 5 aa, Mycobacterium
FDEGH

SEQ ID NO: 474848 - protein, 6 aa, Mycobacterium
FDEGPW

SEQ ID NO: 474849 - protein, 7 aa, Mycobacterium
FDENEKR

SEQ ID NO: 474850 - protein, 12 aa, Mycobacterium
FDEPDLDAAENG

SEQ ID NO: 474851 - protein, 6 aa, Mycobacterium
FDEPGE

SEQ ID NO: 474852 - protein, 8 aa, Mycobacterium
FDEPGKPF

SEQ ID NO: 474853 - protein, 8 aa, Mycobacterium
FDEPNGGL

SEQ ID NO: 474854 - protein, 10 aa, Mycobacterium
FDEPRREDQQ

SEQ ID NO: 474855 - protein, 12 aa, Mycobacterium
FDEPSGDPHGDT

SEQ ID NO: 474856 - protein, 6 aa, Mycobacterium
FDEPTR

SEQ ID NO: 474857 - protein, 7 aa, Mycobacterium
FDEPTYE

SEQ ID NO: 474858 - protein, 16 aa, Mycobacterium
FDERTAERREERCHSP

SEQ ID NO: 474859 - protein, 9 aa, Mycobacterium
FDESGAPHP

SEQ ID NO: 474860 - protein, 10 aa, Mycobacterium
FDESGGASVR

SEQ ID NO: 474861 - protein, 8 aa, Mycobacterium
FDESTAAS

SEQ ID NO: 474862 - protein, 9 aa, Mycobacterium
FDETARPWH

SEQ ID NO: 474863 - protein, 8 aa, Mycobacterium
FDETPSPD

SEQ ID NO: 474864 - protein, 9 aa, Mycobacterium
FDGAAAKQY

SEQ ID NO: 474865 - protein, 7 aa, Mycobacterium
FDGAEAA

SEQ ID NO: 474866 - protein, 8 aa, Mycobacterium
FDGAEAGA

SEQ ID NO: 474867 - protein, 7 aa, Mycobacterium
FDGAETR

SEQ ID NO: 474868 - protein, 8 aa, Mycobacterium
FDGAGQAQ

SEQ ID NO: 474869 - protein, 11 aa, Mycobacterium
FDGAGRPMQTR

SEQ ID NO: 474870 - protein, 6 aa, Mycobacterium
FDGAPG

SEQ ID NO: 474871 - protein, 14 aa, Mycobacterium
FDGAPGTGQAGEAG

SEQ ID NO: 474872 - protein, 11 aa, Mycobacterium
FDGAPKHPTHA

SEQ ID NO: 474873 - protein, 17 aa, Mycobacterium
FDGDASAVQAVREAPKG

SEQ ID NO: 474874 - protein, 12 aa, Mycobacterium
FDGDEQARSRPI

SEQ ID NO: 474875 - protein, 5 aa, Mycobacterium
FDGDG

SEQ ID NO: 474876 - protein, 6 aa, Mycobacterium
FDGDGL

SEQ ID NO: 474877 - protein, 6 aa, Mycobacterium
FDGDGM

SEQ ID NO: 474878 - protein, 7 aa, Mycobacterium
FDGDGRS

SEQ ID NO: 474879 - protein, 5 aa, Mycobacterium
FDGDV

SEQ ID NO: 474880 - protein, 5 aa, Mycobacterium
FDGEP

SEQ ID NO: 474881 - protein, 9 aa, Mycobacterium
FDGEQNLAG

SEQ ID NO: 474882 - protein, 8 aa, Mycobacterium
FDGGPSGH

SEQ ID NO: 474883 - protein, 12 aa, Mycobacterium
FDGGSVLNRTDG

SEQ ID NO: 474884 - protein, 5 aa, Mycobacterium
FDGGT

SEQ ID NO: 474885 - protein, 8 aa, Mycobacterium
FDGGTRSV

SEQ ID NO: 474886 - protein, 9 aa, Mycobacterium
FDGKSPTEI

SEQ ID NO: 474887 - protein, 7 aa, Mycobacterium
FDGNPPP

SEQ ID NO: 474888 - protein, 5 aa, Mycobacterium
FDGPE

SEQ ID NO: 474889 - protein, 23 aa, Mycobacterium
FDGPPWRTTTGEHHSESPRYPRS

SEQ ID NO: 474890 - protein, 9 aa, Mycobacterium
FDGPTDAGD

SEQ ID NO: 474891 - protein, 7 aa, Mycobacterium
FDGPTQA

SEQ ID NO: 474892 - protein, 12 aa, Mycobacterium
FDGPYGNTGTNS

SEQ ID NO: 474893 - protein, 4 aa, Mycobacterium
FDGR

SEQ ID NO: 474894 - protein, 7 aa, Mycobacterium
FDGRDED

SEQ ID NO: 474895 - protein, 8 aa, Mycobacterium
FDGRPQAT

SEQ ID NO: 474896 - protein, 10 aa, Mycobacterium
FDGRSGEPFP

SEQ ID NO: 474897 - protein, 6 aa, Mycobacterium
FDGRTG

SEQ ID NO: 474898 - protein, 5 aa, Mycobacterium
FDGSG

SEQ ID NO: 474899 - protein, 8 aa, Mycobacterium
FDGSGATA

SEQ ID NO: 474900 - protein, 21 aa, Mycobacterium
FDGSGDPEETLQQTEDRQAES

SEQ ID NO: 474901 - protein, 6 aa, Mycobacterium
FDGSGI

SEQ ID NO: 474902 - protein, 7 aa, Mycobacterium
FDGSGID

SEQ ID NO: 474903 - protein, 5 aa, Mycobacterium
FDGST

SEQ ID NO: 474904 - protein, 5 aa, Mycobacterium
FDGTE

SEQ ID NO: 474905 - protein, 5 aa, Mycobacterium
FDGTL

SEQ ID NO: 474906 - protein, 6 aa, Mycobacterium
FDGTSI

SEQ ID NO: 474907 - protein, 11 aa, Mycobacterium
FDGYTSGTTKD

SEQ ID NO: 474908 - protein, 8 aa, Mycobacterium
FDHEKAGL

SEQ ID NO: 474909 - protein, 13 aa, Mycobacterium
FDHQAPDRGLGGP

SEQ ID NO: 474910 - protein, 4 aa, Mycobacterium
FDKD

SEQ ID NO: 474911 - protein, 9 aa, Mycobacterium
FDKDGTGLD

SEQ ID NO: 474912 - protein, 5 aa, Mycobacterium
FDNAD

SEQ ID NO: 474913 - protein, 6 aa, Mycobacterium
FDNERS

SEQ ID NO: 474914 - protein, 15 aa, Mycobacterium
FDNGPWPATPPKERA

SEQ ID NO: 474915 - protein, 4 aa, Mycobacterium
FDNP

SEQ ID NO: 474916 - protein, 11 aa, Mycobacterium
FDNRGRRADEQ

SEQ ID NO: 474917 - protein, 7 aa, Mycobacterium
FDPAADK

SEQ ID NO: 474918 - protein, 11 aa, Mycobacterium
FDPAAGHRCDP

SEQ ID NO: 474919 - protein, 9 aa, Mycobacterium
FDPAAPDAV

SEQ ID NO: 474920 - protein, 10 aa, Mycobacterium
FDPAAQTVSA

SEQ ID NO: 474921 - protein, 7 aa, Mycobacterium
FDPADDK

SEQ ID NO: 474922 - protein, 7 aa, Mycobacterium
FDPAESA

SEQ ID NO: 474923 - protein, 8 aa, Mycobacterium
FDPAKGPS

SEQ ID NO: 474924 - protein, 10 aa, Mycobacterium
FDPARKNARQ

SEQ ID NO: 474925 - protein, 7 aa, Mycobacterium
FDPARPT

SEQ ID NO: 474926 - protein, 5 aa, Mycobacterium
FDPAT

SEQ ID NO: 474927 - protein, 4 aa, Mycobacterium
FDPD

SEQ ID NO: 474928 - protein, 5 aa, Mycobacterium
FDPDA

SEQ ID NO: 474929 - protein, 6 aa, Mycobacterium
FDPDEA

SEQ ID NO: 474930 - protein, 10 aa, Mycobacterium
FDPDEGFPPA

SEQ ID NO: 474931 - protein, 12 aa, Mycobacterium
FDPDGKVPDSDV

SEQ ID NO: 474932 - protein, 6 aa, Mycobacterium
FDPDGR

SEQ ID NO: 474933 - protein, 8 aa, Mycobacterium
FDPDKGPS

SEQ ID NO: 474934 - protein, 18 aa, Mycobacterium
FDPDKNDLDFTTDARPEQ

SEQ ID NO: 474935 - protein, 6 aa, Mycobacterium
FDPDRK

SEQ ID NO: 474936 - protein, 8 aa, Mycobacterium
FDPDSGSD

SEQ ID NO: 474937 - protein, 5 aa, Mycobacterium
FDPDT

SEQ ID NO: 474938 - protein, 12 aa, Mycobacterium
FDPDTADPSLPT

SEQ ID NO: 474939 - protein, 6 aa, Mycobacterium
FDPEAS

SEQ ID NO: 474940 - protein, 5 aa, Mycobacterium
FDPED

SEQ ID NO: 474941 - protein, 9 aa, Mycobacterium
FDPEDTKVT

SEQ ID NO: 474942 - protein, 13 aa, Mycobacterium
FDPEKARQATETL

SEQ ID NO: 474943 - protein, 7 aa, Mycobacterium
FDPEKGA

SEQ ID NO: 474944 - protein, 8 aa, Mycobacterium
FDPEPSVR

SEQ ID NO: 474945 - protein, 5 aa, Mycobacterium
FDPER

SEQ ID NO: 474946 - protein, 6 aa, Mycobacterium
FDPETN

SEQ ID NO: 474947 - protein, 21 aa, Mycobacterium
FDPGLDPQRLAEQASSSAQPL

SEQ ID NO: 474948 - protein, 5 aa, Mycobacterium
FDPGR

SEQ ID NO: 474949 - protein, 6 aa, Mycobacterium
FDPGRD

SEQ ID NO: 474950 - protein, 6 aa, Mycobacterium
FDPGRI

SEQ ID NO: 474951 - protein, 5 aa, Mycobacterium
FDPGS

SEQ ID NO: 474952 - protein, 18 aa, Mycobacterium
FDPGSRAAYSTDASNYRQ

SEQ ID NO: 474953 - protein, 9 aa, Mycobacterium
FDPGSRAVA

SEQ ID NO: 474954 - protein, 5 aa, Mycobacterium
FDPHE

SEQ ID NO: 474955 - protein, 7 aa, Mycobacterium
FDPHTDG

SEQ ID NO: 474956 - protein, 9 aa, Mycobacterium
FDPIPGNDA

SEQ ID NO: 474957 - protein, 11 aa, Mycobacterium
FDPKSAKSLSL

SEQ ID NO: 474958 - protein, 11 aa, Mycobacterium
FDPKSSKSLSL

SEQ ID NO: 474959 - protein, 21 aa, Mycobacterium
FDPKSSKSQSLRTHSQTSGWS

SEQ ID NO: 474960 - protein, 12 aa, Mycobacterium
FDPLDAKESTRI

SEQ ID NO: 474961 - protein, 6 aa, Mycobacterium
FDPNQP

SEQ ID NO: 474962 - protein, 8 aa, Mycobacterium
FDPPEHSA

SEQ ID NO: 474963 - protein, 10 aa, Mycobacterium
FDPPGFAGDP

SEQ ID NO: 474964 - protein, 6 aa, Mycobacterium
FDPPRA

SEQ ID NO: 474965 - protein, 10 aa, Mycobacterium
FDPPRGGNAG

SEQ ID NO: 474966 - protein, 6 aa, Mycobacterium
FDPPSA

SEQ ID NO: 474967 - protein, 9 aa, Mycobacterium
FDPPSGAFR

SEQ ID NO: 474968 - protein, 7 aa, Mycobacterium
FDPPTDY

SEQ ID NO: 474969 - protein, 7 aa, Mycobacterium
FDPQAKG

SEQ ID NO: 474970 - protein, 8 aa, Mycobacterium
FDPQAKGI

SEQ ID NO: 474971 - protein, 8 aa, Mycobacterium
FDPQQAGP

SEQ ID NO: 474972 - protein, 7 aa, Mycobacterium
FDPRERP

SEQ ID NO: 474973 - protein, 5 aa, Mycobacterium
FDPRG

SEQ ID NO: 474974 - protein, 7 aa, Mycobacterium
FDPRGTV

SEQ ID NO: 474975 - protein, 7 aa, Mycobacterium
FDPRPPM

SEQ ID NO: 474976 - protein, 9 aa, Mycobacterium
FDPRQDGGM

SEQ ID NO: 474977 - protein, 5 aa, Mycobacterium
FDPRR

SEQ ID NO: 474978 - protein, 5 aa, Mycobacterium
FDPSL

SEQ ID NO: 474979 - protein, 19 aa, Mycobacterium
FDPSPEGRARTRALLRAYD

SEQ ID NO: 474980 - protein, 9 aa, Mycobacterium
FDPSTGSVQ

SEQ ID NO: 474981 - protein, 4 aa, Mycobacterium
FDPT

SEQ ID NO: 474982 - protein, 7 aa, Mycobacterium
FDPTAAS

SEQ ID NO: 474983 - protein, 8 aa, Mycobacterium
FDPTAPSL

SEQ ID NO: 474984 - protein, 7 aa, Mycobacterium
FDPTGAI

SEQ ID NO: 474985 - protein, 8 aa, Mycobacterium
FDPTPELG

SEQ ID NO: 474986 - protein, 8 aa, Mycobacterium
FDPTRGSY

SEQ ID NO: 474987 - protein, 4 aa, Mycobacterium
FDPV

SEQ ID NO: 474988 - protein, 12 aa, Mycobacterium
FDPVDSDQAAEI

SEQ ID NO: 474989 - protein, 10 aa, Mycobacterium
FDPVGKPGAL

SEQ ID NO: 474990 - protein, 4 aa, Mycobacterium
FDQE

SEQ ID NO: 474991 - protein, 8 aa, Mycobacterium
FDQGDDGV

SEQ ID NO: 474992 - protein, 19 aa, Mycobacterium
FDQPEATRAECGSKKSNYK

SEQ ID NO: 474993 - protein, 9 aa, Mycobacterium
FDQPRAEAA

SEQ ID NO: 474994 - protein, 12 aa, Mycobacterium
FDQRAEERCLFI

SEQ ID NO: 474995 - protein, 11 aa, Mycobacterium
FDRDDPRGGEA

SEQ ID NO: 474996 - protein, 10 aa, Mycobacterium
FDRDPDGAWR

SEQ ID NO: 474997 - protein, 10 aa, Mycobacterium
FDRDPNGDWR

SEQ ID NO: 474998 - protein, 4 aa, Mycobacterium
FDRG

SEQ ID NO: 474999 - protein, 5 aa, Mycobacterium
FDRGG

SEQ ID NO: 475000 - protein, 23 aa, Mycobacterium
FDRGREAGVQIEPSDVIGGKVAG

SEQ ID NO: 475001 - protein, 7 aa, Mycobacterium
FDRNDKR

SEQ ID NO: 475002 - protein, 5 aa, Mycobacterium
FDRPD

SEQ ID NO: 475003 - protein, 17 aa, Mycobacterium
FDRPEPRYRAQRSVEEY

SEQ ID NO: 475004 - protein, 7 aa, Mycobacterium
FDRPGPR

SEQ ID NO: 475005 - protein, 4 aa, Mycobacterium
FDRS

SEQ ID NO: 475006 - protein, 5 aa, Mycobacterium
FDRSR

SEQ ID NO: 475007 - protein, 6 aa, Mycobacterium
FDRSSP

SEQ ID NO: 475008 - protein, 9 aa, Mycobacterium
FDRTEPGAR

SEQ ID NO: 475009 - protein, 7 aa, Mycobacterium
FDRTQPT

SEQ ID NO: 475010 - protein, 12 aa, Mycobacterium
FDRVEPQHPGDA

SEQ ID NO: 475011 - protein, 4 aa, Mycobacterium
FDSA

SEQ ID NO: 475012 - protein, 8 aa, Mycobacterium
FDSAEGSM

SEQ ID NO: 475013 - protein, 9 aa, Mycobacterium
FDSDDPDVV

SEQ ID NO: 475014 - protein, 10 aa, Mycobacterium
FDSENDTEVG

SEQ ID NO: 475015 - protein, 11 aa, Mycobacterium
FDSETFQRTKA

SEQ ID NO: 475016 - protein, 17 aa, Mycobacterium
FDSGAPQRDGVGGQQDS

SEQ ID NO: 475017 - protein, 9 aa, Mycobacterium
FDSGDPQLP

SEQ ID NO: 475018 - protein, 11 aa, Mycobacterium
FDSGGSGTAVY

SEQ ID NO: 475019 - protein, 7 aa, Mycobacterium
FDSHGEE

SEQ ID NO: 475020 - protein, 7 aa, Mycobacterium
FDSHGGP

SEQ ID NO: 475021 - protein, 6 aa, Mycobacterium
FDSPDA

SEQ ID NO: 475022 - protein, 9 aa, Mycobacterium
FDSPDENSS

SEQ ID NO: 475023 - protein, 10 aa, Mycobacterium
FDSPEDAGVG

SEQ ID NO: 475024 - protein, 6 aa, Mycobacterium
FDSPGA

SEQ ID NO: 475025 - protein, 5 aa, Mycobacterium
FDSPI

SEQ ID NO: 475026 - protein, 9 aa, Mycobacterium
FDSRDDGLH

SEQ ID NO: 475027 - protein, 8 aa, Mycobacterium
FDSRDDQL

SEQ ID NO: 475028 - protein, 11 aa, Mycobacterium
FDSRGRRADEQ

SEQ ID NO: 475029 - protein, 8 aa, Mycobacterium
FDSRTNGS

SEQ ID NO: 475030 - protein, 11 aa, Mycobacterium
FDSSADSAEPL

SEQ ID NO: 475031 - protein, 21 aa, Mycobacterium
FDSSGDPDETLQETEARQAEG

SEQ ID NO: 475032 - protein, 21 aa, Mycobacterium
FDSSGDPEETLQETEARQADG

SEQ ID NO: 475033 - protein, 8 aa, Mycobacterium
FDSTDGGW

SEQ ID NO: 475034 - protein, 9 aa, Mycobacterium
FDSTDWPTD

SEQ ID NO: 475035 - protein, 10 aa, Mycobacterium
FDSTGPGQAM

SEQ ID NO: 475036 - protein, 8 aa, Mycobacterium
FDSTSGKL

SEQ ID NO: 475037 - protein, 11 aa, Mycobacterium
FDTARKPNPHL

SEQ ID NO: 475038 - protein, 22 aa, Mycobacterium
FDTASAAATARGRVKATSQRKI

SEQ ID NO: 475039 - protein, 16 aa, Mycobacterium
FDTEEEGIAAANDTEY

SEQ ID NO: 475040 - protein, 7 aa, Mycobacterium
FDTEQTG

SEQ ID NO: 475041 - protein, 10 aa, Mycobacterium
FDTESGDLRG

SEQ ID NO: 475042 - protein, 4 aa, Mycobacterium
FDTG

SEQ ID NO: 475043 - protein, 10 aa, Mycobacterium
FDTGARGSLR

SEQ ID NO: 475044 - protein, 8 aa, Mycobacterium
FDTGSGGQ

SEQ ID NO: 475045 - protein, 41 aa, Mycobacterium
FDTPDADKGFNPHKDDDDFSVSGADNQLSVSAESDAGRRGV

SEQ ID NO: 475046 - protein, 9 aa, Mycobacterium
FDTPDSDDE

SEQ ID NO: 475047 - protein, 8 aa, Mycobacterium
FDTPPSVQ

SEQ ID NO: 475048 - protein, 16 aa, Mycobacterium
FDTPSYRSCGSGYYNT

SEQ ID NO: 475049 - protein, 9 aa, Mycobacterium
FDTPYPPAR

SEQ ID NO: 475050 - protein, 14 aa, Mycobacterium
FDTRAGSASESSVA

SEQ ID NO: 475051 - protein, 8 aa, Mycobacterium
FDTSRGNS

SEQ ID NO: 475052 - protein, 30 aa, Mycobacterium
FDTSSAAGGGNSASAAGGGNSVPALTETGR

SEQ ID NO: 475053 - protein, 14 aa, Mycobacterium
FDTTDGRPAQRTRD

SEQ ID NO: 475054 - protein, 10 aa, Mycobacterium
FDTTQPTAWS

SEQ ID NO: 475055 - protein, 18 aa, Mycobacterium
FDTVGSPAFSAEESARYR

SEQ ID NO: 475056 - protein, 8 aa, Mycobacterium
FDVEDPRG

SEQ ID NO: 475057 - protein, 6 aa, Mycobacterium
FDVETP

SEQ ID NO: 475058 - protein, 6 aa, Mycobacterium
FDVGER

SEQ ID NO: 475059 - protein, 10 aa, Mycobacterium
FDVGRDPNKH

SEQ ID NO: 475060 - protein, 7 aa, Mycobacterium
FDVSPDG

SEQ ID NO: 475061 - protein, 9 aa, Mycobacterium
FEAASPDAF

SEQ ID NO: 475062 - protein, 11 aa, Mycobacterium
FEADGAPATRT

SEQ ID NO: 475063 - protein, 7 aa, Mycobacterium
FEAEGTR

SEQ ID NO: 475064 - protein, 4 aa, Mycobacterium
FEAG

SEQ ID NO: 475065 - protein, 5 aa, Mycobacterium
FEAGE

SEQ ID NO: 475066 - protein, 9 aa, Mycobacterium
FEARRRTQQ

SEQ ID NO: 475067 - protein, 9 aa, Mycobacterium
FEASTPDAL

SEQ ID NO: 475068 - protein, 9 aa, Mycobacterium
FEASTPNAL

SEQ ID NO: 475069 - protein, 26 aa, Mycobacterium
FEATPGDSAGREKASGRSQARQCAQQ

SEQ ID NO: 475070 - protein, 9 aa, Mycobacterium
FEATTTDGP

SEQ ID NO: 475071 - protein, 10 aa, Mycobacterium
FEDENGTVRK

SEQ ID NO: 475072 - protein, 11 aa, Mycobacterium
FEDETGTRRKL

SEQ ID NO: 475073 - protein, 8 aa, Mycobacterium
FEDETGTV

SEQ ID NO: 475074 - protein, 9 aa, Mycobacterium
FEDETGTVR

SEQ ID NO: 475075 - protein, 4 aa, Mycobacterium
FEDG

SEQ ID NO: 475076 - protein, 9 aa, Mycobacterium
FEDGESQDW

SEQ ID NO: 475077 - protein, 10 aa, Mycobacterium
FEDKANREII

SEQ ID NO: 475078 - protein, 11 aa, Mycobacterium
FEDPDEIGRGG

SEQ ID NO: 475079 - protein, 11 aa, Mycobacterium
FEDRASTDPLE

SEQ ID NO: 475080 - protein, 8 aa, Mycobacterium
FEDSTSAT

SEQ ID NO: 475081 - protein, 12 aa, Mycobacterium
FEEAPETGATFE

SEQ ID NO: 475082 - protein, 10 aa, Mycobacterium
FEEAPEVANA

SEQ ID NO: 475083 - protein, 4 aa, Mycobacterium
FEEP

SEQ ID NO: 475084 - protein, 11 aa, Mycobacterium
FEEPKGAGPHA

SEQ ID NO: 475085 - protein, 11 aa, Mycobacterium
FEEPSADRPLR

SEQ ID NO: 475086 - protein, 8 aa, Mycobacterium
FEEQRGAA

SEQ ID NO: 475087 - protein, 18 aa, Mycobacterium
FEESKQRQLDREARTGKR

SEQ ID NO: 475088 - protein, 5 aa, Mycobacterium
FEETA

SEQ ID NO: 475089 - protein, 5 aa, Mycobacterium
FEETQ

SEQ ID NO: 475090 - protein, 6 aa, Mycobacterium
FEETTM

SEQ ID NO: 475091 - protein, 7 aa, Mycobacterium
FEETTTH

SEQ ID NO: 475092 - protein, 8 aa, Mycobacterium
FEETTTHY

SEQ ID NO: 475093 - protein, 5 aa, Mycobacterium
FEGAG

SEQ ID NO: 475094 - protein, 5 aa, Mycobacterium
FEGAR

SEQ ID NO: 475095 - protein, 4 aa, Mycobacterium
FEGD

SEQ ID NO: 475096 - protein, 6 aa, Mycobacterium
FEGDDP

SEQ ID NO: 475097 - protein, 5 aa, Mycobacterium
FEGDP

SEQ ID NO: 475098 - protein, 9 aa, Mycobacterium
FEGEQNLAG

SEQ ID NO: 475099 - protein, 10 aa, Mycobacterium
FEGEQNLSGQ

SEQ ID NO: 475100 - protein, 9 aa, Mycobacterium
FEGHPDNAA

SEQ ID NO: 475101 - protein, 12 aa, Mycobacterium
FEGHPDNASAAV

SEQ ID NO: 475102 - protein, 10 aa, Mycobacterium
FEGKADKTEL

SEQ ID NO: 475103 - protein, 13 aa, Mycobacterium
FEGKGEKLSSSDL

SEQ ID NO: 475104 - protein, 6 aa, Mycobacterium
FEGKSS

SEQ ID NO: 475105 - protein, 7 aa, Mycobacterium
FEGKSSV

SEQ ID NO: 475106 - protein, 14 aa, Mycobacterium
FEGNPDDNGHRGVT

SEQ ID NO: 475107 - protein, 4 aa, Mycobacterium
FEGP

SEQ ID NO: 475108 - protein, 8 aa, Mycobacterium
FEGPDGTR

SEQ ID NO: 475109 - protein, 13 aa, Mycobacterium
FEGPKAPSEDHAP

SEQ ID NO: 475110 - protein, 9 aa, Mycobacterium
FEGPPKKPD

SEQ ID NO: 475111 - protein, 14 aa, Mycobacterium
FEGPTDGTAPENPY

SEQ ID NO: 475112 - protein, 12 aa, Mycobacterium
FEGRDTKTMPRA

SEQ ID NO: 475113 - protein, 7 aa, Mycobacterium
FEGRPLQ

SEQ ID NO: 475114 - protein, 11 aa, Mycobacterium
FEGSETSDMPG

SEQ ID NO: 475115 - protein, 8 aa, Mycobacterium
FEGSGQAQ

SEQ ID NO: 475116 - protein, 6 aa, Mycobacterium
FEGTES

SEQ ID NO: 475117 - protein, 17 aa, Mycobacterium
FEGTTARIREKQKAGDF

SEQ ID NO: 475118 - protein, 18 aa, Mycobacterium
FEGTTARIREKQKAGDIK

SEQ ID NO: 475119 - protein, 5 aa, Mycobacterium
FEHAP

SEQ ID NO: 475120 - protein, 36 aa, Mycobacterium
FEHGQDRRDGFGGPRKQQRHNPSRARARGRQAVRQP

SEQ ID NO: 475121 - protein, 5 aa, Mycobacterium
FEHND

SEQ ID NO: 475122 - protein, 5 aa, Mycobacterium
FEIPE

SEQ ID NO: 475123 - protein, 12 aa, Mycobacterium
FEKPKSLGNQDT

SEQ ID NO: 475124 - protein, 12 aa, Mycobacterium
FEKSGGGTAGPY

SEQ ID NO: 475125 - protein, 11 aa, Mycobacterium
FEKSGRRKARV

SEQ ID NO: 475126 - protein, 8 aa, Mycobacterium
FEKSGSAR

SEQ ID NO: 475127 - protein, 4 aa, Mycobacterium
FEKT

SEQ ID NO: 475128 - protein, 8 aa, Mycobacterium
FEKTAADP

SEQ ID NO: 475129 - protein, 16 aa, Mycobacterium
FEKTKPPDYRPPEGAV

SEQ ID NO: 475130 - protein, 16 aa, Mycobacterium
FEKTKPPDYRPSPSAV

SEQ ID NO: 475131 - protein, 6 aa, Mycobacterium
FENDDS

SEQ ID NO: 475132 - protein, 6 aa, Mycobacterium
FENDEA

SEQ ID NO: 475133 - protein, 5 aa, Mycobacterium
FENDG

SEQ ID NO: 475134 - protein, 7 aa, Mycobacterium
FEPAEDR

SEQ ID NO: 475135 - protein, 6 aa, Mycobacterium
FEPAKR

SEQ ID NO: 475136 - protein, 17 aa, Mycobacterium
FEPDGAGRSGSQGDSGE

SEQ ID NO: 475137 - protein, 7 aa, Mycobacterium
FEPDPDF

SEQ ID NO: 475138 - protein, 5 aa, Mycobacterium
FEPEA

SEQ ID NO: 475139 - protein, 12 aa, Mycobacterium
FEPEGDDISPQI

SEQ ID NO: 475140 - protein, 9 aa, Mycobacterium
FEPESLDEE

SEQ ID NO: 475141 - protein, 6 aa, Mycobacterium
FEPGAE

SEQ ID NO: 475142 - protein, 7 aa, Mycobacterium
FEPGELP

SEQ ID NO: 475143 - protein, 20 aa, Mycobacterium
FEPGGSGRPVGLRPSGALGA

SEQ ID NO: 475144 - protein, 8 aa, Mycobacterium
FEPGGSVG

SEQ ID NO: 475145 - protein, 14 aa, Mycobacterium
FEPGKRIGAGLDET

SEQ ID NO: 475146 - protein, 19 aa, Mycobacterium
FEPGPGLADDPLPEAVSPT

SEQ ID NO: 475147 - protein, 10 aa, Mycobacterium
FEPGQEEPTR

SEQ ID NO: 475148 - protein, 9 aa, Mycobacterium
FEPGQPSAW

SEQ ID NO: 475149 - protein, 13 aa, Mycobacterium
FEPGYPSKTAAPA

SEQ ID NO: 475150 - protein, 5 aa, Mycobacterium
FEPHY

SEQ ID NO: 475151 - protein, 10 aa, Mycobacterium
FEPKSEKSLS

SEQ ID NO: 475152 - protein, 16 aa, Mycobacterium
FEPNNTVPGTGLSPDK

SEQ ID NO: 475153 - protein, 14 aa, Mycobacterium
FEPPADGYVSGEPW

SEQ ID NO: 475154 - protein, 14 aa, Mycobacterium
FEPPEGDYVSGEPW

SEQ ID NO: 475155 - protein, 6 aa, Mycobacterium
FEPPPD

SEQ ID NO: 475156 - protein, 10 aa, Mycobacterium
FEPPTGPGVR

SEQ ID NO: 475157 - protein, 6 aa, Mycobacterium
FEPPTR

SEQ ID NO: 475158 - protein, 15 aa, Mycobacterium
FEPPTVDDRGDASRA

SEQ ID NO: 475159 - protein, 6 aa, Mycobacterium
FEPPYA

SEQ ID NO: 475160 - protein, 17 aa, Mycobacterium
FEPQPAPAPVEPPADQW

SEQ ID NO: 475161 - protein, 6 aa, Mycobacterium
FEPQPE

SEQ ID NO: 475162 - protein, 9 aa, Mycobacterium
FEPRPAQAR

SEQ ID NO: 475163 - protein, 4 aa, Mycobacterium
FEPS

SEQ ID NO: 475164 - protein, 7 aa, Mycobacterium
FEPSAGD

SEQ ID NO: 475165 - protein, 11 aa, Mycobacterium
FEPSAGHRCDP

SEQ ID NO: 475166 - protein, 8 aa, Mycobacterium
FEPSKTRR

SEQ ID NO: 475167 - protein, 11 aa, Mycobacterium
FEPSRTGRTEL

SEQ ID NO: 475168 - protein, 8 aa, Mycobacterium
FEPTDPEV

SEQ ID NO: 475169 - protein, 17 aa, Mycobacterium
FEPTRRGPSRDQARRNV

SEQ ID NO: 475170 - protein, 6 aa, Mycobacterium
FEPVTP

SEQ ID NO: 475171 - protein, 5 aa, Mycobacterium
FEQDD

SEQ ID NO: 475172 - protein, 10 aa, Mycobacterium
FEQDPNGDWR

SEQ ID NO: 475173 - protein, 8 aa, Mycobacterium
FEQEPMDG

SEQ ID NO: 475174 - protein, 4 aa, Mycobacterium
FEQP

SEQ ID NO: 475175 - protein, 10 aa, Mycobacterium
FEQPSPQPGV

SEQ ID NO: 475176 - protein, 5 aa, Mycobacterium
FEQRA

SEQ ID NO: 475177 - protein, 6 aa, Mycobacterium
FEQRPD

SEQ ID NO: 475178 - protein, 4 aa, Mycobacterium
FERA

SEQ ID NO: 475179 - protein, 16 aa, Mycobacterium
FERAAGRVRGERWGPR

SEQ ID NO: 475180 - protein, 11 aa, Mycobacterium
FERDDPRGGEA

SEQ ID NO: 475181 - protein, 13 aa, Mycobacterium
FEREEPKDGNEAW

SEQ ID NO: 475182 - protein, 5 aa, Mycobacterium
FERET

SEQ ID NO: 475183 - protein, 7 aa, Mycobacterium
FERGETP

SEQ ID NO: 475184 - protein, 5 aa, Mycobacterium
FERGR

SEQ ID NO: 475185 - protein, 6 aa, Mycobacterium
FERGRN

SEQ ID NO: 475186 - protein, 7 aa, Mycobacterium
FERPGPR

SEQ ID NO: 475187 - protein, 4 aa, Mycobacterium
FERQ

SEQ ID NO: 475188 - protein, 12 aa, Mycobacterium
FERRANEAAPDL

SEQ ID NO: 475189 - protein, 12 aa, Mycobacterium
FERRTTEKVLSS

SEQ ID NO: 475190 - protein, 5 aa, Mycobacterium
FERSG

SEQ ID NO: 475191 - protein, 14 aa, Mycobacterium
FERSGKGKTLRTNR

SEQ ID NO: 475192 - protein, 9 aa, Mycobacterium
FERSGPERI

SEQ ID NO: 475193 - protein, 10 aa, Mycobacterium
FESDKGKWTK

SEQ ID NO: 475194 - protein, 7 aa, Mycobacterium
FESDQLT

SEQ ID NO: 475195 - protein, 17 aa, Mycobacterium
FESDSKYPYTPDGDREF

SEQ ID NO: 475196 - protein, 17 aa, Mycobacterium
FESDSKYPYTPDGNREF

SEQ ID NO: 475197 - protein, 24 aa, Mycobacterium
FESEIDADAAKEDAASDDERTAAW

SEQ ID NO: 475198 - protein, 35 aa, Mycobacterium
FESEIDESAAKHDAESEDPRIAAKGRARLRAIGAI

SEQ ID NO: 475199 - protein, 35 aa, Mycobacterium
FESEIDESAAREDSESDDPRIAARGRGRLRAVGAI

SEQ ID NO: 475200 - protein, 24 aa, Mycobacterium
FESEINADAAKQDSESDDERTAAW

SEQ ID NO: 475201 - protein, 9 aa, Mycobacterium
FESGDTAGD

SEQ ID NO: 475202 - protein, 8 aa, Mycobacterium
FESGGRSV

SEQ ID NO: 475203 - protein, 9 aa, Mycobacterium
FESGSGWPS

SEQ ID NO: 475204 - protein, 20 aa, Mycobacterium
FESGSSGRPVGLRPSGALGA

SEQ ID NO: 475205 - protein, 7 aa, Mycobacterium
FESPNTV

SEQ ID NO: 475206 - protein, 4 aa, Mycobacterium
FESQ

SEQ ID NO: 475207 - protein, 9 aa, Mycobacterium
FESQDHATV

SEQ ID NO: 475208 - protein, 5 aa, Mycobacterium
FESQI

SEQ ID NO: 475209 - protein, 6 aa, Mycobacterium
FESQIG

SEQ ID NO: 475210 - protein, 6 aa, Mycobacterium
FESRQP

SEQ ID NO: 475211 - protein, 4 aa, Mycobacterium
FESS

SEQ ID NO: 475212 - protein, 11 aa, Mycobacterium
FESSNTPGYSG

SEQ ID NO: 475213 - protein, 6 aa, Mycobacterium
FESTEE

SEQ ID NO: 475214 - protein, 9 aa, Mycobacterium
FETADQETV

SEQ ID NO: 475215 - protein, 11 aa, Mycobacterium
FETATGGVYGE

SEQ ID NO: 475216 - protein, 8 aa, Mycobacterium
FETDKDKW

SEQ ID NO: 475217 - protein, 10 aa, Mycobacterium
FETDKDKWTK

SEQ ID NO: 475218 - protein, 12 aa, Mycobacterium
FETDKDKWTKIS

SEQ ID NO: 475219 - protein, 4 aa, Mycobacterium
FETG

SEQ ID NO: 475220 - protein, 13 aa, Mycobacterium
FETGGAGLPPSPL

SEQ ID NO: 475221 - protein, 5 aa, Mycobacterium
FETGP

SEQ ID NO: 475222 - protein, 15 aa, Mycobacterium
FETGQSGSAPTAPDL

SEQ ID NO: 475223 - protein, 8 aa, Mycobacterium
FETGTLDG

SEQ ID NO: 475224 - protein, 7 aa, Mycobacterium
FETNEDG

SEQ ID NO: 475225 - protein, 17 aa, Mycobacterium
FETPANPSGGRVTFSDS

SEQ ID NO: 475226 - protein, 6 aa, Mycobacterium
FETPPN

SEQ ID NO: 475227 - protein, 10 aa, Mycobacterium
FETSDAGTIT

SEQ ID NO: 475228 - protein, 38 aa, Mycobacterium
FETTGVGSEPEVTELDDEAGDVPVAQGASGPAAPSPMA

SEQ ID NO: 475229 - protein, 5 aa, Mycobacterium
FEVPE

SEQ ID NO: 475230 - protein, 5 aa, Mycobacterium
FGAAD

SEQ ID NO: 475231 - protein, 17 aa, Mycobacterium
FGADANDSGADPQAVAA

SEQ ID NO: 475232 - protein, 9 aa, Mycobacterium
FGADARPWG

SEQ ID NO: 475233 - protein, 10 aa, Mycobacterium
FGADDDNYRE

SEQ ID NO: 475234 - protein, 7 aa, Mycobacterium
FGADEAA

SEQ ID NO: 475235 - protein, 13 aa, Mycobacterium
FGADGAADDGGAE

SEQ ID NO: 475236 - protein, 6 aa, Mycobacterium
FGADGV

SEQ ID NO: 475237 - protein, 20 aa, Mycobacterium
FGADTNIDTVATSRYDIVRP

SEQ ID NO: 475238 - protein, 14 aa, Mycobacterium
FGAEAGVPDAPELK

SEQ ID NO: 475239 - protein, 6 aa, Mycobacterium
FGAEEA

SEQ ID NO: 475240 - protein, 8 aa, Mycobacterium
FGAEEAAA

SEQ ID NO: 475241 - protein, 5 aa, Mycobacterium
FGAEP

SEQ ID NO: 475242 - protein, 9 aa, Mycobacterium
FGAEPGAIG

SEQ ID NO: 475243 - protein, 29 aa, Mycobacterium
FGAEPGVPPMTDNSSYRGGPGQGPDEYYD

SEQ ID NO: 475244 - protein, 4 aa, Mycobacterium
FGAG

SEQ ID NO: 475245 - protein, 22 aa, Mycobacterium
FGAGAPSAVAGAAVKGGRNTLE

SEQ ID NO: 475246 - protein, 11 aa, Mycobacterium
FGAGDDQELTN

SEQ ID NO: 475247 - protein, 5 aa, Mycobacterium
FGAGG

SEQ ID NO: 475248 - protein, 7 aa, Mycobacterium
FGAGGAN

SEQ ID NO: 475249 - protein, 7 aa, Mycobacterium
FGAGKTT

SEQ ID NO: 475250 - protein, 8 aa, Mycobacterium
FGAGSDDV

SEQ ID NO: 475251 - protein, 12 aa, Mycobacterium
FGAGTQVPMPPA

SEQ ID NO: 475252 - protein, 9 aa, Mycobacterium
FGAHRERAE

SEQ ID NO: 475253 - protein, 4 aa, Mycobacterium
FGAK

SEQ ID NO: 475254 - protein, 12 aa, Mycobacterium
FGANTGQDAAGD

SEQ ID NO: 475255 - protein, 21 aa, Mycobacterium
FGAPGNQADRMSNAMQNEEGA

SEQ ID NO: 475256 - protein, 9 aa, Mycobacterium
FGAPPGQVQ

SEQ ID NO: 475257 - protein, 10 aa, Mycobacterium
FGAPTPAESE

SEQ ID NO: 475258 - protein, 13 aa, Mycobacterium
FGARGHHASATAL

SEQ ID NO: 475259 - protein, 8 aa, Mycobacterium
FGARPDGL

SEQ ID NO: 475260 - protein, 6 aa, Mycobacterium
FGARPG

SEQ ID NO: 475261 - protein, 5 aa, Mycobacterium
FGASA

SEQ ID NO: 475262 - protein, 8 aa, Mycobacterium
FGASARSK

SEQ ID NO: 475263 - protein, 13 aa, Mycobacterium
FGASASNSRITSG

SEQ ID NO: 475264 - protein, 5 aa, Mycobacterium
FGASG

SEQ ID NO: 475265 - protein, 9 aa, Mycobacterium
FGASGRNGG

SEQ ID NO: 475266 - protein, 5 aa, Mycobacterium
FGATN

SEQ ID NO: 475267 - protein, 12 aa, Mycobacterium
FGCGPSKVRPEQ

SEQ ID NO: 475268 - protein, 21 aa, Mycobacterium
FGDAGPRPYRPGDATAPQGVY

SEQ ID NO: 475269 - protein, 9 aa, Mycobacterium
FGDAPDVKD

SEQ ID NO: 475270 - protein, 6 aa, Mycobacterium
FGDASR

SEQ ID NO: 475271 - protein, 4 aa, Mycobacterium
FGDD

SEQ ID NO: 475272 - protein, 11 aa, Mycobacterium
FGDDDERSARV

SEQ ID NO: 475273 - protein, 6 aa, Mycobacterium
FGDDDP

SEQ ID NO: 475274 - protein, 8 aa, Mycobacterium
FGDDGLQQ

SEQ ID NO: 475275 - protein, 13 aa, Mycobacterium
FGDDGTGAAGLGD

SEQ ID NO: 475276 - protein, 6 aa, Mycobacterium
FGDDPA

SEQ ID NO: 475277 - protein, 9 aa, Mycobacterium
FGDDPDIDE

SEQ ID NO: 475278 - protein, 10 aa, Mycobacterium
FGDDPDVDEV

SEQ ID NO: 475279 - protein, 28 aa, Mycobacterium
FGDDPNRYTDAKSRKNYAGTSPLTVASG

SEQ ID NO: 475280 - protein, 31 aa, Mycobacterium
FGDDPNRYTTAKSRKNYAGTSPLTIASGKKR

SEQ ID NO: 475281 - protein, 15 aa, Mycobacterium
FGDEARPENPDMADP

SEQ ID NO: 475282 - protein, 9 aa, Mycobacterium
FGDEEQVRS

SEQ ID NO: 475283 - protein, 8 aa, Mycobacterium
FGDEPTDR

SEQ ID NO: 475284 - protein, 4 aa, Mycobacterium
FGDG

SEQ ID NO: 475285 - protein, 10 aa, Mycobacterium
FGDGALKGKP

SEQ ID NO: 475286 - protein, 9 aa, Mycobacterium
FGDGEFPDS

SEQ ID NO: 475287 - protein, 27 aa, Mycobacterium
FGDGGAGGAGGASGFASGGTGGIGGTG

SEQ ID NO: 475288 - protein, 40 aa, Mycobacterium
FGDGGAGGPGGIGGTGAAGVDPPRDPPPKPPDGTTNPLYG

SEQ ID NO: 475289 - protein, 17 aa, Mycobacterium
FGDGGAGGQGGDGGGVT

SEQ ID NO: 475290 - protein, 26 aa, Mycobacterium
FGDGGDGGDCAESNGGIGSGGRGGSA

SEQ ID NO: 475291 - protein, 17 aa, Mycobacterium
FGDGGGGGAGGAGGAGG

SEQ ID NO: 475292 - protein, 23 aa, Mycobacterium
FGDGGNGGTGGAGSAGGNGGTGG

SEQ ID NO: 475293 - protein, 12 aa, Mycobacterium
FGDGGPPDNGAG

SEQ ID NO: 475294 - protein, 11 aa, Mycobacterium
FGDGGPPDNGT

SEQ ID NO: 475295 - protein, 15 aa, Mycobacterium
FGDGGSARDYYPGYP

SEQ ID NO: 475296 - protein, 12 aa, Mycobacterium
FGDGSLTDSGYP

SEQ ID NO: 475297 - protein, 10 aa, Mycobacterium
FGDGSVDNYR

SEQ ID NO: 475298 - protein, 11 aa, Mycobacterium
FGDKGYDGATI

SEQ ID NO: 475299 - protein, 8 aa, Mycobacterium
FGDKPRHD

SEQ ID NO: 475300 - protein, 13 aa, Mycobacterium
FGDKRVKRSPHPF

SEQ ID NO: 475301 - protein, 8 aa, Mycobacterium
FGDKTGNG

SEQ ID NO: 475302 - protein, 11 aa, Mycobacterium
FGDNDSDKLDE

SEQ ID NO: 475303 - protein, 14 aa, Mycobacterium
FGDPAAAGAENPYT

SEQ ID NO: 475304 - protein, 6 aa, Mycobacterium
FGDPTG

SEQ ID NO: 475305 - protein, 6 aa, Mycobacterium
FGDQAV

SEQ ID NO: 475306 - protein, 6 aa, Mycobacterium
FGDQDL

SEQ ID NO: 475307 - protein, 6 aa, Mycobacterium
FGDRQC

SEQ ID NO: 475308 - protein, 21 aa, Mycobacterium
FGDSDTATVPKTAADRRVPVN

SEQ ID NO: 475309 - protein, 7 aa, Mycobacterium
FGDSGND

SEQ ID NO: 475310 - protein, 14 aa, Mycobacterium
FGDSSDVKASRDDL

SEQ ID NO: 475311 - protein, 11 aa, Mycobacterium
FGDTPEANIAG

SEQ ID NO: 475312 - protein, 12 aa, Mycobacterium
FGDTSPSRYPGQ

SEQ ID NO: 475313 - protein, 5 aa, Mycobacterium
FGEAG

SEQ ID NO: 475314 - protein, 8 aa, Mycobacterium
FGEASGSR

SEQ ID NO: 475315 - protein, 12 aa, Mycobacterium
FGEDAEAAEVDA

SEQ ID NO: 475316 - protein, 8 aa, Mycobacterium
FGEDTEAE

SEQ ID NO: 475317 - protein, 6 aa, Mycobacterium
FGEEAA

SEQ ID NO: 475318 - protein, 10 aa, Mycobacterium
FGEEGDEFDP

SEQ ID NO: 475319 - protein, 4 aa, Mycobacterium
FGEG

SEQ ID NO: 475320 - protein, 7 aa, Mycobacterium
FGEGEGR

SEQ ID NO: 475321 - protein, 7 aa, Mycobacterium
FGEGGAD

SEQ ID NO: 475322 - protein, 11 aa, Mycobacterium
FGEGGPPDNGA

SEQ ID NO: 475323 - protein, 8 aa, Mycobacterium
FGEGPARS

SEQ ID NO: 475324 - protein, 6 aa, Mycobacterium
FGEHTD

SEQ ID NO: 475325 - protein, 12 aa, Mycobacterium
FGENAPAEYANA

SEQ ID NO: 475326 - protein, 6 aa, Mycobacterium
FGENPD

SEQ ID NO: 475327 - protein, 12 aa, Mycobacterium
FGEPALAGGALG

SEQ ID NO: 475328 - protein, 15 aa, Mycobacterium
FGEPATAKRLRDRAA

SEQ ID NO: 475329 - protein, 20 aa, Mycobacterium
FGEPDGATEIGDGVRVAIAK

SEQ ID NO: 475330 - protein, 7 aa, Mycobacterium
FGEPGGR

SEQ ID NO: 475331 - protein, 7 aa, Mycobacterium
FGEPPHL

SEQ ID NO: 475332 - protein, 14 aa, Mycobacterium
FGEPPQLGGAATAE

SEQ ID NO: 475333 - protein, 14 aa, Mycobacterium
FGEPSELAGAEAAD

SEQ ID NO: 475334 - protein, 11 aa, Mycobacterium
FGERKGQLAGP

SEQ ID NO: 475335 - protein, 18 aa, Mycobacterium
FGERSVNEGFSGGEKKRH

SEQ ID NO: 475336 - protein, 7 aa, Mycobacterium
FGESDAA

SEQ ID NO: 475337 - protein, 5 aa, Mycobacterium
FGESP

SEQ ID NO: 475338 - protein, 11 aa, Mycobacterium
FGESPDQQVND

SEQ ID NO: 475339 - protein, 8 aa, Mycobacterium
FGEVGDGR

SEQ ID NO: 475340 - protein, 5 aa, Mycobacterium
FGEVP

SEQ ID NO: 475341 - protein, 11 aa, Mycobacterium
FGFPGDPRLAR

SEQ ID NO: 475342 - protein, 4 aa, Mycobacterium
FGGA

SEQ ID NO: 475343 - protein, 9 aa, Mycobacterium
FGGAADPAL

SEQ ID NO: 475344 - protein, 6 aa, Mycobacterium
FGGAAS

SEQ ID NO: 475345 - protein, 11 aa, Mycobacterium
FGGAGGQGGQG

SEQ ID NO: 475346 - protein, 9 aa, Mycobacterium
FGGAKQAKL

SEQ ID NO: 475347 - protein, 9 aa, Mycobacterium
FGGAKQTEL

SEQ ID NO: 475348 - protein, 7 aa, Mycobacterium
FGGASGA

SEQ ID NO: 475349 - protein, 9 aa, Mycobacterium
FGGDAPAEF

SEQ ID NO: 475350 - protein, 10 aa, Mycobacterium
FGGDASPSIS

SEQ ID NO: 475351 - protein, 8 aa, Mycobacterium
FGGDASVR

SEQ ID NO: 475352 - protein, 9 aa, Mycobacterium
FGGDDEGIR

SEQ ID NO: 475353 - protein, 34 aa, Mycobacterium
FGGDGGAGGDAGHGGMGGDGGNGGQGASGGRGGL

SEQ ID NO: 475354 - protein, 7 aa, Mycobacterium
FGGDHDG

SEQ ID NO: 475355 - protein, 5 aa, Mycobacterium
FGGDK

SEQ ID NO: 475356 - protein, 6 aa, Mycobacterium
FGGDPA

SEQ ID NO: 475357 - protein, 6 aa, Mycobacterium
FGGDPD

SEQ ID NO: 475358 - protein, 7 aa, Mycobacterium
FGGDPEN

SEQ ID NO: 475359 - protein, 7 aa, Mycobacterium
FGGDPGN

SEQ ID NO: 475360 - protein, 8 aa, Mycobacterium
FGGDPGNV

SEQ ID NO: 475361 - protein, 8 aa, Mycobacterium
FGGDPGSV

SEQ ID NO: 475362 - protein, 6 aa, Mycobacterium
FGGDPH

SEQ ID NO: 475363 - protein, 7 aa, Mycobacterium
FGGDPKR

SEQ ID NO: 475364 - protein, 7 aa, Mycobacterium
FGGDPNN

SEQ ID NO: 475365 - protein, 6 aa, Mycobacterium
FGGDPQ

SEQ ID NO: 475366 - protein, 7 aa, Mycobacterium
FGGDPRN

SEQ ID NO: 475367 - protein, 7 aa, Mycobacterium
FGGDPSR

SEQ ID NO: 475368 - protein, 51 aa, Mycobacterium
FGGDRRQFGRPQPACHPRGAVDGRAESRNRQRFPGSPPEALTRRHPTEDRH

SEQ ID NO: 475369 - protein, 14 aa, Mycobacterium
FGGDSSVIKDPSTH

SEQ ID NO: 475370 - protein, 21 aa, Mycobacterium
FGGDSVTGTGGNGGAGGDAGG

SEQ ID NO: 475371 - protein, 4 aa, Mycobacterium
FGGE

SEQ ID NO: 475372 - protein, 8 aa, Mycobacterium
FGGEPNTQ

SEQ ID NO: 475373 - protein, 8 aa, Mycobacterium
FGGGATTL

SEQ ID NO: 475374 - protein, 5 aa, Mycobacterium
FGGGD

SEQ ID NO: 475375 - protein, 10 aa, Mycobacterium
FGGGDPVTLP

SEQ ID NO: 475376 - protein, 29 aa, Mycobacterium
FGGGGAGGSGGFSGQANGGGGGAGGSGGF

SEQ ID NO: 475377 - protein, 6 aa, Mycobacterium
FGGGGH

SEQ ID NO: 475378 - protein, 14 aa, Mycobacterium
FGGGGNGGAGGLGI

SEQ ID NO: 475379 - protein, 6 aa, Mycobacterium
FGGGGP

SEQ ID NO: 475380 - protein, 11 aa, Mycobacterium
FGGGGRAVQDA

SEQ ID NO: 475381 - protein, 8 aa, Mycobacterium
FGGGGTDD

SEQ ID NO: 475382 - protein, 34 aa, Mycobacterium
FGGGGTGGAGGGSGSGGGPVGKGGNGGNGGNAQL

SEQ ID NO: 475383 - protein, 17 aa, Mycobacterium
FGGGGTGGAGGTGGPAG

SEQ ID NO: 475384 - protein, 11 aa, Mycobacterium
FGGGLTEADKR

SEQ ID NO: 475385 - protein, 12 aa, Mycobacterium
FGGGPASRGPIG

SEQ ID NO: 475386 - protein, 34 aa, Mycobacterium
FGGGPGGSGGNGGTGGFIGGGGPGGAGGPGGTGT

SEQ ID NO: 475387 - protein, 6 aa, Mycobacterium
FGGGPK

SEQ ID NO: 475388 - protein, 6 aa, Mycobacterium
FGGGPL

SEQ ID NO: 475389 - protein, 9 aa, Mycobacterium
FGGGPLPGL

SEQ ID NO: 475390 - protein, 11 aa, Mycobacterium
FGGGPRNGHGV

SEQ ID NO: 475391 - protein, 8 aa, Mycobacterium
FGGGPTSR

SEQ ID NO: 475392 - protein, 7 aa, Mycobacterium
FGGGPVG

SEQ ID NO: 475393 - protein, 6 aa, Mycobacterium
FGGGRA

SEQ ID NO: 475394 - protein, 7 aa, Mycobacterium
FGGGRAS

SEQ ID NO: 475395 - protein, 5 aa, Mycobacterium
FGGGS

SEQ ID NO: 475396 - protein, 8 aa, Mycobacterium
FGGGSELR

SEQ ID NO: 475397 - protein, 11 aa, Mycobacterium
FGGGSSHIETP

SEQ ID NO: 475398 - protein, 9 aa, Mycobacterium
FGGGSTGRK

SEQ ID NO: 475399 - protein, 12 aa, Mycobacterium
FGGGTFQRAEDK

SEQ ID NO: 475400 - protein, 4 aa, Mycobacterium
FGGH

SEQ ID NO: 475401 - protein, 5 aa, Mycobacterium
FGGKD

SEQ ID NO: 475402 - protein, 7 aa, Mycobacterium
FGGKGRA

SEQ ID NO: 475403 - protein, 8 aa, Mycobacterium
FGGNEPAR

SEQ ID NO: 475404 - protein, 12 aa, Mycobacterium
FGGNGPHGNRPG

SEQ ID NO: 475405 - protein, 12 aa, Mycobacterium
FGGNGPHGTRPG

SEQ ID NO: 475406 - protein, 5 aa, Mycobacterium
FGGNK

SEQ ID NO: 475407 - protein, 8 aa, Mycobacterium
FGGNTTQV

SEQ ID NO: 475408 - protein, 6 aa, Mycobacterium
FGGPAA

SEQ ID NO: 475409 - protein, 10 aa, Mycobacterium
FGGPAGRALA

SEQ ID NO: 475410 - protein, 7 aa, Mycobacterium
FGGPAGV

SEQ ID NO: 475411 - protein, 5 aa, Mycobacterium
FGGPD

SEQ ID NO: 475412 - protein, 7 aa, Mycobacterium
FGGPGAE

SEQ ID NO: 475413 - protein, 29 aa, Mycobacterium
FGGPGGAGGTGGVGTGGDGGNGGAGGNAG

SEQ ID NO: 475414 - protein, 8 aa, Mycobacterium
FGGPGNSY

SEQ ID NO: 475415 - protein, 6 aa, Mycobacterium
FGGPGV

SEQ ID NO: 475416 - protein, 7 aa, Mycobacterium
FGGPIET

SEQ ID NO: 475417 - protein, 9 aa, Mycobacterium
FGGPPADYQ

SEQ ID NO: 475418 - protein, 8 aa, Mycobacterium
FGGPPGAG

SEQ ID NO: 475419 - protein, 7 aa, Mycobacterium
FGGPPGI

SEQ ID NO: 475420 - protein, 7 aa, Mycobacterium
FGGPPGV

SEQ ID NO: 475421 - protein, 11 aa, Mycobacterium
FGGPQVTNDGV

SEQ ID NO: 475422 - protein, 6 aa, Mycobacterium
FGGPRG

SEQ ID NO: 475423 - protein, 7 aa, Mycobacterium
FGGPRGV

SEQ ID NO: 475424 - protein, 7 aa, Mycobacterium
FGGPTGV

SEQ ID NO: 475425 - protein, 10 aa, Mycobacterium
FGGPTITNDG

SEQ ID NO: 475426 - protein, 11 aa, Mycobacterium
FGGPTVTNDGV

SEQ ID NO: 475427 - protein, 9 aa, Mycobacterium
FGGQEPTAT

SEQ ID NO: 475428 - protein, 7 aa, Mycobacterium
FGGQGYG

SEQ ID NO: 475429 - protein, 14 aa, Mycobacterium
FGGQPHRTAAAQPI

SEQ ID NO: 475430 - protein, 6 aa, Mycobacterium
FGGQTR

SEQ ID NO: 475431 - protein, 8 aa, Mycobacterium
FGGQTREL

SEQ ID NO: 475432 - protein, 24 aa, Mycobacterium
FGGQTRELATGASLAADIAAALET

SEQ ID NO: 475433 - protein, 6 aa, Mycobacterium
FGGRDE

SEQ ID NO: 475434 - protein, 9 aa, Mycobacterium
FGGRDGSNL

SEQ ID NO: 475435 - protein, 8 aa, Mycobacterium
FGGRDGTN

SEQ ID NO: 475436 - protein, 5 aa, Mycobacterium
FGGRG

SEQ ID NO: 475437 - protein, 15 aa, Mycobacterium
FGGRGEGRSAGSADS

SEQ ID NO: 475438 - protein, 16 aa, Mycobacterium
FGGRKDSGTGTEEGVE

SEQ ID NO: 475439 - protein, 6 aa, Mycobacterium
FGGRPG

SEQ ID NO: 475440 - protein, 5 aa, Mycobacterium
FGGRR

SEQ ID NO: 475441 - protein, 6 aa, Mycobacterium
FGGRTG

SEQ ID NO: 475442 - protein, 9 aa, Mycobacterium
FGGSDGDGL

SEQ ID NO: 475443 - protein, 18 aa, Mycobacterium
FGGSGGNGGSAGDGGAGG

SEQ ID NO: 475444 - protein, 6 aa, Mycobacterium
FGGSGR

SEQ ID NO: 475445 - protein, 12 aa, Mycobacterium
FGGSGRTSGETP

SEQ ID NO: 475446 - protein, 9 aa, Mycobacterium
FGGSSGVEF

SEQ ID NO: 475447 - protein, 7 aa, Mycobacterium
FGGSSHP

SEQ ID NO: 475448 - protein, 4 aa, Mycobacterium
FGGT

SEQ ID NO: 475449 - protein, 14 aa, Mycobacterium
FGGTAAKGNADAAG

SEQ ID NO: 475450 - protein, 11 aa, Mycobacterium
FGGTASGVTER

SEQ ID NO: 475451 - protein, 11 aa, Mycobacterium
FGGTKDSGLQP

SEQ ID NO: 475452 - protein, 6 aa, Mycobacterium
FGGTKH

SEQ ID NO: 475453 - protein, 9 aa, Mycobacterium
FGGTKNPQW

SEQ ID NO: 475454 - protein, 9 aa, Mycobacterium
FGGTPREPR

SEQ ID NO: 475455 - protein, 7 aa, Mycobacterium
FGGTPSE

SEQ ID NO: 475456 - protein, 15 aa, Mycobacterium
FGGTSQGSKVRGREP

SEQ ID NO: 475457 - protein, 10 aa, Mycobacterium
FGGTTASTGR

SEQ ID NO: 475458 - protein, 10 aa, Mycobacterium
FGGVSGGDWS

SEQ ID NO: 475459 - protein, 4 aa, Mycobacterium
FGGY

SEQ ID NO: 475460 - protein, 19 aa, Mycobacterium
FGGYKASSTQTFKEQAGPT

SEQ ID NO: 475461 - protein, 13 aa, Mycobacterium
FGGYKKSGIGREN

SEQ ID NO: 475462 - protein, 13 aa, Mycobacterium
FGGYKQSGIGREG

SEQ ID NO: 475463 - protein, 13 aa, Mycobacterium
FGGYKRSGNGREW

SEQ ID NO: 475464 - protein, 11 aa, Mycobacterium
FGHAQAASGAL

SEQ ID NO: 475465 - protein, 4 aa, Mycobacterium
FGHN

SEQ ID NO: 475466 - protein, 5 aa, Mycobacterium
FGHPD

SEQ ID NO: 475467 - protein, 8 aa, Mycobacterium
FGKAPSAN

SEQ ID NO: 475468 - protein, 16 aa, Mycobacterium
FGKGNSDSLPDTKNPL

SEQ ID NO: 475469 - protein, 16 aa, Mycobacterium
FGKGYPGADAPARLST

SEQ ID NO: 475470 - protein, 4 aa, Mycobacterium
FGKN

SEQ ID NO: 475471 - protein, 12 aa, Mycobacterium
FGKPDDETGTAS

SEQ ID NO: 475472 - protein, 11 aa, Mycobacterium
FGKPDDVTGTV

SEQ ID NO: 475473 - protein, 8 aa, Mycobacterium
FGKPDGYL

SEQ ID NO: 475474 - protein, 7 aa, Mycobacterium
FGKPIGS

SEQ ID NO: 475475 - protein, 8 aa, Mycobacterium
FGKPTAEE

SEQ ID NO: 475476 - protein, 10 aa, Mycobacterium
FGKPTEEERA

SEQ ID NO: 475477 - protein, 5 aa, Mycobacterium
FGKQA

SEQ ID NO: 475478 - protein, 9 aa, Mycobacterium
FGKSETDAR

SEQ ID NO: 475479 - protein, 23 aa, Mycobacterium
FGKSHGPTDPSRCLGPEPEGAPL

SEQ ID NO: 475480 - protein, 9 aa, Mycobacterium
FGKSPRDAE

SEQ ID NO: 475481 - protein, 14 aa, Mycobacterium
FGLGGNNVVLAFGA

SEQ ID NO: 475482 - protein, 4 aa, Mycobacterium
FGLP

SEQ ID NO: 475483 - protein, 12 aa, Mycobacterium
FGNAADESSYGH

SEQ ID NO: 475484 - protein, 8 aa, Mycobacterium
FGNAGSHN

SEQ ID NO: 475485 - protein, 27 aa, Mycobacterium
FGNAGSNNFGSGNNGSGNLGSGNGGNL

SEQ ID NO: 475486 - protein, 18 aa, Mycobacterium
FGNDPQVGPDGPEDPWAD

SEQ ID NO: 475487 - protein, 9 aa, Mycobacterium
FGNDRDPTA

SEQ ID NO: 475488 - protein, 15 aa, Mycobacterium
FGNGAAEPFAEEIPG

SEQ ID NO: 475489 - protein, 10 aa, Mycobacterium
FGNGALKGKP

SEQ ID NO: 475490 - protein, 68 aa, Mycobacterium
FGNGGAGGLGGAGGVTGAHSGGNGGDGGNGGDAQFAGHGGAGGPGGTGGGGTADDGVAGSNGSPGLFF

SEQ ID NO: 475491 - protein, 10 aa, Mycobacterium
FGNGGGGNFG

SEQ ID NO: 475492 - protein, 6 aa, Mycobacterium
FGNNAA

SEQ ID NO: 475493 - protein, 39 aa, Mycobacterium
FGNNGDGNIGGGNAGSNNIGGGNTGSGNFGFGNSGSNNI

SEQ ID NO: 475494 - protein, 7 aa, Mycobacterium
FGNNNSV

SEQ ID NO: 475495 - protein, 4 aa, Mycobacterium
FGNP

SEQ ID NO: 475496 - protein, 22 aa, Mycobacterium
FGNPAATGDGIRAGEKVGGATE

SEQ ID NO: 475497 - protein, 8 aa, Mycobacterium
FGNPTPKN

SEQ ID NO: 475498 - protein, 8 aa, Mycobacterium
FGNQEGDA

SEQ ID NO: 475499 - protein, 6 aa, Mycobacterium
FGNSGA

SEQ ID NO: 475500 - protein, 12 aa, Mycobacterium
FGNSGASLTDGN

SEQ ID NO: 475501 - protein, 12 aa, Mycobacterium
FGNSGASLTNGN

SEQ ID NO: 475502 - protein, 8 aa, Mycobacterium
FGNSGDNN

SEQ ID NO: 475503 - protein, 8 aa, Mycobacterium
FGNSGNNN

SEQ ID NO: 475504 - protein, 19 aa, Mycobacterium
FGNSGNNNIGFGNSGNNNI

SEQ ID NO: 475505 - protein, 28 aa, Mycobacterium
FGNSGPGAMPTAGNSNVGLGNTGNSNIG

SEQ ID NO: 475506 - protein, 49 aa, Mycobacterium
FGNSGSGNLGIGNSGAGNTGFGNNGQLNTGFGNGGSANTGFSNSGDLNT

SEQ ID NO: 475507 - protein, 20 aa, Mycobacterium
FGNSNSQVSADASGAGGNLG

SEQ ID NO: 475508 - protein, 4 aa, Mycobacterium
FGNT

SEQ ID NO: 475509 - protein, 12 aa, Mycobacterium
FGNTATGGFRSG

SEQ ID NO: 475510 - protein, 5 aa, Mycobacterium
FGNTG

SEQ ID NO: 475511 - protein, 17 aa, Mycobacterium
FGNTGDPSTSSNPGANF

SEQ ID NO: 475512 - protein, 7 aa, Mycobacterium
FGNTGDY

SEQ ID NO: 475513 - protein, 16 aa, Mycobacterium
FGNTGEPATSSNPGVN

SEQ ID NO: 475514 - protein, 98 aa, Mycobacterium
FGNTGNGNFGSGNAGDLNLGSGNNGNVNLGSGNNGNVNFGSGNTGNVNLGSGNAGSLNAGSGNAGNNNLGSGNNGDANLGHGNVGSNNFGSGNIGGGN

SEQ ID NO: 475515 - protein, 9 aa, Mycobacterium
FGNTGNGNI

SEQ ID NO: 475516 - protein, 19 aa, Mycobacterium
FGNTGNGNLGFGNTGNGNI

SEQ ID NO: 475517 - protein, 8 aa, Mycobacterium
FGNTGNNN

SEQ ID NO: 475518 - protein, 15 aa, Mycobacterium
FGNTGNPLTSSNPGI

SEQ ID NO: 475519 - protein, 9 aa, Mycobacterium
FGNTGSASI

SEQ ID NO: 475520 - protein, 9 aa, Mycobacterium
FGNTGSNNF

SEQ ID NO: 475521 - protein, 32 aa, Mycobacterium
FGNTGSNNIGFGNTGNNNIGFGNTGDNNRGIG

SEQ ID NO: 475522 - protein, 33 aa, Mycobacterium
FGNTGSNNIGIGNTGDGNIGFGNTGNDNTGIGL

SEQ ID NO: 475523 - protein, 10 aa, Mycobacterium
FGNTNSGNVG

SEQ ID NO: 475524 - protein, 4 aa, Mycobacterium
FGPA

SEQ ID NO: 475525 - protein, 13 aa, Mycobacterium
FGPAGAEAYRRDL

SEQ ID NO: 475526 - protein, 6 aa, Mycobacterium
FGPAGR

SEQ ID NO: 475527 - protein, 9 aa, Mycobacterium
FGPAPKRLS

SEQ ID NO: 475528 - protein, 12 aa, Mycobacterium
FGPATSWPTPGF

SEQ ID NO: 475529 - protein, 5 aa, Mycobacterium
FGPDA

SEQ ID NO: 475530 - protein, 11 aa, Mycobacterium
FGPDAEAQRAV

SEQ ID NO: 475531 - protein, 5 aa, Mycobacterium
FGPDD

SEQ ID NO: 475532 - protein, 11 aa, Mycobacterium
FGPDEKGNRTV

SEQ ID NO: 475533 - protein, 6 aa, Mycobacterium
FGPDGN

SEQ ID NO: 475534 - protein, 8 aa, Mycobacterium
FGPDGTLR

SEQ ID NO: 475535 - protein, 12 aa, Mycobacterium
FGPDRVRDTPLS

SEQ ID NO: 475536 - protein, 14 aa, Mycobacterium
FGPDSDIADKPDHP

SEQ ID NO: 475537 - protein, 13 aa, Mycobacterium
FGPDSDVADRGDH

SEQ ID NO: 475538 - protein, 12 aa, Mycobacterium
FGPDSMTESGYP

SEQ ID NO: 475539 - protein, 13 aa, Mycobacterium
FGPDSSVDDRPEH

SEQ ID NO: 475540 - protein, 12 aa, Mycobacterium
FGPDTLTDSGYP

SEQ ID NO: 475541 - protein, 8 aa, Mycobacterium
FGPDTNPM

SEQ ID NO: 475542 - protein, 7 aa, Mycobacterium
FGPDTVS

SEQ ID NO: 475543 - protein, 4 aa, Mycobacterium
FGPE

SEQ ID NO: 475544 - protein, 5 aa, Mycobacterium
FGPEE

SEQ ID NO: 475545 - protein, 10 aa, Mycobacterium
FGPEPGTPFG

SEQ ID NO: 475546 - protein, 5 aa, Mycobacterium
FGPES

SEQ ID NO: 475547 - protein, 31 aa, Mycobacterium
FGPESEKKPGDKKDDAQMLGNEEKDDDGIPE

SEQ ID NO: 475548 - protein, 4 aa, Mycobacterium
FGPG

SEQ ID NO: 475549 - protein, 5 aa, Mycobacterium
FGPGA

SEQ ID NO: 475550 - protein, 6 aa, Mycobacterium
FGPGDL

SEQ ID NO: 475551 - protein, 14 aa, Mycobacterium
FGPGDPNLAHRRDE

SEQ ID NO: 475552 - protein, 17 aa, Mycobacterium
FGPGDPNLAHRRDESVP

SEQ ID NO: 475553 - protein, 9 aa, Mycobacterium
FGPGESDDV

SEQ ID NO: 475554 - protein, 6 aa, Mycobacterium
FGPGFG

SEQ ID NO: 475555 - protein, 7 aa, Mycobacterium
FGPGFGP

SEQ ID NO: 475556 - protein, 12 aa, Mycobacterium
FGPGGATAGAGG

SEQ ID NO: 475557 - protein, 11 aa, Mycobacterium
FGPGGDADVAY

SEQ ID NO: 475558 - protein, 19 aa, Mycobacterium
FGPGGFGPGGGGFGPGSFG

SEQ ID NO: 475559 - protein, 10 aa, Mycobacterium
FGPGGRRGAW

SEQ ID NO: 475560 - protein, 23 aa, Mycobacterium
FGPGGRRGGWRRGGPGRGKRGDV

SEQ ID NO: 475561 - protein, 10 aa, Mycobacterium
FGPGGSSSEA

SEQ ID NO: 475562 - protein, 12 aa, Mycobacterium
FGPGGSTVGSAG

SEQ ID NO: 475563 - protein, 10 aa, Mycobacterium
FGPGGTGTFG

SEQ ID NO: 475564 - protein, 9 aa, Mycobacterium
FGPGPAQRR

SEQ ID NO: 475565 - protein, 14 aa, Mycobacterium
FGPGPEQATPPNID

SEQ ID NO: 475566 - protein, 7 aa, Mycobacterium
FGPGPYE

SEQ ID NO: 475567 - protein, 13 aa, Mycobacterium
FGPGQVGRSQVGR

SEQ ID NO: 475568 - protein, 8 aa, Mycobacterium
FGPGSADT

SEQ ID NO: 475569 - protein, 12 aa, Mycobacterium
FGPGSLTDSGYP

SEQ ID NO: 475570 - protein, 20 aa, Mycobacterium
FGPGSRRGGGPRGRSRRGDV

SEQ ID NO: 475571 - protein, 19 aa, Mycobacterium
FGPGTNGAPGTGQAGGPGG

SEQ ID NO: 475572 - protein, 10 aa, Mycobacterium
FGPNKGRAPE

SEQ ID NO: 475573 - protein, 9 aa, Mycobacterium
FGPNTPRFR

SEQ ID NO: 475574 - protein, 8 aa, Mycobacterium
FGPPAGDA

SEQ ID NO: 475575 - protein, 11 aa, Mycobacterium
FGPPASEADPL

SEQ ID NO: 475576 - protein, 9 aa, Mycobacterium
FGPPRDRDE

SEQ ID NO: 475577 - protein, 6 aa, Mycobacterium
FGPPRS

SEQ ID NO: 475578 - protein, 13 aa, Mycobacterium
FGPQKGADPDTVR

SEQ ID NO: 475579 - protein, 9 aa, Mycobacterium
FGPQNPKSL

SEQ ID NO: 475580 - protein, 13 aa, Mycobacterium
FGPRDEAESPSEF

SEQ ID NO: 475581 - protein, 6 aa, Mycobacterium
FGPREP

SEQ ID NO: 475582 - protein, 8 aa, Mycobacterium
FGPREPSQ

SEQ ID NO: 475583 - protein, 5 aa, Mycobacterium
FGPRG

SEQ ID NO: 475584 - protein, 22 aa, Mycobacterium
FGPRQPSADATAAPLGARTEGP

SEQ ID NO: 475585 - protein, 14 aa, Mycobacterium
FGPRRRPRPGRMDP

SEQ ID NO: 475586 - protein, 14 aa, Mycobacterium
FGPSASVAEIDDEQ

SEQ ID NO: 475587 - protein, 12 aa, Mycobacterium
FGPSATRGTGGP

SEQ ID NO: 475588 - protein, 10 aa, Mycobacterium
FGPSGFAPEA

SEQ ID NO: 475589 - protein, 12 aa, Mycobacterium
FGPSGKRPTAIA

SEQ ID NO: 475590 - protein, 10 aa, Mycobacterium
FGPSQEELAD

SEQ ID NO: 475591 - protein, 12 aa, Mycobacterium
FGPSQKELDDAR

SEQ ID NO: 475592 - protein, 8 aa, Mycobacterium
FGPTAAAE

SEQ ID NO: 475593 - protein, 6 aa, Mycobacterium
FGPTCG

SEQ ID NO: 475594 - protein, 13 aa, Mycobacterium
FGPTGGLPADDPR

SEQ ID NO: 475595 - protein, 14 aa, Mycobacterium
FGPTPIESYPPISR

SEQ ID NO: 475596 - protein, 4 aa, Mycobacterium
FGPV

SEQ ID NO: 475597 - protein, 4 aa, Mycobacterium
FGPY

SEQ ID NO: 475598 - protein, 6 aa, Mycobacterium
FGQAGT

SEQ ID NO: 475599 - protein, 23 aa, Mycobacterium
FGQAPQERAGQMREQRQAREREG

SEQ ID NO: 475600 - protein, 4 aa, Mycobacterium
FGQE

SEQ ID NO: 475601 - protein, 9 aa, Mycobacterium
FGQEGPLRD

SEQ ID NO: 475602 - protein, 9 aa, Mycobacterium
FGQEKHPAW

SEQ ID NO: 475603 - protein, 11 aa, Mycobacterium
FGQFTGSEAYR

SEQ ID NO: 475604 - protein, 69 aa, Mycobacterium
FGQGATGGSASSAAQVPAPDAPAPEPASEGAAAGEPDAERAPTPDERSDREDTGAPGRHRAAEADDRID

SEQ ID NO: 475605 - protein, 21 aa, Mycobacterium
FGQGGSGQGGGASGVSQAGYH

SEQ ID NO: 475606 - protein, 10 aa, Mycobacterium
FGQGLPPAEP

SEQ ID NO: 475607 - protein, 11 aa, Mycobacterium
FGQGPGPGENI

SEQ ID NO: 475608 - protein, 8 aa, Mycobacterium
FGQGVNSR

SEQ ID NO: 475609 - protein, 11 aa, Mycobacterium
FGQPDANAADL

SEQ ID NO: 475610 - protein, 7 aa, Mycobacterium
FGQPGQR

SEQ ID NO: 475611 - protein, 6 aa, Mycobacterium
FGQPLT

SEQ ID NO: 475612 - protein, 5 aa, Mycobacterium
FGQPP

SEQ ID NO: 475613 - protein, 6 aa, Mycobacterium
FGQPPL

SEQ ID NO: 475614 - protein, 11 aa, Mycobacterium
FGQRGTASGEV

SEQ ID NO: 475615 - protein, 12 aa, Mycobacterium
FGQRRTGTGTTV

SEQ ID NO: 475616 - protein, 11 aa, Mycobacterium
FGQRTTASGTA

SEQ ID NO: 475617 - protein, 4 aa, Mycobacterium
FGQT

SEQ ID NO: 475618 - protein, 14 aa, Mycobacterium
FGQTGPYRSRPGFG

SEQ ID NO: 475619 - protein, 6 aa, Mycobacterium
FGQTTS

SEQ ID NO: 475620 - protein, 7 aa, Mycobacterium
FGQVGDG

SEQ ID NO: 475621 - protein, 4 aa, Mycobacterium
FGRD

SEQ ID NO: 475622 - protein, 6 aa, Mycobacterium
FGRDGA

SEQ ID NO: 475623 - protein, 9 aa, Mycobacterium
FGRDGTDGY

SEQ ID NO: 475624 - protein, 5 aa, Mycobacterium
FGRDP

SEQ ID NO: 475625 - protein, 6 aa, Mycobacterium
FGRDTA

SEQ ID NO: 475626 - protein, 6 aa, Mycobacterium
FGREPD

SEQ ID NO: 475627 - protein, 9 aa, Mycobacterium
FGRESGGIT

SEQ ID NO: 475628 - protein, 15 aa, Mycobacterium
FGRGAAGFRAEGAAA

SEQ ID NO: 475629 - protein, 14 aa, Mycobacterium
FGRGGATDYQQDLA

SEQ ID NO: 475630 - protein, 13 aa, Mycobacterium
FGRGGATDYQQNL

SEQ ID NO: 475631 - protein, 7 aa, Mycobacterium
FGRGRPP

SEQ ID NO: 475632 - protein, 23 aa, Mycobacterium
FGRGRYSGGGGGFGGFGGDGAQE

SEQ ID NO: 475633 - protein, 8 aa, Mycobacterium
FGRGSNRE

SEQ ID NO: 475634 - protein, 9 aa, Mycobacterium
FGRHGAGDL

SEQ ID NO: 475635 - protein, 10 aa, Mycobacterium
FGRKDPGDLG

SEQ ID NO: 475636 - protein, 8 aa, Mycobacterium
FGRNGDDL

SEQ ID NO: 475637 - protein, 9 aa, Mycobacterium
FGRNPSAPH

SEQ ID NO: 475638 - protein, 7 aa, Mycobacterium
FGRPEEV

SEQ ID NO: 475639 - protein, 16 aa, Mycobacterium
FGRPPKSLSDPDADEV

SEQ ID NO: 475640 - protein, 8 aa, Mycobacterium
FGRPSQTH

SEQ ID NO: 475641 - protein, 4 aa, Mycobacterium
FGRR

SEQ ID NO: 475642 - protein, 7 aa, Mycobacterium
FGRREGA

SEQ ID NO: 475643 - protein, 9 aa, Mycobacterium
FGRRRDDRV

SEQ ID NO: 475644 - protein, 10 aa, Mycobacterium
FGRRSKDPVA

SEQ ID NO: 475645 - protein, 9 aa, Mycobacterium
FGRTPGGYR

SEQ ID NO: 475646 - protein, 12 aa, Mycobacterium
FGRTSRIREPDG

SEQ ID NO: 475647 - protein, 16 aa, Mycobacterium
FGSAAGELGVSQPSLS

SEQ ID NO: 475648 - protein, 5 aa, Mycobacterium
FGSAD

SEQ ID NO: 475649 - protein, 12 aa, Mycobacterium
FGSADQPPEHLS

SEQ ID NO: 475650 - protein, 9 aa, Mycobacterium
FGSAGPQGA

SEQ ID NO: 475651 - protein, 10 aa, Mycobacterium
FGSAPDDDSP

SEQ ID NO: 475652 - protein, 21 aa, Mycobacterium
FGSARKALEAASRAAAFPPEL

SEQ ID NO: 475653 - protein, 6 aa, Mycobacterium
FGSDAA

SEQ ID NO: 475654 - protein, 10 aa, Mycobacterium
FGSDDDNYRE

SEQ ID NO: 475655 - protein, 11 aa, Mycobacterium
FGSDGGATTSV

SEQ ID NO: 475656 - protein, 10 aa, Mycobacterium
FGSDGGGSIR

SEQ ID NO: 475657 - protein, 6 aa, Mycobacterium
FGSDGR

SEQ ID NO: 475658 - protein, 9 aa, Mycobacterium
FGSDQDNYR

SEQ ID NO: 475659 - protein, 8 aa, Mycobacterium
FGSEADAE

SEQ ID NO: 475660 - protein, 10 aa, Mycobacterium
FGSEDAAAER

SEQ ID NO: 475661 - protein, 7 aa, Mycobacterium
FGSEPGE

SEQ ID NO: 475662 - protein, 13 aa, Mycobacterium
FGSETPAVQGPAF

SEQ ID NO: 475663 - protein, 23 aa, Mycobacterium
FGSETPAVQGPGFGDLQGGATLA

SEQ ID NO: 475664 - protein, 4 aa, Mycobacterium
FGSG

SEQ ID NO: 475665 - protein, 6 aa, Mycobacterium
FGSGAP

SEQ ID NO: 475666 - protein, 6 aa, Mycobacterium
FGSGER

SEQ ID NO: 475667 - protein, 11 aa, Mycobacterium
FGSGGDGGAGG

SEQ ID NO: 475668 - protein, 8 aa, Mycobacterium
FGSGGGEA

SEQ ID NO: 475669 - protein, 9 aa, Mycobacterium
FGSGGGEAI

SEQ ID NO: 475670 - protein, 16 aa, Mycobacterium
FGSGGGSGGNGGNAGL

SEQ ID NO: 475671 - protein, 21 aa, Mycobacterium
FGSGGSGGSGGEVVHTASRWH

SEQ ID NO: 475672 - protein, 11 aa, Mycobacterium
FGSGNRGNGNF

SEQ ID NO: 475673 - protein, 9 aa, Mycobacterium
FGSGNSGSF

SEQ ID NO: 475674 - protein, 10 aa, Mycobacterium
FGSGNTGGFN

SEQ ID NO: 475675 - protein, 13 aa, Mycobacterium
FGSGNTGPVDGNR

SEQ ID NO: 475676 - protein, 11 aa, Mycobacterium
FGSGNTVSTGG

SEQ ID NO: 475677 - protein, 5 aa, Mycobacterium
FGSGP

SEQ ID NO: 475678 - protein, 9 aa, Mycobacterium
FGSGPDADV

SEQ ID NO: 475679 - protein, 8 aa, Mycobacterium
FGSGPDAV

SEQ ID NO: 475680 - protein, 6 aa, Mycobacterium
FGSGPR

SEQ ID NO: 475681 - protein, 8 aa, Mycobacterium
FGSGPRYG

SEQ ID NO: 475682 - protein, 8 aa, Mycobacterium
FGSGSPVV

SEQ ID NO: 475683 - protein, 8 aa, Mycobacterium
FGSGTGHA

SEQ ID NO: 475684 - protein, 13 aa, Mycobacterium
FGSGTTAGSGGAW

SEQ ID NO: 475685 - protein, 8 aa, Mycobacterium
FGSNDDNY

SEQ ID NO: 475686 - protein, 6 aa, Mycobacterium
FGSNPH

SEQ ID NO: 475687 - protein, 6 aa, Mycobacterium
FGSPAN

SEQ ID NO: 475688 - protein, 9 aa, Mycobacterium
FGSPDTKRY

SEQ ID NO: 475689 - protein, 24 aa, Mycobacterium
FGSPGHAGIGGQTGTNGAAGGGGF

SEQ ID NO: 475690 - protein, 11 aa, Mycobacterium
FGSPGQSNYAT

SEQ ID NO: 475691 - protein, 13 aa, Mycobacterium
FGSPNGLSTRRII

SEQ ID NO: 475692 - protein, 8 aa, Mycobacterium
FGSPPAAD

SEQ ID NO: 475693 - protein, 6 aa, Mycobacterium
FGSPQL

SEQ ID NO: 475694 - protein, 18 aa, Mycobacterium
FGSQAAAYERGRPSYPPE

SEQ ID NO: 475695 - protein, 8 aa, Mycobacterium
FGSRASKA

SEQ ID NO: 475696 - protein, 8 aa, Mycobacterium
FGSREPDK

SEQ ID NO: 475697 - protein, 22 aa, Mycobacterium
FGSRGAAQAARDAVDRNAGART

SEQ ID NO: 475698 - protein, 8 aa, Mycobacterium
FGSRPQVH

SEQ ID NO: 475699 - protein, 9 aa, Mycobacterium
FGSRSSKTR

SEQ ID NO: 475700 - protein, 4 aa, Mycobacterium
FGSS

SEQ ID NO: 475701 - protein, 6 aa, Mycobacterium
FGSSDG

SEQ ID NO: 475702 - protein, 9 aa, Mycobacterium
FGSSEGGVS

SEQ ID NO: 475703 - protein, 11 aa, Mycobacterium
FGSSEGTPRQI

SEQ ID NO: 475704 - protein, 5 aa, Mycobacterium
FGSTE

SEQ ID NO: 475705 - protein, 7 aa, Mycobacterium
FGSTEGG

SEQ ID NO: 475706 - protein, 8 aa, Mycobacterium
FGSTEGGV

SEQ ID NO: 475707 - protein, 10 aa, Mycobacterium
FGSTGAGRDI

SEQ ID NO: 475708 - protein, 10 aa, Mycobacterium
FGSTGTGRQY

SEQ ID NO: 475709 - protein, 7 aa, Mycobacterium
FGSTHQE

SEQ ID NO: 475710 - protein, 11 aa, Mycobacterium
FGSTWGGGADV

SEQ ID NO: 475711 - protein, 4 aa, Mycobacterium
FGSY

SEQ ID NO: 475712 - protein, 6 aa, Mycobacterium
FGTAAG

SEQ ID NO: 475713 - protein, 7 aa, Mycobacterium
FGTAETP

SEQ ID NO: 475714 - protein, 7 aa, Mycobacterium
FGTAGDD

SEQ ID NO: 475715 - protein, 6 aa, Mycobacterium
FGTAPM

SEQ ID NO: 475716 - protein, 6 aa, Mycobacterium
FGTAQG

SEQ ID NO: 475717 - protein, 14 aa, Mycobacterium
FGTATPAGSEEEAE

SEQ ID NO: 475718 - protein, 4 aa, Mycobacterium
FGTD

SEQ ID NO: 475719 - protein, 7 aa, Mycobacterium
FGTDAAA

SEQ ID NO: 475720 - protein, 7 aa, Mycobacterium
FGTDAGG

SEQ ID NO: 475721 - protein, 10 aa, Mycobacterium
FGTDAKSAMA

SEQ ID NO: 475722 - protein, 16 aa, Mycobacterium
FGTDDGSHPETPSRDD

SEQ ID NO: 475723 - protein, 22 aa, Mycobacterium
FGTDLDSSRELGAATESVADEQ

SEQ ID NO: 475724 - protein, 6 aa, Mycobacterium
FGTDLR

SEQ ID NO: 475725 - protein, 8 aa, Mycobacterium
FGTDPDVA

SEQ ID NO: 475726 - protein, 7 aa, Mycobacterium
FGTDRDG

SEQ ID NO: 475727 - protein, 5 aa, Mycobacterium
FGTDT

SEQ ID NO: 475728 - protein, 4 aa, Mycobacterium
FGTE

SEQ ID NO: 475729 - protein, 7 aa, Mycobacterium
FGTEAQK

SEQ ID NO: 475730 - protein, 12 aa, Mycobacterium
FGTEASPEDQAE

SEQ ID NO: 475731 - protein, 12 aa, Mycobacterium
FGTEASPEDQAQ

SEQ ID NO: 475732 - protein, 23 aa, Mycobacterium
FGTETPAVQGPGFGDLQGGATLA

SEQ ID NO: 475733 - protein, 4 aa, Mycobacterium
FGTG

SEQ ID NO: 475734 - protein, 11 aa, Mycobacterium
FGTGEGSSVAE

SEQ ID NO: 475735 - protein, 11 aa, Mycobacterium
FGTGESSSIGE

SEQ ID NO: 475736 - protein, 26 aa, Mycobacterium
FGTGGTGGAGGAAANATGGNGGAGGG

SEQ ID NO: 475737 - protein, 13 aa, Mycobacterium
FGTGNGADTVTSG

SEQ ID NO: 475738 - protein, 7 aa, Mycobacterium
FGTGPRS

SEQ ID NO: 475739 - protein, 19 aa, Mycobacterium
FGTGSGSYTAVAAADAMTA

SEQ ID NO: 475740 - protein, 60 aa, Mycobacterium
FGTKGGAGGTGGVGGAGGAAGAAPAGNAGSLGAGGVGGTGGQGGDGGNGGNGANGQTGGY

SEQ ID NO: 475741 - protein, 8 aa, Mycobacterium
FGTKRGRK

SEQ ID NO: 475742 - protein, 4 aa, Mycobacterium
FGTN

SEQ ID NO: 475743 - protein, 6 aa, Mycobacterium
FGTNEG

SEQ ID NO: 475744 - protein, 9 aa, Mycobacterium
FGTPADPEY

SEQ ID NO: 475745 - protein, 7 aa, Mycobacterium
FGTPDEV

SEQ ID NO: 475746 - protein, 7 aa, Mycobacterium
FGTPPAA

SEQ ID NO: 475747 - protein, 8 aa, Mycobacterium
FGTPPTLD

SEQ ID NO: 475748 - protein, 9 aa, Mycobacterium
FGTPSADDL

SEQ ID NO: 475749 - protein, 6 aa, Mycobacterium
FGTPVP

SEQ ID NO: 475750 - protein, 6 aa, Mycobacterium
FGTQPD

SEQ ID NO: 475751 - protein, 8 aa, Mycobacterium
FGTREGGA

SEQ ID NO: 475752 - protein, 9 aa, Mycobacterium
FGTRPKQGS

SEQ ID NO: 475753 - protein, 12 aa, Mycobacterium
FGTSGPRSSWRA

SEQ ID NO: 475754 - protein, 8 aa, Mycobacterium
FGTSPTAG

SEQ ID NO: 475755 - protein, 8 aa, Mycobacterium
FGTSTRDI

SEQ ID NO: 475756 - protein, 5 aa, Mycobacterium
FGTTE

SEQ ID NO: 475757 - protein, 7 aa, Mycobacterium
FGTTGPY

SEQ ID NO: 475758 - protein, 12 aa, Mycobacterium
FGTTGPYAENQV

SEQ ID NO: 475759 - protein, 10 aa, Mycobacterium
FGTTPDDDSP

SEQ ID NO: 475760 - protein, 8 aa, Mycobacterium
FGTTPEDD

SEQ ID NO: 475761 - protein, 8 aa, Mycobacterium
FGTTPRPG

SEQ ID NO: 475762 - protein, 11 aa, Mycobacterium
FGTYGDSLSHG

SEQ ID NO: 475763 - protein, 4 aa, Mycobacterium
FGVE

SEQ ID NO: 475764 - protein, 9 aa, Mycobacterium
FGVGSSRPV

SEQ ID NO: 475765 - protein, 12 aa, Mycobacterium
FGVKSGEGFYKY

SEQ ID NO: 475766 - protein, 4 aa, Mycobacterium
FGVP

SEQ ID NO: 475767 - protein, 8 aa, Mycobacterium
FGYPEAGQ

SEQ ID NO: 475768 - protein, 9 aa, Mycobacterium
FGYPEDGQS

SEQ ID NO: 475769 - protein, 19 aa, Mycobacterium
FHAQGTEYSFEGSTRTAEQ

SEQ ID NO: 475770 - protein, 8 aa, Mycobacterium
FHGGRDRT

SEQ ID NO: 475771 - protein, 15 aa, Mycobacterium
FHGPGRAQVGYNEYN

SEQ ID NO: 475772 - protein, 19 aa, Mycobacterium
FHGQAGHGEYLKRSLSQYL

SEQ ID NO: 475773 - protein, 5 aa, Mycobacterium
FHGQR

SEQ ID NO: 475774 - protein, 4 aa, Mycobacterium
FHGR

SEQ ID NO: 475775 - protein, 10 aa, Mycobacterium
FHGRTGNAGH

SEQ ID NO: 475776 - protein, 6 aa, Mycobacterium
FHKRED

SEQ ID NO: 475777 - protein, 11 aa, Mycobacterium
FHPDAAAGAAL

SEQ ID NO: 475778 - protein, 7 aa, Mycobacterium
FHPDDQG

SEQ ID NO: 475779 - protein, 20 aa, Mycobacterium
FHPEKSGDAGAAVLRNWVEA

SEQ ID NO: 475780 - protein, 20 aa, Mycobacterium
FHPEKSGDAGAAVLSNWVQA

SEQ ID NO: 475781 - protein, 21 aa, Mycobacterium
FHPEKSGDAGAELLSNWVGAL

SEQ ID NO: 475782 - protein, 8 aa, Mycobacterium
FHPNRSAR

SEQ ID NO: 475783 - protein, 6 aa, Mycobacterium
FHPRET

SEQ ID NO: 475784 - protein, 17 aa, Mycobacterium
FHPRGRAGAALPASASK

SEQ ID NO: 475785 - protein, 8 aa, Mycobacterium
FHPTSDTH

SEQ ID NO: 475786 - protein, 24 aa, Mycobacterium
FHRGESAYDRYYGDPTNKPNPNLG

SEQ ID NO: 475787 - protein, 25 aa, Mycobacterium
FHRGESAYDRYYGDPTNKPNPNLGE

SEQ ID NO: 475788 - protein, 10 aa, Mycobacterium
FHRSGEALNE

SEQ ID NO: 475789 - protein, 7 aa, Mycobacterium
FHSDGSD

SEQ ID NO: 475790 - protein, 6 aa, Mycobacterium
FKADTK

SEQ ID NO: 475791 - protein, 10 aa, Mycobacterium
FKAENNQRRH

SEQ ID NO: 475792 - protein, 7 aa, Mycobacterium
FKAGKDT

SEQ ID NO: 475793 - protein, 4 aa, Mycobacterium
FKAP

SEQ ID NO: 475794 - protein, 24 aa, Mycobacterium
FKATPGKHAADANDPEKKTVQETV

SEQ ID NO: 475795 - protein, 5 aa, Mycobacterium
FKDAD

SEQ ID NO: 475796 - protein, 9 aa, Mycobacterium
FKDARAKGL

SEQ ID NO: 475797 - protein, 7 aa, Mycobacterium
FKDSTAT

SEQ ID NO: 475798 - protein, 5 aa, Mycobacterium
FKEAA

SEQ ID NO: 475799 - protein, 8 aa, Mycobacterium
FKEARAKG

SEQ ID NO: 475800 - protein, 18 aa, Mycobacterium
FKEQDNRELSERAAADRE

SEQ ID NO: 475801 - protein, 5 aa, Mycobacterium
FKEST

SEQ ID NO: 475802 - protein, 7 aa, Mycobacterium
FKESTAT

SEQ ID NO: 475803 - protein, 4 aa, Mycobacterium
FKGA

SEQ ID NO: 475804 - protein, 6 aa, Mycobacterium
FKGDPE

SEQ ID NO: 475805 - protein, 11 aa, Mycobacterium
FKGHKRSGAEV

SEQ ID NO: 475806 - protein, 5 aa, Mycobacterium
FKGPE

SEQ ID NO: 475807 - protein, 7 aa, Mycobacterium
FKGPQSL

SEQ ID NO: 475808 - protein, 4 aa, Mycobacterium
FKGT

SEQ ID NO: 475809 - protein, 9 aa, Mycobacterium
FKGTEETLQ

SEQ ID NO: 475810 - protein, 7 aa, Mycobacterium
FKGTRNV

SEQ ID NO: 475811 - protein, 4 aa, Mycobacterium
FKHP

SEQ ID NO: 475812 - protein, 6 aa, Mycobacterium
FKKAAS

SEQ ID NO: 475813 - protein, 8 aa, Mycobacterium
FKKGDKVT

SEQ ID NO: 475814 - protein, 8 aa, Mycobacterium
FKNANRDG

SEQ ID NO: 475815 - protein, 12 aa, Mycobacterium
FKPAAKDEPEVG

SEQ ID NO: 475816 - protein, 12 aa, Mycobacterium
FKPDMSDKELDE

SEQ ID NO: 475817 - protein, 7 aa, Mycobacterium
FKPDPEE

SEQ ID NO: 475818 - protein, 14 aa, Mycobacterium
FKPDSDDVRDSPAL

SEQ ID NO: 475819 - protein, 4 aa, Mycobacterium
FKPG

SEQ ID NO: 475820 - protein, 5 aa, Mycobacterium
FKPGD

SEQ ID NO: 475821 - protein, 6 aa, Mycobacterium
FKPGDN

SEQ ID NO: 475822 - protein, 7 aa, Mycobacterium
FKPGGRA

SEQ ID NO: 475823 - protein, 6 aa, Mycobacterium
FKPGPA

SEQ ID NO: 475824 - protein, 5 aa, Mycobacterium
FKPGQ

SEQ ID NO: 475825 - protein, 6 aa, Mycobacterium
FKPKNV

SEQ ID NO: 475826 - protein, 8 aa, Mycobacterium
FKPTARDQ

SEQ ID NO: 475827 - protein, 14 aa, Mycobacterium
FKQQIQDETGLKPE

SEQ ID NO: 475828 - protein, 15 aa, Mycobacterium
FKQTDADVGSFDGGF

SEQ ID NO: 475829 - protein, 8 aa, Mycobacterium
FKRGSKAE

SEQ ID NO: 475830 - protein, 4 aa, Mycobacterium
FKRS

SEQ ID NO: 475831 - protein, 12 aa, Mycobacterium
FKRSSAPQFGAT

SEQ ID NO: 475832 - protein, 5 aa, Mycobacterium
FKRTK

SEQ ID NO: 475833 - protein, 5 aa, Mycobacterium
FKRTS

SEQ ID NO: 475834 - protein, 10 aa, Mycobacterium
FKSEQDGGFT

SEQ ID NO: 475835 - protein, 4 aa, Mycobacterium
FKSG

SEQ ID NO: 475836 - protein, 7 aa, Mycobacterium
FKSGKPH

SEQ ID NO: 475837 - protein, 9 aa, Mycobacterium
FKSGSADIP

SEQ ID NO: 475838 - protein, 11 aa, Mycobacterium
FKSGTSAPPLQ

SEQ ID NO: 475839 - protein, 11 aa, Mycobacterium
FKSGTSEPPLQ

SEQ ID NO: 475840 - protein, 6 aa, Mycobacterium
FKTDEA

SEQ ID NO: 475841 - protein, 7 aa, Mycobacterium
FKTEEAG

SEQ ID NO: 475842 - protein, 10 aa, Mycobacterium
FKTPSGKTRC

SEQ ID NO: 475843 - protein, 9 aa, Mycobacterium
FKTRGGLTT

SEQ ID NO: 475844 - protein, 9 aa, Mycobacterium
FKTSQGKYV

SEQ ID NO: 475845 - protein, 8 aa, Mycobacterium
FKTSYPTD

SEQ ID NO: 475846 - protein, 13 aa, Mycobacterium
FLDGGKNIARDGQ

SEQ ID NO: 475847 - protein, 9 aa, Mycobacterium
FLPDDDSYA

SEQ ID NO: 475848 - protein, 8 aa, Mycobacterium
FLPPPGPR

SEQ ID NO: 475849 - protein, 7 aa, Mycobacterium
FLQPGTA

SEQ ID NO: 475850 - protein, 4 aa, Mycobacterium
FNAA

SEQ ID NO: 475851 - protein, 4 aa, Mycobacterium
FNAG

SEQ ID NO: 475852 - protein, 12 aa, Mycobacterium
FNAGEGLPPLHA

SEQ ID NO: 475853 - protein, 5 aa, Mycobacterium
FNAGP

SEQ ID NO: 475854 - protein, 21 aa, Mycobacterium
FNAPAGASLATGGGQSTNVYS

SEQ ID NO: 475855 - protein, 11 aa, Mycobacterium
FNAPASSSPLH

SEQ ID NO: 475856 - protein, 10 aa, Mycobacterium
FNAPASSSPV

SEQ ID NO: 475857 - protein, 5 aa, Mycobacterium
FNAPP

SEQ ID NO: 475858 - protein, 34 aa, Mycobacterium
FNAPPQTTNPAGGAGQSGAVAQAAGTAPANAQSA

SEQ ID NO: 475859 - protein, 11 aa, Mycobacterium
FNASASGGKKI

SEQ ID NO: 475860 - protein, 4 aa, Mycobacterium
FNAT

SEQ ID NO: 475861 - protein, 6 aa, Mycobacterium
FNDASG

SEQ ID NO: 475862 - protein, 9 aa, Mycobacterium
FNDDPDGAL

SEQ ID NO: 475863 - protein, 7 aa, Mycobacterium
FNDPGAA

SEQ ID NO: 475864 - protein, 7 aa, Mycobacterium
FNDPPEE

SEQ ID NO: 475865 - protein, 5 aa, Mycobacterium
FNEDQ

SEQ ID NO: 475866 - protein, 4 aa, Mycobacterium
FNEH

SEQ ID NO: 475867 - protein, 6 aa, Mycobacterium
FNEHTE

SEQ ID NO: 475868 - protein, 5 aa, Mycobacterium
FNEPG

SEQ ID NO: 475869 - protein, 12 aa, Mycobacterium
FNETPETGATFE

SEQ ID NO: 475870 - protein, 7 aa, Mycobacterium
FNGDEAG

SEQ ID NO: 475871 - protein, 26 aa, Mycobacterium
FNGDPDVPKTDTPAETPAASADAPEI

SEQ ID NO: 475872 - protein, 5 aa, Mycobacterium
FNGEE

SEQ ID NO: 475873 - protein, 6 aa, Mycobacterium
FNGEGK

SEQ ID NO: 475874 - protein, 9 aa, Mycobacterium
FNGESARMR

SEQ ID NO: 475875 - protein, 5 aa, Mycobacterium
FNGET

SEQ ID NO: 475876 - protein, 4 aa, Mycobacterium
FNGI

SEQ ID NO: 475877 - protein, 11 aa, Mycobacterium
FNGKRVPTGHG

SEQ ID NO: 475878 - protein, 4 aa, Mycobacterium
FNGP

SEQ ID NO: 475879 - protein, 12 aa, Mycobacterium
FNGQAAPTKYPA

SEQ ID NO: 475880 - protein, 4 aa, Mycobacterium
FNGR

SEQ ID NO: 475881 - protein, 11 aa, Mycobacterium
FNGSASGGKKI

SEQ ID NO: 475882 - protein, 14 aa, Mycobacterium
FNGSVAEHRAALLT

SEQ ID NO: 475883 - protein, 10 aa, Mycobacterium
FNGTAAPVKY

SEQ ID NO: 475884 - protein, 7 aa, Mycobacterium
FNKPGTI

SEQ ID NO: 475885 - protein, 8 aa, Mycobacterium
FNPAGSIK

SEQ ID NO: 475886 - protein, 9 aa, Mycobacterium
FNPAGSVKD

SEQ ID NO: 475887 - protein, 4 aa, Mycobacterium
FNPD

SEQ ID NO: 475888 - protein, 15 aa, Mycobacterium
FNPDDPEAFASTGGW

SEQ ID NO: 475889 - protein, 15 aa, Mycobacterium
FNPDDPERYTETGGW

SEQ ID NO: 475890 - protein, 7 aa, Mycobacterium
FNPDPEF

SEQ ID NO: 475891 - protein, 15 aa, Mycobacterium
FNPDQPDAYAETGGW

SEQ ID NO: 475892 - protein, 12 aa, Mycobacterium
FNPDRTKLPIPQ

SEQ ID NO: 475893 - protein, 15 aa, Mycobacterium
FNPDRTKLPIPQRSF

SEQ ID NO: 475894 - protein, 12 aa, Mycobacterium
FNPDRTRLPLPD

SEQ ID NO: 475895 - protein, 9 aa, Mycobacterium
FNPDSRREG

SEQ ID NO: 475896 - protein, 7 aa, Mycobacterium
FNPECAP

SEQ ID NO: 475897 - protein, 10 aa, Mycobacterium
FNPEDPDAAG

SEQ ID NO: 475898 - protein, 10 aa, Mycobacterium
FNPGASNTGA

SEQ ID NO: 475899 - protein, 19 aa, Mycobacterium
FNPGPSNTGALNTGTANTG

SEQ ID NO: 475900 - protein, 12 aa, Mycobacterium
FNPGSSNTGSFN

SEQ ID NO: 475901 - protein, 4 aa, Mycobacterium
FNPH

SEQ ID NO: 475902 - protein, 17 aa, Mycobacterium
FNPPPTTTDLTGSLRQT

SEQ ID NO: 475903 - protein, 4 aa, Mycobacterium
FNPR

SEQ ID NO: 475904 - protein, 5 aa, Mycobacterium
FNPTF

SEQ ID NO: 475905 - protein, 10 aa, Mycobacterium
FNPTGDPRRA

SEQ ID NO: 475906 - protein, 16 aa, Mycobacterium
FNQGGGGFGGGFGSDG

SEQ ID NO: 475907 - protein, 8 aa, Mycobacterium
FNQGTGNV

SEQ ID NO: 475908 - protein, 12 aa, Mycobacterium
FNRAGDVTDPAA

SEQ ID NO: 475909 - protein, 9 aa, Mycobacterium
FNRDGAPEK

SEQ ID NO: 475910 - protein, 12 aa, Mycobacterium
FNREAAAAAPSL

SEQ ID NO: 475911 - protein, 8 aa, Mycobacterium
FNRPSDAV

SEQ ID NO: 475912 - protein, 7 aa, Mycobacterium
FNSEGGL

SEQ ID NO: 475913 - protein, 23 aa, Mycobacterium
FNSETADVERRAARDRYAGRTGE

SEQ ID NO: 475914 - protein, 11 aa, Mycobacterium
FNSGDGNTGFF

SEQ ID NO: 475915 - protein, 10 aa, Mycobacterium
FNSGGNTKHS

SEQ ID NO: 475916 - protein, 28 aa, Mycobacterium
FNSGIGSAVNQSVSNSGFGNTGTGNSGF

SEQ ID NO: 475917 - protein, 40 aa, Mycobacterium
FNSGSDNTGFGNSGTGNFGLGNSGSFNTGFGNSGRANTGF

SEQ ID NO: 475918 - protein, 14 aa, Mycobacterium
FNSKDKGEDPAAAE

SEQ ID NO: 475919 - protein, 16 aa, Mycobacterium
FNSQPHPSPIPPRHLL

SEQ ID NO: 475920 - protein, 11 aa, Mycobacterium
FNSSAAGGKKI

SEQ ID NO: 475921 - protein, 8 aa, Mycobacterium
FNSSPDRL

SEQ ID NO: 475922 - protein, 11 aa, Mycobacterium
FNSYGSRRGNH

SEQ ID NO: 475923 - protein, 14 aa, Mycobacterium
FNTAGRPMVDSPRD

SEQ ID NO: 475924 - protein, 4 aa, Mycobacterium
FNTG

SEQ ID NO: 475925 - protein, 7 aa, Mycobacterium
FNTGEKT

SEQ ID NO: 475926 - protein, 5 aa, Mycobacterium
FNTGI

SEQ ID NO: 475927 - protein, 8 aa, Mycobacterium
FNTGNQER

SEQ ID NO: 475928 - protein, 9 aa, Mycobacterium
FNTSGQPAI

SEQ ID NO: 475929 - protein, 18 aa, Mycobacterium
FNTTVGSADTPAGATQSG

SEQ ID NO: 475930 - protein, 8 aa, Mycobacterium
FNVGGGNL

SEQ ID NO: 475931 - protein, 4 aa, Mycobacterium
FPAA

SEQ ID NO: 475932 - protein, 9 aa, Mycobacterium
FPAAETGLK

SEQ ID NO: 475933 - protein, 4 aa, Mycobacterium
FPAD

SEQ ID NO: 475934 - protein, 12 aa, Mycobacterium
FPADPPATGRTS

SEQ ID NO: 475935 - protein, 8 aa, Mycobacterium
FPAEPDLA

SEQ ID NO: 475936 - protein, 5 aa, Mycobacterium
FPAER

SEQ ID NO: 475937 - protein, 9 aa, Mycobacterium
FPAERAQAY

SEQ ID NO: 475938 - protein, 6 aa, Mycobacterium
FPAESG

SEQ ID NO: 475939 - protein, 16 aa, Mycobacterium
FPAESPVNAVTENELR

SEQ ID NO: 475940 - protein, 4 aa, Mycobacterium
FPAG

SEQ ID NO: 475941 - protein, 6 aa, Mycobacterium
FPAGEN

SEQ ID NO: 475942 - protein, 13 aa, Mycobacterium
FPAGGNSPFDPES

SEQ ID NO: 475943 - protein, 18 aa, Mycobacterium
FPAGSDGRPMRSSLQGPE

SEQ ID NO: 475944 - protein, 5 aa, Mycobacterium
FPANT

SEQ ID NO: 475945 - protein, 5 aa, Mycobacterium
FPAPA

SEQ ID NO: 475946 - protein, 6 aa, Mycobacterium
FPAPAG

SEQ ID NO: 475947 - protein, 9 aa, Mycobacterium
FPAPETQIP

SEQ ID NO: 475948 - protein, 11 aa, Mycobacterium
FPAPHAGTAGH

SEQ ID NO: 475949 - protein, 5 aa, Mycobacterium
FPAPK

SEQ ID NO: 475950 - protein, 8 aa, Mycobacterium
FPAPPEHQ

SEQ ID NO: 475951 - protein, 5 aa, Mycobacterium
FPAPQ

SEQ ID NO: 475952 - protein, 18 aa, Mycobacterium
FPAPQSPPRVSSRAANPV

SEQ ID NO: 475953 - protein, 6 aa, Mycobacterium
FPAPQT

SEQ ID NO: 475954 - protein, 30 aa, Mycobacterium
FPAQKPVVTQGHEASGTIAKLGPDVTGWAE

SEQ ID NO: 475955 - protein, 6 aa, Mycobacterium
FPAREL

SEQ ID NO: 475956 - protein, 42 aa, Mycobacterium
FPASDPGALSNGHADDHAPVESAAKHAKGRVSNPVTVKSDEL

SEQ ID NO: 475957 - protein, 9 aa, Mycobacterium
FPASDPGQL

SEQ ID NO: 475958 - protein, 12 aa, Mycobacterium
FPASEPPRPEEH

SEQ ID NO: 475959 - protein, 19 aa, Mycobacterium
FPASPASVATLSGGTSTEG

SEQ ID NO: 475960 - protein, 15 aa, Mycobacterium
FPASRSTHSDAGRSL

SEQ ID NO: 475961 - protein, 6 aa, Mycobacterium
FPATSD

SEQ ID NO: 475962 - protein, 19 aa, Mycobacterium
FPATTRGRSGQNPRPQWPA

SEQ ID NO: 475963 - protein, 4 aa, Mycobacterium
FPDD

SEQ ID NO: 475964 - protein, 21 aa, Mycobacterium
FPDDDEAAQHPNIVAVTATLG

SEQ ID NO: 475965 - protein, 6 aa, Mycobacterium
FPDDDQ

SEQ ID NO: 475966 - protein, 11 aa, Mycobacterium
FPDDEPLNHTG

SEQ ID NO: 475967 - protein, 6 aa, Mycobacterium
FPDDES

SEQ ID NO: 475968 - protein, 11 aa, Mycobacterium
FPDEDSRSPMD

SEQ ID NO: 475969 - protein, 4 aa, Mycobacterium
FPDG

SEQ ID NO: 475970 - protein, 7 aa, Mycobacterium
FPDGEGL

SEQ ID NO: 475971 - protein, 18 aa, Mycobacterium
FPDGENASVAASRQGPDV

SEQ ID NO: 475972 - protein, 10 aa, Mycobacterium
FPDGPPASYV

SEQ ID NO: 475973 - protein, 6 aa, Mycobacterium
FPDGSC

SEQ ID NO: 475974 - protein, 8 aa, Mycobacterium
FPDGSTPE

SEQ ID NO: 475975 - protein, 5 aa, Mycobacterium
FPDGT

SEQ ID NO: 475976 - protein, 10 aa, Mycobacterium
FPDGTTPDAL

SEQ ID NO: 475977 - protein, 11 aa, Mycobacterium
FPDGVQTAENL

SEQ ID NO: 475978 - protein, 9 aa, Mycobacterium
FPDLGADSR

SEQ ID NO: 475979 - protein, 4 aa, Mycobacterium
FPDN

SEQ ID NO: 475980 - protein, 10 aa, Mycobacterium
FPDNNPSTNI

SEQ ID NO: 475981 - protein, 5 aa, Mycobacterium
FPDNT

SEQ ID NO: 475982 - protein, 9 aa, Mycobacterium
FPDPADPNH

SEQ ID NO: 475983 - protein, 11 aa, Mycobacterium
FPDPAPASCGD

SEQ ID NO: 475984 - protein, 11 aa, Mycobacterium
FPDPDAAPAHG

SEQ ID NO: 475985 - protein, 9 aa, Mycobacterium
FPDPEPSYG

SEQ ID NO: 475986 - protein, 5 aa, Mycobacterium
FPDPG

SEQ ID NO: 475987 - protein, 9 aa, Mycobacterium
FPDPGDAVA

SEQ ID NO: 475988 - protein, 10 aa, Mycobacterium
FPDPGDPDQL

SEQ ID NO: 475989 - protein, 10 aa, Mycobacterium
FPDPREPTAM

SEQ ID NO: 475990 - protein, 10 aa, Mycobacterium
FPDPREPTAV

SEQ ID NO: 475991 - protein, 15 aa, Mycobacterium
FPDPTENAGIKPRLP

SEQ ID NO: 475992 - protein, 11 aa, Mycobacterium
FPDPTSSKPGE

SEQ ID NO: 475993 - protein, 4 aa, Mycobacterium
FPDQ

SEQ ID NO: 475994 - protein, 14 aa, Mycobacterium
FPDQTTDMRANNEA

SEQ ID NO: 475995 - protein, 5 aa, Mycobacterium
FPDQV

SEQ ID NO: 475996 - protein, 6 aa, Mycobacterium
FPDRSA

SEQ ID NO: 475997 - protein, 6 aa, Mycobacterium
FPDSDI

SEQ ID NO: 475998 - protein, 5 aa, Mycobacterium
FPDSE

SEQ ID NO: 475999 - protein, 9 aa, Mycobacterium
FPDSHGQNL

SEQ ID NO: 476000 - protein, 9 aa, Mycobacterium
FPDSHPQNL

SEQ ID NO: 476001 - protein, 6 aa, Mycobacterium
FPDSHR

SEQ ID NO: 476002 - protein, 8 aa, Mycobacterium
FPDTDSET

SEQ ID NO: 476003 - protein, 8 aa, Mycobacterium
FPDTESES

SEQ ID NO: 476004 - protein, 5 aa, Mycobacterium
FPDVP

SEQ ID NO: 476005 - protein, 24 aa, Mycobacterium
FPDYKPELPGGRPGGGRSLSAGPI

SEQ ID NO: 476006 - protein, 23 aa, Mycobacterium
FPDYRPELPGGQPAGGRSLSAAP

SEQ ID NO: 476007 - protein, 7 aa, Mycobacterium
FPEAGGA

SEQ ID NO: 476008 - protein, 11 aa, Mycobacterium
FPEASRDRLTE

SEQ ID NO: 476009 - protein, 15 aa, Mycobacterium
FPEDAGGSGGDGADP

SEQ ID NO: 476010 - protein, 6 aa, Mycobacterium
FPEDGS

SEQ ID NO: 476011 - protein, 4 aa, Mycobacterium
FPEE

SEQ ID NO: 476012 - protein, 27 aa, Mycobacterium
FPEEGGPGDTLNPNESTDSDELRNDDG

SEQ ID NO: 476013 - protein, 6 aa, Mycobacterium
FPEETQ

SEQ ID NO: 476014 - protein, 6 aa, Mycobacterium
FPEETR

SEQ ID NO: 476015 - protein, 6 aa, Mycobacterium
FPEGAA

SEQ ID NO: 476016 - protein, 6 aa, Mycobacterium
FPEGEG

SEQ ID NO: 476017 - protein, 9 aa, Mycobacterium
FPEGGRDPW

SEQ ID NO: 476018 - protein, 6 aa, Mycobacterium
FPEGGS

SEQ ID NO: 476019 - protein, 7 aa, Mycobacterium
FPEGHPQ

SEQ ID NO: 476020 - protein, 6 aa, Mycobacterium
FPEGTR

SEQ ID NO: 476021 - protein, 10 aa, Mycobacterium
FPEGVQTAEN

SEQ ID NO: 476022 - protein, 11 aa, Mycobacterium
FPEGVQTAENL

SEQ ID NO: 476023 - protein, 11 aa, Mycobacterium
FPELPDAPTPD

SEQ ID NO: 476024 - protein, 14 aa, Mycobacterium
FPEPAGALVAVPGE

SEQ ID NO: 476025 - protein, 7 aa, Mycobacterium
FPEPETQ

SEQ ID NO: 476026 - protein, 5 aa, Mycobacterium
FPEPG

SEQ ID NO: 476027 - protein, 11 aa, Mycobacterium
FPEPGSAVERG

SEQ ID NO: 476028 - protein, 11 aa, Mycobacterium
FPEPGSTVEKG

SEQ ID NO: 476029 - protein, 5 aa, Mycobacterium
FPEPK

SEQ ID NO: 476030 - protein, 12 aa, Mycobacterium
FPEPQEQGTGPF

SEQ ID NO: 476031 - protein, 4 aa, Mycobacterium
FPEQ

SEQ ID NO: 476032 - protein, 5 aa, Mycobacterium
FPERA

SEQ ID NO: 476033 - protein, 4 aa, Mycobacterium
FPES

SEQ ID NO: 476034 - protein, 7 aa, Mycobacterium
FPESGVR

SEQ ID NO: 476035 - protein, 5 aa, Mycobacterium
FPEST

SEQ ID NO: 476036 - protein, 6 aa, Mycobacterium
FPESYD

SEQ ID NO: 476037 - protein, 5 aa, Mycobacterium
FPETT

SEQ ID NO: 476038 - protein, 8 aa, Mycobacterium
FPGAADAD

SEQ ID NO: 476039 - protein, 8 aa, Mycobacterium
FPGAADAE

SEQ ID NO: 476040 - protein, 16 aa, Mycobacterium
FPGAARRGIQTGGAYS

SEQ ID NO: 476041 - protein, 8 aa, Mycobacterium
FPGAASAE

SEQ ID NO: 476042 - protein, 6 aa, Mycobacterium
FPGAKD

SEQ ID NO: 476043 - protein, 5 aa, Mycobacterium
FPGAN

SEQ ID NO: 476044 - protein, 6 aa, Mycobacterium
FPGAPK

SEQ ID NO: 476045 - protein, 6 aa, Mycobacterium
FPGAQS

SEQ ID NO: 476046 - protein, 7 aa, Mycobacterium
FPGARDA

SEQ ID NO: 476047 - protein, 7 aa, Mycobacterium
FPGATSA

SEQ ID NO: 476048 - protein, 6 aa, Mycobacterium
FPGDDQ

SEQ ID NO: 476049 - protein, 7 aa, Mycobacterium
FPGDEAR

SEQ ID NO: 476050 - protein, 10 aa, Mycobacterium
FPGDEDTERR

SEQ ID NO: 476051 - protein, 6 aa, Mycobacterium
FPGDEP

SEQ ID NO: 476052 - protein, 6 aa, Mycobacterium
FPGDPD

SEQ ID NO: 476053 - protein, 10 aa, Mycobacterium
FPGEKGTTGE

SEQ ID NO: 476054 - protein, 30 aa, Mycobacterium
FPGERADGGEAIEAPEDELASRRKDRARKI

SEQ ID NO: 476055 - protein, 30 aa, Mycobacterium
FPGERADGGESISAPEDELASRRKHRDRKI

SEQ ID NO: 476056 - protein, 7 aa, Mycobacterium
FPGERND

SEQ ID NO: 476057 - protein, 7 aa, Mycobacterium
FPGETSC

SEQ ID NO: 476058 - protein, 4 aa, Mycobacterium
FPGF

SEQ ID NO: 476059 - protein, 6 aa, Mycobacterium
FPGGAE

SEQ ID NO: 476060 - protein, 42 aa, Mycobacterium
FPGGIGGAGGAGGQGGQATGGGNAGDGGTGGQGGTGGQGATS

SEQ ID NO: 476061 - protein, 14 aa, Mycobacterium
FPGGPGRTTNPEEF

SEQ ID NO: 476062 - protein, 6 aa, Mycobacterium
FPGGPV

SEQ ID NO: 476063 - protein, 6 aa, Mycobacterium
FPGGRI

SEQ ID NO: 476064 - protein, 5 aa, Mycobacterium
FPGGS

SEQ ID NO: 476065 - protein, 11 aa, Mycobacterium
FPGIDTNGGYA

SEQ ID NO: 476066 - protein, 11 aa, Mycobacterium
FPGNGPTGCPS

SEQ ID NO: 476067 - protein, 6 aa, Mycobacterium
FPGPDG

SEQ ID NO: 476068 - protein, 7 aa, Mycobacterium
FPGPGSD

SEQ ID NO: 476069 - protein, 6 aa, Mycobacterium
FPGPHG

SEQ ID NO: 476070 - protein, 33 aa, Mycobacterium
FPGPPRTTDPAGLAGQAAATSQSAASATSSSAI

SEQ ID NO: 476071 - protein, 7 aa, Mycobacterium
FPGPRND

SEQ ID NO: 476072 - protein, 11 aa, Mycobacterium
FPGPTGTNAVE

SEQ ID NO: 476073 - protein, 6 aa, Mycobacterium
FPGQGA

SEQ ID NO: 476074 - protein, 11 aa, Mycobacterium
FPGQGSQWPGM

SEQ ID NO: 476075 - protein, 6 aa, Mycobacterium
FPGQRE

SEQ ID NO: 476076 - protein, 13 aa, Mycobacterium
FPGRRTEGANRGP

SEQ ID NO: 476077 - protein, 10 aa, Mycobacterium
FPGRSGTRED

SEQ ID NO: 476078 - protein, 9 aa, Mycobacterium
FPGSFDGES

SEQ ID NO: 476079 - protein, 7 aa, Mycobacterium
FPGSQGS

SEQ ID NO: 476080 - protein, 15 aa, Mycobacterium
FPGSRRNPDVSKQAM

SEQ ID NO: 476081 - protein, 10 aa, Mycobacterium
FPGSTSATVG

SEQ ID NO: 476082 - protein, 12 aa, Mycobacterium
FPGTDDEPESSL

SEQ ID NO: 476083 - protein, 11 aa, Mycobacterium
FPGTKACNGAT

SEQ ID NO: 476084 - protein, 7 aa, Mycobacterium
FPGTPKD

SEQ ID NO: 476085 - protein, 7 aa, Mycobacterium
FPGTTSP

SEQ ID NO: 476086 - protein, 4 aa, Mycobacterium
FPGV

SEQ ID NO: 476087 - protein, 8 aa, Mycobacterium
FPGVENPA

SEQ ID NO: 476088 - protein, 4 aa, Mycobacterium
FPGW

SEQ ID NO: 476089 - protein, 8 aa, Mycobacterium
FPGYPGRA

SEQ ID NO: 476090 - protein, 19 aa, Mycobacterium
FPHQEAASAEELAQSADPM

SEQ ID NO: 476091 - protein, 9 aa, Mycobacterium
FPHQGTEGP

SEQ ID NO: 476092 - protein, 4 aa, Mycobacterium
FPIP

SEQ ID NO: 476093 - protein, 6 aa, Mycobacterium
FPKDDT

SEQ ID NO: 476094 - protein, 6 aa, Mycobacterium
FPKETR

SEQ ID NO: 476095 - protein, 11 aa, Mycobacterium
FPKGVTPISHP

SEQ ID NO: 476096 - protein, 7 aa, Mycobacterium
FPKPLAR

SEQ ID NO: 476097 - protein, 8 aa, Mycobacterium
FPKPLART

SEQ ID NO: 476098 - protein, 4 aa, Mycobacterium
FPKR

SEQ ID NO: 476099 - protein, 19 aa, Mycobacterium
FPKTDTKVGAQEGSETMQG

SEQ ID NO: 476100 - protein, 17 aa, Mycobacterium
FPLPGEAGVAPDPRRAR

SEQ ID NO: 476101 - protein, 9 aa, Mycobacterium
FPLPNGGNG

SEQ ID NO: 476102 - protein, 9 aa, Mycobacterium
FPLTEPEAD

SEQ ID NO: 476103 - protein, 8 aa, Mycobacterium
FPNAERKE

SEQ ID NO: 476104 - protein, 8 aa, Mycobacterium
FPNANGRI

SEQ ID NO: 476105 - protein, 4 aa, Mycobacterium
FPNE

SEQ ID NO: 476106 - protein, 6 aa, Mycobacterium
FPNGER

SEQ ID NO: 476107 - protein, 6 aa, Mycobacterium
FPNGTE

SEQ ID NO: 476108 - protein, 13 aa, Mycobacterium
FPNHEANPLDAEN

SEQ ID NO: 476109 - protein, 11 aa, Mycobacterium
FPNHEANPLDP

SEQ ID NO: 476110 - protein, 17 aa, Mycobacterium
FPNPRTGDRCAGPGHDQ

SEQ ID NO: 476111 - protein, 6 aa, Mycobacterium
FPNTPW

SEQ ID NO: 476112 - protein, 8 aa, Mycobacterium
FPNTSPAH

SEQ ID NO: 476113 - protein, 4 aa, Mycobacterium
FPPA

SEQ ID NO: 476114 - protein, 5 aa, Mycobacterium
FPPAE

SEQ ID NO: 476115 - protein, 28 aa, Mycobacterium
FPPAEDESPSDSAEPAAGPAKSPLPPMP

SEQ ID NO: 476116 - protein, 16 aa, Mycobacterium
FPPAGGGRRRASIEAD

SEQ ID NO: 476117 - protein, 17 aa, Mycobacterium
FPPAGGGRRRPGIDHDQ

SEQ ID NO: 476118 - protein, 5 aa, Mycobacterium
FPPAR

SEQ ID NO: 476119 - protein, 15 aa, Mycobacterium
FPPASVTGTPKGRAR

SEQ ID NO: 476120 - protein, 14 aa, Mycobacterium
FPPASVTGTPKHRA

SEQ ID NO: 476121 - protein, 5 aa, Mycobacterium
FPPAT

SEQ ID NO: 476122 - protein, 4 aa, Mycobacterium
FPPD

SEQ ID NO: 476123 - protein, 6 aa, Mycobacterium
FPPDGE

SEQ ID NO: 476124 - protein, 14 aa, Mycobacterium
FPPDGEFPGSDPDM

SEQ ID NO: 476125 - protein, 8 aa, Mycobacterium
FPPDGHTG

SEQ ID NO: 476126 - protein, 9 aa, Mycobacterium
FPPDGTEPV

SEQ ID NO: 476127 - protein, 15 aa, Mycobacterium
FPPDIDGPHPVSEPE

SEQ ID NO: 476128 - protein, 6 aa, Mycobacterium
FPPDRG

SEQ ID NO: 476129 - protein, 11 aa, Mycobacterium
FPPEGPHPERS

SEQ ID NO: 476130 - protein, 5 aa, Mycobacterium
FPPEK

SEQ ID NO: 476131 - protein, 5 aa, Mycobacterium
FPPEM

SEQ ID NO: 476132 - protein, 13 aa, Mycobacterium
FPPGNAPTDSAVP

SEQ ID NO: 476133 - protein, 6 aa, Mycobacterium
FPPLRT

SEQ ID NO: 476134 - protein, 10 aa, Mycobacterium
FPPLRTPETV

SEQ ID NO: 476135 - protein, 7 aa, Mycobacterium
FPPNHPP

SEQ ID NO: 476136 - protein, 6 aa, Mycobacterium
FPPPAA

SEQ ID NO: 476137 - protein, 8 aa, Mycobacterium
FPPPDAET

SEQ ID NO: 476138 - protein, 30 aa, Mycobacterium
FPPPDGVISPDSPTACGRSAYAKTKGYADR

SEQ ID NO: 476139 - protein, 30 aa, Mycobacterium
FPPPGPVIGPDTPTSAGRSAYAKTKGYADR

SEQ ID NO: 476140 - protein, 13 aa, Mycobacterium
FPPQSQGNDDDAS

SEQ ID NO: 476141 - protein, 8 aa, Mycobacterium
FPPRGDHE

SEQ ID NO: 476142 - protein, 8 aa, Mycobacterium
FPPRPGGI

SEQ ID NO: 476143 - protein, 8 aa, Mycobacterium
FPPRRGGI

SEQ ID NO: 476144 - protein, 4 aa, Mycobacterium
FPPS

SEQ ID NO: 476145 - protein, 37 aa, Mycobacterium
FPPSPPSPPLPAAPPVSPSPPSPPRPPAPPPPPALPS

SEQ ID NO: 476146 - protein, 6 aa, Mycobacterium
FPPTGS

SEQ ID NO: 476147 - protein, 23 aa, Mycobacterium
FPPTPSGSIAGRTLQESTYQPRA

SEQ ID NO: 476148 - protein, 8 aa, Mycobacterium
FPPTPYRA

SEQ ID NO: 476149 - protein, 5 aa, Mycobacterium
FPQAQ

SEQ ID NO: 476150 - protein, 4 aa, Mycobacterium
FPQE

SEQ ID NO: 476151 - protein, 16 aa, Mycobacterium
FPQGLDKAADPAYAAS

SEQ ID NO: 476152 - protein, 15 aa, Mycobacterium
FPQGLDKAADPSYAA

SEQ ID NO: 476153 - protein, 8 aa, Mycobacterium
FPQGPNPV

SEQ ID NO: 476154 - protein, 18 aa, Mycobacterium
FPQLPQAPDDYPTFPDTS

SEQ ID NO: 476155 - protein, 5 aa, Mycobacterium
FPQMT

SEQ ID NO: 476156 - protein, 10 aa, Mycobacterium
FPQNESRHEA

SEQ ID NO: 476157 - protein, 24 aa, Mycobacterium
FPQRDPHGDPIPATDGQVPTPPAR

SEQ ID NO: 476158 - protein, 5 aa, Mycobacterium
FPQSR

SEQ ID NO: 476159 - protein, 62 aa, Mycobacterium
FPQTDGRTACSKDNNSFVPPDENGDTGSSTTSSTTSSTTSSTTTTTTTTTTTTTTTTTTPSA

SEQ ID NO: 476160 - protein, 22 aa, Mycobacterium
FPQTPGAAAQSDNAAEAAVEQP

SEQ ID NO: 476161 - protein, 21 aa, Mycobacterium
FPRAGRRPVPDAAAPSSRGKV

SEQ ID NO: 476162 - protein, 5 aa, Mycobacterium
FPRAK

SEQ ID NO: 476163 - protein, 12 aa, Mycobacterium
FPRAKPCGDGLT

SEQ ID NO: 476164 - protein, 4 aa, Mycobacterium
FPRD

SEQ ID NO: 476165 - protein, 8 aa, Mycobacterium
FPRDPQTG

SEQ ID NO: 476166 - protein, 10 aa, Mycobacterium
FPRGGTSGPW

SEQ ID NO: 476167 - protein, 8 aa, Mycobacterium
FPRPADER

SEQ ID NO: 476168 - protein, 7 aa, Mycobacterium
FPRPDDP

SEQ ID NO: 476169 - protein, 8 aa, Mycobacterium
FPRPDDPL

SEQ ID NO: 476170 - protein, 11 aa, Mycobacterium
FPRPDDPLRAA

SEQ ID NO: 476171 - protein, 8 aa, Mycobacterium
FPRPEGER

SEQ ID NO: 476172 - protein, 15 aa, Mycobacterium
FPRPGPQPAPRPGIH

SEQ ID NO: 476173 - protein, 8 aa, Mycobacterium
FPRPPEER

SEQ ID NO: 476174 - protein, 12 aa, Mycobacterium
FPRPPVPTGDGA

SEQ ID NO: 476175 - protein, 6 aa, Mycobacterium
FPRPQT

SEQ ID NO: 476176 - protein, 6 aa, Mycobacterium
FPRPRS

SEQ ID NO: 476177 - protein, 6 aa, Mycobacterium
FPRPTR

SEQ ID NO: 476178 - protein, 8 aa, Mycobacterium
FPRPTTQI

SEQ ID NO: 476179 - protein, 24 aa, Mycobacterium
FPRRDPHGDPIPASDGQVPTPPAR

SEQ ID NO: 476180 - protein, 16 aa, Mycobacterium
FPSADTTHTDTAPVYG

SEQ ID NO: 476181 - protein, 10 aa, Mycobacterium
FPSAGERLGR

SEQ ID NO: 476182 - protein, 7 aa, Mycobacterium
FPSAGTR

SEQ ID NO: 476183 - protein, 5 aa, Mycobacterium
FPSAR

SEQ ID NO: 476184 - protein, 5 aa, Mycobacterium
FPSDE

SEQ ID NO: 476185 - protein, 6 aa, Mycobacterium
FPSDGE

SEQ ID NO: 476186 - protein, 14 aa, Mycobacterium
FPSDGEFAGSDPDL

SEQ ID NO: 476187 - protein, 6 aa, Mycobacterium
FPSDRG

SEQ ID NO: 476188 - protein, 4 aa, Mycobacterium
FPSF

SEQ ID NO: 476189 - protein, 5 aa, Mycobacterium
FPSGA

SEQ ID NO: 476190 - protein, 9 aa, Mycobacterium
FPSGEGSDL

SEQ ID NO: 476191 - protein, 6 aa, Mycobacterium
FPSGHT

SEQ ID NO: 476192 - protein, 10 aa, Mycobacterium
FPSGKHASAI

SEQ ID NO: 476193 - protein, 8 aa, Mycobacterium
FPSGPVSA

SEQ ID NO: 476194 - protein, 6 aa, Mycobacterium
FPSGRR

SEQ ID NO: 476195 - protein, 7 aa, Mycobacterium
FPSGRTA

SEQ ID NO: 476196 - protein, 8 aa, Mycobacterium
FPSGVGQD

SEQ ID NO: 476197 - protein, 4 aa, Mycobacterium
FPSI

SEQ ID NO: 476198 - protein, 5 aa, Mycobacterium
FPSNL

SEQ ID NO: 476199 - protein, 4 aa, Mycobacterium
FPSP

SEQ ID NO: 476200 - protein, 7 aa, Mycobacterium
FPSPQRT

SEQ ID NO: 476201 - protein, 5 aa, Mycobacterium
FPSQP

SEQ ID NO: 476202 - protein, 18 aa, Mycobacterium
FPSREHAERRPDVARDEA

SEQ ID NO: 476203 - protein, 6 aa, Mycobacterium
FPSRKS

SEQ ID NO: 476204 - protein, 9 aa, Mycobacterium
FPSRNGAQR

SEQ ID NO: 476205 - protein, 9 aa, Mycobacterium
FPSRQEHAE

SEQ ID NO: 476206 - protein, 5 aa, Mycobacterium
FPSST

SEQ ID NO: 476207 - protein, 9 aa, Mycobacterium
FPSTASRST

SEQ ID NO: 476208 - protein, 16 aa, Mycobacterium
FPSTDPSAARCGTERD

SEQ ID NO: 476209 - protein, 8 aa, Mycobacterium
FPSTTAAG

SEQ ID NO: 476210 - protein, 18 aa, Mycobacterium
FPTADEEETAGGPDVAKG

SEQ ID NO: 476211 - protein, 6 aa, Mycobacterium
FPTAGS

SEQ ID NO: 476212 - protein, 7 aa, Mycobacterium
FPTAPVS

SEQ ID NO: 476213 - protein, 6 aa, Mycobacterium
FPTAQS

SEQ ID NO: 476214 - protein, 6 aa, Mycobacterium
FPTASQ

SEQ ID NO: 476215 - protein, 9 aa, Mycobacterium
FPTASQISK

SEQ ID NO: 476216 - protein, 12 aa, Mycobacterium
FPTDDPDDAEAL

SEQ ID NO: 476217 - protein, 11 aa, Mycobacterium
FPTDDPEDTEA

SEQ ID NO: 476218 - protein, 9 aa, Mycobacterium
FPTDGEPVT

SEQ ID NO: 476219 - protein, 5 aa, Mycobacterium
FPTDR

SEQ ID NO: 476220 - protein, 4 aa, Mycobacterium
FPTE

SEQ ID NO: 476221 - protein, 21 aa, Mycobacterium
FPTEPPEAPLPRYSGGTSPRA

SEQ ID NO: 476222 - protein, 21 aa, Mycobacterium
FPTEPPGAPLPPLAGGTSPRA

SEQ ID NO: 476223 - protein, 21 aa, Mycobacterium
FPTEPPGAPLPPYGGGTSPRA

SEQ ID NO: 476224 - protein, 21 aa, Mycobacterium
FPTEPPRDPLPRYTGGTSPRA

SEQ ID NO: 476225 - protein, 21 aa, Mycobacterium
FPTEPPTAPLPRHSGGTSPRA

SEQ ID NO: 476226 - protein, 4 aa, Mycobacterium
FPTG

SEQ ID NO: 476227 - protein, 9 aa, Mycobacterium
FPTGDDGRQ

SEQ ID NO: 476228 - protein, 5 aa, Mycobacterium
FPTGP

SEQ ID NO: 476229 - protein, 5 aa, Mycobacterium
FPTGT

SEQ ID NO: 476230 - protein, 6 aa, Mycobacterium
FPTGTP

SEQ ID NO: 476231 - protein, 7 aa, Mycobacterium
FPTGTPL

SEQ ID NO: 476232 - protein, 6 aa, Mycobacterium
FPTGTS

SEQ ID NO: 476233 - protein, 14 aa, Mycobacterium
FPTGYQVGRANHRI

SEQ ID NO: 476234 - protein, 8 aa, Mycobacterium
FPTKSSAG

SEQ ID NO: 476235 - protein, 6 aa, Mycobacterium
FPTNPE

SEQ ID NO: 476236 - protein, 9 aa, Mycobacterium
FPTPDDPNH

SEQ ID NO: 476237 - protein, 5 aa, Mycobacterium
FPTPG

SEQ ID NO: 476238 - protein, 6 aa, Mycobacterium
FPTPRG

SEQ ID NO: 476239 - protein, 8 aa, Mycobacterium
FPTPSHPD

SEQ ID NO: 476240 - protein, 9 aa, Mycobacterium
FPTPSTQLP

SEQ ID NO: 476241 - protein, 12 aa, Mycobacterium
FPTPTRAQSGAW

SEQ ID NO: 476242 - protein, 5 aa, Mycobacterium
FPTQA

SEQ ID NO: 476243 - protein, 9 aa, Mycobacterium
FPTRNGAQR

SEQ ID NO: 476244 - protein, 5 aa, Mycobacterium
FPTRT

SEQ ID NO: 476245 - protein, 9 aa, Mycobacterium
FPTRTGAQR

SEQ ID NO: 476246 - protein, 14 aa, Mycobacterium
FPTSCGSRSLANEV

SEQ ID NO: 476247 - protein, 4 aa, Mycobacterium
FPVD

SEQ ID NO: 476248 - protein, 6 aa, Mycobacterium
FPYRND

SEQ ID NO: 476249 - protein, 16 aa, Mycobacterium
FQAPGHAAEPASGDLT

SEQ ID NO: 476250 - protein, 9 aa, Mycobacterium
FQASDGSSV

SEQ ID NO: 476251 - protein, 7 aa, Mycobacterium
FQDAPRP

SEQ ID NO: 476252 - protein, 11 aa, Mycobacterium
FQDDDGQRWGR

SEQ ID NO: 476253 - protein, 9 aa, Mycobacterium
FQDDGSAGI

SEQ ID NO: 476254 - protein, 46 aa, Mycobacterium
FQDGQGPTFGGDPRDGFPRSPASELAQGPPGTRPLPTGTALGPDGH

SEQ ID NO: 476255 - protein, 10 aa, Mycobacterium
FQDGSSIADN

SEQ ID NO: 476256 - protein, 9 aa, Mycobacterium
FQDPPDGAL

SEQ ID NO: 476257 - protein, 9 aa, Mycobacterium
FQDPPDSAL

SEQ ID NO: 476258 - protein, 4 aa, Mycobacterium
FQET

SEQ ID NO: 476259 - protein, 10 aa, Mycobacterium
FQGDPGGRAI

SEQ ID NO: 476260 - protein, 5 aa, Mycobacterium
FQGES

SEQ ID NO: 476261 - protein, 11 aa, Mycobacterium
FQGGAADPEAL

SEQ ID NO: 476262 - protein, 10 aa, Mycobacterium
FQGPQPPEQL

SEQ ID NO: 476263 - protein, 5 aa, Mycobacterium
FQGQQ

SEQ ID NO: 476264 - protein, 5 aa, Mycobacterium
FQGRQ

SEQ ID NO: 476265 - protein, 6 aa, Mycobacterium
FQGSYR

SEQ ID NO: 476266 - protein, 6 aa, Mycobacterium
FQGTQA

SEQ ID NO: 476267 - protein, 12 aa, Mycobacterium
FQNGGKGADGAG

SEQ ID NO: 476268 - protein, 8 aa, Mycobacterium
FQNPSPHI

SEQ ID NO: 476269 - protein, 18 aa, Mycobacterium
FQNTNSRNTGFSNSGVNS

SEQ ID NO: 476270 - protein, 5 aa, Mycobacterium
FQNTT

SEQ ID NO: 476271 - protein, 12 aa, Mycobacterium
FQPAAKDQPEVG

SEQ ID NO: 476272 - protein, 6 aa, Mycobacterium
FQPAAV

SEQ ID NO: 476273 - protein, 16 aa, Mycobacterium
FQPAEDAPEDRTDGEL

SEQ ID NO: 476274 - protein, 8 aa, Mycobacterium
FQPDGDKW

SEQ ID NO: 476275 - protein, 4 aa, Mycobacterium
FQPE

SEQ ID NO: 476276 - protein, 10 aa, Mycobacterium
FQPGAKTESL

SEQ ID NO: 476277 - protein, 13 aa, Mycobacterium
FQPGEPEGYRGRE

SEQ ID NO: 476278 - protein, 8 aa, Mycobacterium
FQPGETHK

SEQ ID NO: 476279 - protein, 8 aa, Mycobacterium
FQPGPGRR

SEQ ID NO: 476280 - protein, 4 aa, Mycobacterium
FQPH

SEQ ID NO: 476281 - protein, 15 aa, Mycobacterium
FQPNPAAGRAAPSVP

SEQ ID NO: 476282 - protein, 7 aa, Mycobacterium
FQPNPDF

SEQ ID NO: 476283 - protein, 4 aa, Mycobacterium
FQPQ

SEQ ID NO: 476284 - protein, 16 aa, Mycobacterium
FQPQEGGAEDRTDGEF

SEQ ID NO: 476285 - protein, 11 aa, Mycobacterium
FQPSEAAPEPV

SEQ ID NO: 476286 - protein, 10 aa, Mycobacterium
FQPSEQTPEP

SEQ ID NO: 476287 - protein, 9 aa, Mycobacterium
FQPTNKTSN

SEQ ID NO: 476288 - protein, 10 aa, Mycobacterium
FQQPSPQPGV

SEQ ID NO: 476289 - protein, 7 aa, Mycobacterium
FQQQSGG

SEQ ID NO: 476290 - protein, 7 aa, Mycobacterium
FQQRATE

SEQ ID NO: 476291 - protein, 8 aa, Mycobacterium
FQQRSTEL

SEQ ID NO: 476292 - protein, 12 aa, Mycobacterium
FQRADSRETQRT

SEQ ID NO: 476293 - protein, 5 aa, Mycobacterium
FQRPD

SEQ ID NO: 476294 - protein, 7 aa, Mycobacterium
FQRQSGG

SEQ ID NO: 476295 - protein, 17 aa, Mycobacterium
FQSAYDQASNEQSSTNR

SEQ ID NO: 476296 - protein, 9 aa, Mycobacterium
FQSEPDADA

SEQ ID NO: 476297 - protein, 13 aa, Mycobacterium
FQTDGSAADQERF

SEQ ID NO: 476298 - protein, 7 aa, Mycobacterium
FQTGEAN

SEQ ID NO: 476299 - protein, 6 aa, Mycobacterium
FQTPAD

SEQ ID NO: 476300 - protein, 11 aa, Mycobacterium
FQTRSTKEGGH

SEQ ID NO: 476301 - protein, 9 aa, Mycobacterium
FQTRSTKLG

SEQ ID NO: 476302 - protein, 11 aa, Mycobacterium
FQTRSTKQGGR

SEQ ID NO: 476303 - protein, 7 aa, Mycobacterium
FQTSTGV

SEQ ID NO: 476304 - protein, 8 aa, Mycobacterium
FRADEKAA

SEQ ID NO: 476305 - protein, 9 aa, Mycobacterium
FRADGAASV

SEQ ID NO: 476306 - protein, 6 aa, Mycobacterium
FRADGR

SEQ ID NO: 476307 - protein, 11 aa, Mycobacterium
FRAEGGQFRRP

SEQ ID NO: 476308 - protein, 7 aa, Mycobacterium
FRAEQTA

SEQ ID NO: 476309 - protein, 8 aa, Mycobacterium
FRAGPGRI

SEQ ID NO: 476310 - protein, 7 aa, Mycobacterium
FRAPEAA

SEQ ID NO: 476311 - protein, 11 aa, Mycobacterium
FRATPTADGWT

SEQ ID NO: 476312 - protein, 9 aa, Mycobacterium
FRDDEARQR

SEQ ID NO: 476313 - protein, 9 aa, Mycobacterium
FRDDEARTR

SEQ ID NO: 476314 - protein, 10 aa, Mycobacterium
FRDEASRSKL

SEQ ID NO: 476315 - protein, 17 aa, Mycobacterium
FRDENGKWNPGSDDPLD

SEQ ID NO: 476316 - protein, 8 aa, Mycobacterium
FRDGAPHG

SEQ ID NO: 476317 - protein, 7 aa, Mycobacterium
FRDGEPH

SEQ ID NO: 476318 - protein, 10 aa, Mycobacterium
FRDGGASTFT

SEQ ID NO: 476319 - protein, 6 aa, Mycobacterium
FRDGGP

SEQ ID NO: 476320 - protein, 9 aa, Mycobacterium
FRDGYDTTT

SEQ ID NO: 476321 - protein, 6 aa, Mycobacterium
FRDPDD

SEQ ID NO: 476322 - protein, 6 aa, Mycobacterium
FRDPDG

SEQ ID NO: 476323 - protein, 14 aa, Mycobacterium
FRDPDGIALEFFAG

SEQ ID NO: 476324 - protein, 15 aa, Mycobacterium
FRDPDGIALEFFAPP

SEQ ID NO: 476325 - protein, 7 aa, Mycobacterium
FRDPDGR

SEQ ID NO: 476326 - protein, 7 aa, Mycobacterium
FRDPGDT

SEQ ID NO: 476327 - protein, 7 aa, Mycobacterium
FREAGEQ

SEQ ID NO: 476328 - protein, 5 aa, Mycobacterium
FREDN

SEQ ID NO: 476329 - protein, 5 aa, Mycobacterium
FREGA

SEQ ID NO: 476330 - protein, 8 aa, Mycobacterium
FRESTDRT

SEQ ID NO: 476331 - protein, 6 aa, Mycobacterium
FRGADN

SEQ ID NO: 476332 - protein, 9 aa, Mycobacterium
FRGEGEREV

SEQ ID NO: 476333 - protein, 4 aa, Mycobacterium
FRGG

SEQ ID NO: 476334 - protein, 8 aa, Mycobacterium
FRGGAPAQ

SEQ ID NO: 476335 - protein, 12 aa, Mycobacterium
FRGGNAAPAARA

SEQ ID NO: 476336 - protein, 20 aa, Mycobacterium
FRGGRGDGPSQATGLEEHQP

SEQ ID NO: 476337 - protein, 5 aa, Mycobacterium
FRGPG

SEQ ID NO: 476338 - protein, 32 aa, Mycobacterium
FRGPGKPFAEEQPCSPERAPADQLAAFLGREV

SEQ ID NO: 476339 - protein, 32 aa, Mycobacterium
FRGPGKPFGQEQPCSAELSPADQLAAFLGRKV

SEQ ID NO: 476340 - protein, 9 aa, Mycobacterium
FRGSPQCAG

SEQ ID NO: 476341 - protein, 6 aa, Mycobacterium
FRGTDS

SEQ ID NO: 476342 - protein, 11 aa, Mycobacterium
FRGTGTSNAQN

SEQ ID NO: 476343 - protein, 4 aa, Mycobacterium
FRHP

SEQ ID NO: 476344 - protein, 18 aa, Mycobacterium
FRKDGTITAGSASQISDG

SEQ ID NO: 476345 - protein, 19 aa, Mycobacterium
FRKDGTITAGSASQISDGA

SEQ ID NO: 476346 - protein, 9 aa, Mycobacterium
FRKEQAEAL

SEQ ID NO: 476347 - protein, 8 aa, Mycobacterium
FRKETSVD

SEQ ID NO: 476348 - protein, 11 aa, Mycobacterium
FRKTGAQVPEG

SEQ ID NO: 476349 - protein, 8 aa, Mycobacterium
FRNDSNDA

SEQ ID NO: 476350 - protein, 9 aa, Mycobacterium
FRNDSNDAR

SEQ ID NO: 476351 - protein, 10 aa, Mycobacterium
FRNGALNPNA

SEQ ID NO: 476352 - protein, 6 aa, Mycobacterium
FRNGAT

SEQ ID NO: 476353 - protein, 6 aa, Mycobacterium
FRPAEP

SEQ ID NO: 476354 - protein, 5 aa, Mycobacterium
FRPAP

SEQ ID NO: 476355 - protein, 4 aa, Mycobacterium
FRPD

SEQ ID NO: 476356 - protein, 5 aa, Mycobacterium
FRPDE

SEQ ID NO: 476357 - protein, 17 aa, Mycobacterium
FRPDRGHAKSARSVAET

SEQ ID NO: 476358 - protein, 4 aa, Mycobacterium
FRPG

SEQ ID NO: 476359 - protein, 6 aa, Mycobacterium
FRPGDD

SEQ ID NO: 476360 - protein, 6 aa, Mycobacterium
FRPGDE

SEQ ID NO: 476361 - protein, 7 aa, Mycobacterium
FRPGELP

SEQ ID NO: 476362 - protein, 5 aa, Mycobacterium
FRPGG

SEQ ID NO: 476363 - protein, 6 aa, Mycobacterium
FRPGKA

SEQ ID NO: 476364 - protein, 16 aa, Mycobacterium
FRPGPDGFFEPLAQTT

SEQ ID NO: 476365 - protein, 5 aa, Mycobacterium
FRPGQ

SEQ ID NO: 476366 - protein, 6 aa, Mycobacterium
FRPGRA

SEQ ID NO: 476367 - protein, 9 aa, Mycobacterium
FRPGRRDGD

SEQ ID NO: 476368 - protein, 7 aa, Mycobacterium
FRPGRSC

SEQ ID NO: 476369 - protein, 8 aa, Mycobacterium
FRPGSSPA

SEQ ID NO: 476370 - protein, 7 aa, Mycobacterium
FRPNDQG

SEQ ID NO: 476371 - protein, 10 aa, Mycobacterium
FRPPGGGPSY

SEQ ID NO: 476372 - protein, 8 aa, Mycobacterium
FRPPGQHP

SEQ ID NO: 476373 - protein, 6 aa, Mycobacterium
FRPPQR

SEQ ID NO: 476374 - protein, 9 aa, Mycobacterium
FRPPRTSDT

SEQ ID NO: 476375 - protein, 4 aa, Mycobacterium
FRPT

SEQ ID NO: 476376 - protein, 7 aa, Mycobacterium
FRPTKTL

SEQ ID NO: 476377 - protein, 4 aa, Mycobacterium
FRQA

SEQ ID NO: 476378 - protein, 12 aa, Mycobacterium
FRQDGETLNTSR

SEQ ID NO: 476379 - protein, 4 aa, Mycobacterium
FRQE

SEQ ID NO: 476380 - protein, 10 aa, Mycobacterium
FRQRHEGDGF

SEQ ID NO: 476381 - protein, 18 aa, Mycobacterium
FRQRSDLDEFTDAEWAIN

SEQ ID NO: 476382 - protein, 19 aa, Mycobacterium
FRRDGTITAGSASQISDGA

SEQ ID NO: 476383 - protein, 6 aa, Mycobacterium
FRRDPD

SEQ ID NO: 476384 - protein, 9 aa, Mycobacterium
FRRNGRPHA

SEQ ID NO: 476385 - protein, 10 aa, Mycobacterium
FRRNREPSNN

SEQ ID NO: 476386 - protein, 4 aa, Mycobacterium
FRRP

SEQ ID NO: 476387 - protein, 7 aa, Mycobacterium
FRRPDEK

SEQ ID NO: 476388 - protein, 13 aa, Mycobacterium
FRSARGSDTSGAT

SEQ ID NO: 476389 - protein, 6 aa, Mycobacterium
FRSATD

SEQ ID NO: 476390 - protein, 4 aa, Mycobacterium
FRSD

SEQ ID NO: 476391 - protein, 7 aa, Mycobacterium
FRSDNND

SEQ ID NO: 476392 - protein, 6 aa, Mycobacterium
FRSEEH

SEQ ID NO: 476393 - protein, 6 aa, Mycobacterium
FRSEGA

SEQ ID NO: 476394 - protein, 7 aa, Mycobacterium
FRSENGE

SEQ ID NO: 476395 - protein, 5 aa, Mycobacterium
FRSPT

SEQ ID NO: 476396 - protein, 13 aa, Mycobacterium
FRSPTALPVTFDA

SEQ ID NO: 476397 - protein, 15 aa, Mycobacterium
FRSPTALPVTFEAVP

SEQ ID NO: 476398 - protein, 23 aa, Mycobacterium
FRSPTTPASATTRKPILTAALGG

SEQ ID NO: 476399 - protein, 13 aa, Mycobacterium
FRSTTTDADSKRG

SEQ ID NO: 476400 - protein, 14 aa, Mycobacterium
FRSVDERVKRLIAS

SEQ ID NO: 476401 - protein, 9 aa, Mycobacterium
FRTDSNDSR

SEQ ID NO: 476402 - protein, 4 aa, Mycobacterium
FRTE

SEQ ID NO: 476403 - protein, 4 aa, Mycobacterium
FRTG

SEQ ID NO: 476404 - protein, 11 aa, Mycobacterium
FRTGYRDTETL

SEQ ID NO: 476405 - protein, 9 aa, Mycobacterium
FRTNEEPPF

SEQ ID NO: 476406 - protein, 5 aa, Mycobacterium
FRTNT

SEQ ID NO: 476407 - protein, 6 aa, Mycobacterium
FRTPAG

SEQ ID NO: 476408 - protein, 16 aa, Mycobacterium
FRTPGADTSNATAAGL

SEQ ID NO: 476409 - protein, 11 aa, Mycobacterium
FRTSGEDIAAN

SEQ ID NO: 476410 - protein, 11 aa, Mycobacterium
FRVEPDPQQPG

SEQ ID NO: 476411 - protein, 9 aa, Mycobacterium
FRVPSDDEA

SEQ ID NO: 476412 - protein, 4 aa, Mycobacterium
FSAA

SEQ ID NO: 476413 - protein, 15 aa, Mycobacterium
FSAAENKRDVRASIV

SEQ ID NO: 476414 - protein, 12 aa, Mycobacterium
FSADGAAWDPAQ

SEQ ID NO: 476415 - protein, 20 aa, Mycobacterium
FSADPAALAATAEHAETPEF

SEQ ID NO: 476416 - protein, 11 aa, Mycobacterium
FSADSEPQTVA

SEQ ID NO: 476417 - protein, 11 aa, Mycobacterium
FSADSRGRFPG

SEQ ID NO: 476418 - protein, 4 aa, Mycobacterium
FSAE

SEQ ID NO: 476419 - protein, 5 aa, Mycobacterium
FSAGE

SEQ ID NO: 476420 - protein, 12 aa, Mycobacterium
FSAGGNVKEMAD

SEQ ID NO: 476421 - protein, 6 aa, Mycobacterium
FSAGLG

SEQ ID NO: 476422 - protein, 7 aa, Mycobacterium
FSAGPRR

SEQ ID NO: 476423 - protein, 12 aa, Mycobacterium
FSAGSSGAAVTA

SEQ ID NO: 476424 - protein, 5 aa, Mycobacterium
FSAGT

SEQ ID NO: 476425 - protein, 11 aa, Mycobacterium
FSAKGEARRDQ

SEQ ID NO: 476426 - protein, 12 aa, Mycobacterium
FSAPAAASETCS

SEQ ID NO: 476427 - protein, 10 aa, Mycobacterium
FSAPDDDDTE

SEQ ID NO: 476428 - protein, 15 aa, Mycobacterium
FSAPDDGGAQRRLTP

SEQ ID NO: 476429 - protein, 9 aa, Mycobacterium
FSAPDDGSE

SEQ ID NO: 476430 - protein, 8 aa, Mycobacterium
FSAPDRDD

SEQ ID NO: 476431 - protein, 39 aa, Mycobacterium
FSAPKQDTNPAGTAAQSTAVSQAAAAGTGAGTQSALSSV

SEQ ID NO: 476432 - protein, 10 aa, Mycobacterium
FSAPPTPFNG

SEQ ID NO: 476433 - protein, 10 aa, Mycobacterium
FSAQRAVETG

SEQ ID NO: 476434 - protein, 4 aa, Mycobacterium
FSAS

SEQ ID NO: 476435 - protein, 12 aa, Mycobacterium
FSASADGAGWGE

SEQ ID NO: 476436 - protein, 6 aa, Mycobacterium
FSASQG

SEQ ID NO: 476437 - protein, 7 aa, Mycobacterium
FSATAPN

SEQ ID NO: 476438 - protein, 9 aa, Mycobacterium
FSATDEDGI

SEQ ID NO: 476439 - protein, 35 aa, Mycobacterium
FSATGNYRAQDGNDGNDGNTGRYEHAGSSTVSECG

SEQ ID NO: 476440 - protein, 8 aa, Mycobacterium
FSATTPRS

SEQ ID NO: 476441 - protein, 8 aa, Mycobacterium
FSATTQDT

SEQ ID NO: 476442 - protein, 12 aa, Mycobacterium
FSDAGEPAGIGG

SEQ ID NO: 476443 - protein, 11 aa, Mycobacterium
FSDDAKALDPV

SEQ ID NO: 476444 - protein, 11 aa, Mycobacterium
FSDDEVAAAAN

SEQ ID NO: 476445 - protein, 9 aa, Mycobacterium
FSDEDKAKI

SEQ ID NO: 476446 - protein, 9 aa, Mycobacterium
FSDEEKERY

SEQ ID NO: 476447 - protein, 6 aa, Mycobacterium
FSDEQQ

SEQ ID NO: 476448 - protein, 9 aa, Mycobacterium
FSDETSLRG

SEQ ID NO: 476449 - protein, 18 aa, Mycobacterium
FSDGAGAHGMTATGESAV

SEQ ID NO: 476450 - protein, 12 aa, Mycobacterium
FSDGARDADQAV

SEQ ID NO: 476451 - protein, 6 aa, Mycobacterium
FSDGAT

SEQ ID NO: 476452 - protein, 6 aa, Mycobacterium
FSDGHP

SEQ ID NO: 476453 - protein, 5 aa, Mycobacterium
FSDGR

SEQ ID NO: 476454 - protein, 10 aa, Mycobacterium
FSDGRPPYEE

SEQ ID NO: 476455 - protein, 6 aa, Mycobacterium
FSDGSA

SEQ ID NO: 476456 - protein, 8 aa, Mycobacterium
FSDGSTGV

SEQ ID NO: 476457 - protein, 8 aa, Mycobacterium
FSDHPGSA

SEQ ID NO: 476458 - protein, 9 aa, Mycobacterium
FSDNEAVKT

SEQ ID NO: 476459 - protein, 4 aa, Mycobacterium
FSDP

SEQ ID NO: 476460 - protein, 12 aa, Mycobacterium
FSDPATGTGSGA

SEQ ID NO: 476461 - protein, 10 aa, Mycobacterium
FSDPDATYEE

SEQ ID NO: 476462 - protein, 8 aa, Mycobacterium
FSDPNYAA

SEQ ID NO: 476463 - protein, 7 aa, Mycobacterium
FSDPPSD

SEQ ID NO: 476464 - protein, 6 aa, Mycobacterium
FSDPRH

SEQ ID NO: 476465 - protein, 8 aa, Mycobacterium
FSDQPDYV

SEQ ID NO: 476466 - protein, 13 aa, Mycobacterium
FSDRPDNGSATSA

SEQ ID NO: 476467 - protein, 11 aa, Mycobacterium
FSDRPDYASSW

SEQ ID NO: 476468 - protein, 11 aa, Mycobacterium
FSDRPDYSSTW

SEQ ID NO: 476469 - protein, 14 aa, Mycobacterium
FSDRPNNDSAGATP

SEQ ID NO: 476470 - protein, 4 aa, Mycobacterium
FSDS

SEQ ID NO: 476471 - protein, 113 aa, Mycobacterium
FSDSAGTPVHAASTGGGSVPPPPLTPPPTVPAGESMGPASAHSTPTSLNSAPAAPVQPPAAGGPMGAASGMPVAPPPLGPPPTPPPAAPVAAPPPAAAPPPAQPNAAGGGAQV

SEQ ID NO: 476472 - protein, 7 aa, Mycobacterium
FSDSGHA

SEQ ID NO: 476473 - protein, 12 aa, Mycobacterium
FSDSPDYSSSWP

SEQ ID NO: 476474 - protein, 4 aa, Mycobacterium
FSEA

SEQ ID NO: 476475 - protein, 6 aa, Mycobacterium
FSEAES

SEQ ID NO: 476476 - protein, 11 aa, Mycobacterium
FSEAGIGPSRS

SEQ ID NO: 476477 - protein, 11 aa, Mycobacterium
FSEAGIGPSRT

SEQ ID NO: 476478 - protein, 11 aa, Mycobacterium
FSEAGVGPGRT

SEQ ID NO: 476479 - protein, 6 aa, Mycobacterium
FSEASR

SEQ ID NO: 476480 - protein, 5 aa, Mycobacterium
FSEDD

SEQ ID NO: 476481 - protein, 11 aa, Mycobacterium
FSEDPKALEPA

SEQ ID NO: 476482 - protein, 16 aa, Mycobacterium
FSEDPKALEPAARKVE

SEQ ID NO: 476483 - protein, 11 aa, Mycobacterium
FSEDPKALEPV

SEQ ID NO: 476484 - protein, 14 aa, Mycobacterium
FSEDSDFLVAILRR

SEQ ID NO: 476485 - protein, 4 aa, Mycobacterium
FSEE

SEQ ID NO: 476486 - protein, 9 aa, Mycobacterium
FSEEDARAR

SEQ ID NO: 476487 - protein, 6 aa, Mycobacterium
FSEEDL

SEQ ID NO: 476488 - protein, 4 aa, Mycobacterium
FSEG

SEQ ID NO: 476489 - protein, 7 aa, Mycobacterium
FSEGRTA

SEQ ID NO: 476490 - protein, 11 aa, Mycobacterium
FSEPESGSDLA

SEQ ID NO: 476491 - protein, 11 aa, Mycobacterium
FSEQPKYENAA

SEQ ID NO: 476492 - protein, 15 aa, Mycobacterium
FSEQPQYENAAEIGE

SEQ ID NO: 476493 - protein, 11 aa, Mycobacterium
FSEQPSYENAA

SEQ ID NO: 476494 - protein, 6 aa, Mycobacterium
FSEQRG

SEQ ID NO: 476495 - protein, 10 aa, Mycobacterium
FSESGDPLAA

SEQ ID NO: 476496 - protein, 10 aa, Mycobacterium
FSESSSPRTK

SEQ ID NO: 476497 - protein, 13 aa, Mycobacterium
FSETDRRPPSFDP

SEQ ID NO: 476498 - protein, 11 aa, Mycobacterium
FSGAASDMAEG

SEQ ID NO: 476499 - protein, 28 aa, Mycobacterium
FSGADGSPGGNGGKGGTGGAGGNGGAAG

SEQ ID NO: 476500 - protein, 8 aa, Mycobacterium
FSGADTVG

SEQ ID NO: 476501 - protein, 10 aa, Mycobacterium
FSGANDEQIE

SEQ ID NO: 476502 - protein, 7 aa, Mycobacterium
FSGAPAV

SEQ ID NO: 476503 - protein, 7 aa, Mycobacterium
FSGAPES

SEQ ID NO: 476504 - protein, 11 aa, Mycobacterium
FSGDDARAQAV

SEQ ID NO: 476505 - protein, 12 aa, Mycobacterium
FSGDDGPPQPAQ

SEQ ID NO: 476506 - protein, 9 aa, Mycobacterium
FSGDGIDTK

SEQ ID NO: 476507 - protein, 7 aa, Mycobacterium
FSGDGRV

SEQ ID NO: 476508 - protein, 7 aa, Mycobacterium
FSGDGTY

SEQ ID NO: 476509 - protein, 8 aa, Mycobacterium
FSGDTAKA

SEQ ID NO: 476510 - protein, 10 aa, Mycobacterium
FSGEDGATYE

SEQ ID NO: 476511 - protein, 8 aa, Mycobacterium
FSGEGTGS

SEQ ID NO: 476512 - protein, 25 aa, Mycobacterium
FSGEKREIPVGPDTTAAEQILAAIT

SEQ ID NO: 476513 - protein, 5 aa, Mycobacterium
FSGFS

SEQ ID NO: 476514 - protein, 4 aa, Mycobacterium
FSGG

SEQ ID NO: 476515 - protein, 8 aa, Mycobacterium
FSGGASPL

SEQ ID NO: 476516 - protein, 20 aa, Mycobacterium
FSGGATSRGPIGRVRPGSDS

SEQ ID NO: 476517 - protein, 20 aa, Mycobacterium
FSGGATSRGPVGRVRPGSDS

SEQ ID NO: 476518 - protein, 8 aa, Mycobacterium
FSGGGMPD

SEQ ID NO: 476519 - protein, 11 aa, Mycobacterium
FSGGGNVKEMA

SEQ ID NO: 476520 - protein, 5 aa, Mycobacterium
FSGGP

SEQ ID NO: 476521 - protein, 14 aa, Mycobacterium
FSGGPGATGRSYSD

SEQ ID NO: 476522 - protein, 28 aa, Mycobacterium
FSGGPKRAETAEPDLAGAGAAGAPTAGT

SEQ ID NO: 476523 - protein, 7 aa, Mycobacterium
FSGGPVG

SEQ ID NO: 476524 - protein, 9 aa, Mycobacterium
FSGGQKQRI

SEQ ID NO: 476525 - protein, 8 aa, Mycobacterium
FSGGQRQR

SEQ ID NO: 476526 - protein, 17 aa, Mycobacterium
FSGLGPNLGSGSPSAFA

SEQ ID NO: 476527 - protein, 5 aa, Mycobacterium
FSGPA

SEQ ID NO: 476528 - protein, 5 aa, Mycobacterium
FSGPE

SEQ ID NO: 476529 - protein, 13 aa, Mycobacterium
FSGPHGAESYAQA

SEQ ID NO: 476530 - protein, 14 aa, Mycobacterium
FSGPQTKEVAEREG

SEQ ID NO: 476531 - protein, 10 aa, Mycobacterium
FSGQALSDNG

SEQ ID NO: 476532 - protein, 10 aa, Mycobacterium
FSGQALSDRG

SEQ ID NO: 476533 - protein, 12 aa, Mycobacterium
FSGQEENTDPYL

SEQ ID NO: 476534 - protein, 5 aa, Mycobacterium
FSGQK

SEQ ID NO: 476535 - protein, 9 aa, Mycobacterium
FSGQTGSIE

SEQ ID NO: 476536 - protein, 23 aa, Mycobacterium
FSGQTRELAAGASLATDIAAVIS

SEQ ID NO: 476537 - protein, 11 aa, Mycobacterium
FSGRGRADIQA

SEQ ID NO: 476538 - protein, 6 aa, Mycobacterium
FSGRPH

SEQ ID NO: 476539 - protein, 9 aa, Mycobacterium
FSGRPSHRA

SEQ ID NO: 476540 - protein, 10 aa, Mycobacterium
FSGRSGRKRW

SEQ ID NO: 476541 - protein, 19 aa, Mycobacterium
FSGSARDKITAAGGSATEL

SEQ ID NO: 476542 - protein, 18 aa, Mycobacterium
FSGSAREAITAAGGSVTE

SEQ ID NO: 476543 - protein, 18 aa, Mycobacterium
FSGSAREKITAAGGSATE

SEQ ID NO: 476544 - protein, 19 aa, Mycobacterium
FSGSAREKITAAGGSATEL

SEQ ID NO: 476545 - protein, 18 aa, Mycobacterium
FSGSAREQITAAGGSVTE

SEQ ID NO: 476546 - protein, 5 aa, Mycobacterium
FSGSD

SEQ ID NO: 476547 - protein, 7 aa, Mycobacterium
FSGSSDA

SEQ ID NO: 476548 - protein, 11 aa, Mycobacterium
FSGSTLEVDDN

SEQ ID NO: 476549 - protein, 6 aa, Mycobacterium
FSGSTY

SEQ ID NO: 476550 - protein, 4 aa, Mycobacterium
FSGT

SEQ ID NO: 476551 - protein, 28 aa, Mycobacterium
FSGTGGAGGAGGAGQTVGGAGGTGGGAA

SEQ ID NO: 476552 - protein, 9 aa, Mycobacterium
FSGTSPDGQ

SEQ ID NO: 476553 - protein, 8 aa, Mycobacterium
FSHGEPTA

SEQ ID NO: 476554 - protein, 11 aa, Mycobacterium
FSIGPKERKLG

SEQ ID NO: 476555 - protein, 18 aa, Mycobacterium
FSKDGTITAGSSSPISDG

SEQ ID NO: 476556 - protein, 10 aa, Mycobacterium
FSKKDADAWP

SEQ ID NO: 476557 - protein, 11 aa, Mycobacterium
FSKSATHSLTE

SEQ ID NO: 476558 - protein, 11 aa, Mycobacterium
FSLDPDSPNVI

SEQ ID NO: 476559 - protein, 8 aa, Mycobacterium
FSLGGAAG

SEQ ID NO: 476560 - protein, 9 aa, Mycobacterium
FSLGGEQSG

SEQ ID NO: 476561 - protein, 8 aa, Mycobacterium
FSLGSSKR

SEQ ID NO: 476562 - protein, 29 aa, Mycobacterium
FSNAGSSNVGDSNAGGSNMGSGNAGYSNT

SEQ ID NO: 476563 - protein, 10 aa, Mycobacterium
FSNANPRIAP

SEQ ID NO: 476564 - protein, 8 aa, Mycobacterium
FSNNPFSS

SEQ ID NO: 476565 - protein, 17 aa, Mycobacterium
FSNPGQKATEDYISGRF

SEQ ID NO: 476566 - protein, 17 aa, Mycobacterium
FSNPNQKATEDYISGRF

SEQ ID NO: 476567 - protein, 7 aa, Mycobacterium
FSNPPDE

SEQ ID NO: 476568 - protein, 17 aa, Mycobacterium
FSNPRQKATEDYISGRF

SEQ ID NO: 476569 - protein, 17 aa, Mycobacterium
FSNPSQKATEDYISGRF

SEQ ID NO: 476570 - protein, 17 aa, Mycobacterium
FSNPSQKSTEDYISGRF

SEQ ID NO: 476571 - protein, 6 aa, Mycobacterium
FSNSRS

SEQ ID NO: 476572 - protein, 15 aa, Mycobacterium
FSNTGSSGNGADEEG

SEQ ID NO: 476573 - protein, 4 aa, Mycobacterium
FSPA

SEQ ID NO: 476574 - protein, 9 aa, Mycobacterium
FSPAESDQL

SEQ ID NO: 476575 - protein, 6 aa, Mycobacterium
FSPAGL

SEQ ID NO: 476576 - protein, 6 aa, Mycobacterium
FSPASR

SEQ ID NO: 476577 - protein, 5 aa, Mycobacterium
FSPDA

SEQ ID NO: 476578 - protein, 6 aa, Mycobacterium
FSPDDV

SEQ ID NO: 476579 - protein, 14 aa, Mycobacterium
FSPDGDAYATHGPE

SEQ ID NO: 476580 - protein, 15 aa, Mycobacterium
FSPDGPVAPRGERPR

SEQ ID NO: 476581 - protein, 8 aa, Mycobacterium
FSPDSDAR

SEQ ID NO: 476582 - protein, 7 aa, Mycobacterium
FSPDSGS

SEQ ID NO: 476583 - protein, 8 aa, Mycobacterium
FSPDSGST

SEQ ID NO: 476584 - protein, 10 aa, Mycobacterium
FSPEARDELD

SEQ ID NO: 476585 - protein, 5 aa, Mycobacterium
FSPEG

SEQ ID NO: 476586 - protein, 7 aa, Mycobacterium
FSPEPVD

SEQ ID NO: 476587 - protein, 6 aa, Mycobacterium
FSPERR

SEQ ID NO: 476588 - protein, 14 aa, Mycobacterium
FSPGDDPSTIGSNT

SEQ ID NO: 476589 - protein, 5 aa, Mycobacterium
FSPGE

SEQ ID NO: 476590 - protein, 10 aa, Mycobacterium
FSPGQNHQGD

SEQ ID NO: 476591 - protein, 7 aa, Mycobacterium
FSPGRRG

SEQ ID NO: 476592 - protein, 10 aa, Mycobacterium
FSPGSAERFR

SEQ ID NO: 476593 - protein, 6 aa, Mycobacterium
FSPGTA

SEQ ID NO: 476594 - protein, 16 aa, Mycobacterium
FSPGYPATAGTAGLRE

SEQ ID NO: 476595 - protein, 7 aa, Mycobacterium
FSPHRGP

SEQ ID NO: 476596 - protein, 7 aa, Mycobacterium
FSPKRRE

SEQ ID NO: 476597 - protein, 8 aa, Mycobacterium
FSPPGATQ

SEQ ID NO: 476598 - protein, 8 aa, Mycobacterium
FSPPPPMP

SEQ ID NO: 476599 - protein, 12 aa, Mycobacterium
FSPPSAAGHGGS

SEQ ID NO: 476600 - protein, 8 aa, Mycobacterium
FSPQDRTA

SEQ ID NO: 476601 - protein, 4 aa, Mycobacterium
FSPR

SEQ ID NO: 476602 - protein, 7 aa, Mycobacterium
FSPRATE

SEQ ID NO: 476603 - protein, 5 aa, Mycobacterium
FSPRI

SEQ ID NO: 476604 - protein, 10 aa, Mycobacterium
FSPRQDDYDR

SEQ ID NO: 476605 - protein, 8 aa, Mycobacterium
FSPSGEAS

SEQ ID NO: 476606 - protein, 8 aa, Mycobacterium
FSPSPSEG

SEQ ID NO: 476607 - protein, 7 aa, Mycobacterium
FSPSRAA

SEQ ID NO: 476608 - protein, 5 aa, Mycobacterium
FSPTD

SEQ ID NO: 476609 - protein, 13 aa, Mycobacterium
FSPTFEGSDDFGG

SEQ ID NO: 476610 - protein, 12 aa, Mycobacterium
FSPTRLQTDPAG

SEQ ID NO: 476611 - protein, 20 aa, Mycobacterium
FSPTTTAGDKARPGQRAEAA

SEQ ID NO: 476612 - protein, 4 aa, Mycobacterium
FSPV

SEQ ID NO: 476613 - protein, 14 aa, Mycobacterium
FSPVDGAPTTPIKS

SEQ ID NO: 476614 - protein, 5 aa, Mycobacterium
FSQGG

SEQ ID NO: 476615 - protein, 12 aa, Mycobacterium
FSQGGSENNYER

SEQ ID NO: 476616 - protein, 6 aa, Mycobacterium
FSQGRS

SEQ ID NO: 476617 - protein, 5 aa, Mycobacterium
FSQKG

SEQ ID NO: 476618 - protein, 9 aa, Mycobacterium
FSQNETAAA

SEQ ID NO: 476619 - protein, 7 aa, Mycobacterium
FSQPTGA

SEQ ID NO: 476620 - protein, 17 aa, Mycobacterium
FSQQNAPAQQQASGGGL

SEQ ID NO: 476621 - protein, 14 aa, Mycobacterium
FSQSADLAEQYPDK

SEQ ID NO: 476622 - protein, 8 aa, Mycobacterium
FSQSPKEL

SEQ ID NO: 476623 - protein, 13 aa, Mycobacterium
FSQTGGSSVPSTL

SEQ ID NO: 476624 - protein, 9 aa, Mycobacterium
FSRASGSRG

SEQ ID NO: 476625 - protein, 7 aa, Mycobacterium
FSRDGDD

SEQ ID NO: 476626 - protein, 4 aa, Mycobacterium
FSRE

SEQ ID NO: 476627 - protein, 14 aa, Mycobacterium
FSREDRARADAAYE

SEQ ID NO: 476628 - protein, 6 aa, Mycobacterium
FSREGL

SEQ ID NO: 476629 - protein, 4 aa, Mycobacterium
FSRG

SEQ ID NO: 476630 - protein, 22 aa, Mycobacterium
FSRGGGEGPPPRAGAGSGRGAW

SEQ ID NO: 476631 - protein, 7 aa, Mycobacterium
FSRGREL

SEQ ID NO: 476632 - protein, 8 aa, Mycobacterium
FSRGSAAR

SEQ ID NO: 476633 - protein, 4 aa, Mycobacterium
FSRP

SEQ ID NO: 476634 - protein, 14 aa, Mycobacterium
FSRPAPDHRAQRTM

SEQ ID NO: 476635 - protein, 8 aa, Mycobacterium
FSRPEPHY

SEQ ID NO: 476636 - protein, 12 aa, Mycobacterium
FSRPGARRSRED

SEQ ID NO: 476637 - protein, 9 aa, Mycobacterium
FSRPGTELT

SEQ ID NO: 476638 - protein, 6 aa, Mycobacterium
FSRPTT

SEQ ID NO: 476639 - protein, 9 aa, Mycobacterium
FSRQGEHRA

SEQ ID NO: 476640 - protein, 5 aa, Mycobacterium
FSRSG

SEQ ID NO: 476641 - protein, 22 aa, Mycobacterium
FSRSNAPAPPADPLSIGSSARN

SEQ ID NO: 476642 - protein, 22 aa, Mycobacterium
FSRSNAPAPPPDPLSIGSSARN

SEQ ID NO: 476643 - protein, 9 aa, Mycobacterium
FSRTPEDKE

SEQ ID NO: 476644 - protein, 17 aa, Mycobacterium
FSSAAGALGAAEAPAAA

SEQ ID NO: 476645 - protein, 5 aa, Mycobacterium
FSSAE

SEQ ID NO: 476646 - protein, 10 aa, Mycobacterium
FSSAPSKRDT

SEQ ID NO: 476647 - protein, 7 aa, Mycobacterium
FSSAQQG

SEQ ID NO: 476648 - protein, 5 aa, Mycobacterium
FSSAR

SEQ ID NO: 476649 - protein, 8 aa, Mycobacterium
FSSDADPE

SEQ ID NO: 476650 - protein, 6 aa, Mycobacterium
FSSDEL

SEQ ID NO: 476651 - protein, 8 aa, Mycobacterium
FSSDKGPD

SEQ ID NO: 476652 - protein, 4 aa, Mycobacterium
FSSE

SEQ ID NO: 476653 - protein, 6 aa, Mycobacterium
FSSEAA

SEQ ID NO: 476654 - protein, 10 aa, Mycobacterium
FSSEATAAVR

SEQ ID NO: 476655 - protein, 7 aa, Mycobacterium
FSSEHDM

SEQ ID NO: 476656 - protein, 11 aa, Mycobacterium
FSSGDPDGALA

SEQ ID NO: 476657 - protein, 5 aa, Mycobacterium
FSSGE

SEQ ID NO: 476658 - protein, 8 aa, Mycobacterium
FSSGGGSR

SEQ ID NO: 476659 - protein, 12 aa, Mycobacterium
FSSGNLGSGNTF

SEQ ID NO: 476660 - protein, 5 aa, Mycobacterium
FSSKE

SEQ ID NO: 476661 - protein, 10 aa, Mycobacterium
FSSKRRELAT

SEQ ID NO: 476662 - protein, 11 aa, Mycobacterium
FSSNADHAPEG

SEQ ID NO: 476663 - protein, 9 aa, Mycobacterium
FSSNSEGAC

SEQ ID NO: 476664 - protein, 6 aa, Mycobacterium
FSSPEG

SEQ ID NO: 476665 - protein, 33 aa, Mycobacterium
FSSPNQATSPAGLAAQSTAVTQANATAAATDPI

SEQ ID NO: 476666 - protein, 7 aa, Mycobacterium
FSSPPDC

SEQ ID NO: 476667 - protein, 16 aa, Mycobacterium
FSSPPQVANPSAVTTQ

SEQ ID NO: 476668 - protein, 9 aa, Mycobacterium
FSSPSTAGA

SEQ ID NO: 476669 - protein, 9 aa, Mycobacterium
FSSPSTGAH

SEQ ID NO: 476670 - protein, 11 aa, Mycobacterium
FSSPTAESKGW

SEQ ID NO: 476671 - protein, 4 aa, Mycobacterium
FSSS

SEQ ID NO: 476672 - protein, 16 aa, Mycobacterium
FSSSESDDDSSGTNTV

SEQ ID NO: 476673 - protein, 8 aa, Mycobacterium
FSSSRRPL

SEQ ID NO: 476674 - protein, 9 aa, Mycobacterium
FSSTNTPVT

SEQ ID NO: 476675 - protein, 9 aa, Mycobacterium
FSTAADSNA

SEQ ID NO: 476676 - protein, 9 aa, Mycobacterium
FSTAPSRGA

SEQ ID NO: 476677 - protein, 4 aa, Mycobacterium
FSTD

SEQ ID NO: 476678 - protein, 18 aa, Mycobacterium
FSTDEKSQRYRTENYSGA

SEQ ID NO: 476679 - protein, 5 aa, Mycobacterium
FSTDG

SEQ ID NO: 476680 - protein, 10 aa, Mycobacterium
FSTDSGPVSA

SEQ ID NO: 476681 - protein, 18 aa, Mycobacterium
FSTEEKSQRYATENYGGA

SEQ ID NO: 476682 - protein, 7 aa, Mycobacterium
FSTGDDR

SEQ ID NO: 476683 - protein, 9 aa, Mycobacterium
FSTGKDWSS

SEQ ID NO: 476684 - protein, 9 aa, Mycobacterium
FSTGLQNPD

SEQ ID NO: 476685 - protein, 11 aa, Mycobacterium
FSTGRGDPAWR

SEQ ID NO: 476686 - protein, 6 aa, Mycobacterium
FSTGST

SEQ ID NO: 476687 - protein, 11 aa, Mycobacterium
FSTGTAPLGDH

SEQ ID NO: 476688 - protein, 15 aa, Mycobacterium
FSTGTERLRDAGGRV

SEQ ID NO: 476689 - protein, 4 aa, Mycobacterium
FSTP

SEQ ID NO: 476690 - protein, 9 aa, Mycobacterium
FSTPASGTW

SEQ ID NO: 476691 - protein, 19 aa, Mycobacterium
FSTPEKAGRYRTENYQGAT

SEQ ID NO: 476692 - protein, 17 aa, Mycobacterium
FSTPEKAQRYQTESYRG

SEQ ID NO: 476693 - protein, 16 aa, Mycobacterium
FSTPEPRYRAQRTVEE

SEQ ID NO: 476694 - protein, 7 aa, Mycobacterium
FSTPGTG

SEQ ID NO: 476695 - protein, 9 aa, Mycobacterium
FSTPTAESE

SEQ ID NO: 476696 - protein, 7 aa, Mycobacterium
FSTRDGQ

SEQ ID NO: 476697 - protein, 7 aa, Mycobacterium
FSTREGE

SEQ ID NO: 476698 - protein, 17 aa, Mycobacterium
FSTSAPTKPSAGGTVPD

SEQ ID NO: 476699 - protein, 12 aa, Mycobacterium
FSTSNDDAAQFD

SEQ ID NO: 476700 - protein, 32 aa, Mycobacterium
FSTSNNDAAQFDPDTVKADGKTCRFNPWPYPI

SEQ ID NO: 476701 - protein, 5 aa, Mycobacterium
FSTSP

SEQ ID NO: 476702 - protein, 6 aa, Mycobacterium
FSTSPL

SEQ ID NO: 476703 - protein, 6 aa, Mycobacterium
FSTTDL

SEQ ID NO: 476704 - protein, 12 aa, Mycobacterium
FSTTTLGEANPE

SEQ ID NO: 476705 - protein, 13 aa, Mycobacterium
FSYEKPDGQAVTD

SEQ ID NO: 476706 - protein, 4 aa, Mycobacterium
FSYQ

SEQ ID NO: 476707 - protein, 9 aa, Mycobacterium
FTAAGDSEF

SEQ ID NO: 476708 - protein, 5 aa, Mycobacterium
FTADD

SEQ ID NO: 476709 - protein, 6 aa, Mycobacterium
FTADGA

SEQ ID NO: 476710 - protein, 7 aa, Mycobacterium
FTADGTI

SEQ ID NO: 476711 - protein, 11 aa, Mycobacterium
FTADPNGPLAG

SEQ ID NO: 476712 - protein, 12 aa, Mycobacterium
FTADPSSGIAEH

SEQ ID NO: 476713 - protein, 15 aa, Mycobacterium
FTADSDAWDPSALNS

SEQ ID NO: 476714 - protein, 7 aa, Mycobacterium
FTAEGPN

SEQ ID NO: 476715 - protein, 16 aa, Mycobacterium
FTAGEPSDEEDARPRQ

SEQ ID NO: 476716 - protein, 16 aa, Mycobacterium
FTAGGEAADEDEALPR

SEQ ID NO: 476717 - protein, 31 aa, Mycobacterium
FTAGKVGNNESDHVGSSQVQAAQQDDVGAKA

SEQ ID NO: 476718 - protein, 10 aa, Mycobacterium
FTAKGRATRE

SEQ ID NO: 476719 - protein, 6 aa, Mycobacterium
FTAKTR

SEQ ID NO: 476720 - protein, 13 aa, Mycobacterium
FTANDSPSTRHTA

SEQ ID NO: 476721 - protein, 5 aa, Mycobacterium
FTAPG

SEQ ID NO: 476722 - protein, 29 aa, Mycobacterium
FTAPGRPPVPGAAPRAKSSRTAVGKPGWP

SEQ ID NO: 476723 - protein, 8 aa, Mycobacterium
FTAPNHPY

SEQ ID NO: 476724 - protein, 7 aa, Mycobacterium
FTAPPKE

SEQ ID NO: 476725 - protein, 21 aa, Mycobacterium
FTARPGQSTIKASAMSATGAP

SEQ ID NO: 476726 - protein, 11 aa, Mycobacterium
FTARPSAKTSI

SEQ ID NO: 476727 - protein, 4 aa, Mycobacterium
FTAS

SEQ ID NO: 476728 - protein, 4 aa, Mycobacterium
FTAT

SEQ ID NO: 476729 - protein, 11 aa, Mycobacterium
FTATGSTTPPV

SEQ ID NO: 476730 - protein, 17 aa, Mycobacterium
FTATPEIPQPDELARNG

SEQ ID NO: 476731 - protein, 7 aa, Mycobacterium
FTATTPN

SEQ ID NO: 476732 - protein, 4 aa, Mycobacterium
FTDD

SEQ ID NO: 476733 - protein, 18 aa, Mycobacterium
FTDDDDAIRQANDTKYGL

SEQ ID NO: 476734 - protein, 17 aa, Mycobacterium
FTDDDDALRQANDTAYG

SEQ ID NO: 476735 - protein, 17 aa, Mycobacterium
FTDDDDALRQANDTEYG

SEQ ID NO: 476736 - protein, 5 aa, Mycobacterium
FTDDE

SEQ ID NO: 476737 - protein, 8 aa, Mycobacterium
FTDDPLPD

SEQ ID NO: 476738 - protein, 14 aa, Mycobacterium
FTDDSDFLVAILRP

SEQ ID NO: 476739 - protein, 9 aa, Mycobacterium
FTDEDEAIG

SEQ ID NO: 476740 - protein, 19 aa, Mycobacterium
FTDEGAETYVTSRSRTDLE

SEQ ID NO: 476741 - protein, 10 aa, Mycobacterium
FTDEQKARNV

SEQ ID NO: 476742 - protein, 7 aa, Mycobacterium
FTDGEPH

SEQ ID NO: 476743 - protein, 10 aa, Mycobacterium
FTDGGKAAGS

SEQ ID NO: 476744 - protein, 8 aa, Mycobacterium
FTDGGNLV

SEQ ID NO: 476745 - protein, 8 aa, Mycobacterium
FTDGGSRH

SEQ ID NO: 476746 - protein, 7 aa, Mycobacterium
FTDGSGV

SEQ ID NO: 476747 - protein, 5 aa, Mycobacterium
FTDGV

SEQ ID NO: 476748 - protein, 4 aa, Mycobacterium
FTDK

SEQ ID NO: 476749 - protein, 9 aa, Mycobacterium
FTDPAESRT

SEQ ID NO: 476750 - protein, 8 aa, Mycobacterium
FTDPAGER

SEQ ID NO: 476751 - protein, 17 aa, Mycobacterium
FTDPASSRATLEGMKDG

SEQ ID NO: 476752 - protein, 5 aa, Mycobacterium
FTDPD

SEQ ID NO: 476753 - protein, 7 aa, Mycobacterium
FTDPGER

SEQ ID NO: 476754 - protein, 7 aa, Mycobacterium
FTDPGRR

SEQ ID NO: 476755 - protein, 4 aa, Mycobacterium
FTDR

SEQ ID NO: 476756 - protein, 8 aa, Mycobacterium
FTDREQPM

SEQ ID NO: 476757 - protein, 7 aa, Mycobacterium
FTDRPVP

SEQ ID NO: 476758 - protein, 8 aa, Mycobacterium
FTDSDRLE

SEQ ID NO: 476759 - protein, 10 aa, Mycobacterium
FTDSGEPAGI

SEQ ID NO: 476760 - protein, 13 aa, Mycobacterium
FTDSPAPTPPTLG

SEQ ID NO: 476761 - protein, 6 aa, Mycobacterium
FTDTAG

SEQ ID NO: 476762 - protein, 8 aa, Mycobacterium
FTDTAGER

SEQ ID NO: 476763 - protein, 12 aa, Mycobacterium
FTDTGAPAGIGG

SEQ ID NO: 476764 - protein, 8 aa, Mycobacterium
FTDTKPSA

SEQ ID NO: 476765 - protein, 6 aa, Mycobacterium
FTDVGR

SEQ ID NO: 476766 - protein, 12 aa, Mycobacterium
FTEAAGSAQRSF

SEQ ID NO: 476767 - protein, 6 aa, Mycobacterium
FTEAND

SEQ ID NO: 476768 - protein, 13 aa, Mycobacterium
FTEDGTALGSTHR

SEQ ID NO: 476769 - protein, 6 aa, Mycobacterium
FTEEGR

SEQ ID NO: 476770 - protein, 5 aa, Mycobacterium
FTEEQ

SEQ ID NO: 476771 - protein, 9 aa, Mycobacterium
FTEESPEAY

SEQ ID NO: 476772 - protein, 9 aa, Mycobacterium
FTEGAGTGI

SEQ ID NO: 476773 - protein, 19 aa, Mycobacterium
FTEGHDGGIRYPTDDPRRI

SEQ ID NO: 476774 - protein, 5 aa, Mycobacterium
FTEGR

SEQ ID NO: 476775 - protein, 8 aa, Mycobacterium
FTEGRSSR

SEQ ID NO: 476776 - protein, 5 aa, Mycobacterium
FTEGV

SEQ ID NO: 476777 - protein, 4 aa, Mycobacterium
FTEK

SEQ ID NO: 476778 - protein, 9 aa, Mycobacterium
FTENAGTGI

SEQ ID NO: 476779 - protein, 9 aa, Mycobacterium
FTENASTKV

SEQ ID NO: 476780 - protein, 9 aa, Mycobacterium
FTENASTNV

SEQ ID NO: 476781 - protein, 7 aa, Mycobacterium
FTEPAAA

SEQ ID NO: 476782 - protein, 13 aa, Mycobacterium
FTEPATSARTGSG

SEQ ID NO: 476783 - protein, 5 aa, Mycobacterium
FTEPP

SEQ ID NO: 476784 - protein, 11 aa, Mycobacterium
FTEPPEQRPYG

SEQ ID NO: 476785 - protein, 15 aa, Mycobacterium
FTEPPQTTNETGIAA

SEQ ID NO: 476786 - protein, 10 aa, Mycobacterium
FTEPRNEHKR

SEQ ID NO: 476787 - protein, 8 aa, Mycobacterium
FTERDTRD

SEQ ID NO: 476788 - protein, 14 aa, Mycobacterium
FTESATRNATDSVD

SEQ ID NO: 476789 - protein, 13 aa, Mycobacterium
FTESAVSSRSASG

SEQ ID NO: 476790 - protein, 4 aa, Mycobacterium
FTET

SEQ ID NO: 476791 - protein, 6 aa, Mycobacterium
FTGAAG

SEQ ID NO: 476792 - protein, 6 aa, Mycobacterium
FTGAGG

SEQ ID NO: 476793 - protein, 8 aa, Mycobacterium
FTGARTQN

SEQ ID NO: 476794 - protein, 13 aa, Mycobacterium
FTGATPATPPTLG

SEQ ID NO: 476795 - protein, 8 aa, Mycobacterium
FTGDAARM

SEQ ID NO: 476796 - protein, 7 aa, Mycobacterium
FTGDATQ

SEQ ID NO: 476797 - protein, 9 aa, Mycobacterium
FTGDEDPVP

SEQ ID NO: 476798 - protein, 8 aa, Mycobacterium
FTGDPALR

SEQ ID NO: 476799 - protein, 8 aa, Mycobacterium
FTGDPELK

SEQ ID NO: 476800 - protein, 14 aa, Mycobacterium
FTGDSNRKAPTAPR

SEQ ID NO: 476801 - protein, 8 aa, Mycobacterium
FTGEAAEM

SEQ ID NO: 476802 - protein, 9 aa, Mycobacterium
FTGEAAQMR

SEQ ID NO: 476803 - protein, 5 aa, Mycobacterium
FTGEG

SEQ ID NO: 476804 - protein, 8 aa, Mycobacterium
FTGEGAKM

SEQ ID NO: 476805 - protein, 5 aa, Mycobacterium
FTGEH

SEQ ID NO: 476806 - protein, 8 aa, Mycobacterium
FTGETQPI

SEQ ID NO: 476807 - protein, 22 aa, Mycobacterium
FTGETREIAADGAAAEISSVLA

SEQ ID NO: 476808 - protein, 9 aa, Mycobacterium
FTGETSTGR

SEQ ID NO: 476809 - protein, 4 aa, Mycobacterium
FTGG

SEQ ID NO: 476810 - protein, 17 aa, Mycobacterium
FTGGAAPLTDTDGHGTH

SEQ ID NO: 476811 - protein, 4 aa, Mycobacterium
FTGK

SEQ ID NO: 476812 - protein, 7 aa, Mycobacterium
FTGNAPR

SEQ ID NO: 476813 - protein, 13 aa, Mycobacterium
FTGNPGPTPPTLG

SEQ ID NO: 476814 - protein, 8 aa, Mycobacterium
FTGPGDSV

SEQ ID NO: 476815 - protein, 5 aa, Mycobacterium
FTGPN

SEQ ID NO: 476816 - protein, 8 aa, Mycobacterium
FTGPPDAP

SEQ ID NO: 476817 - protein, 10 aa, Mycobacterium
FTGPRAPERP

SEQ ID NO: 476818 - protein, 8 aa, Mycobacterium
FTGPSISA

SEQ ID NO: 476819 - protein, 6 aa, Mycobacterium
FTGPTS

SEQ ID NO: 476820 - protein, 12 aa, Mycobacterium
FTGRGRTEEPGE

SEQ ID NO: 476821 - protein, 13 aa, Mycobacterium
FTGRPAPTPPTLG

SEQ ID NO: 476822 - protein, 10 aa, Mycobacterium
FTGRRYDSQG

SEQ ID NO: 476823 - protein, 8 aa, Mycobacterium
FTGSDKGY

SEQ ID NO: 476824 - protein, 10 aa, Mycobacterium
FTGSERAGAA

SEQ ID NO: 476825 - protein, 9 aa, Mycobacterium
FTGSSAVGR

SEQ ID NO: 476826 - protein, 10 aa, Mycobacterium
FTGSSGVGKE

SEQ ID NO: 476827 - protein, 5 aa, Mycobacterium
FTGST

SEQ ID NO: 476828 - protein, 9 aa, Mycobacterium
FTGSTATGI

SEQ ID NO: 476829 - protein, 7 aa, Mycobacterium
FTGSTAV

SEQ ID NO: 476830 - protein, 8 aa, Mycobacterium
FTGSTAVG

SEQ ID NO: 476831 - protein, 6 aa, Mycobacterium
FTGSTE

SEQ ID NO: 476832 - protein, 7 aa, Mycobacterium
FTGSTEV

SEQ ID NO: 476833 - protein, 6 aa, Mycobacterium
FTGSTG

SEQ ID NO: 476834 - protein, 6 aa, Mycobacterium
FTGSTK

SEQ ID NO: 476835 - protein, 9 aa, Mycobacterium
FTGSTNAGR

SEQ ID NO: 476836 - protein, 4 aa, Mycobacterium
FTGT

SEQ ID NO: 476837 - protein, 10 aa, Mycobacterium
FTGTPHGSLR

SEQ ID NO: 476838 - protein, 12 aa, Mycobacterium
FTGTQRQQQTFQ

SEQ ID NO: 476839 - protein, 27 aa, Mycobacterium
FTGTRKPPAEPDLAKAGAHAAPQGPDP

SEQ ID NO: 476840 - protein, 8 aa, Mycobacterium
FTGTTTAA

SEQ ID NO: 476841 - protein, 5 aa, Mycobacterium
FTGYT

SEQ ID NO: 476842 - protein, 6 aa, Mycobacterium
FTHEGE

SEQ ID NO: 476843 - protein, 12 aa, Mycobacterium
FTHERRGGRLVP

SEQ ID NO: 476844 - protein, 5 aa, Mycobacterium
FTHGD

SEQ ID NO: 476845 - protein, 10 aa, Mycobacterium
FTISSDGEGG

SEQ ID NO: 476846 - protein, 10 aa, Mycobacterium
FTKDGRARSI

SEQ ID NO: 476847 - protein, 10 aa, Mycobacterium
FTKDNPGAGV

SEQ ID NO: 476848 - protein, 10 aa, Mycobacterium
FTKTPDSYGD

SEQ ID NO: 476849 - protein, 9 aa, Mycobacterium
FTKTTSAGV

SEQ ID NO: 476850 - protein, 9 aa, Mycobacterium
FTKTTSKGV

SEQ ID NO: 476851 - protein, 18 aa, Mycobacterium
FTKTTSKGVETIGGAKRG

SEQ ID NO: 476852 - protein, 18 aa, Mycobacterium
FTKTTSKGVETIGGARRG

SEQ ID NO: 476853 - protein, 18 aa, Mycobacterium
FTKTTSRGVETIGGAKRG

SEQ ID NO: 476854 - protein, 4 aa, Mycobacterium
FTNP

SEQ ID NO: 476855 - protein, 9 aa, Mycobacterium
FTNPDKPYF

SEQ ID NO: 476856 - protein, 21 aa, Mycobacterium
FTNSPMQDGEHTNGVSVDSAG

SEQ ID NO: 476857 - protein, 21 aa, Mycobacterium
FTNSPRPVLTTAEGDAQHASM

SEQ ID NO: 476858 - protein, 9 aa, Mycobacterium
FTPAAPPRF

SEQ ID NO: 476859 - protein, 18 aa, Mycobacterium
FTPADPDEFTARLDELLK

SEQ ID NO: 476860 - protein, 8 aa, Mycobacterium
FTPAERDT

SEQ ID NO: 476861 - protein, 16 aa, Mycobacterium
FTPAGAGPAVDGRPVD

SEQ ID NO: 476862 - protein, 31 aa, Mycobacterium
FTPAPNVTNDSGVAQQAAAVGKATSETEQAN

SEQ ID NO: 476863 - protein, 14 aa, Mycobacterium
FTPAQAAYGATAAG

SEQ ID NO: 476864 - protein, 5 aa, Mycobacterium
FTPAR

SEQ ID NO: 476865 - protein, 5 aa, Mycobacterium
FTPAT

SEQ ID NO: 476866 - protein, 15 aa, Mycobacterium
FTPATDNPTRQAVNS

SEQ ID NO: 476867 - protein, 10 aa, Mycobacterium
FTPDPNDDQV

SEQ ID NO: 476868 - protein, 10 aa, Mycobacterium
FTPDPSGQPS

SEQ ID NO: 476869 - protein, 5 aa, Mycobacterium
FTPDQ

SEQ ID NO: 476870 - protein, 9 aa, Mycobacterium
FTPDRTSAP

SEQ ID NO: 476871 - protein, 7 aa, Mycobacterium
FTPDSGA

SEQ ID NO: 476872 - protein, 12 aa, Mycobacterium
FTPEATAEADDN

SEQ ID NO: 476873 - protein, 13 aa, Mycobacterium
FTPEATKEADGNL

SEQ ID NO: 476874 - protein, 9 aa, Mycobacterium
FTPEDLPGY

SEQ ID NO: 476875 - protein, 10 aa, Mycobacterium
FTPEDQKALA

SEQ ID NO: 476876 - protein, 10 aa, Mycobacterium
FTPEGDDISA

SEQ ID NO: 476877 - protein, 12 aa, Mycobacterium
FTPEGDDISEQI

SEQ ID NO: 476878 - protein, 11 aa, Mycobacterium
FTPEGDDITDQ

SEQ ID NO: 476879 - protein, 12 aa, Mycobacterium
FTPEGDDITGQI

SEQ ID NO: 476880 - protein, 8 aa, Mycobacterium
FTPEQAAD

SEQ ID NO: 476881 - protein, 11 aa, Mycobacterium
FTPESGDRTRV

SEQ ID NO: 476882 - protein, 15 aa, Mycobacterium
FTPESTQAQTGVDPG

SEQ ID NO: 476883 - protein, 4 aa, Mycobacterium
FTPF

SEQ ID NO: 476884 - protein, 7 aa, Mycobacterium
FTPGAQR

SEQ ID NO: 476885 - protein, 11 aa, Mycobacterium
FTPGDRAAARA

SEQ ID NO: 476886 - protein, 5 aa, Mycobacterium
FTPGE

SEQ ID NO: 476887 - protein, 18 aa, Mycobacterium
FTPGERRDAASKTGGEAR

SEQ ID NO: 476888 - protein, 9 aa, Mycobacterium
FTPGPGDAI

SEQ ID NO: 476889 - protein, 7 aa, Mycobacterium
FTPGPGT

SEQ ID NO: 476890 - protein, 6 aa, Mycobacterium
FTPGPR

SEQ ID NO: 476891 - protein, 12 aa, Mycobacterium
FTPGPRRGAGVA

SEQ ID NO: 476892 - protein, 12 aa, Mycobacterium
FTPGPSRDTSRP

SEQ ID NO: 476893 - protein, 6 aa, Mycobacterium
FTPGQR

SEQ ID NO: 476894 - protein, 9 aa, Mycobacterium
FTPGQTSKT

SEQ ID NO: 476895 - protein, 15 aa, Mycobacterium
FTPGRGDATQEETDV

SEQ ID NO: 476896 - protein, 13 aa, Mycobacterium
FTPGRRLGPGIDE

SEQ ID NO: 476897 - protein, 7 aa, Mycobacterium
FTPGSAD

SEQ ID NO: 476898 - protein, 8 aa, Mycobacterium
FTPGSDLA

SEQ ID NO: 476899 - protein, 10 aa, Mycobacterium
FTPGSQQGAD

SEQ ID NO: 476900 - protein, 4 aa, Mycobacterium
FTPK

SEQ ID NO: 476901 - protein, 13 aa, Mycobacterium
FTPKDGGRITVRR

SEQ ID NO: 476902 - protein, 10 aa, Mycobacterium
FTPNPAGAYS

SEQ ID NO: 476903 - protein, 13 aa, Mycobacterium
FTPPAEDDPQRRC

SEQ ID NO: 476904 - protein, 9 aa, Mycobacterium
FTPPDEQPS

SEQ ID NO: 476905 - protein, 38 aa, Mycobacterium
FTPPEVAASTPDGPTEALGEAQAAVESPSEEPAPTPTL

SEQ ID NO: 476906 - protein, 9 aa, Mycobacterium
FTPPGPPRF

SEQ ID NO: 476907 - protein, 35 aa, Mycobacterium
FTPPPETANPAASALQSNATSTAAATAAGAAQSTL

SEQ ID NO: 476908 - protein, 14 aa, Mycobacterium
FTPPPKVTNPYPAS

SEQ ID NO: 476909 - protein, 5 aa, Mycobacterium
FTPPR

SEQ ID NO: 476910 - protein, 10 aa, Mycobacterium
FTPPSGPGVR

SEQ ID NO: 476911 - protein, 4 aa, Mycobacterium
FTPQ

SEQ ID NO: 476912 - protein, 7 aa, Mycobacterium
FTPQPEQ

SEQ ID NO: 476913 - protein, 6 aa, Mycobacterium
FTPQPT

SEQ ID NO: 476914 - protein, 5 aa, Mycobacterium
FTPRA

SEQ ID NO: 476915 - protein, 11 aa, Mycobacterium
FTPRASARMED

SEQ ID NO: 476916 - protein, 7 aa, Mycobacterium
FTPRATA

SEQ ID NO: 476917 - protein, 9 aa, Mycobacterium
FTPRATSRL

SEQ ID NO: 476918 - protein, 5 aa, Mycobacterium
FTPRN

SEQ ID NO: 476919 - protein, 8 aa, Mycobacterium
FTPRPVPS

SEQ ID NO: 476920 - protein, 9 aa, Mycobacterium
FTPRPVPTV

SEQ ID NO: 476921 - protein, 5 aa, Mycobacterium
FTPRR

SEQ ID NO: 476922 - protein, 15 aa, Mycobacterium
FTPRRASGHRSGRRR

SEQ ID NO: 476923 - protein, 9 aa, Mycobacterium
FTPSDGGTH

SEQ ID NO: 476924 - protein, 6 aa, Mycobacterium
FTPSEH

SEQ ID NO: 476925 - protein, 28 aa, Mycobacterium
FTPSGSQEAGDPTAVGAAGSSGGPGGFR

SEQ ID NO: 476926 - protein, 12 aa, Mycobacterium
FTPSGTDGYPQR

SEQ ID NO: 476927 - protein, 5 aa, Mycobacterium
FTPSW

SEQ ID NO: 476928 - protein, 8 aa, Mycobacterium
FTPSWGEP

SEQ ID NO: 476929 - protein, 23 aa, Mycobacterium
FTPTTPSPKPRELPTSDNLASEL

SEQ ID NO: 476930 - protein, 8 aa, Mycobacterium
FTPTTRAR

SEQ ID NO: 476931 - protein, 9 aa, Mycobacterium
FTQDGGPQS

SEQ ID NO: 476932 - protein, 8 aa, Mycobacterium
FTQEGGPQ

SEQ ID NO: 476933 - protein, 8 aa, Mycobacterium
FTQPDGPV

SEQ ID NO: 476934 - protein, 5 aa, Mycobacterium
FTQPG

SEQ ID NO: 476935 - protein, 8 aa, Mycobacterium
FTQPGGPQ

SEQ ID NO: 476936 - protein, 11 aa, Mycobacterium
FTQQERAARGL

SEQ ID NO: 476937 - protein, 6 aa, Mycobacterium
FTQSKR

SEQ ID NO: 476938 - protein, 7 aa, Mycobacterium
FTQSPEQ

SEQ ID NO: 476939 - protein, 7 aa, Mycobacterium
FTQSPKD

SEQ ID NO: 476940 - protein, 4 aa, Mycobacterium
FTQT

SEQ ID NO: 476941 - protein, 8 aa, Mycobacterium
FTRAEPTP

SEQ ID NO: 476942 - protein, 21 aa, Mycobacterium
FTRAEQDEYAAQSHQKAAAAW

SEQ ID NO: 476943 - protein, 10 aa, Mycobacterium
FTRAKDDEVY

SEQ ID NO: 476944 - protein, 6 aa, Mycobacterium
FTRGPV

SEQ ID NO: 476945 - protein, 10 aa, Mycobacterium
FTRGQQDSRF

SEQ ID NO: 476946 - protein, 16 aa, Mycobacterium
FTRGSYGGRLSAGALT

SEQ ID NO: 476947 - protein, 4 aa, Mycobacterium
FTRP

SEQ ID NO: 476948 - protein, 20 aa, Mycobacterium
FTRPPPIHDSGGAPTLGPAP

SEQ ID NO: 476949 - protein, 4 aa, Mycobacterium
FTRR

SEQ ID NO: 476950 - protein, 5 aa, Mycobacterium
FTRRT

SEQ ID NO: 476951 - protein, 7 aa, Mycobacterium
FTRSATG

SEQ ID NO: 476952 - protein, 5 aa, Mycobacterium
FTRSN

SEQ ID NO: 476953 - protein, 15 aa, Mycobacterium
FTRTGAGGVAQVDTE

SEQ ID NO: 476954 - protein, 11 aa, Mycobacterium
FTSDATDSEQW

SEQ ID NO: 476955 - protein, 11 aa, Mycobacterium
FTSDTSREEVG

SEQ ID NO: 476956 - protein, 8 aa, Mycobacterium
FTSEESRK

SEQ ID NO: 476957 - protein, 5 aa, Mycobacterium
FTSEG

SEQ ID NO: 476958 - protein, 6 aa, Mycobacterium
FTSEGL

SEQ ID NO: 476959 - protein, 9 aa, Mycobacterium
FTSERTDEA

SEQ ID NO: 476960 - protein, 32 aa, Mycobacterium
FTSGAAKWQGDAECHSGELPGPNVAASPVRYG

SEQ ID NO: 476961 - protein, 8 aa, Mycobacterium
FTSGSTVS

SEQ ID NO: 476962 - protein, 13 aa, Mycobacterium
FTSSNTVHGGQET

SEQ ID NO: 476963 - protein, 5 aa, Mycobacterium
FTSTS

SEQ ID NO: 476964 - protein, 25 aa, Mycobacterium
FTSTTTAESDDDSAADSRSPDQRPI

SEQ ID NO: 476965 - protein, 10 aa, Mycobacterium
FTTADGPVSG

SEQ ID NO: 476966 - protein, 12 aa, Mycobacterium
FTTARRRGSAAH

SEQ ID NO: 476967 - protein, 4 aa, Mycobacterium
FTTD

SEQ ID NO: 476968 - protein, 10 aa, Mycobacterium
FTTDARPEQM

SEQ ID NO: 476969 - protein, 12 aa, Mycobacterium
FTTDPSHAPEGA

SEQ ID NO: 476970 - protein, 9 aa, Mycobacterium
FTTENSHGI

SEQ ID NO: 476971 - protein, 9 aa, Mycobacterium
FTTETAAQK

SEQ ID NO: 476972 - protein, 11 aa, Mycobacterium
FTTGDACGSVT

SEQ ID NO: 476973 - protein, 6 aa, Mycobacterium
FTTGTG

SEQ ID NO: 476974 - protein, 5 aa, Mycobacterium
FTTPD

SEQ ID NO: 476975 - protein, 8 aa, Mycobacterium
FTTPDGGQ

SEQ ID NO: 476976 - protein, 8 aa, Mycobacterium
FTTPDGTR

SEQ ID NO: 476977 - protein, 8 aa, Mycobacterium
FTTPDPSY

SEQ ID NO: 476978 - protein, 9 aa, Mycobacterium
FTTPEHGAA

SEQ ID NO: 476979 - protein, 6 aa, Mycobacterium
FTTPGY

SEQ ID NO: 476980 - protein, 13 aa, Mycobacterium
FTTPRGRMLRRGG

SEQ ID NO: 476981 - protein, 18 aa, Mycobacterium
FTTPTGTSYRSGAPPRVQ

SEQ ID NO: 476982 - protein, 11 aa, Mycobacterium
FTTRGKDRDDA

SEQ ID NO: 476983 - protein, 10 aa, Mycobacterium
FTTRSTKESG

SEQ ID NO: 476984 - protein, 12 aa, Mycobacterium
FTTRSTKKSGNI

SEQ ID NO: 476985 - protein, 11 aa, Mycobacterium
FTTRSTKPGGN

SEQ ID NO: 476986 - protein, 5 aa, Mycobacterium
FTTSD

SEQ ID NO: 476987 - protein, 19 aa, Mycobacterium
FTTSEHSPKGARTGFPRTR

SEQ ID NO: 476988 - protein, 11 aa, Mycobacterium
FTTSPAARSGP

SEQ ID NO: 476989 - protein, 14 aa, Mycobacterium
FTTSPTDSRSSEYC

SEQ ID NO: 476990 - protein, 11 aa, Mycobacterium
FTTSQPGGENI

SEQ ID NO: 476991 - protein, 11 aa, Mycobacterium
FTTTQSPDGEI

SEQ ID NO: 476992 - protein, 12 aa, Mycobacterium
FTTTTAQRSLRE

SEQ ID NO: 476993 - protein, 9 aa, Mycobacterium
FTTTTRAGG

SEQ ID NO: 476994 - protein, 10 aa, Mycobacterium
FTTTTRAGNA

SEQ ID NO: 476995 - protein, 6 aa, Mycobacterium
FTVSGT

SEQ ID NO: 476996 - protein, 4 aa, Mycobacterium
FTYT

SEQ ID NO: 476997 - protein, 5 aa, Mycobacterium
FVGGE

SEQ ID NO: 476998 - protein, 6 aa, Mycobacterium
FVPPQG

SEQ ID NO: 476999 - protein, 13 aa, Mycobacterium
FVPTGTPVPVPDY

SEQ ID NO: 477000 - protein, 5 aa, Mycobacterium
FVSGE

SEQ ID NO: 477001 - protein, 18 aa, Mycobacterium
FVSPGDVRATARAYGTEP

SEQ ID NO: 477002 - protein, 10 aa, Mycobacterium
FVSSDDPKKA

SEQ ID NO: 477003 - protein, 12 aa, Mycobacterium
FVTGAGGDGLGQ

SEQ ID NO: 477004 - protein, 14 aa, Mycobacterium
FYDDEGNLQPMPAP

SEQ ID NO: 477005 - protein, 10 aa, Mycobacterium
FYETDPDRGF

SEQ ID NO: 477006 - protein, 10 aa, Mycobacterium
FYETDPSRGF

SEQ ID NO: 477007 - protein, 7 aa, Mycobacterium
FYGPAGD

SEQ ID NO: 477008 - protein, 8 aa, Mycobacterium
FYGPRGGQ

SEQ ID NO: 477009 - protein, 6 aa, Mycobacterium
FYPEEA

SEQ ID NO: 477010 - protein, 4 aa, Mycobacterium
FYST

SEQ ID NO: 477011 - protein, 6 aa, Mycobacterium
FYSTGS

SEQ ID NO: 477012 - protein, 6 aa, Mycobacterium
GAAAAA

SEQ ID NO: 477013 - protein, 22 aa, Mycobacterium
GAAAAAAHTATHQTDTTTADTV

SEQ ID NO: 477014 - protein, 22 aa, Mycobacterium
GAAAAAAHTATSHADTPKTETV

SEQ ID NO: 477015 - protein, 12 aa, Mycobacterium
GAAAAADGVGGR

SEQ ID NO: 477016 - protein, 8 aa, Mycobacterium
GAAAAAEA

SEQ ID NO: 477017 - protein, 11 aa, Mycobacterium
GAAAAAGGASV

SEQ ID NO: 477018 - protein, 9 aa, Mycobacterium
GAAAAAGYN

SEQ ID NO: 477019 - protein, 7 aa, Mycobacterium
GAAAAAL

SEQ ID NO: 477020 - protein, 10 aa, Mycobacterium
GAAAAAQDTA

SEQ ID NO: 477021 - protein, 8 aa, Mycobacterium
GAAAAATV

SEQ ID NO: 477022 - protein, 13 aa, Mycobacterium
GAAAAAVPDGHTR

SEQ ID NO: 477023 - protein, 10 aa, Mycobacterium
GAAAAERPAR

SEQ ID NO: 477024 - protein, 9 aa, Mycobacterium
GAAAAGSAA

SEQ ID NO: 477025 - protein, 30 aa, Mycobacterium
GAAAAGSSSGGGSGGGVAVTSSRPSIIPRI

SEQ ID NO: 477026 - protein, 29 aa, Mycobacterium
GAAAAPGASGGTRAASAAVAAAAAGGLET

SEQ ID NO: 477027 - protein, 17 aa, Mycobacterium
GAAAAPTQAEAAEQVTA

SEQ ID NO: 477028 - protein, 10 aa, Mycobacterium
GAAAAQDSPH

SEQ ID NO: 477029 - protein, 45 aa, Mycobacterium
GAAAASALTPFTEPAQTTNPAGPAGQAAAVAQAAGSAAGTLTQSE

SEQ ID NO: 477030 - protein, 7 aa, Mycobacterium
GAAAASL

SEQ ID NO: 477031 - protein, 8 aa, Mycobacterium
GAAAATEN

SEQ ID NO: 477032 - protein, 11 aa, Mycobacterium
GAAADDQPEDR

SEQ ID NO: 477033 - protein, 7 aa, Mycobacterium
GAAAEAN

SEQ ID NO: 477034 - protein, 10 aa, Mycobacterium
GAAAEAPVPD

SEQ ID NO: 477035 - protein, 7 aa, Mycobacterium
GAAAELS

SEQ ID NO: 477036 - protein, 6 aa, Mycobacterium
GAAAEM

SEQ ID NO: 477037 - protein, 11 aa, Mycobacterium
GAAAEQGRSVT

SEQ ID NO: 477038 - protein, 18 aa, Mycobacterium
GAAAESSDPWNNAGTGHS

SEQ ID NO: 477039 - protein, 6 aa, Mycobacterium
GAAAET

SEQ ID NO: 477040 - protein, 5 aa, Mycobacterium
GAAAG

SEQ ID NO: 477041 - protein, 17 aa, Mycobacterium
GAAAGAARTTLARRTSA

SEQ ID NO: 477042 - protein, 6 aa, Mycobacterium
GAAAGE

SEQ ID NO: 477043 - protein, 8 aa, Mycobacterium
GAAAGPIG

SEQ ID NO: 477044 - protein, 14 aa, Mycobacterium
GAAAGTYRAAPGEL

SEQ ID NO: 477045 - protein, 15 aa, Mycobacterium
GAAAKEAAREVGSGA

SEQ ID NO: 477046 - protein, 8 aa, Mycobacterium
GAAAKGNT

SEQ ID NO: 477047 - protein, 10 aa, Mycobacterium
GAAAKSLQAN

SEQ ID NO: 477048 - protein, 7 aa, Mycobacterium
GAAALPA

SEQ ID NO: 477049 - protein, 17 aa, Mycobacterium
GAAANTGDGIRAGQELG

SEQ ID NO: 477050 - protein, 14 aa, Mycobacterium
GAAAPGAFDGPDDF

SEQ ID NO: 477051 - protein, 32 aa, Mycobacterium
GAAAPGGGWTSSATVPDAAAGTPGVPGMPAPG

SEQ ID NO: 477052 - protein, 10 aa, Mycobacterium
GAAAPGTARG

SEQ ID NO: 477053 - protein, 33 aa, Mycobacterium
GAAAPRGPGGGGARFRSTSLKDGSSKDGESPEN

SEQ ID NO: 477054 - protein, 9 aa, Mycobacterium
GAAAPTESV

SEQ ID NO: 477055 - protein, 21 aa, Mycobacterium
GAAAPVTAEAAGIAGRATTLG

SEQ ID NO: 477056 - protein, 6 aa, Mycobacterium
GAAAQA

SEQ ID NO: 477057 - protein, 9 aa, Mycobacterium
GAAAQAGVD

SEQ ID NO: 477058 - protein, 10 aa, Mycobacterium
GAAAQLERSG

SEQ ID NO: 477059 - protein, 10 aa, Mycobacterium
GAAARDAGVP

SEQ ID NO: 477060 - protein, 9 aa, Mycobacterium
GAAARPVQR

SEQ ID NO: 477061 - protein, 7 aa, Mycobacterium
GAAARRA

SEQ ID NO: 477062 - protein, 10 aa, Mycobacterium
GAAASAQTLG

SEQ ID NO: 477063 - protein, 6 aa, Mycobacterium
GAAASG

SEQ ID NO: 477064 - protein, 17 aa, Mycobacterium
GAAASYSGAEAANASPL

SEQ ID NO: 477065 - protein, 27 aa, Mycobacterium
GAAATAVNGTSIGNSAAVETISTLRIS

SEQ ID NO: 477066 - protein, 11 aa, Mycobacterium
GAAATGTHGTG

SEQ ID NO: 477067 - protein, 9 aa, Mycobacterium
GAAATPEAL

SEQ ID NO: 477068 - protein, 14 aa, Mycobacterium
GAAATSGAARPAGL

SEQ ID NO: 477069 - protein, 16 aa, Mycobacterium
GAAAYAGAEAANASPL

SEQ ID NO: 477070 - protein, 8 aa, Mycobacterium
GAAAYRDA

SEQ ID NO: 477071 - protein, 10 aa, Mycobacterium
GAAAYTPPTA

SEQ ID NO: 477072 - protein, 7 aa, Mycobacterium
GAADAAK

SEQ ID NO: 477073 - protein, 6 aa, Mycobacterium
GAADAD

SEQ ID NO: 477074 - protein, 6 aa, Mycobacterium
GAADAE

SEQ ID NO: 477075 - protein, 11 aa, Mycobacterium
GAADAEAQRPA

SEQ ID NO: 477076 - protein, 11 aa, Mycobacterium
GAADAPASTRD

SEQ ID NO: 477077 - protein, 18 aa, Mycobacterium
GAADAVDEIQAADDATGA

SEQ ID NO: 477078 - protein, 5 aa, Mycobacterium
GAADD

SEQ ID NO: 477079 - protein, 6 aa, Mycobacterium
GAADDR

SEQ ID NO: 477080 - protein, 6 aa, Mycobacterium
GAADGS

SEQ ID NO: 477081 - protein, 12 aa, Mycobacterium
GAADGTGFSEGG

SEQ ID NO: 477082 - protein, 10 aa, Mycobacterium
GAADKPAQWP

SEQ ID NO: 477083 - protein, 5 aa, Mycobacterium
GAADL

SEQ ID NO: 477084 - protein, 9 aa, Mycobacterium
GAADNADDR

SEQ ID NO: 477085 - protein, 8 aa, Mycobacterium
GAADPAAQ

SEQ ID NO: 477086 - protein, 9 aa, Mycobacterium
GAADPAGVS

SEQ ID NO: 477087 - protein, 8 aa, Mycobacterium
GAADPGAR

SEQ ID NO: 477088 - protein, 7 aa, Mycobacterium
GAADPQA

SEQ ID NO: 477089 - protein, 19 aa, Mycobacterium
GAADPSSPEAARRRERLSA

SEQ ID NO: 477090 - protein, 8 aa, Mycobacterium
GAADQARA

SEQ ID NO: 477091 - protein, 5 aa, Mycobacterium
GAADR

SEQ ID NO: 477092 - protein, 20 aa, Mycobacterium
GAADRAAEAIESTARRCRQG

SEQ ID NO: 477093 - protein, 10 aa, Mycobacterium
GAADRARFGR

SEQ ID NO: 477094 - protein, 10 aa, Mycobacterium
GAADREQERY

SEQ ID NO: 477095 - protein, 8 aa, Mycobacterium
GAADRERE

SEQ ID NO: 477096 - protein, 9 aa, Mycobacterium
GAADREREV

SEQ ID NO: 477097 - protein, 6 aa, Mycobacterium
GAADRG

SEQ ID NO: 477098 - protein, 5 aa, Mycobacterium
GAADS

SEQ ID NO: 477099 - protein, 9 aa, Mycobacterium
GAADSDAAA

SEQ ID NO: 477100 - protein, 10 aa, Mycobacterium
GAADSEDGPA

SEQ ID NO: 477101 - protein, 9 aa, Mycobacterium
GAADSSLEQ

SEQ ID NO: 477102 - protein, 7 aa, Mycobacterium
GAADTAA

SEQ ID NO: 477103 - protein, 18 aa, Mycobacterium
GAADTKAGLNDAVRRGTR

SEQ ID NO: 477104 - protein, 7 aa, Mycobacterium
GAADTTL

SEQ ID NO: 477105 - protein, 8 aa, Mycobacterium
GAAEAADE

SEQ ID NO: 477106 - protein, 13 aa, Mycobacterium
GAAEADTASGGVS

SEQ ID NO: 477107 - protein, 6 aa, Mycobacterium
GAAEAE

SEQ ID NO: 477108 - protein, 6 aa, Mycobacterium
GAAEAG

SEQ ID NO: 477109 - protein, 5 aa, Mycobacterium
GAAED

SEQ ID NO: 477110 - protein, 19 aa, Mycobacterium
GAAEDGFKKEHGGNGDVGA

SEQ ID NO: 477111 - protein, 18 aa, Mycobacterium
GAAEDGFRKEHGGNGNVG

SEQ ID NO: 477112 - protein, 7 aa, Mycobacterium
GAAEDRA

SEQ ID NO: 477113 - protein, 19 aa, Mycobacterium
GAAEGARSGWVGSSAGALS

SEQ ID NO: 477114 - protein, 18 aa, Mycobacterium
GAAEGASPSVIETQGSAT

SEQ ID NO: 477115 - protein, 9 aa, Mycobacterium
GAAEGETYD

SEQ ID NO: 477116 - protein, 10 aa, Mycobacterium
GAAEGPYADY

SEQ ID NO: 477117 - protein, 6 aa, Mycobacterium
GAAEHG

SEQ ID NO: 477118 - protein, 12 aa, Mycobacterium
GAAEKQVRKAQR

SEQ ID NO: 477119 - protein, 10 aa, Mycobacterium
GAAELEGASA

SEQ ID NO: 477120 - protein, 6 aa, Mycobacterium
GAAELS

SEQ ID NO: 477121 - protein, 10 aa, Mycobacterium
GAAEMEGASA

SEQ ID NO: 477122 - protein, 14 aa, Mycobacterium
GAAEPLSDAGPTGW

SEQ ID NO: 477123 - protein, 8 aa, Mycobacterium
GAAEQTPA

SEQ ID NO: 477124 - protein, 17 aa, Mycobacterium
GAAEREDPLSGLTEQER

SEQ ID NO: 477125 - protein, 20 aa, Mycobacterium
GAAESADRAAERNDVTAAHD

SEQ ID NO: 477126 - protein, 14 aa, Mycobacterium
GAAESATSNRGRTS

SEQ ID NO: 477127 - protein, 9 aa, Mycobacterium
GAAESEQTA

SEQ ID NO: 477128 - protein, 7 aa, Mycobacterium
GAAESPL

SEQ ID NO: 477129 - protein, 7 aa, Mycobacterium
GAAESRP

SEQ ID NO: 477130 - protein, 9 aa, Mycobacterium
GAAESTVDS

SEQ ID NO: 477131 - protein, 9 aa, Mycobacterium
GAAETSRST

SEQ ID NO: 477132 - protein, 18 aa, Mycobacterium
GAAFDDDAEADGSIRDDD

SEQ ID NO: 477133 - protein, 22 aa, Mycobacterium
GAAFNRTDRDNAVLDEAEALLD

SEQ ID NO: 477134 - protein, 15 aa, Mycobacterium
GAAFSEAASAATTKL

SEQ ID NO: 477135 - protein, 12 aa, Mycobacterium
GAAFTWDGSRAI

SEQ ID NO: 477136 - protein, 5 aa, Mycobacterium
GAAGA

SEQ ID NO: 477137 - protein, 13 aa, Mycobacterium
GAAGAGDSVERAR

SEQ ID NO: 477138 - protein, 13 aa, Mycobacterium
GAAGAPANGPTYA

SEQ ID NO: 477139 - protein, 18 aa, Mycobacterium
GAAGARTRYTGIGGNVPQ

SEQ ID NO: 477140 - protein, 10 aa, Mycobacterium
GAAGASSPQF

SEQ ID NO: 477141 - protein, 18 aa, Mycobacterium
GAAGAYATAEAAGAAPLA

SEQ ID NO: 477142 - protein, 7 aa, Mycobacterium
GAAGDAR

SEQ ID NO: 477143 - protein, 43 aa, Mycobacterium
GAAGDEDLDDSDEDSDLDSDEESDDESDEDEIELDDDEDELDE

SEQ ID NO: 477144 - protein, 15 aa, Mycobacterium
GAAGDTVEVKDGYGR

SEQ ID NO: 477145 - protein, 5 aa, Mycobacterium
GAAGE

SEQ ID NO: 477146 - protein, 6 aa, Mycobacterium
GAAGEG

SEQ ID NO: 477147 - protein, 10 aa, Mycobacterium
GAAGELAGQD

SEQ ID NO: 477148 - protein, 10 aa, Mycobacterium
GAAGFGGSPT

SEQ ID NO: 477149 - protein, 73 aa, Mycobacterium
GAAGGAGGAGGLSGYRSAGNGGAGGAGGAGGVLGGDGGAGGDGGAAGNGVNDPVTGAVEGDGGIGGNGGTGGA

SEQ ID NO: 477150 - protein, 44 aa, Mycobacterium
GAAGGAGGNGGAGATGISGPAGQTGGDGGAAGNGGNGGAGGKGG

SEQ ID NO: 477151 - protein, 9 aa, Mycobacterium
GAAGGGRPV

SEQ ID NO: 477152 - protein, 7 aa, Mycobacterium
GAAGGGV

SEQ ID NO: 477153 - protein, 7 aa, Mycobacterium
GAAGGLP

SEQ ID NO: 477154 - protein, 7 aa, Mycobacterium
GAAGGND

SEQ ID NO: 477155 - protein, 9 aa, Mycobacterium
GAAGGPTAT

SEQ ID NO: 477156 - protein, 7 aa, Mycobacterium
GAAGGQG

SEQ ID NO: 477157 - protein, 11 aa, Mycobacterium
GAAGGQPVAGH

SEQ ID NO: 477158 - protein, 9 aa, Mycobacterium
GAAGGRIET

SEQ ID NO: 477159 - protein, 12 aa, Mycobacterium
GAAGGTSAGLSG

SEQ ID NO: 477160 - protein, 5 aa, Mycobacterium
GAAGH

SEQ ID NO: 477161 - protein, 13 aa, Mycobacterium
GAAGIDERTPEQT

SEQ ID NO: 477162 - protein, 8 aa, Mycobacterium
GAAGLPPL

SEQ ID NO: 477163 - protein, 8 aa, Mycobacterium
GAAGLSSP

SEQ ID NO: 477164 - protein, 13 aa, Mycobacterium
GAAGMTPAGESAV

SEQ ID NO: 477165 - protein, 10 aa, Mycobacterium
GAAGNGGDAG

SEQ ID NO: 477166 - protein, 5 aa, Mycobacterium
GAAGP

SEQ ID NO: 477167 - protein, 11 aa, Mycobacterium
GAAGPDARLAG

SEQ ID NO: 477168 - protein, 9 aa, Mycobacterium
GAAGPHPRG

SEQ ID NO: 477169 - protein, 9 aa, Mycobacterium
GAAGPLAPA

SEQ ID NO: 477170 - protein, 18 aa, Mycobacterium
GAAGPTIPAGTANPAGTA

SEQ ID NO: 477171 - protein, 7 aa, Mycobacterium
GAAGPVR

SEQ ID NO: 477172 - protein, 7 aa, Mycobacterium
GAAGQLS

SEQ ID NO: 477173 - protein, 13 aa, Mycobacterium
GAAGRKAGSDAGR

SEQ ID NO: 477174 - protein, 8 aa, Mycobacterium
GAAGRSRA

SEQ ID NO: 477175 - protein, 10 aa, Mycobacterium
GAAGRSRAQS

SEQ ID NO: 477176 - protein, 56 aa, Mycobacterium
GAAGSAGSNAAGGSGGTGGLRGQGGDPGSTGRAGTGSAGADGMNGTDGDPGDPGGM

SEQ ID NO: 477177 - protein, 52 aa, Mycobacterium
GAAGSGGTGGSGGTGGLGGAGGSGIGYSTGGGAGGAGGAGGDAGTGGAAGAT

SEQ ID NO: 477178 - protein, 10 aa, Mycobacterium
GAAGSGSQRL

SEQ ID NO: 477179 - protein, 6 aa, Mycobacterium
GAAGSL

SEQ ID NO: 477180 - protein, 11 aa, Mycobacterium
GAAGSSLAPRA

SEQ ID NO: 477181 - protein, 8 aa, Mycobacterium
GAAGSVGS

SEQ ID NO: 477182 - protein, 6 aa, Mycobacterium
GAAGTL

SEQ ID NO: 477183 - protein, 13 aa, Mycobacterium
GAAGTPTSPGVAT

SEQ ID NO: 477184 - protein, 6 aa, Mycobacterium
GAAGTY

SEQ ID NO: 477185 - protein, 6 aa, Mycobacterium
GAAGVS

SEQ ID NO: 477186 - protein, 8 aa, Mycobacterium
GAAHASKA

SEQ ID NO: 477187 - protein, 42 aa, Mycobacterium
GAAHGPPRARGRDNDFPAPELSAGPASSARRKRPVAARFRHF

SEQ ID NO: 477188 - protein, 6 aa, Mycobacterium
GAAHSV

SEQ ID NO: 477189 - protein, 4 aa, Mycobacterium
GAAI

SEQ ID NO: 477190 - protein, 9 aa, Mycobacterium
GAAIEPGRH

SEQ ID NO: 477191 - protein, 9 aa, Mycobacterium
GAAIGAEYP

SEQ ID NO: 477192 - protein, 10 aa, Mycobacterium
GAAINDRNVD

SEQ ID NO: 477193 - protein, 7 aa, Mycobacterium
GAAIRAG

SEQ ID NO: 477194 - protein, 9 aa, Mycobacterium
GAAISAQPF

SEQ ID NO: 477195 - protein, 9 aa, Mycobacterium
GAAKAGKAM

SEQ ID NO: 477196 - protein, 24 aa, Mycobacterium
GAAKKAAKGAASTAAVAEAGGLER

SEQ ID NO: 477197 - protein, 25 aa, Mycobacterium
GAAKKPGKAAAAAASAASTEATLER

SEQ ID NO: 477198 - protein, 22 aa, Mycobacterium
GAAKKTAKAASTAAVAEAGGLE

SEQ ID NO: 477199 - protein, 7 aa, Mycobacterium
GAAKPAI

SEQ ID NO: 477200 - protein, 7 aa, Mycobacterium
GAAKPGD

SEQ ID NO: 477201 - protein, 11 aa, Mycobacterium
GAAKPTPGNLD

SEQ ID NO: 477202 - protein, 14 aa, Mycobacterium
GAAKSDFDMVEVSR

SEQ ID NO: 477203 - protein, 14 aa, Mycobacterium
GAAKSDFEMIEVSR

SEQ ID NO: 477204 - protein, 14 aa, Mycobacterium
GAAKSDFEMVEIAR

SEQ ID NO: 477205 - protein, 16 aa, Mycobacterium
GAALADGAPEQTIAGE

SEQ ID NO: 477206 - protein, 13 aa, Mycobacterium
GAALAETIVAGAT

SEQ ID NO: 477207 - protein, 5 aa, Mycobacterium
GAALD

SEQ ID NO: 477208 - protein, 7 aa, Mycobacterium
GAALDGT

SEQ ID NO: 477209 - protein, 7 aa, Mycobacterium
GAALPEN

SEQ ID NO: 477210 - protein, 8 aa, Mycobacterium
GAALPSAP

SEQ ID NO: 477211 - protein, 19 aa, Mycobacterium
GAALPTGDPVAESDSATRA

SEQ ID NO: 477212 - protein, 6 aa, Mycobacterium
GAALRG

SEQ ID NO: 477213 - protein, 10 aa, Mycobacterium
GAALTDGALS

SEQ ID NO: 477214 - protein, 5 aa, Mycobacterium
GAAMA

SEQ ID NO: 477215 - protein, 6 aa, Mycobacterium
GAAMPG

SEQ ID NO: 477216 - protein, 4 aa, Mycobacterium
GAAN

SEQ ID NO: 477217 - protein, 12 aa, Mycobacterium
GAANEADGGPNL

SEQ ID NO: 477218 - protein, 8 aa, Mycobacterium
GAANFRND

SEQ ID NO: 477219 - protein, 11 aa, Mycobacterium
GAANGHNSLRP

SEQ ID NO: 477220 - protein, 5 aa, Mycobacterium
GAANP

SEQ ID NO: 477221 - protein, 6 aa, Mycobacterium
GAANPG

SEQ ID NO: 477222 - protein, 9 aa, Mycobacterium
GAANPNGTL

SEQ ID NO: 477223 - protein, 9 aa, Mycobacterium
GAANPSVPS

SEQ ID NO: 477224 - protein, 22 aa, Mycobacterium
GAANPTEARGALTTPRPAPPAR

SEQ ID NO: 477225 - protein, 8 aa, Mycobacterium
GAANQPLA

SEQ ID NO: 477226 - protein, 16 aa, Mycobacterium
GAANRDPTVYADPDRV

SEQ ID NO: 477227 - protein, 18 aa, Mycobacterium
GAANRTQAAMYAADHELL

SEQ ID NO: 477228 - protein, 18 aa, Mycobacterium
GAANRTQAAMYAADHQLL

SEQ ID NO: 477229 - protein, 10 aa, Mycobacterium
GAANSTTDRV

SEQ ID NO: 477230 - protein, 13 aa, Mycobacterium
GAAPAAAAVTTPL

SEQ ID NO: 477231 - protein, 24 aa, Mycobacterium
GAAPAAAAVTTPLAGAAQAVASQA

SEQ ID NO: 477232 - protein, 8 aa, Mycobacterium
GAAPAAEG

SEQ ID NO: 477233 - protein, 18 aa, Mycobacterium
GAAPAAGFAGPGGTGGQG

SEQ ID NO: 477234 - protein, 12 aa, Mycobacterium
GAAPAATSSSGK

SEQ ID NO: 477235 - protein, 17 aa, Mycobacterium
GAAPADTTEPQQGDHER

SEQ ID NO: 477236 - protein, 11 aa, Mycobacterium
GAAPAGDRAVP

SEQ ID NO: 477237 - protein, 9 aa, Mycobacterium
GAAPAGHAS

SEQ ID NO: 477238 - protein, 9 aa, Mycobacterium
GAAPALQAA

SEQ ID NO: 477239 - protein, 25 aa, Mycobacterium
GAAPAPTSGAIQTGPVAPAGEEATE

SEQ ID NO: 477240 - protein, 6 aa, Mycobacterium
GAAPAR

SEQ ID NO: 477241 - protein, 6 aa, Mycobacterium
GAAPAT

SEQ ID NO: 477242 - protein, 14 aa, Mycobacterium
GAAPAVKALPGLGG

SEQ ID NO: 477243 - protein, 24 aa, Mycobacterium
GAAPAVPDDGAGSTPSAAQIGVGG

SEQ ID NO: 477244 - protein, 10 aa, Mycobacterium
GAAPDLGNAA

SEQ ID NO: 477245 - protein, 6 aa, Mycobacterium
GAAPDR

SEQ ID NO: 477246 - protein, 11 aa, Mycobacterium
GAAPDSKPAVV

SEQ ID NO: 477247 - protein, 7 aa, Mycobacterium
GAAPEPM

SEQ ID NO: 477248 - protein, 10 aa, Mycobacterium
GAAPESKPAV

SEQ ID NO: 477249 - protein, 8 aa, Mycobacterium
GAAPFGDG

SEQ ID NO: 477250 - protein, 8 aa, Mycobacterium
GAAPGAAA

SEQ ID NO: 477251 - protein, 8 aa, Mycobacterium
GAAPGADG

SEQ ID NO: 477252 - protein, 10 aa, Mycobacterium
GAAPGAERRT

SEQ ID NO: 477253 - protein, 8 aa, Mycobacterium
GAAPGAPA

SEQ ID NO: 477254 - protein, 8 aa, Mycobacterium
GAAPGDKT

SEQ ID NO: 477255 - protein, 7 aa, Mycobacterium
GAAPGER

SEQ ID NO: 477256 - protein, 24 aa, Mycobacterium
GAAPGGDGGKGGDAQLVGTGGNGG

SEQ ID NO: 477257 - protein, 21 aa, Mycobacterium
GAAPGGRGRAAPVSSQPSFRR

SEQ ID NO: 477258 - protein, 7 aa, Mycobacterium
GAAPGGV

SEQ ID NO: 477259 - protein, 16 aa, Mycobacterium
GAAPGHPAQRPLPSTR

SEQ ID NO: 477260 - protein, 8 aa, Mycobacterium
GAAPGPFR

SEQ ID NO: 477261 - protein, 8 aa, Mycobacterium
GAAPGSPW

SEQ ID NO: 477262 - protein, 9 aa, Mycobacterium
GAAPGSRFP

SEQ ID NO: 477263 - protein, 5 aa, Mycobacterium
GAAPH

SEQ ID NO: 477264 - protein, 5 aa, Mycobacterium
GAAPI

SEQ ID NO: 477265 - protein, 8 aa, Mycobacterium
GAAPLDRD

SEQ ID NO: 477266 - protein, 8 aa, Mycobacterium
GAAPLGNT

SEQ ID NO: 477267 - protein, 11 aa, Mycobacterium
GAAPLRPGKGP

SEQ ID NO: 477268 - protein, 8 aa, Mycobacterium
GAAPLSAG

SEQ ID NO: 477269 - protein, 8 aa, Mycobacterium
GAAPLSSL

SEQ ID NO: 477270 - protein, 6 aa, Mycobacterium
GAAPLT

SEQ ID NO: 477271 - protein, 8 aa, Mycobacterium
GAAPNGID

SEQ ID NO: 477272 - protein, 9 aa, Mycobacterium
GAAPPESIA

SEQ ID NO: 477273 - protein, 8 aa, Mycobacterium
GAAPPGSM

SEQ ID NO: 477274 - protein, 9 aa, Mycobacterium
GAAPPPGTR

SEQ ID NO: 477275 - protein, 8 aa, Mycobacterium
GAAPPQSW

SEQ ID NO: 477276 - protein, 8 aa, Mycobacterium
GAAPQAEL

SEQ ID NO: 477277 - protein, 6 aa, Mycobacterium
GAAPQQ

SEQ ID NO: 477278 - protein, 17 aa, Mycobacterium
GAAPQRSVRSSDEHQPV

SEQ ID NO: 477279 - protein, 8 aa, Mycobacterium
GAAPRADL

SEQ ID NO: 477280 - protein, 18 aa, Mycobacterium
GAAPRARRTPEKGVFRAA

SEQ ID NO: 477281 - protein, 7 aa, Mycobacterium
GAAPRDV

SEQ ID NO: 477282 - protein, 9 aa, Mycobacterium
GAAPRMSPL

SEQ ID NO: 477283 - protein, 8 aa, Mycobacterium
GAAPRTRH

SEQ ID NO: 477284 - protein, 9 aa, Mycobacterium
GAAPSERSA

SEQ ID NO: 477285 - protein, 19 aa, Mycobacterium
GAAPSGADFAGPAVATRTS

SEQ ID NO: 477286 - protein, 22 aa, Mycobacterium
GAAPSPLDAASDPGLPVVQGQV

SEQ ID NO: 477287 - protein, 19 aa, Mycobacterium
GAAPSPTTETPADDQDSAV

SEQ ID NO: 477288 - protein, 8 aa, Mycobacterium
GAAPTADR

SEQ ID NO: 477289 - protein, 8 aa, Mycobacterium
GAAPTAEL

SEQ ID NO: 477290 - protein, 8 aa, Mycobacterium
GAAPTAER

SEQ ID NO: 477291 - protein, 8 aa, Mycobacterium
GAAPTAKL

SEQ ID NO: 477292 - protein, 17 aa, Mycobacterium
GAAPTAPQPSMEEPCVS

SEQ ID NO: 477293 - protein, 12 aa, Mycobacterium
GAAPTASRRPVP

SEQ ID NO: 477294 - protein, 9 aa, Mycobacterium
GAAPTDGTY

SEQ ID NO: 477295 - protein, 9 aa, Mycobacterium
GAAPTEGTY

SEQ ID NO: 477296 - protein, 6 aa, Mycobacterium
GAAPTG

SEQ ID NO: 477297 - protein, 14 aa, Mycobacterium
GAAPTGDRRDRWGN

SEQ ID NO: 477298 - protein, 7 aa, Mycobacterium
GAAPTLD

SEQ ID NO: 477299 - protein, 11 aa, Mycobacterium
GAAPTQEDSRA

SEQ ID NO: 477300 - protein, 9 aa, Mycobacterium
GAAPTSSGK

SEQ ID NO: 477301 - protein, 6 aa, Mycobacterium
GAAPVR

SEQ ID NO: 477302 - protein, 11 aa, Mycobacterium
GAAPYKRARER

SEQ ID NO: 477303 - protein, 15 aa, Mycobacterium
GAAQAKGGSQEAAAG

SEQ ID NO: 477304 - protein, 9 aa, Mycobacterium
GAAQDNPLH

SEQ ID NO: 477305 - protein, 10 aa, Mycobacterium
GAAQESDLPA

SEQ ID NO: 477306 - protein, 10 aa, Mycobacterium
GAAQESGLPA

SEQ ID NO: 477307 - protein, 7 aa, Mycobacterium
GAAQPAI

SEQ ID NO: 477308 - protein, 9 aa, Mycobacterium
GAAQPETRG

SEQ ID NO: 477309 - protein, 7 aa, Mycobacterium
GAAQPHR

SEQ ID NO: 477310 - protein, 8 aa, Mycobacterium
GAAQRGNR

SEQ ID NO: 477311 - protein, 8 aa, Mycobacterium
GAAQRKAT

SEQ ID NO: 477312 - protein, 7 aa, Mycobacterium
GAAQSDV

SEQ ID NO: 477313 - protein, 9 aa, Mycobacterium
GAAQSEALA

SEQ ID NO: 477314 - protein, 9 aa, Mycobacterium
GAAQSESLA

SEQ ID NO: 477315 - protein, 16 aa, Mycobacterium
GAAQSESLARQVPDNG

SEQ ID NO: 477316 - protein, 6 aa, Mycobacterium
GAAQTA

SEQ ID NO: 477317 - protein, 17 aa, Mycobacterium
GAAQTYASAEATGAAPL

SEQ ID NO: 477318 - protein, 6 aa, Mycobacterium
GAAQVP

SEQ ID NO: 477319 - protein, 7 aa, Mycobacterium
GAAQVTK

SEQ ID NO: 477320 - protein, 34 aa, Mycobacterium
GAARAARRRRHEEATATASTPSRSVAAGSGYGDE

SEQ ID NO: 477321 - protein, 9 aa, Mycobacterium
GAARADATK

SEQ ID NO: 477322 - protein, 8 aa, Mycobacterium
GAARAGAD

SEQ ID NO: 477323 - protein, 10 aa, Mycobacterium
GAARAGGGLG

SEQ ID NO: 477324 - protein, 10 aa, Mycobacterium
GAARDASTAI

SEQ ID NO: 477325 - protein, 8 aa, Mycobacterium
GAARDDDE

SEQ ID NO: 477326 - protein, 7 aa, Mycobacterium
GAARDRL

SEQ ID NO: 477327 - protein, 7 aa, Mycobacterium
GAARERG

SEQ ID NO: 477328 - protein, 8 aa, Mycobacterium
GAARGATA

SEQ ID NO: 477329 - protein, 8 aa, Mycobacterium
GAARGDAT

SEQ ID NO: 477330 - protein, 8 aa, Mycobacterium
GAARGGAT

SEQ ID NO: 477331 - protein, 12 aa, Mycobacterium
GAARGGRESTLA

SEQ ID NO: 477332 - protein, 8 aa, Mycobacterium
GAARGNAT

SEQ ID NO: 477333 - protein, 12 aa, Mycobacterium
GAARGPQRQFDD

SEQ ID NO: 477334 - protein, 9 aa, Mycobacterium
GAARGQGRA

SEQ ID NO: 477335 - protein, 9 aa, Mycobacterium
GAARGQGRS

SEQ ID NO: 477336 - protein, 6 aa, Mycobacterium
GAARHG

SEQ ID NO: 477337 - protein, 6 aa, Mycobacterium
GAARIP

SEQ ID NO: 477338 - protein, 16 aa, Mycobacterium
GAARNDSGLPEDEIST

SEQ ID NO: 477339 - protein, 5 aa, Mycobacterium
GAARP

SEQ ID NO: 477340 - protein, 9 aa, Mycobacterium
GAARPAGMD

SEQ ID NO: 477341 - protein, 11 aa, Mycobacterium
GAARPAKDRPI

SEQ ID NO: 477342 - protein, 7 aa, Mycobacterium
GAARPDV

SEQ ID NO: 477343 - protein, 7 aa, Mycobacterium
GAARPEL

SEQ ID NO: 477344 - protein, 21 aa, Mycobacterium
GAARPGRAARGAGAAGRRPVG

SEQ ID NO: 477345 - protein, 15 aa, Mycobacterium
GAARPRMGPPHHRTS

SEQ ID NO: 477346 - protein, 5 aa, Mycobacterium
GAARQ

SEQ ID NO: 477347 - protein, 6 aa, Mycobacterium
GAARQA

SEQ ID NO: 477348 - protein, 5 aa, Mycobacterium
GAARR

SEQ ID NO: 477349 - protein, 10 aa, Mycobacterium
GAARRRTPAR

SEQ ID NO: 477350 - protein, 8 aa, Mycobacterium
GAARSQRE

SEQ ID NO: 477351 - protein, 6 aa, Mycobacterium
GAARTQ

SEQ ID NO: 477352 - protein, 19 aa, Mycobacterium
GAARTTVAPDADALSELGE

SEQ ID NO: 477353 - protein, 24 aa, Mycobacterium
GAARVEAEGARGSAQPANEKRGEK

SEQ ID NO: 477354 - protein, 9 aa, Mycobacterium
GAARVSGRS

SEQ ID NO: 477355 - protein, 5 aa, Mycobacterium
GAASA

SEQ ID NO: 477356 - protein, 7 aa, Mycobacterium
GAASAAR

SEQ ID NO: 477357 - protein, 8 aa, Mycobacterium
GAASAARI

SEQ ID NO: 477358 - protein, 7 aa, Mycobacterium
GAASADM

SEQ ID NO: 477359 - protein, 7 aa, Mycobacterium
GAASASR

SEQ ID NO: 477360 - protein, 10 aa, Mycobacterium
GAASDAAPLA

SEQ ID NO: 477361 - protein, 7 aa, Mycobacterium
GAASDDI

SEQ ID NO: 477362 - protein, 8 aa, Mycobacterium
GAASGARV

SEQ ID NO: 477363 - protein, 8 aa, Mycobacterium
GAASGGGL

SEQ ID NO: 477364 - protein, 7 aa, Mycobacterium
GAASGIG

SEQ ID NO: 477365 - protein, 9 aa, Mycobacterium
GAASGYDDG

SEQ ID NO: 477366 - protein, 9 aa, Mycobacterium
GAASHRATT

SEQ ID NO: 477367 - protein, 5 aa, Mycobacterium
GAASN

SEQ ID NO: 477368 - protein, 9 aa, Mycobacterium
GAASPGDLR

SEQ ID NO: 477369 - protein, 21 aa, Mycobacterium
GAASPQRPAGNATGAYPADPL

SEQ ID NO: 477370 - protein, 7 aa, Mycobacterium
GAASPRE

SEQ ID NO: 477371 - protein, 8 aa, Mycobacterium
GAASPRET

SEQ ID NO: 477372 - protein, 6 aa, Mycobacterium
GAASPV

SEQ ID NO: 477373 - protein, 10 aa, Mycobacterium
GAASSPERRE

SEQ ID NO: 477374 - protein, 14 aa, Mycobacterium
GAASSVAPRAYRAA

SEQ ID NO: 477375 - protein, 9 aa, Mycobacterium
GAASTAMTA

SEQ ID NO: 477376 - protein, 6 aa, Mycobacterium
GAATAA

SEQ ID NO: 477377 - protein, 13 aa, Mycobacterium
GAATAAARAGPIG

SEQ ID NO: 477378 - protein, 11 aa, Mycobacterium
GAATAAPYPLD

SEQ ID NO: 477379 - protein, 8 aa, Mycobacterium
GAATAGQT

SEQ ID NO: 477380 - protein, 12 aa, Mycobacterium
GAATAGVNATSA

SEQ ID NO: 477381 - protein, 12 aa, Mycobacterium
GAATAHTVPGAA

SEQ ID NO: 477382 - protein, 10 aa, Mycobacterium
GAATARGTEM

SEQ ID NO: 477383 - protein, 11 aa, Mycobacterium
GAATARRVGTD

SEQ ID NO: 477384 - protein, 7 aa, Mycobacterium
GAATDTG

SEQ ID NO: 477385 - protein, 7 aa, Mycobacterium
GAATEDG

SEQ ID NO: 477386 - protein, 7 aa, Mycobacterium
GAATEED

SEQ ID NO: 477387 - protein, 7 aa, Mycobacterium
GAATEGT

SEQ ID NO: 477388 - protein, 8 aa, Mycobacterium
GAATGGSW

SEQ ID NO: 477389 - protein, 7 aa, Mycobacterium
GAATGGV

SEQ ID NO: 477390 - protein, 6 aa, Mycobacterium
GAATGI

SEQ ID NO: 477391 - protein, 10 aa, Mycobacterium
GAATGKGPRF

SEQ ID NO: 477392 - protein, 8 aa, Mycobacterium
GAATGQPV

SEQ ID NO: 477393 - protein, 6 aa, Mycobacterium
GAATHG

SEQ ID NO: 477394 - protein, 7 aa, Mycobacterium
GAATHPN

SEQ ID NO: 477395 - protein, 9 aa, Mycobacterium
GAATPDGPV

SEQ ID NO: 477396 - protein, 14 aa, Mycobacterium
GAATPQGKDFTGFD

SEQ ID NO: 477397 - protein, 9 aa, Mycobacterium
GAATPSYGL

SEQ ID NO: 477398 - protein, 18 aa, Mycobacterium
GAATQDGKSGGLGGAGDR

SEQ ID NO: 477399 - protein, 7 aa, Mycobacterium
GAATQQP

SEQ ID NO: 477400 - protein, 5 aa, Mycobacterium
GAATR

SEQ ID NO: 477401 - protein, 8 aa, Mycobacterium
GAATSGEQ

SEQ ID NO: 477402 - protein, 10 aa, Mycobacterium
GAATSPPGNA

SEQ ID NO: 477403 - protein, 7 aa, Mycobacterium
GAATSRP

SEQ ID NO: 477404 - protein, 11 aa, Mycobacterium
GAATTQPASYA

SEQ ID NO: 477405 - protein, 8 aa, Mycobacterium
GAATTTQA

SEQ ID NO: 477406 - protein, 14 aa, Mycobacterium
GAATTYAQAEAANT

SEQ ID NO: 477407 - protein, 18 aa, Mycobacterium
GAATVTGLSGGLGGDGDR

SEQ ID NO: 477408 - protein, 19 aa, Mycobacterium
GAATYDIAGPGRAPLGTRD

SEQ ID NO: 477409 - protein, 4 aa, Mycobacterium
GAAV

SEQ ID NO: 477410 - protein, 5 aa, Mycobacterium
GAAVA

SEQ ID NO: 477411 - protein, 8 aa, Mycobacterium
GAAVAATS

SEQ ID NO: 477412 - protein, 13 aa, Mycobacterium
GAAVDVGTEVSGA

SEQ ID NO: 477413 - protein, 5 aa, Mycobacterium
GAAVE

SEQ ID NO: 477414 - protein, 5 aa, Mycobacterium
GAAVG

SEQ ID NO: 477415 - protein, 17 aa, Mycobacterium
GAAVGASRAAVDSGYYP

SEQ ID NO: 477416 - protein, 21 aa, Mycobacterium
GAAVPAAAAAASVAARSAASE

SEQ ID NO: 477417 - protein, 8 aa, Mycobacterium
GAAVTGGA

SEQ ID NO: 477418 - protein, 6 aa, Mycobacterium
GAAVTR

SEQ ID NO: 477419 - protein, 7 aa, Mycobacterium
GAAWGAP

SEQ ID NO: 477420 - protein, 10 aa, Mycobacterium
GAAYDADDPD

SEQ ID NO: 477421 - protein, 9 aa, Mycobacterium
GAAYPRPGL

SEQ ID NO: 477422 - protein, 8 aa, Mycobacterium
GAAYSAES

SEQ ID NO: 477423 - protein, 9 aa, Mycobacterium
GAAYSPESA

SEQ ID NO: 477424 - protein, 11 aa, Mycobacterium
GAAYSPESAKR

SEQ ID NO: 477425 - protein, 7 aa, Mycobacterium
GAAYTPL

SEQ ID NO: 477426 - protein, 20 aa, Mycobacterium
GACAPTRSDAANDDGIAAER

SEQ ID NO: 477427 - protein, 6 aa, Mycobacterium
GACEGT

SEQ ID NO: 477428 - protein, 8 aa, Mycobacterium
GACGDSEK

SEQ ID NO: 477429 - protein, 6 aa, Mycobacterium
GACSRQ

SEQ ID NO: 477430 - protein, 5 aa, Mycobacterium
GADAA

SEQ ID NO: 477431 - protein, 9 aa, Mycobacterium
GADAALDAA

SEQ ID NO: 477432 - protein, 6 aa, Mycobacterium
GADAAS

SEQ ID NO: 477433 - protein, 8 aa, Mycobacterium
GADADAGV

SEQ ID NO: 477434 - protein, 8 aa, Mycobacterium
GADADDLG

SEQ ID NO: 477435 - protein, 9 aa, Mycobacterium
GADADRAPA

SEQ ID NO: 477436 - protein, 8 aa, Mycobacterium
GADADTVA

SEQ ID NO: 477437 - protein, 5 aa, Mycobacterium
GADAE

SEQ ID NO: 477438 - protein, 8 aa, Mycobacterium
GADAEREY

SEQ ID NO: 477439 - protein, 7 aa, Mycobacterium
GADAGAG

SEQ ID NO: 477440 - protein, 8 aa, Mycobacterium
GADAGAGG

SEQ ID NO: 477441 - protein, 6 aa, Mycobacterium
GADAGD

SEQ ID NO: 477442 - protein, 8 aa, Mycobacterium
GADAGEID

SEQ ID NO: 477443 - protein, 19 aa, Mycobacterium
GADAGLATDYRERSTTIGT

SEQ ID NO: 477444 - protein, 5 aa, Mycobacterium
GADAM

SEQ ID NO: 477445 - protein, 16 aa, Mycobacterium
GADAMRPAAADRAEEI

SEQ ID NO: 477446 - protein, 13 aa, Mycobacterium
GADANPSVNGVPF

SEQ ID NO: 477447 - protein, 9 aa, Mycobacterium
GADAPDADL

SEQ ID NO: 477448 - protein, 7 aa, Mycobacterium
GADAPNR

SEQ ID NO: 477449 - protein, 8 aa, Mycobacterium
GADAPPLN

SEQ ID NO: 477450 - protein, 8 aa, Mycobacterium
GADAPRVG

SEQ ID NO: 477451 - protein, 8 aa, Mycobacterium
GADAPSAL

SEQ ID NO: 477452 - protein, 8 aa, Mycobacterium
GADAPTGD

SEQ ID NO: 477453 - protein, 8 aa, Mycobacterium
GADARDAA

SEQ ID NO: 477454 - protein, 10 aa, Mycobacterium
GADARPAPWP

SEQ ID NO: 477455 - protein, 6 aa, Mycobacterium
GADARR

SEQ ID NO: 477456 - protein, 7 aa, Mycobacterium
GADARRR

SEQ ID NO: 477457 - protein, 7 aa, Mycobacterium
GADASGA

SEQ ID NO: 477458 - protein, 5 aa, Mycobacterium
GADAT

SEQ ID NO: 477459 - protein, 14 aa, Mycobacterium
GADATEAGTAGQAG

SEQ ID NO: 477460 - protein, 8 aa, Mycobacterium
GADATEVD

SEQ ID NO: 477461 - protein, 15 aa, Mycobacterium
GADATTPGANGGNGG

SEQ ID NO: 477462 - protein, 5 aa, Mycobacterium
GADAV

SEQ ID NO: 477463 - protein, 22 aa, Mycobacterium
GADAVDGAAAPMAGTTSQPSLS

SEQ ID NO: 477464 - protein, 11 aa, Mycobacterium
GADAVGSTYAA

SEQ ID NO: 477465 - protein, 13 aa, Mycobacterium
GADAYASSEVANA

SEQ ID NO: 477466 - protein, 4 aa, Mycobacterium
GADD

SEQ ID NO: 477467 - protein, 8 aa, Mycobacterium
GADDADGV

SEQ ID NO: 477468 - protein, 8 aa, Mycobacterium
GADDAEIE

SEQ ID NO: 477469 - protein, 7 aa, Mycobacterium
GADDAQV

SEQ ID NO: 477470 - protein, 9 aa, Mycobacterium
GADDDEISL

SEQ ID NO: 477471 - protein, 6 aa, Mycobacterium
GADDEA

SEQ ID NO: 477472 - protein, 14 aa, Mycobacterium
GADDEEDVRVFEVL

SEQ ID NO: 477473 - protein, 14 aa, Mycobacterium
GADDEGDDAGADGV

SEQ ID NO: 477474 - protein, 6 aa, Mycobacterium
GADDGA

SEQ ID NO: 477475 - protein, 13 aa, Mycobacterium
GADDGSLRPDVQA

SEQ ID NO: 477476 - protein, 11 aa, Mycobacterium
GADDGTPPIPV

SEQ ID NO: 477477 - protein, 6 aa, Mycobacterium
GADDIS

SEQ ID NO: 477478 - protein, 22 aa, Mycobacterium
GADDPAAYGDAEVDKSRRYDRT

SEQ ID NO: 477479 - protein, 12 aa, Mycobacterium
GADDPATPPAKL

SEQ ID NO: 477480 - protein, 7 aa, Mycobacterium
GADDPAV

SEQ ID NO: 477481 - protein, 11 aa, Mycobacterium
GADDPEQAGAP

SEQ ID NO: 477482 - protein, 10 aa, Mycobacterium
GADDPGRGRR

SEQ ID NO: 477483 - protein, 12 aa, Mycobacterium
GADDQAPETPRN

SEQ ID NO: 477484 - protein, 5 aa, Mycobacterium
GADDR

SEQ ID NO: 477485 - protein, 10 aa, Mycobacterium
GADDSGDPAQ

SEQ ID NO: 477486 - protein, 10 aa, Mycobacterium
GADDTVTAAP

SEQ ID NO: 477487 - protein, 14 aa, Mycobacterium
GADDVESAIRVDGR

SEQ ID NO: 477488 - protein, 10 aa, Mycobacterium
GADDVGRAEE

SEQ ID NO: 477489 - protein, 11 aa, Mycobacterium
GADDVGRAEEE

SEQ ID NO: 477490 - protein, 21 aa, Mycobacterium
GADDVPDSTETTLPAGRPEQQ

SEQ ID NO: 477491 - protein, 6 aa, Mycobacterium
GADDVS

SEQ ID NO: 477492 - protein, 7 aa, Mycobacterium
GADDVSA

SEQ ID NO: 477493 - protein, 7 aa, Mycobacterium
GADDVST

SEQ ID NO: 477494 - protein, 11 aa, Mycobacterium
GADEAAARALG

SEQ ID NO: 477495 - protein, 7 aa, Mycobacterium
GADEAEA

SEQ ID NO: 477496 - protein, 8 aa, Mycobacterium
GADEAGAR

SEQ ID NO: 477497 - protein, 7 aa, Mycobacterium
GADEATH

SEQ ID NO: 477498 - protein, 10 aa, Mycobacterium
GADEATRKAA

SEQ ID NO: 477499 - protein, 19 aa, Mycobacterium
GADEDADPDKLRKAAAETG

SEQ ID NO: 477500 - protein, 9 aa, Mycobacterium
GADEDTAYP

SEQ ID NO: 477501 - protein, 9 aa, Mycobacterium
GADEDTERK

SEQ ID NO: 477502 - protein, 8 aa, Mycobacterium
GADEERVT

SEQ ID NO: 477503 - protein, 16 aa, Mycobacterium
GADEGGIDAKQARSLL

SEQ ID NO: 477504 - protein, 7 aa, Mycobacterium
GADEPGI

SEQ ID NO: 477505 - protein, 9 aa, Mycobacterium
GADEPPFDD

SEQ ID NO: 477506 - protein, 9 aa, Mycobacterium
GADESGARA

SEQ ID NO: 477507 - protein, 9 aa, Mycobacterium
GADESGPAA

SEQ ID NO: 477508 - protein, 10 aa, Mycobacterium
GADESTPVPT

SEQ ID NO: 477509 - protein, 7 aa, Mycobacterium
GADETGR

SEQ ID NO: 477510 - protein, 13 aa, Mycobacterium
GADETKLNPNGGA

SEQ ID NO: 477511 - protein, 7 aa, Mycobacterium
GADEVHK

SEQ ID NO: 477512 - protein, 7 aa, Mycobacterium
GADEVSQ

SEQ ID NO: 477513 - protein, 7 aa, Mycobacterium
GADEWDD

SEQ ID NO: 477514 - protein, 16 aa, Mycobacterium
GADEYRRIGTDGSPGT

SEQ ID NO: 477515 - protein, 4 aa, Mycobacterium
GADF

SEQ ID NO: 477516 - protein, 6 aa, Mycobacterium
GADFSD

SEQ ID NO: 477517 - protein, 10 aa, Mycobacterium
GADGADGPTH

SEQ ID NO: 477518 - protein, 10 aa, Mycobacterium
GADGAEHRGE

SEQ ID NO: 477519 - protein, 8 aa, Mycobacterium
GADGAELP

SEQ ID NO: 477520 - protein, 8 aa, Mycobacterium
GADGAGLG

SEQ ID NO: 477521 - protein, 9 aa, Mycobacterium
GADGATGPL

SEQ ID NO: 477522 - protein, 7 aa, Mycobacterium
GADGDGG

SEQ ID NO: 477523 - protein, 9 aa, Mycobacterium
GADGDQVER

SEQ ID NO: 477524 - protein, 7 aa, Mycobacterium
GADGDTA

SEQ ID NO: 477525 - protein, 8 aa, Mycobacterium
GADGELPA

SEQ ID NO: 477526 - protein, 8 aa, Mycobacterium
GADGEQVE

SEQ ID NO: 477527 - protein, 8 aa, Mycobacterium
GADGGARR

SEQ ID NO: 477528 - protein, 11 aa, Mycobacterium
GADGGLRTVPA

SEQ ID NO: 477529 - protein, 10 aa, Mycobacterium
GADGGLRTVS

SEQ ID NO: 477530 - protein, 8 aa, Mycobacterium
GADGGTKR

SEQ ID NO: 477531 - protein, 6 aa, Mycobacterium
GADGID

SEQ ID NO: 477532 - protein, 9 aa, Mycobacterium
GADGKDGAR

SEQ ID NO: 477533 - protein, 6 aa, Mycobacterium
GADGKL

SEQ ID NO: 477534 - protein, 5 aa, Mycobacterium
GADGL

SEQ ID NO: 477535 - protein, 20 aa, Mycobacterium
GADGLRAAGEEALRAPAEAV

SEQ ID NO: 477536 - protein, 9 aa, Mycobacterium
GADGLREAG

SEQ ID NO: 477537 - protein, 6 aa, Mycobacterium
GADGLT

SEQ ID NO: 477538 - protein, 10 aa, Mycobacterium
GADGPATDQR

SEQ ID NO: 477539 - protein, 7 aa, Mycobacterium
GADGPAV

SEQ ID NO: 477540 - protein, 9 aa, Mycobacterium
GADGPPGSW

SEQ ID NO: 477541 - protein, 12 aa, Mycobacterium
GADGPPGSYEDF

SEQ ID NO: 477542 - protein, 11 aa, Mycobacterium
GADGPPGSYQD

SEQ ID NO: 477543 - protein, 7 aa, Mycobacterium
GADGPSF

SEQ ID NO: 477544 - protein, 6 aa, Mycobacterium
GADGPV

SEQ ID NO: 477545 - protein, 6 aa, Mycobacterium
GADGRA

SEQ ID NO: 477546 - protein, 16 aa, Mycobacterium
GADGRDPAETLRDGTA

SEQ ID NO: 477547 - protein, 18 aa, Mycobacterium
GADGRLGDAGADGVAGLS

SEQ ID NO: 477548 - protein, 8 aa, Mycobacterium
GADGRRIA

SEQ ID NO: 477549 - protein, 5 aa, Mycobacterium
GADGS

SEQ ID NO: 477550 - protein, 12 aa, Mycobacterium
GADGSLDTAAAA

SEQ ID NO: 477551 - protein, 7 aa, Mycobacterium
GADGSLY

SEQ ID NO: 477552 - protein, 13 aa, Mycobacterium
GADGSRRDAYGSV

SEQ ID NO: 477553 - protein, 9 aa, Mycobacterium
GADGSRRIP

SEQ ID NO: 477554 - protein, 51 aa, Mycobacterium
GADGSTGAPGAGGAGGAGGAAGGFGAGGSGATAGADGKAGTAGTAGATGPH

SEQ ID NO: 477555 - protein, 21 aa, Mycobacterium
GADGSWAATDDSSALGWVDIP

SEQ ID NO: 477556 - protein, 11 aa, Mycobacterium
GADGTPRGGVA

SEQ ID NO: 477557 - protein, 19 aa, Mycobacterium
GADGTQGGPQLTSPPTDPI

SEQ ID NO: 477558 - protein, 6 aa, Mycobacterium
GADGTR

SEQ ID NO: 477559 - protein, 9 aa, Mycobacterium
GADGTRSVS

SEQ ID NO: 477560 - protein, 9 aa, Mycobacterium
GADGTVTEG

SEQ ID NO: 477561 - protein, 6 aa, Mycobacterium
GADGTW

SEQ ID NO: 477562 - protein, 8 aa, Mycobacterium
GADGVAQP

SEQ ID NO: 477563 - protein, 6 aa, Mycobacterium
GADGVD

SEQ ID NO: 477564 - protein, 15 aa, Mycobacterium
GADGVRRSQADHTYG

SEQ ID NO: 477565 - protein, 24 aa, Mycobacterium
GADGVSPETGSGGIDPDGDDAPPR

SEQ ID NO: 477566 - protein, 4 aa, Mycobacterium
GADH

SEQ ID NO: 477567 - protein, 6 aa, Mycobacterium
GADHAT

SEQ ID NO: 477568 - protein, 9 aa, Mycobacterium
GADHDAITQ

SEQ ID NO: 477569 - protein, 8 aa, Mycobacterium
GADHESVD

SEQ ID NO: 477570 - protein, 12 aa, Mycobacterium
GADHHEDDDAGV

SEQ ID NO: 477571 - protein, 8 aa, Mycobacterium
GADHPRLP

SEQ ID NO: 477572 - protein, 13 aa, Mycobacterium
GADHRGGSPDFPE

SEQ ID NO: 477573 - protein, 7 aa, Mycobacterium
GADIEYS

SEQ ID NO: 477574 - protein, 5 aa, Mycobacterium
GADIT

SEQ ID NO: 477575 - protein, 14 aa, Mycobacterium
GADITASRLRPRLT

SEQ ID NO: 477576 - protein, 7 aa, Mycobacterium
GADITPD

SEQ ID NO: 477577 - protein, 9 aa, Mycobacterium
GADKADADT

SEQ ID NO: 477578 - protein, 15 aa, Mycobacterium
GADKEIGADKQGTEL

SEQ ID NO: 477579 - protein, 8 aa, Mycobacterium
GADKPGVT

SEQ ID NO: 477580 - protein, 8 aa, Mycobacterium
GADKPPFD

SEQ ID NO: 477581 - protein, 7 aa, Mycobacterium
GADKTAA

SEQ ID NO: 477582 - protein, 11 aa, Mycobacterium
GADKTADLDRA

SEQ ID NO: 477583 - protein, 10 aa, Mycobacterium
GADKTRASVD

SEQ ID NO: 477584 - protein, 6 aa, Mycobacterium
GADLDP

SEQ ID NO: 477585 - protein, 9 aa, Mycobacterium
GADLDTARE

SEQ ID NO: 477586 - protein, 8 aa, Mycobacterium
GADLDTRT

SEQ ID NO: 477587 - protein, 15 aa, Mycobacterium
GADLGKEDWNGGFPT

SEQ ID NO: 477588 - protein, 8 aa, Mycobacterium
GADLGTQV

SEQ ID NO: 477589 - protein, 10 aa, Mycobacterium
GADLPGQNDM

SEQ ID NO: 477590 - protein, 13 aa, Mycobacterium
GADLPYRADLRQS

SEQ ID NO: 477591 - protein, 8 aa, Mycobacterium
GADLRGAR

SEQ ID NO: 477592 - protein, 7 aa, Mycobacterium
GADLRGV

SEQ ID NO: 477593 - protein, 5 aa, Mycobacterium
GADLS

SEQ ID NO: 477594 - protein, 8 aa, Mycobacterium
GADLSGDA

SEQ ID NO: 477595 - protein, 10 aa, Mycobacterium
GADLSGGHGV

SEQ ID NO: 477596 - protein, 15 aa, Mycobacterium
GADLSPAVPKQYARA

SEQ ID NO: 477597 - protein, 9 aa, Mycobacterium
GADNESPAE

SEQ ID NO: 477598 - protein, 8 aa, Mycobacterium
GADNPEDV

SEQ ID NO: 477599 - protein, 12 aa, Mycobacterium
GADNPVGNREQD

SEQ ID NO: 477600 - protein, 10 aa, Mycobacterium
GADNTATGEC

SEQ ID NO: 477601 - protein, 16 aa, Mycobacterium
GADNTDEQRFSPGERY

SEQ ID NO: 477602 - protein, 16 aa, Mycobacterium
GADNTEEARYSPGERY

SEQ ID NO: 477603 - protein, 36 aa, Mycobacterium
GADNVGIANSGTGNWGIGNSGSYNTGIGNTGSTNTG

SEQ ID NO: 477604 - protein, 5 aa, Mycobacterium
GADPA

SEQ ID NO: 477605 - protein, 16 aa, Mycobacterium
GADPAAATIIVIPALD

SEQ ID NO: 477606 - protein, 8 aa, Mycobacterium
GADPAAAV

SEQ ID NO: 477607 - protein, 12 aa, Mycobacterium
GADPAAGTPSAL

SEQ ID NO: 477608 - protein, 7 aa, Mycobacterium
GADPAHE

SEQ ID NO: 477609 - protein, 8 aa, Mycobacterium
GADPAKVV

SEQ ID NO: 477610 - protein, 11 aa, Mycobacterium
GADPAPETKDT

SEQ ID NO: 477611 - protein, 8 aa, Mycobacterium
GADPAPPR

SEQ ID NO: 477612 - protein, 6 aa, Mycobacterium
GADPAQ

SEQ ID NO: 477613 - protein, 10 aa, Mycobacterium
GADPARVRPV

SEQ ID NO: 477614 - protein, 8 aa, Mycobacterium
GADPASAV

SEQ ID NO: 477615 - protein, 20 aa, Mycobacterium
GADPAVARAGRAEAAGDDSR

SEQ ID NO: 477616 - protein, 7 aa, Mycobacterium
GADPDAV

SEQ ID NO: 477617 - protein, 8 aa, Mycobacterium
GADPDAVR

SEQ ID NO: 477618 - protein, 15 aa, Mycobacterium
GADPDGQNGTRAARD

SEQ ID NO: 477619 - protein, 17 aa, Mycobacterium
GADPDIGARRVDPATDR

SEQ ID NO: 477620 - protein, 9 aa, Mycobacterium
GADPDLTSG

SEQ ID NO: 477621 - protein, 10 aa, Mycobacterium
GADPDQWADS

SEQ ID NO: 477622 - protein, 8 aa, Mycobacterium
GADPDRAA

SEQ ID NO: 477623 - protein, 9 aa, Mycobacterium
GADPDRAAA

SEQ ID NO: 477624 - protein, 9 aa, Mycobacterium
GADPDRAAR

SEQ ID NO: 477625 - protein, 9 aa, Mycobacterium
GADPDRAEP

SEQ ID NO: 477626 - protein, 9 aa, Mycobacterium
GADPEAATD

SEQ ID NO: 477627 - protein, 7 aa, Mycobacterium
GADPEAC

SEQ ID NO: 477628 - protein, 7 aa, Mycobacterium
GADPEPL

SEQ ID NO: 477629 - protein, 6 aa, Mycobacterium
GADPER

SEQ ID NO: 477630 - protein, 24 aa, Mycobacterium
GADPERVRPCGSDRHPRPAPRPSY

SEQ ID NO: 477631 - protein, 14 aa, Mycobacterium
GADPESVDPDEARH

SEQ ID NO: 477632 - protein, 7 aa, Mycobacterium
GADPEVG

SEQ ID NO: 477633 - protein, 8 aa, Mycobacterium
GADPGGVS

SEQ ID NO: 477634 - protein, 6 aa, Mycobacterium
GADPGI

SEQ ID NO: 477635 - protein, 7 aa, Mycobacterium
GADPGQI

SEQ ID NO: 477636 - protein, 9 aa, Mycobacterium
GADPGRAPA

SEQ ID NO: 477637 - protein, 8 aa, Mycobacterium
GADPGRVH

SEQ ID NO: 477638 - protein, 5 aa, Mycobacterium
GADPK

SEQ ID NO: 477639 - protein, 9 aa, Mycobacterium
GADPLAPPR

SEQ ID NO: 477640 - protein, 7 aa, Mycobacterium
GADPLGN

SEQ ID NO: 477641 - protein, 29 aa, Mycobacterium
GADPLGRGQAAQSKRSAQLQPRTASADEV

SEQ ID NO: 477642 - protein, 7 aa, Mycobacterium
GADPMDP

SEQ ID NO: 477643 - protein, 10 aa, Mycobacterium
GADPNAAKWA

SEQ ID NO: 477644 - protein, 13 aa, Mycobacterium
GADPPAEVKDAQN

SEQ ID NO: 477645 - protein, 11 aa, Mycobacterium
GADPQDPTATR

SEQ ID NO: 477646 - protein, 8 aa, Mycobacterium
GADPQGVA

SEQ ID NO: 477647 - protein, 8 aa, Mycobacterium
GADPQVGA

SEQ ID NO: 477648 - protein, 8 aa, Mycobacterium
GADPRARM

SEQ ID NO: 477649 - protein, 7 aa, Mycobacterium
GADPRDG

SEQ ID NO: 477650 - protein, 6 aa, Mycobacterium
GADPRE

SEQ ID NO: 477651 - protein, 8 aa, Mycobacterium
GADPRGRI

SEQ ID NO: 477652 - protein, 8 aa, Mycobacterium
GADPRGRM

SEQ ID NO: 477653 - protein, 7 aa, Mycobacterium
GADPRLT

SEQ ID NO: 477654 - protein, 8 aa, Mycobacterium
GADPRQIA

SEQ ID NO: 477655 - protein, 10 aa, Mycobacterium
GADPRRVRPV

SEQ ID NO: 477656 - protein, 8 aa, Mycobacterium
GADPRTRM

SEQ ID NO: 477657 - protein, 6 aa, Mycobacterium
GADPSE

SEQ ID NO: 477658 - protein, 7 aa, Mycobacterium
GADPSRG

SEQ ID NO: 477659 - protein, 8 aa, Mycobacterium
GADPSRVG

SEQ ID NO: 477660 - protein, 10 aa, Mycobacterium
GADPTAGRQR

SEQ ID NO: 477661 - protein, 7 aa, Mycobacterium
GADPTDG

SEQ ID NO: 477662 - protein, 8 aa, Mycobacterium
GADPTGEA

SEQ ID NO: 477663 - protein, 7 aa, Mycobacterium
GADPTLA

SEQ ID NO: 477664 - protein, 9 aa, Mycobacterium
GADPTPPAA

SEQ ID NO: 477665 - protein, 7 aa, Mycobacterium
GADPTVA

SEQ ID NO: 477666 - protein, 8 aa, Mycobacterium
GADPVDAT

SEQ ID NO: 477667 - protein, 8 aa, Mycobacterium
GADPVSET

SEQ ID NO: 477668 - protein, 10 aa, Mycobacterium
GADQAPASVH

SEQ ID NO: 477669 - protein, 7 aa, Mycobacterium
GADQIPG

SEQ ID NO: 477670 - protein, 12 aa, Mycobacterium
GADQNAVSTGKE

SEQ ID NO: 477671 - protein, 20 aa, Mycobacterium
GADQPDGSAGLSADVTAAAA

SEQ ID NO: 477672 - protein, 7 aa, Mycobacterium
GADQPGR

SEQ ID NO: 477673 - protein, 7 aa, Mycobacterium
GADQPPF

SEQ ID NO: 477674 - protein, 13 aa, Mycobacterium
GADQRGGSPDFPA

SEQ ID NO: 477675 - protein, 6 aa, Mycobacterium
GADQRR

SEQ ID NO: 477676 - protein, 6 aa, Mycobacterium
GADQVS

SEQ ID NO: 477677 - protein, 13 aa, Mycobacterium
GADRADQLRTDVE

SEQ ID NO: 477678 - protein, 19 aa, Mycobacterium
GADRADQLRTDVEAATAGW

SEQ ID NO: 477679 - protein, 11 aa, Mycobacterium
GADRADTLRTD

SEQ ID NO: 477680 - protein, 14 aa, Mycobacterium
GADRALDQASLARA

SEQ ID NO: 477681 - protein, 10 aa, Mycobacterium
GADRASAAVA

SEQ ID NO: 477682 - protein, 8 aa, Mycobacterium
GADRDEAL

SEQ ID NO: 477683 - protein, 8 aa, Mycobacterium
GADRDEAV

SEQ ID NO: 477684 - protein, 8 aa, Mycobacterium
GADRDKAA

SEQ ID NO: 477685 - protein, 6 aa, Mycobacterium
GADRDR

SEQ ID NO: 477686 - protein, 6 aa, Mycobacterium
GADREA

SEQ ID NO: 477687 - protein, 7 aa, Mycobacterium
GADREQA

SEQ ID NO: 477688 - protein, 9 aa, Mycobacterium
GADRESRAD

SEQ ID NO: 477689 - protein, 9 aa, Mycobacterium
GADRGQGRR

SEQ ID NO: 477690 - protein, 9 aa, Mycobacterium
GADRGTAAQ

SEQ ID NO: 477691 - protein, 8 aa, Mycobacterium
GADRGTQL

SEQ ID NO: 477692 - protein, 7 aa, Mycobacterium
GADRLEP

SEQ ID NO: 477693 - protein, 11 aa, Mycobacterium
GADRPAARPDD

SEQ ID NO: 477694 - protein, 8 aa, Mycobacterium
GADRPGWA

SEQ ID NO: 477695 - protein, 7 aa, Mycobacterium
GADRRTQ

SEQ ID NO: 477696 - protein, 7 aa, Mycobacterium
GADRSRG

SEQ ID NO: 477697 - protein, 6 aa, Mycobacterium
GADRTA

SEQ ID NO: 477698 - protein, 8 aa, Mycobacterium
GADRTGHA

SEQ ID NO: 477699 - protein, 19 aa, Mycobacterium
GADRVRAEGRTHDAGDRSV

SEQ ID NO: 477700 - protein, 4 aa, Mycobacterium
GADS

SEQ ID NO: 477701 - protein, 9 aa, Mycobacterium
GADSFGDER

SEQ ID NO: 477702 - protein, 6 aa, Mycobacterium
GADSPL

SEQ ID NO: 477703 - protein, 7 aa, Mycobacterium
GADSPLV

SEQ ID NO: 477704 - protein, 10 aa, Mycobacterium
GADSPTHAGV

SEQ ID NO: 477705 - protein, 8 aa, Mycobacterium
GADSPYET

SEQ ID NO: 477706 - protein, 6 aa, Mycobacterium
GADSQR

SEQ ID NO: 477707 - protein, 8 aa, Mycobacterium
GADSRGRM

SEQ ID NO: 477708 - protein, 7 aa, Mycobacterium
GADSSDI

SEQ ID NO: 477709 - protein, 8 aa, Mycobacterium
GADSSRPT

SEQ ID NO: 477710 - protein, 9 aa, Mycobacterium
GADSTNLTV

SEQ ID NO: 477711 - protein, 5 aa, Mycobacterium
GADSY

SEQ ID NO: 477712 - protein, 9 aa, Mycobacterium
GADTAAGAR

SEQ ID NO: 477713 - protein, 9 aa, Mycobacterium
GADTAATAR

SEQ ID NO: 477714 - protein, 14 aa, Mycobacterium
GADTADAAPEDAGT

SEQ ID NO: 477715 - protein, 9 aa, Mycobacterium
GADTATGTQ

SEQ ID NO: 477716 - protein, 9 aa, Mycobacterium
GADTDPSIN

SEQ ID NO: 477717 - protein, 9 aa, Mycobacterium
GADTDPTVN

SEQ ID NO: 477718 - protein, 13 aa, Mycobacterium
GADTERTRVLLST

SEQ ID NO: 477719 - protein, 6 aa, Mycobacterium
GADTGA

SEQ ID NO: 477720 - protein, 29 aa, Mycobacterium
GADTGAGAALTATADPEDGTSSPTARSGV

SEQ ID NO: 477721 - protein, 6 aa, Mycobacterium
GADTGL

SEQ ID NO: 477722 - protein, 6 aa, Mycobacterium
GADTLP

SEQ ID NO: 477723 - protein, 10 aa, Mycobacterium
GADTQERRAA

SEQ ID NO: 477724 - protein, 22 aa, Mycobacterium
GADTRSTPAGYRDAIDGPGLLR

SEQ ID NO: 477725 - protein, 5 aa, Mycobacterium
GADTS

SEQ ID NO: 477726 - protein, 6 aa, Mycobacterium
GADTSA

SEQ ID NO: 477727 - protein, 9 aa, Mycobacterium
GADTSEAGT

SEQ ID NO: 477728 - protein, 13 aa, Mycobacterium
GADTTTGRGNNVN

SEQ ID NO: 477729 - protein, 7 aa, Mycobacterium
GADTVQG

SEQ ID NO: 477730 - protein, 7 aa, Mycobacterium
GADTVRD

SEQ ID NO: 477731 - protein, 4 aa, Mycobacterium
GADV

SEQ ID NO: 477732 - protein, 20 aa, Mycobacterium
GADVASGDAFGEVESTKSVS

SEQ ID NO: 477733 - protein, 12 aa, Mycobacterium
GADVDSAGQPLQ

SEQ ID NO: 477734 - protein, 6 aa, Mycobacterium
GADVEP

SEQ ID NO: 477735 - protein, 11 aa, Mycobacterium
GADVPAGDESL

SEQ ID NO: 477736 - protein, 15 aa, Mycobacterium
GADVPGPAHDPTAQW

SEQ ID NO: 477737 - protein, 6 aa, Mycobacterium
GADVPR

SEQ ID NO: 477738 - protein, 9 aa, Mycobacterium
GADVRAAGR

SEQ ID NO: 477739 - protein, 7 aa, Mycobacterium
GADVRNE

SEQ ID NO: 477740 - protein, 8 aa, Mycobacterium
GADYGDAK

SEQ ID NO: 477741 - protein, 8 aa, Mycobacterium
GADYGQAK

SEQ ID NO: 477742 - protein, 8 aa, Mycobacterium
GADYPQAA

SEQ ID NO: 477743 - protein, 5 aa, Mycobacterium
GADYT

SEQ ID NO: 477744 - protein, 11 aa, Mycobacterium
GAEAAAKKDNI

SEQ ID NO: 477745 - protein, 13 aa, Mycobacterium
GAEAANASPLQTA

SEQ ID NO: 477746 - protein, 17 aa, Mycobacterium
GAEAARPHRVTHRKLTR

SEQ ID NO: 477747 - protein, 7 aa, Mycobacterium
GAEADGN

SEQ ID NO: 477748 - protein, 9 aa, Mycobacterium
GAEADPDAA

SEQ ID NO: 477749 - protein, 10 aa, Mycobacterium
GAEADPDAAN

SEQ ID NO: 477750 - protein, 7 aa, Mycobacterium
GAEADQQ

SEQ ID NO: 477751 - protein, 8 aa, Mycobacterium
GAEAERAN

SEQ ID NO: 477752 - protein, 14 aa, Mycobacterium
GAEAERAPNPWSAA

SEQ ID NO: 477753 - protein, 10 aa, Mycobacterium
GAEAETAARV

SEQ ID NO: 477754 - protein, 12 aa, Mycobacterium
GAEAGAALTAHP

SEQ ID NO: 477755 - protein, 12 aa, Mycobacterium
GAEAGGHGRPAL

SEQ ID NO: 477756 - protein, 12 aa, Mycobacterium
GAEAGGHGTPAV

SEQ ID NO: 477757 - protein, 13 aa, Mycobacterium
GAEAGPPTQLPAP

SEQ ID NO: 477758 - protein, 13 aa, Mycobacterium
GAEAGRFRAPAGE

SEQ ID NO: 477759 - protein, 8 aa, Mycobacterium
GAEAGTDL

SEQ ID NO: 477760 - protein, 5 aa, Mycobacterium
GAEAN

SEQ ID NO: 477761 - protein, 6 aa, Mycobacterium
GAEANG

SEQ ID NO: 477762 - protein, 8 aa, Mycobacterium
GAEAQGAR

SEQ ID NO: 477763 - protein, 5 aa, Mycobacterium
GAEAR

SEQ ID NO: 477764 - protein, 7 aa, Mycobacterium
GAEATEA

SEQ ID NO: 477765 - protein, 6 aa, Mycobacterium
GAEAVE

SEQ ID NO: 477766 - protein, 7 aa, Mycobacterium
GAEAVEN

SEQ ID NO: 477767 - protein, 6 aa, Mycobacterium
GAEAVS

SEQ ID NO: 477768 - protein, 9 aa, Mycobacterium
GAEAVTTDD

SEQ ID NO: 477769 - protein, 5 aa, Mycobacterium
GAECP

SEQ ID NO: 477770 - protein, 7 aa, Mycobacterium
GAECPPG

SEQ ID NO: 477771 - protein, 4 aa, Mycobacterium
GAED

SEQ ID NO: 477772 - protein, 5 aa, Mycobacterium
GAEDA

SEQ ID NO: 477773 - protein, 10 aa, Mycobacterium
GAEDENKRKF

SEQ ID NO: 477774 - protein, 7 aa, Mycobacterium
GAEDEVS

SEQ ID NO: 477775 - protein, 6 aa, Mycobacterium
GAEDGL

SEQ ID NO: 477776 - protein, 10 aa, Mycobacterium
GAEDLGGGDV

SEQ ID NO: 477777 - protein, 17 aa, Mycobacterium
GAEDPDEDDNSPGANYA

SEQ ID NO: 477778 - protein, 9 aa, Mycobacterium
GAEDSDVQA

SEQ ID NO: 477779 - protein, 18 aa, Mycobacterium
GAEDSGIEGYTQHTSPVS

SEQ ID NO: 477780 - protein, 11 aa, Mycobacterium
GAEDTPNQKYR

SEQ ID NO: 477781 - protein, 6 aa, Mycobacterium
GAEEAE

SEQ ID NO: 477782 - protein, 11 aa, Mycobacterium
GAEEAPNQKYR

SEQ ID NO: 477783 - protein, 7 aa, Mycobacterium
GAEEHRA

SEQ ID NO: 477784 - protein, 34 aa, Mycobacterium
GAEEKMSPEEAEEWGGAADEPFDPNYHKNTDTLE

SEQ ID NO: 477785 - protein, 8 aa, Mycobacterium
GAEELSSP

SEQ ID NO: 477786 - protein, 12 aa, Mycobacterium
GAEEPTDEERAG

SEQ ID NO: 477787 - protein, 13 aa, Mycobacterium
GAEERFQAAEQNL

SEQ ID NO: 477788 - protein, 7 aa, Mycobacterium
GAEERLR

SEQ ID NO: 477789 - protein, 9 aa, Mycobacterium
GAEESARDE

SEQ ID NO: 477790 - protein, 8 aa, Mycobacterium
GAEESNRD

SEQ ID NO: 477791 - protein, 5 aa, Mycobacterium
GAEEV

SEQ ID NO: 477792 - protein, 7 aa, Mycobacterium
GAEEVSA

SEQ ID NO: 477793 - protein, 5 aa, Mycobacterium
GAEFD

SEQ ID NO: 477794 - protein, 5 aa, Mycobacterium
GAEGA

SEQ ID NO: 477795 - protein, 12 aa, Mycobacterium
GAEGAAEVPESR

SEQ ID NO: 477796 - protein, 11 aa, Mycobacterium
GAEGAEEVPET

SEQ ID NO: 477797 - protein, 15 aa, Mycobacterium
GAEGAVAAGAELTPT

SEQ ID NO: 477798 - protein, 10 aa, Mycobacterium
GAEGDDFDPS

SEQ ID NO: 477799 - protein, 9 aa, Mycobacterium
GAEGDSGDG

SEQ ID NO: 477800 - protein, 7 aa, Mycobacterium
GAEGEDF

SEQ ID NO: 477801 - protein, 9 aa, Mycobacterium
GAEGEGNQH

SEQ ID NO: 477802 - protein, 8 aa, Mycobacterium
GAEGELTN

SEQ ID NO: 477803 - protein, 7 aa, Mycobacterium
GAEGEVR

SEQ ID NO: 477804 - protein, 6 aa, Mycobacterium
GAEGGE

SEQ ID NO: 477805 - protein, 8 aa, Mycobacterium
GAEGGYGN

SEQ ID NO: 477806 - protein, 5 aa, Mycobacterium
GAEGI

SEQ ID NO: 477807 - protein, 6 aa, Mycobacterium
GAEGLP

SEQ ID NO: 477808 - protein, 6 aa, Mycobacterium
GAEGMN

SEQ ID NO: 477809 - protein, 19 aa, Mycobacterium
GAEGPAKGAPLPPADYPNI

SEQ ID NO: 477810 - protein, 11 aa, Mycobacterium
GAEGPTDDEAV

SEQ ID NO: 477811 - protein, 11 aa, Mycobacterium
GAEGPTDDPEV

SEQ ID NO: 477812 - protein, 12 aa, Mycobacterium
GAEGPTDDPEVN

SEQ ID NO: 477813 - protein, 8 aa, Mycobacterium
GAEGQGWK

SEQ ID NO: 477814 - protein, 8 aa, Mycobacterium
GAEGQTET

SEQ ID NO: 477815 - protein, 8 aa, Mycobacterium
GAEGQVST

SEQ ID NO: 477816 - protein, 11 aa, Mycobacterium
GAEGRRPRSLT

SEQ ID NO: 477817 - protein, 13 aa, Mycobacterium
GAEGSKDLPQDDG

SEQ ID NO: 477818 - protein, 6 aa, Mycobacterium
GAEGTN

SEQ ID NO: 477819 - protein, 16 aa, Mycobacterium
GAEHPTGTFPETEKAA

SEQ ID NO: 477820 - protein, 9 aa, Mycobacterium
GAEHRASEA

SEQ ID NO: 477821 - protein, 12 aa, Mycobacterium
GAEIPTDRGYGH

SEQ ID NO: 477822 - protein, 7 aa, Mycobacterium
GAEIRGR

SEQ ID NO: 477823 - protein, 7 aa, Mycobacterium
GAEKFTP

SEQ ID NO: 477824 - protein, 10 aa, Mycobacterium
GAEKPGDEGE

SEQ ID NO: 477825 - protein, 9 aa, Mycobacterium
GAEKTAQLS

SEQ ID NO: 477826 - protein, 7 aa, Mycobacterium
GAEKTNV

SEQ ID NO: 477827 - protein, 6 aa, Mycobacterium
GAELAG

SEQ ID NO: 477828 - protein, 14 aa, Mycobacterium
GAELATSARRQAER

SEQ ID NO: 477829 - protein, 6 aa, Mycobacterium
GAELDD

SEQ ID NO: 477830 - protein, 17 aa, Mycobacterium
GAELGPGYPRRPASHSA

SEQ ID NO: 477831 - protein, 9 aa, Mycobacterium
GAELPSDTH

SEQ ID NO: 477832 - protein, 12 aa, Mycobacterium
GAELSGPVDPGT

SEQ ID NO: 477833 - protein, 8 aa, Mycobacterium
GAELTAGQ

SEQ ID NO: 477834 - protein, 10 aa, Mycobacterium
GAEMGSAEHT

SEQ ID NO: 477835 - protein, 13 aa, Mycobacterium
GAEMTGEDWGSGF

SEQ ID NO: 477836 - protein, 13 aa, Mycobacterium
GAENCPERAITLS

SEQ ID NO: 477837 - protein, 11 aa, Mycobacterium
GAENPDPGPYA

SEQ ID NO: 477838 - protein, 12 aa, Mycobacterium
GAENPGKGRYSD

SEQ ID NO: 477839 - protein, 9 aa, Mycobacterium
GAENQGSGV

SEQ ID NO: 477840 - protein, 5 aa, Mycobacterium
GAENR

SEQ ID NO: 477841 - protein, 7 aa, Mycobacterium
GAENRPT

SEQ ID NO: 477842 - protein, 5 aa, Mycobacterium
GAENS

SEQ ID NO: 477843 - protein, 7 aa, Mycobacterium
GAENSGF

SEQ ID NO: 477844 - protein, 5 aa, Mycobacterium
GAENT

SEQ ID NO: 477845 - protein, 11 aa, Mycobacterium
GAEPAATQRPV

SEQ ID NO: 477846 - protein, 7 aa, Mycobacterium
GAEPATA

SEQ ID NO: 477847 - protein, 9 aa, Mycobacterium
GAEPDAPAN

SEQ ID NO: 477848 - protein, 12 aa, Mycobacterium
GAEPDEDTVTST

SEQ ID NO: 477849 - protein, 9 aa, Mycobacterium
GAEPDEESL

SEQ ID NO: 477850 - protein, 6 aa, Mycobacterium
GAEPDQ

SEQ ID NO: 477851 - protein, 7 aa, Mycobacterium
GAEPGDT

SEQ ID NO: 477852 - protein, 6 aa, Mycobacterium
GAEPGL

SEQ ID NO: 477853 - protein, 7 aa, Mycobacterium
GAEPGSI

SEQ ID NO: 477854 - protein, 23 aa, Mycobacterium
GAEPGTGNHPDRHGQQAQRGGQR

SEQ ID NO: 477855 - protein, 7 aa, Mycobacterium
GAEPGTV

SEQ ID NO: 477856 - protein, 6 aa, Mycobacterium
GAEPID

SEQ ID NO: 477857 - protein, 5 aa, Mycobacterium
GAEPM

SEQ ID NO: 477858 - protein, 5 aa, Mycobacterium
GAEPP

SEQ ID NO: 477859 - protein, 6 aa, Mycobacterium
GAEPQA

SEQ ID NO: 477860 - protein, 14 aa, Mycobacterium
GAEPQDAFRFARTL

SEQ ID NO: 477861 - protein, 6 aa, Mycobacterium
GAEPQH

SEQ ID NO: 477862 - protein, 9 aa, Mycobacterium
GAEPRAERR

SEQ ID NO: 477863 - protein, 8 aa, Mycobacterium
GAEPRATR

SEQ ID NO: 477864 - protein, 7 aa, Mycobacterium
GAEPRPR

SEQ ID NO: 477865 - protein, 6 aa, Mycobacterium
GAEPSE

SEQ ID NO: 477866 - protein, 8 aa, Mycobacterium
GAEPSRGG

SEQ ID NO: 477867 - protein, 6 aa, Mycobacterium
GAEPTA

SEQ ID NO: 477868 - protein, 7 aa, Mycobacterium
GAEPTAE

SEQ ID NO: 477869 - protein, 9 aa, Mycobacterium
GAEPTAERR

SEQ ID NO: 477870 - protein, 8 aa, Mycobacterium
GAEPTAEV

SEQ ID NO: 477871 - protein, 9 aa, Mycobacterium
GAEPTANAI

SEQ ID NO: 477872 - protein, 9 aa, Mycobacterium
GAEPTAQRR

SEQ ID NO: 477873 - protein, 8 aa, Mycobacterium
GAEPTASR

SEQ ID NO: 477874 - protein, 8 aa, Mycobacterium
GAEPTCER

SEQ ID NO: 477875 - protein, 6 aa, Mycobacterium
GAEPTI

SEQ ID NO: 477876 - protein, 8 aa, Mycobacterium
GAEPTPVV

SEQ ID NO: 477877 - protein, 7 aa, Mycobacterium
GAEPVRA

SEQ ID NO: 477878 - protein, 11 aa, Mycobacterium
GAEPVTPGGYG

SEQ ID NO: 477879 - protein, 5 aa, Mycobacterium
GAEQG

SEQ ID NO: 477880 - protein, 10 aa, Mycobacterium
GAEQGGIDPV

SEQ ID NO: 477881 - protein, 10 aa, Mycobacterium
GAEQGGIDRQ

SEQ ID NO: 477882 - protein, 13 aa, Mycobacterium
GAEQGGIDTNQAR

SEQ ID NO: 477883 - protein, 5 aa, Mycobacterium
GAEQI

SEQ ID NO: 477884 - protein, 29 aa, Mycobacterium
GAEQRAGDADPRPGPHPAGHGDGAPEPDG

SEQ ID NO: 477885 - protein, 16 aa, Mycobacterium
GAERAADEALTSSDRR

SEQ ID NO: 477886 - protein, 18 aa, Mycobacterium
GAERADAAEVERNPRSAP

SEQ ID NO: 477887 - protein, 18 aa, Mycobacterium
GAERADAEEIERNPRSAP

SEQ ID NO: 477888 - protein, 13 aa, Mycobacterium
GAERAEALRRYQS

SEQ ID NO: 477889 - protein, 7 aa, Mycobacterium
GAERAHD

SEQ ID NO: 477890 - protein, 6 aa, Mycobacterium
GAERAK

SEQ ID NO: 477891 - protein, 13 aa, Mycobacterium
GAERAQDVAGKTV

SEQ ID NO: 477892 - protein, 11 aa, Mycobacterium
GAERARDWGDA

SEQ ID NO: 477893 - protein, 12 aa, Mycobacterium
GAERAREVSGQT

SEQ ID NO: 477894 - protein, 8 aa, Mycobacterium
GAERASRL

SEQ ID NO: 477895 - protein, 9 aa, Mycobacterium
GAERAVGRD

SEQ ID NO: 477896 - protein, 8 aa, Mycobacterium
GAERDDAR

SEQ ID NO: 477897 - protein, 36 aa, Mycobacterium
GAERDDSDGLQPVSPSGVNSVGAAHGRALRGDELPG

SEQ ID NO: 477898 - protein, 7 aa, Mycobacterium
GAERDEA

SEQ ID NO: 477899 - protein, 22 aa, Mycobacterium
GAERELDRAEKTPARYYLFQRR

SEQ ID NO: 477900 - protein, 7 aa, Mycobacterium
GAERGRE

SEQ ID NO: 477901 - protein, 8 aa, Mycobacterium
GAERGSRL

SEQ ID NO: 477902 - protein, 12 aa, Mycobacterium
GAERLTGPAQIE

SEQ ID NO: 477903 - protein, 5 aa, Mycobacterium
GAERP

SEQ ID NO: 477904 - protein, 7 aa, Mycobacterium
GAERPGY

SEQ ID NO: 477905 - protein, 5 aa, Mycobacterium
GAERQ

SEQ ID NO: 477906 - protein, 17 aa, Mycobacterium
GAERSPTINTAGEPAAI

SEQ ID NO: 477907 - protein, 4 aa, Mycobacterium
GAES

SEQ ID NO: 477908 - protein, 10 aa, Mycobacterium
GAESEAVEEE

SEQ ID NO: 477909 - protein, 10 aa, Mycobacterium
GAESEDDAVT

SEQ ID NO: 477910 - protein, 20 aa, Mycobacterium
GAESGDAIAATGAVGPSSPL

SEQ ID NO: 477911 - protein, 8 aa, Mycobacterium
GAESGPLT

SEQ ID NO: 477912 - protein, 6 aa, Mycobacterium
GAESGV

SEQ ID NO: 477913 - protein, 5 aa, Mycobacterium
GAESL

SEQ ID NO: 477914 - protein, 10 aa, Mycobacterium
GAESLPADER

SEQ ID NO: 477915 - protein, 6 aa, Mycobacterium
GAESMS

SEQ ID NO: 477916 - protein, 9 aa, Mycobacterium
GAESPQETR

SEQ ID NO: 477917 - protein, 10 aa, Mycobacterium
GAESPQETRT

SEQ ID NO: 477918 - protein, 6 aa, Mycobacterium
GAESRS

SEQ ID NO: 477919 - protein, 6 aa, Mycobacterium
GAESVG

SEQ ID NO: 477920 - protein, 4 aa, Mycobacterium
GAET

SEQ ID NO: 477921 - protein, 5 aa, Mycobacterium
GAETA

SEQ ID NO: 477922 - protein, 6 aa, Mycobacterium
GAETAD

SEQ ID NO: 477923 - protein, 7 aa, Mycobacterium
GAETAEG

SEQ ID NO: 477924 - protein, 6 aa, Mycobacterium
GAETAL

SEQ ID NO: 477925 - protein, 8 aa, Mycobacterium
GAETATAA

SEQ ID NO: 477926 - protein, 10 aa, Mycobacterium
GAETATGDAE

SEQ ID NO: 477927 - protein, 5 aa, Mycobacterium
GAETL

SEQ ID NO: 477928 - protein, 5 aa, Mycobacterium
GAETT

SEQ ID NO: 477929 - protein, 10 aa, Mycobacterium
GAETTRNAVG

SEQ ID NO: 477930 - protein, 7 aa, Mycobacterium
GAETTTA

SEQ ID NO: 477931 - protein, 4 aa, Mycobacterium
GAEV

SEQ ID NO: 477932 - protein, 5 aa, Mycobacterium
GAEVD

SEQ ID NO: 477933 - protein, 13 aa, Mycobacterium
GAEVEEVDPGFAD

SEQ ID NO: 477934 - protein, 13 aa, Mycobacterium
GAEVEGRPLRGST

SEQ ID NO: 477935 - protein, 5 aa, Mycobacterium
GAEVK

SEQ ID NO: 477936 - protein, 6 aa, Mycobacterium
GAEVND

SEQ ID NO: 477937 - protein, 6 aa, Mycobacterium
GAEVPG

SEQ ID NO: 477938 - protein, 6 aa, Mycobacterium
GAEYPE

SEQ ID NO: 477939 - protein, 18 aa, Mycobacterium
GAEYPGRPQPGHPGPSGV

SEQ ID NO: 477940 - protein, 27 aa, Mycobacterium
GAEYRDLEQGEESTSDYRSARNGPAPE

SEQ ID NO: 477941 - protein, 7 aa, Mycobacterium
GAFDPEQ

SEQ ID NO: 477942 - protein, 7 aa, Mycobacterium
GAFDPRT

SEQ ID NO: 477943 - protein, 4 aa, Mycobacterium
GAFG

SEQ ID NO: 477944 - protein, 6 aa, Mycobacterium
GAFGKK

SEQ ID NO: 477945 - protein, 32 aa, Mycobacterium
GAFGPQYTQSQYAQQGYGYPAGYAAGGYPGDA

SEQ ID NO: 477946 - protein, 17 aa, Mycobacterium
GAFGQEAPVGPSPTEPG

SEQ ID NO: 477947 - protein, 8 aa, Mycobacterium
GAFNGQPQ

SEQ ID NO: 477948 - protein, 5 aa, Mycobacterium
GAFPA

SEQ ID NO: 477949 - protein, 6 aa, Mycobacterium
GAFPED

SEQ ID NO: 477950 - protein, 11 aa, Mycobacterium
GAFPEGGTDLE

SEQ ID NO: 477951 - protein, 8 aa, Mycobacterium
GAFPGSSV

SEQ ID NO: 477952 - protein, 6 aa, Mycobacterium
GAFPPD

SEQ ID NO: 477953 - protein, 6 aa, Mycobacterium
GAFPQE

SEQ ID NO: 477954 - protein, 5 aa, Mycobacterium
GAFRS

SEQ ID NO: 477955 - protein, 13 aa, Mycobacterium
GAFRSPGMDAQGT

SEQ ID NO: 477956 - protein, 15 aa, Mycobacterium
GAFSAAGRAQARRAA

SEQ ID NO: 477957 - protein, 25 aa, Mycobacterium
GAFSAEPIGQTAGDWAATATAPVPV

SEQ ID NO: 477958 - protein, 9 aa, Mycobacterium
GAFSPDPAA

SEQ ID NO: 477959 - protein, 6 aa, Mycobacterium
GAFTPS

SEQ ID NO: 477960 - protein, 17 aa, Mycobacterium
GAFTTELGDDRPRPVEG

SEQ ID NO: 477961 - protein, 7 aa, Mycobacterium
GAFTTPP

SEQ ID NO: 477962 - protein, 5 aa, Mycobacterium
GAGAA

SEQ ID NO: 477963 - protein, 11 aa, Mycobacterium
GAGAAAPASDL

SEQ ID NO: 477964 - protein, 8 aa, Mycobacterium
GAGAADTL

SEQ ID NO: 477965 - protein, 10 aa, Mycobacterium
GAGAAGELDG

SEQ ID NO: 477966 - protein, 13 aa, Mycobacterium
GAGAAGLPTADEL

SEQ ID NO: 477967 - protein, 7 aa, Mycobacterium
GAGAAGV

SEQ ID NO: 477968 - protein, 6 aa, Mycobacterium
GAGAAP

SEQ ID NO: 477969 - protein, 11 aa, Mycobacterium
GAGAAPGSAAA

SEQ ID NO: 477970 - protein, 6 aa, Mycobacterium
GAGAAT

SEQ ID NO: 477971 - protein, 5 aa, Mycobacterium
GAGAD

SEQ ID NO: 477972 - protein, 50 aa, Mycobacterium
GAGADGGNGFAGGTGGDGGTGGNTTGGTNGSGGNAGHGGNAGNGADGNVG

SEQ ID NO: 477973 - protein, 11 aa, Mycobacterium
GAGADSALADT

SEQ ID NO: 477974 - protein, 10 aa, Mycobacterium
GAGADSESAA

SEQ ID NO: 477975 - protein, 6 aa, Mycobacterium
GAGADT

SEQ ID NO: 477976 - protein, 7 aa, Mycobacterium
GAGAEAA

SEQ ID NO: 477977 - protein, 15 aa, Mycobacterium
GAGAEGPSGSAGAGV

SEQ ID NO: 477978 - protein, 9 aa, Mycobacterium
GAGAEPGDP

SEQ ID NO: 477979 - protein, 5 aa, Mycobacterium
GAGAG

SEQ ID NO: 477980 - protein, 38 aa, Mycobacterium
GAGAGAAKRKVKDPDKSIEMPSRPNSEPIKGERGDPIR

SEQ ID NO: 477981 - protein, 22 aa, Mycobacterium
GAGAGARAGTLKGGVGSASVNV

SEQ ID NO: 477982 - protein, 24 aa, Mycobacterium
GAGAGASPLPQAAANGSPRGSRRR

SEQ ID NO: 477983 - protein, 8 aa, Mycobacterium
GAGAGDLS

SEQ ID NO: 477984 - protein, 8 aa, Mycobacterium
GAGAGELS

SEQ ID NO: 477985 - protein, 8 aa, Mycobacterium
GAGAGGTH

SEQ ID NO: 477986 - protein, 7 aa, Mycobacterium
GAGAGGY

SEQ ID NO: 477987 - protein, 10 aa, Mycobacterium
GAGAGPGAGV

SEQ ID NO: 477988 - protein, 7 aa, Mycobacterium
GAGAGPM

SEQ ID NO: 477989 - protein, 7 aa, Mycobacterium
GAGAGQV

SEQ ID NO: 477990 - protein, 7 aa, Mycobacterium
GAGAGSL

SEQ ID NO: 477991 - protein, 10 aa, Mycobacterium
GAGAGSRDLR

SEQ ID NO: 477992 - protein, 13 aa, Mycobacterium
GAGAISLPLLVSG

SEQ ID NO: 477993 - protein, 9 aa, Mycobacterium
GAGAPAPLR

SEQ ID NO: 477994 - protein, 8 aa, Mycobacterium
GAGAPARR

SEQ ID NO: 477995 - protein, 12 aa, Mycobacterium
GAGAPDAGDPAI

SEQ ID NO: 477996 - protein, 11 aa, Mycobacterium
GAGAPDAYKRA

SEQ ID NO: 477997 - protein, 9 aa, Mycobacterium
GAGAPGARE

SEQ ID NO: 477998 - protein, 9 aa, Mycobacterium
GAGAPRAVP

SEQ ID NO: 477999 - protein, 10 aa, Mycobacterium
GAGAPRDPAG

SEQ ID NO: 478000 - protein, 8 aa, Mycobacterium
GAGAPTEA

SEQ ID NO: 478001 - protein, 9 aa, Mycobacterium
GAGAQPVEQ

SEQ ID NO: 478002 - protein, 9 aa, Mycobacterium
GAGARAPEI

SEQ ID NO: 478003 - protein, 12 aa, Mycobacterium
GAGARDADRRLP

SEQ ID NO: 478004 - protein, 19 aa, Mycobacterium
GAGARPSRPRRGNDLETET

SEQ ID NO: 478005 - protein, 7 aa, Mycobacterium
GAGARRV

SEQ ID NO: 478006 - protein, 17 aa, Mycobacterium
GAGASAYRTLSKASSAN

SEQ ID NO: 478007 - protein, 15 aa, Mycobacterium
GAGASFADADAGGRA

SEQ ID NO: 478008 - protein, 7 aa, Mycobacterium
GAGASQD

SEQ ID NO: 478009 - protein, 10 aa, Mycobacterium
GAGATASVEL

SEQ ID NO: 478010 - protein, 9 aa, Mycobacterium
GAGATEASE

SEQ ID NO: 478011 - protein, 9 aa, Mycobacterium
GAGATEDEL

SEQ ID NO: 478012 - protein, 10 aa, Mycobacterium
GAGATGPEAE

SEQ ID NO: 478013 - protein, 10 aa, Mycobacterium
GAGATPPAKA

SEQ ID NO: 478014 - protein, 10 aa, Mycobacterium
GAGATRDDLD

SEQ ID NO: 478015 - protein, 7 aa, Mycobacterium
GAGATSA

SEQ ID NO: 478016 - protein, 6 aa, Mycobacterium
GAGATT

SEQ ID NO: 478017 - protein, 5 aa, Mycobacterium
GAGAY

SEQ ID NO: 478018 - protein, 5 aa, Mycobacterium
GAGDA

SEQ ID NO: 478019 - protein, 9 aa, Mycobacterium
GAGDAERAA

SEQ ID NO: 478020 - protein, 6 aa, Mycobacterium
GAGDAT

SEQ ID NO: 478021 - protein, 13 aa, Mycobacterium
GAGDDESQDDQGV

SEQ ID NO: 478022 - protein, 7 aa, Mycobacterium
GAGDDYA

SEQ ID NO: 478023 - protein, 7 aa, Mycobacterium
GAGDEAI

SEQ ID NO: 478024 - protein, 18 aa, Mycobacterium
GAGDERRHAGLSALERAL

SEQ ID NO: 478025 - protein, 11 aa, Mycobacterium
GAGDERTQRAN

SEQ ID NO: 478026 - protein, 9 aa, Mycobacterium
GAGDESPAE

SEQ ID NO: 478027 - protein, 18 aa, Mycobacterium
GAGDGGRCDQRGSFTGNE

SEQ ID NO: 478028 - protein, 16 aa, Mycobacterium
GAGDGGSGGNGGAGGQ

SEQ ID NO: 478029 - protein, 14 aa, Mycobacterium
GAGDGIQATDIRSL

SEQ ID NO: 478030 - protein, 29 aa, Mycobacterium
GAGDKTDPADNPPPGPTDHGREGGMATRE

SEQ ID NO: 478031 - protein, 12 aa, Mycobacterium
GAGDLPEGLEGG

SEQ ID NO: 478032 - protein, 5 aa, Mycobacterium
GAGDR

SEQ ID NO: 478033 - protein, 9 aa, Mycobacterium
GAGDRVDGW

SEQ ID NO: 478034 - protein, 6 aa, Mycobacterium
GAGDSL

SEQ ID NO: 478035 - protein, 5 aa, Mycobacterium
GAGDV

SEQ ID NO: 478036 - protein, 7 aa, Mycobacterium
GAGEAAA

SEQ ID NO: 478037 - protein, 7 aa, Mycobacterium
GAGEADT

SEQ ID NO: 478038 - protein, 11 aa, Mycobacterium
GAGEAETAPPF

SEQ ID NO: 478039 - protein, 8 aa, Mycobacterium
GAGEANIN

SEQ ID NO: 478040 - protein, 6 aa, Mycobacterium
GAGEDR

SEQ ID NO: 478041 - protein, 10 aa, Mycobacterium
GAGEEGEIQV

SEQ ID NO: 478042 - protein, 7 aa, Mycobacterium
GAGEEGR

SEQ ID NO: 478043 - protein, 10 aa, Mycobacterium
GAGEGGSRAA

SEQ ID NO: 478044 - protein, 17 aa, Mycobacterium
GAGEGSAISDRDFKAAG

SEQ ID NO: 478045 - protein, 17 aa, Mycobacterium
GAGEGSAISDSDFKAAG

SEQ ID NO: 478046 - protein, 11 aa, Mycobacterium
GAGEGSRDIPQ

SEQ ID NO: 478047 - protein, 7 aa, Mycobacterium
GAGEGYD

SEQ ID NO: 478048 - protein, 17 aa, Mycobacterium
GAGEGYRCTCGDALTPV

SEQ ID NO: 478049 - protein, 6 aa, Mycobacterium
GAGEHG

SEQ ID NO: 478050 - protein, 7 aa, Mycobacterium
GAGEHPN

SEQ ID NO: 478051 - protein, 7 aa, Mycobacterium
GAGEKSF

SEQ ID NO: 478052 - protein, 13 aa, Mycobacterium
GAGELGGAEQATR

SEQ ID NO: 478053 - protein, 8 aa, Mycobacterium
GAGENGDA

SEQ ID NO: 478054 - protein, 12 aa, Mycobacterium
GAGEPAPTEGDE

SEQ ID NO: 478055 - protein, 17 aa, Mycobacterium
GAGEPYRCTCGDELTPV

SEQ ID NO: 478056 - protein, 17 aa, Mycobacterium
GAGEPYRCTCGDELVPV

SEQ ID NO: 478057 - protein, 6 aa, Mycobacterium
GAGERG

SEQ ID NO: 478058 - protein, 7 aa, Mycobacterium
GAGERSM

SEQ ID NO: 478059 - protein, 11 aa, Mycobacterium
GAGESIPFPDD

SEQ ID NO: 478060 - protein, 8 aa, Mycobacterium
GAGESQNL

SEQ ID NO: 478061 - protein, 17 aa, Mycobacterium
GAGESRLRRAEPETPLP

SEQ ID NO: 478062 - protein, 8 aa, Mycobacterium
GAGEYPTI

SEQ ID NO: 478063 - protein, 6 aa, Mycobacterium
GAGFAD

SEQ ID NO: 478064 - protein, 27 aa, Mycobacterium
GAGFGGPGFGGPGFGGPGLGPGGPAGF

SEQ ID NO: 478065 - protein, 5 aa, Mycobacterium
GAGFP

SEQ ID NO: 478066 - protein, 5 aa, Mycobacterium
GAGGA

SEQ ID NO: 478067 - protein, 11 aa, Mycobacterium
GAGGAAGNAGL

SEQ ID NO: 478068 - protein, 13 aa, Mycobacterium
GAGGAALRERTSA

SEQ ID NO: 478069 - protein, 10 aa, Mycobacterium
GAGGADRGSA

SEQ ID NO: 478070 - protein, 23 aa, Mycobacterium
GAGGAGDTGGSGGSTGGDDGPDG

SEQ ID NO: 478071 - protein, 10 aa, Mycobacterium
GAGGAGEDGG

SEQ ID NO: 478072 - protein, 29 aa, Mycobacterium
GAGGAGGAGANTGISNPGFGGAGGDGGAG

SEQ ID NO: 478073 - protein, 29 aa, Mycobacterium
GAGGAGGAGGNSPLGNTANGGNGGTGGAG

SEQ ID NO: 478074 - protein, 26 aa, Mycobacterium
GAGGAGGAGGSSTGGAGGTGGAGGAG

SEQ ID NO: 478075 - protein, 72 aa, Mycobacterium
GAGGAGGDGLDGGPGAMGLTGGTGGHGGDNTSSATRPGVGGAGGYGGTGGTGGTGGTGGNGGNGGAGGAGGL

SEQ ID NO: 478076 - protein, 9 aa, Mycobacterium
GAGGAGGFG

SEQ ID NO: 478077 - protein, 43 aa, Mycobacterium
GAGGAGGHGVAGTAGTTASSAGVSGTDGGAGGIGGDGGAGGAG

SEQ ID NO: 478078 - protein, 25 aa, Mycobacterium
GAGGAGGITIGGTGGTGGAGGTGGQ

SEQ ID NO: 478079 - protein, 12 aa, Mycobacterium
GAGGAGGNGGAG

SEQ ID NO: 478080 - protein, 23 aa, Mycobacterium
GAGGAGGQSLSSGVGGDGGTGGN

SEQ ID NO: 478081 - protein, 65 aa, Mycobacterium
GAGGAGGRLAGHAGSTGSPGTQVSAPGNPGGPSDPGGPVDPGQNAVDAARSGDLASSNGGTITDG

SEQ ID NO: 478082 - protein, 23 aa, Mycobacterium
GAGGAGGTGITSGGVGGDGGAGG

SEQ ID NO: 478083 - protein, 43 aa, Mycobacterium
GAGGAGGVGADGTSAHVDGGTGGTGGTGGGTGGTGGIGGTGGG

SEQ ID NO: 478084 - protein, 10 aa, Mycobacterium
GAGGAPTASA

SEQ ID NO: 478085 - protein, 11 aa, Mycobacterium
GAGGAPTASAV

SEQ ID NO: 478086 - protein, 22 aa, Mycobacterium
GAGGAYAAAEAANASPLQAAQQ

SEQ ID NO: 478087 - protein, 18 aa, Mycobacterium
GAGGAYAAAEAASTSPLQ

SEQ ID NO: 478088 - protein, 6 aa, Mycobacterium
GAGGDF

SEQ ID NO: 478089 - protein, 25 aa, Mycobacterium
GAGGDGGAATGAGGIGGAGGNGSSI

SEQ ID NO: 478090 - protein, 22 aa, Mycobacterium
GAGGDGGIGDDTGGHGGAGGIG

SEQ ID NO: 478091 - protein, 26 aa, Mycobacterium
GAGGDGGNGGKGGKGGLLFGSRGTTG

SEQ ID NO: 478092 - protein, 9 aa, Mycobacterium
GAGGDGGSV

SEQ ID NO: 478093 - protein, 10 aa, Mycobacterium
GAGGDGGVGG

SEQ ID NO: 478094 - protein, 10 aa, Mycobacterium
GAGGDGPARV

SEQ ID NO: 478095 - protein, 26 aa, Mycobacterium
GAGGDPGTGGGQGSDGKLGADGLGGA

SEQ ID NO: 478096 - protein, 13 aa, Mycobacterium
GAGGDSASDGPLT

SEQ ID NO: 478097 - protein, 13 aa, Mycobacterium
GAGGDSPADGPLT

SEQ ID NO: 478098 - protein, 10 aa, Mycobacterium
GAGGEDVSPQ

SEQ ID NO: 478099 - protein, 6 aa, Mycobacterium
GAGGEF

SEQ ID NO: 478100 - protein, 22 aa, Mycobacterium
GAGGEGGIGGITAGKGGAGGTG

SEQ ID NO: 478101 - protein, 23 aa, Mycobacterium
GAGGEGGNSATTAGVGGAGGAGG

SEQ ID NO: 478102 - protein, 11 aa, Mycobacterium
GAGGEPAGIGG

SEQ ID NO: 478103 - protein, 8 aa, Mycobacterium
GAGGETTA

SEQ ID NO: 478104 - protein, 6 aa, Mycobacterium
GAGGEV

SEQ ID NO: 478105 - protein, 56 aa, Mycobacterium
GAGGGAGGHGGPGDTDGGDGGAGGNGGLLGGAGGAGGTGGYSDDAPSSNGGAGGNA

SEQ ID NO: 478106 - protein, 44 aa, Mycobacterium
GAGGGDGGAGGASESANGGAGGAGGHAGAFGGPGGAGGSGGFGD

SEQ ID NO: 478107 - protein, 34 aa, Mycobacterium
GAGGGDGGAGGQGGIGFGGSGGSGGGGGVGGNAG

SEQ ID NO: 478108 - protein, 16 aa, Mycobacterium
GAGGGDGGAGGTGGFH

SEQ ID NO: 478109 - protein, 57 aa, Mycobacterium
GAGGGDGGAGGYGLTGAGGAGGAGGNSGLLSGPGGSGGTGGAGAVADGGVGGAGGSA

SEQ ID NO: 478110 - protein, 25 aa, Mycobacterium
GAGGGGGAAGAGAQGGGLGGDGGDA

SEQ ID NO: 478111 - protein, 31 aa, Mycobacterium
GAGGGGGEGGVGGTGAAGVTGSAGASGVGGR

SEQ ID NO: 478112 - protein, 25 aa, Mycobacterium
GAGGGGGLGGVGDAGAGGAGGVGGG

SEQ ID NO: 478113 - protein, 39 aa, Mycobacterium
GAGGGGGSGGLLGTGGAGGDGGQADDAVGGKGGAGGTGG

SEQ ID NO: 478114 - protein, 35 aa, Mycobacterium
GAGGGGGVAGIGGAGGTGAAAGVTGSAGASGVGGR

SEQ ID NO: 478115 - protein, 35 aa, Mycobacterium
GAGGGGGVAGVGGAGGTGAAAGVTGSAGASGVGGR

SEQ ID NO: 478116 - protein, 9 aa, Mycobacterium
GAGGGGIGT

SEQ ID NO: 478117 - protein, 8 aa, Mycobacterium
GAGGGHAP

SEQ ID NO: 478118 - protein, 25 aa, Mycobacterium
GAGGGHGGTGGYGAFDGGAGGVGGH

SEQ ID NO: 478119 - protein, 6 aa, Mycobacterium
GAGGGI

SEQ ID NO: 478120 - protein, 7 aa, Mycobacterium
GAGGGIG

SEQ ID NO: 478121 - protein, 6 aa, Mycobacterium
GAGGGS

SEQ ID NO: 478122 - protein, 6 aa, Mycobacterium
GAGGGV

SEQ ID NO: 478123 - protein, 5 aa, Mycobacterium
GAGGH

SEQ ID NO: 478124 - protein, 6 aa, Mycobacterium
GAGGHA

SEQ ID NO: 478125 - protein, 61 aa, Mycobacterium
GAGGHGGDGATDGGAGGDGGRTTIDGAGSRATATGGTGGDGGNGGTGHGGGGGSGGTAINY

SEQ ID NO: 478126 - protein, 331 aa, Mycobacterium
GAGGHGGGGGMGGTGGTGAAAAAGINAAAGGTGGDGGAAGAGGAAGVGGFGGSAGSYGNGGGGGNGGTGGAGANAVAGTGDNGSDGAAGGQGGSGGNSGAGGTNGSGGNGGLGGAGGDGGSGTADTGGGAGNGGSGGKGGTGGVSGVAGGGGAGGTGGTGGTGGAGGTGGNGAAGKSDTGDIGGSGGYGGDGGNGGNSLPGGTNGAGGTGGTGGEGGGGGTGTPDTGSGGGDGGDGGYGGYGGSGGLPGHGDGADGVAGTGGKGGAGGAAGTGANATAGTDRYGGYGGDGGGGGGGGYGGNSIRGTGGVGGEGGTGGNSAAGGTSGDGTQV

SEQ ID NO: 478127 - protein, 26 aa, Mycobacterium
GAGGHGGSAINANAGSGGAGGAGGAG

SEQ ID NO: 478128 - protein, 5 aa, Mycobacterium
GAGGI

SEQ ID NO: 478129 - protein, 6 aa, Mycobacterium
GAGGIG

SEQ ID NO: 478130 - protein, 16 aa, Mycobacterium
GAGGKGGTGGTGGTAH

SEQ ID NO: 478131 - protein, 54 aa, Mycobacterium
GAGGLGGQGGTGGIGGTGGAGTTSIAAGTGGNGGAGGAAGGGGTAGAAGPLTNA

SEQ ID NO: 478132 - protein, 10 aa, Mycobacterium
GAGGNADVAY

SEQ ID NO: 478133 - protein, 16 aa, Mycobacterium
GAGGNGAEPRTLGPST

SEQ ID NO: 478134 - protein, 13 aa, Mycobacterium
GAGGNGGAGGAGT

SEQ ID NO: 478135 - protein, 12 aa, Mycobacterium
GAGGNGGAGGAL

SEQ ID NO: 478136 - protein, 14 aa, Mycobacterium
GAGGNGGDGGNGGG

SEQ ID NO: 478137 - protein, 10 aa, Mycobacterium
GAGGNGGNAG

SEQ ID NO: 478138 - protein, 18 aa, Mycobacterium
GAGGNGGNGGAGQAAAGD

SEQ ID NO: 478139 - protein, 9 aa, Mycobacterium
GAGGNRDGA

SEQ ID NO: 478140 - protein, 15 aa, Mycobacterium
GAGGPGGAGGPGVAD

SEQ ID NO: 478141 - protein, 19 aa, Mycobacterium
GAGGPGGTGGVAGAGGAAG

SEQ ID NO: 478142 - protein, 6 aa, Mycobacterium
GAGGPP

SEQ ID NO: 478143 - protein, 11 aa, Mycobacterium
GAGGPTTTSAA

SEQ ID NO: 478144 - protein, 6 aa, Mycobacterium
GAGGPV

SEQ ID NO: 478145 - protein, 9 aa, Mycobacterium
GAGGPVASA

SEQ ID NO: 478146 - protein, 14 aa, Mycobacterium
GAGGPVDDPQCSPL

SEQ ID NO: 478147 - protein, 8 aa, Mycobacterium
GAGGPVPL

SEQ ID NO: 478148 - protein, 12 aa, Mycobacterium
GAGGQDASPQLS

SEQ ID NO: 478149 - protein, 10 aa, Mycobacterium
GAGGQDVSPE

SEQ ID NO: 478150 - protein, 12 aa, Mycobacterium
GAGGQEPSLGRS

SEQ ID NO: 478151 - protein, 13 aa, Mycobacterium
GAGGQGDALILRR

SEQ ID NO: 478152 - protein, 12 aa, Mycobacterium
GAGGQGDALVLR

SEQ ID NO: 478153 - protein, 13 aa, Mycobacterium
GAGGQGDALVLRA

SEQ ID NO: 478154 - protein, 25 aa, Mycobacterium
GAGGQGGAGGAGGTGGAGGAGWDAT

SEQ ID NO: 478155 - protein, 39 aa, Mycobacterium
GAGGQGGDGAQGGDGGAGVDTTTGAGGDGGAGAGGGTSG

SEQ ID NO: 478156 - protein, 27 aa, Mycobacterium
GAGGQGGIASTGLTGGGAGGDGGAGGL

SEQ ID NO: 478157 - protein, 8 aa, Mycobacterium
GAGGQRGH

SEQ ID NO: 478158 - protein, 9 aa, Mycobacterium
GAGGQTGWA

SEQ ID NO: 478159 - protein, 23 aa, Mycobacterium
GAGGRGGDGGVGHNTGGVGGAGG

SEQ ID NO: 478160 - protein, 21 aa, Mycobacterium
GAGGRLEGRRPYYTPVGNEDT

SEQ ID NO: 478161 - protein, 6 aa, Mycobacterium
GAGGRM

SEQ ID NO: 478162 - protein, 12 aa, Mycobacterium
GAGGRRRRSTPA

SEQ ID NO: 478163 - protein, 7 aa, Mycobacterium
GAGGSCH

SEQ ID NO: 478164 - protein, 10 aa, Mycobacterium
GAGGSDISPQ

SEQ ID NO: 478165 - protein, 33 aa, Mycobacterium
GAGGSGGTGGAGATSGPASSHFAGGAGGAGGHG

SEQ ID NO: 478166 - protein, 8 aa, Mycobacterium
GAGGSRDS

SEQ ID NO: 478167 - protein, 13 aa, Mycobacterium
GAGGSTGWADPKR

SEQ ID NO: 478168 - protein, 11 aa, Mycobacterium
GAGGSTRDRTV

SEQ ID NO: 478169 - protein, 5 aa, Mycobacterium
GAGGT

SEQ ID NO: 478170 - protein, 10 aa, Mycobacterium
GAGGTAPAKA

SEQ ID NO: 478171 - protein, 27 aa, Mycobacterium
GAGGTGGAGGAGDNGSGGSGGSGGAGG

SEQ ID NO: 478172 - protein, 32 aa, Mycobacterium
GAGGTGGAGGAGRLGSGATGGAGGAGGAGGPW

SEQ ID NO: 478173 - protein, 21 aa, Mycobacterium
GAGGTGGAGGLGAAGGAGGNG

SEQ ID NO: 478174 - protein, 29 aa, Mycobacterium
GAGGTGGAGGSSFTSTTNGGAGGTGGAGG

SEQ ID NO: 478175 - protein, 27 aa, Mycobacterium
GAGGTGGAGGTGTSGGGGMGGAGGQAG

SEQ ID NO: 478176 - protein, 13 aa, Mycobacterium
GAGGTGGGGGVAP

SEQ ID NO: 478177 - protein, 8 aa, Mycobacterium
GAGGTGGM

SEQ ID NO: 478178 - protein, 60 aa, Mycobacterium
GAGGTGGNGGQGGAGGNGGNGGNASTGGTVGQGGNLALGGQGGTGGAAGGPGGNSGFTGN

SEQ ID NO: 478179 - protein, 11 aa, Mycobacterium
GAGGTGGSGGL

SEQ ID NO: 478180 - protein, 12 aa, Mycobacterium
GAGGTGGTGAIG

SEQ ID NO: 478181 - protein, 23 aa, Mycobacterium
GAGGTGGTGGPNTTVGGTGGAGG

SEQ ID NO: 478182 - protein, 24 aa, Mycobacterium
GAGGTGGVTPGGTGGIGGAGGNGG

SEQ ID NO: 478183 - protein, 7 aa, Mycobacterium
GAGGTLS

SEQ ID NO: 478184 - protein, 10 aa, Mycobacterium
GAGGTSGLAG

SEQ ID NO: 478185 - protein, 7 aa, Mycobacterium
GAGGTVS

SEQ ID NO: 478186 - protein, 6 aa, Mycobacterium
GAGGVA

SEQ ID NO: 478187 - protein, 6 aa, Mycobacterium
GAGGVG

SEQ ID NO: 478188 - protein, 7 aa, Mycobacterium
GAGGVGG

SEQ ID NO: 478189 - protein, 11 aa, Mycobacterium
GAGGVGGSAGL

SEQ ID NO: 478190 - protein, 9 aa, Mycobacterium
GAGGVPGPF

SEQ ID NO: 478191 - protein, 6 aa, Mycobacterium
GAGGVT

SEQ ID NO: 478192 - protein, 6 aa, Mycobacterium
GAGHGD

SEQ ID NO: 478193 - protein, 13 aa, Mycobacterium
GAGHGPVSPLFRL

SEQ ID NO: 478194 - protein, 8 aa, Mycobacterium
GAGHPGTL

SEQ ID NO: 478195 - protein, 14 aa, Mycobacterium
GAGHPRDSSEELAN

SEQ ID NO: 478196 - protein, 9 aa, Mycobacterium
GAGHPRDYS

SEQ ID NO: 478197 - protein, 6 aa, Mycobacterium
GAGHSA

SEQ ID NO: 478198 - protein, 6 aa, Mycobacterium
GAGIDA

SEQ ID NO: 478199 - protein, 10 aa, Mycobacterium
GAGIGADSTR

SEQ ID NO: 478200 - protein, 5 aa, Mycobacterium
GAGIP

SEQ ID NO: 478201 - protein, 5 aa, Mycobacterium
GAGIR

SEQ ID NO: 478202 - protein, 6 aa, Mycobacterium
GAGISR

SEQ ID NO: 478203 - protein, 7 aa, Mycobacterium
GAGITPV

SEQ ID NO: 478204 - protein, 5 aa, Mycobacterium
GAGKA

SEQ ID NO: 478205 - protein, 7 aa, Mycobacterium
GAGKDQR

SEQ ID NO: 478206 - protein, 7 aa, Mycobacterium
GAGKGAR

SEQ ID NO: 478207 - protein, 9 aa, Mycobacterium
GAGKGMGRT

SEQ ID NO: 478208 - protein, 10 aa, Mycobacterium
GAGKGQGRSH

SEQ ID NO: 478209 - protein, 8 aa, Mycobacterium
GAGKGVGA

SEQ ID NO: 478210 - protein, 9 aa, Mycobacterium
GAGKGVGAG

SEQ ID NO: 478211 - protein, 9 aa, Mycobacterium
GAGKGVGQG

SEQ ID NO: 478212 - protein, 8 aa, Mycobacterium
GAGKRIGE

SEQ ID NO: 478213 - protein, 8 aa, Mycobacterium
GAGKRTLT

SEQ ID NO: 478214 - protein, 5 aa, Mycobacterium
GAGKS

SEQ ID NO: 478215 - protein, 22 aa, Mycobacterium
GAGKSVRDGEGYRPSSKPSDGA

SEQ ID NO: 478216 - protein, 6 aa, Mycobacterium
GAGKTS

SEQ ID NO: 478217 - protein, 7 aa, Mycobacterium
GAGKTTV

SEQ ID NO: 478218 - protein, 17 aa, Mycobacterium
GAGLAARSPRGRPAHAG

SEQ ID NO: 478219 - protein, 9 aa, Mycobacterium
GAGLAGGPN

SEQ ID NO: 478220 - protein, 5 aa, Mycobacterium
GAGLD

SEQ ID NO: 478221 - protein, 6 aa, Mycobacterium
GAGLDP

SEQ ID NO: 478222 - protein, 54 aa, Mycobacterium
GAGLGAGPAPLAPPVMPSSAAPASAGPAGAYAPGPAPVAASGGALAAPSPVPVS

SEQ ID NO: 478223 - protein, 10 aa, Mycobacterium
GAGLGQTNSL

SEQ ID NO: 478224 - protein, 18 aa, Mycobacterium
GAGLGSPAKGGAKKRGAA

SEQ ID NO: 478225 - protein, 7 aa, Mycobacterium
GAGLGTA

SEQ ID NO: 478226 - protein, 19 aa, Mycobacterium
GAGLGYDTTKTKGSARRVP

SEQ ID NO: 478227 - protein, 8 aa, Mycobacterium
GAGLNAPD

SEQ ID NO: 478228 - protein, 8 aa, Mycobacterium
GAGLSDDA

SEQ ID NO: 478229 - protein, 15 aa, Mycobacterium
GAGLSYASAEAANVS

SEQ ID NO: 478230 - protein, 5 aa, Mycobacterium
GAGLT

SEQ ID NO: 478231 - protein, 6 aa, Mycobacterium
GAGLTD

SEQ ID NO: 478232 - protein, 7 aa, Mycobacterium
GAGLTDD

SEQ ID NO: 478233 - protein, 4 aa, Mycobacterium
GAGM

SEQ ID NO: 478234 - protein, 4 aa, Mycobacterium
GAGN

SEQ ID NO: 478235 - protein, 11 aa, Mycobacterium
GAGNANDAVTE

SEQ ID NO: 478236 - protein, 9 aa, Mycobacterium
GAGNETTAP

SEQ ID NO: 478237 - protein, 8 aa, Mycobacterium
GAGNETTG

SEQ ID NO: 478238 - protein, 10 aa, Mycobacterium
GAGNFGSATS

SEQ ID NO: 478239 - protein, 6 aa, Mycobacterium
GAGNGG

SEQ ID NO: 478240 - protein, 11 aa, Mycobacterium
GAGNGSAALDT

SEQ ID NO: 478241 - protein, 7 aa, Mycobacterium
GAGNLGD

SEQ ID NO: 478242 - protein, 6 aa, Mycobacterium
GAGNMS

SEQ ID NO: 478243 - protein, 9 aa, Mycobacterium
GAGNNPDRI

SEQ ID NO: 478244 - protein, 10 aa, Mycobacterium
GAGNRAGDGF

SEQ ID NO: 478245 - protein, 11 aa, Mycobacterium
GAGNRAGDGFD

SEQ ID NO: 478246 - protein, 14 aa, Mycobacterium
GAGNRSGDGFDGAV

SEQ ID NO: 478247 - protein, 15 aa, Mycobacterium
GAGNRTGDGFDGAVQ

SEQ ID NO: 478248 - protein, 8 aa, Mycobacterium
GAGNSELT

SEQ ID NO: 478249 - protein, 23 aa, Mycobacterium
GAGNTGNPHRRTEYDRGAHAHYR

SEQ ID NO: 478250 - protein, 10 aa, Mycobacterium
GAGNVAGPNR

SEQ ID NO: 478251 - protein, 6 aa, Mycobacterium
GAGPAA

SEQ ID NO: 478252 - protein, 7 aa, Mycobacterium
GAGPAAA

SEQ ID NO: 478253 - protein, 7 aa, Mycobacterium
GAGPAAM

SEQ ID NO: 478254 - protein, 10 aa, Mycobacterium
GAGPADESNG

SEQ ID NO: 478255 - protein, 7 aa, Mycobacterium
GAGPAPM

SEQ ID NO: 478256 - protein, 8 aa, Mycobacterium
GAGPARRT

SEQ ID NO: 478257 - protein, 7 aa, Mycobacterium
GAGPARV

SEQ ID NO: 478258 - protein, 6 aa, Mycobacterium
GAGPAT

SEQ ID NO: 478259 - protein, 7 aa, Mycobacterium
GAGPCSG

SEQ ID NO: 478260 - protein, 60 aa, Mycobacterium
GAGPDDTDVTDDSVADTAPEDTAPDPDDTEPGDRAAADQETDTDPEPQPVVGPDAADHRP

SEQ ID NO: 478261 - protein, 11 aa, Mycobacterium
GAGPDQPDPVA

SEQ ID NO: 478262 - protein, 7 aa, Mycobacterium
GAGPDWR

SEQ ID NO: 478263 - protein, 8 aa, Mycobacterium
GAGPERTG

SEQ ID NO: 478264 - protein, 23 aa, Mycobacterium
GAGPFPGDPGELPPNPEQSPKQG

SEQ ID NO: 478265 - protein, 7 aa, Mycobacterium
GAGPGAS

SEQ ID NO: 478266 - protein, 6 aa, Mycobacterium
GAGPGE

SEQ ID NO: 478267 - protein, 16 aa, Mycobacterium
GAGPGSGAARKETVDR

SEQ ID NO: 478268 - protein, 16 aa, Mycobacterium
GAGPGSGAARKQTVDR

SEQ ID NO: 478269 - protein, 8 aa, Mycobacterium
GAGPGSTV

SEQ ID NO: 478270 - protein, 7 aa, Mycobacterium
GAGPGTE

SEQ ID NO: 478271 - protein, 5 aa, Mycobacterium
GAGPI

SEQ ID NO: 478272 - protein, 6 aa, Mycobacterium
GAGPKT

SEQ ID NO: 478273 - protein, 5 aa, Mycobacterium
GAGPL

SEQ ID NO: 478274 - protein, 8 aa, Mycobacterium
GAGPPHDG

SEQ ID NO: 478275 - protein, 17 aa, Mycobacterium
GAGPPPRAADADFPDGT

SEQ ID NO: 478276 - protein, 8 aa, Mycobacterium
GAGPPRDF

SEQ ID NO: 478277 - protein, 7 aa, Mycobacterium
GAGPQGR

SEQ ID NO: 478278 - protein, 6 aa, Mycobacterium
GAGPQI

SEQ ID NO: 478279 - protein, 7 aa, Mycobacterium
GAGPRGR

SEQ ID NO: 478280 - protein, 9 aa, Mycobacterium
GAGPRSATE

SEQ ID NO: 478281 - protein, 6 aa, Mycobacterium
GAGPRV

SEQ ID NO: 478282 - protein, 7 aa, Mycobacterium
GAGPSCD

SEQ ID NO: 478283 - protein, 10 aa, Mycobacterium
GAGPSCEQEA

SEQ ID NO: 478284 - protein, 8 aa, Mycobacterium
GAGPSCER

SEQ ID NO: 478285 - protein, 9 aa, Mycobacterium
GAGPSCERQ

SEQ ID NO: 478286 - protein, 17 aa, Mycobacterium
GAGPSLAPQGPDGTPTV

SEQ ID NO: 478287 - protein, 7 aa, Mycobacterium
GAGPSSM

SEQ ID NO: 478288 - protein, 6 aa, Mycobacterium
GAGPTG

SEQ ID NO: 478289 - protein, 6 aa, Mycobacterium
GAGPTS

SEQ ID NO: 478290 - protein, 9 aa, Mycobacterium
GAGPVSTRA

SEQ ID NO: 478291 - protein, 8 aa, Mycobacterium
GAGPVTPA

SEQ ID NO: 478292 - protein, 8 aa, Mycobacterium
GAGQAGRD

SEQ ID NO: 478293 - protein, 5 aa, Mycobacterium
GAGQE

SEQ ID NO: 478294 - protein, 8 aa, Mycobacterium
GAGQGIGR

SEQ ID NO: 478295 - protein, 21 aa, Mycobacterium
GAGQGQGGAKSKGAQQDEEAL

SEQ ID NO: 478296 - protein, 7 aa, Mycobacterium
GAGQGSP

SEQ ID NO: 478297 - protein, 9 aa, Mycobacterium
GAGQHNSLE

SEQ ID NO: 478298 - protein, 6 aa, Mycobacterium
GAGQID

SEQ ID NO: 478299 - protein, 7 aa, Mycobacterium
GAGQLAG

SEQ ID NO: 478300 - protein, 5 aa, Mycobacterium
GAGQM

SEQ ID NO: 478301 - protein, 9 aa, Mycobacterium
GAGQNGAAA

SEQ ID NO: 478302 - protein, 10 aa, Mycobacterium
GAGQNRSRDI

SEQ ID NO: 478303 - protein, 27 aa, Mycobacterium
GAGQPPTSTTTPPAGTTTTVPPAANAW

SEQ ID NO: 478304 - protein, 6 aa, Mycobacterium
GAGQPW

SEQ ID NO: 478305 - protein, 13 aa, Mycobacterium
GAGQRDGVRPNRS

SEQ ID NO: 478306 - protein, 6 aa, Mycobacterium
GAGQRG

SEQ ID NO: 478307 - protein, 10 aa, Mycobacterium
GAGQTGATAA

SEQ ID NO: 478308 - protein, 7 aa, Mycobacterium
GAGQTGL

SEQ ID NO: 478309 - protein, 10 aa, Mycobacterium
GAGQVSGSMG

SEQ ID NO: 478310 - protein, 17 aa, Mycobacterium
GAGRDAGALQKAQELGA

SEQ ID NO: 478311 - protein, 11 aa, Mycobacterium
GAGRDGDQTPV

SEQ ID NO: 478312 - protein, 5 aa, Mycobacterium
GAGRG

SEQ ID NO: 478313 - protein, 8 aa, Mycobacterium
GAGRGAGL

SEQ ID NO: 478314 - protein, 7 aa, Mycobacterium
GAGRGAS

SEQ ID NO: 478315 - protein, 25 aa, Mycobacterium
GAGRGFSSGAGISEEDQNAKGHDAA

SEQ ID NO: 478316 - protein, 13 aa, Mycobacterium
GAGRGGKDSALAR

SEQ ID NO: 478317 - protein, 9 aa, Mycobacterium
GAGRGGRDS

SEQ ID NO: 478318 - protein, 11 aa, Mycobacterium
GAGRGGRDSAL

SEQ ID NO: 478319 - protein, 9 aa, Mycobacterium
GAGRGGRES

SEQ ID NO: 478320 - protein, 8 aa, Mycobacterium
GAGRGIGR

SEQ ID NO: 478321 - protein, 9 aa, Mycobacterium
GAGRGQGRA

SEQ ID NO: 478322 - protein, 9 aa, Mycobacterium
GAGRGVGEG

SEQ ID NO: 478323 - protein, 10 aa, Mycobacterium
GAGRHLPPTH

SEQ ID NO: 478324 - protein, 5 aa, Mycobacterium
GAGRI

SEQ ID NO: 478325 - protein, 18 aa, Mycobacterium
GAGRIPRQAGSLRRAGAG

SEQ ID NO: 478326 - protein, 12 aa, Mycobacterium
GAGRISGAAVLV

SEQ ID NO: 478327 - protein, 17 aa, Mycobacterium
GAGRKADSSDESGLRPR

SEQ ID NO: 478328 - protein, 11 aa, Mycobacterium
GAGRNGPVRYT

SEQ ID NO: 478329 - protein, 10 aa, Mycobacterium
GAGRNPEALD

SEQ ID NO: 478330 - protein, 15 aa, Mycobacterium
GAGRNVSPGMASYSA

SEQ ID NO: 478331 - protein, 12 aa, Mycobacterium
GAGRPAQPPDVD

SEQ ID NO: 478332 - protein, 8 aa, Mycobacterium
GAGRPEAN

SEQ ID NO: 478333 - protein, 6 aa, Mycobacterium
GAGRPI

SEQ ID NO: 478334 - protein, 7 aa, Mycobacterium
GAGRPVR

SEQ ID NO: 478335 - protein, 8 aa, Mycobacterium
GAGRQPGV

SEQ ID NO: 478336 - protein, 8 aa, Mycobacterium
GAGRRDSF

SEQ ID NO: 478337 - protein, 8 aa, Mycobacterium
GAGRRDTF

SEQ ID NO: 478338 - protein, 11 aa, Mycobacterium
GAGRSDDDPLS

SEQ ID NO: 478339 - protein, 7 aa, Mycobacterium
GAGRTLG

SEQ ID NO: 478340 - protein, 6 aa, Mycobacterium
GAGRTT

SEQ ID NO: 478341 - protein, 7 aa, Mycobacterium
GAGRTTR

SEQ ID NO: 478342 - protein, 24 aa, Mycobacterium
GAGRVQSRHQAARHTDADALRSGL

SEQ ID NO: 478343 - protein, 14 aa, Mycobacterium
GAGSAATWTEHPRE

SEQ ID NO: 478344 - protein, 6 aa, Mycobacterium
GAGSAD

SEQ ID NO: 478345 - protein, 14 aa, Mycobacterium
GAGSAFAASEATNA

SEQ ID NO: 478346 - protein, 12 aa, Mycobacterium
GAGSALDAATRG

SEQ ID NO: 478347 - protein, 10 aa, Mycobacterium
GAGSAPGPEA

SEQ ID NO: 478348 - protein, 7 aa, Mycobacterium
GAGSAPM

SEQ ID NO: 478349 - protein, 8 aa, Mycobacterium
GAGSASGF

SEQ ID NO: 478350 - protein, 18 aa, Mycobacterium
GAGSASVEIEQAERDSAV

SEQ ID NO: 478351 - protein, 10 aa, Mycobacterium
GAGSDKAIAA

SEQ ID NO: 478352 - protein, 11 aa, Mycobacterium
GAGSDPDPSIG

SEQ ID NO: 478353 - protein, 9 aa, Mycobacterium
GAGSDRALA

SEQ ID NO: 478354 - protein, 23 aa, Mycobacterium
GAGSDSHNGSNGSPSGGGSERRR

SEQ ID NO: 478355 - protein, 11 aa, Mycobacterium
GAGSELAAKVT

SEQ ID NO: 478356 - protein, 16 aa, Mycobacterium
GAGSELAKKVTPDFAP

SEQ ID NO: 478357 - protein, 6 aa, Mycobacterium
GAGSER

SEQ ID NO: 478358 - protein, 31 aa, Mycobacterium
GAGSESSVAQKARKTTLAAAGAEATAPAPVA

SEQ ID NO: 478359 - protein, 8 aa, Mycobacterium
GAGSGARV

SEQ ID NO: 478360 - protein, 8 aa, Mycobacterium
GAGSGDVS

SEQ ID NO: 478361 - protein, 8 aa, Mycobacterium
GAGSGEGV

SEQ ID NO: 478362 - protein, 8 aa, Mycobacterium
GAGSGIGA

SEQ ID NO: 478363 - protein, 8 aa, Mycobacterium
GAGSGIGQ

SEQ ID NO: 478364 - protein, 9 aa, Mycobacterium
GAGSGIGRG

SEQ ID NO: 478365 - protein, 9 aa, Mycobacterium
GAGSGPGHV

SEQ ID NO: 478366 - protein, 7 aa, Mycobacterium
GAGSGPL

SEQ ID NO: 478367 - protein, 8 aa, Mycobacterium
GAGSGPLL

SEQ ID NO: 478368 - protein, 8 aa, Mycobacterium
GAGSGPML

SEQ ID NO: 478369 - protein, 7 aa, Mycobacterium
GAGSGPV

SEQ ID NO: 478370 - protein, 7 aa, Mycobacterium
GAGSGSI

SEQ ID NO: 478371 - protein, 9 aa, Mycobacterium
GAGSGVGAG

SEQ ID NO: 478372 - protein, 9 aa, Mycobacterium
GAGSGVGKD

SEQ ID NO: 478373 - protein, 8 aa, Mycobacterium
GAGSHPAD

SEQ ID NO: 478374 - protein, 9 aa, Mycobacterium
GAGSHTPMP

SEQ ID NO: 478375 - protein, 26 aa, Mycobacterium
GAGSIAGAGGDAGLFGSGGNGGFNGY

SEQ ID NO: 478376 - protein, 22 aa, Mycobacterium
GAGSIGGAANSTAGAGGDGGEG

SEQ ID NO: 478377 - protein, 23 aa, Mycobacterium
GAGSIGGAGNAAASAGGAGGAGA

SEQ ID NO: 478378 - protein, 8 aa, Mycobacterium
GAGSIGPM

SEQ ID NO: 478379 - protein, 6 aa, Mycobacterium
GAGSLS

SEQ ID NO: 478380 - protein, 8 aa, Mycobacterium
GAGSMSTS

SEQ ID NO: 478381 - protein, 11 aa, Mycobacterium
GAGSNADRTQR

SEQ ID NO: 478382 - protein, 10 aa, Mycobacterium
GAGSNALGAN

SEQ ID NO: 478383 - protein, 9 aa, Mycobacterium
GAGSPADDV

SEQ ID NO: 478384 - protein, 8 aa, Mycobacterium
GAGSPAEI

SEQ ID NO: 478385 - protein, 8 aa, Mycobacterium
GAGSPAYC

SEQ ID NO: 478386 - protein, 14 aa, Mycobacterium
GAGSPDQDSWPEDA

SEQ ID NO: 478387 - protein, 15 aa, Mycobacterium
GAGSPEPDSFSDDAE

SEQ ID NO: 478388 - protein, 16 aa, Mycobacterium
GAGSPGLDRAQTRSGW

SEQ ID NO: 478389 - protein, 10 aa, Mycobacterium
GAGSPHDPYR

SEQ ID NO: 478390 - protein, 9 aa, Mycobacterium
GAGSPRDTL

SEQ ID NO: 478391 - protein, 8 aa, Mycobacterium
GAGSPTEI

SEQ ID NO: 478392 - protein, 8 aa, Mycobacterium
GAGSRAAH

SEQ ID NO: 478393 - protein, 7 aa, Mycobacterium
GAGSRKH

SEQ ID NO: 478394 - protein, 6 aa, Mycobacterium
GAGSRS

SEQ ID NO: 478395 - protein, 7 aa, Mycobacterium
GAGSRSE

SEQ ID NO: 478396 - protein, 9 aa, Mycobacterium
GAGSSTTAH

SEQ ID NO: 478397 - protein, 9 aa, Mycobacterium
GAGSTEPIA

SEQ ID NO: 478398 - protein, 9 aa, Mycobacterium
GAGSTEPQW

SEQ ID NO: 478399 - protein, 7 aa, Mycobacterium
GAGSTSM

SEQ ID NO: 478400 - protein, 17 aa, Mycobacterium
GAGSYAAAEAANTTPLQ

SEQ ID NO: 478401 - protein, 4 aa, Mycobacterium
GAGT

SEQ ID NO: 478402 - protein, 6 aa, Mycobacterium
GAGTDD

SEQ ID NO: 478403 - protein, 7 aa, Mycobacterium
GAGTDDL

SEQ ID NO: 478404 - protein, 6 aa, Mycobacterium
GAGTDG

SEQ ID NO: 478405 - protein, 6 aa, Mycobacterium
GAGTDK

SEQ ID NO: 478406 - protein, 6 aa, Mycobacterium
GAGTED

SEQ ID NO: 478407 - protein, 7 aa, Mycobacterium
GAGTEDL

SEQ ID NO: 478408 - protein, 7 aa, Mycobacterium
GAGTEEL

SEQ ID NO: 478409 - protein, 5 aa, Mycobacterium
GAGTF

SEQ ID NO: 478410 - protein, 7 aa, Mycobacterium
GAGTGAA

SEQ ID NO: 478411 - protein, 7 aa, Mycobacterium
GAGTGAT

SEQ ID NO: 478412 - protein, 7 aa, Mycobacterium
GAGTGPM

SEQ ID NO: 478413 - protein, 8 aa, Mycobacterium
GAGTGRNA

SEQ ID NO: 478414 - protein, 9 aa, Mycobacterium
GAGTGSDAA

SEQ ID NO: 478415 - protein, 12 aa, Mycobacterium
GAGTGSYEPGQT

SEQ ID NO: 478416 - protein, 6 aa, Mycobacterium
GAGTGV

SEQ ID NO: 478417 - protein, 7 aa, Mycobacterium
GAGTHPA

SEQ ID NO: 478418 - protein, 13 aa, Mycobacterium
GAGTLAPGMPTDG

SEQ ID NO: 478419 - protein, 17 aa, Mycobacterium
GAGTPEQHAGGYSDSVE

SEQ ID NO: 478420 - protein, 9 aa, Mycobacterium
GAGTPGEAV

SEQ ID NO: 478421 - protein, 12 aa, Mycobacterium
GAGTPQPRPAGD

SEQ ID NO: 478422 - protein, 8 aa, Mycobacterium
GAGTPVDP

SEQ ID NO: 478423 - protein, 7 aa, Mycobacterium
GAGTRSA

SEQ ID NO: 478424 - protein, 10 aa, Mycobacterium
GAGTSMAGNA

SEQ ID NO: 478425 - protein, 8 aa, Mycobacterium
GAGTTAAG

SEQ ID NO: 478426 - protein, 9 aa, Mycobacterium
GAGTVSEED

SEQ ID NO: 478427 - protein, 16 aa, Mycobacterium
GAGTYASAEAANAAPF

SEQ ID NO: 478428 - protein, 12 aa, Mycobacterium
GAGVATTDGQLR

SEQ ID NO: 478429 - protein, 7 aa, Mycobacterium
GAGVDPR

SEQ ID NO: 478430 - protein, 8 aa, Mycobacterium
GAGVGAGD

SEQ ID NO: 478431 - protein, 26 aa, Mycobacterium
GAGVGARAGALKGGVGTASTALPSGV

SEQ ID NO: 478432 - protein, 7 aa, Mycobacterium
GAGVGGG

SEQ ID NO: 478433 - protein, 67 aa, Mycobacterium
GAGVGGSGGDGGAAPTGTGGDGGAGGDGGGIIGSGGNGGDAGSGVGAANGGNGGNAGITNNGQFTPS

SEQ ID NO: 478434 - protein, 13 aa, Mycobacterium
GAGVIGTPERARA

SEQ ID NO: 478435 - protein, 5 aa, Mycobacterium
GAGVN

SEQ ID NO: 478436 - protein, 5 aa, Mycobacterium
GAGVP

SEQ ID NO: 478437 - protein, 7 aa, Mycobacterium
GAGVPSV

SEQ ID NO: 478438 - protein, 11 aa, Mycobacterium
GAGVQGGSVAG

SEQ ID NO: 478439 - protein, 6 aa, Mycobacterium
GAGVQS

SEQ ID NO: 478440 - protein, 13 aa, Mycobacterium
GAGVQVIPDATVG

SEQ ID NO: 478441 - protein, 6 aa, Mycobacterium
GAGVSA

SEQ ID NO: 478442 - protein, 5 aa, Mycobacterium
GAGVT

SEQ ID NO: 478443 - protein, 5 aa, Mycobacterium
GAGYG

SEQ ID NO: 478444 - protein, 7 aa, Mycobacterium
GAGYGPR

SEQ ID NO: 478445 - protein, 13 aa, Mycobacterium
GAGYPGFDLVGMP

SEQ ID NO: 478446 - protein, 9 aa, Mycobacterium
GAGYPPPAI

SEQ ID NO: 478447 - protein, 7 aa, Mycobacterium
GAGYSEE

SEQ ID NO: 478448 - protein, 13 aa, Mycobacterium
GAHAARRAGGVQA

SEQ ID NO: 478449 - protein, 9 aa, Mycobacterium
GAHAARRTD

SEQ ID NO: 478450 - protein, 8 aa, Mycobacterium
GAHADTSV

SEQ ID NO: 478451 - protein, 5 aa, Mycobacterium
GAHAP

SEQ ID NO: 478452 - protein, 13 aa, Mycobacterium
GAHAPGRTEPAAA

SEQ ID NO: 478453 - protein, 8 aa, Mycobacterium
GAHAQAGR

SEQ ID NO: 478454 - protein, 7 aa, Mycobacterium
GAHARSA

SEQ ID NO: 478455 - protein, 12 aa, Mycobacterium
GAHATPEGATGQ

SEQ ID NO: 478456 - protein, 10 aa, Mycobacterium
GAHDHDHTHA

SEQ ID NO: 478457 - protein, 16 aa, Mycobacterium
GAHDPARMRDPDPAEI

SEQ ID NO: 478458 - protein, 16 aa, Mycobacterium
GAHDPTQLRAPDPAEI

SEQ ID NO: 478459 - protein, 16 aa, Mycobacterium
GAHDRTQMRDPDPDEI

SEQ ID NO: 478460 - protein, 6 aa, Mycobacterium
GAHENP

SEQ ID NO: 478461 - protein, 6 aa, Mycobacterium
GAHEVR

SEQ ID NO: 478462 - protein, 4 aa, Mycobacterium
GAHG

SEQ ID NO: 478463 - protein, 11 aa, Mycobacterium
GAHGAASLADS

SEQ ID NO: 478464 - protein, 6 aa, Mycobacterium
GAHGAG

SEQ ID NO: 478465 - protein, 10 aa, Mycobacterium
GAHGAGTWSV

SEQ ID NO: 478466 - protein, 6 aa, Mycobacterium
GAHGGH

SEQ ID NO: 478467 - protein, 8 aa, Mycobacterium
GAHGGTVT

SEQ ID NO: 478468 - protein, 21 aa, Mycobacterium
GAHGHSDYPRFPDGGGMRTTN

SEQ ID NO: 478469 - protein, 26 aa, Mycobacterium
GAHGQAAAGVRRTGRWRGRPKNQDAY

SEQ ID NO: 478470 - protein, 29 aa, Mycobacterium
GAHHESSSQKAAYGVPQRATPTLRATAPS

SEQ ID NO: 478471 - protein, 4 aa, Mycobacterium
GAHI

SEQ ID NO: 478472 - protein, 4 aa, Mycobacterium
GAHP

SEQ ID NO: 478473 - protein, 5 aa, Mycobacterium
GAHPA

SEQ ID NO: 478474 - protein, 20 aa, Mycobacterium
GAHPANTGKPEFARGPRAAR

SEQ ID NO: 478475 - protein, 16 aa, Mycobacterium
GAHPASASAPALGQDT

SEQ ID NO: 478476 - protein, 5 aa, Mycobacterium
GAHPD

SEQ ID NO: 478477 - protein, 6 aa, Mycobacterium
GAHPGA

SEQ ID NO: 478478 - protein, 6 aa, Mycobacterium
GAHPGM

SEQ ID NO: 478479 - protein, 6 aa, Mycobacterium
GAHPQS

SEQ ID NO: 478480 - protein, 6 aa, Mycobacterium
GAHPSL

SEQ ID NO: 478481 - protein, 20 aa, Mycobacterium
GAHPSNTGKPEFAGTPRGAR

SEQ ID NO: 478482 - protein, 7 aa, Mycobacterium
GAHRAAN

SEQ ID NO: 478483 - protein, 7 aa, Mycobacterium
GAHRGTP

SEQ ID NO: 478484 - protein, 13 aa, Mycobacterium
GAHSAGAVAAGSD

SEQ ID NO: 478485 - protein, 8 aa, Mycobacterium
GAHSAYPG

SEQ ID NO: 478486 - protein, 20 aa, Mycobacterium
GAHSDTPAPAGSGSPMYDPY

SEQ ID NO: 478487 - protein, 6 aa, Mycobacterium
GAHSGT

SEQ ID NO: 478488 - protein, 14 aa, Mycobacterium
GAHSYPDAARTDAE

SEQ ID NO: 478489 - protein, 7 aa, Mycobacterium
GAHTDYG

SEQ ID NO: 478490 - protein, 15 aa, Mycobacterium
GAIAEAKTALGGTDI

SEQ ID NO: 478491 - protein, 8 aa, Mycobacterium
GAIAGAAG

SEQ ID NO: 478492 - protein, 9 aa, Mycobacterium
GAIAGEPGV

SEQ ID NO: 478493 - protein, 9 aa, Mycobacterium
GAIAPDSGL

SEQ ID NO: 478494 - protein, 39 aa, Mycobacterium
GAIDADGPQSPTIDAEEQRDPTATGKRYAAQARAARPQF

SEQ ID NO: 478495 - protein, 7 aa, Mycobacterium
GAIDPDR

SEQ ID NO: 478496 - protein, 8 aa, Mycobacterium
GAIDPPAF

SEQ ID NO: 478497 - protein, 25 aa, Mycobacterium
GAIEDDPNVTDKKLPGNPTRSYRTR

SEQ ID NO: 478498 - protein, 16 aa, Mycobacterium
GAIERESDSDLTEHAS

SEQ ID NO: 478499 - protein, 7 aa, Mycobacterium
GAIGERA

SEQ ID NO: 478500 - protein, 6 aa, Mycobacterium
GAIGQG

SEQ ID NO: 478501 - protein, 20 aa, Mycobacterium
GAIGRGSDKAGQGSRTRPGL

SEQ ID NO: 478502 - protein, 7 aa, Mycobacterium
GAIGRRY

SEQ ID NO: 478503 - protein, 16 aa, Mycobacterium
GAINPGESSEESHRSE

SEQ ID NO: 478504 - protein, 5 aa, Mycobacterium
GAIPA

SEQ ID NO: 478505 - protein, 16 aa, Mycobacterium
GAIPAAVGAGGADDEW

SEQ ID NO: 478506 - protein, 5 aa, Mycobacterium
GAIPC

SEQ ID NO: 478507 - protein, 5 aa, Mycobacterium
GAIPD

SEQ ID NO: 478508 - protein, 6 aa, Mycobacterium
GAIPDD

SEQ ID NO: 478509 - protein, 16 aa, Mycobacterium
GAIPGKRAANSVSSYA

SEQ ID NO: 478510 - protein, 7 aa, Mycobacterium
GAIPPRE

SEQ ID NO: 478511 - protein, 10 aa, Mycobacterium
GAIPQGSLDE

SEQ ID NO: 478512 - protein, 14 aa, Mycobacterium
GAIPRTSSGKIGRR

SEQ ID NO: 478513 - protein, 26 aa, Mycobacterium
GAIPYPDPDVAQPLTEEERQHSEDRV

SEQ ID NO: 478514 - protein, 22 aa, Mycobacterium
GAIQGEGRPVETETAIRSGDPA

SEQ ID NO: 478515 - protein, 8 aa, Mycobacterium
GAIQTTPS

SEQ ID NO: 478516 - protein, 5 aa, Mycobacterium
GAIRN

SEQ ID NO: 478517 - protein, 8 aa, Mycobacterium
GAISTPAR

SEQ ID NO: 478518 - protein, 5 aa, Mycobacterium
GAITD

SEQ ID NO: 478519 - protein, 20 aa, Mycobacterium
GAITDDDGVTPTPGANASVK

SEQ ID NO: 478520 - protein, 7 aa, Mycobacterium
GAITGPA

SEQ ID NO: 478521 - protein, 7 aa, Mycobacterium
GAITLPD

SEQ ID NO: 478522 - protein, 6 aa, Mycobacterium
GAITPA

SEQ ID NO: 478523 - protein, 7 aa, Mycobacterium
GAITPPQ

SEQ ID NO: 478524 - protein, 6 aa, Mycobacterium
GAITPT

SEQ ID NO: 478525 - protein, 10 aa, Mycobacterium
GAITSSGGTA

SEQ ID NO: 478526 - protein, 4 aa, Mycobacterium
GAIV

SEQ ID NO: 478527 - protein, 4 aa, Mycobacterium
GAKA

SEQ ID NO: 478528 - protein, 16 aa, Mycobacterium
GAKAAATDAAAGAERI

SEQ ID NO: 478529 - protein, 14 aa, Mycobacterium
GAKAESAAAEIGNT

SEQ ID NO: 478530 - protein, 5 aa, Mycobacterium
GAKAI

SEQ ID NO: 478531 - protein, 9 aa, Mycobacterium
GAKALRGGK

SEQ ID NO: 478532 - protein, 8 aa, Mycobacterium
GAKALSEA

SEQ ID NO: 478533 - protein, 9 aa, Mycobacterium
GAKAPKLVT

SEQ ID NO: 478534 - protein, 9 aa, Mycobacterium
GAKAPSGFD

SEQ ID NO: 478535 - protein, 7 aa, Mycobacterium
GAKAPVN

SEQ ID NO: 478536 - protein, 5 aa, Mycobacterium
GAKAR

SEQ ID NO: 478537 - protein, 15 aa, Mycobacterium
GAKARAVPVDTAPAP

SEQ ID NO: 478538 - protein, 14 aa, Mycobacterium
GAKARQAKNKARLD

SEQ ID NO: 478539 - protein, 14 aa, Mycobacterium
GAKASEMKKLGQTS

SEQ ID NO: 478540 - protein, 16 aa, Mycobacterium
GAKCPGPQSAAQSDRG

SEQ ID NO: 478541 - protein, 16 aa, Mycobacterium
GAKDDASFTRDHAEQL

SEQ ID NO: 478542 - protein, 10 aa, Mycobacterium
GAKDKHGNEL

SEQ ID NO: 478543 - protein, 13 aa, Mycobacterium
GAKDTLKVGDNSY

SEQ ID NO: 478544 - protein, 12 aa, Mycobacterium
GAKDTSPETEAG

SEQ ID NO: 478545 - protein, 16 aa, Mycobacterium
GAKDVGKRAERATAEG

SEQ ID NO: 478546 - protein, 7 aa, Mycobacterium
GAKEEEL

SEQ ID NO: 478547 - protein, 9 aa, Mycobacterium
GAKEQLRTL

SEQ ID NO: 478548 - protein, 14 aa, Mycobacterium
GAKERQKLATSLRN

SEQ ID NO: 478549 - protein, 11 aa, Mycobacterium
GAKFDETSTGR

SEQ ID NO: 478550 - protein, 8 aa, Mycobacterium
GAKFTPRN

SEQ ID NO: 478551 - protein, 4 aa, Mycobacterium
GAKG

SEQ ID NO: 478552 - protein, 9 aa, Mycobacterium
GAKGGNEQL

SEQ ID NO: 478553 - protein, 8 aa, Mycobacterium
GAKGLRGP

SEQ ID NO: 478554 - protein, 10 aa, Mycobacterium
GAKGQAGSRG

SEQ ID NO: 478555 - protein, 10 aa, Mycobacterium
GAKGRHESSM

SEQ ID NO: 478556 - protein, 8 aa, Mycobacterium
GAKGRSQE

SEQ ID NO: 478557 - protein, 7 aa, Mycobacterium
GAKGSLP

SEQ ID NO: 478558 - protein, 16 aa, Mycobacterium
GAKIGSKGRPLPGGGE

SEQ ID NO: 478559 - protein, 6 aa, Mycobacterium
GAKLPS

SEQ ID NO: 478560 - protein, 5 aa, Mycobacterium
GAKND

SEQ ID NO: 478561 - protein, 16 aa, Mycobacterium
GAKNDPSFTADHAEQL

SEQ ID NO: 478562 - protein, 10 aa, Mycobacterium
GAKPAEGSME

SEQ ID NO: 478563 - protein, 6 aa, Mycobacterium
GAKPEV

SEQ ID NO: 478564 - protein, 10 aa, Mycobacterium
GAKPKAPRVE

SEQ ID NO: 478565 - protein, 8 aa, Mycobacterium
GAKPLSEN

SEQ ID NO: 478566 - protein, 13 aa, Mycobacterium
GAKPNSGAQPAPQ

SEQ ID NO: 478567 - protein, 22 aa, Mycobacterium
GAKPPPGGDGPAGSGPRGDDSW

SEQ ID NO: 478568 - protein, 10 aa, Mycobacterium
GAKPRTPTLG

SEQ ID NO: 478569 - protein, 9 aa, Mycobacterium
GAKPVGADT

SEQ ID NO: 478570 - protein, 10 aa, Mycobacterium
GAKPVGADTG

SEQ ID NO: 478571 - protein, 9 aa, Mycobacterium
GAKPVGAES

SEQ ID NO: 478572 - protein, 10 aa, Mycobacterium
GAKPVGKDTG

SEQ ID NO: 478573 - protein, 11 aa, Mycobacterium
GAKPVGKDTGL

SEQ ID NO: 478574 - protein, 8 aa, Mycobacterium
GAKPVGPS

SEQ ID NO: 478575 - protein, 10 aa, Mycobacterium
GAKPVGRETG

SEQ ID NO: 478576 - protein, 8 aa, Mycobacterium
GAKPVSGS

SEQ ID NO: 478577 - protein, 6 aa, Mycobacterium
GAKPVT

SEQ ID NO: 478578 - protein, 7 aa, Mycobacterium
GAKQDGV

SEQ ID NO: 478579 - protein, 7 aa, Mycobacterium
GAKQEKL

SEQ ID NO: 478580 - protein, 10 aa, Mycobacterium
GAKQKPGQSR

SEQ ID NO: 478581 - protein, 12 aa, Mycobacterium
GAKQQDKPAAQV

SEQ ID NO: 478582 - protein, 6 aa, Mycobacterium
GAKRAR

SEQ ID NO: 478583 - protein, 19 aa, Mycobacterium
GAKRSASSLKVGDPRESDT

SEQ ID NO: 478584 - protein, 9 aa, Mycobacterium
GAKSGAERV

SEQ ID NO: 478585 - protein, 9 aa, Mycobacterium
GAKSGARRI

SEQ ID NO: 478586 - protein, 8 aa, Mycobacterium
GAKSGKKR

SEQ ID NO: 478587 - protein, 7 aa, Mycobacterium
GAKSGKL

SEQ ID NO: 478588 - protein, 13 aa, Mycobacterium
GAKSGKPRSTPIT

SEQ ID NO: 478589 - protein, 9 aa, Mycobacterium
GAKSGKQRI

SEQ ID NO: 478590 - protein, 8 aa, Mycobacterium
GAKSGKRR

SEQ ID NO: 478591 - protein, 13 aa, Mycobacterium
GAKSNKRTRRRDA

SEQ ID NO: 478592 - protein, 8 aa, Mycobacterium
GAKSTVAD

SEQ ID NO: 478593 - protein, 11 aa, Mycobacterium
GAKSVDTAAQT

SEQ ID NO: 478594 - protein, 10 aa, Mycobacterium
GAKSVPAQKH

SEQ ID NO: 478595 - protein, 10 aa, Mycobacterium
GAKSVPPQKH

SEQ ID NO: 478596 - protein, 11 aa, Mycobacterium
GAKTAKAVSKR

SEQ ID NO: 478597 - protein, 13 aa, Mycobacterium
GAKTATDASAARA

SEQ ID NO: 478598 - protein, 17 aa, Mycobacterium
GAKTDGRFVRRELSQNL

SEQ ID NO: 478599 - protein, 9 aa, Mycobacterium
GAKTGENGK

SEQ ID NO: 478600 - protein, 8 aa, Mycobacterium
GAKTPAEI

SEQ ID NO: 478601 - protein, 5 aa, Mycobacterium
GAKVA

SEQ ID NO: 478602 - protein, 7 aa, Mycobacterium
GAKVGSA

SEQ ID NO: 478603 - protein, 11 aa, Mycobacterium
GAKYDSATTKS

SEQ ID NO: 478604 - protein, 6 aa, Mycobacterium
GAKYGL

SEQ ID NO: 478605 - protein, 4 aa, Mycobacterium
GALA

SEQ ID NO: 478606 - protein, 10 aa, Mycobacterium
GALAAPGGEG

SEQ ID NO: 478607 - protein, 9 aa, Mycobacterium
GALAERGGL

SEQ ID NO: 478608 - protein, 11 aa, Mycobacterium
GALAGKTRRAL

SEQ ID NO: 478609 - protein, 6 aa, Mycobacterium
GALAGQ

SEQ ID NO: 478610 - protein, 8 aa, Mycobacterium
GALAGQPL

SEQ ID NO: 478611 - protein, 7 aa, Mycobacterium
GALAGTS

SEQ ID NO: 478612 - protein, 10 aa, Mycobacterium
GALAKSGRFS

SEQ ID NO: 478613 - protein, 8 aa, Mycobacterium
GALANSQL

SEQ ID NO: 478614 - protein, 11 aa, Mycobacterium
GALAPGDPSER

SEQ ID NO: 478615 - protein, 11 aa, Mycobacterium
GALASAPADVR

SEQ ID NO: 478616 - protein, 7 aa, Mycobacterium
GALASTA

SEQ ID NO: 478617 - protein, 11 aa, Mycobacterium
GALASTGVAAG

SEQ ID NO: 478618 - protein, 20 aa, Mycobacterium
GALATGKKAAETVIDDLAGA

SEQ ID NO: 478619 - protein, 17 aa, Mycobacterium
GALDDEAAARVRRQVRA

SEQ ID NO: 478620 - protein, 11 aa, Mycobacterium
GALDDGEVPGG

SEQ ID NO: 478621 - protein, 15 aa, Mycobacterium
GALDDPDSEGRHAAD

SEQ ID NO: 478622 - protein, 5 aa, Mycobacterium
GALDE

SEQ ID NO: 478623 - protein, 8 aa, Mycobacterium
GALDGGAA

SEQ ID NO: 478624 - protein, 19 aa, Mycobacterium
GALDLSSGTPRHLYFYLER

SEQ ID NO: 478625 - protein, 12 aa, Mycobacterium
GALDPATDWPRR

SEQ ID NO: 478626 - protein, 6 aa, Mycobacterium
GALDRP

SEQ ID NO: 478627 - protein, 7 aa, Mycobacterium
GALDTER

SEQ ID NO: 478628 - protein, 5 aa, Mycobacterium
GALEA

SEQ ID NO: 478629 - protein, 8 aa, Mycobacterium
GALEAKPS

SEQ ID NO: 478630 - protein, 11 aa, Mycobacterium
GALEASQQARV

SEQ ID NO: 478631 - protein, 6 aa, Mycobacterium
GALEEA

SEQ ID NO: 478632 - protein, 6 aa, Mycobacterium
GALEGL

SEQ ID NO: 478633 - protein, 7 aa, Mycobacterium
GALENGQ

SEQ ID NO: 478634 - protein, 4 aa, Mycobacterium
GALG

SEQ ID NO: 478635 - protein, 11 aa, Mycobacterium
GALGATPSDAA

SEQ ID NO: 478636 - protein, 9 aa, Mycobacterium
GALGDRPPE

SEQ ID NO: 478637 - protein, 7 aa, Mycobacterium
GALGDTA

SEQ ID NO: 478638 - protein, 7 aa, Mycobacterium
GALGERA

SEQ ID NO: 478639 - protein, 5 aa, Mycobacterium
GALGG

SEQ ID NO: 478640 - protein, 14 aa, Mycobacterium
GALGGDPRIGPAGR

SEQ ID NO: 478641 - protein, 14 aa, Mycobacterium
GALGGKLTGAGGGG

SEQ ID NO: 478642 - protein, 9 aa, Mycobacterium
GALGGPANA

SEQ ID NO: 478643 - protein, 18 aa, Mycobacterium
GALGNTGLPDTETATAIR

SEQ ID NO: 478644 - protein, 8 aa, Mycobacterium
GALGPADL

SEQ ID NO: 478645 - protein, 7 aa, Mycobacterium
GALGPAG

SEQ ID NO: 478646 - protein, 8 aa, Mycobacterium
GALGPGDD

SEQ ID NO: 478647 - protein, 10 aa, Mycobacterium
GALGPTGGGF

SEQ ID NO: 478648 - protein, 19 aa, Mycobacterium
GALGREQETADGAPGERVP

SEQ ID NO: 478649 - protein, 8 aa, Mycobacterium
GALGSTAS

SEQ ID NO: 478650 - protein, 8 aa, Mycobacterium
GALGTAGE

SEQ ID NO: 478651 - protein, 5 aa, Mycobacterium
GALHN

SEQ ID NO: 478652 - protein, 6 aa, Mycobacterium
GALHNR

SEQ ID NO: 478653 - protein, 11 aa, Mycobacterium
GALNGARGNSG

SEQ ID NO: 478654 - protein, 4 aa, Mycobacterium
GALP

SEQ ID NO: 478655 - protein, 5 aa, Mycobacterium
GALPA

SEQ ID NO: 478656 - protein, 10 aa, Mycobacterium
GALPAGTRLP

SEQ ID NO: 478657 - protein, 7 aa, Mycobacterium
GALPDGL

SEQ ID NO: 478658 - protein, 10 aa, Mycobacterium
GALPDPAQCR

SEQ ID NO: 478659 - protein, 13 aa, Mycobacterium
GALPERTAADGYS

SEQ ID NO: 478660 - protein, 6 aa, Mycobacterium
GALPET

SEQ ID NO: 478661 - protein, 5 aa, Mycobacterium
GALPP

SEQ ID NO: 478662 - protein, 6 aa, Mycobacterium
GALPPA

SEQ ID NO: 478663 - protein, 8 aa, Mycobacterium
GALPPGIQ

SEQ ID NO: 478664 - protein, 21 aa, Mycobacterium
GALPPGLSVPAQGGGSGTGQY

SEQ ID NO: 478665 - protein, 19 aa, Mycobacterium
GALPPGVGKAGGAPGHGQY

SEQ ID NO: 478666 - protein, 19 aa, Mycobacterium
GALPPGVGKPGTGSGHGQY

SEQ ID NO: 478667 - protein, 9 aa, Mycobacterium
GALPPPEPA

SEQ ID NO: 478668 - protein, 7 aa, Mycobacterium
GALPQGI

SEQ ID NO: 478669 - protein, 10 aa, Mycobacterium
GALPSESVEA

SEQ ID NO: 478670 - protein, 14 aa, Mycobacterium
GALPTEVTETPAAA

SEQ ID NO: 478671 - protein, 8 aa, Mycobacterium
GALPTPSS

SEQ ID NO: 478672 - protein, 5 aa, Mycobacterium
GALQA

SEQ ID NO: 478673 - protein, 20 aa, Mycobacterium
GALQDGDADVRAYARQALAS

SEQ ID NO: 478674 - protein, 7 aa, Mycobacterium
GALQPGE

SEQ ID NO: 478675 - protein, 15 aa, Mycobacterium
GALQPGVGRPAGPSV

SEQ ID NO: 478676 - protein, 4 aa, Mycobacterium
GALR

SEQ ID NO: 478677 - protein, 13 aa, Mycobacterium
GALRADEGEPGSR

SEQ ID NO: 478678 - protein, 10 aa, Mycobacterium
GALRDAGIER

SEQ ID NO: 478679 - protein, 13 aa, Mycobacterium
GALRDGAATAEDV

SEQ ID NO: 478680 - protein, 7 aa, Mycobacterium
GALRDSD

SEQ ID NO: 478681 - protein, 5 aa, Mycobacterium
GALRG

SEQ ID NO: 478682 - protein, 8 aa, Mycobacterium
GALRGGRE

SEQ ID NO: 478683 - protein, 5 aa, Mycobacterium
GALRP

SEQ ID NO: 478684 - protein, 6 aa, Mycobacterium
GALRPG

SEQ ID NO: 478685 - protein, 15 aa, Mycobacterium
GALRTDREGVTSGQI

SEQ ID NO: 478686 - protein, 7 aa, Mycobacterium
GALSGAD

SEQ ID NO: 478687 - protein, 12 aa, Mycobacterium
GALSPDTGPTGA

SEQ ID NO: 478688 - protein, 9 aa, Mycobacterium
GALSPEHRA

SEQ ID NO: 478689 - protein, 9 aa, Mycobacterium
GALSPSYGL

SEQ ID NO: 478690 - protein, 28 aa, Mycobacterium
GALSSGISNSGTNSSGGFNTGDDQSGFF

SEQ ID NO: 478691 - protein, 16 aa, Mycobacterium
GALSVNQRPHELTVVP

SEQ ID NO: 478692 - protein, 16 aa, Mycobacterium
GALTATQLGGAAAAAE

SEQ ID NO: 478693 - protein, 15 aa, Mycobacterium
GALTDQTARQDAAEQ

SEQ ID NO: 478694 - protein, 11 aa, Mycobacterium
GALTDRRTDTV

SEQ ID NO: 478695 - protein, 11 aa, Mycobacterium
GALTDRRTETV

SEQ ID NO: 478696 - protein, 16 aa, Mycobacterium
GALTEQAARQDSADQA

SEQ ID NO: 478697 - protein, 9 aa, Mycobacterium
GALTERGEV

SEQ ID NO: 478698 - protein, 9 aa, Mycobacterium
GALTGGGYR

SEQ ID NO: 478699 - protein, 9 aa, Mycobacterium
GALTPDNTH

SEQ ID NO: 478700 - protein, 4 aa, Mycobacterium
GAME

SEQ ID NO: 478701 - protein, 18 aa, Mycobacterium
GAMETATDGLRKQVLATY

SEQ ID NO: 478702 - protein, 5 aa, Mycobacterium
GAMGG

SEQ ID NO: 478703 - protein, 9 aa, Mycobacterium
GAMGGSASE

SEQ ID NO: 478704 - protein, 8 aa, Mycobacterium
GAMGPEGD

SEQ ID NO: 478705 - protein, 14 aa, Mycobacterium
GAMGRRAGAAAGYT

SEQ ID NO: 478706 - protein, 7 aa, Mycobacterium
GAMRSQQ

SEQ ID NO: 478707 - protein, 21 aa, Mycobacterium
GAMSGTEGVKRITGDAAHRTM

SEQ ID NO: 478708 - protein, 4 aa, Mycobacterium
GAMT

SEQ ID NO: 478709 - protein, 6 aa, Mycobacterium
GANAAR

SEQ ID NO: 478710 - protein, 15 aa, Mycobacterium
GANAATGSGQDGGAG

SEQ ID NO: 478711 - protein, 15 aa, Mycobacterium
GANAEVNDAVRGKGS

SEQ ID NO: 478712 - protein, 9 aa, Mycobacterium
GANAGPDRG

SEQ ID NO: 478713 - protein, 11 aa, Mycobacterium
GANAGPDRNWR

SEQ ID NO: 478714 - protein, 11 aa, Mycobacterium
GANAGPDRSAI

SEQ ID NO: 478715 - protein, 5 aa, Mycobacterium
GANAR

SEQ ID NO: 478716 - protein, 14 aa, Mycobacterium
GANATTPGGNGGDG

SEQ ID NO: 478717 - protein, 6 aa, Mycobacterium
GANDAL

SEQ ID NO: 478718 - protein, 6 aa, Mycobacterium
GANDAV

SEQ ID NO: 478719 - protein, 7 aa, Mycobacterium
GANDAVT

SEQ ID NO: 478720 - protein, 9 aa, Mycobacterium
GANDGGGSI

SEQ ID NO: 478721 - protein, 10 aa, Mycobacterium
GANDGGGSIR

SEQ ID NO: 478722 - protein, 8 aa, Mycobacterium
GANDGVRE

SEQ ID NO: 478723 - protein, 11 aa, Mycobacterium
GANDPARSGFE

SEQ ID NO: 478724 - protein, 8 aa, Mycobacterium
GANDPEIS

SEQ ID NO: 478725 - protein, 8 aa, Mycobacterium
GANDRSLE

SEQ ID NO: 478726 - protein, 13 aa, Mycobacterium
GANEDIDSPYGPK

SEQ ID NO: 478727 - protein, 7 aa, Mycobacterium
GANERDH

SEQ ID NO: 478728 - protein, 9 aa, Mycobacterium
GANEVGARE

SEQ ID NO: 478729 - protein, 7 aa, Mycobacterium
GANEYSL

SEQ ID NO: 478730 - protein, 11 aa, Mycobacterium
GANFDTPPSVQ

SEQ ID NO: 478731 - protein, 13 aa, Mycobacterium
GANFGSANIGSGN

SEQ ID NO: 478732 - protein, 17 aa, Mycobacterium
GANFPGGLDESKPDGFD

SEQ ID NO: 478733 - protein, 17 aa, Mycobacterium
GANFPGGLDESKPDGFE

SEQ ID NO: 478734 - protein, 18 aa, Mycobacterium
GANFPGGLDETKPDGFDT

SEQ ID NO: 478735 - protein, 11 aa, Mycobacterium
GANFQTPPSVQ

SEQ ID NO: 478736 - protein, 11 aa, Mycobacterium
GANGADGPGGV

SEQ ID NO: 478737 - protein, 10 aa, Mycobacterium
GANGAGKSSL

SEQ ID NO: 478738 - protein, 11 aa, Mycobacterium
GANGGAAGNVP

SEQ ID NO: 478739 - protein, 8 aa, Mycobacterium
GANGGAIR

SEQ ID NO: 478740 - protein, 8 aa, Mycobacterium
GANGKAEI

SEQ ID NO: 478741 - protein, 9 aa, Mycobacterium
GANGKSEVT

SEQ ID NO: 478742 - protein, 9 aa, Mycobacterium
GANGKSSIT

SEQ ID NO: 478743 - protein, 6 aa, Mycobacterium
GANGNL

SEQ ID NO: 478744 - protein, 8 aa, Mycobacterium
GANGSATH

SEQ ID NO: 478745 - protein, 10 aa, Mycobacterium
GANGSGKSNL

SEQ ID NO: 478746 - protein, 10 aa, Mycobacterium
GANGSGKSSL

SEQ ID NO: 478747 - protein, 10 aa, Mycobacterium
GANGTGKSNL

SEQ ID NO: 478748 - protein, 9 aa, Mycobacterium
GANGTQDGG

SEQ ID NO: 478749 - protein, 8 aa, Mycobacterium
GANGVSGH

SEQ ID NO: 478750 - protein, 9 aa, Mycobacterium
GANHGGNKH

SEQ ID NO: 478751 - protein, 9 aa, Mycobacterium
GANHGSSKH

SEQ ID NO: 478752 - protein, 5 aa, Mycobacterium
GANIN

SEQ ID NO: 478753 - protein, 6 aa, Mycobacterium
GANKRF

SEQ ID NO: 478754 - protein, 10 aa, Mycobacterium
GANKRRTTVG

SEQ ID NO: 478755 - protein, 5 aa, Mycobacterium
GANNG

SEQ ID NO: 478756 - protein, 5 aa, Mycobacterium
GANNM

SEQ ID NO: 478757 - protein, 5 aa, Mycobacterium
GANNS

SEQ ID NO: 478758 - protein, 15 aa, Mycobacterium
GANPAPEGAASPVRP

SEQ ID NO: 478759 - protein, 8 aa, Mycobacterium
GANPDGSL

SEQ ID NO: 478760 - protein, 7 aa, Mycobacterium
GANPEAL

SEQ ID NO: 478761 - protein, 7 aa, Mycobacterium
GANPFKR

SEQ ID NO: 478762 - protein, 5 aa, Mycobacterium
GANPG

SEQ ID NO: 478763 - protein, 7 aa, Mycobacterium
GANPHDL

SEQ ID NO: 478764 - protein, 8 aa, Mycobacterium
GANPKASA

SEQ ID NO: 478765 - protein, 6 aa, Mycobacterium
GANPNW

SEQ ID NO: 478766 - protein, 9 aa, Mycobacterium
GANPPETEL

SEQ ID NO: 478767 - protein, 10 aa, Mycobacterium
GANPQRDKRI

SEQ ID NO: 478768 - protein, 7 aa, Mycobacterium
GANPSAY

SEQ ID NO: 478769 - protein, 13 aa, Mycobacterium
GANQTAEGAMNTE

SEQ ID NO: 478770 - protein, 8 aa, Mycobacterium
GANRDAGL

SEQ ID NO: 478771 - protein, 8 aa, Mycobacterium
GANREQAL

SEQ ID NO: 478772 - protein, 6 aa, Mycobacterium
GANRPG

SEQ ID NO: 478773 - protein, 6 aa, Mycobacterium
GANRPP

SEQ ID NO: 478774 - protein, 12 aa, Mycobacterium
GANRSTMSGSLD

SEQ ID NO: 478775 - protein, 7 aa, Mycobacterium
GANRTET

SEQ ID NO: 478776 - protein, 4 aa, Mycobacterium
GANS

SEQ ID NO: 478777 - protein, 12 aa, Mycobacterium
GANSAIPHHRPT

SEQ ID NO: 478778 - protein, 7 aa, Mycobacterium
GANSDSM

SEQ ID NO: 478779 - protein, 7 aa, Mycobacterium
GANSGLG

SEQ ID NO: 478780 - protein, 10 aa, Mycobacterium
GANSLGDHVS

SEQ ID NO: 478781 - protein, 11 aa, Mycobacterium
GANSNATANTT

SEQ ID NO: 478782 - protein, 8 aa, Mycobacterium
GANSTVDQ

SEQ ID NO: 478783 - protein, 6 aa, Mycobacterium
GANSVP

SEQ ID NO: 478784 - protein, 17 aa, Mycobacterium
GANSYTAEGATVSVTPG

SEQ ID NO: 478785 - protein, 6 aa, Mycobacterium
GANTAL

SEQ ID NO: 478786 - protein, 8 aa, Mycobacterium
GANTGIGY

SEQ ID NO: 478787 - protein, 8 aa, Mycobacterium
GANTGLGF

SEQ ID NO: 478788 - protein, 22 aa, Mycobacterium
GANTLTDKAPGGYRPDAEAAQR

SEQ ID NO: 478789 - protein, 9 aa, Mycobacterium
GANTSRASI

SEQ ID NO: 478790 - protein, 6 aa, Mycobacterium
GANTTF

SEQ ID NO: 478791 - protein, 6 aa, Mycobacterium
GANTVG

SEQ ID NO: 478792 - protein, 4 aa, Mycobacterium
GANV

SEQ ID NO: 478793 - protein, 11 aa, Mycobacterium
GANYGGADAAG

SEQ ID NO: 478794 - protein, 4 aa, Mycobacterium
GAPA

SEQ ID NO: 478795 - protein, 12 aa, Mycobacterium
GAPAADFGAASR

SEQ ID NO: 478796 - protein, 8 aa, Mycobacterium
GAPAAEEA

SEQ ID NO: 478797 - protein, 19 aa, Mycobacterium
GAPAAGAGASSALLSRPSV

SEQ ID NO: 478798 - protein, 12 aa, Mycobacterium
GAPAAGKSTVAE

SEQ ID NO: 478799 - protein, 6 aa, Mycobacterium
GAPAAR

SEQ ID NO: 478800 - protein, 9 aa, Mycobacterium
GAPAATTAQ

SEQ ID NO: 478801 - protein, 7 aa, Mycobacterium
GAPAAVN

SEQ ID NO: 478802 - protein, 18 aa, Mycobacterium
GAPAAVNSALTNAKKGAT

SEQ ID NO: 478803 - protein, 5 aa, Mycobacterium
GAPAD

SEQ ID NO: 478804 - protein, 8 aa, Mycobacterium
GAPADEAR

SEQ ID NO: 478805 - protein, 11 aa, Mycobacterium
GAPADFKKRSY

SEQ ID NO: 478806 - protein, 16 aa, Mycobacterium
GAPADGTVGDEPPLDT

SEQ ID NO: 478807 - protein, 6 aa, Mycobacterium
GAPADI

SEQ ID NO: 478808 - protein, 7 aa, Mycobacterium
GAPADLS

SEQ ID NO: 478809 - protein, 10 aa, Mycobacterium
GAPADRAEAV

SEQ ID NO: 478810 - protein, 7 aa, Mycobacterium
GAPADRD

SEQ ID NO: 478811 - protein, 17 aa, Mycobacterium
GAPADSADDSDDTAPPR

SEQ ID NO: 478812 - protein, 12 aa, Mycobacterium
GAPADTGGPAAH

SEQ ID NO: 478813 - protein, 5 aa, Mycobacterium
GAPAE

SEQ ID NO: 478814 - protein, 8 aa, Mycobacterium
GAPAEAAD

SEQ ID NO: 478815 - protein, 14 aa, Mycobacterium
GAPAELIGTDGGAA

SEQ ID NO: 478816 - protein, 18 aa, Mycobacterium
GAPAERDAGPSLGPNFAA

SEQ ID NO: 478817 - protein, 14 aa, Mycobacterium
GAPAGEDDGEPVEE

SEQ ID NO: 478818 - protein, 13 aa, Mycobacterium
GAPAGPTGEPEWP

SEQ ID NO: 478819 - protein, 5 aa, Mycobacterium
GAPAH

SEQ ID NO: 478820 - protein, 6 aa, Mycobacterium
GAPALA

SEQ ID NO: 478821 - protein, 6 aa, Mycobacterium
GAPAMS

SEQ ID NO: 478822 - protein, 9 aa, Mycobacterium
GAPANGGSC

SEQ ID NO: 478823 - protein, 9 aa, Mycobacterium
GAPANVEPL

SEQ ID NO: 478824 - protein, 6 aa, Mycobacterium
GAPAPA

SEQ ID NO: 478825 - protein, 15 aa, Mycobacterium
GAPAPAQTDTNPAGA

SEQ ID NO: 478826 - protein, 10 aa, Mycobacterium
GAPAPGPAPA

SEQ ID NO: 478827 - protein, 6 aa, Mycobacterium
GAPAPL

SEQ ID NO: 478828 - protein, 7 aa, Mycobacterium
GAPAPQI

SEQ ID NO: 478829 - protein, 10 aa, Mycobacterium
GAPAPRQRDR

SEQ ID NO: 478830 - protein, 13 aa, Mycobacterium
GAPAPSATAEGCG

SEQ ID NO: 478831 - protein, 11 aa, Mycobacterium
GAPAPSPTARS

SEQ ID NO: 478832 - protein, 8 aa, Mycobacterium
GAPAPVRT

SEQ ID NO: 478833 - protein, 15 aa, Mycobacterium
GAPAQRRAGYAPASA

SEQ ID NO: 478834 - protein, 5 aa, Mycobacterium
GAPAR

SEQ ID NO: 478835 - protein, 7 aa, Mycobacterium
GAPARAV

SEQ ID NO: 478836 - protein, 8 aa, Mycobacterium
GAPARISQ

SEQ ID NO: 478837 - protein, 10 aa, Mycobacterium
GAPARPLTGT

SEQ ID NO: 478838 - protein, 12 aa, Mycobacterium
GAPARTSKPKFR

SEQ ID NO: 478839 - protein, 5 aa, Mycobacterium
GAPAS

SEQ ID NO: 478840 - protein, 16 aa, Mycobacterium
GAPASPAAFADSVPAQ

SEQ ID NO: 478841 - protein, 14 aa, Mycobacterium
GAPASPAAFAEANQ

SEQ ID NO: 478842 - protein, 16 aa, Mycobacterium
GAPASTEITSARVDPA

SEQ ID NO: 478843 - protein, 18 aa, Mycobacterium
GAPASTPARTLDEQAEAT

SEQ ID NO: 478844 - protein, 13 aa, Mycobacterium
GAPATASYTNHGP

SEQ ID NO: 478845 - protein, 8 aa, Mycobacterium
GAPATEAT

SEQ ID NO: 478846 - protein, 6 aa, Mycobacterium
GAPATL

SEQ ID NO: 478847 - protein, 6 aa, Mycobacterium
GAPATS

SEQ ID NO: 478848 - protein, 10 aa, Mycobacterium
GAPATSPGTV

SEQ ID NO: 478849 - protein, 5 aa, Mycobacterium
GAPAV

SEQ ID NO: 478850 - protein, 8 aa, Mycobacterium
GAPAVSGS

SEQ ID NO: 478851 - protein, 8 aa, Mycobacterium
GAPAVSPA

SEQ ID NO: 478852 - protein, 14 aa, Mycobacterium
GAPCRPPHCVAAES

SEQ ID NO: 478853 - protein, 4 aa, Mycobacterium
GAPD

SEQ ID NO: 478854 - protein, 5 aa, Mycobacterium
GAPDA

SEQ ID NO: 478855 - protein, 6 aa, Mycobacterium
GAPDAA

SEQ ID NO: 478856 - protein, 7 aa, Mycobacterium
GAPDAEW

SEQ ID NO: 478857 - protein, 12 aa, Mycobacterium
GAPDAGGSALPL

SEQ ID NO: 478858 - protein, 15 aa, Mycobacterium
GAPDAGGSALPLRKR

SEQ ID NO: 478859 - protein, 5 aa, Mycobacterium
GAPDD

SEQ ID NO: 478860 - protein, 6 aa, Mycobacterium
GAPDDR

SEQ ID NO: 478861 - protein, 8 aa, Mycobacterium
GAPDDTAG

SEQ ID NO: 478862 - protein, 5 aa, Mycobacterium
GAPDE

SEQ ID NO: 478863 - protein, 8 aa, Mycobacterium
GAPDEDLG

SEQ ID NO: 478864 - protein, 8 aa, Mycobacterium
GAPDEEGC

SEQ ID NO: 478865 - protein, 7 aa, Mycobacterium
GAPDEND

SEQ ID NO: 478866 - protein, 5 aa, Mycobacterium
GAPDF

SEQ ID NO: 478867 - protein, 5 aa, Mycobacterium
GAPDG

SEQ ID NO: 478868 - protein, 6 aa, Mycobacterium
GAPDGI

SEQ ID NO: 478869 - protein, 7 aa, Mycobacterium
GAPDGRR

SEQ ID NO: 478870 - protein, 6 aa, Mycobacterium
GAPDGV

SEQ ID NO: 478871 - protein, 6 aa, Mycobacterium
GAPDIK

SEQ ID NO: 478872 - protein, 6 aa, Mycobacterium
GAPDLA

SEQ ID NO: 478873 - protein, 24 aa, Mycobacterium
GAPDLSSDARFATNDDRVRNRPAL

SEQ ID NO: 478874 - protein, 6 aa, Mycobacterium
GAPDMT

SEQ ID NO: 478875 - protein, 9 aa, Mycobacterium
GAPDPEGAG

SEQ ID NO: 478876 - protein, 19 aa, Mycobacterium
GAPDPGMARAGAAAAARRR

SEQ ID NO: 478877 - protein, 11 aa, Mycobacterium
GAPDPLDPDDD

SEQ ID NO: 478878 - protein, 15 aa, Mycobacterium
GAPDRRGDRARWTED

SEQ ID NO: 478879 - protein, 21 aa, Mycobacterium
GAPDSAPSFGDTMEKASQTNL

SEQ ID NO: 478880 - protein, 11 aa, Mycobacterium
GAPDSAPVDEL

SEQ ID NO: 478881 - protein, 5 aa, Mycobacterium
GAPDT

SEQ ID NO: 478882 - protein, 7 aa, Mycobacterium
GAPDTDW

SEQ ID NO: 478883 - protein, 10 aa, Mycobacterium
GAPDTERGLA

SEQ ID NO: 478884 - protein, 6 aa, Mycobacterium
GAPDTP

SEQ ID NO: 478885 - protein, 9 aa, Mycobacterium
GAPDTPEQI

SEQ ID NO: 478886 - protein, 10 aa, Mycobacterium
GAPDTQRGLA

SEQ ID NO: 478887 - protein, 6 aa, Mycobacterium
GAPDTR

SEQ ID NO: 478888 - protein, 5 aa, Mycobacterium
GAPDV

SEQ ID NO: 478889 - protein, 8 aa, Mycobacterium
GAPDVDPA

SEQ ID NO: 478890 - protein, 6 aa, Mycobacterium
GAPEDL

SEQ ID NO: 478891 - protein, 6 aa, Mycobacterium
GAPEDM

SEQ ID NO: 478892 - protein, 22 aa, Mycobacterium
GAPEEREAAAALPEKGGPRAAG

SEQ ID NO: 478893 - protein, 7 aa, Mycobacterium
GAPEEVY

SEQ ID NO: 478894 - protein, 5 aa, Mycobacterium
GAPEG

SEQ ID NO: 478895 - protein, 13 aa, Mycobacterium
GAPEGPDEALRTE

SEQ ID NO: 478896 - protein, 7 aa, Mycobacterium
GAPEGTL

SEQ ID NO: 478897 - protein, 19 aa, Mycobacterium
GAPEGTPFPADERRPGQTV

SEQ ID NO: 478898 - protein, 9 aa, Mycobacterium
GAPEGTVAA

SEQ ID NO: 478899 - protein, 6 aa, Mycobacterium
GAPEMN

SEQ ID NO: 478900 - protein, 29 aa, Mycobacterium
GAPENSGSEQSKAHSEGRASRFREETRAE

SEQ ID NO: 478901 - protein, 12 aa, Mycobacterium
GAPEPEQPEETR

SEQ ID NO: 478902 - protein, 11 aa, Mycobacterium
GAPEPPRGEQT

SEQ ID NO: 478903 - protein, 8 aa, Mycobacterium
GAPEPRHD

SEQ ID NO: 478904 - protein, 9 aa, Mycobacterium
GAPEPTGDI

SEQ ID NO: 478905 - protein, 12 aa, Mycobacterium
GAPESADHVPPT

SEQ ID NO: 478906 - protein, 7 aa, Mycobacterium
GAPESAR

SEQ ID NO: 478907 - protein, 8 aa, Mycobacterium
GAPETPAM

SEQ ID NO: 478908 - protein, 9 aa, Mycobacterium
GAPETPAMS

SEQ ID NO: 478909 - protein, 7 aa, Mycobacterium
GAPETRV

SEQ ID NO: 478910 - protein, 6 aa, Mycobacterium
GAPETT

SEQ ID NO: 478911 - protein, 5 aa, Mycobacterium
GAPEW

SEQ ID NO: 478912 - protein, 8 aa, Mycobacterium
GAPFSGSD

SEQ ID NO: 478913 - protein, 6 aa, Mycobacterium
GAPGAC

SEQ ID NO: 478914 - protein, 9 aa, Mycobacterium
GAPGADDQL

SEQ ID NO: 478915 - protein, 10 aa, Mycobacterium
GAPGAETGVD

SEQ ID NO: 478916 - protein, 8 aa, Mycobacterium
GAPGAGTR

SEQ ID NO: 478917 - protein, 8 aa, Mycobacterium
GAPGAGWE

SEQ ID NO: 478918 - protein, 6 aa, Mycobacterium
GAPGAL

SEQ ID NO: 478919 - protein, 9 aa, Mycobacterium
GAPGAPGLD

SEQ ID NO: 478920 - protein, 9 aa, Mycobacterium
GAPGAPGMD

SEQ ID NO: 478921 - protein, 7 aa, Mycobacterium
GAPGARE

SEQ ID NO: 478922 - protein, 6 aa, Mycobacterium
GAPGEI

SEQ ID NO: 478923 - protein, 7 aa, Mycobacterium
GAPGEND

SEQ ID NO: 478924 - protein, 6 aa, Mycobacterium
GAPGEY

SEQ ID NO: 478925 - protein, 6 aa, Mycobacterium
GAPGFE

SEQ ID NO: 478926 - protein, 7 aa, Mycobacterium
GAPGGAL

SEQ ID NO: 478927 - protein, 7 aa, Mycobacterium
GAPGGDA

SEQ ID NO: 478928 - protein, 6 aa, Mycobacterium
GAPGHD

SEQ ID NO: 478929 - protein, 6 aa, Mycobacterium
GAPGHE

SEQ ID NO: 478930 - protein, 9 aa, Mycobacterium
GAPGHTPGS

SEQ ID NO: 478931 - protein, 7 aa, Mycobacterium
GAPGIGK

SEQ ID NO: 478932 - protein, 9 aa, Mycobacterium
GAPGKAVSA

SEQ ID NO: 478933 - protein, 8 aa, Mycobacterium
GAPGKGNT

SEQ ID NO: 478934 - protein, 11 aa, Mycobacterium
GAPGLRHGSPA

SEQ ID NO: 478935 - protein, 9 aa, Mycobacterium
GAPGNSDGC

SEQ ID NO: 478936 - protein, 12 aa, Mycobacterium
GAPGPTPDDSVS

SEQ ID NO: 478937 - protein, 14 aa, Mycobacterium
GAPGPWRRPERPIT

SEQ ID NO: 478938 - protein, 9 aa, Mycobacterium
GAPGQANYA

SEQ ID NO: 478939 - protein, 7 aa, Mycobacterium
GAPGQGE

SEQ ID NO: 478940 - protein, 11 aa, Mycobacterium
GAPGQGSYAAA

SEQ ID NO: 478941 - protein, 12 aa, Mycobacterium
GAPGRASANGTS

SEQ ID NO: 478942 - protein, 10 aa, Mycobacterium
GAPGRDNPGN

SEQ ID NO: 478943 - protein, 9 aa, Mycobacterium
GAPGSQTLA

SEQ ID NO: 478944 - protein, 8 aa, Mycobacterium
GAPGSRMY

SEQ ID NO: 478945 - protein, 5 aa, Mycobacterium
GAPGT

SEQ ID NO: 478946 - protein, 9 aa, Mycobacterium
GAPGTAAPL

SEQ ID NO: 478947 - protein, 18 aa, Mycobacterium
GAPGTAAPLADGLKEAGA

SEQ ID NO: 478948 - protein, 12 aa, Mycobacterium
GAPGTAAVAILS

SEQ ID NO: 478949 - protein, 6 aa, Mycobacterium
GAPGVT

SEQ ID NO: 478950 - protein, 12 aa, Mycobacterium
GAPGWDVSPEEL

SEQ ID NO: 478951 - protein, 5 aa, Mycobacterium
GAPGY

SEQ ID NO: 478952 - protein, 6 aa, Mycobacterium
GAPHND

SEQ ID NO: 478953 - protein, 7 aa, Mycobacterium
GAPHNDP

SEQ ID NO: 478954 - protein, 5 aa, Mycobacterium
GAPIA

SEQ ID NO: 478955 - protein, 6 aa, Mycobacterium
GAPIAP

SEQ ID NO: 478956 - protein, 6 aa, Mycobacterium
GAPIGL

SEQ ID NO: 478957 - protein, 5 aa, Mycobacterium
GAPIP

SEQ ID NO: 478958 - protein, 5 aa, Mycobacterium
GAPIR

SEQ ID NO: 478959 - protein, 18 aa, Mycobacterium
GAPITDTNTPLPLVELKL

SEQ ID NO: 478960 - protein, 8 aa, Mycobacterium
GAPITPEL

SEQ ID NO: 478961 - protein, 9 aa, Mycobacterium
GAPKDPTLK

SEQ ID NO: 478962 - protein, 22 aa, Mycobacterium
GAPKDPTLKLGGRKTAKAVSKR

SEQ ID NO: 478963 - protein, 12 aa, Mycobacterium
GAPKDRRGHAAE

SEQ ID NO: 478964 - protein, 8 aa, Mycobacterium
GAPKEYKH

SEQ ID NO: 478965 - protein, 14 aa, Mycobacterium
GAPKFEGSQSLPEV

SEQ ID NO: 478966 - protein, 8 aa, Mycobacterium
GAPKFPPS

SEQ ID NO: 478967 - protein, 20 aa, Mycobacterium
GAPKGRDLGIPGEKLPGSYA

SEQ ID NO: 478968 - protein, 6 aa, Mycobacterium
GAPKPD

SEQ ID NO: 478969 - protein, 9 aa, Mycobacterium
GAPLAPGRR

SEQ ID NO: 478970 - protein, 5 aa, Mycobacterium
GAPLG

SEQ ID NO: 478971 - protein, 6 aa, Mycobacterium
GAPLGA

SEQ ID NO: 478972 - protein, 6 aa, Mycobacterium
GAPLGP

SEQ ID NO: 478973 - protein, 12 aa, Mycobacterium
GAPLNSDQAREL

SEQ ID NO: 478974 - protein, 5 aa, Mycobacterium
GAPLP

SEQ ID NO: 478975 - protein, 9 aa, Mycobacterium
GAPLPTKME

SEQ ID NO: 478976 - protein, 5 aa, Mycobacterium
GAPLS

SEQ ID NO: 478977 - protein, 9 aa, Mycobacterium
GAPLSAAAA

SEQ ID NO: 478978 - protein, 20 aa, Mycobacterium
GAPLTAPDVAAGTPLPPSVR

SEQ ID NO: 478979 - protein, 5 aa, Mycobacterium
GAPMA

SEQ ID NO: 478980 - protein, 5 aa, Mycobacterium
GAPMT

SEQ ID NO: 478981 - protein, 7 aa, Mycobacterium
GAPNDGW

SEQ ID NO: 478982 - protein, 7 aa, Mycobacterium
GAPNDRR

SEQ ID NO: 478983 - protein, 21 aa, Mycobacterium
GAPNEADGSPNRGYKVRPKGG

SEQ ID NO: 478984 - protein, 5 aa, Mycobacterium
GAPNG

SEQ ID NO: 478985 - protein, 6 aa, Mycobacterium
GAPNYD

SEQ ID NO: 478986 - protein, 4 aa, Mycobacterium
GAPP

SEQ ID NO: 478987 - protein, 8 aa, Mycobacterium
GAPPADAT

SEQ ID NO: 478988 - protein, 31 aa, Mycobacterium
GAPPAGGGAGSDPEPEPDPPGGGQSTNNSVF

SEQ ID NO: 478989 - protein, 9 aa, Mycobacterium
GAPPAQQRA

SEQ ID NO: 478990 - protein, 8 aa, Mycobacterium
GAPPARAL

SEQ ID NO: 478991 - protein, 10 aa, Mycobacterium
GAPPDDPRLT

SEQ ID NO: 478992 - protein, 14 aa, Mycobacterium
GAPPEDEPPAPSSL

SEQ ID NO: 478993 - protein, 6 aa, Mycobacterium
GAPPEI

SEQ ID NO: 478994 - protein, 15 aa, Mycobacterium
GAPPGAGAGGAAAVP

SEQ ID NO: 478995 - protein, 17 aa, Mycobacterium
GAPPGERHGSTADEVRS

SEQ ID NO: 478996 - protein, 6 aa, Mycobacterium
GAPPGP

SEQ ID NO: 478997 - protein, 9 aa, Mycobacterium
GAPPGSIDS

SEQ ID NO: 478998 - protein, 6 aa, Mycobacterium
GAPPGY

SEQ ID NO: 478999 - protein, 13 aa, Mycobacterium
GAPPLPSTGEGYR

SEQ ID NO: 479000 - protein, 6 aa, Mycobacterium
GAPPLS

SEQ ID NO: 479001 - protein, 8 aa, Mycobacterium
GAPPMSAP

SEQ ID NO: 479002 - protein, 7 aa, Mycobacterium
GAPPPDV

SEQ ID NO: 479003 - protein, 10 aa, Mycobacterium
GAPPPPRPHN

SEQ ID NO: 479004 - protein, 22 aa, Mycobacterium
GAPPRDDARPVDGETRCAPAPS

SEQ ID NO: 479005 - protein, 7 aa, Mycobacterium
GAPPRLQ

SEQ ID NO: 479006 - protein, 6 aa, Mycobacterium
GAPPRR

SEQ ID NO: 479007 - protein, 7 aa, Mycobacterium
GAPPRRR

SEQ ID NO: 479008 - protein, 6 aa, Mycobacterium
GAPPRS

SEQ ID NO: 479009 - protein, 6 aa, Mycobacterium
GAPPRV

SEQ ID NO: 479010 - protein, 18 aa, Mycobacterium
GAPPSLSERDAAAGSLDE

SEQ ID NO: 479011 - protein, 9 aa, Mycobacterium
GAPPSPGGC

SEQ ID NO: 479012 - protein, 22 aa, Mycobacterium
GAPPSPLDVPSDPGLPVVKAQV

SEQ ID NO: 479013 - protein, 8 aa, Mycobacterium
GAPPSPVA

SEQ ID NO: 479014 - protein, 7 aa, Mycobacterium
GAPPSQL

SEQ ID NO: 479015 - protein, 9 aa, Mycobacterium
GAPPTEGTY

SEQ ID NO: 479016 - protein, 19 aa, Mycobacterium
GAPPTLSDRDAAAPSLDDV

SEQ ID NO: 479017 - protein, 9 aa, Mycobacterium
GAPPTPQSD

SEQ ID NO: 479018 - protein, 141 aa, Mycobacterium
GAPPTPTPPRPEAPRRPGPPPPATTWRSPSPPAAPQPSRSATEPFAAAPKPPQPPTAPTRPLATETSPHSVRAGEQQQPQQPAPPPEQPPSDAPRHSRRARRGHRYRAEPDDDQVPSAAGAALPQHRATDKTQPASRVGPA

SEQ ID NO: 479019 - protein, 7 aa, Mycobacterium
GAPPTSC

SEQ ID NO: 479020 - protein, 15 aa, Mycobacterium
GAPPYPLSEIELDVA

SEQ ID NO: 479021 - protein, 7 aa, Mycobacterium
GAPQAGL

SEQ ID NO: 479022 - protein, 9 aa, Mycobacterium
GAPQAYSPD

SEQ ID NO: 479023 - protein, 6 aa, Mycobacterium
GAPQDE

SEQ ID NO: 479024 - protein, 9 aa, Mycobacterium
GAPQDPERT

SEQ ID NO: 479025 - protein, 7 aa, Mycobacterium
GAPQPGQ

SEQ ID NO: 479026 - protein, 6 aa, Mycobacterium
GAPQRA

SEQ ID NO: 479027 - protein, 7 aa, Mycobacterium
GAPQRRP

SEQ ID NO: 479028 - protein, 5 aa, Mycobacterium
GAPQT

SEQ ID NO: 479029 - protein, 6 aa, Mycobacterium
GAPQTL

SEQ ID NO: 479030 - protein, 7 aa, Mycobacterium
GAPQTLD

SEQ ID NO: 479031 - protein, 8 aa, Mycobacterium
GAPQVNAA

SEQ ID NO: 479032 - protein, 7 aa, Mycobacterium
GAPRAGL

SEQ ID NO: 479033 - protein, 11 aa, Mycobacterium
GAPRAGRRAAA

SEQ ID NO: 479034 - protein, 7 aa, Mycobacterium
GAPRAVS

SEQ ID NO: 479035 - protein, 7 aa, Mycobacterium
GAPRAYQ

SEQ ID NO: 479036 - protein, 5 aa, Mycobacterium
GAPRC

SEQ ID NO: 479037 - protein, 6 aa, Mycobacterium
GAPRED

SEQ ID NO: 479038 - protein, 7 aa, Mycobacterium
GAPREGY

SEQ ID NO: 479039 - protein, 8 aa, Mycobacterium
GAPRGRAA

SEQ ID NO: 479040 - protein, 6 aa, Mycobacterium
GAPRGV

SEQ ID NO: 479041 - protein, 20 aa, Mycobacterium
GAPRHDEADHAADTDGRPGI

SEQ ID NO: 479042 - protein, 7 aa, Mycobacterium
GAPRNRG

SEQ ID NO: 479043 - protein, 6 aa, Mycobacterium
GAPRPD

SEQ ID NO: 479044 - protein, 8 aa, Mycobacterium
GAPRPERQ

SEQ ID NO: 479045 - protein, 8 aa, Mycobacterium
GAPRPGRR

SEQ ID NO: 479046 - protein, 6 aa, Mycobacterium
GAPRPL

SEQ ID NO: 479047 - protein, 10 aa, Mycobacterium
GAPRPRPAEM

SEQ ID NO: 479048 - protein, 6 aa, Mycobacterium
GAPRQK

SEQ ID NO: 479049 - protein, 9 aa, Mycobacterium
GAPRRHGAR

SEQ ID NO: 479050 - protein, 42 aa, Mycobacterium
GAPRSDLATARSTYGHDTHATPAPPTPATKYRPQVPARSRVS

SEQ ID NO: 479051 - protein, 7 aa, Mycobacterium
GAPRSGL

SEQ ID NO: 479052 - protein, 6 aa, Mycobacterium
GAPRSP

SEQ ID NO: 479053 - protein, 7 aa, Mycobacterium
GAPRSST

SEQ ID NO: 479054 - protein, 8 aa, Mycobacterium
GAPSALTV

SEQ ID NO: 479055 - protein, 18 aa, Mycobacterium
GAPSATPSETTDSTRNLA

SEQ ID NO: 479056 - protein, 14 aa, Mycobacterium
GAPSDREIGSNFAA

SEQ ID NO: 479057 - protein, 7 aa, Mycobacterium
GAPSDRR

SEQ ID NO: 479058 - protein, 7 aa, Mycobacterium
GAPSDTA

SEQ ID NO: 479059 - protein, 6 aa, Mycobacterium
GAPSGA

SEQ ID NO: 479060 - protein, 20 aa, Mycobacterium
GAPSGAYVRRTGDDVQPGDV

SEQ ID NO: 479061 - protein, 10 aa, Mycobacterium
GAPSGIASCP

SEQ ID NO: 479062 - protein, 6 aa, Mycobacterium
GAPSGS

SEQ ID NO: 479063 - protein, 5 aa, Mycobacterium
GAPSL

SEQ ID NO: 479064 - protein, 7 aa, Mycobacterium
GAPSLSP

SEQ ID NO: 479065 - protein, 6 aa, Mycobacterium
GAPSMS

SEQ ID NO: 479066 - protein, 9 aa, Mycobacterium
GAPSQRREG

SEQ ID NO: 479067 - protein, 11 aa, Mycobacterium
GAPSSDPTAEL

SEQ ID NO: 479068 - protein, 10 aa, Mycobacterium
GAPSTDPPLQ

SEQ ID NO: 479069 - protein, 15 aa, Mycobacterium
GAPSTFGGPVPTPTL

SEQ ID NO: 479070 - protein, 8 aa, Mycobacterium
GAPTAGGS

SEQ ID NO: 479071 - protein, 7 aa, Mycobacterium
GAPTALT

SEQ ID NO: 479072 - protein, 9 aa, Mycobacterium
GAPTALTVR

SEQ ID NO: 479073 - protein, 8 aa, Mycobacterium
GAPTAPSE

SEQ ID NO: 479074 - protein, 8 aa, Mycobacterium
GAPTAQQL

SEQ ID NO: 479075 - protein, 6 aa, Mycobacterium
GAPTDL

SEQ ID NO: 479076 - protein, 7 aa, Mycobacterium
GAPTDRA

SEQ ID NO: 479077 - protein, 27 aa, Mycobacterium
GAPTDTALKERKHRVEDAVSAAKAAVE

SEQ ID NO: 479078 - protein, 14 aa, Mycobacterium
GAPTDTRPLDDRED

SEQ ID NO: 479079 - protein, 7 aa, Mycobacterium
GAPTEQE

SEQ ID NO: 479080 - protein, 7 aa, Mycobacterium
GAPTGLL

SEQ ID NO: 479081 - protein, 12 aa, Mycobacterium
GAPTHPTPTRRR

SEQ ID NO: 479082 - protein, 9 aa, Mycobacterium
GAPTPAETD

SEQ ID NO: 479083 - protein, 9 aa, Mycobacterium
GAPTPASFT

SEQ ID NO: 479084 - protein, 9 aa, Mycobacterium
GAPTPPGSA

SEQ ID NO: 479085 - protein, 10 aa, Mycobacterium
GAPTPSESEL

SEQ ID NO: 479086 - protein, 9 aa, Mycobacterium
GAPTPSESR

SEQ ID NO: 479087 - protein, 10 aa, Mycobacterium
GAPTPSETEL

SEQ ID NO: 479088 - protein, 9 aa, Mycobacterium
GAPTPTETE

SEQ ID NO: 479089 - protein, 7 aa, Mycobacterium
GAPTRNH

SEQ ID NO: 479090 - protein, 7 aa, Mycobacterium
GAPTSRS

SEQ ID NO: 479091 - protein, 13 aa, Mycobacterium
GAPTSTGGASERT

SEQ ID NO: 479092 - protein, 10 aa, Mycobacterium
GAPTSYPPEV

SEQ ID NO: 479093 - protein, 12 aa, Mycobacterium
GAPTTGRDDPDT

SEQ ID NO: 479094 - protein, 17 aa, Mycobacterium
GAPTTYPAEAPLSAFQL

SEQ ID NO: 479095 - protein, 8 aa, Mycobacterium
GAPTVEEQ

SEQ ID NO: 479096 - protein, 13 aa, Mycobacterium
GAPVAGEGDGPAA

SEQ ID NO: 479097 - protein, 10 aa, Mycobacterium
GAPVANPETI

SEQ ID NO: 479098 - protein, 6 aa, Mycobacterium
GAPVAQ

SEQ ID NO: 479099 - protein, 5 aa, Mycobacterium
GAPVD

SEQ ID NO: 479100 - protein, 7 aa, Mycobacterium
GAPVDAS

SEQ ID NO: 479101 - protein, 10 aa, Mycobacterium
GAPVEDGALP

SEQ ID NO: 479102 - protein, 6 aa, Mycobacterium
GAPVGA

SEQ ID NO: 479103 - protein, 7 aa, Mycobacterium
GAPVGSA

SEQ ID NO: 479104 - protein, 10 aa, Mycobacterium
GAPVKDPETI

SEQ ID NO: 479105 - protein, 10 aa, Mycobacterium
GAPVKNPETI

SEQ ID NO: 479106 - protein, 23 aa, Mycobacterium
GAPVPAAGLDPATPVPGYLLGCR

SEQ ID NO: 479107 - protein, 9 aa, Mycobacterium
GAPVPDGDL

SEQ ID NO: 479108 - protein, 6 aa, Mycobacterium
GAPVPG

SEQ ID NO: 479109 - protein, 7 aa, Mycobacterium
GAPVPRY

SEQ ID NO: 479110 - protein, 9 aa, Mycobacterium
GAPVPSDTH

SEQ ID NO: 479111 - protein, 17 aa, Mycobacterium
GAPVPTPCASSRPRRPC

SEQ ID NO: 479112 - protein, 7 aa, Mycobacterium
GAPVQQR

SEQ ID NO: 479113 - protein, 5 aa, Mycobacterium
GAPVS

SEQ ID NO: 479114 - protein, 7 aa, Mycobacterium
GAPVTMR

SEQ ID NO: 479115 - protein, 10 aa, Mycobacterium
GAPWASGPAV

SEQ ID NO: 479116 - protein, 5 aa, Mycobacterium
GAPWE

SEQ ID NO: 479117 - protein, 5 aa, Mycobacterium
GAPWP

SEQ ID NO: 479118 - protein, 12 aa, Mycobacterium
GAPWPAKYPGRS

SEQ ID NO: 479119 - protein, 7 aa, Mycobacterium
GAPYGIP

SEQ ID NO: 479120 - protein, 13 aa, Mycobacterium
GAPYNQQTRYDCS

SEQ ID NO: 479121 - protein, 12 aa, Mycobacterium
GAPYSPEPGAVA

SEQ ID NO: 479122 - protein, 6 aa, Mycobacterium
GAPYTG

SEQ ID NO: 479123 - protein, 14 aa, Mycobacterium
GAPYYDTYETADGK

SEQ ID NO: 479124 - protein, 9 aa, Mycobacterium
GAQAAKDSE

SEQ ID NO: 479125 - protein, 12 aa, Mycobacterium
GAQADRSTRTPV

SEQ ID NO: 479126 - protein, 18 aa, Mycobacterium
GAQAEEAGARAKLAAGAY

SEQ ID NO: 479127 - protein, 10 aa, Mycobacterium
GAQAGEAELG

SEQ ID NO: 479128 - protein, 6 aa, Mycobacterium
GAQAGN

SEQ ID NO: 479129 - protein, 9 aa, Mycobacterium
GAQAGPRSP

SEQ ID NO: 479130 - protein, 8 aa, Mycobacterium
GAQAGQRS

SEQ ID NO: 479131 - protein, 13 aa, Mycobacterium
GAQAGRRSGHRAQ

SEQ ID NO: 479132 - protein, 8 aa, Mycobacterium
GAQANAEE

SEQ ID NO: 479133 - protein, 8 aa, Mycobacterium
GAQAPTEA

SEQ ID NO: 479134 - protein, 8 aa, Mycobacterium
GAQAPTET

SEQ ID NO: 479135 - protein, 7 aa, Mycobacterium
GAQARAT

SEQ ID NO: 479136 - protein, 9 aa, Mycobacterium
GAQARFGED

SEQ ID NO: 479137 - protein, 9 aa, Mycobacterium
GAQASEAAL

SEQ ID NO: 479138 - protein, 9 aa, Mycobacterium
GAQASRLAA

SEQ ID NO: 479139 - protein, 8 aa, Mycobacterium
GAQATRDD

SEQ ID NO: 479140 - protein, 8 aa, Mycobacterium
GAQATTGA

SEQ ID NO: 479141 - protein, 8 aa, Mycobacterium
GAQAYDDA

SEQ ID NO: 479142 - protein, 9 aa, Mycobacterium
GAQDLNDNQ

SEQ ID NO: 479143 - protein, 4 aa, Mycobacterium
GAQE

SEQ ID NO: 479144 - protein, 7 aa, Mycobacterium
GAQEAEL

SEQ ID NO: 479145 - protein, 15 aa, Mycobacterium
GAQEFGGAPVADTPG

SEQ ID NO: 479146 - protein, 6 aa, Mycobacterium
GAQEGD

SEQ ID NO: 479147 - protein, 20 aa, Mycobacterium
GAQESAAVPPMGSGEGNPSW

SEQ ID NO: 479148 - protein, 6 aa, Mycobacterium
GAQFDQ

SEQ ID NO: 479149 - protein, 4 aa, Mycobacterium
GAQG

SEQ ID NO: 479150 - protein, 5 aa, Mycobacterium
GAQGA

SEQ ID NO: 479151 - protein, 8 aa, Mycobacterium
GAQGASVR

SEQ ID NO: 479152 - protein, 5 aa, Mycobacterium
GAQGG

SEQ ID NO: 479153 - protein, 11 aa, Mycobacterium
GAQGGKKHAGS

SEQ ID NO: 479154 - protein, 10 aa, Mycobacterium
GAQGGRPEAL

SEQ ID NO: 479155 - protein, 14 aa, Mycobacterium
GAQGGRPEALGGLG

SEQ ID NO: 479156 - protein, 6 aa, Mycobacterium
GAQGIP

SEQ ID NO: 479157 - protein, 5 aa, Mycobacterium
GAQGL

SEQ ID NO: 479158 - protein, 7 aa, Mycobacterium
GAQGPIR

SEQ ID NO: 479159 - protein, 5 aa, Mycobacterium
GAQGQ

SEQ ID NO: 479160 - protein, 9 aa, Mycobacterium
GAQGQANYA

SEQ ID NO: 479161 - protein, 15 aa, Mycobacterium
GAQGRASTDLSSTAA

SEQ ID NO: 479162 - protein, 5 aa, Mycobacterium
GAQGS

SEQ ID NO: 479163 - protein, 5 aa, Mycobacterium
GAQGV

SEQ ID NO: 479164 - protein, 7 aa, Mycobacterium
GAQGVAE

SEQ ID NO: 479165 - protein, 14 aa, Mycobacterium
GAQGVQNGGVDGAA

SEQ ID NO: 479166 - protein, 6 aa, Mycobacterium
GAQHAR

SEQ ID NO: 479167 - protein, 13 aa, Mycobacterium
GAQHTLNSAHTDA

SEQ ID NO: 479168 - protein, 6 aa, Mycobacterium
GAQIPA

SEQ ID NO: 479169 - protein, 50 aa, Mycobacterium
GAQKLPADGPAVKRGSTAAPAKRAAAKKAAPAKKAPAKKAAPAKKAPVKK

SEQ ID NO: 479170 - protein, 4 aa, Mycobacterium
GAQL

SEQ ID NO: 479171 - protein, 29 aa, Mycobacterium
GAQLGNATAERGTATALDRRTSVTQRPDG

SEQ ID NO: 479172 - protein, 15 aa, Mycobacterium
GAQNDPSFTTDHAEQ

SEQ ID NO: 479173 - protein, 6 aa, Mycobacterium
GAQNPG

SEQ ID NO: 479174 - protein, 6 aa, Mycobacterium
GAQNPK

SEQ ID NO: 479175 - protein, 6 aa, Mycobacterium
GAQNPR

SEQ ID NO: 479176 - protein, 6 aa, Mycobacterium
GAQNPT

SEQ ID NO: 479177 - protein, 4 aa, Mycobacterium
GAQP

SEQ ID NO: 479178 - protein, 12 aa, Mycobacterium
GAQPADSPAVGG

SEQ ID NO: 479179 - protein, 11 aa, Mycobacterium
GAQPAGHGSKL

SEQ ID NO: 479180 - protein, 18 aa, Mycobacterium
GAQPAPTSGQRVQAGQPW

SEQ ID NO: 479181 - protein, 9 aa, Mycobacterium
GAQPATERR

SEQ ID NO: 479182 - protein, 22 aa, Mycobacterium
GAQPDGAAPLSEAELEKLFLAL

SEQ ID NO: 479183 - protein, 8 aa, Mycobacterium
GAQPEGQV

SEQ ID NO: 479184 - protein, 7 aa, Mycobacterium
GAQPELG

SEQ ID NO: 479185 - protein, 6 aa, Mycobacterium
GAQPGD

SEQ ID NO: 479186 - protein, 7 aa, Mycobacterium
GAQPGDI

SEQ ID NO: 479187 - protein, 9 aa, Mycobacterium
GAQPGDKTM

SEQ ID NO: 479188 - protein, 8 aa, Mycobacterium
GAQPHPYR

SEQ ID NO: 479189 - protein, 7 aa, Mycobacterium
GAQPKAL

SEQ ID NO: 479190 - protein, 7 aa, Mycobacterium
GAQPLGT

SEQ ID NO: 479191 - protein, 8 aa, Mycobacterium
GAQPLREN

SEQ ID NO: 479192 - protein, 5 aa, Mycobacterium
GAQPN

SEQ ID NO: 479193 - protein, 11 aa, Mycobacterium
GAQPNSAEPEG

SEQ ID NO: 479194 - protein, 35 aa, Mycobacterium
GAQPPSADLANLGGDALRPAPVGAYPAGASAYGAE

SEQ ID NO: 479195 - protein, 7 aa, Mycobacterium
GAQPPVR

SEQ ID NO: 479196 - protein, 8 aa, Mycobacterium
GAQPQTAN

SEQ ID NO: 479197 - protein, 10 aa, Mycobacterium
GAQPSGEDTD

SEQ ID NO: 479198 - protein, 22 aa, Mycobacterium
GAQPSPLDAASDPGLPVVKGQV

SEQ ID NO: 479199 - protein, 22 aa, Mycobacterium
GAQPSSLQAAADPGLPVVKGQV

SEQ ID NO: 479200 - protein, 10 aa, Mycobacterium
GAQPTAERRT

SEQ ID NO: 479201 - protein, 7 aa, Mycobacterium
GAQPVGD

SEQ ID NO: 479202 - protein, 6 aa, Mycobacterium
GAQPVR

SEQ ID NO: 479203 - protein, 5 aa, Mycobacterium
GAQQA

SEQ ID NO: 479204 - protein, 27 aa, Mycobacterium
GAQQGGAPPTGAETGPTVTAGERRRTR

SEQ ID NO: 479205 - protein, 6 aa, Mycobacterium
GAQQGL

SEQ ID NO: 479206 - protein, 5 aa, Mycobacterium
GAQQI

SEQ ID NO: 479207 - protein, 9 aa, Mycobacterium
GAQQPNGYT

SEQ ID NO: 479208 - protein, 20 aa, Mycobacterium
GAQQPRPSRPRRGNDLETET

SEQ ID NO: 479209 - protein, 11 aa, Mycobacterium
GAQQPSDRHAN

SEQ ID NO: 479210 - protein, 6 aa, Mycobacterium
GAQQQV

SEQ ID NO: 479211 - protein, 12 aa, Mycobacterium
GAQQRAQSLGGL

SEQ ID NO: 479212 - protein, 13 aa, Mycobacterium
GAQQRAQSLGGLT

SEQ ID NO: 479213 - protein, 12 aa, Mycobacterium
GAQRAEDIAGET

SEQ ID NO: 479214 - protein, 6 aa, Mycobacterium
GAQRDQ

SEQ ID NO: 479215 - protein, 7 aa, Mycobacterium
GAQRERA

SEQ ID NO: 479216 - protein, 5 aa, Mycobacterium
GAQRG

SEQ ID NO: 479217 - protein, 6 aa, Mycobacterium
GAQRGG

SEQ ID NO: 479218 - protein, 7 aa, Mycobacterium
GAQRGGV

SEQ ID NO: 479219 - protein, 17 aa, Mycobacterium
GAQRPDELVGVAGHGTR

SEQ ID NO: 479220 - protein, 13 aa, Mycobacterium
GAQRPENLLAMMA

SEQ ID NO: 479221 - protein, 10 aa, Mycobacterium
GAQRPGSGNV

SEQ ID NO: 479222 - protein, 6 aa, Mycobacterium
GAQRPW

SEQ ID NO: 479223 - protein, 14 aa, Mycobacterium
GAQRRAEDRQRTEL

SEQ ID NO: 479224 - protein, 6 aa, Mycobacterium
GAQRYG

SEQ ID NO: 479225 - protein, 14 aa, Mycobacterium
GAQSATDIDTDPDG

SEQ ID NO: 479226 - protein, 11 aa, Mycobacterium
GAQSEQLPKIG

SEQ ID NO: 479227 - protein, 8 aa, Mycobacterium
GAQSGKKR

SEQ ID NO: 479228 - protein, 6 aa, Mycobacterium
GAQSGL

SEQ ID NO: 479229 - protein, 6 aa, Mycobacterium
GAQSNL

SEQ ID NO: 479230 - protein, 16 aa, Mycobacterium
GAQSPDAETLTYGQSV

SEQ ID NO: 479231 - protein, 8 aa, Mycobacterium
GAQSPKES

SEQ ID NO: 479232 - protein, 8 aa, Mycobacterium
GAQSPRES

SEQ ID NO: 479233 - protein, 20 aa, Mycobacterium
GAQSPVHPPLATDETSTSVA

SEQ ID NO: 479234 - protein, 7 aa, Mycobacterium
GAQSVSR

SEQ ID NO: 479235 - protein, 8 aa, Mycobacterium
GAQTAAET

SEQ ID NO: 479236 - protein, 12 aa, Mycobacterium
GAQTAGSAGLRG

SEQ ID NO: 479237 - protein, 9 aa, Mycobacterium
GAQTDAGNV

SEQ ID NO: 479238 - protein, 10 aa, Mycobacterium
GAQTDGQRAA

SEQ ID NO: 479239 - protein, 7 aa, Mycobacterium
GAQTGDP

SEQ ID NO: 479240 - protein, 7 aa, Mycobacterium
GAQTHNG

SEQ ID NO: 479241 - protein, 12 aa, Mycobacterium
GAQTLGTPAMQD

SEQ ID NO: 479242 - protein, 13 aa, Mycobacterium
GAQTPTEPPTPPT

SEQ ID NO: 479243 - protein, 17 aa, Mycobacterium
GAQTRDFERGAAPKPPA

SEQ ID NO: 479244 - protein, 6 aa, Mycobacterium
GAQTRE

SEQ ID NO: 479245 - protein, 8 aa, Mycobacterium
GAQTRRTA

SEQ ID NO: 479246 - protein, 11 aa, Mycobacterium
GAQTTPAAIGA

SEQ ID NO: 479247 - protein, 15 aa, Mycobacterium
GAQVNPDEDLTPSQS

SEQ ID NO: 479248 - protein, 20 aa, Mycobacterium
GAQVSATTAARQAADPAARL

SEQ ID NO: 479249 - protein, 4 aa, Mycobacterium
GAQW

SEQ ID NO: 479250 - protein, 13 aa, Mycobacterium
GAQYAETASAAYR

SEQ ID NO: 479251 - protein, 5 aa, Mycobacterium
GARAA

SEQ ID NO: 479252 - protein, 16 aa, Mycobacterium
GARAAAANAAAGAERI

SEQ ID NO: 479253 - protein, 8 aa, Mycobacterium
GARAAANG

SEQ ID NO: 479254 - protein, 13 aa, Mycobacterium
GARAACKERSTEN

SEQ ID NO: 479255 - protein, 11 aa, Mycobacterium
GARAAETAGQA

SEQ ID NO: 479256 - protein, 25 aa, Mycobacterium
GARAAGNPVDTAPWGRHATTADHRA

SEQ ID NO: 479257 - protein, 12 aa, Mycobacterium
GARAAGTPLDTA

SEQ ID NO: 479258 - protein, 5 aa, Mycobacterium
GARAD

SEQ ID NO: 479259 - protein, 7 aa, Mycobacterium
GARADAR

SEQ ID NO: 479260 - protein, 14 aa, Mycobacterium
GARADERLRSGAPL

SEQ ID NO: 479261 - protein, 18 aa, Mycobacterium
GARADGHDHARGAAEAGA

SEQ ID NO: 479262 - protein, 18 aa, Mycobacterium
GARADGHDYAGAAVEAGA

SEQ ID NO: 479263 - protein, 8 aa, Mycobacterium
GARADKGL

SEQ ID NO: 479264 - protein, 6 aa, Mycobacterium
GARAGE

SEQ ID NO: 479265 - protein, 7 aa, Mycobacterium
GARAGTL

SEQ ID NO: 479266 - protein, 5 aa, Mycobacterium
GARAI

SEQ ID NO: 479267 - protein, 8 aa, Mycobacterium
GARALGDN

SEQ ID NO: 479268 - protein, 11 aa, Mycobacterium
GARAPKLVSNS

SEQ ID NO: 479269 - protein, 7 aa, Mycobacterium
GARAQAR

SEQ ID NO: 479270 - protein, 6 aa, Mycobacterium
GARASE

SEQ ID NO: 479271 - protein, 23 aa, Mycobacterium
GARATGRPLDTSPWGAHATTADH

SEQ ID NO: 479272 - protein, 13 aa, Mycobacterium
GARAYASAEAAIA

SEQ ID NO: 479273 - protein, 7 aa, Mycobacterium
GARCPGC

SEQ ID NO: 479274 - protein, 4 aa, Mycobacterium
GARD

SEQ ID NO: 479275 - protein, 6 aa, Mycobacterium
GARDAP

SEQ ID NO: 479276 - protein, 7 aa, Mycobacterium
GARDARD

SEQ ID NO: 479277 - protein, 8 aa, Mycobacterium
GARDGRSV

SEQ ID NO: 479278 - protein, 5 aa, Mycobacterium
GARDI

SEQ ID NO: 479279 - protein, 8 aa, Mycobacterium
GARDPDIT

SEQ ID NO: 479280 - protein, 5 aa, Mycobacterium
GARDR

SEQ ID NO: 479281 - protein, 8 aa, Mycobacterium
GARDRPRS

SEQ ID NO: 479282 - protein, 7 aa, Mycobacterium
GAREDLP

SEQ ID NO: 479283 - protein, 10 aa, Mycobacterium
GAREEAEVAQ

SEQ ID NO: 479284 - protein, 7 aa, Mycobacterium
GAREEEL

SEQ ID NO: 479285 - protein, 5 aa, Mycobacterium
GAREF

SEQ ID NO: 479286 - protein, 14 aa, Mycobacterium
GAREGTLAPGQLRG

SEQ ID NO: 479287 - protein, 16 aa, Mycobacterium
GAREGTLTPAELSGST

SEQ ID NO: 479288 - protein, 5 aa, Mycobacterium
GAREM

SEQ ID NO: 479289 - protein, 7 aa, Mycobacterium
GARENNL

SEQ ID NO: 479290 - protein, 9 aa, Mycobacterium
GAREPGACP

SEQ ID NO: 479291 - protein, 5 aa, Mycobacterium
GARER

SEQ ID NO: 479292 - protein, 8 aa, Mycobacterium
GARESALA

SEQ ID NO: 479293 - protein, 5 aa, Mycobacterium
GARET

SEQ ID NO: 479294 - protein, 6 aa, Mycobacterium
GARETV

SEQ ID NO: 479295 - protein, 11 aa, Mycobacterium
GARFGNPEPGL

SEQ ID NO: 479296 - protein, 10 aa, Mycobacterium
GARFRGDRGA

SEQ ID NO: 479297 - protein, 8 aa, Mycobacterium
GARGAAAR

SEQ ID NO: 479298 - protein, 11 aa, Mycobacterium
GARGAADEVTQ

SEQ ID NO: 479299 - protein, 7 aa, Mycobacterium
GARGAAR

SEQ ID NO: 479300 - protein, 11 aa, Mycobacterium
GARGAGEKREP

SEQ ID NO: 479301 - protein, 10 aa, Mycobacterium
GARGAGGDYQ

SEQ ID NO: 479302 - protein, 9 aa, Mycobacterium
GARGAHAEL

SEQ ID NO: 479303 - protein, 8 aa, Mycobacterium
GARGAHDE

SEQ ID NO: 479304 - protein, 8 aa, Mycobacterium
GARGAHEE

SEQ ID NO: 479305 - protein, 6 aa, Mycobacterium
GARGAQ

SEQ ID NO: 479306 - protein, 14 aa, Mycobacterium
GARGASYVSDDERF

SEQ ID NO: 479307 - protein, 10 aa, Mycobacterium
GARGATVRRG

SEQ ID NO: 479308 - protein, 10 aa, Mycobacterium
GARGDNSTHL

SEQ ID NO: 479309 - protein, 9 aa, Mycobacterium
GARGDRDDV

SEQ ID NO: 479310 - protein, 8 aa, Mycobacterium
GARGEAGE

SEQ ID NO: 479311 - protein, 6 aa, Mycobacterium
GARGEG

SEQ ID NO: 479312 - protein, 10 aa, Mycobacterium
GARGEPTAQD

SEQ ID NO: 479313 - protein, 13 aa, Mycobacterium
GARGGIDLPEGDI

SEQ ID NO: 479314 - protein, 15 aa, Mycobacterium
GARGGIDLPKEDVDR

SEQ ID NO: 479315 - protein, 8 aa, Mycobacterium
GARGGIDV

SEQ ID NO: 479316 - protein, 9 aa, Mycobacterium
GARGGSNGG

SEQ ID NO: 479317 - protein, 7 aa, Mycobacterium
GARGRAA

SEQ ID NO: 479318 - protein, 9 aa, Mycobacterium
GARGREDDA

SEQ ID NO: 479319 - protein, 7 aa, Mycobacterium
GARGRER

SEQ ID NO: 479320 - protein, 15 aa, Mycobacterium
GARGRYGTPDAAPRA

SEQ ID NO: 479321 - protein, 10 aa, Mycobacterium
GARGTWAKEG

SEQ ID NO: 479322 - protein, 4 aa, Mycobacterium
GARH

SEQ ID NO: 479323 - protein, 9 aa, Mycobacterium
GARHERGAR

SEQ ID NO: 479324 - protein, 6 aa, Mycobacterium
GARHRD

SEQ ID NO: 479325 - protein, 6 aa, Mycobacterium
GARHSM

SEQ ID NO: 479326 - protein, 12 aa, Mycobacterium
GARIAEQVKQWI

SEQ ID NO: 479327 - protein, 7 aa, Mycobacterium
GARIDPD

SEQ ID NO: 479328 - protein, 7 aa, Mycobacterium
GARIGSD

SEQ ID NO: 479329 - protein, 6 aa, Mycobacterium
GARITR

SEQ ID NO: 479330 - protein, 7 aa, Mycobacterium
GARITTA

SEQ ID NO: 479331 - protein, 11 aa, Mycobacterium
GARKGGPEQLR

SEQ ID NO: 479332 - protein, 7 aa, Mycobacterium
GARKGSY

SEQ ID NO: 479333 - protein, 12 aa, Mycobacterium
GARKRIEDALDS

SEQ ID NO: 479334 - protein, 10 aa, Mycobacterium
GARLAKRDGA

SEQ ID NO: 479335 - protein, 11 aa, Mycobacterium
GARLAKRDGAV

SEQ ID NO: 479336 - protein, 15 aa, Mycobacterium
GARLDAESPAAQGHS

SEQ ID NO: 479337 - protein, 7 aa, Mycobacterium
GARLDSD

SEQ ID NO: 479338 - protein, 5 aa, Mycobacterium
GARLG

SEQ ID NO: 479339 - protein, 9 aa, Mycobacterium
GARLGPDTS

SEQ ID NO: 479340 - protein, 9 aa, Mycobacterium
GARLGPETS

SEQ ID NO: 479341 - protein, 13 aa, Mycobacterium
GARLRDVGTAARA

SEQ ID NO: 479342 - protein, 14 aa, Mycobacterium
GARLTAAEDALASA

SEQ ID NO: 479343 - protein, 9 aa, Mycobacterium
GARNADGDG

SEQ ID NO: 479344 - protein, 6 aa, Mycobacterium
GARNDS

SEQ ID NO: 479345 - protein, 14 aa, Mycobacterium
GARNEPKGPQRPHP

SEQ ID NO: 479346 - protein, 13 aa, Mycobacterium
GARNEPKGVQRPH

SEQ ID NO: 479347 - protein, 11 aa, Mycobacterium
GARNLTERPGV

SEQ ID NO: 479348 - protein, 17 aa, Mycobacterium
GARNREIPVPGANTPGV

SEQ ID NO: 479349 - protein, 5 aa, Mycobacterium
GARNS

SEQ ID NO: 479350 - protein, 12 aa, Mycobacterium
GARNSSIGEDEI

SEQ ID NO: 479351 - protein, 4 aa, Mycobacterium
GARP

SEQ ID NO: 479352 - protein, 5 aa, Mycobacterium
GARPA

SEQ ID NO: 479353 - protein, 11 aa, Mycobacterium
GARPAFTDRPE

SEQ ID NO: 479354 - protein, 9 aa, Mycobacterium
GARPATGPV

SEQ ID NO: 479355 - protein, 8 aa, Mycobacterium
GARPAWRG

SEQ ID NO: 479356 - protein, 7 aa, Mycobacterium
GARPEAA

SEQ ID NO: 479357 - protein, 6 aa, Mycobacterium
GARPEG

SEQ ID NO: 479358 - protein, 6 aa, Mycobacterium
GARPGE

SEQ ID NO: 479359 - protein, 7 aa, Mycobacterium
GARPGEQ

SEQ ID NO: 479360 - protein, 16 aa, Mycobacterium
GARPGEQRTYTLPSGA

SEQ ID NO: 479361 - protein, 7 aa, Mycobacterium
GARPGER

SEQ ID NO: 479362 - protein, 7 aa, Mycobacterium
GARPGES

SEQ ID NO: 479363 - protein, 9 aa, Mycobacterium
GARPGPAVD

SEQ ID NO: 479364 - protein, 12 aa, Mycobacterium
GARPGPTHRDNR

SEQ ID NO: 479365 - protein, 6 aa, Mycobacterium
GARPGR

SEQ ID NO: 479366 - protein, 6 aa, Mycobacterium
GARPGS

SEQ ID NO: 479367 - protein, 6 aa, Mycobacterium
GARPLT

SEQ ID NO: 479368 - protein, 10 aa, Mycobacterium
GARPNSDNDI

SEQ ID NO: 479369 - protein, 8 aa, Mycobacterium
GARPPQHS

SEQ ID NO: 479370 - protein, 6 aa, Mycobacterium
GARPRR

SEQ ID NO: 479371 - protein, 7 aa, Mycobacterium
GARPSPV

SEQ ID NO: 479372 - protein, 8 aa, Mycobacterium
GARPTAQF

SEQ ID NO: 479373 - protein, 13 aa, Mycobacterium
GARPTEARNLMEL

SEQ ID NO: 479374 - protein, 13 aa, Mycobacterium
GARPTPDSQYWPG

SEQ ID NO: 479375 - protein, 23 aa, Mycobacterium
GARPVDRPRRGRAPRPGLPRRPG

SEQ ID NO: 479376 - protein, 8 aa, Mycobacterium
GARPVGGE

SEQ ID NO: 479377 - protein, 5 aa, Mycobacterium
GARQA

SEQ ID NO: 479378 - protein, 8 aa, Mycobacterium
GARQAAEK

SEQ ID NO: 479379 - protein, 7 aa, Mycobacterium
GARQERI

SEQ ID NO: 479380 - protein, 7 aa, Mycobacterium
GARQGAG

SEQ ID NO: 479381 - protein, 11 aa, Mycobacterium
GARQLEAGERI

SEQ ID NO: 479382 - protein, 6 aa, Mycobacterium
GARQPT

SEQ ID NO: 479383 - protein, 37 aa, Mycobacterium
GARQRSRHRPRCRGDGHRRHRASAPPQGTHPTRTGRQ

SEQ ID NO: 479384 - protein, 9 aa, Mycobacterium
GARQRYESG

SEQ ID NO: 479385 - protein, 8 aa, Mycobacterium
GARQSALA

SEQ ID NO: 479386 - protein, 11 aa, Mycobacterium
GARQTKSQGTA

SEQ ID NO: 479387 - protein, 8 aa, Mycobacterium
GARQVPGR

SEQ ID NO: 479388 - protein, 5 aa, Mycobacterium
GARRA

SEQ ID NO: 479389 - protein, 11 aa, Mycobacterium
GARRATEVSAK

SEQ ID NO: 479390 - protein, 15 aa, Mycobacterium
GARRDVPKVAGDATR

SEQ ID NO: 479391 - protein, 12 aa, Mycobacterium
GARREAASAFGD

SEQ ID NO: 479392 - protein, 6 aa, Mycobacterium
GARREL

SEQ ID NO: 479393 - protein, 5 aa, Mycobacterium
GARRG

SEQ ID NO: 479394 - protein, 23 aa, Mycobacterium
GARRGGAVSGIGGHNAAMAVLAS

SEQ ID NO: 479395 - protein, 24 aa, Mycobacterium
GARRGGAVSGIGGHNAAMAVLASL

SEQ ID NO: 479396 - protein, 6 aa, Mycobacterium
GARRGV

SEQ ID NO: 479397 - protein, 11 aa, Mycobacterium
GARRHRDGAPL

SEQ ID NO: 479398 - protein, 6 aa, Mycobacterium
GARRIT

SEQ ID NO: 479399 - protein, 10 aa, Mycobacterium
GARRKPRSVE

SEQ ID NO: 479400 - protein, 13 aa, Mycobacterium
GARRLERETTKAI

SEQ ID NO: 479401 - protein, 13 aa, Mycobacterium
GARRLTTNRYDAE

SEQ ID NO: 479402 - protein, 5 aa, Mycobacterium
GARRP

SEQ ID NO: 479403 - protein, 7 aa, Mycobacterium
GARRPAG

SEQ ID NO: 479404 - protein, 9 aa, Mycobacterium
GARRRDGGV

SEQ ID NO: 479405 - protein, 10 aa, Mycobacterium
GARRREQRSD

SEQ ID NO: 479406 - protein, 6 aa, Mycobacterium
GARRRS

SEQ ID NO: 479407 - protein, 6 aa, Mycobacterium
GARRRT

SEQ ID NO: 479408 - protein, 20 aa, Mycobacterium
GARRSRTSTVRGWDSMPAVI

SEQ ID NO: 479409 - protein, 6 aa, Mycobacterium
GARRSY

SEQ ID NO: 479410 - protein, 5 aa, Mycobacterium
GARRV

SEQ ID NO: 479411 - protein, 7 aa, Mycobacterium
GARRVQA

SEQ ID NO: 479412 - protein, 4 aa, Mycobacterium
GARS

SEQ ID NO: 479413 - protein, 23 aa, Mycobacterium
GARSAQSHAAAVAGTDDLPTAAS

SEQ ID NO: 479414 - protein, 7 aa, Mycobacterium
GARSATG

SEQ ID NO: 479415 - protein, 8 aa, Mycobacterium
GARSDGHD

SEQ ID NO: 479416 - protein, 9 aa, Mycobacterium
GARSDGHDF

SEQ ID NO: 479417 - protein, 8 aa, Mycobacterium
GARSDVNV

SEQ ID NO: 479418 - protein, 7 aa, Mycobacterium
GARSEAV

SEQ ID NO: 479419 - protein, 10 aa, Mycobacterium
GARSGAANTA

SEQ ID NO: 479420 - protein, 12 aa, Mycobacterium
GARSGDKGGNAN

SEQ ID NO: 479421 - protein, 12 aa, Mycobacterium
GARSGDKGGSAN

SEQ ID NO: 479422 - protein, 9 aa, Mycobacterium
GARSHDELR

SEQ ID NO: 479423 - protein, 13 aa, Mycobacterium
GARSNSGEGGEDV

SEQ ID NO: 479424 - protein, 5 aa, Mycobacterium
GARSP

SEQ ID NO: 479425 - protein, 7 aa, Mycobacterium
GARSPAP

SEQ ID NO: 479426 - protein, 11 aa, Mycobacterium
GARSPGAPTVE

SEQ ID NO: 479427 - protein, 6 aa, Mycobacterium
GARSPM

SEQ ID NO: 479428 - protein, 18 aa, Mycobacterium
GARSPSAVGAGSGAPAGW

SEQ ID NO: 479429 - protein, 6 aa, Mycobacterium
GARSQL

SEQ ID NO: 479430 - protein, 5 aa, Mycobacterium
GARSR

SEQ ID NO: 479431 - protein, 8 aa, Mycobacterium
GARSSDMA

SEQ ID NO: 479432 - protein, 9 aa, Mycobacterium
GARSSSHAV

SEQ ID NO: 479433 - protein, 19 aa, Mycobacterium
GARSTKASSTSGLDGPGWE

SEQ ID NO: 479434 - protein, 6 aa, Mycobacterium
GARSVP

SEQ ID NO: 479435 - protein, 4 aa, Mycobacterium
GART

SEQ ID NO: 479436 - protein, 5 aa, Mycobacterium
GARTA

SEQ ID NO: 479437 - protein, 11 aa, Mycobacterium
GARTAVPRQQT

SEQ ID NO: 479438 - protein, 11 aa, Mycobacterium
GARTAVRRQQT

SEQ ID NO: 479439 - protein, 9 aa, Mycobacterium
GARTGEKGK

SEQ ID NO: 479440 - protein, 7 aa, Mycobacterium
GARTGQF

SEQ ID NO: 479441 - protein, 9 aa, Mycobacterium
GARTPDHHP

SEQ ID NO: 479442 - protein, 18 aa, Mycobacterium
GARTPDQHPNLPVTPDQL

SEQ ID NO: 479443 - protein, 11 aa, Mycobacterium
GARTRAGQPLT

SEQ ID NO: 479444 - protein, 8 aa, Mycobacterium
GARTRQGY

SEQ ID NO: 479445 - protein, 5 aa, Mycobacterium
GARTS

SEQ ID NO: 479446 - protein, 6 aa, Mycobacterium
GARTSI

SEQ ID NO: 479447 - protein, 19 aa, Mycobacterium
GARTSQGRTLREVSDSARV

SEQ ID NO: 479448 - protein, 7 aa, Mycobacterium
GARTVTT

SEQ ID NO: 479449 - protein, 6 aa, Mycobacterium
GARVAA

SEQ ID NO: 479450 - protein, 5 aa, Mycobacterium
GARVG

SEQ ID NO: 479451 - protein, 8 aa, Mycobacterium
GARVGDKT

SEQ ID NO: 479452 - protein, 18 aa, Mycobacterium
GARVGQSSQPHAAVSSGT

SEQ ID NO: 479453 - protein, 5 aa, Mycobacterium
GARVQ

SEQ ID NO: 479454 - protein, 5 aa, Mycobacterium
GARVT

SEQ ID NO: 479455 - protein, 10 aa, Mycobacterium
GARVTGVDPS

SEQ ID NO: 479456 - protein, 7 aa, Mycobacterium
GARVTSQ

SEQ ID NO: 479457 - protein, 10 aa, Mycobacterium
GARWDEESRR

SEQ ID NO: 479458 - protein, 9 aa, Mycobacterium
GARYRGDRG

SEQ ID NO: 479459 - protein, 5 aa, Mycobacterium
GARYS

SEQ ID NO: 479460 - protein, 9 aa, Mycobacterium
GASAAAAQV

SEQ ID NO: 479461 - protein, 11 aa, Mycobacterium
GASAAAASLTP

SEQ ID NO: 479462 - protein, 27 aa, Mycobacterium
GASAAAATLTPFTPPSATTDAAGLARQ

SEQ ID NO: 479463 - protein, 11 aa, Mycobacterium
GASAAAGALAG

SEQ ID NO: 479464 - protein, 83 aa, Mycobacterium
GASAAAKDDAESGGAAGVDKGSDAAAGTPAGVATGEADAPEAVEATGPDADGVASAAESADNPTVNVSRETSSEFDTPIGAAA

SEQ ID NO: 479465 - protein, 9 aa, Mycobacterium
GASAAASAL

SEQ ID NO: 479466 - protein, 10 aa, Mycobacterium
GASAAASGLA

SEQ ID NO: 479467 - protein, 10 aa, Mycobacterium
GASAAASTLT

SEQ ID NO: 479468 - protein, 8 aa, Mycobacterium
GASAAATR

SEQ ID NO: 479469 - protein, 10 aa, Mycobacterium
GASAAATRLT

SEQ ID NO: 479470 - protein, 9 aa, Mycobacterium
GASAAATTL

SEQ ID NO: 479471 - protein, 12 aa, Mycobacterium
GASAAGGPVLDA

SEQ ID NO: 479472 - protein, 6 aa, Mycobacterium
GASAAQ

SEQ ID NO: 479473 - protein, 11 aa, Mycobacterium
GASAASRQRGL

SEQ ID NO: 479474 - protein, 10 aa, Mycobacterium
GASAASRTRN

SEQ ID NO: 479475 - protein, 7 aa, Mycobacterium
GASAAVQ

SEQ ID NO: 479476 - protein, 8 aa, Mycobacterium
GASAAVQG

SEQ ID NO: 479477 - protein, 8 aa, Mycobacterium
GASADDKT

SEQ ID NO: 479478 - protein, 8 aa, Mycobacterium
GASADPER

SEQ ID NO: 479479 - protein, 7 aa, Mycobacterium
GASADRM

SEQ ID NO: 479480 - protein, 10 aa, Mycobacterium
GASAEAPVPD

SEQ ID NO: 479481 - protein, 15 aa, Mycobacterium
GASAEQAAAKIGSGA

SEQ ID NO: 479482 - protein, 6 aa, Mycobacterium
GASAGA

SEQ ID NO: 479483 - protein, 7 aa, Mycobacterium
GASAGAA

SEQ ID NO: 479484 - protein, 10 aa, Mycobacterium
GASAGAGLPT

SEQ ID NO: 479485 - protein, 11 aa, Mycobacterium
GASAGDYAQMG

SEQ ID NO: 479486 - protein, 9 aa, Mycobacterium
GASAGEPRQ

SEQ ID NO: 479487 - protein, 7 aa, Mycobacterium
GASAGEV

SEQ ID NO: 479488 - protein, 6 aa, Mycobacterium
GASAGG

SEQ ID NO: 479489 - protein, 9 aa, Mycobacterium
GASAGGGLA

SEQ ID NO: 479490 - protein, 10 aa, Mycobacterium
GASAGYTEKM

SEQ ID NO: 479491 - protein, 5 aa, Mycobacterium
GASAL

SEQ ID NO: 479492 - protein, 9 aa, Mycobacterium
GASAPARQW

SEQ ID NO: 479493 - protein, 15 aa, Mycobacterium
GASAPEAPAAIDVDQ

SEQ ID NO: 479494 - protein, 10 aa, Mycobacterium
GASAQATTLT

SEQ ID NO: 479495 - protein, 11 aa, Mycobacterium
GASAQYEDSPL

SEQ ID NO: 479496 - protein, 8 aa, Mycobacterium
GASARGAG

SEQ ID NO: 479497 - protein, 54 aa, Mycobacterium
GASATASELTPFADPGTTTDPAGLAAQSAAVAKAAATPAGTSAPALSSADPGLV

SEQ ID NO: 479498 - protein, 5 aa, Mycobacterium
GASAV

SEQ ID NO: 479499 - protein, 22 aa, Mycobacterium
GASAVDGAAAPLAGTTSQPALS

SEQ ID NO: 479500 - protein, 22 aa, Mycobacterium
GASAVDGASSPLAGTTSQPALS

SEQ ID NO: 479501 - protein, 16 aa, Mycobacterium
GASAYTGAEAANVSPL

SEQ ID NO: 479502 - protein, 19 aa, Mycobacterium
GASCDRPDIPGFAMSASND

SEQ ID NO: 479503 - protein, 4 aa, Mycobacterium
GASD

SEQ ID NO: 479504 - protein, 6 aa, Mycobacterium
GASDAE

SEQ ID NO: 479505 - protein, 9 aa, Mycobacterium
GASDDTTGQ

SEQ ID NO: 479506 - protein, 9 aa, Mycobacterium
GASDEAAIR

SEQ ID NO: 479507 - protein, 10 aa, Mycobacterium
GASDEAELSA

SEQ ID NO: 479508 - protein, 8 aa, Mycobacterium
GASDEDRA

SEQ ID NO: 479509 - protein, 9 aa, Mycobacterium
GASDETTGQ

SEQ ID NO: 479510 - protein, 5 aa, Mycobacterium
GASDF

SEQ ID NO: 479511 - protein, 8 aa, Mycobacterium
GASDGFPR

SEQ ID NO: 479512 - protein, 15 aa, Mycobacterium
GASDGGAGGDGGRAG

SEQ ID NO: 479513 - protein, 10 aa, Mycobacterium
GASDGTPRQR

SEQ ID NO: 479514 - protein, 8 aa, Mycobacterium
GASDGVGA

SEQ ID NO: 479515 - protein, 7 aa, Mycobacterium
GASDNGI

SEQ ID NO: 479516 - protein, 7 aa, Mycobacterium
GASDPLT

SEQ ID NO: 479517 - protein, 7 aa, Mycobacterium
GASDPTV

SEQ ID NO: 479518 - protein, 10 aa, Mycobacterium
GASDSNAAAT

SEQ ID NO: 479519 - protein, 8 aa, Mycobacterium
GASDTARF

SEQ ID NO: 479520 - protein, 7 aa, Mycobacterium
GASDTPV

SEQ ID NO: 479521 - protein, 4 aa, Mycobacterium
GASE

SEQ ID NO: 479522 - protein, 6 aa, Mycobacterium
GASEAA

SEQ ID NO: 479523 - protein, 9 aa, Mycobacterium
GASEAKRAA

SEQ ID NO: 479524 - protein, 32 aa, Mycobacterium
GASEASGTSEAANGTSEVSGAPVRTEQPRTQA

SEQ ID NO: 479525 - protein, 17 aa, Mycobacterium
GASEASKQRARARMSEA

SEQ ID NO: 479526 - protein, 9 aa, Mycobacterium
GASEESPLE

SEQ ID NO: 479527 - protein, 12 aa, Mycobacterium
GASEFTPSQDEL

SEQ ID NO: 479528 - protein, 9 aa, Mycobacterium
GASEGAGLG

SEQ ID NO: 479529 - protein, 11 aa, Mycobacterium
GASEGEPRQSI

SEQ ID NO: 479530 - protein, 9 aa, Mycobacterium
GASEGPDAR

SEQ ID NO: 479531 - protein, 11 aa, Mycobacterium
GASEGTPRQSL

SEQ ID NO: 479532 - protein, 8 aa, Mycobacterium
GASEITPG

SEQ ID NO: 479533 - protein, 7 aa, Mycobacterium
GASELDA

SEQ ID NO: 479534 - protein, 11 aa, Mycobacterium
GASEPPEDRHT

SEQ ID NO: 479535 - protein, 9 aa, Mycobacterium
GASERPSDR

SEQ ID NO: 479536 - protein, 32 aa, Mycobacterium
GASESGAQMSAYTTSGAETQPATFTPQPDTAV

SEQ ID NO: 479537 - protein, 9 aa, Mycobacterium
GASESSTEL

SEQ ID NO: 479538 - protein, 33 aa, Mycobacterium
GASETGTGGLSTVTKGQMHPGGPTVKISSTTTV

SEQ ID NO: 479539 - protein, 12 aa, Mycobacterium
GASEVTPSQAAL

SEQ ID NO: 479540 - protein, 6 aa, Mycobacterium
GASFEQ

SEQ ID NO: 479541 - protein, 15 aa, Mycobacterium
GASFPYRKDPDDKNI

SEQ ID NO: 479542 - protein, 9 aa, Mycobacterium
GASGAKPDF

SEQ ID NO: 479543 - protein, 10 aa, Mycobacterium
GASGAPPGTL

SEQ ID NO: 479544 - protein, 11 aa, Mycobacterium
GASGAQTVEIG

SEQ ID NO: 479545 - protein, 10 aa, Mycobacterium
GASGARPEHT

SEQ ID NO: 479546 - protein, 9 aa, Mycobacterium
GASGASGKK

SEQ ID NO: 479547 - protein, 6 aa, Mycobacterium
GASGAW

SEQ ID NO: 479548 - protein, 16 aa, Mycobacterium
GASGAYAAAEAANVSP

SEQ ID NO: 479549 - protein, 14 aa, Mycobacterium
GASGDGSRSNKTEV

SEQ ID NO: 479550 - protein, 21 aa, Mycobacterium
GASGDHLTDADRAATERNKAR

SEQ ID NO: 479551 - protein, 9 aa, Mycobacterium
GASGEEAHF

SEQ ID NO: 479552 - protein, 6 aa, Mycobacterium
GASGEG

SEQ ID NO: 479553 - protein, 10 aa, Mycobacterium
GASGEHEGFP

SEQ ID NO: 479554 - protein, 9 aa, Mycobacterium
GASGEHQSF

SEQ ID NO: 479555 - protein, 9 aa, Mycobacterium
GASGGHHDV

SEQ ID NO: 479556 - protein, 8 aa, Mycobacterium
GASGGIGE

SEQ ID NO: 479557 - protein, 10 aa, Mycobacterium
GASGGKLDAG

SEQ ID NO: 479558 - protein, 18 aa, Mycobacterium
GASGGSYAATEAANAIAA

SEQ ID NO: 479559 - protein, 7 aa, Mycobacterium
GASGGVG

SEQ ID NO: 479560 - protein, 12 aa, Mycobacterium
GASGIAPDQRDL

SEQ ID NO: 479561 - protein, 12 aa, Mycobacterium
GASGIAPGQAEL

SEQ ID NO: 479562 - protein, 7 aa, Mycobacterium
GASGIGS

SEQ ID NO: 479563 - protein, 5 aa, Mycobacterium
GASGK

SEQ ID NO: 479564 - protein, 5 aa, Mycobacterium
GASGL

SEQ ID NO: 479565 - protein, 7 aa, Mycobacterium
GASGMGA

SEQ ID NO: 479566 - protein, 8 aa, Mycobacterium
GASGMGAY

SEQ ID NO: 479567 - protein, 8 aa, Mycobacterium
GASGMGRV

SEQ ID NO: 479568 - protein, 7 aa, Mycobacterium
GASGPLD

SEQ ID NO: 479569 - protein, 7 aa, Mycobacterium
GASGPNI

SEQ ID NO: 479570 - protein, 8 aa, Mycobacterium
GASGPQGA

SEQ ID NO: 479571 - protein, 11 aa, Mycobacterium
GASGPRSSWRA

SEQ ID NO: 479572 - protein, 15 aa, Mycobacterium
GASGPTVGDPDDGVD

SEQ ID NO: 479573 - protein, 9 aa, Mycobacterium
GASGRRGDR

SEQ ID NO: 479574 - protein, 10 aa, Mycobacterium
GASGSATPNS

SEQ ID NO: 479575 - protein, 9 aa, Mycobacterium
GASGSHSRD

SEQ ID NO: 479576 - protein, 28 aa, Mycobacterium
GASGSPGTPPPSTVARSGWTRKNPFPAE

SEQ ID NO: 479577 - protein, 15 aa, Mycobacterium
GASGSYASAEAANVT

SEQ ID NO: 479578 - protein, 9 aa, Mycobacterium
GASGTDSAV

SEQ ID NO: 479579 - protein, 7 aa, Mycobacterium
GASGTSL

SEQ ID NO: 479580 - protein, 9 aa, Mycobacterium
GASGTSPTF

SEQ ID NO: 479581 - protein, 6 aa, Mycobacterium
GASGVA

SEQ ID NO: 479582 - protein, 10 aa, Mycobacterium
GASGVDQPTA

SEQ ID NO: 479583 - protein, 9 aa, Mycobacterium
GASGVSRKP

SEQ ID NO: 479584 - protein, 9 aa, Mycobacterium
GASGVSSAE

SEQ ID NO: 479585 - protein, 7 aa, Mycobacterium
GASGYDA

SEQ ID NO: 479586 - protein, 5 aa, Mycobacterium
GASHH

SEQ ID NO: 479587 - protein, 6 aa, Mycobacterium
GASIPQ

SEQ ID NO: 479588 - protein, 8 aa, Mycobacterium
GASITLDG

SEQ ID NO: 479589 - protein, 9 aa, Mycobacterium
GASKGGQSV

SEQ ID NO: 479590 - protein, 6 aa, Mycobacterium
GASKTA

SEQ ID NO: 479591 - protein, 4 aa, Mycobacterium
GASL

SEQ ID NO: 479592 - protein, 8 aa, Mycobacterium
GASLQDPA

SEQ ID NO: 479593 - protein, 10 aa, Mycobacterium
GASMEGTITG

SEQ ID NO: 479594 - protein, 16 aa, Mycobacterium
GASNAYQGEGGKDHPT

SEQ ID NO: 479595 - protein, 9 aa, Mycobacterium
GASNGDRPE

SEQ ID NO: 479596 - protein, 9 aa, Mycobacterium
GASNGQVTE

SEQ ID NO: 479597 - protein, 7 aa, Mycobacterium
GASNVTG

SEQ ID NO: 479598 - protein, 5 aa, Mycobacterium
GASPA

SEQ ID NO: 479599 - protein, 8 aa, Mycobacterium
GASPAALE

SEQ ID NO: 479600 - protein, 28 aa, Mycobacterium
GASPAAPAQAAAAVGEAAAQVGAGDGMR

SEQ ID NO: 479601 - protein, 30 aa, Mycobacterium
GASPAAPAQAASAVGQAAAEAAAGDGMRSA

SEQ ID NO: 479602 - protein, 9 aa, Mycobacterium
GASPAGPIT

SEQ ID NO: 479603 - protein, 14 aa, Mycobacterium
GASPAQYRNGTRSV

SEQ ID NO: 479604 - protein, 11 aa, Mycobacterium
GASPDGSRKAK

SEQ ID NO: 479605 - protein, 11 aa, Mycobacterium
GASPDGSRRTK

SEQ ID NO: 479606 - protein, 11 aa, Mycobacterium
GASPDGTRSLK

SEQ ID NO: 479607 - protein, 6 aa, Mycobacterium
GASPDI

SEQ ID NO: 479608 - protein, 5 aa, Mycobacterium
GASPE

SEQ ID NO: 479609 - protein, 9 aa, Mycobacterium
GASPEDGRG

SEQ ID NO: 479610 - protein, 9 aa, Mycobacterium
GASPGGDLA

SEQ ID NO: 479611 - protein, 21 aa, Mycobacterium
GASPGGDLSIGEDAARASRNF

SEQ ID NO: 479612 - protein, 9 aa, Mycobacterium
GASPGSDLA

SEQ ID NO: 479613 - protein, 23 aa, Mycobacterium
GASPIYRGGEGNLTGHLRAVLAE

SEQ ID NO: 479614 - protein, 6 aa, Mycobacterium
GASPLA

SEQ ID NO: 479615 - protein, 8 aa, Mycobacterium
GASPPAPI

SEQ ID NO: 479616 - protein, 10 aa, Mycobacterium
GASPQGTPGA

SEQ ID NO: 479617 - protein, 8 aa, Mycobacterium
GASPRAAT

SEQ ID NO: 479618 - protein, 7 aa, Mycobacterium
GASPRAS

SEQ ID NO: 479619 - protein, 16 aa, Mycobacterium
GASPRELPSARPDGER

SEQ ID NO: 479620 - protein, 7 aa, Mycobacterium
GASPRGV

SEQ ID NO: 479621 - protein, 14 aa, Mycobacterium
GASPRRRLTPEDRR

SEQ ID NO: 479622 - protein, 7 aa, Mycobacterium
GASPRVL

SEQ ID NO: 479623 - protein, 16 aa, Mycobacterium
GASPRVLPNAEPDGER

SEQ ID NO: 479624 - protein, 16 aa, Mycobacterium
GASPRVLPSAQPDGER

SEQ ID NO: 479625 - protein, 9 aa, Mycobacterium
GASPTADHH

SEQ ID NO: 479626 - protein, 10 aa, Mycobacterium
GASPTAERRT

SEQ ID NO: 479627 - protein, 8 aa, Mycobacterium
GASPTSPM

SEQ ID NO: 479628 - protein, 15 aa, Mycobacterium
GASPTTIVAPPAAKT

SEQ ID NO: 479629 - protein, 6 aa, Mycobacterium
GASPWA

SEQ ID NO: 479630 - protein, 11 aa, Mycobacterium
GASPYKRARER

SEQ ID NO: 479631 - protein, 6 aa, Mycobacterium
GASQDV

SEQ ID NO: 479632 - protein, 10 aa, Mycobacterium
GASQESELPS

SEQ ID NO: 479633 - protein, 11 aa, Mycobacterium
GASQESELPSD

SEQ ID NO: 479634 - protein, 8 aa, Mycobacterium
GASQNIGE

SEQ ID NO: 479635 - protein, 26 aa, Mycobacterium
GASQRMGRDKASLPVPGSAGGSGAAT

SEQ ID NO: 479636 - protein, 8 aa, Mycobacterium
GASQSEAL

SEQ ID NO: 479637 - protein, 16 aa, Mycobacterium
GASQSEDLARQVEDNG

SEQ ID NO: 479638 - protein, 16 aa, Mycobacterium
GASQSESLARQVDDNG

SEQ ID NO: 479639 - protein, 16 aa, Mycobacterium
GASQSESLARQVSDNG

SEQ ID NO: 479640 - protein, 8 aa, Mycobacterium
GASQTAKE

SEQ ID NO: 479641 - protein, 57 aa, Mycobacterium
GASRAAGAPGTGRAADTASAPVGGNGAGSGVAEAAGAAIATEAAGPSVTATDPACTA

SEQ ID NO: 479642 - protein, 8 aa, Mycobacterium
GASRAEAL

SEQ ID NO: 479643 - protein, 14 aa, Mycobacterium
GASRENDFVMTRVL

SEQ ID NO: 479644 - protein, 24 aa, Mycobacterium
GASRGDPGPFTNGNGPELANGDSL

SEQ ID NO: 479645 - protein, 7 aa, Mycobacterium
GASRGFG

SEQ ID NO: 479646 - protein, 7 aa, Mycobacterium
GASRGIG

SEQ ID NO: 479647 - protein, 8 aa, Mycobacterium
GASRGIGR

SEQ ID NO: 479648 - protein, 7 aa, Mycobacterium
GASRGLG

SEQ ID NO: 479649 - protein, 11 aa, Mycobacterium
GASRNRTARRE

SEQ ID NO: 479650 - protein, 7 aa, Mycobacterium
GASRPAY

SEQ ID NO: 479651 - protein, 9 aa, Mycobacterium
GASRPHESI

SEQ ID NO: 479652 - protein, 16 aa, Mycobacterium
GASRQVPKVAGDATRL

SEQ ID NO: 479653 - protein, 16 aa, Mycobacterium
GASRRVPKVAGDATRL

SEQ ID NO: 479654 - protein, 11 aa, Mycobacterium
GASRTTQRNTR

SEQ ID NO: 479655 - protein, 5 aa, Mycobacterium
GASRY

SEQ ID NO: 479656 - protein, 14 aa, Mycobacterium
GASSAINQIDGLLA

SEQ ID NO: 479657 - protein, 8 aa, Mycobacterium
GASSDRRL

SEQ ID NO: 479658 - protein, 8 aa, Mycobacterium
GASSEYSD

SEQ ID NO: 479659 - protein, 14 aa, Mycobacterium
GASSGIGAATAKSL

SEQ ID NO: 479660 - protein, 14 aa, Mycobacterium
GASSGIGAATARTL

SEQ ID NO: 479661 - protein, 9 aa, Mycobacterium
GASSGIGAE

SEQ ID NO: 479662 - protein, 8 aa, Mycobacterium
GASSGIGE

SEQ ID NO: 479663 - protein, 9 aa, Mycobacterium
GASSGIGEA

SEQ ID NO: 479664 - protein, 10 aa, Mycobacterium
GASSGIGEAT

SEQ ID NO: 479665 - protein, 15 aa, Mycobacterium
GASSGIGEATAKNLA

SEQ ID NO: 479666 - protein, 14 aa, Mycobacterium
GASSGIGEATAQTL

SEQ ID NO: 479667 - protein, 9 aa, Mycobacterium
GASSGIGKE

SEQ ID NO: 479668 - protein, 8 aa, Mycobacterium
GASSGIGR

SEQ ID NO: 479669 - protein, 8 aa, Mycobacterium
GASSGLDD

SEQ ID NO: 479670 - protein, 15 aa, Mycobacterium
GASSGLGRESARALA

SEQ ID NO: 479671 - protein, 8 aa, Mycobacterium
GASSGLVG

SEQ ID NO: 479672 - protein, 12 aa, Mycobacterium
GASSGNYGSPQA

SEQ ID NO: 479673 - protein, 8 aa, Mycobacterium
GASSGSLA

SEQ ID NO: 479674 - protein, 16 aa, Mycobacterium
GASSPGLARNTPPEHD

SEQ ID NO: 479675 - protein, 7 aa, Mycobacterium
GASSRAL

SEQ ID NO: 479676 - protein, 12 aa, Mycobacterium
GASSRGRQFGAE

SEQ ID NO: 479677 - protein, 9 aa, Mycobacterium
GASSSDLAP

SEQ ID NO: 479678 - protein, 17 aa, Mycobacterium
GASSSPAPATSTAMPGH

SEQ ID NO: 479679 - protein, 5 aa, Mycobacterium
GASST

SEQ ID NO: 479680 - protein, 9 aa, Mycobacterium
GASSTGQLD

SEQ ID NO: 479681 - protein, 8 aa, Mycobacterium
GASSTSAG

SEQ ID NO: 479682 - protein, 5 aa, Mycobacterium
GASSV

SEQ ID NO: 479683 - protein, 6 aa, Mycobacterium
GASSVA

SEQ ID NO: 479684 - protein, 6 aa, Mycobacterium
GASSVG

SEQ ID NO: 479685 - protein, 16 aa, Mycobacterium
GASSVGENVKGRAQAV

SEQ ID NO: 479686 - protein, 12 aa, Mycobacterium
GASSVRRADPEA

SEQ ID NO: 479687 - protein, 16 aa, Mycobacterium
GASSYAAAEAANASPL

SEQ ID NO: 479688 - protein, 16 aa, Mycobacterium
GASTAEAQDRAGTDVA

SEQ ID NO: 479689 - protein, 9 aa, Mycobacterium
GASTDQERR

SEQ ID NO: 479690 - protein, 16 aa, Mycobacterium
GASTEEAQDRAGTDVA

SEQ ID NO: 479691 - protein, 6 aa, Mycobacterium
GASTEV

SEQ ID NO: 479692 - protein, 5 aa, Mycobacterium
GASTF

SEQ ID NO: 479693 - protein, 6 aa, Mycobacterium
GASTFD

SEQ ID NO: 479694 - protein, 8 aa, Mycobacterium
GASTGIGK

SEQ ID NO: 479695 - protein, 9 aa, Mycobacterium
GASTPASDI

SEQ ID NO: 479696 - protein, 22 aa, Mycobacterium
GASTPVATDTNASSVTYSKDGQ

SEQ ID NO: 479697 - protein, 6 aa, Mycobacterium
GASTQQ

SEQ ID NO: 479698 - protein, 30 aa, Mycobacterium
GASTSALNDLASGAPVATGIGTSAQSLSGL

SEQ ID NO: 479699 - protein, 9 aa, Mycobacterium
GASTSRASI

SEQ ID NO: 479700 - protein, 9 aa, Mycobacterium
GASTTNEVA

SEQ ID NO: 479701 - protein, 6 aa, Mycobacterium
GASTVK

SEQ ID NO: 479702 - protein, 8 aa, Mycobacterium
GASTYRAE

SEQ ID NO: 479703 - protein, 5 aa, Mycobacterium
GASVE

SEQ ID NO: 479704 - protein, 6 aa, Mycobacterium
GASVGA

SEQ ID NO: 479705 - protein, 18 aa, Mycobacterium
GASVRTAGRIREADADAA

SEQ ID NO: 479706 - protein, 5 aa, Mycobacterium
GASVV

SEQ ID NO: 479707 - protein, 4 aa, Mycobacterium
GASY

SEQ ID NO: 479708 - protein, 6 aa, Mycobacterium
GASYAD

SEQ ID NO: 479709 - protein, 5 aa, Mycobacterium
GASYE

SEQ ID NO: 479710 - protein, 8 aa, Mycobacterium
GASYEPKW

SEQ ID NO: 479711 - protein, 12 aa, Mycobacterium
GASYGRAKPTLQ

SEQ ID NO: 479712 - protein, 5 aa, Mycobacterium
GASYT

SEQ ID NO: 479713 - protein, 11 aa, Mycobacterium
GASYTRDGEAF

SEQ ID NO: 479714 - protein, 12 aa, Mycobacterium
GASYTRDGESFT

SEQ ID NO: 479715 - protein, 5 aa, Mycobacterium
GATAA

SEQ ID NO: 479716 - protein, 16 aa, Mycobacterium
GATAAGAVERATNAVG

SEQ ID NO: 479717 - protein, 13 aa, Mycobacterium
GATAAGDLPAGYD

SEQ ID NO: 479718 - protein, 7 aa, Mycobacterium
GATAAGV

SEQ ID NO: 479719 - protein, 13 aa, Mycobacterium
GATAARDLPIPGR

SEQ ID NO: 479720 - protein, 9 aa, Mycobacterium
GATADGYAE

SEQ ID NO: 479721 - protein, 8 aa, Mycobacterium
GATADGYH

SEQ ID NO: 479722 - protein, 10 aa, Mycobacterium
GATADHLSGG

SEQ ID NO: 479723 - protein, 9 aa, Mycobacterium
GATADHLSN

SEQ ID NO: 479724 - protein, 6 aa, Mycobacterium
GATADP

SEQ ID NO: 479725 - protein, 9 aa, Mycobacterium
GATAEGYAE

SEQ ID NO: 479726 - protein, 8 aa, Mycobacterium
GATAERHK

SEQ ID NO: 479727 - protein, 14 aa, Mycobacterium
GATAEVNDAVRGAG

SEQ ID NO: 479728 - protein, 23 aa, Mycobacterium
GATAGAADASAEGAAAPESSTDA

SEQ ID NO: 479729 - protein, 8 aa, Mycobacterium
GATAGPVY

SEQ ID NO: 479730 - protein, 14 aa, Mycobacterium
GATAGRAHTARGDA

SEQ ID NO: 479731 - protein, 13 aa, Mycobacterium
GATAGRGSQARRA

SEQ ID NO: 479732 - protein, 12 aa, Mycobacterium
GATAGSPTDTDA

SEQ ID NO: 479733 - protein, 9 aa, Mycobacterium
GATALANDA

SEQ ID NO: 479734 - protein, 10 aa, Mycobacterium
GATALGNDQP

SEQ ID NO: 479735 - protein, 7 aa, Mycobacterium
GATANRV

SEQ ID NO: 479736 - protein, 9 aa, Mycobacterium
GATAPDGRC

SEQ ID NO: 479737 - protein, 9 aa, Mycobacterium
GATAPDLPG

SEQ ID NO: 479738 - protein, 7 aa, Mycobacterium
GATAPRV

SEQ ID NO: 479739 - protein, 11 aa, Mycobacterium
GATAPTGGPHA

SEQ ID NO: 479740 - protein, 6 aa, Mycobacterium
GATAQA

SEQ ID NO: 479741 - protein, 8 aa, Mycobacterium
GATAQEAI

SEQ ID NO: 479742 - protein, 6 aa, Mycobacterium
GATAQR

SEQ ID NO: 479743 - protein, 10 aa, Mycobacterium
GATARDGASS

SEQ ID NO: 479744 - protein, 13 aa, Mycobacterium
GATARRDLPIPGR

SEQ ID NO: 479745 - protein, 6 aa, Mycobacterium
GATART

SEQ ID NO: 479746 - protein, 11 aa, Mycobacterium
GATASGKLPAG

SEQ ID NO: 479747 - protein, 10 aa, Mycobacterium
GATASLAPSA

SEQ ID NO: 479748 - protein, 13 aa, Mycobacterium
GATASPAGLGGTP

SEQ ID NO: 479749 - protein, 7 aa, Mycobacterium
GATASTS

SEQ ID NO: 479750 - protein, 10 aa, Mycobacterium
GATATRRRRE

SEQ ID NO: 479751 - protein, 7 aa, Mycobacterium
GATATSA

SEQ ID NO: 479752 - protein, 9 aa, Mycobacterium
GATATSPRL

SEQ ID NO: 479753 - protein, 5 aa, Mycobacterium
GATAV

SEQ ID NO: 479754 - protein, 9 aa, Mycobacterium
GATCEDPHE

SEQ ID NO: 479755 - protein, 8 aa, Mycobacterium
GATDAQRR

SEQ ID NO: 479756 - protein, 13 aa, Mycobacterium
GATDAVDASATDD

SEQ ID NO: 479757 - protein, 10 aa, Mycobacterium
GATDDAVSDH

SEQ ID NO: 479758 - protein, 10 aa, Mycobacterium
GATDDDPARV

SEQ ID NO: 479759 - protein, 9 aa, Mycobacterium
GATDETTGQ

SEQ ID NO: 479760 - protein, 14 aa, Mycobacterium
GATDFSKKSGRSEL

SEQ ID NO: 479761 - protein, 9 aa, Mycobacterium
GATDGEAGL

SEQ ID NO: 479762 - protein, 10 aa, Mycobacterium
GATDGEPGLQ

SEQ ID NO: 479763 - protein, 11 aa, Mycobacterium
GATDKSQATID

SEQ ID NO: 479764 - protein, 11 aa, Mycobacterium
GATDNAARGDL

SEQ ID NO: 479765 - protein, 12 aa, Mycobacterium
GATDPGADPDRR

SEQ ID NO: 479766 - protein, 12 aa, Mycobacterium
GATDQDRRQLPQ

SEQ ID NO: 479767 - protein, 6 aa, Mycobacterium
GATDRM

SEQ ID NO: 479768 - protein, 8 aa, Mycobacterium
GATDSAVG

SEQ ID NO: 479769 - protein, 9 aa, Mycobacterium
GATDTINAR

SEQ ID NO: 479770 - protein, 7 aa, Mycobacterium
GATDVAD

SEQ ID NO: 479771 - protein, 13 aa, Mycobacterium
GATDVGPRSTVPG

SEQ ID NO: 479772 - protein, 9 aa, Mycobacterium
GATEDGVNT

SEQ ID NO: 479773 - protein, 13 aa, Mycobacterium
GATEDSSGYSQNT

SEQ ID NO: 479774 - protein, 8 aa, Mycobacterium
GATEFAGE

SEQ ID NO: 479775 - protein, 6 aa, Mycobacterium
GATEGL

SEQ ID NO: 479776 - protein, 17 aa, Mycobacterium
GATEHPTITGEHEGQPQ

SEQ ID NO: 479777 - protein, 5 aa, Mycobacterium
GATEI

SEQ ID NO: 479778 - protein, 8 aa, Mycobacterium
GATEIGGT

SEQ ID NO: 479779 - protein, 5 aa, Mycobacterium
GATEP

SEQ ID NO: 479780 - protein, 8 aa, Mycobacterium
GATEPAKS

SEQ ID NO: 479781 - protein, 7 aa, Mycobacterium
GATEPAV

SEQ ID NO: 479782 - protein, 8 aa, Mycobacterium
GATEPEQE

SEQ ID NO: 479783 - protein, 8 aa, Mycobacterium
GATESGCA

SEQ ID NO: 479784 - protein, 11 aa, Mycobacterium
GATESKPRGPS

SEQ ID NO: 479785 - protein, 12 aa, Mycobacterium
GATESKPRGPST

SEQ ID NO: 479786 - protein, 8 aa, Mycobacterium
GATESRSL

SEQ ID NO: 479787 - protein, 5 aa, Mycobacterium
GATET

SEQ ID NO: 479788 - protein, 6 aa, Mycobacterium
GATETS

SEQ ID NO: 479789 - protein, 8 aa, Mycobacterium
GATETSGA

SEQ ID NO: 479790 - protein, 8 aa, Mycobacterium
GATEVSER

SEQ ID NO: 479791 - protein, 5 aa, Mycobacterium
GATEY

SEQ ID NO: 479792 - protein, 8 aa, Mycobacterium
GATEYAAA

SEQ ID NO: 479793 - protein, 13 aa, Mycobacterium
GATFGDEAARAAA

SEQ ID NO: 479794 - protein, 12 aa, Mycobacterium
GATFSDAAARDA

SEQ ID NO: 479795 - protein, 11 aa, Mycobacterium
GATFSEGAARE

SEQ ID NO: 479796 - protein, 5 aa, Mycobacterium
GATGA

SEQ ID NO: 479797 - protein, 7 aa, Mycobacterium
GATGARS

SEQ ID NO: 479798 - protein, 24 aa, Mycobacterium
GATGEYQAATKDAPEQGVYSSPAE

SEQ ID NO: 479799 - protein, 15 aa, Mycobacterium
GATGGGFTKTAGRSA

SEQ ID NO: 479800 - protein, 7 aa, Mycobacterium
GATGGGI

SEQ ID NO: 479801 - protein, 6 aa, Mycobacterium
GATGGS

SEQ ID NO: 479802 - protein, 8 aa, Mycobacterium
GATGGTQL

SEQ ID NO: 479803 - protein, 6 aa, Mycobacterium
GATGGV

SEQ ID NO: 479804 - protein, 10 aa, Mycobacterium
GATGHRLDDP

SEQ ID NO: 479805 - protein, 7 aa, Mycobacterium
GATGIGA

SEQ ID NO: 479806 - protein, 6 aa, Mycobacterium
GATGKP

SEQ ID NO: 479807 - protein, 18 aa, Mycobacterium
GATGNEARYVEDSGTSMA

SEQ ID NO: 479808 - protein, 9 aa, Mycobacterium
GATGNFTQT

SEQ ID NO: 479809 - protein, 8 aa, Mycobacterium
GATGPALG

SEQ ID NO: 479810 - protein, 30 aa, Mycobacterium
GATGPASAREPFETPGATDEDPVRVVQDGE

SEQ ID NO: 479811 - protein, 30 aa, Mycobacterium
GATGPDAAREPYEMPGATDEDPVQVVQNGE

SEQ ID NO: 479812 - protein, 7 aa, Mycobacterium
GATGPRI

SEQ ID NO: 479813 - protein, 7 aa, Mycobacterium
GATGPRS

SEQ ID NO: 479814 - protein, 12 aa, Mycobacterium
GATGPRSSWRAT

SEQ ID NO: 479815 - protein, 9 aa, Mycobacterium
GATGPSDRA

SEQ ID NO: 479816 - protein, 6 aa, Mycobacterium
GATGQL

SEQ ID NO: 479817 - protein, 15 aa, Mycobacterium
GATGRPEQEFAAIVS

SEQ ID NO: 479818 - protein, 6 aa, Mycobacterium
GATGRR

SEQ ID NO: 479819 - protein, 15 aa, Mycobacterium
GATGSGAGEEQGVQD

SEQ ID NO: 479820 - protein, 8 aa, Mycobacterium
GATGSRLV

SEQ ID NO: 479821 - protein, 12 aa, Mycobacterium
GATGTDAAAAER

SEQ ID NO: 479822 - protein, 10 aa, Mycobacterium
GATGTGKTKS

SEQ ID NO: 479823 - protein, 11 aa, Mycobacterium
GATGTGKTKSL

SEQ ID NO: 479824 - protein, 7 aa, Mycobacterium
GATGTLK

SEQ ID NO: 479825 - protein, 6 aa, Mycobacterium
GATGTP

SEQ ID NO: 479826 - protein, 7 aa, Mycobacterium
GATGVRG

SEQ ID NO: 479827 - protein, 4 aa, Mycobacterium
GATH

SEQ ID NO: 479828 - protein, 6 aa, Mycobacterium
GATHAP

SEQ ID NO: 479829 - protein, 6 aa, Mycobacterium
GATHCG

SEQ ID NO: 479830 - protein, 8 aa, Mycobacterium
GATHSPHH

SEQ ID NO: 479831 - protein, 6 aa, Mycobacterium
GATKAA

SEQ ID NO: 479832 - protein, 7 aa, Mycobacterium
GATKERA

SEQ ID NO: 479833 - protein, 8 aa, Mycobacterium
GATKGIGA

SEQ ID NO: 479834 - protein, 18 aa, Mycobacterium
GATKPSEAPLPAPAELTD

SEQ ID NO: 479835 - protein, 11 aa, Mycobacterium
GATLDSTIGRT

SEQ ID NO: 479836 - protein, 40 aa, Mycobacterium
GATLGAGQKITATQAKNGQTSSSTALPETVGAGPSPATGL

SEQ ID NO: 479837 - protein, 6 aa, Mycobacterium
GATLNA

SEQ ID NO: 479838 - protein, 9 aa, Mycobacterium
GATLPARGT

SEQ ID NO: 479839 - protein, 7 aa, Mycobacterium
GATLQTG

SEQ ID NO: 479840 - protein, 9 aa, Mycobacterium
GATLRDPHE

SEQ ID NO: 479841 - protein, 8 aa, Mycobacterium
GATLSAEE

SEQ ID NO: 479842 - protein, 13 aa, Mycobacterium
GATLTPGNTRDAV

SEQ ID NO: 479843 - protein, 6 aa, Mycobacterium
GATLTY

SEQ ID NO: 479844 - protein, 4 aa, Mycobacterium
GATM

SEQ ID NO: 479845 - protein, 10 aa, Mycobacterium
GATMARQSKS

SEQ ID NO: 479846 - protein, 5 aa, Mycobacterium
GATND

SEQ ID NO: 479847 - protein, 11 aa, Mycobacterium
GATNDELRAVR

SEQ ID NO: 479848 - protein, 6 aa, Mycobacterium
GATNRA

SEQ ID NO: 479849 - protein, 6 aa, Mycobacterium
GATNRI

SEQ ID NO: 479850 - protein, 6 aa, Mycobacterium
GATNVD

SEQ ID NO: 479851 - protein, 7 aa, Mycobacterium
GATNYGG

SEQ ID NO: 479852 - protein, 7 aa, Mycobacterium
GATPAAI

SEQ ID NO: 479853 - protein, 11 aa, Mycobacterium
GATPAANPYPT

SEQ ID NO: 479854 - protein, 8 aa, Mycobacterium
GATPAERS

SEQ ID NO: 479855 - protein, 20 aa, Mycobacterium
GATPAGGVERQAGTAEDGQM

SEQ ID NO: 479856 - protein, 21 aa, Mycobacterium
GATPAGGVERQAGTTADGENR

SEQ ID NO: 479857 - protein, 12 aa, Mycobacterium
GATPATSPTTAS

SEQ ID NO: 479858 - protein, 6 aa, Mycobacterium
GATPAW

SEQ ID NO: 479859 - protein, 5 aa, Mycobacterium
GATPD

SEQ ID NO: 479860 - protein, 11 aa, Mycobacterium
GATPDAAQQKD

SEQ ID NO: 479861 - protein, 7 aa, Mycobacterium
GATPDNL

SEQ ID NO: 479862 - protein, 7 aa, Mycobacterium
GATPDNP

SEQ ID NO: 479863 - protein, 14 aa, Mycobacterium
GATPEGAPVGGDPL

SEQ ID NO: 479864 - protein, 12 aa, Mycobacterium
GATPELTHIHGV

SEQ ID NO: 479865 - protein, 9 aa, Mycobacterium
GATPESTAL

SEQ ID NO: 479866 - protein, 6 aa, Mycobacterium
GATPGA

SEQ ID NO: 479867 - protein, 27 aa, Mycobacterium
GATPGPVSLSAPDPTVTTTKASDVDAV

SEQ ID NO: 479868 - protein, 19 aa, Mycobacterium
GATPGQQRSYQLPNGGTQQ

SEQ ID NO: 479869 - protein, 7 aa, Mycobacterium
GATPGRV

SEQ ID NO: 479870 - protein, 13 aa, Mycobacterium
GATPGSTVKIGVG

SEQ ID NO: 479871 - protein, 6 aa, Mycobacterium
GATPGT

SEQ ID NO: 479872 - protein, 8 aa, Mycobacterium
GATPHEAA

SEQ ID NO: 479873 - protein, 19 aa, Mycobacterium
GATPHYGPDPGAHPATVDD

SEQ ID NO: 479874 - protein, 5 aa, Mycobacterium
GATPK

SEQ ID NO: 479875 - protein, 14 aa, Mycobacterium
GATPKRATATETAV

SEQ ID NO: 479876 - protein, 9 aa, Mycobacterium
GATPKRDWE

SEQ ID NO: 479877 - protein, 9 aa, Mycobacterium
GATPLKAPA

SEQ ID NO: 479878 - protein, 8 aa, Mycobacterium
GATPLRRP

SEQ ID NO: 479879 - protein, 10 aa, Mycobacterium
GATPPDSPYP

SEQ ID NO: 479880 - protein, 11 aa, Mycobacterium
GATPPDSPYPT

SEQ ID NO: 479881 - protein, 17 aa, Mycobacterium
GATPPGTPPVPGGSGSV

SEQ ID NO: 479882 - protein, 8 aa, Mycobacterium
GATPPLDR

SEQ ID NO: 479883 - protein, 11 aa, Mycobacterium
GATPPNSPYPT

SEQ ID NO: 479884 - protein, 10 aa, Mycobacterium
GATPPNSPYQ

SEQ ID NO: 479885 - protein, 21 aa, Mycobacterium
GATPPTTTPATTAAKPSPSTV

SEQ ID NO: 479886 - protein, 7 aa, Mycobacterium
GATPPVA

SEQ ID NO: 479887 - protein, 7 aa, Mycobacterium
GATPQAL

SEQ ID NO: 479888 - protein, 8 aa, Mycobacterium
GATPQQVA

SEQ ID NO: 479889 - protein, 6 aa, Mycobacterium
GATPQW

SEQ ID NO: 479890 - protein, 7 aa, Mycobacterium
GATPQWA

SEQ ID NO: 479891 - protein, 5 aa, Mycobacterium
GATPR

SEQ ID NO: 479892 - protein, 8 aa, Mycobacterium
GATPRDAA

SEQ ID NO: 479893 - protein, 5 aa, Mycobacterium
GATPS

SEQ ID NO: 479894 - protein, 10 aa, Mycobacterium
GATPSADPEA

SEQ ID NO: 479895 - protein, 9 aa, Mycobacterium
GATPSTAYS

SEQ ID NO: 479896 - protein, 6 aa, Mycobacterium
GATPSV

SEQ ID NO: 479897 - protein, 10 aa, Mycobacterium
GATPTAERRE

SEQ ID NO: 479898 - protein, 10 aa, Mycobacterium
GATPTAPDLA

SEQ ID NO: 479899 - protein, 10 aa, Mycobacterium
GATPVGSPAV

SEQ ID NO: 479900 - protein, 9 aa, Mycobacterium
GATPVKAPA

SEQ ID NO: 479901 - protein, 9 aa, Mycobacterium
GATPVPGRT

SEQ ID NO: 479902 - protein, 6 aa, Mycobacterium
GATQAE

SEQ ID NO: 479903 - protein, 8 aa, Mycobacterium
GATQAPKG

SEQ ID NO: 479904 - protein, 9 aa, Mycobacterium
GATQGHSGT

SEQ ID NO: 479905 - protein, 7 aa, Mycobacterium
GATQGRR

SEQ ID NO: 479906 - protein, 15 aa, Mycobacterium
GATQTFPPAIPDTER

SEQ ID NO: 479907 - protein, 13 aa, Mycobacterium
GATRAQRDAYKRA

SEQ ID NO: 479908 - protein, 10 aa, Mycobacterium
GATRDGSNTY

SEQ ID NO: 479909 - protein, 5 aa, Mycobacterium
GATRE

SEQ ID NO: 479910 - protein, 12 aa, Mycobacterium
GATREEALERSR

SEQ ID NO: 479911 - protein, 5 aa, Mycobacterium
GATRG

SEQ ID NO: 479912 - protein, 10 aa, Mycobacterium
GATRGAGRGI

SEQ ID NO: 479913 - protein, 14 aa, Mycobacterium
GATRGDGRSGEDVT

SEQ ID NO: 479914 - protein, 5 aa, Mycobacterium
GATRL

SEQ ID NO: 479915 - protein, 12 aa, Mycobacterium
GATRNAYSLTGA

SEQ ID NO: 479916 - protein, 5 aa, Mycobacterium
GATRQ

SEQ ID NO: 479917 - protein, 16 aa, Mycobacterium
GATRTDGAGTDIATRT

SEQ ID NO: 479918 - protein, 13 aa, Mycobacterium
GATRTDSDGYAFD

SEQ ID NO: 479919 - protein, 9 aa, Mycobacterium
GATSADEAA

SEQ ID NO: 479920 - protein, 8 aa, Mycobacterium
GATSANGD

SEQ ID NO: 479921 - protein, 8 aa, Mycobacterium
GATSDAAA

SEQ ID NO: 479922 - protein, 5 aa, Mycobacterium
GATSG

SEQ ID NO: 479923 - protein, 9 aa, Mycobacterium
GATSGHTQK

SEQ ID NO: 479924 - protein, 8 aa, Mycobacterium
GATSGKKD

SEQ ID NO: 479925 - protein, 7 aa, Mycobacterium
GATSGMA

SEQ ID NO: 479926 - protein, 7 aa, Mycobacterium
GATSGPV

SEQ ID NO: 479927 - protein, 9 aa, Mycobacterium
GATSLPDRE

SEQ ID NO: 479928 - protein, 6 aa, Mycobacterium
GATSPP

SEQ ID NO: 479929 - protein, 8 aa, Mycobacterium
GATSRTAL

SEQ ID NO: 479930 - protein, 6 aa, Mycobacterium
GATSSA

SEQ ID NO: 479931 - protein, 8 aa, Mycobacterium
GATSSEST

SEQ ID NO: 479932 - protein, 7 aa, Mycobacterium
GATSTLA

SEQ ID NO: 479933 - protein, 6 aa, Mycobacterium
GATSVE

SEQ ID NO: 479934 - protein, 7 aa, Mycobacterium
GATSVEN

SEQ ID NO: 479935 - protein, 4 aa, Mycobacterium
GATT

SEQ ID NO: 479936 - protein, 9 aa, Mycobacterium
GATTADEAA

SEQ ID NO: 479937 - protein, 24 aa, Mycobacterium
GATTALAEPGGASDGDLHASTPIT

SEQ ID NO: 479938 - protein, 7 aa, Mycobacterium
GATTARR

SEQ ID NO: 479939 - protein, 8 aa, Mycobacterium
GATTATAQ

SEQ ID NO: 479940 - protein, 7 aa, Mycobacterium
GATTDGS

SEQ ID NO: 479941 - protein, 7 aa, Mycobacterium
GATTEQA

SEQ ID NO: 479942 - protein, 6 aa, Mycobacterium
GATTFN

SEQ ID NO: 479943 - protein, 6 aa, Mycobacterium
GATTGH

SEQ ID NO: 479944 - protein, 5 aa, Mycobacterium
GATTI

SEQ ID NO: 479945 - protein, 6 aa, Mycobacterium
GATTKN

SEQ ID NO: 479946 - protein, 7 aa, Mycobacterium
GATTNFD

SEQ ID NO: 479947 - protein, 9 aa, Mycobacterium
GATTPDART

SEQ ID NO: 479948 - protein, 6 aa, Mycobacterium
GATTQM

SEQ ID NO: 479949 - protein, 5 aa, Mycobacterium
GATTR

SEQ ID NO: 479950 - protein, 7 aa, Mycobacterium
GATTTRE

SEQ ID NO: 479951 - protein, 13 aa, Mycobacterium
GATTTVYPTTNAT

SEQ ID NO: 479952 - protein, 5 aa, Mycobacterium
GATVA

SEQ ID NO: 479953 - protein, 15 aa, Mycobacterium
GATVDATDEGGARRH

SEQ ID NO: 479954 - protein, 11 aa, Mycobacterium
GATVDERSDGA

SEQ ID NO: 479955 - protein, 9 aa, Mycobacterium
GATVEDPHE

SEQ ID NO: 479956 - protein, 5 aa, Mycobacterium
GATVG

SEQ ID NO: 479957 - protein, 20 aa, Mycobacterium
GATVQATQPVEQRKAPAKWS

SEQ ID NO: 479958 - protein, 9 aa, Mycobacterium
GATVSGTAN

SEQ ID NO: 479959 - protein, 9 aa, Mycobacterium
GATVSNEDG

SEQ ID NO: 479960 - protein, 7 aa, Mycobacterium
GATVSPP

SEQ ID NO: 479961 - protein, 12 aa, Mycobacterium
GATVSRGRGRPA

SEQ ID NO: 479962 - protein, 11 aa, Mycobacterium
GATVSSRSAAA

SEQ ID NO: 479963 - protein, 6 aa, Mycobacterium
GATVSV

SEQ ID NO: 479964 - protein, 7 aa, Mycobacterium
GATVTSA

SEQ ID NO: 479965 - protein, 8 aa, Mycobacterium
GATVTSAP

SEQ ID NO: 479966 - protein, 4 aa, Mycobacterium
GATY

SEQ ID NO: 479967 - protein, 7 aa, Mycobacterium
GATYPDA

SEQ ID NO: 479968 - protein, 11 aa, Mycobacterium
GATYPGAGATI

SEQ ID NO: 479969 - protein, 12 aa, Mycobacterium
GATYQRDGETFD

SEQ ID NO: 479970 - protein, 16 aa, Mycobacterium
GATYRPGTRFGPQGIR

SEQ ID NO: 479971 - protein, 10 aa, Mycobacterium
GAVAASGLTG

SEQ ID NO: 479972 - protein, 6 aa, Mycobacterium
GAVAAT

SEQ ID NO: 479973 - protein, 8 aa, Mycobacterium
GAVADAGA

SEQ ID NO: 479974 - protein, 11 aa, Mycobacterium
GAVADGPTSAA

SEQ ID NO: 479975 - protein, 7 aa, Mycobacterium
GAVAGRD

SEQ ID NO: 479976 - protein, 10 aa, Mycobacterium
GAVAPDDVGP

SEQ ID NO: 479977 - protein, 8 aa, Mycobacterium
GAVAPRSF

SEQ ID NO: 479978 - protein, 6 aa, Mycobacterium
GAVDAR

SEQ ID NO: 479979 - protein, 14 aa, Mycobacterium
GAVDASAEAANGVA

SEQ ID NO: 479980 - protein, 5 aa, Mycobacterium
GAVDD

SEQ ID NO: 479981 - protein, 12 aa, Mycobacterium
GAVDDIPSGSSL

SEQ ID NO: 479982 - protein, 6 aa, Mycobacterium
GAVDDS

SEQ ID NO: 479983 - protein, 5 aa, Mycobacterium
GAVDE

SEQ ID NO: 479984 - protein, 7 aa, Mycobacterium
GAVDEPT

SEQ ID NO: 479985 - protein, 13 aa, Mycobacterium
GAVDQVRTRARQR

SEQ ID NO: 479986 - protein, 5 aa, Mycobacterium
GAVDS

SEQ ID NO: 479987 - protein, 12 aa, Mycobacterium
GAVEAAGYTPPT

SEQ ID NO: 479988 - protein, 13 aa, Mycobacterium
GAVEEATDTAAAN

SEQ ID NO: 479989 - protein, 6 aa, Mycobacterium
GAVEES

SEQ ID NO: 479990 - protein, 12 aa, Mycobacterium
GAVEGVKGKAKE

SEQ ID NO: 479991 - protein, 5 aa, Mycobacterium
GAVEP

SEQ ID NO: 479992 - protein, 11 aa, Mycobacterium
GAVEQKSVRSG

SEQ ID NO: 479993 - protein, 23 aa, Mycobacterium
GAVETAGRRGTRVRDRPAITPRS

SEQ ID NO: 479994 - protein, 9 aa, Mycobacterium
GAVGASDVA

SEQ ID NO: 479995 - protein, 15 aa, Mycobacterium
GAVGGAGDDQRGAGL

SEQ ID NO: 479996 - protein, 13 aa, Mycobacterium
GAVGGNSARRGAV

SEQ ID NO: 479997 - protein, 6 aa, Mycobacterium
GAVGHG

SEQ ID NO: 479998 - protein, 10 aa, Mycobacterium
GAVGPAGHPI

SEQ ID NO: 479999 - protein, 12 aa, Mycobacterium
GAVGPKAHGEIG

SEQ ID NO: 480000 - protein, 5 aa, Mycobacterium
GAVGR

SEQ ID NO: 480001 - protein, 15 aa, Mycobacterium
GAVGSGERADQPGAD

SEQ ID NO: 480002 - protein, 9 aa, Mycobacterium
GAVGTASAQ

SEQ ID NO: 480003 - protein, 6 aa, Mycobacterium
GAVHGG

SEQ ID NO: 480004 - protein, 5 aa, Mycobacterium
GAVHR

SEQ ID NO: 480005 - protein, 9 aa, Mycobacterium
GAVKARTAA

SEQ ID NO: 480006 - protein, 19 aa, Mycobacterium
GAVNDGAKLATGGGRPAGL

SEQ ID NO: 480007 - protein, 53 aa, Mycobacterium
GAVNPDVEPRPTVNDSAQPQSNDAFGAEPGVPPMTDNSSYRGGQGQGRPDEYY

SEQ ID NO: 480008 - protein, 5 aa, Mycobacterium
GAVNR

SEQ ID NO: 480009 - protein, 5 aa, Mycobacterium
GAVPA

SEQ ID NO: 480010 - protein, 6 aa, Mycobacterium
GAVPAE

SEQ ID NO: 480011 - protein, 6 aa, Mycobacterium
GAVPDE

SEQ ID NO: 480012 - protein, 6 aa, Mycobacterium
GAVPED

SEQ ID NO: 480013 - protein, 8 aa, Mycobacterium
GAVPGAGE

SEQ ID NO: 480014 - protein, 11 aa, Mycobacterium
GAVPGALAGQR

SEQ ID NO: 480015 - protein, 18 aa, Mycobacterium
GAVPGEQADQGVHRHQPD

SEQ ID NO: 480016 - protein, 8 aa, Mycobacterium
GAVPGSSF

SEQ ID NO: 480017 - protein, 5 aa, Mycobacterium
GAVPP

SEQ ID NO: 480018 - protein, 11 aa, Mycobacterium
GAVPPAPEAPQ

SEQ ID NO: 480019 - protein, 9 aa, Mycobacterium
GAVPPGPQF

SEQ ID NO: 480020 - protein, 14 aa, Mycobacterium
GAVPPPEKRRAGVP

SEQ ID NO: 480021 - protein, 6 aa, Mycobacterium
GAVPPT

SEQ ID NO: 480022 - protein, 7 aa, Mycobacterium
GAVPPTL

SEQ ID NO: 480023 - protein, 6 aa, Mycobacterium
GAVPQR

SEQ ID NO: 480024 - protein, 9 aa, Mycobacterium
GAVPRTSTY

SEQ ID NO: 480025 - protein, 5 aa, Mycobacterium
GAVPT

SEQ ID NO: 480026 - protein, 5 aa, Mycobacterium
GAVQG

SEQ ID NO: 480027 - protein, 9 aa, Mycobacterium
GAVQPDEAA

SEQ ID NO: 480028 - protein, 8 aa, Mycobacterium
GAVQRGDT

SEQ ID NO: 480029 - protein, 15 aa, Mycobacterium
GAVQTRVDEVSDGGV

SEQ ID NO: 480030 - protein, 10 aa, Mycobacterium
GAVRDKDGIS

SEQ ID NO: 480031 - protein, 5 aa, Mycobacterium
GAVRG

SEQ ID NO: 480032 - protein, 18 aa, Mycobacterium
GAVRSGDAGVAGDGRARP

SEQ ID NO: 480033 - protein, 5 aa, Mycobacterium
GAVRT

SEQ ID NO: 480034 - protein, 4 aa, Mycobacterium
GAVS

SEQ ID NO: 480035 - protein, 6 aa, Mycobacterium
GAVSAD

SEQ ID NO: 480036 - protein, 6 aa, Mycobacterium
GAVSAG

SEQ ID NO: 480037 - protein, 14 aa, Mycobacterium
GAVSATLDDGGSVA

SEQ ID NO: 480038 - protein, 13 aa, Mycobacterium
GAVSDPSAPFGGM

SEQ ID NO: 480039 - protein, 6 aa, Mycobacterium
GAVSEG

SEQ ID NO: 480040 - protein, 6 aa, Mycobacterium
GAVSEK

SEQ ID NO: 480041 - protein, 12 aa, Mycobacterium
GAVSGAASGPSI

SEQ ID NO: 480042 - protein, 30 aa, Mycobacterium
GAVSGGVSGTGSLGSSNSIGGSVGGGATGY

SEQ ID NO: 480043 - protein, 10 aa, Mycobacterium
GAVSKSATAV

SEQ ID NO: 480044 - protein, 7 aa, Mycobacterium
GAVSNNI

SEQ ID NO: 480045 - protein, 7 aa, Mycobacterium
GAVSPAV

SEQ ID NO: 480046 - protein, 7 aa, Mycobacterium
GAVSPGA

SEQ ID NO: 480047 - protein, 7 aa, Mycobacterium
GAVSPHT

SEQ ID NO: 480048 - protein, 16 aa, Mycobacterium
GAVSSAVAEGSAGQPV

SEQ ID NO: 480049 - protein, 5 aa, Mycobacterium
GAVTD

SEQ ID NO: 480050 - protein, 8 aa, Mycobacterium
GAVTDEHR

SEQ ID NO: 480051 - protein, 7 aa, Mycobacterium
GAVTDGL

SEQ ID NO: 480052 - protein, 9 aa, Mycobacterium
GAVTDPTEA

SEQ ID NO: 480053 - protein, 10 aa, Mycobacterium
GAVTEDPSAS

SEQ ID NO: 480054 - protein, 7 aa, Mycobacterium
GAVTERQ

SEQ ID NO: 480055 - protein, 5 aa, Mycobacterium
GAVTG

SEQ ID NO: 480056 - protein, 6 aa, Mycobacterium
GAVTGK

SEQ ID NO: 480057 - protein, 6 aa, Mycobacterium
GAVTGS

SEQ ID NO: 480058 - protein, 8 aa, Mycobacterium
GAVTPPQG

SEQ ID NO: 480059 - protein, 9 aa, Mycobacterium
GAVTQDPTH

SEQ ID NO: 480060 - protein, 6 aa, Mycobacterium
GAVTSA

SEQ ID NO: 480061 - protein, 7 aa, Mycobacterium
GAVTSDE

SEQ ID NO: 480062 - protein, 21 aa, Mycobacterium
GAVTSGRAGFSTTGLGPDEAV

SEQ ID NO: 480063 - protein, 4 aa, Mycobacterium
GAVV

SEQ ID NO: 480064 - protein, 12 aa, Mycobacterium
GAVYTNTGASGV

SEQ ID NO: 480065 - protein, 6 aa, Mycobacterium
GAWDDP

SEQ ID NO: 480066 - protein, 8 aa, Mycobacterium
GAWGSPEK

SEQ ID NO: 480067 - protein, 15 aa, Mycobacterium
GAWPETEESEFSNRQ

SEQ ID NO: 480068 - protein, 9 aa, Mycobacterium
GAWQGPSGR

SEQ ID NO: 480069 - protein, 9 aa, Mycobacterium
GAWSPGGKF

SEQ ID NO: 480070 - protein, 4 aa, Mycobacterium
GAYA

SEQ ID NO: 480071 - protein, 14 aa, Mycobacterium
GAYADAAEARGTWD

SEQ ID NO: 480072 - protein, 19 aa, Mycobacterium
GAYAGTVDDAEDALEGQLW

SEQ ID NO: 480073 - protein, 9 aa, Mycobacterium
GAYAPDPAA

SEQ ID NO: 480074 - protein, 7 aa, Mycobacterium
GAYAPGK

SEQ ID NO: 480075 - protein, 6 aa, Mycobacterium
GAYAPY

SEQ ID NO: 480076 - protein, 6 aa, Mycobacterium
GAYGAE

SEQ ID NO: 480077 - protein, 19 aa, Mycobacterium
GAYGDADKAVNNAKGELGK

SEQ ID NO: 480078 - protein, 15 aa, Mycobacterium
GAYGDDAANEIAAVL

SEQ ID NO: 480079 - protein, 8 aa, Mycobacterium
GAYGEKQM

SEQ ID NO: 480080 - protein, 7 aa, Mycobacterium
GAYGIDG

SEQ ID NO: 480081 - protein, 7 aa, Mycobacterium
GAYGIQD

SEQ ID NO: 480082 - protein, 9 aa, Mycobacterium
GAYGPEQAH

SEQ ID NO: 480083 - protein, 6 aa, Mycobacterium
GAYGTP

SEQ ID NO: 480084 - protein, 5 aa, Mycobacterium
GAYLN

SEQ ID NO: 480085 - protein, 4 aa, Mycobacterium
GAYP

SEQ ID NO: 480086 - protein, 9 aa, Mycobacterium
GAYPDLSEQ

SEQ ID NO: 480087 - protein, 7 aa, Mycobacterium
GAYPPVT

SEQ ID NO: 480088 - protein, 7 aa, Mycobacterium
GAYPSTL

SEQ ID NO: 480089 - protein, 8 aa, Mycobacterium
GAYPSTLG

SEQ ID NO: 480090 - protein, 21 aa, Mycobacterium
GAYPTNAGRPEFADGPRAARL

SEQ ID NO: 480091 - protein, 6 aa, Mycobacterium
GAYQRK

SEQ ID NO: 480092 - protein, 5 aa, Mycobacterium
GAYQY

SEQ ID NO: 480093 - protein, 4 aa, Mycobacterium
GAYR

SEQ ID NO: 480094 - protein, 13 aa, Mycobacterium
GAYREPPPPRRDR

SEQ ID NO: 480095 - protein, 6 aa, Mycobacterium
GAYRNS

SEQ ID NO: 480096 - protein, 8 aa, Mycobacterium
GAYRPDPA

SEQ ID NO: 480097 - protein, 8 aa, Mycobacterium
GAYSAAYS

SEQ ID NO: 480098 - protein, 4 aa, Mycobacterium
GAYT

SEQ ID NO: 480099 - protein, 6 aa, Mycobacterium
GAYTDT

SEQ ID NO: 480100 - protein, 5 aa, Mycobacterium
GAYTS

SEQ ID NO: 480101 - protein, 5 aa, Mycobacterium
GCAAP

SEQ ID NO: 480102 - protein, 11 aa, Mycobacterium
GCADATSAMEA

SEQ ID NO: 480103 - protein, 13 aa, Mycobacterium
GCAEKARADEPYR

SEQ ID NO: 480104 - protein, 16 aa, Mycobacterium
GCAGGRPVTRPVDEGE

SEQ ID NO: 480105 - protein, 10 aa, Mycobacterium
GCAGHSDGDV

SEQ ID NO: 480106 - protein, 17 aa, Mycobacterium
GCAPEATATEAHYPGTY

SEQ ID NO: 480107 - protein, 7 aa, Mycobacterium
GCATGDP

SEQ ID NO: 480108 - protein, 5 aa, Mycobacterium
GCCDG

SEQ ID NO: 480109 - protein, 12 aa, Mycobacterium
GCCGSGPAGPAV

SEQ ID NO: 480110 - protein, 5 aa, Mycobacterium
GCDGS

SEQ ID NO: 480111 - protein, 7 aa, Mycobacterium
GCDPAQF

SEQ ID NO: 480112 - protein, 6 aa, Mycobacterium
GCDPGE

SEQ ID NO: 480113 - protein, 11 aa, Mycobacterium
GCDQATEAEIA

SEQ ID NO: 480114 - protein, 11 aa, Mycobacterium
GCDRTTARIDD

SEQ ID NO: 480115 - protein, 4 aa, Mycobacterium
GCED

SEQ ID NO: 480116 - protein, 5 aa, Mycobacterium
GCEGA

SEQ ID NO: 480117 - protein, 12 aa, Mycobacterium
GCEGAGDLAGGD

SEQ ID NO: 480118 - protein, 7 aa, Mycobacterium
GCEPEAR

SEQ ID NO: 480119 - protein, 17 aa, Mycobacterium
GCESVNSRPHGLTVVPT

SEQ ID NO: 480120 - protein, 5 aa, Mycobacterium
GCGAT

SEQ ID NO: 480121 - protein, 20 aa, Mycobacterium
GCGDSKPHASNPATDMAHNT

SEQ ID NO: 480122 - protein, 7 aa, Mycobacterium
GCGEGGD

SEQ ID NO: 480123 - protein, 11 aa, Mycobacterium
GCGETDSDDPV

SEQ ID NO: 480124 - protein, 4 aa, Mycobacterium
GCGG

SEQ ID NO: 480125 - protein, 5 aa, Mycobacterium
GCGGH

SEQ ID NO: 480126 - protein, 9 aa, Mycobacterium
GCGGKDAQE

SEQ ID NO: 480127 - protein, 9 aa, Mycobacterium
GCGGMGGAQ

SEQ ID NO: 480128 - protein, 11 aa, Mycobacterium
GCGGPAAPDIS

SEQ ID NO: 480129 - protein, 10 aa, Mycobacterium
GCGGSSATAY

SEQ ID NO: 480130 - protein, 4 aa, Mycobacterium
GCGL

SEQ ID NO: 480131 - protein, 7 aa, Mycobacterium
GCGNTDS

SEQ ID NO: 480132 - protein, 11 aa, Mycobacterium
GCGPEADSECL

SEQ ID NO: 480133 - protein, 10 aa, Mycobacterium
GCGPGGAPFG

SEQ ID NO: 480134 - protein, 8 aa, Mycobacterium
GCGQWPGE

SEQ ID NO: 480135 - protein, 6 aa, Mycobacterium
GCGSGA

SEQ ID NO: 480136 - protein, 5 aa, Mycobacterium
GCHPE

SEQ ID NO: 480137 - protein, 5 aa, Mycobacterium
GCKPG

SEQ ID NO: 480138 - protein, 15 aa, Mycobacterium
GCMGPNGEDIEQEAE

SEQ ID NO: 480139 - protein, 9 aa, Mycobacterium
GCPAASSTL

SEQ ID NO: 480140 - protein, 12 aa, Mycobacterium
GCPADTSAEEGV

SEQ ID NO: 480141 - protein, 6 aa, Mycobacterium
GCPAGE

SEQ ID NO: 480142 - protein, 7 aa, Mycobacterium
GCPAGEN

SEQ ID NO: 480143 - protein, 6 aa, Mycobacterium
GCPDHQ

SEQ ID NO: 480144 - protein, 6 aa, Mycobacterium
GCPESS

SEQ ID NO: 480145 - protein, 19 aa, Mycobacterium
GCPEYAKQNPSGPGSVAGM

SEQ ID NO: 480146 - protein, 6 aa, Mycobacterium
GCPFDP

SEQ ID NO: 480147 - protein, 5 aa, Mycobacterium
GCPGE

SEQ ID NO: 480148 - protein, 5 aa, Mycobacterium
GCPGT

SEQ ID NO: 480149 - protein, 8 aa, Mycobacterium
GCPPDSDR

SEQ ID NO: 480150 - protein, 6 aa, Mycobacterium
GCPPES

SEQ ID NO: 480151 - protein, 7 aa, Mycobacterium
GCPPSPD

SEQ ID NO: 480152 - protein, 7 aa, Mycobacterium
GCPPTPA

SEQ ID NO: 480153 - protein, 7 aa, Mycobacterium
GCPPTPD

SEQ ID NO: 480154 - protein, 4 aa, Mycobacterium
GCPV

SEQ ID NO: 480155 - protein, 8 aa, Mycobacterium
GCQNTVQS

SEQ ID NO: 480156 - protein, 4 aa, Mycobacterium
GCQS

SEQ ID NO: 480157 - protein, 6 aa, Mycobacterium
GCQTGG

SEQ ID NO: 480158 - protein, 13 aa, Mycobacterium
GCRDNARDDEPYR

SEQ ID NO: 480159 - protein, 9 aa, Mycobacterium
GCRNGDCGT

SEQ ID NO: 480160 - protein, 11 aa, Mycobacterium
GCRNSATVAQT

SEQ ID NO: 480161 - protein, 7 aa, Mycobacterium
GCRPEDP

SEQ ID NO: 480162 - protein, 11 aa, Mycobacterium
GCRPNPGPGGW

SEQ ID NO: 480163 - protein, 7 aa, Mycobacterium
GCRTRPG

SEQ ID NO: 480164 - protein, 13 aa, Mycobacterium
GCRYTNRNNAYTN

SEQ ID NO: 480165 - protein, 8 aa, Mycobacterium
GCSASGDW

SEQ ID NO: 480166 - protein, 9 aa, Mycobacterium
GCSEDADGV

SEQ ID NO: 480167 - protein, 4 aa, Mycobacterium
GCSG

SEQ ID NO: 480168 - protein, 9 aa, Mycobacterium
GCSGSREGL

SEQ ID NO: 480169 - protein, 8 aa, Mycobacterium
GCSPDDPV

SEQ ID NO: 480170 - protein, 8 aa, Mycobacterium
GCSPTDAV

SEQ ID NO: 480171 - protein, 13 aa, Mycobacterium
GCSRPRPSGASTC

SEQ ID NO: 480172 - protein, 4 aa, Mycobacterium
GCSS

SEQ ID NO: 480173 - protein, 7 aa, Mycobacterium
GCSSKSA

SEQ ID NO: 480174 - protein, 8 aa, Mycobacterium
GCSSPVTS

SEQ ID NO: 480175 - protein, 8 aa, Mycobacterium
GCSWDNNN

SEQ ID NO: 480176 - protein, 4 aa, Mycobacterium
GCTA

SEQ ID NO: 480177 - protein, 33 aa, Mycobacterium
GCTATAGPEAKGVRATPVEPATATAAAVATVAP

SEQ ID NO: 480178 - protein, 5 aa, Mycobacterium
GCTHP

SEQ ID NO: 480179 - protein, 4 aa, Mycobacterium
GCTP

SEQ ID NO: 480180 - protein, 6 aa, Mycobacterium
GCTPSA

SEQ ID NO: 480181 - protein, 6 aa, Mycobacterium
GCTSAD

SEQ ID NO: 480182 - protein, 4 aa, Mycobacterium
GCTT

SEQ ID NO: 480183 - protein, 7 aa, Mycobacterium
GCTTTTD

SEQ ID NO: 480184 - protein, 10 aa, Mycobacterium
GDAAAAAQGW

SEQ ID NO: 480185 - protein, 8 aa, Mycobacterium
GDAAAAGA

SEQ ID NO: 480186 - protein, 7 aa, Mycobacterium
GDAAADA

SEQ ID NO: 480187 - protein, 7 aa, Mycobacterium
GDAAADG

SEQ ID NO: 480188 - protein, 7 aa, Mycobacterium
GDAAADR

SEQ ID NO: 480189 - protein, 6 aa, Mycobacterium
GDAAAE

SEQ ID NO: 480190 - protein, 13 aa, Mycobacterium
GDAAAGQGSSSME

SEQ ID NO: 480191 - protein, 7 aa, Mycobacterium
GDAAAKI

SEQ ID NO: 480192 - protein, 10 aa, Mycobacterium
GDAAAPSGKA

SEQ ID NO: 480193 - protein, 10 aa, Mycobacterium
GDAAAPSGQP

SEQ ID NO: 480194 - protein, 6 aa, Mycobacterium
GDAAAQ

SEQ ID NO: 480195 - protein, 6 aa, Mycobacterium
GDAAAR

SEQ ID NO: 480196 - protein, 5 aa, Mycobacterium
GDAAD

SEQ ID NO: 480197 - protein, 9 aa, Mycobacterium
GDAADAALA

SEQ ID NO: 480198 - protein, 6 aa, Mycobacterium
GDAADV

SEQ ID NO: 480199 - protein, 17 aa, Mycobacterium
GDAAEEIARRSRGTPRI

SEQ ID NO: 480200 - protein, 8 aa, Mycobacterium
GDAAEPAY

SEQ ID NO: 480201 - protein, 8 aa, Mycobacterium
GDAAETAV

SEQ ID NO: 480202 - protein, 8 aa, Mycobacterium
GDAAETVQ

SEQ ID NO: 480203 - protein, 8 aa, Mycobacterium
GDAAFAAG

SEQ ID NO: 480204 - protein, 12 aa, Mycobacterium
GDAAGDDYTDDV

SEQ ID NO: 480205 - protein, 11 aa, Mycobacterium
GDAAGEAKAHT

SEQ ID NO: 480206 - protein, 9 aa, Mycobacterium
GDAAGYAVN

SEQ ID NO: 480207 - protein, 6 aa, Mycobacterium
GDAAIG

SEQ ID NO: 480208 - protein, 11 aa, Mycobacterium
GDAAKAGSADV

SEQ ID NO: 480209 - protein, 6 aa, Mycobacterium
GDAAKL

SEQ ID NO: 480210 - protein, 7 aa, Mycobacterium
GDAAKQA

SEQ ID NO: 480211 - protein, 8 aa, Mycobacterium
GDAALTRR

SEQ ID NO: 480212 - protein, 10 aa, Mycobacterium
GDAANASAAA

SEQ ID NO: 480213 - protein, 5 aa, Mycobacterium
GDAAP

SEQ ID NO: 480214 - protein, 16 aa, Mycobacterium
GDAAPASRPLIIDRIA

SEQ ID NO: 480215 - protein, 9 aa, Mycobacterium
GDAAPGGRT

SEQ ID NO: 480216 - protein, 9 aa, Mycobacterium
GDAAPGTLV

SEQ ID NO: 480217 - protein, 10 aa, Mycobacterium
GDAAPHDPEG

SEQ ID NO: 480218 - protein, 7 aa, Mycobacterium
GDAAPIT

SEQ ID NO: 480219 - protein, 12 aa, Mycobacterium
GDAAQPPSATDL

SEQ ID NO: 480220 - protein, 7 aa, Mycobacterium
GDAARER

SEQ ID NO: 480221 - protein, 11 aa, Mycobacterium
GDAAREVAEPL

SEQ ID NO: 480222 - protein, 8 aa, Mycobacterium
GDAARPGA

SEQ ID NO: 480223 - protein, 9 aa, Mycobacterium
GDAARRDAD

SEQ ID NO: 480224 - protein, 8 aa, Mycobacterium
GDAARTDP

SEQ ID NO: 480225 - protein, 6 aa, Mycobacterium
GDAARY

SEQ ID NO: 480226 - protein, 10 aa, Mycobacterium
GDAASAASDV

SEQ ID NO: 480227 - protein, 10 aa, Mycobacterium
GDAASGTLVT

SEQ ID NO: 480228 - protein, 9 aa, Mycobacterium
GDAASPSGV

SEQ ID NO: 480229 - protein, 20 aa, Mycobacterium
GDAASSYVAQDAAAASTYTG

SEQ ID NO: 480230 - protein, 13 aa, Mycobacterium
GDAATACEASMDQ

SEQ ID NO: 480231 - protein, 8 aa, Mycobacterium
GDAATGTQ

SEQ ID NO: 480232 - protein, 13 aa, Mycobacterium
GDAAVDDRTPEQT

SEQ ID NO: 480233 - protein, 9 aa, Mycobacterium
GDAAVEANE

SEQ ID NO: 480234 - protein, 6 aa, Mycobacterium
GDAAYR

SEQ ID NO: 480235 - protein, 9 aa, Mycobacterium
GDADAGAAT

SEQ ID NO: 480236 - protein, 5 aa, Mycobacterium
GDADD

SEQ ID NO: 480237 - protein, 9 aa, Mycobacterium
GDADDATLQ

SEQ ID NO: 480238 - protein, 6 aa, Mycobacterium
GDADDG

SEQ ID NO: 480239 - protein, 10 aa, Mycobacterium
GDADDSAADA

SEQ ID NO: 480240 - protein, 17 aa, Mycobacterium
GDADDVGDTMAAGDESA

SEQ ID NO: 480241 - protein, 5 aa, Mycobacterium
GDADE

SEQ ID NO: 480242 - protein, 8 aa, Mycobacterium
GDADEATL

SEQ ID NO: 480243 - protein, 6 aa, Mycobacterium
GDADED

SEQ ID NO: 480244 - protein, 5 aa, Mycobacterium
GDADG

SEQ ID NO: 480245 - protein, 8 aa, Mycobacterium
GDADGTVS

SEQ ID NO: 480246 - protein, 10 aa, Mycobacterium
GDADGVQRKT

SEQ ID NO: 480247 - protein, 17 aa, Mycobacterium
GDADKRQVASASQKTGV

SEQ ID NO: 480248 - protein, 6 aa, Mycobacterium
GDADNE

SEQ ID NO: 480249 - protein, 5 aa, Mycobacterium
GDADP

SEQ ID NO: 480250 - protein, 20 aa, Mycobacterium
GDADPDVAVPARREDLSGLP

SEQ ID NO: 480251 - protein, 7 aa, Mycobacterium
GDADPQT

SEQ ID NO: 480252 - protein, 16 aa, Mycobacterium
GDADRDIAVPGRRTDV

SEQ ID NO: 480253 - protein, 7 aa, Mycobacterium
GDADRDV

SEQ ID NO: 480254 - protein, 6 aa, Mycobacterium
GDADSE

SEQ ID NO: 480255 - protein, 9 aa, Mycobacterium
GDADTAAQT

SEQ ID NO: 480256 - protein, 15 aa, Mycobacterium
GDADVDVSPAERTGT

SEQ ID NO: 480257 - protein, 4 aa, Mycobacterium
GDAE

SEQ ID NO: 480258 - protein, 9 aa, Mycobacterium
GDAEAARAA

SEQ ID NO: 480259 - protein, 9 aa, Mycobacterium
GDAEAATLP

SEQ ID NO: 480260 - protein, 7 aa, Mycobacterium
GDAEAEH

SEQ ID NO: 480261 - protein, 9 aa, Mycobacterium
GDAEASEAL

SEQ ID NO: 480262 - protein, 11 aa, Mycobacterium
GDAEASGATGN

SEQ ID NO: 480263 - protein, 22 aa, Mycobacterium
GDAEATAPAAWQQAGRGRPAKR

SEQ ID NO: 480264 - protein, 7 aa, Mycobacterium
GDAEDAV

SEQ ID NO: 480265 - protein, 16 aa, Mycobacterium
GDAEDVGDTMAAGDER

SEQ ID NO: 480266 - protein, 14 aa, Mycobacterium
GDAEEAGGKGANMG

SEQ ID NO: 480267 - protein, 20 aa, Mycobacterium
GDAEGGPDRPVLDWRFRALQ

SEQ ID NO: 480268 - protein, 10 aa, Mycobacterium
GDAEKASAMR

SEQ ID NO: 480269 - protein, 7 aa, Mycobacterium
GDAEPAL

SEQ ID NO: 480270 - protein, 7 aa, Mycobacterium
GDAEPDI

SEQ ID NO: 480271 - protein, 7 aa, Mycobacterium
GDAEPEF

SEQ ID NO: 480272 - protein, 6 aa, Mycobacterium
GDAEPR

SEQ ID NO: 480273 - protein, 17 aa, Mycobacterium
GDAEPRLSRADPAGAGL

SEQ ID NO: 480274 - protein, 6 aa, Mycobacterium
GDAERI

SEQ ID NO: 480275 - protein, 8 aa, Mycobacterium
GDAERTAV

SEQ ID NO: 480276 - protein, 10 aa, Mycobacterium
GDAESEADVD

SEQ ID NO: 480277 - protein, 7 aa, Mycobacterium
GDAESEF

SEQ ID NO: 480278 - protein, 8 aa, Mycobacterium
GDAESVPA

SEQ ID NO: 480279 - protein, 7 aa, Mycobacterium
GDAETVS

SEQ ID NO: 480280 - protein, 7 aa, Mycobacterium
GDAFGTS

SEQ ID NO: 480281 - protein, 4 aa, Mycobacterium
GDAG

SEQ ID NO: 480282 - protein, 5 aa, Mycobacterium
GDAGA

SEQ ID NO: 480283 - protein, 14 aa, Mycobacterium
GDAGAGGGGGTGLV

SEQ ID NO: 480284 - protein, 14 aa, Mycobacterium
GDAGAGGQGGASVA

SEQ ID NO: 480285 - protein, 8 aa, Mycobacterium
GDAGALER

SEQ ID NO: 480286 - protein, 10 aa, Mycobacterium
GDAGAPSSPY

SEQ ID NO: 480287 - protein, 7 aa, Mycobacterium
GDAGAVA

SEQ ID NO: 480288 - protein, 45 aa, Mycobacterium
GDAGDGGDAGTGGEGGDGGTGGSGAMSGQTGDQGAGGTPGTAGAS

SEQ ID NO: 480289 - protein, 7 aa, Mycobacterium
GDAGDVA

SEQ ID NO: 480290 - protein, 5 aa, Mycobacterium
GDAGE

SEQ ID NO: 480291 - protein, 7 aa, Mycobacterium
GDAGEGR

SEQ ID NO: 480292 - protein, 12 aa, Mycobacterium
GDAGERDGRGWE

SEQ ID NO: 480293 - protein, 13 aa, Mycobacterium
GDAGERQVARRPE

SEQ ID NO: 480294 - protein, 15 aa, Mycobacterium
GDAGGAVARDRRDGF

SEQ ID NO: 480295 - protein, 7 aa, Mycobacterium
GDAGLTG

SEQ ID NO: 480296 - protein, 15 aa, Mycobacterium
GDAGNDLREDLPEDV

SEQ ID NO: 480297 - protein, 7 aa, Mycobacterium
GDAGPFA

SEQ ID NO: 480298 - protein, 18 aa, Mycobacterium
GDAGPTNGTGGNGGNGGN

SEQ ID NO: 480299 - protein, 5 aa, Mycobacterium
GDAGQ

SEQ ID NO: 480300 - protein, 12 aa, Mycobacterium
GDAGQRQVPRRP

SEQ ID NO: 480301 - protein, 5 aa, Mycobacterium
GDAGR

SEQ ID NO: 480302 - protein, 8 aa, Mycobacterium
GDAGRMDD

SEQ ID NO: 480303 - protein, 10 aa, Mycobacterium
GDAGRTMSER

SEQ ID NO: 480304 - protein, 10 aa, Mycobacterium
GDAGSEGSEF

SEQ ID NO: 480305 - protein, 6 aa, Mycobacterium
GDAGSM

SEQ ID NO: 480306 - protein, 6 aa, Mycobacterium
GDAGTL

SEQ ID NO: 480307 - protein, 7 aa, Mycobacterium
GDAGTLE

SEQ ID NO: 480308 - protein, 10 aa, Mycobacterium
GDAGTSSRAR

SEQ ID NO: 480309 - protein, 7 aa, Mycobacterium
GDAGYLD

SEQ ID NO: 480310 - protein, 18 aa, Mycobacterium
GDAIADTNTVATGAGGRA

SEQ ID NO: 480311 - protein, 7 aa, Mycobacterium
GDAIAEG

SEQ ID NO: 480312 - protein, 66 aa, Mycobacterium
GDAIDSVGGIGGKGGGGADGGGGGASSTSTGGAPGGVGGDGDDGDPPTGQTGGGGGTGGGGGAPGV

SEQ ID NO: 480313 - protein, 6 aa, Mycobacterium
GDAKER

SEQ ID NO: 480314 - protein, 8 aa, Mycobacterium
GDAKGITP

SEQ ID NO: 480315 - protein, 8 aa, Mycobacterium
GDAKPGNF

SEQ ID NO: 480316 - protein, 5 aa, Mycobacterium
GDALP

SEQ ID NO: 480317 - protein, 7 aa, Mycobacterium
GDAMPNA

SEQ ID NO: 480318 - protein, 8 aa, Mycobacterium
GDANAAGA

SEQ ID NO: 480319 - protein, 6 aa, Mycobacterium
GDANEP

SEQ ID NO: 480320 - protein, 33 aa, Mycobacterium
GDANLGSGNLGNANFGNGNLGDTNLGSGNNGFS

SEQ ID NO: 480321 - protein, 21 aa, Mycobacterium
GDANLSGHTYPDQSLYPANSV

SEQ ID NO: 480322 - protein, 5 aa, Mycobacterium
GDANM

SEQ ID NO: 480323 - protein, 8 aa, Mycobacterium
GDANPQEF

SEQ ID NO: 480324 - protein, 8 aa, Mycobacterium
GDANPYGA

SEQ ID NO: 480325 - protein, 9 aa, Mycobacterium
GDANTDDEL

SEQ ID NO: 480326 - protein, 7 aa, Mycobacterium
GDAPAAD

SEQ ID NO: 480327 - protein, 7 aa, Mycobacterium
GDAPAAL

SEQ ID NO: 480328 - protein, 16 aa, Mycobacterium
GDAPAGGAQRDDVAGA

SEQ ID NO: 480329 - protein, 14 aa, Mycobacterium
GDAPAHLVNPEVLG

SEQ ID NO: 480330 - protein, 6 aa, Mycobacterium
GDAPAR

SEQ ID NO: 480331 - protein, 5 aa, Mycobacterium
GDAPD

SEQ ID NO: 480332 - protein, 7 aa, Mycobacterium
GDAPDEA

SEQ ID NO: 480333 - protein, 9 aa, Mycobacterium
GDAPDEGQG

SEQ ID NO: 480334 - protein, 13 aa, Mycobacterium
GDAPEDSIDPLSP

SEQ ID NO: 480335 - protein, 7 aa, Mycobacterium
GDAPEPW

SEQ ID NO: 480336 - protein, 6 aa, Mycobacterium
GDAPFP

SEQ ID NO: 480337 - protein, 8 aa, Mycobacterium
GDAPGGAL

SEQ ID NO: 480338 - protein, 8 aa, Mycobacterium
GDAPGGIA

SEQ ID NO: 480339 - protein, 7 aa, Mycobacterium
GDAPGHL

SEQ ID NO: 480340 - protein, 8 aa, Mycobacterium
GDAPGVDR

SEQ ID NO: 480341 - protein, 9 aa, Mycobacterium
GDAPIPANS

SEQ ID NO: 480342 - protein, 7 aa, Mycobacterium
GDAPLGD

SEQ ID NO: 480343 - protein, 16 aa, Mycobacterium
GDAPLPEQSKNTKASW

SEQ ID NO: 480344 - protein, 8 aa, Mycobacterium
GDAPPDGF

SEQ ID NO: 480345 - protein, 13 aa, Mycobacterium
GDAPPDMTDSSDA

SEQ ID NO: 480346 - protein, 13 aa, Mycobacterium
GDAPPDPVQPPDD

SEQ ID NO: 480347 - protein, 13 aa, Mycobacterium
GDAPPEPGYVPSQ

SEQ ID NO: 480348 - protein, 7 aa, Mycobacterium
GDAPPFG

SEQ ID NO: 480349 - protein, 14 aa, Mycobacterium
GDAPPFGFSSSPET

SEQ ID NO: 480350 - protein, 7 aa, Mycobacterium
GDAPREQ

SEQ ID NO: 480351 - protein, 13 aa, Mycobacterium
GDAPTGSQAWTQR

SEQ ID NO: 480352 - protein, 10 aa, Mycobacterium
GDAPVAEEDG

SEQ ID NO: 480353 - protein, 6 aa, Mycobacterium
GDAPVG

SEQ ID NO: 480354 - protein, 8 aa, Mycobacterium
GDAPVKNY

SEQ ID NO: 480355 - protein, 22 aa, Mycobacterium
GDAQANAAAAWQQEGRGRPAKR

SEQ ID NO: 480356 - protein, 7 aa, Mycobacterium
GDAQEGM

SEQ ID NO: 480357 - protein, 6 aa, Mycobacterium
GDAQEP

SEQ ID NO: 480358 - protein, 9 aa, Mycobacterium
GDAQGANER

SEQ ID NO: 480359 - protein, 14 aa, Mycobacterium
GDAQPRYSAARRGA

SEQ ID NO: 480360 - protein, 8 aa, Mycobacterium
GDAQQPDV

SEQ ID NO: 480361 - protein, 7 aa, Mycobacterium
GDAQQTI

SEQ ID NO: 480362 - protein, 6 aa, Mycobacterium
GDAQSL

SEQ ID NO: 480363 - protein, 7 aa, Mycobacterium
GDARAPA

SEQ ID NO: 480364 - protein, 6 aa, Mycobacterium
GDARGA

SEQ ID NO: 480365 - protein, 7 aa, Mycobacterium
GDARPIP

SEQ ID NO: 480366 - protein, 6 aa, Mycobacterium
GDARPL

SEQ ID NO: 480367 - protein, 10 aa, Mycobacterium
GDARRARDGV

SEQ ID NO: 480368 - protein, 8 aa, Mycobacterium
GDARSPSV

SEQ ID NO: 480369 - protein, 8 aa, Mycobacterium
GDARTAVG

SEQ ID NO: 480370 - protein, 17 aa, Mycobacterium
GDARVPRSHVSPDGGPL

SEQ ID NO: 480371 - protein, 5 aa, Mycobacterium
GDASA

SEQ ID NO: 480372 - protein, 7 aa, Mycobacterium
GDASAAL

SEQ ID NO: 480373 - protein, 9 aa, Mycobacterium
GDASAGGGA

SEQ ID NO: 480374 - protein, 9 aa, Mycobacterium
GDASAPITR

SEQ ID NO: 480375 - protein, 8 aa, Mycobacterium
GDASAPLN

SEQ ID NO: 480376 - protein, 7 aa, Mycobacterium
GDASAPT

SEQ ID NO: 480377 - protein, 8 aa, Mycobacterium
GDASATHR

SEQ ID NO: 480378 - protein, 11 aa, Mycobacterium
GDASAWAGVGT

SEQ ID NO: 480379 - protein, 5 aa, Mycobacterium
GDASG

SEQ ID NO: 480380 - protein, 15 aa, Mycobacterium
GDASGAAGATGGGRV

SEQ ID NO: 480381 - protein, 7 aa, Mycobacterium
GDASGHN

SEQ ID NO: 480382 - protein, 9 aa, Mycobacterium
GDASGLDAG

SEQ ID NO: 480383 - protein, 8 aa, Mycobacterium
GDASGPYE

SEQ ID NO: 480384 - protein, 10 aa, Mycobacterium
GDASLPDEAV

SEQ ID NO: 480385 - protein, 8 aa, Mycobacterium
GDASPTEL

SEQ ID NO: 480386 - protein, 9 aa, Mycobacterium
GDASSVSAG

SEQ ID NO: 480387 - protein, 16 aa, Mycobacterium
GDASSYSPVDSPVALA

SEQ ID NO: 480388 - protein, 7 aa, Mycobacterium
GDASTYS

SEQ ID NO: 480389 - protein, 4 aa, Mycobacterium
GDAT

SEQ ID NO: 480390 - protein, 10 aa, Mycobacterium
GDATDDGTLT

SEQ ID NO: 480391 - protein, 18 aa, Mycobacterium
GDATDPRPPRRRDPAQRR

SEQ ID NO: 480392 - protein, 5 aa, Mycobacterium
GDATE

SEQ ID NO: 480393 - protein, 23 aa, Mycobacterium
GDATERAASRRRTQEFLSSLCPA

SEQ ID NO: 480394 - protein, 5 aa, Mycobacterium
GDATK

SEQ ID NO: 480395 - protein, 10 aa, Mycobacterium
GDATKAAQSL

SEQ ID NO: 480396 - protein, 15 aa, Mycobacterium
GDATNSNLEYGGPGL

SEQ ID NO: 480397 - protein, 9 aa, Mycobacterium
GDATPGTLV

SEQ ID NO: 480398 - protein, 8 aa, Mycobacterium
GDATPPSL

SEQ ID NO: 480399 - protein, 5 aa, Mycobacterium
GDATR

SEQ ID NO: 480400 - protein, 9 aa, Mycobacterium
GDATRAAQS

SEQ ID NO: 480401 - protein, 13 aa, Mycobacterium
GDATRQTDHPERY

SEQ ID NO: 480402 - protein, 7 aa, Mycobacterium
GDATSAL

SEQ ID NO: 480403 - protein, 7 aa, Mycobacterium
GDATTGA

SEQ ID NO: 480404 - protein, 14 aa, Mycobacterium
GDATTRAANERAVT

SEQ ID NO: 480405 - protein, 8 aa, Mycobacterium
GDATTRRV

SEQ ID NO: 480406 - protein, 4 aa, Mycobacterium
GDAV

SEQ ID NO: 480407 - protein, 6 aa, Mycobacterium
GDAVAG

SEQ ID NO: 480408 - protein, 9 aa, Mycobacterium
GDAVDPATG

SEQ ID NO: 480409 - protein, 7 aa, Mycobacterium
GDAVEQA

SEQ ID NO: 480410 - protein, 9 aa, Mycobacterium
GDAVGGRVR

SEQ ID NO: 480411 - protein, 36 aa, Mycobacterium
GDAVGHRGAHPTHSSASAGSAVAEQPGGAAGAAHPG

SEQ ID NO: 480412 - protein, 6 aa, Mycobacterium
GDAVPA

SEQ ID NO: 480413 - protein, 9 aa, Mycobacterium
GDAVSAGPE

SEQ ID NO: 480414 - protein, 9 aa, Mycobacterium
GDAVTASYD

SEQ ID NO: 480415 - protein, 8 aa, Mycobacterium
GDAVTGAT

SEQ ID NO: 480416 - protein, 5 aa, Mycobacterium
GDAYT

SEQ ID NO: 480417 - protein, 16 aa, Mycobacterium
GDAYYDPDPMAPGRMP

SEQ ID NO: 480418 - protein, 15 aa, Mycobacterium
GDCAPSAADIDAVLT

SEQ ID NO: 480419 - protein, 9 aa, Mycobacterium
GDCESWGTD

SEQ ID NO: 480420 - protein, 13 aa, Mycobacterium
GDCGPDSPMARST

SEQ ID NO: 480421 - protein, 7 aa, Mycobacterium
GDCGQKS

SEQ ID NO: 480422 - protein, 8 aa, Mycobacterium
GDCGQKSN

SEQ ID NO: 480423 - protein, 10 aa, Mycobacterium
GDCGSGFGTG

SEQ ID NO: 480424 - protein, 8 aa, Mycobacterium
GDCRETSD

SEQ ID NO: 480425 - protein, 5 aa, Mycobacterium
GDCRT

SEQ ID NO: 480426 - protein, 4 aa, Mycobacterium
GDCY

SEQ ID NO: 480427 - protein, 8 aa, Mycobacterium
GDDAAADQ

SEQ ID NO: 480428 - protein, 9 aa, Mycobacterium
GDDAAAESL

SEQ ID NO: 480429 - protein, 6 aa, Mycobacterium
GDDAAE

SEQ ID NO: 480430 - protein, 17 aa, Mycobacterium
GDDAAPAGLREPGSPLA

SEQ ID NO: 480431 - protein, 9 aa, Mycobacterium
GDDAAVGTA

SEQ ID NO: 480432 - protein, 7 aa, Mycobacterium
GDDAEEA

SEQ ID NO: 480433 - protein, 9 aa, Mycobacterium
GDDAEIADG

SEQ ID NO: 480434 - protein, 7 aa, Mycobacterium
GDDAFTE

SEQ ID NO: 480435 - protein, 19 aa, Mycobacterium
GDDAGKKTEKAGGKSASAL

SEQ ID NO: 480436 - protein, 5 aa, Mycobacterium
GDDAP

SEQ ID NO: 480437 - protein, 9 aa, Mycobacterium
GDDAPQSLI

SEQ ID NO: 480438 - protein, 8 aa, Mycobacterium
GDDARLRA

SEQ ID NO: 480439 - protein, 7 aa, Mycobacterium
GDDARVT

SEQ ID NO: 480440 - protein, 10 aa, Mycobacterium
GDDASDGRLA

SEQ ID NO: 480441 - protein, 5 aa, Mycobacterium
GDDAT

SEQ ID NO: 480442 - protein, 8 aa, Mycobacterium
GDDATTRQ

SEQ ID NO: 480443 - protein, 5 aa, Mycobacterium
GDDAV

SEQ ID NO: 480444 - protein, 5 aa, Mycobacterium
GDDDA

SEQ ID NO: 480445 - protein, 9 aa, Mycobacterium
GDDDAGTSI

SEQ ID NO: 480446 - protein, 13 aa, Mycobacterium
GDDDALSARAPRY

SEQ ID NO: 480447 - protein, 6 aa, Mycobacterium
GDDDAS

SEQ ID NO: 480448 - protein, 10 aa, Mycobacterium
GDDDASTCGA

SEQ ID NO: 480449 - protein, 5 aa, Mycobacterium
GDDDD

SEQ ID NO: 480450 - protein, 12 aa, Mycobacterium
GDDDDQSSSPLQ

SEQ ID NO: 480451 - protein, 27 aa, Mycobacterium
GDDDDVTDLGGPAGQERREKLAEDTDD

SEQ ID NO: 480452 - protein, 7 aa, Mycobacterium
GDDDELG

SEQ ID NO: 480453 - protein, 7 aa, Mycobacterium
GDDDEVG

SEQ ID NO: 480454 - protein, 7 aa, Mycobacterium
GDDDGGE

SEQ ID NO: 480455 - protein, 9 aa, Mycobacterium
GDDDPDKFD

SEQ ID NO: 480456 - protein, 13 aa, Mycobacterium
GDDDPPDEVSSEE

SEQ ID NO: 480457 - protein, 15 aa, Mycobacterium
GDDDREARTTELPDG

SEQ ID NO: 480458 - protein, 5 aa, Mycobacterium
GDDDS

SEQ ID NO: 480459 - protein, 8 aa, Mycobacterium
GDDEALSE

SEQ ID NO: 480460 - protein, 31 aa, Mycobacterium
GDDEAQAFNSDRDPSRQQPIHDQDSEHDSVR

SEQ ID NO: 480461 - protein, 7 aa, Mycobacterium
GDDEATL

SEQ ID NO: 480462 - protein, 8 aa, Mycobacterium
GDDEGHLS

SEQ ID NO: 480463 - protein, 8 aa, Mycobacterium
GDDEGRGF

SEQ ID NO: 480464 - protein, 11 aa, Mycobacterium
GDDEHSEIPAE

SEQ ID NO: 480465 - protein, 5 aa, Mycobacterium
GDDEI

SEQ ID NO: 480466 - protein, 10 aa, Mycobacterium
GDDELADGRT

SEQ ID NO: 480467 - protein, 7 aa, Mycobacterium
GDDELEA

SEQ ID NO: 480468 - protein, 9 aa, Mycobacterium
GDDEPEPAV

SEQ ID NO: 480469 - protein, 5 aa, Mycobacterium
GDDEQ

SEQ ID NO: 480470 - protein, 8 aa, Mycobacterium
GDDERNAQ

SEQ ID NO: 480471 - protein, 10 aa, Mycobacterium
GDDERVRRTR

SEQ ID NO: 480472 - protein, 13 aa, Mycobacterium
GDDFEKGSDNGVN

SEQ ID NO: 480473 - protein, 6 aa, Mycobacterium
GDDGAA

SEQ ID NO: 480474 - protein, 6 aa, Mycobacterium
GDDGAT

SEQ ID NO: 480475 - protein, 6 aa, Mycobacterium
GDDGCT

SEQ ID NO: 480476 - protein, 12 aa, Mycobacterium
GDDGDDGEDGQN

SEQ ID NO: 480477 - protein, 27 aa, Mycobacterium
GDDGDFRDEAADQAKAGAAPKAPRLPW

SEQ ID NO: 480478 - protein, 5 aa, Mycobacterium
GDDGE

SEQ ID NO: 480479 - protein, 6 aa, Mycobacterium
GDDGEH

SEQ ID NO: 480480 - protein, 10 aa, Mycobacterium
GDDGERQAAE

SEQ ID NO: 480481 - protein, 21 aa, Mycobacterium
GDDGERTPQRANLNDSLTPDE

SEQ ID NO: 480482 - protein, 8 aa, Mycobacterium
GDDGETFQ

SEQ ID NO: 480483 - protein, 8 aa, Mycobacterium
GDDGEVET

SEQ ID NO: 480484 - protein, 17 aa, Mycobacterium
GDDGEYVSARQAADRAG

SEQ ID NO: 480485 - protein, 8 aa, Mycobacterium
GDDGGGEL

SEQ ID NO: 480486 - protein, 6 aa, Mycobacterium
GDDGGL

SEQ ID NO: 480487 - protein, 7 aa, Mycobacterium
GDDGNFR

SEQ ID NO: 480488 - protein, 9 aa, Mycobacterium
GDDGNGATV

SEQ ID NO: 480489 - protein, 5 aa, Mycobacterium
GDDGP

SEQ ID NO: 480490 - protein, 18 aa, Mycobacterium
GDDGQKIEDVNSGVEAVN

SEQ ID NO: 480491 - protein, 7 aa, Mycobacterium
GDDGQPM

SEQ ID NO: 480492 - protein, 9 aa, Mycobacterium
GDDGQQIED

SEQ ID NO: 480493 - protein, 10 aa, Mycobacterium
GDDGQQIEDV

SEQ ID NO: 480494 - protein, 13 aa, Mycobacterium
GDDGQSIDDVRSG

SEQ ID NO: 480495 - protein, 6 aa, Mycobacterium
GDDGRI

SEQ ID NO: 480496 - protein, 9 aa, Mycobacterium
GDDGRILSP

SEQ ID NO: 480497 - protein, 9 aa, Mycobacterium
GDDGRTLPW

SEQ ID NO: 480498 - protein, 11 aa, Mycobacterium
GDDGSADETVG

SEQ ID NO: 480499 - protein, 12 aa, Mycobacterium
GDDGSLTAAGRE

SEQ ID NO: 480500 - protein, 5 aa, Mycobacterium
GDDGV

SEQ ID NO: 480501 - protein, 6 aa, Mycobacterium
GDDGVG

SEQ ID NO: 480502 - protein, 7 aa, Mycobacterium
GDDGVGS

SEQ ID NO: 480503 - protein, 6 aa, Mycobacterium
GDDGVT

SEQ ID NO: 480504 - protein, 10 aa, Mycobacterium
GDDGYEAARR

SEQ ID NO: 480505 - protein, 4 aa, Mycobacterium
GDDH

SEQ ID NO: 480506 - protein, 18 aa, Mycobacterium
GDDHQPPAAQQRAEDLPH

SEQ ID NO: 480507 - protein, 6 aa, Mycobacterium
GDDHTS

SEQ ID NO: 480508 - protein, 6 aa, Mycobacterium
GDDHYR

SEQ ID NO: 480509 - protein, 8 aa, Mycobacterium
GDDIGEQI

SEQ ID NO: 480510 - protein, 9 aa, Mycobacterium
GDDKPRSVD

SEQ ID NO: 480511 - protein, 4 aa, Mycobacterium
GDDL

SEQ ID NO: 480512 - protein, 26 aa, Mycobacterium
GDDLGTAKTKATNGYSTLSGVNANST

SEQ ID NO: 480513 - protein, 8 aa, Mycobacterium
GDDLPEPL

SEQ ID NO: 480514 - protein, 6 aa, Mycobacterium
GDDMPE

SEQ ID NO: 480515 - protein, 8 aa, Mycobacterium
GDDNDAFT

SEQ ID NO: 480516 - protein, 14 aa, Mycobacterium
GDDNLAEPRAPYPH

SEQ ID NO: 480517 - protein, 15 aa, Mycobacterium
GDDNLAEPRSPYPHA

SEQ ID NO: 480518 - protein, 6 aa, Mycobacterium
GDDNRT

SEQ ID NO: 480519 - protein, 8 aa, Mycobacterium
GDDPAAEQ

SEQ ID NO: 480520 - protein, 8 aa, Mycobacterium
GDDPAAGQ

SEQ ID NO: 480521 - protein, 7 aa, Mycobacterium
GDDPAAY

SEQ ID NO: 480522 - protein, 7 aa, Mycobacterium
GDDPAHL

SEQ ID NO: 480523 - protein, 9 aa, Mycobacterium
GDDPARPEL

SEQ ID NO: 480524 - protein, 9 aa, Mycobacterium
GDDPASRLQ

SEQ ID NO: 480525 - protein, 12 aa, Mycobacterium
GDDPDKKEYSKL

SEQ ID NO: 480526 - protein, 10 aa, Mycobacterium
GDDPENPFNG

SEQ ID NO: 480527 - protein, 8 aa, Mycobacterium
GDDPEVNE

SEQ ID NO: 480528 - protein, 7 aa, Mycobacterium
GDDPFEE

SEQ ID NO: 480529 - protein, 6 aa, Mycobacterium
GDDPFG

SEQ ID NO: 480530 - protein, 17 aa, Mycobacterium
GDDPGAKSSSLPVASER

SEQ ID NO: 480531 - protein, 10 aa, Mycobacterium
GDDPGDPALT

SEQ ID NO: 480532 - protein, 10 aa, Mycobacterium
GDDPGLQERL

SEQ ID NO: 480533 - protein, 9 aa, Mycobacterium
GDDPGSHAY

SEQ ID NO: 480534 - protein, 9 aa, Mycobacterium
GDDPGSQAY

SEQ ID NO: 480535 - protein, 11 aa, Mycobacterium
GDDPGTGIHPA

SEQ ID NO: 480536 - protein, 6 aa, Mycobacterium
GDDPHK

SEQ ID NO: 480537 - protein, 6 aa, Mycobacterium
GDDPIG

SEQ ID NO: 480538 - protein, 5 aa, Mycobacterium
GDDPL

SEQ ID NO: 480539 - protein, 13 aa, Mycobacterium
GDDPLDASGVHPE

SEQ ID NO: 480540 - protein, 14 aa, Mycobacterium
GDDPLDASGVHPES

SEQ ID NO: 480541 - protein, 7 aa, Mycobacterium
GDDPLKR

SEQ ID NO: 480542 - protein, 9 aa, Mycobacterium
GDDPLMGES

SEQ ID NO: 480543 - protein, 6 aa, Mycobacterium
GDDPLY

SEQ ID NO: 480544 - protein, 10 aa, Mycobacterium
GDDPNRYTTA

SEQ ID NO: 480545 - protein, 8 aa, Mycobacterium
GDDPPRVH

SEQ ID NO: 480546 - protein, 17 aa, Mycobacterium
GDDPRIPDGSTDPVSKT

SEQ ID NO: 480547 - protein, 8 aa, Mycobacterium
GDDPRPAA

SEQ ID NO: 480548 - protein, 13 aa, Mycobacterium
GDDPRTAGQRRAD

SEQ ID NO: 480549 - protein, 7 aa, Mycobacterium
GDDPRWK

SEQ ID NO: 480550 - protein, 5 aa, Mycobacterium
GDDPV

SEQ ID NO: 480551 - protein, 7 aa, Mycobacterium
GDDPWPE

SEQ ID NO: 480552 - protein, 5 aa, Mycobacterium
GDDPY

SEQ ID NO: 480553 - protein, 6 aa, Mycobacterium
GDDPYE

SEQ ID NO: 480554 - protein, 6 aa, Mycobacterium
GDDPYR

SEQ ID NO: 480555 - protein, 5 aa, Mycobacterium
GDDQA

SEQ ID NO: 480556 - protein, 9 aa, Mycobacterium
GDDQEDQLR

SEQ ID NO: 480557 - protein, 14 aa, Mycobacterium
GDDQEEADDKAKSM

SEQ ID NO: 480558 - protein, 6 aa, Mycobacterium
GDDQPR

SEQ ID NO: 480559 - protein, 18 aa, Mycobacterium
GDDRDAATLSMQTVVARL

SEQ ID NO: 480560 - protein, 9 aa, Mycobacterium
GDDRDCDHR

SEQ ID NO: 480561 - protein, 7 aa, Mycobacterium
GDDRDDV

SEQ ID NO: 480562 - protein, 9 aa, Mycobacterium
GDDRDRARR

SEQ ID NO: 480563 - protein, 5 aa, Mycobacterium
GDDRE

SEQ ID NO: 480564 - protein, 6 aa, Mycobacterium
GDDRIG

SEQ ID NO: 480565 - protein, 10 aa, Mycobacterium
GDDRIGDVRG

SEQ ID NO: 480566 - protein, 11 aa, Mycobacterium
GDDRIGDVRGR

SEQ ID NO: 480567 - protein, 13 aa, Mycobacterium
GDDRPYRIATPAG

SEQ ID NO: 480568 - protein, 5 aa, Mycobacterium
GDDRT

SEQ ID NO: 480569 - protein, 6 aa, Mycobacterium
GDDRTS

SEQ ID NO: 480570 - protein, 11 aa, Mycobacterium
GDDSAPAARPR

SEQ ID NO: 480571 - protein, 12 aa, Mycobacterium
GDDSAPGGGRPR

SEQ ID NO: 480572 - protein, 6 aa, Mycobacterium
GDDSCA

SEQ ID NO: 480573 - protein, 8 aa, Mycobacterium
GDDSCRPA

SEQ ID NO: 480574 - protein, 13 aa, Mycobacterium
GDDSDIAEGLTRR

SEQ ID NO: 480575 - protein, 13 aa, Mycobacterium
GDDSDLTDGLTRR

SEQ ID NO: 480576 - protein, 9 aa, Mycobacterium
GDDSEIADG

SEQ ID NO: 480577 - protein, 13 aa, Mycobacterium
GDDSEPTDGLTRR

SEQ ID NO: 480578 - protein, 9 aa, Mycobacterium
GDDSERLTG

SEQ ID NO: 480579 - protein, 15 aa, Mycobacterium
GDDSERLTGAAGLST

SEQ ID NO: 480580 - protein, 16 aa, Mycobacterium
GDDSERLTGAAGLSTV

SEQ ID NO: 480581 - protein, 9 aa, Mycobacterium
GDDSETLTG

SEQ ID NO: 480582 - protein, 10 aa, Mycobacterium
GDDSETRQIP

SEQ ID NO: 480583 - protein, 13 aa, Mycobacterium
GDDSEVADGLTRR

SEQ ID NO: 480584 - protein, 7 aa, Mycobacterium
GDDSFTE

SEQ ID NO: 480585 - protein, 9 aa, Mycobacterium
GDDSGTDWL

SEQ ID NO: 480586 - protein, 9 aa, Mycobacterium
GDDSGTRQI

SEQ ID NO: 480587 - protein, 8 aa, Mycobacterium
GDDSLEKE

SEQ ID NO: 480588 - protein, 8 aa, Mycobacterium
GDDSLEQE

SEQ ID NO: 480589 - protein, 9 aa, Mycobacterium
GDDSPADRG

SEQ ID NO: 480590 - protein, 8 aa, Mycobacterium
GDDSTERI

SEQ ID NO: 480591 - protein, 17 aa, Mycobacterium
GDDSTRLGPTTMPLQWP

SEQ ID NO: 480592 - protein, 7 aa, Mycobacterium
GDDSTSA

SEQ ID NO: 480593 - protein, 8 aa, Mycobacterium
GDDSTSAL

SEQ ID NO: 480594 - protein, 5 aa, Mycobacterium
GDDSV

SEQ ID NO: 480595 - protein, 8 aa, Mycobacterium
GDDTARAA

SEQ ID NO: 480596 - protein, 9 aa, Mycobacterium
GDDTATRAR

SEQ ID NO: 480597 - protein, 8 aa, Mycobacterium
GDDTCRPA

SEQ ID NO: 480598 - protein, 8 aa, Mycobacterium
GDDTPDEG

SEQ ID NO: 480599 - protein, 7 aa, Mycobacterium
GDDTPFS

SEQ ID NO: 480600 - protein, 7 aa, Mycobacterium
GDDTPWS

SEQ ID NO: 480601 - protein, 19 aa, Mycobacterium
GDDTRQWGPPYDSDGQATY

SEQ ID NO: 480602 - protein, 7 aa, Mycobacterium
GDDTTAR

SEQ ID NO: 480603 - protein, 5 aa, Mycobacterium
GDDTV

SEQ ID NO: 480604 - protein, 6 aa, Mycobacterium
GDDTVR

SEQ ID NO: 480605 - protein, 5 aa, Mycobacterium
GDDVG

SEQ ID NO: 480606 - protein, 17 aa, Mycobacterium
GDDVGTGKAKSANGYAT

SEQ ID NO: 480607 - protein, 6 aa, Mycobacterium
GDDVHR

SEQ ID NO: 480608 - protein, 8 aa, Mycobacterium
GDDVPAAL

SEQ ID NO: 480609 - protein, 11 aa, Mycobacterium
GDDVPRDGTTI

SEQ ID NO: 480610 - protein, 13 aa, Mycobacterium
GDDVSDTAARGEA

SEQ ID NO: 480611 - protein, 7 aa, Mycobacterium
GDDVTGA

SEQ ID NO: 480612 - protein, 13 aa, Mycobacterium
GDDWDPEQSQLSE

SEQ ID NO: 480613 - protein, 15 aa, Mycobacterium
GDDWHGNPDALRNDR

SEQ ID NO: 480614 - protein, 14 aa, Mycobacterium
GDDYATDDERRAAY

SEQ ID NO: 480615 - protein, 14 aa, Mycobacterium
GDDYATDEERRAAY

SEQ ID NO: 480616 - protein, 5 aa, Mycobacterium
GDDYD

SEQ ID NO: 480617 - protein, 12 aa, Mycobacterium
GDDYTRRPFSER

SEQ ID NO: 480618 - protein, 5 aa, Mycobacterium
GDEAA

SEQ ID NO: 480619 - protein, 8 aa, Mycobacterium
GDEAAAAA

SEQ ID NO: 480620 - protein, 33 aa, Mycobacterium
GDEAAARKEFSAASVDGQLRPDAAAALDDPGYG

SEQ ID NO: 480621 - protein, 9 aa, Mycobacterium
GDEAAVDAR

SEQ ID NO: 480622 - protein, 14 aa, Mycobacterium
GDEAELPAGQEGEL

SEQ ID NO: 480623 - protein, 13 aa, Mycobacterium
GDEAELRTQAGPL

SEQ ID NO: 480624 - protein, 7 aa, Mycobacterium
GDEAGEG

SEQ ID NO: 480625 - protein, 8 aa, Mycobacterium
GDEAGGTM

SEQ ID NO: 480626 - protein, 5 aa, Mycobacterium
GDEAH

SEQ ID NO: 480627 - protein, 6 aa, Mycobacterium
GDEANQ

SEQ ID NO: 480628 - protein, 7 aa, Mycobacterium
GDEATDA

SEQ ID NO: 480629 - protein, 16 aa, Mycobacterium
GDEATTARTVSAPTSH

SEQ ID NO: 480630 - protein, 10 aa, Mycobacterium
GDECPPRPSP

SEQ ID NO: 480631 - protein, 7 aa, Mycobacterium
GDECPQK

SEQ ID NO: 480632 - protein, 7 aa, Mycobacterium
GDECPQR

SEQ ID NO: 480633 - protein, 7 aa, Mycobacterium
GDEDEAV

SEQ ID NO: 480634 - protein, 11 aa, Mycobacterium
GDEDELRAQAG

SEQ ID NO: 480635 - protein, 12 aa, Mycobacterium
GDEDELRDEAGE

SEQ ID NO: 480636 - protein, 13 aa, Mycobacterium
GDEDELREQAGDL

SEQ ID NO: 480637 - protein, 6 aa, Mycobacterium
GDEDGI

SEQ ID NO: 480638 - protein, 5 aa, Mycobacterium
GDEDM

SEQ ID NO: 480639 - protein, 6 aa, Mycobacterium
GDEDNE

SEQ ID NO: 480640 - protein, 6 aa, Mycobacterium
GDEDPY

SEQ ID NO: 480641 - protein, 12 aa, Mycobacterium
GDEDQLRSQAGR

SEQ ID NO: 480642 - protein, 6 aa, Mycobacterium
GDEDRL

SEQ ID NO: 480643 - protein, 9 aa, Mycobacterium
GDEDSVRAG

SEQ ID NO: 480644 - protein, 9 aa, Mycobacterium
GDEDTVRGR

SEQ ID NO: 480645 - protein, 4 aa, Mycobacterium
GDEE

SEQ ID NO: 480646 - protein, 6 aa, Mycobacterium
GDEEAN

SEQ ID NO: 480647 - protein, 5 aa, Mycobacterium
GDEEE

SEQ ID NO: 480648 - protein, 6 aa, Mycobacterium
GDEEEL

SEQ ID NO: 480649 - protein, 7 aa, Mycobacterium
GDEEISQ

SEQ ID NO: 480650 - protein, 9 aa, Mycobacterium
GDEEKPAGQ

SEQ ID NO: 480651 - protein, 9 aa, Mycobacterium
GDEELADGR

SEQ ID NO: 480652 - protein, 7 aa, Mycobacterium
GDEELEK

SEQ ID NO: 480653 - protein, 14 aa, Mycobacterium
GDEEPTEDDAPHET

SEQ ID NO: 480654 - protein, 7 aa, Mycobacterium
GDEEQRR

SEQ ID NO: 480655 - protein, 4 aa, Mycobacterium
GDEF

SEQ ID NO: 480656 - protein, 9 aa, Mycobacterium
GDEFGGGPR

SEQ ID NO: 480657 - protein, 9 aa, Mycobacterium
GDEGAANMQ

SEQ ID NO: 480658 - protein, 6 aa, Mycobacterium
GDEGAG

SEQ ID NO: 480659 - protein, 8 aa, Mycobacterium
GDEGAKPF

SEQ ID NO: 480660 - protein, 6 aa, Mycobacterium
GDEGDL

SEQ ID NO: 480661 - protein, 7 aa, Mycobacterium
GDEGDPM

SEQ ID NO: 480662 - protein, 21 aa, Mycobacterium
GDEGEPTPQRANLNDSLTPDE

SEQ ID NO: 480663 - protein, 7 aa, Mycobacterium
GDEGHHA

SEQ ID NO: 480664 - protein, 12 aa, Mycobacterium
GDEGKGKATDLL

SEQ ID NO: 480665 - protein, 15 aa, Mycobacterium
GDEGSRYRSPQGQIT

SEQ ID NO: 480666 - protein, 8 aa, Mycobacterium
GDEGSVDE

SEQ ID NO: 480667 - protein, 5 aa, Mycobacterium
GDEGY

SEQ ID NO: 480668 - protein, 5 aa, Mycobacterium
GDEHP

SEQ ID NO: 480669 - protein, 5 aa, Mycobacterium
GDEHR

SEQ ID NO: 480670 - protein, 7 aa, Mycobacterium
GDEHTAP

SEQ ID NO: 480671 - protein, 5 aa, Mycobacterium
GDEIP

SEQ ID NO: 480672 - protein, 6 aa, Mycobacterium
GDEIST

SEQ ID NO: 480673 - protein, 7 aa, Mycobacterium
GDEITGE

SEQ ID NO: 480674 - protein, 17 aa, Mycobacterium
GDEKKFPGEISGGMRKR

SEQ ID NO: 480675 - protein, 18 aa, Mycobacterium
GDEKKFPGEISGGMRKRA

SEQ ID NO: 480676 - protein, 9 aa, Mycobacterium
GDEKSTATR

SEQ ID NO: 480677 - protein, 16 aa, Mycobacterium
GDEKTHQQMFQKALAA

SEQ ID NO: 480678 - protein, 6 aa, Mycobacterium
GDELAR

SEQ ID NO: 480679 - protein, 8 aa, Mycobacterium
GDELARRR

SEQ ID NO: 480680 - protein, 5 aa, Mycobacterium
GDELE

SEQ ID NO: 480681 - protein, 9 aa, Mycobacterium
GDELGPAAE

SEQ ID NO: 480682 - protein, 7 aa, Mycobacterium
GDELSAY

SEQ ID NO: 480683 - protein, 9 aa, Mycobacterium
GDELTSDGR

SEQ ID NO: 480684 - protein, 4 aa, Mycobacterium
GDEM

SEQ ID NO: 480685 - protein, 11 aa, Mycobacterium
GDEMPSSQFGP

SEQ ID NO: 480686 - protein, 12 aa, Mycobacterium
GDEMPSSQFGPL

SEQ ID NO: 480687 - protein, 5 aa, Mycobacterium
GDEMT

SEQ ID NO: 480688 - protein, 5 aa, Mycobacterium
GDENL

SEQ ID NO: 480689 - protein, 17 aa, Mycobacterium
GDENQTIDDVNSGVQAI

SEQ ID NO: 480690 - protein, 11 aa, Mycobacterium
GDENRAPSRQE

SEQ ID NO: 480691 - protein, 8 aa, Mycobacterium
GDENRPAW

SEQ ID NO: 480692 - protein, 179 aa, Mycobacterium
GDEPAGGTGGTGGHGGTGGHGGTGGAAGNGGAGGAGGQAGDGGSGGEGGDGGTGAQGTTVSLPGSGGNAGNGGNAGGGGVGGTGGAGATGAPAGRGGTGGNGGNAGAGGKGGAGAFGGAGSSPGFLSPAGNGGAGGDAGTAAAGGDGGAGGAGPSGGNGGTGGNGGHGGNGGNGAEGAI

SEQ ID NO: 480693 - protein, 8 aa, Mycobacterium
GDEPAPQT

SEQ ID NO: 480694 - protein, 9 aa, Mycobacterium
GDEPAQGSG

SEQ ID NO: 480695 - protein, 7 aa, Mycobacterium
GDEPDAN

SEQ ID NO: 480696 - protein, 6 aa, Mycobacterium
GDEPES

SEQ ID NO: 480697 - protein, 8 aa, Mycobacterium
GDEPGGLA

SEQ ID NO: 480698 - protein, 8 aa, Mycobacterium
GDEPGRGF

SEQ ID NO: 480699 - protein, 8 aa, Mycobacterium
GDEPGWDR

SEQ ID NO: 480700 - protein, 27 aa, Mycobacterium
GDEPLPGPPPPGGCDGAIPPDQPDAPA

SEQ ID NO: 480701 - protein, 9 aa, Mycobacterium
GDEPMTGAQ

SEQ ID NO: 480702 - protein, 7 aa, Mycobacterium
GDEPPFG

SEQ ID NO: 480703 - protein, 23 aa, Mycobacterium
GDEPPGRRVSGSAKGGRRKARKR

SEQ ID NO: 480704 - protein, 12 aa, Mycobacterium
GDEPPPADGGAQ

SEQ ID NO: 480705 - protein, 7 aa, Mycobacterium
GDEPPQK

SEQ ID NO: 480706 - protein, 16 aa, Mycobacterium
GDEPQPATSAHRGAAH

SEQ ID NO: 480707 - protein, 6 aa, Mycobacterium
GDEPQQ

SEQ ID NO: 480708 - protein, 10 aa, Mycobacterium
GDEPSVSSGV

SEQ ID NO: 480709 - protein, 5 aa, Mycobacterium
GDEPT

SEQ ID NO: 480710 - protein, 10 aa, Mycobacterium
GDEPTGVTTA

SEQ ID NO: 480711 - protein, 6 aa, Mycobacterium
GDEPTV

SEQ ID NO: 480712 - protein, 23 aa, Mycobacterium
GDEPVGLPAQRRHTARQPGDRPA

SEQ ID NO: 480713 - protein, 8 aa, Mycobacterium
GDEQFGAA

SEQ ID NO: 480714 - protein, 8 aa, Mycobacterium
GDEQRADA

SEQ ID NO: 480715 - protein, 7 aa, Mycobacterium
GDEQSRR

SEQ ID NO: 480716 - protein, 7 aa, Mycobacterium
GDEQTHE

SEQ ID NO: 480717 - protein, 13 aa, Mycobacterium
GDEQTRAVKASLS

SEQ ID NO: 480718 - protein, 5 aa, Mycobacterium
GDERA

SEQ ID NO: 480719 - protein, 14 aa, Mycobacterium
GDERAEVVVVTHAG

SEQ ID NO: 480720 - protein, 5 aa, Mycobacterium
GDERF

SEQ ID NO: 480721 - protein, 5 aa, Mycobacterium
GDERL

SEQ ID NO: 480722 - protein, 7 aa, Mycobacterium
GDERRRD

SEQ ID NO: 480723 - protein, 7 aa, Mycobacterium
GDERRRR

SEQ ID NO: 480724 - protein, 11 aa, Mycobacterium
GDESGGGGSFA

SEQ ID NO: 480725 - protein, 9 aa, Mycobacterium
GDESGSVSA

SEQ ID NO: 480726 - protein, 15 aa, Mycobacterium
GDESMARSRKPEVYS

SEQ ID NO: 480727 - protein, 8 aa, Mycobacterium
GDESNGEL

SEQ ID NO: 480728 - protein, 6 aa, Mycobacterium
GDESRS

SEQ ID NO: 480729 - protein, 4 aa, Mycobacterium
GDET

SEQ ID NO: 480730 - protein, 9 aa, Mycobacterium
GDETATNTD

SEQ ID NO: 480731 - protein, 7 aa, Mycobacterium
GDETCRP

SEQ ID NO: 480732 - protein, 8 aa, Mycobacterium
GDETCRPQ

SEQ ID NO: 480733 - protein, 6 aa, Mycobacterium
GDETGV

SEQ ID NO: 480734 - protein, 12 aa, Mycobacterium
GDETKAVAAIFA

SEQ ID NO: 480735 - protein, 12 aa, Mycobacterium
GDETKAVAGLFS

SEQ ID NO: 480736 - protein, 12 aa, Mycobacterium
GDETKAVASIFA

SEQ ID NO: 480737 - protein, 8 aa, Mycobacterium
GDETSDAV

SEQ ID NO: 480738 - protein, 5 aa, Mycobacterium
GDETV

SEQ ID NO: 480739 - protein, 6 aa, Mycobacterium
GDEVGV

SEQ ID NO: 480740 - protein, 8 aa, Mycobacterium
GDEVKPTE

SEQ ID NO: 480741 - protein, 7 aa, Mycobacterium
GDEVRAG

SEQ ID NO: 480742 - protein, 5 aa, Mycobacterium
GDEVS

SEQ ID NO: 480743 - protein, 6 aa, Mycobacterium
GDEVST

SEQ ID NO: 480744 - protein, 20 aa, Mycobacterium
GDEVTAGESFGEVESTKSVS

SEQ ID NO: 480745 - protein, 13 aa, Mycobacterium
GDEVTEHVGGSPL

SEQ ID NO: 480746 - protein, 4 aa, Mycobacterium
GDEW

SEQ ID NO: 480747 - protein, 6 aa, Mycobacterium
GDEYTA

SEQ ID NO: 480748 - protein, 4 aa, Mycobacterium
GDFA

SEQ ID NO: 480749 - protein, 9 aa, Mycobacterium
GDFAAEPSD

SEQ ID NO: 480750 - protein, 12 aa, Mycobacterium
GDFAGARAAAER

SEQ ID NO: 480751 - protein, 6 aa, Mycobacterium
GDFAGE

SEQ ID NO: 480752 - protein, 11 aa, Mycobacterium
GDFAGESRRLG

SEQ ID NO: 480753 - protein, 8 aa, Mycobacterium
GDFAGESY

SEQ ID NO: 480754 - protein, 11 aa, Mycobacterium
GDFDDDDRPAR

SEQ ID NO: 480755 - protein, 5 aa, Mycobacterium
GDFDG

SEQ ID NO: 480756 - protein, 12 aa, Mycobacterium
GDFDRRGRAADE

SEQ ID NO: 480757 - protein, 4 aa, Mycobacterium
GDFE

SEQ ID NO: 480758 - protein, 4 aa, Mycobacterium
GDFG

SEQ ID NO: 480759 - protein, 6 aa, Mycobacterium
GDFGAK

SEQ ID NO: 480760 - protein, 6 aa, Mycobacterium
GDFGGP

SEQ ID NO: 480761 - protein, 6 aa, Mycobacterium
GDFPES

SEQ ID NO: 480762 - protein, 5 aa, Mycobacterium
GDFPG

SEQ ID NO: 480763 - protein, 6 aa, Mycobacterium
GDFPGG

SEQ ID NO: 480764 - protein, 6 aa, Mycobacterium
GDFPSP

SEQ ID NO: 480765 - protein, 6 aa, Mycobacterium
GDFQGT

SEQ ID NO: 480766 - protein, 7 aa, Mycobacterium
GDFQGTP

SEQ ID NO: 480767 - protein, 4 aa, Mycobacterium
GDFR

SEQ ID NO: 480768 - protein, 11 aa, Mycobacterium
GDFSARAEPYR

SEQ ID NO: 480769 - protein, 7 aa, Mycobacterium
GDFSEDD

SEQ ID NO: 480770 - protein, 8 aa, Mycobacterium
GDFSTGTG

SEQ ID NO: 480771 - protein, 21 aa, Mycobacterium
GDFTAGRQSPPQRRDRWLHRL

SEQ ID NO: 480772 - protein, 8 aa, Mycobacterium
GDGAAAPM

SEQ ID NO: 480773 - protein, 7 aa, Mycobacterium
GDGAAEL

SEQ ID NO: 480774 - protein, 6 aa, Mycobacterium
GDGAAG

SEQ ID NO: 480775 - protein, 15 aa, Mycobacterium
GDGAAGAAGGDGGQT

SEQ ID NO: 480776 - protein, 13 aa, Mycobacterium
GDGAAGTATNPNG

SEQ ID NO: 480777 - protein, 11 aa, Mycobacterium
GDGAAISRRQR

SEQ ID NO: 480778 - protein, 16 aa, Mycobacterium
GDGAAPDWPRHPSPLG

SEQ ID NO: 480779 - protein, 17 aa, Mycobacterium
GDGADGISPGQDGGDGG

SEQ ID NO: 480780 - protein, 7 aa, Mycobacterium
GDGADIG

SEQ ID NO: 480781 - protein, 10 aa, Mycobacterium
GDGAEPGSGL

SEQ ID NO: 480782 - protein, 11 aa, Mycobacterium
GDGAEPTSRRP

SEQ ID NO: 480783 - protein, 8 aa, Mycobacterium
GDGAGAER

SEQ ID NO: 480784 - protein, 7 aa, Mycobacterium
GDGAGAR

SEQ ID NO: 480785 - protein, 7 aa, Mycobacterium
GDGAGSE

SEQ ID NO: 480786 - protein, 6 aa, Mycobacterium
GDGAGV

SEQ ID NO: 480787 - protein, 7 aa, Mycobacterium
GDGAGVG

SEQ ID NO: 480788 - protein, 10 aa, Mycobacterium
GDGAIDPPAF

SEQ ID NO: 480789 - protein, 8 aa, Mycobacterium
GDGALKDK

SEQ ID NO: 480790 - protein, 9 aa, Mycobacterium
GDGALRDPR

SEQ ID NO: 480791 - protein, 10 aa, Mycobacterium
GDGANDAAAI

SEQ ID NO: 480792 - protein, 18 aa, Mycobacterium
GDGANGSPGTGQNGGDGG

SEQ ID NO: 480793 - protein, 7 aa, Mycobacterium
GDGAQVP

SEQ ID NO: 480794 - protein, 14 aa, Mycobacterium
GDGARASAMAAWLF

SEQ ID NO: 480795 - protein, 5 aa, Mycobacterium
GDGAT

SEQ ID NO: 480796 - protein, 8 aa, Mycobacterium
GDGATGRF

SEQ ID NO: 480797 - protein, 10 aa, Mycobacterium
GDGATNTGSF

SEQ ID NO: 480798 - protein, 8 aa, Mycobacterium
GDGATSQE

SEQ ID NO: 480799 - protein, 5 aa, Mycobacterium
GDGAW

SEQ ID NO: 480800 - protein, 9 aa, Mycobacterium
GDGAYTGAG

SEQ ID NO: 480801 - protein, 9 aa, Mycobacterium
GDGDDAEAR

SEQ ID NO: 480802 - protein, 8 aa, Mycobacterium
GDGDDPVA

SEQ ID NO: 480803 - protein, 9 aa, Mycobacterium
GDGDDTKTI

SEQ ID NO: 480804 - protein, 10 aa, Mycobacterium
GDGDESDEDK

SEQ ID NO: 480805 - protein, 9 aa, Mycobacterium
GDGDESPAE

SEQ ID NO: 480806 - protein, 10 aa, Mycobacterium
GDGDGAQATT

SEQ ID NO: 480807 - protein, 10 aa, Mycobacterium
GDGDGASAVR

SEQ ID NO: 480808 - protein, 10 aa, Mycobacterium
GDGDGDDDEL

SEQ ID NO: 480809 - protein, 11 aa, Mycobacterium
GDGDGPRATAR

SEQ ID NO: 480810 - protein, 11 aa, Mycobacterium
GDGDGPSPRQL

SEQ ID NO: 480811 - protein, 5 aa, Mycobacterium
GDGDK

SEQ ID NO: 480812 - protein, 6 aa, Mycobacterium
GDGDLE

SEQ ID NO: 480813 - protein, 12 aa, Mycobacterium
GDGDRPSPGDPL

SEQ ID NO: 480814 - protein, 6 aa, Mycobacterium
GDGDRQ

SEQ ID NO: 480815 - protein, 8 aa, Mycobacterium
GDGDSALA

SEQ ID NO: 480816 - protein, 9 aa, Mycobacterium
GDGDSLSIG

SEQ ID NO: 480817 - protein, 16 aa, Mycobacterium
GDGDSTADTAAPGSPW

SEQ ID NO: 480818 - protein, 16 aa, Mycobacterium
GDGDSTADTASPGSPW

SEQ ID NO: 480819 - protein, 11 aa, Mycobacterium
GDGDSTADTAV

SEQ ID NO: 480820 - protein, 12 aa, Mycobacterium
GDGDTATWAERA

SEQ ID NO: 480821 - protein, 18 aa, Mycobacterium
GDGDTPRLEQADSALEAA

SEQ ID NO: 480822 - protein, 8 aa, Mycobacterium
GDGDTVDL

SEQ ID NO: 480823 - protein, 17 aa, Mycobacterium
GDGDWRDVGAPARAAEF

SEQ ID NO: 480824 - protein, 4 aa, Mycobacterium
GDGE

SEQ ID NO: 480825 - protein, 14 aa, Mycobacterium
GDGEAAGADAVADD

SEQ ID NO: 480826 - protein, 12 aa, Mycobacterium
GDGEAETGPLAT

SEQ ID NO: 480827 - protein, 9 aa, Mycobacterium
GDGEAGPFV

SEQ ID NO: 480828 - protein, 11 aa, Mycobacterium
GDGEAGPYVEG

SEQ ID NO: 480829 - protein, 7 aa, Mycobacterium
GDGEAQR

SEQ ID NO: 480830 - protein, 7 aa, Mycobacterium
GDGEFPD

SEQ ID NO: 480831 - protein, 7 aa, Mycobacterium
GDGEGDL

SEQ ID NO: 480832 - protein, 18 aa, Mycobacterium
GDGEKTPSFTDAQSAARH

SEQ ID NO: 480833 - protein, 6 aa, Mycobacterium
GDGESI

SEQ ID NO: 480834 - protein, 5 aa, Mycobacterium
GDGET

SEQ ID NO: 480835 - protein, 7 aa, Mycobacterium
GDGFGHS

SEQ ID NO: 480836 - protein, 8 aa, Mycobacterium
GDGFKDHA

SEQ ID NO: 480837 - protein, 11 aa, Mycobacterium
GDGFQDGGAQR

SEQ ID NO: 480838 - protein, 25 aa, Mycobacterium
GDGGADGGTTTADGVSRAASGMAPT

SEQ ID NO: 480839 - protein, 10 aa, Mycobacterium
GDGGAGAVGG

SEQ ID NO: 480840 - protein, 15 aa, Mycobacterium
GDGGAGDVGVGGDGE

SEQ ID NO: 480841 - protein, 22 aa, Mycobacterium
GDGGAGGAATTGTGGAGGGGGL

SEQ ID NO: 480842 - protein, 26 aa, Mycobacterium
GDGGAGGAGGGGTVAAGAAGGSGGNA

SEQ ID NO: 480843 - protein, 46 aa, Mycobacterium
GDGGAGGAGGQGGAGRVGAAGGASSGGTGGHGGVGGIGGSGGAGGW

SEQ ID NO: 480844 - protein, 29 aa, Mycobacterium
GDGGAGGHGGSGGSGGGTGGSGGSAGTLL

SEQ ID NO: 480845 - protein, 9 aa, Mycobacterium
GDGGAGGLG

SEQ ID NO: 480846 - protein, 16 aa, Mycobacterium
GDGGAGGQGGDGAVSD

SEQ ID NO: 480847 - protein, 18 aa, Mycobacterium
GDGGAGGQGGDGGPAGLV

SEQ ID NO: 480848 - protein, 29 aa, Mycobacterium
GDGGAGGTGGAANIGSGGDGGGGGTGGTL

SEQ ID NO: 480849 - protein, 8 aa, Mycobacterium
GDGGAGVA

SEQ ID NO: 480850 - protein, 33 aa, Mycobacterium
GDGGDGGDGIFGGPGGAGGTGGTLFGSDGASGA

SEQ ID NO: 480851 - protein, 29 aa, Mycobacterium
GDGGDGGRGAPGGAGGMGGSLFGQDGSNG

SEQ ID NO: 480852 - protein, 6 aa, Mycobacterium
GDGGFA

SEQ ID NO: 480853 - protein, 6 aa, Mycobacterium
GDGGFG

SEQ ID NO: 480854 - protein, 27 aa, Mycobacterium
GDGGGGGAGGAGASGAGDGDPGTAGGD

SEQ ID NO: 480855 - protein, 87 aa, Mycobacterium
  misc_feature (38)..(38): Xaa can be any naturally occurring amino acid
GDGGGGGAGGFGSNGDGGDGGDGGNGGVIGTGGAGGLXGVAGNAGGTGGGGGHGGRGGTFGDGGAGGDGGRGGLAGGLGGKGGDAGF

SEQ ID NO: 480856 - protein, 10 aa, Mycobacterium
GDGGGGPTRE

SEQ ID NO: 480857 - protein, 11 aa, Mycobacterium
GDGGHGGAGGV

SEQ ID NO: 480858 - protein, 6 aa, Mycobacterium
GDGGHT

SEQ ID NO: 480859 - protein, 8 aa, Mycobacterium
GDGGLDEQ

SEQ ID NO: 480860 - protein, 11 aa, Mycobacterium
GDGGLGGDGGI

SEQ ID NO: 480861 - protein, 8 aa, Mycobacterium
GDGGLGGT

SEQ ID NO: 480862 - protein, 24 aa, Mycobacterium
GDGGNGGAGAPGLSGLGGAGGRGG

SEQ ID NO: 480863 - protein, 11 aa, Mycobacterium
GDGGNGGAGGI

SEQ ID NO: 480864 - protein, 191 aa, Mycobacterium
GDGGNGGAGGVGGTGGDGGNGATGGTGATAGANGQDGGNGGTGGTGGQGGAGGAGGATFTGKAGTQGAGGAGGDGGAGGNAGNGGSGATGADGATVGTGVDGQDGGNGGAGGTGGQGGAGGDGGAGSTTGNQGGGGAGGNGGGGGAGGNGGSGANGADGSISGLGGQAGGNGGDGGDAGVGGSGGDGGAGL

SEQ ID NO: 480865 - protein, 12 aa, Mycobacterium
GDGGNGGQGGYG

SEQ ID NO: 480866 - protein, 9 aa, Mycobacterium
GDGGNLDDD

SEQ ID NO: 480867 - protein, 7 aa, Mycobacterium
GDGGPFT

SEQ ID NO: 480868 - protein, 10 aa, Mycobacterium
GDGGPWGDRR

SEQ ID NO: 480869 - protein, 5 aa, Mycobacterium
GDGGQ

SEQ ID NO: 480870 - protein, 9 aa, Mycobacterium
GDGGRPDRK

SEQ ID NO: 480871 - protein, 14 aa, Mycobacterium
GDGGSGGAGGDGGL

SEQ ID NO: 480872 - protein, 15 aa, Mycobacterium
GDGGSGGNGGVGGPG

SEQ ID NO: 480873 - protein, 27 aa, Mycobacterium
GDGGTGGDGGFGGITSGDGGNGGTGAL

SEQ ID NO: 480874 - protein, 56 aa, Mycobacterium
GDGGTGGNGGLATAGGAGGDGGAGGKAALIGSGGNGGAGGSGTVDPGGNGGRGGDA

SEQ ID NO: 480875 - protein, 7 aa, Mycobacterium
GDGGTVS

SEQ ID NO: 480876 - protein, 29 aa, Mycobacterium
GDGGVGGIGGGSTAAGATGGTGGTGGAGG

SEQ ID NO: 480877 - protein, 7 aa, Mycobacterium
GDGGWRE

SEQ ID NO: 480878 - protein, 8 aa, Mycobacterium
GDGGYQFT

SEQ ID NO: 480879 - protein, 4 aa, Mycobacterium
GDGH

SEQ ID NO: 480880 - protein, 5 aa, Mycobacterium
GDGIS

SEQ ID NO: 480881 - protein, 15 aa, Mycobacterium
GDGISGSARIDPGDG

SEQ ID NO: 480882 - protein, 7 aa, Mycobacterium
GDGITPP

SEQ ID NO: 480883 - protein, 8 aa, Mycobacterium
GDGKPHAV

SEQ ID NO: 480884 - protein, 9 aa, Mycobacterium
GDGLAGSTC

SEQ ID NO: 480885 - protein, 9 aa, Mycobacterium
GDGLDPTED

SEQ ID NO: 480886 - protein, 7 aa, Mycobacterium
GDGLGGS

SEQ ID NO: 480887 - protein, 5 aa, Mycobacterium
GDGLH

SEQ ID NO: 480888 - protein, 8 aa, Mycobacterium
GDGLPTRS

SEQ ID NO: 480889 - protein, 6 aa, Mycobacterium
GDGLRG

SEQ ID NO: 480890 - protein, 7 aa, Mycobacterium
GDGLTAD

SEQ ID NO: 480891 - protein, 8 aa, Mycobacterium
GDGMDAPL

SEQ ID NO: 480892 - protein, 11 aa, Mycobacterium
GDGMPGPNGFT

SEQ ID NO: 480893 - protein, 6 aa, Mycobacterium
GDGMRD

SEQ ID NO: 480894 - protein, 7 aa, Mycobacterium
GDGMTGQ

SEQ ID NO: 480895 - protein, 4 aa, Mycobacterium
GDGN

SEQ ID NO: 480896 - protein, 5 aa, Mycobacterium
GDGNF

SEQ ID NO: 480897 - protein, 15 aa, Mycobacterium
GDGNGGWYVLTGFPK

SEQ ID NO: 480898 - protein, 6 aa, Mycobacterium
GDGNHP

SEQ ID NO: 480899 - protein, 5 aa, Mycobacterium
GDGNI

SEQ ID NO: 480900 - protein, 15 aa, Mycobacterium
GDGNIGAFSSGTNSV

SEQ ID NO: 480901 - protein, 16 aa, Mycobacterium
GDGNIGAFSSGTNSVF

SEQ ID NO: 480902 - protein, 14 aa, Mycobacterium
GDGNIGGGNYGNNN

SEQ ID NO: 480903 - protein, 9 aa, Mycobacterium
GDGNQYQKI

SEQ ID NO: 480904 - protein, 5 aa, Mycobacterium
GDGNR

SEQ ID NO: 480905 - protein, 9 aa, Mycobacterium
GDGNRDPRL

SEQ ID NO: 480906 - protein, 10 aa, Mycobacterium
GDGNRGSNNF

SEQ ID NO: 480907 - protein, 16 aa, Mycobacterium
GDGNSTADTAAPGSPW

SEQ ID NO: 480908 - protein, 15 aa, Mycobacterium
GDGNSTADTKRPDSP

SEQ ID NO: 480909 - protein, 16 aa, Mycobacterium
GDGNTAAAASAVGTGN

SEQ ID NO: 480910 - protein, 7 aa, Mycobacterium
GDGNTGI

SEQ ID NO: 480911 - protein, 7 aa, Mycobacterium
GDGNTGW

SEQ ID NO: 480912 - protein, 10 aa, Mycobacterium
GDGNTVNASS

SEQ ID NO: 480913 - protein, 9 aa, Mycobacterium
GDGNVGAAN

SEQ ID NO: 480914 - protein, 8 aa, Mycobacterium
GDGNVRVT

SEQ ID NO: 480915 - protein, 24 aa, Mycobacterium
GDGNWGIGNSGDTNTGIGNSGSFN

SEQ ID NO: 480916 - protein, 8 aa, Mycobacterium
GDGNYAEA

SEQ ID NO: 480917 - protein, 13 aa, Mycobacterium
GDGPAKGFASHGE

SEQ ID NO: 480918 - protein, 7 aa, Mycobacterium
GDGPARD

SEQ ID NO: 480919 - protein, 8 aa, Mycobacterium
GDGPEEKA

SEQ ID NO: 480920 - protein, 10 aa, Mycobacterium
GDGPETAALA

SEQ ID NO: 480921 - protein, 5 aa, Mycobacterium
GDGPL

SEQ ID NO: 480922 - protein, 9 aa, Mycobacterium
GDGPLAGKK

SEQ ID NO: 480923 - protein, 15 aa, Mycobacterium
GDGPLDDEPPAAPTM

SEQ ID NO: 480924 - protein, 6 aa, Mycobacterium
GDGPLG

SEQ ID NO: 480925 - protein, 11 aa, Mycobacterium
GDGPLPDPSEA

SEQ ID NO: 480926 - protein, 7 aa, Mycobacterium
GDGPLTG

SEQ ID NO: 480927 - protein, 9 aa, Mycobacterium
GDGPNGIGR

SEQ ID NO: 480928 - protein, 20 aa, Mycobacterium
GDGPPVAEPAARAKSVASSM

SEQ ID NO: 480929 - protein, 6 aa, Mycobacterium
GDGPQV

SEQ ID NO: 480930 - protein, 7 aa, Mycobacterium
GDGPSAL

SEQ ID NO: 480931 - protein, 6 aa, Mycobacterium
GDGPSL

SEQ ID NO: 480932 - protein, 7 aa, Mycobacterium
GDGPTAV

SEQ ID NO: 480933 - protein, 8 aa, Mycobacterium
GDGPTPVR

SEQ ID NO: 480934 - protein, 8 aa, Mycobacterium
GDGPVRPG

SEQ ID NO: 480935 - protein, 12 aa, Mycobacterium
GDGPYTEVLGDP

SEQ ID NO: 480936 - protein, 10 aa, Mycobacterium
GDGQAAIRTT

SEQ ID NO: 480937 - protein, 6 aa, Mycobacterium
GDGQHR

SEQ ID NO: 480938 - protein, 5 aa, Mycobacterium
GDGQI

SEQ ID NO: 480939 - protein, 9 aa, Mycobacterium
GDGQLTGKG

SEQ ID NO: 480940 - protein, 9 aa, Mycobacterium
GDGQQRNRV

SEQ ID NO: 480941 - protein, 18 aa, Mycobacterium
GDGQQTPSFADAQSAARH

SEQ ID NO: 480942 - protein, 5 aa, Mycobacterium
GDGQV

SEQ ID NO: 480943 - protein, 6 aa, Mycobacterium
GDGQVG

SEQ ID NO: 480944 - protein, 6 aa, Mycobacterium
GDGRAR

SEQ ID NO: 480945 - protein, 17 aa, Mycobacterium
GDGRAVPATFSRVGAQE

SEQ ID NO: 480946 - protein, 5 aa, Mycobacterium
GDGRE

SEQ ID NO: 480947 - protein, 6 aa, Mycobacterium
GDGRGR

SEQ ID NO: 480948 - protein, 9 aa, Mycobacterium
GDGRGRDLG

SEQ ID NO: 480949 - protein, 8 aa, Mycobacterium
GDGRGREL

SEQ ID NO: 480950 - protein, 6 aa, Mycobacterium
GDGRLD

SEQ ID NO: 480951 - protein, 6 aa, Mycobacterium
GDGRPA

SEQ ID NO: 480952 - protein, 5 aa, Mycobacterium
GDGRR

SEQ ID NO: 480953 - protein, 8 aa, Mycobacterium
GDGRRLAG

SEQ ID NO: 480954 - protein, 11 aa, Mycobacterium
GDGRRRVGTGS

SEQ ID NO: 480955 - protein, 5 aa, Mycobacterium
GDGRS

SEQ ID NO: 480956 - protein, 7 aa, Mycobacterium
GDGRTAV

SEQ ID NO: 480957 - protein, 7 aa, Mycobacterium
GDGRYSP

SEQ ID NO: 480958 - protein, 10 aa, Mycobacterium
GDGSAAVRTT

SEQ ID NO: 480959 - protein, 6 aa, Mycobacterium
GDGSAV

SEQ ID NO: 480960 - protein, 8 aa, Mycobacterium
GDGSCSAL

SEQ ID NO: 480961 - protein, 11 aa, Mycobacterium
GDGSCSGLPRN

SEQ ID NO: 480962 - protein, 11 aa, Mycobacterium
GDGSCSRRPHN

SEQ ID NO: 480963 - protein, 8 aa, Mycobacterium
GDGSDTRD

SEQ ID NO: 480964 - protein, 10 aa, Mycobacterium
GDGSEAVAGA

SEQ ID NO: 480965 - protein, 6 aa, Mycobacterium
GDGSEH

SEQ ID NO: 480966 - protein, 5 aa, Mycobacterium
GDGSG

SEQ ID NO: 480967 - protein, 10 aa, Mycobacterium
GDGSGAQATA

SEQ ID NO: 480968 - protein, 20 aa, Mycobacterium
GDGSGTLTGTQIPVDKGALK

SEQ ID NO: 480969 - protein, 20 aa, Mycobacterium
GDGSGTVTGTQIPVDKGALK

SEQ ID NO: 480970 - protein, 10 aa, Mycobacterium
GDGSKYQQIA

SEQ ID NO: 480971 - protein, 9 aa, Mycobacterium
GDGSLDPAA

SEQ ID NO: 480972 - protein, 6 aa, Mycobacterium
GDGSLH

SEQ ID NO: 480973 - protein, 7 aa, Mycobacterium
GDGSNAL

SEQ ID NO: 480974 - protein, 8 aa, Mycobacterium
GDGSPPIR

SEQ ID NO: 480975 - protein, 7 aa, Mycobacterium
GDGSQAL

SEQ ID NO: 480976 - protein, 9 aa, Mycobacterium
GDGSRIGAN

SEQ ID NO: 480977 - protein, 7 aa, Mycobacterium
GDGSRQT

SEQ ID NO: 480978 - protein, 12 aa, Mycobacterium
GDGSSADDYYPQ

SEQ ID NO: 480979 - protein, 5 aa, Mycobacterium
GDGST

SEQ ID NO: 480980 - protein, 17 aa, Mycobacterium
GDGSTISGRISIDGEVK

SEQ ID NO: 480981 - protein, 6 aa, Mycobacterium
GDGSTW

SEQ ID NO: 480982 - protein, 11 aa, Mycobacterium
GDGSVPASRPR

SEQ ID NO: 480983 - protein, 7 aa, Mycobacterium
GDGSVTE

SEQ ID NO: 480984 - protein, 4 aa, Mycobacterium
GDGT

SEQ ID NO: 480985 - protein, 8 aa, Mycobacterium
GDGTAGHA

SEQ ID NO: 480986 - protein, 6 aa, Mycobacterium
GDGTAV

SEQ ID NO: 480987 - protein, 18 aa, Mycobacterium
GDGTDGAAGSGQNGGPGG

SEQ ID NO: 480988 - protein, 18 aa, Mycobacterium
GDGTGEAAVAPQAPRRSY

SEQ ID NO: 480989 - protein, 6 aa, Mycobacterium
GDGTHR

SEQ ID NO: 480990 - protein, 8 aa, Mycobacterium
GDGTLEEV

SEQ ID NO: 480991 - protein, 7 aa, Mycobacterium
GDGTLGE

SEQ ID NO: 480992 - protein, 10 aa, Mycobacterium
GDGTLPPAGG

SEQ ID NO: 480993 - protein, 5 aa, Mycobacterium
GDGTN

SEQ ID NO: 480994 - protein, 6 aa, Mycobacterium
GDGTNA

SEQ ID NO: 480995 - protein, 8 aa, Mycobacterium
GDGTPDRI

SEQ ID NO: 480996 - protein, 10 aa, Mycobacterium
GDGTPETQRA

SEQ ID NO: 480997 - protein, 7 aa, Mycobacterium
GDGTPHQ

SEQ ID NO: 480998 - protein, 7 aa, Mycobacterium
GDGTPQT

SEQ ID NO: 480999 - protein, 5 aa, Mycobacterium
GDGTQ

SEQ ID NO: 481000 - protein, 6 aa, Mycobacterium
GDGTQA

SEQ ID NO: 481001 - protein, 8 aa, Mycobacterium
GDGTQGGY

SEQ ID NO: 481002 - protein, 6 aa, Mycobacterium
GDGTQQ

SEQ ID NO: 481003 - protein, 8 aa, Mycobacterium
GDGTRHSE

SEQ ID NO: 481004 - protein, 18 aa, Mycobacterium
GDGTRIGFSDTGNRKAPT

SEQ ID NO: 481005 - protein, 14 aa, Mycobacterium
GDGTSAAAQITTAD

SEQ ID NO: 481006 - protein, 7 aa, Mycobacterium
GDGTTAV

SEQ ID NO: 481007 - protein, 8 aa, Mycobacterium
GDGTTRDF

SEQ ID NO: 481008 - protein, 11 aa, Mycobacterium
GDGTVREEDRD

SEQ ID NO: 481009 - protein, 7 aa, Mycobacterium
GDGTVSE

SEQ ID NO: 481010 - protein, 13 aa, Mycobacterium
GDGVADPTQRSRD

SEQ ID NO: 481011 - protein, 8 aa, Mycobacterium
GDGVAGAA

SEQ ID NO: 481012 - protein, 10 aa, Mycobacterium
GDGVDTRRRD

SEQ ID NO: 481013 - protein, 15 aa, Mycobacterium
GDGVQIEDAGAYAAS

SEQ ID NO: 481014 - protein, 8 aa, Mycobacterium
GDGVSPDM

SEQ ID NO: 481015 - protein, 18 aa, Mycobacterium
GDGVTTRTMQSSDPAQPL

SEQ ID NO: 481016 - protein, 5 aa, Mycobacterium
GDGVV

SEQ ID NO: 481017 - protein, 13 aa, Mycobacterium
GDGYRALRNNDTL

SEQ ID NO: 481018 - protein, 6 aa, Mycobacterium
GDGYSE

SEQ ID NO: 481019 - protein, 8 aa, Mycobacterium
GDHADQAW

SEQ ID NO: 481020 - protein, 8 aa, Mycobacterium
GDHADTAG

SEQ ID NO: 481021 - protein, 18 aa, Mycobacterium
GDHAGDPAFRRTADQQRQ

SEQ ID NO: 481022 - protein, 8 aa, Mycobacterium
GDHAPADI

SEQ ID NO: 481023 - protein, 6 aa, Mycobacterium
GDHAPG

SEQ ID NO: 481024 - protein, 7 aa, Mycobacterium
GDHDAAA

SEQ ID NO: 481025 - protein, 7 aa, Mycobacterium
GDHDGAD

SEQ ID NO: 481026 - protein, 15 aa, Mycobacterium
GDHDHGRPHAIGRPE

SEQ ID NO: 481027 - protein, 6 aa, Mycobacterium
GDHEGA

SEQ ID NO: 481028 - protein, 4 aa, Mycobacterium
GDHG

SEQ ID NO: 481029 - protein, 5 aa, Mycobacterium
GDHGA

SEQ ID NO: 481030 - protein, 5 aa, Mycobacterium
GDHGD

SEQ ID NO: 481031 - protein, 10 aa, Mycobacterium
GDHGDGDHQR

SEQ ID NO: 481032 - protein, 12 aa, Mycobacterium
GDHGDVRQHASR

SEQ ID NO: 481033 - protein, 9 aa, Mycobacterium
GDHGETRDV

SEQ ID NO: 481034 - protein, 10 aa, Mycobacterium
GDHHQRDRQQ

SEQ ID NO: 481035 - protein, 11 aa, Mycobacterium
GDHHRADQRQF

SEQ ID NO: 481036 - protein, 9 aa, Mycobacterium
GDHHRRDRR

SEQ ID NO: 481037 - protein, 10 aa, Mycobacterium
GDHHRSDRQQ

SEQ ID NO: 481038 - protein, 9 aa, Mycobacterium
GDHHRTDRR

SEQ ID NO: 481039 - protein, 11 aa, Mycobacterium
GDHHRTDRRQF

SEQ ID NO: 481040 - protein, 4 aa, Mycobacterium
GDHI

SEQ ID NO: 481041 - protein, 6 aa, Mycobacterium
GDHNPI

SEQ ID NO: 481042 - protein, 5 aa, Mycobacterium
GDHPA

SEQ ID NO: 481043 - protein, 7 aa, Mycobacterium
GDHPDGQ

SEQ ID NO: 481044 - protein, 9 aa, Mycobacterium
GDHPDPGEM

SEQ ID NO: 481045 - protein, 8 aa, Mycobacterium
GDHPGFSG

SEQ ID NO: 481046 - protein, 8 aa, Mycobacterium
GDHPGPAN

SEQ ID NO: 481047 - protein, 6 aa, Mycobacterium
GDHPGV

SEQ ID NO: 481048 - protein, 6 aa, Mycobacterium
GDHPPW

SEQ ID NO: 481049 - protein, 5 aa, Mycobacterium
GDHPR

SEQ ID NO: 481050 - protein, 14 aa, Mycobacterium
GDHPRLDDNSEAAV

SEQ ID NO: 481051 - protein, 8 aa, Mycobacterium
GDHQPPTG

SEQ ID NO: 481052 - protein, 21 aa, Mycobacterium
GDHQVPGAKKALGHAYGGGSQ

SEQ ID NO: 481053 - protein, 5 aa, Mycobacterium
GDHRN

SEQ ID NO: 481054 - protein, 7 aa, Mycobacterium
GDHRPHG

SEQ ID NO: 481055 - protein, 9 aa, Mycobacterium
GDHSAAQNL

SEQ ID NO: 481056 - protein, 14 aa, Mycobacterium
GDHSGASAGFSNRD

SEQ ID NO: 481057 - protein, 19 aa, Mycobacterium
GDHSQDSVARRSGFGTPDT

SEQ ID NO: 481058 - protein, 6 aa, Mycobacterium
GDHSTY

SEQ ID NO: 481059 - protein, 8 aa, Mycobacterium
GDHTDEAQ

SEQ ID NO: 481060 - protein, 6 aa, Mycobacterium
GDHTDG

SEQ ID NO: 481061 - protein, 7 aa, Mycobacterium
GDHTGGI

SEQ ID NO: 481062 - protein, 18 aa, Mycobacterium
GDHTPSDTAPRPSAPDLD

SEQ ID NO: 481063 - protein, 4 aa, Mycobacterium
GDHV

SEQ ID NO: 481064 - protein, 4 aa, Mycobacterium
GDIA

SEQ ID NO: 481065 - protein, 15 aa, Mycobacterium
GDIAERARRAEASGF

SEQ ID NO: 481066 - protein, 7 aa, Mycobacterium
GDIAPEE

SEQ ID NO: 481067 - protein, 8 aa, Mycobacterium
GDIAPTTR

SEQ ID NO: 481068 - protein, 10 aa, Mycobacterium
GDIASAREAF

SEQ ID NO: 481069 - protein, 6 aa, Mycobacterium
GDIATA

SEQ ID NO: 481070 - protein, 5 aa, Mycobacterium
GDIDD

SEQ ID NO: 481071 - protein, 5 aa, Mycobacterium
GDIDK

SEQ ID NO: 481072 - protein, 10 aa, Mycobacterium
GDIDKVTGKR

SEQ ID NO: 481073 - protein, 5 aa, Mycobacterium
GDIDP

SEQ ID NO: 481074 - protein, 6 aa, Mycobacterium
GDIDPG

SEQ ID NO: 481075 - protein, 9 aa, Mycobacterium
GDIDSTTVD

SEQ ID NO: 481076 - protein, 5 aa, Mycobacterium
GDIDT

SEQ ID NO: 481077 - protein, 8 aa, Mycobacterium
GDIDTDAM

SEQ ID NO: 481078 - protein, 9 aa, Mycobacterium
GDIDTHEDG

SEQ ID NO: 481079 - protein, 12 aa, Mycobacterium
GDIEANPRQPRQ

SEQ ID NO: 481080 - protein, 5 aa, Mycobacterium
GDIED

SEQ ID NO: 481081 - protein, 9 aa, Mycobacterium
GDIEDTATG

SEQ ID NO: 481082 - protein, 13 aa, Mycobacterium
GDIEEGVTSEASS

SEQ ID NO: 481083 - protein, 14 aa, Mycobacterium
GDIEEGVTSEASSL

SEQ ID NO: 481084 - protein, 16 aa, Mycobacterium
GDIEEGVTSEASSLAG

SEQ ID NO: 481085 - protein, 19 aa, Mycobacterium
GDIEEGVTSEASSLAGTQQ

SEQ ID NO: 481086 - protein, 5 aa, Mycobacterium
GDIEP

SEQ ID NO: 481087 - protein, 10 aa, Mycobacterium
GDIGDDEDVQ

SEQ ID NO: 481088 - protein, 5 aa, Mycobacterium
GDIGG

SEQ ID NO: 481089 - protein, 34 aa, Mycobacterium
GDIGGKGGSGGTGGTGLTGAGGAGGAGGTGGQAD

SEQ ID NO: 481090 - protein, 7 aa, Mycobacterium
GDIGQEP

SEQ ID NO: 481091 - protein, 5 aa, Mycobacterium
GDIKD

SEQ ID NO: 481092 - protein, 6 aa, Mycobacterium
GDINPG

SEQ ID NO: 481093 - protein, 4 aa, Mycobacterium
GDIP

SEQ ID NO: 481094 - protein, 6 aa, Mycobacterium
GDIPDD

SEQ ID NO: 481095 - protein, 7 aa, Mycobacterium
GDIPGGE

SEQ ID NO: 481096 - protein, 5 aa, Mycobacterium
GDIPK

SEQ ID NO: 481097 - protein, 11 aa, Mycobacterium
GDIPQGQRERT

SEQ ID NO: 481098 - protein, 8 aa, Mycobacterium
GDIPSDGI

SEQ ID NO: 481099 - protein, 4 aa, Mycobacterium
GDIQ

SEQ ID NO: 481100 - protein, 6 aa, Mycobacterium
GDIQAR

SEQ ID NO: 481101 - protein, 8 aa, Mycobacterium
GDIRDSDA

SEQ ID NO: 481102 - protein, 10 aa, Mycobacterium
GDIRGDGGAA

SEQ ID NO: 481103 - protein, 11 aa, Mycobacterium
GDISEAAYAGD

SEQ ID NO: 481104 - protein, 11 aa, Mycobacterium
GDISQAAYTGD

SEQ ID NO: 481105 - protein, 12 aa, Mycobacterium
GDISQGAYPGDG

SEQ ID NO: 481106 - protein, 12 aa, Mycobacterium
GDISQSAHTGDG

SEQ ID NO: 481107 - protein, 8 aa, Mycobacterium
GDITDAQS

SEQ ID NO: 481108 - protein, 5 aa, Mycobacterium
GDITG

SEQ ID NO: 481109 - protein, 7 aa, Mycobacterium
GDITPEE

SEQ ID NO: 481110 - protein, 7 aa, Mycobacterium
GDKAAAL

SEQ ID NO: 481111 - protein, 18 aa, Mycobacterium
GDKADSRPSQLSGGQQQR

SEQ ID NO: 481112 - protein, 10 aa, Mycobacterium
GDKATGLGKP

SEQ ID NO: 481113 - protein, 10 aa, Mycobacterium
GDKATSGEDA

SEQ ID NO: 481114 - protein, 4 aa, Mycobacterium
GDKD

SEQ ID NO: 481115 - protein, 10 aa, Mycobacterium
GDKDAERARA

SEQ ID NO: 481116 - protein, 9 aa, Mycobacterium
GDKDGAAKV

SEQ ID NO: 481117 - protein, 20 aa, Mycobacterium
GDKDTTGNVESDAKSEQFSE

SEQ ID NO: 481118 - protein, 5 aa, Mycobacterium
GDKEA

SEQ ID NO: 481119 - protein, 6 aa, Mycobacterium
GDKEAV

SEQ ID NO: 481120 - protein, 5 aa, Mycobacterium
GDKED

SEQ ID NO: 481121 - protein, 12 aa, Mycobacterium
GDKEHPASRGYT

SEQ ID NO: 481122 - protein, 9 aa, Mycobacterium
GDKGAANLG

SEQ ID NO: 481123 - protein, 7 aa, Mycobacterium
GDKGAQI

SEQ ID NO: 481124 - protein, 9 aa, Mycobacterium
GDKGATNLG

SEQ ID NO: 481125 - protein, 8 aa, Mycobacterium
GDKGEANL

SEQ ID NO: 481126 - protein, 9 aa, Mycobacterium
GDKGEANLG

SEQ ID NO: 481127 - protein, 9 aa, Mycobacterium
GDKGEPNLG

SEQ ID NO: 481128 - protein, 9 aa, Mycobacterium
GDKGQANLG

SEQ ID NO: 481129 - protein, 8 aa, Mycobacterium
GDKGQPLW

SEQ ID NO: 481130 - protein, 9 aa, Mycobacterium
GDKGRTNLG

SEQ ID NO: 481131 - protein, 4 aa, Mycobacterium
GDKI

SEQ ID NO: 481132 - protein, 4 aa, Mycobacterium
GDKK

SEQ ID NO: 481133 - protein, 23 aa, Mycobacterium
GDKKGLGAKRTLAERSATQTAVA

SEQ ID NO: 481134 - protein, 8 aa, Mycobacterium
GDKKNRSG

SEQ ID NO: 481135 - protein, 8 aa, Mycobacterium
GDKKSRAG

SEQ ID NO: 481136 - protein, 8 aa, Mycobacterium
GDKKTRSG

SEQ ID NO: 481137 - protein, 8 aa, Mycobacterium
GDKNPLEQ

SEQ ID NO: 481138 - protein, 6 aa, Mycobacterium
GDKPAT

SEQ ID NO: 481139 - protein, 10 aa, Mycobacterium
GDKPLGRRPS

SEQ ID NO: 481140 - protein, 8 aa, Mycobacterium
GDKPPLPF

SEQ ID NO: 481141 - protein, 7 aa, Mycobacterium
GDKRLSD

SEQ ID NO: 481142 - protein, 15 aa, Mycobacterium
GDKRPSPTDARSPGF

SEQ ID NO: 481143 - protein, 10 aa, Mycobacterium
GDKRPVDSLT

SEQ ID NO: 481144 - protein, 10 aa, Mycobacterium
GDKRSAVSTN

SEQ ID NO: 481145 - protein, 8 aa, Mycobacterium
GDKRYRDF

SEQ ID NO: 481146 - protein, 8 aa, Mycobacterium
GDKSADDV

SEQ ID NO: 481147 - protein, 11 aa, Mycobacterium
GDKSASPRIKA

SEQ ID NO: 481148 - protein, 10 aa, Mycobacterium
GDKSEPGLGL

SEQ ID NO: 481149 - protein, 8 aa, Mycobacterium
GDKSHQRG

SEQ ID NO: 481150 - protein, 8 aa, Mycobacterium
GDKSKLST

SEQ ID NO: 481151 - protein, 15 aa, Mycobacterium
GDKSPAAQSDTSTDA

SEQ ID NO: 481152 - protein, 7 aa, Mycobacterium
GDKTPVS

SEQ ID NO: 481153 - protein, 9 aa, Mycobacterium
GDKTPVSLA

SEQ ID NO: 481154 - protein, 8 aa, Mycobacterium
GDKTPVSV

SEQ ID NO: 481155 - protein, 12 aa, Mycobacterium
GDKTSNTATDGG

SEQ ID NO: 481156 - protein, 25 aa, Mycobacterium
GDKTWPAPQGWSSPQQWAGPPDPVL

SEQ ID NO: 481157 - protein, 11 aa, Mycobacterium
GDKVASNQTEI

SEQ ID NO: 481158 - protein, 8 aa, Mycobacterium
GDKVGKDV

SEQ ID NO: 481159 - protein, 13 aa, Mycobacterium
GDKVPRKGGPGVT

SEQ ID NO: 481160 - protein, 7 aa, Mycobacterium
GDKVSRG

SEQ ID NO: 481161 - protein, 6 aa, Mycobacterium
GDLAAA

SEQ ID NO: 481162 - protein, 5 aa, Mycobacterium
GDLAE

SEQ ID NO: 481163 - protein, 6 aa, Mycobacterium
GDLAEA

SEQ ID NO: 481164 - protein, 14 aa, Mycobacterium
GDLAERHGRPHSPG

SEQ ID NO: 481165 - protein, 7 aa, Mycobacterium
GDLAGTR

SEQ ID NO: 481166 - protein, 13 aa, Mycobacterium
GDLAKPDTGLRQK

SEQ ID NO: 481167 - protein, 21 aa, Mycobacterium
GDLAKPETDLRQKAAAAVGAS

SEQ ID NO: 481168 - protein, 6 aa, Mycobacterium
GDLAPG

SEQ ID NO: 481169 - protein, 10 aa, Mycobacterium
GDLASASLSY

SEQ ID NO: 481170 - protein, 8 aa, Mycobacterium
GDLATPQG

SEQ ID NO: 481171 - protein, 6 aa, Mycobacterium
GDLDAQ

SEQ ID NO: 481172 - protein, 10 aa, Mycobacterium
GDLDDRPDEV

SEQ ID NO: 481173 - protein, 5 aa, Mycobacterium
GDLDE

SEQ ID NO: 481174 - protein, 7 aa, Mycobacterium
GDLDGQE

SEQ ID NO: 481175 - protein, 10 aa, Mycobacterium
GDLDKVTGKR

SEQ ID NO: 481176 - protein, 5 aa, Mycobacterium
GDLDP

SEQ ID NO: 481177 - protein, 9 aa, Mycobacterium
GDLDPDTVT

SEQ ID NO: 481178 - protein, 17 aa, Mycobacterium
GDLDPEQLADRFRMAWS

SEQ ID NO: 481179 - protein, 8 aa, Mycobacterium
GDLDQDPE

SEQ ID NO: 481180 - protein, 9 aa, Mycobacterium
GDLDQVTGK

SEQ ID NO: 481181 - protein, 6 aa, Mycobacterium
GDLDRT

SEQ ID NO: 481182 - protein, 12 aa, Mycobacterium
GDLDTGQLSDDE

SEQ ID NO: 481183 - protein, 10 aa, Mycobacterium
GDLEERPGHD

SEQ ID NO: 481184 - protein, 23 aa, Mycobacterium
GDLEGPATGGPDVEDEGGANSHD

SEQ ID NO: 481185 - protein, 10 aa, Mycobacterium
GDLEGSPELV

SEQ ID NO: 481186 - protein, 14 aa, Mycobacterium
GDLEPHGVHPGDPY

SEQ ID NO: 481187 - protein, 5 aa, Mycobacterium
GDLER

SEQ ID NO: 481188 - protein, 8 aa, Mycobacterium
GDLESNAK

SEQ ID NO: 481189 - protein, 9 aa, Mycobacterium
GDLESNPQL

SEQ ID NO: 481190 - protein, 22 aa, Mycobacterium
GDLETQAVTAERNCPEGAISLS

SEQ ID NO: 481191 - protein, 4 aa, Mycobacterium
GDLG

SEQ ID NO: 481192 - protein, 12 aa, Mycobacterium
GDLGAADEGIGP

SEQ ID NO: 481193 - protein, 9 aa, Mycobacterium
GDLGASAAR

SEQ ID NO: 481194 - protein, 9 aa, Mycobacterium
GDLGNAGAL

SEQ ID NO: 481195 - protein, 33 aa, Mycobacterium
GDLGPDCPEPRPSCDDEGQSGRADVAASPPAAA

SEQ ID NO: 481196 - protein, 6 aa, Mycobacterium
GDLGPG

SEQ ID NO: 481197 - protein, 8 aa, Mycobacterium
GDLGQHNG

SEQ ID NO: 481198 - protein, 8 aa, Mycobacterium
GDLGSGKS

SEQ ID NO: 481199 - protein, 8 aa, Mycobacterium
GDLGSHNG

SEQ ID NO: 481200 - protein, 11 aa, Mycobacterium
GDLGSSAARKY

SEQ ID NO: 481201 - protein, 5 aa, Mycobacterium
GDLGT

SEQ ID NO: 481202 - protein, 13 aa, Mycobacterium
GDLGTGGAGGTGG

SEQ ID NO: 481203 - protein, 13 aa, Mycobacterium
GDLKDGEGSVGTF

SEQ ID NO: 481204 - protein, 10 aa, Mycobacterium
GDLKDSDSRI

SEQ ID NO: 481205 - protein, 8 aa, Mycobacterium
GDLNDREL

SEQ ID NO: 481206 - protein, 5 aa, Mycobacterium
GDLNP

SEQ ID NO: 481207 - protein, 11 aa, Mycobacterium
GDLNQGNGNVG

SEQ ID NO: 481208 - protein, 4 aa, Mycobacterium
GDLP

SEQ ID NO: 481209 - protein, 8 aa, Mycobacterium
GDLPADSA

SEQ ID NO: 481210 - protein, 8 aa, Mycobacterium
GDLPAGVT

SEQ ID NO: 481211 - protein, 26 aa, Mycobacterium
GDLPGEGRRHAQRNRDADAVAQPPDV

SEQ ID NO: 481212 - protein, 13 aa, Mycobacterium
GDLPGTARIGAPE

SEQ ID NO: 481213 - protein, 17 aa, Mycobacterium
GDLPGTARVGPEGSGLA

SEQ ID NO: 481214 - protein, 12 aa, Mycobacterium
GDLPGTSRIGPP

SEQ ID NO: 481215 - protein, 6 aa, Mycobacterium
GDLPPR

SEQ ID NO: 481216 - protein, 10 aa, Mycobacterium
GDLPPTTAAA

SEQ ID NO: 481217 - protein, 14 aa, Mycobacterium
GDLPRDSIDQLVSI

SEQ ID NO: 481218 - protein, 6 aa, Mycobacterium
GDLPRG

SEQ ID NO: 481219 - protein, 12 aa, Mycobacterium
GDLPSKPSDVEG

SEQ ID NO: 481220 - protein, 6 aa, Mycobacterium
GDLPTE

SEQ ID NO: 481221 - protein, 13 aa, Mycobacterium
GDLPTEHESEAPG

SEQ ID NO: 481222 - protein, 12 aa, Mycobacterium
GDLPTEPEPDAS

SEQ ID NO: 481223 - protein, 4 aa, Mycobacterium
GDLQ

SEQ ID NO: 481224 - protein, 10 aa, Mycobacterium
GDLQGGATLA

SEQ ID NO: 481225 - protein, 29 aa, Mycobacterium
GDLQPEPDPEPGPPPAPAGPVPVGPADDQ

SEQ ID NO: 481226 - protein, 14 aa, Mycobacterium
GDLQTRGVHPGDPY

SEQ ID NO: 481227 - protein, 11 aa, Mycobacterium
GDLRADSDTDA

SEQ ID NO: 481228 - protein, 12 aa, Mycobacterium
GDLRDALDSDES

SEQ ID NO: 481229 - protein, 6 aa, Mycobacterium
GDLRGG

SEQ ID NO: 481230 - protein, 4 aa, Mycobacterium
GDLS

SEQ ID NO: 481231 - protein, 12 aa, Mycobacterium
GDLSAATDTPAL

SEQ ID NO: 481232 - protein, 7 aa, Mycobacterium
GDLSAGM

SEQ ID NO: 481233 - protein, 9 aa, Mycobacterium
GDLSAPALP

SEQ ID NO: 481234 - protein, 9 aa, Mycobacterium
GDLSDPAEK

SEQ ID NO: 481235 - protein, 9 aa, Mycobacterium
GDLSDPAEN

SEQ ID NO: 481236 - protein, 14 aa, Mycobacterium
GDLSEDVDKGGKTF

SEQ ID NO: 481237 - protein, 14 aa, Mycobacterium
GDLSEEVDKGGKTF

SEQ ID NO: 481238 - protein, 14 aa, Mycobacterium
GDLSEEVSKGGKTF

SEQ ID NO: 481239 - protein, 14 aa, Mycobacterium
GDLSEPSTAEVAEA

SEQ ID NO: 481240 - protein, 16 aa, Mycobacterium
GDLSGDSVPTGGDDPH

SEQ ID NO: 481241 - protein, 27 aa, Mycobacterium
GDLSGISQPGEAGDKTAARAKDTGDDW

SEQ ID NO: 481242 - protein, 31 aa, Mycobacterium
GDLSGLAKPGESNDKVTQRAADTGDDWTPTG

SEQ ID NO: 481243 - protein, 26 aa, Mycobacterium
GDLSGLARPGEAGDKTAARIKDTGDD

SEQ ID NO: 481244 - protein, 31 aa, Mycobacterium
GDLSGLSAPGKGDDKTAARARDTGDDWTPTG

SEQ ID NO: 481245 - protein, 31 aa, Mycobacterium
GDLSGLSRAGEVNDKTAARAKDTGDTWTPTG

SEQ ID NO: 481246 - protein, 29 aa, Mycobacterium
GDLSGLSRAGQTDDKLAARAEETGDAWTP

SEQ ID NO: 481247 - protein, 31 aa, Mycobacterium
GDLSGLSRPGEPHDKVAQRAADTGDEWAPTA

SEQ ID NO: 481248 - protein, 16 aa, Mycobacterium
GDLSNDGLTGLAPPTG

SEQ ID NO: 481249 - protein, 9 aa, Mycobacterium
GDLSPATVS

SEQ ID NO: 481250 - protein, 10 aa, Mycobacterium
GDLSTPEKSR

SEQ ID NO: 481251 - protein, 15 aa, Mycobacterium
GDLTEPSAAQVAEAA

SEQ ID NO: 481252 - protein, 12 aa, Mycobacterium
GDLTEPSPAQVA

SEQ ID NO: 481253 - protein, 5 aa, Mycobacterium
GDLTG

SEQ ID NO: 481254 - protein, 16 aa, Mycobacterium
GDLTGGDTAGAADAAN

SEQ ID NO: 481255 - protein, 7 aa, Mycobacterium
GDLTGIG

SEQ ID NO: 481256 - protein, 7 aa, Mycobacterium
GDLTGLP

SEQ ID NO: 481257 - protein, 7 aa, Mycobacterium
GDLTPAM

SEQ ID NO: 481258 - protein, 6 aa, Mycobacterium
GDLTPQ

SEQ ID NO: 481259 - protein, 7 aa, Mycobacterium
GDLTPTM

SEQ ID NO: 481260 - protein, 5 aa, Mycobacterium
GDLTS

SEQ ID NO: 481261 - protein, 7 aa, Mycobacterium
GDLTSAR

SEQ ID NO: 481262 - protein, 4 aa, Mycobacterium
GDLV

SEQ ID NO: 481263 - protein, 8 aa, Mycobacterium
GDLYGSPG

SEQ ID NO: 481264 - protein, 4 aa, Mycobacterium
GDMA

SEQ ID NO: 481265 - protein, 4 aa, Mycobacterium
GDMG

SEQ ID NO: 481266 - protein, 8 aa, Mycobacterium
GDMPGGER

SEQ ID NO: 481267 - protein, 6 aa, Mycobacterium
GDMPGI

SEQ ID NO: 481268 - protein, 14 aa, Mycobacterium
GDMRGTAEDSNERI

SEQ ID NO: 481269 - protein, 9 aa, Mycobacterium
GDMSARDGL

SEQ ID NO: 481270 - protein, 5 aa, Mycobacterium
GDMTN

SEQ ID NO: 481271 - protein, 8 aa, Mycobacterium
GDMTPGDE

SEQ ID NO: 481272 - protein, 5 aa, Mycobacterium
GDMTR

SEQ ID NO: 481273 - protein, 5 aa, Mycobacterium
GDMYP

SEQ ID NO: 481274 - protein, 5 aa, Mycobacterium
GDNAD

SEQ ID NO: 481275 - protein, 6 aa, Mycobacterium
GDNAGS

SEQ ID NO: 481276 - protein, 5 aa, Mycobacterium
GDNAS

SEQ ID NO: 481277 - protein, 6 aa, Mycobacterium
GDNASD

SEQ ID NO: 481278 - protein, 10 aa, Mycobacterium
GDNASDGSGV

SEQ ID NO: 481279 - protein, 8 aa, Mycobacterium
GDNATADN

SEQ ID NO: 481280 - protein, 16 aa, Mycobacterium
GDNDGSPPTPADNGGY

SEQ ID NO: 481281 - protein, 9 aa, Mycobacterium
GDNDRGSPM

SEQ ID NO: 481282 - protein, 7 aa, Mycobacterium
GDNDTER

SEQ ID NO: 481283 - protein, 5 aa, Mycobacterium
GDNDV

SEQ ID NO: 481284 - protein, 5 aa, Mycobacterium
GDNEF

SEQ ID NO: 481285 - protein, 7 aa, Mycobacterium
GDNETAR

SEQ ID NO: 481286 - protein, 13 aa, Mycobacterium
GDNFSAGHDLGSE

SEQ ID NO: 481287 - protein, 10 aa, Mycobacterium
GDNGAGKSSL

SEQ ID NO: 481288 - protein, 9 aa, Mycobacterium
GDNGAGKST

SEQ ID NO: 481289 - protein, 10 aa, Mycobacterium
GDNGAGKSTL

SEQ ID NO: 481290 - protein, 6 aa, Mycobacterium
GDNGAK

SEQ ID NO: 481291 - protein, 7 aa, Mycobacterium
GDNGAKA

SEQ ID NO: 481292 - protein, 7 aa, Mycobacterium
GDNGLSR

SEQ ID NO: 481293 - protein, 7 aa, Mycobacterium
GDNGRRR

SEQ ID NO: 481294 - protein, 5 aa, Mycobacterium
GDNHR

SEQ ID NO: 481295 - protein, 10 aa, Mycobacterium
GDNIEDPAQI

SEQ ID NO: 481296 - protein, 5 aa, Mycobacterium
GDNKE

SEQ ID NO: 481297 - protein, 7 aa, Mycobacterium
GDNKHNG

SEQ ID NO: 481298 - protein, 9 aa, Mycobacterium
GDNLAHPKA

SEQ ID NO: 481299 - protein, 4 aa, Mycobacterium
GDNN

SEQ ID NO: 481300 - protein, 7 aa, Mycobacterium
GDNNDAF

SEQ ID NO: 481301 - protein, 10 aa, Mycobacterium
GDNNGVKATS

SEQ ID NO: 481302 - protein, 8 aa, Mycobacterium
GDNNMHDG

SEQ ID NO: 481303 - protein, 5 aa, Mycobacterium
GDNNV

SEQ ID NO: 481304 - protein, 7 aa, Mycobacterium
GDNPAYA

SEQ ID NO: 481305 - protein, 8 aa, Mycobacterium
GDNPDSGV

SEQ ID NO: 481306 - protein, 6 aa, Mycobacterium
GDNPDV

SEQ ID NO: 481307 - protein, 5 aa, Mycobacterium
GDNPE

SEQ ID NO: 481308 - protein, 7 aa, Mycobacterium
GDNPEWD

SEQ ID NO: 481309 - protein, 8 aa, Mycobacterium
GDNPGCTV

SEQ ID NO: 481310 - protein, 7 aa, Mycobacterium
GDNPPEL

SEQ ID NO: 481311 - protein, 5 aa, Mycobacterium
GDNQI

SEQ ID NO: 481312 - protein, 5 aa, Mycobacterium
GDNQV

SEQ ID NO: 481313 - protein, 6 aa, Mycobacterium
GDNQVG

SEQ ID NO: 481314 - protein, 7 aa, Mycobacterium
GDNQVGI

SEQ ID NO: 481315 - protein, 7 aa, Mycobacterium
GDNRTEA

SEQ ID NO: 481316 - protein, 4 aa, Mycobacterium
GDNS

SEQ ID NO: 481317 - protein, 8 aa, Mycobacterium
GDNSGTVE

SEQ ID NO: 481318 - protein, 9 aa, Mycobacterium
GDNSRSVEE

SEQ ID NO: 481319 - protein, 7 aa, Mycobacterium
GDNSTTW

SEQ ID NO: 481320 - protein, 8 aa, Mycobacterium
GDNSTTWN

SEQ ID NO: 481321 - protein, 14 aa, Mycobacterium
GDNTEQTDEWFPLA

SEQ ID NO: 481322 - protein, 5 aa, Mycobacterium
GDNTN

SEQ ID NO: 481323 - protein, 9 aa, Mycobacterium
GDNTRPDAI

SEQ ID NO: 481324 - protein, 4 aa, Mycobacterium
GDNV

SEQ ID NO: 481325 - protein, 13 aa, Mycobacterium
GDNVTAGYRTASG

SEQ ID NO: 481326 - protein, 7 aa, Mycobacterium
GDPAAAE

SEQ ID NO: 481327 - protein, 12 aa, Mycobacterium
GDPAAAKPLSEG

SEQ ID NO: 481328 - protein, 8 aa, Mycobacterium
GDPAAARQ

SEQ ID NO: 481329 - protein, 19 aa, Mycobacterium
GDPAAASANRIAKDSGATW

SEQ ID NO: 481330 - protein, 17 aa, Mycobacterium
GDPAAEAELDAAENPSI

SEQ ID NO: 481331 - protein, 14 aa, Mycobacterium
GDPAAGAGIVPDST

SEQ ID NO: 481332 - protein, 8 aa, Mycobacterium
GDPAAGTY

SEQ ID NO: 481333 - protein, 22 aa, Mycobacterium
GDPAALGPTLADAAKAAEQGGA

SEQ ID NO: 481334 - protein, 11 aa, Mycobacterium
GDPAASKRART

SEQ ID NO: 481335 - protein, 9 aa, Mycobacterium
GDPAATAAL

SEQ ID NO: 481336 - protein, 7 aa, Mycobacterium
GDPAATP

SEQ ID NO: 481337 - protein, 10 aa, Mycobacterium
GDPADEATDI

SEQ ID NO: 481338 - protein, 11 aa, Mycobacterium
GDPADEKTDIG

SEQ ID NO: 481339 - protein, 11 aa, Mycobacterium
GDPADEKTDVG

SEQ ID NO: 481340 - protein, 7 aa, Mycobacterium
GDPADEL

SEQ ID NO: 481341 - protein, 19 aa, Mycobacterium
GDPADGADIGDGVRVSIAK

SEQ ID NO: 481342 - protein, 6 aa, Mycobacterium
GDPADI

SEQ ID NO: 481343 - protein, 7 aa, Mycobacterium
GDPADMA

SEQ ID NO: 481344 - protein, 19 aa, Mycobacterium
GDPADNNADGSPRVPHPPR

SEQ ID NO: 481345 - protein, 6 aa, Mycobacterium
GDPADP

SEQ ID NO: 481346 - protein, 9 aa, Mycobacterium
GDPADPDSM

SEQ ID NO: 481347 - protein, 11 aa, Mycobacterium
GDPADPDTDLG

SEQ ID NO: 481348 - protein, 9 aa, Mycobacterium
GDPADPEAA

SEQ ID NO: 481349 - protein, 9 aa, Mycobacterium
GDPADPKTY

SEQ ID NO: 481350 - protein, 8 aa, Mycobacterium
GDPADPNT

SEQ ID NO: 481351 - protein, 5 aa, Mycobacterium
GDPAE

SEQ ID NO: 481352 - protein, 8 aa, Mycobacterium
GDPAEGEV

SEQ ID NO: 481353 - protein, 6 aa, Mycobacterium
GDPAEL

SEQ ID NO: 481354 - protein, 8 aa, Mycobacterium
GDPAEPDL

SEQ ID NO: 481355 - protein, 8 aa, Mycobacterium
GDPAERRR

SEQ ID NO: 481356 - protein, 5 aa, Mycobacterium
GDPAF

SEQ ID NO: 481357 - protein, 8 aa, Mycobacterium
GDPAGDVN

SEQ ID NO: 481358 - protein, 9 aa, Mycobacterium
GDPAGELTA

SEQ ID NO: 481359 - protein, 7 aa, Mycobacterium
GDPAKLR

SEQ ID NO: 481360 - protein, 5 aa, Mycobacterium
GDPAL

SEQ ID NO: 481361 - protein, 6 aa, Mycobacterium
GDPALG

SEQ ID NO: 481362 - protein, 7 aa, Mycobacterium
GDPALGA

SEQ ID NO: 481363 - protein, 12 aa, Mycobacterium
GDPALPERLSAR

SEQ ID NO: 481364 - protein, 8 aa, Mycobacterium
GDPALPTT

SEQ ID NO: 481365 - protein, 6 aa, Mycobacterium
GDPANH

SEQ ID NO: 481366 - protein, 10 aa, Mycobacterium
GDPANLDGLG

SEQ ID NO: 481367 - protein, 6 aa, Mycobacterium
GDPANS

SEQ ID NO: 481368 - protein, 7 aa, Mycobacterium
GDPAPEF

SEQ ID NO: 481369 - protein, 7 aa, Mycobacterium
GDPAPLA

SEQ ID NO: 481370 - protein, 16 aa, Mycobacterium
GDPAPPPQVNRGRTDV

SEQ ID NO: 481371 - protein, 9 aa, Mycobacterium
GDPAPRSIP

SEQ ID NO: 481372 - protein, 10 aa, Mycobacterium
GDPAPTQELN

SEQ ID NO: 481373 - protein, 7 aa, Mycobacterium
GDPAQDF

SEQ ID NO: 481374 - protein, 6 aa, Mycobacterium
GDPAQI

SEQ ID NO: 481375 - protein, 7 aa, Mycobacterium
GDPARGL

SEQ ID NO: 481376 - protein, 22 aa, Mycobacterium
GDPARLGPTLADAAKAAEQGGA

SEQ ID NO: 481377 - protein, 9 aa, Mycobacterium
GDPARPGML

SEQ ID NO: 481378 - protein, 11 aa, Mycobacterium
GDPASRGTEMG

SEQ ID NO: 481379 - protein, 5 aa, Mycobacterium
GDPAT

SEQ ID NO: 481380 - protein, 9 aa, Mycobacterium
GDPATGAEK

SEQ ID NO: 481381 - protein, 9 aa, Mycobacterium
GDPATGAEQ

SEQ ID NO: 481382 - protein, 11 aa, Mycobacterium
GDPATGSDRGA

SEQ ID NO: 481383 - protein, 6 aa, Mycobacterium
GDPATL

SEQ ID NO: 481384 - protein, 9 aa, Mycobacterium
GDPATPPHW

SEQ ID NO: 481385 - protein, 8 aa, Mycobacterium
GDPAWSTS

SEQ ID NO: 481386 - protein, 8 aa, Mycobacterium
GDPAYDPE

SEQ ID NO: 481387 - protein, 16 aa, Mycobacterium
GDPAYGYDTGPANVPT

SEQ ID NO: 481388 - protein, 15 aa, Mycobacterium
GDPAYGYSTSPADIT

SEQ ID NO: 481389 - protein, 8 aa, Mycobacterium
GDPAYQTE

SEQ ID NO: 481390 - protein, 5 aa, Mycobacterium
GDPDA

SEQ ID NO: 481391 - protein, 9 aa, Mycobacterium
GDPDAFPAG

SEQ ID NO: 481392 - protein, 10 aa, Mycobacterium
GDPDAFPATD

SEQ ID NO: 481393 - protein, 9 aa, Mycobacterium
GDPDAFPRG

SEQ ID NO: 481394 - protein, 7 aa, Mycobacterium
GDPDAVP

SEQ ID NO: 481395 - protein, 9 aa, Mycobacterium
GDPDDDVGT

SEQ ID NO: 481396 - protein, 9 aa, Mycobacterium
GDPDDKLES

SEQ ID NO: 481397 - protein, 9 aa, Mycobacterium
GDPDDPEQL

SEQ ID NO: 481398 - protein, 7 aa, Mycobacterium
GDPDEDF

SEQ ID NO: 481399 - protein, 8 aa, Mycobacterium
GDPDEGAE

SEQ ID NO: 481400 - protein, 8 aa, Mycobacterium
GDPDEGDR

SEQ ID NO: 481401 - protein, 14 aa, Mycobacterium
GDPDERTRDGGPTI

SEQ ID NO: 481402 - protein, 6 aa, Mycobacterium
GDPDEV

SEQ ID NO: 481403 - protein, 7 aa, Mycobacterium
GDPDEYL

SEQ ID NO: 481404 - protein, 8 aa, Mycobacterium
GDPDGGAV

SEQ ID NO: 481405 - protein, 7 aa, Mycobacterium
GDPDGGV

SEQ ID NO: 481406 - protein, 13 aa, Mycobacterium
GDPDLRFGLYGPG

SEQ ID NO: 481407 - protein, 8 aa, Mycobacterium
GDPDPKHV

SEQ ID NO: 481408 - protein, 15 aa, Mycobacterium
GDPDPNNPNDIRPPK

SEQ ID NO: 481409 - protein, 12 aa, Mycobacterium
GDPDPRRRGTGG

SEQ ID NO: 481410 - protein, 6 aa, Mycobacterium
GDPDPW

SEQ ID NO: 481411 - protein, 8 aa, Mycobacterium
GDPDQVAE

SEQ ID NO: 481412 - protein, 8 aa, Mycobacterium
GDPDRAAA

SEQ ID NO: 481413 - protein, 8 aa, Mycobacterium
GDPDRPGM

SEQ ID NO: 481414 - protein, 9 aa, Mycobacterium
GDPDRPGML

SEQ ID NO: 481415 - protein, 9 aa, Mycobacterium
GDPDRPLTA

SEQ ID NO: 481416 - protein, 15 aa, Mycobacterium
GDPDRPLTSADYDRP

SEQ ID NO: 481417 - protein, 10 aa, Mycobacterium
GDPDRPPVRT

SEQ ID NO: 481418 - protein, 7 aa, Mycobacterium
GDPDRRI

SEQ ID NO: 481419 - protein, 16 aa, Mycobacterium
GDPDRTAPGARHLAAS

SEQ ID NO: 481420 - protein, 10 aa, Mycobacterium
GDPDSARRAQ

SEQ ID NO: 481421 - protein, 16 aa, Mycobacterium
GDPDSRNDDDSAASMP

SEQ ID NO: 481422 - protein, 17 aa, Mycobacterium
GDPDSRNDDDSADSMPK

SEQ ID NO: 481423 - protein, 14 aa, Mycobacterium
GDPDSRNDDDSAGF

SEQ ID NO: 481424 - protein, 16 aa, Mycobacterium
GDPDSRNDDDSAPNMP

SEQ ID NO: 481425 - protein, 9 aa, Mycobacterium
GDPDTGGDE

SEQ ID NO: 481426 - protein, 9 aa, Mycobacterium
GDPDVLDGG

SEQ ID NO: 481427 - protein, 7 aa, Mycobacterium
GDPDYVT

SEQ ID NO: 481428 - protein, 5 aa, Mycobacterium
GDPEA

SEQ ID NO: 481429 - protein, 8 aa, Mycobacterium
GDPEAHSQ

SEQ ID NO: 481430 - protein, 6 aa, Mycobacterium
GDPEAV

SEQ ID NO: 481431 - protein, 8 aa, Mycobacterium
GDPECCPS

SEQ ID NO: 481432 - protein, 7 aa, Mycobacterium
GDPEEDI

SEQ ID NO: 481433 - protein, 5 aa, Mycobacterium
GDPEI

SEQ ID NO: 481434 - protein, 9 aa, Mycobacterium
GDPEKTART

SEQ ID NO: 481435 - protein, 9 aa, Mycobacterium
GDPELATTQ

SEQ ID NO: 481436 - protein, 6 aa, Mycobacterium
GDPELN

SEQ ID NO: 481437 - protein, 10 aa, Mycobacterium
GDPELPPVPE

SEQ ID NO: 481438 - protein, 7 aa, Mycobacterium
GDPENFE

SEQ ID NO: 481439 - protein, 6 aa, Mycobacterium
GDPENP

SEQ ID NO: 481440 - protein, 6 aa, Mycobacterium
GDPEPA

SEQ ID NO: 481441 - protein, 14 aa, Mycobacterium
GDPEPTQGVDNGMS

SEQ ID NO: 481442 - protein, 14 aa, Mycobacterium
GDPEPWPGAGTNWR

SEQ ID NO: 481443 - protein, 10 aa, Mycobacterium
GDPEQGPTRG

SEQ ID NO: 481444 - protein, 7 aa, Mycobacterium
GDPEQPF

SEQ ID NO: 481445 - protein, 9 aa, Mycobacterium
GDPEQPFSY

SEQ ID NO: 481446 - protein, 5 aa, Mycobacterium
GDPER

SEQ ID NO: 481447 - protein, 6 aa, Mycobacterium
GDPESA

SEQ ID NO: 481448 - protein, 8 aa, Mycobacterium
GDPESHIR

SEQ ID NO: 481449 - protein, 16 aa, Mycobacterium
GDPESRNDDDSAASMP

SEQ ID NO: 481450 - protein, 15 aa, Mycobacterium
GDPETWPERPAIGRP

SEQ ID NO: 481451 - protein, 5 aa, Mycobacterium
GDPEV

SEQ ID NO: 481452 - protein, 5 aa, Mycobacterium
GDPFD

SEQ ID NO: 481453 - protein, 4 aa, Mycobacterium
GDPG

SEQ ID NO: 481454 - protein, 6 aa, Mycobacterium
GDPGAA

SEQ ID NO: 481455 - protein, 7 aa, Mycobacterium
GDPGAAL

SEQ ID NO: 481456 - protein, 9 aa, Mycobacterium
GDPGAAMPV

SEQ ID NO: 481457 - protein, 11 aa, Mycobacterium
GDPGAASANRI

SEQ ID NO: 481458 - protein, 11 aa, Mycobacterium
GDPGAEGTEMG

SEQ ID NO: 481459 - protein, 9 aa, Mycobacterium
GDPGAESGF

SEQ ID NO: 481460 - protein, 9 aa, Mycobacterium
GDPGAVSAN

SEQ ID NO: 481461 - protein, 8 aa, Mycobacterium
GDPGDLDE

SEQ ID NO: 481462 - protein, 7 aa, Mycobacterium
GDPGDLT

SEQ ID NO: 481463 - protein, 10 aa, Mycobacterium
GDPGDRADGV

SEQ ID NO: 481464 - protein, 9 aa, Mycobacterium
GDPGEAARR

SEQ ID NO: 481465 - protein, 10 aa, Mycobacterium
GDPGEHAATA

SEQ ID NO: 481466 - protein, 5 aa, Mycobacterium
GDPGF

SEQ ID NO: 481467 - protein, 5 aa, Mycobacterium
GDPGG

SEQ ID NO: 481468 - protein, 10 aa, Mycobacterium
GDPGHRPNAA

SEQ ID NO: 481469 - protein, 8 aa, Mycobacterium
GDPGIGKS

SEQ ID NO: 481470 - protein, 8 aa, Mycobacterium
GDPGLDTS

SEQ ID NO: 481471 - protein, 11 aa, Mycobacterium
GDPGPRPVGTG

SEQ ID NO: 481472 - protein, 16 aa, Mycobacterium
GDPGQKSDDVSGSGSY

SEQ ID NO: 481473 - protein, 5 aa, Mycobacterium
GDPGR

SEQ ID NO: 481474 - protein, 6 aa, Mycobacterium
GDPGRF

SEQ ID NO: 481475 - protein, 8 aa, Mycobacterium
GDPGSETG

SEQ ID NO: 481476 - protein, 15 aa, Mycobacterium
GDPGSPKPRPQPASV

SEQ ID NO: 481477 - protein, 9 aa, Mycobacterium
GDPGSVSAN

SEQ ID NO: 481478 - protein, 6 aa, Mycobacterium
GDPGTE

SEQ ID NO: 481479 - protein, 15 aa, Mycobacterium
GDPGTLSSASSIPAG

SEQ ID NO: 481480 - protein, 8 aa, Mycobacterium
GDPGVGKS

SEQ ID NO: 481481 - protein, 6 aa, Mycobacterium
GDPGVS

SEQ ID NO: 481482 - protein, 10 aa, Mycobacterium
GDPGYRPNAA

SEQ ID NO: 481483 - protein, 13 aa, Mycobacterium
GDPGYRPNAALGP

SEQ ID NO: 481484 - protein, 7 aa, Mycobacterium
GDPGYTE

SEQ ID NO: 481485 - protein, 13 aa, Mycobacterium
GDPHNDDDIAGAV

SEQ ID NO: 481486 - protein, 10 aa, Mycobacterium
GDPHNGDDIA

SEQ ID NO: 481487 - protein, 6 aa, Mycobacterium
GDPHPE

SEQ ID NO: 481488 - protein, 6 aa, Mycobacterium
GDPHPG

SEQ ID NO: 481489 - protein, 7 aa, Mycobacterium
GDPHSTL

SEQ ID NO: 481490 - protein, 6 aa, Mycobacterium
GDPHVE

SEQ ID NO: 481491 - protein, 10 aa, Mycobacterium
GDPICSDGNQ

SEQ ID NO: 481492 - protein, 9 aa, Mycobacterium
GDPICSGGT

SEQ ID NO: 481493 - protein, 12 aa, Mycobacterium
GDPIPSTDEAVT

SEQ ID NO: 481494 - protein, 7 aa, Mycobacterium
GDPITGG

SEQ ID NO: 481495 - protein, 4 aa, Mycobacterium
GDPK

SEQ ID NO: 481496 - protein, 10 aa, Mycobacterium
GDPKDIHATD

SEQ ID NO: 481497 - protein, 7 aa, Mycobacterium
GDPKGTT

SEQ ID NO: 481498 - protein, 6 aa, Mycobacterium
GDPKRL

SEQ ID NO: 481499 - protein, 9 aa, Mycobacterium
GDPKSLTGR

SEQ ID NO: 481500 - protein, 7 aa, Mycobacterium
GDPKSRV

SEQ ID NO: 481501 - protein, 9 aa, Mycobacterium
GDPKVTVTQ

SEQ ID NO: 481502 - protein, 5 aa, Mycobacterium
GDPLA

SEQ ID NO: 481503 - protein, 7 aa, Mycobacterium
GDPLDAR

SEQ ID NO: 481504 - protein, 15 aa, Mycobacterium
GDPLDGATPSGASSI

SEQ ID NO: 481505 - protein, 8 aa, Mycobacterium
GDPLDPAT

SEQ ID NO: 481506 - protein, 19 aa, Mycobacterium
GDPLDTSDVDPGFSHIDYD

SEQ ID NO: 481507 - protein, 16 aa, Mycobacterium
GDPLEGAGAAANGFSG

SEQ ID NO: 481508 - protein, 16 aa, Mycobacterium
GDPLENGGGGNGFGGF

SEQ ID NO: 481509 - protein, 18 aa, Mycobacterium
GDPLESAAAAGAGFGGGF

SEQ ID NO: 481510 - protein, 17 aa, Mycobacterium
GDPLESAAAGGGGFSGF

SEQ ID NO: 481511 - protein, 16 aa, Mycobacterium
GDPLESAGASASGFAG

SEQ ID NO: 481512 - protein, 6 aa, Mycobacterium
GDPLGG

SEQ ID NO: 481513 - protein, 6 aa, Mycobacterium
GDPLGQ

SEQ ID NO: 481514 - protein, 6 aa, Mycobacterium
GDPLPD

SEQ ID NO: 481515 - protein, 14 aa, Mycobacterium
GDPLPPGRSGVAGT

SEQ ID NO: 481516 - protein, 5 aa, Mycobacterium
GDPLT

SEQ ID NO: 481517 - protein, 7 aa, Mycobacterium
GDPLTAA

SEQ ID NO: 481518 - protein, 19 aa, Mycobacterium
GDPMENAAAAGGGFGGGFG

SEQ ID NO: 481519 - protein, 17 aa, Mycobacterium
GDPMESVGGAPNGFGGF

SEQ ID NO: 481520 - protein, 6 aa, Mycobacterium
GDPMSL

SEQ ID NO: 481521 - protein, 10 aa, Mycobacterium
GDPNAFTGNG

SEQ ID NO: 481522 - protein, 10 aa, Mycobacterium
GDPNELSEER

SEQ ID NO: 481523 - protein, 8 aa, Mycobacterium
GDPNGAVA

SEQ ID NO: 481524 - protein, 12 aa, Mycobacterium
GDPNGGGAGRSS

SEQ ID NO: 481525 - protein, 9 aa, Mycobacterium
GDPNGRAKL

SEQ ID NO: 481526 - protein, 7 aa, Mycobacterium
GDPNGRD

SEQ ID NO: 481527 - protein, 6 aa, Mycobacterium
GDPNGV

SEQ ID NO: 481528 - protein, 5 aa, Mycobacterium
GDPNI

SEQ ID NO: 481529 - protein, 25 aa, Mycobacterium
GDPNPPAKQAPAAPGAQPGGQEPSV

SEQ ID NO: 481530 - protein, 5 aa, Mycobacterium
GDPNQ

SEQ ID NO: 481531 - protein, 9 aa, Mycobacterium
GDPNTLHGG

SEQ ID NO: 481532 - protein, 10 aa, Mycobacterium
GDPNYGYSTG

SEQ ID NO: 481533 - protein, 16 aa, Mycobacterium
GDPNYGYSTGPANVPT

SEQ ID NO: 481534 - protein, 10 aa, Mycobacterium
GDPNYGYSTS

SEQ ID NO: 481535 - protein, 13 aa, Mycobacterium
GDPPAGGPQRDHV

SEQ ID NO: 481536 - protein, 6 aa, Mycobacterium
GDPPAI

SEQ ID NO: 481537 - protein, 13 aa, Mycobacterium
GDPPDYEPTPDRT

SEQ ID NO: 481538 - protein, 13 aa, Mycobacterium
GDPPDYEPTRDRT

SEQ ID NO: 481539 - protein, 7 aa, Mycobacterium
GDPPPGL

SEQ ID NO: 481540 - protein, 9 aa, Mycobacterium
GDPPPRAVP

SEQ ID NO: 481541 - protein, 5 aa, Mycobacterium
GDPPR

SEQ ID NO: 481542 - protein, 4 aa, Mycobacterium
GDPQ

SEQ ID NO: 481543 - protein, 5 aa, Mycobacterium
GDPQA

SEQ ID NO: 481544 - protein, 6 aa, Mycobacterium
GDPQAH

SEQ ID NO: 481545 - protein, 7 aa, Mycobacterium
GDPQANV

SEQ ID NO: 481546 - protein, 7 aa, Mycobacterium
GDPQPTI

SEQ ID NO: 481547 - protein, 18 aa, Mycobacterium
GDPQRAEAAAQVFIARLR

SEQ ID NO: 481548 - protein, 8 aa, Mycobacterium
GDPQRNEA

SEQ ID NO: 481549 - protein, 7 aa, Mycobacterium
GDPQRPG

SEQ ID NO: 481550 - protein, 8 aa, Mycobacterium
GDPQRPGL

SEQ ID NO: 481551 - protein, 6 aa, Mycobacterium
GDPQRV

SEQ ID NO: 481552 - protein, 9 aa, Mycobacterium
GDPRDADAA

SEQ ID NO: 481553 - protein, 9 aa, Mycobacterium
GDPRDESAY

SEQ ID NO: 481554 - protein, 6 aa, Mycobacterium
GDPRDR

SEQ ID NO: 481555 - protein, 5 aa, Mycobacterium
GDPRF

SEQ ID NO: 481556 - protein, 6 aa, Mycobacterium
GDPRGR

SEQ ID NO: 481557 - protein, 8 aa, Mycobacterium
GDPRGRHE

SEQ ID NO: 481558 - protein, 6 aa, Mycobacterium
GDPRLP

SEQ ID NO: 481559 - protein, 20 aa, Mycobacterium
GDPRLSEAVDEARRHARRTN

SEQ ID NO: 481560 - protein, 8 aa, Mycobacterium
GDPRPGEV

SEQ ID NO: 481561 - protein, 6 aa, Mycobacterium
GDPRQL

SEQ ID NO: 481562 - protein, 8 aa, Mycobacterium
GDPRRARS

SEQ ID NO: 481563 - protein, 8 aa, Mycobacterium
GDPRRPGM

SEQ ID NO: 481564 - protein, 6 aa, Mycobacterium
GDPRSE

SEQ ID NO: 481565 - protein, 8 aa, Mycobacterium
GDPRTSRD

SEQ ID NO: 481566 - protein, 10 aa, Mycobacterium
GDPRTVSPER

SEQ ID NO: 481567 - protein, 15 aa, Mycobacterium
GDPRYGYSTAPANIE

SEQ ID NO: 481568 - protein, 17 aa, Mycobacterium
GDPRYGYSTAPANVPTP

SEQ ID NO: 481569 - protein, 8 aa, Mycobacterium
GDPSAAPR

SEQ ID NO: 481570 - protein, 9 aa, Mycobacterium
GDPSAPGTL

SEQ ID NO: 481571 - protein, 13 aa, Mycobacterium
GDPSAPTKTHPPT

SEQ ID NO: 481572 - protein, 10 aa, Mycobacterium
GDPSDGLPGV

SEQ ID NO: 481573 - protein, 18 aa, Mycobacterium
GDPSDGLPGVPGIGEKTA

SEQ ID NO: 481574 - protein, 19 aa, Mycobacterium
GDPSDGLPGVPGVGEKTAA

SEQ ID NO: 481575 - protein, 10 aa, Mycobacterium
GDPSDPGTQL

SEQ ID NO: 481576 - protein, 10 aa, Mycobacterium
GDPSGAAAGE

SEQ ID NO: 481577 - protein, 13 aa, Mycobacterium
GDPSGHASMESNR

SEQ ID NO: 481578 - protein, 10 aa, Mycobacterium
GDPSGLEGMG

SEQ ID NO: 481579 - protein, 6 aa, Mycobacterium
GDPSGQ

SEQ ID NO: 481580 - protein, 11 aa, Mycobacterium
GDPSGTAAAGE

SEQ ID NO: 481581 - protein, 11 aa, Mycobacterium
GDPSHSGPRAI

SEQ ID NO: 481582 - protein, 9 aa, Mycobacterium
GDPSITDAN

SEQ ID NO: 481583 - protein, 5 aa, Mycobacterium
GDPSM

SEQ ID NO: 481584 - protein, 8 aa, Mycobacterium
GDPSMPSG

SEQ ID NO: 481585 - protein, 8 aa, Mycobacterium
GDPSPEEI

SEQ ID NO: 481586 - protein, 13 aa, Mycobacterium
GDPSPIDNGGSKW

SEQ ID NO: 481587 - protein, 12 aa, Mycobacterium
GDPSPLDTGGTK

SEQ ID NO: 481588 - protein, 9 aa, Mycobacterium
GDPSQATPL

SEQ ID NO: 481589 - protein, 16 aa, Mycobacterium
GDPSQKGDDVSGSGSY

SEQ ID NO: 481590 - protein, 7 aa, Mycobacterium
GDPSQPF

SEQ ID NO: 481591 - protein, 8 aa, Mycobacterium
GDPSRAAK

SEQ ID NO: 481592 - protein, 21 aa, Mycobacterium
GDPSRRTSGAWPSSRPYGSVS

SEQ ID NO: 481593 - protein, 9 aa, Mycobacterium
GDPSRVAGW

SEQ ID NO: 481594 - protein, 10 aa, Mycobacterium
GDPSSSSAPV

SEQ ID NO: 481595 - protein, 9 aa, Mycobacterium
GDPSTGGDE

SEQ ID NO: 481596 - protein, 8 aa, Mycobacterium
GDPSVNEA

SEQ ID NO: 481597 - protein, 6 aa, Mycobacterium
GDPSVY

SEQ ID NO: 481598 - protein, 4 aa, Mycobacterium
GDPT

SEQ ID NO: 481599 - protein, 12 aa, Mycobacterium
GDPTADDTQMGP

SEQ ID NO: 481600 - protein, 9 aa, Mycobacterium
GDPTDPDEA

SEQ ID NO: 481601 - protein, 32 aa, Mycobacterium
GDPTDPETDVGPLATESGRDEIAKQVDDAAAA

SEQ ID NO: 481602 - protein, 18 aa, Mycobacterium
GDPTDPGTVQGPQISKVQ

SEQ ID NO: 481603 - protein, 5 aa, Mycobacterium
GDPTF

SEQ ID NO: 481604 - protein, 13 aa, Mycobacterium
GDPTGTGRGGPGY

SEQ ID NO: 481605 - protein, 12 aa, Mycobacterium
GDPTIKPNPNLR

SEQ ID NO: 481606 - protein, 8 aa, Mycobacterium
GDPTLPNP

SEQ ID NO: 481607 - protein, 9 aa, Mycobacterium
GDPTLPNPN

SEQ ID NO: 481608 - protein, 5 aa, Mycobacterium
GDPTM

SEQ ID NO: 481609 - protein, 6 aa, Mycobacterium
GDPTPV

SEQ ID NO: 481610 - protein, 12 aa, Mycobacterium
GDPTQRPPKHPV

SEQ ID NO: 481611 - protein, 5 aa, Mycobacterium
GDPTR

SEQ ID NO: 481612 - protein, 7 aa, Mycobacterium
GDPTRER

SEQ ID NO: 481613 - protein, 7 aa, Mycobacterium
GDPTRRV

SEQ ID NO: 481614 - protein, 6 aa, Mycobacterium
GDPTSR

SEQ ID NO: 481615 - protein, 5 aa, Mycobacterium
GDPTT

SEQ ID NO: 481616 - protein, 13 aa, Mycobacterium
GDPTTASSQDGAR

SEQ ID NO: 481617 - protein, 12 aa, Mycobacterium
GDPTTATAAEGE

SEQ ID NO: 481618 - protein, 12 aa, Mycobacterium
GDPTTATADEGR

SEQ ID NO: 481619 - protein, 12 aa, Mycobacterium
GDPTTATAEEGR

SEQ ID NO: 481620 - protein, 10 aa, Mycobacterium
GDPTTATAVE

SEQ ID NO: 481621 - protein, 9 aa, Mycobacterium
GDPTTGGDE

SEQ ID NO: 481622 - protein, 5 aa, Mycobacterium
GDPTV

SEQ ID NO: 481623 - protein, 13 aa, Mycobacterium
GDPTVTPNPNLRP

SEQ ID NO: 481624 - protein, 18 aa, Mycobacterium
GDPTVTPNPNLRPLDDGP

SEQ ID NO: 481625 - protein, 13 aa, Mycobacterium
GDPTVTPSPNLRP

SEQ ID NO: 481626 - protein, 6 aa, Mycobacterium
GDPTWP

SEQ ID NO: 481627 - protein, 11 aa, Mycobacterium
GDPVDDATQMG

SEQ ID NO: 481628 - protein, 10 aa, Mycobacterium
GDPVDEAAGP

SEQ ID NO: 481629 - protein, 11 aa, Mycobacterium
GDPVDYREAGE

SEQ ID NO: 481630 - protein, 7 aa, Mycobacterium
GDPVERP

SEQ ID NO: 481631 - protein, 5 aa, Mycobacterium
GDPVF

SEQ ID NO: 481632 - protein, 10 aa, Mycobacterium
GDPVGGWPEP

SEQ ID NO: 481633 - protein, 5 aa, Mycobacterium
GDPVI

SEQ ID NO: 481634 - protein, 6 aa, Mycobacterium
GDPVKD

SEQ ID NO: 481635 - protein, 6 aa, Mycobacterium
GDPVPG

SEQ ID NO: 481636 - protein, 18 aa, Mycobacterium
GDPVPPVDTYASGRPADQ

SEQ ID NO: 481637 - protein, 5 aa, Mycobacterium
GDPVQ

SEQ ID NO: 481638 - protein, 16 aa, Mycobacterium
GDPVTDENGQPPITAK

SEQ ID NO: 481639 - protein, 14 aa, Mycobacterium
GDPVTQRTARRYSY

SEQ ID NO: 481640 - protein, 8 aa, Mycobacterium
GDPVTSGY

SEQ ID NO: 481641 - protein, 20 aa, Mycobacterium
GDPVVGSGAGDAARDQPAVP

SEQ ID NO: 481642 - protein, 7 aa, Mycobacterium
GDPWDAA

SEQ ID NO: 481643 - protein, 9 aa, Mycobacterium
GDPWTPTSR

SEQ ID NO: 481644 - protein, 19 aa, Mycobacterium
GDPYAQRRPLDPDPDSAAG

SEQ ID NO: 481645 - protein, 8 aa, Mycobacterium
GDPYCSSG

SEQ ID NO: 481646 - protein, 7 aa, Mycobacterium
GDPYPAY

SEQ ID NO: 481647 - protein, 11 aa, Mycobacterium
GDQAAISKSTV

SEQ ID NO: 481648 - protein, 6 aa, Mycobacterium
GDQADI

SEQ ID NO: 481649 - protein, 8 aa, Mycobacterium
GDQAGSVL

SEQ ID NO: 481650 - protein, 10 aa, Mycobacterium
GDQAPFEGAG

SEQ ID NO: 481651 - protein, 6 aa, Mycobacterium
GDQATF

SEQ ID NO: 481652 - protein, 5 aa, Mycobacterium
GDQAV

SEQ ID NO: 481653 - protein, 10 aa, Mycobacterium
GDQAVNPRNP

SEQ ID NO: 481654 - protein, 7 aa, Mycobacterium
GDQDALR

SEQ ID NO: 481655 - protein, 10 aa, Mycobacterium
GDQDPEFANN

SEQ ID NO: 481656 - protein, 14 aa, Mycobacterium
GDQDPEFASNDAIT

SEQ ID NO: 481657 - protein, 14 aa, Mycobacterium
GDQDPEFASNDAMT

SEQ ID NO: 481658 - protein, 10 aa, Mycobacterium
GDQDPEFATN

SEQ ID NO: 481659 - protein, 8 aa, Mycobacterium
GDQDRADA

SEQ ID NO: 481660 - protein, 7 aa, Mycobacterium
GDQEHPF

SEQ ID NO: 481661 - protein, 7 aa, Mycobacterium
GDQEPPP

SEQ ID NO: 481662 - protein, 9 aa, Mycobacterium
GDQFQGAPQ

SEQ ID NO: 481663 - protein, 7 aa, Mycobacterium
GDQGRSI

SEQ ID NO: 481664 - protein, 8 aa, Mycobacterium
GDQGRSQI

SEQ ID NO: 481665 - protein, 8 aa, Mycobacterium
GDQGTQTM

SEQ ID NO: 481666 - protein, 6 aa, Mycobacterium
GDQHDQ

SEQ ID NO: 481667 - protein, 14 aa, Mycobacterium
GDQHPSPIDPNFTG

SEQ ID NO: 481668 - protein, 8 aa, Mycobacterium
GDQKNASL

SEQ ID NO: 481669 - protein, 16 aa, Mycobacterium
GDQKQQEQDLQRARDN

SEQ ID NO: 481670 - protein, 9 aa, Mycobacterium
GDQKTSSAW

SEQ ID NO: 481671 - protein, 8 aa, Mycobacterium
GDQLPEKT

SEQ ID NO: 481672 - protein, 12 aa, Mycobacterium
GDQLPEKTYPLT

SEQ ID NO: 481673 - protein, 10 aa, Mycobacterium
GDQLPERTYP

SEQ ID NO: 481674 - protein, 6 aa, Mycobacterium
GDQLQG

SEQ ID NO: 481675 - protein, 10 aa, Mycobacterium
GDQPERTGRT

SEQ ID NO: 481676 - protein, 8 aa, Mycobacterium
GDQPEVQA

SEQ ID NO: 481677 - protein, 19 aa, Mycobacterium
GDQPGDGARLPMLPESWDG

SEQ ID NO: 481678 - protein, 8 aa, Mycobacterium
GDQPGRSI

SEQ ID NO: 481679 - protein, 10 aa, Mycobacterium
GDQPIQSASG

SEQ ID NO: 481680 - protein, 14 aa, Mycobacterium
GDQPPVGMFPEKQQ

SEQ ID NO: 481681 - protein, 8 aa, Mycobacterium
GDQPSDET

SEQ ID NO: 481682 - protein, 6 aa, Mycobacterium
GDQPTK

SEQ ID NO: 481683 - protein, 6 aa, Mycobacterium
GDQPTL

SEQ ID NO: 481684 - protein, 5 aa, Mycobacterium
GDQPV

SEQ ID NO: 481685 - protein, 15 aa, Mycobacterium
GDQPVGAAADRPQRL

SEQ ID NO: 481686 - protein, 8 aa, Mycobacterium
GDQQGQVS

SEQ ID NO: 481687 - protein, 5 aa, Mycobacterium
GDQQW

SEQ ID NO: 481688 - protein, 5 aa, Mycobacterium
GDQRA

SEQ ID NO: 481689 - protein, 18 aa, Mycobacterium
GDQRAADGVGQAPAGPGL

SEQ ID NO: 481690 - protein, 6 aa, Mycobacterium
GDQRGL

SEQ ID NO: 481691 - protein, 22 aa, Mycobacterium
GDQRIRGRSGYQYASGDTADTV

SEQ ID NO: 481692 - protein, 28 aa, Mycobacterium
GDQRIRGRSGYQYASGDTAETVDPARAG

SEQ ID NO: 481693 - protein, 22 aa, Mycobacterium
GDQRIRGRSGYQYASGETADTV

SEQ ID NO: 481694 - protein, 28 aa, Mycobacterium
GDQRIRGRSGYQYASGETADTVDPARAG

SEQ ID NO: 481695 - protein, 28 aa, Mycobacterium
GDQRIRGRTGYQYAGGETAETVDPGRAG

SEQ ID NO: 481696 - protein, 28 aa, Mycobacterium
GDQRIRGRTGYQYASGETAETVDPARAG

SEQ ID NO: 481697 - protein, 8 aa, Mycobacterium
GDQRNASL

SEQ ID NO: 481698 - protein, 7 aa, Mycobacterium
GDQRSTV

SEQ ID NO: 481699 - protein, 22 aa, Mycobacterium
GDQSAPPEPRVPRVPEGSAGIE

SEQ ID NO: 481700 - protein, 36 aa, Mycobacterium
GDQSFEKRPYPPGQHGRARIKESEYRQQLQEKQKAR

SEQ ID NO: 481701 - protein, 36 aa, Mycobacterium
GDQSFEKRPYPPGQHGRARIKESEYRTQLQEKQKAR

SEQ ID NO: 481702 - protein, 9 aa, Mycobacterium
GDQSGPYAG

SEQ ID NO: 481703 - protein, 20 aa, Mycobacterium
GDQSSTPTNSHGRSPTAPLG

SEQ ID NO: 481704 - protein, 10 aa, Mycobacterium
GDQSTPTLER

SEQ ID NO: 481705 - protein, 14 aa, Mycobacterium
GDQTMTAPGGSEVP

SEQ ID NO: 481706 - protein, 9 aa, Mycobacterium
GDQTPDPRS

SEQ ID NO: 481707 - protein, 7 aa, Mycobacterium
GDQTPEL

SEQ ID NO: 481708 - protein, 7 aa, Mycobacterium
GDQTRVG

SEQ ID NO: 481709 - protein, 4 aa, Mycobacterium
GDQV

SEQ ID NO: 481710 - protein, 25 aa, Mycobacterium
GDQVSRIKTDGTPGFRGSKSDAATL

SEQ ID NO: 481711 - protein, 11 aa, Mycobacterium
GDRAAETGRQI

SEQ ID NO: 481712 - protein, 11 aa, Mycobacterium
GDRAAQTGAQI

SEQ ID NO: 481713 - protein, 6 aa, Mycobacterium
GDRAAR

SEQ ID NO: 481714 - protein, 11 aa, Mycobacterium
GDRAARTGEQI

SEQ ID NO: 481715 - protein, 5 aa, Mycobacterium
GDRAD

SEQ ID NO: 481716 - protein, 9 aa, Mycobacterium
GDRADVDEN

SEQ ID NO: 481717 - protein, 5 aa, Mycobacterium
GDRAE

SEQ ID NO: 481718 - protein, 13 aa, Mycobacterium
GDRAEDEVEQYGS

SEQ ID NO: 481719 - protein, 9 aa, Mycobacterium
GDRAERRRR

SEQ ID NO: 481720 - protein, 6 aa, Mycobacterium
GDRAET

SEQ ID NO: 481721 - protein, 7 aa, Mycobacterium
GDRAFSA

SEQ ID NO: 481722 - protein, 16 aa, Mycobacterium
GDRANGAFPAGMPPEF

SEQ ID NO: 481723 - protein, 10 aa, Mycobacterium
GDRAPETGAQ

SEQ ID NO: 481724 - protein, 8 aa, Mycobacterium
GDRAPFNN

SEQ ID NO: 481725 - protein, 12 aa, Mycobacterium
GDRAPGHGVDGD

SEQ ID NO: 481726 - protein, 11 aa, Mycobacterium
GDRAPKTGAEV

SEQ ID NO: 481727 - protein, 11 aa, Mycobacterium
GDRAPKTGAQV

SEQ ID NO: 481728 - protein, 10 aa, Mycobacterium
GDRAPQTGAQ

SEQ ID NO: 481729 - protein, 6 aa, Mycobacterium
GDRARA

SEQ ID NO: 481730 - protein, 8 aa, Mycobacterium
GDRARAHE

SEQ ID NO: 481731 - protein, 19 aa, Mycobacterium
GDRARDAHPCNGDDDARYA

SEQ ID NO: 481732 - protein, 9 aa, Mycobacterium
GDRARSEDV

SEQ ID NO: 481733 - protein, 10 aa, Mycobacterium
GDRASQGDQF

SEQ ID NO: 481734 - protein, 6 aa, Mycobacterium
GDRASS

SEQ ID NO: 481735 - protein, 8 aa, Mycobacterium
GDRASSPA

SEQ ID NO: 481736 - protein, 15 aa, Mycobacterium
GDRASYGWQRDGGHA

SEQ ID NO: 481737 - protein, 6 aa, Mycobacterium
GDRATG

SEQ ID NO: 481738 - protein, 5 aa, Mycobacterium
GDRAV

SEQ ID NO: 481739 - protein, 12 aa, Mycobacterium
GDRAVGNYSGGM

SEQ ID NO: 481740 - protein, 7 aa, Mycobacterium
GDRCQTR

SEQ ID NO: 481741 - protein, 15 aa, Mycobacterium
GDRCRSDDRGRRYRS

SEQ ID NO: 481742 - protein, 10 aa, Mycobacterium
GDRDAAAPRL

SEQ ID NO: 481743 - protein, 10 aa, Mycobacterium
GDRDAASREV

SEQ ID NO: 481744 - protein, 11 aa, Mycobacterium
GDRDELRDAGV

SEQ ID NO: 481745 - protein, 11 aa, Mycobacterium
GDRDGNGTDPT

SEQ ID NO: 481746 - protein, 8 aa, Mycobacterium
GDRDGQTL

SEQ ID NO: 481747 - protein, 14 aa, Mycobacterium
GDRDGRAAVQSPIQ

SEQ ID NO: 481748 - protein, 10 aa, Mycobacterium
GDRDKARMSR

SEQ ID NO: 481749 - protein, 5 aa, Mycobacterium
GDRDP

SEQ ID NO: 481750 - protein, 6 aa, Mycobacterium
GDRDQV

SEQ ID NO: 481751 - protein, 6 aa, Mycobacterium
GDRDRQ

SEQ ID NO: 481752 - protein, 6 aa, Mycobacterium
GDRDRR

SEQ ID NO: 481753 - protein, 10 aa, Mycobacterium
GDRDVSETDV

SEQ ID NO: 481754 - protein, 4 aa, Mycobacterium
GDRE

SEQ ID NO: 481755 - protein, 9 aa, Mycobacterium
GDREATRAL

SEQ ID NO: 481756 - protein, 9 aa, Mycobacterium
GDREPTTQQ

SEQ ID NO: 481757 - protein, 9 aa, Mycobacterium
GDRERADNV

SEQ ID NO: 481758 - protein, 6 aa, Mycobacterium
GDRETE

SEQ ID NO: 481759 - protein, 7 aa, Mycobacterium
GDRETLR

SEQ ID NO: 481760 - protein, 8 aa, Mycobacterium
GDRETLSA

SEQ ID NO: 481761 - protein, 4 aa, Mycobacterium
GDRF

SEQ ID NO: 481762 - protein, 7 aa, Mycobacterium
GDRFPDG

SEQ ID NO: 481763 - protein, 12 aa, Mycobacterium
GDRGAGAVAART

SEQ ID NO: 481764 - protein, 12 aa, Mycobacterium
GDRGAGGVIKPG

SEQ ID NO: 481765 - protein, 17 aa, Mycobacterium
GDRGAIPRRADTSHRSV

SEQ ID NO: 481766 - protein, 6 aa, Mycobacterium
GDRGDA

SEQ ID NO: 481767 - protein, 31 aa, Mycobacterium
GDRGDVSVADPEGAHRGRRSGAVEPAATPDD

SEQ ID NO: 481768 - protein, 6 aa, Mycobacterium
GDRGDW

SEQ ID NO: 481769 - protein, 9 aa, Mycobacterium
GDRGERERA

SEQ ID NO: 481770 - protein, 7 aa, Mycobacterium
GDRGGRL

SEQ ID NO: 481771 - protein, 5 aa, Mycobacterium
GDRGH

SEQ ID NO: 481772 - protein, 5 aa, Mycobacterium
GDRGL

SEQ ID NO: 481773 - protein, 6 aa, Mycobacterium
GDRGLK

SEQ ID NO: 481774 - protein, 12 aa, Mycobacterium
GDRGPGAVASHT

SEQ ID NO: 481775 - protein, 7 aa, Mycobacterium
GDRGRSR

SEQ ID NO: 481776 - protein, 10 aa, Mycobacterium
GDRGSDSAGV

SEQ ID NO: 481777 - protein, 8 aa, Mycobacterium
GDRGSVDD

SEQ ID NO: 481778 - protein, 8 aa, Mycobacterium
GDRGSVST

SEQ ID NO: 481779 - protein, 5 aa, Mycobacterium
GDRGV

SEQ ID NO: 481780 - protein, 15 aa, Mycobacterium
GDRGVAGRSDSPAAS

SEQ ID NO: 481781 - protein, 27 aa, Mycobacterium
GDRHPRPAPRPSYSALAATKSTAAGLT

SEQ ID NO: 481782 - protein, 5 aa, Mycobacterium
GDRHT

SEQ ID NO: 481783 - protein, 4 aa, Mycobacterium
GDRI

SEQ ID NO: 481784 - protein, 8 aa, Mycobacterium
GDRKRPAR

SEQ ID NO: 481785 - protein, 4 aa, Mycobacterium
GDRL

SEQ ID NO: 481786 - protein, 5 aa, Mycobacterium
GDRLK

SEQ ID NO: 481787 - protein, 8 aa, Mycobacterium
GDRNAADE

SEQ ID NO: 481788 - protein, 11 aa, Mycobacterium
GDRNASTGNVS

SEQ ID NO: 481789 - protein, 13 aa, Mycobacterium
GDRNHHDTEFGPT

SEQ ID NO: 481790 - protein, 6 aa, Mycobacterium
GDRNPL

SEQ ID NO: 481791 - protein, 8 aa, Mycobacterium
GDRNPPVF

SEQ ID NO: 481792 - protein, 8 aa, Mycobacterium
GDRNTAAE

SEQ ID NO: 481793 - protein, 6 aa, Mycobacterium
GDRPAD

SEQ ID NO: 481794 - protein, 7 aa, Mycobacterium
GDRPALG

SEQ ID NO: 481795 - protein, 8 aa, Mycobacterium
GDRPAQLE

SEQ ID NO: 481796 - protein, 14 aa, Mycobacterium
GDRPCTRADGAATR

SEQ ID NO: 481797 - protein, 5 aa, Mycobacterium
GDRPD

SEQ ID NO: 481798 - protein, 9 aa, Mycobacterium
GDRPDAPEK

SEQ ID NO: 481799 - protein, 9 aa, Mycobacterium
GDRPDDSPV

SEQ ID NO: 481800 - protein, 16 aa, Mycobacterium
GDRPDGAERCDGLHRL

SEQ ID NO: 481801 - protein, 6 aa, Mycobacterium
GDRPDV

SEQ ID NO: 481802 - protein, 7 aa, Mycobacterium
GDRPEPA

SEQ ID NO: 481803 - protein, 7 aa, Mycobacterium
GDRPGAW

SEQ ID NO: 481804 - protein, 8 aa, Mycobacterium
GDRPGRSI

SEQ ID NO: 481805 - protein, 8 aa, Mycobacterium
GDRPGSSI

SEQ ID NO: 481806 - protein, 6 aa, Mycobacterium
GDRPLE

SEQ ID NO: 481807 - protein, 12 aa, Mycobacterium
GDRPLPPPTEAA

SEQ ID NO: 481808 - protein, 8 aa, Mycobacterium
GDRPLTLP

SEQ ID NO: 481809 - protein, 8 aa, Mycobacterium
GDRPPEVA

SEQ ID NO: 481810 - protein, 7 aa, Mycobacterium
GDRPPRV

SEQ ID NO: 481811 - protein, 12 aa, Mycobacterium
GDRPRSRAASKL

SEQ ID NO: 481812 - protein, 17 aa, Mycobacterium
GDRPRWQTTGEDGRARS

SEQ ID NO: 481813 - protein, 13 aa, Mycobacterium
GDRPSETAKAARE

SEQ ID NO: 481814 - protein, 9 aa, Mycobacterium
GDRPSGPIP

SEQ ID NO: 481815 - protein, 6 aa, Mycobacterium
GDRPTD

SEQ ID NO: 481816 - protein, 7 aa, Mycobacterium
GDRPVQV

SEQ ID NO: 481817 - protein, 5 aa, Mycobacterium
GDRPW

SEQ ID NO: 481818 - protein, 8 aa, Mycobacterium
GDRQAAER

SEQ ID NO: 481819 - protein, 9 aa, Mycobacterium
GDRQKTTEI

SEQ ID NO: 481820 - protein, 8 aa, Mycobacterium
GDRQRADA

SEQ ID NO: 481821 - protein, 11 aa, Mycobacterium
GDRQVPNDPQV

SEQ ID NO: 481822 - protein, 6 aa, Mycobacterium
GDRRAA

SEQ ID NO: 481823 - protein, 5 aa, Mycobacterium
GDRRD

SEQ ID NO: 481824 - protein, 7 aa, Mycobacterium
GDRRRAD

SEQ ID NO: 481825 - protein, 13 aa, Mycobacterium
GDRRVRGSVPPPE

SEQ ID NO: 481826 - protein, 4 aa, Mycobacterium
GDRS

SEQ ID NO: 481827 - protein, 8 aa, Mycobacterium
GDRSAAVT

SEQ ID NO: 481828 - protein, 94 aa, Mycobacterium
GDRSASGHPTITAPESAASPVAMPPSMGAPSASGGGSASSLSGAMPKMSGGGGLSSAGGSGLSSPGGVSSGGSGLSGLSSGGAPSAPAAPTPTQ

SEQ ID NO: 481829 - protein, 5 aa, Mycobacterium
GDRSG

SEQ ID NO: 481830 - protein, 8 aa, Mycobacterium
GDRSGAKL

SEQ ID NO: 481831 - protein, 7 aa, Mycobacterium
GDRSGDQ

SEQ ID NO: 481832 - protein, 8 aa, Mycobacterium
GDRSITTV

SEQ ID NO: 481833 - protein, 18 aa, Mycobacterium
GDRSLKGAMKGADRSGAS

SEQ ID NO: 481834 - protein, 13 aa, Mycobacterium
GDRSPATVAAKTE

SEQ ID NO: 481835 - protein, 13 aa, Mycobacterium
GDRSPRAVASRTE

SEQ ID NO: 481836 - protein, 8 aa, Mycobacterium
GDRSPTLE

SEQ ID NO: 481837 - protein, 11 aa, Mycobacterium
GDRSQDYPELD

SEQ ID NO: 481838 - protein, 7 aa, Mycobacterium
GDRSREE

SEQ ID NO: 481839 - protein, 9 aa, Mycobacterium
GDRSSRRQA

SEQ ID NO: 481840 - protein, 16 aa, Mycobacterium
GDRSSYRSTKIPSPLM

SEQ ID NO: 481841 - protein, 7 aa, Mycobacterium
GDRTAEG

SEQ ID NO: 481842 - protein, 6 aa, Mycobacterium
GDRTAQ

SEQ ID NO: 481843 - protein, 11 aa, Mycobacterium
GDRTGGGGNVE

SEQ ID NO: 481844 - protein, 9 aa, Mycobacterium
GDRTIGSAE

SEQ ID NO: 481845 - protein, 7 aa, Mycobacterium
GDRTPPR

SEQ ID NO: 481846 - protein, 8 aa, Mycobacterium
GDRTPRAL

SEQ ID NO: 481847 - protein, 10 aa, Mycobacterium
GDRTTSRECR

SEQ ID NO: 481848 - protein, 8 aa, Mycobacterium
GDRTTSTI

SEQ ID NO: 481849 - protein, 5 aa, Mycobacterium
GDRTV

SEQ ID NO: 481850 - protein, 8 aa, Mycobacterium
GDRTVGAA

SEQ ID NO: 481851 - protein, 24 aa, Mycobacterium
GDRTVTTATGDGYRTTSYRELGRQ

SEQ ID NO: 481852 - protein, 7 aa, Mycobacterium
GDRVDAA

SEQ ID NO: 481853 - protein, 9 aa, Mycobacterium
GDRVPRPVR

SEQ ID NO: 481854 - protein, 8 aa, Mycobacterium
GDRVRAEA

SEQ ID NO: 481855 - protein, 15 aa, Mycobacterium
GDRVTRPRRVTAPTS

SEQ ID NO: 481856 - protein, 12 aa, Mycobacterium
GDRWSSAATDTI

SEQ ID NO: 481857 - protein, 18 aa, Mycobacterium
GDRWTENSDHLSATDRAQ

SEQ ID NO: 481858 - protein, 8 aa, Mycobacterium
GDRYPASV

SEQ ID NO: 481859 - protein, 9 aa, Mycobacterium
GDRYTPTPA

SEQ ID NO: 481860 - protein, 4 aa, Mycobacterium
GDSA

SEQ ID NO: 481861 - protein, 7 aa, Mycobacterium
GDSAAEL

SEQ ID NO: 481862 - protein, 12 aa, Mycobacterium
GDSADGRDFGAK

SEQ ID NO: 481863 - protein, 17 aa, Mycobacterium
GDSADVGDTMAAGDESA

SEQ ID NO: 481864 - protein, 8 aa, Mycobacterium
GDSAEGRA

SEQ ID NO: 481865 - protein, 6 aa, Mycobacterium
GDSAEL

SEQ ID NO: 481866 - protein, 7 aa, Mycobacterium
GDSAELA

SEQ ID NO: 481867 - protein, 8 aa, Mycobacterium
GDSAGGGI

SEQ ID NO: 481868 - protein, 8 aa, Mycobacterium
GDSAGGGL

SEQ ID NO: 481869 - protein, 9 aa, Mycobacterium
GDSAGGGLA

SEQ ID NO: 481870 - protein, 8 aa, Mycobacterium
GDSAGGNI

SEQ ID NO: 481871 - protein, 9 aa, Mycobacterium
GDSAGGNLA

SEQ ID NO: 481872 - protein, 8 aa, Mycobacterium
GDSAGGQI

SEQ ID NO: 481873 - protein, 7 aa, Mycobacterium
GDSAGGY

SEQ ID NO: 481874 - protein, 9 aa, Mycobacterium
GDSAGTDME

SEQ ID NO: 481875 - protein, 8 aa, Mycobacterium
GDSAHTYR

SEQ ID NO: 481876 - protein, 8 aa, Mycobacterium
GDSAKLRA

SEQ ID NO: 481877 - protein, 19 aa, Mycobacterium
GDSAPSADATENGQNRPIT

SEQ ID NO: 481878 - protein, 8 aa, Mycobacterium
GDSAPTHW

SEQ ID NO: 481879 - protein, 26 aa, Mycobacterium
GDSAQSAVSAPRAIAGGQVDGATADS

SEQ ID NO: 481880 - protein, 5 aa, Mycobacterium
GDSAR

SEQ ID NO: 481881 - protein, 7 aa, Mycobacterium
GDSATAM

SEQ ID NO: 481882 - protein, 9 aa, Mycobacterium
GDSATATSE

SEQ ID NO: 481883 - protein, 8 aa, Mycobacterium
GDSATGTQ

SEQ ID NO: 481884 - protein, 7 aa, Mycobacterium
GDSATYT

SEQ ID NO: 481885 - protein, 8 aa, Mycobacterium
GDSAVPKY

SEQ ID NO: 481886 - protein, 5 aa, Mycobacterium
GDSCD

SEQ ID NO: 481887 - protein, 7 aa, Mycobacterium
GDSDATV

SEQ ID NO: 481888 - protein, 40 aa, Mycobacterium
GDSDDSDDSDDSDEDDDSDDSDDDSDEDEDSDSDEDEEPV

SEQ ID NO: 481889 - protein, 9 aa, Mycobacterium
GDSDHGREF

SEQ ID NO: 481890 - protein, 8 aa, Mycobacterium
GDSDIQQD

SEQ ID NO: 481891 - protein, 7 aa, Mycobacterium
GDSDNEA

SEQ ID NO: 481892 - protein, 7 aa, Mycobacterium
GDSDRGA

SEQ ID NO: 481893 - protein, 10 aa, Mycobacterium
GDSDTGRAHA

SEQ ID NO: 481894 - protein, 6 aa, Mycobacterium
GDSDTV

SEQ ID NO: 481895 - protein, 10 aa, Mycobacterium
GDSEDGDEAG

SEQ ID NO: 481896 - protein, 10 aa, Mycobacterium
GDSEGGWGDG

SEQ ID NO: 481897 - protein, 9 aa, Mycobacterium
GDSEGRPRQ

SEQ ID NO: 481898 - protein, 10 aa, Mycobacterium
GDSEGSPRQH

SEQ ID NO: 481899 - protein, 7 aa, Mycobacterium
GDSEPDR

SEQ ID NO: 481900 - protein, 7 aa, Mycobacterium
GDSERLR

SEQ ID NO: 481901 - protein, 6 aa, Mycobacterium
GDSFNA

SEQ ID NO: 481902 - protein, 7 aa, Mycobacterium
GDSFPGK

SEQ ID NO: 481903 - protein, 50 aa, Mycobacterium
GDSGAGGAGGKGGNGGTAAAGTQGHGGNGGNGGLAGIAGDGGDGATGTYD

SEQ ID NO: 481904 - protein, 6 aa, Mycobacterium
GDSGAT

SEQ ID NO: 481905 - protein, 10 aa, Mycobacterium
GDSGDFSGSF

SEQ ID NO: 481906 - protein, 8 aa, Mycobacterium
GDSGDGMQ

SEQ ID NO: 481907 - protein, 6 aa, Mycobacterium
GDSGFV

SEQ ID NO: 481908 - protein, 9 aa, Mycobacterium
GDSGGRPRQ

SEQ ID NO: 481909 - protein, 7 aa, Mycobacterium
GDSGKPA

SEQ ID NO: 481910 - protein, 7 aa, Mycobacterium
GDSGLEQ

SEQ ID NO: 481911 - protein, 5 aa, Mycobacterium
GDSGR

SEQ ID NO: 481912 - protein, 16 aa, Mycobacterium
GDSGRGSRNKSKADSL

SEQ ID NO: 481913 - protein, 7 aa, Mycobacterium
GDSGRKV

SEQ ID NO: 481914 - protein, 7 aa, Mycobacterium
GDSGRLN

SEQ ID NO: 481915 - protein, 8 aa, Mycobacterium
GDSGSSTN

SEQ ID NO: 481916 - protein, 16 aa, Mycobacterium
GDSGVDGDRGDTFEHG

SEQ ID NO: 481917 - protein, 5 aa, Mycobacterium
GDSGY

SEQ ID NO: 481918 - protein, 12 aa, Mycobacterium
GDSHAQAAKAAA

SEQ ID NO: 481919 - protein, 5 aa, Mycobacterium
GDSHP

SEQ ID NO: 481920 - protein, 9 aa, Mycobacterium
GDSHPRLSS

SEQ ID NO: 481921 - protein, 8 aa, Mycobacterium
GDSIAPEA

SEQ ID NO: 481922 - protein, 11 aa, Mycobacterium
GDSIGAQRRGT

SEQ ID NO: 481923 - protein, 8 aa, Mycobacterium
GDSIPDAD

SEQ ID NO: 481924 - protein, 7 aa, Mycobacterium
GDSKNTL

SEQ ID NO: 481925 - protein, 5 aa, Mycobacterium
GDSLD

SEQ ID NO: 481926 - protein, 6 aa, Mycobacterium
GDSLQT

SEQ ID NO: 481927 - protein, 7 aa, Mycobacterium
GDSLTDR

SEQ ID NO: 481928 - protein, 4 aa, Mycobacterium
GDSM

SEQ ID NO: 481929 - protein, 5 aa, Mycobacterium
GDSMT

SEQ ID NO: 481930 - protein, 12 aa, Mycobacterium
GDSMYPGKAGTN

SEQ ID NO: 481931 - protein, 10 aa, Mycobacterium
GDSNGKAPTA

SEQ ID NO: 481932 - protein, 5 aa, Mycobacterium
GDSNT

SEQ ID NO: 481933 - protein, 4 aa, Mycobacterium
GDSP

SEQ ID NO: 481934 - protein, 22 aa, Mycobacterium
GDSPAHPAGQPEQGASRGMAHD

SEQ ID NO: 481935 - protein, 19 aa, Mycobacterium
GDSPAPAAVDTPGTASGYA

SEQ ID NO: 481936 - protein, 9 aa, Mycobacterium
GDSPARADY

SEQ ID NO: 481937 - protein, 5 aa, Mycobacterium
GDSPD

SEQ ID NO: 481938 - protein, 7 aa, Mycobacterium
GDSPEHP

SEQ ID NO: 481939 - protein, 22 aa, Mycobacterium
GDSPEQSAEHPERGASRGLAHD

SEQ ID NO: 481940 - protein, 8 aa, Mycobacterium
GDSPETAA

SEQ ID NO: 481941 - protein, 9 aa, Mycobacterium
GDSPFRPGG

SEQ ID NO: 481942 - protein, 23 aa, Mycobacterium
GDSPGGHPENEPEHGATHGMAHD

SEQ ID NO: 481943 - protein, 8 aa, Mycobacterium
GDSPQSGV

SEQ ID NO: 481944 - protein, 7 aa, Mycobacterium
GDSPQWA

SEQ ID NO: 481945 - protein, 7 aa, Mycobacterium
GDSPRHD

SEQ ID NO: 481946 - protein, 5 aa, Mycobacterium
GDSPV

SEQ ID NO: 481947 - protein, 32 aa, Mycobacterium
GDSRDSRGDRDSRGRRGDGGRGRDRDGDKSNY

SEQ ID NO: 481948 - protein, 8 aa, Mycobacterium
GDSRETTL

SEQ ID NO: 481949 - protein, 6 aa, Mycobacterium
GDSRGR

SEQ ID NO: 481950 - protein, 9 aa, Mycobacterium
GDSRGYKLD

SEQ ID NO: 481951 - protein, 5 aa, Mycobacterium
GDSRH

SEQ ID NO: 481952 - protein, 6 aa, Mycobacterium
GDSRHP

SEQ ID NO: 481953 - protein, 7 aa, Mycobacterium
GDSRPGN

SEQ ID NO: 481954 - protein, 5 aa, Mycobacterium
GDSRR

SEQ ID NO: 481955 - protein, 9 aa, Mycobacterium
GDSRRANPW

SEQ ID NO: 481956 - protein, 7 aa, Mycobacterium
GDSRSPV

SEQ ID NO: 481957 - protein, 10 aa, Mycobacterium
GDSRTGTANV

SEQ ID NO: 481958 - protein, 12 aa, Mycobacterium
GDSSAPPADDTV

SEQ ID NO: 481959 - protein, 8 aa, Mycobacterium
GDSSAVAT

SEQ ID NO: 481960 - protein, 8 aa, Mycobacterium
GDSSAVMP

SEQ ID NO: 481961 - protein, 19 aa, Mycobacterium
GDSSGQIAQRGDSEAAGAH

SEQ ID NO: 481962 - protein, 15 aa, Mycobacterium
GDSSIGFGNAGDHNV

SEQ ID NO: 481963 - protein, 8 aa, Mycobacterium
GDSSIGQI

SEQ ID NO: 481964 - protein, 9 aa, Mycobacterium
GDSSINSDA

SEQ ID NO: 481965 - protein, 8 aa, Mycobacterium
GDSSPTHW

SEQ ID NO: 481966 - protein, 10 aa, Mycobacterium
GDSTARARQA

SEQ ID NO: 481967 - protein, 8 aa, Mycobacterium
GDSTDHAD

SEQ ID NO: 481968 - protein, 7 aa, Mycobacterium
GDSTGVA

SEQ ID NO: 481969 - protein, 5 aa, Mycobacterium
GDSTL

SEQ ID NO: 481970 - protein, 9 aa, Mycobacterium
GDSTPTSDY

SEQ ID NO: 481971 - protein, 17 aa, Mycobacterium
GDSTRPYDIDDEPAPLS

SEQ ID NO: 481972 - protein, 14 aa, Mycobacterium
GDSTRVDISGSSVG

SEQ ID NO: 481973 - protein, 7 aa, Mycobacterium
GDSVGVD

SEQ ID NO: 481974 - protein, 8 aa, Mycobacterium
GDSVNAEP

SEQ ID NO: 481975 - protein, 5 aa, Mycobacterium
GDSVP

SEQ ID NO: 481976 - protein, 11 aa, Mycobacterium
GDSVPDLPGSS

SEQ ID NO: 481977 - protein, 8 aa, Mycobacterium
GDSVPSAP

SEQ ID NO: 481978 - protein, 5 aa, Mycobacterium
GDSVQ

SEQ ID NO: 481979 - protein, 11 aa, Mycobacterium
GDSWPSRPGRV

SEQ ID NO: 481980 - protein, 9 aa, Mycobacterium
GDSYPDNTN

SEQ ID NO: 481981 - protein, 5 aa, Mycobacterium
GDSYR

SEQ ID NO: 481982 - protein, 18 aa, Mycobacterium
GDSYRMKDAKHRKEQPKP

SEQ ID NO: 481983 - protein, 18 aa, Mycobacterium
GDSYRMKDARHRKEQPQP

SEQ ID NO: 481984 - protein, 9 aa, Mycobacterium
GDTAAGTKA

SEQ ID NO: 481985 - protein, 17 aa, Mycobacterium
GDTADKRRRRAEAAGRR

SEQ ID NO: 481986 - protein, 5 aa, Mycobacterium
GDTAG

SEQ ID NO: 481987 - protein, 17 aa, Mycobacterium
GDTAGKRRHRAEAAGRR

SEQ ID NO: 481988 - protein, 5 aa, Mycobacterium
GDTAI

SEQ ID NO: 481989 - protein, 8 aa, Mycobacterium
GDTAPQEL

SEQ ID NO: 481990 - protein, 8 aa, Mycobacterium
GDTARARS

SEQ ID NO: 481991 - protein, 8 aa, Mycobacterium
GDTASNTV

SEQ ID NO: 481992 - protein, 6 aa, Mycobacterium
GDTASS

SEQ ID NO: 481993 - protein, 24 aa, Mycobacterium
GDTASSAAAPAAVAPDEPEAHDAP

SEQ ID NO: 481994 - protein, 6 aa, Mycobacterium
GDTATA

SEQ ID NO: 481995 - protein, 19 aa, Mycobacterium
GDTATAAQLSDNPNEAREA

SEQ ID NO: 481996 - protein, 7 aa, Mycobacterium
GDTATAT

SEQ ID NO: 481997 - protein, 7 aa, Mycobacterium
GDTATGS

SEQ ID NO: 481998 - protein, 8 aa, Mycobacterium
GDTAYASA

SEQ ID NO: 481999 - protein, 4 aa, Mycobacterium
GDTC

SEQ ID NO: 482000 - protein, 9 aa, Mycobacterium
GDTDAVDDP

SEQ ID NO: 482001 - protein, 5 aa, Mycobacterium
GDTDD

SEQ ID NO: 482002 - protein, 6 aa, Mycobacterium
GDTDDV

SEQ ID NO: 482003 - protein, 6 aa, Mycobacterium
GDTDEL

SEQ ID NO: 482004 - protein, 7 aa, Mycobacterium
GDTDGTF

SEQ ID NO: 482005 - protein, 14 aa, Mycobacterium
GDTDNVPAVQDPSQ

SEQ ID NO: 482006 - protein, 9 aa, Mycobacterium
GDTDQTERL

SEQ ID NO: 482007 - protein, 6 aa, Mycobacterium
GDTDSE

SEQ ID NO: 482008 - protein, 8 aa, Mycobacterium
GDTDTATA

SEQ ID NO: 482009 - protein, 7 aa, Mycobacterium
GDTDTSF

SEQ ID NO: 482010 - protein, 11 aa, Mycobacterium
GDTDVFSSDAA

SEQ ID NO: 482011 - protein, 14 aa, Mycobacterium
GDTEADREQAAAGT

SEQ ID NO: 482012 - protein, 7 aa, Mycobacterium
GDTEAVE

SEQ ID NO: 482013 - protein, 10 aa, Mycobacterium
GDTEDKPEVA

SEQ ID NO: 482014 - protein, 6 aa, Mycobacterium
GDTEGD

SEQ ID NO: 482015 - protein, 7 aa, Mycobacterium
GDTEGQG

SEQ ID NO: 482016 - protein, 10 aa, Mycobacterium
GDTEKVPSTA

SEQ ID NO: 482017 - protein, 5 aa, Mycobacterium
GDTEL

SEQ ID NO: 482018 - protein, 7 aa, Mycobacterium
GDTEPRA

SEQ ID NO: 482019 - protein, 8 aa, Mycobacterium
GDTESPAP

SEQ ID NO: 482020 - protein, 6 aa, Mycobacterium
GDTETG

SEQ ID NO: 482021 - protein, 7 aa, Mycobacterium
GDTGAGQ

SEQ ID NO: 482022 - protein, 12 aa, Mycobacterium
GDTGANAPEHWP

SEQ ID NO: 482023 - protein, 7 aa, Mycobacterium
GDTGDKL

SEQ ID NO: 482024 - protein, 7 aa, Mycobacterium
GDTGDLG

SEQ ID NO: 482025 - protein, 7 aa, Mycobacterium
GDTGDLS

SEQ ID NO: 482026 - protein, 12 aa, Mycobacterium
GDTGESRLPTDD

SEQ ID NO: 482027 - protein, 6 aa, Mycobacterium
GDTGEV

SEQ ID NO: 482028 - protein, 5 aa, Mycobacterium
GDTGI

SEQ ID NO: 482029 - protein, 11 aa, Mycobacterium
GDTGKGKRQKI

SEQ ID NO: 482030 - protein, 5 aa, Mycobacterium
GDTGL

SEQ ID NO: 482031 - protein, 5 aa, Mycobacterium
GDTGP

SEQ ID NO: 482032 - protein, 10 aa, Mycobacterium
GDTGPNAPQN

SEQ ID NO: 482033 - protein, 9 aa, Mycobacterium
GDTGPRVGV

SEQ ID NO: 482034 - protein, 5 aa, Mycobacterium
GDTGR

SEQ ID NO: 482035 - protein, 5 aa, Mycobacterium
GDTGV

SEQ ID NO: 482036 - protein, 13 aa, Mycobacterium
GDTGVTVAGPDGL

SEQ ID NO: 482037 - protein, 5 aa, Mycobacterium
GDTGY

SEQ ID NO: 482038 - protein, 8 aa, Mycobacterium
GDTGYTKS

SEQ ID NO: 482039 - protein, 10 aa, Mycobacterium
GDTHRGTAGD

SEQ ID NO: 482040 - protein, 4 aa, Mycobacterium
GDTI

SEQ ID NO: 482041 - protein, 7 aa, Mycobacterium
GDTIDEN

SEQ ID NO: 482042 - protein, 12 aa, Mycobacterium
GDTIDGHPRSRS

SEQ ID NO: 482043 - protein, 17 aa, Mycobacterium
GDTIDSNGLGVYPPPTT

SEQ ID NO: 482044 - protein, 13 aa, Mycobacterium
GDTIEGKPRSRSV

SEQ ID NO: 482045 - protein, 5 aa, Mycobacterium
GDTIG

SEQ ID NO: 482046 - protein, 12 aa, Mycobacterium
GDTIGARQRSRS

SEQ ID NO: 482047 - protein, 14 aa, Mycobacterium
GDTIGGGARSGELT

SEQ ID NO: 482048 - protein, 15 aa, Mycobacterium
GDTIGLESTAAAATV

SEQ ID NO: 482049 - protein, 5 aa, Mycobacterium
GDTIT

SEQ ID NO: 482050 - protein, 5 aa, Mycobacterium
GDTKA

SEQ ID NO: 482051 - protein, 6 aa, Mycobacterium
GDTKAI

SEQ ID NO: 482052 - protein, 5 aa, Mycobacterium
GDTLP

SEQ ID NO: 482053 - protein, 6 aa, Mycobacterium
GDTLPA

SEQ ID NO: 482054 - protein, 9 aa, Mycobacterium
GDTLPPGAR

SEQ ID NO: 482055 - protein, 8 aa, Mycobacterium
GDTLPSGS

SEQ ID NO: 482056 - protein, 7 aa, Mycobacterium
GDTLPSM

SEQ ID NO: 482057 - protein, 8 aa, Mycobacterium
GDTLRTDA

SEQ ID NO: 482058 - protein, 10 aa, Mycobacterium
GDTLTATEAA

SEQ ID NO: 482059 - protein, 22 aa, Mycobacterium
GDTMTGRGRAVAKRRDTSVDPP

SEQ ID NO: 482060 - protein, 8 aa, Mycobacterium
GDTNGAPD

SEQ ID NO: 482061 - protein, 7 aa, Mycobacterium
GDTNTEV

SEQ ID NO: 482062 - protein, 4 aa, Mycobacterium
GDTP

SEQ ID NO: 482063 - protein, 6 aa, Mycobacterium
GDTPAD

SEQ ID NO: 482064 - protein, 8 aa, Mycobacterium
GDTPAEAT

SEQ ID NO: 482065 - protein, 7 aa, Mycobacterium
GDTPAGK

SEQ ID NO: 482066 - protein, 7 aa, Mycobacterium
GDTPAPA

SEQ ID NO: 482067 - protein, 24 aa, Mycobacterium
GDTPARRHQSRRRTAEFLASVAAG

SEQ ID NO: 482068 - protein, 14 aa, Mycobacterium
GDTPDEAQDNARHI

SEQ ID NO: 482069 - protein, 17 aa, Mycobacterium
GDTPEPVADAPADERDP

SEQ ID NO: 482070 - protein, 8 aa, Mycobacterium
GDTPERKR

SEQ ID NO: 482071 - protein, 26 aa, Mycobacterium
GDTPGGSEGHSEGHPEHGATRGMAHD

SEQ ID NO: 482072 - protein, 9 aa, Mycobacterium
GDTPGSAQT

SEQ ID NO: 482073 - protein, 11 aa, Mycobacterium
GDTPKAQIREE

SEQ ID NO: 482074 - protein, 6 aa, Mycobacterium
GDTPLL

SEQ ID NO: 482075 - protein, 7 aa, Mycobacterium
GDTPLPV

SEQ ID NO: 482076 - protein, 6 aa, Mycobacterium
GDTPLR

SEQ ID NO: 482077 - protein, 8 aa, Mycobacterium
GDTPRDLQ

SEQ ID NO: 482078 - protein, 7 aa, Mycobacterium
GDTPTEL

SEQ ID NO: 482079 - protein, 6 aa, Mycobacterium
GDTPVE

SEQ ID NO: 482080 - protein, 17 aa, Mycobacterium
GDTPVGVTTSGTFSPTL

SEQ ID NO: 482081 - protein, 4 aa, Mycobacterium
GDTQ

SEQ ID NO: 482082 - protein, 5 aa, Mycobacterium
GDTQA

SEQ ID NO: 482083 - protein, 6 aa, Mycobacterium
GDTQAS

SEQ ID NO: 482084 - protein, 7 aa, Mycobacterium
GDTQERG

SEQ ID NO: 482085 - protein, 5 aa, Mycobacterium
GDTQT

SEQ ID NO: 482086 - protein, 4 aa, Mycobacterium
GDTR

SEQ ID NO: 482087 - protein, 8 aa, Mycobacterium
GDTRAADA

SEQ ID NO: 482088 - protein, 5 aa, Mycobacterium
GDTRG

SEQ ID NO: 482089 - protein, 7 aa, Mycobacterium
GDTRKAI

SEQ ID NO: 482090 - protein, 19 aa, Mycobacterium
GDTRLDDRPGRAREVADRT

SEQ ID NO: 482091 - protein, 15 aa, Mycobacterium
GDTRLRATADGRSSV

SEQ ID NO: 482092 - protein, 15 aa, Mycobacterium
GDTRLRATAEGRSSV

SEQ ID NO: 482093 - protein, 14 aa, Mycobacterium
GDTRLRATSDGRST

SEQ ID NO: 482094 - protein, 8 aa, Mycobacterium
GDTRNRGR

SEQ ID NO: 482095 - protein, 33 aa, Mycobacterium
GDTRQNKGAQQNPQGSPAIKAEKPFTHEQHSPT

SEQ ID NO: 482096 - protein, 5 aa, Mycobacterium
GDTRR

SEQ ID NO: 482097 - protein, 8 aa, Mycobacterium
GDTRRAHE

SEQ ID NO: 482098 - protein, 6 aa, Mycobacterium
GDTRTK

SEQ ID NO: 482099 - protein, 6 aa, Mycobacterium
GDTRTV

SEQ ID NO: 482100 - protein, 16 aa, Mycobacterium
GDTRVGVTTSGTFSPT

SEQ ID NO: 482101 - protein, 5 aa, Mycobacterium
GDTSA

SEQ ID NO: 482102 - protein, 17 aa, Mycobacterium
GDTSADTPARQTLGPLD

SEQ ID NO: 482103 - protein, 8 aa, Mycobacterium
GDTSDIDS

SEQ ID NO: 482104 - protein, 13 aa, Mycobacterium
GDTSDVTTDRHPP

SEQ ID NO: 482105 - protein, 9 aa, Mycobacterium
GDTSGIDDA

SEQ ID NO: 482106 - protein, 10 aa, Mycobacterium
GDTSTAQAGG

SEQ ID NO: 482107 - protein, 4 aa, Mycobacterium
GDTT

SEQ ID NO: 482108 - protein, 10 aa, Mycobacterium
GDTTAPVTRP

SEQ ID NO: 482109 - protein, 17 aa, Mycobacterium
GDTTDKRRRRAEAAGRR

SEQ ID NO: 482110 - protein, 7 aa, Mycobacterium
GDTTDTI

SEQ ID NO: 482111 - protein, 8 aa, Mycobacterium
GDTTEVAD

SEQ ID NO: 482112 - protein, 6 aa, Mycobacterium
GDTTIE

SEQ ID NO: 482113 - protein, 7 aa, Mycobacterium
GDTTKLA

SEQ ID NO: 482114 - protein, 5 aa, Mycobacterium
GDTTL

SEQ ID NO: 482115 - protein, 8 aa, Mycobacterium
GDTTMGVA

SEQ ID NO: 482116 - protein, 8 aa, Mycobacterium
GDTTPGRV

SEQ ID NO: 482117 - protein, 10 aa, Mycobacterium
GDTTTSPRLQ

SEQ ID NO: 482118 - protein, 5 aa, Mycobacterium
GDTTV

SEQ ID NO: 482119 - protein, 6 aa, Mycobacterium
GDTTVT

SEQ ID NO: 482120 - protein, 5 aa, Mycobacterium
GDTTY

SEQ ID NO: 482121 - protein, 5 aa, Mycobacterium
GDTVA

SEQ ID NO: 482122 - protein, 12 aa, Mycobacterium
GDTVASSPIKGT

SEQ ID NO: 482123 - protein, 8 aa, Mycobacterium
GDTVEGRS

SEQ ID NO: 482124 - protein, 17 aa, Mycobacterium
GDTVPRGGNAGGGGQPG

SEQ ID NO: 482125 - protein, 8 aa, Mycobacterium
GDTVRTPG

SEQ ID NO: 482126 - protein, 13 aa, Mycobacterium
GDTVTGRAGESQE

SEQ ID NO: 482127 - protein, 12 aa, Mycobacterium
GDTVTSYGPPAS

SEQ ID NO: 482128 - protein, 5 aa, Mycobacterium
GDTWD

SEQ ID NO: 482129 - protein, 6 aa, Mycobacterium
GDTYDT

SEQ ID NO: 482130 - protein, 8 aa, Mycobacterium
GDVAAKAR

SEQ ID NO: 482131 - protein, 7 aa, Mycobacterium
GDVADSY

SEQ ID NO: 482132 - protein, 8 aa, Mycobacterium
GDVAEQKV

SEQ ID NO: 482133 - protein, 7 aa, Mycobacterium
GDVAESY

SEQ ID NO: 482134 - protein, 22 aa, Mycobacterium
GDVAKPDARSTASPFDHSDDAA

SEQ ID NO: 482135 - protein, 14 aa, Mycobacterium
GDVAPAEGELLPDT

SEQ ID NO: 482136 - protein, 7 aa, Mycobacterium
GDVAPAS

SEQ ID NO: 482137 - protein, 6 aa, Mycobacterium
GDVAPG

SEQ ID NO: 482138 - protein, 10 aa, Mycobacterium
GDVASRDADG

SEQ ID NO: 482139 - protein, 6 aa, Mycobacterium
GDVDAQ

SEQ ID NO: 482140 - protein, 10 aa, Mycobacterium
GDVDDLAPGD

SEQ ID NO: 482141 - protein, 5 aa, Mycobacterium
GDVDG

SEQ ID NO: 482142 - protein, 7 aa, Mycobacterium
GDVDGSC

SEQ ID NO: 482143 - protein, 7 aa, Mycobacterium
GDVDPYG

SEQ ID NO: 482144 - protein, 9 aa, Mycobacterium
GDVDTGYGK

SEQ ID NO: 482145 - protein, 9 aa, Mycobacterium
GDVDTQNGA

SEQ ID NO: 482146 - protein, 4 aa, Mycobacterium
GDVE

SEQ ID NO: 482147 - protein, 16 aa, Mycobacterium
GDVEAAGAEVEDAHRD

SEQ ID NO: 482148 - protein, 5 aa, Mycobacterium
GDVEK

SEQ ID NO: 482149 - protein, 12 aa, Mycobacterium
GDVEKTRKTAEA

SEQ ID NO: 482150 - protein, 6 aa, Mycobacterium
GDVEPC

SEQ ID NO: 482151 - protein, 7 aa, Mycobacterium
GDVEPSV

SEQ ID NO: 482152 - protein, 12 aa, Mycobacterium
GDVERAGREAGG

SEQ ID NO: 482153 - protein, 8 aa, Mycobacterium
GDVGAGDT

SEQ ID NO: 482154 - protein, 19 aa, Mycobacterium
GDVGAKKPAAPGKPAKTDR

SEQ ID NO: 482155 - protein, 13 aa, Mycobacterium
GDVGAKKVYDPRS

SEQ ID NO: 482156 - protein, 8 aa, Mycobacterium
GDVGDATL

SEQ ID NO: 482157 - protein, 8 aa, Mycobacterium
GDVGDTSE

SEQ ID NO: 482158 - protein, 6 aa, Mycobacterium
GDVGDV

SEQ ID NO: 482159 - protein, 23 aa, Mycobacterium
GDVGGGLTAPQSPMLNPNNAPGV

SEQ ID NO: 482160 - protein, 6 aa, Mycobacterium
GDVGGL

SEQ ID NO: 482161 - protein, 8 aa, Mycobacterium
GDVGPTTT

SEQ ID NO: 482162 - protein, 7 aa, Mycobacterium
GDVGRLD

SEQ ID NO: 482163 - protein, 10 aa, Mycobacterium
GDVHDGGSAA

SEQ ID NO: 482164 - protein, 4 aa, Mycobacterium
GDVI

SEQ ID NO: 482165 - protein, 12 aa, Mycobacterium
GDVITSSAGVFL

SEQ ID NO: 482166 - protein, 8 aa, Mycobacterium
GDVLPSQE

SEQ ID NO: 482167 - protein, 10 aa, Mycobacterium
GDVLSDDATL

SEQ ID NO: 482168 - protein, 4 aa, Mycobacterium
GDVN

SEQ ID NO: 482169 - protein, 6 aa, Mycobacterium
GDVNDG

SEQ ID NO: 482170 - protein, 5 aa, Mycobacterium
GDVNE

SEQ ID NO: 482171 - protein, 37 aa, Mycobacterium
GDVNPEAVDDEHQDDEDAEDEAGDDISPAFSHSDDES

SEQ ID NO: 482172 - protein, 20 aa, Mycobacterium
GDVNQSARRTPHTETGPYDN

SEQ ID NO: 482173 - protein, 5 aa, Mycobacterium
GDVNT

SEQ ID NO: 482174 - protein, 27 aa, Mycobacterium
GDVNTDIGSTADTGDTNSGFNNTGSNV

SEQ ID NO: 482175 - protein, 15 aa, Mycobacterium
GDVNTGSFNAGSVNT

SEQ ID NO: 482176 - protein, 16 aa, Mycobacterium
GDVNTGSGNSGHTNTG

SEQ ID NO: 482177 - protein, 4 aa, Mycobacterium
GDVP

SEQ ID NO: 482178 - protein, 8 aa, Mycobacterium
GDVPAATP

SEQ ID NO: 482179 - protein, 8 aa, Mycobacterium
GDVPAGDS

SEQ ID NO: 482180 - protein, 10 aa, Mycobacterium
GDVPAGTPMG

SEQ ID NO: 482181 - protein, 5 aa, Mycobacterium
GDVPK

SEQ ID NO: 482182 - protein, 12 aa, Mycobacterium
GDVPLRPGTTPE

SEQ ID NO: 482183 - protein, 15 aa, Mycobacterium
GDVPPAANRPDGTDA

SEQ ID NO: 482184 - protein, 8 aa, Mycobacterium
GDVPPDRM

SEQ ID NO: 482185 - protein, 11 aa, Mycobacterium
GDVPPEPGYVP

SEQ ID NO: 482186 - protein, 6 aa, Mycobacterium
GDVPSA

SEQ ID NO: 482187 - protein, 13 aa, Mycobacterium
GDVPSLPGSRESS

SEQ ID NO: 482188 - protein, 4 aa, Mycobacterium
GDVR

SEQ ID NO: 482189 - protein, 9 aa, Mycobacterium
GDVRDRASL

SEQ ID NO: 482190 - protein, 5 aa, Mycobacterium
GDVRE

SEQ ID NO: 482191 - protein, 5 aa, Mycobacterium
GDVRG

SEQ ID NO: 482192 - protein, 5 aa, Mycobacterium
GDVRT

SEQ ID NO: 482193 - protein, 11 aa, Mycobacterium
GDVSGDSASRD

SEQ ID NO: 482194 - protein, 6 aa, Mycobacterium
GDVSKR

SEQ ID NO: 482195 - protein, 12 aa, Mycobacterium
GDVSPADAGLGT

SEQ ID NO: 482196 - protein, 9 aa, Mycobacterium
GDVSRGGVD

SEQ ID NO: 482197 - protein, 15 aa, Mycobacterium
GDVSRGGVDMTDPGA

SEQ ID NO: 482198 - protein, 11 aa, Mycobacterium
GDVSSAAGAVT

SEQ ID NO: 482199 - protein, 4 aa, Mycobacterium
GDVT

SEQ ID NO: 482200 - protein, 39 aa, Mycobacterium
GDVTARGSSDFASAQEMGREQSGLSAPYPPEGEGVSPEN

SEQ ID NO: 482201 - protein, 6 aa, Mycobacterium
GDVTDR

SEQ ID NO: 482202 - protein, 6 aa, Mycobacterium
GDVTDS

SEQ ID NO: 482203 - protein, 7 aa, Mycobacterium
GDVTDSA

SEQ ID NO: 482204 - protein, 10 aa, Mycobacterium
GDVTGGRGAR

SEQ ID NO: 482205 - protein, 14 aa, Mycobacterium
GDVTIGGSPDDREQ

SEQ ID NO: 482206 - protein, 5 aa, Mycobacterium
GDVTQ

SEQ ID NO: 482207 - protein, 5 aa, Mycobacterium
GDVTR

SEQ ID NO: 482208 - protein, 9 aa, Mycobacterium
GDWDQTRDD

SEQ ID NO: 482209 - protein, 6 aa, Mycobacterium
GDWGGN

SEQ ID NO: 482210 - protein, 16 aa, Mycobacterium
GDWPPGFPEHERPSYS

SEQ ID NO: 482211 - protein, 5 aa, Mycobacterium
GDWPT

SEQ ID NO: 482212 - protein, 9 aa, Mycobacterium
GDWQGPSAR

SEQ ID NO: 482213 - protein, 8 aa, Mycobacterium
GDWREPPR

SEQ ID NO: 482214 - protein, 6 aa, Mycobacterium
GDWSEA

SEQ ID NO: 482215 - protein, 9 aa, Mycobacterium
GDWSSSADS

SEQ ID NO: 482216 - protein, 9 aa, Mycobacterium
GDWSSSSES

SEQ ID NO: 482217 - protein, 8 aa, Mycobacterium
GDWTTASD

SEQ ID NO: 482218 - protein, 16 aa, Mycobacterium
GDWTTTSSESKLRLPG

SEQ ID NO: 482219 - protein, 4 aa, Mycobacterium
GDYD

SEQ ID NO: 482220 - protein, 30 aa, Mycobacterium
GDYDESDVKVRSGRGSRPRTKTRPEHADAE

SEQ ID NO: 482221 - protein, 8 aa, Mycobacterium
GDYDQATK

SEQ ID NO: 482222 - protein, 11 aa, Mycobacterium
GDYDSYRPTFS

SEQ ID NO: 482223 - protein, 11 aa, Mycobacterium
GDYDSYRPTLS

SEQ ID NO: 482224 - protein, 11 aa, Mycobacterium
GDYDSYRPTMT

SEQ ID NO: 482225 - protein, 6 aa, Mycobacterium
GDYEAT

SEQ ID NO: 482226 - protein, 5 aa, Mycobacterium
GDYES

SEQ ID NO: 482227 - protein, 22 aa, Mycobacterium
GDYESPGEASPGTPWPPSEGPQ

SEQ ID NO: 482228 - protein, 7 aa, Mycobacterium
GDYESTM

SEQ ID NO: 482229 - protein, 4 aa, Mycobacterium
GDYG

SEQ ID NO: 482230 - protein, 5 aa, Mycobacterium
GDYGE

SEQ ID NO: 482231 - protein, 7 aa, Mycobacterium
GDYGGDS

SEQ ID NO: 482232 - protein, 5 aa, Mycobacterium
GDYGL

SEQ ID NO: 482233 - protein, 7 aa, Mycobacterium
GDYGLAG

SEQ ID NO: 482234 - protein, 6 aa, Mycobacterium
GDYGPD

SEQ ID NO: 482235 - protein, 6 aa, Mycobacterium
GDYGTY

SEQ ID NO: 482236 - protein, 5 aa, Mycobacterium
GDYGY

SEQ ID NO: 482237 - protein, 13 aa, Mycobacterium
GDYHETGCKPEAG

SEQ ID NO: 482238 - protein, 7 aa, Mycobacterium
GDYHGTR

SEQ ID NO: 482239 - protein, 8 aa, Mycobacterium
GDYKPGIP

SEQ ID NO: 482240 - protein, 15 aa, Mycobacterium
GDYNTGLANTGDVNT

SEQ ID NO: 482241 - protein, 4 aa, Mycobacterium
GDYP

SEQ ID NO: 482242 - protein, 5 aa, Mycobacterium
GDYPA

SEQ ID NO: 482243 - protein, 5 aa, Mycobacterium
GDYPD

SEQ ID NO: 482244 - protein, 8 aa, Mycobacterium
GDYPDHEA

SEQ ID NO: 482245 - protein, 5 aa, Mycobacterium
GDYPG

SEQ ID NO: 482246 - protein, 7 aa, Mycobacterium
GDYPKIG

SEQ ID NO: 482247 - protein, 4 aa, Mycobacterium
GDYQ

SEQ ID NO: 482248 - protein, 6 aa, Mycobacterium
GDYQDI

SEQ ID NO: 482249 - protein, 5 aa, Mycobacterium
GDYQE

SEQ ID NO: 482250 - protein, 7 aa, Mycobacterium
GDYQRKT

SEQ ID NO: 482251 - protein, 6 aa, Mycobacterium
GDYQST

SEQ ID NO: 482252 - protein, 4 aa, Mycobacterium
GDYR

SEQ ID NO: 482253 - protein, 13 aa, Mycobacterium
GDYRRYPDAGEPW

SEQ ID NO: 482254 - protein, 9 aa, Mycobacterium
GDYSDHKAA

SEQ ID NO: 482255 - protein, 6 aa, Mycobacterium
GDYSPE

SEQ ID NO: 482256 - protein, 12 aa, Mycobacterium
GDYSSYYEPSQA

SEQ ID NO: 482257 - protein, 6 aa, Mycobacterium
GDYSTA

SEQ ID NO: 482258 - protein, 10 aa, Mycobacterium
GDYSVPGQQS

SEQ ID NO: 482259 - protein, 8 aa, Mycobacterium
GDYTPATS

SEQ ID NO: 482260 - protein, 20 aa, Mycobacterium
GDYTRGKHADGEAGAPDHQT

SEQ ID NO: 482261 - protein, 23 aa, Mycobacterium
GDYTRGRHADGESGADDHQTKRR

SEQ ID NO: 482262 - protein, 16 aa, Mycobacterium
GDYVRRTGDDVQPGDV

SEQ ID NO: 482263 - protein, 15 aa, Mycobacterium
GDYVSTGDGTQDCDA

SEQ ID NO: 482264 - protein, 4 aa, Mycobacterium
GEAA

SEQ ID NO: 482265 - protein, 9 aa, Mycobacterium
GEAAAQRAH

SEQ ID NO: 482266 - protein, 12 aa, Mycobacterium
GEAAATRGQAPE

SEQ ID NO: 482267 - protein, 22 aa, Mycobacterium
GEAADGQQPMTEAELEKLFLAL

SEQ ID NO: 482268 - protein, 22 aa, Mycobacterium
GEAAEGQEPMSEAELEKLFLAL

SEQ ID NO: 482269 - protein, 10 aa, Mycobacterium
GEAAEQTPRS

SEQ ID NO: 482270 - protein, 10 aa, Mycobacterium
GEAAGALTAQ

SEQ ID NO: 482271 - protein, 11 aa, Mycobacterium
GEAAGEMRKAA

SEQ ID NO: 482272 - protein, 10 aa, Mycobacterium
GEAAGGHRDT

SEQ ID NO: 482273 - protein, 7 aa, Mycobacterium
GEAAGVH

SEQ ID NO: 482274 - protein, 9 aa, Mycobacterium
GEAAKPPSV

SEQ ID NO: 482275 - protein, 19 aa, Mycobacterium
GEAAPESAPEKPHRGRAEK

SEQ ID NO: 482276 - protein, 13 aa, Mycobacterium
GEAAPHARDERRA

SEQ ID NO: 482277 - protein, 16 aa, Mycobacterium
GEAAQPRGGGRRGRGT

SEQ ID NO: 482278 - protein, 10 aa, Mycobacterium
GEAARAREIS

SEQ ID NO: 482279 - protein, 7 aa, Mycobacterium
GEAARDA

SEQ ID NO: 482280 - protein, 7 aa, Mycobacterium
GEAARQG

SEQ ID NO: 482281 - protein, 9 aa, Mycobacterium
GEAASGTLV

SEQ ID NO: 482282 - protein, 7 aa, Mycobacterium
GEAATAA

SEQ ID NO: 482283 - protein, 15 aa, Mycobacterium
GEAATAADGPPDPVH

SEQ ID NO: 482284 - protein, 10 aa, Mycobacterium
GEAATPDERR

SEQ ID NO: 482285 - protein, 5 aa, Mycobacterium
GEAAV

SEQ ID NO: 482286 - protein, 5 aa, Mycobacterium
GEACR

SEQ ID NO: 482287 - protein, 5 aa, Mycobacterium
GEADD

SEQ ID NO: 482288 - protein, 8 aa, Mycobacterium
GEADDGAA

SEQ ID NO: 482289 - protein, 9 aa, Mycobacterium
GEADDGATA

SEQ ID NO: 482290 - protein, 14 aa, Mycobacterium
GEADDSAAKTVDAQ

SEQ ID NO: 482291 - protein, 8 aa, Mycobacterium
GEADEREP

SEQ ID NO: 482292 - protein, 7 aa, Mycobacterium
GEADFDE

SEQ ID NO: 482293 - protein, 6 aa, Mycobacterium
GEADGI

SEQ ID NO: 482294 - protein, 10 aa, Mycobacterium
GEADGPPTLP

SEQ ID NO: 482295 - protein, 7 aa, Mycobacterium
GEADGSI

SEQ ID NO: 482296 - protein, 9 aa, Mycobacterium
GEADHEHSA

SEQ ID NO: 482297 - protein, 12 aa, Mycobacterium
GEADHEHSAPHT

SEQ ID NO: 482298 - protein, 7 aa, Mycobacterium
GEADPRS

SEQ ID NO: 482299 - protein, 9 aa, Mycobacterium
GEADQAERA

SEQ ID NO: 482300 - protein, 7 aa, Mycobacterium
GEADQPK

SEQ ID NO: 482301 - protein, 7 aa, Mycobacterium
GEADTAA

SEQ ID NO: 482302 - protein, 4 aa, Mycobacterium
GEAE

SEQ ID NO: 482303 - protein, 8 aa, Mycobacterium
GEAEATGE

SEQ ID NO: 482304 - protein, 5 aa, Mycobacterium
GEAEL

SEQ ID NO: 482305 - protein, 11 aa, Mycobacterium
GEAELAQNSVQ

SEQ ID NO: 482306 - protein, 25 aa, Mycobacterium
GEAELDDRFGNDAQTGEDPTTGGRY

SEQ ID NO: 482307 - protein, 6 aa, Mycobacterium
GEAELS

SEQ ID NO: 482308 - protein, 10 aa, Mycobacterium
GEAENQVDGA

SEQ ID NO: 482309 - protein, 14 aa, Mycobacterium
GEAEPAGRPDDPPF

SEQ ID NO: 482310 - protein, 19 aa, Mycobacterium
GEAESTAASQPGVRPQSRR

SEQ ID NO: 482311 - protein, 10 aa, Mycobacterium
GEAFDTPAAT

SEQ ID NO: 482312 - protein, 12 aa, Mycobacterium
GEAGAAADGAGV

SEQ ID NO: 482313 - protein, 7 aa, Mycobacterium
GEAGAAR

SEQ ID NO: 482314 - protein, 6 aa, Mycobacterium
GEAGAL

SEQ ID NO: 482315 - protein, 6 aa, Mycobacterium
GEAGAR

SEQ ID NO: 482316 - protein, 10 aa, Mycobacterium
GEAGARFDTG

SEQ ID NO: 482317 - protein, 5 aa, Mycobacterium
GEAGD

SEQ ID NO: 482318 - protein, 10 aa, Mycobacterium
GEAGDGQEAV

SEQ ID NO: 482319 - protein, 10 aa, Mycobacterium
GEAGDRQIDN

SEQ ID NO: 482320 - protein, 7 aa, Mycobacterium
GEAGDRW

SEQ ID NO: 482321 - protein, 6 aa, Mycobacterium
GEAGED

SEQ ID NO: 482322 - protein, 13 aa, Mycobacterium
GEAGEKFDTPFGT

SEQ ID NO: 482323 - protein, 10 aa, Mycobacterium
GEAGEQFDTP

SEQ ID NO: 482324 - protein, 21 aa, Mycobacterium
GEAGERDARGWETDLLAGLNL

SEQ ID NO: 482325 - protein, 13 aa, Mycobacterium
GEAGERQVAQRPE

SEQ ID NO: 482326 - protein, 14 aa, Mycobacterium
GEAGERQVSRRPDV

SEQ ID NO: 482327 - protein, 10 aa, Mycobacterium
GEAGIGPEDV

SEQ ID NO: 482328 - protein, 6 aa, Mycobacterium
GEAGLD

SEQ ID NO: 482329 - protein, 9 aa, Mycobacterium
GEAGLTTVA

SEQ ID NO: 482330 - protein, 7 aa, Mycobacterium
GEAGPFV

SEQ ID NO: 482331 - protein, 24 aa, Mycobacterium
GEAGPGPSYLDPGSGGPQNDFTNR

SEQ ID NO: 482332 - protein, 21 aa, Mycobacterium
GEAGPRDSRGWETDLLAGLDL

SEQ ID NO: 482333 - protein, 13 aa, Mycobacterium
GEAGPREDLGARG

SEQ ID NO: 482334 - protein, 10 aa, Mycobacterium
GEAGQRFDTP

SEQ ID NO: 482335 - protein, 10 aa, Mycobacterium
GEAGQSFETP

SEQ ID NO: 482336 - protein, 10 aa, Mycobacterium
GEAGQTFDTP

SEQ ID NO: 482337 - protein, 6 aa, Mycobacterium
GEAGTI

SEQ ID NO: 482338 - protein, 8 aa, Mycobacterium
GEAGTPVD

SEQ ID NO: 482339 - protein, 8 aa, Mycobacterium
GEAGTRGL

SEQ ID NO: 482340 - protein, 11 aa, Mycobacterium
GEAGVRTARAG

SEQ ID NO: 482341 - protein, 7 aa, Mycobacterium
GEAGVTP

SEQ ID NO: 482342 - protein, 8 aa, Mycobacterium
GEAHEQRA

SEQ ID NO: 482343 - protein, 12 aa, Mycobacterium
GEAHGEENLVPT

SEQ ID NO: 482344 - protein, 14 aa, Mycobacterium
GEAHYGSPDKDPAV

SEQ ID NO: 482345 - protein, 5 aa, Mycobacterium
GEAIQ

SEQ ID NO: 482346 - protein, 5 aa, Mycobacterium
GEAKA

SEQ ID NO: 482347 - protein, 6 aa, Mycobacterium
GEAKEF

SEQ ID NO: 482348 - protein, 5 aa, Mycobacterium
GEAKP

SEQ ID NO: 482349 - protein, 11 aa, Mycobacterium
GEAKPEERARA

SEQ ID NO: 482350 - protein, 8 aa, Mycobacterium
GEAKQAIT

SEQ ID NO: 482351 - protein, 6 aa, Mycobacterium
GEAKSE

SEQ ID NO: 482352 - protein, 13 aa, Mycobacterium
GEAKVDTDESGVR

SEQ ID NO: 482353 - protein, 7 aa, Mycobacterium
GEAKWGQ

SEQ ID NO: 482354 - protein, 8 aa, Mycobacterium
GEALGKPA

SEQ ID NO: 482355 - protein, 7 aa, Mycobacterium
GEALGRP

SEQ ID NO: 482356 - protein, 6 aa, Mycobacterium
GEALGS

SEQ ID NO: 482357 - protein, 23 aa, Mycobacterium
GEALPAAPRIRPRGARGPARGAA

SEQ ID NO: 482358 - protein, 33 aa, Mycobacterium
GEALPAGGTAGPGATPATPAAEGGGQITEKPFG

SEQ ID NO: 482359 - protein, 8 aa, Mycobacterium
GEALPGEL

SEQ ID NO: 482360 - protein, 39 aa, Mycobacterium
GEALPSGGATSTPATPSTQGTPSDPATNQTPPNTENPLG

SEQ ID NO: 482361 - protein, 35 aa, Mycobacterium
GEALPTGGTPAAGTTPATPAPAESAGGAVSEKPLG

SEQ ID NO: 482362 - protein, 29 aa, Mycobacterium
GEALPTGSTATPAPATSPEQANPANPLGQ

SEQ ID NO: 482363 - protein, 9 aa, Mycobacterium
GEALSPADL

SEQ ID NO: 482364 - protein, 12 aa, Mycobacterium
GEALTNSNGWDQ

SEQ ID NO: 482365 - protein, 4 aa, Mycobacterium
GEAN

SEQ ID NO: 482366 - protein, 24 aa, Mycobacterium
GEANGENPWPRRQSAHGSATDGLP

SEQ ID NO: 482367 - protein, 7 aa, Mycobacterium
GEANGTT

SEQ ID NO: 482368 - protein, 5 aa, Mycobacterium
GEANK

SEQ ID NO: 482369 - protein, 7 aa, Mycobacterium
GEANPLE

SEQ ID NO: 482370 - protein, 9 aa, Mycobacterium
GEANPRTRS

SEQ ID NO: 482371 - protein, 10 aa, Mycobacterium
GEANPRTRSG

SEQ ID NO: 482372 - protein, 4 aa, Mycobacterium
GEAP

SEQ ID NO: 482373 - protein, 7 aa, Mycobacterium
GEAPAGR

SEQ ID NO: 482374 - protein, 5 aa, Mycobacterium
GEAPD

SEQ ID NO: 482375 - protein, 14 aa, Mycobacterium
GEAPDIEAGLRSSD

SEQ ID NO: 482376 - protein, 6 aa, Mycobacterium
GEAPDS

SEQ ID NO: 482377 - protein, 5 aa, Mycobacterium
GEAPE

SEQ ID NO: 482378 - protein, 6 aa, Mycobacterium
GEAPFP

SEQ ID NO: 482379 - protein, 7 aa, Mycobacterium
GEAPGEI

SEQ ID NO: 482380 - protein, 7 aa, Mycobacterium
GEAPLPD

SEQ ID NO: 482381 - protein, 8 aa, Mycobacterium
GEAPPAAG

SEQ ID NO: 482382 - protein, 10 aa, Mycobacterium
GEAPPARSAA

SEQ ID NO: 482383 - protein, 16 aa, Mycobacterium
GEAPQGATWSQVTPAA

SEQ ID NO: 482384 - protein, 7 aa, Mycobacterium
GEAPREI

SEQ ID NO: 482385 - protein, 13 aa, Mycobacterium
GEAPSDSRPPRRA

SEQ ID NO: 482386 - protein, 8 aa, Mycobacterium
GEAPSTYD

SEQ ID NO: 482387 - protein, 5 aa, Mycobacterium
GEAPT

SEQ ID NO: 482388 - protein, 14 aa, Mycobacterium
GEAPTAASWGAANR

SEQ ID NO: 482389 - protein, 9 aa, Mycobacterium
GEAPTFGTS

SEQ ID NO: 482390 - protein, 7 aa, Mycobacterium
GEAPTVS

SEQ ID NO: 482391 - protein, 27 aa, Mycobacterium
GEAQERSAAAAEGADEWHDPRADGNLP

SEQ ID NO: 482392 - protein, 11 aa, Mycobacterium
GEARAPSAREL

SEQ ID NO: 482393 - protein, 6 aa, Mycobacterium
GEARDR

SEQ ID NO: 482394 - protein, 16 aa, Mycobacterium
GEARGAKDYASEADAR

SEQ ID NO: 482395 - protein, 5 aa, Mycobacterium
GEARP

SEQ ID NO: 482396 - protein, 9 aa, Mycobacterium
GEARPQDSV

SEQ ID NO: 482397 - protein, 5 aa, Mycobacterium
GEARR

SEQ ID NO: 482398 - protein, 7 aa, Mycobacterium
GEARRAG

SEQ ID NO: 482399 - protein, 5 aa, Mycobacterium
GEARV

SEQ ID NO: 482400 - protein, 15 aa, Mycobacterium
GEASDALREAGADAI

SEQ ID NO: 482401 - protein, 8 aa, Mycobacterium
GEASLTKT

SEQ ID NO: 482402 - protein, 10 aa, Mycobacterium
GEASPPAGTL

SEQ ID NO: 482403 - protein, 8 aa, Mycobacterium
GEASQTSW

SEQ ID NO: 482404 - protein, 5 aa, Mycobacterium
GEASR

SEQ ID NO: 482405 - protein, 6 aa, Mycobacterium
GEASRR

SEQ ID NO: 482406 - protein, 5 aa, Mycobacterium
GEAST

SEQ ID NO: 482407 - protein, 7 aa, Mycobacterium
GEASTHS

SEQ ID NO: 482408 - protein, 5 aa, Mycobacterium
GEASY

SEQ ID NO: 482409 - protein, 9 aa, Mycobacterium
GEATAAELE

SEQ ID NO: 482410 - protein, 9 aa, Mycobacterium
GEATAGRPA

SEQ ID NO: 482411 - protein, 6 aa, Mycobacterium
GEATDA

SEQ ID NO: 482412 - protein, 12 aa, Mycobacterium
GEATGLGIPTGG

SEQ ID NO: 482413 - protein, 7 aa, Mycobacterium
GEATGTA

SEQ ID NO: 482414 - protein, 7 aa, Mycobacterium
GEATGVS

SEQ ID NO: 482415 - protein, 7 aa, Mycobacterium
GEATKRI

SEQ ID NO: 482416 - protein, 10 aa, Mycobacterium
GEATRYRPDQ

SEQ ID NO: 482417 - protein, 8 aa, Mycobacterium
GEATTQEV

SEQ ID NO: 482418 - protein, 5 aa, Mycobacterium
GEATV

SEQ ID NO: 482419 - protein, 6 aa, Mycobacterium
GEAVAE

SEQ ID NO: 482420 - protein, 8 aa, Mycobacterium
GEAVARST

SEQ ID NO: 482421 - protein, 5 aa, Mycobacterium
GEAVE

SEQ ID NO: 482422 - protein, 8 aa, Mycobacterium
GEAVEHAD

SEQ ID NO: 482423 - protein, 9 aa, Mycobacterium
GEAVGADSS

SEQ ID NO: 482424 - protein, 7 aa, Mycobacterium
GEAVGTR

SEQ ID NO: 482425 - protein, 5 aa, Mycobacterium
GEAVP

SEQ ID NO: 482426 - protein, 10 aa, Mycobacterium
GEAVSLSGDE

SEQ ID NO: 482427 - protein, 18 aa, Mycobacterium
GEAVSTPAPADTPPEPAP

SEQ ID NO: 482428 - protein, 10 aa, Mycobacterium
GECERRGQEW

SEQ ID NO: 482429 - protein, 8 aa, Mycobacterium
GECGARQV

SEQ ID NO: 482430 - protein, 9 aa, Mycobacterium
GECNRGQQE

SEQ ID NO: 482431 - protein, 4 aa, Mycobacterium
GECS

SEQ ID NO: 482432 - protein, 9 aa, Mycobacterium
GECTHPPKW

SEQ ID NO: 482433 - protein, 19 aa, Mycobacterium
GECTRDPERWTTTADDDAK

SEQ ID NO: 482434 - protein, 6 aa, Mycobacterium
GEDADL

SEQ ID NO: 482435 - protein, 7 aa, Mycobacterium
GEDADMN

SEQ ID NO: 482436 - protein, 5 aa, Mycobacterium
GEDAG

SEQ ID NO: 482437 - protein, 7 aa, Mycobacterium
GEDAGRN

SEQ ID NO: 482438 - protein, 9 aa, Mycobacterium
GEDAQLPHH

SEQ ID NO: 482439 - protein, 7 aa, Mycobacterium
GEDAVGS

SEQ ID NO: 482440 - protein, 9 aa, Mycobacterium
GEDAVRESL

SEQ ID NO: 482441 - protein, 4 aa, Mycobacterium
GEDD

SEQ ID NO: 482442 - protein, 8 aa, Mycobacterium
GEDDDAER

SEQ ID NO: 482443 - protein, 8 aa, Mycobacterium
GEDDEHGH

SEQ ID NO: 482444 - protein, 8 aa, Mycobacterium
GEDDERGT

SEQ ID NO: 482445 - protein, 6 aa, Mycobacterium
GEDDPV

SEQ ID NO: 482446 - protein, 8 aa, Mycobacterium
GEDDQPGW

SEQ ID NO: 482447 - protein, 10 aa, Mycobacterium
GEDDRDHDAT

SEQ ID NO: 482448 - protein, 7 aa, Mycobacterium
GEDEDEI

SEQ ID NO: 482449 - protein, 8 aa, Mycobacterium
GEDEEAER

SEQ ID NO: 482450 - protein, 8 aa, Mycobacterium
GEDGATYE

SEQ ID NO: 482451 - protein, 7 aa, Mycobacterium
GEDGDPA

SEQ ID NO: 482452 - protein, 8 aa, Mycobacterium
GEDGEASD

SEQ ID NO: 482453 - protein, 10 aa, Mycobacterium
GEDGEPAGVD

SEQ ID NO: 482454 - protein, 9 aa, Mycobacterium
GEDGGHGDV

SEQ ID NO: 482455 - protein, 7 aa, Mycobacterium
GEDGGTA

SEQ ID NO: 482456 - protein, 8 aa, Mycobacterium
GEDGLKRE

SEQ ID NO: 482457 - protein, 6 aa, Mycobacterium
GEDGNR

SEQ ID NO: 482458 - protein, 8 aa, Mycobacterium
GEDGPEGI

SEQ ID NO: 482459 - protein, 9 aa, Mycobacterium
GEDGPTGIG

SEQ ID NO: 482460 - protein, 7 aa, Mycobacterium
GEDGQDD

SEQ ID NO: 482461 - protein, 12 aa, Mycobacterium
GEDGQPVAAGSI

SEQ ID NO: 482462 - protein, 12 aa, Mycobacterium
GEDGQPVPQGEV

SEQ ID NO: 482463 - protein, 8 aa, Mycobacterium
GEDGRFRP

SEQ ID NO: 482464 - protein, 9 aa, Mycobacterium
GEDGRYRPA

SEQ ID NO: 482465 - protein, 10 aa, Mycobacterium
GEDGRYRPAS

SEQ ID NO: 482466 - protein, 7 aa, Mycobacterium
GEDGSAQ

SEQ ID NO: 482467 - protein, 8 aa, Mycobacterium
GEDGSDTV

SEQ ID NO: 482468 - protein, 7 aa, Mycobacterium
GEDGVGS

SEQ ID NO: 482469 - protein, 7 aa, Mycobacterium
GEDGWES

SEQ ID NO: 482470 - protein, 10 aa, Mycobacterium
GEDHARASRN

SEQ ID NO: 482471 - protein, 7 aa, Mycobacterium
GEDHRRR

SEQ ID NO: 482472 - protein, 7 aa, Mycobacterium
GEDIPED

SEQ ID NO: 482473 - protein, 8 aa, Mycobacterium
GEDKGMRD

SEQ ID NO: 482474 - protein, 8 aa, Mycobacterium
GEDKPTRA

SEQ ID NO: 482475 - protein, 9 aa, Mycobacterium
GEDLASGDS

SEQ ID NO: 482476 - protein, 11 aa, Mycobacterium
GEDLDKAREVA

SEQ ID NO: 482477 - protein, 10 aa, Mycobacterium
GEDLEAGNTY

SEQ ID NO: 482478 - protein, 10 aa, Mycobacterium
GEDLESGNLD

SEQ ID NO: 482479 - protein, 5 aa, Mycobacterium
GEDLG

SEQ ID NO: 482480 - protein, 9 aa, Mycobacterium
GEDLGSGAD

SEQ ID NO: 482481 - protein, 9 aa, Mycobacterium
GEDMESGDL

SEQ ID NO: 482482 - protein, 6 aa, Mycobacterium
GEDMPT

SEQ ID NO: 482483 - protein, 20 aa, Mycobacterium
GEDMSSSDTQAGSKTGTAQI

SEQ ID NO: 482484 - protein, 9 aa, Mycobacterium
GEDNGWDTR

SEQ ID NO: 482485 - protein, 7 aa, Mycobacterium
GEDPAAL

SEQ ID NO: 482486 - protein, 6 aa, Mycobacterium
GEDPAG

SEQ ID NO: 482487 - protein, 11 aa, Mycobacterium
GEDPAGDPGRR

SEQ ID NO: 482488 - protein, 8 aa, Mycobacterium
GEDPARRL

SEQ ID NO: 482489 - protein, 11 aa, Mycobacterium
GEDPATVRPTQ

SEQ ID NO: 482490 - protein, 8 aa, Mycobacterium
GEDPDIDE

SEQ ID NO: 482491 - protein, 16 aa, Mycobacterium
GEDPDRHGLADTPARV

SEQ ID NO: 482492 - protein, 8 aa, Mycobacterium
GEDPDVDQ

SEQ ID NO: 482493 - protein, 8 aa, Mycobacterium
GEDPGGMA

SEQ ID NO: 482494 - protein, 7 aa, Mycobacterium
GEDPGRL

SEQ ID NO: 482495 - protein, 5 aa, Mycobacterium
GEDPI

SEQ ID NO: 482496 - protein, 7 aa, Mycobacterium
GEDPKLR

SEQ ID NO: 482497 - protein, 13 aa, Mycobacterium
GEDPLDASGVHPE

SEQ ID NO: 482498 - protein, 4 aa, Mycobacterium
GEDQ

SEQ ID NO: 482499 - protein, 9 aa, Mycobacterium
GEDQHQDTG

SEQ ID NO: 482500 - protein, 9 aa, Mycobacterium
GEDQSAEQA

SEQ ID NO: 482501 - protein, 6 aa, Mycobacterium
GEDQYG

SEQ ID NO: 482502 - protein, 5 aa, Mycobacterium
GEDRA

SEQ ID NO: 482503 - protein, 5 aa, Mycobacterium
GEDRD

SEQ ID NO: 482504 - protein, 8 aa, Mycobacterium
GEDREGAE

SEQ ID NO: 482505 - protein, 7 aa, Mycobacterium
GEDREKI

SEQ ID NO: 482506 - protein, 5 aa, Mycobacterium
GEDRH

SEQ ID NO: 482507 - protein, 5 aa, Mycobacterium
GEDRL

SEQ ID NO: 482508 - protein, 8 aa, Mycobacterium
GEDRRPDW

SEQ ID NO: 482509 - protein, 10 aa, Mycobacterium
GEDRVDPAPV

SEQ ID NO: 482510 - protein, 11 aa, Mycobacterium
GEDSATPDEAS

SEQ ID NO: 482511 - protein, 15 aa, Mycobacterium
GEDSERLTGATGLST

SEQ ID NO: 482512 - protein, 9 aa, Mycobacterium
GEDSGPAES

SEQ ID NO: 482513 - protein, 17 aa, Mycobacterium
GEDSGVLGTNESIESVG

SEQ ID NO: 482514 - protein, 7 aa, Mycobacterium
GEDSPYE

SEQ ID NO: 482515 - protein, 9 aa, Mycobacterium
GEDSQRAAA

SEQ ID NO: 482516 - protein, 7 aa, Mycobacterium
GEDSVGE

SEQ ID NO: 482517 - protein, 8 aa, Mycobacterium
GEDSWGRG

SEQ ID NO: 482518 - protein, 4 aa, Mycobacterium
GEDT

SEQ ID NO: 482519 - protein, 9 aa, Mycobacterium
GEDTDDGTL

SEQ ID NO: 482520 - protein, 14 aa, Mycobacterium
GEDTERARAMLSAR

SEQ ID NO: 482521 - protein, 9 aa, Mycobacterium
GEDTGGSIR

SEQ ID NO: 482522 - protein, 6 aa, Mycobacterium
GEDTGL

SEQ ID NO: 482523 - protein, 9 aa, Mycobacterium
GEDTGYASN

SEQ ID NO: 482524 - protein, 6 aa, Mycobacterium
GEDTHR

SEQ ID NO: 482525 - protein, 8 aa, Mycobacterium
GEDTITEH

SEQ ID NO: 482526 - protein, 6 aa, Mycobacterium
GEDTPA

SEQ ID NO: 482527 - protein, 14 aa, Mycobacterium
GEDTTDSEQATRTV

SEQ ID NO: 482528 - protein, 7 aa, Mycobacterium
GEDTTSA

SEQ ID NO: 482529 - protein, 14 aa, Mycobacterium
GEDTTSKEDADNTV

SEQ ID NO: 482530 - protein, 9 aa, Mycobacterium
GEDTVRRGR

SEQ ID NO: 482531 - protein, 7 aa, Mycobacterium
GEDVQTV

SEQ ID NO: 482532 - protein, 13 aa, Mycobacterium
GEDVTDLPPAKRG

SEQ ID NO: 482533 - protein, 6 aa, Mycobacterium
GEDYAL

SEQ ID NO: 482534 - protein, 6 aa, Mycobacterium
GEEADT

SEQ ID NO: 482535 - protein, 7 aa, Mycobacterium
GEEASTV

SEQ ID NO: 482536 - protein, 12 aa, Mycobacterium
GEEATAAGTARY

SEQ ID NO: 482537 - protein, 12 aa, Mycobacterium
GEECDGEDTRLG

SEQ ID NO: 482538 - protein, 21 aa, Mycobacterium
GEEDAAEAPAPAEAQPADAVT

SEQ ID NO: 482539 - protein, 16 aa, Mycobacterium
GEEDHHEASRMPGGTE

SEQ ID NO: 482540 - protein, 5 aa, Mycobacterium
GEEEA

SEQ ID NO: 482541 - protein, 13 aa, Mycobacterium
GEEEGGKQEGRAG

SEQ ID NO: 482542 - protein, 10 aa, Mycobacterium
GEEEGGSVDI

SEQ ID NO: 482543 - protein, 7 aa, Mycobacterium
GEEEGIG

SEQ ID NO: 482544 - protein, 13 aa, Mycobacterium
GEEEGSDTALANY

SEQ ID NO: 482545 - protein, 11 aa, Mycobacterium
GEEELDDGRTH

SEQ ID NO: 482546 - protein, 6 aa, Mycobacterium
GEEELR

SEQ ID NO: 482547 - protein, 4 aa, Mycobacterium
GEEG

SEQ ID NO: 482548 - protein, 6 aa, Mycobacterium
GEEGEA

SEQ ID NO: 482549 - protein, 7 aa, Mycobacterium
GEEGEDF

SEQ ID NO: 482550 - protein, 5 aa, Mycobacterium
GEEGK

SEQ ID NO: 482551 - protein, 7 aa, Mycobacterium
GEEGQGF

SEQ ID NO: 482552 - protein, 5 aa, Mycobacterium
GEEGR

SEQ ID NO: 482553 - protein, 6 aa, Mycobacterium
GEEGTG

SEQ ID NO: 482554 - protein, 5 aa, Mycobacterium
GEEHR

SEQ ID NO: 482555 - protein, 7 aa, Mycobacterium
GEEHRQR

SEQ ID NO: 482556 - protein, 7 aa, Mycobacterium
GEEHRRR

SEQ ID NO: 482557 - protein, 10 aa, Mycobacterium
GEEKAADDVF

SEQ ID NO: 482558 - protein, 14 aa, Mycobacterium
GEEKETGLSDSSPW

SEQ ID NO: 482559 - protein, 5 aa, Mycobacterium
GEEKV

SEQ ID NO: 482560 - protein, 8 aa, Mycobacterium
GEEKVGVD

SEQ ID NO: 482561 - protein, 36 aa, Mycobacterium
GEELAAGKAVTVDDARRAAERAEASHERDEEAHRRG

SEQ ID NO: 482562 - protein, 7 aa, Mycobacterium
GEELDPG

SEQ ID NO: 482563 - protein, 57 aa, Mycobacterium
GEELPDAQEEDPSAHDASDNPDEDNDPQDVSSDEPAAGPTPVTLPDGETVTAASPQL

SEQ ID NO: 482564 - protein, 8 aa, Mycobacterium
GEELPEDR

SEQ ID NO: 482565 - protein, 6 aa, Mycobacterium
GEELQQ

SEQ ID NO: 482566 - protein, 7 aa, Mycobacterium
GEELTEA

SEQ ID NO: 482567 - protein, 15 aa, Mycobacterium
GEEMGAPASLAAGPQ

SEQ ID NO: 482568 - protein, 6 aa, Mycobacterium
GEENQG

SEQ ID NO: 482569 - protein, 14 aa, Mycobacterium
GEEPDGGLSDTSPW

SEQ ID NO: 482570 - protein, 29 aa, Mycobacterium
GEEPDRLQPPAVETTTATQSEADAAAAGA

SEQ ID NO: 482571 - protein, 7 aa, Mycobacterium
GEEPLDD

SEQ ID NO: 482572 - protein, 5 aa, Mycobacterium
GEEPR

SEQ ID NO: 482573 - protein, 8 aa, Mycobacterium
GEEPRADS

SEQ ID NO: 482574 - protein, 6 aa, Mycobacterium
GEEQGR

SEQ ID NO: 482575 - protein, 5 aa, Mycobacterium
GEEQL

SEQ ID NO: 482576 - protein, 8 aa, Mycobacterium
GEERDEAW

SEQ ID NO: 482577 - protein, 5 aa, Mycobacterium
GEERL

SEQ ID NO: 482578 - protein, 16 aa, Mycobacterium
GEERPDRGTPSFATPI

SEQ ID NO: 482579 - protein, 4 aa, Mycobacterium
GEES

SEQ ID NO: 482580 - protein, 7 aa, Mycobacterium
GEESAAQ

SEQ ID NO: 482581 - protein, 8 aa, Mycobacterium
GEESDRVD

SEQ ID NO: 482582 - protein, 10 aa, Mycobacterium
GEESERPGQR

SEQ ID NO: 482583 - protein, 12 aa, Mycobacterium
GEESTASGTARY

SEQ ID NO: 482584 - protein, 8 aa, Mycobacterium
GEESTTVE

SEQ ID NO: 482585 - protein, 9 aa, Mycobacterium
GEETESASQ

SEQ ID NO: 482586 - protein, 6 aa, Mycobacterium
GEETGY

SEQ ID NO: 482587 - protein, 8 aa, Mycobacterium
GEETHADL

SEQ ID NO: 482588 - protein, 7 aa, Mycobacterium
GEETHAE

SEQ ID NO: 482589 - protein, 12 aa, Mycobacterium
GEETKAVACLFS

SEQ ID NO: 482590 - protein, 8 aa, Mycobacterium
GEETPYGT

SEQ ID NO: 482591 - protein, 6 aa, Mycobacterium
GEEVGR

SEQ ID NO: 482592 - protein, 7 aa, Mycobacterium
GEEVTGE

SEQ ID NO: 482593 - protein, 5 aa, Mycobacterium
GEEYD

SEQ ID NO: 482594 - protein, 11 aa, Mycobacterium
GEEYGGEATFT

SEQ ID NO: 482595 - protein, 5 aa, Mycobacterium
GEEYP

SEQ ID NO: 482596 - protein, 9 aa, Mycobacterium
GEFAGQEAE

SEQ ID NO: 482597 - protein, 4 aa, Mycobacterium
GEFD

SEQ ID NO: 482598 - protein, 9 aa, Mycobacterium
GEFDDAQRA

SEQ ID NO: 482599 - protein, 6 aa, Mycobacterium
GEFDGR

SEQ ID NO: 482600 - protein, 9 aa, Mycobacterium
GEFDPVKAA

SEQ ID NO: 482601 - protein, 6 aa, Mycobacterium
GEFDTG

SEQ ID NO: 482602 - protein, 11 aa, Mycobacterium
GEFEARRRTQQ

SEQ ID NO: 482603 - protein, 8 aa, Mycobacterium
GEFEPAQR

SEQ ID NO: 482604 - protein, 11 aa, Mycobacterium
GEFESVADTDS

SEQ ID NO: 482605 - protein, 4 aa, Mycobacterium
GEFG

SEQ ID NO: 482606 - protein, 7 aa, Mycobacterium
GEFGEAD

SEQ ID NO: 482607 - protein, 6 aa, Mycobacterium
GEFGGR

SEQ ID NO: 482608 - protein, 6 aa, Mycobacterium
GEFGGT

SEQ ID NO: 482609 - protein, 15 aa, Mycobacterium
GEFGHNKTAAAAGRA

SEQ ID NO: 482610 - protein, 11 aa, Mycobacterium
GEFGPDDPISV

SEQ ID NO: 482611 - protein, 4 aa, Mycobacterium
GEFN

SEQ ID NO: 482612 - protein, 6 aa, Mycobacterium
GEFNDE

SEQ ID NO: 482613 - protein, 4 aa, Mycobacterium
GEFP

SEQ ID NO: 482614 - protein, 6 aa, Mycobacterium
GEFQTG

SEQ ID NO: 482615 - protein, 7 aa, Mycobacterium
GEFRPRP

SEQ ID NO: 482616 - protein, 5 aa, Mycobacterium
GEFRT

SEQ ID NO: 482617 - protein, 13 aa, Mycobacterium
GEFSDAERARKRG

SEQ ID NO: 482618 - protein, 7 aa, Mycobacterium
GEFSGLP

SEQ ID NO: 482619 - protein, 9 aa, Mycobacterium
GEFSSEPSA

SEQ ID NO: 482620 - protein, 10 aa, Mycobacterium
GEFSSQPSAV

SEQ ID NO: 482621 - protein, 6 aa, Mycobacterium
GEFTES

SEQ ID NO: 482622 - protein, 15 aa, Mycobacterium
GEFVDGKTQGKYSDT

SEQ ID NO: 482623 - protein, 5 aa, Mycobacterium
GEGAA

SEQ ID NO: 482624 - protein, 8 aa, Mycobacterium
GEGAAAHA

SEQ ID NO: 482625 - protein, 9 aa, Mycobacterium
GEGAAAHAE

SEQ ID NO: 482626 - protein, 11 aa, Mycobacterium
GEGAASADTVA

SEQ ID NO: 482627 - protein, 12 aa, Mycobacterium
GEGADSLPTDER

SEQ ID NO: 482628 - protein, 10 aa, Mycobacterium
GEGAGSGPHT

SEQ ID NO: 482629 - protein, 7 aa, Mycobacterium
GEGAGSI

SEQ ID NO: 482630 - protein, 7 aa, Mycobacterium
GEGAGSV

SEQ ID NO: 482631 - protein, 7 aa, Mycobacterium
GEGAPAW

SEQ ID NO: 482632 - protein, 29 aa, Mycobacterium
GEGAPGKRSRARNRTGKPIAATAEPGEGH

SEQ ID NO: 482633 - protein, 18 aa, Mycobacterium
GEGAPGRRSRARNGSGSV

SEQ ID NO: 482634 - protein, 27 aa, Mycobacterium
GEGAPGRRSRARNRTGSVVSATSDPHV

SEQ ID NO: 482635 - protein, 9 aa, Mycobacterium
GEGARAARY

SEQ ID NO: 482636 - protein, 5 aa, Mycobacterium
GEGAS

SEQ ID NO: 482637 - protein, 11 aa, Mycobacterium
GEGASARPRAE

SEQ ID NO: 482638 - protein, 10 aa, Mycobacterium
GEGATKSVEY

SEQ ID NO: 482639 - protein, 5 aa, Mycobacterium
GEGCR

SEQ ID NO: 482640 - protein, 9 aa, Mycobacterium
GEGDDAEAR

SEQ ID NO: 482641 - protein, 10 aa, Mycobacterium
GEGDDAEARI

SEQ ID NO: 482642 - protein, 6 aa, Mycobacterium
GEGDGV

SEQ ID NO: 482643 - protein, 6 aa, Mycobacterium
GEGDID

SEQ ID NO: 482644 - protein, 12 aa, Mycobacterium
GEGDIDGSLRPR

SEQ ID NO: 482645 - protein, 11 aa, Mycobacterium
GEGDLDRNVTR

SEQ ID NO: 482646 - protein, 5 aa, Mycobacterium
GEGDM

SEQ ID NO: 482647 - protein, 8 aa, Mycobacterium
GEGDMPQT

SEQ ID NO: 482648 - protein, 11 aa, Mycobacterium
GEGDPEPLRAA

SEQ ID NO: 482649 - protein, 5 aa, Mycobacterium
GEGDT

SEQ ID NO: 482650 - protein, 8 aa, Mycobacterium
GEGDTFST

SEQ ID NO: 482651 - protein, 18 aa, Mycobacterium
GEGEAGKLIDNGDTTYGG

SEQ ID NO: 482652 - protein, 14 aa, Mycobacterium
GEGEDQQTNNEQSV

SEQ ID NO: 482653 - protein, 13 aa, Mycobacterium
GEGEGRDADGDYR

SEQ ID NO: 482654 - protein, 12 aa, Mycobacterium
GEGEGRDAHGDY

SEQ ID NO: 482655 - protein, 13 aa, Mycobacterium
GEGEGRDTDGDYR

SEQ ID NO: 482656 - protein, 11 aa, Mycobacterium
GEGEGRGPHGD

SEQ ID NO: 482657 - protein, 27 aa, Mycobacterium
GEGEKTVYAGDASGRFEPAEPFAFLGL

SEQ ID NO: 482658 - protein, 6 aa, Mycobacterium
GEGEPF

SEQ ID NO: 482659 - protein, 12 aa, Mycobacterium
GEGERGQVPAPA

SEQ ID NO: 482660 - protein, 8 aa, Mycobacterium
GEGEVTPD

SEQ ID NO: 482661 - protein, 8 aa, Mycobacterium
GEGEYADR

SEQ ID NO: 482662 - protein, 5 aa, Mycobacterium
GEGFT

SEQ ID NO: 482663 - protein, 4 aa, Mycobacterium
GEGG

SEQ ID NO: 482664 - protein, 7 aa, Mycobacterium
GEGGARI

SEQ ID NO: 482665 - protein, 5 aa, Mycobacterium
GEGGE

SEQ ID NO: 482666 - protein, 23 aa, Mycobacterium
GEGGFGGDRGPSTSTAAPDRAPD

SEQ ID NO: 482667 - protein, 24 aa, Mycobacterium
GEGGFGGERGPSGGDAAPERAPDL

SEQ ID NO: 482668 - protein, 24 aa, Mycobacterium
GEGGFGGERGPSSHGGVPERDADL

SEQ ID NO: 482669 - protein, 24 aa, Mycobacterium
GEGGFGGERGPSTSDAAPDRAPDV

SEQ ID NO: 482670 - protein, 23 aa, Mycobacterium
GEGGFGGERGPSTSFEPPSRAPD

SEQ ID NO: 482671 - protein, 10 aa, Mycobacterium
GEGGGEQVAE

SEQ ID NO: 482672 - protein, 8 aa, Mycobacterium
GEGGGGLE

SEQ ID NO: 482673 - protein, 12 aa, Mycobacterium
GEGGGTGTGGAP

SEQ ID NO: 482674 - protein, 5 aa, Mycobacterium
GEGGL

SEQ ID NO: 482675 - protein, 9 aa, Mycobacterium
GEGGNLGLT

SEQ ID NO: 482676 - protein, 16 aa, Mycobacterium
GEGGQLGTRPMLRSQS

SEQ ID NO: 482677 - protein, 6 aa, Mycobacterium
GEGGRA

SEQ ID NO: 482678 - protein, 9 aa, Mycobacterium
GEGGRSSGI

SEQ ID NO: 482679 - protein, 13 aa, Mycobacterium
GEGGSQDSRPVGG

SEQ ID NO: 482680 - protein, 9 aa, Mycobacterium
GEGGSQSIT

SEQ ID NO: 482681 - protein, 5 aa, Mycobacterium
GEGGV

SEQ ID NO: 482682 - protein, 9 aa, Mycobacterium
GEGGVAPAD

SEQ ID NO: 482683 - protein, 12 aa, Mycobacterium
GEGGVKGLSGPE

SEQ ID NO: 482684 - protein, 14 aa, Mycobacterium
GEGGVKGLSGPEKA

SEQ ID NO: 482685 - protein, 14 aa, Mycobacterium
GEGGVKSLSGPEKA

SEQ ID NO: 482686 - protein, 15 aa, Mycobacterium
GEGGYVGRDDAANMT

SEQ ID NO: 482687 - protein, 21 aa, Mycobacterium
GEGHSGAAATGFSEASGPIDD

SEQ ID NO: 482688 - protein, 8 aa, Mycobacterium
GEGKADAV

SEQ ID NO: 482689 - protein, 6 aa, Mycobacterium
GEGKDL

SEQ ID NO: 482690 - protein, 10 aa, Mycobacterium
GEGKFDDQTL

SEQ ID NO: 482691 - protein, 10 aa, Mycobacterium
GEGKGARVST

SEQ ID NO: 482692 - protein, 10 aa, Mycobacterium
GEGKGSVSRA

SEQ ID NO: 482693 - protein, 4 aa, Mycobacterium
GEGL

SEQ ID NO: 482694 - protein, 18 aa, Mycobacterium
GEGLAAGTKKNPSGNLPR

SEQ ID NO: 482695 - protein, 14 aa, Mycobacterium
GEGLLDTTSDSSVA

SEQ ID NO: 482696 - protein, 8 aa, Mycobacterium
GEGLTNPE

SEQ ID NO: 482697 - protein, 11 aa, Mycobacterium
GEGMGPGGEVK

SEQ ID NO: 482698 - protein, 9 aa, Mycobacterium
GEGNDLHTE

SEQ ID NO: 482699 - protein, 5 aa, Mycobacterium
GEGNP

SEQ ID NO: 482700 - protein, 9 aa, Mycobacterium
GEGNRPPPE

SEQ ID NO: 482701 - protein, 15 aa, Mycobacterium
GEGNSTADTAAPGSP

SEQ ID NO: 482702 - protein, 18 aa, Mycobacterium
GEGNSTADTAGVLGPDSP

SEQ ID NO: 482703 - protein, 5 aa, Mycobacterium
GEGNT

SEQ ID NO: 482704 - protein, 18 aa, Mycobacterium
GEGNTNVHAEAGPGGANI

SEQ ID NO: 482705 - protein, 6 aa, Mycobacterium
GEGPAA

SEQ ID NO: 482706 - protein, 5 aa, Mycobacterium
GEGPC

SEQ ID NO: 482707 - protein, 10 aa, Mycobacterium
GEGPDAVSAY

SEQ ID NO: 482708 - protein, 7 aa, Mycobacterium
GEGPGHE

SEQ ID NO: 482709 - protein, 8 aa, Mycobacterium
GEGPTEKK

SEQ ID NO: 482710 - protein, 22 aa, Mycobacterium
GEGPVRATRAGDGYRLTGTRTQ

SEQ ID NO: 482711 - protein, 12 aa, Mycobacterium
GEGQDSKAQGAC

SEQ ID NO: 482712 - protein, 9 aa, Mycobacterium
GEGQHQDAG

SEQ ID NO: 482713 - protein, 6 aa, Mycobacterium
GEGRAA

SEQ ID NO: 482714 - protein, 10 aa, Mycobacterium
GEGRAAAAER

SEQ ID NO: 482715 - protein, 11 aa, Mycobacterium
GEGRAGEYPTI

SEQ ID NO: 482716 - protein, 14 aa, Mycobacterium
GEGRAIGKVLIDVP

SEQ ID NO: 482717 - protein, 5 aa, Mycobacterium
GEGRD

SEQ ID NO: 482718 - protein, 9 aa, Mycobacterium
GEGRDKGPV

SEQ ID NO: 482719 - protein, 9 aa, Mycobacterium
GEGRFDDQS

SEQ ID NO: 482720 - protein, 5 aa, Mycobacterium
GEGRG

SEQ ID NO: 482721 - protein, 9 aa, Mycobacterium
GEGRGKRPV

SEQ ID NO: 482722 - protein, 19 aa, Mycobacterium
GEGRKDTRTARMTGRARDG

SEQ ID NO: 482723 - protein, 7 aa, Mycobacterium
GEGRPDK

SEQ ID NO: 482724 - protein, 7 aa, Mycobacterium
GEGRPDR

SEQ ID NO: 482725 - protein, 7 aa, Mycobacterium
GEGRRGL

SEQ ID NO: 482726 - protein, 6 aa, Mycobacterium
GEGRRP

SEQ ID NO: 482727 - protein, 9 aa, Mycobacterium
GEGRRSPEW

SEQ ID NO: 482728 - protein, 8 aa, Mycobacterium
GEGRSRDD

SEQ ID NO: 482729 - protein, 8 aa, Mycobacterium
GEGRTRDD

SEQ ID NO: 482730 - protein, 4 aa, Mycobacterium
GEGS

SEQ ID NO: 482731 - protein, 10 aa, Mycobacterium
GEGSAASGPR

SEQ ID NO: 482732 - protein, 5 aa, Mycobacterium
GEGSG

SEQ ID NO: 482733 - protein, 6 aa, Mycobacterium
GEGSGA

SEQ ID NO: 482734 - protein, 7 aa, Mycobacterium
GEGSGAA

SEQ ID NO: 482735 - protein, 13 aa, Mycobacterium
GEGSHTDAPVDTK

SEQ ID NO: 482736 - protein, 14 aa, Mycobacterium
GEGSLERERTGERP

SEQ ID NO: 482737 - protein, 10 aa, Mycobacterium
GEGSPAPDAD

SEQ ID NO: 482738 - protein, 5 aa, Mycobacterium
GEGSV

SEQ ID NO: 482739 - protein, 8 aa, Mycobacterium
GEGSVDAQ

SEQ ID NO: 482740 - protein, 6 aa, Mycobacterium
GEGTAA

SEQ ID NO: 482741 - protein, 7 aa, Mycobacterium
GEGTGAA

SEQ ID NO: 482742 - protein, 7 aa, Mycobacterium
GEGTGAT

SEQ ID NO: 482743 - protein, 25 aa, Mycobacterium
GEGTGSTVETHATPIGSGPDGRPRT

SEQ ID NO: 482744 - protein, 7 aa, Mycobacterium
GEGTGSV

SEQ ID NO: 482745 - protein, 14 aa, Mycobacterium
GEGTKKLSKRDPQS

SEQ ID NO: 482746 - protein, 11 aa, Mycobacterium
GEGTKKTEEND

SEQ ID NO: 482747 - protein, 6 aa, Mycobacterium
GEGTLT

SEQ ID NO: 482748 - protein, 6 aa, Mycobacterium
GEGTSE

SEQ ID NO: 482749 - protein, 22 aa, Mycobacterium
GEGTSPPILGGRPAHGRTENAY

SEQ ID NO: 482750 - protein, 5 aa, Mycobacterium
GEGVD

SEQ ID NO: 482751 - protein, 10 aa, Mycobacterium
GEGVDPARVG

SEQ ID NO: 482752 - protein, 5 aa, Mycobacterium
GEGVG

SEQ ID NO: 482753 - protein, 8 aa, Mycobacterium
GEGVPGAP

SEQ ID NO: 482754 - protein, 6 aa, Mycobacterium
GEGVQD

SEQ ID NO: 482755 - protein, 5 aa, Mycobacterium
GEGVR

SEQ ID NO: 482756 - protein, 12 aa, Mycobacterium
GEGVRRTGGSAV

SEQ ID NO: 482757 - protein, 9 aa, Mycobacterium
GEGVTDHQV

SEQ ID NO: 482758 - protein, 10 aa, Mycobacterium
GEGVTQHQVG

SEQ ID NO: 482759 - protein, 5 aa, Mycobacterium
GEGYD

SEQ ID NO: 482760 - protein, 8 aa, Mycobacterium
GEGYGKTS

SEQ ID NO: 482761 - protein, 7 aa, Mycobacterium
GEHAARA

SEQ ID NO: 482762 - protein, 8 aa, Mycobacterium
GEHAARAE

SEQ ID NO: 482763 - protein, 12 aa, Mycobacterium
GEHAESKDHHPD

SEQ ID NO: 482764 - protein, 5 aa, Mycobacterium
GEHAP

SEQ ID NO: 482765 - protein, 5 aa, Mycobacterium
GEHAS

SEQ ID NO: 482766 - protein, 8 aa, Mycobacterium
GEHDQHGN

SEQ ID NO: 482767 - protein, 6 aa, Mycobacterium
GEHDQL

SEQ ID NO: 482768 - protein, 5 aa, Mycobacterium
GEHDR

SEQ ID NO: 482769 - protein, 10 aa, Mycobacterium
GEHDSPGEAT

SEQ ID NO: 482770 - protein, 22 aa, Mycobacterium
GEHDSPGEVSPGSVWPPSEGPQ

SEQ ID NO: 482771 - protein, 17 aa, Mycobacterium
GEHDSVDDAGQKYRNTF

SEQ ID NO: 482772 - protein, 5 aa, Mycobacterium
GEHDT

SEQ ID NO: 482773 - protein, 21 aa, Mycobacterium
GEHDVNAQDLDGKTPLHYATE

SEQ ID NO: 482774 - protein, 7 aa, Mycobacterium
GEHDYEP

SEQ ID NO: 482775 - protein, 8 aa, Mycobacterium
GEHEAEDQ

SEQ ID NO: 482776 - protein, 34 aa, Mycobacterium
GEHERAGHHGQHQRGGRDQAPGGRGADPDGLGGR

SEQ ID NO: 482777 - protein, 4 aa, Mycobacterium
GEHG

SEQ ID NO: 482778 - protein, 6 aa, Mycobacterium
GEHGDK

SEQ ID NO: 482779 - protein, 6 aa, Mycobacterium
GEHGDL

SEQ ID NO: 482780 - protein, 11 aa, Mycobacterium
GEHGGSGGSLD

SEQ ID NO: 482781 - protein, 6 aa, Mycobacterium
GEHGLT

SEQ ID NO: 482782 - protein, 6 aa, Mycobacterium
GEHGPE

SEQ ID NO: 482783 - protein, 7 aa, Mycobacterium
GEHGPIG

SEQ ID NO: 482784 - protein, 13 aa, Mycobacterium
GEHGQAGHSTETM

SEQ ID NO: 482785 - protein, 10 aa, Mycobacterium
GEHGSGAGAP

SEQ ID NO: 482786 - protein, 12 aa, Mycobacterium
GEHGSTFGGNPL

SEQ ID NO: 482787 - protein, 15 aa, Mycobacterium
GEHGSTFGGNPLGAA

SEQ ID NO: 482788 - protein, 5 aa, Mycobacterium
GEHGT

SEQ ID NO: 482789 - protein, 7 aa, Mycobacterium
GEHGTGA

SEQ ID NO: 482790 - protein, 8 aa, Mycobacterium
GEHGTGET

SEQ ID NO: 482791 - protein, 9 aa, Mycobacterium
GEHGVGPGS

SEQ ID NO: 482792 - protein, 11 aa, Mycobacterium
GEHGVSTPRSK

SEQ ID NO: 482793 - protein, 6 aa, Mycobacterium
GEHGYG

SEQ ID NO: 482794 - protein, 7 aa, Mycobacterium
GEHLPSP

SEQ ID NO: 482795 - protein, 6 aa, Mycobacterium
GEHNTE

SEQ ID NO: 482796 - protein, 4 aa, Mycobacterium
GEHP

SEQ ID NO: 482797 - protein, 7 aa, Mycobacterium
GEHPDGA

SEQ ID NO: 482798 - protein, 6 aa, Mycobacterium
GEHPEY

SEQ ID NO: 482799 - protein, 14 aa, Mycobacterium
GEHPPALDAPAAAA

SEQ ID NO: 482800 - protein, 13 aa, Mycobacterium
GEHPYRPITPESI

SEQ ID NO: 482801 - protein, 7 aa, Mycobacterium
GEHQGVT

SEQ ID NO: 482802 - protein, 10 aa, Mycobacterium
GEHQVPNARK

SEQ ID NO: 482803 - protein, 9 aa, Mycobacterium
GEHRPTSLA

SEQ ID NO: 482804 - protein, 4 aa, Mycobacterium
GEHS

SEQ ID NO: 482805 - protein, 15 aa, Mycobacterium
GEHSTNGGKPGVVDD

SEQ ID NO: 482806 - protein, 4 aa, Mycobacterium
GEHT

SEQ ID NO: 482807 - protein, 7 aa, Mycobacterium
GEHTEGI

SEQ ID NO: 482808 - protein, 8 aa, Mycobacterium
GEHTNDMP

SEQ ID NO: 482809 - protein, 7 aa, Mycobacterium
GEHTRDE

SEQ ID NO: 482810 - protein, 5 aa, Mycobacterium
GEHTT

SEQ ID NO: 482811 - protein, 6 aa, Mycobacterium
GEHVPV

SEQ ID NO: 482812 - protein, 12 aa, Mycobacterium
GEHVSDATYARA

SEQ ID NO: 482813 - protein, 4 aa, Mycobacterium
GEIA

SEQ ID NO: 482814 - protein, 9 aa, Mycobacterium
GEIAAPDDD

SEQ ID NO: 482815 - protein, 5 aa, Mycobacterium
GEIAD

SEQ ID NO: 482816 - protein, 14 aa, Mycobacterium
GEIAGAAAAAKAGI

SEQ ID NO: 482817 - protein, 13 aa, Mycobacterium
GEIAGAQAAARAG

SEQ ID NO: 482818 - protein, 9 aa, Mycobacterium
GEIAGPDAI

SEQ ID NO: 482819 - protein, 8 aa, Mycobacterium
GEIAPDAD

SEQ ID NO: 482820 - protein, 8 aa, Mycobacterium
GEIAPRSV

SEQ ID NO: 482821 - protein, 10 aa, Mycobacterium
GEIARPDDDV

SEQ ID NO: 482822 - protein, 8 aa, Mycobacterium
GEIDADAV

SEQ ID NO: 482823 - protein, 8 aa, Mycobacterium
GEIDPATV

SEQ ID NO: 482824 - protein, 5 aa, Mycobacterium
GEIDS

SEQ ID NO: 482825 - protein, 10 aa, Mycobacterium
GEIDSPARAA

SEQ ID NO: 482826 - protein, 10 aa, Mycobacterium
GEIDSPTRAA

SEQ ID NO: 482827 - protein, 7 aa, Mycobacterium
GEIDTAT

SEQ ID NO: 482828 - protein, 21 aa, Mycobacterium
GEIEAADAVDGEVRRVEIPPD

SEQ ID NO: 482829 - protein, 8 aa, Mycobacterium
GEIEAADN

SEQ ID NO: 482830 - protein, 17 aa, Mycobacterium
GEIEDTVTAGDPVSREV

SEQ ID NO: 482831 - protein, 14 aa, Mycobacterium
GEIEPEPVVTGPST

SEQ ID NO: 482832 - protein, 6 aa, Mycobacterium
GEIGMR

SEQ ID NO: 482833 - protein, 10 aa, Mycobacterium
GEIGVTDGSG

SEQ ID NO: 482834 - protein, 13 aa, Mycobacterium
GEIHADTDRAEAA

SEQ ID NO: 482835 - protein, 9 aa, Mycobacterium
GEINTVAGN

SEQ ID NO: 482836 - protein, 13 aa, Mycobacterium
GEIPDPQDPQTFQ

SEQ ID NO: 482837 - protein, 7 aa, Mycobacterium
GEIPEPN

SEQ ID NO: 482838 - protein, 8 aa, Mycobacterium
GEIPPSST

SEQ ID NO: 482839 - protein, 5 aa, Mycobacterium
GEIPQ

SEQ ID NO: 482840 - protein, 5 aa, Mycobacterium
GEIQA

SEQ ID NO: 482841 - protein, 5 aa, Mycobacterium
GEIQQ

SEQ ID NO: 482842 - protein, 6 aa, Mycobacterium
GEIQQN

SEQ ID NO: 482843 - protein, 6 aa, Mycobacterium
GEIQRN

SEQ ID NO: 482844 - protein, 8 aa, Mycobacterium
GEIRDPQL

SEQ ID NO: 482845 - protein, 12 aa, Mycobacterium
GEIRGGAMPRPE

SEQ ID NO: 482846 - protein, 11 aa, Mycobacterium
GEIRSNGNPGA

SEQ ID NO: 482847 - protein, 4 aa, Mycobacterium
GEIS

SEQ ID NO: 482848 - protein, 11 aa, Mycobacterium
GEISATKDSVA

SEQ ID NO: 482849 - protein, 7 aa, Mycobacterium
GEISPEP

SEQ ID NO: 482850 - protein, 13 aa, Mycobacterium
GEISRDGDSVTLR

SEQ ID NO: 482851 - protein, 18 aa, Mycobacterium
GEISRGEDVAENRANMRR

SEQ ID NO: 482852 - protein, 5 aa, Mycobacterium
GEISS

SEQ ID NO: 482853 - protein, 7 aa, Mycobacterium
GEISTPI

SEQ ID NO: 482854 - protein, 4 aa, Mycobacterium
GEIT

SEQ ID NO: 482855 - protein, 16 aa, Mycobacterium
GEITADLGDPAAPADV

SEQ ID NO: 482856 - protein, 7 aa, Mycobacterium
GEITGDS

SEQ ID NO: 482857 - protein, 5 aa, Mycobacterium
GEITT

SEQ ID NO: 482858 - protein, 10 aa, Mycobacterium
GEKAFSAGAD

SEQ ID NO: 482859 - protein, 7 aa, Mycobacterium
GEKAKRA

SEQ ID NO: 482860 - protein, 11 aa, Mycobacterium
GEKAPYGTKQI

SEQ ID NO: 482861 - protein, 9 aa, Mycobacterium
GEKDADTLT

SEQ ID NO: 482862 - protein, 6 aa, Mycobacterium
GEKEQA

SEQ ID NO: 482863 - protein, 4 aa, Mycobacterium
GEKG

SEQ ID NO: 482864 - protein, 28 aa, Mycobacterium
GEKGGWARPPAPDQVRDRRAEDALGREG

SEQ ID NO: 482865 - protein, 9 aa, Mycobacterium
GEKGRTGEN

SEQ ID NO: 482866 - protein, 11 aa, Mycobacterium
GEKGTAKSTAV

SEQ ID NO: 482867 - protein, 5 aa, Mycobacterium
GEKHE

SEQ ID NO: 482868 - protein, 9 aa, Mycobacterium
GEKKAKTAR

SEQ ID NO: 482869 - protein, 7 aa, Mycobacterium
GEKMSKS

SEQ ID NO: 482870 - protein, 8 aa, Mycobacterium
GEKMSKSI

SEQ ID NO: 482871 - protein, 12 aa, Mycobacterium
GEKMSKSLGNTI

SEQ ID NO: 482872 - protein, 9 aa, Mycobacterium
GEKMSKSVG

SEQ ID NO: 482873 - protein, 8 aa, Mycobacterium
GEKPCPNR

SEQ ID NO: 482874 - protein, 18 aa, Mycobacterium
GEKPGEPSWPTPWGRGRP

SEQ ID NO: 482875 - protein, 8 aa, Mycobacterium
GEKPGHTS

SEQ ID NO: 482876 - protein, 9 aa, Mycobacterium
GEKPGRSVT

SEQ ID NO: 482877 - protein, 5 aa, Mycobacterium
GEKQM

SEQ ID NO: 482878 - protein, 22 aa, Mycobacterium
GEKRPAGGNRRGNRLPRDERRG

SEQ ID NO: 482879 - protein, 6 aa, Mycobacterium
GEKRSY

SEQ ID NO: 482880 - protein, 22 aa, Mycobacterium
GEKSGPSAAAPVVPPGRTVGAS

SEQ ID NO: 482881 - protein, 7 aa, Mycobacterium
GEKSLDD

SEQ ID NO: 482882 - protein, 10 aa, Mycobacterium
GEKSPLAQAR

SEQ ID NO: 482883 - protein, 19 aa, Mycobacterium
GEKTASLGMSEPSAGSDLA

SEQ ID NO: 482884 - protein, 7 aa, Mycobacterium
GEKTMYG

SEQ ID NO: 482885 - protein, 22 aa, Mycobacterium
GEKTTDSVRPVGPAPVQPGGPP

SEQ ID NO: 482886 - protein, 4 aa, Mycobacterium
GEKV

SEQ ID NO: 482887 - protein, 24 aa, Mycobacterium
GEKVNKRSGKTGNASGGELTAQEA

SEQ ID NO: 482888 - protein, 12 aa, Mycobacterium
GEKVPRAGSGHA

SEQ ID NO: 482889 - protein, 12 aa, Mycobacterium
GEKYQPPTARQE

SEQ ID NO: 482890 - protein, 11 aa, Mycobacterium
GELAAEGRSDA

SEQ ID NO: 482891 - protein, 6 aa, Mycobacterium
GELADE

SEQ ID NO: 482892 - protein, 9 aa, Mycobacterium
GELADGGAG

SEQ ID NO: 482893 - protein, 11 aa, Mycobacterium
GELAEDKTALD

SEQ ID NO: 482894 - protein, 8 aa, Mycobacterium
GELAEQPV

SEQ ID NO: 482895 - protein, 6 aa, Mycobacterium
GELAGN

SEQ ID NO: 482896 - protein, 7 aa, Mycobacterium
GELAGPW

SEQ ID NO: 482897 - protein, 13 aa, Mycobacterium
GELAGQAGELTGM

SEQ ID NO: 482898 - protein, 10 aa, Mycobacterium
GELAQAAESA

SEQ ID NO: 482899 - protein, 12 aa, Mycobacterium
GELASARDAEFD

SEQ ID NO: 482900 - protein, 13 aa, Mycobacterium
GELASATGDFGSA

SEQ ID NO: 482901 - protein, 6 aa, Mycobacterium
GELASE

SEQ ID NO: 482902 - protein, 4 aa, Mycobacterium
GELD

SEQ ID NO: 482903 - protein, 7 aa, Mycobacterium
GELDDGA

SEQ ID NO: 482904 - protein, 17 aa, Mycobacterium
GELDDNGDGSSDDYRAR

SEQ ID NO: 482905 - protein, 7 aa, Mycobacterium
GELDDTD

SEQ ID NO: 482906 - protein, 5 aa, Mycobacterium
GELDE

SEQ ID NO: 482907 - protein, 7 aa, Mycobacterium
GELDGDR

SEQ ID NO: 482908 - protein, 8 aa, Mycobacterium
GELDGRDE

SEQ ID NO: 482909 - protein, 9 aa, Mycobacterium
GELDGRDRE

SEQ ID NO: 482910 - protein, 6 aa, Mycobacterium
GELDGT

SEQ ID NO: 482911 - protein, 10 aa, Mycobacterium
GELDNPGAMT

SEQ ID NO: 482912 - protein, 8 aa, Mycobacterium
GELDPAGN

SEQ ID NO: 482913 - protein, 9 aa, Mycobacterium
GELDQGEVG

SEQ ID NO: 482914 - protein, 5 aa, Mycobacterium
GELDR

SEQ ID NO: 482915 - protein, 5 aa, Mycobacterium
GELEE

SEQ ID NO: 482916 - protein, 10 aa, Mycobacterium
GELEGDAREA

SEQ ID NO: 482917 - protein, 8 aa, Mycobacterium
GELEGPDL

SEQ ID NO: 482918 - protein, 17 aa, Mycobacterium
GELENASRTAAKTQRPE

SEQ ID NO: 482919 - protein, 19 aa, Mycobacterium
GELEQATAERPQQRAAQRR

SEQ ID NO: 482920 - protein, 10 aa, Mycobacterium
GELESAAESF

SEQ ID NO: 482921 - protein, 5 aa, Mycobacterium
GELET

SEQ ID NO: 482922 - protein, 7 aa, Mycobacterium
GELGAAA

SEQ ID NO: 482923 - protein, 10 aa, Mycobacterium
GELGAAPGRI

SEQ ID NO: 482924 - protein, 8 aa, Mycobacterium
GELGAESS

SEQ ID NO: 482925 - protein, 6 aa, Mycobacterium
GELGAN

SEQ ID NO: 482926 - protein, 5 aa, Mycobacterium
GELGD

SEQ ID NO: 482927 - protein, 17 aa, Mycobacterium
GELGEAGTNAHHGSGTT

SEQ ID NO: 482928 - protein, 6 aa, Mycobacterium
GELGEP

SEQ ID NO: 482929 - protein, 5 aa, Mycobacterium
GELGG

SEQ ID NO: 482930 - protein, 20 aa, Mycobacterium
GELGGATADAITAAGGSARA

SEQ ID NO: 482931 - protein, 13 aa, Mycobacterium
GELGGDPQQVNPL

SEQ ID NO: 482932 - protein, 10 aa, Mycobacterium
GELGGTSDDV

SEQ ID NO: 482933 - protein, 16 aa, Mycobacterium
GELGPDGEEGSDDYRA

SEQ ID NO: 482934 - protein, 14 aa, Mycobacterium
GELGPEGPEDGAYR

SEQ ID NO: 482935 - protein, 13 aa, Mycobacterium
GELGPVSPSGSGR

SEQ ID NO: 482936 - protein, 12 aa, Mycobacterium
GELGQADRDSHA

SEQ ID NO: 482937 - protein, 8 aa, Mycobacterium
GELGRHNG

SEQ ID NO: 482938 - protein, 8 aa, Mycobacterium
GELGRSAA

SEQ ID NO: 482939 - protein, 11 aa, Mycobacterium
GELGSAAATFS

SEQ ID NO: 482940 - protein, 12 aa, Mycobacterium
GELGSAATAFSS

SEQ ID NO: 482941 - protein, 7 aa, Mycobacterium
GELGYTP

SEQ ID NO: 482942 - protein, 6 aa, Mycobacterium
GELHGP

SEQ ID NO: 482943 - protein, 4 aa, Mycobacterium
GELI

SEQ ID NO: 482944 - protein, 5 aa, Mycobacterium
GELIG

SEQ ID NO: 482945 - protein, 10 aa, Mycobacterium
GELNADKSNA

SEQ ID NO: 482946 - protein, 8 aa, Mycobacterium
GELNREGR

SEQ ID NO: 482947 - protein, 14 aa, Mycobacterium
GELNTDKKNRLSEN

SEQ ID NO: 482948 - protein, 36 aa, Mycobacterium
GELNTGFENGGTLNTGSWNSGDGNTGSGNSGETNTG

SEQ ID NO: 482949 - protein, 8 aa, Mycobacterium
GELPADTD

SEQ ID NO: 482950 - protein, 6 aa, Mycobacterium
GELPAK

SEQ ID NO: 482951 - protein, 6 aa, Mycobacterium
GELPAR

SEQ ID NO: 482952 - protein, 6 aa, Mycobacterium
GELPDD

SEQ ID NO: 482953 - protein, 6 aa, Mycobacterium
GELPDQ

SEQ ID NO: 482954 - protein, 14 aa, Mycobacterium
GELPEDHIDHLVSM

SEQ ID NO: 482955 - protein, 7 aa, Mycobacterium
GELPEPN

SEQ ID NO: 482956 - protein, 6 aa, Mycobacterium
GELPEQ

SEQ ID NO: 482957 - protein, 6 aa, Mycobacterium
GELPES

SEQ ID NO: 482958 - protein, 7 aa, Mycobacterium
GELPGNL

SEQ ID NO: 482959 - protein, 6 aa, Mycobacterium
GELPNR

SEQ ID NO: 482960 - protein, 8 aa, Mycobacterium
GELPPAEP

SEQ ID NO: 482961 - protein, 17 aa, Mycobacterium
GELPPEELADRFRLAWS

SEQ ID NO: 482962 - protein, 8 aa, Mycobacterium
GELPPPEP

SEQ ID NO: 482963 - protein, 6 aa, Mycobacterium
GELPPT

SEQ ID NO: 482964 - protein, 7 aa, Mycobacterium
GELPPVD

SEQ ID NO: 482965 - protein, 5 aa, Mycobacterium
GELPQ

SEQ ID NO: 482966 - protein, 12 aa, Mycobacterium
GELPQKAAAAQK

SEQ ID NO: 482967 - protein, 6 aa, Mycobacterium
GELPRA

SEQ ID NO: 482968 - protein, 14 aa, Mycobacterium
GELPRDSIDQLVSI

SEQ ID NO: 482969 - protein, 10 aa, Mycobacterium
GELPTTPEEV

SEQ ID NO: 482970 - protein, 4 aa, Mycobacterium
GELQ

SEQ ID NO: 482971 - protein, 6 aa, Mycobacterium
GELRDR

SEQ ID NO: 482972 - protein, 6 aa, Mycobacterium
GELRGS

SEQ ID NO: 482973 - protein, 7 aa, Mycobacterium
GELRGSG

SEQ ID NO: 482974 - protein, 5 aa, Mycobacterium
GELRP

SEQ ID NO: 482975 - protein, 10 aa, Mycobacterium
GELRPDADPR

SEQ ID NO: 482976 - protein, 7 aa, Mycobacterium
GELRTEN

SEQ ID NO: 482977 - protein, 4 aa, Mycobacterium
GELS

SEQ ID NO: 482978 - protein, 14 aa, Mycobacterium
GELSASDVDVEGSP

SEQ ID NO: 482979 - protein, 8 aa, Mycobacterium
GELSDDDL

SEQ ID NO: 482980 - protein, 9 aa, Mycobacterium
GELSDDDVE

SEQ ID NO: 482981 - protein, 8 aa, Mycobacterium
GELSDEDL

SEQ ID NO: 482982 - protein, 11 aa, Mycobacterium
GELSDRPRRRE

SEQ ID NO: 482983 - protein, 7 aa, Mycobacterium
GELSEGM

SEQ ID NO: 482984 - protein, 16 aa, Mycobacterium
GELSESGPPAPARADG

SEQ ID NO: 482985 - protein, 5 aa, Mycobacterium
GELSG

SEQ ID NO: 482986 - protein, 6 aa, Mycobacterium
GELSGG

SEQ ID NO: 482987 - protein, 5 aa, Mycobacterium
GELSR

SEQ ID NO: 482988 - protein, 6 aa, Mycobacterium
GELSSR

SEQ ID NO: 482989 - protein, 15 aa, Mycobacterium
GELSTAGPDDDTADG

SEQ ID NO: 482990 - protein, 10 aa, Mycobacterium
GELSTSEAEA

SEQ ID NO: 482991 - protein, 4 aa, Mycobacterium
GELT

SEQ ID NO: 482992 - protein, 5 aa, Mycobacterium
GELTA

SEQ ID NO: 482993 - protein, 11 aa, Mycobacterium
GELTDQEDTLA

SEQ ID NO: 482994 - protein, 9 aa, Mycobacterium
GELTDRERA

SEQ ID NO: 482995 - protein, 5 aa, Mycobacterium
GELTG

SEQ ID NO: 482996 - protein, 7 aa, Mycobacterium
GELTGGL

SEQ ID NO: 482997 - protein, 17 aa, Mycobacterium
GELTKARTKAAKSLAKA

SEQ ID NO: 482998 - protein, 6 aa, Mycobacterium
GELTPH

SEQ ID NO: 482999 - protein, 6 aa, Mycobacterium
GELTPT

SEQ ID NO: 483000 - protein, 6 aa, Mycobacterium
GELTRQ

SEQ ID NO: 483001 - protein, 8 aa, Mycobacterium
GELTTQSQ

SEQ ID NO: 483002 - protein, 6 aa, Mycobacterium
GELTTR

SEQ ID NO: 483003 - protein, 5 aa, Mycobacterium
GELVS

SEQ ID NO: 483004 - protein, 4 aa, Mycobacterium
GELY

SEQ ID NO: 483005 - protein, 10 aa, Mycobacterium
GEMDEPESRG

SEQ ID NO: 483006 - protein, 10 aa, Mycobacterium
GEMDGEYDRR

SEQ ID NO: 483007 - protein, 5 aa, Mycobacterium
GEMER

SEQ ID NO: 483008 - protein, 8 aa, Mycobacterium
GEMGEGPV

SEQ ID NO: 483009 - protein, 9 aa, Mycobacterium
GEMGEGPVQ

SEQ ID NO: 483010 - protein, 24 aa, Mycobacterium
GEMGEGPVRATTTADGVTLTGTRT

SEQ ID NO: 483011 - protein, 6 aa, Mycobacterium
GEMGGT

SEQ ID NO: 483012 - protein, 22 aa, Mycobacterium
GEMGQGPVQAQADGDDHRLTGS

SEQ ID NO: 483013 - protein, 4 aa, Mycobacterium
GEMI

SEQ ID NO: 483014 - protein, 23 aa, Mycobacterium
GEMPAGSPRSRHRPRVVPRWRTR

SEQ ID NO: 483015 - protein, 7 aa, Mycobacterium
GEMPTDP

SEQ ID NO: 483016 - protein, 13 aa, Mycobacterium
GEMPVGPRRRRKG

SEQ ID NO: 483017 - protein, 7 aa, Mycobacterium
GEMRSET

SEQ ID NO: 483018 - protein, 5 aa, Mycobacterium
GEMSS

SEQ ID NO: 483019 - protein, 11 aa, Mycobacterium
GEMTDAEAEEF

SEQ ID NO: 483020 - protein, 6 aa, Mycobacterium
GEMTPE

SEQ ID NO: 483021 - protein, 6 aa, Mycobacterium
GEMTPN
